United States Patent 7,341,835 (METHODS OF ANALYSIS OF ALTERNATIVE SPLICING IN MOUSE) - sequence listing, part 16

SEQ ID NO: 598954 - DNA, 25 bp, Mus musculus
cctgaagcagggacagcgctggacc

SEQ ID NO: 598955 - DNA, 25 bp, Mus musculus
cctgaagcagggtcagcgctggacc

SEQ ID NO: 598956 - DNA, 25 bp, Mus musculus
cctgaagcccttattgatagagttt

SEQ ID NO: 598957 - DNA, 25 bp, Mus musculus
cctgaagccctttttgatagagttt

SEQ ID NO: 598958 - DNA, 25 bp, Mus musculus
cctgaagctaccctggactctgctg

SEQ ID NO: 598959 - DNA, 25 bp, Mus musculus
cctgaagctaccgtggactctgctg

SEQ ID NO: 598960 - DNA, 25 bp, Mus musculus
cctgaagctactcggcaagggcacc

SEQ ID NO: 598961 - DNA, 25 bp, Mus musculus
cctgaagctactgggcaagggcacc

SEQ ID NO: 598962 - DNA, 25 bp, Mus musculus
cctgaagctcttcctgtcacggagg

SEQ ID NO: 598963 - DNA, 25 bp, Mus musculus
cctgaagctcttgctgtcacggagg

SEQ ID NO: 598964 - DNA, 25 bp, Mus musculus
cctgaagctgcacccaaaccaagtg

SEQ ID NO: 598965 - DNA, 25 bp, Mus musculus
cctgaagctgcagccaaaccaagtg

SEQ ID NO: 598966 - DNA, 25 bp, Mus musculus
cctgaagctgctctttgaatacctg

SEQ ID NO: 598967 - DNA, 25 bp, Mus musculus
cctgaagctgctgtttgaatacctg

SEQ ID NO: 598968 - DNA, 25 bp, Mus musculus
cctgaagctggcagagctctttgaa

SEQ ID NO: 598969 - DNA, 25 bp, Mus musculus
cctgaagctggctgagctctttgaa

SEQ ID NO: 598970 - DNA, 25 bp, Mus musculus
cctgaaggaaatccgtttggctctc

SEQ ID NO: 598971 - DNA, 25 bp, Mus musculus
cctgaaggaaatgcgtttggctctc

SEQ ID NO: 598972 - DNA, 25 bp, Mus musculus
cctgaaggaatcagagggcttcctg

SEQ ID NO: 598973 - DNA, 25 bp, Mus musculus
cctgaaggaatctgagggcttcctg

SEQ ID NO: 598974 - DNA, 25 bp, Mus musculus
cctgaaggacacagccaatcgcctg

SEQ ID NO: 598975 - DNA, 25 bp, Mus musculus
cctgaaggacactgccaatcgcctg

SEQ ID NO: 598976 - DNA, 25 bp, Mus musculus
cctgaaggaccaccatcaaaattac

SEQ ID NO: 598977 - DNA, 25 bp, Mus musculus
cctgaaggaccagcatcaaaattac

SEQ ID NO: 598978 - DNA, 25 bp, Mus musculus
cctgaaggacgcaaaggagtacgct

SEQ ID NO: 598979 - DNA, 25 bp, Mus musculus
cctgaaggacgcagtcctggaactc

SEQ ID NO: 598980 - DNA, 25 bp, Mus musculus
cctgaaggacgctaaggagtacgct

SEQ ID NO: 598981 - DNA, 25 bp, Mus musculus
cctgaaggacgctgtcctggaactc

SEQ ID NO: 598982 - DNA, 25 bp, Mus musculus
cctgaaggagtccaccaccagtgag

SEQ ID NO: 598983 - DNA, 25 bp, Mus musculus
cctgaaggagtcgaccaccagtgag

SEQ ID NO: 598984 - DNA, 25 bp, Mus musculus
cctgaaggatatcatgctctactgc

SEQ ID NO: 598985 - DNA, 25 bp, Mus musculus
cctgaaggatatgatgctctactgc

SEQ ID NO: 598986 - DNA, 25 bp, Mus musculus
cctgaaggatgacaaatgttgtgcc

SEQ ID NO: 598987 - DNA, 25 bp, Mus musculus
cctgaaggatgagaaatgttgtgcc

SEQ ID NO: 598988 - DNA, 25 bp, Mus musculus
cctgaaggcatacattatctgaaac

SEQ ID NO: 598989 - DNA, 25 bp, Mus musculus
cctgaaggcatagattatctgaaac

SEQ ID NO: 598990 - DNA, 25 bp, Mus musculus
cctgaaggccaacatgaaggtgtat

SEQ ID NO: 598991 - DNA, 25 bp, Mus musculus
cctgaaggccaagatgaaggtgtat

SEQ ID NO: 598992 - DNA, 25 bp, Mus musculus
cctgaaggcgaaaggagtccaggct

SEQ ID NO: 598993 - DNA, 25 bp, Mus musculus
cctgaaggcgaatggagtccaggct

SEQ ID NO: 598994 - DNA, 25 bp, Mus musculus
cctgaaggctctcattggagtgtct

SEQ ID NO: 598995 - DNA, 25 bp, Mus musculus
cctgaaggctctcctcaacgtggtg

SEQ ID NO: 598996 - DNA, 25 bp, Mus musculus
cctgaaggctctgattggagtgtct

SEQ ID NO: 598997 - DNA, 25 bp, Mus musculus
cctgaaggctctgctcaacgtggtg

SEQ ID NO: 598998 - DNA, 25 bp, Mus musculus
cctgaagtaagaagaaagctgggag

SEQ ID NO: 598999 - DNA, 25 bp, Mus musculus
cctgaagtaagatgaaagctgggag

SEQ ID NO: 599000 - DNA, 25 bp, Mus musculus
cctgaagtaggaccgaaaggcagcc

SEQ ID NO: 599001 - DNA, 25 bp, Mus musculus
cctgaagtaggagcgaaaggcagcc

SEQ ID NO: 599002 - DNA, 25 bp, Mus musculus
cctgaagtctcaaaggagaaggcca

SEQ ID NO: 599003 - DNA, 25 bp, Mus musculus
cctgaagtctcataggagaaggcca

SEQ ID NO: 599004 - DNA, 25 bp, Mus musculus
cctgaagtgacaaagttggaaatca

SEQ ID NO: 599005 - DNA, 25 bp, Mus musculus
cctgaagtgacatagttggaaatca

SEQ ID NO: 599006 - DNA, 25 bp, Mus musculus
cctgaagtgacccagggcaagaact

SEQ ID NO: 599007 - DNA, 25 bp, Mus musculus
cctgaagtgaccgagggcaagaact

SEQ ID NO: 599008 - DNA, 25 bp, Mus musculus
cctgaagtgatacgccttttgaaaa

SEQ ID NO: 599009 - DNA, 25 bp, Mus musculus
cctgaagtgataggccttttgaaaa

SEQ ID NO: 599010 - DNA, 25 bp, Mus musculus
cctgaagtgatcagaaatgaacctg

SEQ ID NO: 599011 - DNA, 25 bp, Mus musculus
cctgaagtgatctgaaatgaacctg

SEQ ID NO: 599012 - DNA, 25 bp, Mus musculus
cctgaagtgcccagcagtggtagca

SEQ ID NO: 599013 - DNA, 25 bp, Mus musculus
cctgaagtgccctgcagtggtagca

SEQ ID NO: 599014 - DNA, 25 bp, Mus musculus
cctgaagtggtgcaacccctggaga

SEQ ID NO: 599015 - DNA, 25 bp, Mus musculus
cctgaagtggtggaacccctggaga

SEQ ID NO: 599016 - DNA, 25 bp, Mus musculus
cctgaagttacgctgtgacctgccc

SEQ ID NO: 599017 - DNA, 25 bp, Mus musculus
cctgaagttacggtgtgacctgccc

SEQ ID NO: 599018 - DNA, 25 bp, Mus musculus
cctgaagttaggatcctccagcctc

SEQ ID NO: 599019 - DNA, 25 bp, Mus musculus
cctgaagttaggttcctccagcctc

SEQ ID NO: 599020 - DNA, 25 bp, Mus musculus
cctgaagttcgcaacagaggctgca

SEQ ID NO: 599021 - DNA, 25 bp, Mus musculus
cctgaagttcgctacagaggctgca

SEQ ID NO: 599022 - DNA, 25 bp, Mus musculus
cctgaagttctacatgattccataa

SEQ ID NO: 599023 - DNA, 25 bp, Mus musculus
cctgaagttctagatgattccataa

SEQ ID NO: 599024 - DNA, 25 bp, Mus musculus
cctgaagttgcactttagacacatg

SEQ ID NO: 599025 - DNA, 25 bp, Mus musculus
cctgaagttgcagtttagacacatg

SEQ ID NO: 599026 - DNA, 25 bp, Mus musculus
cctgaagtttgtcctatggatgccc

SEQ ID NO: 599027 - DNA, 25 bp, Mus musculus
cctgaagtttgtgctatggatgccc

SEQ ID NO: 599028 - DNA, 25 bp, Mus musculus
cctgaataagaccaaagaagcttcc

SEQ ID NO: 599029 - DNA, 25 bp, Mus musculus
cctgaataagacgaaagaagcttcc

SEQ ID NO: 599030 - DNA, 25 bp, Mus musculus
cctgaataagagcagtccagatacc

SEQ ID NO: 599031 - DNA, 25 bp, Mus musculus
cctgaataagaggagtccagatacc

SEQ ID NO: 599032 - DNA, 25 bp, Mus musculus
cctgaataagctaccggtgaagaat

SEQ ID NO: 599033 - DNA, 25 bp, Mus musculus
cctgaataagcttccggtgaagaat

SEQ ID NO: 599034 - DNA, 25 bp, Mus musculus
cctgaataatccagtagcatgtttt

SEQ ID NO: 599035 - DNA, 25 bp, Mus musculus
cctgaataatcctgtagcatgtttt

SEQ ID NO: 599036 - DNA, 25 bp, Mus musculus
cctgaatacatgacactgtggcggg

SEQ ID NO: 599037 - DNA, 25 bp, Mus musculus
cctgaatacatgtcactgtggcggg

SEQ ID NO: 599038 - DNA, 25 bp, Mus musculus
cctgaatagccgatctggaagctga

SEQ ID NO: 599039 - DNA, 25 bp, Mus musculus
cctgaatagccgttctggaagctga

SEQ ID NO: 599040 - DNA, 25 bp, Mus musculus
cctgaatcacgactgaatggtttgg

SEQ ID NO: 599041 - DNA, 25 bp, Mus musculus
cctgaatcacgagtgaatggtttgg

SEQ ID NO: 599042 - DNA, 25 bp, Mus musculus
cctgaatcagaactgggatgttaag

SEQ ID NO: 599043 - DNA, 25 bp, Mus musculus
cctgaatcagaagtgggatgttaag

SEQ ID NO: 599044 - DNA, 25 bp, Mus musculus
cctgaatccatcatgtttaattagc

SEQ ID NO: 599045 - DNA, 25 bp, Mus musculus
cctgaatccatcattgcagctgcat

SEQ ID NO: 599046 - DNA, 25 bp, Mus musculus
cctgaatccatcttgtttaattagc

SEQ ID NO: 599047 - DNA, 25 bp, Mus musculus
cctgaatccatctttgcagctgcat

SEQ ID NO: 599048 - DNA, 25 bp, Mus musculus
cctgaatccccaacatcatgaactg

SEQ ID NO: 599049 - DNA, 25 bp, Mus musculus
cctgaatccccatcatcatgaactg

SEQ ID NO: 599050 - DNA, 25 bp, Mus musculus
cctgaatcctagagacggtgagcca

SEQ ID NO: 599051 - DNA, 25 bp, Mus musculus
cctgaatcctagtgacggtgagcca

SEQ ID NO: 599052 - DNA, 25 bp, Mus musculus
cctgaatcggaaaaaattcggcggg

SEQ ID NO: 599053 - DNA, 25 bp, Mus musculus
cctgaatcggaataaattcggcggg

SEQ ID NO: 599054 - DNA, 25 bp, Mus musculus
cctgaatctcctaagcacacacttt

SEQ ID NO: 599055 - DNA, 25 bp, Mus musculus
cctgaatctccttagcacacacttt

SEQ ID NO: 599056 - DNA, 25 bp, Mus musculus
cctgaatctgcaagctgggcgtgga

SEQ ID NO: 599057 - DNA, 25 bp, Mus musculus
cctgaatctgcatgctgggcgtgga

SEQ ID NO: 599058 - DNA, 25 bp, Mus musculus
cctgaatgaaccagaaagcaaagac

SEQ ID NO: 599059 - DNA, 25 bp, Mus musculus
cctgaatgaacctgaaagcaaagac

SEQ ID NO: 599060 - DNA, 25 bp, Mus musculus
cctgaatgaggacgtcttcactccc

SEQ ID NO: 599061 - DNA, 25 bp, Mus musculus
cctgaatgaggaggtcttcactccc

SEQ ID NO: 599062 - DNA, 25 bp, Mus musculus
cctgaatgagttccccatggttgtg

SEQ ID NO: 599063 - DNA, 25 bp, Mus musculus
cctgaatgagttgcccatggttgtg

SEQ ID NO: 599064 - DNA, 25 bp, Mus musculus
cctgaatgcccacgaatcagccaag

SEQ ID NO: 599065 - DNA, 25 bp, Mus musculus
cctgaatgcccaggaatcagccaag

SEQ ID NO: 599066 - DNA, 25 bp, Mus musculus
cctgaatgccggatggcagatgagt

SEQ ID NO: 599067 - DNA, 25 bp, Mus musculus
cctgaatgccggttggcagatgagt

SEQ ID NO: 599068 - DNA, 25 bp, Mus musculus
cctgaatggctgagagaatggccgc

SEQ ID NO: 599069 - DNA, 25 bp, Mus musculus
cctgaatggctgtgagaatggccgc

SEQ ID NO: 599070 - DNA, 25 bp, Mus musculus
cctgaatgtgagactcttcctcaga

SEQ ID NO: 599071 - DNA, 25 bp, Mus musculus
cctgaatgtgagtctcttcctcaga

SEQ ID NO: 599072 - DNA, 25 bp, Mus musculus
cctgaattagacatgtgttttctca

SEQ ID NO: 599073 - DNA, 25 bp, Mus musculus
cctgaattagacttgtgttttctca

SEQ ID NO: 599074 - DNA, 25 bp, Mus musculus
cctgaattcaggagtgtctcttgcc

SEQ ID NO: 599075 - DNA, 25 bp, Mus musculus
cctgaattcaggtgtgtctcttgcc

SEQ ID NO: 599076 - DNA, 25 bp, Mus musculus
cctgaattgcttagcctaaggaagc

SEQ ID NO: 599077 - DNA, 25 bp, Mus musculus
cctgaattgctttgcctaaggaagc

SEQ ID NO: 599078 - DNA, 25 bp, Mus musculus
cctgaatttaagcaaagtgatgcca

SEQ ID NO: 599079 - DNA, 25 bp, Mus musculus
cctgaatttaaggaaagtgatgcca

SEQ ID NO: 599080 - DNA, 25 bp, Mus musculus
cctgaatttttccatcacagatgac

SEQ ID NO: 599081 - DNA, 25 bp, Mus musculus
cctgaatttttcgatcacagatgac

SEQ ID NO: 599082 - DNA, 25 bp, Mus musculus
cctgacaaggctctatccattattg

SEQ ID NO: 599083 - DNA, 25 bp, Mus musculus
cctgacaaggctgtatccattattg

SEQ ID NO: 599084 - DNA, 25 bp, Mus musculus
cctgacaatcagcatgcctaccggg

SEQ ID NO: 599085 - DNA, 25 bp, Mus musculus
cctgacaatcaggatgcctaccggg

SEQ ID NO: 599086 - DNA, 25 bp, Mus musculus
cctgacacaagtcgcgagcaggaag

SEQ ID NO: 599087 - DNA, 25 bp, Mus musculus
cctgacacaagtggcgagcaggaag

SEQ ID NO: 599088 - DNA, 25 bp, Mus musculus
cctgacactgtgacaatacacgctg

SEQ ID NO: 599089 - DNA, 25 bp, Mus musculus
cctgacactgtgtcaatacacgctg

SEQ ID NO: 599090 - DNA, 25 bp, Mus musculus
cctgacagaatcactttgatccggg

SEQ ID NO: 599091 - DNA, 25 bp, Mus musculus
cctgacagaatctctttgatccggg

SEQ ID NO: 599092 - DNA, 25 bp, Mus musculus
cctgacagagctcctcggcactgct

SEQ ID NO: 599093 - DNA, 25 bp, Mus musculus
cctgacagagctgctcggcactgct

SEQ ID NO: 599094 - DNA, 25 bp, Mus musculus
cctgacagctttctgacggcaacat

SEQ ID NO: 599095 - DNA, 25 bp, Mus musculus
cctgacagctttgtgacggcaacat

SEQ ID NO: 599096 - DNA, 25 bp, Mus musculus
cctgacaggagaaggctatattctg

SEQ ID NO: 599097 - DNA, 25 bp, Mus musculus
cctgacaggagatggctatattctg

SEQ ID NO: 599098 - DNA, 25 bp, Mus musculus
cctgacaggccgcattgtctatatt

SEQ ID NO: 599099 - DNA, 25 bp, Mus musculus
cctgacaggccggattgtctatatt

SEQ ID NO: 599100 - DNA, 25 bp, Mus musculus
cctgacagggcaccatctgagtggc

SEQ ID NO: 599101 - DNA, 25 bp, Mus musculus
cctgacagggcagcatctgagtggc

SEQ ID NO: 599102 - DNA, 25 bp, Mus musculus
cctgacaggtaacgacaggagcaga

SEQ ID NO: 599103 - DNA, 25 bp, Mus musculus
cctgacaggtaaggacaggagcaga

SEQ ID NO: 599104 - DNA, 25 bp, Mus musculus
cctgacagtcaaatgtatgaagttg

SEQ ID NO: 599105 - DNA, 25 bp, Mus musculus
cctgacagtcaattgtatgaagttg

SEQ ID NO: 599106 - DNA, 25 bp, Mus musculus
cctgacagtgtcattcttaaaacga

SEQ ID NO: 599107 - DNA, 25 bp, Mus musculus
cctgacagtgtctttcttaaaacga

SEQ ID NO: 599108 - DNA, 25 bp, Mus musculus
cctgacagttgtcatcgcatggagt

SEQ ID NO: 599109 - DNA, 25 bp, Mus musculus
cctgacagttgtgatcgcatggagt

SEQ ID NO: 599110 - DNA, 25 bp, Mus musculus
cctgacatccaaccaaaagaagaac

SEQ ID NO: 599111 - DNA, 25 bp, Mus musculus
cctgacatccaagcaaaagaagaac

SEQ ID NO: 599112 - DNA, 25 bp, Mus musculus
cctgacatctaacggactcccagaa

SEQ ID NO: 599113 - DNA, 25 bp, Mus musculus
cctgacatctaagggactcccagaa

SEQ ID NO: 599114 - DNA, 25 bp, Mus musculus
cctgacatgctgagaaaggatggca

SEQ ID NO: 599115 - DNA, 25 bp, Mus musculus
cctgacatgctgtgaaaggatggca

SEQ ID NO: 599116 - DNA, 25 bp, Mus musculus
cctgacatggtcagggacttctgga

SEQ ID NO: 599117 - DNA, 25 bp, Mus musculus
cctgacatggtctgggacttctgga

SEQ ID NO: 599118 - DNA, 25 bp, Mus musculus
cctgacatttttccacaagtacaac

SEQ ID NO: 599119 - DNA, 25 bp, Mus musculus
cctgacatttttgcacaagtacaac

SEQ ID NO: 599120 - DNA, 25 bp, Mus musculus
cctgaccaagccacgttagccttgg

SEQ ID NO: 599121 - DNA, 25 bp, Mus musculus
cctgaccaagcctcgttagccttgg

SEQ ID NO: 599122 - DNA, 25 bp, Mus musculus
cctgaccactctctgtgaattggca

SEQ ID NO: 599123 - DNA, 25 bp, Mus musculus
cctgaccactctgtgtgaattggca

SEQ ID NO: 599124 - DNA, 25 bp, Mus musculus
cctgaccagcttagccatcctaatg

SEQ ID NO: 599125 - DNA, 25 bp, Mus musculus
cctgaccagctttgccatcctaatg

SEQ ID NO: 599126 - DNA, 25 bp, Mus musculus
cctgaccatctgattccctgagtac

SEQ ID NO: 599127 - DNA, 25 bp, Mus musculus
cctgaccatctgcagctgaaagaca

SEQ ID NO: 599128 - DNA, 25 bp, Mus musculus
cctgaccatctggagctgaaagaca

SEQ ID NO: 599129 - DNA, 25 bp, Mus musculus
cctgaccatctgtttccctgagtac

SEQ ID NO: 599130 - DNA, 25 bp, Mus musculus
cctgaccatgtgcatgaaggagtgc

SEQ ID NO: 599131 - DNA, 25 bp, Mus musculus
cctgaccatgtggatgaaggagtgc

SEQ ID NO: 599132 - DNA, 25 bp, Mus musculus
cctgaccattcccaggaactcaaag

SEQ ID NO: 599133 - DNA, 25 bp, Mus musculus
cctgaccattccgaggaactcaaag

SEQ ID NO: 599134 - DNA, 25 bp, Mus musculus
cctgacccaggaccatatgaacttt

SEQ ID NO: 599135 - DNA, 25 bp, Mus musculus
cctgacccaggagcatatgaacttt

SEQ ID NO: 599136 - DNA, 25 bp, Mus musculus
cctgaccctggtcaatgcaccatat

SEQ ID NO: 599137 - DNA, 25 bp, Mus musculus
cctgaccctggtgaatgcaccatat

SEQ ID NO: 599138 - DNA, 25 bp, Mus musculus
cctgacccttgtctttgaatacgtg

SEQ ID NO: 599139 - DNA, 25 bp, Mus musculus
cctgacccttgtgtttgaatacgtg

SEQ ID NO: 599140 - DNA, 25 bp, Mus musculus
cctgaccgggaacaaattccaatga

SEQ ID NO: 599141 - DNA, 25 bp, Mus musculus
cctgaccgggaagaaattccaatga

SEQ ID NO: 599142 - DNA, 25 bp, Mus musculus
cctgacctaaagcaggaagatggaa

SEQ ID NO: 599143 - DNA, 25 bp, Mus musculus
cctgacctaaaggaggaagatggaa

SEQ ID NO: 599144 - DNA, 25 bp, Mus musculus
cctgacctatgaaggtggtgtagac

SEQ ID NO: 599145 - DNA, 25 bp, Mus musculus
cctgacctatgatggtggtgtagac

SEQ ID NO: 599146 - DNA, 25 bp, Mus musculus
cctgacctcagcaacatcgttcgag

SEQ ID NO: 599147 - DNA, 25 bp, Mus musculus
cctgacctcagctacatcgttcgag

SEQ ID NO: 599148 - DNA, 25 bp, Mus musculus
cctgacctgagtcatcagactgacc

SEQ ID NO: 599149 - DNA, 25 bp, Mus musculus
cctgacctgagtgatcagactgacc

SEQ ID NO: 599150 - DNA, 25 bp, Mus musculus
cctgaccttcttcgagtatgatggc

SEQ ID NO: 599151 - DNA, 25 bp, Mus musculus
cctgaccttcttggagtatgatggc

SEQ ID NO: 599152 - DNA, 25 bp, Mus musculus
cctgaccttggcattgttgtgctta

SEQ ID NO: 599153 - DNA, 25 bp, Mus musculus
cctgaccttggctttgttgtgctta

SEQ ID NO: 599154 - DNA, 25 bp, Mus musculus
cctgacgactttactggatggacac

SEQ ID NO: 599155 - DNA, 25 bp, Mus musculus
cctgacgacttttctggatggacac

SEQ ID NO: 599156 - DNA, 25 bp, Mus musculus
cctgacgataagaaagaagtattcc

SEQ ID NO: 599157 - DNA, 25 bp, Mus musculus
cctgacgataagtaagaagtattcc

SEQ ID NO: 599158 - DNA, 25 bp, Mus musculus
cctgacgccgggaaagtttgccgag

SEQ ID NO: 599159 - DNA, 25 bp, Mus musculus
cctgacgccgggtaagtttgccgag

SEQ ID NO: 599160 - DNA, 25 bp, Mus musculus
cctgacgcttcacttcatgtatgat

SEQ ID NO: 599161 - DNA, 25 bp, Mus musculus
cctgacgcttcagttcatgtatgat

SEQ ID NO: 599162 - DNA, 25 bp, Mus musculus
cctgacggaaggatgatcgtgtcat

SEQ ID NO: 599163 - DNA, 25 bp, Mus musculus
cctgacggaaggttgatcgtgtcat

SEQ ID NO: 599164 - DNA, 25 bp, Mus musculus
cctgacggaagtcctggctgtgttc

SEQ ID NO: 599165 - DNA, 25 bp, Mus musculus
cctgacggaagtgctggctgtgttc

SEQ ID NO: 599166 - DNA, 25 bp, Mus musculus
cctgacggagcacgtgatttcccct

SEQ ID NO: 599167 - DNA, 25 bp, Mus musculus
cctgacggagcaggtgatttcccct

SEQ ID NO: 599168 - DNA, 25 bp, Mus musculus
cctgacggagccacagcttggcctg

SEQ ID NO: 599169 - DNA, 25 bp, Mus musculus
cctgacggagcctcagcttggcctg

SEQ ID NO: 599170 - DNA, 25 bp, Mus musculus
cctgacggcctacggaaatccttgc

SEQ ID NO: 599171 - DNA, 25 bp, Mus musculus
cctgacggcctagggaaatccttgc

SEQ ID NO: 599172 - DNA, 25 bp, Mus musculus
cctgacggctctccagttgtggtcg

SEQ ID NO: 599173 - DNA, 25 bp, Mus musculus
cctgacggctctgcagttgtggtcg

SEQ ID NO: 599174 - DNA, 25 bp, Mus musculus
cctgacgggcgcatctactactaca

SEQ ID NO: 599175 - DNA, 25 bp, Mus musculus
cctgacgggcgcttctactactaca

SEQ ID NO: 599176 - DNA, 25 bp, Mus musculus
cctgacggttcaaacaggaacccac

SEQ ID NO: 599177 - DNA, 25 bp, Mus musculus
cctgacggttcatacaggaacccac

SEQ ID NO: 599178 - DNA, 25 bp, Mus musculus
cctgacggttgtaagagtggaatca

SEQ ID NO: 599179 - DNA, 25 bp, Mus musculus
cctgacggttgttagagtggaatca

SEQ ID NO: 599180 - DNA, 25 bp, Mus musculus
cctgactaaagtcgatgagattgtg

SEQ ID NO: 599181 - DNA, 25 bp, Mus musculus
cctgactaaagtggatgagattgtg

SEQ ID NO: 599182 - DNA, 25 bp, Mus musculus
cctgactcagacctggtggaaaaca

SEQ ID NO: 599183 - DNA, 25 bp, Mus musculus
cctgactcagacgtggtggaaaaca

SEQ ID NO: 599184 - DNA, 25 bp, Mus musculus
cctgactcaggcatgaactccagaa

SEQ ID NO: 599185 - DNA, 25 bp, Mus musculus
cctgactcaggcttgaactccagaa

SEQ ID NO: 599186 - DNA, 25 bp, Mus musculus
cctgactgagctctgccgggtagaa

SEQ ID NO: 599187 - DNA, 25 bp, Mus musculus
cctgactgagctgtgccgggtagaa

SEQ ID NO: 599188 - DNA, 25 bp, Mus musculus
cctgactgcagaagagcgtcaagaa

SEQ ID NO: 599189 - DNA, 25 bp, Mus musculus
cctgactgcagatgagcgtcaagaa

SEQ ID NO: 599190 - DNA, 25 bp, Mus musculus
cctgactgccagagcgaggttggct

SEQ ID NO: 599191 - DNA, 25 bp, Mus musculus
cctgactgccagctccagagagtaa

SEQ ID NO: 599192 - DNA, 25 bp, Mus musculus
cctgactgccaggtccagagagtaa

SEQ ID NO: 599193 - DNA, 25 bp, Mus musculus
cctgactgccagtgcgaggttggct

SEQ ID NO: 599194 - DNA, 25 bp, Mus musculus
cctgactggagccaggtcaactgtt

SEQ ID NO: 599195 - DNA, 25 bp, Mus musculus
cctgactggagcgaggtcaactgtt

SEQ ID NO: 599196 - DNA, 25 bp, Mus musculus
cctgactggatcatgggtgagatga

SEQ ID NO: 599197 - DNA, 25 bp, Mus musculus
cctgactggatcttgggtgagatga

SEQ ID NO: 599198 - DNA, 25 bp, Mus musculus
cctgactgggaacgtcctgggacct

SEQ ID NO: 599199 - DNA, 25 bp, Mus musculus
cctgactgggaaggtcctgggacct

SEQ ID NO: 599200 - DNA, 25 bp, Mus musculus
cctgactggtatagaaagccgagtc

SEQ ID NO: 599201 - DNA, 25 bp, Mus musculus
cctgactggtattgaaagccgagtc

SEQ ID NO: 599202 - DNA, 25 bp, Mus musculus
cctgactgtagcatgctgtgctctg

SEQ ID NO: 599203 - DNA, 25 bp, Mus musculus
cctgactgtagcttgctgtgctctg

SEQ ID NO: 599204 - DNA, 25 bp, Mus musculus
cctgactgtctgcatatgggtgaac

SEQ ID NO: 599205 - DNA, 25 bp, Mus musculus
cctgactgtctggatatgggtgaac

SEQ ID NO: 599206 - DNA, 25 bp, Mus musculus
cctgacttacggagagttggtgttc

SEQ ID NO: 599207 - DNA, 25 bp, Mus musculus
cctgacttacggtgagttggtgttc

SEQ ID NO: 599208 - DNA, 25 bp, Mus musculus
cctgactttagaagtgaaacaacta

SEQ ID NO: 599209 - DNA, 25 bp, Mus musculus
cctgactttagatgtgaaacaacta

SEQ ID NO: 599210 - DNA, 25 bp, Mus musculus
cctgactttcacagctcagtatgaa

SEQ ID NO: 599211 - DNA, 25 bp, Mus musculus
cctgactttcactgctcagtatgaa

SEQ ID NO: 599212 - DNA, 25 bp, Mus musculus
cctgactttgtgaacatccagctgt

SEQ ID NO: 599213 - DNA, 25 bp, Mus musculus
cctgactttgtgtacatccagctgt

SEQ ID NO: 599214 - DNA, 25 bp, Mus musculus
cctgagaaacatcattcaagaaggg

SEQ ID NO: 599215 - DNA, 25 bp, Mus musculus
cctgagaaacatgattcaagaaggg

SEQ ID NO: 599216 - DNA, 25 bp, Mus musculus
cctgagaaagatcaacgtggccttc

SEQ ID NO: 599217 - DNA, 25 bp, Mus musculus
cctgagaaagatgaacgtggccttc

SEQ ID NO: 599218 - DNA, 25 bp, Mus musculus
cctgagaaataaacgcctcttagat

SEQ ID NO: 599219 - DNA, 25 bp, Mus musculus
cctgagaaataatcgcctcttagat

SEQ ID NO: 599220 - DNA, 25 bp, Mus musculus
cctgagaaatgtatgtactgaagca

SEQ ID NO: 599221 - DNA, 25 bp, Mus musculus
cctgagaaatgtttgtactgaagca

SEQ ID NO: 599222 - DNA, 25 bp, Mus musculus
cctgagaacagtaggtagggcgcac

SEQ ID NO: 599223 - DNA, 25 bp, Mus musculus
cctgagaacagttggtagggcgcac

SEQ ID NO: 599224 - DNA, 25 bp, Mus musculus
cctgagaacccacatccaggaggag

SEQ ID NO: 599225 - DNA, 25 bp, Mus musculus
cctgagaacccagatccaggaggag

SEQ ID NO: 599226 - DNA, 25 bp, Mus musculus
cctgagaacctcaagctaatgatga

SEQ ID NO: 599227 - DNA, 25 bp, Mus musculus
cctgagaacctctagctaatgatga

SEQ ID NO: 599228 - DNA, 25 bp, Mus musculus
cctgagaaccttagaagtgatgaac

SEQ ID NO: 599229 - DNA, 25 bp, Mus musculus
cctgagaacctttgaagtgatgaac

SEQ ID NO: 599230 - DNA, 25 bp, Mus musculus
cctgagaacgccctggacgagattc

SEQ ID NO: 599231 - DNA, 25 bp, Mus musculus
cctgagaacgccgtggacgagattc

SEQ ID NO: 599232 - DNA, 25 bp, Mus musculus
cctgagaacttcagggtgagtctga

SEQ ID NO: 599233 - DNA, 25 bp, Mus musculus
cctgagaacttctgggtgagtctga

SEQ ID NO: 599234 - DNA, 25 bp, Mus musculus
cctgagaagccacgctagtgttgcc

SEQ ID NO: 599235 - DNA, 25 bp, Mus musculus
cctgagaagccaggctagtgttgcc

SEQ ID NO: 599236 - DNA, 25 bp, Mus musculus
cctgagaaggataggcacaggccag

SEQ ID NO: 599237 - DNA, 25 bp, Mus musculus
cctgagaaggattggcacaggccag

SEQ ID NO: 599238 - DNA, 25 bp, Mus musculus
cctgagaagtggaccccagaggtga

SEQ ID NO: 599239 - DNA, 25 bp, Mus musculus
cctgagaagtggtccccagaggtga

SEQ ID NO: 599240 - DNA, 25 bp, Mus musculus
cctgagaataccctgatgtccctga

SEQ ID NO: 599241 - DNA, 25 bp, Mus musculus
cctgagaataccgtgatgtccctga

SEQ ID NO: 599242 - DNA, 25 bp, Mus musculus
cctgagaatatgacaggacggcatc

SEQ ID NO: 599243 - DNA, 25 bp, Mus musculus
cctgagaatatgtcaggacggcatc

SEQ ID NO: 599244 - DNA, 25 bp, Mus musculus
cctgagaatcaaccgctttgcctgg

SEQ ID NO: 599245 - DNA, 25 bp, Mus musculus
cctgagaatcaagcgctttgcctgg

SEQ ID NO: 599246 - DNA, 25 bp, Mus musculus
cctgagacccttcactggtggcagg

SEQ ID NO: 599247 - DNA, 25 bp, Mus musculus
cctgagacccttgactggtggcagg

SEQ ID NO: 599248 - DNA, 25 bp, Mus musculus
cctgagacgacacggactcgaccgt

SEQ ID NO: 599249 - DNA, 25 bp, Mus musculus
cctgagacgacagggactcgaccgt

SEQ ID NO: 599250 - DNA, 25 bp, Mus musculus
cctgagacggagaaagcgcctgctg

SEQ ID NO: 599251 - DNA, 25 bp, Mus musculus
cctgagacggagtaagcgcctgctg

SEQ ID NO: 599252 - DNA, 25 bp, Mus musculus
cctgagactgatatcttgactaatt

SEQ ID NO: 599253 - DNA, 25 bp, Mus musculus
cctgagactgatttcttgactaatt

SEQ ID NO: 599254 - DNA, 25 bp, Mus musculus
cctgagactgctcgcacagaataaa

SEQ ID NO: 599255 - DNA, 25 bp, Mus musculus
cctgagactgctggcacagaataaa

SEQ ID NO: 599256 - DNA, 25 bp, Mus musculus
cctgagactggcctgatagactgca

SEQ ID NO: 599257 - DNA, 25 bp, Mus musculus
cctgagactggcgtgatagactgca

SEQ ID NO: 599258 - DNA, 25 bp, Mus musculus
cctgagactggtctttgctccctgg

SEQ ID NO: 599259 - DNA, 25 bp, Mus musculus
cctgagactggtgtttgctccctgg

SEQ ID NO: 599260 - DNA, 25 bp, Mus musculus
cctgagactgtgctaaccagaagga

SEQ ID NO: 599261 - DNA, 25 bp, Mus musculus
cctgagactgtggtaaccagaagga

SEQ ID NO: 599262 - DNA, 25 bp, Mus musculus
cctgagagaattaaacgtcatcacg

SEQ ID NO: 599263 - DNA, 25 bp, Mus musculus
cctgagagaatttaacgtcatcacg

SEQ ID NO: 599264 - DNA, 25 bp, Mus musculus
cctgagagagacagtgcctgggatc

SEQ ID NO: 599265 - DNA, 25 bp, Mus musculus
cctgagagagactgtgcctgggatc

SEQ ID NO: 599266 - DNA, 25 bp, Mus musculus
cctgagagatcgctttgccatcgat

SEQ ID NO: 599267 - DNA, 25 bp, Mus musculus
cctgagagatcggtttgccatcgat

SEQ ID NO: 599268 - DNA, 25 bp, Mus musculus
cctgagagatgtcaaaagctacctg

SEQ ID NO: 599269 - DNA, 25 bp, Mus musculus
cctgagagatgtgaaaagctacctg

SEQ ID NO: 599270 - DNA, 25 bp, Mus musculus
cctgagagcaccctccctgaaaaaa

SEQ ID NO: 599271 - DNA, 25 bp, Mus musculus
cctgagagcaccgtccctgaaaaaa

SEQ ID NO: 599272 - DNA, 25 bp, Mus musculus
cctgagagccgacatcggtcctcga

SEQ ID NO: 599273 - DNA, 25 bp, Mus musculus
cctgagagccgagatcggtcctcga

SEQ ID NO: 599274 - DNA, 25 bp, Mus musculus
cctgagagcctgaactaaggacgat

SEQ ID NO: 599275 - DNA, 25 bp, Mus musculus
cctgagagcctgtactaaggacgat

SEQ ID NO: 599276 - DNA, 25 bp, Mus musculus
cctgagagctttcaatttggatcct

SEQ ID NO: 599277 - DNA, 25 bp, Mus musculus
cctgagagctttgaatttggatcct

SEQ ID NO: 599278 - DNA, 25 bp, Mus musculus
cctgagaggcagagggtaaacaaag

SEQ ID NO: 599279 - DNA, 25 bp, Mus musculus
cctgagaggcagtgggtaaacaaag

SEQ ID NO: 599280 - DNA, 25 bp, Mus musculus
cctgagaggccgcatgattcttcta

SEQ ID NO: 599281 - DNA, 25 bp, Mus musculus
cctgagaggccggatgattcttcta

SEQ ID NO: 599282 - DNA, 25 bp, Mus musculus
cctgagagtaatatgaatgaagaaa

SEQ ID NO: 599283 - DNA, 25 bp, Mus musculus
cctgagagtaatttgaatgaagaaa

SEQ ID NO: 599284 - DNA, 25 bp, Mus musculus
cctgagagtccaagattcttgctca

SEQ ID NO: 599285 - DNA, 25 bp, Mus musculus
cctgagagtccatgattcttgctca

SEQ ID NO: 599286 - DNA, 25 bp, Mus musculus
cctgagagtctcagcagtatcgggc

SEQ ID NO: 599287 - DNA, 25 bp, Mus musculus
cctgagagtctctgcagtatcgggc

SEQ ID NO: 599288 - DNA, 25 bp, Mus musculus
cctgagagtgctcgtgtttccccga

SEQ ID NO: 599289 - DNA, 25 bp, Mus musculus
cctgagagtgctggtgtttccccga

SEQ ID NO: 599290 - DNA, 25 bp, Mus musculus
cctgagagtggacccaacctttgac

SEQ ID NO: 599291 - DNA, 25 bp, Mus musculus
cctgagagtggagccaacctttgac

SEQ ID NO: 599292 - DNA, 25 bp, Mus musculus
cctgagatacaaaagattgtcagca

SEQ ID NO: 599293 - DNA, 25 bp, Mus musculus
cctgagatacaatagattgtcagca

SEQ ID NO: 599294 - DNA, 25 bp, Mus musculus
cctgagatcttcctgcccatagagg

SEQ ID NO: 599295 - DNA, 25 bp, Mus musculus
cctgagatcttcgtgcccatagagg

SEQ ID NO: 599296 - DNA, 25 bp, Mus musculus
cctgagatgcgcagcggaagaaaac

SEQ ID NO: 599297 - DNA, 25 bp, Mus musculus
cctgagatgcgctgcggaagaaaac

SEQ ID NO: 599298 - DNA, 25 bp, Mus musculus
cctgagatgtagcaggcgcacctgt

SEQ ID NO: 599299 - DNA, 25 bp, Mus musculus
cctgagatgtaggaggcgcacctgt

SEQ ID NO: 599300 - DNA, 25 bp, Mus musculus
cctgagattgaacctgctctcttcc

SEQ ID NO: 599301 - DNA, 25 bp, Mus musculus
cctgagattgaagctgctctcttcc

SEQ ID NO: 599302 - DNA, 25 bp, Mus musculus
cctgagcaacggagaaacagaatct

SEQ ID NO: 599303 - DNA, 25 bp, Mus musculus
cctgagcaacggtgaaacagaatct

SEQ ID NO: 599304 - DNA, 25 bp, Mus musculus
cctgagcaagagctaccatatttac

SEQ ID NO: 599305 - DNA, 25 bp, Mus musculus
cctgagcaagaggtaccatatttac

SEQ ID NO: 599306 - DNA, 25 bp, Mus musculus
cctgagcaagggatttgaaacatgc

SEQ ID NO: 599307 - DNA, 25 bp, Mus musculus
cctgagcaagggttttgaaacatgc

SEQ ID NO: 599308 - DNA, 25 bp, Mus musculus
cctgagcaatatcaacgagactctc

SEQ ID NO: 599309 - DNA, 25 bp, Mus musculus
cctgagcaatatgaacgagactctc

SEQ ID NO: 599310 - DNA, 25 bp, Mus musculus
cctgagcacaaccaatgggcattaa

SEQ ID NO: 599311 - DNA, 25 bp, Mus musculus
cctgagcacaacgaatgggcattaa

SEQ ID NO: 599312 - DNA, 25 bp, Mus musculus
cctgagcacactacataggcccgag

SEQ ID NO: 599313 - DNA, 25 bp, Mus musculus
cctgagcacacttcataggcccgag

SEQ ID NO: 599314 - DNA, 25 bp, Mus musculus
cctgagcacgtcagtgaagtgttgc

SEQ ID NO: 599315 - DNA, 25 bp, Mus musculus
cctgagcacgtctgtgaagtgttgc

SEQ ID NO: 599316 - DNA, 25 bp, Mus musculus
cctgagcagatccagaaaatctggc

SEQ ID NO: 599317 - DNA, 25 bp, Mus musculus
cctgagcagatcgagaaaatctggc

SEQ ID NO: 599318 - DNA, 25 bp, Mus musculus
cctgagcagcagaagttcaccatca

SEQ ID NO: 599319 - DNA, 25 bp, Mus musculus
cctgagcagcagtagttcaccatca

SEQ ID NO: 599320 - DNA, 25 bp, Mus musculus
cctgagcagcgaccatgggcctgct

SEQ ID NO: 599321 - DNA, 25 bp, Mus musculus
cctgagcagcgagcatgggcctgct

SEQ ID NO: 599322 - DNA, 25 bp, Mus musculus
cctgagcatagtctgtcagctgtac

SEQ ID NO: 599323 - DNA, 25 bp, Mus musculus
cctgagcatagtgtgtcagctgtac

SEQ ID NO: 599324 - DNA, 25 bp, Mus musculus
cctgagccaagaatcatgtatggga

SEQ ID NO: 599325 - DNA, 25 bp, Mus musculus
cctgagccaagattcatgtatggga

SEQ ID NO: 599326 - DNA, 25 bp, Mus musculus
cctgagccacaaagaaccgcacatg

SEQ ID NO: 599327 - DNA, 25 bp, Mus musculus
cctgagccacaatgaaccgcacatg

SEQ ID NO: 599328 - DNA, 25 bp, Mus musculus
cctgagccccaaaaaccatgaggtg

SEQ ID NO: 599329 - DNA, 25 bp, Mus musculus
cctgagccccaataaccatgaggtg

SEQ ID NO: 599330 - DNA, 25 bp, Mus musculus
cctgagcccctacagccatgatggg

SEQ ID NO: 599331 - DNA, 25 bp, Mus musculus
cctgagcccctagagccatgatggg

SEQ ID NO: 599332 - DNA, 25 bp, Mus musculus
cctgagccgaacaggaacgttgttg

SEQ ID NO: 599333 - DNA, 25 bp, Mus musculus
cctgagccgaactggaacgttgttg

SEQ ID NO: 599334 - DNA, 25 bp, Mus musculus
cctgagccgagcagctgcgcgacgt

SEQ ID NO: 599335 - DNA, 25 bp, Mus musculus
cctgagccgagctgctgcgcgacgt

SEQ ID NO: 599336 - DNA, 25 bp, Mus musculus
cctgagcctgaaaccttatgagggc

SEQ ID NO: 599337 - DNA, 25 bp, Mus musculus
cctgagcctgaacatggttctgtcc

SEQ ID NO: 599338 - DNA, 25 bp, Mus musculus
cctgagcctgaagatggttctgtcc

SEQ ID NO: 599339 - DNA, 25 bp, Mus musculus
cctgagcctgaatccttatgagggc

SEQ ID NO: 599340 - DNA, 25 bp, Mus musculus
cctgagcctgcaaagtggaagagat

SEQ ID NO: 599341 - DNA, 25 bp, Mus musculus
cctgagcctgcatagtggaagagat

SEQ ID NO: 599342 - DNA, 25 bp, Mus musculus
cctgagccttggaacatccttcgca

SEQ ID NO: 599343 - DNA, 25 bp, Mus musculus
cctgagccttggcaaagagggccca

SEQ ID NO: 599344 - DNA, 25 bp, Mus musculus
cctgagccttgggaaagagggccca

SEQ ID NO: 599345 - DNA, 25 bp, Mus musculus
cctgagccttggtacatccttcgca

SEQ ID NO: 599346 - DNA, 25 bp, Mus musculus
cctgagcgagataaaagttggcatc

SEQ ID NO: 599347 - DNA, 25 bp, Mus musculus
cctgagcgagattaaagttggcatc

SEQ ID NO: 599348 - DNA, 25 bp, Mus musculus
cctgagcggctccatgccatcagag

SEQ ID NO: 599349 - DNA, 25 bp, Mus musculus
cctgagcggctcgatgccatcagag

SEQ ID NO: 599350 - DNA, 25 bp, Mus musculus
cctgagcgtatcatccccaatcaga

SEQ ID NO: 599351 - DNA, 25 bp, Mus musculus
cctgagcgtatcttccccaatcaga

SEQ ID NO: 599352 - DNA, 25 bp, Mus musculus
cctgagctaattcgaaagtgtaact

SEQ ID NO: 599353 - DNA, 25 bp, Mus musculus
cctgagctaattggaaagtgtaact

SEQ ID NO: 599354 - DNA, 25 bp, Mus musculus
cctgagctactcaatgaaggacgac

SEQ ID NO: 599355 - DNA, 25 bp, Mus musculus
cctgagctactctatgaaggacgac

SEQ ID NO: 599356 - DNA, 25 bp, Mus musculus
cctgagctccttccgggtgccatat

SEQ ID NO: 599357 - DNA, 25 bp, Mus musculus
cctgagctccttgcgggtgccatat

SEQ ID NO: 599358 - DNA, 25 bp, Mus musculus
cctgagctctctcccatatctggga

SEQ ID NO: 599359 - DNA, 25 bp, Mus musculus
cctgagctctctgccatatctggga

SEQ ID NO: 599360 - DNA, 25 bp, Mus musculus
cctgagctgccacaggtgattgcca

SEQ ID NO: 599361 - DNA, 25 bp, Mus musculus
cctgagctgccagaggtgattgcca

SEQ ID NO: 599362 - DNA, 25 bp, Mus musculus
cctgagctggctcaggacttaactg

SEQ ID NO: 599363 - DNA, 25 bp, Mus musculus
cctgagctggctgaggacttaactg

SEQ ID NO: 599364 - DNA, 25 bp, Mus musculus
cctgagctgtatcaacaaggatcat

SEQ ID NO: 599365 - DNA, 25 bp, Mus musculus
cctgagctgtatgaacaaggatcat

SEQ ID NO: 599366 - DNA, 25 bp, Mus musculus
cctgagctgtctattggtcttcttc

SEQ ID NO: 599367 - DNA, 25 bp, Mus musculus
cctgagctgtcttttggtcttcttc

SEQ ID NO: 599368 - DNA, 25 bp, Mus musculus
cctgagctgtggcatgtgcctacat

SEQ ID NO: 599369 - DNA, 25 bp, Mus musculus
cctgagctgtgggatgtgcctacat

SEQ ID NO: 599370 - DNA, 25 bp, Mus musculus
cctgagctgtttcgagaagtgcctg

SEQ ID NO: 599371 - DNA, 25 bp, Mus musculus
cctgagctgtttggagaagtgcctg

SEQ ID NO: 599372 - DNA, 25 bp, Mus musculus
cctgagcttttgaacagagccgact

SEQ ID NO: 599373 - DNA, 25 bp, Mus musculus
cctgagcttttgtacagagccgact

SEQ ID NO: 599374 - DNA, 25 bp, Mus musculus
cctgaggaacgacattggtgccact

SEQ ID NO: 599375 - DNA, 25 bp, Mus musculus
cctgaggaacgagattggtgccact

SEQ ID NO: 599376 - DNA, 25 bp, Mus musculus
cctgaggaagatcagctctgacttg

SEQ ID NO: 599377 - DNA, 25 bp, Mus musculus
cctgaggaagatgagctctgacttg

SEQ ID NO: 599378 - DNA, 25 bp, Mus musculus
cctgaggaagtgacaacaggagtgc

SEQ ID NO: 599379 - DNA, 25 bp, Mus musculus
cctgaggaagtgtcaacaggagtgc

SEQ ID NO: 599380 - DNA, 25 bp, Mus musculus
cctgaggaatttactccactggaag

SEQ ID NO: 599381 - DNA, 25 bp, Mus musculus
cctgaggaattttctccactggaag

SEQ ID NO: 599382 - DNA, 25 bp, Mus musculus
cctgaggacatgagcttgagtgact

SEQ ID NO: 599383 - DNA, 25 bp, Mus musculus
cctgaggacatgtgcttgagtgact

SEQ ID NO: 599384 - DNA, 25 bp, Mus musculus
cctgaggactatagagcaaaaacag

SEQ ID NO: 599385 - DNA, 25 bp, Mus musculus
cctgaggactattgagcaaaaacag

SEQ ID NO: 599386 - DNA, 25 bp, Mus musculus
cctgaggacttgcatgacaagtttg

SEQ ID NO: 599387 - DNA, 25 bp, Mus musculus
cctgaggacttggatgacaagtttg

SEQ ID NO: 599388 - DNA, 25 bp, Mus musculus
cctgaggagtcacggctcagacctg

SEQ ID NO: 599389 - DNA, 25 bp, Mus musculus
cctgaggagtcagggctcagacctg

SEQ ID NO: 599390 - DNA, 25 bp, Mus musculus
cctgaggcctcgaagttgcagttca

SEQ ID NO: 599391 - DNA, 25 bp, Mus musculus
cctgaggcctcgtagttgcagttca

SEQ ID NO: 599392 - DNA, 25 bp, Mus musculus
cctgaggccttcatttgtgtttctc

SEQ ID NO: 599393 - DNA, 25 bp, Mus musculus
cctgaggccttcttttgtgtttctc

SEQ ID NO: 599394 - DNA, 25 bp, Mus musculus
cctgaggcgttgattgaccggatct

SEQ ID NO: 599395 - DNA, 25 bp, Mus musculus
cctgaggcgttgtttgaccggatct

SEQ ID NO: 599396 - DNA, 25 bp, Mus musculus
cctgaggctcgtcggtttgatctac

SEQ ID NO: 599397 - DNA, 25 bp, Mus musculus
cctgaggctcgtgggtttgatctac

SEQ ID NO: 599398 - DNA, 25 bp, Mus musculus
cctgaggctgctctgtaagcgcctg

SEQ ID NO: 599399 - DNA, 25 bp, Mus musculus
cctgaggctgctgtgtaagcgcctg

SEQ ID NO: 599400 - DNA, 25 bp, Mus musculus
cctgaggctgtacatgtacatcaca

SEQ ID NO: 599401 - DNA, 25 bp, Mus musculus
cctgaggctgtagatgtacatcaca

SEQ ID NO: 599402 - DNA, 25 bp, Mus musculus
cctgaggctgtccagcagactttcc

SEQ ID NO: 599403 - DNA, 25 bp, Mus musculus
cctgaggctgtcgagcagactttcc

SEQ ID NO: 599404 - DNA, 25 bp, Mus musculus
cctgagggaagcaccgcaaggaaga

SEQ ID NO: 599405 - DNA, 25 bp, Mus musculus
cctgagggaagctccgcaaggaaga

SEQ ID NO: 599406 - DNA, 25 bp, Mus musculus
cctgagggaccactattacgtaatc

SEQ ID NO: 599407 - DNA, 25 bp, Mus musculus
cctgagggaccagtattacgtaatc

SEQ ID NO: 599408 - DNA, 25 bp, Mus musculus
cctgagggacctcacgaagaagatg

SEQ ID NO: 599409 - DNA, 25 bp, Mus musculus
cctgagggacctgacgaagaagatg

SEQ ID NO: 599410 - DNA, 25 bp, Mus musculus
cctgagggcgcaaggccttgctctc

SEQ ID NO: 599411 - DNA, 25 bp, Mus musculus
cctgagggcgcatggccttgctctc

SEQ ID NO: 599412 - DNA, 25 bp, Mus musculus
cctgagggcgctcagacagacttac

SEQ ID NO: 599413 - DNA, 25 bp, Mus musculus
cctgagggcgctgagacagacttac

SEQ ID NO: 599414 - DNA, 25 bp, Mus musculus
cctgagggcttaatttggctgctgg

SEQ ID NO: 599415 - DNA, 25 bp, Mus musculus
cctgagggcttattttggctgctgg

SEQ ID NO: 599416 - DNA, 25 bp, Mus musculus
cctgaggtgacacttcgaggttccc

SEQ ID NO: 599417 - DNA, 25 bp, Mus musculus
cctgaggtgacagttcgaggttccc

SEQ ID NO: 599418 - DNA, 25 bp, Mus musculus
cctgaggtgcccaggattctaatcc

SEQ ID NO: 599419 - DNA, 25 bp, Mus musculus
cctgaggtgccctggattctaatcc

SEQ ID NO: 599420 - DNA, 25 bp, Mus musculus
cctgaggtgtgaagtgaccaagaca

SEQ ID NO: 599421 - DNA, 25 bp, Mus musculus
cctgaggtgtgatgtgaccaagaca

SEQ ID NO: 599422 - DNA, 25 bp, Mus musculus
cctgaggtgtttaaggagatgatgt

SEQ ID NO: 599423 - DNA, 25 bp, Mus musculus
cctgaggtgttttaggagatgatgt

SEQ ID NO: 599424 - DNA, 25 bp, Mus musculus
cctgaggttgacctagtgattcaga

SEQ ID NO: 599425 - DNA, 25 bp, Mus musculus
cctgaggttgacgtagtgattcaga

SEQ ID NO: 599426 - DNA, 25 bp, Mus musculus
cctgaggttttgcttcagattgatg

SEQ ID NO: 599427 - DNA, 25 bp, Mus musculus
cctgaggttttggttcagattgatg

SEQ ID NO: 599428 - DNA, 25 bp, Mus musculus
cctgagtacatcagtcattgctgtc

SEQ ID NO: 599429 - DNA, 25 bp, Mus musculus
cctgagtacatctgtcattgctgtc

SEQ ID NO: 599430 - DNA, 25 bp, Mus musculus
cctgagtaccgtctgaggaaattct

SEQ ID NO: 599431 - DNA, 25 bp, Mus musculus
cctgagtaccgtgtgaggaaattct

SEQ ID NO: 599432 - DNA, 25 bp, Mus musculus
cctgagtatccgagaagtggaggac

SEQ ID NO: 599433 - DNA, 25 bp, Mus musculus
cctgagtatccgtgaagtggaggac

SEQ ID NO: 599434 - DNA, 25 bp, Mus musculus
cctgagtcagaactttgatgatgag

SEQ ID NO: 599435 - DNA, 25 bp, Mus musculus
cctgagtcagaagtttgatgatgag

SEQ ID NO: 599436 - DNA, 25 bp, Mus musculus
cctgagtcagcgaggctcctcactg

SEQ ID NO: 599437 - DNA, 25 bp, Mus musculus
cctgagtcagcgtggctcctcactg

SEQ ID NO: 599438 - DNA, 25 bp, Mus musculus
cctgagtcagtcatcagaaatatta

SEQ ID NO: 599439 - DNA, 25 bp, Mus musculus
cctgagtcagtcttcagaaatatta

SEQ ID NO: 599440 - DNA, 25 bp, Mus musculus
cctgagtcatgacagagaaaagata

SEQ ID NO: 599441 - DNA, 25 bp, Mus musculus
cctgagtcatgagagagaaaagata

SEQ ID NO: 599442 - DNA, 25 bp, Mus musculus
cctgagtccgatatgtgtggctgag

SEQ ID NO: 599443 - DNA, 25 bp, Mus musculus
cctgagtccgatttgtgtggctgag

SEQ ID NO: 599444 - DNA, 25 bp, Mus musculus
cctgagtcctcacgaggttgtatct

SEQ ID NO: 599445 - DNA, 25 bp, Mus musculus
cctgagtcctcaggaggttgtatct

SEQ ID NO: 599446 - DNA, 25 bp, Mus musculus
cctgagtcctgacagcatcatggag

SEQ ID NO: 599447 - DNA, 25 bp, Mus musculus
cctgagtcctgagagcatcatggag

SEQ ID NO: 599448 - DNA, 25 bp, Mus musculus
cctgagtccttaaaggtgaaattag

SEQ ID NO: 599449 - DNA, 25 bp, Mus musculus
cctgagtccttataggtgaaattag

SEQ ID NO: 599450 - DNA, 25 bp, Mus musculus
cctgagtcgccaaggtgactgtggt

SEQ ID NO: 599451 - DNA, 25 bp, Mus musculus
cctgagtcgccatggtgactgtggt

SEQ ID NO: 599452 - DNA, 25 bp, Mus musculus
cctgagtcgctaagacatcgctgtt

SEQ ID NO: 599453 - DNA, 25 bp, Mus musculus
cctgagtcgctatgacatcgctgtt

SEQ ID NO: 599454 - DNA, 25 bp, Mus musculus
cctgagtcggctcctggttcgctac

SEQ ID NO: 599455 - DNA, 25 bp, Mus musculus
cctgagtcggctgctggttcgctac

SEQ ID NO: 599456 - DNA, 25 bp, Mus musculus
cctgagtctagcattgggaagttcc

SEQ ID NO: 599457 - DNA, 25 bp, Mus musculus
cctgagtctagctttgggaagttcc

SEQ ID NO: 599458 - DNA, 25 bp, Mus musculus
cctgagtctctaagtattgtggaaa

SEQ ID NO: 599459 - DNA, 25 bp, Mus musculus
cctgagtctctatgtattgtggaaa

SEQ ID NO: 599460 - DNA, 25 bp, Mus musculus
cctgagtgaagtcaagtctgaagtg

SEQ ID NO: 599461 - DNA, 25 bp, Mus musculus
cctgagtgaagtgaagtctgaagtg

SEQ ID NO: 599462 - DNA, 25 bp, Mus musculus
cctgagtgaccgacgtgcttgcaga

SEQ ID NO: 599463 - DNA, 25 bp, Mus musculus
cctgagtgaccgtcgtgcttgcaga

SEQ ID NO: 599464 - DNA, 25 bp, Mus musculus
cctgagtgacctcccgaccaaggaa

SEQ ID NO: 599465 - DNA, 25 bp, Mus musculus
cctgagtgacctgccgaccaaggaa

SEQ ID NO: 599466 - DNA, 25 bp, Mus musculus
cctgagtgatctctatggtgacaac

SEQ ID NO: 599467 - DNA, 25 bp, Mus musculus
cctgagtgatctgtatggtgacaac

SEQ ID NO: 599468 - DNA, 25 bp, Mus musculus
cctgagtgatgaccacgtgtttgaa

SEQ ID NO: 599469 - DNA, 25 bp, Mus musculus
cctgagtgatgagcacgtgtttgaa

SEQ ID NO: 599470 - DNA, 25 bp, Mus musculus
cctgagtgcactcgatagagagcaa

SEQ ID NO: 599471 - DNA, 25 bp, Mus musculus
cctgagtgcactggatagagagcaa

SEQ ID NO: 599472 - DNA, 25 bp, Mus musculus
cctgagtgcagacgacaagcttctc

SEQ ID NO: 599473 - DNA, 25 bp, Mus musculus
cctgagtgcagaggacaagcttctc

SEQ ID NO: 599474 - DNA, 25 bp, Mus musculus
cctgagtgcgggacggtgtagccga

SEQ ID NO: 599475 - DNA, 25 bp, Mus musculus
cctgagtgcgggtcggtgtagccga

SEQ ID NO: 599476 - DNA, 25 bp, Mus musculus
cctgagttactgaccccagtgaggg

SEQ ID NO: 599477 - DNA, 25 bp, Mus musculus
cctgagttactgtccccagtgaggg

SEQ ID NO: 599478 - DNA, 25 bp, Mus musculus
cctgagttagaaaagaaggattttg

SEQ ID NO: 599479 - DNA, 25 bp, Mus musculus
cctgagttagaatagaaggattttg

SEQ ID NO: 599480 - DNA, 25 bp, Mus musculus
cctgagttcaggagacaagtggagc

SEQ ID NO: 599481 - DNA, 25 bp, Mus musculus
cctgagttcaggtgacaagtggagc

SEQ ID NO: 599482 - DNA, 25 bp, Mus musculus
cctgagttcctcaagcttgcttact

SEQ ID NO: 599483 - DNA, 25 bp, Mus musculus
cctgagttcctctagcttgcttact

SEQ ID NO: 599484 - DNA, 25 bp, Mus musculus
cctgagttcggtcggtcaataggct

SEQ ID NO: 599485 - DNA, 25 bp, Mus musculus
cctgagttcggtgggtcaataggct

SEQ ID NO: 599486 - DNA, 25 bp, Mus musculus
cctgagttctggcaccttctgggag

SEQ ID NO: 599487 - DNA, 25 bp, Mus musculus
cctgagttctgggaccttctgggag

SEQ ID NO: 599488 - DNA, 25 bp, Mus musculus
cctgagttgcatctcttgttttgaa

SEQ ID NO: 599489 - DNA, 25 bp, Mus musculus
cctgagttgcatgtcttgttttgaa

SEQ ID NO: 599490 - DNA, 25 bp, Mus musculus
cctgagtttatgaacctgggaccct

SEQ ID NO: 599491 - DNA, 25 bp, Mus musculus
cctgagtttatgtacctgggaccct

SEQ ID NO: 599492 - DNA, 25 bp, Mus musculus
cctgagttttgtagtgcaagagaac

SEQ ID NO: 599493 - DNA, 25 bp, Mus musculus
cctgagttttgttgtgcaagagaac

SEQ ID NO: 599494 - DNA, 25 bp, Mus musculus
cctgataaaagaccggcttgcccta

SEQ ID NO: 599495 - DNA, 25 bp, Mus musculus
cctgataaaagagcggcttgcccta

SEQ ID NO: 599496 - DNA, 25 bp, Mus musculus
cctgataacttcatagctgcctgca

SEQ ID NO: 599497 - DNA, 25 bp, Mus musculus
cctgataacttcttagctgcctgca

SEQ ID NO: 599498 - DNA, 25 bp, Mus musculus
cctgatacagtgcaaggctggagcc

SEQ ID NO: 599499 - DNA, 25 bp, Mus musculus
cctgatacagtggaaggctggagcc

SEQ ID NO: 599500 - DNA, 25 bp, Mus musculus
cctgataccaacattgtctacctct

SEQ ID NO: 599501 - DNA, 25 bp, Mus musculus
cctgataccaactttgtctacctct

SEQ ID NO: 599502 - DNA, 25 bp, Mus musculus
cctgatagtcttcaagatgcatggg

SEQ ID NO: 599503 - DNA, 25 bp, Mus musculus
cctgatagtcttgaagatgcatggg

SEQ ID NO: 599504 - DNA, 25 bp, Mus musculus
cctgatagttgaagacaagccctga

SEQ ID NO: 599505 - DNA, 25 bp, Mus musculus
cctgatagttgatgacaagccctga

SEQ ID NO: 599506 - DNA, 25 bp, Mus musculus
cctgatatctcaagaaacattcaag

SEQ ID NO: 599507 - DNA, 25 bp, Mus musculus
cctgatatctcatgaaacattcaag

SEQ ID NO: 599508 - DNA, 25 bp, Mus musculus
cctgatatgaaaaaggagcaagacc

SEQ ID NO: 599509 - DNA, 25 bp, Mus musculus
cctgatatgaaataggagcaagacc

SEQ ID NO: 599510 - DNA, 25 bp, Mus musculus
cctgatattattccgttggaagcgg

SEQ ID NO: 599511 - DNA, 25 bp, Mus musculus
cctgatattattgcgttggaagcgg

SEQ ID NO: 599512 - DNA, 25 bp, Mus musculus
cctgatcaacaaaccggatgagcgt

SEQ ID NO: 599513 - DNA, 25 bp, Mus musculus
cctgatcaacaatccggatgagcgt

SEQ ID NO: 599514 - DNA, 25 bp, Mus musculus
cctgatcaagtgcataaggaagatg

SEQ ID NO: 599515 - DNA, 25 bp, Mus musculus
cctgatcaagtggataaggaagatg

SEQ ID NO: 599516 - DNA, 25 bp, Mus musculus
cctgatcacaggcaaatgggagaaa

SEQ ID NO: 599517 - DNA, 25 bp, Mus musculus
cctgatcacagggaaatgggagaaa

SEQ ID NO: 599518 - DNA, 25 bp, Mus musculus
cctgatcacattactggaacgacga

SEQ ID NO: 599519 - DNA, 25 bp, Mus musculus
cctgatcacatttctggaacgacga

SEQ ID NO: 599520 - DNA, 25 bp, Mus musculus
cctgatcactggcagaggtacactc

SEQ ID NO: 599521 - DNA, 25 bp, Mus musculus
cctgatcactgggagaggtacactc

SEQ ID NO: 599522 - DNA, 25 bp, Mus musculus
cctgatcagatcagagagggagttc

SEQ ID NO: 599523 - DNA, 25 bp, Mus musculus
cctgatcagatctgagagggagttc

SEQ ID NO: 599524 - DNA, 25 bp, Mus musculus
cctgatcatgcacagctgggctcgg

SEQ ID NO: 599525 - DNA, 25 bp, Mus musculus
cctgatcatgcagagctgggctcgg

SEQ ID NO: 599526 - DNA, 25 bp, Mus musculus
cctgatcccatgagccaggaagatg

SEQ ID NO: 599527 - DNA, 25 bp, Mus musculus
cctgatcccatgtgccaggaagatg

SEQ ID NO: 599528 - DNA, 25 bp, Mus musculus
cctgatcccggacagagtgtttatg

SEQ ID NO: 599529 - DNA, 25 bp, Mus musculus
cctgatcccggagagagtgtttatg

SEQ ID NO: 599530 - DNA, 25 bp, Mus musculus
cctgatccgagcagcaaatgaccga

SEQ ID NO: 599531 - DNA, 25 bp, Mus musculus
cctgatccgagctgcaaatgaccga

SEQ ID NO: 599532 - DNA, 25 bp, Mus musculus
cctgatcctaagagagcaaccttga

SEQ ID NO: 599533 - DNA, 25 bp, Mus musculus
cctgatcctaagtgagcaaccttga

SEQ ID NO: 599534 - DNA, 25 bp, Mus musculus
cctgatccttgccaataagtattgc

SEQ ID NO: 599535 - DNA, 25 bp, Mus musculus
cctgatccttgcgaataagtattgc

SEQ ID NO: 599536 - DNA, 25 bp, Mus musculus
cctgatcggccaaaggatgaagtat

SEQ ID NO: 599537 - DNA, 25 bp, Mus musculus
cctgatcggccataggatgaagtat

SEQ ID NO: 599538 - DNA, 25 bp, Mus musculus
cctgatctagctccccagtctgagt

SEQ ID NO: 599539 - DNA, 25 bp, Mus musculus
cctgatctagctgcccagtctgagt

SEQ ID NO: 599540 - DNA, 25 bp, Mus musculus
cctgatctcagtaggaggacaacat

SEQ ID NO: 599541 - DNA, 25 bp, Mus musculus
cctgatctcagttggaggacaacat

SEQ ID NO: 599542 - DNA, 25 bp, Mus musculus
cctgatctggataagaggaagtacc

SEQ ID NO: 599543 - DNA, 25 bp, Mus musculus
cctgatctggattagaggaagtacc

SEQ ID NO: 599544 - DNA, 25 bp, Mus musculus
cctgatctggttagcggagagataa

SEQ ID NO: 599545 - DNA, 25 bp, Mus musculus
cctgatctggtttgcggagagataa

SEQ ID NO: 599546 - DNA, 25 bp, Mus musculus
cctgatcttagaataagaggtcacc

SEQ ID NO: 599547 - DNA, 25 bp, Mus musculus
cctgatcttagattaagaggtcacc

SEQ ID NO: 599548 - DNA, 25 bp, Mus musculus
cctgatctttaaagaagtggccaaa

SEQ ID NO: 599549 - DNA, 25 bp, Mus musculus
cctgatctttaatgaagtggccaaa

SEQ ID NO: 599550 - DNA, 25 bp, Mus musculus
cctgatgaactgcaaatgctgatgt

SEQ ID NO: 599551 - DNA, 25 bp, Mus musculus
cctgatgaactggaaatgctgatgt

SEQ ID NO: 599552 - DNA, 25 bp, Mus musculus
cctgatgaaggaagccctcggttgc

SEQ ID NO: 599553 - DNA, 25 bp, Mus musculus
cctgatgaaggatgccctcggttgc

SEQ ID NO: 599554 - DNA, 25 bp, Mus musculus
cctgatgaatgtagatgtcatgcca

SEQ ID NO: 599555 - DNA, 25 bp, Mus musculus
cctgatgaatgttgatgtcatgcca

SEQ ID NO: 599556 - DNA, 25 bp, Mus musculus
cctgatgaccctcaagggacttcca

SEQ ID NO: 599557 - DNA, 25 bp, Mus musculus
cctgatgaccctgaagggacttcca

SEQ ID NO: 599558 - DNA, 25 bp, Mus musculus
cctgatgacctaattgatgccacaa

SEQ ID NO: 599559 - DNA, 25 bp, Mus musculus
cctgatgacctacccaatggccatg

SEQ ID NO: 599560 - DNA, 25 bp, Mus musculus
cctgatgacctagccaatggccatg

SEQ ID NO: 599561 - DNA, 25 bp, Mus musculus
cctgatgacctatttgatgccacaa

SEQ ID NO: 599562 - DNA, 25 bp, Mus musculus
cctgatgacgataaaatctatttct

SEQ ID NO: 599563 - DNA, 25 bp, Mus musculus
cctgatgacgattaaatctatttct

SEQ ID NO: 599564 - DNA, 25 bp, Mus musculus
cctgatgagcagaaggtatttgccc

SEQ ID NO: 599565 - DNA, 25 bp, Mus musculus
cctgatgagcagtaggtatttgccc

SEQ ID NO: 599566 - DNA, 25 bp, Mus musculus
cctgatgaggaacatcttggaatcc

SEQ ID NO: 599567 - DNA, 25 bp, Mus musculus
cctgatgaggaagatcttggaatcc

SEQ ID NO: 599568 - DNA, 25 bp, Mus musculus
cctgatgaggttctcacagagtatt

SEQ ID NO: 599569 - DNA, 25 bp, Mus musculus
cctgatgaggttgtcacagagtatt

SEQ ID NO: 599570 - DNA, 25 bp, Mus musculus
cctgatgagtacattgagaaactgg

SEQ ID NO: 599571 - DNA, 25 bp, Mus musculus
cctgatgagtactttgagaaactgg

SEQ ID NO: 599572 - DNA, 25 bp, Mus musculus
cctgatgagtctctggacgacttca

SEQ ID NO: 599573 - DNA, 25 bp, Mus musculus
cctgatgagtctgtggacgacttca

SEQ ID NO: 599574 - DNA, 25 bp, Mus musculus
cctgatgagttcacccaggaagaga

SEQ ID NO: 599575 - DNA, 25 bp, Mus musculus
cctgatgagttctcccaggaagaga

SEQ ID NO: 599576 - DNA, 25 bp, Mus musculus
cctgatgatagccattgagtacaag

SEQ ID NO: 599577 - DNA, 25 bp, Mus musculus
cctgatgatagcgattgagtacaag

SEQ ID NO: 599578 - DNA, 25 bp, Mus musculus
cctgatgatcttctacataattggt

SEQ ID NO: 599579 - DNA, 25 bp, Mus musculus
cctgatgatcttgtacataattggt

SEQ ID NO: 599580 - DNA, 25 bp, Mus musculus
cctgatgatggtattcctacacaag

SEQ ID NO: 599581 - DNA, 25 bp, Mus musculus
cctgatgatggttttcctacacaag

SEQ ID NO: 599582 - DNA, 25 bp, Mus musculus
cctgatgatgtccagcctatcgcca

SEQ ID NO: 599583 - DNA, 25 bp, Mus musculus
cctgatgatgtcgagcctatcgcca

SEQ ID NO: 599584 - DNA, 25 bp, Mus musculus
cctgatgcaggtccttctgtcaggc

SEQ ID NO: 599585 - DNA, 25 bp, Mus musculus
cctgatgcaggtgcttctgtcaggc

SEQ ID NO: 599586 - DNA, 25 bp, Mus musculus
cctgatgcagtacaggtgacaccca

SEQ ID NO: 599587 - DNA, 25 bp, Mus musculus
cctgatgcagtagaggtgacaccca

SEQ ID NO: 599588 - DNA, 25 bp, Mus musculus
cctgatgccatcaagcccgtgggaa

SEQ ID NO: 599589 - DNA, 25 bp, Mus musculus
cctgatgccatctagcccgtgggaa

SEQ ID NO: 599590 - DNA, 25 bp, Mus musculus
cctgatgcctaaacagcacctggaa

SEQ ID NO: 599591 - DNA, 25 bp, Mus musculus
cctgatgcctaatcagcacctggaa

SEQ ID NO: 599592 - DNA, 25 bp, Mus musculus
cctgatgcggtaaccaattaactca

SEQ ID NO: 599593 - DNA, 25 bp, Mus musculus
cctgatgcggtatccaattaactca

SEQ ID NO: 599594 - DNA, 25 bp, Mus musculus
cctgatgctacacgacgtttggaga

SEQ ID NO: 599595 - DNA, 25 bp, Mus musculus
cctgatgctacaggacgtttggaga

SEQ ID NO: 599596 - DNA, 25 bp, Mus musculus
cctgatgctactactcctgctgctg

SEQ ID NO: 599597 - DNA, 25 bp, Mus musculus
cctgatgctacttctcctgctgctg

SEQ ID NO: 599598 - DNA, 25 bp, Mus musculus
cctgatggacaaccccacactgtat

SEQ ID NO: 599599 - DNA, 25 bp, Mus musculus
cctgatggacaagcccacactgtat

SEQ ID NO: 599600 - DNA, 25 bp, Mus musculus
cctgatggagcccaccgcaggatct

SEQ ID NO: 599601 - DNA, 25 bp, Mus musculus
cctgatggagccgaccgcaggatct

SEQ ID NO: 599602 - DNA, 25 bp, Mus musculus
cctgatggagctctaaaaccaccca

SEQ ID NO: 599603 - DNA, 25 bp, Mus musculus
cctgatggagctgtaaaaccaccca

SEQ ID NO: 599604 - DNA, 25 bp, Mus musculus
cctgatggaggaactaactctgaaa

SEQ ID NO: 599605 - DNA, 25 bp, Mus musculus
cctgatggaggatctaactctgaaa

SEQ ID NO: 599606 - DNA, 25 bp, Mus musculus
cctgatggataaaatggaaaaggac

SEQ ID NO: 599607 - DNA, 25 bp, Mus musculus
cctgatggataatatggaaaaggac

SEQ ID NO: 599608 - DNA, 25 bp, Mus musculus
cctgatggatacattggaggacaac

SEQ ID NO: 599609 - DNA, 25 bp, Mus musculus
cctgatggatactttggaggacaac

SEQ ID NO: 599610 - DNA, 25 bp, Mus musculus
cctgatggatttcgtggagttccat

SEQ ID NO: 599611 - DNA, 25 bp, Mus musculus
cctgatggatttggtggagttccat

SEQ ID NO: 599612 - DNA, 25 bp, Mus musculus
cctgatggcactctaacgctgcatg

SEQ ID NO: 599613 - DNA, 25 bp, Mus musculus
cctgatggcactgtaacgctgcatg

SEQ ID NO: 599614 - DNA, 25 bp, Mus musculus
cctgatggcagccttagcccaagtg

SEQ ID NO: 599615 - DNA, 25 bp, Mus musculus
cctgatggcagcgttagcccaagtg

SEQ ID NO: 599616 - DNA, 25 bp, Mus musculus
cctgatggccccaagggtgaacgtg

SEQ ID NO: 599617 - DNA, 25 bp, Mus musculus
cctgatggcccctagggtgaacgtg

SEQ ID NO: 599618 - DNA, 25 bp, Mus musculus
cctgatggccctcaagaagtttgtg

SEQ ID NO: 599619 - DNA, 25 bp, Mus musculus
cctgatggccctgaagaagtttgtg

SEQ ID NO: 599620 - DNA, 25 bp, Mus musculus
cctgatggcctcactaactggaaga

SEQ ID NO: 599621 - DNA, 25 bp, Mus musculus
cctgatggcctctctaactggaaga

SEQ ID NO: 599622 - DNA, 25 bp, Mus musculus
cctgatgggagcctataaagtgact

SEQ ID NO: 599623 - DNA, 25 bp, Mus musculus
cctgatgggagcgtataaagtgact

SEQ ID NO: 599624 - DNA, 25 bp, Mus musculus
cctgatgggattctcgtctaaaccg

SEQ ID NO: 599625 - DNA, 25 bp, Mus musculus
cctgatgggattgtcgtctaaaccg

SEQ ID NO: 599626 - DNA, 25 bp, Mus musculus
cctgatgggcagatgcccagcgata

SEQ ID NO: 599627 - DNA, 25 bp, Mus musculus
cctgatgggcagttgcccagcgata

SEQ ID NO: 599628 - DNA, 25 bp, Mus musculus
cctgatgggcctaaatgagtcttcc

SEQ ID NO: 599629 - DNA, 25 bp, Mus musculus
cctgatgggccttaatgagtcttcc

SEQ ID NO: 599630 - DNA, 25 bp, Mus musculus
cctgatggtttaatggcgtcagata

SEQ ID NO: 599631 - DNA, 25 bp, Mus musculus
cctgatggtttattggcgtcagata

SEQ ID NO: 599632 - DNA, 25 bp, Mus musculus
cctgatgtcaaaccccgagagaaga

SEQ ID NO: 599633 - DNA, 25 bp, Mus musculus
cctgatgtcaaagcccgagagaaga

SEQ ID NO: 599634 - DNA, 25 bp, Mus musculus
cctgatgtgcttctcatgtaccgat

SEQ ID NO: 599635 - DNA, 25 bp, Mus musculus
cctgatgtgcttgtcatgtaccgat

SEQ ID NO: 599636 - DNA, 25 bp, Mus musculus
cctgatgttgttcagagtcagccag

SEQ ID NO: 599637 - DNA, 25 bp, Mus musculus
cctgatgttgttgagagtcagccag

SEQ ID NO: 599638 - DNA, 25 bp, Mus musculus
cctgattagcatcggatccaacgac

SEQ ID NO: 599639 - DNA, 25 bp, Mus musculus
cctgattagcatgggatccaacgac

SEQ ID NO: 599640 - DNA, 25 bp, Mus musculus
cctgattctgaacctgggatctgaa

SEQ ID NO: 599641 - DNA, 25 bp, Mus musculus
cctgattctgaagctgggatctgaa

SEQ ID NO: 599642 - DNA, 25 bp, Mus musculus
cctgattctggtcggacttctggtc

SEQ ID NO: 599643 - DNA, 25 bp, Mus musculus
cctgattctggtgggacttctggtc

SEQ ID NO: 599644 - DNA, 25 bp, Mus musculus
cctgattgagaaccttcctggtagt

SEQ ID NO: 599645 - DNA, 25 bp, Mus musculus
cctgattgagaagcttcctggtagt

SEQ ID NO: 599646 - DNA, 25 bp, Mus musculus
cctgattgctgacaactccacaaat

SEQ ID NO: 599647 - DNA, 25 bp, Mus musculus
cctgattgctgagaactccacaaat

SEQ ID NO: 599648 - DNA, 25 bp, Mus musculus
cctgattgtgcacaggatcatcaag

SEQ ID NO: 599649 - DNA, 25 bp, Mus musculus
cctgattgtgcagaggatcatcaag

SEQ ID NO: 599650 - DNA, 25 bp, Mus musculus
cctgattgtggcaagtgcagcttgc

SEQ ID NO: 599651 - DNA, 25 bp, Mus musculus
cctgattgtggctagtgcagcttgc

SEQ ID NO: 599652 - DNA, 25 bp, Mus musculus
cctgattgtggtccctgagatcttc

SEQ ID NO: 599653 - DNA, 25 bp, Mus musculus
cctgattgtggtgcctgagatcttc

SEQ ID NO: 599654 - DNA, 25 bp, Mus musculus
cctgatttgtctccagggtacctgg

SEQ ID NO: 599655 - DNA, 25 bp, Mus musculus
cctgatttgtctgcagggtacctgg

SEQ ID NO: 599656 - DNA, 25 bp, Mus musculus
cctgatttgttcaagacctccagag

SEQ ID NO: 599657 - DNA, 25 bp, Mus musculus
cctgatttgttctagacctccagag

SEQ ID NO: 599658 - DNA, 25 bp, Mus musculus
cctgattttcagcaccgatgacttt

SEQ ID NO: 599659 - DNA, 25 bp, Mus musculus
cctgattttcaggaccgatgacttt

SEQ ID NO: 599660 - DNA, 25 bp, Mus musculus
cctgcaaaagtgagagattgcgctg

SEQ ID NO: 599661 - DNA, 25 bp, Mus musculus
cctgcaaaagtgtgagattgcgctg

SEQ ID NO: 599662 - DNA, 25 bp, Mus musculus
cctgcaaaagttcttcctatgaaag

SEQ ID NO: 599663 - DNA, 25 bp, Mus musculus
cctgcaaaagttgttcctatgaaag

SEQ ID NO: 599664 - DNA, 25 bp, Mus musculus
cctgcaaagatgcacggcagctgct

SEQ ID NO: 599665 - DNA, 25 bp, Mus musculus
cctgcaaagatggacggcagctgct

SEQ ID NO: 599666 - DNA, 25 bp, Mus musculus
cctgcaaagcttaccgggacttggc

SEQ ID NO: 599667 - DNA, 25 bp, Mus musculus
cctgcaaagctttccgggacttggc

SEQ ID NO: 599668 - DNA, 25 bp, Mus musculus
cctgcaaagtggacatgtgggctac

SEQ ID NO: 599669 - DNA, 25 bp, Mus musculus
cctgcaaagtggtcatgtgggctac

SEQ ID NO: 599670 - DNA, 25 bp, Mus musculus
cctgcaaatcagcacgctcagcgtg

SEQ ID NO: 599671 - DNA, 25 bp, Mus musculus
cctgcaaatcaggacgctcagcgtg

SEQ ID NO: 599672 - DNA, 25 bp, Mus musculus
cctgcaactctgaggacagcctctg

SEQ ID NO: 599673 - DNA, 25 bp, Mus musculus
cctgcaactctgtggacagcctctg

SEQ ID NO: 599674 - DNA, 25 bp, Mus musculus
cctgcaagaactcgcacattgtcga

SEQ ID NO: 599675 - DNA, 25 bp, Mus musculus
cctgcaagaactggcacattgtcga

SEQ ID NO: 599676 - DNA, 25 bp, Mus musculus
cctgcaagaattcaataaagagctt

SEQ ID NO: 599677 - DNA, 25 bp, Mus musculus
cctgcaagaattgaataaagagctt

SEQ ID NO: 599678 - DNA, 25 bp, Mus musculus
cctgcaagatcaaaaaggaaatgtc

SEQ ID NO: 599679 - DNA, 25 bp, Mus musculus
cctgcaagatcataaaggaaatgtc

SEQ ID NO: 599680 - DNA, 25 bp, Mus musculus
cctgcaaggagcatgctcagactac

SEQ ID NO: 599681 - DNA, 25 bp, Mus musculus
cctgcaaggagcttgctcagactac

SEQ ID NO: 599682 - DNA, 25 bp, Mus musculus
cctgcaaggcatccgtgtccagcgg

SEQ ID NO: 599683 - DNA, 25 bp, Mus musculus
cctgcaaggcatgcgtgtccagcgg

SEQ ID NO: 599684 - DNA, 25 bp, Mus musculus
cctgcaaggcggagctgtctgtgct

SEQ ID NO: 599685 - DNA, 25 bp, Mus musculus
cctgcaaggcggtgctgtctgtgct

SEQ ID NO: 599686 - DNA, 25 bp, Mus musculus
cctgcaagggaacgcactcagttag

SEQ ID NO: 599687 - DNA, 25 bp, Mus musculus
cctgcaagggaaggcactcagttag

SEQ ID NO: 599688 - DNA, 25 bp, Mus musculus
cctgcaagtacaatggaaaagatga

SEQ ID NO: 599689 - DNA, 25 bp, Mus musculus
cctgcaagtacattggaaaagatga

SEQ ID NO: 599690 - DNA, 25 bp, Mus musculus
cctgcaatctggacttagaaaactt

SEQ ID NO: 599691 - DNA, 25 bp, Mus musculus
cctgcaatctggtcttagaaaactt

SEQ ID NO: 599692 - DNA, 25 bp, Mus musculus
cctgcaatgactctggaggctccca

SEQ ID NO: 599693 - DNA, 25 bp, Mus musculus
cctgcaatgactgtggaggctccca

SEQ ID NO: 599694 - DNA, 25 bp, Mus musculus
cctgcaatgctacatctgccttcag

SEQ ID NO: 599695 - DNA, 25 bp, Mus musculus
cctgcaatgctagatctgccttcag

SEQ ID NO: 599696 - DNA, 25 bp, Mus musculus
cctgcaatggtgcaggaagacccac

SEQ ID NO: 599697 - DNA, 25 bp, Mus musculus
cctgcaatggtggaggaagacccac

SEQ ID NO: 599698 - DNA, 25 bp, Mus musculus
cctgcaatgtggagcagtccttctt

SEQ ID NO: 599699 - DNA, 25 bp, Mus musculus
cctgcaatgtggtgcagtccttctt

SEQ ID NO: 599700 - DNA, 25 bp, Mus musculus
cctgcaattcagacccctaagtgtg

SEQ ID NO: 599701 - DNA, 25 bp, Mus musculus
cctgcaattcagtcccctaagtgtg

SEQ ID NO: 599702 - DNA, 25 bp, Mus musculus
cctgcaatttcaacacagaatagcc

SEQ ID NO: 599703 - DNA, 25 bp, Mus musculus
cctgcaatttcatcacagaatagcc

SEQ ID NO: 599704 - DNA, 25 bp, Mus musculus
cctgcacaaaacaggatttttgccc

SEQ ID NO: 599705 - DNA, 25 bp, Mus musculus
cctgcacaaaactggatttttgccc

SEQ ID NO: 599706 - DNA, 25 bp, Mus musculus
cctgcacaagatagccccactggtg

SEQ ID NO: 599707 - DNA, 25 bp, Mus musculus
cctgcacaagattgccccactggtg

SEQ ID NO: 599708 - DNA, 25 bp, Mus musculus
cctgcacaagtgctcctcatcggat

SEQ ID NO: 599709 - DNA, 25 bp, Mus musculus
cctgcacaagtggtcctcatcggat

SEQ ID NO: 599710 - DNA, 25 bp, Mus musculus
cctgcacacagtaggtacttactgc

SEQ ID NO: 599711 - DNA, 25 bp, Mus musculus
cctgcacacagttggtacttactgc

SEQ ID NO: 599712 - DNA, 25 bp, Mus musculus
cctgcacactggacagaagatgcct

SEQ ID NO: 599713 - DNA, 25 bp, Mus musculus
cctgcacactggtcagaagatgcct

SEQ ID NO: 599714 - DNA, 25 bp, Mus musculus
cctgcacacttcattggctggtatc

SEQ ID NO: 599715 - DNA, 25 bp, Mus musculus
cctgcacacttctttggctggtatc

SEQ ID NO: 599716 - DNA, 25 bp, Mus musculus
cctgcacagagcctacgggacactg

SEQ ID NO: 599717 - DNA, 25 bp, Mus musculus
cctgcacagagcgtacgggacactg

SEQ ID NO: 599718 - DNA, 25 bp, Mus musculus
cctgcacagcaacggtagaagcttt

SEQ ID NO: 599719 - DNA, 25 bp, Mus musculus
cctgcacagcaagggtagaagcttt

SEQ ID NO: 599720 - DNA, 25 bp, Mus musculus
cctgcacagggaaaagacacccctg

SEQ ID NO: 599721 - DNA, 25 bp, Mus musculus
cctgcacagggataagacacccctg

SEQ ID NO: 599722 - DNA, 25 bp, Mus musculus
cctgcacagtggacctctctgctgg

SEQ ID NO: 599723 - DNA, 25 bp, Mus musculus
cctgcacagtggtcctctctgctgg

SEQ ID NO: 599724 - DNA, 25 bp, Mus musculus
cctgcacatcgccaaggctctggga

SEQ ID NO: 599725 - DNA, 25 bp, Mus musculus
cctgcacatcgcgaaggctctggga

SEQ ID NO: 599726 - DNA, 25 bp, Mus musculus
cctgcacccagtactcatgtcggag

SEQ ID NO: 599727 - DNA, 25 bp, Mus musculus
cctgcacccagttctcatgtcggag

SEQ ID NO: 599728 - DNA, 25 bp, Mus musculus
cctgcaccgctgagactggagactc

SEQ ID NO: 599729 - DNA, 25 bp, Mus musculus
cctgcaccgctgtgactggagactc

SEQ ID NO: 599730 - DNA, 25 bp, Mus musculus
cctgcaccggtaagaccgtggcact

SEQ ID NO: 599731 - DNA, 25 bp, Mus musculus
cctgcaccggtatgaccgtggcact

SEQ ID NO: 599732 - DNA, 25 bp, Mus musculus
cctgcacctggcagcgcagtacggg

SEQ ID NO: 599733 - DNA, 25 bp, Mus musculus
cctgcacctggctgcgcagtacggg

SEQ ID NO: 599734 - DNA, 25 bp, Mus musculus
cctgcacgagcgcactctcagtgtg

SEQ ID NO: 599735 - DNA, 25 bp, Mus musculus
cctgcacgagcggactctcagtgtg

SEQ ID NO: 599736 - DNA, 25 bp, Mus musculus
cctgcacggtgcaggcaatcagatc

SEQ ID NO: 599737 - DNA, 25 bp, Mus musculus
cctgcacggtgctggcaatcagatc

SEQ ID NO: 599738 - DNA, 25 bp, Mus musculus
cctgcacggttaaggcggcatgaac

SEQ ID NO: 599739 - DNA, 25 bp, Mus musculus
cctgcacggttatggcggcatgaac

SEQ ID NO: 599740 - DNA, 25 bp, Mus musculus
cctgcacgtggtccttcgctgcaga

SEQ ID NO: 599741 - DNA, 25 bp, Mus musculus
cctgcacgtggtgcttcgctgcaga

SEQ ID NO: 599742 - DNA, 25 bp, Mus musculus
cctgcactattgaggatatcttgga

SEQ ID NO: 599743 - DNA, 25 bp, Mus musculus
cctgcactattgtggatatcttgga

SEQ ID NO: 599744 - DNA, 25 bp, Mus musculus
cctgcactcaggacagaaccatctg

SEQ ID NO: 599745 - DNA, 25 bp, Mus musculus
cctgcactcaggtcagaaccatctg

SEQ ID NO: 599746 - DNA, 25 bp, Mus musculus
cctgcactgaggagcctcggatccg

SEQ ID NO: 599747 - DNA, 25 bp, Mus musculus
cctgcactgaggtgcctcggatccg

SEQ ID NO: 599748 - DNA, 25 bp, Mus musculus
cctgcacttcccctcggtggtagat

SEQ ID NO: 599749 - DNA, 25 bp, Mus musculus
cctgcacttcccgtcggtggtagat

SEQ ID NO: 599750 - DNA, 25 bp, Mus musculus
cctgcacttctaagtgcaagatgtg

SEQ ID NO: 599751 - DNA, 25 bp, Mus musculus
cctgcacttctatgtgcaagatgtg

SEQ ID NO: 599752 - DNA, 25 bp, Mus musculus
cctgcacttggcagcggaagaagca

SEQ ID NO: 599753 - DNA, 25 bp, Mus musculus
cctgcacttggctgcggaagaagca

SEQ ID NO: 599754 - DNA, 25 bp, Mus musculus
cctgcagaagagatgcctggtccct

SEQ ID NO: 599755 - DNA, 25 bp, Mus musculus
cctgcagaagagttgcctggtccct

SEQ ID NO: 599756 - DNA, 25 bp, Mus musculus
cctgcagacaggactgggagttctg

SEQ ID NO: 599757 - DNA, 25 bp, Mus musculus
cctgcagacaggtctgggagttctg

SEQ ID NO: 599758 - DNA, 25 bp, Mus musculus
cctgcagactctaagacatggagtt

SEQ ID NO: 599759 - DNA, 25 bp, Mus musculus
cctgcagactcttagacatggagtt

SEQ ID NO: 599760 - DNA, 25 bp, Mus musculus
cctgcagagaggctgagctgtccac

SEQ ID NO: 599761 - DNA, 25 bp, Mus musculus
cctgcagagagggtgagctgtccac

SEQ ID NO: 599762 - DNA, 25 bp, Mus musculus
cctgcagagcagagtccggcagcgc

SEQ ID NO: 599763 - DNA, 25 bp, Mus musculus
cctgcagagcagtgtccggcagcgc

SEQ ID NO: 599764 - DNA, 25 bp, Mus musculus
cctgcagagctacgtggcacaccat

SEQ ID NO: 599765 - DNA, 25 bp, Mus musculus
cctgcagagctaggtggcacaccat

SEQ ID NO: 599766 - DNA, 25 bp, Mus musculus
cctgcagagtctcggaaaagttgcc

SEQ ID NO: 599767 - DNA, 25 bp, Mus musculus
cctgcagagtctgggaaaagttgcc

SEQ ID NO: 599768 - DNA, 25 bp, Mus musculus
cctgcagatttaagtttcacagtct

SEQ ID NO: 599769 - DNA, 25 bp, Mus musculus
cctgcagatttatgtttcacagtct

SEQ ID NO: 599770 - DNA, 25 bp, Mus musculus
cctgcagcaaagactttagtggaca

SEQ ID NO: 599771 - DNA, 25 bp, Mus musculus
cctgcagcaaagagcccaacaactg

SEQ ID NO: 599772 - DNA, 25 bp, Mus musculus
cctgcagcaaagtctttagtggaca

SEQ ID NO: 599773 - DNA, 25 bp, Mus musculus
cctgcagcaaagtgcccaacaactg

SEQ ID NO: 599774 - DNA, 25 bp, Mus musculus
cctgcagcaataacgggtcttaatt

SEQ ID NO: 599775 - DNA, 25 bp, Mus musculus
cctgcagcaatatcgggtcttaatt

SEQ ID NO: 599776 - DNA, 25 bp, Mus musculus
cctgcagcactgagcagtctggagc

SEQ ID NO: 599777 - DNA, 25 bp, Mus musculus
cctgcagcactgtgcagtctggagc

SEQ ID NO: 599778 - DNA, 25 bp, Mus musculus
cctgcagcagataatggacagtgtg

SEQ ID NO: 599779 - DNA, 25 bp, Mus musculus
cctgcagcagattatggacagtgtg

SEQ ID NO: 599780 - DNA, 25 bp, Mus musculus
cctgcagcaggaaaacctcttgctt

SEQ ID NO: 599781 - DNA, 25 bp, Mus musculus
cctgcagcaggataacctcttgctt

SEQ ID NO: 599782 - DNA, 25 bp, Mus musculus
cctgcagcaggtagaccaaggagca

SEQ ID NO: 599783 - DNA, 25 bp, Mus musculus
cctgcagcaggttgaccaaggagca

SEQ ID NO: 599784 - DNA, 25 bp, Mus musculus
cctgcagcatcaatccgtgccttaa

SEQ ID NO: 599785 - DNA, 25 bp, Mus musculus
cctgcagcatcattccgtgccttaa

SEQ ID NO: 599786 - DNA, 25 bp, Mus musculus
cctgcagcctacagggctgcgcagg

SEQ ID NO: 599787 - DNA, 25 bp, Mus musculus
cctgcagcctactgggctgcgcagg

SEQ ID NO: 599788 - DNA, 25 bp, Mus musculus
cctgcagcggtgactgggacaacat

SEQ ID NO: 599789 - DNA, 25 bp, Mus musculus
cctgcagcggtgtctgggacaacat

SEQ ID NO: 599790 - DNA, 25 bp, Mus musculus
cctgcagctaacatgaaggtactct

SEQ ID NO: 599791 - DNA, 25 bp, Mus musculus
cctgcagctaacttgaaggtactct

SEQ ID NO: 599792 - DNA, 25 bp, Mus musculus
cctgcagctgtaccctgagaactcg

SEQ ID NO: 599793 - DNA, 25 bp, Mus musculus
cctgcagctgtagcctgagaactcg

SEQ ID NO: 599794 - DNA, 25 bp, Mus musculus
cctgcagcttggctcaccatgtttg

SEQ ID NO: 599795 - DNA, 25 bp, Mus musculus
cctgcagcttgggtcaccatgtttg

SEQ ID NO: 599796 - DNA, 25 bp, Mus musculus
cctgcagctttactttttcgaagat

SEQ ID NO: 599797 - DNA, 25 bp, Mus musculus
cctgcagctttagtttttcgaagat

SEQ ID NO: 599798 - DNA, 25 bp, Mus musculus
cctgcaggaacaaggcaacctgcca

SEQ ID NO: 599799 - DNA, 25 bp, Mus musculus
cctgcaggaacatggcaacctgcca

SEQ ID NO: 599800 - DNA, 25 bp, Mus musculus
cctgcaggaagcctactgagcagtg

SEQ ID NO: 599801 - DNA, 25 bp, Mus musculus
cctgcaggaagcgtactgagcagtg

SEQ ID NO: 599802 - DNA, 25 bp, Mus musculus
cctgcaggagctacatgagcagctg

SEQ ID NO: 599803 - DNA, 25 bp, Mus musculus
cctgcaggagcttcatgagcagctg

SEQ ID NO: 599804 - DNA, 25 bp, Mus musculus
cctgcaggaggccaatggaagcaca

SEQ ID NO: 599805 - DNA, 25 bp, Mus musculus
cctgcaggaggcgaatggaagcaca

SEQ ID NO: 599806 - DNA, 25 bp, Mus musculus
cctgcaggagttcgcaaaccggctt

SEQ ID NO: 599807 - DNA, 25 bp, Mus musculus
cctgcaggagttggcaaaccggctt

SEQ ID NO: 599808 - DNA, 25 bp, Mus musculus
cctgcaggccaacgctgtggaactg

SEQ ID NO: 599809 - DNA, 25 bp, Mus musculus
cctgcaggccaaggctgtggaactg

SEQ ID NO: 599810 - DNA, 25 bp, Mus musculus
cctgcaggcgaaaaagaacttctcc

SEQ ID NO: 599811 - DNA, 25 bp, Mus musculus
cctgcaggcgaataagaacttctcc

SEQ ID NO: 599812 - DNA, 25 bp, Mus musculus
cctgcaggctcaagaggaacaattg

SEQ ID NO: 599813 - DNA, 25 bp, Mus musculus
cctgcaggctcatgaggaacaattg

SEQ ID NO: 599814 - DNA, 25 bp, Mus musculus
cctgcaggctgcatgagcgaagttc

SEQ ID NO: 599815 - DNA, 25 bp, Mus musculus
cctgcaggctgcttgagcgaagttc

SEQ ID NO: 599816 - DNA, 25 bp, Mus musculus
cctgcaggtcggacacccttgagga

SEQ ID NO: 599817 - DNA, 25 bp, Mus musculus
cctgcaggtcggtcacccttgagga

SEQ ID NO: 599818 - DNA, 25 bp, Mus musculus
cctgcaggtgcaaggccgagcctgc

SEQ ID NO: 599819 - DNA, 25 bp, Mus musculus
cctgcaggtgcatggccgagcctgc

SEQ ID NO: 599820 - DNA, 25 bp, Mus musculus
cctgcaggttgcagaagtgtctaaa

SEQ ID NO: 599821 - DNA, 25 bp, Mus musculus
cctgcaggttgctgaagtgtctaaa

SEQ ID NO: 599822 - DNA, 25 bp, Mus musculus
cctgcagtacaactacaccttttgg

SEQ ID NO: 599823 - DNA, 25 bp, Mus musculus
cctgcagtacaagtacaccttttgg

SEQ ID NO: 599824 - DNA, 25 bp, Mus musculus
cctgcagtagccagttaatgttaag

SEQ ID NO: 599825 - DNA, 25 bp, Mus musculus
cctgcagtagcctgttaatgttaag

SEQ ID NO: 599826 - DNA, 25 bp, Mus musculus
cctgcagtaggccttgttagaagtc

SEQ ID NO: 599827 - DNA, 25 bp, Mus musculus
cctgcagtaggcgttgttagaagtc

SEQ ID NO: 599828 - DNA, 25 bp, Mus musculus
cctgcagtctgaaaagggatatgcc

SEQ ID NO: 599829 - DNA, 25 bp, Mus musculus
cctgcagtctgacggctctgatgag

SEQ ID NO: 599830 - DNA, 25 bp, Mus musculus
cctgcagtctgagggctctgatgag

SEQ ID NO: 599831 - DNA, 25 bp, Mus musculus
cctgcagtctgataagggatatgcc

SEQ ID NO: 599832 - DNA, 25 bp, Mus musculus
cctgcagtctggacaaagagcattt

SEQ ID NO: 599833 - DNA, 25 bp, Mus musculus
cctgcagtctggagctgaagactcg

SEQ ID NO: 599834 - DNA, 25 bp, Mus musculus
cctgcagtctggtcaaagagcattt

SEQ ID NO: 599835 - DNA, 25 bp, Mus musculus
cctgcagtctggtgctgaagactcg

SEQ ID NO: 599836 - DNA, 25 bp, Mus musculus
cctgcagtgcataaagcagaatgct

SEQ ID NO: 599837 - DNA, 25 bp, Mus musculus
cctgcagtgcattaagcagaatgct

SEQ ID NO: 599838 - DNA, 25 bp, Mus musculus
cctgcagtgcgactagacttctata

SEQ ID NO: 599839 - DNA, 25 bp, Mus musculus
cctgcagtgcgagtagacttctata

SEQ ID NO: 599840 - DNA, 25 bp, Mus musculus
cctgcagttagtagtattgctgtgg

SEQ ID NO: 599841 - DNA, 25 bp, Mus musculus
cctgcagttagttgtattgctgtgg

SEQ ID NO: 599842 - DNA, 25 bp, Mus musculus
cctgcagttgaaagggatggccctg

SEQ ID NO: 599843 - DNA, 25 bp, Mus musculus
cctgcagttgaatgggatggccctg

SEQ ID NO: 599844 - DNA, 25 bp, Mus musculus
cctgcagttgatagagggagacgca

SEQ ID NO: 599845 - DNA, 25 bp, Mus musculus
cctgcagttgattgagggagacgca

SEQ ID NO: 599846 - DNA, 25 bp, Mus musculus
cctgcatattgcagaggatgatggg

SEQ ID NO: 599847 - DNA, 25 bp, Mus musculus
cctgcatattgctgaggatgatggg

SEQ ID NO: 599848 - DNA, 25 bp, Mus musculus
cctgcatcatgaagcctgaggagat

SEQ ID NO: 599849 - DNA, 25 bp, Mus musculus
cctgcatcatgatgcctgaggagat

SEQ ID NO: 599850 - DNA, 25 bp, Mus musculus
cctgcatcatttactgtgcggccct

SEQ ID NO: 599851 - DNA, 25 bp, Mus musculus
cctgcatcattttctgtgcggccct

SEQ ID NO: 599852 - DNA, 25 bp, Mus musculus
cctgcatcctggaacggtgacagcg

SEQ ID NO: 599853 - DNA, 25 bp, Mus musculus
cctgcatcctggtacggtgacagcg

SEQ ID NO: 599854 - DNA, 25 bp, Mus musculus
cctgcatcgcggctgttcatggaac

SEQ ID NO: 599855 - DNA, 25 bp, Mus musculus
cctgcatcgcgggtgttcatggaac

SEQ ID NO: 599856 - DNA, 25 bp, Mus musculus
cctgcatctcagcaaggacggtcct

SEQ ID NO: 599857 - DNA, 25 bp, Mus musculus
cctgcatctcaggaaggacggtcct

SEQ ID NO: 599858 - DNA, 25 bp, Mus musculus
cctgcatctcctccagaacacagag

SEQ ID NO: 599859 - DNA, 25 bp, Mus musculus
cctgcatctcctgcagaacacagag

SEQ ID NO: 599860 - DNA, 25 bp, Mus musculus
cctgcatgagggatatgacagctat

SEQ ID NO: 599861 - DNA, 25 bp, Mus musculus
cctgcatgagggttatgacagctat

SEQ ID NO: 599862 - DNA, 25 bp, Mus musculus
cctgcatgattgagaactttgctcc

SEQ ID NO: 599863 - DNA, 25 bp, Mus musculus
cctgcatgattgtgaactttgctcc

SEQ ID NO: 599864 - DNA, 25 bp, Mus musculus
cctgcatgcaagcaagcacttttgt

SEQ ID NO: 599865 - DNA, 25 bp, Mus musculus
cctgcatgcaaggaagcacttttgt

SEQ ID NO: 599866 - DNA, 25 bp, Mus musculus
cctgcatggaatcgaaggagtcccg

SEQ ID NO: 599867 - DNA, 25 bp, Mus musculus
cctgcatggaatctgctagtgtgtt

SEQ ID NO: 599868 - DNA, 25 bp, Mus musculus
cctgcatggaatggaaggagtcccg

SEQ ID NO: 599869 - DNA, 25 bp, Mus musculus
cctgcatggaatgtgctagtgtgtt

SEQ ID NO: 599870 - DNA, 25 bp, Mus musculus
cctgcatggacgagaatggaccttg

SEQ ID NO: 599871 - DNA, 25 bp, Mus musculus
cctgcatggacgtgaatggaccttg

SEQ ID NO: 599872 - DNA, 25 bp, Mus musculus
cctgcatggatacttctgggccagc

SEQ ID NO: 599873 - DNA, 25 bp, Mus musculus
cctgcatggatagttctgggccagc

SEQ ID NO: 599874 - DNA, 25 bp, Mus musculus
cctgcatggtaccaaaagccttgga

SEQ ID NO: 599875 - DNA, 25 bp, Mus musculus
cctgcatggtacgaaaagccttgga

SEQ ID NO: 599876 - DNA, 25 bp, Mus musculus
cctgcatgtgtgctgtggacgcttc

SEQ ID NO: 599877 - DNA, 25 bp, Mus musculus
cctgcatgtgtggtgtggacgcttc

SEQ ID NO: 599878 - DNA, 25 bp, Mus musculus
cctgcattaaagacgtggccatcaa

SEQ ID NO: 599879 - DNA, 25 bp, Mus musculus
cctgcattaaagtcgtggccatcaa

SEQ ID NO: 599880 - DNA, 25 bp, Mus musculus
cctgcattatggactctataagaag

SEQ ID NO: 599881 - DNA, 25 bp, Mus musculus
cctgcattatggtctctataagaag

SEQ ID NO: 599882 - DNA, 25 bp, Mus musculus
cctgcattgaagctgtagtcctgcg

SEQ ID NO: 599883 - DNA, 25 bp, Mus musculus
cctgcattgaaggtgtagtcctgcg

SEQ ID NO: 599884 - DNA, 25 bp, Mus musculus
cctgcattgcaaatggagggatgtt

SEQ ID NO: 599885 - DNA, 25 bp, Mus musculus
cctgcattgcaattggagggatgtt

SEQ ID NO: 599886 - DNA, 25 bp, Mus musculus
cctgcattggaaaccaagagtgttg

SEQ ID NO: 599887 - DNA, 25 bp, Mus musculus
cctgcattggaatccaagagtgttg

SEQ ID NO: 599888 - DNA, 25 bp, Mus musculus
cctgccaaaagtaatgctccagagc

SEQ ID NO: 599889 - DNA, 25 bp, Mus musculus
cctgccaaaagttatgctccagagc

SEQ ID NO: 599890 - DNA, 25 bp, Mus musculus
cctgccaaagtgcatgtcttctaca

SEQ ID NO: 599891 - DNA, 25 bp, Mus musculus
cctgccaaagtggatgtcttctaca

SEQ ID NO: 599892 - DNA, 25 bp, Mus musculus
cctgccaacatccagtctataaatt

SEQ ID NO: 599893 - DNA, 25 bp, Mus musculus
cctgccaacatcgagtctataaatt

SEQ ID NO: 599894 - DNA, 25 bp, Mus musculus
cctgccaagaacacagaaccagagg

SEQ ID NO: 599895 - DNA, 25 bp, Mus musculus
cctgccaagaactcagaaccagagg

SEQ ID NO: 599896 - DNA, 25 bp, Mus musculus
cctgccaagtttctgtgcttcctag

SEQ ID NO: 599897 - DNA, 25 bp, Mus musculus
cctgccaagtttgtgtgcttcctag

SEQ ID NO: 599898 - DNA, 25 bp, Mus musculus
cctgccacaatgagatcggctccta

SEQ ID NO: 599899 - DNA, 25 bp, Mus musculus
cctgccacaatgagggggctcaact

SEQ ID NO: 599900 - DNA, 25 bp, Mus musculus
cctgccacaatgtgatcggctccta

SEQ ID NO: 599901 - DNA, 25 bp, Mus musculus
cctgccacaatgtgggggctcaact

SEQ ID NO: 599902 - DNA, 25 bp, Mus musculus
cctgccacacaactgaggtggttgc

SEQ ID NO: 599903 - DNA, 25 bp, Mus musculus
cctgccacacaagtgaggtggttgc

SEQ ID NO: 599904 - DNA, 25 bp, Mus musculus
cctgccacggaaaccaggcttgtgc

SEQ ID NO: 599905 - DNA, 25 bp, Mus musculus
cctgccacggaatccaggcttgtgc

SEQ ID NO: 599906 - DNA, 25 bp, Mus musculus
cctgccactcgaagtcacatggaag

SEQ ID NO: 599907 - DNA, 25 bp, Mus musculus
cctgccactcgatgtcacatggaag

SEQ ID NO: 599908 - DNA, 25 bp, Mus musculus
cctgccacttaaccggagatttcct

SEQ ID NO: 599909 - DNA, 25 bp, Mus musculus
cctgccacttaagcggagatttcct

SEQ ID NO: 599910 - DNA, 25 bp, Mus musculus
cctgccacttttcatgcttacaaaa

SEQ ID NO: 599911 - DNA, 25 bp, Mus musculus
cctgccacttttgatgcttacaaaa

SEQ ID NO: 599912 - DNA, 25 bp, Mus musculus
cctgccagaaccatcattgcaaaca

SEQ ID NO: 599913 - DNA, 25 bp, Mus musculus
cctgccagaaccttcattgcaaaca

SEQ ID NO: 599914 - DNA, 25 bp, Mus musculus
cctgccagagccacggaggtgtgga

SEQ ID NO: 599915 - DNA, 25 bp, Mus musculus
cctgccagagcctcggaggtgtgga

SEQ ID NO: 599916 - DNA, 25 bp, Mus musculus
cctgccagatgcagacagggagcgt

SEQ ID NO: 599917 - DNA, 25 bp, Mus musculus
cctgccagatgctgacagggagcgt

SEQ ID NO: 599918 - DNA, 25 bp, Mus musculus
cctgccagatgtctctgctaaggac

SEQ ID NO: 599919 - DNA, 25 bp, Mus musculus
cctgccagatgtgtctgctaaggac

SEQ ID NO: 599920 - DNA, 25 bp, Mus musculus
cctgccagctggacatatgatagga

SEQ ID NO: 599921 - DNA, 25 bp, Mus musculus
cctgccagctggtcatatgatagga

SEQ ID NO: 599922 - DNA, 25 bp, Mus musculus
cctgccaggagtatactgtcacaga

SEQ ID NO: 599923 - DNA, 25 bp, Mus musculus
cctgccaggagtttactgtcacaga

SEQ ID NO: 599924 - DNA, 25 bp, Mus musculus
cctgccagggaaccaacaagtggtg

SEQ ID NO: 599925 - DNA, 25 bp, Mus musculus
cctgccagggaagcaacaagtggtg

SEQ ID NO: 599926 - DNA, 25 bp, Mus musculus
cctgccaggtggacacatcagctgt

SEQ ID NO: 599927 - DNA, 25 bp, Mus musculus
cctgccaggtggtcacatcagctgt

SEQ ID NO: 599928 - DNA, 25 bp, Mus musculus
cctgccagttccagggacggagcta

SEQ ID NO: 599929 - DNA, 25 bp, Mus musculus
cctgccagttcctgggacggagcta

SEQ ID NO: 599930 - DNA, 25 bp, Mus musculus
cctgccagtttccagcctgaacaat

SEQ ID NO: 599931 - DNA, 25 bp, Mus musculus
cctgccagtttcgagcctgaacaat

SEQ ID NO: 599932 - DNA, 25 bp, Mus musculus
cctgccatatccaggagtgtcctga

SEQ ID NO: 599933 - DNA, 25 bp, Mus musculus
cctgccatatcctggagtgtcctga

SEQ ID NO: 599934 - DNA, 25 bp, Mus musculus
cctgccatcgtgcaactagctgaag

SEQ ID NO: 599935 - DNA, 25 bp, Mus musculus
cctgccatcgtggaactagctgaag

SEQ ID NO: 599936 - DNA, 25 bp, Mus musculus
cctgccatctgacagctagttggtt

SEQ ID NO: 599937 - DNA, 25 bp, Mus musculus
cctgccatctgagagctagttggtt

SEQ ID NO: 599938 - DNA, 25 bp, Mus musculus
cctgccatgcgtacagatctagcgg

SEQ ID NO: 599939 - DNA, 25 bp, Mus musculus
cctgccatgcgttcagatctagcgg

SEQ ID NO: 599940 - DNA, 25 bp, Mus musculus
cctgccatttggaggagcgggaata

SEQ ID NO: 599941 - DNA, 25 bp, Mus musculus
cctgccatttggtggagcgggaata

SEQ ID NO: 599942 - DNA, 25 bp, Mus musculus
cctgcccagagcacaagacttctga

SEQ ID NO: 599943 - DNA, 25 bp, Mus musculus
cctgcccagagctcaagacttctga

SEQ ID NO: 599944 - DNA, 25 bp, Mus musculus
cctgcccagaggagcttatacaggg

SEQ ID NO: 599945 - DNA, 25 bp, Mus musculus
cctgcccagaggtgcttatacaggg

SEQ ID NO: 599946 - DNA, 25 bp, Mus musculus
cctgcccagggactagatacatttt

SEQ ID NO: 599947 - DNA, 25 bp, Mus musculus
cctgcccagggagtagatacatttt

SEQ ID NO: 599948 - DNA, 25 bp, Mus musculus
cctgcccatggacagaaatgcagag

SEQ ID NO: 599949 - DNA, 25 bp, Mus musculus
cctgcccatggagagaaatgcagag

SEQ ID NO: 599950 - DNA, 25 bp, Mus musculus
cctgccccagagcaaagaattaaat

SEQ ID NO: 599951 - DNA, 25 bp, Mus musculus
cctgccccagaggaaagaattaaat

SEQ ID NO: 599952 - DNA, 25 bp, Mus musculus
cctgccccagggagcaagaggcaag

SEQ ID NO: 599953 - DNA, 25 bp, Mus musculus
cctgccccagggtgcaagaggcaag

SEQ ID NO: 599954 - DNA, 25 bp, Mus musculus
cctgccccgatgactgatgaaatac

SEQ ID NO: 599955 - DNA, 25 bp, Mus musculus
cctgccccgatgtctgatgaaatac

SEQ ID NO: 599956 - DNA, 25 bp, Mus musculus
cctgcccgagtgaatgggacaggtt

SEQ ID NO: 599957 - DNA, 25 bp, Mus musculus
cctgcccgagtgacgcgggccagat

SEQ ID NO: 599958 - DNA, 25 bp, Mus musculus
cctgcccgagtgtatgggacaggtt

SEQ ID NO: 599959 - DNA, 25 bp, Mus musculus
cctgcccgagtgtcgcgggccagat

SEQ ID NO: 599960 - DNA, 25 bp, Mus musculus
cctgcccgggtgcaaggtcgaatgt

SEQ ID NO: 599961 - DNA, 25 bp, Mus musculus
cctgcccgggtggaaggtcgaatgt

SEQ ID NO: 599962 - DNA, 25 bp, Mus musculus
cctgccctaggcatcctgaattact

SEQ ID NO: 599963 - DNA, 25 bp, Mus musculus
cctgccctaggcttcctgaattact

SEQ ID NO: 599964 - DNA, 25 bp, Mus musculus
cctgccctcctgatgagaccatgga

SEQ ID NO: 599965 - DNA, 25 bp, Mus musculus
cctgccctcctgttgagaccatgga

SEQ ID NO: 599966 - DNA, 25 bp, Mus musculus
cctgccctctttataatctgccaga

SEQ ID NO: 599967 - DNA, 25 bp, Mus musculus
cctgccctctttttaatctgccaga

SEQ ID NO: 599968 - DNA, 25 bp, Mus musculus
cctgccctgagactccacaggaaag

SEQ ID NO: 599969 - DNA, 25 bp, Mus musculus
cctgccctgagagtccacaggaaag

SEQ ID NO: 599970 - DNA, 25 bp, Mus musculus
cctgccctgagcatttgattcctta

SEQ ID NO: 599971 - DNA, 25 bp, Mus musculus
cctgccctgagcttttgattcctta

SEQ ID NO: 599972 - DNA, 25 bp, Mus musculus
cctgccctgaggcatcctataaggc

SEQ ID NO: 599973 - DNA, 25 bp, Mus musculus
cctgccctgagggatcctataaggc

SEQ ID NO: 599974 - DNA, 25 bp, Mus musculus
cctgcccttgaaacacatcatgagg

SEQ ID NO: 599975 - DNA, 25 bp, Mus musculus
cctgcccttgaatcacatcatgagg

SEQ ID NO: 599976 - DNA, 25 bp, Mus musculus
cctgccgacagcaaggttctccttt

SEQ ID NO: 599977 - DNA, 25 bp, Mus musculus
cctgccgacagctaggttctccttt

SEQ ID NO: 599978 - DNA, 25 bp, Mus musculus
cctgccgagaaaattgttggcagag

SEQ ID NO: 599979 - DNA, 25 bp, Mus musculus
cctgccgagaaatttgttggcagag

SEQ ID NO: 599980 - DNA, 25 bp, Mus musculus
cctgccgccgggatgagtgtgactc

SEQ ID NO: 599981 - DNA, 25 bp, Mus musculus
cctgccgccgggttgagtgtgactc

SEQ ID NO: 599982 - DNA, 25 bp, Mus musculus
cctgccgccgtccagtagaaaacag

SEQ ID NO: 599983 - DNA, 25 bp, Mus musculus
cctgccgccgtcgagtagaaaacag

SEQ ID NO: 599984 - DNA, 25 bp, Mus musculus
cctgccgctacgaggtgttgtgtcg

SEQ ID NO: 599985 - DNA, 25 bp, Mus musculus
cctgccgctacgtggtgttgtgtcg

SEQ ID NO: 599986 - DNA, 25 bp, Mus musculus
cctgccgggcttctggtgacgtcat

SEQ ID NO: 599987 - DNA, 25 bp, Mus musculus
cctgccgggcttgtggtgacgtcat

SEQ ID NO: 599988 - DNA, 25 bp, Mus musculus
cctgccgttcagagcgtctggcaaa

SEQ ID NO: 599989 - DNA, 25 bp, Mus musculus
cctgccgttcagtgcgtctggcaaa

SEQ ID NO: 599990 - DNA, 25 bp, Mus musculus
cctgccgtttaaaagagcctggctg

SEQ ID NO: 599991 - DNA, 25 bp, Mus musculus
cctgccgtttaatagagcctggctg

SEQ ID NO: 599992 - DNA, 25 bp, Mus musculus
cctgcctagaccatattgtgacgta

SEQ ID NO: 599993 - DNA, 25 bp, Mus musculus
cctgcctagaccttattgtgacgta

SEQ ID NO: 599994 - DNA, 25 bp, Mus musculus
cctgcctagggaagcaagagaggta

SEQ ID NO: 599995 - DNA, 25 bp, Mus musculus
cctgcctagggatgcaagagaggta

SEQ ID NO: 599996 - DNA, 25 bp, Mus musculus
cctgcctatgcaaaacggtctcaga

SEQ ID NO: 599997 - DNA, 25 bp, Mus musculus
cctgcctatgcataacggtctcaga

SEQ ID NO: 599998 - DNA, 25 bp, Mus musculus
cctgcctcaggtcactcggagaaca

SEQ ID NO: 599999 - DNA, 25 bp, Mus musculus
cctgcctcaggtgactcggagaaca

SEQ ID NO: 600000 - DNA, 25 bp, Mus musculus
cctgcctcagtcagtgagaatcacg

SEQ ID NO: 600001 - DNA, 25 bp, Mus musculus
cctgcctcagtctgtgagaatcacg

SEQ ID NO: 600002 - DNA, 25 bp, Mus musculus
cctgcctccacaccagattgagaag

SEQ ID NO: 600003 - DNA, 25 bp, Mus musculus
cctgcctccacagcagattgagaag

SEQ ID NO: 600004 - DNA, 25 bp, Mus musculus
cctgcctccggaataagctgttgaa

SEQ ID NO: 600005 - DNA, 25 bp, Mus musculus
cctgcctccggattaagctgttgaa

SEQ ID NO: 600006 - DNA, 25 bp, Mus musculus
cctgcctcggagcaaagacttagag

SEQ ID NO: 600007 - DNA, 25 bp, Mus musculus
cctgcctcggaggaaagacttagag

SEQ ID NO: 600008 - DNA, 25 bp, Mus musculus
cctgcctcggcgaagtgggctagaa

SEQ ID NO: 600009 - DNA, 25 bp, Mus musculus
cctgcctcggcgtagtgggctagaa

SEQ ID NO: 600010 - DNA, 25 bp, Mus musculus
cctgcctcttctaccagaagatggt

SEQ ID NO: 600011 - DNA, 25 bp, Mus musculus
cctgcctcttcttccagaagatggt

SEQ ID NO: 600012 - DNA, 25 bp, Mus musculus
cctgcctcttggaggaactgctgga

SEQ ID NO: 600013 - DNA, 25 bp, Mus musculus
cctgcctcttggtggaactgctgga

SEQ ID NO: 600014 - DNA, 25 bp, Mus musculus
cctgcctgacaccaggaagcttgaa

SEQ ID NO: 600015 - DNA, 25 bp, Mus musculus
cctgcctgacacgaggaagcttgaa

SEQ ID NO: 600016 - DNA, 25 bp, Mus musculus
cctgcctgagccaatttatgggact

SEQ ID NO: 600017 - DNA, 25 bp, Mus musculus
cctgcctgagcctatttatgggact

SEQ ID NO: 600018 - DNA, 25 bp, Mus musculus
cctgcctgcgaacatgttggaaata

SEQ ID NO: 600019 - DNA, 25 bp, Mus musculus
cctgcctgcgaagatgttggaaata

SEQ ID NO: 600020 - DNA, 25 bp, Mus musculus
cctgcctggacgagatgaacgtggt

SEQ ID NO: 600021 - DNA, 25 bp, Mus musculus
cctgcctggacgtgatgaacgtggt

SEQ ID NO: 600022 - DNA, 25 bp, Mus musculus
cctgcctggattccgagctgactga

SEQ ID NO: 600023 - DNA, 25 bp, Mus musculus
cctgcctggattgcgagctgactga

SEQ ID NO: 600024 - DNA, 25 bp, Mus musculus
cctgcctgggagactagtgctttca

SEQ ID NO: 600025 - DNA, 25 bp, Mus musculus
cctgcctgggagtctagtgctttca

SEQ ID NO: 600026 - DNA, 25 bp, Mus musculus
cctgcctgggtgctatcactgtgag

SEQ ID NO: 600027 - DNA, 25 bp, Mus musculus
cctgcctgggtggtatcactgtgag

SEQ ID NO: 600028 - DNA, 25 bp, Mus musculus
cctgcctgtgcgagcaattcttgca

SEQ ID NO: 600029 - DNA, 25 bp, Mus musculus
cctgcctgtgcgtgcaattcttgca

SEQ ID NO: 600030 - DNA, 25 bp, Mus musculus
cctgcctgtgttagtatggaaccca

SEQ ID NO: 600031 - DNA, 25 bp, Mus musculus
cctgcctgtgtttgtatggaaccca

SEQ ID NO: 600032 - DNA, 25 bp, Mus musculus
cctgcctgttgcaaaggacaatggg

SEQ ID NO: 600033 - DNA, 25 bp, Mus musculus
cctgcctgttgctaaggacaatggg

SEQ ID NO: 600034 - DNA, 25 bp, Mus musculus
cctgccttacggcaatgaccctggg

SEQ ID NO: 600035 - DNA, 25 bp, Mus musculus
cctgccttacgggaatgaccctggg

SEQ ID NO: 600036 - DNA, 25 bp, Mus musculus
cctgccttagaaatggagtcatgta

SEQ ID NO: 600037 - DNA, 25 bp, Mus musculus
cctgccttagaattggagtcatgta

SEQ ID NO: 600038 - DNA, 25 bp, Mus musculus
cctgccttcaggatcgtcacgggtt

SEQ ID NO: 600039 - DNA, 25 bp, Mus musculus
cctgccttcaggttcgtcacgggtt

SEQ ID NO: 600040 - DNA, 25 bp, Mus musculus
cctgccttcgtgagcacagtgggca

SEQ ID NO: 600041 - DNA, 25 bp, Mus musculus
cctgccttcgtgtgcacagtgggca

SEQ ID NO: 600042 - DNA, 25 bp, Mus musculus
cctgccttctcaacattatgattga

SEQ ID NO: 600043 - DNA, 25 bp, Mus musculus
cctgccttctcatcattatgattga

SEQ ID NO: 600044 - DNA, 25 bp, Mus musculus
cctgccttcttcatatgcaagacgg

SEQ ID NO: 600045 - DNA, 25 bp, Mus musculus
cctgccttcttcttatgcaagacgg

SEQ ID NO: 600046 - DNA, 25 bp, Mus musculus
cctgccttgataaacttggtgacca

SEQ ID NO: 600047 - DNA, 25 bp, Mus musculus
cctgccttgatatacttggtgacca

SEQ ID NO: 600048 - DNA, 25 bp, Mus musculus
cctgccttgtctcaaagagaagaga

SEQ ID NO: 600049 - DNA, 25 bp, Mus musculus
cctgccttgtctgaaagagaagaga

SEQ ID NO: 600050 - DNA, 25 bp, Mus musculus
cctgccttgtgaacctgtttgcctg

SEQ ID NO: 600051 - DNA, 25 bp, Mus musculus
cctgccttgtgatcctgtttgcctg

SEQ ID NO: 600052 - DNA, 25 bp, Mus musculus
cctgcctttctacggcgctagcaaa

SEQ ID NO: 600053 - DNA, 25 bp, Mus musculus
cctgcctttctagggcgctagcaaa

SEQ ID NO: 600054 - DNA, 25 bp, Mus musculus
cctgcctttgacctggatgaaaaaa

SEQ ID NO: 600055 - DNA, 25 bp, Mus musculus
cctgcctttgacgtggatgaaaaaa

SEQ ID NO: 600056 - DNA, 25 bp, Mus musculus
cctgcctttgatctgcgcgggtaat

SEQ ID NO: 600057 - DNA, 25 bp, Mus musculus
cctgcctttgatgtgcgcgggtaat

SEQ ID NO: 600058 - DNA, 25 bp, Mus musculus
cctgcgaatcgaccctgggcaggac

SEQ ID NO: 600059 - DNA, 25 bp, Mus musculus
cctgcgaatcgagcctgggcaggac

SEQ ID NO: 600060 - DNA, 25 bp, Mus musculus
cctgcgaatgcgaaagcctcgtgga

SEQ ID NO: 600061 - DNA, 25 bp, Mus musculus
cctgcgaatgcgtaagcctcgtgga

SEQ ID NO: 600062 - DNA, 25 bp, Mus musculus
cctgcgaccacaccaaggggttgga

SEQ ID NO: 600063 - DNA, 25 bp, Mus musculus
cctgcgaccacagcaaggggttgga

SEQ ID NO: 600064 - DNA, 25 bp, Mus musculus
cctgcgacctgaaccacggggaggt

SEQ ID NO: 600065 - DNA, 25 bp, Mus musculus
cctgcgacctgatccacggggaggt

SEQ ID NO: 600066 - DNA, 25 bp, Mus musculus
cctgcgacgacgacatagatggcga

SEQ ID NO: 600067 - DNA, 25 bp, Mus musculus
cctgcgacgacgtcatagatggcga

SEQ ID NO: 600068 - DNA, 25 bp, Mus musculus
cctgcgacttctcgaggaggctctg

SEQ ID NO: 600069 - DNA, 25 bp, Mus musculus
cctgcgacttctggaggaggctctg

SEQ ID NO: 600070 - DNA, 25 bp, Mus musculus
cctgcgagggtgacataggcacctg

SEQ ID NO: 600071 - DNA, 25 bp, Mus musculus
cctgcgagggtgtcataggcacctg

SEQ ID NO: 600072 - DNA, 25 bp, Mus musculus
cctgcgatcgacatctaacttttgc

SEQ ID NO: 600073 - DNA, 25 bp, Mus musculus
cctgcgatcgacttctaacttttgc

SEQ ID NO: 600074 - DNA, 25 bp, Mus musculus
cctgcgatcgttaaccaaaattctt

SEQ ID NO: 600075 - DNA, 25 bp, Mus musculus
cctgcgatcgtttaccaaaattctt

SEQ ID NO: 600076 - DNA, 25 bp, Mus musculus
cctgcgatggaaacgtggaccatgc

SEQ ID NO: 600077 - DNA, 25 bp, Mus musculus
cctgcgatggaatcgtggaccatgc

SEQ ID NO: 600078 - DNA, 25 bp, Mus musculus
cctgcgcaaagacttagcccctggg

SEQ ID NO: 600079 - DNA, 25 bp, Mus musculus
cctgcgcaaagagttagcccctggg

SEQ ID NO: 600080 - DNA, 25 bp, Mus musculus
cctgcgcaaagtaaacaaacacata

SEQ ID NO: 600081 - DNA, 25 bp, Mus musculus
cctgcgcaaagttaacaaacacata

SEQ ID NO: 600082 - DNA, 25 bp, Mus musculus
cctgcgcaattaaaaggagcacatg

SEQ ID NO: 600083 - DNA, 25 bp, Mus musculus
cctgcgcaattataaggagcacatg

SEQ ID NO: 600084 - DNA, 25 bp, Mus musculus
cctgcgcacaggacttagtatcggt

SEQ ID NO: 600085 - DNA, 25 bp, Mus musculus
cctgcgcacaggtcttagtatcggt

SEQ ID NO: 600086 - DNA, 25 bp, Mus musculus
cctgcgcagaagagaacggcttgaa

SEQ ID NO: 600087 - DNA, 25 bp, Mus musculus
cctgcgcagaagtgaacggcttgaa

SEQ ID NO: 600088 - DNA, 25 bp, Mus musculus
cctgcgcagctgctaagaagcctgt

SEQ ID NO: 600089 - DNA, 25 bp, Mus musculus
cctgcgcagctgctcggttcagaga

SEQ ID NO: 600090 - DNA, 25 bp, Mus musculus
cctgcgcagctggtaagaagcctgt

SEQ ID NO: 600091 - DNA, 25 bp, Mus musculus
cctgcgcagctggtcggttcagaga

SEQ ID NO: 600092 - DNA, 25 bp, Mus musculus
cctgcgcatagtcgtgattgacctg

SEQ ID NO: 600093 - DNA, 25 bp, Mus musculus
cctgcgcatagtggtgattgacctg

SEQ ID NO: 600094 - DNA, 25 bp, Mus musculus
cctgcgccaacaatggaacttgcgt

SEQ ID NO: 600095 - DNA, 25 bp, Mus musculus
cctgcgccaacattggaacttgcgt

SEQ ID NO: 600096 - DNA, 25 bp, Mus musculus
cctgcgccaatcatgggtgaagggc

SEQ ID NO: 600097 - DNA, 25 bp, Mus musculus
cctgcgccaatcttgggtgaagggc

SEQ ID NO: 600098 - DNA, 25 bp, Mus musculus
cctgcgccagggaattctaaaacaa

SEQ ID NO: 600099 - DNA, 25 bp, Mus musculus
cctgcgccagggactggacattctt

SEQ ID NO: 600100 - DNA, 25 bp, Mus musculus
cctgcgccagggtattctaaaacaa

SEQ ID NO: 600101 - DNA, 25 bp, Mus musculus
cctgcgccagggtctggacattctt

SEQ ID NO: 600102 - DNA, 25 bp, Mus musculus
cctgcgcctgtgcaggtgagctacc

SEQ ID NO: 600103 - DNA, 25 bp, Mus musculus
cctgcgcctgtggaggtgagctacc

SEQ ID NO: 600104 - DNA, 25 bp, Mus musculus
cctgcgcgcactattggcggtcgca

SEQ ID NO: 600105 - DNA, 25 bp, Mus musculus
cctgcgcgcacttttggcggtcgca

SEQ ID NO: 600106 - DNA, 25 bp, Mus musculus
cctgcgctacctcaagtggagaagg

SEQ ID NO: 600107 - DNA, 25 bp, Mus musculus
cctgcgctacctgaagtggagaagg

SEQ ID NO: 600108 - DNA, 25 bp, Mus musculus
cctgcgctgcgacgcgatgacagtc

SEQ ID NO: 600109 - DNA, 25 bp, Mus musculus
cctgcgctgcgaggcgatgacagtc

SEQ ID NO: 600110 - DNA, 25 bp, Mus musculus
cctgcgctgggtccagacgctgtct

SEQ ID NO: 600111 - DNA, 25 bp, Mus musculus
cctgcgctgggtgcagacgctgtct

SEQ ID NO: 600112 - DNA, 25 bp, Mus musculus
cctgcgctgtggctttcgctgcctg

SEQ ID NO: 600113 - DNA, 25 bp, Mus musculus
cctgcgctgtgggtttcgctgcctg

SEQ ID NO: 600114 - DNA, 25 bp, Mus musculus
cctgcgcttcacctggagcatgaag

SEQ ID NO: 600115 - DNA, 25 bp, Mus musculus
cctgcgcttcacgtggagcatgaag

SEQ ID NO: 600116 - DNA, 25 bp, Mus musculus
cctgcgcttggaatggttgctctgc

SEQ ID NO: 600117 - DNA, 25 bp, Mus musculus
cctgcgcttggattggttgctctgc

SEQ ID NO: 600118 - DNA, 25 bp, Mus musculus
cctgcggaagaacgtagtggccttc

SEQ ID NO: 600119 - DNA, 25 bp, Mus musculus
cctgcggaagaaggtagtggccttc

SEQ ID NO: 600120 - DNA, 25 bp, Mus musculus
cctgcggacatcaactatgatgaga

SEQ ID NO: 600121 - DNA, 25 bp, Mus musculus
cctgcggacatctactatgatgaga

SEQ ID NO: 600122 - DNA, 25 bp, Mus musculus
cctgcggactttacaaagaacagta

SEQ ID NO: 600123 - DNA, 25 bp, Mus musculus
cctgcggacttttcaaagaacagta

SEQ ID NO: 600124 - DNA, 25 bp, Mus musculus
cctgcggagcggacccaccgaagta

SEQ ID NO: 600125 - DNA, 25 bp, Mus musculus
cctgcggagcggtcccaccgaagta

SEQ ID NO: 600126 - DNA, 25 bp, Mus musculus
cctgcggatgggacaagctggtcaa

SEQ ID NO: 600127 - DNA, 25 bp, Mus musculus
cctgcggatgggtcaagctggtcaa

SEQ ID NO: 600128 - DNA, 25 bp, Mus musculus
cctgcggcagttctctgatgacaag

SEQ ID NO: 600129 - DNA, 25 bp, Mus musculus
cctgcggcagttgtctgatgacaag

SEQ ID NO: 600130 - DNA, 25 bp, Mus musculus
cctgcggccccgagcaggtgataag

SEQ ID NO: 600131 - DNA, 25 bp, Mus musculus
cctgcggccccgtgcaggtgataag

SEQ ID NO: 600132 - DNA, 25 bp, Mus musculus
cctgcggctggaaggtgtagtcact

SEQ ID NO: 600133 - DNA, 25 bp, Mus musculus
cctgcggctggatggtgtagtcact

SEQ ID NO: 600134 - DNA, 25 bp, Mus musculus
cctgcggctgggaggtcctttctct

SEQ ID NO: 600135 - DNA, 25 bp, Mus musculus
cctgcggctgggtggtcctttctct

SEQ ID NO: 600136 - DNA, 25 bp, Mus musculus
cctgcgggaaaaccaagaacgactg

SEQ ID NO: 600137 - DNA, 25 bp, Mus musculus
cctgcgggaaaagcaagaacgactg

SEQ ID NO: 600138 - DNA, 25 bp, Mus musculus
cctgcgggaactactgtgcaaaaca

SEQ ID NO: 600139 - DNA, 25 bp, Mus musculus
cctgcgggaacttctgtgcaaaaca

SEQ ID NO: 600140 - DNA, 25 bp, Mus musculus
cctgcgggacgacgtctccattgac

SEQ ID NO: 600141 - DNA, 25 bp, Mus musculus
cctgcgggacgaggtctccattgac

SEQ ID NO: 600142 - DNA, 25 bp, Mus musculus
cctgcgggcacgactgttcagagaa

SEQ ID NO: 600143 - DNA, 25 bp, Mus musculus
cctgcgggcacgtctgttcagagaa

SEQ ID NO: 600144 - DNA, 25 bp, Mus musculus
cctgcgggcatcaacaacctggatg

SEQ ID NO: 600145 - DNA, 25 bp, Mus musculus
cctgcgggcatctacaacctggatg

SEQ ID NO: 600146 - DNA, 25 bp, Mus musculus
cctgcggtcataatcaagcacatag

SEQ ID NO: 600147 - DNA, 25 bp, Mus musculus
cctgcggtcatattcaagcacatag

SEQ ID NO: 600148 - DNA, 25 bp, Mus musculus
cctgcggtccgaagagctcagactc

SEQ ID NO: 600149 - DNA, 25 bp, Mus musculus
cctgcggtccgatgagctcagactc

SEQ ID NO: 600150 - DNA, 25 bp, Mus musculus
cctgcggtcgttcgcctcattcgag

SEQ ID NO: 600151 - DNA, 25 bp, Mus musculus
cctgcggtcgttggcctcattcgag

SEQ ID NO: 600152 - DNA, 25 bp, Mus musculus
cctgcggtttgcagacatggagtgc

SEQ ID NO: 600153 - DNA, 25 bp, Mus musculus
cctgcggtttgctgacatggagtgc

SEQ ID NO: 600154 - DNA, 25 bp, Mus musculus
cctgcgtaatctcaaactaaaactc

SEQ ID NO: 600155 - DNA, 25 bp, Mus musculus
cctgcgtaatctgaaactaaaactc

SEQ ID NO: 600156 - DNA, 25 bp, Mus musculus
cctgcgtagtgaattgtgaacttgg

SEQ ID NO: 600157 - DNA, 25 bp, Mus musculus
cctgcgtagtgatttgtgaacttgg

SEQ ID NO: 600158 - DNA, 25 bp, Mus musculus
cctgcgtatgtgcatggcaagtgct

SEQ ID NO: 600159 - DNA, 25 bp, Mus musculus
cctgcgtatgtggatggcaagtgct

SEQ ID NO: 600160 - DNA, 25 bp, Mus musculus
cctgcgtgctagagttctgcgtggc

SEQ ID NO: 600161 - DNA, 25 bp, Mus musculus
cctgcgtgctagtgttctgcgtggc

SEQ ID NO: 600162 - DNA, 25 bp, Mus musculus
cctgcgtggagtctgttcctgtgca

SEQ ID NO: 600163 - DNA, 25 bp, Mus musculus
cctgcgtggagtgtgttcctgtgca

SEQ ID NO: 600164 - DNA, 25 bp, Mus musculus
cctgcgtgtgttccacccagctgtg

SEQ ID NO: 600165 - DNA, 25 bp, Mus musculus
cctgcgtgtgttgcacccagctgtg

SEQ ID NO: 600166 - DNA, 25 bp, Mus musculus
cctgcgttacttagacatgggattt

SEQ ID NO: 600167 - DNA, 25 bp, Mus musculus
cctgcgttactttgacatgggattt

SEQ ID NO: 600168 - DNA, 25 bp, Mus musculus
cctgcgttctaacagcagggccttt

SEQ ID NO: 600169 - DNA, 25 bp, Mus musculus
cctgcgttctaagagcagggccttt

SEQ ID NO: 600170 - DNA, 25 bp, Mus musculus
cctgctaagtcacagccttgggctg

SEQ ID NO: 600171 - DNA, 25 bp, Mus musculus
cctgctaagtcagagccttgggctg

SEQ ID NO: 600172 - DNA, 25 bp, Mus musculus
cctgctaccccaatggaagtggcca

SEQ ID NO: 600173 - DNA, 25 bp, Mus musculus
cctgctaccccattggaagtggcca

SEQ ID NO: 600174 - DNA, 25 bp, Mus musculus
cctgctacgtgcagagaccctgtct

SEQ ID NO: 600175 - DNA, 25 bp, Mus musculus
cctgctacgtgctgagaccctgtct

SEQ ID NO: 600176 - DNA, 25 bp, Mus musculus
cctgctactcccatagaactaagac

SEQ ID NO: 600177 - DNA, 25 bp, Mus musculus
cctgctactcccttagaactaagac

SEQ ID NO: 600178 - DNA, 25 bp, Mus musculus
cctgctactgctcgttgctggtgcg

SEQ ID NO: 600179 - DNA, 25 bp, Mus musculus
cctgctactgctggttgctggtgcg

SEQ ID NO: 600180 - DNA, 25 bp, Mus musculus
cctgctagctgtcggcatctttgga

SEQ ID NO: 600181 - DNA, 25 bp, Mus musculus
cctgctagctgtgggcatctttgga

SEQ ID NO: 600182 - DNA, 25 bp, Mus musculus
cctgctaggctgaaacatactatga

SEQ ID NO: 600183 - DNA, 25 bp, Mus musculus
cctgctaggctgtaacatactatga

SEQ ID NO: 600184 - DNA, 25 bp, Mus musculus
cctgctagtctaaagagagtggctt

SEQ ID NO: 600185 - DNA, 25 bp, Mus musculus
cctgctagtctatagagagtggctt

SEQ ID NO: 600186 - DNA, 25 bp, Mus musculus
cctgctagtgcgagttggaattact

SEQ ID NO: 600187 - DNA, 25 bp, Mus musculus
cctgctagtgcgtgttggaattact

SEQ ID NO: 600188 - DNA, 25 bp, Mus musculus
cctgctatgagtattgatgggaaaa

SEQ ID NO: 600189 - DNA, 25 bp, Mus musculus
cctgctatgagttttgatgggaaaa

SEQ ID NO: 600190 - DNA, 25 bp, Mus musculus
cctgctatgtatcgccctcaggtct

SEQ ID NO: 600191 - DNA, 25 bp, Mus musculus
cctgctatgtatggccctcaggtct

SEQ ID NO: 600192 - DNA, 25 bp, Mus musculus
cctgctatgtggcttcaatgagaag

SEQ ID NO: 600193 - DNA, 25 bp, Mus musculus
cctgctatgtgggttcaatgagaag

SEQ ID NO: 600194 - DNA, 25 bp, Mus musculus
cctgctcaaatacgtgagatggtcc

SEQ ID NO: 600195 - DNA, 25 bp, Mus musculus
cctgctcaaataggtgagatggtcc

SEQ ID NO: 600196 - DNA, 25 bp, Mus musculus
cctgctcaagatcagtgtgggcctg

SEQ ID NO: 600197 - DNA, 25 bp, Mus musculus
cctgctcaagatgagtgtgggcctg

SEQ ID NO: 600198 - DNA, 25 bp, Mus musculus
cctgctcaaggaagaggaccatgac

SEQ ID NO: 600199 - DNA, 25 bp, Mus musculus
cctgctcaaggatgaggaccatgac

SEQ ID NO: 600200 - DNA, 25 bp, Mus musculus
cctgctcaagttcgcgagacattcc

SEQ ID NO: 600201 - DNA, 25 bp, Mus musculus
cctgctcaagttggcgagacattcc

SEQ ID NO: 600202 - DNA, 25 bp, Mus musculus
cctgctcacagtatatgacttcgag

SEQ ID NO: 600203 - DNA, 25 bp, Mus musculus
cctgctcacagtttatgacttcgag

SEQ ID NO: 600204 - DNA, 25 bp, Mus musculus
cctgctcacatgagaagtgatagga

SEQ ID NO: 600205 - DNA, 25 bp, Mus musculus
cctgctcacatgtgaagtgatagga

SEQ ID NO: 600206 - DNA, 25 bp, Mus musculus
cctgctcagggcaagaagagtccgc

SEQ ID NO: 600207 - DNA, 25 bp, Mus musculus
cctgctcagggctagaagagtccgc

SEQ ID NO: 600208 - DNA, 25 bp, Mus musculus
cctgctcatcacacctgtgcttgag

SEQ ID NO: 600209 - DNA, 25 bp, Mus musculus
cctgctcatcactcctgtgcttgag

SEQ ID NO: 600210 - DNA, 25 bp, Mus musculus
cctgctcatcccactgaaggacaag

SEQ ID NO: 600211 - DNA, 25 bp, Mus musculus
cctgctcatccctctgaaggacaag

SEQ ID NO: 600212 - DNA, 25 bp, Mus musculus
cctgctcatgggaggcacaaaggag

SEQ ID NO: 600213 - DNA, 25 bp, Mus musculus
cctgctcatgggtggcacaaaggag

SEQ ID NO: 600214 - DNA, 25 bp, Mus musculus
cctgctcattggcaaatcttcattt

SEQ ID NO: 600215 - DNA, 25 bp, Mus musculus
cctgctcattgggaaatcttcattt

SEQ ID NO: 600216 - DNA, 25 bp, Mus musculus
cctgctccagggatgggtcttttta

SEQ ID NO: 600217 - DNA, 25 bp, Mus musculus
cctgctccagggttgggtcttttta

SEQ ID NO: 600218 - DNA, 25 bp, Mus musculus
cctgctcccagcaacaactgtatgt

SEQ ID NO: 600219 - DNA, 25 bp, Mus musculus
cctgctcccagctacaactgtatgt

SEQ ID NO: 600220 - DNA, 25 bp, Mus musculus
cctgctcccattcgcgagtttgaga

SEQ ID NO: 600221 - DNA, 25 bp, Mus musculus
cctgctcccattggcgagtttgaga

SEQ ID NO: 600222 - DNA, 25 bp, Mus musculus
cctgctccgagtctgcttcgtgtct

SEQ ID NO: 600223 - DNA, 25 bp, Mus musculus
cctgctccgagtgtgcttcgtgtct

SEQ ID NO: 600224 - DNA, 25 bp, Mus musculus
cctgctccgcggctattgtcaggag

SEQ ID NO: 600225 - DNA, 25 bp, Mus musculus
cctgctccgcgggtattgtcaggag

SEQ ID NO: 600226 - DNA, 25 bp, Mus musculus
cctgctccgggacgcaagtgctact

SEQ ID NO: 600227 - DNA, 25 bp, Mus musculus
cctgctccgggaggcaagtgctact

SEQ ID NO: 600228 - DNA, 25 bp, Mus musculus
cctgctcctgcaactctgtggacag

SEQ ID NO: 600229 - DNA, 25 bp, Mus musculus
cctgctcctgcaactgtggcaagag

SEQ ID NO: 600230 - DNA, 25 bp, Mus musculus
cctgctcctgcatctctgtggacag

SEQ ID NO: 600231 - DNA, 25 bp, Mus musculus
cctgctcctgcatctgtggcaagag

SEQ ID NO: 600232 - DNA, 25 bp, Mus musculus
cctgctcctggtaaagtgtttgatc

SEQ ID NO: 600233 - DNA, 25 bp, Mus musculus
cctgctcctggttaagtgtttgatc

SEQ ID NO: 600234 - DNA, 25 bp, Mus musculus
cctgctcgagcaagtggctccaaaa

SEQ ID NO: 600235 - DNA, 25 bp, Mus musculus
cctgctcgagcatgtggctccaaaa

SEQ ID NO: 600236 - DNA, 25 bp, Mus musculus
cctgctcgggatcacaaagcctcgt

SEQ ID NO: 600237 - DNA, 25 bp, Mus musculus
cctgctcgggatgacaaagcctcgt

SEQ ID NO: 600238 - DNA, 25 bp, Mus musculus
cctgctctacaacggagatgtggac

SEQ ID NO: 600239 - DNA, 25 bp, Mus musculus
cctgctctacaagggagatgtggac

SEQ ID NO: 600240 - DNA, 25 bp, Mus musculus
cctgctctcaacaacaacatcgtgt

SEQ ID NO: 600241 - DNA, 25 bp, Mus musculus
cctgctctcaactacaacatcgtgt

SEQ ID NO: 600242 - DNA, 25 bp, Mus musculus
cctgctctcgatatggctgggtaac

SEQ ID NO: 600243 - DNA, 25 bp, Mus musculus
cctgctctcgatttggctgggtaac

SEQ ID NO: 600244 - DNA, 25 bp, Mus musculus
cctgctctctgccagaatggccgat

SEQ ID NO: 600245 - DNA, 25 bp, Mus musculus
cctgctctctgcgagaatggccgat

SEQ ID NO: 600246 - DNA, 25 bp, Mus musculus
cctgctctgaaaatggaaggatggg

SEQ ID NO: 600247 - DNA, 25 bp, Mus musculus
cctgctctgaaattggaaggatggg

SEQ ID NO: 600248 - DNA, 25 bp, Mus musculus
cctgctctgatgctggcatttcatg

SEQ ID NO: 600249 - DNA, 25 bp, Mus musculus
cctgctctgatggtggcatttcatg

SEQ ID NO: 600250 - DNA, 25 bp, Mus musculus
cctgctctgcctcataagccgtgtg

SEQ ID NO: 600251 - DNA, 25 bp, Mus musculus
cctgctctgcctgataagccgtgtg

SEQ ID NO: 600252 - DNA, 25 bp, Mus musculus
cctgctctgctgaggtgtggcctta

SEQ ID NO: 600253 - DNA, 25 bp, Mus musculus
cctgctctgctgtggtgtggcctta

SEQ ID NO: 600254 - DNA, 25 bp, Mus musculus
cctgctcttccgcaatagacctgtt

SEQ ID NO: 600255 - DNA, 25 bp, Mus musculus
cctgctcttccggaatagacctgtt

SEQ ID NO: 600256 - DNA, 25 bp, Mus musculus
cctgctcttcgacctgctgacaggg

SEQ ID NO: 600257 - DNA, 25 bp, Mus musculus
cctgctcttcgagctgctgacaggg

SEQ ID NO: 600258 - DNA, 25 bp, Mus musculus
cctgctcttggtattcgtcacagaa

SEQ ID NO: 600259 - DNA, 25 bp, Mus musculus
cctgctcttggtcattgggactggc

SEQ ID NO: 600260 - DNA, 25 bp, Mus musculus
cctgctcttggtgattgggactggc

SEQ ID NO: 600261 - DNA, 25 bp, Mus musculus
cctgctcttggttttcgtcacagaa

SEQ ID NO: 600262 - DNA, 25 bp, Mus musculus
cctgctgaaaacaggcgtaactgta

SEQ ID NO: 600263 - DNA, 25 bp, Mus musculus
cctgctgaaaactggcgtaactgta

SEQ ID NO: 600264 - DNA, 25 bp, Mus musculus
cctgctgaagcgaggccttctggag

SEQ ID NO: 600265 - DNA, 25 bp, Mus musculus
cctgctgaagcgtggccttctggag

SEQ ID NO: 600266 - DNA, 25 bp, Mus musculus
cctgctgaatcaagtggccgatctg

SEQ ID NO: 600267 - DNA, 25 bp, Mus musculus
cctgctgaatcatgtggccgatctg

SEQ ID NO: 600268 - DNA, 25 bp, Mus musculus
cctgctgaatttcaccggtacaatt

SEQ ID NO: 600269 - DNA, 25 bp, Mus musculus
cctgctgaatttgaccggtacaatt

SEQ ID NO: 600270 - DNA, 25 bp, Mus musculus
cctgctgactatctttcagggcaaa

SEQ ID NO: 600271 - DNA, 25 bp, Mus musculus
cctgctgactatgtttcagggcaaa

SEQ ID NO: 600272 - DNA, 25 bp, Mus musculus
cctgctgactcaagaaacggtaaga

SEQ ID NO: 600273 - DNA, 25 bp, Mus musculus
cctgctgactcatgaaacggtaaga

SEQ ID NO: 600274 - DNA, 25 bp, Mus musculus
cctgctgagataacctgctgatcct

SEQ ID NO: 600275 - DNA, 25 bp, Mus musculus
cctgctgagatatcctgctgatcct

SEQ ID NO: 600276 - DNA, 25 bp, Mus musculus
cctgctgagcttctgcactgtgtca

SEQ ID NO: 600277 - DNA, 25 bp, Mus musculus
cctgctgagcttgtgcactgtgtca

SEQ ID NO: 600278 - DNA, 25 bp, Mus musculus
cctgctgagttacatgacctccaag

SEQ ID NO: 600279 - DNA, 25 bp, Mus musculus
cctgctgagttagatgacctccaag

SEQ ID NO: 600280 - DNA, 25 bp, Mus musculus
cctgctgatattcatgcttctgagc

SEQ ID NO: 600281 - DNA, 25 bp, Mus musculus
cctgctgatattgatgcttctgagc

SEQ ID NO: 600282 - DNA, 25 bp, Mus musculus
cctgctgatcctcggagtgggccct

SEQ ID NO: 600283 - DNA, 25 bp, Mus musculus
cctgctgatcctgggagtgggccct

SEQ ID NO: 600284 - DNA, 25 bp, Mus musculus
cctgctgcagttaagctggaagact

SEQ ID NO: 600285 - DNA, 25 bp, Mus musculus
cctgctgcagtttagctggaagact

SEQ ID NO: 600286 - DNA, 25 bp, Mus musculus
cctgctgcatctcagcctgtgatac

SEQ ID NO: 600287 - DNA, 25 bp, Mus musculus
cctgctgcatctgagcctgtgatac

SEQ ID NO: 600288 - DNA, 25 bp, Mus musculus
cctgctgcgtgtcgaacatgggccc

SEQ ID NO: 600289 - DNA, 25 bp, Mus musculus
cctgctgcgtgtggaacatgggccc

SEQ ID NO: 600290 - DNA, 25 bp, Mus musculus
cctgctgctaggctgtaaggatctc

SEQ ID NO: 600291 - DNA, 25 bp, Mus musculus
cctgctgctagggtgtaaggatctc

SEQ ID NO: 600292 - DNA, 25 bp, Mus musculus
cctgctgctgacagtgaattctgag

SEQ ID NO: 600293 - DNA, 25 bp, Mus musculus
cctgctgctgactgtgaattctgag

SEQ ID NO: 600294 - DNA, 25 bp, Mus musculus
cctgctgctggtccttttgggagtc

SEQ ID NO: 600295 - DNA, 25 bp, Mus musculus
cctgctgctggtctataagcagaga

SEQ ID NO: 600296 - DNA, 25 bp, Mus musculus
cctgctgctggtgcttttgggagtc

SEQ ID NO: 600297 - DNA, 25 bp, Mus musculus
cctgctgctggtgtataagcagaga

SEQ ID NO: 600298 - DNA, 25 bp, Mus musculus
cctgctggaagccaccattgctgtg

SEQ ID NO: 600299 - DNA, 25 bp, Mus musculus
cctgctggaagcgaccattgctgtg

SEQ ID NO: 600300 - DNA, 25 bp, Mus musculus
cctgctggacctcaacgagatgtag

SEQ ID NO: 600301 - DNA, 25 bp, Mus musculus
cctgctggacctgaacgagatgtag

SEQ ID NO: 600302 - DNA, 25 bp, Mus musculus
cctgctggacgaccagtgggtgctc

SEQ ID NO: 600303 - DNA, 25 bp, Mus musculus
cctgctggacgagcagtgggtgctc

SEQ ID NO: 600304 - DNA, 25 bp, Mus musculus
cctgctggagctactgctccaagaa

SEQ ID NO: 600305 - DNA, 25 bp, Mus musculus
cctgctggagcttctgctccaagaa

SEQ ID NO: 600306 - DNA, 25 bp, Mus musculus
cctgctggctcgcaggtccaaggct

SEQ ID NO: 600307 - DNA, 25 bp, Mus musculus
cctgctggctcggaggtccaaggct

SEQ ID NO: 600308 - DNA, 25 bp, Mus musculus
cctgctggctgcacagtgttctgtg

SEQ ID NO: 600309 - DNA, 25 bp, Mus musculus
cctgctggctgctcagtgttctgtg

SEQ ID NO: 600310 - DNA, 25 bp, Mus musculus
cctgctgggcgcagacaccaagcag

SEQ ID NO: 600311 - DNA, 25 bp, Mus musculus
cctgctgggcgctgacaccaagcag

SEQ ID NO: 600312 - DNA, 25 bp, Mus musculus
cctgctgggcttacgatctgcagga

SEQ ID NO: 600313 - DNA, 25 bp, Mus musculus
cctgctgggctttcgatctgcagga

SEQ ID NO: 600314 - DNA, 25 bp, Mus musculus
cctgctggtcctcatgttcatgacc

SEQ ID NO: 600315 - DNA, 25 bp, Mus musculus
cctgctggtcctgatgttcatgacc

SEQ ID NO: 600316 - DNA, 25 bp, Mus musculus
cctgctggtggaatcctgggtcaga

SEQ ID NO: 600317 - DNA, 25 bp, Mus musculus
cctgctggtggattcctgggtcaga

SEQ ID NO: 600318 - DNA, 25 bp, Mus musculus
cctgctggtggtcaagtatgcctta

SEQ ID NO: 600319 - DNA, 25 bp, Mus musculus
cctgctggtggtgaagtatgcctta

SEQ ID NO: 600320 - DNA, 25 bp, Mus musculus
cctgctgtaacacggtggtgctgcc

SEQ ID NO: 600321 - DNA, 25 bp, Mus musculus
cctgctgtaacagggtggtgctgcc

SEQ ID NO: 600322 - DNA, 25 bp, Mus musculus
cctgctgtaactcggatgctaagaa

SEQ ID NO: 600323 - DNA, 25 bp, Mus musculus
cctgctgtaactgggatgctaagaa

SEQ ID NO: 600324 - DNA, 25 bp, Mus musculus
cctgctgtcactagagtatgatttt

SEQ ID NO: 600325 - DNA, 25 bp, Mus musculus
cctgctgtcacttgagtatgatttt

SEQ ID NO: 600326 - DNA, 25 bp, Mus musculus
cctgctgtccagagctcgggagagc

SEQ ID NO: 600327 - DNA, 25 bp, Mus musculus
cctgctgtccagtgctcgggagagc

SEQ ID NO: 600328 - DNA, 25 bp, Mus musculus
cctgctgtgactctcgcctgggcga

SEQ ID NO: 600329 - DNA, 25 bp, Mus musculus
cctgctgtgactgtcgcctgggcga

SEQ ID NO: 600330 - DNA, 25 bp, Mus musculus
cctgctgtgcttagctggctggatc

SEQ ID NO: 600331 - DNA, 25 bp, Mus musculus
cctgctgtgctttgctggctggatc

SEQ ID NO: 600332 - DNA, 25 bp, Mus musculus
cctgctgtggaaattggacaaatcc

SEQ ID NO: 600333 - DNA, 25 bp, Mus musculus
cctgctgtggaatttggacaaatcc

SEQ ID NO: 600334 - DNA, 25 bp, Mus musculus
cctgctgtggagctgcctcagtacg

SEQ ID NO: 600335 - DNA, 25 bp, Mus musculus
cctgctgtggaggtgcctcagtacg

SEQ ID NO: 600336 - DNA, 25 bp, Mus musculus
cctgctgtttcgcaggcagaagctg

SEQ ID NO: 600337 - DNA, 25 bp, Mus musculus
cctgctgtttcggaggcagaagctg

SEQ ID NO: 600338 - DNA, 25 bp, Mus musculus
cctgctgtttggagagaacaataac

SEQ ID NO: 600339 - DNA, 25 bp, Mus musculus
cctgctgtttggtgagaacaataac

SEQ ID NO: 600340 - DNA, 25 bp, Mus musculus
cctgcttactatcacggaagattaa

SEQ ID NO: 600341 - DNA, 25 bp, Mus musculus
cctgcttactatgacggaagattaa

SEQ ID NO: 600342 - DNA, 25 bp, Mus musculus
cctgcttacttacacatcttggaca

SEQ ID NO: 600343 - DNA, 25 bp, Mus musculus
cctgcttacttagacatcttggaca

SEQ ID NO: 600344 - DNA, 25 bp, Mus musculus
cctgcttagtacagattgcctcagt

SEQ ID NO: 600345 - DNA, 25 bp, Mus musculus
cctgcttagtactgattgcctcagt

SEQ ID NO: 600346 - DNA, 25 bp, Mus musculus
cctgcttatcaccataatgggcatc

SEQ ID NO: 600347 - DNA, 25 bp, Mus musculus
cctgcttatcacgataatgggcatc

SEQ ID NO: 600348 - DNA, 25 bp, Mus musculus
cctgcttcaatgacctatgatgaca

SEQ ID NO: 600349 - DNA, 25 bp, Mus musculus
cctgcttcaatgtcctatgatgaca

SEQ ID NO: 600350 - DNA, 25 bp, Mus musculus
cctgcttcaggtagacacggcgctg

SEQ ID NO: 600351 - DNA, 25 bp, Mus musculus
cctgcttcaggtatagggttatcta

SEQ ID NO: 600352 - DNA, 25 bp, Mus musculus
cctgcttcaggttgacacggcgctg

SEQ ID NO: 600353 - DNA, 25 bp, Mus musculus
cctgcttcaggtttagggttatcta

SEQ ID NO: 600354 - DNA, 25 bp, Mus musculus
cctgcttcctgaattcaatgcacta

SEQ ID NO: 600355 - DNA, 25 bp, Mus musculus
cctgcttcctgatttcaatgcacta

SEQ ID NO: 600356 - DNA, 25 bp, Mus musculus
cctgcttcgagaatggctgccactc

SEQ ID NO: 600357 - DNA, 25 bp, Mus musculus
cctgcttcgagattggctgccactc

SEQ ID NO: 600358 - DNA, 25 bp, Mus musculus
cctgcttcggagacagccatggcag

SEQ ID NO: 600359 - DNA, 25 bp, Mus musculus
cctgcttcggagtcagccatggcag

SEQ ID NO: 600360 - DNA, 25 bp, Mus musculus
cctgcttctcaaaagtgtccttctg

SEQ ID NO: 600361 - DNA, 25 bp, Mus musculus
cctgcttctcaatagtgtccttctg

SEQ ID NO: 600362 - DNA, 25 bp, Mus musculus
cctgcttctgaaacaaatgtcagaa

SEQ ID NO: 600363 - DNA, 25 bp, Mus musculus
cctgcttctgaatcaaatgtcagaa

SEQ ID NO: 600364 - DNA, 25 bp, Mus musculus
cctgcttctgctattcgtggcagca

SEQ ID NO: 600365 - DNA, 25 bp, Mus musculus
cctgcttctgcttttcgtggcagca

SEQ ID NO: 600366 - DNA, 25 bp, Mus musculus
cctgcttgaagtatgagtgggaacc

SEQ ID NO: 600367 - DNA, 25 bp, Mus musculus
cctgcttgaagtttgagtgggaacc

SEQ ID NO: 600368 - DNA, 25 bp, Mus musculus
cctgcttgattgcttcagcgtgcca

SEQ ID NO: 600369 - DNA, 25 bp, Mus musculus
cctgcttgattggttcagcgtgcca

SEQ ID NO: 600370 - DNA, 25 bp, Mus musculus
cctgcttgcctacatatcccaggtg

SEQ ID NO: 600371 - DNA, 25 bp, Mus musculus
cctgcttgcctagatatcccaggtg

SEQ ID NO: 600372 - DNA, 25 bp, Mus musculus
cctgcttggaatcctatgataaaag

SEQ ID NO: 600373 - DNA, 25 bp, Mus musculus
cctgcttggaatgctatgataaaag

SEQ ID NO: 600374 - DNA, 25 bp, Mus musculus
cctgcttggctactagagaaacaat

SEQ ID NO: 600375 - DNA, 25 bp, Mus musculus
cctgcttggctagtagagaaacaat

SEQ ID NO: 600376 - DNA, 25 bp, Mus musculus
cctgcttgggtgcattcagcctttg

SEQ ID NO: 600377 - DNA, 25 bp, Mus musculus
cctgcttgggtggattcagcctttg

SEQ ID NO: 600378 - DNA, 25 bp, Mus musculus
cctgcttggtcacaggtggccccgt

SEQ ID NO: 600379 - DNA, 25 bp, Mus musculus
cctgcttggtcagaggtggccccgt

SEQ ID NO: 600380 - DNA, 25 bp, Mus musculus
cctgcttgtagtcggcactgcttct

SEQ ID NO: 600381 - DNA, 25 bp, Mus musculus
cctgcttgtagtgggcactgcttct

SEQ ID NO: 600382 - DNA, 25 bp, Mus musculus
cctgctttactacgtcaagtctctc

SEQ ID NO: 600383 - DNA, 25 bp, Mus musculus
cctgctttactaggtcaagtctctc

SEQ ID NO: 600384 - DNA, 25 bp, Mus musculus
cctgctttcagcctgatggatatga

SEQ ID NO: 600385 - DNA, 25 bp, Mus musculus
cctgctttcagcgtgatggatatga

SEQ ID NO: 600386 - DNA, 25 bp, Mus musculus
cctgctttcatcaagcctgtggtct

SEQ ID NO: 600387 - DNA, 25 bp, Mus musculus
cctgctttcatctagcctgtggtct

SEQ ID NO: 600388 - DNA, 25 bp, Mus musculus
cctgctttgcgtccgatgggaaact

SEQ ID NO: 600389 - DNA, 25 bp, Mus musculus
cctgctttgcgtgcgatgggaaact

SEQ ID NO: 600390 - DNA, 25 bp, Mus musculus
cctgctttgctaaccagaaaggatt

SEQ ID NO: 600391 - DNA, 25 bp, Mus musculus
cctgctttgctatccagaaaggatt

SEQ ID NO: 600392 - DNA, 25 bp, Mus musculus
cctgctttggttctgaaggccagtg

SEQ ID NO: 600393 - DNA, 25 bp, Mus musculus
cctgctttggttgtgaaggccagtg

SEQ ID NO: 600394 - DNA, 25 bp, Mus musculus
cctgcttttagcaaccatgaaattg

SEQ ID NO: 600395 - DNA, 25 bp, Mus musculus
cctgcttttagctaccatgaaattg

SEQ ID NO: 600396 - DNA, 25 bp, Mus musculus
cctgcttttgccagtacactggctt

SEQ ID NO: 600397 - DNA, 25 bp, Mus musculus
cctgcttttgcctgtacactggctt

SEQ ID NO: 600398 - DNA, 25 bp, Mus musculus
cctgctttttgccaagggcttccct

SEQ ID NO: 600399 - DNA, 25 bp, Mus musculus
cctgctttttgcctaaggcacccag

SEQ ID NO: 600400 - DNA, 25 bp, Mus musculus
cctgctttttgcgaagggcttccct

SEQ ID NO: 600401 - DNA, 25 bp, Mus musculus
cctgctttttgcgtaaggcacccag

SEQ ID NO: 600402 - DNA, 25 bp, Mus musculus
cctggaaaaaatcacggatctcgta

SEQ ID NO: 600403 - DNA, 25 bp, Mus musculus
cctggaaaaaatgacggatctcgta

SEQ ID NO: 600404 - DNA, 25 bp, Mus musculus
cctggaaaacataatgtagttcaga

SEQ ID NO: 600405 - DNA, 25 bp, Mus musculus
cctggaaaacattatgtagttcaga

SEQ ID NO: 600406 - DNA, 25 bp, Mus musculus
cctggaaacgagagaggaaatgact

SEQ ID NO: 600407 - DNA, 25 bp, Mus musculus
cctggaaacgagtgaggaaatgact

SEQ ID NO: 600408 - DNA, 25 bp, Mus musculus
cctggaaacttgcactactggacat

SEQ ID NO: 600409 - DNA, 25 bp, Mus musculus
cctggaaacttggactactggacat

SEQ ID NO: 600410 - DNA, 25 bp, Mus musculus
cctggaaagaaaacatctaatagcc

SEQ ID NO: 600411 - DNA, 25 bp, Mus musculus
cctggaaagaaatcatctaatagcc

SEQ ID NO: 600412 - DNA, 25 bp, Mus musculus
cctggaaagagtataagtcagatac

SEQ ID NO: 600413 - DNA, 25 bp, Mus musculus
cctggaaagagtttaagtcagatac

SEQ ID NO: 600414 - DNA, 25 bp, Mus musculus
cctggaaaggatcctggtgctggat

SEQ ID NO: 600415 - DNA, 25 bp, Mus musculus
cctggaaaggatgctggtgctggat

SEQ ID NO: 600416 - DNA, 25 bp, Mus musculus
cctggaaagggcagaaattcagggc

SEQ ID NO: 600417 - DNA, 25 bp, Mus musculus
cctggaaagggctgaaattcagggc

SEQ ID NO: 600418 - DNA, 25 bp, Mus musculus
cctggaaatctacaatgagaacctg

SEQ ID NO: 600419 - DNA, 25 bp, Mus musculus
cctggaaatctagaatgagaacctg

SEQ ID NO: 600420 - DNA, 25 bp, Mus musculus
cctggaaatgagacacaacttacgt

SEQ ID NO: 600421 - DNA, 25 bp, Mus musculus
cctggaaatgagtcacaacttacgt

SEQ ID NO: 600422 - DNA, 25 bp, Mus musculus
cctggaaatgctaagcagaccctct

SEQ ID NO: 600423 - DNA, 25 bp, Mus musculus
cctggaaatgcttagcagaccctct

SEQ ID NO: 600424 - DNA, 25 bp, Mus musculus
cctggaaatgtaacttattctgaga

SEQ ID NO: 600425 - DNA, 25 bp, Mus musculus
cctggaaatgtaagggatcaactat

SEQ ID NO: 600426 - DNA, 25 bp, Mus musculus
cctggaaatgtatcttattctgaga

SEQ ID NO: 600427 - DNA, 25 bp, Mus musculus
cctggaaatgtatgggatcaactat

SEQ ID NO: 600428 - DNA, 25 bp, Mus musculus
cctggaaatgttaggtccagaagga

SEQ ID NO: 600429 - DNA, 25 bp, Mus musculus
cctggaaatgtttggtccagaagga

SEQ ID NO: 600430 - DNA, 25 bp, Mus musculus
cctggaacagagaggtccaattaga

SEQ ID NO: 600431 - DNA, 25 bp, Mus musculus
cctggaacagagtggtccaattaga

SEQ ID NO: 600432 - DNA, 25 bp, Mus musculus
cctggaacccaaagaaaccttgatt

SEQ ID NO: 600433 - DNA, 25 bp, Mus musculus
cctggaacccaatgaaaccttgatt

SEQ ID NO: 600434 - DNA, 25 bp, Mus musculus
cctggaaccggaactctatttttct

SEQ ID NO: 600435 - DNA, 25 bp, Mus musculus
cctggaaccggaagtgaaggcagct

SEQ ID NO: 600436 - DNA, 25 bp, Mus musculus
cctggaaccggatctctatttttct

SEQ ID NO: 600437 - DNA, 25 bp, Mus musculus
cctggaaccggatgtgaaggcagct

SEQ ID NO: 600438 - DNA, 25 bp, Mus musculus
cctggaacctcaagggaaggtgtga

SEQ ID NO: 600439 - DNA, 25 bp, Mus musculus
cctggaacctcatgggaaggtgtga

SEQ ID NO: 600440 - DNA, 25 bp, Mus musculus
cctggaaccttgacccttgaggcta

SEQ ID NO: 600441 - DNA, 25 bp, Mus musculus
cctggaaccttgtcccttgaggcta

SEQ ID NO: 600442 - DNA, 25 bp, Mus musculus
cctggaactaagagaagcatctagt

SEQ ID NO: 600443 - DNA, 25 bp, Mus musculus
cctggaactaagaggacgcaagccc

SEQ ID NO: 600444 - DNA, 25 bp, Mus musculus
cctggaactaagtgaagcatctagt

SEQ ID NO: 600445 - DNA, 25 bp, Mus musculus
cctggaactaagtggacgcaagccc

SEQ ID NO: 600446 - DNA, 25 bp, Mus musculus
cctggaactcaaagcctcaaatgac

SEQ ID NO: 600447 - DNA, 25 bp, Mus musculus
cctggaactcaatgcctcaaatgac

SEQ ID NO: 600448 - DNA, 25 bp, Mus musculus
cctggaactgacactggctgaagca

SEQ ID NO: 600449 - DNA, 25 bp, Mus musculus
cctggaactgactctggctgaagca

SEQ ID NO: 600450 - DNA, 25 bp, Mus musculus
cctggaagaacaaggagtggagacc

SEQ ID NO: 600451 - DNA, 25 bp, Mus musculus
cctggaagaacatggagtggagacc

SEQ ID NO: 600452 - DNA, 25 bp, Mus musculus
cctggaagaaccagctgagtgagat

SEQ ID NO: 600453 - DNA, 25 bp, Mus musculus
cctggaagaacctgctgagtgagat

SEQ ID NO: 600454 - DNA, 25 bp, Mus musculus
cctggaagagaacatcttgctgctg

SEQ ID NO: 600455 - DNA, 25 bp, Mus musculus
cctggaagagaagatcttgctgctg

SEQ ID NO: 600456 - DNA, 25 bp, Mus musculus
cctggaagatgacacaacaccagag

SEQ ID NO: 600457 - DNA, 25 bp, Mus musculus
cctggaagatgagacaacaccagag

SEQ ID NO: 600458 - DNA, 25 bp, Mus musculus
cctggaagatgtaaggcatgcactg

SEQ ID NO: 600459 - DNA, 25 bp, Mus musculus
cctggaagatgttaggcatgcactg

SEQ ID NO: 600460 - DNA, 25 bp, Mus musculus
cctggaagcattacggtcgtaggga

SEQ ID NO: 600461 - DNA, 25 bp, Mus musculus
cctggaagcatttcggtcgtaggga

SEQ ID NO: 600462 - DNA, 25 bp, Mus musculus
cctggaagccctcgagaacaagact

SEQ ID NO: 600463 - DNA, 25 bp, Mus musculus
cctggaagccctggagaacaagact

SEQ ID NO: 600464 - DNA, 25 bp, Mus musculus
cctggaagctatagtttgcataaaa

SEQ ID NO: 600465 - DNA, 25 bp, Mus musculus
cctggaagctattgtttgcataaaa

SEQ ID NO: 600466 - DNA, 25 bp, Mus musculus
cctggaagctggagtcacaatcact

SEQ ID NO: 600467 - DNA, 25 bp, Mus musculus
cctggaagctggtgtcacaatcact

SEQ ID NO: 600468 - DNA, 25 bp, Mus musculus
cctggaaggagaactggaagagtat

SEQ ID NO: 600469 - DNA, 25 bp, Mus musculus
cctggaaggagatctggaagagtat

SEQ ID NO: 600470 - DNA, 25 bp, Mus musculus
cctggaaggcctcgatcttcagcca

SEQ ID NO: 600471 - DNA, 25 bp, Mus musculus
cctggaaggcctggatcttcagcca

SEQ ID NO: 600472 - DNA, 25 bp, Mus musculus
cctggaagggctcaggtataacaga

SEQ ID NO: 600473 - DNA, 25 bp, Mus musculus
cctggaagggctgaggtataacaga

SEQ ID NO: 600474 - DNA, 25 bp, Mus musculus
cctggaagtacccaggcaaaaggcg

SEQ ID NO: 600475 - DNA, 25 bp, Mus musculus
cctggaagtaccgaggcaaaaggcg

SEQ ID NO: 600476 - DNA, 25 bp, Mus musculus
cctggaagtagcattgtaaagcccc

SEQ ID NO: 600477 - DNA, 25 bp, Mus musculus
cctggaagtagctttgtaaagcccc

SEQ ID NO: 600478 - DNA, 25 bp, Mus musculus
cctggaagtcttagggccctgaaca

SEQ ID NO: 600479 - DNA, 25 bp, Mus musculus
cctggaagtctttgggccctgaaca

SEQ ID NO: 600480 - DNA, 25 bp, Mus musculus
cctggaagtgcgagttcgagaagtt

SEQ ID NO: 600481 - DNA, 25 bp, Mus musculus
cctggaagtgcgtgttcgagaagtt

SEQ ID NO: 600482 - DNA, 25 bp, Mus musculus
cctggaagtgtcacgaattgtgggc

SEQ ID NO: 600483 - DNA, 25 bp, Mus musculus
cctggaagtgtctcgaattgtgggc

SEQ ID NO: 600484 - DNA, 25 bp, Mus musculus
cctggaagttcgaaaccctggcctg

SEQ ID NO: 600485 - DNA, 25 bp, Mus musculus
cctggaagttcgtaaccctggcctg

SEQ ID NO: 600486 - DNA, 25 bp, Mus musculus
cctggaagttgccaagcagaactga

SEQ ID NO: 600487 - DNA, 25 bp, Mus musculus
cctggaagttgcgaagcagaactga

SEQ ID NO: 600488 - DNA, 25 bp, Mus musculus
cctggaagttggacagctatcccag

SEQ ID NO: 600489 - DNA, 25 bp, Mus musculus
cctggaagttggtcagctatcccag

SEQ ID NO: 600490 - DNA, 25 bp, Mus musculus
cctggaagttttagcctagctgtgc

SEQ ID NO: 600491 - DNA, 25 bp, Mus musculus
cctggaagtttttgcctagctgtgc

SEQ ID NO: 600492 - DNA, 25 bp, Mus musculus
cctggaatcaagatataatgaagaa

SEQ ID NO: 600493 - DNA, 25 bp, Mus musculus
cctggaatcaagttataatgaagaa

SEQ ID NO: 600494 - DNA, 25 bp, Mus musculus
cctggaatccctcctgtggtgtacc

SEQ ID NO: 600495 - DNA, 25 bp, Mus musculus
cctggaatccctgctgtggtgtacc

SEQ ID NO: 600496 - DNA, 25 bp, Mus musculus
cctggaatcgtaattgttgcagcca

SEQ ID NO: 600497 - DNA, 25 bp, Mus musculus
cctggaatcgtatttgttgcagcca

SEQ ID NO: 600498 - DNA, 25 bp, Mus musculus
cctggaatgatgaggctttactctg

SEQ ID NO: 600499 - DNA, 25 bp, Mus musculus
cctggaatgatgtggctttactctg

SEQ ID NO: 600500 - DNA, 25 bp, Mus musculus
cctggaatggacagatcatcacccg

SEQ ID NO: 600501 - DNA, 25 bp, Mus musculus
cctggaatggacatgtgtgctatgc

SEQ ID NO: 600502 - DNA, 25 bp, Mus musculus
cctggaatggactgatcatcacccg

SEQ ID NO: 600503 - DNA, 25 bp, Mus musculus
cctggaatggacttgtgtgctatgc

SEQ ID NO: 600504 - DNA, 25 bp, Mus musculus
cctggaatgtcaagacccactacct

SEQ ID NO: 600505 - DNA, 25 bp, Mus musculus
cctggaatgtcatgacccactacct

SEQ ID NO: 600506 - DNA, 25 bp, Mus musculus
cctggaatgtctacattatctgctt

SEQ ID NO: 600507 - DNA, 25 bp, Mus musculus
cctggaatgtcttcattatctgctt

SEQ ID NO: 600508 - DNA, 25 bp, Mus musculus
cctggaattcaactaaggcatgtct

SEQ ID NO: 600509 - DNA, 25 bp, Mus musculus
cctggaattcaagtaaggcatgtct

SEQ ID NO: 600510 - DNA, 25 bp, Mus musculus
cctggaattcctcttgtggtggctc

SEQ ID NO: 600511 - DNA, 25 bp, Mus musculus
cctggaattcctgttgtggtggctc

SEQ ID NO: 600512 - DNA, 25 bp, Mus musculus
cctggaattctaatctgagtgggca

SEQ ID NO: 600513 - DNA, 25 bp, Mus musculus
cctggaattctattctgagtgggca

SEQ ID NO: 600514 - DNA, 25 bp, Mus musculus
cctggaattgaaccacagaggactg

SEQ ID NO: 600515 - DNA, 25 bp, Mus musculus
cctggaattgaagcacagaggactg

SEQ ID NO: 600516 - DNA, 25 bp, Mus musculus
cctggaattgagctgctttggacag

SEQ ID NO: 600517 - DNA, 25 bp, Mus musculus
cctggaattgaggtgctttggacag

SEQ ID NO: 600518 - DNA, 25 bp, Mus musculus
cctggaatttcacctgaagcagcct

SEQ ID NO: 600519 - DNA, 25 bp, Mus musculus
cctggaatttcagctgaagcagcct

SEQ ID NO: 600520 - DNA, 25 bp, Mus musculus
cctggaatttgaagacctagatggg

SEQ ID NO: 600521 - DNA, 25 bp, Mus musculus
cctggaatttgatgacctagatggg

SEQ ID NO: 600522 - DNA, 25 bp, Mus musculus
cctggaatttgcatcgggctttgcc

SEQ ID NO: 600523 - DNA, 25 bp, Mus musculus
cctggaatttgcttcgggctttgcc

SEQ ID NO: 600524 - DNA, 25 bp, Mus musculus
cctggacaacggcaagccttatgtc

SEQ ID NO: 600525 - DNA, 25 bp, Mus musculus
cctggacaacgggaagccttatgtc

SEQ ID NO: 600526 - DNA, 25 bp, Mus musculus
cctggacaacgtcagcgcgcgcgtt

SEQ ID NO: 600527 - DNA, 25 bp, Mus musculus
cctggacaacgtgagcgcgcgcgtt

SEQ ID NO: 600528 - DNA, 25 bp, Mus musculus
cctggacaagtcagtcattgagctc

SEQ ID NO: 600529 - DNA, 25 bp, Mus musculus
cctggacaagtcctatgtgaactat

SEQ ID NO: 600530 - DNA, 25 bp, Mus musculus
cctggacaagtcgtatgtgaactat

SEQ ID NO: 600531 - DNA, 25 bp, Mus musculus
cctggacaagtctgtcattgagctc

SEQ ID NO: 600532 - DNA, 25 bp, Mus musculus
cctggacaatacacagcagttgaag

SEQ ID NO: 600533 - DNA, 25 bp, Mus musculus
cctggacaatactcagcagttgaag

SEQ ID NO: 600534 - DNA, 25 bp, Mus musculus
cctggacactgcaacctggaaaggc

SEQ ID NO: 600535 - DNA, 25 bp, Mus musculus
cctggacactgctacctggaaaggc

SEQ ID NO: 600536 - DNA, 25 bp, Mus musculus
cctggacagagaatgctcggccttc

SEQ ID NO: 600537 - DNA, 25 bp, Mus musculus
cctggacagagattgctcggccttc

SEQ ID NO: 600538 - DNA, 25 bp, Mus musculus
cctggacagattacttcgacccaat

SEQ ID NO: 600539 - DNA, 25 bp, Mus musculus
cctggacagatttcttcgacccaat

SEQ ID NO: 600540 - DNA, 25 bp, Mus musculus
cctggacagcagcagtctcggcttg

SEQ ID NO: 600541 - DNA, 25 bp, Mus musculus
cctggacagcaggagtctcggcttg

SEQ ID NO: 600542 - DNA, 25 bp, Mus musculus
cctggacagcgcacgcagaagagct

SEQ ID NO: 600543 - DNA, 25 bp, Mus musculus
cctggacagcgctcgcagaagagct

SEQ ID NO: 600544 - DNA, 25 bp, Mus musculus
cctggacagggactgtcctgtcacc

SEQ ID NO: 600545 - DNA, 25 bp, Mus musculus
cctggacagggagtgtcctgtcacc

SEQ ID NO: 600546 - DNA, 25 bp, Mus musculus
cctggacaggtaccacttgtcttct

SEQ ID NO: 600547 - DNA, 25 bp, Mus musculus
cctggacaggtagcacttgtcttct

SEQ ID NO: 600548 - DNA, 25 bp, Mus musculus
cctggacatcagacagtttttatga

SEQ ID NO: 600549 - DNA, 25 bp, Mus musculus
cctggacatcagtcagtttttatga

SEQ ID NO: 600550 - DNA, 25 bp, Mus musculus
cctggacatctactctgccgtggat

SEQ ID NO: 600551 - DNA, 25 bp, Mus musculus
cctggacatctagtctgccgtggat

SEQ ID NO: 600552 - DNA, 25 bp, Mus musculus
cctggacatgctctgtagacccttg

SEQ ID NO: 600553 - DNA, 25 bp, Mus musculus
cctggacatgctgtgtagacccttg

SEQ ID NO: 600554 - DNA, 25 bp, Mus musculus
cctggacatggaagatgggacctta

SEQ ID NO: 600555 - DNA, 25 bp, Mus musculus
cctggacatggatgatgggacctta

SEQ ID NO: 600556 - DNA, 25 bp, Mus musculus
cctggaccacatagtggaacgcaag

SEQ ID NO: 600557 - DNA, 25 bp, Mus musculus
cctggaccacattgtggaacgcaag

SEQ ID NO: 600558 - DNA, 25 bp, Mus musculus
cctggaccaccacatcattgagaat

SEQ ID NO: 600559 - DNA, 25 bp, Mus musculus
cctggaccaccagatcattgagaat

SEQ ID NO: 600560 - DNA, 25 bp, Mus musculus
cctggacccctgaggactggaagga

SEQ ID NO: 600561 - DNA, 25 bp, Mus musculus
cctggacccctgtggactggaagga

SEQ ID NO: 600562 - DNA, 25 bp, Mus musculus
cctggaccctggaatgaccctcacc

SEQ ID NO: 600563 - DNA, 25 bp, Mus musculus
cctggaccctggtatgaccctcacc

SEQ ID NO: 600564 - DNA, 25 bp, Mus musculus
cctggaccgccactcaggacagtgt

SEQ ID NO: 600565 - DNA, 25 bp, Mus musculus
cctggaccgccagtcaggacagtgt

SEQ ID NO: 600566 - DNA, 25 bp, Mus musculus
cctggacctgctcgcaatgttgctg

SEQ ID NO: 600567 - DNA, 25 bp, Mus musculus
cctggacctgctggcaatgttgctg

SEQ ID NO: 600568 - DNA, 25 bp, Mus musculus
cctggacctggaagtgccgtacttt

SEQ ID NO: 600569 - DNA, 25 bp, Mus musculus
cctggacctggatgtgccgtacttt

SEQ ID NO: 600570 - DNA, 25 bp, Mus musculus
cctggacgcagtatgattggttaaa

SEQ ID NO: 600571 - DNA, 25 bp, Mus musculus
cctggacgcagtttgattggttaaa

SEQ ID NO: 600572 - DNA, 25 bp, Mus musculus
cctggacgccttagtttttagccat

SEQ ID NO: 600573 - DNA, 25 bp, Mus musculus
cctggacgcctttgtttttagccat

SEQ ID NO: 600574 - DNA, 25 bp, Mus musculus
cctggacgggtaacctcagagctgt

SEQ ID NO: 600575 - DNA, 25 bp, Mus musculus
cctggacgggtatcctcagagctgt

SEQ ID NO: 600576 - DNA, 25 bp, Mus musculus
cctggactacatcgcggtggaatac

SEQ ID NO: 600577 - DNA, 25 bp, Mus musculus
cctggactacatcggaccatgcaaa

SEQ ID NO: 600578 - DNA, 25 bp, Mus musculus
cctggactacatggcggtggaatac

SEQ ID NO: 600579 - DNA, 25 bp, Mus musculus
cctggactacatgggaccatgcaaa

SEQ ID NO: 600580 - DNA, 25 bp, Mus musculus
cctggactatttcgccattggtgtc

SEQ ID NO: 600581 - DNA, 25 bp, Mus musculus
cctggactatttggccattggtgtc

SEQ ID NO: 600582 - DNA, 25 bp, Mus musculus
cctggactcggacaagtgaccgtca

SEQ ID NO: 600583 - DNA, 25 bp, Mus musculus
cctggactcggaccagtgtgtaaag

SEQ ID NO: 600584 - DNA, 25 bp, Mus musculus
cctggactcggagaagtgaccgtca

SEQ ID NO: 600585 - DNA, 25 bp, Mus musculus
cctggactcggagcagtgtgtaaag

SEQ ID NO: 600586 - DNA, 25 bp, Mus musculus
cctggactgcatatttggaaaaagg

SEQ ID NO: 600587 - DNA, 25 bp, Mus musculus
cctggactgcatttttggaaaaagg

SEQ ID NO: 600588 - DNA, 25 bp, Mus musculus
cctggactgtggcttatgaaatcaa

SEQ ID NO: 600589 - DNA, 25 bp, Mus musculus
cctggactgtgggttatgaaatcaa

SEQ ID NO: 600590 - DNA, 25 bp, Mus musculus
cctggacttcaaccgcaacttacag

SEQ ID NO: 600591 - DNA, 25 bp, Mus musculus
cctggacttcaagcgcaacttacag

SEQ ID NO: 600592 - DNA, 25 bp, Mus musculus
cctggacttcatcgccagcaaggga

SEQ ID NO: 600593 - DNA, 25 bp, Mus musculus
cctggacttcatggccagcaaggga

SEQ ID NO: 600594 - DNA, 25 bp, Mus musculus
cctggacttcgtcggcaagttcttg

SEQ ID NO: 600595 - DNA, 25 bp, Mus musculus
cctggacttcgtgggcaagttcttg

SEQ ID NO: 600596 - DNA, 25 bp, Mus musculus
cctggacttgacctcaatcacaaac

SEQ ID NO: 600597 - DNA, 25 bp, Mus musculus
cctggacttgacgtcaatcacaaac

SEQ ID NO: 600598 - DNA, 25 bp, Mus musculus
cctggagaaacacaaactcttcatc

SEQ ID NO: 600599 - DNA, 25 bp, Mus musculus
cctggagaaacacctgctatttcaa

SEQ ID NO: 600600 - DNA, 25 bp, Mus musculus
cctggagaaacagaaactcttcatc

SEQ ID NO: 600601 - DNA, 25 bp, Mus musculus
cctggagaaacagctgctatttcaa

SEQ ID NO: 600602 - DNA, 25 bp, Mus musculus
cctggagaaccgatacgacgcgcta

SEQ ID NO: 600603 - DNA, 25 bp, Mus musculus
cctggagaaccgttacgacgcgcta

SEQ ID NO: 600604 - DNA, 25 bp, Mus musculus
cctggagaacctcagtatccgagaa

SEQ ID NO: 600605 - DNA, 25 bp, Mus musculus
cctggagaacctgagtatccgagaa

SEQ ID NO: 600606 - DNA, 25 bp, Mus musculus
cctggagaacttcgccgagtaggcc

SEQ ID NO: 600607 - DNA, 25 bp, Mus musculus
cctggagaacttggccgagtaggcc

SEQ ID NO: 600608 - DNA, 25 bp, Mus musculus
cctggagaagagaatcgacggtctg

SEQ ID NO: 600609 - DNA, 25 bp, Mus musculus
cctggagaagagtatcgacggtctg

SEQ ID NO: 600610 - DNA, 25 bp, Mus musculus
cctggagaaggcctacatcaaggac

SEQ ID NO: 600611 - DNA, 25 bp, Mus musculus
cctggagaaggcgtacatcaaggac

SEQ ID NO: 600612 - DNA, 25 bp, Mus musculus
cctggagaatgaccccgactgccgg

SEQ ID NO: 600613 - DNA, 25 bp, Mus musculus
cctggagaatgagcccgactgccgg

SEQ ID NO: 600614 - DNA, 25 bp, Mus musculus
cctggagacaccaactccaagcagg

SEQ ID NO: 600615 - DNA, 25 bp, Mus musculus
cctggagacacctactccaagcagg

SEQ ID NO: 600616 - DNA, 25 bp, Mus musculus
cctggagacactcgaaggccaccag

SEQ ID NO: 600617 - DNA, 25 bp, Mus musculus
cctggagacactcgacaagcacaac

SEQ ID NO: 600618 - DNA, 25 bp, Mus musculus
cctggagacactggaaggccaccag

SEQ ID NO: 600619 - DNA, 25 bp, Mus musculus
cctggagacactggacaagcacaac

SEQ ID NO: 600620 - DNA, 25 bp, Mus musculus
cctggagacagtcggtcagaagttc

SEQ ID NO: 600621 - DNA, 25 bp, Mus musculus
cctggagacagtgggtcagaagttc

SEQ ID NO: 600622 - DNA, 25 bp, Mus musculus
cctggagacccacgcaagccaggag

SEQ ID NO: 600623 - DNA, 25 bp, Mus musculus
cctggagacccaggcaagccaggag

SEQ ID NO: 600624 - DNA, 25 bp, Mus musculus
cctggagacttcactctgtctgtta

SEQ ID NO: 600625 - DNA, 25 bp, Mus musculus
cctggagacttctctctgtctgtta

SEQ ID NO: 600626 - DNA, 25 bp, Mus musculus
cctggagaggacaatgggtcgatcc

SEQ ID NO: 600627 - DNA, 25 bp, Mus musculus
cctggagaggactatgggtcgatcc

SEQ ID NO: 600628 - DNA, 25 bp, Mus musculus
cctggagaggcgacactagaacttt

SEQ ID NO: 600629 - DNA, 25 bp, Mus musculus
cctggagaggcgtcactagaacttt

SEQ ID NO: 600630 - DNA, 25 bp, Mus musculus
cctggagatgagaaccctgctgtta

SEQ ID NO: 600631 - DNA, 25 bp, Mus musculus
cctggagatgagtaccctgctgtta

SEQ ID NO: 600632 - DNA, 25 bp, Mus musculus
cctggagatgcgatggtgaaaatga

SEQ ID NO: 600633 - DNA, 25 bp, Mus musculus
cctggagatgcgttggtgaaaatga

SEQ ID NO: 600634 - DNA, 25 bp, Mus musculus
cctggagcaaggctagcactgtgac

SEQ ID NO: 600635 - DNA, 25 bp, Mus musculus
cctggagcaagggtagcactgtgac

SEQ ID NO: 600636 - DNA, 25 bp, Mus musculus
cctggagcaattagcttccatgact

SEQ ID NO: 600637 - DNA, 25 bp, Mus musculus
cctggagcaattcatgtcattggtc

SEQ ID NO: 600638 - DNA, 25 bp, Mus musculus
cctggagcaattgatgtcattggtc

SEQ ID NO: 600639 - DNA, 25 bp, Mus musculus
cctggagcaatttgcttccatgact

SEQ ID NO: 600640 - DNA, 25 bp, Mus musculus
cctggagcacatctccgctggatct

SEQ ID NO: 600641 - DNA, 25 bp, Mus musculus
cctggagcacatgtccgctggatct

SEQ ID NO: 600642 - DNA, 25 bp, Mus musculus
cctggagcagatcgagaaagaaaac

SEQ ID NO: 600643 - DNA, 25 bp, Mus musculus
cctggagcagatggagaaagaaaac

SEQ ID NO: 600644 - DNA, 25 bp, Mus musculus
cctggagcagggacataattgttct

SEQ ID NO: 600645 - DNA, 25 bp, Mus musculus
cctggagcagggtcataattgttct

SEQ ID NO: 600646 - DNA, 25 bp, Mus musculus
cctggagcaggtaagacgtgagacc

SEQ ID NO: 600647 - DNA, 25 bp, Mus musculus
cctggagcaggttagacgtgagacc

SEQ ID NO: 600648 - DNA, 25 bp, Mus musculus
cctggagcatgaagaccacgagctc

SEQ ID NO: 600649 - DNA, 25 bp, Mus musculus
cctggagcatgatgaccacgagctc

SEQ ID NO: 600650 - DNA, 25 bp, Mus musculus
cctggagcatttcaagaaggcttaa

SEQ ID NO: 600651 - DNA, 25 bp, Mus musculus
cctggagcatttgaagaaggcttaa

SEQ ID NO: 600652 - DNA, 25 bp, Mus musculus
cctggagccagtcgatttcggatca

SEQ ID NO: 600653 - DNA, 25 bp, Mus musculus
cctggagccagtggatttcggatca

SEQ ID NO: 600654 - DNA, 25 bp, Mus musculus
cctggagccctgcaaaccctatatg

SEQ ID NO: 600655 - DNA, 25 bp, Mus musculus
cctggagccctggaaaccctatatg

SEQ ID NO: 600656 - DNA, 25 bp, Mus musculus
cctggagccgcaaggtggctttcgt

SEQ ID NO: 600657 - DNA, 25 bp, Mus musculus
cctggagccgcatggtggctttcgt

SEQ ID NO: 600658 - DNA, 25 bp, Mus musculus
cctggagccgtgcacaacttactgc

SEQ ID NO: 600659 - DNA, 25 bp, Mus musculus
cctggagccgtggacaacttactgc

SEQ ID NO: 600660 - DNA, 25 bp, Mus musculus
cctggagcctacaccaaaggcgtgg

SEQ ID NO: 600661 - DNA, 25 bp, Mus musculus
cctggagcctactccaaaggcgtgg

SEQ ID NO: 600662 - DNA, 25 bp, Mus musculus
cctggagcgtcacacttaacaggaa

SEQ ID NO: 600663 - DNA, 25 bp, Mus musculus
cctggagcgtcagacttaacaggaa

SEQ ID NO: 600664 - DNA, 25 bp, Mus musculus
cctggagctactcagaaagcataag

SEQ ID NO: 600665 - DNA, 25 bp, Mus musculus
cctggagctactgagaaagcataag

SEQ ID NO: 600666 - DNA, 25 bp, Mus musculus
cctggagctagtcttgtgtgagcct

SEQ ID NO: 600667 - DNA, 25 bp, Mus musculus
cctggagctagtgttgtgtgagcct

SEQ ID NO: 600668 - DNA, 25 bp, Mus musculus
cctggagctcgtaagccgccaggag

SEQ ID NO: 600669 - DNA, 25 bp, Mus musculus
cctggagctcgttagccgccaggag

SEQ ID NO: 600670 - DNA, 25 bp, Mus musculus
cctggagctctaaagggaatcccta

SEQ ID NO: 600671 - DNA, 25 bp, Mus musculus
cctggagctctacatcaataggatg

SEQ ID NO: 600672 - DNA, 25 bp, Mus musculus
cctggagctctagatcaataggatg

SEQ ID NO: 600673 - DNA, 25 bp, Mus musculus
cctggagctctatagggaatcccta

SEQ ID NO: 600674 - DNA, 25 bp, Mus musculus
cctggagctggcaaggattccccta

SEQ ID NO: 600675 - DNA, 25 bp, Mus musculus
cctggagctggctaggattccccta

SEQ ID NO: 600676 - DNA, 25 bp, Mus musculus
cctggagctgttatgccagattatc

SEQ ID NO: 600677 - DNA, 25 bp, Mus musculus
cctggagctgttttgccagattatc

SEQ ID NO: 600678 - DNA, 25 bp, Mus musculus
cctggagctttcaatctgaccacag

SEQ ID NO: 600679 - DNA, 25 bp, Mus musculus
cctggagctttctatctgaccacag

SEQ ID NO: 600680 - DNA, 25 bp, Mus musculus
cctggagctttgacctctggaggct

SEQ ID NO: 600681 - DNA, 25 bp, Mus musculus
cctggagctttgtcctctggaggct

SEQ ID NO: 600682 - DNA, 25 bp, Mus musculus
cctggaggacacaatcgcccaggta

SEQ ID NO: 600683 - DNA, 25 bp, Mus musculus
cctggaggacactatcgcccaggta

SEQ ID NO: 600684 - DNA, 25 bp, Mus musculus
cctggaggacctcaatatgctctac

SEQ ID NO: 600685 - DNA, 25 bp, Mus musculus
cctggaggacctgaatatgctctac

SEQ ID NO: 600686 - DNA, 25 bp, Mus musculus
cctggaggacttcatggaaaatctg

SEQ ID NO: 600687 - DNA, 25 bp, Mus musculus
cctggaggacttgatggaaaatctg

SEQ ID NO: 600688 - DNA, 25 bp, Mus musculus
cctggaggagcaacaatggcagctg

SEQ ID NO: 600689 - DNA, 25 bp, Mus musculus
cctggaggagcaagatgccatatct

SEQ ID NO: 600690 - DNA, 25 bp, Mus musculus
cctggaggagcatcaatggcagctg

SEQ ID NO: 600691 - DNA, 25 bp, Mus musculus
cctggaggagcatgatgccatatct

SEQ ID NO: 600692 - DNA, 25 bp, Mus musculus
cctggaggagctcatcgactacacc

SEQ ID NO: 600693 - DNA, 25 bp, Mus musculus
cctggaggagctgatcgactacacc

SEQ ID NO: 600694 - DNA, 25 bp, Mus musculus
cctggaggagggacgtctgacgctg

SEQ ID NO: 600695 - DNA, 25 bp, Mus musculus
cctggaggagggtcgtctgacgctg

SEQ ID NO: 600696 - DNA, 25 bp, Mus musculus
cctggaggagtccatatgtgtcaat

SEQ ID NO: 600697 - DNA, 25 bp, Mus musculus
cctggaggagtcgatatgtgtcaat

SEQ ID NO: 600698 - DNA, 25 bp, Mus musculus
cctggaggagttaactcgctacctg

SEQ ID NO: 600699 - DNA, 25 bp, Mus musculus
cctggaggagtttactcgctacctg

SEQ ID NO: 600700 - DNA, 25 bp, Mus musculus
cctggaggataaatttagttcagcc

SEQ ID NO: 600701 - DNA, 25 bp, Mus musculus
cctggaggataattttagttcagcc

SEQ ID NO: 600702 - DNA, 25 bp, Mus musculus
cctggaggccgtaaagattcaggag

SEQ ID NO: 600703 - DNA, 25 bp, Mus musculus
cctggaggccgttaagattcaggag

SEQ ID NO: 600704 - DNA, 25 bp, Mus musculus
cctggaggcgagaccccggttgtca

SEQ ID NO: 600705 - DNA, 25 bp, Mus musculus
cctggaggcgagtccccggttgtca

SEQ ID NO: 600706 - DNA, 25 bp, Mus musculus
cctggaggcgctcggacacatgttc

SEQ ID NO: 600707 - DNA, 25 bp, Mus musculus
cctggaggcgctgggacacatgttc

SEQ ID NO: 600708 - DNA, 25 bp, Mus musculus
cctggagggctgatggttcttgact

SEQ ID NO: 600709 - DNA, 25 bp, Mus musculus
cctggagggctgttggttcttgact

SEQ ID NO: 600710 - DNA, 25 bp, Mus musculus
cctggaggggcaactacgctctatc

SEQ ID NO: 600711 - DNA, 25 bp, Mus musculus
cctggaggggcatctacgctctatc

SEQ ID NO: 600712 - DNA, 25 bp, Mus musculus
cctggaggtcctcagcacttcttcg

SEQ ID NO: 600713 - DNA, 25 bp, Mus musculus
cctggaggtcctgagcacttcttcg

SEQ ID NO: 600714 - DNA, 25 bp, Mus musculus
cctggagtaataacgccaagctgca

SEQ ID NO: 600715 - DNA, 25 bp, Mus musculus
cctggagtaatatcgccaagctgca

SEQ ID NO: 600716 - DNA, 25 bp, Mus musculus
cctggagtacaacccctatgcttgg

SEQ ID NO: 600717 - DNA, 25 bp, Mus musculus
cctggagtacaagccctatgcttgg

SEQ ID NO: 600718 - DNA, 25 bp, Mus musculus
cctggagtacatcaaagtggtggac

SEQ ID NO: 600719 - DNA, 25 bp, Mus musculus
cctggagtacatgaaagtggtggac

SEQ ID NO: 600720 - DNA, 25 bp, Mus musculus
cctggagtaccgcttttacaagcag

SEQ ID NO: 600721 - DNA, 25 bp, Mus musculus
cctggagtaccggttttacaagcag

SEQ ID NO: 600722 - DNA, 25 bp, Mus musculus
cctggagtatctcaaagaagaccct

SEQ ID NO: 600723 - DNA, 25 bp, Mus musculus
cctggagtatctgaaagaagaccct

SEQ ID NO: 600724 - DNA, 25 bp, Mus musculus
cctggagtcccacaatattaatgag

SEQ ID NO: 600725 - DNA, 25 bp, Mus musculus
cctggagtcccagaatattaatgag

SEQ ID NO: 600726 - DNA, 25 bp, Mus musculus
cctggagtcgcacgttccccaatga

SEQ ID NO: 600727 - DNA, 25 bp, Mus musculus
cctggagtcgcaggttccccaatga

SEQ ID NO: 600728 - DNA, 25 bp, Mus musculus
cctggagtctacaaatgtcactgac

SEQ ID NO: 600729 - DNA, 25 bp, Mus musculus
cctggagtctactaatgtcactgac

SEQ ID NO: 600730 - DNA, 25 bp, Mus musculus
cctggagtctctctatattgagata

SEQ ID NO: 600731 - DNA, 25 bp, Mus musculus
cctggagtctctgtatattgagata

SEQ ID NO: 600732 - DNA, 25 bp, Mus musculus
cctggagtcttcagggcagactgat

SEQ ID NO: 600733 - DNA, 25 bp, Mus musculus
cctggagtcttctgggcagactgat

SEQ ID NO: 600734 - DNA, 25 bp, Mus musculus
cctggagtgacaccagctgccatca

SEQ ID NO: 600735 - DNA, 25 bp, Mus musculus
cctggagtgacagcagctgccatca

SEQ ID NO: 600736 - DNA, 25 bp, Mus musculus
cctggagtgtgtcagatactgcatc

SEQ ID NO: 600737 - DNA, 25 bp, Mus musculus
cctggagtgtgtgagatactgcatc

SEQ ID NO: 600738 - DNA, 25 bp, Mus musculus
cctggagttactcccattgagttag

SEQ ID NO: 600739 - DNA, 25 bp, Mus musculus
cctggagttactgccattgagttag

SEQ ID NO: 600740 - DNA, 25 bp, Mus musculus
cctggagttagaacaagtgactgtc

SEQ ID NO: 600741 - DNA, 25 bp, Mus musculus
cctggagttagatcaagtgactgtc

SEQ ID NO: 600742 - DNA, 25 bp, Mus musculus
cctggagtttgaagcagacgttcaa

SEQ ID NO: 600743 - DNA, 25 bp, Mus musculus
cctggagtttgatgcagacgttcaa

SEQ ID NO: 600744 - DNA, 25 bp, Mus musculus
cctggataagagcaccctggacctc

SEQ ID NO: 600745 - DNA, 25 bp, Mus musculus
cctggataagaggaccctggacctc

SEQ ID NO: 600746 - DNA, 25 bp, Mus musculus
cctggataagatcatagaagaaggc

SEQ ID NO: 600747 - DNA, 25 bp, Mus musculus
cctggataagatgatagaagaaggc

SEQ ID NO: 600748 - DNA, 25 bp, Mus musculus
cctggatacagaccggagccatcat

SEQ ID NO: 600749 - DNA, 25 bp, Mus musculus
cctggatacagagcggagccatcat

SEQ ID NO: 600750 - DNA, 25 bp, Mus musculus
cctggatagataccagcacagggaa

SEQ ID NO: 600751 - DNA, 25 bp, Mus musculus
cctggatagatagcagcacagggaa

SEQ ID NO: 600752 - DNA, 25 bp, Mus musculus
cctggatatcaaaaagttacctggg

SEQ ID NO: 600753 - DNA, 25 bp, Mus musculus
cctggatatcaataagttacctggg

SEQ ID NO: 600754 - DNA, 25 bp, Mus musculus
cctggatatgctcccctgggtgcaa

SEQ ID NO: 600755 - DNA, 25 bp, Mus musculus
cctggatatgctgccctgggtgcaa

SEQ ID NO: 600756 - DNA, 25 bp, Mus musculus
cctggatatggacgataaggattac

SEQ ID NO: 600757 - DNA, 25 bp, Mus musculus
cctggatatggaggataaggattac

SEQ ID NO: 600758 - DNA, 25 bp, Mus musculus
cctggatcagatatggagaactaaa

SEQ ID NO: 600759 - DNA, 25 bp, Mus musculus
cctggatcagatttggagaactaaa

SEQ ID NO: 600760 - DNA, 25 bp, Mus musculus
cctggatcaggaaggtcattggtcg

SEQ ID NO: 600761 - DNA, 25 bp, Mus musculus
cctggatcaggatggtcattggtcg

SEQ ID NO: 600762 - DNA, 25 bp, Mus musculus
cctggatcatctcgacccaagggtg

SEQ ID NO: 600763 - DNA, 25 bp, Mus musculus
cctggatcatctggacccaagggtg

SEQ ID NO: 600764 - DNA, 25 bp, Mus musculus
cctggatcctgtcctgggtcaagcc

SEQ ID NO: 600765 - DNA, 25 bp, Mus musculus
cctggatcctgtgctgggtcaagcc

SEQ ID NO: 600766 - DNA, 25 bp, Mus musculus
cctggatcgtgcacagggagcccat

SEQ ID NO: 600767 - DNA, 25 bp, Mus musculus
cctggatcgtgctcagggagcccat

SEQ ID NO: 600768 - DNA, 25 bp, Mus musculus
cctggatgacaaacagatagttacc

SEQ ID NO: 600769 - DNA, 25 bp, Mus musculus
cctggatgacaatcagatagttacc

SEQ ID NO: 600770 - DNA, 25 bp, Mus musculus
cctggatgaccgatacagcgtggta

SEQ ID NO: 600771 - DNA, 25 bp, Mus musculus
cctggatgaccgttacagcgtggta

SEQ ID NO: 600772 - DNA, 25 bp, Mus musculus
cctggatgagccagacacaatgcac

SEQ ID NO: 600773 - DNA, 25 bp, Mus musculus
cctggatgagcctgacacaatgcac

SEQ ID NO: 600774 - DNA, 25 bp, Mus musculus
cctggatgagcgatgcagaagagtc

SEQ ID NO: 600775 - DNA, 25 bp, Mus musculus
cctggatgagcgttgcagaagagtc

SEQ ID NO: 600776 - DNA, 25 bp, Mus musculus
cctggatgaggactatccctgctcg

SEQ ID NO: 600777 - DNA, 25 bp, Mus musculus
cctggatgaggagtatccctgctcg

SEQ ID NO: 600778 - DNA, 25 bp, Mus musculus
cctggatgaggtatgcggcagccat

SEQ ID NO: 600779 - DNA, 25 bp, Mus musculus
cctggatgaggtttgcggcagccat

SEQ ID NO: 600780 - DNA, 25 bp, Mus musculus
cctggatgatgtcgatcataaaatc

SEQ ID NO: 600781 - DNA, 25 bp, Mus musculus
cctggatgatgtggatcataaaatc

SEQ ID NO: 600782 - DNA, 25 bp, Mus musculus
cctggatgcagtatcttaaggagga

SEQ ID NO: 600783 - DNA, 25 bp, Mus musculus
cctggatgcagtttcttaaggagga

SEQ ID NO: 600784 - DNA, 25 bp, Mus musculus
cctggatgctcccaagcccaaaaaa

SEQ ID NO: 600785 - DNA, 25 bp, Mus musculus
cctggatgctccgaagcccaaaaaa

SEQ ID NO: 600786 - DNA, 25 bp, Mus musculus
cctggatgcttgaatactttgctcc

SEQ ID NO: 600787 - DNA, 25 bp, Mus musculus
cctggatgcttgtatactttgctcc

SEQ ID NO: 600788 - DNA, 25 bp, Mus musculus
cctggatggaaaagacgtagactct

SEQ ID NO: 600789 - DNA, 25 bp, Mus musculus
cctggatggaaatgacgtagactct

SEQ ID NO: 600790 - DNA, 25 bp, Mus musculus
cctggatggagacaccaagaattcc

SEQ ID NO: 600791 - DNA, 25 bp, Mus musculus
cctggatggagagaccaagaattcc

SEQ ID NO: 600792 - DNA, 25 bp, Mus musculus
cctggatggagcagatagcactggt

SEQ ID NO: 600793 - DNA, 25 bp, Mus musculus
cctggatggagctgatagcactggt

SEQ ID NO: 600794 - DNA, 25 bp, Mus musculus
cctggatggattaaaggcactgacc

SEQ ID NO: 600795 - DNA, 25 bp, Mus musculus
cctggatggatttaaggcactgacc

SEQ ID NO: 600796 - DNA, 25 bp, Mus musculus
cctggatggcaaacacgaagcttct

SEQ ID NO: 600797 - DNA, 25 bp, Mus musculus
cctggatggcaatcacgaagcttct

SEQ ID NO: 600798 - DNA, 25 bp, Mus musculus
cctggatgggatcagcagtgtcaac

SEQ ID NO: 600799 - DNA, 25 bp, Mus musculus
cctggatgggatgagcagtgtcaac

SEQ ID NO: 600800 - DNA, 25 bp, Mus musculus
cctggatgtagtactcaagagccat

SEQ ID NO: 600801 - DNA, 25 bp, Mus musculus
cctggatgtagttctcaagagccat

SEQ ID NO: 600802 - DNA, 25 bp, Mus musculus
cctggatgtcagagtttcggaattg

SEQ ID NO: 600803 - DNA, 25 bp, Mus musculus
cctggatgtcagtgtttcggaattg

SEQ ID NO: 600804 - DNA, 25 bp, Mus musculus
cctggatgtgaaaagtatgatggca

SEQ ID NO: 600805 - DNA, 25 bp, Mus musculus
cctggatgtgaatagtatgatggca

SEQ ID NO: 600806 - DNA, 25 bp, Mus musculus
cctggatgtgccctactttgcggat

SEQ ID NO: 600807 - DNA, 25 bp, Mus musculus
cctggatgtgccgtactttgcggat

SEQ ID NO: 600808 - DNA, 25 bp, Mus musculus
cctggatgtggcaaacggctactct

SEQ ID NO: 600809 - DNA, 25 bp, Mus musculus
cctggatgtggctaacggctactct

SEQ ID NO: 600810 - DNA, 25 bp, Mus musculus
cctggattaatcatgagagagcttg

SEQ ID NO: 600811 - DNA, 25 bp, Mus musculus
cctggattaatcttgagagagcttg

SEQ ID NO: 600812 - DNA, 25 bp, Mus musculus
cctggattatataatggattcgtac

SEQ ID NO: 600813 - DNA, 25 bp, Mus musculus
cctggattatatcatgggtggctgc

SEQ ID NO: 600814 - DNA, 25 bp, Mus musculus
cctggattatatgatgggtggctgc

SEQ ID NO: 600815 - DNA, 25 bp, Mus musculus
cctggattatattatggattcgtac

SEQ ID NO: 600816 - DNA, 25 bp, Mus musculus
cctggattccaacgcaagttatgcc

SEQ ID NO: 600817 - DNA, 25 bp, Mus musculus
cctggattccaaggcaagttatgcc

SEQ ID NO: 600818 - DNA, 25 bp, Mus musculus
cctggattccagagagattggagat

SEQ ID NO: 600819 - DNA, 25 bp, Mus musculus
cctggattccagtgagattggagat

SEQ ID NO: 600820 - DNA, 25 bp, Mus musculus
cctggattccgactttttgaagacg

SEQ ID NO: 600821 - DNA, 25 bp, Mus musculus
cctggattccgagtttttgaagacg

SEQ ID NO: 600822 - DNA, 25 bp, Mus musculus
cctggattcgcaaggctgaatcgaa

SEQ ID NO: 600823 - DNA, 25 bp, Mus musculus
cctggattcgcatggctgaatcgaa

SEQ ID NO: 600824 - DNA, 25 bp, Mus musculus
cctggattgggaagagaacacctca

SEQ ID NO: 600825 - DNA, 25 bp, Mus musculus
cctggattgggatgagaacacctca

SEQ ID NO: 600826 - DNA, 25 bp, Mus musculus
cctggatttaacaggcgactatttt

SEQ ID NO: 600827 - DNA, 25 bp, Mus musculus
cctggatttaactggcgactatttt

SEQ ID NO: 600828 - DNA, 25 bp, Mus musculus
cctggcaaaatcagagggcccacgc

SEQ ID NO: 600829 - DNA, 25 bp, Mus musculus
cctggcaaaatctgagggcccacgc

SEQ ID NO: 600830 - DNA, 25 bp, Mus musculus
cctggcaacagaaggtcaggtttgc

SEQ ID NO: 600831 - DNA, 25 bp, Mus musculus
cctggcaacagatggtcaggtttgc

SEQ ID NO: 600832 - DNA, 25 bp, Mus musculus
cctggcaacgacagccgctggaact

SEQ ID NO: 600833 - DNA, 25 bp, Mus musculus
cctggcaacgactgccgctggaact

SEQ ID NO: 600834 - DNA, 25 bp, Mus musculus
cctggcaagtgtcaagagcgcagca

SEQ ID NO: 600835 - DNA, 25 bp, Mus musculus
cctggcaagtgtgaagagcgcagca

SEQ ID NO: 600836 - DNA, 25 bp, Mus musculus
cctggcaataacagtgactgatctt

SEQ ID NO: 600837 - DNA, 25 bp, Mus musculus
cctggcaataactgtgactgatctt

SEQ ID NO: 600838 - DNA, 25 bp, Mus musculus
cctggcaatgccatagagaaggagg

SEQ ID NO: 600839 - DNA, 25 bp, Mus musculus
cctggcaatgccttagagaaggagg

SEQ ID NO: 600840 - DNA, 25 bp, Mus musculus
cctggcaccacaaacacagaggatg

SEQ ID NO: 600841 - DNA, 25 bp, Mus musculus
cctggcaccacatacacagaggatg

SEQ ID NO: 600842 - DNA, 25 bp, Mus musculus
cctggcactagacaatgtggagctc

SEQ ID NO: 600843 - DNA, 25 bp, Mus musculus
cctggcactagagaatgtggagctc

SEQ ID NO: 600844 - DNA, 25 bp, Mus musculus
cctggcactgctcaaagaagagccg

SEQ ID NO: 600845 - DNA, 25 bp, Mus musculus
cctggcactgctgaaagaagagccg

SEQ ID NO: 600846 - DNA, 25 bp, Mus musculus
cctggcactggacgacggtggcttg

SEQ ID NO: 600847 - DNA, 25 bp, Mus musculus
cctggcactggaggacggtggcttg

SEQ ID NO: 600848 - DNA, 25 bp, Mus musculus
cctggcagacatagcgagtcatgaa

SEQ ID NO: 600849 - DNA, 25 bp, Mus musculus
cctggcagacattgcgagtcatgaa

SEQ ID NO: 600850 - DNA, 25 bp, Mus musculus
cctggcagagatcacactagccctg

SEQ ID NO: 600851 - DNA, 25 bp, Mus musculus
cctggcagagatgacactagccctg

SEQ ID NO: 600852 - DNA, 25 bp, Mus musculus
cctggcagatgactttaaagaactt

SEQ ID NO: 600853 - DNA, 25 bp, Mus musculus
cctggcagatgagtttaaagaactt

SEQ ID NO: 600854 - DNA, 25 bp, Mus musculus
cctggcagcacaaccgtggaaagtc

SEQ ID NO: 600855 - DNA, 25 bp, Mus musculus
cctggcagcacatccgtggaaagtc

SEQ ID NO: 600856 - DNA, 25 bp, Mus musculus
cctggcagcagtagcaggagcaaga

SEQ ID NO: 600857 - DNA, 25 bp, Mus musculus
cctggcagcagttgcaggagcaaga

SEQ ID NO: 600858 - DNA, 25 bp, Mus musculus
cctggcagcattaatggagttccac

SEQ ID NO: 600859 - DNA, 25 bp, Mus musculus
cctggcagcatttatggagttccac

SEQ ID NO: 600860 - DNA, 25 bp, Mus musculus
cctggcagcgctctatggaccacgt

SEQ ID NO: 600861 - DNA, 25 bp, Mus musculus
cctggcagcgctgtatggaccacgt

SEQ ID NO: 600862 - DNA, 25 bp, Mus musculus
cctggcagctcaatgcgtggagtgt

SEQ ID NO: 600863 - DNA, 25 bp, Mus musculus
cctggcagctcattgcgtggagtgt

SEQ ID NO: 600864 - DNA, 25 bp, Mus musculus
cctggcaggattagcccaaggagct

SEQ ID NO: 600865 - DNA, 25 bp, Mus musculus
cctggcaggatttgcccaaggagct

SEQ ID NO: 600866 - DNA, 25 bp, Mus musculus
cctggcagtcccagagttgaaggag

SEQ ID NO: 600867 - DNA, 25 bp, Mus musculus
cctggcagtccctgagttgaaggag

SEQ ID NO: 600868 - DNA, 25 bp, Mus musculus
cctggcagtcggcagctgactccag

SEQ ID NO: 600869 - DNA, 25 bp, Mus musculus
cctggcagtcgggagctgactccag

SEQ ID NO: 600870 - DNA, 25 bp, Mus musculus
cctggcagtgatacacgaagccccg

SEQ ID NO: 600871 - DNA, 25 bp, Mus musculus
cctggcagtgattcacgaagccccg

SEQ ID NO: 600872 - DNA, 25 bp, Mus musculus
cctggcatggcaccatacgggcctt

SEQ ID NO: 600873 - DNA, 25 bp, Mus musculus
cctggcatggcagcatacgggcctt

SEQ ID NO: 600874 - DNA, 25 bp, Mus musculus
cctggcattcagagacgagagagga

SEQ ID NO: 600875 - DNA, 25 bp, Mus musculus
cctggcattcagtgacgagagagga

SEQ ID NO: 600876 - DNA, 25 bp, Mus musculus
cctggcattccgctggaggagctct

SEQ ID NO: 600877 - DNA, 25 bp, Mus musculus
cctggcattccggtggaggagctct

SEQ ID NO: 600878 - DNA, 25 bp, Mus musculus
cctggcatttgccaagctgctgaac

SEQ ID NO: 600879 - DNA, 25 bp, Mus musculus
cctggcatttgcgaagctgctgaac

SEQ ID NO: 600880 - DNA, 25 bp, Mus musculus
cctggccaacggaccagagctgatg

SEQ ID NO: 600881 - DNA, 25 bp, Mus musculus
cctggccaacggtccagagctgatg

SEQ ID NO: 600882 - DNA, 25 bp, Mus musculus
cctggccaaggtactcctgtatgga

SEQ ID NO: 600883 - DNA, 25 bp, Mus musculus
cctggccaaggttctcctgtatgga

SEQ ID NO: 600884 - DNA, 25 bp, Mus musculus
cctggccaataacgcagagagcgtg

SEQ ID NO: 600885 - DNA, 25 bp, Mus musculus
cctggccaataaggcagagagcgtg

SEQ ID NO: 600886 - DNA, 25 bp, Mus musculus
cctggccacaggactcaacgatggg

SEQ ID NO: 600887 - DNA, 25 bp, Mus musculus
cctggccacaggtctcaacgatggg

SEQ ID NO: 600888 - DNA, 25 bp, Mus musculus
cctggccagactagcatctgggaag

SEQ ID NO: 600889 - DNA, 25 bp, Mus musculus
cctggccagacttgcatctgggaag

SEQ ID NO: 600890 - DNA, 25 bp, Mus musculus
cctggccaggaacgacctcgtggac

SEQ ID NO: 600891 - DNA, 25 bp, Mus musculus
cctggccaggaaggacctcgtggac

SEQ ID NO: 600892 - DNA, 25 bp, Mus musculus
cctggccaggctagagaagatctgt

SEQ ID NO: 600893 - DNA, 25 bp, Mus musculus
cctggccaggcttgagaagatctgt

SEQ ID NO: 600894 - DNA, 25 bp, Mus musculus
cctggccaggttacagcgatgttaa

SEQ ID NO: 600895 - DNA, 25 bp, Mus musculus
cctggccaggtttcagcgatgttaa

SEQ ID NO: 600896 - DNA, 25 bp, Mus musculus
cctggccagtctactttggagctca

SEQ ID NO: 600897 - DNA, 25 bp, Mus musculus
cctggccagtcttctttggagctca

SEQ ID NO: 600898 - DNA, 25 bp, Mus musculus
cctggccagtttagacgaggaactg

SEQ ID NO: 600899 - DNA, 25 bp, Mus musculus
cctggccagttttgacgaggaactg

SEQ ID NO: 600900 - DNA, 25 bp, Mus musculus
cctggccatgagcttggatgcctca

SEQ ID NO: 600901 - DNA, 25 bp, Mus musculus
cctggccatgaggttggatgcctca

SEQ ID NO: 600902 - DNA, 25 bp, Mus musculus
cctggccatgataaattatgtatta

SEQ ID NO: 600903 - DNA, 25 bp, Mus musculus
cctggccatgattaattatgtatta

SEQ ID NO: 600904 - DNA, 25 bp, Mus musculus
cctggccattgtcgtttacacggac

SEQ ID NO: 600905 - DNA, 25 bp, Mus musculus
cctggccattgtggtttacacggac

SEQ ID NO: 600906 - DNA, 25 bp, Mus musculus
cctggcccattcaatgttcaccagt

SEQ ID NO: 600907 - DNA, 25 bp, Mus musculus
cctggcccattctatgttcaccagt

SEQ ID NO: 600908 - DNA, 25 bp, Mus musculus
cctggccccaaacgagtgtgacttc

SEQ ID NO: 600909 - DNA, 25 bp, Mus musculus
cctggccccaaaggagtgtgacttc

SEQ ID NO: 600910 - DNA, 25 bp, Mus musculus
cctggcccggaacctaggtgagttc

SEQ ID NO: 600911 - DNA, 25 bp, Mus musculus
cctggcccggaagctaggtgagttc

SEQ ID NO: 600912 - DNA, 25 bp, Mus musculus
cctggccgaggcatcagctggagcc

SEQ ID NO: 600913 - DNA, 25 bp, Mus musculus
cctggccgaggcttcagctggagcc

SEQ ID NO: 600914 - DNA, 25 bp, Mus musculus
cctggccgagggagttctctctagc

SEQ ID NO: 600915 - DNA, 25 bp, Mus musculus
cctggccgagggtgttctctctagc

SEQ ID NO: 600916 - DNA, 25 bp, Mus musculus
cctggccgcccaactctggtgtggt

SEQ ID NO: 600917 - DNA, 25 bp, Mus musculus
cctggccgcccatctctggtgtggt

SEQ ID NO: 600918 - DNA, 25 bp, Mus musculus
cctggccggaagcttggtgaaaact

SEQ ID NO: 600919 - DNA, 25 bp, Mus musculus
cctggccggaaggttggtgaaaact

SEQ ID NO: 600920 - DNA, 25 bp, Mus musculus
cctggccggctaagatatcgccctg

SEQ ID NO: 600921 - DNA, 25 bp, Mus musculus
cctggccggctatgatatcgccctg

SEQ ID NO: 600922 - DNA, 25 bp, Mus musculus
cctggcctacagagggaagctggat

SEQ ID NO: 600923 - DNA, 25 bp, Mus musculus
cctggcctacagtgggaagctggat

SEQ ID NO: 600924 - DNA, 25 bp, Mus musculus
cctggcctatggacacattctctac

SEQ ID NO: 600925 - DNA, 25 bp, Mus musculus
cctggcctatggtcacattctctac

SEQ ID NO: 600926 - DNA, 25 bp, Mus musculus
cctggcctatgtctattatcagcag

SEQ ID NO: 600927 - DNA, 25 bp, Mus musculus
cctggcctatgtgtattatcagcag

SEQ ID NO: 600928 - DNA, 25 bp, Mus musculus
cctggcctccggctaactagtgctt

SEQ ID NO: 600929 - DNA, 25 bp, Mus musculus
cctggcctccgggtaactagtgctt

SEQ ID NO: 600930 - DNA, 25 bp, Mus musculus
cctggcctcctgaatggcgggtctg

SEQ ID NO: 600931 - DNA, 25 bp, Mus musculus
cctggcctcctgtatggcgggtctg

SEQ ID NO: 600932 - DNA, 25 bp, Mus musculus
cctggcctgaccagggtagtaacta

SEQ ID NO: 600933 - DNA, 25 bp, Mus musculus
cctggcctgacctgggtagtaacta

SEQ ID NO: 600934 - DNA, 25 bp, Mus musculus
cctggcctgaggcatcacgatgtgc

SEQ ID NO: 600935 - DNA, 25 bp, Mus musculus
cctggcctgagggatcacgatgtgc

SEQ ID NO: 600936 - DNA, 25 bp, Mus musculus
cctggcctggcactatgggccttgt

SEQ ID NO: 600937 - DNA, 25 bp, Mus musculus
cctggcctggcagtatgggccttgt

SEQ ID NO: 600938 - DNA, 25 bp, Mus musculus
cctggcctggtgcattgcgggcgga

SEQ ID NO: 600939 - DNA, 25 bp, Mus musculus
cctggcctggtggattgcgggcgga

SEQ ID NO: 600940 - DNA, 25 bp, Mus musculus
cctggcctgtgtaattgtgtcgatc

SEQ ID NO: 600941 - DNA, 25 bp, Mus musculus
cctggcctgtgttattgtgtcgatc

SEQ ID NO: 600942 - DNA, 25 bp, Mus musculus
cctggccttagaagagtccctgttc

SEQ ID NO: 600943 - DNA, 25 bp, Mus musculus
cctggccttagatgagtccctgttc

SEQ ID NO: 600944 - DNA, 25 bp, Mus musculus
cctggccttcatcgttttcacagaa

SEQ ID NO: 600945 - DNA, 25 bp, Mus musculus
cctggccttcatggttttcacagaa

SEQ ID NO: 600946 - DNA, 25 bp, Mus musculus
cctggcctttggagggcatattgct

SEQ ID NO: 600947 - DNA, 25 bp, Mus musculus
cctggcctttggtgggcatattgct

SEQ ID NO: 600948 - DNA, 25 bp, Mus musculus
cctggcgagaccaagctggatgctg

SEQ ID NO: 600949 - DNA, 25 bp, Mus musculus
cctggcgagacctagctggatgctg

SEQ ID NO: 600950 - DNA, 25 bp, Mus musculus
cctggcgagcacctgcggaatgcac

SEQ ID NO: 600951 - DNA, 25 bp, Mus musculus
cctggcgagcacgtgcggaatgcac

SEQ ID NO: 600952 - DNA, 25 bp, Mus musculus
cctggcgcatgtcgtattcgggctt

SEQ ID NO: 600953 - DNA, 25 bp, Mus musculus
cctggcgcatgtggtattcgggctt

SEQ ID NO: 600954 - DNA, 25 bp, Mus musculus
cctggcgccgcaaggatgcatctga

SEQ ID NO: 600955 - DNA, 25 bp, Mus musculus
cctggcgccgcatggatgcatctga

SEQ ID NO: 600956 - DNA, 25 bp, Mus musculus
cctggcgcctctcatgtaaccagaa

SEQ ID NO: 600957 - DNA, 25 bp, Mus musculus
cctggcgcctctcgactcaaaggag

SEQ ID NO: 600958 - DNA, 25 bp, Mus musculus
cctggcgcctctgatgtaaccagaa

SEQ ID NO: 600959 - DNA, 25 bp, Mus musculus
cctggcgcctctggactcaaaggag

SEQ ID NO: 600960 - DNA, 25 bp, Mus musculus
cctggcgcgcagcaatgagaagcta

SEQ ID NO: 600961 - DNA, 25 bp, Mus musculus
cctggcgcgcaggaatgagaagcta

SEQ ID NO: 600962 - DNA, 25 bp, Mus musculus
cctggcgctcatccttctggtgcag

SEQ ID NO: 600963 - DNA, 25 bp, Mus musculus
cctggcgctcatgcttctggtgcag

SEQ ID NO: 600964 - DNA, 25 bp, Mus musculus
cctggcgctgtgaccccatagactt

SEQ ID NO: 600965 - DNA, 25 bp, Mus musculus
cctggcgctgtgtccccatagactt

SEQ ID NO: 600966 - DNA, 25 bp, Mus musculus
cctggcggacaaaagcattcgaagt

SEQ ID NO: 600967 - DNA, 25 bp, Mus musculus
cctggcggacaatagcattcgaagt

SEQ ID NO: 600968 - DNA, 25 bp, Mus musculus
cctggcggatgtcgttcagattgca

SEQ ID NO: 600969 - DNA, 25 bp, Mus musculus
cctggcggatgtggttcagattgca

SEQ ID NO: 600970 - DNA, 25 bp, Mus musculus
cctggcgggttccagctgctctatc

SEQ ID NO: 600971 - DNA, 25 bp, Mus musculus
cctggcgggttcgagctgctctatc

SEQ ID NO: 600972 - DNA, 25 bp, Mus musculus
cctggcggtgcccatcattatcaag

SEQ ID NO: 600973 - DNA, 25 bp, Mus musculus
cctggcggtgccgatcattatcaag

SEQ ID NO: 600974 - DNA, 25 bp, Mus musculus
cctggcgtatgtcgagtatgaaaac

SEQ ID NO: 600975 - DNA, 25 bp, Mus musculus
cctggcgtatgtggagtatgaaaac

SEQ ID NO: 600976 - DNA, 25 bp, Mus musculus
cctggctaaacaactgtgtgggcca

SEQ ID NO: 600977 - DNA, 25 bp, Mus musculus
cctggctaaacatctgtgtgggcca

SEQ ID NO: 600978 - DNA, 25 bp, Mus musculus
cctggctaaagtcaagtccctctta

SEQ ID NO: 600979 - DNA, 25 bp, Mus musculus
cctggctaaagtgaagtccctctta

SEQ ID NO: 600980 - DNA, 25 bp, Mus musculus
cctggctacccacgaagtagcacta

SEQ ID NO: 600981 - DNA, 25 bp, Mus musculus
cctggctacccaggaagtagcacta

SEQ ID NO: 600982 - DNA, 25 bp, Mus musculus
cctggctacctgagtgaagatggag

SEQ ID NO: 600983 - DNA, 25 bp, Mus musculus
cctggctacctgtgtgaagatggag

SEQ ID NO: 600984 - DNA, 25 bp, Mus musculus
cctggctactgtcaccggcattgct

SEQ ID NO: 600985 - DNA, 25 bp, Mus musculus
cctggctactgtgaccggcattgct

SEQ ID NO: 600986 - DNA, 25 bp, Mus musculus
cctggctagagcagactctgtggga

SEQ ID NO: 600987 - DNA, 25 bp, Mus musculus
cctggctagagctgactctgtggga

SEQ ID NO: 600988 - DNA, 25 bp, Mus musculus
cctggctaggacactgatcatggca

SEQ ID NO: 600989 - DNA, 25 bp, Mus musculus
cctggctaggactctgatcatggca

SEQ ID NO: 600990 - DNA, 25 bp, Mus musculus
cctggctcaacacatctaaggtgga

SEQ ID NO: 600991 - DNA, 25 bp, Mus musculus
cctggctcaacagatctaaggtgga

SEQ ID NO: 600992 - DNA, 25 bp, Mus musculus
cctggctcctatctactaccgagga

SEQ ID NO: 600993 - DNA, 25 bp, Mus musculus
cctggctcctatgtactaccgagga

SEQ ID NO: 600994 - DNA, 25 bp, Mus musculus
cctggctcctctcgccaaggttatt

SEQ ID NO: 600995 - DNA, 25 bp, Mus musculus
cctggctcctctggccaaggttatt

SEQ ID NO: 600996 - DNA, 25 bp, Mus musculus
cctggctcgagaagtgcacaacctg

SEQ ID NO: 600997 - DNA, 25 bp, Mus musculus
cctggctcgagatgtgcacaacctg

SEQ ID NO: 600998 - DNA, 25 bp, Mus musculus
cctggctctgccatttaaagttgtg

SEQ ID NO: 600999 - DNA, 25 bp, Mus musculus
cctggctctgccttttaaagttgtg

SEQ ID NO: 601000 - DNA, 25 bp, Mus musculus
cctggctctgctcatggggatacat

SEQ ID NO: 601001 - DNA, 25 bp, Mus musculus
cctggctctgctgatggggatacat

SEQ ID NO: 601002 - DNA, 25 bp, Mus musculus
cctggctcttcaagctttccaaggt

SEQ ID NO: 601003 - DNA, 25 bp, Mus musculus
cctggctcttcatgctttccaaggt

SEQ ID NO: 601004 - DNA, 25 bp, Mus musculus
cctggctgaaagcaaacggagtgcc

SEQ ID NO: 601005 - DNA, 25 bp, Mus musculus
cctggctgaaaggaaacggagtgcc

SEQ ID NO: 601006 - DNA, 25 bp, Mus musculus
cctggctgagccatagagctccaag

SEQ ID NO: 601007 - DNA, 25 bp, Mus musculus
cctggctgagccttagagctccaag

SEQ ID NO: 601008 - DNA, 25 bp, Mus musculus
cctggctgagctagttgctggcatt

SEQ ID NO: 601009 - DNA, 25 bp, Mus musculus
cctggctgagcttgttgctggcatt

SEQ ID NO: 601010 - DNA, 25 bp, Mus musculus
cctggctgcactacatgacaaccat

SEQ ID NO: 601011 - DNA, 25 bp, Mus musculus
cctggctgcacttcatgacaaccat

SEQ ID NO: 601012 - DNA, 25 bp, Mus musculus
cctggctgcagaccaagggctttag

SEQ ID NO: 601013 - DNA, 25 bp, Mus musculus
cctggctgcagagcaagggctttag

SEQ ID NO: 601014 - DNA, 25 bp, Mus musculus
cctggctgcattcttcatatttggc

SEQ ID NO: 601015 - DNA, 25 bp, Mus musculus
cctggctgcattgttcatatttggc

SEQ ID NO: 601016 - DNA, 25 bp, Mus musculus
cctggctgccgacacggagtcagac

SEQ ID NO: 601017 - DNA, 25 bp, Mus musculus
cctggctgccgagacggagtcagac

SEQ ID NO: 601018 - DNA, 25 bp, Mus musculus
cctggctgcgctaacggtcgcgtag

SEQ ID NO: 601019 - DNA, 25 bp, Mus musculus
cctggctgcgcttacggtcgcgtag

SEQ ID NO: 601020 - DNA, 25 bp, Mus musculus
cctggctgctcgcactgttgagtct

SEQ ID NO: 601021 - DNA, 25 bp, Mus musculus
cctggctgctcggactgttgagtct

SEQ ID NO: 601022 - DNA, 25 bp, Mus musculus
cctggctgggcgatgagaataaccc

SEQ ID NO: 601023 - DNA, 25 bp, Mus musculus
cctggctgggcgttgagaataaccc

SEQ ID NO: 601024 - DNA, 25 bp, Mus musculus
cctggctgggttcgtagacctcgct

SEQ ID NO: 601025 - DNA, 25 bp, Mus musculus
cctggctgggttggtagacctcgct

SEQ ID NO: 601026 - DNA, 25 bp, Mus musculus
cctggctgtaccacgttaccagaag

SEQ ID NO: 601027 - DNA, 25 bp, Mus musculus
cctggctgtacctcgttaccagaag

SEQ ID NO: 601028 - DNA, 25 bp, Mus musculus
cctggctgtactagggaaaggctgt

SEQ ID NO: 601029 - DNA, 25 bp, Mus musculus
cctggctgtacttgggaaaggctgt

SEQ ID NO: 601030 - DNA, 25 bp, Mus musculus
cctggctgtcaccatttcagagatg

SEQ ID NO: 601031 - DNA, 25 bp, Mus musculus
cctggctgtcacgatttcagagatg

SEQ ID NO: 601032 - DNA, 25 bp, Mus musculus
cctggctgtgtcaatggagtctgca

SEQ ID NO: 601033 - DNA, 25 bp, Mus musculus
cctggctgtgtctatggagtctgca

SEQ ID NO: 601034 - DNA, 25 bp, Mus musculus
cctggctgtgttcctgccgaggaca

SEQ ID NO: 601035 - DNA, 25 bp, Mus musculus
cctggctgtgttgctgccgaggaca

SEQ ID NO: 601036 - DNA, 25 bp, Mus musculus
cctggctgttgacagtgaggattat

SEQ ID NO: 601037 - DNA, 25 bp, Mus musculus
cctggctgttgagagtgaggattat

SEQ ID NO: 601038 - DNA, 25 bp, Mus musculus
cctggcttgacaagctgagctctgc

SEQ ID NO: 601039 - DNA, 25 bp, Mus musculus
cctggcttgacatgctgagctctgc

SEQ ID NO: 601040 - DNA, 25 bp, Mus musculus
cctggcttgctacctttttggacgc

SEQ ID NO: 601041 - DNA, 25 bp, Mus musculus
cctggcttgctagctttttggacgc

SEQ ID NO: 601042 - DNA, 25 bp, Mus musculus
cctggcttggaaccgggtcgacata

SEQ ID NO: 601043 - DNA, 25 bp, Mus musculus
cctggcttggaagcgggtcgacata

SEQ ID NO: 601044 - DNA, 25 bp, Mus musculus
cctggcttgggaaggcccgagtcca

SEQ ID NO: 601045 - DNA, 25 bp, Mus musculus
cctggcttgggatggcccgagtcca

SEQ ID NO: 601046 - DNA, 25 bp, Mus musculus
cctggcttgtacactgggttggctg

SEQ ID NO: 601047 - DNA, 25 bp, Mus musculus
cctggcttgtactctgggttggctg

SEQ ID NO: 601048 - DNA, 25 bp, Mus musculus
cctggctttctgaagaagaattgaa

SEQ ID NO: 601049 - DNA, 25 bp, Mus musculus
cctggctttctgtagaagaattgaa

SEQ ID NO: 601050 - DNA, 25 bp, Mus musculus
cctggctttggccatcaaggaagcc

SEQ ID NO: 601051 - DNA, 25 bp, Mus musculus
cctggctttggcgatcaaggaagcc

SEQ ID NO: 601052 - DNA, 25 bp, Mus musculus
cctgggaaaaggcagttgcaaccag

SEQ ID NO: 601053 - DNA, 25 bp, Mus musculus
cctgggaaaagggagttgcaaccag

SEQ ID NO: 601054 - DNA, 25 bp, Mus musculus
cctgggaaagtacatatcagggagc

SEQ ID NO: 601055 - DNA, 25 bp, Mus musculus
cctgggaaagtagatatcagggagc

SEQ ID NO: 601056 - DNA, 25 bp, Mus musculus
cctgggaaccacagctggatagagg

SEQ ID NO: 601057 - DNA, 25 bp, Mus musculus
cctgggaaccaccttaagatccaag

SEQ ID NO: 601058 - DNA, 25 bp, Mus musculus
cctgggaaccacgttaagatccaag

SEQ ID NO: 601059 - DNA, 25 bp, Mus musculus
cctgggaaccactgctggatagagg

SEQ ID NO: 601060 - DNA, 25 bp, Mus musculus
cctgggaaccggacatcagcctttg

SEQ ID NO: 601061 - DNA, 25 bp, Mus musculus
cctgggaaccggtcatcagcctttg

SEQ ID NO: 601062 - DNA, 25 bp, Mus musculus
cctgggaactccactctctgaggca

SEQ ID NO: 601063 - DNA, 25 bp, Mus musculus
cctgggaactcctctctctgaggca

SEQ ID NO: 601064 - DNA, 25 bp, Mus musculus
cctgggaactggagacccttacaca

SEQ ID NO: 601065 - DNA, 25 bp, Mus musculus
cctgggaactggtgacccttacaca

SEQ ID NO: 601066 - DNA, 25 bp, Mus musculus
cctgggaacttcagaggtggcgcca

SEQ ID NO: 601067 - DNA, 25 bp, Mus musculus
cctgggaacttctgaggtggcgcca

SEQ ID NO: 601068 - DNA, 25 bp, Mus musculus
cctgggaagctgaagacccaaccaa

SEQ ID NO: 601069 - DNA, 25 bp, Mus musculus
cctgggaagctgtagacccaaccaa

SEQ ID NO: 601070 - DNA, 25 bp, Mus musculus
cctgggaagtagaggcttgaaaaat

SEQ ID NO: 601071 - DNA, 25 bp, Mus musculus
cctgggaagtagtggcttgaaaaat

SEQ ID NO: 601072 - DNA, 25 bp, Mus musculus
cctgggaatacactcccttgttcaa

SEQ ID NO: 601073 - DNA, 25 bp, Mus musculus
cctgggaatacagtcccttgttcaa

SEQ ID NO: 601074 - DNA, 25 bp, Mus musculus
cctgggaatatacgcttcgattgtc

SEQ ID NO: 601075 - DNA, 25 bp, Mus musculus
cctgggaatataggcttcgattgtc

SEQ ID NO: 601076 - DNA, 25 bp, Mus musculus
cctgggaatcacagacttcatacga

SEQ ID NO: 601077 - DNA, 25 bp, Mus musculus
cctgggaatcactgacttcatacga

SEQ ID NO: 601078 - DNA, 25 bp, Mus musculus
cctgggaatctccagaaggagtacc

SEQ ID NO: 601079 - DNA, 25 bp, Mus musculus
cctgggaatctcgagaaggagtacc

SEQ ID NO: 601080 - DNA, 25 bp, Mus musculus
cctgggacaagaacttcactgagaa

SEQ ID NO: 601081 - DNA, 25 bp, Mus musculus
cctgggacaagatcttcactgagaa

SEQ ID NO: 601082 - DNA, 25 bp, Mus musculus
cctgggacagccacgtagactgata

SEQ ID NO: 601083 - DNA, 25 bp, Mus musculus
cctgggacagcctcgtagactgata

SEQ ID NO: 601084 - DNA, 25 bp, Mus musculus
cctgggacaggcagccaagaaaatg

SEQ ID NO: 601085 - DNA, 25 bp, Mus musculus
cctgggacaggctgccaagaaaatg

SEQ ID NO: 601086 - DNA, 25 bp, Mus musculus
cctgggacagttccatgcataactc

SEQ ID NO: 601087 - DNA, 25 bp, Mus musculus
cctgggacagttgcatgcataactc

SEQ ID NO: 601088 - DNA, 25 bp, Mus musculus
cctgggacataaagctggttgccgc

SEQ ID NO: 601089 - DNA, 25 bp, Mus musculus
cctgggacataatgctggttgccgc

SEQ ID NO: 601090 - DNA, 25 bp, Mus musculus
cctgggacatcgatgtccagagagt

SEQ ID NO: 601091 - DNA, 25 bp, Mus musculus
cctgggacatcgttgtccagagagt

SEQ ID NO: 601092 - DNA, 25 bp, Mus musculus
cctgggaccacacgacttcctggag

SEQ ID NO: 601093 - DNA, 25 bp, Mus musculus
cctgggaccacaggacttcctggag

SEQ ID NO: 601094 - DNA, 25 bp, Mus musculus
cctgggacccaactggtaagattgg

SEQ ID NO: 601095 - DNA, 25 bp, Mus musculus
cctgggacccaagtggtaagattgg

SEQ ID NO: 601096 - DNA, 25 bp, Mus musculus
cctgggacggcgaggctggaaaaag

SEQ ID NO: 601097 - DNA, 25 bp, Mus musculus
cctgggacggcgtggctggaaaaag

SEQ ID NO: 601098 - DNA, 25 bp, Mus musculus
cctgggacgggaccacacttcgcag

SEQ ID NO: 601099 - DNA, 25 bp, Mus musculus
cctgggacgggagcacacttcgcag

SEQ ID NO: 601100 - DNA, 25 bp, Mus musculus
cctgggactggacctggacagggcc

SEQ ID NO: 601101 - DNA, 25 bp, Mus musculus
cctgggactggagctggacagggcc

SEQ ID NO: 601102 - DNA, 25 bp, Mus musculus
cctgggacttgaattaaggttgatt

SEQ ID NO: 601103 - DNA, 25 bp, Mus musculus
cctgggacttgatttaaggttgatt

SEQ ID NO: 601104 - DNA, 25 bp, Mus musculus
cctgggacttttctggcaagtcatc

SEQ ID NO: 601105 - DNA, 25 bp, Mus musculus
cctgggacttttgtggcaagtcatc

SEQ ID NO: 601106 - DNA, 25 bp, Mus musculus
cctgggagaataactggctcgtggg

SEQ ID NO: 601107 - DNA, 25 bp, Mus musculus
cctgggagaatatctggctcgtggg

SEQ ID NO: 601108 - DNA, 25 bp, Mus musculus
cctgggagacaacaagctaagccca

SEQ ID NO: 601109 - DNA, 25 bp, Mus musculus
cctgggagacaagaagctaagccca

SEQ ID NO: 601110 - DNA, 25 bp, Mus musculus
cctgggagacccaactgtgttgctg

SEQ ID NO: 601111 - DNA, 25 bp, Mus musculus
cctgggagaccctactgtgttgctg

SEQ ID NO: 601112 - DNA, 25 bp, Mus musculus
cctgggagaggcaaggagcgcctgc

SEQ ID NO: 601113 - DNA, 25 bp, Mus musculus
cctgggagaggctaggagcgcctgc

SEQ ID NO: 601114 - DNA, 25 bp, Mus musculus
cctgggagcacacgaatgtcgaaga

SEQ ID NO: 601115 - DNA, 25 bp, Mus musculus
cctgggagcacaggaatgtcgaaga

SEQ ID NO: 601116 - DNA, 25 bp, Mus musculus
cctgggagcatgatcgtggacaagc

SEQ ID NO: 601117 - DNA, 25 bp, Mus musculus
cctgggagcatgttcgtggacaagc

SEQ ID NO: 601118 - DNA, 25 bp, Mus musculus
cctgggagccacatctgtggtggca

SEQ ID NO: 601119 - DNA, 25 bp, Mus musculus
cctgggagccacttctgtggtggca

SEQ ID NO: 601120 - DNA, 25 bp, Mus musculus
cctgggagctccactcaagcgaaag

SEQ ID NO: 601121 - DNA, 25 bp, Mus musculus
cctgggagctcctctcaagcgaaag

SEQ ID NO: 601122 - DNA, 25 bp, Mus musculus
cctgggagctctatggctcagctaa

SEQ ID NO: 601123 - DNA, 25 bp, Mus musculus
cctgggagctctttggctcagctaa

SEQ ID NO: 601124 - DNA, 25 bp, Mus musculus
cctgggaggctgcatggctacatcc

SEQ ID NO: 601125 - DNA, 25 bp, Mus musculus
cctgggaggctggatggctacatcc

SEQ ID NO: 601126 - DNA, 25 bp, Mus musculus
cctgggagtctactgctttcatggc

SEQ ID NO: 601127 - DNA, 25 bp, Mus musculus
cctgggagtctagtgctttcatggc

SEQ ID NO: 601128 - DNA, 25 bp, Mus musculus
cctgggagtgcacctcaaggatcta

SEQ ID NO: 601129 - DNA, 25 bp, Mus musculus
cctgggagtgcagctcaaggatcta

SEQ ID NO: 601130 - DNA, 25 bp, Mus musculus
cctgggagttagcaagggaatgagt

SEQ ID NO: 601131 - DNA, 25 bp, Mus musculus
cctgggagttaggaagggaatgagt

SEQ ID NO: 601132 - DNA, 25 bp, Mus musculus
cctgggagttctccctggttcgcga

SEQ ID NO: 601133 - DNA, 25 bp, Mus musculus
cctgggagttctgcctggttcgcga

SEQ ID NO: 601134 - DNA, 25 bp, Mus musculus
cctgggatatgcaggatttagccaa

SEQ ID NO: 601135 - DNA, 25 bp, Mus musculus
cctgggatatgctggatttagccaa

SEQ ID NO: 601136 - DNA, 25 bp, Mus musculus
cctgggatcgatcttaccacggagc

SEQ ID NO: 601137 - DNA, 25 bp, Mus musculus
cctgggatcgatgttaccacggagc

SEQ ID NO: 601138 - DNA, 25 bp, Mus musculus
cctgggatcgtcactggagcctggc

SEQ ID NO: 601139 - DNA, 25 bp, Mus musculus
cctgggatcgtctctggagcctggc

SEQ ID NO: 601140 - DNA, 25 bp, Mus musculus
cctgggatctctattgtcacattaa

SEQ ID NO: 601141 - DNA, 25 bp, Mus musculus
cctgggatctcttttgtcacattaa

SEQ ID NO: 601142 - DNA, 25 bp, Mus musculus
cctgggatctgaaccaaagcccaag

SEQ ID NO: 601143 - DNA, 25 bp, Mus musculus
cctgggatctgatccaaagcccaag

SEQ ID NO: 601144 - DNA, 25 bp, Mus musculus
cctgggatctttagtgtcagaggag

SEQ ID NO: 601145 - DNA, 25 bp, Mus musculus
cctgggatcttttgtgtcagaggag

SEQ ID NO: 601146 - DNA, 25 bp, Mus musculus
cctgggatggctcaactccttcttg

SEQ ID NO: 601147 - DNA, 25 bp, Mus musculus
cctgggatggctctacatcgggctc

SEQ ID NO: 601148 - DNA, 25 bp, Mus musculus
cctgggatggctgaactccttcttg

SEQ ID NO: 601149 - DNA, 25 bp, Mus musculus
cctgggatggctgtacatcgggctc

SEQ ID NO: 601150 - DNA, 25 bp, Mus musculus
cctgggattgtaaacctggagtgta

SEQ ID NO: 601151 - DNA, 25 bp, Mus musculus
cctgggattgtatacctggagtgta

SEQ ID NO: 601152 - DNA, 25 bp, Mus musculus
cctgggcaaaggacctacttgagcc

SEQ ID NO: 601153 - DNA, 25 bp, Mus musculus
cctgggcaaaggtcctacttgagcc

SEQ ID NO: 601154 - DNA, 25 bp, Mus musculus
cctgggcaaggccttgaaccccttg

SEQ ID NO: 601155 - DNA, 25 bp, Mus musculus
cctgggcaaggcgttgaaccccttg

SEQ ID NO: 601156 - DNA, 25 bp, Mus musculus
cctgggcaagggacgttacaagata

SEQ ID NO: 601157 - DNA, 25 bp, Mus musculus
cctgggcaagggtcgttacaagata

SEQ ID NO: 601158 - DNA, 25 bp, Mus musculus
cctgggcaatatcatcgtgattgtg

SEQ ID NO: 601159 - DNA, 25 bp, Mus musculus
cctgggcaatatgatcgtgattgtg

SEQ ID NO: 601160 - DNA, 25 bp, Mus musculus
cctgggcaccagataatgaacactt

SEQ ID NO: 601161 - DNA, 25 bp, Mus musculus
cctgggcaccagttaatgaacactt

SEQ ID NO: 601162 - DNA, 25 bp, Mus musculus
cctgggcactgtcaatgaataagcc

SEQ ID NO: 601163 - DNA, 25 bp, Mus musculus
cctgggcactgtgaatgaataagcc

SEQ ID NO: 601164 - DNA, 25 bp, Mus musculus
cctgggcagagaagaaagaatcagc

SEQ ID NO: 601165 - DNA, 25 bp, Mus musculus
cctgggcagagatgaaagaatcagc

SEQ ID NO: 601166 - DNA, 25 bp, Mus musculus
cctgggcagcgtatcccagtttgag

SEQ ID NO: 601167 - DNA, 25 bp, Mus musculus
cctgggcagcgtttcccagtttgag

SEQ ID NO: 601168 - DNA, 25 bp, Mus musculus
cctgggcagtggagtaagaccttgt

SEQ ID NO: 601169 - DNA, 25 bp, Mus musculus
cctgggcagtggtgtaagaccttgt

SEQ ID NO: 601170 - DNA, 25 bp, Mus musculus
cctgggcatcctagaagtgactgtc

SEQ ID NO: 601171 - DNA, 25 bp, Mus musculus
cctgggcatccttgaagtgactgtc

SEQ ID NO: 601172 - DNA, 25 bp, Mus musculus
cctgggcatcgcctggagtgacaca

SEQ ID NO: 601173 - DNA, 25 bp, Mus musculus
cctgggcatcgcgtggagtgacaca

SEQ ID NO: 601174 - DNA, 25 bp, Mus musculus
cctgggcatctacaagcagggcctt

SEQ ID NO: 601175 - DNA, 25 bp, Mus musculus
cctgggcatctagaagcagggcctt

SEQ ID NO: 601176 - DNA, 25 bp, Mus musculus
cctgggcatctgctatgatatgcgc

SEQ ID NO: 601177 - DNA, 25 bp, Mus musculus
cctgggcatctggtatgatatgcgc

SEQ ID NO: 601178 - DNA, 25 bp, Mus musculus
cctgggcatgatctacaccgtggga

SEQ ID NO: 601179 - DNA, 25 bp, Mus musculus
cctgggcatgatgtacaccgtggga

SEQ ID NO: 601180 - DNA, 25 bp, Mus musculus
cctgggcatggtcatgttcttctgg

SEQ ID NO: 601181 - DNA, 25 bp, Mus musculus
cctgggcatggtgatgttcttctgg

SEQ ID NO: 601182 - DNA, 25 bp, Mus musculus
cctgggccaaggaacacaatggtgt

SEQ ID NO: 601183 - DNA, 25 bp, Mus musculus
cctgggccaaggtacacaatggtgt

SEQ ID NO: 601184 - DNA, 25 bp, Mus musculus
cctgggccagcaactgactacctgt

SEQ ID NO: 601185 - DNA, 25 bp, Mus musculus
cctgggccagcatctgactacctgt

SEQ ID NO: 601186 - DNA, 25 bp, Mus musculus
cctgggccaggactgatctcaccgt

SEQ ID NO: 601187 - DNA, 25 bp, Mus musculus
cctgggccaggagtgatctcaccgt

SEQ ID NO: 601188 - DNA, 25 bp, Mus musculus
cctgggcccctaagaggtccttggg

SEQ ID NO: 601189 - DNA, 25 bp, Mus musculus
cctgggcccctatgaggtccttggg

SEQ ID NO: 601190 - DNA, 25 bp, Mus musculus
cctgggccccttactacagaggagg

SEQ ID NO: 601191 - DNA, 25 bp, Mus musculus
cctgggcccctttctacagaggagg

SEQ ID NO: 601192 - DNA, 25 bp, Mus musculus
cctgggccctggaaagttcaagtgc

SEQ ID NO: 601193 - DNA, 25 bp, Mus musculus
cctgggccctggatgaagtacagct

SEQ ID NO: 601194 - DNA, 25 bp, Mus musculus
cctgggccctggtaagttcaagtgc

SEQ ID NO: 601195 - DNA, 25 bp, Mus musculus
cctgggccctggttgaagtacagct

SEQ ID NO: 601196 - DNA, 25 bp, Mus musculus
cctgggccggtaagcctatgtccgt

SEQ ID NO: 601197 - DNA, 25 bp, Mus musculus
cctgggccggtatgcctatgtccgt

SEQ ID NO: 601198 - DNA, 25 bp, Mus musculus
cctgggccgtgcagccatcaaactt

SEQ ID NO: 601199 - DNA, 25 bp, Mus musculus
cctgggccgtgctgccatcaaactt

SEQ ID NO: 601200 - DNA, 25 bp, Mus musculus
cctgggcctgaaacgctcagattac

SEQ ID NO: 601201 - DNA, 25 bp, Mus musculus
cctgggcctgaatcgctcagattac

SEQ ID NO: 601202 - DNA, 25 bp, Mus musculus
cctgggcgaaaaccataagcgtagc

SEQ ID NO: 601203 - DNA, 25 bp, Mus musculus
cctgggcgaaaagcataagcgtagc

SEQ ID NO: 601204 - DNA, 25 bp, Mus musculus
cctgggcgcagcagtttcgtctgct

SEQ ID NO: 601205 - DNA, 25 bp, Mus musculus
cctgggcgcagctgtttcgtctgct

SEQ ID NO: 601206 - DNA, 25 bp, Mus musculus
cctgggcgggagatccatggagact

SEQ ID NO: 601207 - DNA, 25 bp, Mus musculus
cctgggcgggagttccatggagact

SEQ ID NO: 601208 - DNA, 25 bp, Mus musculus
cctgggcgttaacccgcgcgtcaat

SEQ ID NO: 601209 - DNA, 25 bp, Mus musculus
cctgggcgttaagccgcgcgtcaat

SEQ ID NO: 601210 - DNA, 25 bp, Mus musculus
cctgggctacgacacttgtggccga

SEQ ID NO: 601211 - DNA, 25 bp, Mus musculus
cctgggctacgagacttgtggccga

SEQ ID NO: 601212 - DNA, 25 bp, Mus musculus
cctgggctatcacagaacttgctat

SEQ ID NO: 601213 - DNA, 25 bp, Mus musculus
cctgggctatcagagaacttgctat

SEQ ID NO: 601214 - DNA, 25 bp, Mus musculus
cctgggctcatcaaggcctcgtgtg

SEQ ID NO: 601215 - DNA, 25 bp, Mus musculus
cctgggctcatctaggcctcgtgtg

SEQ ID NO: 601216 - DNA, 25 bp, Mus musculus
cctgggctccttaggctgcaagaat

SEQ ID NO: 601217 - DNA, 25 bp, Mus musculus
cctgggctccttcggacactaggtc

SEQ ID NO: 601218 - DNA, 25 bp, Mus musculus
cctgggctccttgggacactaggtc

SEQ ID NO: 601219 - DNA, 25 bp, Mus musculus
cctgggctcctttggctgcaagaat

SEQ ID NO: 601220 - DNA, 25 bp, Mus musculus
cctgggctctgtaggtctagttcta

SEQ ID NO: 601221 - DNA, 25 bp, Mus musculus
cctgggctctgttggtctagttcta

SEQ ID NO: 601222 - DNA, 25 bp, Mus musculus
cctgggctgcatagttagtgttaat

SEQ ID NO: 601223 - DNA, 25 bp, Mus musculus
cctgggctgcattgttagtgttaat

SEQ ID NO: 601224 - DNA, 25 bp, Mus musculus
cctgggctgctgagccactttcaag

SEQ ID NO: 601225 - DNA, 25 bp, Mus musculus
cctgggctgctgtgccactttcaag

SEQ ID NO: 601226 - DNA, 25 bp, Mus musculus
cctgggctggaacatttacgcttcg

SEQ ID NO: 601227 - DNA, 25 bp, Mus musculus
cctgggctggaagatttacgcttcg

SEQ ID NO: 601228 - DNA, 25 bp, Mus musculus
cctgggctggccctgatcatgacaa

SEQ ID NO: 601229 - DNA, 25 bp, Mus musculus
cctgggctggccgtgatcatgacaa

SEQ ID NO: 601230 - DNA, 25 bp, Mus musculus
cctgggctgtatcggtgctgtcaat

SEQ ID NO: 601231 - DNA, 25 bp, Mus musculus
cctgggctgtatgggtgctgtcaat

SEQ ID NO: 601232 - DNA, 25 bp, Mus musculus
cctgggctgtgaacgattaggctgc

SEQ ID NO: 601233 - DNA, 25 bp, Mus musculus
cctgggctgtgatcgattaggctgc

SEQ ID NO: 601234 - DNA, 25 bp, Mus musculus
cctgggcttcatcgcacaagagcaa

SEQ ID NO: 601235 - DNA, 25 bp, Mus musculus
cctgggcttcatggcacaagagcaa

SEQ ID NO: 601236 - DNA, 25 bp, Mus musculus
cctgggcttcctccaacagagatac

SEQ ID NO: 601237 - DNA, 25 bp, Mus musculus
cctgggcttcctgcaacagagatac

SEQ ID NO: 601238 - DNA, 25 bp, Mus musculus
cctgggcttgaacagtatgctatta

SEQ ID NO: 601239 - DNA, 25 bp, Mus musculus
cctgggcttgaagagtatgctatta

SEQ ID NO: 601240 - DNA, 25 bp, Mus musculus
cctgggcttggtagagaaccagagt

SEQ ID NO: 601241 - DNA, 25 bp, Mus musculus
cctgggcttggttgagaaccagagt

SEQ ID NO: 601242 - DNA, 25 bp, Mus musculus
cctgggctttacatctaactgctgc

SEQ ID NO: 601243 - DNA, 25 bp, Mus musculus
cctgggctttacttctaactgctgc

SEQ ID NO: 601244 - DNA, 25 bp, Mus musculus
cctgggctttcgctttgatgtggca

SEQ ID NO: 601245 - DNA, 25 bp, Mus musculus
cctgggctttcggtttgatgtggca

SEQ ID NO: 601246 - DNA, 25 bp, Mus musculus
cctgggggcctgactccgtaagatg

SEQ ID NO: 601247 - DNA, 25 bp, Mus musculus
cctgggggcctgtctccgtaagatg

SEQ ID NO: 601248 - DNA, 25 bp, Mus musculus
cctgggggctggagccctactccaa

SEQ ID NO: 601249 - DNA, 25 bp, Mus musculus
cctgggggctggtgccctactccaa

SEQ ID NO: 601250 - DNA, 25 bp, Mus musculus
cctgggtaatgaaggtgtgctgttt

SEQ ID NO: 601251 - DNA, 25 bp, Mus musculus
cctgggtaatgatggtgtgctgttt

SEQ ID NO: 601252 - DNA, 25 bp, Mus musculus
cctgggtacagaagtgacagggaca

SEQ ID NO: 601253 - DNA, 25 bp, Mus musculus
cctgggtacagacagaccactggtt

SEQ ID NO: 601254 - DNA, 25 bp, Mus musculus
cctgggtacagagagaccactggtt

SEQ ID NO: 601255 - DNA, 25 bp, Mus musculus
cctgggtacagatgtgacagggaca

SEQ ID NO: 601256 - DNA, 25 bp, Mus musculus
cctgggtacagcaattcatcctcaa

SEQ ID NO: 601257 - DNA, 25 bp, Mus musculus
cctgggtacagctattcatcctcaa

SEQ ID NO: 601258 - DNA, 25 bp, Mus musculus
cctgggtaccaacaaaaggctctag

SEQ ID NO: 601259 - DNA, 25 bp, Mus musculus
cctgggtaccaagaaaaggctctag

SEQ ID NO: 601260 - DNA, 25 bp, Mus musculus
cctgggtaccgactgagagaaatca

SEQ ID NO: 601261 - DNA, 25 bp, Mus musculus
cctgggtaccgagtgagagaaatca

SEQ ID NO: 601262 - DNA, 25 bp, Mus musculus
cctgggtactgtaggttcactgtgg

SEQ ID NO: 601263 - DNA, 25 bp, Mus musculus
cctgggtactgttggttcactgtgg

SEQ ID NO: 601264 - DNA, 25 bp, Mus musculus
cctgggtatcaacgtaccaggaagt

SEQ ID NO: 601265 - DNA, 25 bp, Mus musculus
cctgggtatcaaggtaccaggaagt

SEQ ID NO: 601266 - DNA, 25 bp, Mus musculus
cctgggtatccgcaactcttaagcg

SEQ ID NO: 601267 - DNA, 25 bp, Mus musculus
cctgggtatccggaactcttaagcg

SEQ ID NO: 601268 - DNA, 25 bp, Mus musculus
cctgggtatcctcctcttcgagctg

SEQ ID NO: 601269 - DNA, 25 bp, Mus musculus
cctgggtatcctgctcttcgagctg

SEQ ID NO: 601270 - DNA, 25 bp, Mus musculus
cctgggtcacagaaacttgtcacat

SEQ ID NO: 601271 - DNA, 25 bp, Mus musculus
cctgggtcacagtaacttgtcacat

SEQ ID NO: 601272 - DNA, 25 bp, Mus musculus
cctgggtccccgagtatctgtatgt

SEQ ID NO: 601273 - DNA, 25 bp, Mus musculus
cctgggtccccgtgtatctgtatgt

SEQ ID NO: 601274 - DNA, 25 bp, Mus musculus
cctgggtccggacagttctgctgat

SEQ ID NO: 601275 - DNA, 25 bp, Mus musculus
cctgggtccggagagttctgctgat

SEQ ID NO: 601276 - DNA, 25 bp, Mus musculus
cctgggtctcacaggctacgggatc

SEQ ID NO: 601277 - DNA, 25 bp, Mus musculus
cctgggtctcactggctacgggatc

SEQ ID NO: 601278 - DNA, 25 bp, Mus musculus
cctgggtctggaaagtaggtcttag

SEQ ID NO: 601279 - DNA, 25 bp, Mus musculus
cctgggtctggatagtaggtcttag

SEQ ID NO: 601280 - DNA, 25 bp, Mus musculus
cctgggtctgtacctagggagctac

SEQ ID NO: 601281 - DNA, 25 bp, Mus musculus
cctgggtctgtagctagggagctac

SEQ ID NO: 601282 - DNA, 25 bp, Mus musculus
cctgggtctttgacatagctggtgc

SEQ ID NO: 601283 - DNA, 25 bp, Mus musculus
cctgggtctttgtcatagctggtgc

SEQ ID NO: 601284 - DNA, 25 bp, Mus musculus
cctgggtgacaaaggagtcataacc

SEQ ID NO: 601285 - DNA, 25 bp, Mus musculus
cctgggtgacaatggagtcataacc

SEQ ID NO: 601286 - DNA, 25 bp, Mus musculus
cctgggtgaggccttgaagttgagg

SEQ ID NO: 601287 - DNA, 25 bp, Mus musculus
cctgggtgaggcgttgaagttgagg

SEQ ID NO: 601288 - DNA, 25 bp, Mus musculus
cctgggtgagtaatcttttgaggaa

SEQ ID NO: 601289 - DNA, 25 bp, Mus musculus
cctgggtgagtattcttttgaggaa

SEQ ID NO: 601290 - DNA, 25 bp, Mus musculus
cctgggtgagtgcaagccacacaga

SEQ ID NO: 601291 - DNA, 25 bp, Mus musculus
cctgggtgagtggaagccacacaga

SEQ ID NO: 601292 - DNA, 25 bp, Mus musculus
cctgggtgatcaatggcgagacagt

SEQ ID NO: 601293 - DNA, 25 bp, Mus musculus
cctgggtgatcattggcgagacagt

SEQ ID NO: 601294 - DNA, 25 bp, Mus musculus
cctgggtgatccattctgatggcga

SEQ ID NO: 601295 - DNA, 25 bp, Mus musculus
cctgggtgatcctttctgatggcga

SEQ ID NO: 601296 - DNA, 25 bp, Mus musculus
cctgggtgcactccatggacagtcc

SEQ ID NO: 601297 - DNA, 25 bp, Mus musculus
cctgggtgcactgcatggacagtcc

SEQ ID NO: 601298 - DNA, 25 bp, Mus musculus
cctgggtgcctcaccaaattataaa

SEQ ID NO: 601299 - DNA, 25 bp, Mus musculus
cctgggtgcctctccaaattataaa

SEQ ID NO: 601300 - DNA, 25 bp, Mus musculus
cctgggtgctgcaagcctgcagcca

SEQ ID NO: 601301 - DNA, 25 bp, Mus musculus
cctgggtgctgcagggcccctgaaa

SEQ ID NO: 601302 - DNA, 25 bp, Mus musculus
cctgggtgctgctagcctgcagcca

SEQ ID NO: 601303 - DNA, 25 bp, Mus musculus
cctgggtgctgctgggcccctgaaa

SEQ ID NO: 601304 - DNA, 25 bp, Mus musculus
cctgggtgctgtcatcctgggcttc

SEQ ID NO: 601305 - DNA, 25 bp, Mus musculus
cctgggtgctgtgatcctgggcttc

SEQ ID NO: 601306 - DNA, 25 bp, Mus musculus
cctgggtggcctatcaccagtatta

SEQ ID NO: 601307 - DNA, 25 bp, Mus musculus
cctgggtggcctttcaccagtatta

SEQ ID NO: 601308 - DNA, 25 bp, Mus musculus
cctgggtggtaacatcgtgtgcaaa

SEQ ID NO: 601309 - DNA, 25 bp, Mus musculus
cctgggtggtaagatcgtgtgcaaa

SEQ ID NO: 601310 - DNA, 25 bp, Mus musculus
cctgggtggtccaaggtatgcatct

SEQ ID NO: 601311 - DNA, 25 bp, Mus musculus
cctgggtggtcctaggtatgcatct

SEQ ID NO: 601312 - DNA, 25 bp, Mus musculus
cctgggtgtagcacatttggagcct

SEQ ID NO: 601313 - DNA, 25 bp, Mus musculus
cctgggtgtagctcatttggagcct

SEQ ID NO: 601314 - DNA, 25 bp, Mus musculus
cctgggttagccaagagagacagag

SEQ ID NO: 601315 - DNA, 25 bp, Mus musculus
cctgggttagcctagagagacagag

SEQ ID NO: 601316 - DNA, 25 bp, Mus musculus
cctgggttgagaccatggctagact

SEQ ID NO: 601317 - DNA, 25 bp, Mus musculus
cctgggttgagagcatggctagact

SEQ ID NO: 601318 - DNA, 25 bp, Mus musculus
cctgggttggagatgtctttaccac

SEQ ID NO: 601319 - DNA, 25 bp, Mus musculus
cctgggttggagttgtctttaccac

SEQ ID NO: 601320 - DNA, 25 bp, Mus musculus
cctgggttttgtctatggttgctac

SEQ ID NO: 601321 - DNA, 25 bp, Mus musculus
cctgggttttgtgtatggttgctac

SEQ ID NO: 601322 - DNA, 25 bp, Mus musculus
cctggtaaaccaccacacttggagt

SEQ ID NO: 601323 - DNA, 25 bp, Mus musculus
cctggtaaaccagcacacttggagt

SEQ ID NO: 601324 - DNA, 25 bp, Mus musculus
cctggtaaccgacgaggctgcaact

SEQ ID NO: 601325 - DNA, 25 bp, Mus musculus
cctggtaaccgaggaggctgcaact

SEQ ID NO: 601326 - DNA, 25 bp, Mus musculus
cctggtaaccgcctcaagattctgg

SEQ ID NO: 601327 - DNA, 25 bp, Mus musculus
cctggtaaccgcgtcaagattctgg

SEQ ID NO: 601328 - DNA, 25 bp, Mus musculus
cctggtaatcctcatgctggcccga

SEQ ID NO: 601329 - DNA, 25 bp, Mus musculus
cctggtaatcctgatgctggcccga

SEQ ID NO: 601330 - DNA, 25 bp, Mus musculus
cctggtacacgacgcaggcagtcct

SEQ ID NO: 601331 - DNA, 25 bp, Mus musculus
cctggtacacgaggcaggcagtcct

SEQ ID NO: 601332 - DNA, 25 bp, Mus musculus
cctggtacaggcagctccagggcag

SEQ ID NO: 601333 - DNA, 25 bp, Mus musculus
cctggtacaggctgctccagggcag

SEQ ID NO: 601334 - DNA, 25 bp, Mus musculus
cctggtacttccattgcttcagagg

SEQ ID NO: 601335 - DNA, 25 bp, Mus musculus
cctggtacttcctttgcttcagagg

SEQ ID NO: 601336 - DNA, 25 bp, Mus musculus
cctggtagaccacctgcggatgctg

SEQ ID NO: 601337 - DNA, 25 bp, Mus musculus
cctggtagaccagctgcggatgctg

SEQ ID NO: 601338 - DNA, 25 bp, Mus musculus
cctggtagaggacatgtatgccgct

SEQ ID NO: 601339 - DNA, 25 bp, Mus musculus
cctggtagaggagatgtatgccgct

SEQ ID NO: 601340 - DNA, 25 bp, Mus musculus
cctggtagatctcgcaggctcagag

SEQ ID NO: 601341 - DNA, 25 bp, Mus musculus
cctggtagatctggcaggctcagag

SEQ ID NO: 601342 - DNA, 25 bp, Mus musculus
cctggtagatgaatttggccggatc

SEQ ID NO: 601343 - DNA, 25 bp, Mus musculus
cctggtagatgattttggccggatc

SEQ ID NO: 601344 - DNA, 25 bp, Mus musculus
cctggtagatgcagacaagaagatg

SEQ ID NO: 601345 - DNA, 25 bp, Mus musculus
cctggtagatgctgacaagaagatg

SEQ ID NO: 601346 - DNA, 25 bp, Mus musculus
cctggtaggatgcacctgaatcagc

SEQ ID NO: 601347 - DNA, 25 bp, Mus musculus
cctggtaggatggacctgaatcagc

SEQ ID NO: 601348 - DNA, 25 bp, Mus musculus
cctggtatgaagatcgtcgagtgcc

SEQ ID NO: 601349 - DNA, 25 bp, Mus musculus
cctggtatgaagttcgtcgagtgcc

SEQ ID NO: 601350 - DNA, 25 bp, Mus musculus
cctggtatgattcgcagccttcctg

SEQ ID NO: 601351 - DNA, 25 bp, Mus musculus
cctggtatgattggcagccttcctg

SEQ ID NO: 601352 - DNA, 25 bp, Mus musculus
cctggtatgcataagattaaatgtc

SEQ ID NO: 601353 - DNA, 25 bp, Mus musculus
cctggtatgcattagattaaatgtc

SEQ ID NO: 601354 - DNA, 25 bp, Mus musculus
cctggtattaatcctgaagtaagaa

SEQ ID NO: 601355 - DNA, 25 bp, Mus musculus
cctggtattaatgctgaagtaagaa

SEQ ID NO: 601356 - DNA, 25 bp, Mus musculus
cctggtattgggaaagtggatatca

SEQ ID NO: 601357 - DNA, 25 bp, Mus musculus
cctggtattgggtaagtggatatca

SEQ ID NO: 601358 - DNA, 25 bp, Mus musculus
cctggtcaaactagaattctccttc

SEQ ID NO: 601359 - DNA, 25 bp, Mus musculus
cctggtcaaacttgaattctccttc

SEQ ID NO: 601360 - DNA, 25 bp, Mus musculus
cctggtcaagacaaattcacgtttg

SEQ ID NO: 601361 - DNA, 25 bp, Mus musculus
cctggtcaagactaattcacgtttg

SEQ ID NO: 601362 - DNA, 25 bp, Mus musculus
cctggtcaagatagtgcccgtgttc

SEQ ID NO: 601363 - DNA, 25 bp, Mus musculus
cctggtcaagattgtgcccgtgttc

SEQ ID NO: 601364 - DNA, 25 bp, Mus musculus
cctggtcacagtctcctgagttgca

SEQ ID NO: 601365 - DNA, 25 bp, Mus musculus
cctggtcacagtgtcctgagttgca

SEQ ID NO: 601366 - DNA, 25 bp, Mus musculus
cctggtcaccttctacgagagagat

SEQ ID NO: 601367 - DNA, 25 bp, Mus musculus
cctggtcaccttctgcttgggggaa

SEQ ID NO: 601368 - DNA, 25 bp, Mus musculus
cctggtcaccttgtacgagagagat

SEQ ID NO: 601369 - DNA, 25 bp, Mus musculus
cctggtcaccttgtgcttgggggaa

SEQ ID NO: 601370 - DNA, 25 bp, Mus musculus
cctggtcacttcatggagcctcctg

SEQ ID NO: 601371 - DNA, 25 bp, Mus musculus
cctggtcacttcttggagcctcctg

SEQ ID NO: 601372 - DNA, 25 bp, Mus musculus
cctggtcagacacgacctcgaggag

SEQ ID NO: 601373 - DNA, 25 bp, Mus musculus
cctggtcagacaggacctcgaggag

SEQ ID NO: 601374 - DNA, 25 bp, Mus musculus
cctggtcagcatacgcggtgtggac

SEQ ID NO: 601375 - DNA, 25 bp, Mus musculus
cctggtcagcattcgcggtgtggac

SEQ ID NO: 601376 - DNA, 25 bp, Mus musculus
cctggtcaggacattagttctagtc

SEQ ID NO: 601377 - DNA, 25 bp, Mus musculus
cctggtcaggactttagttctagtc

SEQ ID NO: 601378 - DNA, 25 bp, Mus musculus
cctggtcaggatcgcttgttgttac

SEQ ID NO: 601379 - DNA, 25 bp, Mus musculus
cctggtcaggatggcttgttgttac

SEQ ID NO: 601380 - DNA, 25 bp, Mus musculus
cctggtcatagaagaagctgatcgc

SEQ ID NO: 601381 - DNA, 25 bp, Mus musculus
cctggtcatagatgaagctgatcgc

SEQ ID NO: 601382 - DNA, 25 bp, Mus musculus
cctggtccaagaaatcctcgataag

SEQ ID NO: 601383 - DNA, 25 bp, Mus musculus
cctggtccaagatatcctcgataag

SEQ ID NO: 601384 - DNA, 25 bp, Mus musculus
cctggtccaaggcatgctgtagata

SEQ ID NO: 601385 - DNA, 25 bp, Mus musculus
cctggtccaagggatgctgtagata

SEQ ID NO: 601386 - DNA, 25 bp, Mus musculus
cctggtcccatacgcacagaacgat

SEQ ID NO: 601387 - DNA, 25 bp, Mus musculus
cctggtcccataggcacagaacgat

SEQ ID NO: 601388 - DNA, 25 bp, Mus musculus
cctggtccctataattggcctacaa

SEQ ID NO: 601389 - DNA, 25 bp, Mus musculus
cctggtccctattattggcctacaa

SEQ ID NO: 601390 - DNA, 25 bp, Mus musculus
cctggtccctggctggtatgccaac

SEQ ID NO: 601391 - DNA, 25 bp, Mus musculus
cctggtccctgggtggtatgccaac

SEQ ID NO: 601392 - DNA, 25 bp, Mus musculus
cctggtccggacctctctggatgtc

SEQ ID NO: 601393 - DNA, 25 bp, Mus musculus
cctggtccggacgtctctggatgtc

SEQ ID NO: 601394 - DNA, 25 bp, Mus musculus
cctggtcctgggacttttgtggcaa

SEQ ID NO: 601395 - DNA, 25 bp, Mus musculus
cctggtcctgggtcttttgtggcaa

SEQ ID NO: 601396 - DNA, 25 bp, Mus musculus
cctggtcctgtactctatgagtagt

SEQ ID NO: 601397 - DNA, 25 bp, Mus musculus
cctggtcctgtagtctatgagtagt

SEQ ID NO: 601398 - DNA, 25 bp, Mus musculus
cctggtcggactattgcacgatctg

SEQ ID NO: 601399 - DNA, 25 bp, Mus musculus
cctggtcggacttttgcacgatctg

SEQ ID NO: 601400 - DNA, 25 bp, Mus musculus
cctggtcggctcagggagttagtta

SEQ ID NO: 601401 - DNA, 25 bp, Mus musculus
cctggtcggctctgggagttagtta

SEQ ID NO: 601402 - DNA, 25 bp, Mus musculus
cctggtctacctctgcgtggaggac

SEQ ID NO: 601403 - DNA, 25 bp, Mus musculus
cctggtctacctgtgcgtggaggac

SEQ ID NO: 601404 - DNA, 25 bp, Mus musculus
cctggtctatcgacccgatgtggac

SEQ ID NO: 601405 - DNA, 25 bp, Mus musculus
cctggtctatcgtcccgatgtggac

SEQ ID NO: 601406 - DNA, 25 bp, Mus musculus
cctggtctcaatcgcgcagtcaggg

SEQ ID NO: 601407 - DNA, 25 bp, Mus musculus
cctggtctcaatggcgcagtcaggg

SEQ ID NO: 601408 - DNA, 25 bp, Mus musculus
cctggtctgcaacatctctggtgac

SEQ ID NO: 601409 - DNA, 25 bp, Mus musculus
cctggtctgcaagatctctggtgac

SEQ ID NO: 601410 - DNA, 25 bp, Mus musculus
cctggtctgtacaggtgttgttaac

SEQ ID NO: 601411 - DNA, 25 bp, Mus musculus
cctggtctgtactggtgttgttaac

SEQ ID NO: 601412 - DNA, 25 bp, Mus musculus
cctggtcttctgagtgttttgctgc

SEQ ID NO: 601413 - DNA, 25 bp, Mus musculus
cctggtcttctgtgtgttttgctgc

SEQ ID NO: 601414 - DNA, 25 bp, Mus musculus
cctggtgaaatgctaggctgcttca

SEQ ID NO: 601415 - DNA, 25 bp, Mus musculus
cctggtgaaatggtaggctgcttca

SEQ ID NO: 601416 - DNA, 25 bp, Mus musculus
cctggtgaagataccaacaactgag

SEQ ID NO: 601417 - DNA, 25 bp, Mus musculus
cctggtgaagattccaacaactgag

SEQ ID NO: 601418 - DNA, 25 bp, Mus musculus
cctggtgaagccatatgtcaatgag

SEQ ID NO: 601419 - DNA, 25 bp, Mus musculus
cctggtgaagccttatgtcaatgag

SEQ ID NO: 601420 - DNA, 25 bp, Mus musculus
cctggtgaatatctcctttctgtat

SEQ ID NO: 601421 - DNA, 25 bp, Mus musculus
cctggtgaatatgtcctttctgtat

SEQ ID NO: 601422 - DNA, 25 bp, Mus musculus
cctggtgaatgcaatcatcaacagt

SEQ ID NO: 601423 - DNA, 25 bp, Mus musculus
cctggtgaatgcaccatataagcgg

SEQ ID NO: 601424 - DNA, 25 bp, Mus musculus
cctggtgaatgctatcatcaacagt

SEQ ID NO: 601425 - DNA, 25 bp, Mus musculus
cctggtgaatgctccatataagcgg

SEQ ID NO: 601426 - DNA, 25 bp, Mus musculus
cctggtgacaagcaagaacctgtgt

SEQ ID NO: 601427 - DNA, 25 bp, Mus musculus
cctggtgacaaggaagaacctgtgt

SEQ ID NO: 601428 - DNA, 25 bp, Mus musculus
cctggtgaccataaatcgttctgct

SEQ ID NO: 601429 - DNA, 25 bp, Mus musculus
cctggtgaccattaatcgttctgct

SEQ ID NO: 601430 - DNA, 25 bp, Mus musculus
cctggtgaccgacgataacgtaatg

SEQ ID NO: 601431 - DNA, 25 bp, Mus musculus
cctggtgaccgaggataacgtaatg

SEQ ID NO: 601432 - DNA, 25 bp, Mus musculus
cctggtgactcaccagctgtccaag

SEQ ID NO: 601433 - DNA, 25 bp, Mus musculus
cctggtgactcagcagctgtccaag

SEQ ID NO: 601434 - DNA, 25 bp, Mus musculus
cctggtgagcgtcgtgtccctgttc

SEQ ID NO: 601435 - DNA, 25 bp, Mus musculus
cctggtgagcgtggtgtccctgttc

SEQ ID NO: 601436 - DNA, 25 bp, Mus musculus
cctggtgaggcactttggacagcaa

SEQ ID NO: 601437 - DNA, 25 bp, Mus musculus
cctggtgaggcagtttggacagcaa

SEQ ID NO: 601438 - DNA, 25 bp, Mus musculus
cctggtgatatactggaaattgctg

SEQ ID NO: 601439 - DNA, 25 bp, Mus musculus
cctggtgatatagtggaaattgctg

SEQ ID NO: 601440 - DNA, 25 bp, Mus musculus
cctggtgatcgaaacactgaaggaa

SEQ ID NO: 601441 - DNA, 25 bp, Mus musculus
cctggtgatcgatacactgaaggaa

SEQ ID NO: 601442 - DNA, 25 bp, Mus musculus
cctggtgatgaaccccagcctgaag

SEQ ID NO: 601443 - DNA, 25 bp, Mus musculus
cctggtgatgaagcccagcctgaag

SEQ ID NO: 601444 - DNA, 25 bp, Mus musculus
cctggtgattctatgctgtggtttc

SEQ ID NO: 601445 - DNA, 25 bp, Mus musculus
cctggtgattctttgctgtggtttc

SEQ ID NO: 601446 - DNA, 25 bp, Mus musculus
cctggtgcaagcacagtactggcat

SEQ ID NO: 601447 - DNA, 25 bp, Mus musculus
cctggtgcaagctcagtactggcat

SEQ ID NO: 601448 - DNA, 25 bp, Mus musculus
cctggtgcaccgagtggcaatcgtc

SEQ ID NO: 601449 - DNA, 25 bp, Mus musculus
cctggtgcaccgtgtggcaatcgtc

SEQ ID NO: 601450 - DNA, 25 bp, Mus musculus
cctggtgcagagactcagcagaagt

SEQ ID NO: 601451 - DNA, 25 bp, Mus musculus
cctggtgcagagtctcagcagaagt

SEQ ID NO: 601452 - DNA, 25 bp, Mus musculus
cctggtgccatgaccttctccgaga

SEQ ID NO: 601453 - DNA, 25 bp, Mus musculus
cctggtgccatgtccttctccgaga

SEQ ID NO: 601454 - DNA, 25 bp, Mus musculus
cctggtgcgaagaactgggagaaat

SEQ ID NO: 601455 - DNA, 25 bp, Mus musculus
cctggtgcgaagtactgggagaaat

SEQ ID NO: 601456 - DNA, 25 bp, Mus musculus
cctggtgcgagaaggtcggcatcca

SEQ ID NO: 601457 - DNA, 25 bp, Mus musculus
cctggtgcgagatggtcggcatcca

SEQ ID NO: 601458 - DNA, 25 bp, Mus musculus
cctggtgctctcagagccaagtagc

SEQ ID NO: 601459 - DNA, 25 bp, Mus musculus
cctggtgctctctgagccaagtagc

SEQ ID NO: 601460 - DNA, 25 bp, Mus musculus
cctggtgctgaacccagttaaacgg

SEQ ID NO: 601461 - DNA, 25 bp, Mus musculus
cctggtgctgaagccagttaaacgg

SEQ ID NO: 601462 - DNA, 25 bp, Mus musculus
cctggtgcttgaaaggaacttggca

SEQ ID NO: 601463 - DNA, 25 bp, Mus musculus
cctggtgcttgataggaacttggca

SEQ ID NO: 601464 - DNA, 25 bp, Mus musculus
cctggtggaacgatacgtgcacgac

SEQ ID NO: 601465 - DNA, 25 bp, Mus musculus
cctggtggaacgttacgtgcacgac

SEQ ID NO: 601466 - DNA, 25 bp, Mus musculus
cctggtggaagaaatcaggaaaagg

SEQ ID NO: 601467 - DNA, 25 bp, Mus musculus
cctggtggaagatatcaggaaaagg

SEQ ID NO: 601468 - DNA, 25 bp, Mus musculus
cctggtggaccgactggagaccatg

SEQ ID NO: 601469 - DNA, 25 bp, Mus musculus
cctggtggaccgcagtctgagaaat

SEQ ID NO: 601470 - DNA, 25 bp, Mus musculus
cctggtggaccggagtctgagaaat

SEQ ID NO: 601471 - DNA, 25 bp, Mus musculus
cctggtggaccgtctggagaccatg

SEQ ID NO: 601472 - DNA, 25 bp, Mus musculus
cctggtggactcagagaaggatgca

SEQ ID NO: 601473 - DNA, 25 bp, Mus musculus
cctggtggactctgagaaggatgca

SEQ ID NO: 601474 - DNA, 25 bp, Mus musculus
cctggtggagaccacagtgagctca

SEQ ID NO: 601475 - DNA, 25 bp, Mus musculus
cctggtggagacgacagtgagctca

SEQ ID NO: 601476 - DNA, 25 bp, Mus musculus
cctggtggagctcagcggcgggacc

SEQ ID NO: 601477 - DNA, 25 bp, Mus musculus
cctggtggagctgagcggcgggacc

SEQ ID NO: 601478 - DNA, 25 bp, Mus musculus
cctggtggaggtcttaaccaagaga

SEQ ID NO: 601479 - DNA, 25 bp, Mus musculus
cctggtggaggtgttaaccaagaga

SEQ ID NO: 601480 - DNA, 25 bp, Mus musculus
cctggtggatctcaatgcatttgaa

SEQ ID NO: 601481 - DNA, 25 bp, Mus musculus
cctggtggatctgaatgcatttgaa

SEQ ID NO: 601482 - DNA, 25 bp, Mus musculus
cctggtggatttcgacatggtcctg

SEQ ID NO: 601483 - DNA, 25 bp, Mus musculus
cctggtggatttggacatggtcctg

SEQ ID NO: 601484 - DNA, 25 bp, Mus musculus
cctggtggcaggaccagctgacgtc

SEQ ID NO: 601485 - DNA, 25 bp, Mus musculus
cctggtggcaggtccagctgacgtc

SEQ ID NO: 601486 - DNA, 25 bp, Mus musculus
cctggtggcatcagttcctatagga

SEQ ID NO: 601487 - DNA, 25 bp, Mus musculus
cctggtggcatctgttcctatagga

SEQ ID NO: 601488 - DNA, 25 bp, Mus musculus
cctggtggcctgcagtgatctgact

SEQ ID NO: 601489 - DNA, 25 bp, Mus musculus
cctggtggcctggagtgatctgact

SEQ ID NO: 601490 - DNA, 25 bp, Mus musculus
cctggtggcgctaaggctaactgca

SEQ ID NO: 601491 - DNA, 25 bp, Mus musculus
cctggtggcgcttaggctaactgca

SEQ ID NO: 601492 - DNA, 25 bp, Mus musculus
cctggtggcttacctactggatcaa

SEQ ID NO: 601493 - DNA, 25 bp, Mus musculus
cctggtggcttagctactggatcaa

SEQ ID NO: 601494 - DNA, 25 bp, Mus musculus
cctggtgggctgaccattgcaggca

SEQ ID NO: 601495 - DNA, 25 bp, Mus musculus
cctggtgggctgtccattgcaggca

SEQ ID NO: 601496 - DNA, 25 bp, Mus musculus
cctggtgggtcaatcggatgcccat

SEQ ID NO: 601497 - DNA, 25 bp, Mus musculus
cctggtgggtcattcggatgcccat

SEQ ID NO: 601498 - DNA, 25 bp, Mus musculus
cctggtgggtgaaaataatactctg

SEQ ID NO: 601499 - DNA, 25 bp, Mus musculus
cctggtgggtgataataatactctg

SEQ ID NO: 601500 - DNA, 25 bp, Mus musculus
cctggtggtaccctagacctgacct

SEQ ID NO: 601501 - DNA, 25 bp, Mus musculus
cctggtggtaccgtagacctgacct

SEQ ID NO: 601502 - DNA, 25 bp, Mus musculus
cctggtggtactactggtgaagtga

SEQ ID NO: 601503 - DNA, 25 bp, Mus musculus
cctggtggtacttctggtgaagtga

SEQ ID NO: 601504 - DNA, 25 bp, Mus musculus
cctggtggtgcacactatacagcca

SEQ ID NO: 601505 - DNA, 25 bp, Mus musculus
cctggtggtgcagactatacagcca

SEQ ID NO: 601506 - DNA, 25 bp, Mus musculus
cctggtggtgtaactcggacactca

SEQ ID NO: 601507 - DNA, 25 bp, Mus musculus
cctggtggtgtatctcggacactca

SEQ ID NO: 601508 - DNA, 25 bp, Mus musculus
cctggtgtacctcggtctcgtggat

SEQ ID NO: 601509 - DNA, 25 bp, Mus musculus
cctggtgtacctgggtctcgtggat

SEQ ID NO: 601510 - DNA, 25 bp, Mus musculus
cctggtgtcggcatcccgggcaaga

SEQ ID NO: 601511 - DNA, 25 bp, Mus musculus
cctggtgtcggcttcccgggcaaga

SEQ ID NO: 601512 - DNA, 25 bp, Mus musculus
cctggtgtctttaggagctggtgtc

SEQ ID NO: 601513 - DNA, 25 bp, Mus musculus
cctggtgtcttttggagctggtgtc

SEQ ID NO: 601514 - DNA, 25 bp, Mus musculus
cctggtgtgccgagctttgctgtct

SEQ ID NO: 601515 - DNA, 25 bp, Mus musculus
cctggtgtgccgtgctttgctgtct

SEQ ID NO: 601516 - DNA, 25 bp, Mus musculus
cctggtgtgtgacgaaacggccaac

SEQ ID NO: 601517 - DNA, 25 bp, Mus musculus
cctggtgtgtgaggaaacggccaac

SEQ ID NO: 601518 - DNA, 25 bp, Mus musculus
cctggtgtgtggaaagtagatatga

SEQ ID NO: 601519 - DNA, 25 bp, Mus musculus
cctggtgtgtggtaagtagatatga

SEQ ID NO: 601520 - DNA, 25 bp, Mus musculus
cctggtgttcctcgctgagcttgtt

SEQ ID NO: 601521 - DNA, 25 bp, Mus musculus
cctggtgttcctggctgagcttgtt

SEQ ID NO: 601522 - DNA, 25 bp, Mus musculus
cctggtgtttggacatatggaaact

SEQ ID NO: 601523 - DNA, 25 bp, Mus musculus
cctggtgtttggtcatatggaaact

SEQ ID NO: 601524 - DNA, 25 bp, Mus musculus
cctggtgttttactagtgccatgca

SEQ ID NO: 601525 - DNA, 25 bp, Mus musculus
cctggtgttttagtagtgccatgca

SEQ ID NO: 601526 - DNA, 25 bp, Mus musculus
cctggttaagtgattgatcaccctg

SEQ ID NO: 601527 - DNA, 25 bp, Mus musculus
cctggttaagtgtttgatcaccctg

SEQ ID NO: 601528 - DNA, 25 bp, Mus musculus
cctggttaggcgcaaaaattttgtg

SEQ ID NO: 601529 - DNA, 25 bp, Mus musculus
cctggttaggcggaaaaattttgtg

SEQ ID NO: 601530 - DNA, 25 bp, Mus musculus
cctggttatcatacgagagcagaca

SEQ ID NO: 601531 - DNA, 25 bp, Mus musculus
cctggttatcattcgagagcagaca

SEQ ID NO: 601532 - DNA, 25 bp, Mus musculus
cctggttcaagactactttgtgctg

SEQ ID NO: 601533 - DNA, 25 bp, Mus musculus
cctggttcaagagtactttgtgctg

SEQ ID NO: 601534 - DNA, 25 bp, Mus musculus
cctggttcccaacgaccattcagga

SEQ ID NO: 601535 - DNA, 25 bp, Mus musculus
cctggttcccaaggaccattcagga

SEQ ID NO: 601536 - DNA, 25 bp, Mus musculus
cctggttctgcaacagctggaggac

SEQ ID NO: 601537 - DNA, 25 bp, Mus musculus
cctggttctgcatcagctggaggac

SEQ ID NO: 601538 - DNA, 25 bp, Mus musculus
cctggttcttgtatagtggaacaag

SEQ ID NO: 601539 - DNA, 25 bp, Mus musculus
cctggttcttgtttagtggaacaag

SEQ ID NO: 601540 - DNA, 25 bp, Mus musculus
cctggttgaagtcaggcttcctgaa

SEQ ID NO: 601541 - DNA, 25 bp, Mus musculus
cctggttgaagtgaggcttcctgaa

SEQ ID NO: 601542 - DNA, 25 bp, Mus musculus
cctggttgcagaagtgcctaaagag

SEQ ID NO: 601543 - DNA, 25 bp, Mus musculus
cctggttgcagatgtgcctaaagag

SEQ ID NO: 601544 - DNA, 25 bp, Mus musculus
cctggttggatcctcgtctctgcaa

SEQ ID NO: 601545 - DNA, 25 bp, Mus musculus
cctggttggatcgtcgtctctgcaa

SEQ ID NO: 601546 - DNA, 25 bp, Mus musculus
cctggttggtatcccgggacttcag

SEQ ID NO: 601547 - DNA, 25 bp, Mus musculus
cctggttggtatgccgggacttcag

SEQ ID NO: 601548 - DNA, 25 bp, Mus musculus
cctggttggtctcgtcaacgtagtc

SEQ ID NO: 601549 - DNA, 25 bp, Mus musculus
cctggttggtctggtcaacgtagtc

SEQ ID NO: 601550 - DNA, 25 bp, Mus musculus
cctggttgtcctccggcttgtgttc

SEQ ID NO: 601551 - DNA, 25 bp, Mus musculus
cctggttgtcctgcggcttgtgttc

SEQ ID NO: 601552 - DNA, 25 bp, Mus musculus
cctggttgtgtgagcacttttataa

SEQ ID NO: 601553 - DNA, 25 bp, Mus musculus
cctggttgtgtgtgcacttttataa

SEQ ID NO: 601554 - DNA, 25 bp, Mus musculus
cctggttgtttgaagtctgtgaagg

SEQ ID NO: 601555 - DNA, 25 bp, Mus musculus
cctggttgtttgtagtctgtgaagg

SEQ ID NO: 601556 - DNA, 25 bp, Mus musculus
cctggtttatgacatcactcggaag

SEQ ID NO: 601557 - DNA, 25 bp, Mus musculus
cctggtttatgacggccagcagttc

SEQ ID NO: 601558 - DNA, 25 bp, Mus musculus
cctggtttatgagatcactcggaag

SEQ ID NO: 601559 - DNA, 25 bp, Mus musculus
cctggtttatgagggccagcagttc

SEQ ID NO: 601560 - DNA, 25 bp, Mus musculus
cctggtttcatcatgtaaagcccct

SEQ ID NO: 601561 - DNA, 25 bp, Mus musculus
cctggtttcatcttgtaaagcccct

SEQ ID NO: 601562 - DNA, 25 bp, Mus musculus
cctggtttcattcgaaggcctcaga

SEQ ID NO: 601563 - DNA, 25 bp, Mus musculus
cctggtttcattggaaggcctcaga

SEQ ID NO: 601564 - DNA, 25 bp, Mus musculus
cctggtttccgacgagacaaaggag

SEQ ID NO: 601565 - DNA, 25 bp, Mus musculus
cctggtttccgaggagacaaaggag

SEQ ID NO: 601566 - DNA, 25 bp, Mus musculus
cctggtttgaggctcaggccgataa

SEQ ID NO: 601567 - DNA, 25 bp, Mus musculus
cctggtttgagggtcaggccgataa

SEQ ID NO: 601568 - DNA, 25 bp, Mus musculus
cctggtttgataacgggagcatctg

SEQ ID NO: 601569 - DNA, 25 bp, Mus musculus
cctggtttgatatcgggagcatctg

SEQ ID NO: 601570 - DNA, 25 bp, Mus musculus
cctggtttgcctcataaagccttcc

SEQ ID NO: 601571 - DNA, 25 bp, Mus musculus
cctggtttgcctgataaagccttcc

SEQ ID NO: 601572 - DNA, 25 bp, Mus musculus
cctgtaaaccccagcaccttaggag

SEQ ID NO: 601573 - DNA, 25 bp, Mus musculus
cctgtaaacccctgcaccttaggag

SEQ ID NO: 601574 - DNA, 25 bp, Mus musculus
cctgtaaagaagaggatggcactgc

SEQ ID NO: 601575 - DNA, 25 bp, Mus musculus
cctgtaaagaagtggatggcactgc

SEQ ID NO: 601576 - DNA, 25 bp, Mus musculus
cctgtaaagacacatgggaactcgt

SEQ ID NO: 601577 - DNA, 25 bp, Mus musculus
cctgtaaagacagatgggaactcgt

SEQ ID NO: 601578 - DNA, 25 bp, Mus musculus
cctgtaacttcaatgtcggcatggg

SEQ ID NO: 601579 - DNA, 25 bp, Mus musculus
cctgtaacttcattgtcggcatggg

SEQ ID NO: 601580 - DNA, 25 bp, Mus musculus
cctgtaagccggcacacttccagaa

SEQ ID NO: 601581 - DNA, 25 bp, Mus musculus
cctgtaagccgggacacttccagaa

SEQ ID NO: 601582 - DNA, 25 bp, Mus musculus
cctgtaagcctcaacatgacagtga

SEQ ID NO: 601583 - DNA, 25 bp, Mus musculus
cctgtaagcctctacatgacagtga

SEQ ID NO: 601584 - DNA, 25 bp, Mus musculus
cctgtaaggacccagagatcatgcg

SEQ ID NO: 601585 - DNA, 25 bp, Mus musculus
cctgtaaggaccgagagatcatgcg

SEQ ID NO: 601586 - DNA, 25 bp, Mus musculus
cctgtaataaagagggatccgaaca

SEQ ID NO: 601587 - DNA, 25 bp, Mus musculus
cctgtaataaagtgggatccgaaca

SEQ ID NO: 601588 - DNA, 25 bp, Mus musculus
cctgtaatcatgagtactctggaga

SEQ ID NO: 601589 - DNA, 25 bp, Mus musculus
cctgtaatcatgtgtactctggaga

SEQ ID NO: 601590 - DNA, 25 bp, Mus musculus
cctgtaatccacagctccagaggca

SEQ ID NO: 601591 - DNA, 25 bp, Mus musculus
cctgtaatccactgctccagaggca

SEQ ID NO: 601592 - DNA, 25 bp, Mus musculus
cctgtaatggacaaacttgatgcta

SEQ ID NO: 601593 - DNA, 25 bp, Mus musculus
cctgtaatggactaacttgatgcta

SEQ ID NO: 601594 - DNA, 25 bp, Mus musculus
cctgtaattaagcaggcttaagtga

SEQ ID NO: 601595 - DNA, 25 bp, Mus musculus
cctgtaattaaggaggcttaagtga

SEQ ID NO: 601596 - DNA, 25 bp, Mus musculus
cctgtaattgagagtgcgcatgcca

SEQ ID NO: 601597 - DNA, 25 bp, Mus musculus
cctgtaattgagtgtgcgcatgcca

SEQ ID NO: 601598 - DNA, 25 bp, Mus musculus
cctgtaattgttccgaccatcagtt

SEQ ID NO: 601599 - DNA, 25 bp, Mus musculus
cctgtaattgttgcgaccatcagtt

SEQ ID NO: 601600 - DNA, 25 bp, Mus musculus
cctgtacaaaggacatggccagttg

SEQ ID NO: 601601 - DNA, 25 bp, Mus musculus
cctgtacaaaggtcatggccagttg

SEQ ID NO: 601602 - DNA, 25 bp, Mus musculus
cctgtacagttgcaaacattgagta

SEQ ID NO: 601603 - DNA, 25 bp, Mus musculus
cctgtacagttggaaacattgagta

SEQ ID NO: 601604 - DNA, 25 bp, Mus musculus
cctgtacataaaactggaaatactc

SEQ ID NO: 601605 - DNA, 25 bp, Mus musculus
cctgtacataaatctggaaatactc

SEQ ID NO: 601606 - DNA, 25 bp, Mus musculus
cctgtacatggaactgaatgccctc

SEQ ID NO: 601607 - DNA, 25 bp, Mus musculus
cctgtacatggatctgaatgccctc

SEQ ID NO: 601608 - DNA, 25 bp, Mus musculus
cctgtaccatgtcaatgaaaagccg

SEQ ID NO: 601609 - DNA, 25 bp, Mus musculus
cctgtaccatgtgaatgaaaagccg

SEQ ID NO: 601610 - DNA, 25 bp, Mus musculus
cctgtacccaggagctctgggccgg

SEQ ID NO: 601611 - DNA, 25 bp, Mus musculus
cctgtacccaggtgctctgggccgg

SEQ ID NO: 601612 - DNA, 25 bp, Mus musculus
cctgtacccggaacaacaaagcgag

SEQ ID NO: 601613 - DNA, 25 bp, Mus musculus
cctgtacccggatcaacaaagcgag

SEQ ID NO: 601614 - DNA, 25 bp, Mus musculus
cctgtacctagcacaagacgaggag

SEQ ID NO: 601615 - DNA, 25 bp, Mus musculus
cctgtacctagctcaagacgaggag

SEQ ID NO: 601616 - DNA, 25 bp, Mus musculus
cctgtacctctgagggaagtgccta

SEQ ID NO: 601617 - DNA, 25 bp, Mus musculus
cctgtacctctgtgggaagtgccta

SEQ ID NO: 601618 - DNA, 25 bp, Mus musculus
cctgtacggcctcactgaagctatc

SEQ ID NO: 601619 - DNA, 25 bp, Mus musculus
cctgtacggcctgactgaagctatc

SEQ ID NO: 601620 - DNA, 25 bp, Mus musculus
cctgtacggttgatggaaaggtcaa

SEQ ID NO: 601621 - DNA, 25 bp, Mus musculus
cctgtacggttgttggaaaggtcaa

SEQ ID NO: 601622 - DNA, 25 bp, Mus musculus
cctgtactctataaaccagacgata

SEQ ID NO: 601623 - DNA, 25 bp, Mus musculus
cctgtactctattaaccagacgata

SEQ ID NO: 601624 - DNA, 25 bp, Mus musculus
cctgtacttcccagatagggttgtt

SEQ ID NO: 601625 - DNA, 25 bp, Mus musculus
cctgtacttccctgatagggttgtt

SEQ ID NO: 601626 - DNA, 25 bp, Mus musculus
cctgtagaatagcatcacttcccag

SEQ ID NO: 601627 - DNA, 25 bp, Mus musculus
cctgtagaataggatcacttcccag

SEQ ID NO: 601628 - DNA, 25 bp, Mus musculus
cctgtagagaagatttacacttcct

SEQ ID NO: 601629 - DNA, 25 bp, Mus musculus
cctgtagagaagttttacacttcct

SEQ ID NO: 601630 - DNA, 25 bp, Mus musculus
cctgtagagccaccagattgtgttg

SEQ ID NO: 601631 - DNA, 25 bp, Mus musculus
cctgtagagccagcagattgtgttg

SEQ ID NO: 601632 - DNA, 25 bp, Mus musculus
cctgtagagttgattgaaggtgaac

SEQ ID NO: 601633 - DNA, 25 bp, Mus musculus
cctgtagagttgtttgaaggtgaac

SEQ ID NO: 601634 - DNA, 25 bp, Mus musculus
cctgtagcaagaagaagggccagcc

SEQ ID NO: 601635 - DNA, 25 bp, Mus musculus
cctgtagcaagatgaagggccagcc

SEQ ID NO: 601636 - DNA, 25 bp, Mus musculus
cctgtagcaattctgaaacgccaac

SEQ ID NO: 601637 - DNA, 25 bp, Mus musculus
cctgtagcaattgtgaaacgccaac

SEQ ID NO: 601638 - DNA, 25 bp, Mus musculus
cctgtagccctgcagagaggaaaag

SEQ ID NO: 601639 - DNA, 25 bp, Mus musculus
cctgtagccctggagagaggaaaag

SEQ ID NO: 601640 - DNA, 25 bp, Mus musculus
cctgtagcctgaccgcactagtggt

SEQ ID NO: 601641 - DNA, 25 bp, Mus musculus
cctgtagcctgagcgcactagtggt

SEQ ID NO: 601642 - DNA, 25 bp, Mus musculus
cctgtagtctaacccatgggagtct

SEQ ID NO: 601643 - DNA, 25 bp, Mus musculus
cctgtagtctaagccatgggagtct

SEQ ID NO: 601644 - DNA, 25 bp, Mus musculus
cctgtagtgtacataaagatgcaga

SEQ ID NO: 601645 - DNA, 25 bp, Mus musculus
cctgtagtgtacttaaagatgcaga

SEQ ID NO: 601646 - DNA, 25 bp, Mus musculus
cctgtataacccagggactggcgca

SEQ ID NO: 601647 - DNA, 25 bp, Mus musculus
cctgtataaccctgggactggcgca

SEQ ID NO: 601648 - DNA, 25 bp, Mus musculus
cctgtataaggacgcccaggaggcc

SEQ ID NO: 601649 - DNA, 25 bp, Mus musculus
cctgtataaggaggcccaggaggcc

SEQ ID NO: 601650 - DNA, 25 bp, Mus musculus
cctgtatatccgaggactgcagcca

SEQ ID NO: 601651 - DNA, 25 bp, Mus musculus
cctgtatatccgtggactgcagcca

SEQ ID NO: 601652 - DNA, 25 bp, Mus musculus
cctgtatatgaacaacgaattcctt

SEQ ID NO: 601653 - DNA, 25 bp, Mus musculus
cctgtatatgaagaacgaattcctt

SEQ ID NO: 601654 - DNA, 25 bp, Mus musculus
cctgtatcacacatgtggtctctga

SEQ ID NO: 601655 - DNA, 25 bp, Mus musculus
cctgtatcacacttgtggtctctga

SEQ ID NO: 601656 - DNA, 25 bp, Mus musculus
cctgtatcataactggcagatgctg

SEQ ID NO: 601657 - DNA, 25 bp, Mus musculus
cctgtatcataagtggcagatgctg

SEQ ID NO: 601658 - DNA, 25 bp, Mus musculus
cctgtatccctgcagagccaaaaaa

SEQ ID NO: 601659 - DNA, 25 bp, Mus musculus
cctgtatccctggagagccaaaaaa

SEQ ID NO: 601660 - DNA, 25 bp, Mus musculus
cctgtatctaatcaatctcaagcct

SEQ ID NO: 601661 - DNA, 25 bp, Mus musculus
cctgtatctaatgaatctcaagcct

SEQ ID NO: 601662 - DNA, 25 bp, Mus musculus
cctgtatgacgacattgtgccttga

SEQ ID NO: 601663 - DNA, 25 bp, Mus musculus
cctgtatgacgagattgtgccttga

SEQ ID NO: 601664 - DNA, 25 bp, Mus musculus
cctgtatgagaacgacaacacctat

SEQ ID NO: 601665 - DNA, 25 bp, Mus musculus
cctgtatgagaaggacaacacctat

SEQ ID NO: 601666 - DNA, 25 bp, Mus musculus
cctgtatgagttctggcaggatgaa

SEQ ID NO: 601667 - DNA, 25 bp, Mus musculus
cctgtatgagttgtggcaggatgaa

SEQ ID NO: 601668 - DNA, 25 bp, Mus musculus
cctgtatggcacacctgatggctgt

SEQ ID NO: 601669 - DNA, 25 bp, Mus musculus
cctgtatggcactcctgatggctgt

SEQ ID NO: 601670 - DNA, 25 bp, Mus musculus
cctgtatgtgaaaagagtatgctcc

SEQ ID NO: 601671 - DNA, 25 bp, Mus musculus
cctgtatgtgaatagagtatgctcc

SEQ ID NO: 601672 - DNA, 25 bp, Mus musculus
cctgtattcagactgaacttcatcg

SEQ ID NO: 601673 - DNA, 25 bp, Mus musculus
cctgtattcagagtgaacttcatcg

SEQ ID NO: 601674 - DNA, 25 bp, Mus musculus
cctgtatttgcactggtgtaaaagc

SEQ ID NO: 601675 - DNA, 25 bp, Mus musculus
cctgtatttgcagtggtgtaaaagc

SEQ ID NO: 601676 - DNA, 25 bp, Mus musculus
cctgtcaaattccactttcactggg

SEQ ID NO: 601677 - DNA, 25 bp, Mus musculus
cctgtcaaattcgactttcactggg

SEQ ID NO: 601678 - DNA, 25 bp, Mus musculus
cctgtcaacggcaaagccatctgca

SEQ ID NO: 601679 - DNA, 25 bp, Mus musculus
cctgtcaacggctaagccatctgca

SEQ ID NO: 601680 - DNA, 25 bp, Mus musculus
cctgtcaagggcagcttggtaggaa

SEQ ID NO: 601681 - DNA, 25 bp, Mus musculus
cctgtcaagggctgcttggtaggaa

SEQ ID NO: 601682 - DNA, 25 bp, Mus musculus
cctgtcaccatacgaacagacattt

SEQ ID NO: 601683 - DNA, 25 bp, Mus musculus
cctgtcaccataggaacagacattt

SEQ ID NO: 601684 - DNA, 25 bp, Mus musculus
cctgtcaccatccagagcggagatt

SEQ ID NO: 601685 - DNA, 25 bp, Mus musculus
cctgtcaccatcgagagcggagatt

SEQ ID NO: 601686 - DNA, 25 bp, Mus musculus
cctgtcagaactaatcgatatcagc

SEQ ID NO: 601687 - DNA, 25 bp, Mus musculus
cctgtcagaacttatcgatatcagc

SEQ ID NO: 601688 - DNA, 25 bp, Mus musculus
cctgtcagaatgaccattctagtgc

SEQ ID NO: 601689 - DNA, 25 bp, Mus musculus
cctgtcagaatgtccattctagtgc

SEQ ID NO: 601690 - DNA, 25 bp, Mus musculus
cctgtcagatgtcgttgtttaaaca

SEQ ID NO: 601691 - DNA, 25 bp, Mus musculus
cctgtcagatgtggttgtttaaaca

SEQ ID NO: 601692 - DNA, 25 bp, Mus musculus
cctgtcagctccacaaataggagtt

SEQ ID NO: 601693 - DNA, 25 bp, Mus musculus
cctgtcagctcctcaaataggagtt

SEQ ID NO: 601694 - DNA, 25 bp, Mus musculus
cctgtcagctgcacaaaggccagtc

SEQ ID NO: 601695 - DNA, 25 bp, Mus musculus
cctgtcagctgctcaaaggccagtc

SEQ ID NO: 601696 - DNA, 25 bp, Mus musculus
cctgtcaggaggcatctctggtgac

SEQ ID NO: 601697 - DNA, 25 bp, Mus musculus
cctgtcaggagggatctctggtgac

SEQ ID NO: 601698 - DNA, 25 bp, Mus musculus
cctgtcataaacacattatcagtgg

SEQ ID NO: 601699 - DNA, 25 bp, Mus musculus
cctgtcataaactcattatcagtgg

SEQ ID NO: 601700 - DNA, 25 bp, Mus musculus
cctgtcatccataagagcggtaatc

SEQ ID NO: 601701 - DNA, 25 bp, Mus musculus
cctgtcatccattagagcggtaatc

SEQ ID NO: 601702 - DNA, 25 bp, Mus musculus
cctgtcatcgagaccagtaccctga

SEQ ID NO: 601703 - DNA, 25 bp, Mus musculus
cctgtcatcgagtccagtaccctga

SEQ ID NO: 601704 - DNA, 25 bp, Mus musculus
cctgtcatggatcaaacatgctgtc

SEQ ID NO: 601705 - DNA, 25 bp, Mus musculus
cctgtcatggatgaaacatgctgtc

SEQ ID NO: 601706 - DNA, 25 bp, Mus musculus
cctgtcatttatcatgtgaagtacc

SEQ ID NO: 601707 - DNA, 25 bp, Mus musculus
cctgtcatttatgatgtgaagtacc

SEQ ID NO: 601708 - DNA, 25 bp, Mus musculus
cctgtccaccatcattgacgggagt

SEQ ID NO: 601709 - DNA, 25 bp, Mus musculus
cctgtccaccatgattgacgggagt

SEQ ID NO: 601710 - DNA, 25 bp, Mus musculus
cctgtccagtgaaggaagccgagcg

SEQ ID NO: 601711 - DNA, 25 bp, Mus musculus
cctgtccagtgacaacagccgtgag

SEQ ID NO: 601712 - DNA, 25 bp, Mus musculus
cctgtccagtgagaacagccgtgag

SEQ ID NO: 601713 - DNA, 25 bp, Mus musculus
cctgtccagtgatggaagccgagcg

SEQ ID NO: 601714 - DNA, 25 bp, Mus musculus
cctgtccccttcctgcggatataga

SEQ ID NO: 601715 - DNA, 25 bp, Mus musculus
cctgtccccttcgtgcggatataga

SEQ ID NO: 601716 - DNA, 25 bp, Mus musculus
cctgtcccgatgagagttccagcgg

SEQ ID NO: 601717 - DNA, 25 bp, Mus musculus
cctgtcccgatgtgagttccagcgg

SEQ ID NO: 601718 - DNA, 25 bp, Mus musculus
cctgtcctatgtaccagagaaagga

SEQ ID NO: 601719 - DNA, 25 bp, Mus musculus
cctgtcctatgttccagagaaagga

SEQ ID NO: 601720 - DNA, 25 bp, Mus musculus
cctgtcctgcttcaaacagagcaag

SEQ ID NO: 601721 - DNA, 25 bp, Mus musculus
cctgtcctgcttgaaacagagcaag

SEQ ID NO: 601722 - DNA, 25 bp, Mus musculus
cctgtcctggagaagcccagctgct

SEQ ID NO: 601723 - DNA, 25 bp, Mus musculus
cctgtcctggagtagcccagctgct

SEQ ID NO: 601724 - DNA, 25 bp, Mus musculus
cctgtcctttgcctgttggtcaatg

SEQ ID NO: 601725 - DNA, 25 bp, Mus musculus
cctgtcctttgcgtgttggtcaatg

SEQ ID NO: 601726 - DNA, 25 bp, Mus musculus
cctgtcgagaagagcgggacgtcac

SEQ ID NO: 601727 - DNA, 25 bp, Mus musculus
cctgtcgagaagtgcgggacgtcac

SEQ ID NO: 601728 - DNA, 25 bp, Mus musculus
cctgtcgcctgcaaatcaggacgct

SEQ ID NO: 601729 - DNA, 25 bp, Mus musculus
cctgtcgcctgctaatcaggacgct

SEQ ID NO: 601730 - DNA, 25 bp, Mus musculus
cctgtcgctgcgagggcaccatcta

SEQ ID NO: 601731 - DNA, 25 bp, Mus musculus
cctgtcgctgcgtgggcaccatcta

SEQ ID NO: 601732 - DNA, 25 bp, Mus musculus
cctgtcggacctcgtatctgagatg

SEQ ID NO: 601733 - DNA, 25 bp, Mus musculus
cctgtcggacctggtatctgagatg

SEQ ID NO: 601734 - DNA, 25 bp, Mus musculus
cctgtcggcgtgaccgtgcggttcc

SEQ ID NO: 601735 - DNA, 25 bp, Mus musculus
cctgtcggcgtgtccgtgcggttcc

SEQ ID NO: 601736 - DNA, 25 bp, Mus musculus
cctgtcggcttgctcatggagtaca

SEQ ID NO: 601737 - DNA, 25 bp, Mus musculus
cctgtcggcttggtcatggagtaca

SEQ ID NO: 601738 - DNA, 25 bp, Mus musculus
cctgtcgtagtcacagaggagcagt

SEQ ID NO: 601739 - DNA, 25 bp, Mus musculus
cctgtcgtagtctcagaggagcagt

SEQ ID NO: 601740 - DNA, 25 bp, Mus musculus
cctgtcgtcggacgctggtacaaag

SEQ ID NO: 601741 - DNA, 25 bp, Mus musculus
cctgtcgtcggaggctggtacaaag

SEQ ID NO: 601742 - DNA, 25 bp, Mus musculus
cctgtcgtgcaaacgctagggaggc

SEQ ID NO: 601743 - DNA, 25 bp, Mus musculus
cctgtcgtgcaatcgctagggaggc

SEQ ID NO: 601744 - DNA, 25 bp, Mus musculus
cctgtcgttcctccttacagtagga

SEQ ID NO: 601745 - DNA, 25 bp, Mus musculus
cctgtcgttcctgcttacagtagga

SEQ ID NO: 601746 - DNA, 25 bp, Mus musculus
cctgtctacgctcgccaatttggaa

SEQ ID NO: 601747 - DNA, 25 bp, Mus musculus
cctgtctacgctggccaatttggaa

SEQ ID NO: 601748 - DNA, 25 bp, Mus musculus
cctgtctagagcagcttggtatggg

SEQ ID NO: 601749 - DNA, 25 bp, Mus musculus
cctgtctagagctgcttggtatggg

SEQ ID NO: 601750 - DNA, 25 bp, Mus musculus
cctgtctcagcccatacagattgca

SEQ ID NO: 601751 - DNA, 25 bp, Mus musculus
cctgtctcagccgatacagattgca

SEQ ID NO: 601752 - DNA, 25 bp, Mus musculus
cctgtctcaggaactgagcagtcca

SEQ ID NO: 601753 - DNA, 25 bp, Mus musculus
cctgtctcaggatctgagcagtcca

SEQ ID NO: 601754 - DNA, 25 bp, Mus musculus
cctgtctccgagatcagtcggcgaa

SEQ ID NO: 601755 - DNA, 25 bp, Mus musculus
cctgtctccgagttcagtcggcgaa

SEQ ID NO: 601756 - DNA, 25 bp, Mus musculus
cctgtctcgggtcagtggcatcctg

SEQ ID NO: 601757 - DNA, 25 bp, Mus musculus
cctgtctcgggtgagtggcatcctg

SEQ ID NO: 601758 - DNA, 25 bp, Mus musculus
cctgtctctagacattgggaagaac

SEQ ID NO: 601759 - DNA, 25 bp, Mus musculus
cctgtctctagagattgggaagaac

SEQ ID NO: 601760 - DNA, 25 bp, Mus musculus
cctgtctgagcgataatgacgtctt

SEQ ID NO: 601761 - DNA, 25 bp, Mus musculus
cctgtctgagcgttaatgacgtctt

SEQ ID NO: 601762 - DNA, 25 bp, Mus musculus
cctgtctgataacaatctggtggcc

SEQ ID NO: 601763 - DNA, 25 bp, Mus musculus
cctgtctgataagaatctggtggcc

SEQ ID NO: 601764 - DNA, 25 bp, Mus musculus
cctgtctgatctcgtatcagagatg

SEQ ID NO: 601765 - DNA, 25 bp, Mus musculus
cctgtctgatctggtatcagagatg

SEQ ID NO: 601766 - DNA, 25 bp, Mus musculus
cctgtctgatgacgaggagcctcct

SEQ ID NO: 601767 - DNA, 25 bp, Mus musculus
cctgtctgatgaggaggagcctcct

SEQ ID NO: 601768 - DNA, 25 bp, Mus musculus
cctgtctgatgcacggatttttatc

SEQ ID NO: 601769 - DNA, 25 bp, Mus musculus
cctgtctgatgctcggatttttatc

SEQ ID NO: 601770 - DNA, 25 bp, Mus musculus
cctgtctgcggtatcagaggatggc

SEQ ID NO: 601771 - DNA, 25 bp, Mus musculus
cctgtctgcggtttcagaggatggc

SEQ ID NO: 601772 - DNA, 25 bp, Mus musculus
cctgtctgcgttcggaacctggtca

SEQ ID NO: 601773 - DNA, 25 bp, Mus musculus
cctgtctgcgttgggaacctggtca

SEQ ID NO: 601774 - DNA, 25 bp, Mus musculus
cctgtctggctgcaaacatggcgtc

SEQ ID NO: 601775 - DNA, 25 bp, Mus musculus
cctgtctggctggaaacatggcgtc

SEQ ID NO: 601776 - DNA, 25 bp, Mus musculus
cctgtctgggtaatttaaactgatg

SEQ ID NO: 601777 - DNA, 25 bp, Mus musculus
cctgtctgggtattttaaactgatg

SEQ ID NO: 601778 - DNA, 25 bp, Mus musculus
cctgtctggtctagagattggcgtt

SEQ ID NO: 601779 - DNA, 25 bp, Mus musculus
cctgtctggtcttgagattggcgtt

SEQ ID NO: 601780 - DNA, 25 bp, Mus musculus
cctgtctgtataactggtagctctt

SEQ ID NO: 601781 - DNA, 25 bp, Mus musculus
cctgtctgtatatctggtagctctt

SEQ ID NO: 601782 - DNA, 25 bp, Mus musculus
cctgtctgtgctataacgcacttgg

SEQ ID NO: 601783 - DNA, 25 bp, Mus musculus
cctgtctgtgctttaacgcacttgg

SEQ ID NO: 601784 - DNA, 25 bp, Mus musculus
cctgtctgttttcgacaacttctgg

SEQ ID NO: 601785 - DNA, 25 bp, Mus musculus
cctgtctgttttggacaacttctgg

SEQ ID NO: 601786 - DNA, 25 bp, Mus musculus
cctgtcttccttactttatagtcgg

SEQ ID NO: 601787 - DNA, 25 bp, Mus musculus
cctgtcttcctttctttatagtcgg

SEQ ID NO: 601788 - DNA, 25 bp, Mus musculus
cctgtcttgaatctcgtcacctgga

SEQ ID NO: 601789 - DNA, 25 bp, Mus musculus
cctgtcttgaatgtcgtcacctgga

SEQ ID NO: 601790 - DNA, 25 bp, Mus musculus
cctgtcttgactcaggttaccctga

SEQ ID NO: 601791 - DNA, 25 bp, Mus musculus
cctgtcttgactgaggttaccctga

SEQ ID NO: 601792 - DNA, 25 bp, Mus musculus
cctgtcttgagaaacttcatttatt

SEQ ID NO: 601793 - DNA, 25 bp, Mus musculus
cctgtcttgagatacttcatttatt

SEQ ID NO: 601794 - DNA, 25 bp, Mus musculus
cctgtctttgccaacatgagccggg

SEQ ID NO: 601795 - DNA, 25 bp, Mus musculus
cctgtctttgcctacatgagccggg

SEQ ID NO: 601796 - DNA, 25 bp, Mus musculus
cctgtctttgctctcactttctgag

SEQ ID NO: 601797 - DNA, 25 bp, Mus musculus
cctgtctttgctgtcactttctgag

SEQ ID NO: 601798 - DNA, 25 bp, Mus musculus
cctgtcttttcgctgctcactggca

SEQ ID NO: 601799 - DNA, 25 bp, Mus musculus
cctgtcttttcggtgctcactggca

SEQ ID NO: 601800 - DNA, 25 bp, Mus musculus
cctgtgaaagccaggaaagaagctc

SEQ ID NO: 601801 - DNA, 25 bp, Mus musculus
cctgtgaaagcctggaaagaagctc

SEQ ID NO: 601802 - DNA, 25 bp, Mus musculus
cctgtgaaagtaagtcacacacagg

SEQ ID NO: 601803 - DNA, 25 bp, Mus musculus
cctgtgaaagtatgtcacacacagg

SEQ ID NO: 601804 - DNA, 25 bp, Mus musculus
cctgtgaaccaacccaagacatata

SEQ ID NO: 601805 - DNA, 25 bp, Mus musculus
cctgtgaaccaagccaagacatata

SEQ ID NO: 601806 - DNA, 25 bp, Mus musculus
cctgtgaactccaggccattgataa

SEQ ID NO: 601807 - DNA, 25 bp, Mus musculus
cctgtgaactcctggccattgataa

SEQ ID NO: 601808 - DNA, 25 bp, Mus musculus
cctgtgaatgcacgcctggttttga

SEQ ID NO: 601809 - DNA, 25 bp, Mus musculus
cctgtgaatgcaggcctggttttga

SEQ ID NO: 601810 - DNA, 25 bp, Mus musculus
cctgtgacattgcatggacggcaca

SEQ ID NO: 601811 - DNA, 25 bp, Mus musculus
cctgtgacattggatggacggcaca

SEQ ID NO: 601812 - DNA, 25 bp, Mus musculus
cctgtgaccgcaacaaagatgagtt

SEQ ID NO: 601813 - DNA, 25 bp, Mus musculus
cctgtgaccgcatcaaagatgagtt

SEQ ID NO: 601814 - DNA, 25 bp, Mus musculus
cctgtgacgaatacgtgggcgcccg

SEQ ID NO: 601815 - DNA, 25 bp, Mus musculus
cctgtgacgaattcgtgggcgcccg

SEQ ID NO: 601816 - DNA, 25 bp, Mus musculus
cctgtgacttctcgactcttgctgt

SEQ ID NO: 601817 - DNA, 25 bp, Mus musculus
cctgtgacttctggactcttgctgt

SEQ ID NO: 601818 - DNA, 25 bp, Mus musculus
cctgtgagaagtatctatgatgaca

SEQ ID NO: 601819 - DNA, 25 bp, Mus musculus
cctgtgagaagtttctatgatgaca

SEQ ID NO: 601820 - DNA, 25 bp, Mus musculus
cctgtgagaattacaagaagatcaa

SEQ ID NO: 601821 - DNA, 25 bp, Mus musculus
cctgtgagaatttcaagaagatcaa

SEQ ID NO: 601822 - DNA, 25 bp, Mus musculus
cctgtgagactccacatagctctct

SEQ ID NO: 601823 - DNA, 25 bp, Mus musculus
cctgtgagactcgacatagctctct

SEQ ID NO: 601824 - DNA, 25 bp, Mus musculus
cctgtgagagttaatgcggatggaa

SEQ ID NO: 601825 - DNA, 25 bp, Mus musculus
cctgtgagagttccaactgcgcaga

SEQ ID NO: 601826 - DNA, 25 bp, Mus musculus
cctgtgagagttgcaactgcgcaga

SEQ ID NO: 601827 - DNA, 25 bp, Mus musculus
cctgtgagagtttatgcggatggaa

SEQ ID NO: 601828 - DNA, 25 bp, Mus musculus
cctgtgagatatcccatgaaatatt

SEQ ID NO: 601829 - DNA, 25 bp, Mus musculus
cctgtgagatatgccatgaaatatt

SEQ ID NO: 601830 - DNA, 25 bp, Mus musculus
cctgtgagatctccatgtaaactct

SEQ ID NO: 601831 - DNA, 25 bp, Mus musculus
cctgtgagatctgcatgtaaactct

SEQ ID NO: 601832 - DNA, 25 bp, Mus musculus
cctgtgagatggcacacagagatgt

SEQ ID NO: 601833 - DNA, 25 bp, Mus musculus
cctgtgagatggctttaaaactgta

SEQ ID NO: 601834 - DNA, 25 bp, Mus musculus
cctgtgagatgggacacagagatgt

SEQ ID NO: 601835 - DNA, 25 bp, Mus musculus
cctgtgagatgggtttaaaactgta

SEQ ID NO: 601836 - DNA, 25 bp, Mus musculus
cctgtgagcacacctagtggcctgg

SEQ ID NO: 601837 - DNA, 25 bp, Mus musculus
cctgtgagcacagctagtggcctgg

SEQ ID NO: 601838 - DNA, 25 bp, Mus musculus
cctgtgagcgtacccgggtgtcaat

SEQ ID NO: 601839 - DNA, 25 bp, Mus musculus
cctgtgagcgtagccgggtgtcaat

SEQ ID NO: 601840 - DNA, 25 bp, Mus musculus
cctgtgaggaaaccatggaagagcc

SEQ ID NO: 601841 - DNA, 25 bp, Mus musculus
cctgtgaggaaagcatggaagagcc

SEQ ID NO: 601842 - DNA, 25 bp, Mus musculus
cctgtgagggatcttgttacttgac

SEQ ID NO: 601843 - DNA, 25 bp, Mus musculus
cctgtgagggatgttgttacttgac

SEQ ID NO: 601844 - DNA, 25 bp, Mus musculus
cctgtgagtccccattctagagcca

SEQ ID NO: 601845 - DNA, 25 bp, Mus musculus
cctgtgagtcccgattctagagcca

SEQ ID NO: 601846 - DNA, 25 bp, Mus musculus
cctgtgatcatgcaattagagcgcc

SEQ ID NO: 601847 - DNA, 25 bp, Mus musculus
cctgtgatcatggaattagagcgcc

SEQ ID NO: 601848 - DNA, 25 bp, Mus musculus
cctgtgatcctcatccgcagtcgat

SEQ ID NO: 601849 - DNA, 25 bp, Mus musculus
cctgtgatcctcatggatgagacgc

SEQ ID NO: 601850 - DNA, 25 bp, Mus musculus
cctgtgatcctcttccgcagtcgat

SEQ ID NO: 601851 - DNA, 25 bp, Mus musculus
cctgtgatcctcttggatgagacgc

SEQ ID NO: 601852 - DNA, 25 bp, Mus musculus
cctgtgatcctgaaccatcacgtgg

SEQ ID NO: 601853 - DNA, 25 bp, Mus musculus
cctgtgatcctgtaccatcacgtgg

SEQ ID NO: 601854 - DNA, 25 bp, Mus musculus
cctgtgatgaatcttataaagatcc

SEQ ID NO: 601855 - DNA, 25 bp, Mus musculus
cctgtgatgaatgttataaagatcc

SEQ ID NO: 601856 - DNA, 25 bp, Mus musculus
cctgtgatgacaaacgccacagaga

SEQ ID NO: 601857 - DNA, 25 bp, Mus musculus
cctgtgatgacatacgccacagaga

SEQ ID NO: 601858 - DNA, 25 bp, Mus musculus
cctgtgatgccacggagcatagaga

SEQ ID NO: 601859 - DNA, 25 bp, Mus musculus
cctgtgatgccagggagcatagaga

SEQ ID NO: 601860 - DNA, 25 bp, Mus musculus
cctgtgatgggtcccatgaccccaa

SEQ ID NO: 601861 - DNA, 25 bp, Mus musculus
cctgtgatgggtgccatgaccccaa

SEQ ID NO: 601862 - DNA, 25 bp, Mus musculus
cctgtgcaagaaccagagtgaagga

SEQ ID NO: 601863 - DNA, 25 bp, Mus musculus
cctgtgcaagaagcagagtgaagga

SEQ ID NO: 601864 - DNA, 25 bp, Mus musculus
cctgtgcacaatctaccttttgaga

SEQ ID NO: 601865 - DNA, 25 bp, Mus musculus
cctgtgcacaatgtaccttttgaga

SEQ ID NO: 601866 - DNA, 25 bp, Mus musculus
cctgtgcagacacctcaaaaaagcc

SEQ ID NO: 601867 - DNA, 25 bp, Mus musculus
cctgtgcagacagctcaaaaaagcc

SEQ ID NO: 601868 - DNA, 25 bp, Mus musculus
cctgtgcagctaacaaagcatgagc

SEQ ID NO: 601869 - DNA, 25 bp, Mus musculus
cctgtgcagctatcaaagcatgagc

SEQ ID NO: 601870 - DNA, 25 bp, Mus musculus
cctgtgcagctgcaattctctctaa

SEQ ID NO: 601871 - DNA, 25 bp, Mus musculus
cctgtgcagctggaattctctctaa

SEQ ID NO: 601872 - DNA, 25 bp, Mus musculus
cctgtgcaggagaggtgtccatttc

SEQ ID NO: 601873 - DNA, 25 bp, Mus musculus
cctgtgcaggagtggtgtccatttc

SEQ ID NO: 601874 - DNA, 25 bp, Mus musculus
cctgtgcaggtgctcatgaagaact

SEQ ID NO: 601875 - DNA, 25 bp, Mus musculus
cctgtgcaggtggtcatgaagaact

SEQ ID NO: 601876 - DNA, 25 bp, Mus musculus
cctgtgccaactctgaatatgagct

SEQ ID NO: 601877 - DNA, 25 bp, Mus musculus
cctgtgccaactgtgaatatgagct

SEQ ID NO: 601878 - DNA, 25 bp, Mus musculus
cctgtgccaagcagaggaactgatg

SEQ ID NO: 601879 - DNA, 25 bp, Mus musculus
cctgtgccaagctgaggaactgatg

SEQ ID NO: 601880 - DNA, 25 bp, Mus musculus
cctgtgccagccagatagggctcat

SEQ ID NO: 601881 - DNA, 25 bp, Mus musculus
cctgtgccagcctgatagggctcat

SEQ ID NO: 601882 - DNA, 25 bp, Mus musculus
cctgtgccagtaagatgtggatgag

SEQ ID NO: 601883 - DNA, 25 bp, Mus musculus
cctgtgccagtatgatgtggatgag

SEQ ID NO: 601884 - DNA, 25 bp, Mus musculus
cctgtgccgttcctgagcaatttcg

SEQ ID NO: 601885 - DNA, 25 bp, Mus musculus
cctgtgccgttcgtgagcaatttcg

SEQ ID NO: 601886 - DNA, 25 bp, Mus musculus
cctgtgcctaggctagcattttcag

SEQ ID NO: 601887 - DNA, 25 bp, Mus musculus
cctgtgcctagggtagcattttcag

SEQ ID NO: 601888 - DNA, 25 bp, Mus musculus
cctgtgcctggaaggcaaagaattc

SEQ ID NO: 601889 - DNA, 25 bp, Mus musculus
cctgtgcctggatggcaaagaattc

SEQ ID NO: 601890 - DNA, 25 bp, Mus musculus
cctgtgcgacgtcctgtatggcaaa

SEQ ID NO: 601891 - DNA, 25 bp, Mus musculus
cctgtgcgacgtgctgtatggcaaa

SEQ ID NO: 601892 - DNA, 25 bp, Mus musculus
cctgtgcgagaacatggacaatgca

SEQ ID NO: 601893 - DNA, 25 bp, Mus musculus
cctgtgcgagaagatggacaatgca

SEQ ID NO: 601894 - DNA, 25 bp, Mus musculus
cctgtgcgagcaattcttgcagagc

SEQ ID NO: 601895 - DNA, 25 bp, Mus musculus
cctgtgcgagcatttcttgcagagc

SEQ ID NO: 601896 - DNA, 25 bp, Mus musculus
cctgtgcggacgagaggtgctgcgg

SEQ ID NO: 601897 - DNA, 25 bp, Mus musculus
cctgtgcggacgtgaggtgctgcgg

SEQ ID NO: 601898 - DNA, 25 bp, Mus musculus
cctgtgcggactcttctacctgttc

SEQ ID NO: 601899 - DNA, 25 bp, Mus musculus
cctgtgcggactgttctacctgttc

SEQ ID NO: 601900 - DNA, 25 bp, Mus musculus
cctgtgcgggataccatgctgttga

SEQ ID NO: 601901 - DNA, 25 bp, Mus musculus
cctgtgcgggattccatgctgttga

SEQ ID NO: 601902 - DNA, 25 bp, Mus musculus
cctgtgcgtgggaattgggctccga

SEQ ID NO: 601903 - DNA, 25 bp, Mus musculus
cctgtgcgtgggtattgggctccga

SEQ ID NO: 601904 - DNA, 25 bp, Mus musculus
cctgtgcgttgcaaatgtttgtgag

SEQ ID NO: 601905 - DNA, 25 bp, Mus musculus
cctgtgcgttgctaatgtttgtgag

SEQ ID NO: 601906 - DNA, 25 bp, Mus musculus
cctgtgctatatagccatggaggag

SEQ ID NO: 601907 - DNA, 25 bp, Mus musculus
cctgtgctatattgccatggaggag

SEQ ID NO: 601908 - DNA, 25 bp, Mus musculus
cctgtgctattgagcagtgaccatg

SEQ ID NO: 601909 - DNA, 25 bp, Mus musculus
cctgtgctattgtgcagtgaccatg

SEQ ID NO: 601910 - DNA, 25 bp, Mus musculus
cctgtgctcgttcccgagcgacgga

SEQ ID NO: 601911 - DNA, 25 bp, Mus musculus
cctgtgctcgttgccgagcgacgga

SEQ ID NO: 601912 - DNA, 25 bp, Mus musculus
cctgtgctgagaaacttaagcgtct

SEQ ID NO: 601913 - DNA, 25 bp, Mus musculus
cctgtgctgagatacttaagcgtct

SEQ ID NO: 601914 - DNA, 25 bp, Mus musculus
cctgtgctggacagcgcttctatca

SEQ ID NO: 601915 - DNA, 25 bp, Mus musculus
cctgtgctggactgcgcttctatca

SEQ ID NO: 601916 - DNA, 25 bp, Mus musculus
cctgtgctgggccaacatttagcta

SEQ ID NO: 601917 - DNA, 25 bp, Mus musculus
cctgtgctgggcgaacatttagcta

SEQ ID NO: 601918 - DNA, 25 bp, Mus musculus
cctgtgctgtggacatcgatggaga

SEQ ID NO: 601919 - DNA, 25 bp, Mus musculus
cctgtgctgtggtcatcgatggaga

SEQ ID NO: 601920 - DNA, 25 bp, Mus musculus
cctgtgcttttcataagcagtacaa

SEQ ID NO: 601921 - DNA, 25 bp, Mus musculus
cctgtgcttttcttaagcagtacaa

SEQ ID NO: 601922 - DNA, 25 bp, Mus musculus
cctgtggaaaccaggatgtgaatag

SEQ ID NO: 601923 - DNA, 25 bp, Mus musculus
cctgtggaaacctggatgtgaatag

SEQ ID NO: 601924 - DNA, 25 bp, Mus musculus
cctgtggaagaaatacggtgacaag

SEQ ID NO: 601925 - DNA, 25 bp, Mus musculus
cctgtggaagaattacggtgacaag

SEQ ID NO: 601926 - DNA, 25 bp, Mus musculus
cctgtggacgatagagctgtagagc

SEQ ID NO: 601927 - DNA, 25 bp, Mus musculus
cctgtggacgatcatatcaacgggc

SEQ ID NO: 601928 - DNA, 25 bp, Mus musculus
cctgtggacgatgatatcaacgggc

SEQ ID NO: 601929 - DNA, 25 bp, Mus musculus
cctgtggacgattgagctgtagagc

SEQ ID NO: 601930 - DNA, 25 bp, Mus musculus
cctgtggagagacttattcttggag

SEQ ID NO: 601931 - DNA, 25 bp, Mus musculus
cctgtggagagagttattcttggag

SEQ ID NO: 601932 - DNA, 25 bp, Mus musculus
cctgtggagagcacctggcgtctga

SEQ ID NO: 601933 - DNA, 25 bp, Mus musculus
cctgtggagagctcctggcgtctga

SEQ ID NO: 601934 - DNA, 25 bp, Mus musculus
cctgtggagctcacaagaatatctc

SEQ ID NO: 601935 - DNA, 25 bp, Mus musculus
cctgtggagctcctctgagaaaaat

SEQ ID NO: 601936 - DNA, 25 bp, Mus musculus
cctgtggagctcgtctgagaaaaat

SEQ ID NO: 601937 - DNA, 25 bp, Mus musculus
cctgtggagctctcaagaatatctc

SEQ ID NO: 601938 - DNA, 25 bp, Mus musculus
cctgtggagcttctcactggagatg

SEQ ID NO: 601939 - DNA, 25 bp, Mus musculus
cctgtggagcttgtcactggagatg

SEQ ID NO: 601940 - DNA, 25 bp, Mus musculus
cctgtggataatcccgtttgctttc

SEQ ID NO: 601941 - DNA, 25 bp, Mus musculus
cctgtggataatgccgtttgctttc

SEQ ID NO: 601942 - DNA, 25 bp, Mus musculus
cctgtggcaaagacaaaagcgtctg

SEQ ID NO: 601943 - DNA, 25 bp, Mus musculus
cctgtggcaaagtcaaaagcgtctg

SEQ ID NO: 601944 - DNA, 25 bp, Mus musculus
cctgtggcagagctattcacactga

SEQ ID NO: 601945 - DNA, 25 bp, Mus musculus
cctgtggcagaggtattcacactga

SEQ ID NO: 601946 - DNA, 25 bp, Mus musculus
cctgtggcatacaagttctgtcttc

SEQ ID NO: 601947 - DNA, 25 bp, Mus musculus
cctgtggcatactagttctgtcttc

SEQ ID NO: 601948 - DNA, 25 bp, Mus musculus
cctgtggccaagcagaaagtagtga

SEQ ID NO: 601949 - DNA, 25 bp, Mus musculus
cctgtggccaaggagaaagtagtga

SEQ ID NO: 601950 - DNA, 25 bp, Mus musculus
cctgtggcctcgcaggcatgaaaca

SEQ ID NO: 601951 - DNA, 25 bp, Mus musculus
cctgtggcctcggaggcatgaaaca

SEQ ID NO: 601952 - DNA, 25 bp, Mus musculus
cctgtggcctgcaaggtctagtgaa

SEQ ID NO: 601953 - DNA, 25 bp, Mus musculus
cctgtggcctgctaggtctagtgaa

SEQ ID NO: 601954 - DNA, 25 bp, Mus musculus
cctgtggcctggaagctctcgaaac

SEQ ID NO: 601955 - DNA, 25 bp, Mus musculus
cctgtggcctggtagctctcgaaac

SEQ ID NO: 601956 - DNA, 25 bp, Mus musculus
cctgtggctcatcaggatgtcagag

SEQ ID NO: 601957 - DNA, 25 bp, Mus musculus
cctgtggctcatgaggatgtcagag

SEQ ID NO: 601958 - DNA, 25 bp, Mus musculus
cctgtggctggacttcgatggtgac

SEQ ID NO: 601959 - DNA, 25 bp, Mus musculus
cctgtggctggagttcgatggtgac

SEQ ID NO: 601960 - DNA, 25 bp, Mus musculus
cctgtgggaaatcacccgcttcttc

SEQ ID NO: 601961 - DNA, 25 bp, Mus musculus
cctgtgggaaatgacccgcttcttc

SEQ ID NO: 601962 - DNA, 25 bp, Mus musculus
cctgtgggacgaccagaagggtgcc

SEQ ID NO: 601963 - DNA, 25 bp, Mus musculus
cctgtgggacgagcagaagggtgcc

SEQ ID NO: 601964 - DNA, 25 bp, Mus musculus
cctgtgggccgaagctgaccaactc

SEQ ID NO: 601965 - DNA, 25 bp, Mus musculus
cctgtgggccgatgctgaccaactc

SEQ ID NO: 601966 - DNA, 25 bp, Mus musculus
cctgtgggctgtactacaagcttca

SEQ ID NO: 601967 - DNA, 25 bp, Mus musculus
cctgtgggctgttctacaagcttca

SEQ ID NO: 601968 - DNA, 25 bp, Mus musculus
cctgtgggtcatcatggagaaaagc

SEQ ID NO: 601969 - DNA, 25 bp, Mus musculus
cctgtgggtcatgatggagaaaagc

SEQ ID NO: 601970 - DNA, 25 bp, Mus musculus
cctgtgggtctcaagagtctggaga

SEQ ID NO: 601971 - DNA, 25 bp, Mus musculus
cctgtgggtctctagagtctggaga

SEQ ID NO: 601972 - DNA, 25 bp, Mus musculus
cctgtgggtggaacctagggccaga

SEQ ID NO: 601973 - DNA, 25 bp, Mus musculus
cctgtgggtggatcctagggccaga

SEQ ID NO: 601974 - DNA, 25 bp, Mus musculus
cctgtgggttagagcaccgggatct

SEQ ID NO: 601975 - DNA, 25 bp, Mus musculus
cctgtgggttagtgcaccgggatct

SEQ ID NO: 601976 - DNA, 25 bp, Mus musculus
cctgtggtatctcaccaaggagaag

SEQ ID NO: 601977 - DNA, 25 bp, Mus musculus
cctgtggtatctgaccaaggagaag

SEQ ID NO: 601978 - DNA, 25 bp, Mus musculus
cctgtggtcaggcatcatcatctgc

SEQ ID NO: 601979 - DNA, 25 bp, Mus musculus
cctgtggtcagggatcatcatctgc

SEQ ID NO: 601980 - DNA, 25 bp, Mus musculus
cctgtggtgacgctgtgatcacaag

SEQ ID NO: 601981 - DNA, 25 bp, Mus musculus
cctgtggtgacggtgtgatcacaag

SEQ ID NO: 601982 - DNA, 25 bp, Mus musculus
cctgtggtgagcatctctcccagta

SEQ ID NO: 601983 - DNA, 25 bp, Mus musculus
cctgtggtgagcttctctcccagta

SEQ ID NO: 601984 - DNA, 25 bp, Mus musculus
cctgtggtgagtatctcatgtgctc

SEQ ID NO: 601985 - DNA, 25 bp, Mus musculus
cctgtggtgagtttctcatgtgctc

SEQ ID NO: 601986 - DNA, 25 bp, Mus musculus
cctgtggtgcctctttcagcccaga

SEQ ID NO: 601987 - DNA, 25 bp, Mus musculus
cctgtggtgcctgtttcagcccaga

SEQ ID NO: 601988 - DNA, 25 bp, Mus musculus
cctgtggtggacaccacacaaggca

SEQ ID NO: 601989 - DNA, 25 bp, Mus musculus
cctgtggtggactccacacaaggca

SEQ ID NO: 601990 - DNA, 25 bp, Mus musculus
cctgtggttaaaccagccttggaaa

SEQ ID NO: 601991 - DNA, 25 bp, Mus musculus
cctgtggttaaagcagccttggaaa

SEQ ID NO: 601992 - DNA, 25 bp, Mus musculus
cctgtggttcaaatggcagctgaga

SEQ ID NO: 601993 - DNA, 25 bp, Mus musculus
cctgtggttcaattggcagctgaga

SEQ ID NO: 601994 - DNA, 25 bp, Mus musculus
cctgtggttcggatacgatgtgaag

SEQ ID NO: 601995 - DNA, 25 bp, Mus musculus
cctgtggttcggttacgatgtgaag

SEQ ID NO: 601996 - DNA, 25 bp, Mus musculus
cctgtgtaaggtctttgggcacacc

SEQ ID NO: 601997 - DNA, 25 bp, Mus musculus
cctgtgtaaggtgtttgggcacacc

SEQ ID NO: 601998 - DNA, 25 bp, Mus musculus
cctgtgtacttgaagaccactgaag

SEQ ID NO: 601999 - DNA, 25 bp, Mus musculus
cctgtgtacttgtagaccactgaag

SEQ ID NO: 602000 - DNA, 25 bp, Mus musculus
cctgtgtagacgcagcaatggctga

SEQ ID NO: 602001 - DNA, 25 bp, Mus musculus
cctgtgtagacggagcaatggctga

SEQ ID NO: 602002 - DNA, 25 bp, Mus musculus
cctgtgtatactctatatttgggca

SEQ ID NO: 602003 - DNA, 25 bp, Mus musculus
cctgtgtatactgtatatttgggca

SEQ ID NO: 602004 - DNA, 25 bp, Mus musculus
cctgtgtcctgaagggaaaggctac

SEQ ID NO: 602005 - DNA, 25 bp, Mus musculus
cctgtgtcctgacccttcataagaa

SEQ ID NO: 602006 - DNA, 25 bp, Mus musculus
cctgtgtcctgagccttcataagaa

SEQ ID NO: 602007 - DNA, 25 bp, Mus musculus
cctgtgtcctgatgggaaaggctac

SEQ ID NO: 602008 - DNA, 25 bp, Mus musculus
cctgtgtcgctgagagaatattgag

SEQ ID NO: 602009 - DNA, 25 bp, Mus musculus
cctgtgtcgctgtgagaatattgag

SEQ ID NO: 602010 - DNA, 25 bp, Mus musculus
cctgtgtctcggctctgctcagcgt

SEQ ID NO: 602011 - DNA, 25 bp, Mus musculus
cctgtgtctcgggtctgctcagcgt

SEQ ID NO: 602012 - DNA, 25 bp, Mus musculus
cctgtgtctgcaaagaatttcttcc

SEQ ID NO: 602013 - DNA, 25 bp, Mus musculus
cctgtgtctgcatagaatttcttcc

SEQ ID NO: 602014 - DNA, 25 bp, Mus musculus
cctgtgtctgcgaagtcctatggaa

SEQ ID NO: 602015 - DNA, 25 bp, Mus musculus
cctgtgtctgcgtagtcctatggaa

SEQ ID NO: 602016 - DNA, 25 bp, Mus musculus
cctgtgtcttcaagccatctgggaa

SEQ ID NO: 602017 - DNA, 25 bp, Mus musculus
cctgtgtcttcatgccatctgggaa

SEQ ID NO: 602018 - DNA, 25 bp, Mus musculus
cctgtgtgaaacatcagtgctagcc

SEQ ID NO: 602019 - DNA, 25 bp, Mus musculus
cctgtgtgaaacttcagtgctagcc

SEQ ID NO: 602020 - DNA, 25 bp, Mus musculus
cctgtgtgagaacattgccggccac

SEQ ID NO: 602021 - DNA, 25 bp, Mus musculus
cctgtgtgagaagattgccggccac

SEQ ID NO: 602022 - DNA, 25 bp, Mus musculus
cctgtgtgccgaaactgtcaaacgc

SEQ ID NO: 602023 - DNA, 25 bp, Mus musculus
cctgtgtgccgatactgtcaaacgc

SEQ ID NO: 602024 - DNA, 25 bp, Mus musculus
cctgtgtggataagagcaaaaaccc

SEQ ID NO: 602025 - DNA, 25 bp, Mus musculus
cctgtgtggatatgagcaaaaaccc

SEQ ID NO: 602026 - DNA, 25 bp, Mus musculus
cctgtgtggatgctatcaactcctt

SEQ ID NO: 602027 - DNA, 25 bp, Mus musculus
cctgtgtggatggtatcaactcctt

SEQ ID NO: 602028 - DNA, 25 bp, Mus musculus
cctgtgtggcgaccgagtcattgtt

SEQ ID NO: 602029 - DNA, 25 bp, Mus musculus
cctgtgtggcgagcgagtcattgtt

SEQ ID NO: 602030 - DNA, 25 bp, Mus musculus
cctgtgtgggtaccaacccctgcta

SEQ ID NO: 602031 - DNA, 25 bp, Mus musculus
cctgtgtgggtagcaacccctgcta

SEQ ID NO: 602032 - DNA, 25 bp, Mus musculus
cctgtgtgttttcaagaggctcgta

SEQ ID NO: 602033 - DNA, 25 bp, Mus musculus
cctgtgtgttttgaagaggctcgta

SEQ ID NO: 602034 - DNA, 25 bp, Mus musculus
cctgtgttacatagcccctgctttg

SEQ ID NO: 602035 - DNA, 25 bp, Mus musculus
cctgtgttacattgcccctgctttg

SEQ ID NO: 602036 - DNA, 25 bp, Mus musculus
cctgtgttctctcgcactccaaagg

SEQ ID NO: 602037 - DNA, 25 bp, Mus musculus
cctgtgttctctggcactccaaagg

SEQ ID NO: 602038 - DNA, 25 bp, Mus musculus
cctgtgtttggacaactgtcagaca

SEQ ID NO: 602039 - DNA, 25 bp, Mus musculus
cctgtgtttggagaactgtcagaca

SEQ ID NO: 602040 - DNA, 25 bp, Mus musculus
cctgttaacaagatcaagatgcacg

SEQ ID NO: 602041 - DNA, 25 bp, Mus musculus
cctgttaacaagttcaagatgcacg

SEQ ID NO: 602042 - DNA, 25 bp, Mus musculus
cctgttacaggaatggttatgaatt

SEQ ID NO: 602043 - DNA, 25 bp, Mus musculus
cctgttacaggattggttatgaatt

SEQ ID NO: 602044 - DNA, 25 bp, Mus musculus
cctgttacatgtcggatatcgagtt

SEQ ID NO: 602045 - DNA, 25 bp, Mus musculus
cctgttacatgtgggatatcgagtt

SEQ ID NO: 602046 - DNA, 25 bp, Mus musculus
cctgttagaagaagattaaagtcag

SEQ ID NO: 602047 - DNA, 25 bp, Mus musculus
cctgttagaagatgattaaagtcag

SEQ ID NO: 602048 - DNA, 25 bp, Mus musculus
cctgttagcattcatggcagatgcc

SEQ ID NO: 602049 - DNA, 25 bp, Mus musculus
cctgttagcattgatggcagatgcc

SEQ ID NO: 602050 - DNA, 25 bp, Mus musculus
cctgttagtggaagagcctctgaga

SEQ ID NO: 602051 - DNA, 25 bp, Mus musculus
cctgttagtggatgagcctctgaga

SEQ ID NO: 602052 - DNA, 25 bp, Mus musculus
cctgttatcctgacataccacgaca

SEQ ID NO: 602053 - DNA, 25 bp, Mus musculus
cctgttatcctgtcataccacgaca

SEQ ID NO: 602054 - DNA, 25 bp, Mus musculus
cctgttatgcttccttgcagatctg

SEQ ID NO: 602055 - DNA, 25 bp, Mus musculus
cctgttatgcttgcttgcagatctg

SEQ ID NO: 602056 - DNA, 25 bp, Mus musculus
cctgttatggagatgttagactggt

SEQ ID NO: 602057 - DNA, 25 bp, Mus musculus
cctgttatggagttgttagactggt

SEQ ID NO: 602058 - DNA, 25 bp, Mus musculus
cctgttatgtgcattctttctggca

SEQ ID NO: 602059 - DNA, 25 bp, Mus musculus
cctgttatgtgctttctttctggca

SEQ ID NO: 602060 - DNA, 25 bp, Mus musculus
cctgttcaagaaacgactagacaag

SEQ ID NO: 602061 - DNA, 25 bp, Mus musculus
cctgttcaagaatcgactagacaag

SEQ ID NO: 602062 - DNA, 25 bp, Mus musculus
cctgttcaagtaagcatggatcacc

SEQ ID NO: 602063 - DNA, 25 bp, Mus musculus
cctgttcaagtatgcatggatcacc

SEQ ID NO: 602064 - DNA, 25 bp, Mus musculus
cctgttcagaggaaggaaagtctac

SEQ ID NO: 602065 - DNA, 25 bp, Mus musculus
cctgttcagaggtaggaaagtctac

SEQ ID NO: 602066 - DNA, 25 bp, Mus musculus
cctgttcagctgaccagacatgtaa

SEQ ID NO: 602067 - DNA, 25 bp, Mus musculus
cctgttcagctgtccagacatgtaa

SEQ ID NO: 602068 - DNA, 25 bp, Mus musculus
cctgttcagttgaattacttttgcc

SEQ ID NO: 602069 - DNA, 25 bp, Mus musculus
cctgttcagttgtattacttttgcc

SEQ ID NO: 602070 - DNA, 25 bp, Mus musculus
cctgttcatggtcggagtgttactg

SEQ ID NO: 602071 - DNA, 25 bp, Mus musculus
cctgttcatggtgggagtgttactg

SEQ ID NO: 602072 - DNA, 25 bp, Mus musculus
cctgttcattgtcggagtcacctgt

SEQ ID NO: 602073 - DNA, 25 bp, Mus musculus
cctgttcattgtgggagtcacctgt

SEQ ID NO: 602074 - DNA, 25 bp, Mus musculus
cctgttccagaactatttgaggacc

SEQ ID NO: 602075 - DNA, 25 bp, Mus musculus
cctgttccagaagtatttgaggacc

SEQ ID NO: 602076 - DNA, 25 bp, Mus musculus
cctgttcccgtcaaactgagcgtgc

SEQ ID NO: 602077 - DNA, 25 bp, Mus musculus
cctgttcccgtctaactgagcgtgc

SEQ ID NO: 602078 - DNA, 25 bp, Mus musculus
cctgttccggagcagactgagccca

SEQ ID NO: 602079 - DNA, 25 bp, Mus musculus
cctgttccggaggagactgagccca

SEQ ID NO: 602080 - DNA, 25 bp, Mus musculus
cctgttcctacacacacggaagtgg

SEQ ID NO: 602081 - DNA, 25 bp, Mus musculus
cctgttcctacagacacggaagtgg

SEQ ID NO: 602082 - DNA, 25 bp, Mus musculus
cctgttcctctacatcctctggaga

SEQ ID NO: 602083 - DNA, 25 bp, Mus musculus
cctgttcctctagatcctctggaga

SEQ ID NO: 602084 - DNA, 25 bp, Mus musculus
cctgttcgagcaagtagatcgggaa

SEQ ID NO: 602085 - DNA, 25 bp, Mus musculus
cctgttcgagcatgtagatcgggaa

SEQ ID NO: 602086 - DNA, 25 bp, Mus musculus
cctgttcgcggacgctgctagctgc

SEQ ID NO: 602087 - DNA, 25 bp, Mus musculus
cctgttcgcggaggctgctagctgc

SEQ ID NO: 602088 - DNA, 25 bp, Mus musculus
cctgttctcaaactttgtaaccatg

SEQ ID NO: 602089 - DNA, 25 bp, Mus musculus
cctgttctcaaagtttgtaaccatg

SEQ ID NO: 602090 - DNA, 25 bp, Mus musculus
cctgttctcaggagatgtgagtcac

SEQ ID NO: 602091 - DNA, 25 bp, Mus musculus
cctgttctcaggtgatgtgagtcac

SEQ ID NO: 602092 - DNA, 25 bp, Mus musculus
cctgttctcgctcccactggagtgg

SEQ ID NO: 602093 - DNA, 25 bp, Mus musculus
cctgttctcgctgccactggagtgg

SEQ ID NO: 602094 - DNA, 25 bp, Mus musculus
cctgttctctagcagaggaaataaa

SEQ ID NO: 602095 - DNA, 25 bp, Mus musculus
cctgttctctaggagaggaaataaa

SEQ ID NO: 602096 - DNA, 25 bp, Mus musculus
cctgttctgaggctgcaggtcccac

SEQ ID NO: 602097 - DNA, 25 bp, Mus musculus
cctgttctgagggtgcaggtcccac

SEQ ID NO: 602098 - DNA, 25 bp, Mus musculus
cctgttctggtgactcgtcagcttc

SEQ ID NO: 602099 - DNA, 25 bp, Mus musculus
cctgttctggtgtctcgtcagcttc

SEQ ID NO: 602100 - DNA, 25 bp, Mus musculus
cctgttctgtctcctatgtgggtgc

SEQ ID NO: 602101 - DNA, 25 bp, Mus musculus
cctgttctgtctgctatgtgggtgc

SEQ ID NO: 602102 - DNA, 25 bp, Mus musculus
cctgttcttcgcagaccagttcctg

SEQ ID NO: 602103 - DNA, 25 bp, Mus musculus
cctgttcttcgctgaccagttcctg

SEQ ID NO: 602104 - DNA, 25 bp, Mus musculus
cctgttcttcgtcatggagtttctc

SEQ ID NO: 602105 - DNA, 25 bp, Mus musculus
cctgttcttcgtgatggagtttctc

SEQ ID NO: 602106 - DNA, 25 bp, Mus musculus
cctgttgaagagaaggtcggtccct

SEQ ID NO: 602107 - DNA, 25 bp, Mus musculus
cctgttgaagagtaggtcggtccct

SEQ ID NO: 602108 - DNA, 25 bp, Mus musculus
cctgttgaggagagatgacttccgg

SEQ ID NO: 602109 - DNA, 25 bp, Mus musculus
cctgttgaggagtgatgacttccgg

SEQ ID NO: 602110 - DNA, 25 bp, Mus musculus
cctgttgcaacgagagccttcgaga

SEQ ID NO: 602111 - DNA, 25 bp, Mus musculus
cctgttgcaacgtgagccttcgaga

SEQ ID NO: 602112 - DNA, 25 bp, Mus musculus
cctgttgcagccagctcccttagga

SEQ ID NO: 602113 - DNA, 25 bp, Mus musculus
cctgttgcagcctgctcccttagga

SEQ ID NO: 602114 - DNA, 25 bp, Mus musculus
cctgttgctactcggctccagttct

SEQ ID NO: 602115 - DNA, 25 bp, Mus musculus
cctgttgctactgggctccagttct

SEQ ID NO: 602116 - DNA, 25 bp, Mus musculus
cctgttgctgcacgttggcttcctg

SEQ ID NO: 602117 - DNA, 25 bp, Mus musculus
cctgttgctgcaggttggcttcctg

SEQ ID NO: 602118 - DNA, 25 bp, Mus musculus
cctgttgcttctccatctgtaagaa

SEQ ID NO: 602119 - DNA, 25 bp, Mus musculus
cctgttgcttctgcatctgtaagaa

SEQ ID NO: 602120 - DNA, 25 bp, Mus musculus
cctgttggaagaccatttaggtgag

SEQ ID NO: 602121 - DNA, 25 bp, Mus musculus
cctgttggaagactcctcatcactc

SEQ ID NO: 602122 - DNA, 25 bp, Mus musculus
cctgttggaagagcatttaggtgag

SEQ ID NO: 602123 - DNA, 25 bp, Mus musculus
cctgttggaagagtcctcatcactc

SEQ ID NO: 602124 - DNA, 25 bp, Mus musculus
cctgttggacctaaaggagaacctg

SEQ ID NO: 602125 - DNA, 25 bp, Mus musculus
cctgttggaccttaaggagaacctg

SEQ ID NO: 602126 - DNA, 25 bp, Mus musculus
cctgttggagctctgggactccctg

SEQ ID NO: 602127 - DNA, 25 bp, Mus musculus
cctgttggagctgtgggactccctg

SEQ ID NO: 602128 - DNA, 25 bp, Mus musculus
cctgttggatggaaggacacatccc

SEQ ID NO: 602129 - DNA, 25 bp, Mus musculus
cctgttggatggtaggacacatccc

SEQ ID NO: 602130 - DNA, 25 bp, Mus musculus
cctgttggcctgctgatgtaagacg

SEQ ID NO: 602131 - DNA, 25 bp, Mus musculus
cctgttggcctggtgatgtaagacg

SEQ ID NO: 602132 - DNA, 25 bp, Mus musculus
cctgttgggtgcagaccgcggctca

SEQ ID NO: 602133 - DNA, 25 bp, Mus musculus
cctgttgggtgctgaccgcggctca

SEQ ID NO: 602134 - DNA, 25 bp, Mus musculus
cctgttgtccaactcaaaggagccc

SEQ ID NO: 602135 - DNA, 25 bp, Mus musculus
cctgttgtccaagtcaaaggagccc

SEQ ID NO: 602136 - DNA, 25 bp, Mus musculus
cctgttgtccatcaactgggccatt

SEQ ID NO: 602137 - DNA, 25 bp, Mus musculus
cctgttgtccatgaactgggccatt

SEQ ID NO: 602138 - DNA, 25 bp, Mus musculus
cctgttgtgcaaaggtggtggaatc

SEQ ID NO: 602139 - DNA, 25 bp, Mus musculus
cctgttgtgcaatggtggtggaatc

SEQ ID NO: 602140 - DNA, 25 bp, Mus musculus
cctgttgtgtaccactggccctggg

SEQ ID NO: 602141 - DNA, 25 bp, Mus musculus
cctgttgtgtacgactggccctggg

SEQ ID NO: 602142 - DNA, 25 bp, Mus musculus
cctgttgtgtctattaagctgaaca

SEQ ID NO: 602143 - DNA, 25 bp, Mus musculus
cctgttgtgtcttttaagctgaaca

SEQ ID NO: 602144 - DNA, 25 bp, Mus musculus
cctgttgttaaaacaatgctgtact

SEQ ID NO: 602145 - DNA, 25 bp, Mus musculus
cctgttgttaaatcaatgctgtact

SEQ ID NO: 602146 - DNA, 25 bp, Mus musculus
cctgttgttactatccgtgccagaa

SEQ ID NO: 602147 - DNA, 25 bp, Mus musculus
cctgttgttactttccgtgccagaa

SEQ ID NO: 602148 - DNA, 25 bp, Mus musculus
cctgttgttattcgtcctcgtacta

SEQ ID NO: 602149 - DNA, 25 bp, Mus musculus
cctgttgttattggtcctcgtacta

SEQ ID NO: 602150 - DNA, 25 bp, Mus musculus
cctgttgttcctctggatatccaga

SEQ ID NO: 602151 - DNA, 25 bp, Mus musculus
cctgttgttcctgtggatatccaga

SEQ ID NO: 602152 - DNA, 25 bp, Mus musculus
cctgttgttcgcagtccatggtgct

SEQ ID NO: 602153 - DNA, 25 bp, Mus musculus
cctgttgttcgctgtccatggtgct

SEQ ID NO: 602154 - DNA, 25 bp, Mus musculus
cctgttgttcttcgagtcaagagca

SEQ ID NO: 602155 - DNA, 25 bp, Mus musculus
cctgttgttcttggagtcaagagca

SEQ ID NO: 602156 - DNA, 25 bp, Mus musculus
cctgttgtttatatgctgtgtgaca

SEQ ID NO: 602157 - DNA, 25 bp, Mus musculus
cctgttgtttatttgctgtgtgaca

SEQ ID NO: 602158 - DNA, 25 bp, Mus musculus
cctgtttaatgaagagatggatgac

SEQ ID NO: 602159 - DNA, 25 bp, Mus musculus
cctgtttaatgatgagatggatgac

SEQ ID NO: 602160 - DNA, 25 bp, Mus musculus
cctgtttacttgagagcccctctca

SEQ ID NO: 602161 - DNA, 25 bp, Mus musculus
cctgtttacttgtgagcccctctca

SEQ ID NO: 602162 - DNA, 25 bp, Mus musculus
cctgtttataggcattgcagctctt

SEQ ID NO: 602163 - DNA, 25 bp, Mus musculus
cctgtttatagggattgcagctctt

SEQ ID NO: 602164 - DNA, 25 bp, Mus musculus
cctgtttatcacaggccctgaagtt

SEQ ID NO: 602165 - DNA, 25 bp, Mus musculus
cctgtttatcactggccctgaagtt

SEQ ID NO: 602166 - DNA, 25 bp, Mus musculus
cctgtttcacagcatgaggccacca

SEQ ID NO: 602167 - DNA, 25 bp, Mus musculus
cctgtttcacaggatgaggccacca

SEQ ID NO: 602168 - DNA, 25 bp, Mus musculus
cctgtttcagaaccacatcgagaac

SEQ ID NO: 602169 - DNA, 25 bp, Mus musculus
cctgtttcagaagcacatcgagaac

SEQ ID NO: 602170 - DNA, 25 bp, Mus musculus
cctgtttgagatatttgaaatcgaa

SEQ ID NO: 602171 - DNA, 25 bp, Mus musculus
cctgtttgagatttttgaaatcgaa

SEQ ID NO: 602172 - DNA, 25 bp, Mus musculus
cctgtttgaggtcggtccaggacat

SEQ ID NO: 602173 - DNA, 25 bp, Mus musculus
cctgtttgaggtgggtccaggacat

SEQ ID NO: 602174 - DNA, 25 bp, Mus musculus
cctgtttgagttatgtgttggttcc

SEQ ID NO: 602175 - DNA, 25 bp, Mus musculus
cctgtttgagttttgtgttggttcc

SEQ ID NO: 602176 - DNA, 25 bp, Mus musculus
cctgtttgcagtacagagacaggct

SEQ ID NO: 602177 - DNA, 25 bp, Mus musculus
cctgtttgcagttcagagacaggct

SEQ ID NO: 602178 - DNA, 25 bp, Mus musculus
cctgtttggagcacaagccctccta

SEQ ID NO: 602179 - DNA, 25 bp, Mus musculus
cctgtttggagctcaagccctccta

SEQ ID NO: 602180 - DNA, 25 bp, Mus musculus
cctgtttggcgtccactacatggtg

SEQ ID NO: 602181 - DNA, 25 bp, Mus musculus
cctgtttggcgtgcactacatggtg

SEQ ID NO: 602182 - DNA, 25 bp, Mus musculus
cctgtttggtggcatttagaagcac

SEQ ID NO: 602183 - DNA, 25 bp, Mus musculus
cctgtttggtgggatttagaagcac

SEQ ID NO: 602184 - DNA, 25 bp, Mus musculus
cctgtttgtcggacgaggagacatg

SEQ ID NO: 602185 - DNA, 25 bp, Mus musculus
cctgtttgtcggtcgaggagacatg

SEQ ID NO: 602186 - DNA, 25 bp, Mus musculus
cctgttttcactaggctctgggtgc

SEQ ID NO: 602187 - DNA, 25 bp, Mus musculus
cctgttttcacttggctctgggtgc

SEQ ID NO: 602188 - DNA, 25 bp, Mus musculus
cctgttttcttgactctctcaggac

SEQ ID NO: 602189 - DNA, 25 bp, Mus musculus
cctgttttcttgtctctctcaggac

SEQ ID NO: 602190 - DNA, 25 bp, Mus musculus
cctgttttgcgcaagtgtgagctcc

SEQ ID NO: 602191 - DNA, 25 bp, Mus musculus
cctgttttgcgctagtgtgagctcc

SEQ ID NO: 602192 - DNA, 25 bp, Mus musculus
cctgtttttctgcagaaggtgtttg

SEQ ID NO: 602193 - DNA, 25 bp, Mus musculus
cctgtttttctggagaaggtgtttg

SEQ ID NO: 602194 - DNA, 25 bp, Mus musculus
cctgtttttgggatacaacatctga

SEQ ID NO: 602195 - DNA, 25 bp, Mus musculus
cctgtttttgggttacaacatctga

SEQ ID NO: 602196 - DNA, 25 bp, Mus musculus
ccttaaaaaatccaagagaggagca

SEQ ID NO: 602197 - DNA, 25 bp, Mus musculus
ccttaaaaaatcgaagagaggagca

SEQ ID NO: 602198 - DNA, 25 bp, Mus musculus
ccttaaaagattacgacatgaactg

SEQ ID NO: 602199 - DNA, 25 bp, Mus musculus
ccttaaaagatttcgacatgaactg

SEQ ID NO: 602200 - DNA, 25 bp, Mus musculus
ccttaaacttttccctgatgattaa

SEQ ID NO: 602201 - DNA, 25 bp, Mus musculus
ccttaaacttttgcctgatgattaa

SEQ ID NO: 602202 - DNA, 25 bp, Mus musculus
ccttaaagaaagagtttgctgaaca

SEQ ID NO: 602203 - DNA, 25 bp, Mus musculus
ccttaaagaaagtgtttgctgaaca

SEQ ID NO: 602204 - DNA, 25 bp, Mus musculus
ccttaaaggatacattagctgacac

SEQ ID NO: 602205 - DNA, 25 bp, Mus musculus
ccttaaaggatagattagctgacac

SEQ ID NO: 602206 - DNA, 25 bp, Mus musculus
ccttaaaggtggagacttctgcagc

SEQ ID NO: 602207 - DNA, 25 bp, Mus musculus
ccttaaaggtggtgacttctgcagc

SEQ ID NO: 602208 - DNA, 25 bp, Mus musculus
ccttaaaggttcaatgaagattcac

SEQ ID NO: 602209 - DNA, 25 bp, Mus musculus
ccttaaaggttctatgaagattcac

SEQ ID NO: 602210 - DNA, 25 bp, Mus musculus
ccttaacaggatcggtgcagcgaac

SEQ ID NO: 602211 - DNA, 25 bp, Mus musculus
ccttaacaggatgggtgcagcgaac

SEQ ID NO: 602212 - DNA, 25 bp, Mus musculus
ccttaacagtgaatttggacttcca

SEQ ID NO: 602213 - DNA, 25 bp, Mus musculus
ccttaacagtgattttggacttcca

SEQ ID NO: 602214 - DNA, 25 bp, Mus musculus
ccttaacatggaagtgttccctgtg

SEQ ID NO: 602215 - DNA, 25 bp, Mus musculus
ccttaacatggatgtgttccctgtg

SEQ ID NO: 602216 - DNA, 25 bp, Mus musculus
ccttaagaatgcatgcggcgctcct

SEQ ID NO: 602217 - DNA, 25 bp, Mus musculus
ccttaagaatgcttgcggcgctcct

SEQ ID NO: 602218 - DNA, 25 bp, Mus musculus
ccttaagcaaagacgggagaatatt

SEQ ID NO: 602219 - DNA, 25 bp, Mus musculus
ccttaagcaaagtcgggagaatatt

SEQ ID NO: 602220 - DNA, 25 bp, Mus musculus
ccttaaggcttcaaactggtccact

SEQ ID NO: 602221 - DNA, 25 bp, Mus musculus
ccttaaggcttctaactggtccact

SEQ ID NO: 602222 - DNA, 25 bp, Mus musculus
ccttaagggaagagcagacaagaac

SEQ ID NO: 602223 - DNA, 25 bp, Mus musculus
ccttaagggaagtgcagacaagaac

SEQ ID NO: 602224 - DNA, 25 bp, Mus musculus
ccttaaggttcacagcgatggatgc

SEQ ID NO: 602225 - DNA, 25 bp, Mus musculus
ccttaaggttcagagcgatggatgc

SEQ ID NO: 602226 - DNA, 25 bp, Mus musculus
ccttaagtgtgaaagtaatgacaga

SEQ ID NO: 602227 - DNA, 25 bp, Mus musculus
ccttaagtgtgatagtaatgacaga

SEQ ID NO: 602228 - DNA, 25 bp, Mus musculus
ccttaataaatgagtaatccttagc

SEQ ID NO: 602229 - DNA, 25 bp, Mus musculus
ccttaataaatgtgtaatccttagc

SEQ ID NO: 602230 - DNA, 25 bp, Mus musculus
ccttaatggctacatgtggctttgc

SEQ ID NO: 602231 - DNA, 25 bp, Mus musculus
ccttaatggctagatgtggctttgc

SEQ ID NO: 602232 - DNA, 25 bp, Mus musculus
ccttaattacatcctactcgatggg

SEQ ID NO: 602233 - DNA, 25 bp, Mus musculus
ccttaattacatgctactcgatggg

SEQ ID NO: 602234 - DNA, 25 bp, Mus musculus
ccttacaaatgccacaagtgcggga

SEQ ID NO: 602235 - DNA, 25 bp, Mus musculus
ccttacaaatgcgacaagtgcggga

SEQ ID NO: 602236 - DNA, 25 bp, Mus musculus
ccttacaacaggaaacactatcgtg

SEQ ID NO: 602237 - DNA, 25 bp, Mus musculus
ccttacaacaggtaacactatcgtg

SEQ ID NO: 602238 - DNA, 25 bp, Mus musculus
ccttacaactatcgctgcttggaca

SEQ ID NO: 602239 - DNA, 25 bp, Mus musculus
ccttacaactatggctgcttggaca

SEQ ID NO: 602240 - DNA, 25 bp, Mus musculus
ccttacaagtgtagatacatctggc

SEQ ID NO: 602241 - DNA, 25 bp, Mus musculus
ccttacaagtgttgatacatctggc

SEQ ID NO: 602242 - DNA, 25 bp, Mus musculus
ccttacaatactagagctctttgat

SEQ ID NO: 602243 - DNA, 25 bp, Mus musculus
ccttacaatacttgagctctttgat

SEQ ID NO: 602244 - DNA, 25 bp, Mus musculus
ccttacaatctaaggaagaagatga

SEQ ID NO: 602245 - DNA, 25 bp, Mus musculus
ccttacaatctatggaagaagatga

SEQ ID NO: 602246 - DNA, 25 bp, Mus musculus
ccttacaatgccaggtcctcagtgg

SEQ ID NO: 602247 - DNA, 25 bp, Mus musculus
ccttacaatgcctggtcctcagtgg

SEQ ID NO: 602248 - DNA, 25 bp, Mus musculus
ccttacaatgtaccagtgccttcag

SEQ ID NO: 602249 - DNA, 25 bp, Mus musculus
ccttacaatgtagcagtgccttcag

SEQ ID NO: 602250 - DNA, 25 bp, Mus musculus
ccttacacacagaacatccagatct

SEQ ID NO: 602251 - DNA, 25 bp, Mus musculus
ccttacacacagtacatccagatct

SEQ ID NO: 602252 - DNA, 25 bp, Mus musculus
ccttacacagagaaatcaggaaaat

SEQ ID NO: 602253 - DNA, 25 bp, Mus musculus
ccttacacagagtaatcaggaaaat

SEQ ID NO: 602254 - DNA, 25 bp, Mus musculus
ccttacagaatgaatgcatacagcc

SEQ ID NO: 602255 - DNA, 25 bp, Mus musculus
ccttacagaatgtatgcatacagcc

SEQ ID NO: 602256 - DNA, 25 bp, Mus musculus
ccttacataaaacgaggaacctgct

SEQ ID NO: 602257 - DNA, 25 bp, Mus musculus
ccttacataaaaggaggaacctgct

SEQ ID NO: 602258 - DNA, 25 bp, Mus musculus
ccttacatcggccatgtcatggaag

SEQ ID NO: 602259 - DNA, 25 bp, Mus musculus
ccttacatcggcgatgtcatggaag

SEQ ID NO: 602260 - DNA, 25 bp, Mus musculus
ccttacatggcacgtgtgaggtttg

SEQ ID NO: 602261 - DNA, 25 bp, Mus musculus
ccttacatggcaggtgtgaggtttg

SEQ ID NO: 602262 - DNA, 25 bp, Mus musculus
ccttacattggaattgtgacgatcc

SEQ ID NO: 602263 - DNA, 25 bp, Mus musculus
ccttacattggatttgtgacgatcc

SEQ ID NO: 602264 - DNA, 25 bp, Mus musculus
ccttaccagtatcaactggatcact

SEQ ID NO: 602265 - DNA, 25 bp, Mus musculus
ccttaccagtatgaactggatcact

SEQ ID NO: 602266 - DNA, 25 bp, Mus musculus
ccttacctgttgcacctgtgttagc

SEQ ID NO: 602267 - DNA, 25 bp, Mus musculus
ccttacctgttggacctgtgttagc

SEQ ID NO: 602268 - DNA, 25 bp, Mus musculus
ccttaccttaggacagccactggac

SEQ ID NO: 602269 - DNA, 25 bp, Mus musculus
ccttaccttaggtcagccactggac

SEQ ID NO: 602270 - DNA, 25 bp, Mus musculus
ccttaccttctgctccgtggtggaa

SEQ ID NO: 602271 - DNA, 25 bp, Mus musculus
ccttaccttctggtccgtggtggaa

SEQ ID NO: 602272 - DNA, 25 bp, Mus musculus
ccttacgaaatcacgggtgctggag

SEQ ID NO: 602273 - DNA, 25 bp, Mus musculus
ccttacgaaatctcgggtgctggag

SEQ ID NO: 602274 - DNA, 25 bp, Mus musculus
ccttacgagtgaccatgagcgagta

SEQ ID NO: 602275 - DNA, 25 bp, Mus musculus
ccttacgagtgagcatgagcgagta

SEQ ID NO: 602276 - DNA, 25 bp, Mus musculus
ccttacggaagcagccctcttacag

SEQ ID NO: 602277 - DNA, 25 bp, Mus musculus
ccttacggaagctgccctcttacag

SEQ ID NO: 602278 - DNA, 25 bp, Mus musculus
ccttacggatgtcgccggtcccaga

SEQ ID NO: 602279 - DNA, 25 bp, Mus musculus
ccttacggatgtggccggtcccaga

SEQ ID NO: 602280 - DNA, 25 bp, Mus musculus
ccttacggtaagaggaatggtgctc

SEQ ID NO: 602281 - DNA, 25 bp, Mus musculus
ccttacggtaagtggaatggtgctc

SEQ ID NO: 602282 - DNA, 25 bp, Mus musculus
ccttactaaagaacacaggaagaga

SEQ ID NO: 602283 - DNA, 25 bp, Mus musculus
ccttactaaagatcacaggaagaga

SEQ ID NO: 602284 - DNA, 25 bp, Mus musculus
ccttactcagcacaggaaacaagag

SEQ ID NO: 602285 - DNA, 25 bp, Mus musculus
ccttactcagcagaggaaacaagag

SEQ ID NO: 602286 - DNA, 25 bp, Mus musculus
ccttactgaagtcgccaatggcatt

SEQ ID NO: 602287 - DNA, 25 bp, Mus musculus
ccttactgaagtggccaatggcatt

SEQ ID NO: 602288 - DNA, 25 bp, Mus musculus
ccttactgcttcacaacttggagga

SEQ ID NO: 602289 - DNA, 25 bp, Mus musculus
ccttactgcttctcaacttggagga

SEQ ID NO: 602290 - DNA, 25 bp, Mus musculus
ccttactgtgtgcagcattgtgtgc

SEQ ID NO: 602291 - DNA, 25 bp, Mus musculus
ccttactgtgtggagcattgtgtgc

SEQ ID NO: 602292 - DNA, 25 bp, Mus musculus
ccttacttgaaacgctggacctgaa

SEQ ID NO: 602293 - DNA, 25 bp, Mus musculus
ccttacttgaaaggctggacctgaa

SEQ ID NO: 602294 - DNA, 25 bp, Mus musculus
ccttacttgaggactgtgggtgaga

SEQ ID NO: 602295 - DNA, 25 bp, Mus musculus
ccttacttgaggtctgtgggtgaga

SEQ ID NO: 602296 - DNA, 25 bp, Mus musculus
ccttacttggatcgatgctgagaca

SEQ ID NO: 602297 - DNA, 25 bp, Mus musculus
ccttacttggatggatgctgagaca

SEQ ID NO: 602298 - DNA, 25 bp, Mus musculus
ccttagaaagccagatcgacaacag

SEQ ID NO: 602299 - DNA, 25 bp, Mus musculus
ccttagaaagcctgatcgacaacag

SEQ ID NO: 602300 - DNA, 25 bp, Mus musculus
ccttagaagattagcggagttttat

SEQ ID NO: 602301 - DNA, 25 bp, Mus musculus
ccttagaagatttgcggagttttat

SEQ ID NO: 602302 - DNA, 25 bp, Mus musculus
ccttagactgagctgagcagagatg

SEQ ID NO: 602303 - DNA, 25 bp, Mus musculus
ccttagactgaggtgagcagagatg

SEQ ID NO: 602304 - DNA, 25 bp, Mus musculus
ccttagagagttcggtggatgttat

SEQ ID NO: 602305 - DNA, 25 bp, Mus musculus
ccttagagagttgggtggatgttat

SEQ ID NO: 602306 - DNA, 25 bp, Mus musculus
ccttagagcaaacagatcaaagcat

SEQ ID NO: 602307 - DNA, 25 bp, Mus musculus
ccttagagcaaagagatcaaagcat

SEQ ID NO: 602308 - DNA, 25 bp, Mus musculus
ccttagagctccaaccggcagtggc

SEQ ID NO: 602309 - DNA, 25 bp, Mus musculus
ccttagagctcctaccggcagtggc

SEQ ID NO: 602310 - DNA, 25 bp, Mus musculus
ccttagagcttccattcggcgaatg

SEQ ID NO: 602311 - DNA, 25 bp, Mus musculus
ccttagagcttcgattcggcgaatg

SEQ ID NO: 602312 - DNA, 25 bp, Mus musculus
ccttagaggtggacagatgcacact

SEQ ID NO: 602313 - DNA, 25 bp, Mus musculus
ccttagaggtggtcagatgcacact

SEQ ID NO: 602314 - DNA, 25 bp, Mus musculus
ccttagagttcaagggagttaacat

SEQ ID NO: 602315 - DNA, 25 bp, Mus musculus
ccttagagttcatgggagttaacat

SEQ ID NO: 602316 - DNA, 25 bp, Mus musculus
ccttagagttgaccatctgtttgcc

SEQ ID NO: 602317 - DNA, 25 bp, Mus musculus
ccttagagttgagcatctgtttgcc

SEQ ID NO: 602318 - DNA, 25 bp, Mus musculus
ccttagataatgctgatggtcctcc

SEQ ID NO: 602319 - DNA, 25 bp, Mus musculus
ccttagataatggtgatggtcctcc

SEQ ID NO: 602320 - DNA, 25 bp, Mus musculus
ccttagatcaggacggtcagggacg

SEQ ID NO: 602321 - DNA, 25 bp, Mus musculus
ccttagatcaggtcggtcagggacg

SEQ ID NO: 602322 - DNA, 25 bp, Mus musculus
ccttagcaaacaatctgagggaaga

SEQ ID NO: 602323 - DNA, 25 bp, Mus musculus
ccttagcaaacattctgagggaaga

SEQ ID NO: 602324 - DNA, 25 bp, Mus musculus
ccttagcaaccccaacgtggaagtg

SEQ ID NO: 602325 - DNA, 25 bp, Mus musculus
ccttagcaacccgaacgtggaagtg

SEQ ID NO: 602326 - DNA, 25 bp, Mus musculus
ccttagcaagtcaggacacagagtg

SEQ ID NO: 602327 - DNA, 25 bp, Mus musculus
ccttagcaagtctggacacagagtg

SEQ ID NO: 602328 - DNA, 25 bp, Mus musculus
ccttagcaggtgcagtaggagctca

SEQ ID NO: 602329 - DNA, 25 bp, Mus musculus
ccttagcaggtggagtaggagctca

SEQ ID NO: 602330 - DNA, 25 bp, Mus musculus
ccttagcatgtaacactctgtggag

SEQ ID NO: 602331 - DNA, 25 bp, Mus musculus
ccttagcatgtatcactctgtggag

SEQ ID NO: 602332 - DNA, 25 bp, Mus musculus
ccttagccacataggagatgctgtt

SEQ ID NO: 602333 - DNA, 25 bp, Mus musculus
ccttagccacattggagatgctgtt

SEQ ID NO: 602334 - DNA, 25 bp, Mus musculus
ccttagccactcatcttgtagtggg

SEQ ID NO: 602335 - DNA, 25 bp, Mus musculus
ccttagccactcttcttgtagtggg

SEQ ID NO: 602336 - DNA, 25 bp, Mus musculus
ccttagccttccatattggtaggga

SEQ ID NO: 602337 - DNA, 25 bp, Mus musculus
ccttagccttccttattggtaggga

SEQ ID NO: 602338 - DNA, 25 bp, Mus musculus
ccttagcgatggcacccggtagagc

SEQ ID NO: 602339 - DNA, 25 bp, Mus musculus
ccttagcgatgggacccggtagagc

SEQ ID NO: 602340 - DNA, 25 bp, Mus musculus
ccttagctctgaccatgtgtgcatt

SEQ ID NO: 602341 - DNA, 25 bp, Mus musculus
ccttagctctgagcatgtgtgcatt

SEQ ID NO: 602342 - DNA, 25 bp, Mus musculus
ccttagctgaggcttttcagagggt

SEQ ID NO: 602343 - DNA, 25 bp, Mus musculus
ccttagctgagggttttcagagggt

SEQ ID NO: 602344 - DNA, 25 bp, Mus musculus
ccttaggagagtcgcagagagcatt

SEQ ID NO: 602345 - DNA, 25 bp, Mus musculus
ccttaggagagtggcagagagcatt

SEQ ID NO: 602346 - DNA, 25 bp, Mus musculus
ccttaggagcggctgtcaatctgaa

SEQ ID NO: 602347 - DNA, 25 bp, Mus musculus
ccttaggagcgggtgtcaatctgaa

SEQ ID NO: 602348 - DNA, 25 bp, Mus musculus
ccttaggagttaagcagatggtaga

SEQ ID NO: 602349 - DNA, 25 bp, Mus musculus
ccttaggagttatgcagatggtaga

SEQ ID NO: 602350 - DNA, 25 bp, Mus musculus
ccttaggatcatacaggtgacagtc

SEQ ID NO: 602351 - DNA, 25 bp, Mus musculus
ccttaggatcattcaggtgacagtc

SEQ ID NO: 602352 - DNA, 25 bp, Mus musculus
ccttaggcacagaagatgtgacccc

SEQ ID NO: 602353 - DNA, 25 bp, Mus musculus
ccttaggcacagtagatgtgacccc

SEQ ID NO: 602354 - DNA, 25 bp, Mus musculus
ccttaggcgtcgaggccgagggatg

SEQ ID NO: 602355 - DNA, 25 bp, Mus musculus
ccttaggcgtcgtggccgagggatg

SEQ ID NO: 602356 - DNA, 25 bp, Mus musculus
ccttaggctgttcataggaaaaaca

SEQ ID NO: 602357 - DNA, 25 bp, Mus musculus
ccttaggctgttgataggaaaaaca

SEQ ID NO: 602358 - DNA, 25 bp, Mus musculus
ccttaggcttatatccagctgtttg

SEQ ID NO: 602359 - DNA, 25 bp, Mus musculus
ccttaggcttatttccagctgtttg

SEQ ID NO: 602360 - DNA, 25 bp, Mus musculus
ccttagggaccaaggccgatcctcg

SEQ ID NO: 602361 - DNA, 25 bp, Mus musculus
ccttagggaccatggccgatcctcg

SEQ ID NO: 602362 - DNA, 25 bp, Mus musculus
ccttagggccatcgacagtgaacta

SEQ ID NO: 602363 - DNA, 25 bp, Mus musculus
ccttagggccatggacagtgaacta

SEQ ID NO: 602364 - DNA, 25 bp, Mus musculus
ccttagggttctcggctaggcatcc

SEQ ID NO: 602365 - DNA, 25 bp, Mus musculus
ccttagggttctgggctaggcatcc

SEQ ID NO: 602366 - DNA, 25 bp, Mus musculus
ccttagtcctcacccttgccagggt

SEQ ID NO: 602367 - DNA, 25 bp, Mus musculus
ccttagtcctcagccttgccagggt

SEQ ID NO: 602368 - DNA, 25 bp, Mus musculus
ccttagtgcactctggaagtgtgta

SEQ ID NO: 602369 - DNA, 25 bp, Mus musculus
ccttagtgcactgtggaagtgtgta

SEQ ID NO: 602370 - DNA, 25 bp, Mus musculus
ccttagtgcatgaatcgttccttga

SEQ ID NO: 602371 - DNA, 25 bp, Mus musculus
ccttagtgcatgtatcgttccttga

SEQ ID NO: 602372 - DNA, 25 bp, Mus musculus
ccttagtggctcacaggaacatcac

SEQ ID NO: 602373 - DNA, 25 bp, Mus musculus
ccttagtggctctcaggaacatcac

SEQ ID NO: 602374 - DNA, 25 bp, Mus musculus
ccttagtggtagcttttgtctgcaa

SEQ ID NO: 602375 - DNA, 25 bp, Mus musculus
ccttagtggtaggttttgtctgcaa

SEQ ID NO: 602376 - DNA, 25 bp, Mus musculus
ccttagtggtccataccgtcatctc

SEQ ID NO: 602377 - DNA, 25 bp, Mus musculus
ccttagtggtccttaccgtcatctc

SEQ ID NO: 602378 - DNA, 25 bp, Mus musculus
ccttataaaactcgcaggctctgga

SEQ ID NO: 602379 - DNA, 25 bp, Mus musculus
ccttataaaactggcaggctctgga

SEQ ID NO: 602380 - DNA, 25 bp, Mus musculus
ccttatacaccaagatgaaggatca

SEQ ID NO: 602381 - DNA, 25 bp, Mus musculus
ccttatacaccatgatgaaggatca

SEQ ID NO: 602382 - DNA, 25 bp, Mus musculus
ccttatagtgctcaggaaacatggg

SEQ ID NO: 602383 - DNA, 25 bp, Mus musculus
ccttatagtgctgaggaaacatggg

SEQ ID NO: 602384 - DNA, 25 bp, Mus musculus
ccttatatggagatgttgaacacag

SEQ ID NO: 602385 - DNA, 25 bp, Mus musculus
ccttatatggagttgttgaacacag

SEQ ID NO: 602386 - DNA, 25 bp, Mus musculus
ccttatcaagcccaagcgaaggctg

SEQ ID NO: 602387 - DNA, 25 bp, Mus musculus
ccttatcaagccgaagcgaaggctg

SEQ ID NO: 602388 - DNA, 25 bp, Mus musculus
ccttatcacgaacaatgaagaggag

SEQ ID NO: 602389 - DNA, 25 bp, Mus musculus
ccttatcacgaagaatgaagaggag

SEQ ID NO: 602390 - DNA, 25 bp, Mus musculus
ccttatcagatgaaaagtatatcac

SEQ ID NO: 602391 - DNA, 25 bp, Mus musculus
ccttatcagatgtaaagtatatcac

SEQ ID NO: 602392 - DNA, 25 bp, Mus musculus
ccttatcagtcgctgtccatagaca

SEQ ID NO: 602393 - DNA, 25 bp, Mus musculus
ccttatcagtcggtgtccatagaca

SEQ ID NO: 602394 - DNA, 25 bp, Mus musculus
ccttatccaagaacacagggaattc

SEQ ID NO: 602395 - DNA, 25 bp, Mus musculus
ccttatccaagatcacagggaattc

SEQ ID NO: 602396 - DNA, 25 bp, Mus musculus
ccttatcctgaacgtgtcgcggtga

SEQ ID NO: 602397 - DNA, 25 bp, Mus musculus
ccttatcctgaaggtgtcgcggtga

SEQ ID NO: 602398 - DNA, 25 bp, Mus musculus
ccttatcttagtcttactgaatatg

SEQ ID NO: 602399 - DNA, 25 bp, Mus musculus
ccttatcttagtgttactgaatatg

SEQ ID NO: 602400 - DNA, 25 bp, Mus musculus
ccttatctttgtcacagtcttgctg

SEQ ID NO: 602401 - DNA, 25 bp, Mus musculus
ccttatctttgtgacagtcttgctg

SEQ ID NO: 602402 - DNA, 25 bp, Mus musculus
ccttatgaaagcactgaaggtgaga

SEQ ID NO: 602403 - DNA, 25 bp, Mus musculus
ccttatgaaagctctgaaggtgaga

SEQ ID NO: 602404 - DNA, 25 bp, Mus musculus
ccttatgaacccatcgtctgcatct

SEQ ID NO: 602405 - DNA, 25 bp, Mus musculus
ccttatgaacccttcgtctgcatct

SEQ ID NO: 602406 - DNA, 25 bp, Mus musculus
ccttatgaggatcactgtatctgta

SEQ ID NO: 602407 - DNA, 25 bp, Mus musculus
ccttatgaggatgactgtatctgta

SEQ ID NO: 602408 - DNA, 25 bp, Mus musculus
ccttatgataacaatgtcccatctg

SEQ ID NO: 602409 - DNA, 25 bp, Mus musculus
ccttatgataactatgtcccatctg

SEQ ID NO: 602410 - DNA, 25 bp, Mus musculus
ccttatgctgtgacaagaacattat

SEQ ID NO: 602411 - DNA, 25 bp, Mus musculus
ccttatgctgtgtcaagaacattat

SEQ ID NO: 602412 - DNA, 25 bp, Mus musculus
ccttatggacagcttacctttggat

SEQ ID NO: 602413 - DNA, 25 bp, Mus musculus
ccttatggacaggttacctttggat

SEQ ID NO: 602414 - DNA, 25 bp, Mus musculus
ccttatggctcgctcacttttactg

SEQ ID NO: 602415 - DNA, 25 bp, Mus musculus
ccttatggctcggtcacttttactg

SEQ ID NO: 602416 - DNA, 25 bp, Mus musculus
ccttatggttgaatgctgttggcta

SEQ ID NO: 602417 - DNA, 25 bp, Mus musculus
ccttatggttgattgctgttggcta

SEQ ID NO: 602418 - DNA, 25 bp, Mus musculus
ccttatgtggaacctctccctgact

SEQ ID NO: 602419 - DNA, 25 bp, Mus musculus
ccttatgtggaagctctccctgact

SEQ ID NO: 602420 - DNA, 25 bp, Mus musculus
ccttatgtggatcgacagaatcgca

SEQ ID NO: 602421 - DNA, 25 bp, Mus musculus
ccttatgtggatggacagaatcgca

SEQ ID NO: 602422 - DNA, 25 bp, Mus musculus
ccttattaggtgcaatagtcattcc

SEQ ID NO: 602423 - DNA, 25 bp, Mus musculus
ccttattaggtggaatagtcattcc

SEQ ID NO: 602424 - DNA, 25 bp, Mus musculus
ccttattatggaaagtgtggtcccg

SEQ ID NO: 602425 - DNA, 25 bp, Mus musculus
ccttattatggatagtgtggtcccg

SEQ ID NO: 602426 - DNA, 25 bp, Mus musculus
ccttattatttcataggcaatgtgg

SEQ ID NO: 602427 - DNA, 25 bp, Mus musculus
ccttattatttcttaggcaatgtgg

SEQ ID NO: 602428 - DNA, 25 bp, Mus musculus
ccttattcatcgcttgcaaaacggg

SEQ ID NO: 602429 - DNA, 25 bp, Mus musculus
ccttattcatcggttgcaaaacggg

SEQ ID NO: 602430 - DNA, 25 bp, Mus musculus
ccttattgaacactatgggaagctg

SEQ ID NO: 602431 - DNA, 25 bp, Mus musculus
ccttattgaacagtatgggaagctg

SEQ ID NO: 602432 - DNA, 25 bp, Mus musculus
ccttatttggagactgagccaggag

SEQ ID NO: 602433 - DNA, 25 bp, Mus musculus
ccttatttggagtctgagccaggag

SEQ ID NO: 602434 - DNA, 25 bp, Mus musculus
ccttcaaatgaaagtgttagtccac

SEQ ID NO: 602435 - DNA, 25 bp, Mus musculus
ccttcaaatgaatgtgttagtccac

SEQ ID NO: 602436 - DNA, 25 bp, Mus musculus
ccttcaacaaagatctgctggcctg

SEQ ID NO: 602437 - DNA, 25 bp, Mus musculus
ccttcaacaaagttctgctggcctg

SEQ ID NO: 602438 - DNA, 25 bp, Mus musculus
ccttcaacactacagaaaatatgtg

SEQ ID NO: 602439 - DNA, 25 bp, Mus musculus
ccttcaacactagagaaaatatgtg

SEQ ID NO: 602440 - DNA, 25 bp, Mus musculus
ccttcaacactgaccaaggatcagc

SEQ ID NO: 602441 - DNA, 25 bp, Mus musculus
ccttcaacactgtccaaggatcagc

SEQ ID NO: 602442 - DNA, 25 bp, Mus musculus
ccttcaacggcaagaaggaggaagg

SEQ ID NO: 602443 - DNA, 25 bp, Mus musculus
ccttcaacggcatgaaggaggaagg

SEQ ID NO: 602444 - DNA, 25 bp, Mus musculus
ccttcaagaactaggtgcagagaaa

SEQ ID NO: 602445 - DNA, 25 bp, Mus musculus
ccttcaagaacttggtgcagagaaa

SEQ ID NO: 602446 - DNA, 25 bp, Mus musculus
ccttcaagagttcccacaatctggc

SEQ ID NO: 602447 - DNA, 25 bp, Mus musculus
ccttcaagagttgccacaatctggc

SEQ ID NO: 602448 - DNA, 25 bp, Mus musculus
ccttcaaggactcgcctggagcatt

SEQ ID NO: 602449 - DNA, 25 bp, Mus musculus
ccttcaaggactggcctggagcatt

SEQ ID NO: 602450 - DNA, 25 bp, Mus musculus
ccttcaaggtgtcctcagacagcag

SEQ ID NO: 602451 - DNA, 25 bp, Mus musculus
ccttcaaggtgtgctcagacagcag

SEQ ID NO: 602452 - DNA, 25 bp, Mus musculus
ccttcaagtgccagatctgtcccta

SEQ ID NO: 602453 - DNA, 25 bp, Mus musculus
ccttcaagtgcctgatctgtcccta

SEQ ID NO: 602454 - DNA, 25 bp, Mus musculus
ccttcaataacgataaacagtggct

SEQ ID NO: 602455 - DNA, 25 bp, Mus musculus
ccttcaataacgttaaacagtggct

SEQ ID NO: 602456 - DNA, 25 bp, Mus musculus
ccttcaatccgaccatcttagagaa

SEQ ID NO: 602457 - DNA, 25 bp, Mus musculus
ccttcaatccgagcatcttagagaa

SEQ ID NO: 602458 - DNA, 25 bp, Mus musculus
ccttcaatggtgaccgtgatcgggc

SEQ ID NO: 602459 - DNA, 25 bp, Mus musculus
ccttcaatggtgtccgtgatcgggc

SEQ ID NO: 602460 - DNA, 25 bp, Mus musculus
ccttcaatgtctaagaccggcccag

SEQ ID NO: 602461 - DNA, 25 bp, Mus musculus
ccttcaatgtcttagaccggcccag

SEQ ID NO: 602462 - DNA, 25 bp, Mus musculus
ccttcacacaggactttggcggaaa

SEQ ID NO: 602463 - DNA, 25 bp, Mus musculus
ccttcacacaggtctttggcggaaa

SEQ ID NO: 602464 - DNA, 25 bp, Mus musculus
ccttcacacggaagggctcttcaca

SEQ ID NO: 602465 - DNA, 25 bp, Mus musculus
ccttcacacggatgggctcttcaca

SEQ ID NO: 602466 - DNA, 25 bp, Mus musculus
ccttcacagatgaagtcactacaaa

SEQ ID NO: 602467 - DNA, 25 bp, Mus musculus
ccttcacagatgtagtcactacaaa

SEQ ID NO: 602468 - DNA, 25 bp, Mus musculus
ccttcacatcttatggcaaaaagct

SEQ ID NO: 602469 - DNA, 25 bp, Mus musculus
ccttcacatcttttggcaaaaagct

SEQ ID NO: 602470 - DNA, 25 bp, Mus musculus
ccttcacctggaaggagtcggcgtg

SEQ ID NO: 602471 - DNA, 25 bp, Mus musculus
ccttcacctggatggagtcggcgtg

SEQ ID NO: 602472 - DNA, 25 bp, Mus musculus
ccttcacctgggacacgggctactt

SEQ ID NO: 602473 - DNA, 25 bp, Mus musculus
ccttcacctgggtcacgggctactt

SEQ ID NO: 602474 - DNA, 25 bp, Mus musculus
ccttcacctttcatggaaataggag

SEQ ID NO: 602475 - DNA, 25 bp, Mus musculus
ccttcacctttcttggaaataggag

SEQ ID NO: 602476 - DNA, 25 bp, Mus musculus
ccttcacgctgaagacggtgctgat

SEQ ID NO: 602477 - DNA, 25 bp, Mus musculus
ccttcacgctgatgacggtgctgat

SEQ ID NO: 602478 - DNA, 25 bp, Mus musculus
ccttcacggatcacaagaatgggtc

SEQ ID NO: 602479 - DNA, 25 bp, Mus musculus
ccttcacggatctcaagaatgggtc

SEQ ID NO: 602480 - DNA, 25 bp, Mus musculus
ccttcacgtactatggagtgtccgc

SEQ ID NO: 602481 - DNA, 25 bp, Mus musculus
ccttcacgtactttggagtgtccgc

SEQ ID NO: 602482 - DNA, 25 bp, Mus musculus
ccttcacgttcaccttgttaaatgt

SEQ ID NO: 602483 - DNA, 25 bp, Mus musculus
ccttcacgttcagcttgttaaatgt

SEQ ID NO: 602484 - DNA, 25 bp, Mus musculus
ccttcactatggatggtgtgagcac

SEQ ID NO: 602485 - DNA, 25 bp, Mus musculus
ccttcactatggttggtgtgagcac

SEQ ID NO: 602486 - DNA, 25 bp, Mus musculus
ccttcactcgcaacaactgtcaggg

SEQ ID NO: 602487 - DNA, 25 bp, Mus musculus
ccttcactcgcatcaactgtcaggg

SEQ ID NO: 602488 - DNA, 25 bp, Mus musculus
ccttcactgcagagaaccggaagaa

SEQ ID NO: 602489 - DNA, 25 bp, Mus musculus
ccttcactgcagtgaaccggaagaa

SEQ ID NO: 602490 - DNA, 25 bp, Mus musculus
ccttcactggctcgacgttcatgga

SEQ ID NO: 602491 - DNA, 25 bp, Mus musculus
ccttcactggctggacgttcatgga

SEQ ID NO: 602492 - DNA, 25 bp, Mus musculus
ccttcactgtgtagatggcagaact

SEQ ID NO: 602493 - DNA, 25 bp, Mus musculus
ccttcactgtgttgatggcagaact

SEQ ID NO: 602494 - DNA, 25 bp, Mus musculus
ccttcagaacctatccattgcatcg

SEQ ID NO: 602495 - DNA, 25 bp, Mus musculus
ccttcagaacctttccattgcatcg

SEQ ID NO: 602496 - DNA, 25 bp, Mus musculus
ccttcagaagcaagatgactttgaa

SEQ ID NO: 602497 - DNA, 25 bp, Mus musculus
ccttcagaagcatgatgactttgaa

SEQ ID NO: 602498 - DNA, 25 bp, Mus musculus
ccttcagaagtaccattaacctgaa

SEQ ID NO: 602499 - DNA, 25 bp, Mus musculus
ccttcagaagtagcattaacctgaa

SEQ ID NO: 602500 - DNA, 25 bp, Mus musculus
ccttcagacagtccagttatcaaag

SEQ ID NO: 602501 - DNA, 25 bp, Mus musculus
ccttcagacagtgcagttatcaaag

SEQ ID NO: 602502 - DNA, 25 bp, Mus musculus
ccttcagagcatcttttaagaggat

SEQ ID NO: 602503 - DNA, 25 bp, Mus musculus
ccttcagagcatgttttaagaggat

SEQ ID NO: 602504 - DNA, 25 bp, Mus musculus
ccttcagagcccacaagctggataa

SEQ ID NO: 602505 - DNA, 25 bp, Mus musculus
ccttcagagccctcaagctggataa

SEQ ID NO: 602506 - DNA, 25 bp, Mus musculus
ccttcagatagactcatgtggcatc

SEQ ID NO: 602507 - DNA, 25 bp, Mus musculus
ccttcagatagagtcatgtggcatc

SEQ ID NO: 602508 - DNA, 25 bp, Mus musculus
ccttcagatattatgccgggtgggc

SEQ ID NO: 602509 - DNA, 25 bp, Mus musculus
ccttcagatattttgccgggtgggc

SEQ ID NO: 602510 - DNA, 25 bp, Mus musculus
ccttcagcagctcccggaaactatt

SEQ ID NO: 602511 - DNA, 25 bp, Mus musculus
ccttcagcagctgccggaaactatt

SEQ ID NO: 602512 - DNA, 25 bp, Mus musculus
ccttcagcctttccattttggagac

SEQ ID NO: 602513 - DNA, 25 bp, Mus musculus
ccttcagcctttgcattttggagac

SEQ ID NO: 602514 - DNA, 25 bp, Mus musculus
ccttcagcggaaacatgcggcaaat

SEQ ID NO: 602515 - DNA, 25 bp, Mus musculus
ccttcagcggaatcatgcggcaaat

SEQ ID NO: 602516 - DNA, 25 bp, Mus musculus
ccttcagcgtcgagtctctgctgga

SEQ ID NO: 602517 - DNA, 25 bp, Mus musculus
ccttcagcgtcgtgtctctgctgga

SEQ ID NO: 602518 - DNA, 25 bp, Mus musculus
ccttcagctctacatcagagtgtgc

SEQ ID NO: 602519 - DNA, 25 bp, Mus musculus
ccttcagctctagatcagagtgtgc

SEQ ID NO: 602520 - DNA, 25 bp, Mus musculus
ccttcagcttcgagatcccctttga

SEQ ID NO: 602521 - DNA, 25 bp, Mus musculus
ccttcagcttcgtgatcccctttga

SEQ ID NO: 602522 - DNA, 25 bp, Mus musculus
ccttcaggaattcgatgaactccct

SEQ ID NO: 602523 - DNA, 25 bp, Mus musculus
ccttcaggaattggatgaactccct

SEQ ID NO: 602524 - DNA, 25 bp, Mus musculus
ccttcaggatccaccttaaggaatg

SEQ ID NO: 602525 - DNA, 25 bp, Mus musculus
ccttcaggatcctccttaaggaatg

SEQ ID NO: 602526 - DNA, 25 bp, Mus musculus
ccttcaggctgacgaatgtggcatc

SEQ ID NO: 602527 - DNA, 25 bp, Mus musculus
ccttcaggctgaggaatgtggcatc

SEQ ID NO: 602528 - DNA, 25 bp, Mus musculus
ccttcagggctgagagcaacgaccc

SEQ ID NO: 602529 - DNA, 25 bp, Mus musculus
ccttcagggctgtgagcaacgaccc

SEQ ID NO: 602530 - DNA, 25 bp, Mus musculus
ccttcaggtgttagaatgtgagcgt

SEQ ID NO: 602531 - DNA, 25 bp, Mus musculus
ccttcaggtgtttgaatgtgagcgt

SEQ ID NO: 602532 - DNA, 25 bp, Mus musculus
ccttcagtagaacgtgaagctggcc

SEQ ID NO: 602533 - DNA, 25 bp, Mus musculus
ccttcagtagaaggtgaagctggcc

SEQ ID NO: 602534 - DNA, 25 bp, Mus musculus
ccttcagtataaaatgtacaaaacg

SEQ ID NO: 602535 - DNA, 25 bp, Mus musculus
ccttcagtataatatgtacaaaacg

SEQ ID NO: 602536 - DNA, 25 bp, Mus musculus
ccttcagtgaagcatgattctgacc

SEQ ID NO: 602537 - DNA, 25 bp, Mus musculus
ccttcagtgaaggatgattctgacc

SEQ ID NO: 602538 - DNA, 25 bp, Mus musculus
ccttcagtgcagcatggagctacac

SEQ ID NO: 602539 - DNA, 25 bp, Mus musculus
ccttcagtgcaggatggagctacac

SEQ ID NO: 602540 - DNA, 25 bp, Mus musculus
ccttcagtgcatccaacacctggta

SEQ ID NO: 602541 - DNA, 25 bp, Mus musculus
ccttcagtgcatgcaacacctggta

SEQ ID NO: 602542 - DNA, 25 bp, Mus musculus
ccttcagtgcttcctggctatcatt

SEQ ID NO: 602543 - DNA, 25 bp, Mus musculus
ccttcagtgcttgctggctatcatt

SEQ ID NO: 602544 - DNA, 25 bp, Mus musculus
ccttcagtgtgacgctgtatatgaa

SEQ ID NO: 602545 - DNA, 25 bp, Mus musculus
ccttcagtgtgaggctgtatatgaa

SEQ ID NO: 602546 - DNA, 25 bp, Mus musculus
ccttcagtgtgcaggatggcagccc

SEQ ID NO: 602547 - DNA, 25 bp, Mus musculus
ccttcagtgtgctggatggcagccc

SEQ ID NO: 602548 - DNA, 25 bp, Mus musculus
ccttcagtttagatgaggataccac

SEQ ID NO: 602549 - DNA, 25 bp, Mus musculus
ccttcagtttagttgaggataccac

SEQ ID NO: 602550 - DNA, 25 bp, Mus musculus
ccttcagtttggctataacattggg

SEQ ID NO: 602551 - DNA, 25 bp, Mus musculus
ccttcagtttgggtataacattggg

SEQ ID NO: 602552 - DNA, 25 bp, Mus musculus
ccttcatagaagctatggaagtgga

SEQ ID NO: 602553 - DNA, 25 bp, Mus musculus
ccttcatagaaggtatggaagtgga

SEQ ID NO: 602554 - DNA, 25 bp, Mus musculus
ccttcatagccaccgtcggcataga

SEQ ID NO: 602555 - DNA, 25 bp, Mus musculus
ccttcatagccagcgtcggcataga

SEQ ID NO: 602556 - DNA, 25 bp, Mus musculus
ccttcatccattcagcctgaaggag

SEQ ID NO: 602557 - DNA, 25 bp, Mus musculus
ccttcatccattgagcctgaaggag

SEQ ID NO: 602558 - DNA, 25 bp, Mus musculus
ccttcatcggagactacctgccgtg

SEQ ID NO: 602559 - DNA, 25 bp, Mus musculus
ccttcatcggagtctacctgccgtg

SEQ ID NO: 602560 - DNA, 25 bp, Mus musculus
ccttcatcggctagaagagggcccc

SEQ ID NO: 602561 - DNA, 25 bp, Mus musculus
ccttcatcggcttgaagagggcccc

SEQ ID NO: 602562 - DNA, 25 bp, Mus musculus
ccttcatcgtttacacagaagctgt

SEQ ID NO: 602563 - DNA, 25 bp, Mus musculus
ccttcatcgttttcacagaagctgt

SEQ ID NO: 602564 - DNA, 25 bp, Mus musculus
ccttcatctgctcgtgcgggatgta

SEQ ID NO: 602565 - DNA, 25 bp, Mus musculus
ccttcatctgctggtgcgggatgta

SEQ ID NO: 602566 - DNA, 25 bp, Mus musculus
ccttcatgcagtcggaccagtgccg

SEQ ID NO: 602567 - DNA, 25 bp, Mus musculus
ccttcatgcagtgggaccagtgccg

SEQ ID NO: 602568 - DNA, 25 bp, Mus musculus
ccttcattctggagaccttccggca

SEQ ID NO: 602569 - DNA, 25 bp, Mus musculus
ccttcattctggtgaccttccggca

SEQ ID NO: 602570 - DNA, 25 bp, Mus musculus
ccttcattgtagaactggcctatgc

SEQ ID NO: 602571 - DNA, 25 bp, Mus musculus
ccttcattgtagtactggcctatgc

SEQ ID NO: 602572 - DNA, 25 bp, Mus musculus
ccttcattgtgaatgacatccttat

SEQ ID NO: 602573 - DNA, 25 bp, Mus musculus
ccttcattgtgattgacatccttat

SEQ ID NO: 602574 - DNA, 25 bp, Mus musculus
ccttccaaaacccttattcagatga

SEQ ID NO: 602575 - DNA, 25 bp, Mus musculus
ccttccaaaaccgttattcagatga

SEQ ID NO: 602576 - DNA, 25 bp, Mus musculus
ccttccaaaggacattggaaactgc

SEQ ID NO: 602577 - DNA, 25 bp, Mus musculus
ccttccaaaggagattggaaactgc

SEQ ID NO: 602578 - DNA, 25 bp, Mus musculus
ccttccacacaaagaaaacatactg

SEQ ID NO: 602579 - DNA, 25 bp, Mus musculus
ccttccacacaatgaaaacatactg

SEQ ID NO: 602580 - DNA, 25 bp, Mus musculus
ccttccactcgtaggcgcttaggcg

SEQ ID NO: 602581 - DNA, 25 bp, Mus musculus
ccttccactcgttggcgcttaggcg

SEQ ID NO: 602582 - DNA, 25 bp, Mus musculus
ccttccactttgatatcctgaagcc

SEQ ID NO: 602583 - DNA, 25 bp, Mus musculus
ccttccactttgttatcctgaagcc

SEQ ID NO: 602584 - DNA, 25 bp, Mus musculus
ccttccagcaagatttggttataga

SEQ ID NO: 602585 - DNA, 25 bp, Mus musculus
ccttccagcaagttttggttataga

SEQ ID NO: 602586 - DNA, 25 bp, Mus musculus
ccttccagccatacccagttgagat

SEQ ID NO: 602587 - DNA, 25 bp, Mus musculus
ccttccagccattcccagttgagat

SEQ ID NO: 602588 - DNA, 25 bp, Mus musculus
ccttccagcgagcaatattctgtaa

SEQ ID NO: 602589 - DNA, 25 bp, Mus musculus
ccttccagcgaggaatattctgtaa

SEQ ID NO: 602590 - DNA, 25 bp, Mus musculus
ccttccaggcaacacattttccaag

SEQ ID NO: 602591 - DNA, 25 bp, Mus musculus
ccttccaggcaagacattttccaag

SEQ ID NO: 602592 - DNA, 25 bp, Mus musculus
ccttccagtaccataatgacttcat

SEQ ID NO: 602593 - DNA, 25 bp, Mus musculus
ccttccagtaccttaatgacttcat

SEQ ID NO: 602594 - DNA, 25 bp, Mus musculus
ccttccagtgtacgacctgagggtg

SEQ ID NO: 602595 - DNA, 25 bp, Mus musculus
ccttccagtgtaggacctgagggtg

SEQ ID NO: 602596 - DNA, 25 bp, Mus musculus
ccttccatattgctagggaggagtt

SEQ ID NO: 602597 - DNA, 25 bp, Mus musculus
ccttccatattggtagggaggagtt

SEQ ID NO: 602598 - DNA, 25 bp, Mus musculus
ccttccatgaccaagttagagtaat

SEQ ID NO: 602599 - DNA, 25 bp, Mus musculus
ccttccatgacctagttagagtaat

SEQ ID NO: 602600 - DNA, 25 bp, Mus musculus
ccttccatgggtcatggctgcagtg

SEQ ID NO: 602601 - DNA, 25 bp, Mus musculus
ccttccatgggtgatggctgcagtg

SEQ ID NO: 602602 - DNA, 25 bp, Mus musculus
ccttccatggtgaggataagcttat

SEQ ID NO: 602603 - DNA, 25 bp, Mus musculus
ccttccatggtgtggataagcttat

SEQ ID NO: 602604 - DNA, 25 bp, Mus musculus
ccttccatgtggagtagtctgggtg

SEQ ID NO: 602605 - DNA, 25 bp, Mus musculus
ccttccatgtggtgtagtctgggtg

SEQ ID NO: 602606 - DNA, 25 bp, Mus musculus
ccttcccaaggaacgtaagagtggc

SEQ ID NO: 602607 - DNA, 25 bp, Mus musculus
ccttcccaaggatcgtaagagtggc

SEQ ID NO: 602608 - DNA, 25 bp, Mus musculus
ccttcccaaggccctgacaaagaag

SEQ ID NO: 602609 - DNA, 25 bp, Mus musculus
ccttcccaaggcgctgacaaagaag

SEQ ID NO: 602610 - DNA, 25 bp, Mus musculus
ccttcccaagtgcacagtacatctg

SEQ ID NO: 602611 - DNA, 25 bp, Mus musculus
ccttcccaagtggacagtacatctg

SEQ ID NO: 602612 - DNA, 25 bp, Mus musculus
ccttcccacaaaacttccagtatga

SEQ ID NO: 602613 - DNA, 25 bp, Mus musculus
ccttcccacaaatcttccagtatga

SEQ ID NO: 602614 - DNA, 25 bp, Mus musculus
ccttcccactggacacagttgaggt

SEQ ID NO: 602615 - DNA, 25 bp, Mus musculus
ccttcccactggtcacagttgaggt

SEQ ID NO: 602616 - DNA, 25 bp, Mus musculus
ccttcccagctaccaggaggaggtg

SEQ ID NO: 602617 - DNA, 25 bp, Mus musculus
ccttcccagctagcaggaggaggtg

SEQ ID NO: 602618 - DNA, 25 bp, Mus musculus
ccttcccagtgcaggcctaagttct

SEQ ID NO: 602619 - DNA, 25 bp, Mus musculus
ccttcccagtgctggcctaagttct

SEQ ID NO: 602620 - DNA, 25 bp, Mus musculus
ccttccccaggaccattgtggcagt

SEQ ID NO: 602621 - DNA, 25 bp, Mus musculus
ccttccccaggagcattgtggcagt

SEQ ID NO: 602622 - DNA, 25 bp, Mus musculus
ccttccccagggagaagtggcagcg

SEQ ID NO: 602623 - DNA, 25 bp, Mus musculus
ccttccccagggtgaagtggcagcg

SEQ ID NO: 602624 - DNA, 25 bp, Mus musculus
ccttcccggagcaacactgtgctgc

SEQ ID NO: 602625 - DNA, 25 bp, Mus musculus
ccttcccggagctacactgtgctgc

SEQ ID NO: 602626 - DNA, 25 bp, Mus musculus
ccttcccgggctatggagtgcgtca

SEQ ID NO: 602627 - DNA, 25 bp, Mus musculus
ccttcccgggctttggagtgcgtca

SEQ ID NO: 602628 - DNA, 25 bp, Mus musculus
ccttcccgtcagcacagttcgtgag

SEQ ID NO: 602629 - DNA, 25 bp, Mus musculus
ccttcccgtcaggacagttcgtgag

SEQ ID NO: 602630 - DNA, 25 bp, Mus musculus
ccttccctgtgaactgacgtttgtg

SEQ ID NO: 602631 - DNA, 25 bp, Mus musculus
ccttccctgtgatctgacgtttgtg

SEQ ID NO: 602632 - DNA, 25 bp, Mus musculus
ccttcccttcagatccgaaggaatg

SEQ ID NO: 602633 - DNA, 25 bp, Mus musculus
ccttcccttcagttccgaaggaatg

SEQ ID NO: 602634 - DNA, 25 bp, Mus musculus
ccttccgaaaatcgtgcaacaaaca

SEQ ID NO: 602635 - DNA, 25 bp, Mus musculus
ccttccgaaaatggtgcaacaaaca

SEQ ID NO: 602636 - DNA, 25 bp, Mus musculus
ccttccgaagctcagctgaattact

SEQ ID NO: 602637 - DNA, 25 bp, Mus musculus
ccttccgaagctgagctgaattact

SEQ ID NO: 602638 - DNA, 25 bp, Mus musculus
ccttccgacaggaccaaggctcaga

SEQ ID NO: 602639 - DNA, 25 bp, Mus musculus
ccttccgacaggtccaaggctcaga

SEQ ID NO: 602640 - DNA, 25 bp, Mus musculus
ccttccgcgacgaggccgttgactt

SEQ ID NO: 602641 - DNA, 25 bp, Mus musculus
ccttccgcgacgtggccgttgactt

SEQ ID NO: 602642 - DNA, 25 bp, Mus musculus
ccttccgctttgatgccgacaacgt

SEQ ID NO: 602643 - DNA, 25 bp, Mus musculus
ccttccgctttgttgccgacaacgt

SEQ ID NO: 602644 - DNA, 25 bp, Mus musculus
ccttccggaattatgacaacattac

SEQ ID NO: 602645 - DNA, 25 bp, Mus musculus
ccttccggaattttgacaacattac

SEQ ID NO: 602646 - DNA, 25 bp, Mus musculus
ccttccggatagaggataaacagct

SEQ ID NO: 602647 - DNA, 25 bp, Mus musculus
ccttccggatagtggataaacagct

SEQ ID NO: 602648 - DNA, 25 bp, Mus musculus
ccttccggcctgagtgtagtcagca

SEQ ID NO: 602649 - DNA, 25 bp, Mus musculus
ccttccggcctgtgtgtagtcagca

SEQ ID NO: 602650 - DNA, 25 bp, Mus musculus
ccttccgggagcacaaggcagcttt

SEQ ID NO: 602651 - DNA, 25 bp, Mus musculus
ccttccgggagctcaaggcagcttt

SEQ ID NO: 602652 - DNA, 25 bp, Mus musculus
ccttccgggtgccatatgagaaaat

SEQ ID NO: 602653 - DNA, 25 bp, Mus musculus
ccttccgggtgcgatatgagaaaat

SEQ ID NO: 602654 - DNA, 25 bp, Mus musculus
ccttccggtctgagctcctacgtga

SEQ ID NO: 602655 - DNA, 25 bp, Mus musculus
ccttccggtctgtgctcctacgtga

SEQ ID NO: 602656 - DNA, 25 bp, Mus musculus
ccttccgtcgggaaacagatgggag

SEQ ID NO: 602657 - DNA, 25 bp, Mus musculus
ccttccgtcgggtaacagatgggag

SEQ ID NO: 602658 - DNA, 25 bp, Mus musculus
ccttccgtggaacaggcgtccgtgt

SEQ ID NO: 602659 - DNA, 25 bp, Mus musculus
ccttccgtggaagaggcgtccgtgt

SEQ ID NO: 602660 - DNA, 25 bp, Mus musculus
ccttcctaggtgcagagagccagct

SEQ ID NO: 602661 - DNA, 25 bp, Mus musculus
ccttcctaggtggagagagccagct

SEQ ID NO: 602662 - DNA, 25 bp, Mus musculus
ccttcctataaaaactgctggtcag

SEQ ID NO: 602663 - DNA, 25 bp, Mus musculus
ccttcctataaatactgctggtcag

SEQ ID NO: 602664 - DNA, 25 bp, Mus musculus
ccttcctcagctaggtacacagtat

SEQ ID NO: 602665 - DNA, 25 bp, Mus musculus
ccttcctcagcttggtacacagtat

SEQ ID NO: 602666 - DNA, 25 bp, Mus musculus
ccttcctcattgaggccatgtgctg

SEQ ID NO: 602667 - DNA, 25 bp, Mus musculus
ccttcctcattgtggccatgtgctg

SEQ ID NO: 602668 - DNA, 25 bp, Mus musculus
ccttcctcccagacaaagacttggt

SEQ ID NO: 602669 - DNA, 25 bp, Mus musculus
ccttcctcccagtcaaagacttggt

SEQ ID NO: 602670 - DNA, 25 bp, Mus musculus
ccttcctcttaaatggctgggcaca

SEQ ID NO: 602671 - DNA, 25 bp, Mus musculus
ccttcctcttaattggctgggcaca

SEQ ID NO: 602672 - DNA, 25 bp, Mus musculus
ccttcctgaagaatacggtgatgga

SEQ ID NO: 602673 - DNA, 25 bp, Mus musculus
ccttcctgaagattacggtgatgga

SEQ ID NO: 602674 - DNA, 25 bp, Mus musculus
ccttcctgagtaacgtaaagaatga

SEQ ID NO: 602675 - DNA, 25 bp, Mus musculus
ccttcctgagtatcgtaaagaatga

SEQ ID NO: 602676 - DNA, 25 bp, Mus musculus
ccttcctgcagactgtggaaaatgc

SEQ ID NO: 602677 - DNA, 25 bp, Mus musculus
ccttcctgcagagtgtggaaaatgc

SEQ ID NO: 602678 - DNA, 25 bp, Mus musculus
ccttcctgcatcacagaggagggca

SEQ ID NO: 602679 - DNA, 25 bp, Mus musculus
ccttcctgcatctcagaggagggca

SEQ ID NO: 602680 - DNA, 25 bp, Mus musculus
ccttcctgcggaaatagacagcact

SEQ ID NO: 602681 - DNA, 25 bp, Mus musculus
ccttcctgcggatatagacagcact

SEQ ID NO: 602682 - DNA, 25 bp, Mus musculus
ccttcctgcgggaggtgaatgtact

SEQ ID NO: 602683 - DNA, 25 bp, Mus musculus
ccttcctgcgggtggtgaatgtact

SEQ ID NO: 602684 - DNA, 25 bp, Mus musculus
ccttcctgctgcaacaaggcgtaga

SEQ ID NO: 602685 - DNA, 25 bp, Mus musculus
ccttcctgctgctacaaggcgtaga

SEQ ID NO: 602686 - DNA, 25 bp, Mus musculus
ccttcctggactatataagactgtc

SEQ ID NO: 602687 - DNA, 25 bp, Mus musculus
ccttcctggactttataagactgtc

SEQ ID NO: 602688 - DNA, 25 bp, Mus musculus
ccttcctggagcaaacactgtctag

SEQ ID NO: 602689 - DNA, 25 bp, Mus musculus
ccttcctggagctaacactgtctag

SEQ ID NO: 602690 - DNA, 25 bp, Mus musculus
ccttcctggattatatcatgggtgg

SEQ ID NO: 602691 - DNA, 25 bp, Mus musculus
ccttcctggattttatcatgggtgg

SEQ ID NO: 602692 - DNA, 25 bp, Mus musculus
ccttcctggcatcgccattgtcaag

SEQ ID NO: 602693 - DNA, 25 bp, Mus musculus
ccttcctggcatggccattgtcaag

SEQ ID NO: 602694 - DNA, 25 bp, Mus musculus
ccttcctggcgcaaacatgggaaca

SEQ ID NO: 602695 - DNA, 25 bp, Mus musculus
ccttcctggcgctaacatgggaaca

SEQ ID NO: 602696 - DNA, 25 bp, Mus musculus
ccttcctggtcgaggcctctgtcta

SEQ ID NO: 602697 - DNA, 25 bp, Mus musculus
ccttcctggtcgtggcctctgtcta

SEQ ID NO: 602698 - DNA, 25 bp, Mus musculus
ccttcctgtgccattgcgccagtga

SEQ ID NO: 602699 - DNA, 25 bp, Mus musculus
ccttcctgtgcctttgcgccagtga

SEQ ID NO: 602700 - DNA, 25 bp, Mus musculus
ccttcctttggtcgcatcggaaagg

SEQ ID NO: 602701 - DNA, 25 bp, Mus musculus
ccttcctttggtggcatcggaaagg

SEQ ID NO: 602702 - DNA, 25 bp, Mus musculus
ccttcgaaaccacgatgaccgtgag

SEQ ID NO: 602703 - DNA, 25 bp, Mus musculus
ccttcgaaaccaggatgaccgtgag

SEQ ID NO: 602704 - DNA, 25 bp, Mus musculus
ccttcgaaacgtccgccagctggaa

SEQ ID NO: 602705 - DNA, 25 bp, Mus musculus
ccttcgaaacgtgcgccagctggaa

SEQ ID NO: 602706 - DNA, 25 bp, Mus musculus
ccttcgaagaacagtgcaggaacaa

SEQ ID NO: 602707 - DNA, 25 bp, Mus musculus
ccttcgaagaactgtgcaggaacaa

SEQ ID NO: 602708 - DNA, 25 bp, Mus musculus
ccttcgacacgaagaaggtgaagat

SEQ ID NO: 602709 - DNA, 25 bp, Mus musculus
ccttcgacacgatgaaggtgaagat

SEQ ID NO: 602710 - DNA, 25 bp, Mus musculus
ccttcgacggcgacttcgcaaggaa

SEQ ID NO: 602711 - DNA, 25 bp, Mus musculus
ccttcgacggcgtcttcgcaaggaa

SEQ ID NO: 602712 - DNA, 25 bp, Mus musculus
ccttcgagacatcgtggatgacgac

SEQ ID NO: 602713 - DNA, 25 bp, Mus musculus
ccttcgagacatggtggatgacgac

SEQ ID NO: 602714 - DNA, 25 bp, Mus musculus
ccttcgagcgggagtggcacaagtt

SEQ ID NO: 602715 - DNA, 25 bp, Mus musculus
ccttcgagcgggtgtggcacaagtt

SEQ ID NO: 602716 - DNA, 25 bp, Mus musculus
ccttcgaggacaaccatcagtacag

SEQ ID NO: 602717 - DNA, 25 bp, Mus musculus
ccttcgaggacatccatcagtacag

SEQ ID NO: 602718 - DNA, 25 bp, Mus musculus
ccttcgaggagaccgctgcagctga

SEQ ID NO: 602719 - DNA, 25 bp, Mus musculus
ccttcgaggagagcgctgcagctga

SEQ ID NO: 602720 - DNA, 25 bp, Mus musculus
ccttcgaggagcagaatgcggtgct

SEQ ID NO: 602721 - DNA, 25 bp, Mus musculus
ccttcgaggagctgaatgcggtgct

SEQ ID NO: 602722 - DNA, 25 bp, Mus musculus
ccttcgagtgaacctaactgtcagc

SEQ ID NO: 602723 - DNA, 25 bp, Mus musculus
ccttcgagtgaagctaactgtcagc

SEQ ID NO: 602724 - DNA, 25 bp, Mus musculus
ccttcgatcgctctggtcgggtagc

SEQ ID NO: 602725 - DNA, 25 bp, Mus musculus
ccttcgatcgctgtggtcgggtagc

SEQ ID NO: 602726 - DNA, 25 bp, Mus musculus
ccttcgatgagtattttcaaattga

SEQ ID NO: 602727 - DNA, 25 bp, Mus musculus
ccttcgatgagttttttcaaattga

SEQ ID NO: 602728 - DNA, 25 bp, Mus musculus
ccttcgatgccaaaacggagcaggg

SEQ ID NO: 602729 - DNA, 25 bp, Mus musculus
ccttcgatgccataacggagcaggg

SEQ ID NO: 602730 - DNA, 25 bp, Mus musculus
ccttcgcaacatcccctggtatgtg

SEQ ID NO: 602731 - DNA, 25 bp, Mus musculus
ccttcgcaacatgccctggtatgtg

SEQ ID NO: 602732 - DNA, 25 bp, Mus musculus
ccttcgcaagaacctgattgggaaa

SEQ ID NO: 602733 - DNA, 25 bp, Mus musculus
ccttcgcaagaagctgattgggaaa

SEQ ID NO: 602734 - DNA, 25 bp, Mus musculus
ccttcgcatgcacctgtgtcggaca

SEQ ID NO: 602735 - DNA, 25 bp, Mus musculus
ccttcgcatgcagctgtgtcggaca

SEQ ID NO: 602736 - DNA, 25 bp, Mus musculus
ccttcgcatggacaatttgaacaga

SEQ ID NO: 602737 - DNA, 25 bp, Mus musculus
ccttcgcatggagaatttgaacaga

SEQ ID NO: 602738 - DNA, 25 bp, Mus musculus
ccttcgccagagagataaggacttg

SEQ ID NO: 602739 - DNA, 25 bp, Mus musculus
ccttcgccagagtgataaggacttg

SEQ ID NO: 602740 - DNA, 25 bp, Mus musculus
ccttcgccttctaacgtttgtgcca

SEQ ID NO: 602741 - DNA, 25 bp, Mus musculus
ccttcgccttcttacgtttgtgcca

SEQ ID NO: 602742 - DNA, 25 bp, Mus musculus
ccttcgcggctcaaggtgggagacc

SEQ ID NO: 602743 - DNA, 25 bp, Mus musculus
ccttcgcggctctaggtgggagacc

SEQ ID NO: 602744 - DNA, 25 bp, Mus musculus
ccttcgcgtgcaaggctctgaccga

SEQ ID NO: 602745 - DNA, 25 bp, Mus musculus
ccttcgcgtgcatggctctgaccga

SEQ ID NO: 602746 - DNA, 25 bp, Mus musculus
ccttcgctgaccagattggttatgt

SEQ ID NO: 602747 - DNA, 25 bp, Mus musculus
ccttcgctgacctgattggttatgt

SEQ ID NO: 602748 - DNA, 25 bp, Mus musculus
ccttcgctgcgaagcctgtataacc

SEQ ID NO: 602749 - DNA, 25 bp, Mus musculus
ccttcgctgcgatgcctgtataacc

SEQ ID NO: 602750 - DNA, 25 bp, Mus musculus
ccttcgctgtggaggtgacattgct

SEQ ID NO: 602751 - DNA, 25 bp, Mus musculus
ccttcgctgtggtggtgacattgct

SEQ ID NO: 602752 - DNA, 25 bp, Mus musculus
ccttcggaaggcacaggtgtgattc

SEQ ID NO: 602753 - DNA, 25 bp, Mus musculus
ccttcggaaggctcaggtgtgattc

SEQ ID NO: 602754 - DNA, 25 bp, Mus musculus
ccttcggagtcacgacggtacctgc

SEQ ID NO: 602755 - DNA, 25 bp, Mus musculus
ccttcggagtcaggacggtacctgc

SEQ ID NO: 602756 - DNA, 25 bp, Mus musculus
ccttcggattggctgcgtttgccgc

SEQ ID NO: 602757 - DNA, 25 bp, Mus musculus
ccttcggattgggtgcgtttgccgc

SEQ ID NO: 602758 - DNA, 25 bp, Mus musculus
ccttcggcagccactcaagcgtggt

SEQ ID NO: 602759 - DNA, 25 bp, Mus musculus
ccttcggcagcctctcaagcgtggt

SEQ ID NO: 602760 - DNA, 25 bp, Mus musculus
ccttcggccgagatgaacttttacg

SEQ ID NO: 602761 - DNA, 25 bp, Mus musculus
ccttcggccgagatgtgcagtgtgt

SEQ ID NO: 602762 - DNA, 25 bp, Mus musculus
ccttcggccgagttgaacttttacg

SEQ ID NO: 602763 - DNA, 25 bp, Mus musculus
ccttcggccgagttgtgcagtgtgt

SEQ ID NO: 602764 - DNA, 25 bp, Mus musculus
ccttcgggagatccaagatattcat

SEQ ID NO: 602765 - DNA, 25 bp, Mus musculus
ccttcgggagatgcaagatattcat

SEQ ID NO: 602766 - DNA, 25 bp, Mus musculus
ccttcgggcacacaaaaaacagtct

SEQ ID NO: 602767 - DNA, 25 bp, Mus musculus
ccttcgggcacagaaaaaacagtct

SEQ ID NO: 602768 - DNA, 25 bp, Mus musculus
ccttcgggcacgcaaggatcgagtt

SEQ ID NO: 602769 - DNA, 25 bp, Mus musculus
ccttcgggcacggaaggatcgagtt

SEQ ID NO: 602770 - DNA, 25 bp, Mus musculus
ccttcgggctatccagaatttctta

SEQ ID NO: 602771 - DNA, 25 bp, Mus musculus
ccttcgggctatgcagaatttctta

SEQ ID NO: 602772 - DNA, 25 bp, Mus musculus
ccttcgggctgaaggatactgggct

SEQ ID NO: 602773 - DNA, 25 bp, Mus musculus
ccttcgggctgatggatactgggct

SEQ ID NO: 602774 - DNA, 25 bp, Mus musculus
ccttcggtcagcagtctctgtgcat

SEQ ID NO: 602775 - DNA, 25 bp, Mus musculus
ccttcggtcagctgtctctgtgcat

SEQ ID NO: 602776 - DNA, 25 bp, Mus musculus
ccttcggtgttgctaagcactgtgc

SEQ ID NO: 602777 - DNA, 25 bp, Mus musculus
ccttcggtgttggtaagcactgtgc

SEQ ID NO: 602778 - DNA, 25 bp, Mus musculus
ccttcgtcgcctatccagaggcgat

SEQ ID NO: 602779 - DNA, 25 bp, Mus musculus
ccttcgtcgcctttccagaggcgat

SEQ ID NO: 602780 - DNA, 25 bp, Mus musculus
ccttcgtctgcgagttttgtggcaa

SEQ ID NO: 602781 - DNA, 25 bp, Mus musculus
ccttcgtctgcgtgttttgtggcaa

SEQ ID NO: 602782 - DNA, 25 bp, Mus musculus
ccttcgtcttccagggcaagcagta

SEQ ID NO: 602783 - DNA, 25 bp, Mus musculus
ccttcgtcttcctgggcaagcagta

SEQ ID NO: 602784 - DNA, 25 bp, Mus musculus
ccttcgtggaccagggagcttgctg

SEQ ID NO: 602785 - DNA, 25 bp, Mus musculus
ccttcgtggacctgggagcttgctg

SEQ ID NO: 602786 - DNA, 25 bp, Mus musculus
ccttcgtggagtacgaggtcccaga

SEQ ID NO: 602787 - DNA, 25 bp, Mus musculus
ccttcgtggagttcgaggtcccaga

SEQ ID NO: 602788 - DNA, 25 bp, Mus musculus
ccttcgtgttccacaacctgctggg

SEQ ID NO: 602789 - DNA, 25 bp, Mus musculus
ccttcgtgttcctcaacctgctggg

SEQ ID NO: 602790 - DNA, 25 bp, Mus musculus
ccttcgttccaaattgccagaatta

SEQ ID NO: 602791 - DNA, 25 bp, Mus musculus
ccttcgttccaatttgccagaatta

SEQ ID NO: 602792 - DNA, 25 bp, Mus musculus
ccttcgttgaaaaatatgagaaaca

SEQ ID NO: 602793 - DNA, 25 bp, Mus musculus
ccttcgttgaaatatatgagaaaca

SEQ ID NO: 602794 - DNA, 25 bp, Mus musculus
ccttcgttgagcagccgtggtctcc

SEQ ID NO: 602795 - DNA, 25 bp, Mus musculus
ccttcgttgagctgccgtggtctcc

SEQ ID NO: 602796 - DNA, 25 bp, Mus musculus
ccttctaaacataggctacattgag

SEQ ID NO: 602797 - DNA, 25 bp, Mus musculus
ccttctaaacattggctacattgag

SEQ ID NO: 602798 - DNA, 25 bp, Mus musculus
ccttctaaagacagaaaacctggat

SEQ ID NO: 602799 - DNA, 25 bp, Mus musculus
ccttctaaagactgaaaacctggat

SEQ ID NO: 602800 - DNA, 25 bp, Mus musculus
ccttctaacaggattattttgggag

SEQ ID NO: 602801 - DNA, 25 bp, Mus musculus
ccttctaacaggtttattttgggag

SEQ ID NO: 602802 - DNA, 25 bp, Mus musculus
ccttctaactatctgaggcttaaag

SEQ ID NO: 602803 - DNA, 25 bp, Mus musculus
ccttctaactatgtgaggcttaaag

SEQ ID NO: 602804 - DNA, 25 bp, Mus musculus
ccttctaagactagctgagttgtgg

SEQ ID NO: 602805 - DNA, 25 bp, Mus musculus
ccttctaagacttgctgagttgtgg

SEQ ID NO: 602806 - DNA, 25 bp, Mus musculus
ccttctaaggtccatcctgagagaa

SEQ ID NO: 602807 - DNA, 25 bp, Mus musculus
ccttctaaggtcgatcctgagagaa

SEQ ID NO: 602808 - DNA, 25 bp, Mus musculus
ccttctacaactccagaaatatgac

SEQ ID NO: 602809 - DNA, 25 bp, Mus musculus
ccttctacaactgcagaaatatgac

SEQ ID NO: 602810 - DNA, 25 bp, Mus musculus
ccttctacaaggagggcaggtttat

SEQ ID NO: 602811 - DNA, 25 bp, Mus musculus
ccttctacaaggtgggcaggtttat

SEQ ID NO: 602812 - DNA, 25 bp, Mus musculus
ccttctatagaaaggtctgggccaa

SEQ ID NO: 602813 - DNA, 25 bp, Mus musculus
ccttctatagaatggtctgggccaa

SEQ ID NO: 602814 - DNA, 25 bp, Mus musculus
ccttctataggtactgcagggttgc

SEQ ID NO: 602815 - DNA, 25 bp, Mus musculus
ccttctataggttctgcagggttgc

SEQ ID NO: 602816 - DNA, 25 bp, Mus musculus
ccttctatccagagccgtccaaggt

SEQ ID NO: 602817 - DNA, 25 bp, Mus musculus
ccttctatccagtgccgtccaaggt

SEQ ID NO: 602818 - DNA, 25 bp, Mus musculus
ccttctatcgagacatgcctcatag

SEQ ID NO: 602819 - DNA, 25 bp, Mus musculus
ccttctatcgagtcatgcctcatag

SEQ ID NO: 602820 - DNA, 25 bp, Mus musculus
ccttctatggagataagatgaatct

SEQ ID NO: 602821 - DNA, 25 bp, Mus musculus
ccttctatggagttaagatgaatct

SEQ ID NO: 602822 - DNA, 25 bp, Mus musculus
ccttctatttacatcctgatggata

SEQ ID NO: 602823 - DNA, 25 bp, Mus musculus
ccttctatttacttcctgatggata

SEQ ID NO: 602824 - DNA, 25 bp, Mus musculus
ccttctcaaagtagcatgcacaatg

SEQ ID NO: 602825 - DNA, 25 bp, Mus musculus
ccttctcaaagttgcatgcacaatg

SEQ ID NO: 602826 - DNA, 25 bp, Mus musculus
ccttctcaagggagcggctgtggaa

SEQ ID NO: 602827 - DNA, 25 bp, Mus musculus
ccttctcaagggtgcggctgtggaa

SEQ ID NO: 602828 - DNA, 25 bp, Mus musculus
ccttctcaatgaactgcacaacttc

SEQ ID NO: 602829 - DNA, 25 bp, Mus musculus
ccttctcaatgatctgcacaacttc

SEQ ID NO: 602830 - DNA, 25 bp, Mus musculus
ccttctcacaatcttatccatggga

SEQ ID NO: 602831 - DNA, 25 bp, Mus musculus
ccttctcacaatgttatccatggga

SEQ ID NO: 602832 - DNA, 25 bp, Mus musculus
ccttctcaccaccagttaagtgttg

SEQ ID NO: 602833 - DNA, 25 bp, Mus musculus
ccttctcaccacgagttaagtgttg

SEQ ID NO: 602834 - DNA, 25 bp, Mus musculus
ccttctcacggtaaacttccagtca

SEQ ID NO: 602835 - DNA, 25 bp, Mus musculus
ccttctcacggttaacttccagtca

SEQ ID NO: 602836 - DNA, 25 bp, Mus musculus
ccttctcaggaaagatgccctatcc

SEQ ID NO: 602837 - DNA, 25 bp, Mus musculus
ccttctcaggaatgatgccctatcc

SEQ ID NO: 602838 - DNA, 25 bp, Mus musculus
ccttctcaggatatggctatatcaa

SEQ ID NO: 602839 - DNA, 25 bp, Mus musculus
ccttctcaggatttggctatatcaa

SEQ ID NO: 602840 - DNA, 25 bp, Mus musculus
ccttctcagtggagacacacagact

SEQ ID NO: 602841 - DNA, 25 bp, Mus musculus
ccttctcagtggtgacacacagact

SEQ ID NO: 602842 - DNA, 25 bp, Mus musculus
ccttctcatactagaccaagacgga

SEQ ID NO: 602843 - DNA, 25 bp, Mus musculus
ccttctcatacttgaccaagacgga

SEQ ID NO: 602844 - DNA, 25 bp, Mus musculus
ccttctccaaagcagccgatgtcta

SEQ ID NO: 602845 - DNA, 25 bp, Mus musculus
ccttctccaaaggagccgatgtcta

SEQ ID NO: 602846 - DNA, 25 bp, Mus musculus
ccttctccatggatgaccgcatagc

SEQ ID NO: 602847 - DNA, 25 bp, Mus musculus
ccttctccatggttgaccgcatagc

SEQ ID NO: 602848 - DNA, 25 bp, Mus musculus
ccttctccatgtacactatgctgta

SEQ ID NO: 602849 - DNA, 25 bp, Mus musculus
ccttctccatgttcactatgctgta

SEQ ID NO: 602850 - DNA, 25 bp, Mus musculus
ccttctcccttgagccgtagtctgt

SEQ ID NO: 602851 - DNA, 25 bp, Mus musculus
ccttctcccttgtgccgtagtctgt

SEQ ID NO: 602852 - DNA, 25 bp, Mus musculus
ccttctccgactagcttgggtaggg

SEQ ID NO: 602853 - DNA, 25 bp, Mus musculus
ccttctccgacttgcttgggtaggg

SEQ ID NO: 602854 - DNA, 25 bp, Mus musculus
ccttctccgatgcagagcgctggaa

SEQ ID NO: 602855 - DNA, 25 bp, Mus musculus
ccttctccgatggagagcgctggaa

SEQ ID NO: 602856 - DNA, 25 bp, Mus musculus
ccttctccggctacttcaagtctgg

SEQ ID NO: 602857 - DNA, 25 bp, Mus musculus
ccttctccggcttcttcaagtctgg

SEQ ID NO: 602858 - DNA, 25 bp, Mus musculus
ccttctcctcatcgcggtggcagga

SEQ ID NO: 602859 - DNA, 25 bp, Mus musculus
ccttctcctcatggcggtggcagga

SEQ ID NO: 602860 - DNA, 25 bp, Mus musculus
ccttctcctggacgtgtgaggctag

SEQ ID NO: 602861 - DNA, 25 bp, Mus musculus
ccttctcctggaggtgtgaggctag

SEQ ID NO: 602862 - DNA, 25 bp, Mus musculus
ccttctcggattcccgggaatgcaa

SEQ ID NO: 602863 - DNA, 25 bp, Mus musculus
ccttctcggattgccgggaatgcaa

SEQ ID NO: 602864 - DNA, 25 bp, Mus musculus
ccttctctacagagggcactcctga

SEQ ID NO: 602865 - DNA, 25 bp, Mus musculus
ccttctctacagtgggcactcctga

SEQ ID NO: 602866 - DNA, 25 bp, Mus musculus
ccttctctatctcggtgcttaataa

SEQ ID NO: 602867 - DNA, 25 bp, Mus musculus
ccttctctatctgggtgcttaataa

SEQ ID NO: 602868 - DNA, 25 bp, Mus musculus
ccttctctcagaatgtgtggctttg

SEQ ID NO: 602869 - DNA, 25 bp, Mus musculus
ccttctctcagattgtgtggctttg

SEQ ID NO: 602870 - DNA, 25 bp, Mus musculus
ccttctctccgtcgagcttgaagct

SEQ ID NO: 602871 - DNA, 25 bp, Mus musculus
ccttctctccgtggagcttgaagct

SEQ ID NO: 602872 - DNA, 25 bp, Mus musculus
ccttctctcctgaggcctcggtgga

SEQ ID NO: 602873 - DNA, 25 bp, Mus musculus
ccttctctcctgtggcctcggtgga

SEQ ID NO: 602874 - DNA, 25 bp, Mus musculus
ccttctctggttctgggaatagact

SEQ ID NO: 602875 - DNA, 25 bp, Mus musculus
ccttctctggttgtgggaatagact

SEQ ID NO: 602876 - DNA, 25 bp, Mus musculus
ccttctctgtccaacgctgtcataa

SEQ ID NO: 602877 - DNA, 25 bp, Mus musculus
ccttctctgtcctacgctgtcataa

SEQ ID NO: 602878 - DNA, 25 bp, Mus musculus
ccttctctgtctcctcgtggtgtgg

SEQ ID NO: 602879 - DNA, 25 bp, Mus musculus
ccttctctgtctgctcgtggtgtgg

SEQ ID NO: 602880 - DNA, 25 bp, Mus musculus
ccttctctgtgaaggcaatgcggac

SEQ ID NO: 602881 - DNA, 25 bp, Mus musculus
ccttctctgtgatggcaatgcggac

SEQ ID NO: 602882 - DNA, 25 bp, Mus musculus
ccttctcttggtcaccgggagaaga

SEQ ID NO: 602883 - DNA, 25 bp, Mus musculus
ccttctcttggtgaccgggagaaga

SEQ ID NO: 602884 - DNA, 25 bp, Mus musculus
ccttctgaaatcaacaggggttgga

SEQ ID NO: 602885 - DNA, 25 bp, Mus musculus
ccttctgaaatctacaggggttgga

SEQ ID NO: 602886 - DNA, 25 bp, Mus musculus
ccttctgaaggaccagaagaagtgc

SEQ ID NO: 602887 - DNA, 25 bp, Mus musculus
ccttctgaaggagcagaagaagtgc

SEQ ID NO: 602888 - DNA, 25 bp, Mus musculus
ccttctgaccatcaagaaagacgag

SEQ ID NO: 602889 - DNA, 25 bp, Mus musculus
ccttctgaccatgaagaaagacgag

SEQ ID NO: 602890 - DNA, 25 bp, Mus musculus
ccttctgagagcagagaggtgatct

SEQ ID NO: 602891 - DNA, 25 bp, Mus musculus
ccttctgagagctgagaggtgatct

SEQ ID NO: 602892 - DNA, 25 bp, Mus musculus
ccttctgagtgcagacgttaagtca

SEQ ID NO: 602893 - DNA, 25 bp, Mus musculus
ccttctgagtgctgacgttaagtca

SEQ ID NO: 602894 - DNA, 25 bp, Mus musculus
ccttctgatcataggaggatttgag

SEQ ID NO: 602895 - DNA, 25 bp, Mus musculus
ccttctgatcattggaggatttgag

SEQ ID NO: 602896 - DNA, 25 bp, Mus musculus
ccttctgcacgcagcggaggagatt

SEQ ID NO: 602897 - DNA, 25 bp, Mus musculus
ccttctgcacgctgcggaggagatt

SEQ ID NO: 602898 - DNA, 25 bp, Mus musculus
ccttctgccccaaggactgctggga

SEQ ID NO: 602899 - DNA, 25 bp, Mus musculus
ccttctgccccatggactgctggga

SEQ ID NO: 602900 - DNA, 25 bp, Mus musculus
ccttctgccttacggttgcatctca

SEQ ID NO: 602901 - DNA, 25 bp, Mus musculus
ccttctgccttagggttgcatctca

SEQ ID NO: 602902 - DNA, 25 bp, Mus musculus
ccttctgcggcgagtagggcctcgc

SEQ ID NO: 602903 - DNA, 25 bp, Mus musculus
ccttctgcggcgtgtagggcctcgc

SEQ ID NO: 602904 - DNA, 25 bp, Mus musculus
ccttctggatttcgtgagcacactg

SEQ ID NO: 602905 - DNA, 25 bp, Mus musculus
ccttctggatttggtgagcacactg

SEQ ID NO: 602906 - DNA, 25 bp, Mus musculus
ccttctggctgcctaagaagagtag

SEQ ID NO: 602907 - DNA, 25 bp, Mus musculus
ccttctggctgcgtaagaagagtag

SEQ ID NO: 602908 - DNA, 25 bp, Mus musculus
ccttctgggaataatgtggcctgtg

SEQ ID NO: 602909 - DNA, 25 bp, Mus musculus
ccttctgggaattatgtggcctgtg

SEQ ID NO: 602910 - DNA, 25 bp, Mus musculus
ccttctgggagcctgcacacaggat

SEQ ID NO: 602911 - DNA, 25 bp, Mus musculus
ccttctgggagcgtgcacacaggat

SEQ ID NO: 602912 - DNA, 25 bp, Mus musculus
ccttctgggattaccttctttgcct

SEQ ID NO: 602913 - DNA, 25 bp, Mus musculus
ccttctgggatttccttctttgcct

SEQ ID NO: 602914 - DNA, 25 bp, Mus musculus
ccttctgggcagaagcaactttggg

SEQ ID NO: 602915 - DNA, 25 bp, Mus musculus
ccttctgggcagtagcaactttggg

SEQ ID NO: 602916 - DNA, 25 bp, Mus musculus
ccttctgggcctccatggtcgttgt

SEQ ID NO: 602917 - DNA, 25 bp, Mus musculus
ccttctgggcctgcatggtcgttgt

SEQ ID NO: 602918 - DNA, 25 bp, Mus musculus
ccttctgggtacatcacggactttg

SEQ ID NO: 602919 - DNA, 25 bp, Mus musculus
ccttctgggtacttcacggactttg

SEQ ID NO: 602920 - DNA, 25 bp, Mus musculus
ccttctggtccactgaatgggtctc

SEQ ID NO: 602921 - DNA, 25 bp, Mus musculus
ccttctggtccagtgaatgggtctc

SEQ ID NO: 602922 - DNA, 25 bp, Mus musculus
ccttctgtcctgaggctcaaggaca

SEQ ID NO: 602923 - DNA, 25 bp, Mus musculus
ccttctgtcctgtggctcaaggaca

SEQ ID NO: 602924 - DNA, 25 bp, Mus musculus
ccttctgtgaggaggacatcaatga

SEQ ID NO: 602925 - DNA, 25 bp, Mus musculus
ccttctgtgaggtggacatcaatga

SEQ ID NO: 602926 - DNA, 25 bp, Mus musculus
ccttctgtgattatgctaggagata

SEQ ID NO: 602927 - DNA, 25 bp, Mus musculus
ccttctgtgattttgctaggagata

SEQ ID NO: 602928 - DNA, 25 bp, Mus musculus
ccttctgtgttgaggactacaagat

SEQ ID NO: 602929 - DNA, 25 bp, Mus musculus
ccttctgtgttgtggactacaagat

SEQ ID NO: 602930 - DNA, 25 bp, Mus musculus
ccttctgttacacttggttttctca

SEQ ID NO: 602931 - DNA, 25 bp, Mus musculus
ccttctgttacagttggttttctca

SEQ ID NO: 602932 - DNA, 25 bp, Mus musculus
ccttctgttactatgcgggcatgac

SEQ ID NO: 602933 - DNA, 25 bp, Mus musculus
ccttctgttactttgcgggcatgac

SEQ ID NO: 602934 - DNA, 25 bp, Mus musculus
ccttctgttgataaagatggagctt

SEQ ID NO: 602935 - DNA, 25 bp, Mus musculus
ccttctgttgattaagatggagctt

SEQ ID NO: 602936 - DNA, 25 bp, Mus musculus
ccttcttaaaggcaagcagcttctt

SEQ ID NO: 602937 - DNA, 25 bp, Mus musculus
ccttcttaaagggaagcagcttctt

SEQ ID NO: 602938 - DNA, 25 bp, Mus musculus
ccttcttagaacaggtcgcctatta

SEQ ID NO: 602939 - DNA, 25 bp, Mus musculus
ccttcttagaactggtcgcctatta

SEQ ID NO: 602940 - DNA, 25 bp, Mus musculus
ccttcttagagaatcgtggtttccg

SEQ ID NO: 602941 - DNA, 25 bp, Mus musculus
ccttcttagagattcgtggtttccg

SEQ ID NO: 602942 - DNA, 25 bp, Mus musculus
ccttcttcaaccctgaagaggctgc

SEQ ID NO: 602943 - DNA, 25 bp, Mus musculus
ccttcttcaaccgtgaagaggctgc

SEQ ID NO: 602944 - DNA, 25 bp, Mus musculus
ccttcttccaccagagggcctgaaa

SEQ ID NO: 602945 - DNA, 25 bp, Mus musculus
ccttcttccacctgagggcctgaaa

SEQ ID NO: 602946 - DNA, 25 bp, Mus musculus
ccttcttccgagagccagctgtggt

SEQ ID NO: 602947 - DNA, 25 bp, Mus musculus
ccttcttccgagtgccagctgtggt

SEQ ID NO: 602948 - DNA, 25 bp, Mus musculus
ccttcttcctgtacgtggctttcca

SEQ ID NO: 602949 - DNA, 25 bp, Mus musculus
ccttcttcctgttcgtggctttcca

SEQ ID NO: 602950 - DNA, 25 bp, Mus musculus
ccttcttcgccacagatgaacttaa

SEQ ID NO: 602951 - DNA, 25 bp, Mus musculus
ccttcttcgccagagatgaacttaa

SEQ ID NO: 602952 - DNA, 25 bp, Mus musculus
ccttcttcggctacaacttcggcaa

SEQ ID NO: 602953 - DNA, 25 bp, Mus musculus
ccttcttcggcttcaacttcggcaa

SEQ ID NO: 602954 - DNA, 25 bp, Mus musculus
ccttcttgaaaactctcgcctggtt

SEQ ID NO: 602955 - DNA, 25 bp, Mus musculus
ccttcttgaaaagtctcgcctggtt

SEQ ID NO: 602956 - DNA, 25 bp, Mus musculus
ccttcttgaaatccatgccgaattc

SEQ ID NO: 602957 - DNA, 25 bp, Mus musculus
ccttcttgaaatgcatgccgaattc

SEQ ID NO: 602958 - DNA, 25 bp, Mus musculus
ccttcttgagatcctgtgtatctgc

SEQ ID NO: 602959 - DNA, 25 bp, Mus musculus
ccttcttgagatgctgtgtatctgc

SEQ ID NO: 602960 - DNA, 25 bp, Mus musculus
ccttcttgctttcgactgtctgcac

SEQ ID NO: 602961 - DNA, 25 bp, Mus musculus
ccttcttgctttggactgtctgcac

SEQ ID NO: 602962 - DNA, 25 bp, Mus musculus
ccttcttggtgcagtgatgtgatgt

SEQ ID NO: 602963 - DNA, 25 bp, Mus musculus
ccttcttggtgctgtgatgtgatgt

SEQ ID NO: 602964 - DNA, 25 bp, Mus musculus
ccttcttgtaagaagcccctgtctc

SEQ ID NO: 602965 - DNA, 25 bp, Mus musculus
ccttcttgtaagtagcccctgtctc

SEQ ID NO: 602966 - DNA, 25 bp, Mus musculus
ccttcttgtgctatgaagtgactag

SEQ ID NO: 602967 - DNA, 25 bp, Mus musculus
ccttcttgtgctttgaagtgactag

SEQ ID NO: 602968 - DNA, 25 bp, Mus musculus
ccttcttgttagaagagccactcca

SEQ ID NO: 602969 - DNA, 25 bp, Mus musculus
ccttcttgttagtagagccactcca

SEQ ID NO: 602970 - DNA, 25 bp, Mus musculus
ccttctttaagtccacagtggatgt

SEQ ID NO: 602971 - DNA, 25 bp, Mus musculus
ccttctttaagtgcacagtggatgt

SEQ ID NO: 602972 - DNA, 25 bp, Mus musculus
ccttctttcccaccaatgtggagca

SEQ ID NO: 602973 - DNA, 25 bp, Mus musculus
ccttctttcccagcaatgtggagca

SEQ ID NO: 602974 - DNA, 25 bp, Mus musculus
ccttctttgcccatgacggtgtgca

SEQ ID NO: 602975 - DNA, 25 bp, Mus musculus
ccttctttgcccttgacggtgtgca

SEQ ID NO: 602976 - DNA, 25 bp, Mus musculus
ccttctttgtctctgaacttcacct

SEQ ID NO: 602977 - DNA, 25 bp, Mus musculus
ccttctttgtctgtgaacttcacct

SEQ ID NO: 602978 - DNA, 25 bp, Mus musculus
ccttcttttgggagttggtggcagt

SEQ ID NO: 602979 - DNA, 25 bp, Mus musculus
ccttcttttgggtgttggtggcagt

SEQ ID NO: 602980 - DNA, 25 bp, Mus musculus
ccttgaaaaaatcggtcaaggagct

SEQ ID NO: 602981 - DNA, 25 bp, Mus musculus
ccttgaaaaaatgggtcaaggagct

SEQ ID NO: 602982 - DNA, 25 bp, Mus musculus
ccttgaaaaccgacagaagaagctg

SEQ ID NO: 602983 - DNA, 25 bp, Mus musculus
ccttgaaaaccgtcagaagaagctg

SEQ ID NO: 602984 - DNA, 25 bp, Mus musculus
ccttgaaaacctagtggaggtcatt

SEQ ID NO: 602985 - DNA, 25 bp, Mus musculus
ccttgaaaaccttgtggaggtcatt

SEQ ID NO: 602986 - DNA, 25 bp, Mus musculus
ccttgaaaagaacgctggaatgcag

SEQ ID NO: 602987 - DNA, 25 bp, Mus musculus
ccttgaaaagaaggctggaatgcag

SEQ ID NO: 602988 - DNA, 25 bp, Mus musculus
ccttgaaaatcgctgggcgaattgc

SEQ ID NO: 602989 - DNA, 25 bp, Mus musculus
ccttgaaaatcggtgggcgaattgc

SEQ ID NO: 602990 - DNA, 25 bp, Mus musculus
ccttgaaacacaacatgagggtccc

SEQ ID NO: 602991 - DNA, 25 bp, Mus musculus
ccttgaaacacatcatgagggtccc

SEQ ID NO: 602992 - DNA, 25 bp, Mus musculus
ccttgaaagagaaggaagagtccat

SEQ ID NO: 602993 - DNA, 25 bp, Mus musculus
ccttgaaagagatggaagagtccat

SEQ ID NO: 602994 - DNA, 25 bp, Mus musculus
ccttgaaagcataaatggctgcaga

SEQ ID NO: 602995 - DNA, 25 bp, Mus musculus
ccttgaaagcattaatggctgcaga

SEQ ID NO: 602996 - DNA, 25 bp, Mus musculus
ccttgaaagtggcatcctagagaca

SEQ ID NO: 602997 - DNA, 25 bp, Mus musculus
ccttgaaagtgggatcctagagaca

SEQ ID NO: 602998 - DNA, 25 bp, Mus musculus
ccttgaaatgtcagtagcctggcat

SEQ ID NO: 602999 - DNA, 25 bp, Mus musculus
ccttgaaatgtctgtagcctggcat

SEQ ID NO: 603000 - DNA, 25 bp, Mus musculus
ccttgaacaaggcaaatatggtttt

SEQ ID NO: 603001 - DNA, 25 bp, Mus musculus
ccttgaacaagggaaatatggtttt

SEQ ID NO: 603002 - DNA, 25 bp, Mus musculus
ccttgaacagaactttgaactggaa

SEQ ID NO: 603003 - DNA, 25 bp, Mus musculus
ccttgaacagaagtttgaactggaa

SEQ ID NO: 603004 - DNA, 25 bp, Mus musculus
ccttgaacaggcagccactcgctga

SEQ ID NO: 603005 - DNA, 25 bp, Mus musculus
ccttgaacaggctgccactcgctga

SEQ ID NO: 603006 - DNA, 25 bp, Mus musculus
ccttgaacaggtagccaggatgcat

SEQ ID NO: 603007 - DNA, 25 bp, Mus musculus
ccttgaacaggttgccaggatgcat

SEQ ID NO: 603008 - DNA, 25 bp, Mus musculus
ccttgaacatagagtgtggccctga

SEQ ID NO: 603009 - DNA, 25 bp, Mus musculus
ccttgaacatagtgtgtggccctga

SEQ ID NO: 603010 - DNA, 25 bp, Mus musculus
ccttgaacccttctgggaggtcctg

SEQ ID NO: 603011 - DNA, 25 bp, Mus musculus
ccttgaacccttgtgggaggtcctg

SEQ ID NO: 603012 - DNA, 25 bp, Mus musculus
ccttgaacgtcaccaaaagatgcta

SEQ ID NO: 603013 - DNA, 25 bp, Mus musculus
ccttgaacgtcagcaaaagatgcta

SEQ ID NO: 603014 - DNA, 25 bp, Mus musculus
ccttgaactcaacacagttcttctg

SEQ ID NO: 603015 - DNA, 25 bp, Mus musculus
ccttgaactcaagacagttcttctg

SEQ ID NO: 603016 - DNA, 25 bp, Mus musculus
ccttgaagagaaagtcaagacgcag

SEQ ID NO: 603017 - DNA, 25 bp, Mus musculus
ccttgaagagaatgtcaagacgcag

SEQ ID NO: 603018 - DNA, 25 bp, Mus musculus
ccttgaagatggctttctgacagtc

SEQ ID NO: 603019 - DNA, 25 bp, Mus musculus
ccttgaagatgggtttctgacagtc

SEQ ID NO: 603020 - DNA, 25 bp, Mus musculus
ccttgaagccccagagcttggtgaa

SEQ ID NO: 603021 - DNA, 25 bp, Mus musculus
ccttgaagcccctgagcttggtgaa

SEQ ID NO: 603022 - DNA, 25 bp, Mus musculus
ccttgaagcgaaagctggagaaact

SEQ ID NO: 603023 - DNA, 25 bp, Mus musculus
ccttgaagcgaatgctggagaaact

SEQ ID NO: 603024 - DNA, 25 bp, Mus musculus
ccttgaaggaagatctcagttggag

SEQ ID NO: 603025 - DNA, 25 bp, Mus musculus
ccttgaaggaagttctcagttggag

SEQ ID NO: 603026 - DNA, 25 bp, Mus musculus
ccttgaaggtggaaagactcgctgt

SEQ ID NO: 603027 - DNA, 25 bp, Mus musculus
ccttgaaggtggtaagactcgctgt

SEQ ID NO: 603028 - DNA, 25 bp, Mus musculus
ccttgaaggttcagatgaatacctg

SEQ ID NO: 603029 - DNA, 25 bp, Mus musculus
ccttgaaggttctgatgaatacctg

SEQ ID NO: 603030 - DNA, 25 bp, Mus musculus
ccttgaagtctgaattccggccagt

SEQ ID NO: 603031 - DNA, 25 bp, Mus musculus
ccttgaagtctgtattccggccagt

SEQ ID NO: 603032 - DNA, 25 bp, Mus musculus
ccttgaagttgacgttggcttgtct

SEQ ID NO: 603033 - DNA, 25 bp, Mus musculus
ccttgaagttgaggttggcttgtct

SEQ ID NO: 603034 - DNA, 25 bp, Mus musculus
ccttgaatcgttacagcgatagcat

SEQ ID NO: 603035 - DNA, 25 bp, Mus musculus
ccttgaatcgtttcagcgatagcat

SEQ ID NO: 603036 - DNA, 25 bp, Mus musculus
ccttgaatgaaaacgaggcatggaa

SEQ ID NO: 603037 - DNA, 25 bp, Mus musculus
ccttgaatgaaatcgaggcatggaa

SEQ ID NO: 603038 - DNA, 25 bp, Mus musculus
ccttgaatgccactgacacacagat

SEQ ID NO: 603039 - DNA, 25 bp, Mus musculus
ccttgaatgccagtgacacacagat

SEQ ID NO: 603040 - DNA, 25 bp, Mus musculus
ccttgaattctgaggctaggagcca

SEQ ID NO: 603041 - DNA, 25 bp, Mus musculus
ccttgaattctgtggctaggagcca

SEQ ID NO: 603042 - DNA, 25 bp, Mus musculus
ccttgaccatagagaacactgttgt

SEQ ID NO: 603043 - DNA, 25 bp, Mus musculus
ccttgaccatagtgaacactgttgt

SEQ ID NO: 603044 - DNA, 25 bp, Mus musculus
ccttgaccatccagggaaggaatat

SEQ ID NO: 603045 - DNA, 25 bp, Mus musculus
ccttgaccatcctgggaaggaatat

SEQ ID NO: 603046 - DNA, 25 bp, Mus musculus
ccttgacccaggaacagtcatgtcg

SEQ ID NO: 603047 - DNA, 25 bp, Mus musculus
ccttgacccaggtacagtcatgtcg

SEQ ID NO: 603048 - DNA, 25 bp, Mus musculus
ccttgaccccagaagaggccactgt

SEQ ID NO: 603049 - DNA, 25 bp, Mus musculus
ccttgaccccagtagaggccactgt

SEQ ID NO: 603050 - DNA, 25 bp, Mus musculus
ccttgacctggaaagtatgatgagc

SEQ ID NO: 603051 - DNA, 25 bp, Mus musculus
ccttgacctggatagtatgatgagc

SEQ ID NO: 603052 - DNA, 25 bp, Mus musculus
ccttgacgatgtcccatttaagata

SEQ ID NO: 603053 - DNA, 25 bp, Mus musculus
ccttgacgatgtgccatttaagata

SEQ ID NO: 603054 - DNA, 25 bp, Mus musculus
ccttgacgggcacaggaatgggcca

SEQ ID NO: 603055 - DNA, 25 bp, Mus musculus
ccttgacgggcagaggaatgggcca

SEQ ID NO: 603056 - DNA, 25 bp, Mus musculus
ccttgactcagtcgatggtgtacca

SEQ ID NO: 603057 - DNA, 25 bp, Mus musculus
ccttgactcagtggatggtgtacca

SEQ ID NO: 603058 - DNA, 25 bp, Mus musculus
ccttgactccgcaataatgcgaaga

SEQ ID NO: 603059 - DNA, 25 bp, Mus musculus
ccttgactccgctataatgcgaaga

SEQ ID NO: 603060 - DNA, 25 bp, Mus musculus
ccttgactgacaacgctaagtatac

SEQ ID NO: 603061 - DNA, 25 bp, Mus musculus
ccttgactgacatcgctaagtatac

SEQ ID NO: 603062 - DNA, 25 bp, Mus musculus
ccttgacttgcgctgccgactgggt

SEQ ID NO: 603063 - DNA, 25 bp, Mus musculus
ccttgacttgcggtgccgactgggt

SEQ ID NO: 603064 - DNA, 25 bp, Mus musculus
ccttgagacacccaggtactgccgg

SEQ ID NO: 603065 - DNA, 25 bp, Mus musculus
ccttgagacaccgaggtactgccgg

SEQ ID NO: 603066 - DNA, 25 bp, Mus musculus
ccttgagagaaccttcccgctttct

SEQ ID NO: 603067 - DNA, 25 bp, Mus musculus
ccttgagagaacgttcccgctttct

SEQ ID NO: 603068 - DNA, 25 bp, Mus musculus
ccttgagagggcatctgtctagaca

SEQ ID NO: 603069 - DNA, 25 bp, Mus musculus
ccttgagagggcttctgtctagaca

SEQ ID NO: 603070 - DNA, 25 bp, Mus musculus
ccttgagatatgcagctgtgaggac

SEQ ID NO: 603071 - DNA, 25 bp, Mus musculus
ccttgagatatggagctgtgaggac

SEQ ID NO: 603072 - DNA, 25 bp, Mus musculus
ccttgagcagaacagtacgcggtgc

SEQ ID NO: 603073 - DNA, 25 bp, Mus musculus
ccttgagcagaagagtacgcggtgc

SEQ ID NO: 603074 - DNA, 25 bp, Mus musculus
ccttgagcagacacaccaatgtgaa

SEQ ID NO: 603075 - DNA, 25 bp, Mus musculus
ccttgagcagactcaccaatgtgaa

SEQ ID NO: 603076 - DNA, 25 bp, Mus musculus
ccttgagcagctctgtcggcagtac

SEQ ID NO: 603077 - DNA, 25 bp, Mus musculus
ccttgagcagctgtgtcggcagtac

SEQ ID NO: 603078 - DNA, 25 bp, Mus musculus
ccttgagcctccctgagttgtcagg

SEQ ID NO: 603079 - DNA, 25 bp, Mus musculus
ccttgagcctccgtgagttgtcagg

SEQ ID NO: 603080 - DNA, 25 bp, Mus musculus
ccttgagcgcttatgacttggtgct

SEQ ID NO: 603081 - DNA, 25 bp, Mus musculus
ccttgagcgcttttgacttggtgct

SEQ ID NO: 603082 - DNA, 25 bp, Mus musculus
ccttgagctgcaagatgggcaccca

SEQ ID NO: 603083 - DNA, 25 bp, Mus musculus
ccttgagctgcatgatgggcaccca

SEQ ID NO: 603084 - DNA, 25 bp, Mus musculus
ccttgaggacgcatggaccgtggtc

SEQ ID NO: 603085 - DNA, 25 bp, Mus musculus
ccttgaggacgcttggaccgtggtc

SEQ ID NO: 603086 - DNA, 25 bp, Mus musculus
ccttgaggagatagatagagctctg

SEQ ID NO: 603087 - DNA, 25 bp, Mus musculus
ccttgaggagattgatagagctctg

SEQ ID NO: 603088 - DNA, 25 bp, Mus musculus
ccttgaggagcccatggccctgcag

SEQ ID NO: 603089 - DNA, 25 bp, Mus musculus
ccttgaggagccgatggccctgcag

SEQ ID NO: 603090 - DNA, 25 bp, Mus musculus
ccttgaggagctagagcagtttgcc

SEQ ID NO: 603091 - DNA, 25 bp, Mus musculus
ccttgaggagcttgagcagtttgcc

SEQ ID NO: 603092 - DNA, 25 bp, Mus musculus
ccttgaggcaaacgtccgaggcatc

SEQ ID NO: 603093 - DNA, 25 bp, Mus musculus
ccttgaggcaaaggtccgaggcatc

SEQ ID NO: 603094 - DNA, 25 bp, Mus musculus
ccttgaggcagaaaagtcatttgac

SEQ ID NO: 603095 - DNA, 25 bp, Mus musculus
ccttgaggcagataagtcatttgac

SEQ ID NO: 603096 - DNA, 25 bp, Mus musculus
ccttgaggctatacatgccaaaggt

SEQ ID NO: 603097 - DNA, 25 bp, Mus musculus
ccttgaggctattcatgccaaaggt

SEQ ID NO: 603098 - DNA, 25 bp, Mus musculus
ccttgaggctgccatgggaaccagt

SEQ ID NO: 603099 - DNA, 25 bp, Mus musculus
ccttgaggctgcgatgggaaccagt

SEQ ID NO: 603100 - DNA, 25 bp, Mus musculus
ccttgagtgccacccatagttctga

SEQ ID NO: 603101 - DNA, 25 bp, Mus musculus
ccttgagtgccagccatagttctga

SEQ ID NO: 603102 - DNA, 25 bp, Mus musculus
ccttgagttttaataagtgacactt

SEQ ID NO: 603103 - DNA, 25 bp, Mus musculus
ccttgagttttattaagtgacactt

SEQ ID NO: 603104 - DNA, 25 bp, Mus musculus
ccttgatacaggcatggacagcgga

SEQ ID NO: 603105 - DNA, 25 bp, Mus musculus
ccttgatacagggatggacagcgga

SEQ ID NO: 603106 - DNA, 25 bp, Mus musculus
ccttgatcagcaacgaatgtttgaa

SEQ ID NO: 603107 - DNA, 25 bp, Mus musculus
ccttgatcagcatcgaatgtttgaa

SEQ ID NO: 603108 - DNA, 25 bp, Mus musculus
ccttgatcccagcaacgtggattct

SEQ ID NO: 603109 - DNA, 25 bp, Mus musculus
ccttgatcccaggaacgtggattct

SEQ ID NO: 603110 - DNA, 25 bp, Mus musculus
ccttgatcggccagactgggaggat

SEQ ID NO: 603111 - DNA, 25 bp, Mus musculus
ccttgatcggcctgactgggaggat

SEQ ID NO: 603112 - DNA, 25 bp, Mus musculus
ccttgatgatgcacttatgaagcag

SEQ ID NO: 603113 - DNA, 25 bp, Mus musculus
ccttgatgatgctcttatgaagcag

SEQ ID NO: 603114 - DNA, 25 bp, Mus musculus
ccttgatgcaagctaaagtcatttg

SEQ ID NO: 603115 - DNA, 25 bp, Mus musculus
ccttgatgcaaggtaaagtcatttg

SEQ ID NO: 603116 - DNA, 25 bp, Mus musculus
ccttgatgccataaaactactgcta

SEQ ID NO: 603117 - DNA, 25 bp, Mus musculus
ccttgatgccattaaactactgcta

SEQ ID NO: 603118 - DNA, 25 bp, Mus musculus
ccttgatgctggcatctggtgtacc

SEQ ID NO: 603119 - DNA, 25 bp, Mus musculus
ccttgatgctgggatctggtgtacc

SEQ ID NO: 603120 - DNA, 25 bp, Mus musculus
ccttgatggatcaggacatggagtt

SEQ ID NO: 603121 - DNA, 25 bp, Mus musculus
ccttgatggatctggacatggagtt

SEQ ID NO: 603122 - DNA, 25 bp, Mus musculus
ccttgatggctgatgggaagaaaag

SEQ ID NO: 603123 - DNA, 25 bp, Mus musculus
ccttgatggctgttgggaagaaaag

SEQ ID NO: 603124 - DNA, 25 bp, Mus musculus
ccttgatggtcaatcatcacttgga

SEQ ID NO: 603125 - DNA, 25 bp, Mus musculus
ccttgatggtcattcatcacttgga

SEQ ID NO: 603126 - DNA, 25 bp, Mus musculus
ccttgatggtgaagtaaattccatg

SEQ ID NO: 603127 - DNA, 25 bp, Mus musculus
ccttgatggtgatgtaaattccatg

SEQ ID NO: 603128 - DNA, 25 bp, Mus musculus
ccttgattccaaccccagcagtaag

SEQ ID NO: 603129 - DNA, 25 bp, Mus musculus
ccttgattccaagcccagcagtaag

SEQ ID NO: 603130 - DNA, 25 bp, Mus musculus
ccttgattctagcatatctctccaa

SEQ ID NO: 603131 - DNA, 25 bp, Mus musculus
ccttgattctaggatatctctccaa

SEQ ID NO: 603132 - DNA, 25 bp, Mus musculus
ccttgattggccacaacagggagaa

SEQ ID NO: 603133 - DNA, 25 bp, Mus musculus
ccttgattggcctcaacagggagaa

SEQ ID NO: 603134 - DNA, 25 bp, Mus musculus
ccttgattgtgaatggtggttcttc

SEQ ID NO: 603135 - DNA, 25 bp, Mus musculus
ccttgattgtgattggtggttcttc

SEQ ID NO: 603136 - DNA, 25 bp, Mus musculus
ccttgatttaccagacatggacgta

SEQ ID NO: 603137 - DNA, 25 bp, Mus musculus
ccttgatttacctgacatggacgta

SEQ ID NO: 603138 - DNA, 25 bp, Mus musculus
ccttgcaaactgcagagtgacactc

SEQ ID NO: 603139 - DNA, 25 bp, Mus musculus
ccttgcaaactggagagtgacactc

SEQ ID NO: 603140 - DNA, 25 bp, Mus musculus
ccttgcaaagcgacatagatcagcc

SEQ ID NO: 603141 - DNA, 25 bp, Mus musculus
ccttgcaaagcgtcatagatcagcc

SEQ ID NO: 603142 - DNA, 25 bp, Mus musculus
ccttgcaaataaacacagattagct

SEQ ID NO: 603143 - DNA, 25 bp, Mus musculus
ccttgcaaataatcacagattagct

SEQ ID NO: 603144 - DNA, 25 bp, Mus musculus
ccttgcaatgtcaaaaccacgtgtg

SEQ ID NO: 603145 - DNA, 25 bp, Mus musculus
ccttgcaatgtctaaaccacgtgtg

SEQ ID NO: 603146 - DNA, 25 bp, Mus musculus
ccttgcaatgtgcatgtttttgatg

SEQ ID NO: 603147 - DNA, 25 bp, Mus musculus
ccttgcaatgtggatgtttttgatg

SEQ ID NO: 603148 - DNA, 25 bp, Mus musculus
ccttgcacaggcaggatctactaca

SEQ ID NO: 603149 - DNA, 25 bp, Mus musculus
ccttgcacaggctggatctactaca

SEQ ID NO: 603150 - DNA, 25 bp, Mus musculus
ccttgcacttaaatcaggagtcgct

SEQ ID NO: 603151 - DNA, 25 bp, Mus musculus
ccttgcacttaattcaggagtcgct

SEQ ID NO: 603152 - DNA, 25 bp, Mus musculus
ccttgcacttccaactccgattgtg

SEQ ID NO: 603153 - DNA, 25 bp, Mus musculus
ccttgcacttcctactccgattgtg

SEQ ID NO: 603154 - DNA, 25 bp, Mus musculus
ccttgcagagctcatagaagagtac

SEQ ID NO: 603155 - DNA, 25 bp, Mus musculus
ccttgcagagctgatagaagagtac

SEQ ID NO: 603156 - DNA, 25 bp, Mus musculus
ccttgcaggccgcagcatcacaatt

SEQ ID NO: 603157 - DNA, 25 bp, Mus musculus
ccttgcaggccggagcatcacaatt

SEQ ID NO: 603158 - DNA, 25 bp, Mus musculus
ccttgcattcttagtgcagctgtga

SEQ ID NO: 603159 - DNA, 25 bp, Mus musculus
ccttgcattctttgtgcagctgtga

SEQ ID NO: 603160 - DNA, 25 bp, Mus musculus
ccttgcattgtgaagcaggtttgct

SEQ ID NO: 603161 - DNA, 25 bp, Mus musculus
ccttgcattgtgtagcaggtttgct

SEQ ID NO: 603162 - DNA, 25 bp, Mus musculus
ccttgccaaggtcagctgtaggcct

SEQ ID NO: 603163 - DNA, 25 bp, Mus musculus
ccttgccaaggtgagctgtaggcct

SEQ ID NO: 603164 - DNA, 25 bp, Mus musculus
ccttgccactggagcagcggataga

SEQ ID NO: 603165 - DNA, 25 bp, Mus musculus
ccttgccactggtgcagcggataga

SEQ ID NO: 603166 - DNA, 25 bp, Mus musculus
ccttgccaggtgcaagtctgcagca

SEQ ID NO: 603167 - DNA, 25 bp, Mus musculus
ccttgccaggtggaagtctgcagca

SEQ ID NO: 603168 - DNA, 25 bp, Mus musculus
ccttgcccaagacttttttgacaga

SEQ ID NO: 603169 - DNA, 25 bp, Mus musculus
ccttgcccaagagttttttgacaga

SEQ ID NO: 603170 - DNA, 25 bp, Mus musculus
ccttgcccaatgagatcgcgtatct

SEQ ID NO: 603171 - DNA, 25 bp, Mus musculus
ccttgcccaatgtgatcgcgtatct

SEQ ID NO: 603172 - DNA, 25 bp, Mus musculus
ccttgcccaccacaaggtgtctaaa

SEQ ID NO: 603173 - DNA, 25 bp, Mus musculus
ccttgcccaccagaaggtgtctaaa

SEQ ID NO: 603174 - DNA, 25 bp, Mus musculus
ccttgcccagccagaagagcttgat

SEQ ID NO: 603175 - DNA, 25 bp, Mus musculus
ccttgcccagcctgaagagcttgat

SEQ ID NO: 603176 - DNA, 25 bp, Mus musculus
ccttgcccaggaagtccaaagatcc

SEQ ID NO: 603177 - DNA, 25 bp, Mus musculus
ccttgcccaggatgtccaaagatcc

SEQ ID NO: 603178 - DNA, 25 bp, Mus musculus
ccttgcccatggagagtgactgtga

SEQ ID NO: 603179 - DNA, 25 bp, Mus musculus
ccttgcccatggtgagtgactgtga

SEQ ID NO: 603180 - DNA, 25 bp, Mus musculus
ccttgccctgccaatcataatgtgg

SEQ ID NO: 603181 - DNA, 25 bp, Mus musculus
ccttgccctgcctatcataatgtgg

SEQ ID NO: 603182 - DNA, 25 bp, Mus musculus
ccttgcccttcaaagtggtggtgat

SEQ ID NO: 603183 - DNA, 25 bp, Mus musculus
ccttgcccttcatagtggtggtgat

SEQ ID NO: 603184 - DNA, 25 bp, Mus musculus
ccttgccggagaccagattctccag

SEQ ID NO: 603185 - DNA, 25 bp, Mus musculus
ccttgccggagagcagattctccag

SEQ ID NO: 603186 - DNA, 25 bp, Mus musculus
ccttgccgtacaccgaggtctcagg

SEQ ID NO: 603187 - DNA, 25 bp, Mus musculus
ccttgccgtacagcgaggtctcagg

SEQ ID NO: 603188 - DNA, 25 bp, Mus musculus
ccttgcctgagtatgtagacaacac

SEQ ID NO: 603189 - DNA, 25 bp, Mus musculus
ccttgcctgagtttgtagacaacac

SEQ ID NO: 603190 - DNA, 25 bp, Mus musculus
ccttgcctgatgaatgtagatgtca

SEQ ID NO: 603191 - DNA, 25 bp, Mus musculus
ccttgcctgatgtatgtagatgtca

SEQ ID NO: 603192 - DNA, 25 bp, Mus musculus
ccttgcctgctgcaagtctgttttg

SEQ ID NO: 603193 - DNA, 25 bp, Mus musculus
ccttgcctgctggaagtctgttttg

SEQ ID NO: 603194 - DNA, 25 bp, Mus musculus
ccttgcctgtgaacctcatggatga

SEQ ID NO: 603195 - DNA, 25 bp, Mus musculus
ccttgcctgtgatcctcatggatga

SEQ ID NO: 603196 - DNA, 25 bp, Mus musculus
ccttgcgcaagtcggcaccaaaggc

SEQ ID NO: 603197 - DNA, 25 bp, Mus musculus
ccttgcgcaagtgggcaccaaaggc

SEQ ID NO: 603198 - DNA, 25 bp, Mus musculus
ccttgcgcacagagggcggtatctg

SEQ ID NO: 603199 - DNA, 25 bp, Mus musculus
ccttgcgcacagtgggcggtatctg

SEQ ID NO: 603200 - DNA, 25 bp, Mus musculus
ccttgcgccagaagacctttgactg

SEQ ID NO: 603201 - DNA, 25 bp, Mus musculus
ccttgcgccagatgacctttgactg

SEQ ID NO: 603202 - DNA, 25 bp, Mus musculus
ccttgcgcctggaggatgtaccaga

SEQ ID NO: 603203 - DNA, 25 bp, Mus musculus
ccttgcgcctggtggatgtaccaga

SEQ ID NO: 603204 - DNA, 25 bp, Mus musculus
ccttgcggctcacacaaagcaggag

SEQ ID NO: 603205 - DNA, 25 bp, Mus musculus
ccttgcggctcagacaaagcaggag

SEQ ID NO: 603206 - DNA, 25 bp, Mus musculus
ccttgcgtcacaaggaacgttgcta

SEQ ID NO: 603207 - DNA, 25 bp, Mus musculus
ccttgcgtcacatggaacgttgcta

SEQ ID NO: 603208 - DNA, 25 bp, Mus musculus
ccttgctaaagtacggtgtgtatga

SEQ ID NO: 603209 - DNA, 25 bp, Mus musculus
ccttgctaaagttcggtgtgtatga

SEQ ID NO: 603210 - DNA, 25 bp, Mus musculus
ccttgctaaggtacacagtgtcaca

SEQ ID NO: 603211 - DNA, 25 bp, Mus musculus
ccttgctaaggttcacagtgtcaca

SEQ ID NO: 603212 - DNA, 25 bp, Mus musculus
ccttgctagggaatttgggccacga

SEQ ID NO: 603213 - DNA, 25 bp, Mus musculus
ccttgctagggattttgggccacga

SEQ ID NO: 603214 - DNA, 25 bp, Mus musculus
ccttgctcaaaaaacgtgaaactga

SEQ ID NO: 603215 - DNA, 25 bp, Mus musculus
ccttgctcaaaatacgtgaaactga

SEQ ID NO: 603216 - DNA, 25 bp, Mus musculus
ccttgctcatggagcaaattaacag

SEQ ID NO: 603217 - DNA, 25 bp, Mus musculus
ccttgctcatggtgcaaattaacag

SEQ ID NO: 603218 - DNA, 25 bp, Mus musculus
ccttgctcggtgctctgtgaggaca

SEQ ID NO: 603219 - DNA, 25 bp, Mus musculus
ccttgctcggtggtctgtgaggaca

SEQ ID NO: 603220 - DNA, 25 bp, Mus musculus
ccttgctgacagaggcgggatttga

SEQ ID NO: 603221 - DNA, 25 bp, Mus musculus
ccttgctgacagtggcgggatttga

SEQ ID NO: 603222 - DNA, 25 bp, Mus musculus
ccttgctgatctagacaaagaagag

SEQ ID NO: 603223 - DNA, 25 bp, Mus musculus
ccttgctgatcttgacaaagaagag

SEQ ID NO: 603224 - DNA, 25 bp, Mus musculus
ccttgctgcaggctgtcacaaacac

SEQ ID NO: 603225 - DNA, 25 bp, Mus musculus
ccttgctgcagggtgtcacaaacac

SEQ ID NO: 603226 - DNA, 25 bp, Mus musculus
ccttgctgctccaagccactttgtg

SEQ ID NO: 603227 - DNA, 25 bp, Mus musculus
ccttgctgctcctagccactttgtg

SEQ ID NO: 603228 - DNA, 25 bp, Mus musculus
ccttgctggcaacctggactctagg

SEQ ID NO: 603229 - DNA, 25 bp, Mus musculus
ccttgctggcaagctggactctagg

SEQ ID NO: 603230 - DNA, 25 bp, Mus musculus
ccttgctgggcaagagcagagagat

SEQ ID NO: 603231 - DNA, 25 bp, Mus musculus
ccttgctgggcatgagcagagagat

SEQ ID NO: 603232 - DNA, 25 bp, Mus musculus
ccttgctgtatcctatgtaaataac

SEQ ID NO: 603233 - DNA, 25 bp, Mus musculus
ccttgctgtatcgtatgtaaataac

SEQ ID NO: 603234 - DNA, 25 bp, Mus musculus
ccttgctgtgatacctggtggctca

SEQ ID NO: 603235 - DNA, 25 bp, Mus musculus
ccttgctgtgattcctggtggctca

SEQ ID NO: 603236 - DNA, 25 bp, Mus musculus
ccttgcttcaggaatgaggtgggca

SEQ ID NO: 603237 - DNA, 25 bp, Mus musculus
ccttgcttcaggtatgaggtgggca

SEQ ID NO: 603238 - DNA, 25 bp, Mus musculus
ccttgcttgcatagtgttcctggtg

SEQ ID NO: 603239 - DNA, 25 bp, Mus musculus
ccttgcttgcattgtgttcctggtg

SEQ ID NO: 603240 - DNA, 25 bp, Mus musculus
ccttgcttggctcagtcaatagggc

SEQ ID NO: 603241 - DNA, 25 bp, Mus musculus
ccttgcttggctgagtcaatagggc

SEQ ID NO: 603242 - DNA, 25 bp, Mus musculus
ccttgcttggtgaggaacagtgccg

SEQ ID NO: 603243 - DNA, 25 bp, Mus musculus
ccttgcttggtgtggaacagtgccg

SEQ ID NO: 603244 - DNA, 25 bp, Mus musculus
ccttggaacaggctatgcttgatgc

SEQ ID NO: 603245 - DNA, 25 bp, Mus musculus
ccttggaacagggtatgcttgatgc

SEQ ID NO: 603246 - DNA, 25 bp, Mus musculus
ccttggaagaagactgcatgcatct

SEQ ID NO: 603247 - DNA, 25 bp, Mus musculus
ccttggaagaagtctgcatgcatct

SEQ ID NO: 603248 - DNA, 25 bp, Mus musculus
ccttggaagcctatgggagtctaca

SEQ ID NO: 603249 - DNA, 25 bp, Mus musculus
ccttggaagcctttgggagtctaca

SEQ ID NO: 603250 - DNA, 25 bp, Mus musculus
ccttggaatggcaagatcaggttca

SEQ ID NO: 603251 - DNA, 25 bp, Mus musculus
ccttggaatggctagatcaggttca

SEQ ID NO: 603252 - DNA, 25 bp, Mus musculus
ccttggaatgtgaagacacaggcaa

SEQ ID NO: 603253 - DNA, 25 bp, Mus musculus
ccttggaatgtgtagacacaggcaa

SEQ ID NO: 603254 - DNA, 25 bp, Mus musculus
ccttggaatttaagctacaccgact

SEQ ID NO: 603255 - DNA, 25 bp, Mus musculus
ccttggaatttatgctacaccgact

SEQ ID NO: 603256 - DNA, 25 bp, Mus musculus
ccttggacaccaaggagaatcagga

SEQ ID NO: 603257 - DNA, 25 bp, Mus musculus
ccttggacaccatggagaatcagga

SEQ ID NO: 603258 - DNA, 25 bp, Mus musculus
ccttggacatgcacaccagggagaa

SEQ ID NO: 603259 - DNA, 25 bp, Mus musculus
ccttggacatgctcaccagggagaa

SEQ ID NO: 603260 - DNA, 25 bp, Mus musculus
ccttggaccagaagatcattacctg

SEQ ID NO: 603261 - DNA, 25 bp, Mus musculus
ccttggaccagatgatcattacctg

SEQ ID NO: 603262 - DNA, 25 bp, Mus musculus
ccttggaccgctcaaaagggcctga

SEQ ID NO: 603263 - DNA, 25 bp, Mus musculus
ccttggaccgctgaaaagggcctga

SEQ ID NO: 603264 - DNA, 25 bp, Mus musculus
ccttggaccggaccagttgccagat

SEQ ID NO: 603265 - DNA, 25 bp, Mus musculus
ccttggaccggagcagttgccagat

SEQ ID NO: 603266 - DNA, 25 bp, Mus musculus
ccttggacgttgctgctggcatgtt

SEQ ID NO: 603267 - DNA, 25 bp, Mus musculus
ccttggacgttggtgctggcatgtt

SEQ ID NO: 603268 - DNA, 25 bp, Mus musculus
ccttggactccaacagaggcttctc

SEQ ID NO: 603269 - DNA, 25 bp, Mus musculus
ccttggactccatcagaggcttctc

SEQ ID NO: 603270 - DNA, 25 bp, Mus musculus
ccttggactctcctgcgtgggtgca

SEQ ID NO: 603271 - DNA, 25 bp, Mus musculus
ccttggactctcgtgcgtgggtgca

SEQ ID NO: 603272 - DNA, 25 bp, Mus musculus
ccttggactgggatcgagcctgctt

SEQ ID NO: 603273 - DNA, 25 bp, Mus musculus
ccttggactgggttcgagcctgctt

SEQ ID NO: 603274 - DNA, 25 bp, Mus musculus
ccttggacttgaacatatgacagac

SEQ ID NO: 603275 - DNA, 25 bp, Mus musculus
ccttggacttgaaggataagacgaa

SEQ ID NO: 603276 - DNA, 25 bp, Mus musculus
ccttggacttgatcatatgacagac

SEQ ID NO: 603277 - DNA, 25 bp, Mus musculus
ccttggacttgatggataagacgaa

SEQ ID NO: 603278 - DNA, 25 bp, Mus musculus
ccttggagaagaatagagcgggacc

SEQ ID NO: 603279 - DNA, 25 bp, Mus musculus
ccttggagaagattagagcgggacc

SEQ ID NO: 603280 - DNA, 25 bp, Mus musculus
ccttggagacgcagaaacaagttat

SEQ ID NO: 603281 - DNA, 25 bp, Mus musculus
ccttggagacgctgaaacaagttat

SEQ ID NO: 603282 - DNA, 25 bp, Mus musculus
ccttggagaggcctgagacagccac

SEQ ID NO: 603283 - DNA, 25 bp, Mus musculus
ccttggagaggcgtgagacagccac

SEQ ID NO: 603284 - DNA, 25 bp, Mus musculus
ccttggagcccactgtagaactgta

SEQ ID NO: 603285 - DNA, 25 bp, Mus musculus
ccttggagcccagtgtagaactgta

SEQ ID NO: 603286 - DNA, 25 bp, Mus musculus
ccttggagccgtcaaaacaattgcc

SEQ ID NO: 603287 - DNA, 25 bp, Mus musculus
ccttggagccgtgaaaacaattgcc

SEQ ID NO: 603288 - DNA, 25 bp, Mus musculus
ccttggagcggtacctgcggagact

SEQ ID NO: 603289 - DNA, 25 bp, Mus musculus
ccttggagcggttcctgcggagact

SEQ ID NO: 603290 - DNA, 25 bp, Mus musculus
ccttggagcgtgactttgagcggac

SEQ ID NO: 603291 - DNA, 25 bp, Mus musculus
ccttggagcgtgtctttgagcggac

SEQ ID NO: 603292 - DNA, 25 bp, Mus musculus
ccttggagctcactggtttaaaagt

SEQ ID NO: 603293 - DNA, 25 bp, Mus musculus
ccttggagctcagtggtttaaaagt

SEQ ID NO: 603294 - DNA, 25 bp, Mus musculus
ccttggaggatgaagcaagaatgaa

SEQ ID NO: 603295 - DNA, 25 bp, Mus musculus
ccttggaggatgtagcaagaatgaa

SEQ ID NO: 603296 - DNA, 25 bp, Mus musculus
ccttggaggcatccagttcagcaga

SEQ ID NO: 603297 - DNA, 25 bp, Mus musculus
ccttggaggcatgcagttcagcaga

SEQ ID NO: 603298 - DNA, 25 bp, Mus musculus
ccttggagggccacaccaagagggt

SEQ ID NO: 603299 - DNA, 25 bp, Mus musculus
ccttggagggcctcaccaagagggt

SEQ ID NO: 603300 - DNA, 25 bp, Mus musculus
ccttggagtgatccaggttcagaac

SEQ ID NO: 603301 - DNA, 25 bp, Mus musculus
ccttggagtgatgcaggttcagaac

SEQ ID NO: 603302 - DNA, 25 bp, Mus musculus
ccttggagtggtaggaagagacaaa

SEQ ID NO: 603303 - DNA, 25 bp, Mus musculus
ccttggagtggttggaagagacaaa

SEQ ID NO: 603304 - DNA, 25 bp, Mus musculus
ccttggataaccaaaagagtaactg

SEQ ID NO: 603305 - DNA, 25 bp, Mus musculus
ccttggataacctaaagagtaactg

SEQ ID NO: 603306 - DNA, 25 bp, Mus musculus
ccttggatctctccgctgaaggaac

SEQ ID NO: 603307 - DNA, 25 bp, Mus musculus
ccttggatctctgcgctgaaggaac

SEQ ID NO: 603308 - DNA, 25 bp, Mus musculus
ccttggatgagactgcaaccaagct

SEQ ID NO: 603309 - DNA, 25 bp, Mus musculus
ccttggatgagagtgcaaccaagct

SEQ ID NO: 603310 - DNA, 25 bp, Mus musculus
ccttggatgggcattagaggcactg

SEQ ID NO: 603311 - DNA, 25 bp, Mus musculus
ccttggatgggctttagaggcactg

SEQ ID NO: 603312 - DNA, 25 bp, Mus musculus
ccttggatgtgaaaattgccttttg

SEQ ID NO: 603313 - DNA, 25 bp, Mus musculus
ccttggatgtgataattgccttttg

SEQ ID NO: 603314 - DNA, 25 bp, Mus musculus
ccttggatgtggctctattgctcaa

SEQ ID NO: 603315 - DNA, 25 bp, Mus musculus
ccttggatgtgggtctattgctcaa

SEQ ID NO: 603316 - DNA, 25 bp, Mus musculus
ccttggattcatctggacctctgga

SEQ ID NO: 603317 - DNA, 25 bp, Mus musculus
ccttggattcatgtggacctctgga

SEQ ID NO: 603318 - DNA, 25 bp, Mus musculus
ccttggattcgaagatgatgttgtc

SEQ ID NO: 603319 - DNA, 25 bp, Mus musculus
ccttggattcgatgatgatgttgtc

SEQ ID NO: 603320 - DNA, 25 bp, Mus musculus
ccttggcaaatgcagaccgcagtga

SEQ ID NO: 603321 - DNA, 25 bp, Mus musculus
ccttggcaaatggagaccgcagtga

SEQ ID NO: 603322 - DNA, 25 bp, Mus musculus
ccttggcaactgctaaatttgttca

SEQ ID NO: 603323 - DNA, 25 bp, Mus musculus
ccttggcaactggtaaatttgttca

SEQ ID NO: 603324 - DNA, 25 bp, Mus musculus
ccttggcaaggcaaccagagctgtg

SEQ ID NO: 603325 - DNA, 25 bp, Mus musculus
ccttggcaaggctaccagagctgtg

SEQ ID NO: 603326 - DNA, 25 bp, Mus musculus
ccttggcacaggaggatactcccat

SEQ ID NO: 603327 - DNA, 25 bp, Mus musculus
ccttggcacaggtggatactcccat

SEQ ID NO: 603328 - DNA, 25 bp, Mus musculus
ccttggcaccagagacggatgaagc

SEQ ID NO: 603329 - DNA, 25 bp, Mus musculus
ccttggcaccagtgacggatgaagc

SEQ ID NO: 603330 - DNA, 25 bp, Mus musculus
ccttggcactgcaggtgctcttcct

SEQ ID NO: 603331 - DNA, 25 bp, Mus musculus
ccttggcactgctggtgctcttcct

SEQ ID NO: 603332 - DNA, 25 bp, Mus musculus
ccttggcagctgacttgagaaatct

SEQ ID NO: 603333 - DNA, 25 bp, Mus musculus
ccttggcagctgtcttgagaaatct

SEQ ID NO: 603334 - DNA, 25 bp, Mus musculus
ccttggcaggacctagttctcacag

SEQ ID NO: 603335 - DNA, 25 bp, Mus musculus
ccttggcaggacgtagttctcacag

SEQ ID NO: 603336 - DNA, 25 bp, Mus musculus
ccttggcaggtgacactgcatgcta

SEQ ID NO: 603337 - DNA, 25 bp, Mus musculus
ccttggcaggtgtcactgcatgcta

SEQ ID NO: 603338 - DNA, 25 bp, Mus musculus
ccttggcatagaagcaagcaagcgg

SEQ ID NO: 603339 - DNA, 25 bp, Mus musculus
ccttggcatagatgcaagcaagcgg

SEQ ID NO: 603340 - DNA, 25 bp, Mus musculus
ccttggcatgaaatagagaacagtc

SEQ ID NO: 603341 - DNA, 25 bp, Mus musculus
ccttggcatgaattagagaacagtc

SEQ ID NO: 603342 - DNA, 25 bp, Mus musculus
ccttggcatgcgcattcacatttct

SEQ ID NO: 603343 - DNA, 25 bp, Mus musculus
ccttggcatgcggattcacatttct

SEQ ID NO: 603344 - DNA, 25 bp, Mus musculus
ccttggccaagcagggtttgtgatc

SEQ ID NO: 603345 - DNA, 25 bp, Mus musculus
ccttggccaagctgggtttgtgatc

SEQ ID NO: 603346 - DNA, 25 bp, Mus musculus
ccttggccaccgaaacagagcctgt

SEQ ID NO: 603347 - DNA, 25 bp, Mus musculus
ccttggccaccgtaacagagcctgt

SEQ ID NO: 603348 - DNA, 25 bp, Mus musculus
ccttggccagcccatcgaggaatgg

SEQ ID NO: 603349 - DNA, 25 bp, Mus musculus
ccttggccagccgatcgaggaatgg

SEQ ID NO: 603350 - DNA, 25 bp, Mus musculus
ccttggccatgaccgctgggacatt

SEQ ID NO: 603351 - DNA, 25 bp, Mus musculus
ccttggccatgagcgctgggacatt

SEQ ID NO: 603352 - DNA, 25 bp, Mus musculus
ccttggcccaggcaatgtggaagcc

SEQ ID NO: 603353 - DNA, 25 bp, Mus musculus
ccttggcccagggaatgtggaagcc

SEQ ID NO: 603354 - DNA, 25 bp, Mus musculus
ccttggccgagcctcaaaggcctga

SEQ ID NO: 603355 - DNA, 25 bp, Mus musculus
ccttggccgagcgtcaaaggcctga

SEQ ID NO: 603356 - DNA, 25 bp, Mus musculus
ccttggccttgaacaggacaggccg

SEQ ID NO: 603357 - DNA, 25 bp, Mus musculus
ccttggccttgatcaggacaggccg

SEQ ID NO: 603358 - DNA, 25 bp, Mus musculus
ccttggcgaattaagggctgctggc

SEQ ID NO: 603359 - DNA, 25 bp, Mus musculus
ccttggcgaatttagggctgctggc

SEQ ID NO: 603360 - DNA, 25 bp, Mus musculus
ccttggcgcgacaacaaagctccag

SEQ ID NO: 603361 - DNA, 25 bp, Mus musculus
ccttggcgcgactacaaagctccag

SEQ ID NO: 603362 - DNA, 25 bp, Mus musculus
ccttggcgcgtcagctgtacatgaa

SEQ ID NO: 603363 - DNA, 25 bp, Mus musculus
ccttggcgcgtctgctgtacatgaa

SEQ ID NO: 603364 - DNA, 25 bp, Mus musculus
ccttggcgctggctgagtcaccgta

SEQ ID NO: 603365 - DNA, 25 bp, Mus musculus
ccttggcgctgggtgagtcaccgta

SEQ ID NO: 603366 - DNA, 25 bp, Mus musculus
ccttggctcactagtcattgtaaaa

SEQ ID NO: 603367 - DNA, 25 bp, Mus musculus
ccttggctcacttgtcattgtaaaa

SEQ ID NO: 603368 - DNA, 25 bp, Mus musculus
ccttggctcagaagggcagctctgt

SEQ ID NO: 603369 - DNA, 25 bp, Mus musculus
ccttggctcagatgggcagctctgt

SEQ ID NO: 603370 - DNA, 25 bp, Mus musculus
ccttggctcgcgacacgtgctgata

SEQ ID NO: 603371 - DNA, 25 bp, Mus musculus
ccttggctcgcgtcacgtgctgata

SEQ ID NO: 603372 - DNA, 25 bp, Mus musculus
ccttggctctggactgggcattgga

SEQ ID NO: 603373 - DNA, 25 bp, Mus musculus
ccttggctctggtctgggcattgga

SEQ ID NO: 603374 - DNA, 25 bp, Mus musculus
ccttggctgaaacaggacgactgga

SEQ ID NO: 603375 - DNA, 25 bp, Mus musculus
ccttggctgaaagaggacgactgga

SEQ ID NO: 603376 - DNA, 25 bp, Mus musculus
ccttggctgttaccctgtggagctg

SEQ ID NO: 603377 - DNA, 25 bp, Mus musculus
ccttggctgttagcctgtggagctg

SEQ ID NO: 603378 - DNA, 25 bp, Mus musculus
ccttggcttccaaatcagcctaggg

SEQ ID NO: 603379 - DNA, 25 bp, Mus musculus
ccttggcttccaccagcttgtcaga

SEQ ID NO: 603380 - DNA, 25 bp, Mus musculus
ccttggcttccagcagcttgtcaga

SEQ ID NO: 603381 - DNA, 25 bp, Mus musculus
ccttggcttccatatcagcctaggg

SEQ ID NO: 603382 - DNA, 25 bp, Mus musculus
ccttggcttgggagaccttggctgt

SEQ ID NO: 603383 - DNA, 25 bp, Mus musculus
ccttggcttgggtgaccttggctgt

SEQ ID NO: 603384 - DNA, 25 bp, Mus musculus
ccttggctttgtagtgcttaggaaa

SEQ ID NO: 603385 - DNA, 25 bp, Mus musculus
ccttggctttgttgtgcttaggaaa

SEQ ID NO: 603386 - DNA, 25 bp, Mus musculus
ccttgggaaatcagttccacgtgga

SEQ ID NO: 603387 - DNA, 25 bp, Mus musculus
ccttgggaaatctgttccacgtgga

SEQ ID NO: 603388 - DNA, 25 bp, Mus musculus
ccttgggaatgccttgagtagctca

SEQ ID NO: 603389 - DNA, 25 bp, Mus musculus
ccttgggaatgcgttgagtagctca

SEQ ID NO: 603390 - DNA, 25 bp, Mus musculus
ccttgggaatgtagagcaccgtatc

SEQ ID NO: 603391 - DNA, 25 bp, Mus musculus
ccttgggaatgttgagcaccgtatc

SEQ ID NO: 603392 - DNA, 25 bp, Mus musculus
ccttgggacactatggaacttgcac

SEQ ID NO: 603393 - DNA, 25 bp, Mus musculus
ccttgggacactttggaacttgcac

SEQ ID NO: 603394 - DNA, 25 bp, Mus musculus
ccttgggacctgagtctaacagcta

SEQ ID NO: 603395 - DNA, 25 bp, Mus musculus
ccttgggacctgtgtctaacagcta

SEQ ID NO: 603396 - DNA, 25 bp, Mus musculus
ccttgggactgactggcaaagctca

SEQ ID NO: 603397 - DNA, 25 bp, Mus musculus
ccttgggactgagtggcaaagctca

SEQ ID NO: 603398 - DNA, 25 bp, Mus musculus
ccttgggagccaaagctgaggagtc

SEQ ID NO: 603399 - DNA, 25 bp, Mus musculus
ccttgggagccatagctgaggagtc

SEQ ID NO: 603400 - DNA, 25 bp, Mus musculus
ccttgggaggcaagaggaggcgctg

SEQ ID NO: 603401 - DNA, 25 bp, Mus musculus
ccttgggaggcatgaggaggcgctg

SEQ ID NO: 603402 - DNA, 25 bp, Mus musculus
ccttgggagtccatcttgtgacagt

SEQ ID NO: 603403 - DNA, 25 bp, Mus musculus
ccttgggagtccttcttgtgacagt

SEQ ID NO: 603404 - DNA, 25 bp, Mus musculus
ccttgggatacaaagaaccagaaag

SEQ ID NO: 603405 - DNA, 25 bp, Mus musculus
ccttgggatacatagaaccagaaag

SEQ ID NO: 603406 - DNA, 25 bp, Mus musculus
ccttgggatgagaaagataatgatg

SEQ ID NO: 603407 - DNA, 25 bp, Mus musculus
ccttgggatgagtaagataatgatg

SEQ ID NO: 603408 - DNA, 25 bp, Mus musculus
ccttgggcatctcacacagcgggtg

SEQ ID NO: 603409 - DNA, 25 bp, Mus musculus
ccttgggcatctgacacagcgggtg

SEQ ID NO: 603410 - DNA, 25 bp, Mus musculus
ccttgggcccacacagaaatctcat

SEQ ID NO: 603411 - DNA, 25 bp, Mus musculus
ccttgggcccactcagaaatctcat

SEQ ID NO: 603412 - DNA, 25 bp, Mus musculus
ccttggggtacacgtgccagatgtc

SEQ ID NO: 603413 - DNA, 25 bp, Mus musculus
ccttggggtacaggtgccagatgtc

SEQ ID NO: 603414 - DNA, 25 bp, Mus musculus
ccttgggtaagtcgccagagccctt

SEQ ID NO: 603415 - DNA, 25 bp, Mus musculus
ccttgggtaagtggccagagccctt

SEQ ID NO: 603416 - DNA, 25 bp, Mus musculus
ccttgggtagctacacttactccac

SEQ ID NO: 603417 - DNA, 25 bp, Mus musculus
ccttgggtagcttcacttactccac

SEQ ID NO: 603418 - DNA, 25 bp, Mus musculus
ccttgggtcatcaccagcagctttg

SEQ ID NO: 603419 - DNA, 25 bp, Mus musculus
ccttgggtcatctccagcagctttg

SEQ ID NO: 603420 - DNA, 25 bp, Mus musculus
ccttgggtctccacagaggtgctgg

SEQ ID NO: 603421 - DNA, 25 bp, Mus musculus
ccttgggtctcctcagaggtgctgg

SEQ ID NO: 603422 - DNA, 25 bp, Mus musculus
ccttgggttatgcagcagagaaaag

SEQ ID NO: 603423 - DNA, 25 bp, Mus musculus
ccttgggttatggagcagagaaaag

SEQ ID NO: 603424 - DNA, 25 bp, Mus musculus
ccttggtaaaaactgctggtatcac

SEQ ID NO: 603425 - DNA, 25 bp, Mus musculus
ccttggtaaaaagtgctggtatcac

SEQ ID NO: 603426 - DNA, 25 bp, Mus musculus
ccttggtaatacctgccatcgggat

SEQ ID NO: 603427 - DNA, 25 bp, Mus musculus
ccttggtaatacgtgccatcgggat

SEQ ID NO: 603428 - DNA, 25 bp, Mus musculus
ccttggtagaagataaactgagtct

SEQ ID NO: 603429 - DNA, 25 bp, Mus musculus
ccttggtagaagttaaactgagtct

SEQ ID NO: 603430 - DNA, 25 bp, Mus musculus
ccttggtagcagctgatgccttaga

SEQ ID NO: 603431 - DNA, 25 bp, Mus musculus
ccttggtagcagcttgtgtgaatgc

SEQ ID NO: 603432 - DNA, 25 bp, Mus musculus
ccttggtagcaggtgatgccttaga

SEQ ID NO: 603433 - DNA, 25 bp, Mus musculus
ccttggtagcaggttgtgtgaatgc

SEQ ID NO: 603434 - DNA, 25 bp, Mus musculus
ccttggtatggtatactcccacaag

SEQ ID NO: 603435 - DNA, 25 bp, Mus musculus
ccttggtatggtttactcccacaag

SEQ ID NO: 603436 - DNA, 25 bp, Mus musculus
ccttggtcagaaaccgagtctccga

SEQ ID NO: 603437 - DNA, 25 bp, Mus musculus
ccttggtcagaatccgagtctccga

SEQ ID NO: 603438 - DNA, 25 bp, Mus musculus
ccttggtgaatacgaggagtacatc

SEQ ID NO: 603439 - DNA, 25 bp, Mus musculus
ccttggtgaataggaggagtacatc

SEQ ID NO: 603440 - DNA, 25 bp, Mus musculus
ccttggtgacaactccagagagaca

SEQ ID NO: 603441 - DNA, 25 bp, Mus musculus
ccttggtgacaagtccagagagaca

SEQ ID NO: 603442 - DNA, 25 bp, Mus musculus
ccttggtgatcacttttgaagtcac

SEQ ID NO: 603443 - DNA, 25 bp, Mus musculus
ccttggtgatcagttttgaagtcac

SEQ ID NO: 603444 - DNA, 25 bp, Mus musculus
ccttggtgattgcttccatcctggg

SEQ ID NO: 603445 - DNA, 25 bp, Mus musculus
ccttggtgattggttccatcctggg

SEQ ID NO: 603446 - DNA, 25 bp, Mus musculus
ccttggtgcacgaaagccttctaac

SEQ ID NO: 603447 - DNA, 25 bp, Mus musculus
ccttggtgcacgtaagccttctaac

SEQ ID NO: 603448 - DNA, 25 bp, Mus musculus
ccttggtgccctccggtcgaagttg

SEQ ID NO: 603449 - DNA, 25 bp, Mus musculus
ccttggtgccctgcggtcgaagttg

SEQ ID NO: 603450 - DNA, 25 bp, Mus musculus
ccttggtgctatctggtgaaggaca

SEQ ID NO: 603451 - DNA, 25 bp, Mus musculus
ccttggtgctatgtggtgaaggaca

SEQ ID NO: 603452 - DNA, 25 bp, Mus musculus
ccttggtgctgactcagacctcgga

SEQ ID NO: 603453 - DNA, 25 bp, Mus musculus
ccttggtgctgagtcagacctcgga

SEQ ID NO: 603454 - DNA, 25 bp, Mus musculus
ccttggtggaacatcaaatcatgcc

SEQ ID NO: 603455 - DNA, 25 bp, Mus musculus
ccttggtggaacttcaaatcatgcc

SEQ ID NO: 603456 - DNA, 25 bp, Mus musculus
ccttggtggaccagacaagtggtga

SEQ ID NO: 603457 - DNA, 25 bp, Mus musculus
ccttggtggacctgacaagtggtga

SEQ ID NO: 603458 - DNA, 25 bp, Mus musculus
ccttggtggaggagcacaagtctga

SEQ ID NO: 603459 - DNA, 25 bp, Mus musculus
ccttggtggaggtgcacaagtctga

SEQ ID NO: 603460 - DNA, 25 bp, Mus musculus
ccttggtggctgctctcaacatcga

SEQ ID NO: 603461 - DNA, 25 bp, Mus musculus
ccttggtggctggtctcaacatcga

SEQ ID NO: 603462 - DNA, 25 bp, Mus musculus
ccttggtgtagcacaacagctgact

SEQ ID NO: 603463 - DNA, 25 bp, Mus musculus
ccttggtgtagctcaacagctgact

SEQ ID NO: 603464 - DNA, 25 bp, Mus musculus
ccttggttcgacacatggagtcacg

SEQ ID NO: 603465 - DNA, 25 bp, Mus musculus
ccttggttcgactcatggagtcacg

SEQ ID NO: 603466 - DNA, 25 bp, Mus musculus
ccttggttgaagaagtagcgacttt

SEQ ID NO: 603467 - DNA, 25 bp, Mus musculus
ccttggttgaagtagtagcgacttt

SEQ ID NO: 603468 - DNA, 25 bp, Mus musculus
ccttggttgcagctagtgcagtaca

SEQ ID NO: 603469 - DNA, 25 bp, Mus musculus
ccttggttgcaggtagtgcagtaca

SEQ ID NO: 603470 - DNA, 25 bp, Mus musculus
ccttgtaaactcagcagcaggtgtt

SEQ ID NO: 603471 - DNA, 25 bp, Mus musculus
ccttgtaaactctgcagcaggtgtt

SEQ ID NO: 603472 - DNA, 25 bp, Mus musculus
ccttgtacagatcgtgtataaatga

SEQ ID NO: 603473 - DNA, 25 bp, Mus musculus
ccttgtacagatggtgtataaatga

SEQ ID NO: 603474 - DNA, 25 bp, Mus musculus
ccttgtacagtcagggtggccatgg

SEQ ID NO: 603475 - DNA, 25 bp, Mus musculus
ccttgtacagtctgggtggccatgg

SEQ ID NO: 603476 - DNA, 25 bp, Mus musculus
ccttgtactctgatcaggaggctgc

SEQ ID NO: 603477 - DNA, 25 bp, Mus musculus
ccttgtactctgttcaggaggctgc

SEQ ID NO: 603478 - DNA, 25 bp, Mus musculus
ccttgtacttggctgagtggcagaa

SEQ ID NO: 603479 - DNA, 25 bp, Mus musculus
ccttgtacttgggtgagtggcagaa

SEQ ID NO: 603480 - DNA, 25 bp, Mus musculus
ccttgtagctacaaaactggcaaaa

SEQ ID NO: 603481 - DNA, 25 bp, Mus musculus
ccttgtagctactaaactggcaaaa

SEQ ID NO: 603482 - DNA, 25 bp, Mus musculus
ccttgtaggaagcattgcagctggt

SEQ ID NO: 603483 - DNA, 25 bp, Mus musculus
ccttgtaggaaggattgcagctggt

SEQ ID NO: 603484 - DNA, 25 bp, Mus musculus
ccttgtaggcatatctgctaatcta

SEQ ID NO: 603485 - DNA, 25 bp, Mus musculus
ccttgtaggcatttctgctaatcta

SEQ ID NO: 603486 - DNA, 25 bp, Mus musculus
ccttgtagttgcaaccagtctataa

SEQ ID NO: 603487 - DNA, 25 bp, Mus musculus
ccttgtagttgctaccagtctataa

SEQ ID NO: 603488 - DNA, 25 bp, Mus musculus
ccttgtatgcctagcaggtaactca

SEQ ID NO: 603489 - DNA, 25 bp, Mus musculus
ccttgtatgccttgcaggtaactca

SEQ ID NO: 603490 - DNA, 25 bp, Mus musculus
ccttgtcaagggacccagggacaca

SEQ ID NO: 603491 - DNA, 25 bp, Mus musculus
ccttgtcaagggtcccagggacaca

SEQ ID NO: 603492 - DNA, 25 bp, Mus musculus
ccttgtcagcgcctctcaggatgga

SEQ ID NO: 603493 - DNA, 25 bp, Mus musculus
ccttgtcagcgcgtctcaggatgga

SEQ ID NO: 603494 - DNA, 25 bp, Mus musculus
ccttgtcatacaagtctcgggaaga

SEQ ID NO: 603495 - DNA, 25 bp, Mus musculus
ccttgtcatacatgtctcgggaaga

SEQ ID NO: 603496 - DNA, 25 bp, Mus musculus
ccttgtccagataagtagagccctt

SEQ ID NO: 603497 - DNA, 25 bp, Mus musculus
ccttgtccagattagtagagccctt

SEQ ID NO: 603498 - DNA, 25 bp, Mus musculus
ccttgtccatgcagtgtaggtgacc

SEQ ID NO: 603499 - DNA, 25 bp, Mus musculus
ccttgtccatgctgtgtaggtgacc

SEQ ID NO: 603500 - DNA, 25 bp, Mus musculus
ccttgtcccaagcagaccatgctgg

SEQ ID NO: 603501 - DNA, 25 bp, Mus musculus
ccttgtcccaaggagaccatgctgg

SEQ ID NO: 603502 - DNA, 25 bp, Mus musculus
ccttgtccccatagatgcagaggta

SEQ ID NO: 603503 - DNA, 25 bp, Mus musculus
ccttgtccccattgatgcagaggta

SEQ ID NO: 603504 - DNA, 25 bp, Mus musculus
ccttgtccggatctctactggttcc

SEQ ID NO: 603505 - DNA, 25 bp, Mus musculus
ccttgtccggatgtctactggttcc

SEQ ID NO: 603506 - DNA, 25 bp, Mus musculus
ccttgtccggcacccggaatggcga

SEQ ID NO: 603507 - DNA, 25 bp, Mus musculus
ccttgtccggcagccggaatggcga

SEQ ID NO: 603508 - DNA, 25 bp, Mus musculus
ccttgtccttacagtcccgagaaga

SEQ ID NO: 603509 - DNA, 25 bp, Mus musculus
ccttgtccttactgtcccgagaaga

SEQ ID NO: 603510 - DNA, 25 bp, Mus musculus
ccttgtcgccgtaagcttgatcatc

SEQ ID NO: 603511 - DNA, 25 bp, Mus musculus
ccttgtcgccgttagcttgatcatc

SEQ ID NO: 603512 - DNA, 25 bp, Mus musculus
ccttgtcggaagagatggacaattc

SEQ ID NO: 603513 - DNA, 25 bp, Mus musculus
ccttgtcggaagtgatggacaattc

SEQ ID NO: 603514 - DNA, 25 bp, Mus musculus
ccttgtcgtatcagggagatgagca

SEQ ID NO: 603515 - DNA, 25 bp, Mus musculus
ccttgtcgtatctgggagatgagca

SEQ ID NO: 603516 - DNA, 25 bp, Mus musculus
ccttgtctaaggagttacactgcca

SEQ ID NO: 603517 - DNA, 25 bp, Mus musculus
ccttgtctaaggtgttacactgcca

SEQ ID NO: 603518 - DNA, 25 bp, Mus musculus
ccttgtctatgaagccctcagctgg

SEQ ID NO: 603519 - DNA, 25 bp, Mus musculus
ccttgtctatgatgccctcagctgg

SEQ ID NO: 603520 - DNA, 25 bp, Mus musculus
ccttgtctcaaacagaagagaacaa

SEQ ID NO: 603521 - DNA, 25 bp, Mus musculus
ccttgtctcaaagagaagagaacaa

SEQ ID NO: 603522 - DNA, 25 bp, Mus musculus
ccttgtctcacacctgctgcaaggt

SEQ ID NO: 603523 - DNA, 25 bp, Mus musculus
ccttgtctcacagctgctgcaaggt

SEQ ID NO: 603524 - DNA, 25 bp, Mus musculus
ccttgtctctgtcatgggctacctc

SEQ ID NO: 603525 - DNA, 25 bp, Mus musculus
ccttgtctctgtgatgggctacctc

SEQ ID NO: 603526 - DNA, 25 bp, Mus musculus
ccttgtctttgtactaagcatcggg

SEQ ID NO: 603527 - DNA, 25 bp, Mus musculus
ccttgtctttgttctaagcatcggg

SEQ ID NO: 603528 - DNA, 25 bp, Mus musculus
ccttgtcttttgactttaggacgct

SEQ ID NO: 603529 - DNA, 25 bp, Mus musculus
ccttgtcttttgtctttaggacgct

SEQ ID NO: 603530 - DNA, 25 bp, Mus musculus
ccttgtgaggaaaggcactgactct

SEQ ID NO: 603531 - DNA, 25 bp, Mus musculus
ccttgtgaggaatggcactgactct

SEQ ID NO: 603532 - DNA, 25 bp, Mus musculus
ccttgtgaggacagaacacagtcct

SEQ ID NO: 603533 - DNA, 25 bp, Mus musculus
ccttgtgaggactgaacacagtcct

SEQ ID NO: 603534 - DNA, 25 bp, Mus musculus
ccttgtgagtcacgattatgtcaat

SEQ ID NO: 603535 - DNA, 25 bp, Mus musculus
ccttgtgagtcaggattatgtcaat

SEQ ID NO: 603536 - DNA, 25 bp, Mus musculus
ccttgtgatcttcaagcaggcagaa

SEQ ID NO: 603537 - DNA, 25 bp, Mus musculus
ccttgtgatcttgaagcaggcagaa

SEQ ID NO: 603538 - DNA, 25 bp, Mus musculus
ccttgtgcaagaactctgagcccca

SEQ ID NO: 603539 - DNA, 25 bp, Mus musculus
ccttgtgcaagatctctgagcccca

SEQ ID NO: 603540 - DNA, 25 bp, Mus musculus
ccttgtgccgtactctgtctccggg

SEQ ID NO: 603541 - DNA, 25 bp, Mus musculus
ccttgtgccgtagtctgtctccggg

SEQ ID NO: 603542 - DNA, 25 bp, Mus musculus
ccttgtgcctacacagggtgatgca

SEQ ID NO: 603543 - DNA, 25 bp, Mus musculus
ccttgtgcctactcagggtgatgca

SEQ ID NO: 603544 - DNA, 25 bp, Mus musculus
ccttgtgctgtgaagaggcccgcag

SEQ ID NO: 603545 - DNA, 25 bp, Mus musculus
ccttgtgctgtgtagaggcccgcag

SEQ ID NO: 603546 - DNA, 25 bp, Mus musculus
ccttgtggaaggaggcgagaacatc

SEQ ID NO: 603547 - DNA, 25 bp, Mus musculus
ccttgtggaaggtggcgagaacatc

SEQ ID NO: 603548 - DNA, 25 bp, Mus musculus
ccttgtggagaactctctgggtagc

SEQ ID NO: 603549 - DNA, 25 bp, Mus musculus
ccttgtggagaagtctctgggtagc

SEQ ID NO: 603550 - DNA, 25 bp, Mus musculus
ccttgtggaggtcattctttgcagc

SEQ ID NO: 603551 - DNA, 25 bp, Mus musculus
ccttgtggaggtgattctttgcagc

SEQ ID NO: 603552 - DNA, 25 bp, Mus musculus
ccttgtggataacatctctgtggat

SEQ ID NO: 603553 - DNA, 25 bp, Mus musculus
ccttgtggataagatctctgtggat

SEQ ID NO: 603554 - DNA, 25 bp, Mus musculus
ccttgtggcccgactcattatccat

SEQ ID NO: 603555 - DNA, 25 bp, Mus musculus
ccttgtggcccgtctcattatccat

SEQ ID NO: 603556 - DNA, 25 bp, Mus musculus
ccttgtgggaccacgctggcagtag

SEQ ID NO: 603557 - DNA, 25 bp, Mus musculus
ccttgtgggacctcgctggcagtag

SEQ ID NO: 603558 - DNA, 25 bp, Mus musculus
ccttgtggtcatagcccctgatacc

SEQ ID NO: 603559 - DNA, 25 bp, Mus musculus
ccttgtggtcattgcccctgatacc

SEQ ID NO: 603560 - DNA, 25 bp, Mus musculus
ccttgtgtaacaaagtcagcgtgga

SEQ ID NO: 603561 - DNA, 25 bp, Mus musculus
ccttgtgtaacatagtcagcgtgga

SEQ ID NO: 603562 - DNA, 25 bp, Mus musculus
ccttgtgtctgcacgacctgtggaa

SEQ ID NO: 603563 - DNA, 25 bp, Mus musculus
ccttgtgtctgctcgacctgtggaa

SEQ ID NO: 603564 - DNA, 25 bp, Mus musculus
ccttgtgtgcaaagtgaagaatccc

SEQ ID NO: 603565 - DNA, 25 bp, Mus musculus
ccttgtgtgcaatgtgaagaatccc

SEQ ID NO: 603566 - DNA, 25 bp, Mus musculus
ccttgtgtgtacagtagcaggctgt

SEQ ID NO: 603567 - DNA, 25 bp, Mus musculus
ccttgtgtgtactgtagcaggctgt

SEQ ID NO: 603568 - DNA, 25 bp, Mus musculus
ccttgtgtgtcacatgtgcgactgt

SEQ ID NO: 603569 - DNA, 25 bp, Mus musculus
ccttgtgtgtcagatgtgcgactgt

SEQ ID NO: 603570 - DNA, 25 bp, Mus musculus
ccttgtgtttgtagacggaatccga

SEQ ID NO: 603571 - DNA, 25 bp, Mus musculus
ccttgtgtttgttgacggaatccga

SEQ ID NO: 603572 - DNA, 25 bp, Mus musculus
ccttgttaccctctggaccatggtg

SEQ ID NO: 603573 - DNA, 25 bp, Mus musculus
ccttgttaccctgtggaccatggtg

SEQ ID NO: 603574 - DNA, 25 bp, Mus musculus
ccttgttagaagacctcctggcggg

SEQ ID NO: 603575 - DNA, 25 bp, Mus musculus
ccttgttagaagtcctcctggcggg

SEQ ID NO: 603576 - DNA, 25 bp, Mus musculus
ccttgttatcctcacccaaggtgaa

SEQ ID NO: 603577 - DNA, 25 bp, Mus musculus
ccttgttatcctgacccaaggtgaa

SEQ ID NO: 603578 - DNA, 25 bp, Mus musculus
ccttgttatgcgcaagtttctacag

SEQ ID NO: 603579 - DNA, 25 bp, Mus musculus
ccttgttatgcggaagtttctacag

SEQ ID NO: 603580 - DNA, 25 bp, Mus musculus
ccttgttcaccaactaaaactgcca

SEQ ID NO: 603581 - DNA, 25 bp, Mus musculus
ccttgttcaccatctaaaactgcca

SEQ ID NO: 603582 - DNA, 25 bp, Mus musculus
ccttgttcatctagggagcgctata

SEQ ID NO: 603583 - DNA, 25 bp, Mus musculus
ccttgttcatcttgggagcgctata

SEQ ID NO: 603584 - DNA, 25 bp, Mus musculus
ccttgttgatccctagttatgggct

SEQ ID NO: 603585 - DNA, 25 bp, Mus musculus
ccttgttgatccgtagttatgggct

SEQ ID NO: 603586 - DNA, 25 bp, Mus musculus
ccttgttgcaagagtaagtatactt

SEQ ID NO: 603587 - DNA, 25 bp, Mus musculus
ccttgttgcaagtgtaagtatactt

SEQ ID NO: 603588 - DNA, 25 bp, Mus musculus
ccttgttgctcacaggatgctgaac

SEQ ID NO: 603589 - DNA, 25 bp, Mus musculus
ccttgttgctcagaggatgctgaac

SEQ ID NO: 603590 - DNA, 25 bp, Mus musculus
ccttgttgctgtagaactggaaaaa

SEQ ID NO: 603591 - DNA, 25 bp, Mus musculus
ccttgttgctgtctctcaggagcct

SEQ ID NO: 603592 - DNA, 25 bp, Mus musculus
ccttgttgctgtgtctcaggagcct

SEQ ID NO: 603593 - DNA, 25 bp, Mus musculus
ccttgttgctgttgaactggaaaaa

SEQ ID NO: 603594 - DNA, 25 bp, Mus musculus
ccttgttggccgatttattcatctg

SEQ ID NO: 603595 - DNA, 25 bp, Mus musculus
ccttgttggccgttttattcatctg

SEQ ID NO: 603596 - DNA, 25 bp, Mus musculus
ccttgttgtagactaagaatctttc

SEQ ID NO: 603597 - DNA, 25 bp, Mus musculus
ccttgttgtagagtaagaatctttc

SEQ ID NO: 603598 - DNA, 25 bp, Mus musculus
ccttgttgtttgaagacgcttgtgc

SEQ ID NO: 603599 - DNA, 25 bp, Mus musculus
ccttgttgtttgtagacgcttgtgc

SEQ ID NO: 603600 - DNA, 25 bp, Mus musculus
ccttgtttgcctagggattggcttt

SEQ ID NO: 603601 - DNA, 25 bp, Mus musculus
ccttgtttgccttgggattggcttt

SEQ ID NO: 603602 - DNA, 25 bp, Mus musculus
ccttgtttggatctgttgctgatga

SEQ ID NO: 603603 - DNA, 25 bp, Mus musculus
ccttgtttggatgtgttgctgatga

SEQ ID NO: 603604 - DNA, 25 bp, Mus musculus
ccttgtttgtaaatccttagacgct

SEQ ID NO: 603605 - DNA, 25 bp, Mus musculus
ccttgtttgtaattccttagacgct

SEQ ID NO: 603606 - DNA, 25 bp, Mus musculus
ccttgttttcagatagaagctttgc

SEQ ID NO: 603607 - DNA, 25 bp, Mus musculus
ccttgttttcagttagaagctttgc

SEQ ID NO: 603608 - DNA, 25 bp, Mus musculus
ccttgttttctgacagtgagtagac

SEQ ID NO: 603609 - DNA, 25 bp, Mus musculus
ccttgttttctgtcagtgagtagac

SEQ ID NO: 603610 - DNA, 25 bp, Mus musculus
ccttgttttggcacagcctgcaact

SEQ ID NO: 603611 - DNA, 25 bp, Mus musculus
ccttgttttggctcagcctgcaact

SEQ ID NO: 603612 - DNA, 25 bp, Mus musculus
cctttaaaacacacgggccatctca

SEQ ID NO: 603613 - DNA, 25 bp, Mus musculus
cctttaaaacactcgggccatctca

SEQ ID NO: 603614 - DNA, 25 bp, Mus musculus
cctttaaagaggctgcaatcatcta

SEQ ID NO: 603615 - DNA, 25 bp, Mus musculus
cctttaaagagggtgcaatcatcta

SEQ ID NO: 603616 - DNA, 25 bp, Mus musculus
cctttaaaggtgaagtggtggatgc

SEQ ID NO: 603617 - DNA, 25 bp, Mus musculus
cctttaaaggtgtagtggtggatgc

SEQ ID NO: 603618 - DNA, 25 bp, Mus musculus
cctttaacttccatgggctgctggc

SEQ ID NO: 603619 - DNA, 25 bp, Mus musculus
cctttaacttccttgggctgctggc

SEQ ID NO: 603620 - DNA, 25 bp, Mus musculus
cctttaatgagtactccaagtttga

SEQ ID NO: 603621 - DNA, 25 bp, Mus musculus
cctttaatgagttctccaagtttga

SEQ ID NO: 603622 - DNA, 25 bp, Mus musculus
cctttaattagtacatttatccaga

SEQ ID NO: 603623 - DNA, 25 bp, Mus musculus
cctttaattagttcatttatccaga

SEQ ID NO: 603624 - DNA, 25 bp, Mus musculus
cctttacaccagctgtgacaacaga

SEQ ID NO: 603625 - DNA, 25 bp, Mus musculus
cctttacaccaggtgtgacaacaga

SEQ ID NO: 603626 - DNA, 25 bp, Mus musculus
cctttaccacgtaactggatggacg

SEQ ID NO: 603627 - DNA, 25 bp, Mus musculus
cctttaccacgttactggatggacg

SEQ ID NO: 603628 - DNA, 25 bp, Mus musculus
cctttacccagtctgcaagccttaa

SEQ ID NO: 603629 - DNA, 25 bp, Mus musculus
cctttacccagtgtgcaagccttaa

SEQ ID NO: 603630 - DNA, 25 bp, Mus musculus
cctttacgaagaatagtggcctctg

SEQ ID NO: 603631 - DNA, 25 bp, Mus musculus
cctttacgaagattagtggcctctg

SEQ ID NO: 603632 - DNA, 25 bp, Mus musculus
cctttactgctgctctttgggttgc

SEQ ID NO: 603633 - DNA, 25 bp, Mus musculus
cctttactgctggtctttgggttgc

SEQ ID NO: 603634 - DNA, 25 bp, Mus musculus
cctttactgtgcaagtttgcggatg

SEQ ID NO: 603635 - DNA, 25 bp, Mus musculus
cctttactgtgctagtttgcggatg

SEQ ID NO: 603636 - DNA, 25 bp, Mus musculus
cctttactgtttagccatctcccat

SEQ ID NO: 603637 - DNA, 25 bp, Mus musculus
cctttactgttttgccatctcccat

SEQ ID NO: 603638 - DNA, 25 bp, Mus musculus
cctttagaacagaggtgcctagtgt

SEQ ID NO: 603639 - DNA, 25 bp, Mus musculus
cctttagaacagtggtgcctagtgt

SEQ ID NO: 603640 - DNA, 25 bp, Mus musculus
cctttagacgcgcacggcatccgaa

SEQ ID NO: 603641 - DNA, 25 bp, Mus musculus
cctttagacgcggacggcatccgaa

SEQ ID NO: 603642 - DNA, 25 bp, Mus musculus
cctttagagaagcagaaatgcgcag

SEQ ID NO: 603643 - DNA, 25 bp, Mus musculus
cctttagagaaggagaaatgcgcag

SEQ ID NO: 603644 - DNA, 25 bp, Mus musculus
cctttagaggaactgatagtgggca

SEQ ID NO: 603645 - DNA, 25 bp, Mus musculus
cctttagaggaagtgatagtgggca

SEQ ID NO: 603646 - DNA, 25 bp, Mus musculus
cctttagcagcaagtggcattttgt

SEQ ID NO: 603647 - DNA, 25 bp, Mus musculus
cctttagcagcatgtggcattttgt

SEQ ID NO: 603648 - DNA, 25 bp, Mus musculus
cctttagcccagaggagatgaaaca

SEQ ID NO: 603649 - DNA, 25 bp, Mus musculus
cctttagcccagtggagatgaaaca

SEQ ID NO: 603650 - DNA, 25 bp, Mus musculus
cctttagccctcagcggaagctgca

SEQ ID NO: 603651 - DNA, 25 bp, Mus musculus
cctttagccctctgcggaagctgca

SEQ ID NO: 603652 - DNA, 25 bp, Mus musculus
cctttagcgcttcatccttggttaa

SEQ ID NO: 603653 - DNA, 25 bp, Mus musculus
cctttagcgcttgatccttggttaa

SEQ ID NO: 603654 - DNA, 25 bp, Mus musculus
cctttagctgggaaaacagtagtca

SEQ ID NO: 603655 - DNA, 25 bp, Mus musculus
cctttagctgggtaaacagtagtca

SEQ ID NO: 603656 - DNA, 25 bp, Mus musculus
cctttaggagctccgatccgggagc

SEQ ID NO: 603657 - DNA, 25 bp, Mus musculus
cctttaggagctgcgatccgggagc

SEQ ID NO: 603658 - DNA, 25 bp, Mus musculus
cctttagtgcagagtggcaccagtg

SEQ ID NO: 603659 - DNA, 25 bp, Mus musculus
cctttagtgcagtgtggcaccagtg

SEQ ID NO: 603660 - DNA, 25 bp, Mus musculus
cctttagttagccatacaatgggtc

SEQ ID NO: 603661 - DNA, 25 bp, Mus musculus
cctttagttagcgatacaatgggtc

SEQ ID NO: 603662 - DNA, 25 bp, Mus musculus
cctttatccaggcacaaacctgaca

SEQ ID NO: 603663 - DNA, 25 bp, Mus musculus
cctttatccagggacaaacctgaca

SEQ ID NO: 603664 - DNA, 25 bp, Mus musculus
cctttatgaacactcagcgggcagc

SEQ ID NO: 603665 - DNA, 25 bp, Mus musculus
cctttatgaacagtcagcgggcagc

SEQ ID NO: 603666 - DNA, 25 bp, Mus musculus
cctttatgactcatactccaccaag

SEQ ID NO: 603667 - DNA, 25 bp, Mus musculus
cctttatgactcttactccaccaag

SEQ ID NO: 603668 - DNA, 25 bp, Mus musculus
cctttatggaagatcagtaccacac

SEQ ID NO: 603669 - DNA, 25 bp, Mus musculus
cctttatggaagttcagtaccacac

SEQ ID NO: 603670 - DNA, 25 bp, Mus musculus
cctttatggagcagccgctgggtga

SEQ ID NO: 603671 - DNA, 25 bp, Mus musculus
cctttatggagctgccgctgggtga

SEQ ID NO: 603672 - DNA, 25 bp, Mus musculus
cctttatgtggacaagattgatgtg

SEQ ID NO: 603673 - DNA, 25 bp, Mus musculus
cctttatgtggagaagattgatgtg

SEQ ID NO: 603674 - DNA, 25 bp, Mus musculus
cctttattctgtccatgcactgagc

SEQ ID NO: 603675 - DNA, 25 bp, Mus musculus
cctttattctgtgcatgcactgagc

SEQ ID NO: 603676 - DNA, 25 bp, Mus musculus
cctttattgcaacggaaatccttag

SEQ ID NO: 603677 - DNA, 25 bp, Mus musculus
cctttattgcaagggaaatccttag

SEQ ID NO: 603678 - DNA, 25 bp, Mus musculus
cctttcaactcaagaggccagggag

SEQ ID NO: 603679 - DNA, 25 bp, Mus musculus
cctttcaactcatgaggccagggag

SEQ ID NO: 603680 - DNA, 25 bp, Mus musculus
cctttcaagagacgctttttattct

SEQ ID NO: 603681 - DNA, 25 bp, Mus musculus
cctttcaagagaggctttttattct

SEQ ID NO: 603682 - DNA, 25 bp, Mus musculus
cctttcaagtacctaagtcctggca

SEQ ID NO: 603683 - DNA, 25 bp, Mus musculus
cctttcaagtacgtaagtcctggca

SEQ ID NO: 603684 - DNA, 25 bp, Mus musculus
cctttcaagtgcaacaagtgtggcc

SEQ ID NO: 603685 - DNA, 25 bp, Mus musculus
cctttcaagtgctacaagtgtggcc

SEQ ID NO: 603686 - DNA, 25 bp, Mus musculus
cctttcaattttcgtagcgcgcaca

SEQ ID NO: 603687 - DNA, 25 bp, Mus musculus
cctttcaattttggtagcgcgcaca

SEQ ID NO: 603688 - DNA, 25 bp, Mus musculus
cctttcacccggaaatgattgtgga

SEQ ID NO: 603689 - DNA, 25 bp, Mus musculus
cctttcacccggtaatgattgtgga

SEQ ID NO: 603690 - DNA, 25 bp, Mus musculus
cctttcaccgttacactgtgcgggc

SEQ ID NO: 603691 - DNA, 25 bp, Mus musculus
cctttcaccgtttcactgtgcgggc

SEQ ID NO: 603692 - DNA, 25 bp, Mus musculus
cctttcactatgctggccgtgaaga

SEQ ID NO: 603693 - DNA, 25 bp, Mus musculus
cctttcactatggtggccgtgaaga

SEQ ID NO: 603694 - DNA, 25 bp, Mus musculus
cctttcactggtctggcaatgagca

SEQ ID NO: 603695 - DNA, 25 bp, Mus musculus
cctttcactggtgtggcaatgagca

SEQ ID NO: 603696 - DNA, 25 bp, Mus musculus
cctttcagacatctgtgtagtttgc

SEQ ID NO: 603697 - DNA, 25 bp, Mus musculus
cctttcagacatgtgtgtagtttgc

SEQ ID NO: 603698 - DNA, 25 bp, Mus musculus
cctttcagatgcagcgactaagcag

SEQ ID NO: 603699 - DNA, 25 bp, Mus musculus
cctttcagatgctgcgactaagcag

SEQ ID NO: 603700 - DNA, 25 bp, Mus musculus
cctttcagctagagttgtgccttta

SEQ ID NO: 603701 - DNA, 25 bp, Mus musculus
cctttcagctagtgttgtgccttta

SEQ ID NO: 603702 - DNA, 25 bp, Mus musculus
cctttcagtgagactaccattacga

SEQ ID NO: 603703 - DNA, 25 bp, Mus musculus
cctttcagtgagtctaccattacga

SEQ ID NO: 603704 - DNA, 25 bp, Mus musculus
cctttcagtgctacggagcccaagg

SEQ ID NO: 603705 - DNA, 25 bp, Mus musculus
cctttcagtgcttcggagcccaagg

SEQ ID NO: 603706 - DNA, 25 bp, Mus musculus
cctttcagttgcatgaagattatcc

SEQ ID NO: 603707 - DNA, 25 bp, Mus musculus
cctttcagttgcttgaagattatcc

SEQ ID NO: 603708 - DNA, 25 bp, Mus musculus
cctttcataaggcatcagcccaatg

SEQ ID NO: 603709 - DNA, 25 bp, Mus musculus
cctttcataagggatcagcccaatg

SEQ ID NO: 603710 - DNA, 25 bp, Mus musculus
cctttcatcctgcttggagtctttg

SEQ ID NO: 603711 - DNA, 25 bp, Mus musculus
cctttcatcctggttggagtctttg

SEQ ID NO: 603712 - DNA, 25 bp, Mus musculus
cctttcatcttgaggcaactgagaa

SEQ ID NO: 603713 - DNA, 25 bp, Mus musculus
cctttcatcttgtggcaactgagaa

SEQ ID NO: 603714 - DNA, 25 bp, Mus musculus
cctttcatgtctctgcacagggcca

SEQ ID NO: 603715 - DNA, 25 bp, Mus musculus
cctttcatgtctgtgcacagggcca

SEQ ID NO: 603716 - DNA, 25 bp, Mus musculus
cctttccaacatcggtgttcaggtt

SEQ ID NO: 603717 - DNA, 25 bp, Mus musculus
cctttccaacatgggtgttcaggtt

SEQ ID NO: 603718 - DNA, 25 bp, Mus musculus
cctttccaaggaacagatgataaac

SEQ ID NO: 603719 - DNA, 25 bp, Mus musculus
cctttccaaggatcagatgataaac

SEQ ID NO: 603720 - DNA, 25 bp, Mus musculus
cctttccacccaataagtaactgtg

SEQ ID NO: 603721 - DNA, 25 bp, Mus musculus
cctttccacccattaagtaactgtg

SEQ ID NO: 603722 - DNA, 25 bp, Mus musculus
cctttccacgtgaggatcaggatgt

SEQ ID NO: 603723 - DNA, 25 bp, Mus musculus
cctttccacgtgtggatcaggatgt

SEQ ID NO: 603724 - DNA, 25 bp, Mus musculus
cctttccagcaaccagtggtcgtat

SEQ ID NO: 603725 - DNA, 25 bp, Mus musculus
cctttccagcaagcagtggtcgtat

SEQ ID NO: 603726 - DNA, 25 bp, Mus musculus
cctttccaggaaccacataattgaa

SEQ ID NO: 603727 - DNA, 25 bp, Mus musculus
cctttccaggaagcacataattgaa

SEQ ID NO: 603728 - DNA, 25 bp, Mus musculus
cctttccatctcagaggctcagcag

SEQ ID NO: 603729 - DNA, 25 bp, Mus musculus
cctttccatctctgaggctcagcag

SEQ ID NO: 603730 - DNA, 25 bp, Mus musculus
cctttcccaaggaatgagaatgagc

SEQ ID NO: 603731 - DNA, 25 bp, Mus musculus
cctttcccaaggtatgagaatgagc

SEQ ID NO: 603732 - DNA, 25 bp, Mus musculus
cctttcccatagatgagaagccaca

SEQ ID NO: 603733 - DNA, 25 bp, Mus musculus
cctttcccatagttgagaagccaca

SEQ ID NO: 603734 - DNA, 25 bp, Mus musculus
cctttccgatccagtactccaggga

SEQ ID NO: 603735 - DNA, 25 bp, Mus musculus
cctttccgatcctgtactccaggga

SEQ ID NO: 603736 - DNA, 25 bp, Mus musculus
cctttcctcagcaaaggagagactg

SEQ ID NO: 603737 - DNA, 25 bp, Mus musculus
cctttcctcagctaaggagagactg

SEQ ID NO: 603738 - DNA, 25 bp, Mus musculus
cctttcctcctcaagagaagagctg

SEQ ID NO: 603739 - DNA, 25 bp, Mus musculus
cctttcctcctctagagaagagctg

SEQ ID NO: 603740 - DNA, 25 bp, Mus musculus
cctttcctggaacttggtgcctgag

SEQ ID NO: 603741 - DNA, 25 bp, Mus musculus
cctttcctggaagttggtgcctgag

SEQ ID NO: 603742 - DNA, 25 bp, Mus musculus
cctttcctgtgaatggaggctccaa

SEQ ID NO: 603743 - DNA, 25 bp, Mus musculus
cctttcctgtgattggaggctccaa

SEQ ID NO: 603744 - DNA, 25 bp, Mus musculus
cctttccttaggagggccaggctga

SEQ ID NO: 603745 - DNA, 25 bp, Mus musculus
cctttccttaggtgggccaggctga

SEQ ID NO: 603746 - DNA, 25 bp, Mus musculus
cctttccttcgacgttgaagctagc

SEQ ID NO: 603747 - DNA, 25 bp, Mus musculus
cctttccttcgaggttgaagctagc

SEQ ID NO: 603748 - DNA, 25 bp, Mus musculus
cctttccttttgcatccctgttcag

SEQ ID NO: 603749 - DNA, 25 bp, Mus musculus
cctttccttttggatccctgttcag

SEQ ID NO: 603750 - DNA, 25 bp, Mus musculus
cctttcgcaagtcggctaggatccg

SEQ ID NO: 603751 - DNA, 25 bp, Mus musculus
cctttcgcaagtgggctaggatccg

SEQ ID NO: 603752 - DNA, 25 bp, Mus musculus
cctttcgcaggtcgcgtcacgggtc

SEQ ID NO: 603753 - DNA, 25 bp, Mus musculus
cctttcgcaggtggcgtcacgggtc

SEQ ID NO: 603754 - DNA, 25 bp, Mus musculus
cctttcgccagacacgagggcaaaa

SEQ ID NO: 603755 - DNA, 25 bp, Mus musculus
cctttcgccagagacgagggcaaaa

SEQ ID NO: 603756 - DNA, 25 bp, Mus musculus
cctttcgctgatccaagagcctagt

SEQ ID NO: 603757 - DNA, 25 bp, Mus musculus
cctttcgctgatgcaagagcctagt

SEQ ID NO: 603758 - DNA, 25 bp, Mus musculus
cctttcggtcttcctcagattggag

SEQ ID NO: 603759 - DNA, 25 bp, Mus musculus
cctttcggtcttgctcagattggag

SEQ ID NO: 603760 - DNA, 25 bp, Mus musculus
cctttctacggcatcttgggagccc

SEQ ID NO: 603761 - DNA, 25 bp, Mus musculus
cctttctacggcttcttgggagccc

SEQ ID NO: 603762 - DNA, 25 bp, Mus musculus
cctttctcccacatgatccatgaag

SEQ ID NO: 603763 - DNA, 25 bp, Mus musculus
cctttctcccacttgatccatgaag

SEQ ID NO: 603764 - DNA, 25 bp, Mus musculus
cctttctctaatagtctccgtgttc

SEQ ID NO: 603765 - DNA, 25 bp, Mus musculus
cctttctctaattgtctccgtgttc

SEQ ID NO: 603766 - DNA, 25 bp, Mus musculus
cctttctcttagctggcatgctgtg

SEQ ID NO: 603767 - DNA, 25 bp, Mus musculus
cctttctcttaggtggcatgctgtg

SEQ ID NO: 603768 - DNA, 25 bp, Mus musculus
cctttctgaactacacgaggaccct

SEQ ID NO: 603769 - DNA, 25 bp, Mus musculus
cctttctgaacttcacgaggaccct

SEQ ID NO: 603770 - DNA, 25 bp, Mus musculus
cctttctgcaggaacatgatgatga

SEQ ID NO: 603771 - DNA, 25 bp, Mus musculus
cctttctgcaggtacatgatgatga

SEQ ID NO: 603772 - DNA, 25 bp, Mus musculus
cctttctggaggagacacttcttca

SEQ ID NO: 603773 - DNA, 25 bp, Mus musculus
cctttctggaggtgacacttcttca

SEQ ID NO: 603774 - DNA, 25 bp, Mus musculus
cctttctgtatgctagagaaataga

SEQ ID NO: 603775 - DNA, 25 bp, Mus musculus
cctttctgtatggtagagaaataga

SEQ ID NO: 603776 - DNA, 25 bp, Mus musculus
cctttcttaggtcacttcatgggca

SEQ ID NO: 603777 - DNA, 25 bp, Mus musculus
cctttcttaggtgacttcatgggca

SEQ ID NO: 603778 - DNA, 25 bp, Mus musculus
cctttcttatttccccttcgatgac

SEQ ID NO: 603779 - DNA, 25 bp, Mus musculus
cctttcttatttgcccttcgatgac

SEQ ID NO: 603780 - DNA, 25 bp, Mus musculus
cctttcttcagaacagcgttttcca

SEQ ID NO: 603781 - DNA, 25 bp, Mus musculus
cctttcttcagatcagcgttttcca

SEQ ID NO: 603782 - DNA, 25 bp, Mus musculus
cctttcttgaagaggagcgcataca

SEQ ID NO: 603783 - DNA, 25 bp, Mus musculus
cctttcttgaagtggagcgcataca

SEQ ID NO: 603784 - DNA, 25 bp, Mus musculus
cctttcttgaggaggtctggaagtg

SEQ ID NO: 603785 - DNA, 25 bp, Mus musculus
cctttcttgaggtggtctggaagtg

SEQ ID NO: 603786 - DNA, 25 bp, Mus musculus
cctttcttggaaataggaggcagac

SEQ ID NO: 603787 - DNA, 25 bp, Mus musculus
cctttcttggaattaggaggcagac

SEQ ID NO: 603788 - DNA, 25 bp, Mus musculus
cctttgaaagtaaggcatctgaaga

SEQ ID NO: 603789 - DNA, 25 bp, Mus musculus
cctttgaaagtatggcatctgaaga

SEQ ID NO: 603790 - DNA, 25 bp, Mus musculus
cctttgaagaatataagaatgaacg

SEQ ID NO: 603791 - DNA, 25 bp, Mus musculus
cctttgaagaatttaagaatgaacg

SEQ ID NO: 603792 - DNA, 25 bp, Mus musculus
cctttgaagacaatcagttctgtta

SEQ ID NO: 603793 - DNA, 25 bp, Mus musculus
cctttgaagacattcagttctgtta

SEQ ID NO: 603794 - DNA, 25 bp, Mus musculus
cctttgaagaggctcgaagaagaac

SEQ ID NO: 603795 - DNA, 25 bp, Mus musculus
cctttgaagagggtcgaagaagaac

SEQ ID NO: 603796 - DNA, 25 bp, Mus musculus
cctttgaaggaaatggagcagttta

SEQ ID NO: 603797 - DNA, 25 bp, Mus musculus
cctttgaaggaattggagcagttta

SEQ ID NO: 603798 - DNA, 25 bp, Mus musculus
cctttgaatccacaagtcacgatga

SEQ ID NO: 603799 - DNA, 25 bp, Mus musculus
cctttgaatccagaagtcacgatga

SEQ ID NO: 603800 - DNA, 25 bp, Mus musculus
cctttgacaaacacggagagcacct

SEQ ID NO: 603801 - DNA, 25 bp, Mus musculus
cctttgacaaactcggagagcacct

SEQ ID NO: 603802 - DNA, 25 bp, Mus musculus
cctttgacaaggaccactttcttca

SEQ ID NO: 603803 - DNA, 25 bp, Mus musculus
cctttgacaaggtccactttcttca

SEQ ID NO: 603804 - DNA, 25 bp, Mus musculus
cctttgacagcaacaatgtgacaga

SEQ ID NO: 603805 - DNA, 25 bp, Mus musculus
cctttgacagcatcaatgtgacaga

SEQ ID NO: 603806 - DNA, 25 bp, Mus musculus
cctttgacagctagcagccatcagt

SEQ ID NO: 603807 - DNA, 25 bp, Mus musculus
cctttgacagcttgcagccatcagt

SEQ ID NO: 603808 - DNA, 25 bp, Mus musculus
cctttgaccagacaacagggcataa

SEQ ID NO: 603809 - DNA, 25 bp, Mus musculus
cctttgaccagagaacagggcataa

SEQ ID NO: 603810 - DNA, 25 bp, Mus musculus
cctttgacctggaggaccggagtct

SEQ ID NO: 603811 - DNA, 25 bp, Mus musculus
cctttgacctggtggaccggagtct

SEQ ID NO: 603812 - DNA, 25 bp, Mus musculus
cctttgacctgtaccgtatcctctg

SEQ ID NO: 603813 - DNA, 25 bp, Mus musculus
cctttgacctgttccgtatcctctg

SEQ ID NO: 603814 - DNA, 25 bp, Mus musculus
cctttgacgatgagaccctgaggct

SEQ ID NO: 603815 - DNA, 25 bp, Mus musculus
cctttgacgatgtgaccctgaggct

SEQ ID NO: 603816 - DNA, 25 bp, Mus musculus
cctttgactggaagagggtatccag

SEQ ID NO: 603817 - DNA, 25 bp, Mus musculus
cctttgactggatgagggtatccag

SEQ ID NO: 603818 - DNA, 25 bp, Mus musculus
cctttgactgtcaggagtgggccga

SEQ ID NO: 603819 - DNA, 25 bp, Mus musculus
cctttgactgtctggagtgggccga

SEQ ID NO: 603820 - DNA, 25 bp, Mus musculus
cctttgactttgagattggcgtggt

SEQ ID NO: 603821 - DNA, 25 bp, Mus musculus
cctttgactttgtgattggcgtggt

SEQ ID NO: 603822 - DNA, 25 bp, Mus musculus
cctttgagacttcgcgcaactgggc

SEQ ID NO: 603823 - DNA, 25 bp, Mus musculus
cctttgagacttggcgcaactgggc

SEQ ID NO: 603824 - DNA, 25 bp, Mus musculus
cctttgagagcacgagcacatttcc

SEQ ID NO: 603825 - DNA, 25 bp, Mus musculus
cctttgagagcaggagcacatttcc

SEQ ID NO: 603826 - DNA, 25 bp, Mus musculus
cctttgagagcgacccgggagcctg

SEQ ID NO: 603827 - DNA, 25 bp, Mus musculus
cctttgagagcgtcccgggagcctg

SEQ ID NO: 603828 - DNA, 25 bp, Mus musculus
cctttgagattgctgcgtggactga

SEQ ID NO: 603829 - DNA, 25 bp, Mus musculus
cctttgagattggtgcgtggactga

SEQ ID NO: 603830 - DNA, 25 bp, Mus musculus
cctttgagccgacagcgatcgagct

SEQ ID NO: 603831 - DNA, 25 bp, Mus musculus
cctttgagccgagagcgatcgagct

SEQ ID NO: 603832 - DNA, 25 bp, Mus musculus
cctttgagctgacggcctccggtgg

SEQ ID NO: 603833 - DNA, 25 bp, Mus musculus
cctttgagctgagggcctccggtgg

SEQ ID NO: 603834 - DNA, 25 bp, Mus musculus
cctttgagcttcagggccttagcac

SEQ ID NO: 603835 - DNA, 25 bp, Mus musculus
cctttgagcttctgggccttagcac

SEQ ID NO: 603836 - DNA, 25 bp, Mus musculus
cctttgaggagaatcagttcttcaa

SEQ ID NO: 603837 - DNA, 25 bp, Mus musculus
cctttgaggagattcagttcttcaa

SEQ ID NO: 603838 - DNA, 25 bp, Mus musculus
cctttgaggatgaatgtgggactta

SEQ ID NO: 603839 - DNA, 25 bp, Mus musculus
cctttgaggatgtatgtgggactta

SEQ ID NO: 603840 - DNA, 25 bp, Mus musculus
cctttgaggcagatgagccggacag

SEQ ID NO: 603841 - DNA, 25 bp, Mus musculus
cctttgaggcagttgagccggacag

SEQ ID NO: 603842 - DNA, 25 bp, Mus musculus
cctttgaggcttcctcgcatggctg

SEQ ID NO: 603843 - DNA, 25 bp, Mus musculus
cctttgaggcttgctcgcatggctg

SEQ ID NO: 603844 - DNA, 25 bp, Mus musculus
cctttgagtaatcgacaaatgggcc

SEQ ID NO: 603845 - DNA, 25 bp, Mus musculus
cctttgagtaatggacaaatgggcc

SEQ ID NO: 603846 - DNA, 25 bp, Mus musculus
cctttgagtccaatgagtgttccac

SEQ ID NO: 603847 - DNA, 25 bp, Mus musculus
cctttgagtccattgagtgttccac

SEQ ID NO: 603848 - DNA, 25 bp, Mus musculus
cctttgagtgcaatggcaacgtgaa

SEQ ID NO: 603849 - DNA, 25 bp, Mus musculus
cctttgagtgcattggcaacgtgaa

SEQ ID NO: 603850 - DNA, 25 bp, Mus musculus
cctttgatgtcccaatgcctccttt

SEQ ID NO: 603851 - DNA, 25 bp, Mus musculus
cctttgatgtccgaatgcctccttt

SEQ ID NO: 603852 - DNA, 25 bp, Mus musculus
cctttgatttcgctccctctggaga

SEQ ID NO: 603853 - DNA, 25 bp, Mus musculus
cctttgatttcggtccctctggaga

SEQ ID NO: 603854 - DNA, 25 bp, Mus musculus
cctttgcaattcagtgtagtagaat

SEQ ID NO: 603855 - DNA, 25 bp, Mus musculus
cctttgcaattctgtgtagtagaat

SEQ ID NO: 603856 - DNA, 25 bp, Mus musculus
cctttgcacagtatatcactacgat

SEQ ID NO: 603857 - DNA, 25 bp, Mus musculus
cctttgcacagtttatcactacgat

SEQ ID NO: 603858 - DNA, 25 bp, Mus musculus
cctttgcacatcaattggatgaata

SEQ ID NO: 603859 - DNA, 25 bp, Mus musculus
cctttgcacatctattggatgaata

SEQ ID NO: 603860 - DNA, 25 bp, Mus musculus
cctttgcagactcagttcaaggaga

SEQ ID NO: 603861 - DNA, 25 bp, Mus musculus
cctttgcagactgagttcaaggaga

SEQ ID NO: 603862 - DNA, 25 bp, Mus musculus
cctttgcattgcaccagaggatccc

SEQ ID NO: 603863 - DNA, 25 bp, Mus musculus
cctttgcattgctccagaggatccc

SEQ ID NO: 603864 - DNA, 25 bp, Mus musculus
cctttgccagtaaggccagcagaga

SEQ ID NO: 603865 - DNA, 25 bp, Mus musculus
cctttgccagtatggccagcagaga

SEQ ID NO: 603866 - DNA, 25 bp, Mus musculus
cctttgccagtgagaaggcatttgg

SEQ ID NO: 603867 - DNA, 25 bp, Mus musculus
cctttgccagtgtgaaggcatttgg

SEQ ID NO: 603868 - DNA, 25 bp, Mus musculus
cctttgcccaccatatagtgctgag

SEQ ID NO: 603869 - DNA, 25 bp, Mus musculus
cctttgcccaccttatagtgctgag

SEQ ID NO: 603870 - DNA, 25 bp, Mus musculus
cctttgcctagtccagggagccatc

SEQ ID NO: 603871 - DNA, 25 bp, Mus musculus
cctttgcctagtgcagggagccatc

SEQ ID NO: 603872 - DNA, 25 bp, Mus musculus
cctttgcctgtacccctggagagag

SEQ ID NO: 603873 - DNA, 25 bp, Mus musculus
cctttgcctgtagccctggagagag

SEQ ID NO: 603874 - DNA, 25 bp, Mus musculus
cctttgcctgttcgtcaatggtgac

SEQ ID NO: 603875 - DNA, 25 bp, Mus musculus
cctttgcctgttggtcaatggtgac

SEQ ID NO: 603876 - DNA, 25 bp, Mus musculus
cctttgcgagggactctggagtcac

SEQ ID NO: 603877 - DNA, 25 bp, Mus musculus
cctttgcgagggtctctggagtcac

SEQ ID NO: 603878 - DNA, 25 bp, Mus musculus
cctttgcgggaacagggtgctattc

SEQ ID NO: 603879 - DNA, 25 bp, Mus musculus
cctttgcgggaagagggtgctattc

SEQ ID NO: 603880 - DNA, 25 bp, Mus musculus
cctttgcgtcacattaagcgtcctg

SEQ ID NO: 603881 - DNA, 25 bp, Mus musculus
cctttgcgtcactttaagcgtcctg

SEQ ID NO: 603882 - DNA, 25 bp, Mus musculus
cctttgctaagactgctgccatgct

SEQ ID NO: 603883 - DNA, 25 bp, Mus musculus
cctttgctaagagtgctgccatgct

SEQ ID NO: 603884 - DNA, 25 bp, Mus musculus
cctttgctaatgcaatatttggctg

SEQ ID NO: 603885 - DNA, 25 bp, Mus musculus
cctttgctaatggaatatttggctg

SEQ ID NO: 603886 - DNA, 25 bp, Mus musculus
cctttgctcttgactgcagagacat

SEQ ID NO: 603887 - DNA, 25 bp, Mus musculus
cctttgctcttgtctgcagagacat

SEQ ID NO: 603888 - DNA, 25 bp, Mus musculus
cctttgctgcagcaggctacatgcc

SEQ ID NO: 603889 - DNA, 25 bp, Mus musculus
cctttgctgcaggaggctacatgcc

SEQ ID NO: 603890 - DNA, 25 bp, Mus musculus
cctttgctgtaaacaatgtcaagaa

SEQ ID NO: 603891 - DNA, 25 bp, Mus musculus
cctttgctgtaatcaatgtcaagaa

SEQ ID NO: 603892 - DNA, 25 bp, Mus musculus
cctttgctgtgtcggcagtactctg

SEQ ID NO: 603893 - DNA, 25 bp, Mus musculus
cctttgctgtgtgggcagtactctg

SEQ ID NO: 603894 - DNA, 25 bp, Mus musculus
cctttggaaataactcatgtccttt

SEQ ID NO: 603895 - DNA, 25 bp, Mus musculus
cctttggaaatacccgcctggttct

SEQ ID NO: 603896 - DNA, 25 bp, Mus musculus
cctttggaaatagccgcctggttct

SEQ ID NO: 603897 - DNA, 25 bp, Mus musculus
cctttggaaatatctcatgtccttt

SEQ ID NO: 603898 - DNA, 25 bp, Mus musculus
cctttggaacttaggcgagacagaa

SEQ ID NO: 603899 - DNA, 25 bp, Mus musculus
cctttggaactttggcgagacagaa

SEQ ID NO: 603900 - DNA, 25 bp, Mus musculus
cctttggactttcatgttagttcac

SEQ ID NO: 603901 - DNA, 25 bp, Mus musculus
cctttggactttgatgttagttcac

SEQ ID NO: 603902 - DNA, 25 bp, Mus musculus
cctttggagcaacttagggcacaag

SEQ ID NO: 603903 - DNA, 25 bp, Mus musculus
cctttggagcaagttagggcacaag

SEQ ID NO: 603904 - DNA, 25 bp, Mus musculus
cctttggagggcagtcgcttccact

SEQ ID NO: 603905 - DNA, 25 bp, Mus musculus
cctttggagggcatattgcttttgc

SEQ ID NO: 603906 - DNA, 25 bp, Mus musculus
cctttggagggctgtcgcttccact

SEQ ID NO: 603907 - DNA, 25 bp, Mus musculus
cctttggagggcttattgcttttgc

SEQ ID NO: 603908 - DNA, 25 bp, Mus musculus
cctttggagtacaatctgatcccct

SEQ ID NO: 603909 - DNA, 25 bp, Mus musculus
cctttggagtactatctgatcccct

SEQ ID NO: 603910 - DNA, 25 bp, Mus musculus
cctttggatttcaggtgtggagata

SEQ ID NO: 603911 - DNA, 25 bp, Mus musculus
cctttggatttctggtgtggagata

SEQ ID NO: 603912 - DNA, 25 bp, Mus musculus
cctttggcaaagcagacagcggcct

SEQ ID NO: 603913 - DNA, 25 bp, Mus musculus
cctttggcaaaggagacagcggcct

SEQ ID NO: 603914 - DNA, 25 bp, Mus musculus
cctttggcaaatacctgggctacct

SEQ ID NO: 603915 - DNA, 25 bp, Mus musculus
cctttggcaaattcctgggctacct

SEQ ID NO: 603916 - DNA, 25 bp, Mus musculus
cctttggcactgagtacaagggcaa

SEQ ID NO: 603917 - DNA, 25 bp, Mus musculus
cctttggcactgtgtacaagggcaa

SEQ ID NO: 603918 - DNA, 25 bp, Mus musculus
cctttggcatgtctgaccgggacca

SEQ ID NO: 603919 - DNA, 25 bp, Mus musculus
cctttggcatgtgtgaccgggacca

SEQ ID NO: 603920 - DNA, 25 bp, Mus musculus
cctttggccccaacaagagcattga

SEQ ID NO: 603921 - DNA, 25 bp, Mus musculus
cctttggccccatcaagagcattga

SEQ ID NO: 603922 - DNA, 25 bp, Mus musculus
cctttggccgggacatctctacttg

SEQ ID NO: 603923 - DNA, 25 bp, Mus musculus
cctttggccgggtcatctctacttg

SEQ ID NO: 603924 - DNA, 25 bp, Mus musculus
cctttggcctcgctgtgctaggcac

SEQ ID NO: 603925 - DNA, 25 bp, Mus musculus
cctttggcctcggtgtgctaggcac

SEQ ID NO: 603926 - DNA, 25 bp, Mus musculus
cctttggctccccaggagagtttga

SEQ ID NO: 603927 - DNA, 25 bp, Mus musculus
cctttggctcccgaggagagtttga

SEQ ID NO: 603928 - DNA, 25 bp, Mus musculus
cctttggctgcacccagctagaagc

SEQ ID NO: 603929 - DNA, 25 bp, Mus musculus
cctttggctgcagccagctagaagc

SEQ ID NO: 603930 - DNA, 25 bp, Mus musculus
cctttgggaacaagctggatacttt

SEQ ID NO: 603931 - DNA, 25 bp, Mus musculus
cctttgggaacatgctggatacttt

SEQ ID NO: 603932 - DNA, 25 bp, Mus musculus
cctttgggacagatacgagaagagg

SEQ ID NO: 603933 - DNA, 25 bp, Mus musculus
cctttgggacagttacgagaagagg

SEQ ID NO: 603934 - DNA, 25 bp, Mus musculus
cctttgggcgtcacatggtggaaaa

SEQ ID NO: 603935 - DNA, 25 bp, Mus musculus
cctttgggcgtctcatggtggaaaa

SEQ ID NO: 603936 - DNA, 25 bp, Mus musculus
cctttgggcttactttccacaggat

SEQ ID NO: 603937 - DNA, 25 bp, Mus musculus
cctttgggcttagtttccacaggat

SEQ ID NO: 603938 - DNA, 25 bp, Mus musculus
cctttgggggcactaacattgagcc

SEQ ID NO: 603939 - DNA, 25 bp, Mus musculus
cctttgggggcagtaacattgagcc

SEQ ID NO: 603940 - DNA, 25 bp, Mus musculus
cctttggtatcactcaatcaggaaa

SEQ ID NO: 603941 - DNA, 25 bp, Mus musculus
cctttggtatcagtcaatcaggaaa

SEQ ID NO: 603942 - DNA, 25 bp, Mus musculus
cctttggtcaacaactgggcctgca

SEQ ID NO: 603943 - DNA, 25 bp, Mus musculus
cctttggtcaactactgggcctgca

SEQ ID NO: 603944 - DNA, 25 bp, Mus musculus
cctttggtcatccagatgtctgacg

SEQ ID NO: 603945 - DNA, 25 bp, Mus musculus
cctttggtcatcgagatgtctgacg

SEQ ID NO: 603946 - DNA, 25 bp, Mus musculus
cctttggtcttgactagattgcaga

SEQ ID NO: 603947 - DNA, 25 bp, Mus musculus
cctttggtcttgtctagattgcaga

SEQ ID NO: 603948 - DNA, 25 bp, Mus musculus
cctttggtgccaatgagctggtcca

SEQ ID NO: 603949 - DNA, 25 bp, Mus musculus
cctttggtgccattgagctggtcca

SEQ ID NO: 603950 - DNA, 25 bp, Mus musculus
cctttggtggaacaaacatatgact

SEQ ID NO: 603951 - DNA, 25 bp, Mus musculus
cctttggtggaagaaacatatgact

SEQ ID NO: 603952 - DNA, 25 bp, Mus musculus
cctttggtggctctaaagttcctga

SEQ ID NO: 603953 - DNA, 25 bp, Mus musculus
cctttggtggctgtaaagttcctga

SEQ ID NO: 603954 - DNA, 25 bp, Mus musculus
cctttgtaagatctagaggacacat

SEQ ID NO: 603955 - DNA, 25 bp, Mus musculus
cctttgtaagatgtagaggacacat

SEQ ID NO: 603956 - DNA, 25 bp, Mus musculus
cctttgtacacaaggagcgggcaga

SEQ ID NO: 603957 - DNA, 25 bp, Mus musculus
cctttgtacacacgcagcgttttga

SEQ ID NO: 603958 - DNA, 25 bp, Mus musculus
cctttgtacacaggcagcgttttga

SEQ ID NO: 603959 - DNA, 25 bp, Mus musculus
cctttgtacacatggagcgggcaga

SEQ ID NO: 603960 - DNA, 25 bp, Mus musculus
cctttgtacatgcaacaacttggag

SEQ ID NO: 603961 - DNA, 25 bp, Mus musculus
cctttgtacatggaacaacttggag

SEQ ID NO: 603962 - DNA, 25 bp, Mus musculus
cctttgtagtggctgtcaagcagga

SEQ ID NO: 603963 - DNA, 25 bp, Mus musculus
cctttgtagtgggtgtcaagcagga

SEQ ID NO: 603964 - DNA, 25 bp, Mus musculus
cctttgtatcagaggtgcaagccaa

SEQ ID NO: 603965 - DNA, 25 bp, Mus musculus
cctttgtatcagtggtgcaagccaa

SEQ ID NO: 603966 - DNA, 25 bp, Mus musculus
cctttgtcacgtcgcacaggtacca

SEQ ID NO: 603967 - DNA, 25 bp, Mus musculus
cctttgtcacgtggcacaggtacca

SEQ ID NO: 603968 - DNA, 25 bp, Mus musculus
cctttgtcagcaaaggcaggagtcc

SEQ ID NO: 603969 - DNA, 25 bp, Mus musculus
cctttgtcagcataggcaggagtcc

SEQ ID NO: 603970 - DNA, 25 bp, Mus musculus
cctttgtcccgacctgtgggatgcg

SEQ ID NO: 603971 - DNA, 25 bp, Mus musculus
cctttgtcccgagctgtgggatgcg

SEQ ID NO: 603972 - DNA, 25 bp, Mus musculus
cctttgtcctggagtgtcctttttg

SEQ ID NO: 603973 - DNA, 25 bp, Mus musculus
cctttgtcctggtgtgtcctttttg

SEQ ID NO: 603974 - DNA, 25 bp, Mus musculus
cctttgtctcccactcagattggta

SEQ ID NO: 603975 - DNA, 25 bp, Mus musculus
cctttgtctccctctcagattggta

SEQ ID NO: 603976 - DNA, 25 bp, Mus musculus
cctttgtgaacaagcatggtggcca

SEQ ID NO: 603977 - DNA, 25 bp, Mus musculus
cctttgtgaacatgcatggtggcca

SEQ ID NO: 603978 - DNA, 25 bp, Mus musculus
cctttgtgagaaccctgatgaggag

SEQ ID NO: 603979 - DNA, 25 bp, Mus musculus
cctttgtgagaagcctgatgaggag

SEQ ID NO: 603980 - DNA, 25 bp, Mus musculus
cctttgtgagatctggttttactga

SEQ ID NO: 603981 - DNA, 25 bp, Mus musculus
cctttgtgagatgtggttttactga

SEQ ID NO: 603982 - DNA, 25 bp, Mus musculus
cctttgtgcaaaataagttcgacga

SEQ ID NO: 603983 - DNA, 25 bp, Mus musculus
cctttgtgcaaattaagttcgacga

SEQ ID NO: 603984 - DNA, 25 bp, Mus musculus
cctttgtgcatgagctgggagacct

SEQ ID NO: 603985 - DNA, 25 bp, Mus musculus
cctttgtgcatgtgctgggagacct

SEQ ID NO: 603986 - DNA, 25 bp, Mus musculus
cctttgtgcccacctgggatttgtc

SEQ ID NO: 603987 - DNA, 25 bp, Mus musculus
cctttgtgcccagctgggatttgtc

SEQ ID NO: 603988 - DNA, 25 bp, Mus musculus
cctttgtgctgcaccagactggagc

SEQ ID NO: 603989 - DNA, 25 bp, Mus musculus
cctttgtgctgctccagactggagc

SEQ ID NO: 603990 - DNA, 25 bp, Mus musculus
cctttgtggaaaagatggagtgact

SEQ ID NO: 603991 - DNA, 25 bp, Mus musculus
cctttgtggaaatgatggagtgact

SEQ ID NO: 603992 - DNA, 25 bp, Mus musculus
cctttgtggaagaaacctagtgctg

SEQ ID NO: 603993 - DNA, 25 bp, Mus musculus
cctttgtggaagtaacctagtgctg

SEQ ID NO: 603994 - DNA, 25 bp, Mus musculus
cctttgtggcatcgttggctatcag

SEQ ID NO: 603995 - DNA, 25 bp, Mus musculus
cctttgtggcatggttggctatcag

SEQ ID NO: 603996 - DNA, 25 bp, Mus musculus
cctttgtgggtgctctgggttttct

SEQ ID NO: 603997 - DNA, 25 bp, Mus musculus
cctttgtgggtggtctgggttttct

SEQ ID NO: 603998 - DNA, 25 bp, Mus musculus
cctttgtgttggaaaatgtgagcgt

SEQ ID NO: 603999 - DNA, 25 bp, Mus musculus
cctttgtgttggtaaatgtgagcgt

SEQ ID NO: 604000 - DNA, 25 bp, Mus musculus
cctttgtgttgtctgagcaaccagc

SEQ ID NO: 604001 - DNA, 25 bp, Mus musculus
cctttgtgttgtgtgagcaaccagc

SEQ ID NO: 604002 - DNA, 25 bp, Mus musculus
cctttgttcactccggcctggtggg

SEQ ID NO: 604003 - DNA, 25 bp, Mus musculus
cctttgttcactgcggcctggtggg

SEQ ID NO: 604004 - DNA, 25 bp, Mus musculus
cctttgttcaggaagaggccccaga

SEQ ID NO: 604005 - DNA, 25 bp, Mus musculus
cctttgttcaggtagaggccccaga

SEQ ID NO: 604006 - DNA, 25 bp, Mus musculus
cctttgttgtccagagcagctccgt

SEQ ID NO: 604007 - DNA, 25 bp, Mus musculus
cctttgttgtcctgagcagctccgt

SEQ ID NO: 604008 - DNA, 25 bp, Mus musculus
ccttttaaagagactggcccacaga

SEQ ID NO: 604009 - DNA, 25 bp, Mus musculus
ccttttaaagagtctggcccacaga

SEQ ID NO: 604010 - DNA, 25 bp, Mus musculus
ccttttaatgcgatgaagacaaaga

SEQ ID NO: 604011 - DNA, 25 bp, Mus musculus
ccttttaatgcgttgaagacaaaga

SEQ ID NO: 604012 - DNA, 25 bp, Mus musculus
ccttttaggtctattgctcatagca

SEQ ID NO: 604013 - DNA, 25 bp, Mus musculus
ccttttaggtcttttgctcatagca

SEQ ID NO: 604014 - DNA, 25 bp, Mus musculus
ccttttattcatctgggaaatcaag

SEQ ID NO: 604015 - DNA, 25 bp, Mus musculus
ccttttattcatgtgggaaatcaag

SEQ ID NO: 604016 - DNA, 25 bp, Mus musculus
ccttttcaagcaagtggcaagttca

SEQ ID NO: 604017 - DNA, 25 bp, Mus musculus
ccttttcaagcatgtggcaagttca

SEQ ID NO: 604018 - DNA, 25 bp, Mus musculus
ccttttcagaagctcatatttaagg

SEQ ID NO: 604019 - DNA, 25 bp, Mus musculus
ccttttcagaaggtcatatttaagg

SEQ ID NO: 604020 - DNA, 25 bp, Mus musculus
ccttttccggaaccagtggtgaggc

SEQ ID NO: 604021 - DNA, 25 bp, Mus musculus
ccttttccggaagcagtggtgaggc

SEQ ID NO: 604022 - DNA, 25 bp, Mus musculus
ccttttcggaggagctactggtgtg

SEQ ID NO: 604023 - DNA, 25 bp, Mus musculus
ccttttcggaggtgctactggtgtg

SEQ ID NO: 604024 - DNA, 25 bp, Mus musculus
ccttttcggtgtattgcatctgaaa

SEQ ID NO: 604025 - DNA, 25 bp, Mus musculus
ccttttcggtgttttgcatctgaaa

SEQ ID NO: 604026 - DNA, 25 bp, Mus musculus
ccttttcttgggagactgtcagtcc

SEQ ID NO: 604027 - DNA, 25 bp, Mus musculus
ccttttcttgggtgactgtcagtcc

SEQ ID NO: 604028 - DNA, 25 bp, Mus musculus
ccttttgatgttcgctcgatgctga

SEQ ID NO: 604029 - DNA, 25 bp, Mus musculus
ccttttgatgttggctcgatgctga

SEQ ID NO: 604030 - DNA, 25 bp, Mus musculus
ccttttgcaggtccagagatcggcc

SEQ ID NO: 604031 - DNA, 25 bp, Mus musculus
ccttttgcaggtgcagagatcggcc

SEQ ID NO: 604032 - DNA, 25 bp, Mus musculus
ccttttgcatctagtttcccgggat

SEQ ID NO: 604033 - DNA, 25 bp, Mus musculus
ccttttgcatcttgtttcccgggat

SEQ ID NO: 604034 - DNA, 25 bp, Mus musculus
ccttttgctacacgcacttttcctt

SEQ ID NO: 604035 - DNA, 25 bp, Mus musculus
ccttttgctacaggcacttttcctt

SEQ ID NO: 604036 - DNA, 25 bp, Mus musculus
ccttttgctgtaagtagattgggca

SEQ ID NO: 604037 - DNA, 25 bp, Mus musculus
ccttttgctgtatgtagattgggca

SEQ ID NO: 604038 - DNA, 25 bp, Mus musculus
ccttttgcttccagcacttttgcaa

SEQ ID NO: 604039 - DNA, 25 bp, Mus musculus
ccttttgcttcctgcacttttgcaa

SEQ ID NO: 604040 - DNA, 25 bp, Mus musculus
ccttttgggccaatctgggaccagt

SEQ ID NO: 604041 - DNA, 25 bp, Mus musculus
ccttttgggccattctgggaccagt

SEQ ID NO: 604042 - DNA, 25 bp, Mus musculus
ccttttgggctcaatgtttcctatg

SEQ ID NO: 604043 - DNA, 25 bp, Mus musculus
ccttttgggctctatgtttcctatg

SEQ ID NO: 604044 - DNA, 25 bp, Mus musculus
ccttttgggcttctggtgagcactg

SEQ ID NO: 604045 - DNA, 25 bp, Mus musculus
ccttttgggcttgtggtgagcactg

SEQ ID NO: 604046 - DNA, 25 bp, Mus musculus
ccttttggtaacagtactgacgtga

SEQ ID NO: 604047 - DNA, 25 bp, Mus musculus
ccttttggtaactgtactgacgtga

SEQ ID NO: 604048 - DNA, 25 bp, Mus musculus
ccttttgtgaaaataggaattccag

SEQ ID NO: 604049 - DNA, 25 bp, Mus musculus
ccttttgtgaaattaggaattccag

SEQ ID NO: 604050 - DNA, 25 bp, Mus musculus
ccttttgtggaacaagtaataagtg

SEQ ID NO: 604051 - DNA, 25 bp, Mus musculus
ccttttgtggaagaagtaataagtg

SEQ ID NO: 604052 - DNA, 25 bp, Mus musculus
ccttttgtggcccttactatgcacg

SEQ ID NO: 604053 - DNA, 25 bp, Mus musculus
ccttttgtggccgttactatgcacg

SEQ ID NO: 604054 - DNA, 25 bp, Mus musculus
ccttttgtgggtagcattctttgaa

SEQ ID NO: 604055 - DNA, 25 bp, Mus musculus
ccttttgtgggttgcattctttgaa

SEQ ID NO: 604056 - DNA, 25 bp, Mus musculus
ccttttgtgtgtagactgagcccag

SEQ ID NO: 604057 - DNA, 25 bp, Mus musculus
ccttttgtgtgttgactgagcccag

SEQ ID NO: 604058 - DNA, 25 bp, Mus musculus
cctttttatactcaaggagattctc

SEQ ID NO: 604059 - DNA, 25 bp, Mus musculus
cctttttatactgaaggagattctc

SEQ ID NO: 604060 - DNA, 25 bp, Mus musculus
cctttttatctcatggatggaggag

SEQ ID NO: 604061 - DNA, 25 bp, Mus musculus
cctttttatctcttggatggaggag

SEQ ID NO: 604062 - DNA, 25 bp, Mus musculus
cctttttccggcacatcaattggga

SEQ ID NO: 604063 - DNA, 25 bp, Mus musculus
cctttttccggctcatcaattggga

SEQ ID NO: 604064 - DNA, 25 bp, Mus musculus
cctttttctgcgctacggagtggag

SEQ ID NO: 604065 - DNA, 25 bp, Mus musculus
cctttttctgcggtacggagtggag

SEQ ID NO: 604066 - DNA, 25 bp, Mus musculus
cctttttggatgaggatcgtctgga

SEQ ID NO: 604067 - DNA, 25 bp, Mus musculus
cctttttggatgtggatcgtctgga

SEQ ID NO: 604068 - DNA, 25 bp, Mus musculus
cctttttggtatatggtcacatagt

SEQ ID NO: 604069 - DNA, 25 bp, Mus musculus
cctttttggtatttggtcacatagt

SEQ ID NO: 604070 - DNA, 25 bp, Mus musculus
cctttttggtgcatgtattgaagga

SEQ ID NO: 604071 - DNA, 25 bp, Mus musculus
cctttttggtgcttgtattgaagga

SEQ ID NO: 604072 - DNA, 25 bp, Mus musculus
cctttttgtaggagtgttggtgatt

SEQ ID NO: 604073 - DNA, 25 bp, Mus musculus
cctttttgtaggtgtgttggtgatt

SEQ ID NO: 604074 - DNA, 25 bp, Mus musculus
cctttttgtggcctcagaatttgga

SEQ ID NO: 604075 - DNA, 25 bp, Mus musculus
cctttttgtggcgtcagaatttgga

SEQ ID NO: 604076 - DNA, 25 bp, Mus musculus
cgaaaaaagggcctcagtatccatg

SEQ ID NO: 604077 - DNA, 25 bp, Mus musculus
cgaaaaaagggcgtcagtatccatg

SEQ ID NO: 604078 - DNA, 25 bp, Mus musculus
cgaaaaacactacccaaggcgcctg

SEQ ID NO: 604079 - DNA, 25 bp, Mus musculus
cgaaaaacactagccaaggcgcctg

SEQ ID NO: 604080 - DNA, 25 bp, Mus musculus
cgaaaaacagtgaccggacaccact

SEQ ID NO: 604081 - DNA, 25 bp, Mus musculus
cgaaaaacagtgtccggacaccact

SEQ ID NO: 604082 - DNA, 25 bp, Mus musculus
cgaaaacccaggcttcgagaccact

SEQ ID NO: 604083 - DNA, 25 bp, Mus musculus
cgaaaacccagggttcgagaccact

SEQ ID NO: 604084 - DNA, 25 bp, Mus musculus
cgaaaacgtattccagagagggaac

SEQ ID NO: 604085 - DNA, 25 bp, Mus musculus
cgaaaacgtattgcagagagggaac

SEQ ID NO: 604086 - DNA, 25 bp, Mus musculus
cgaaaacgtgcccaatgaaaagagt

SEQ ID NO: 604087 - DNA, 25 bp, Mus musculus
cgaaaacgtgccgaatgaaaagagt

SEQ ID NO: 604088 - DNA, 25 bp, Mus musculus
cgaaaagaaggcaacatctcagact

SEQ ID NO: 604089 - DNA, 25 bp, Mus musculus
cgaaaagaaggctacatctcagact

SEQ ID NO: 604090 - DNA, 25 bp, Mus musculus
cgaaaagatgacaaaagtccgcggt

SEQ ID NO: 604091 - DNA, 25 bp, Mus musculus
cgaaaagatgactaaagtccgcggt

SEQ ID NO: 604092 - DNA, 25 bp, Mus musculus
cgaaaagcccacctgctttgcacgg

SEQ ID NO: 604093 - DNA, 25 bp, Mus musculus
cgaaaagcccacgtgctttgcacgg

SEQ ID NO: 604094 - DNA, 25 bp, Mus musculus
cgaaaagcgaatcatcattactggg

SEQ ID NO: 604095 - DNA, 25 bp, Mus musculus
cgaaaagcgaatgatcattactggg

SEQ ID NO: 604096 - DNA, 25 bp, Mus musculus
cgaaaatcaagaaggtgtcatgcac

SEQ ID NO: 604097 - DNA, 25 bp, Mus musculus
cgaaaatcaagatggtgtcatgcac

SEQ ID NO: 604098 - DNA, 25 bp, Mus musculus
cgaaaatgggctcgactttctattg

SEQ ID NO: 604099 - DNA, 25 bp, Mus musculus
cgaaaatgggctggactttctattg

SEQ ID NO: 604100 - DNA, 25 bp, Mus musculus
cgaaaatttgacaggcaaggacggg

SEQ ID NO: 604101 - DNA, 25 bp, Mus musculus
cgaaaatttgactggcaaggacggg

SEQ ID NO: 604102 - DNA, 25 bp, Mus musculus
cgaaacaagctgacgagtttgtcca

SEQ ID NO: 604103 - DNA, 25 bp, Mus musculus
cgaaacaagctgtcgagtttgtcca

SEQ ID NO: 604104 - DNA, 25 bp, Mus musculus
cgaaacaatgaaacagaaaagccca

SEQ ID NO: 604105 - DNA, 25 bp, Mus musculus
cgaaacaatgaatcagaaaagccca

SEQ ID NO: 604106 - DNA, 25 bp, Mus musculus
cgaaacatctcccaaggcttcagtg

SEQ ID NO: 604107 - DNA, 25 bp, Mus musculus
cgaaacatctccgaaggcttcagtg

SEQ ID NO: 604108 - DNA, 25 bp, Mus musculus
cgaaaccacgtgaataggatgtgtc

SEQ ID NO: 604109 - DNA, 25 bp, Mus musculus
cgaaaccacgtgtataggatgtgtc

SEQ ID NO: 604110 - DNA, 25 bp, Mus musculus
cgaaaccaggagagacccaggagga

SEQ ID NO: 604111 - DNA, 25 bp, Mus musculus
cgaaaccaggagtgacccaggagga

SEQ ID NO: 604112 - DNA, 25 bp, Mus musculus
cgaaaccgggcaactgggggcctct

SEQ ID NO: 604113 - DNA, 25 bp, Mus musculus
cgaaaccgggcatctgggggcctct

SEQ ID NO: 604114 - DNA, 25 bp, Mus musculus
cgaaacctgtctcggaatgccagga

SEQ ID NO: 604115 - DNA, 25 bp, Mus musculus
cgaaacctgtctgggaatgccagga

SEQ ID NO: 604116 - DNA, 25 bp, Mus musculus
cgaaactgtgagagactgttcccca

SEQ ID NO: 604117 - DNA, 25 bp, Mus musculus
cgaaactgtgagtgactgttcccca

SEQ ID NO: 604118 - DNA, 25 bp, Mus musculus
cgaaactgtgctcaacttggcttat

SEQ ID NO: 604119 - DNA, 25 bp, Mus musculus
cgaaactgtgctgaacttggcttat

SEQ ID NO: 604120 - DNA, 25 bp, Mus musculus
cgaaagaaagctctaggcatgaact

SEQ ID NO: 604121 - DNA, 25 bp, Mus musculus
cgaaagaaagctgtaggcatgaact

SEQ ID NO: 604122 - DNA, 25 bp, Mus musculus
cgaaagagaccgcatataccaggat

SEQ ID NO: 604123 - DNA, 25 bp, Mus musculus
cgaaagagaccggatataccaggat

SEQ ID NO: 604124 - DNA, 25 bp, Mus musculus
cgaaagagacttagattctgtgtac

SEQ ID NO: 604125 - DNA, 25 bp, Mus musculus
cgaaagagactttgattctgtgtac

SEQ ID NO: 604126 - DNA, 25 bp, Mus musculus
cgaaagaggtaacgtctcctctgct

SEQ ID NO: 604127 - DNA, 25 bp, Mus musculus
cgaaagaggtaaggtctcctctgct

SEQ ID NO: 604128 - DNA, 25 bp, Mus musculus
cgaaagagtcatcaaacttttggca

SEQ ID NO: 604129 - DNA, 25 bp, Mus musculus
cgaaagagtcatgaaacttttggca

SEQ ID NO: 604130 - DNA, 25 bp, Mus musculus
cgaaagcaaccgaggagcctcgtaa

SEQ ID NO: 604131 - DNA, 25 bp, Mus musculus
cgaaagcaaccgtggagcctcgtaa

SEQ ID NO: 604132 - DNA, 25 bp, Mus musculus
cgaaagcacagcctcacgatgagaa

SEQ ID NO: 604133 - DNA, 25 bp, Mus musculus
cgaaagcacagcgtcacgatgagaa

SEQ ID NO: 604134 - DNA, 25 bp, Mus musculus
cgaaagcactgacttcccagggagt

SEQ ID NO: 604135 - DNA, 25 bp, Mus musculus
cgaaagcactgagttcccagggagt

SEQ ID NO: 604136 - DNA, 25 bp, Mus musculus
cgaaagccaggcagatctgaatgac

SEQ ID NO: 604137 - DNA, 25 bp, Mus musculus
cgaaagccaggctgatctgaatgac

SEQ ID NO: 604138 - DNA, 25 bp, Mus musculus
cgaaagcggcgcatacgtactcaat

SEQ ID NO: 604139 - DNA, 25 bp, Mus musculus
cgaaagcggcgcttacgtactcaat

SEQ ID NO: 604140 - DNA, 25 bp, Mus musculus
cgaaagctccggcagaccggccaga

SEQ ID NO: 604141 - DNA, 25 bp, Mus musculus
cgaaagctccgggagaccggccaga

SEQ ID NO: 604142 - DNA, 25 bp, Mus musculus
cgaaagctcttgaaagtatgcggag

SEQ ID NO: 604143 - DNA, 25 bp, Mus musculus
cgaaagctcttgtaagtatgcggag

SEQ ID NO: 604144 - DNA, 25 bp, Mus musculus
cgaaagctgcagagtaaattatacc

SEQ ID NO: 604145 - DNA, 25 bp, Mus musculus
cgaaagctgcagtgtaaattatacc

SEQ ID NO: 604146 - DNA, 25 bp, Mus musculus
cgaaaggctcatcccaagcataaag

SEQ ID NO: 604147 - DNA, 25 bp, Mus musculus
cgaaaggctcatgccaagcataaag

SEQ ID NO: 604148 - DNA, 25 bp, Mus musculus
cgaaagggtgatccgttctgaagat

SEQ ID NO: 604149 - DNA, 25 bp, Mus musculus
cgaaagggtgatgcgttctgaagat

SEQ ID NO: 604150 - DNA, 25 bp, Mus musculus
cgaaagtacaacaaggagagagaga

SEQ ID NO: 604151 - DNA, 25 bp, Mus musculus
cgaaagtacaactaggagagagaga

SEQ ID NO: 604152 - DNA, 25 bp, Mus musculus
cgaaagtgagggacgcacgctgtct

SEQ ID NO: 604153 - DNA, 25 bp, Mus musculus
cgaaagtgagggtcgcacgctgtct

SEQ ID NO: 604154 - DNA, 25 bp, Mus musculus
cgaaagtgtgagagcaagaaacccc

SEQ ID NO: 604155 - DNA, 25 bp, Mus musculus
cgaaagtgtgagtgcaagaaacccc

SEQ ID NO: 604156 - DNA, 25 bp, Mus musculus
cgaaatatgcagaacgcagaaataa

SEQ ID NO: 604157 - DNA, 25 bp, Mus musculus
cgaaatatgcagtacgcagaaataa

SEQ ID NO: 604158 - DNA, 25 bp, Mus musculus
cgaaatcacgggagctggagatgca

SEQ ID NO: 604159 - DNA, 25 bp, Mus musculus
cgaaatcacgggtgctggagatgca

SEQ ID NO: 604160 - DNA, 25 bp, Mus musculus
cgaaatcaggagattctttgccaga

SEQ ID NO: 604161 - DNA, 25 bp, Mus musculus
cgaaatcaggagtttctttgccaga

SEQ ID NO: 604162 - DNA, 25 bp, Mus musculus
cgaaatgacctgcagcagcacaacc

SEQ ID NO: 604163 - DNA, 25 bp, Mus musculus
cgaaatgacctggagcagcacaacc

SEQ ID NO: 604164 - DNA, 25 bp, Mus musculus
cgaaatgctgctatctgcacagacc

SEQ ID NO: 604165 - DNA, 25 bp, Mus musculus
cgaaatgctgctttctgcacagacc

SEQ ID NO: 604166 - DNA, 25 bp, Mus musculus
cgaaatggagtcatgcagggcctgt

SEQ ID NO: 604167 - DNA, 25 bp, Mus musculus
cgaaatggagtcttgcagggcctgt

SEQ ID NO: 604168 - DNA, 25 bp, Mus musculus
cgaaatggcaccctcttcatcatgg

SEQ ID NO: 604169 - DNA, 25 bp, Mus musculus
cgaaatggcaccgtcttcatcatgg

SEQ ID NO: 604170 - DNA, 25 bp, Mus musculus
cgaaatggcccaaaccgtcagctct

SEQ ID NO: 604171 - DNA, 25 bp, Mus musculus
cgaaatggcccataccgtcagctct

SEQ ID NO: 604172 - DNA, 25 bp, Mus musculus
cgaaatgggccacactttccaagat

SEQ ID NO: 604173 - DNA, 25 bp, Mus musculus
cgaaatgggccagactttccaagat

SEQ ID NO: 604174 - DNA, 25 bp, Mus musculus
cgaaattaatgcacgcgagtgtgtg

SEQ ID NO: 604175 - DNA, 25 bp, Mus musculus
cgaaattaatgctcgcgagtgtgtg

SEQ ID NO: 604176 - DNA, 25 bp, Mus musculus
cgaaattaccgaccacagtgttgtg

SEQ ID NO: 604177 - DNA, 25 bp, Mus musculus
cgaaattaccgagcacagtgttgtg

SEQ ID NO: 604178 - DNA, 25 bp, Mus musculus
cgaaattaccttcttcagtgtacta

SEQ ID NO: 604179 - DNA, 25 bp, Mus musculus
cgaaattaccttgttcagtgtacta

SEQ ID NO: 604180 - DNA, 25 bp, Mus musculus
cgaaattcctgtccagctgaagaca

SEQ ID NO: 604181 - DNA, 25 bp, Mus musculus
cgaaattcctgtgcagctgaagaca

SEQ ID NO: 604182 - DNA, 25 bp, Mus musculus
cgaaattgctgtcgactggaccagc

SEQ ID NO: 604183 - DNA, 25 bp, Mus musculus
cgaaattgctgtggactggaccagc

SEQ ID NO: 604184 - DNA, 25 bp, Mus musculus
cgaacaacgcttcctcaagattgca

SEQ ID NO: 604185 - DNA, 25 bp, Mus musculus
cgaacaacgcttgctcaagattgca

SEQ ID NO: 604186 - DNA, 25 bp, Mus musculus
cgaacaacttgaagtcactggaggc

SEQ ID NO: 604187 - DNA, 25 bp, Mus musculus
cgaacaacttgatgtcactggaggc

SEQ ID NO: 604188 - DNA, 25 bp, Mus musculus
cgaacaatacagctacgactcgcac

SEQ ID NO: 604189 - DNA, 25 bp, Mus musculus
cgaacaatacaggtacgactcgcac

SEQ ID NO: 604190 - DNA, 25 bp, Mus musculus
cgaacaatttctatgcagcaatctt

SEQ ID NO: 604191 - DNA, 25 bp, Mus musculus
cgaacaatttctttgcagcaatctt

SEQ ID NO: 604192 - DNA, 25 bp, Mus musculus
cgaacacagcggaccgccggagctg

SEQ ID NO: 604193 - DNA, 25 bp, Mus musculus
cgaacacagcggtccgccggagctg

SEQ ID NO: 604194 - DNA, 25 bp, Mus musculus
cgaacacatattcgacctgagcaca

SEQ ID NO: 604195 - DNA, 25 bp, Mus musculus
cgaacacatattggacctgagcaca

SEQ ID NO: 604196 - DNA, 25 bp, Mus musculus
cgaacaccaaacagctgtcatatga

SEQ ID NO: 604197 - DNA, 25 bp, Mus musculus
cgaacaccaaactgctgtcatatga

SEQ ID NO: 604198 - DNA, 25 bp, Mus musculus
cgaacacctgtaagtgggcggcctg

SEQ ID NO: 604199 - DNA, 25 bp, Mus musculus
cgaacacctgtatgtgggcggcctg

SEQ ID NO: 604200 - DNA, 25 bp, Mus musculus
cgaacacggcgtcctctaagagctg

SEQ ID NO: 604201 - DNA, 25 bp, Mus musculus
cgaacacggcgtgctctaagagctg

SEQ ID NO: 604202 - DNA, 25 bp, Mus musculus
cgaacacgtttgaggcagagctaaa

SEQ ID NO: 604203 - DNA, 25 bp, Mus musculus
cgaacacgtttgtggcagagctaaa

SEQ ID NO: 604204 - DNA, 25 bp, Mus musculus
cgaacactatcacagccgaaagcat

SEQ ID NO: 604205 - DNA, 25 bp, Mus musculus
cgaacactatcagagccgaaagcat

SEQ ID NO: 604206 - DNA, 25 bp, Mus musculus
cgaacagattttcatttggatgtga

SEQ ID NO: 604207 - DNA, 25 bp, Mus musculus
cgaacagattttgatttggatgtga

SEQ ID NO: 604208 - DNA, 25 bp, Mus musculus
cgaacagccttgaggagatatatgt

SEQ ID NO: 604209 - DNA, 25 bp, Mus musculus
cgaacagccttgtggagatatatgt

SEQ ID NO: 604210 - DNA, 25 bp, Mus musculus
cgaacaggacaaatatgagatgcac

SEQ ID NO: 604211 - DNA, 25 bp, Mus musculus
cgaacaggacaattatgagatgcac

SEQ ID NO: 604212 - DNA, 25 bp, Mus musculus
cgaacagtctgcatggctaagtggc

SEQ ID NO: 604213 - DNA, 25 bp, Mus musculus
cgaacagtctgcttggctaagtggc

SEQ ID NO: 604214 - DNA, 25 bp, Mus musculus
cgaaccacactgagagtgatgtgcc

SEQ ID NO: 604215 - DNA, 25 bp, Mus musculus
cgaaccacactgtgagtgatgtgcc

SEQ ID NO: 604216 - DNA, 25 bp, Mus musculus
cgaaccaggacactggagtgaccac

SEQ ID NO: 604217 - DNA, 25 bp, Mus musculus
cgaaccaggacagtggagtgaccac

SEQ ID NO: 604218 - DNA, 25 bp, Mus musculus
cgaaccaggaggaccaagccgctgg

SEQ ID NO: 604219 - DNA, 25 bp, Mus musculus
cgaaccaggaggtccaagccgctgg

SEQ ID NO: 604220 - DNA, 25 bp, Mus musculus
cgaaccatctgcacctcaatggaca

SEQ ID NO: 604221 - DNA, 25 bp, Mus musculus
cgaaccatctgctcctcaatggaca

SEQ ID NO: 604222 - DNA, 25 bp, Mus musculus
cgaacccaagtacaaggtggtccag

SEQ ID NO: 604223 - DNA, 25 bp, Mus musculus
cgaacccaagtagaaggtggtccag

SEQ ID NO: 604224 - DNA, 25 bp, Mus musculus
cgaaccccagggaccagaaggacat

SEQ ID NO: 604225 - DNA, 25 bp, Mus musculus
cgaaccccagggtccagaaggacat

SEQ ID NO: 604226 - DNA, 25 bp, Mus musculus
cgaaccggcagtatttcccactgag

SEQ ID NO: 604227 - DNA, 25 bp, Mus musculus
cgaaccggcagtttttcccactgag

SEQ ID NO: 604228 - DNA, 25 bp, Mus musculus
cgaaccttcgttcactatgcccaga

SEQ ID NO: 604229 - DNA, 25 bp, Mus musculus
cgaaccttcgttgactatgcccaga

SEQ ID NO: 604230 - DNA, 25 bp, Mus musculus
cgaacgagccatccgtatggctgac

SEQ ID NO: 604231 - DNA, 25 bp, Mus musculus
cgaacgagccatgcgtatggctgac

SEQ ID NO: 604232 - DNA, 25 bp, Mus musculus
cgaacgctggctcagaccaaagagt

SEQ ID NO: 604233 - DNA, 25 bp, Mus musculus
cgaacgctggctgagaccaaagagt

SEQ ID NO: 604234 - DNA, 25 bp, Mus musculus
cgaacggaccagatgtgaagaccag

SEQ ID NO: 604235 - DNA, 25 bp, Mus musculus
cgaacggaccagttgtgaagaccag

SEQ ID NO: 604236 - DNA, 25 bp, Mus musculus
cgaacgggtcgtacctgctgaggat

SEQ ID NO: 604237 - DNA, 25 bp, Mus musculus
cgaacgggtcgttcctgctgaggat

SEQ ID NO: 604238 - DNA, 25 bp, Mus musculus
cgaacggtgcgaacaagaagctgtc

SEQ ID NO: 604239 - DNA, 25 bp, Mus musculus
cgaacggtgcgatcaagaagctgtc

SEQ ID NO: 604240 - DNA, 25 bp, Mus musculus
cgaactaagaatcgagtcataagag

SEQ ID NO: 604241 - DNA, 25 bp, Mus musculus
cgaactaagaatggagtcataagag

SEQ ID NO: 604242 - DNA, 25 bp, Mus musculus
cgaactagcggccatggcgaaccag

SEQ ID NO: 604243 - DNA, 25 bp, Mus musculus
cgaactagcggcgatggcgaaccag

SEQ ID NO: 604244 - DNA, 25 bp, Mus musculus
cgaactcacctacaacctagagaag

SEQ ID NO: 604245 - DNA, 25 bp, Mus musculus
cgaactcacctagaacctagagaag

SEQ ID NO: 604246 - DNA, 25 bp, Mus musculus
cgaactcctttgatgtgatcagtga

SEQ ID NO: 604247 - DNA, 25 bp, Mus musculus
cgaactcctttgttgtgatcagtga

SEQ ID NO: 604248 - DNA, 25 bp, Mus musculus
cgaactgaaatcctggcgatgcctg

SEQ ID NO: 604249 - DNA, 25 bp, Mus musculus
cgaactgaaatcgtggcgatgcctg

SEQ ID NO: 604250 - DNA, 25 bp, Mus musculus
cgaactgaaggaaatggaacaattt

SEQ ID NO: 604251 - DNA, 25 bp, Mus musculus
cgaactgaaggatatggaacaattt

SEQ ID NO: 604252 - DNA, 25 bp, Mus musculus
cgaactgacactagactgggccggt

SEQ ID NO: 604253 - DNA, 25 bp, Mus musculus
cgaactgacacttgactgggccggt

SEQ ID NO: 604254 - DNA, 25 bp, Mus musculus
cgaactgacccaaggctatgacgac

SEQ ID NO: 604255 - DNA, 25 bp, Mus musculus
cgaactgacccatggctatgacgac

SEQ ID NO: 604256 - DNA, 25 bp, Mus musculus
cgaactgtggaactagagaaggtcc

SEQ ID NO: 604257 - DNA, 25 bp, Mus musculus
cgaactgtggaagtagagaaggtcc

SEQ ID NO: 604258 - DNA, 25 bp, Mus musculus
cgaacttgaagaaacagaggtcaaa

SEQ ID NO: 604259 - DNA, 25 bp, Mus musculus
cgaacttgaagatacagaggtcaaa

SEQ ID NO: 604260 - DNA, 25 bp, Mus musculus
cgaacttggaagagactgtctgatc

SEQ ID NO: 604261 - DNA, 25 bp, Mus musculus
cgaacttggaagtgactgtctgatc

SEQ ID NO: 604262 - DNA, 25 bp, Mus musculus
cgaactttggttattgagatggtaa

SEQ ID NO: 604263 - DNA, 25 bp, Mus musculus
cgaactttggtttttgagatggtaa

SEQ ID NO: 604264 - DNA, 25 bp, Mus musculus
cgaagaaaacgacccagaaacatgc

SEQ ID NO: 604265 - DNA, 25 bp, Mus musculus
cgaagaaaacgagccagaaacatgc

SEQ ID NO: 604266 - DNA, 25 bp, Mus musculus
cgaagaaagacacaggagtattaaa

SEQ ID NO: 604267 - DNA, 25 bp, Mus musculus
cgaagaaagacagaggagtattaaa

SEQ ID NO: 604268 - DNA, 25 bp, Mus musculus
cgaagaacacggagtcgtcggcccg

SEQ ID NO: 604269 - DNA, 25 bp, Mus musculus
cgaagaacacggtgtcgtcggcccg

SEQ ID NO: 604270 - DNA, 25 bp, Mus musculus
cgaagaagaactcgagaatttgagg

SEQ ID NO: 604271 - DNA, 25 bp, Mus musculus
cgaagaagaactggagaatttgagg

SEQ ID NO: 604272 - DNA, 25 bp, Mus musculus
cgaagaagagagagataaactgtgg

SEQ ID NO: 604273 - DNA, 25 bp, Mus musculus
cgaagaagagagtgataaactgtgg

SEQ ID NO: 604274 - DNA, 25 bp, Mus musculus
cgaagaagagatccgcgaggccttc

SEQ ID NO: 604275 - DNA, 25 bp, Mus musculus
cgaagaagagatgcgcgaggccttc

SEQ ID NO: 604276 - DNA, 25 bp, Mus musculus
cgaagaagcaggcatcggagacacc

SEQ ID NO: 604277 - DNA, 25 bp, Mus musculus
cgaagaagcagggatcggagacacc

SEQ ID NO: 604278 - DNA, 25 bp, Mus musculus
cgaagaaggtacattagtgaagaac

SEQ ID NO: 604279 - DNA, 25 bp, Mus musculus
cgaagaaggtactttagtgaagaac

SEQ ID NO: 604280 - DNA, 25 bp, Mus musculus
cgaagaaggtgaaggcgactatctg

SEQ ID NO: 604281 - DNA, 25 bp, Mus musculus
cgaagaaggtgatggcgactatctg

SEQ ID NO: 604282 - DNA, 25 bp, Mus musculus
cgaagaagtcttacaatgatgatgc

SEQ ID NO: 604283 - DNA, 25 bp, Mus musculus
cgaagaagtctttcaatgatgatgc

SEQ ID NO: 604284 - DNA, 25 bp, Mus musculus
cgaagacaatcgagagaaagcagca

SEQ ID NO: 604285 - DNA, 25 bp, Mus musculus
cgaagacaatcgtgagaaagcagca

SEQ ID NO: 604286 - DNA, 25 bp, Mus musculus
cgaagacaatggacagctggatgat

SEQ ID NO: 604287 - DNA, 25 bp, Mus musculus
cgaagacaatggtcagctggatgat

SEQ ID NO: 604288 - DNA, 25 bp, Mus musculus
cgaagacacggcagtatgaacccaa

SEQ ID NO: 604289 - DNA, 25 bp, Mus musculus
cgaagacacggctgtatgaacccaa

SEQ ID NO: 604290 - DNA, 25 bp, Mus musculus
cgaagacatcaaagcagcgtttgca

SEQ ID NO: 604291 - DNA, 25 bp, Mus musculus
cgaagacatcaatgcagcgtttgca

SEQ ID NO: 604292 - DNA, 25 bp, Mus musculus
cgaagacttggaacgaattctgact

SEQ ID NO: 604293 - DNA, 25 bp, Mus musculus
cgaagacttggatcgaattctgact

SEQ ID NO: 604294 - DNA, 25 bp, Mus musculus
cgaagagactcacccggagtctccg

SEQ ID NO: 604295 - DNA, 25 bp, Mus musculus
cgaagagactcagccggagtctccg

SEQ ID NO: 604296 - DNA, 25 bp, Mus musculus
cgaagagcagatcctcattctggaa

SEQ ID NO: 604297 - DNA, 25 bp, Mus musculus
cgaagagcagatgctcattctggaa

SEQ ID NO: 604298 - DNA, 25 bp, Mus musculus
cgaagagcttcgagcagagacggca

SEQ ID NO: 604299 - DNA, 25 bp, Mus musculus
cgaagagcttcgtgcagagacggca

SEQ ID NO: 604300 - DNA, 25 bp, Mus musculus
cgaagagttcatcaggctacatgac

SEQ ID NO: 604301 - DNA, 25 bp, Mus musculus
cgaagagttcatgaggctacatgac

SEQ ID NO: 604302 - DNA, 25 bp, Mus musculus
cgaagagtttatcaagagatacagt

SEQ ID NO: 604303 - DNA, 25 bp, Mus musculus
cgaagagtttatgaagagatacagt

SEQ ID NO: 604304 - DNA, 25 bp, Mus musculus
cgaagatcgaccacctgcaggaaca

SEQ ID NO: 604305 - DNA, 25 bp, Mus musculus
cgaagatcgacctcctgcaggaaca

SEQ ID NO: 604306 - DNA, 25 bp, Mus musculus
cgaagatcttcccagacaggacaga

SEQ ID NO: 604307 - DNA, 25 bp, Mus musculus
cgaagatcttccgagacaggacaga

SEQ ID NO: 604308 - DNA, 25 bp, Mus musculus
cgaagatcttttacagtctgatggg

SEQ ID NO: 604309 - DNA, 25 bp, Mus musculus
cgaagatctttttcagtctgatggg

SEQ ID NO: 604310 - DNA, 25 bp, Mus musculus
cgaagatgatggcaatgacctcaca

SEQ ID NO: 604311 - DNA, 25 bp, Mus musculus
cgaagatgatgggaatgacctcaca

SEQ ID NO: 604312 - DNA, 25 bp, Mus musculus
cgaagatggatcctttattggcgca

SEQ ID NO: 604313 - DNA, 25 bp, Mus musculus
cgaagatggatcgtttattggcgca

SEQ ID NO: 604314 - DNA, 25 bp, Mus musculus
cgaagatggcggctctcaaactcct

SEQ ID NO: 604315 - DNA, 25 bp, Mus musculus
cgaagatggcgggtctcaaactcct

SEQ ID NO: 604316 - DNA, 25 bp, Mus musculus
cgaagcaagataccagatggcactg

SEQ ID NO: 604317 - DNA, 25 bp, Mus musculus
cgaagcaagatagcagatggcactg

SEQ ID NO: 604318 - DNA, 25 bp, Mus musculus
cgaagcaatgcaactgggtcatctc

SEQ ID NO: 604319 - DNA, 25 bp, Mus musculus
cgaagcaatgcatctgggtcatctc

SEQ ID NO: 604320 - DNA, 25 bp, Mus musculus
cgaagcacgctgaaggcacaatgga

SEQ ID NO: 604321 - DNA, 25 bp, Mus musculus
cgaagcacgctgaatgagatctact

SEQ ID NO: 604322 - DNA, 25 bp, Mus musculus
cgaagcacgctgtaggcacaatgga

SEQ ID NO: 604323 - DNA, 25 bp, Mus musculus
cgaagcacgctgtatgagatctact

SEQ ID NO: 604324 - DNA, 25 bp, Mus musculus
cgaagccactggaatcctgaaggaa

SEQ ID NO: 604325 - DNA, 25 bp, Mus musculus
cgaagccactggtatcctgaaggaa

SEQ ID NO: 604326 - DNA, 25 bp, Mus musculus
cgaagcccaagaagccggagcgacg

SEQ ID NO: 604327 - DNA, 25 bp, Mus musculus
cgaagcccaagatgccggagcgacg

SEQ ID NO: 604328 - DNA, 25 bp, Mus musculus
cgaagccgacttctgaaaggagaaa

SEQ ID NO: 604329 - DNA, 25 bp, Mus musculus
cgaagccgacttgtgaaaggagaaa

SEQ ID NO: 604330 - DNA, 25 bp, Mus musculus
cgaagcctgattccgtagagccaca

SEQ ID NO: 604331 - DNA, 25 bp, Mus musculus
cgaagcctgattgcgtagagccaca

SEQ ID NO: 604332 - DNA, 25 bp, Mus musculus
cgaagcctgttccacgctatggata

SEQ ID NO: 604333 - DNA, 25 bp, Mus musculus
cgaagcctgttcgacgctatggata

SEQ ID NO: 604334 - DNA, 25 bp, Mus musculus
cgaagcgaagatcgtggactacagc

SEQ ID NO: 604335 - DNA, 25 bp, Mus musculus
cgaagcgaagatggtggactacagc

SEQ ID NO: 604336 - DNA, 25 bp, Mus musculus
cgaagctctcctacgacccggaaga

SEQ ID NO: 604337 - DNA, 25 bp, Mus musculus
cgaagctctccttcgacccggaaga

SEQ ID NO: 604338 - DNA, 25 bp, Mus musculus
cgaaggaagcatccctgtttgaaca

SEQ ID NO: 604339 - DNA, 25 bp, Mus musculus
cgaaggaagcatgcctgtttgaaca

SEQ ID NO: 604340 - DNA, 25 bp, Mus musculus
cgaaggacagccacactgagcaacc

SEQ ID NO: 604341 - DNA, 25 bp, Mus musculus
cgaaggacagcctcactgagcaacc

SEQ ID NO: 604342 - DNA, 25 bp, Mus musculus
cgaaggacggagagctgcttacatc

SEQ ID NO: 604343 - DNA, 25 bp, Mus musculus
cgaaggacggagtgctgcttacatc

SEQ ID NO: 604344 - DNA, 25 bp, Mus musculus
cgaaggagagaaactgtttgcatgt

SEQ ID NO: 604345 - DNA, 25 bp, Mus musculus
cgaaggagagaatctgtttgcatgt

SEQ ID NO: 604346 - DNA, 25 bp, Mus musculus
cgaaggagagggagacaatgaccaa

SEQ ID NO: 604347 - DNA, 25 bp, Mus musculus
cgaaggagagggtgacaatgaccaa

SEQ ID NO: 604348 - DNA, 25 bp, Mus musculus
cgaaggagttctacacaaagcacaa

SEQ ID NO: 604349 - DNA, 25 bp, Mus musculus
cgaaggagttcttcacaaagcacaa

SEQ ID NO: 604350 - DNA, 25 bp, Mus musculus
cgaaggatccttagagttcatggga

SEQ ID NO: 604351 - DNA, 25 bp, Mus musculus
cgaaggatcctttgagttcatggga

SEQ ID NO: 604352 - DNA, 25 bp, Mus musculus
cgaaggatcgttaactgaatatgag

SEQ ID NO: 604353 - DNA, 25 bp, Mus musculus
cgaaggatcgtttactgaatatgag

SEQ ID NO: 604354 - DNA, 25 bp, Mus musculus
cgaaggcatgggattcaccgagttc

SEQ ID NO: 604355 - DNA, 25 bp, Mus musculus
cgaaggcatgggtttcaccgagttc

SEQ ID NO: 604356 - DNA, 25 bp, Mus musculus
cgaaggcccgtcatgaaggctaatg

SEQ ID NO: 604357 - DNA, 25 bp, Mus musculus
cgaaggcccgtcttgaaggctaatg

SEQ ID NO: 604358 - DNA, 25 bp, Mus musculus
cgaaggcctaaaagtcctggtgaca

SEQ ID NO: 604359 - DNA, 25 bp, Mus musculus
cgaaggcctaaatgtcctggtgaca

SEQ ID NO: 604360 - DNA, 25 bp, Mus musculus
cgaaggctgaatcaactacagatca

SEQ ID NO: 604361 - DNA, 25 bp, Mus musculus
cgaaggctgaatgaactacagatca

SEQ ID NO: 604362 - DNA, 25 bp, Mus musculus
cgaaggctgtcccaggtaggctcct

SEQ ID NO: 604363 - DNA, 25 bp, Mus musculus
cgaaggctgtccgaggtaggctcct

SEQ ID NO: 604364 - DNA, 25 bp, Mus musculus
cgaaggctgtggagaaactggaccc

SEQ ID NO: 604365 - DNA, 25 bp, Mus musculus
cgaaggctgtggtgaaactggaccc

SEQ ID NO: 604366 - DNA, 25 bp, Mus musculus
cgaaggtggacaccttacagtctca

SEQ ID NO: 604367 - DNA, 25 bp, Mus musculus
cgaaggtggacagcttacagtctca

SEQ ID NO: 604368 - DNA, 25 bp, Mus musculus
cgaaggtttcctctggatgctgcca

SEQ ID NO: 604369 - DNA, 25 bp, Mus musculus
cgaaggtttcctgtggatgctgcca

SEQ ID NO: 604370 - DNA, 25 bp, Mus musculus
cgaagtaagcttacacgagtaagaa

SEQ ID NO: 604371 - DNA, 25 bp, Mus musculus
cgaagtaagctttcacgagtaagaa

SEQ ID NO: 604372 - DNA, 25 bp, Mus musculus
cgaagtagcgtcacttcagtgggtg

SEQ ID NO: 604373 - DNA, 25 bp, Mus musculus
cgaagtagcgtctcttcagtgggtg

SEQ ID NO: 604374 - DNA, 25 bp, Mus musculus
cgaagtatccacctggacatctact

SEQ ID NO: 604375 - DNA, 25 bp, Mus musculus
cgaagtatccacgtggacatctact

SEQ ID NO: 604376 - DNA, 25 bp, Mus musculus
cgaagtatgtatcgccggagctccc

SEQ ID NO: 604377 - DNA, 25 bp, Mus musculus
cgaagtatgtatggccggagctccc

SEQ ID NO: 604378 - DNA, 25 bp, Mus musculus
cgaagtcaaagcaggagtcgtgagc

SEQ ID NO: 604379 - DNA, 25 bp, Mus musculus
cgaagtcaaagctggagtcgtgagc

SEQ ID NO: 604380 - DNA, 25 bp, Mus musculus
cgaagtgaataccatgggcttttgc

SEQ ID NO: 604381 - DNA, 25 bp, Mus musculus
cgaagtgaatacgatgggcttttgc

SEQ ID NO: 604382 - DNA, 25 bp, Mus musculus
cgaagtggccaacggcactgaagcc

SEQ ID NO: 604383 - DNA, 25 bp, Mus musculus
cgaagtggccaagggcactgaagcc

SEQ ID NO: 604384 - DNA, 25 bp, Mus musculus
cgaagtgggctacaagtctgagtcc

SEQ ID NO: 604385 - DNA, 25 bp, Mus musculus
cgaagtgggctagaagtctgagtcc

SEQ ID NO: 604386 - DNA, 25 bp, Mus musculus
cgaagtggttacagactgctgtgcc

SEQ ID NO: 604387 - DNA, 25 bp, Mus musculus
cgaagtggttactgactgctgtgcc

SEQ ID NO: 604388 - DNA, 25 bp, Mus musculus
cgaagtgtgaaacgatccggagaca

SEQ ID NO: 604389 - DNA, 25 bp, Mus musculus
cgaagtgtgaaaggatccggagaca

SEQ ID NO: 604390 - DNA, 25 bp, Mus musculus
cgaagtgttggaaacaggccagact

SEQ ID NO: 604391 - DNA, 25 bp, Mus musculus
cgaagtgttggatacaggccagact

SEQ ID NO: 604392 - DNA, 25 bp, Mus musculus
cgaagttctggaagggaagacaccg

SEQ ID NO: 604393 - DNA, 25 bp, Mus musculus
cgaagttctggatgggaagacaccg

SEQ ID NO: 604394 - DNA, 25 bp, Mus musculus
cgaagttgatgcatatgtccagaaa

SEQ ID NO: 604395 - DNA, 25 bp, Mus musculus
cgaagttgatgcttatgtccagaaa

SEQ ID NO: 604396 - DNA, 25 bp, Mus musculus
cgaagttttctaaaatgcccatctg

SEQ ID NO: 604397 - DNA, 25 bp, Mus musculus
cgaagttttctataatgcccatctg

SEQ ID NO: 604398 - DNA, 25 bp, Mus musculus
cgaataactgagactggtgtgggct

SEQ ID NO: 604399 - DNA, 25 bp, Mus musculus
cgaataactgagtctggtgtgggct

SEQ ID NO: 604400 - DNA, 25 bp, Mus musculus
cgaataattactcggaggtgattta

SEQ ID NO: 604401 - DNA, 25 bp, Mus musculus
cgaataattactgggaggtgattta

SEQ ID NO: 604402 - DNA, 25 bp, Mus musculus
cgaatacggttcacctgggtcctag

SEQ ID NO: 604403 - DNA, 25 bp, Mus musculus
cgaatacggttctcctgggtcctag

SEQ ID NO: 604404 - DNA, 25 bp, Mus musculus
cgaatacttggaccggactccttgc

SEQ ID NO: 604405 - DNA, 25 bp, Mus musculus
cgaatacttggagcggactccttgc

SEQ ID NO: 604406 - DNA, 25 bp, Mus musculus
cgaatagagcgacccactggccaaa

SEQ ID NO: 604407 - DNA, 25 bp, Mus musculus
cgaatagagcgagccactggccaaa

SEQ ID NO: 604408 - DNA, 25 bp, Mus musculus
cgaatagccgagcacccacgcagag

SEQ ID NO: 604409 - DNA, 25 bp, Mus musculus
cgaatagccgaggacccacgcagag

SEQ ID NO: 604410 - DNA, 25 bp, Mus musculus
cgaatcaaccagacataccagcagc

SEQ ID NO: 604411 - DNA, 25 bp, Mus musculus
cgaatcaaccagtcataccagcagc

SEQ ID NO: 604412 - DNA, 25 bp, Mus musculus
cgaatcaatggacgattggtttatg

SEQ ID NO: 604413 - DNA, 25 bp, Mus musculus
cgaatcaatggaggattggtttatg

SEQ ID NO: 604414 - DNA, 25 bp, Mus musculus
cgaatcagttggattcagggttggt

SEQ ID NO: 604415 - DNA, 25 bp, Mus musculus
cgaatcagttggtttcagggttggt

SEQ ID NO: 604416 - DNA, 25 bp, Mus musculus
cgaatcatggctaatcggaagccct

SEQ ID NO: 604417 - DNA, 25 bp, Mus musculus
cgaatcatggcttatcggaagccct

SEQ ID NO: 604418 - DNA, 25 bp, Mus musculus
cgaatccaaagtcggcatgttcaat

SEQ ID NO: 604419 - DNA, 25 bp, Mus musculus
cgaatccaaagtgggcatgttcaat

SEQ ID NO: 604420 - DNA, 25 bp, Mus musculus
cgaatccagtgtcagatccagggcc

SEQ ID NO: 604421 - DNA, 25 bp, Mus musculus
cgaatccagtgtgagatccagggcc

SEQ ID NO: 604422 - DNA, 25 bp, Mus musculus
cgaatcccagccaaaccaggaaaat

SEQ ID NO: 604423 - DNA, 25 bp, Mus musculus
cgaatcccagcctaaccaggaaaat

SEQ ID NO: 604424 - DNA, 25 bp, Mus musculus
cgaatccctaaaacacatgtgcttg

SEQ ID NO: 604425 - DNA, 25 bp, Mus musculus
cgaatccctaaatcacatgtgcttg

SEQ ID NO: 604426 - DNA, 25 bp, Mus musculus
cgaatccctgcactgaaagagaaga

SEQ ID NO: 604427 - DNA, 25 bp, Mus musculus
cgaatccctgcagtgaaagagaaga

SEQ ID NO: 604428 - DNA, 25 bp, Mus musculus
cgaatcctaaccactccatggtctg

SEQ ID NO: 604429 - DNA, 25 bp, Mus musculus
cgaatcctaacctctccatggtctg

SEQ ID NO: 604430 - DNA, 25 bp, Mus musculus
cgaatcctcttacagccttggacat

SEQ ID NO: 604431 - DNA, 25 bp, Mus musculus
cgaatcctcttagagccttggacat

SEQ ID NO: 604432 - DNA, 25 bp, Mus musculus
cgaatcgtggcactcatcggcgctg

SEQ ID NO: 604433 - DNA, 25 bp, Mus musculus
cgaatcgtggcagtcatcggcgctg

SEQ ID NO: 604434 - DNA, 25 bp, Mus musculus
cgaatctcagggagaagatgaactc

SEQ ID NO: 604435 - DNA, 25 bp, Mus musculus
cgaatctcagggtgaagatgaactc

SEQ ID NO: 604436 - DNA, 25 bp, Mus musculus
cgaatctggcaaaccttacgcaggg

SEQ ID NO: 604437 - DNA, 25 bp, Mus musculus
cgaatctggcaatccttacgcaggg

SEQ ID NO: 604438 - DNA, 25 bp, Mus musculus
cgaatctgttgactacgtggatgac

SEQ ID NO: 604439 - DNA, 25 bp, Mus musculus
cgaatctgttgagtacgtggatgac

SEQ ID NO: 604440 - DNA, 25 bp, Mus musculus
cgaatcttggcgacattgacaatga

SEQ ID NO: 604441 - DNA, 25 bp, Mus musculus
cgaatcttggcgtcattgacaatga

SEQ ID NO: 604442 - DNA, 25 bp, Mus musculus
cgaatctttgagagggtccgacaga

SEQ ID NO: 604443 - DNA, 25 bp, Mus musculus
cgaatctttgagtgggtccgacaga

SEQ ID NO: 604444 - DNA, 25 bp, Mus musculus
cgaatgaccgacaagtgccagcagt

SEQ ID NO: 604445 - DNA, 25 bp, Mus musculus
cgaatgaccgactagtgccagcagt

SEQ ID NO: 604446 - DNA, 25 bp, Mus musculus
cgaatgagagcgagctggtacccga

SEQ ID NO: 604447 - DNA, 25 bp, Mus musculus
cgaatgagagcgtgctggtacccga

SEQ ID NO: 604448 - DNA, 25 bp, Mus musculus
cgaatgatccggcattcaagagaca

SEQ ID NO: 604449 - DNA, 25 bp, Mus musculus
cgaatgatccgggattcaagagaca

SEQ ID NO: 604450 - DNA, 25 bp, Mus musculus
cgaatgcacgagagcctgcacctgt

SEQ ID NO: 604451 - DNA, 25 bp, Mus musculus
cgaatgcacgagtgcctgcacctgt

SEQ ID NO: 604452 - DNA, 25 bp, Mus musculus
cgaatgcagacgaacgaggtggatc

SEQ ID NO: 604453 - DNA, 25 bp, Mus musculus
cgaatgcagacgtacgaggtggatc

SEQ ID NO: 604454 - DNA, 25 bp, Mus musculus
cgaatgccggatcacatctaacttt

SEQ ID NO: 604455 - DNA, 25 bp, Mus musculus
cgaatgccggatgacatctaacttt

SEQ ID NO: 604456 - DNA, 25 bp, Mus musculus
cgaatgctagaacaaggctctttcc

SEQ ID NO: 604457 - DNA, 25 bp, Mus musculus
cgaatgctagaagaaggctctttcc

SEQ ID NO: 604458 - DNA, 25 bp, Mus musculus
cgaatgctatcgctgcttgtggaag

SEQ ID NO: 604459 - DNA, 25 bp, Mus musculus
cgaatgctatcggtgcttgtggaag

SEQ ID NO: 604460 - DNA, 25 bp, Mus musculus
cgaatggaagagaatgagcggaacc

SEQ ID NO: 604461 - DNA, 25 bp, Mus musculus
cgaatggaagagtatgagcggaacc

SEQ ID NO: 604462 - DNA, 25 bp, Mus musculus
cgaatggaatctatagcactcaggg

SEQ ID NO: 604463 - DNA, 25 bp, Mus musculus
cgaatggaatctttagcactcaggg

SEQ ID NO: 604464 - DNA, 25 bp, Mus musculus
cgaatggacagcattggatcaacca

SEQ ID NO: 604465 - DNA, 25 bp, Mus musculus
cgaatggacagctttggatcaacca

SEQ ID NO: 604466 - DNA, 25 bp, Mus musculus
cgaatggataagaaactgctggctg

SEQ ID NO: 604467 - DNA, 25 bp, Mus musculus
cgaatggataagtaactgctggctg

SEQ ID NO: 604468 - DNA, 25 bp, Mus musculus
cgaatgggactgcaagttatacctg

SEQ ID NO: 604469 - DNA, 25 bp, Mus musculus
cgaatgggactggaagttatacctg

SEQ ID NO: 604470 - DNA, 25 bp, Mus musculus
cgaatgggctacctgccagtgcaga

SEQ ID NO: 604471 - DNA, 25 bp, Mus musculus
cgaatgggctacgtgccagtgcaga

SEQ ID NO: 604472 - DNA, 25 bp, Mus musculus
cgaatggtcagccagggctacagtc

SEQ ID NO: 604473 - DNA, 25 bp, Mus musculus
cgaatggtcagcgagggctacagtc

SEQ ID NO: 604474 - DNA, 25 bp, Mus musculus
cgaatgtcaggccaaccaggcgtca

SEQ ID NO: 604475 - DNA, 25 bp, Mus musculus
cgaatgtcaggcgaaccaggcgtca

SEQ ID NO: 604476 - DNA, 25 bp, Mus musculus
cgaatgttgtttactacctgcaagg

SEQ ID NO: 604477 - DNA, 25 bp, Mus musculus
cgaatgttgttttctacctgcaagg

SEQ ID NO: 604478 - DNA, 25 bp, Mus musculus
cgaattaaagctaaagacatagttc

SEQ ID NO: 604479 - DNA, 25 bp, Mus musculus
cgaattaaagcttaagacatagttc

SEQ ID NO: 604480 - DNA, 25 bp, Mus musculus
cgaattagctgtagccaatactgta

SEQ ID NO: 604481 - DNA, 25 bp, Mus musculus
cgaattagctgttgccaatactgta

SEQ ID NO: 604482 - DNA, 25 bp, Mus musculus
cgaattatggcaccgtcaagtgggt

SEQ ID NO: 604483 - DNA, 25 bp, Mus musculus
cgaattatggcagcgtcaagtgggt

SEQ ID NO: 604484 - DNA, 25 bp, Mus musculus
cgaattcacaatacttagctggagt

SEQ ID NO: 604485 - DNA, 25 bp, Mus musculus
cgaattcacaattcttagctggagt

SEQ ID NO: 604486 - DNA, 25 bp, Mus musculus
cgaattcatgtgcttgtccaaggcc

SEQ ID NO: 604487 - DNA, 25 bp, Mus musculus
cgaattcatgtggttgtccaaggcc

SEQ ID NO: 604488 - DNA, 25 bp, Mus musculus
cgaattccaaagattcagcaactgg

SEQ ID NO: 604489 - DNA, 25 bp, Mus musculus
cgaattccaaagtttcagcaactgg

SEQ ID NO: 604490 - DNA, 25 bp, Mus musculus
cgaattccagccacgttgagccagg

SEQ ID NO: 604491 - DNA, 25 bp, Mus musculus
cgaattccagcctcgttgagccagg

SEQ ID NO: 604492 - DNA, 25 bp, Mus musculus
cgaattcctttgacggcaatcccta

SEQ ID NO: 604493 - DNA, 25 bp, Mus musculus
cgaattcctttgtcggcaatcccta

SEQ ID NO: 604494 - DNA, 25 bp, Mus musculus
cgaattcggcctcagaattaaaaga

SEQ ID NO: 604495 - DNA, 25 bp, Mus musculus
cgaattcggcctgagaattaaaaga

SEQ ID NO: 604496 - DNA, 25 bp, Mus musculus
cgaattcgtggaacgcagcgtggct

SEQ ID NO: 604497 - DNA, 25 bp, Mus musculus
cgaattcgtggatcgcagcgtggct

SEQ ID NO: 604498 - DNA, 25 bp, Mus musculus
cgaattctgagaacccctacaatgg

SEQ ID NO: 604499 - DNA, 25 bp, Mus musculus
cgaattctgagatcccctacaatgg

SEQ ID NO: 604500 - DNA, 25 bp, Mus musculus
cgaattgctagtcgcttactgaaag

SEQ ID NO: 604501 - DNA, 25 bp, Mus musculus
cgaattgctagtggcttactgaaag

SEQ ID NO: 604502 - DNA, 25 bp, Mus musculus
cgaattggaccaagtgagggacaac

SEQ ID NO: 604503 - DNA, 25 bp, Mus musculus
cgaattggaccatgtgagggacaac

SEQ ID NO: 604504 - DNA, 25 bp, Mus musculus
cgaattgtggaaactcaccaaccca

SEQ ID NO: 604505 - DNA, 25 bp, Mus musculus
cgaattgtggaatctcaccaaccca

SEQ ID NO: 604506 - DNA, 25 bp, Mus musculus
cgaatttaagctaggtaagatcact

SEQ ID NO: 604507 - DNA, 25 bp, Mus musculus
cgaatttaagcttggtaagatcact

SEQ ID NO: 604508 - DNA, 25 bp, Mus musculus
cgaattttagcaatataacaacagc

SEQ ID NO: 604509 - DNA, 25 bp, Mus musculus
cgaattttagcattataacaacagc

SEQ ID NO: 604510 - DNA, 25 bp, Mus musculus
cgacaaatacctcggagcaatgact

SEQ ID NO: 604511 - DNA, 25 bp, Mus musculus
cgacaaatacctgggagcaatgact

SEQ ID NO: 604512 - DNA, 25 bp, Mus musculus
cgacaaatcagaaccaattgggcca

SEQ ID NO: 604513 - DNA, 25 bp, Mus musculus
cgacaaatcagatccaattgggcca

SEQ ID NO: 604514 - DNA, 25 bp, Mus musculus
cgacaacaaaatagagcaagctatg

SEQ ID NO: 604515 - DNA, 25 bp, Mus musculus
cgacaacaaaattgagcaagctatg

SEQ ID NO: 604516 - DNA, 25 bp, Mus musculus
cgacaacactaaaattgcggttact

SEQ ID NO: 604517 - DNA, 25 bp, Mus musculus
cgacaacactaatattgcggttact

SEQ ID NO: 604518 - DNA, 25 bp, Mus musculus
cgacaacaggaaaggagcctgtcac

SEQ ID NO: 604519 - DNA, 25 bp, Mus musculus
cgacaacaggaatggagcctgtcac

SEQ ID NO: 604520 - DNA, 25 bp, Mus musculus
cgacaacaggttctacatccaatgg

SEQ ID NO: 604521 - DNA, 25 bp, Mus musculus
cgacaacaggttgtacatccaatgg

SEQ ID NO: 604522 - DNA, 25 bp, Mus musculus
cgacaacatgaacaagatcatcctg

SEQ ID NO: 604523 - DNA, 25 bp, Mus musculus
cgacaacatgaagaagatcatcctg

SEQ ID NO: 604524 - DNA, 25 bp, Mus musculus
cgacaacatgtcctactctgtggag

SEQ ID NO: 604525 - DNA, 25 bp, Mus musculus
cgacaacatgtcgtactctgtggag

SEQ ID NO: 604526 - DNA, 25 bp, Mus musculus
cgacaagaagaacagtccagcactt

SEQ ID NO: 604527 - DNA, 25 bp, Mus musculus
cgacaagaagaagagtccagcactt

SEQ ID NO: 604528 - DNA, 25 bp, Mus musculus
cgacaagacagtagaattcctccag

SEQ ID NO: 604529 - DNA, 25 bp, Mus musculus
cgacaagacagttgaattcctccag

SEQ ID NO: 604530 - DNA, 25 bp, Mus musculus
cgacaagagagacccaaggagcggg

SEQ ID NO: 604531 - DNA, 25 bp, Mus musculus
cgacaagagagagccaaggagcggg

SEQ ID NO: 604532 - DNA, 25 bp, Mus musculus
cgacaagaggctactcagcagattg

SEQ ID NO: 604533 - DNA, 25 bp, Mus musculus
cgacaagaggcttctcagcagattg

SEQ ID NO: 604534 - DNA, 25 bp, Mus musculus
cgacaagatgctcaaatatgcgctt

SEQ ID NO: 604535 - DNA, 25 bp, Mus musculus
cgacaagatgctgaaatatgcgctt

SEQ ID NO: 604536 - DNA, 25 bp, Mus musculus
cgacaaggaccgaactgccaagcct

SEQ ID NO: 604537 - DNA, 25 bp, Mus musculus
cgacaaggaccgtactgccaagcct

SEQ ID NO: 604538 - DNA, 25 bp, Mus musculus
cgacaaggagctcatcgccaccgtg

SEQ ID NO: 604539 - DNA, 25 bp, Mus musculus
cgacaaggagctgatcgccaccgtg

SEQ ID NO: 604540 - DNA, 25 bp, Mus musculus
cgacaagtggtgatcgccctgactg

SEQ ID NO: 604541 - DNA, 25 bp, Mus musculus
cgacaagtggtgttcgccctgactg

SEQ ID NO: 604542 - DNA, 25 bp, Mus musculus
cgacaatgcctgctgacacggagtg

SEQ ID NO: 604543 - DNA, 25 bp, Mus musculus
cgacaatgcctggtgacacggagtg

SEQ ID NO: 604544 - DNA, 25 bp, Mus musculus
cgacaattccgtcccgagtgacaga

SEQ ID NO: 604545 - DNA, 25 bp, Mus musculus
cgacaattccgtgccgagtgacaga

SEQ ID NO: 604546 - DNA, 25 bp, Mus musculus
cgacacagaggccacaaagtacagg

SEQ ID NO: 604547 - DNA, 25 bp, Mus musculus
cgacacagaggcgacaaagtacagg

SEQ ID NO: 604548 - DNA, 25 bp, Mus musculus
cgacacagcgttccccgaatatcgg

SEQ ID NO: 604549 - DNA, 25 bp, Mus musculus
cgacacagcgttgcccgaatatcgg

SEQ ID NO: 604550 - DNA, 25 bp, Mus musculus
cgacacaggagtcccgctcattgaa

SEQ ID NO: 604551 - DNA, 25 bp, Mus musculus
cgacacaggagtgccgctcattgaa

SEQ ID NO: 604552 - DNA, 25 bp, Mus musculus
cgacacatgctcatctcttgggctg

SEQ ID NO: 604553 - DNA, 25 bp, Mus musculus
cgacacatgctcttctcttgggctg

SEQ ID NO: 604554 - DNA, 25 bp, Mus musculus
cgacacatggctcaagtgaatgctt

SEQ ID NO: 604555 - DNA, 25 bp, Mus musculus
cgacacatggctgaagtgaatgctt

SEQ ID NO: 604556 - DNA, 25 bp, Mus musculus
cgacaccgagacagagatacagcca

SEQ ID NO: 604557 - DNA, 25 bp, Mus musculus
cgacaccgagactgagatacagcca

SEQ ID NO: 604558 - DNA, 25 bp, Mus musculus
cgacacctgcgtacgcgggagaagc

SEQ ID NO: 604559 - DNA, 25 bp, Mus musculus
cgacacctgcgttcgcgggagaagc

SEQ ID NO: 604560 - DNA, 25 bp, Mus musculus
cgacactcgagtcgtagctcccatt

SEQ ID NO: 604561 - DNA, 25 bp, Mus musculus
cgacactcgagtggtagctcccatt

SEQ ID NO: 604562 - DNA, 25 bp, Mus musculus
cgacactgagagaggccttaatgca

SEQ ID NO: 604563 - DNA, 25 bp, Mus musculus
cgacactgagagtggccttaatgca

SEQ ID NO: 604564 - DNA, 25 bp, Mus musculus
cgacactgagccacggagcgcgctt

SEQ ID NO: 604565 - DNA, 25 bp, Mus musculus
cgacactgagcctcggagcgcgctt

SEQ ID NO: 604566 - DNA, 25 bp, Mus musculus
cgacagaaccatccccgtgagctgg

SEQ ID NO: 604567 - DNA, 25 bp, Mus musculus
cgacagaaccatgcccgtgagctgg

SEQ ID NO: 604568 - DNA, 25 bp, Mus musculus
cgacagaacctaaagcagagtggca

SEQ ID NO: 604569 - DNA, 25 bp, Mus musculus
cgacagaacctatagcagagtggca

SEQ ID NO: 604570 - DNA, 25 bp, Mus musculus
cgacagacactgagaacggaagaca

SEQ ID NO: 604571 - DNA, 25 bp, Mus musculus
cgacagacactgtgaacggaagaca

SEQ ID NO: 604572 - DNA, 25 bp, Mus musculus
cgacagacttataattggatgattc

SEQ ID NO: 604573 - DNA, 25 bp, Mus musculus
cgacagacttattattggatgattc

SEQ ID NO: 604574 - DNA, 25 bp, Mus musculus
cgacagaggaagatcaacgaatggc

SEQ ID NO: 604575 - DNA, 25 bp, Mus musculus
cgacagaggaagttcaacgaatggc

SEQ ID NO: 604576 - DNA, 25 bp, Mus musculus
cgacagagtcttcctcaatgatgga

SEQ ID NO: 604577 - DNA, 25 bp, Mus musculus
cgacagagtcttgctcaatgatgga

SEQ ID NO: 604578 - DNA, 25 bp, Mus musculus
cgacagcacctccaagcaaaggaca

SEQ ID NO: 604579 - DNA, 25 bp, Mus musculus
cgacagcacctcgaagcaaaggaca

SEQ ID NO: 604580 - DNA, 25 bp, Mus musculus
cgacagcagcccagcaaacggagga

SEQ ID NO: 604581 - DNA, 25 bp, Mus musculus
cgacagcagccctgcaaacggagga

SEQ ID NO: 604582 - DNA, 25 bp, Mus musculus
cgacagccacataaagagcagcaag

SEQ ID NO: 604583 - DNA, 25 bp, Mus musculus
cgacagccacattaagagcagcaag

SEQ ID NO: 604584 - DNA, 25 bp, Mus musculus
cgacagccatgaataccgggtgtgc

SEQ ID NO: 604585 - DNA, 25 bp, Mus musculus
cgacagccatgattaccgggtgtgc

SEQ ID NO: 604586 - DNA, 25 bp, Mus musculus
cgacagcgtccaccagcgagtgaaa

SEQ ID NO: 604587 - DNA, 25 bp, Mus musculus
cgacagcgtccagcagcgagtgaaa

SEQ ID NO: 604588 - DNA, 25 bp, Mus musculus
cgacagctatttcagaagaagcagc

SEQ ID NO: 604589 - DNA, 25 bp, Mus musculus
cgacagctatttgagaagaagcagc

SEQ ID NO: 604590 - DNA, 25 bp, Mus musculus
cgacagctcaatcagaagctggtgc

SEQ ID NO: 604591 - DNA, 25 bp, Mus musculus
cgacagctcaatgagaagctggtgc

SEQ ID NO: 604592 - DNA, 25 bp, Mus musculus
cgacagctgaaacttaaggacttgg

SEQ ID NO: 604593 - DNA, 25 bp, Mus musculus
cgacagctgaaagttaaggacttgg

SEQ ID NO: 604594 - DNA, 25 bp, Mus musculus
cgacagctggcgatcccactgtacg

SEQ ID NO: 604595 - DNA, 25 bp, Mus musculus
cgacagctggcgttcccactgtacg

SEQ ID NO: 604596 - DNA, 25 bp, Mus musculus
cgacaggattcgatggctaccgtcc

SEQ ID NO: 604597 - DNA, 25 bp, Mus musculus
cgacaggattcgttggctaccgtcc

SEQ ID NO: 604598 - DNA, 25 bp, Mus musculus
cgacaggtgcgcacccttcaaggag

SEQ ID NO: 604599 - DNA, 25 bp, Mus musculus
cgacaggtgcgctcccttcaaggag

SEQ ID NO: 604600 - DNA, 25 bp, Mus musculus
cgacagtaaatcaatccagaaagac

SEQ ID NO: 604601 - DNA, 25 bp, Mus musculus
cgacagtaaatctatccagaaagac

SEQ ID NO: 604602 - DNA, 25 bp, Mus musculus
cgacagtatgaccagagccatgtga

SEQ ID NO: 604603 - DNA, 25 bp, Mus musculus
cgacagtatgacgagagccatgtga

SEQ ID NO: 604604 - DNA, 25 bp, Mus musculus
cgacagtgagaactcttcccgggca

SEQ ID NO: 604605 - DNA, 25 bp, Mus musculus
cgacagtgagaagtcttcccgggca

SEQ ID NO: 604606 - DNA, 25 bp, Mus musculus
cgacagttcctacccagactcttga

SEQ ID NO: 604607 - DNA, 25 bp, Mus musculus
cgacagttcctagccagactcttga

SEQ ID NO: 604608 - DNA, 25 bp, Mus musculus
cgacataatgcccaaagacttttta

SEQ ID NO: 604609 - DNA, 25 bp, Mus musculus
cgacataatgccgaaagacttttta

SEQ ID NO: 604610 - DNA, 25 bp, Mus musculus
cgacatcctgatccggacttctggg

SEQ ID NO: 604611 - DNA, 25 bp, Mus musculus
cgacatcctgatgcggacttctggg

SEQ ID NO: 604612 - DNA, 25 bp, Mus musculus
cgacatcgaagtcgatggcaagcag

SEQ ID NO: 604613 - DNA, 25 bp, Mus musculus
cgacatcgaagtggatggcaagcag

SEQ ID NO: 604614 - DNA, 25 bp, Mus musculus
cgacatcggtccacgacttagtgcg

SEQ ID NO: 604615 - DNA, 25 bp, Mus musculus
cgacatcggtcctcgacttagtgcg

SEQ ID NO: 604616 - DNA, 25 bp, Mus musculus
cgacatctccaacttctacctgaag

SEQ ID NO: 604617 - DNA, 25 bp, Mus musculus
cgacatctccaagttctacctgaag

SEQ ID NO: 604618 - DNA, 25 bp, Mus musculus
cgacatgacggacagcatcccgctg

SEQ ID NO: 604619 - DNA, 25 bp, Mus musculus
cgacatgacggagagcatcccgctg

SEQ ID NO: 604620 - DNA, 25 bp, Mus musculus
cgacatgagggcatcctctgtggag

SEQ ID NO: 604621 - DNA, 25 bp, Mus musculus
cgacatgagggcttcctctgtggag

SEQ ID NO: 604622 - DNA, 25 bp, Mus musculus
cgacatgggctgattctgcgccgtt

SEQ ID NO: 604623 - DNA, 25 bp, Mus musculus
cgacatgggctgtttctgcgccgtt

SEQ ID NO: 604624 - DNA, 25 bp, Mus musculus
cgacatgttaaaacgggtcagctgg

SEQ ID NO: 604625 - DNA, 25 bp, Mus musculus
cgacatgttaaatcgggtcagctgg

SEQ ID NO: 604626 - DNA, 25 bp, Mus musculus
cgacattcgacaagaacgcggcggg

SEQ ID NO: 604627 - DNA, 25 bp, Mus musculus
cgacattcgacatgaacgcggcggg

SEQ ID NO: 604628 - DNA, 25 bp, Mus musculus
cgacattgaggacgacttaggagcc

SEQ ID NO: 604629 - DNA, 25 bp, Mus musculus
cgacattgaggaggacttaggagcc

SEQ ID NO: 604630 - DNA, 25 bp, Mus musculus
cgacattgtgccatgattgccagag

SEQ ID NO: 604631 - DNA, 25 bp, Mus musculus
cgacattgtgccttgattgccagag

SEQ ID NO: 604632 - DNA, 25 bp, Mus musculus
cgaccaaaccagcaccgtggctgtg

SEQ ID NO: 604633 - DNA, 25 bp, Mus musculus
cgaccaaaccaggaccgtggctgtg

SEQ ID NO: 604634 - DNA, 25 bp, Mus musculus
cgaccaagcctgacgcggagatggt

SEQ ID NO: 604635 - DNA, 25 bp, Mus musculus
cgaccaagcctgtcgcggagatggt

SEQ ID NO: 604636 - DNA, 25 bp, Mus musculus
cgaccaaggacacccgcagggagct

SEQ ID NO: 604637 - DNA, 25 bp, Mus musculus
cgaccaaggacagccgcagggagct

SEQ ID NO: 604638 - DNA, 25 bp, Mus musculus
cgaccagagcttcgacgaggcgcaa

SEQ ID NO: 604639 - DNA, 25 bp, Mus musculus
cgaccagagcttggacgaggcgcaa

SEQ ID NO: 604640 - DNA, 25 bp, Mus musculus
cgaccagcaggaaggctgccaacaa

SEQ ID NO: 604641 - DNA, 25 bp, Mus musculus
cgaccagcaggatggctgccaacaa

SEQ ID NO: 604642 - DNA, 25 bp, Mus musculus
cgaccagcttgtaagacaggctaag

SEQ ID NO: 604643 - DNA, 25 bp, Mus musculus
cgaccagcttgttagacaggctaag

SEQ ID NO: 604644 - DNA, 25 bp, Mus musculus
cgaccagggcagaggagccagcaca

SEQ ID NO: 604645 - DNA, 25 bp, Mus musculus
cgaccagggcagtggagccagcaca

SEQ ID NO: 604646 - DNA, 25 bp, Mus musculus
cgaccagtattgactgcggatctgc

SEQ ID NO: 604647 - DNA, 25 bp, Mus musculus
cgaccagtattgtctgcggatctgc

SEQ ID NO: 604648 - DNA, 25 bp, Mus musculus
cgaccagttgcccaatcttgccgat

SEQ ID NO: 604649 - DNA, 25 bp, Mus musculus
cgaccagttgccgaatcttgccgat

SEQ ID NO: 604650 - DNA, 25 bp, Mus musculus
cgaccataagcgcatctcaaagtta

SEQ ID NO: 604651 - DNA, 25 bp, Mus musculus
cgaccataagcggatctcaaagtta

SEQ ID NO: 604652 - DNA, 25 bp, Mus musculus
cgaccatggcgaagagaaagccatc

SEQ ID NO: 604653 - DNA, 25 bp, Mus musculus
cgaccatggcgatgagaaagccatc

SEQ ID NO: 604654 - DNA, 25 bp, Mus musculus
cgaccattatcacccagagagagga

SEQ ID NO: 604655 - DNA, 25 bp, Mus musculus
cgaccattatcagccagagagagga

SEQ ID NO: 604656 - DNA, 25 bp, Mus musculus
cgacccaaagaacagccccgtggtg

SEQ ID NO: 604657 - DNA, 25 bp, Mus musculus
cgacccaaagaagagccccgtggtg

SEQ ID NO: 604658 - DNA, 25 bp, Mus musculus
cgacccaagctccagagatgtgggt

SEQ ID NO: 604659 - DNA, 25 bp, Mus musculus
cgacccaagctcgagagatgtgggt

SEQ ID NO: 604660 - DNA, 25 bp, Mus musculus
cgacccacgggcatttatggtgaag

SEQ ID NO: 604661 - DNA, 25 bp, Mus musculus
cgacccacgggcttttatggtgaag

SEQ ID NO: 604662 - DNA, 25 bp, Mus musculus
cgacccctgctacctgatcaatgag

SEQ ID NO: 604663 - DNA, 25 bp, Mus musculus
cgacccctgctagctgatcaatgag

SEQ ID NO: 604664 - DNA, 25 bp, Mus musculus
cgaccctagggtatggagcaattcc

SEQ ID NO: 604665 - DNA, 25 bp, Mus musculus
cgaccctagggtttggagcaattcc

SEQ ID NO: 604666 - DNA, 25 bp, Mus musculus
cgaccctcctggcatatccttaggg

SEQ ID NO: 604667 - DNA, 25 bp, Mus musculus
cgaccctcctgggatatccttaggg

SEQ ID NO: 604668 - DNA, 25 bp, Mus musculus
cgaccgaagacgcagggacaaattt

SEQ ID NO: 604669 - DNA, 25 bp, Mus musculus
cgaccgaagacggagggacaaattt

SEQ ID NO: 604670 - DNA, 25 bp, Mus musculus
cgaccgcattaacgagctaggtact

SEQ ID NO: 604671 - DNA, 25 bp, Mus musculus
cgaccgcattaaggagctaggtact

SEQ ID NO: 604672 - DNA, 25 bp, Mus musculus
cgaccgcctctgctttgtcatggag

SEQ ID NO: 604673 - DNA, 25 bp, Mus musculus
cgaccgcctctggtttgtcatggag

SEQ ID NO: 604674 - DNA, 25 bp, Mus musculus
cgaccgcctggtcggctacccaggc

SEQ ID NO: 604675 - DNA, 25 bp, Mus musculus
cgaccgcctggtgggctacccaggc

SEQ ID NO: 604676 - DNA, 25 bp, Mus musculus
cgaccgcgtgtacacacaccagagt

SEQ ID NO: 604677 - DNA, 25 bp, Mus musculus
cgaccgcgtgtagacacaccagagt

SEQ ID NO: 604678 - DNA, 25 bp, Mus musculus
cgaccgctggttacgaagacatgtg

SEQ ID NO: 604679 - DNA, 25 bp, Mus musculus
cgaccgctggtttcgaagacatgtg

SEQ ID NO: 604680 - DNA, 25 bp, Mus musculus
cgaccggtttgacttttcatccctg

SEQ ID NO: 604681 - DNA, 25 bp, Mus musculus
cgaccggtttgagttttcatccctg

SEQ ID NO: 604682 - DNA, 25 bp, Mus musculus
cgaccgttgttaagggcaactggag

SEQ ID NO: 604683 - DNA, 25 bp, Mus musculus
cgaccgttgttatgggcaactggag

SEQ ID NO: 604684 - DNA, 25 bp, Mus musculus
cgacctacaactcagcgcatgacta

SEQ ID NO: 604685 - DNA, 25 bp, Mus musculus
cgacctacaactgagcgcatgacta

SEQ ID NO: 604686 - DNA, 25 bp, Mus musculus
cgacctagacagagacttttggaat

SEQ ID NO: 604687 - DNA, 25 bp, Mus musculus
cgacctagacagtgacttttggaat

SEQ ID NO: 604688 - DNA, 25 bp, Mus musculus
cgacctcatctacccgcaagggtta

SEQ ID NO: 604689 - DNA, 25 bp, Mus musculus
cgacctcatctagccgcaagggtta

SEQ ID NO: 604690 - DNA, 25 bp, Mus musculus
cgacctctggaactccgttccggag

SEQ ID NO: 604691 - DNA, 25 bp, Mus musculus
cgacctctggaagtccgttccggag

SEQ ID NO: 604692 - DNA, 25 bp, Mus musculus
cgacctcttcagcatggagatatta

SEQ ID NO: 604693 - DNA, 25 bp, Mus musculus
cgacctcttcaggatggagatatta

SEQ ID NO: 604694 - DNA, 25 bp, Mus musculus
cgacctgaccagattgaatgtgaag

SEQ ID NO: 604695 - DNA, 25 bp, Mus musculus
cgacctgaccagtttgaatgtgaag

SEQ ID NO: 604696 - DNA, 25 bp, Mus musculus
cgacctgcttttatgccttcgtggg

SEQ ID NO: 604697 - DNA, 25 bp, Mus musculus
cgacctgcttttttgccttcgtggg

SEQ ID NO: 604698 - DNA, 25 bp, Mus musculus
cgacctggaaggctgtattaagacc

SEQ ID NO: 604699 - DNA, 25 bp, Mus musculus
cgacctggaagggtgtattaagacc

SEQ ID NO: 604700 - DNA, 25 bp, Mus musculus
cgacctggactgcatttttggaaaa

SEQ ID NO: 604701 - DNA, 25 bp, Mus musculus
cgacctggactggatttttggaaaa

SEQ ID NO: 604702 - DNA, 25 bp, Mus musculus
cgacctggcactaaaggccctgaga

SEQ ID NO: 604703 - DNA, 25 bp, Mus musculus
cgacctggcacttaaggccctgaga

SEQ ID NO: 604704 - DNA, 25 bp, Mus musculus
cgaccttcgagaacgctctgagtgc

SEQ ID NO: 604705 - DNA, 25 bp, Mus musculus
cgaccttcgagatcgctctgagtgc

SEQ ID NO: 604706 - DNA, 25 bp, Mus musculus
cgaccttggcttactacgtgcagca

SEQ ID NO: 604707 - DNA, 25 bp, Mus musculus
cgaccttggctttctacgtgcagca

SEQ ID NO: 604708 - DNA, 25 bp, Mus musculus
cgacgaaatcgacgagaacagcatg

SEQ ID NO: 604709 - DNA, 25 bp, Mus musculus
cgacgaaatcgaggagaacagcatg

SEQ ID NO: 604710 - DNA, 25 bp, Mus musculus
cgacgaatatcaccgcacatgggta

SEQ ID NO: 604711 - DNA, 25 bp, Mus musculus
cgacgaatatcagcgcacatgggta

SEQ ID NO: 604712 - DNA, 25 bp, Mus musculus
cgacgacgacaaagatcctgaaaat

SEQ ID NO: 604713 - DNA, 25 bp, Mus musculus
cgacgacgacaatgatcctgaaaat

SEQ ID NO: 604714 - DNA, 25 bp, Mus musculus
cgacgacgagtacgactacctcttt

SEQ ID NO: 604715 - DNA, 25 bp, Mus musculus
cgacgacgagtaggactacctcttt

SEQ ID NO: 604716 - DNA, 25 bp, Mus musculus
cgacgacgcatcctggctccttatt

SEQ ID NO: 604717 - DNA, 25 bp, Mus musculus
cgacgacgcatcgtggctccttatt

SEQ ID NO: 604718 - DNA, 25 bp, Mus musculus
cgacgagatctaagacggaatagag

SEQ ID NO: 604719 - DNA, 25 bp, Mus musculus
cgacgagatctatgacggaatagag

SEQ ID NO: 604720 - DNA, 25 bp, Mus musculus
cgacgagatggacaataagatgacc

SEQ ID NO: 604721 - DNA, 25 bp, Mus musculus
cgacgagatggagaataagatgacc

SEQ ID NO: 604722 - DNA, 25 bp, Mus musculus
cgacgagcagaaccgcagaaatctc

SEQ ID NO: 604723 - DNA, 25 bp, Mus musculus
cgacgagcagaagcgcagaaatctc

SEQ ID NO: 604724 - DNA, 25 bp, Mus musculus
cgacgagccgcaaagatgaagaatt

SEQ ID NO: 604725 - DNA, 25 bp, Mus musculus
cgacgagccgcatagatgaagaatt

SEQ ID NO: 604726 - DNA, 25 bp, Mus musculus
cgacgaggaccgagaaaaggagatt

SEQ ID NO: 604727 - DNA, 25 bp, Mus musculus
cgacgaggaccgtgaaaaggagatt

SEQ ID NO: 604728 - DNA, 25 bp, Mus musculus
cgacgagtcggaaggagaggagttc

SEQ ID NO: 604729 - DNA, 25 bp, Mus musculus
cgacgagtcggatggagaggagttc

SEQ ID NO: 604730 - DNA, 25 bp, Mus musculus
cgacgagtgtgcacgaggtgcctta

SEQ ID NO: 604731 - DNA, 25 bp, Mus musculus
cgacgagtgtgctcgaggtgcctta

SEQ ID NO: 604732 - DNA, 25 bp, Mus musculus
cgacgagttgtgctcgctgggcaaa

SEQ ID NO: 604733 - DNA, 25 bp, Mus musculus
cgacgagttgtggtcgctgggcaaa

SEQ ID NO: 604734 - DNA, 25 bp, Mus musculus
cgacgatcttgtacaaattgaagct

SEQ ID NO: 604735 - DNA, 25 bp, Mus musculus
cgacgatcttgttcaaattgaagct

SEQ ID NO: 604736 - DNA, 25 bp, Mus musculus
cgacgatgaagacgctgatgatgat

SEQ ID NO: 604737 - DNA, 25 bp, Mus musculus
cgacgatgaagaggctgatgatgat

SEQ ID NO: 604738 - DNA, 25 bp, Mus musculus
cgacgcacggctcctgagaatgagt

SEQ ID NO: 604739 - DNA, 25 bp, Mus musculus
cgacgcacggctgctgagaatgagt

SEQ ID NO: 604740 - DNA, 25 bp, Mus musculus
cgacgcatgatcaacaagatcgaca

SEQ ID NO: 604741 - DNA, 25 bp, Mus musculus
cgacgcatgatctacaagatcgaca

SEQ ID NO: 604742 - DNA, 25 bp, Mus musculus
cgacgccgtcagcaggaaaacattt

SEQ ID NO: 604743 - DNA, 25 bp, Mus musculus
cgacgccgtcaggaggaaaacattt

SEQ ID NO: 604744 - DNA, 25 bp, Mus musculus
cgacgctaatcgagggccgctcggc

SEQ ID NO: 604745 - DNA, 25 bp, Mus musculus
cgacgctaatcgtgggccgctcggc

SEQ ID NO: 604746 - DNA, 25 bp, Mus musculus
cgacgctaatgtcggttactgttgc

SEQ ID NO: 604747 - DNA, 25 bp, Mus musculus
cgacgctaatgtgggttactgttgc

SEQ ID NO: 604748 - DNA, 25 bp, Mus musculus
cgacgctggaacacagatattcttt

SEQ ID NO: 604749 - DNA, 25 bp, Mus musculus
cgacgctggaactcagatattcttt

SEQ ID NO: 604750 - DNA, 25 bp, Mus musculus
cgacgcttggcgctgcttcgagaac

SEQ ID NO: 604751 - DNA, 25 bp, Mus musculus
cgacgcttggcggtgcttcgagaac

SEQ ID NO: 604752 - DNA, 25 bp, Mus musculus
cgacggagccggattacctgaagtg

SEQ ID NO: 604753 - DNA, 25 bp, Mus musculus
cgacggagccggtttacctgaagtg

SEQ ID NO: 604754 - DNA, 25 bp, Mus musculus
cgacggcaagcgcttcctgggctct

SEQ ID NO: 604755 - DNA, 25 bp, Mus musculus
cgacggcaagcggttcctgggctct

SEQ ID NO: 604756 - DNA, 25 bp, Mus musculus
cgacggcctagaccctgggctgcat

SEQ ID NO: 604757 - DNA, 25 bp, Mus musculus
cgacggcctagagcctgggctgcat

SEQ ID NO: 604758 - DNA, 25 bp, Mus musculus
cgacggcgacttcgcaaggaagaaa

SEQ ID NO: 604759 - DNA, 25 bp, Mus musculus
cgacggcgacttggcaaggaagaaa

SEQ ID NO: 604760 - DNA, 25 bp, Mus musculus
cgacggcgccgactggctggaggag

SEQ ID NO: 604761 - DNA, 25 bp, Mus musculus
cgacggcgccgagtggctggaggag

SEQ ID NO: 604762 - DNA, 25 bp, Mus musculus
cgacggctcgtcaacaagtttggca

SEQ ID NO: 604763 - DNA, 25 bp, Mus musculus
cgacggctcgtctacaagtttggca

SEQ ID NO: 604764 - DNA, 25 bp, Mus musculus
cgacggcttctcatcatggcggacc

SEQ ID NO: 604765 - DNA, 25 bp, Mus musculus
cgacggcttctcttcatggcggacc

SEQ ID NO: 604766 - DNA, 25 bp, Mus musculus
cgacgggaacgcacttctgtgaggt

SEQ ID NO: 604767 - DNA, 25 bp, Mus musculus
cgacgggaacgctcttctgtgaggt

SEQ ID NO: 604768 - DNA, 25 bp, Mus musculus
cgacgggaccatcacggagtaagta

SEQ ID NO: 604769 - DNA, 25 bp, Mus musculus
cgacgggaccatgacggagtaagta

SEQ ID NO: 604770 - DNA, 25 bp, Mus musculus
cgacgggcctgcactcaagaaggca

SEQ ID NO: 604771 - DNA, 25 bp, Mus musculus
cgacgggcctgctctcaagaaggca

SEQ ID NO: 604772 - DNA, 25 bp, Mus musculus
cgacgtcttgaacgctccggcttgg

SEQ ID NO: 604773 - DNA, 25 bp, Mus musculus
cgacgtcttgaaggctccggcttgg

SEQ ID NO: 604774 - DNA, 25 bp, Mus musculus
cgacgtgcggtgagccatccacctg

SEQ ID NO: 604775 - DNA, 25 bp, Mus musculus
cgacgtgcggtgtgccatccacctg

SEQ ID NO: 604776 - DNA, 25 bp, Mus musculus
cgacgtgctgtaaggcaaagttggc

SEQ ID NO: 604777 - DNA, 25 bp, Mus musculus
cgacgtgctgtatggcaaagttggc

SEQ ID NO: 604778 - DNA, 25 bp, Mus musculus
cgacgtggccgtagacttctctccg

SEQ ID NO: 604779 - DNA, 25 bp, Mus musculus
cgacgtggccgttgacttctctccg

SEQ ID NO: 604780 - DNA, 25 bp, Mus musculus
cgacgttgttcgatacagggtctat

SEQ ID NO: 604781 - DNA, 25 bp, Mus musculus
cgacgttgttcgttacagggtctat

SEQ ID NO: 604782 - DNA, 25 bp, Mus musculus
cgactaaaagtgaaggacctgcggc

SEQ ID NO: 604783 - DNA, 25 bp, Mus musculus
cgactaaaagtgtaggacctgcggc

SEQ ID NO: 604784 - DNA, 25 bp, Mus musculus
cgactacagctgctctacacaacgg

SEQ ID NO: 604785 - DNA, 25 bp, Mus musculus
cgactacagctggtctacacaacgg

SEQ ID NO: 604786 - DNA, 25 bp, Mus musculus
cgactacatctacccggagcagttc

SEQ ID NO: 604787 - DNA, 25 bp, Mus musculus
cgactacatctagccggagcagttc

SEQ ID NO: 604788 - DNA, 25 bp, Mus musculus
cgactacatggaccagtgcaagccc

SEQ ID NO: 604789 - DNA, 25 bp, Mus musculus
cgactacatggagcagtgcaagccc

SEQ ID NO: 604790 - DNA, 25 bp, Mus musculus
cgactacctaggacgctctggccaa

SEQ ID NO: 604791 - DNA, 25 bp, Mus musculus
cgactacctaggtcgctctggccaa

SEQ ID NO: 604792 - DNA, 25 bp, Mus musculus
cgactacggcctacgggcaggcagt

SEQ ID NO: 604793 - DNA, 25 bp, Mus musculus
cgactacggccttcgggcaggcagt

SEQ ID NO: 604794 - DNA, 25 bp, Mus musculus
cgactatgaggccaatgacccctgg

SEQ ID NO: 604795 - DNA, 25 bp, Mus musculus
cgactatgaggcgaatgacccctgg

SEQ ID NO: 604796 - DNA, 25 bp, Mus musculus
cgactcctgtgaccgcatcaaagat

SEQ ID NO: 604797 - DNA, 25 bp, Mus musculus
cgactcctgtgagcgcatcaaagat

SEQ ID NO: 604798 - DNA, 25 bp, Mus musculus
cgactctacgtgagacgtacagccc

SEQ ID NO: 604799 - DNA, 25 bp, Mus musculus
cgactctacgtgtgacgtacagccc

SEQ ID NO: 604800 - DNA, 25 bp, Mus musculus
cgactctcctgtcccaaatgtaaaa

SEQ ID NO: 604801 - DNA, 25 bp, Mus musculus
cgactctcctgtgccaaatgtaaaa

SEQ ID NO: 604802 - DNA, 25 bp, Mus musculus
cgactctgtcttctggtattggccc

SEQ ID NO: 604803 - DNA, 25 bp, Mus musculus
cgactctgtcttgtggtattggccc

SEQ ID NO: 604804 - DNA, 25 bp, Mus musculus
cgactcttccgacgctgaagctggg

SEQ ID NO: 604805 - DNA, 25 bp, Mus musculus
cgactcttccgaggctgaagctggg

SEQ ID NO: 604806 - DNA, 25 bp, Mus musculus
cgactcttggagatagactccgtag

SEQ ID NO: 604807 - DNA, 25 bp, Mus musculus
cgactcttggagttagactccgtag

SEQ ID NO: 604808 - DNA, 25 bp, Mus musculus
cgactgaaggctatggaccaggaga

SEQ ID NO: 604809 - DNA, 25 bp, Mus musculus
cgactgaaggctttggaccaggaga

SEQ ID NO: 604810 - DNA, 25 bp, Mus musculus
cgactgagcaggactaccaatgtag

SEQ ID NO: 604811 - DNA, 25 bp, Mus musculus
cgactgagcaggtctaccaatgtag

SEQ ID NO: 604812 - DNA, 25 bp, Mus musculus
cgactgatctcgacgtggagcgaga

SEQ ID NO: 604813 - DNA, 25 bp, Mus musculus
cgactgatctcgtcgtggagcgaga

SEQ ID NO: 604814 - DNA, 25 bp, Mus musculus
cgactgccacatagatgccatctgc

SEQ ID NO: 604815 - DNA, 25 bp, Mus musculus
cgactgccacattgatgccatctgc

SEQ ID NO: 604816 - DNA, 25 bp, Mus musculus
cgactgcttcagagagatgttcaga

SEQ ID NO: 604817 - DNA, 25 bp, Mus musculus
cgactgcttcagtgagatgttcaga

SEQ ID NO: 604818 - DNA, 25 bp, Mus musculus
cgactgcttcatactggacctggga

SEQ ID NO: 604819 - DNA, 25 bp, Mus musculus
cgactgcttcattctggacctggga

SEQ ID NO: 604820 - DNA, 25 bp, Mus musculus
cgactggagatgagattgctatcaa

SEQ ID NO: 604821 - DNA, 25 bp, Mus musculus
cgactggagatgtgattgctatcaa

SEQ ID NO: 604822 - DNA, 25 bp, Mus musculus
cgactggaggaaccccaagtgtcac

SEQ ID NO: 604823 - DNA, 25 bp, Mus musculus
cgactggaggaagcccaagtgtcac

SEQ ID NO: 604824 - DNA, 25 bp, Mus musculus
cgactggagtccaacaaggaaggga

SEQ ID NO: 604825 - DNA, 25 bp, Mus musculus
cgactggagtcctacaaggaaggga

SEQ ID NO: 604826 - DNA, 25 bp, Mus musculus
cgactggcctcgagaggtatctcta

SEQ ID NO: 604827 - DNA, 25 bp, Mus musculus
cgactggcctcgtgaggtatctcta

SEQ ID NO: 604828 - DNA, 25 bp, Mus musculus
cgactggtacagaacataatgaaga

SEQ ID NO: 604829 - DNA, 25 bp, Mus musculus
cgactggtacagtacataatgaaga

SEQ ID NO: 604830 - DNA, 25 bp, Mus musculus
cgactggttggtcgaagttgccaca

SEQ ID NO: 604831 - DNA, 25 bp, Mus musculus
cgactggttggtggaagttgccaca

SEQ ID NO: 604832 - DNA, 25 bp, Mus musculus
cgactgtaggccaccttcgggaaca

SEQ ID NO: 604833 - DNA, 25 bp, Mus musculus
cgactgtaggcctccttcgggaaca

SEQ ID NO: 604834 - DNA, 25 bp, Mus musculus
cgactgtccctcaagtgagtgactt

SEQ ID NO: 604835 - DNA, 25 bp, Mus musculus
cgactgtccctctagtgagtgactt

SEQ ID NO: 604836 - DNA, 25 bp, Mus musculus
cgactgtgctgtcccagagcctgtt

SEQ ID NO: 604837 - DNA, 25 bp, Mus musculus
cgactgtgctgtgccagagcctgtt

SEQ ID NO: 604838 - DNA, 25 bp, Mus musculus
cgactgttaagtatccaaagatact

SEQ ID NO: 604839 - DNA, 25 bp, Mus musculus
cgactgttaagtttccaaagatact

SEQ ID NO: 604840 - DNA, 25 bp, Mus musculus
cgactgtttaaaaattccaggcaac

SEQ ID NO: 604841 - DNA, 25 bp, Mus musculus
cgactgtttaaatattccaggcaac

SEQ ID NO: 604842 - DNA, 25 bp, Mus musculus
cgacttaggctccaacgtaactgca

SEQ ID NO: 604843 - DNA, 25 bp, Mus musculus
cgacttaggctcgaacgtaactgca

SEQ ID NO: 604844 - DNA, 25 bp, Mus musculus
cgacttatcggaagccttagtcatc

SEQ ID NO: 604845 - DNA, 25 bp, Mus musculus
cgacttatcggatgccttagtcatc

SEQ ID NO: 604846 - DNA, 25 bp, Mus musculus
cgacttcaaataccgggcactgcag

SEQ ID NO: 604847 - DNA, 25 bp, Mus musculus
cgacttcaaatagcgggcactgcag

SEQ ID NO: 604848 - DNA, 25 bp, Mus musculus
cgacttccagggacggcgctaccgg

SEQ ID NO: 604849 - DNA, 25 bp, Mus musculus
cgacttccagggtcggcgctaccgg

SEQ ID NO: 604850 - DNA, 25 bp, Mus musculus
cgacttccgaaaaaagatcattcta

SEQ ID NO: 604851 - DNA, 25 bp, Mus musculus
cgacttccgaaataagatcattcta

SEQ ID NO: 604852 - DNA, 25 bp, Mus musculus
cgacttccgcttctggaagagtctg

SEQ ID NO: 604853 - DNA, 25 bp, Mus musculus
cgacttccgcttgtggaagagtctg

SEQ ID NO: 604854 - DNA, 25 bp, Mus musculus
cgacttggaaggctgcgtgcactat

SEQ ID NO: 604855 - DNA, 25 bp, Mus musculus
cgacttggaagggtgcgtgcactat

SEQ ID NO: 604856 - DNA, 25 bp, Mus musculus
cgacttgggtgaccagtgaagccta

SEQ ID NO: 604857 - DNA, 25 bp, Mus musculus
cgacttgggtgagcagtgaagccta

SEQ ID NO: 604858 - DNA, 25 bp, Mus musculus
cgacttgtcatgaaccaaagcacag

SEQ ID NO: 604859 - DNA, 25 bp, Mus musculus
cgacttgtcatgtaccaaagcacag

SEQ ID NO: 604860 - DNA, 25 bp, Mus musculus
cgacttgtgaatcggactcggaccg

SEQ ID NO: 604861 - DNA, 25 bp, Mus musculus
cgacttgtgaatgggactcggaccg

SEQ ID NO: 604862 - DNA, 25 bp, Mus musculus
cgacttgtttaactgtgagatcaca

SEQ ID NO: 604863 - DNA, 25 bp, Mus musculus
cgacttgtttaagtgtgagatcaca

SEQ ID NO: 604864 - DNA, 25 bp, Mus musculus
cgactttgctgaaccccagcgtgcg

SEQ ID NO: 604865 - DNA, 25 bp, Mus musculus
cgactttgctgatccccagcgtgcg

SEQ ID NO: 604866 - DNA, 25 bp, Mus musculus
cgactttggcctcggatacagacag

SEQ ID NO: 604867 - DNA, 25 bp, Mus musculus
cgactttggcctgggatacagacag

SEQ ID NO: 604868 - DNA, 25 bp, Mus musculus
cgactttgggctctcacggcttata

SEQ ID NO: 604869 - DNA, 25 bp, Mus musculus
cgactttgggctgtcacggcttata

SEQ ID NO: 604870 - DNA, 25 bp, Mus musculus
cgacttttttcacacccgcatcggg

SEQ ID NO: 604871 - DNA, 25 bp, Mus musculus
cgacttttttcagacccgcatcggg

SEQ ID NO: 604872 - DNA, 25 bp, Mus musculus
cgagaaaaagacatcaggagaagcc

SEQ ID NO: 604873 - DNA, 25 bp, Mus musculus
cgagaaaaagacttcaggagaagcc

SEQ ID NO: 604874 - DNA, 25 bp, Mus musculus
cgagaaaacaccatgatgtggagaa

SEQ ID NO: 604875 - DNA, 25 bp, Mus musculus
cgagaaaacaccttgatgtggagaa

SEQ ID NO: 604876 - DNA, 25 bp, Mus musculus
cgagaaaccagaccgaacgcctatt

SEQ ID NO: 604877 - DNA, 25 bp, Mus musculus
cgagaaaccagagcgaacgcctatt

SEQ ID NO: 604878 - DNA, 25 bp, Mus musculus
cgagaaagattgcaacccagatgag

SEQ ID NO: 604879 - DNA, 25 bp, Mus musculus
cgagaaagattggaacccagatgag

SEQ ID NO: 604880 - DNA, 25 bp, Mus musculus
cgagaaagccaacggcctgattctg

SEQ ID NO: 604881 - DNA, 25 bp, Mus musculus
cgagaaagccaagggcctgattctg

SEQ ID NO: 604882 - DNA, 25 bp, Mus musculus
cgagaaagccgcacttacctagcgg

SEQ ID NO: 604883 - DNA, 25 bp, Mus musculus
cgagaaagccgctcttacctagcgg

SEQ ID NO: 604884 - DNA, 25 bp, Mus musculus
cgagaaaggataactcacaagagtc

SEQ ID NO: 604885 - DNA, 25 bp, Mus musculus
cgagaaaggatatctcacaagagtc

SEQ ID NO: 604886 - DNA, 25 bp, Mus musculus
cgagaaagtctgactaatgcagcag

SEQ ID NO: 604887 - DNA, 25 bp, Mus musculus
cgagaaagtctgtctaatgcagcag

SEQ ID NO: 604888 - DNA, 25 bp, Mus musculus
cgagaaattccaccccaaagtcgag

SEQ ID NO: 604889 - DNA, 25 bp, Mus musculus
cgagaaattccagcccaaagtcgag

SEQ ID NO: 604890 - DNA, 25 bp, Mus musculus
cgagaacacgcccatgattgctggc

SEQ ID NO: 604891 - DNA, 25 bp, Mus musculus
cgagaacacgccgatgattgctggc

SEQ ID NO: 604892 - DNA, 25 bp, Mus musculus
cgagaacacgctagctaaggattat

SEQ ID NO: 604893 - DNA, 25 bp, Mus musculus
cgagaacacgcttgctaaggattat

SEQ ID NO: 604894 - DNA, 25 bp, Mus musculus
cgagaacataccatacagcttttac

SEQ ID NO: 604895 - DNA, 25 bp, Mus musculus
cgagaacataccttacagcttttac

SEQ ID NO: 604896 - DNA, 25 bp, Mus musculus
cgagaacattcgctatggccgagaa

SEQ ID NO: 604897 - DNA, 25 bp, Mus musculus
cgagaacattcggtatggccgagaa

SEQ ID NO: 604898 - DNA, 25 bp, Mus musculus
cgagaaccagccatacccttggact

SEQ ID NO: 604899 - DNA, 25 bp, Mus musculus
cgagaaccagccttacccttggact

SEQ ID NO: 604900 - DNA, 25 bp, Mus musculus
cgagaacgctctcagtgccggcttc

SEQ ID NO: 604901 - DNA, 25 bp, Mus musculus
cgagaacgctctgagtgccggcttc

SEQ ID NO: 604902 - DNA, 25 bp, Mus musculus
cgagaacggaggctacgggaggcac

SEQ ID NO: 604903 - DNA, 25 bp, Mus musculus
cgagaacggagggtacgggaggcac

SEQ ID NO: 604904 - DNA, 25 bp, Mus musculus
cgagaactagttcttatgaagtgtg

SEQ ID NO: 604905 - DNA, 25 bp, Mus musculus
cgagaactagttgttatgaagtgtg

SEQ ID NO: 604906 - DNA, 25 bp, Mus musculus
cgagaactatggatatggctatggc

SEQ ID NO: 604907 - DNA, 25 bp, Mus musculus
cgagaactatggttatggctatggc

SEQ ID NO: 604908 - DNA, 25 bp, Mus musculus
cgagaactggagaaggtcgtgtact

SEQ ID NO: 604909 - DNA, 25 bp, Mus musculus
cgagaactggagtaggtcgtgtact

SEQ ID NO: 604910 - DNA, 25 bp, Mus musculus
cgagaactggtacaacttcgaaata

SEQ ID NO: 604911 - DNA, 25 bp, Mus musculus
cgagaactggtagaacttcgaaata

SEQ ID NO: 604912 - DNA, 25 bp, Mus musculus
cgagaagactaacgcatggtcctgg

SEQ ID NO: 604913 - DNA, 25 bp, Mus musculus
cgagaagactaaggcatggtcctgg

SEQ ID NO: 604914 - DNA, 25 bp, Mus musculus
cgagaagactcaacacgcattgggc

SEQ ID NO: 604915 - DNA, 25 bp, Mus musculus
cgagaagactcatcacgcattgggc

SEQ ID NO: 604916 - DNA, 25 bp, Mus musculus
cgagaagccgcaatgaccgagatta

SEQ ID NO: 604917 - DNA, 25 bp, Mus musculus
cgagaagccgcattgaccgagatta

SEQ ID NO: 604918 - DNA, 25 bp, Mus musculus
cgagaagccggaacctgcggccgtc

SEQ ID NO: 604919 - DNA, 25 bp, Mus musculus
cgagaagccggatcctgcggccgtc

SEQ ID NO: 604920 - DNA, 25 bp, Mus musculus
cgagaagcctggagtcagagcagac

SEQ ID NO: 604921 - DNA, 25 bp, Mus musculus
cgagaagcctggtgtcagagcagac

SEQ ID NO: 604922 - DNA, 25 bp, Mus musculus
cgagaagctactacagaggtgcagc

SEQ ID NO: 604923 - DNA, 25 bp, Mus musculus
cgagaagctacttcagaggtgcagc

SEQ ID NO: 604924 - DNA, 25 bp, Mus musculus
cgagaagctgttcccacacttcaca

SEQ ID NO: 604925 - DNA, 25 bp, Mus musculus
cgagaagctgttgccacacttcaca

SEQ ID NO: 604926 - DNA, 25 bp, Mus musculus
cgagaaggaagtcattgatgccctc

SEQ ID NO: 604927 - DNA, 25 bp, Mus musculus
cgagaaggaagtgattgatgccctc

SEQ ID NO: 604928 - DNA, 25 bp, Mus musculus
cgagaaggccagaagctgttgttac

SEQ ID NO: 604929 - DNA, 25 bp, Mus musculus
cgagaaggccagtagctgttgttac

SEQ ID NO: 604930 - DNA, 25 bp, Mus musculus
cgagaagtatttccccggcagctga

SEQ ID NO: 604931 - DNA, 25 bp, Mus musculus
cgagaagtatttgcccggcagctga

SEQ ID NO: 604932 - DNA, 25 bp, Mus musculus
cgagaagtggagcactccaaaaagc

SEQ ID NO: 604933 - DNA, 25 bp, Mus musculus
cgagaagtggaggactccaaaaagc

SEQ ID NO: 604934 - DNA, 25 bp, Mus musculus
cgagaagtgttcagtgcctggtaaa

SEQ ID NO: 604935 - DNA, 25 bp, Mus musculus
cgagaagtgttctgtgcctggtaaa

SEQ ID NO: 604936 - DNA, 25 bp, Mus musculus
cgagaataagaacattgccagcgcc

SEQ ID NO: 604937 - DNA, 25 bp, Mus musculus
cgagaataagaagattgccagcgcc

SEQ ID NO: 604938 - DNA, 25 bp, Mus musculus
cgagaatattggcagctcctccgag

SEQ ID NO: 604939 - DNA, 25 bp, Mus musculus
cgagaatattgggagctcctccgag

SEQ ID NO: 604940 - DNA, 25 bp, Mus musculus
cgagaatgccaaagtccagctgtca

SEQ ID NO: 604941 - DNA, 25 bp, Mus musculus
cgagaatgccaatgtccagctgtca

SEQ ID NO: 604942 - DNA, 25 bp, Mus musculus
cgagacaccatacactacttgctct

SEQ ID NO: 604943 - DNA, 25 bp, Mus musculus
cgagacaccatagactacttgctct

SEQ ID NO: 604944 - DNA, 25 bp, Mus musculus
cgagacatagagagctacgcaatct

SEQ ID NO: 604945 - DNA, 25 bp, Mus musculus
cgagacatagagtgctacgcaatct

SEQ ID NO: 604946 - DNA, 25 bp, Mus musculus
cgagacatcggccaagagaacagag

SEQ ID NO: 604947 - DNA, 25 bp, Mus musculus
cgagacatcggcgaagagaacagag

SEQ ID NO: 604948 - DNA, 25 bp, Mus musculus
cgagaccaagttatctgttaaagat

SEQ ID NO: 604949 - DNA, 25 bp, Mus musculus
cgagaccaagttttctgttaaagat

SEQ ID NO: 604950 - DNA, 25 bp, Mus musculus
cgagaccaccttataccagcgttat

SEQ ID NO: 604951 - DNA, 25 bp, Mus musculus
cgagaccaccttttaccagcgttat

SEQ ID NO: 604952 - DNA, 25 bp, Mus musculus
cgagaccaggtgacagtacgaggcc

SEQ ID NO: 604953 - DNA, 25 bp, Mus musculus
cgagaccaggtgtcagtacgaggcc

SEQ ID NO: 604954 - DNA, 25 bp, Mus musculus
cgagacccagacctaagtgcagtgt

SEQ ID NO: 604955 - DNA, 25 bp, Mus musculus
cgagacccagacgtaagtgcagtgt

SEQ ID NO: 604956 - DNA, 25 bp, Mus musculus
cgagacccagggaattgccgctgtt

SEQ ID NO: 604957 - DNA, 25 bp, Mus musculus
cgagacccagggtattgccgctgtt

SEQ ID NO: 604958 - DNA, 25 bp, Mus musculus
cgagacccattgatggatgtgtatg

SEQ ID NO: 604959 - DNA, 25 bp, Mus musculus
cgagacccattgttggatgtgtatg

SEQ ID NO: 604960 - DNA, 25 bp, Mus musculus
cgagaccccagcctgtgtcgtgtca

SEQ ID NO: 604961 - DNA, 25 bp, Mus musculus
cgagaccccagcgtgtgtcgtgtca

SEQ ID NO: 604962 - DNA, 25 bp, Mus musculus
cgagacctgaacattgagcgaggtg

SEQ ID NO: 604963 - DNA, 25 bp, Mus musculus
cgagacctgaactttgagcgaggtg

SEQ ID NO: 604964 - DNA, 25 bp, Mus musculus
cgagacctttctcagctggaagaga

SEQ ID NO: 604965 - DNA, 25 bp, Mus musculus
cgagacctttctgagctggaagaga

SEQ ID NO: 604966 - DNA, 25 bp, Mus musculus
cgagacgaccctcagcaaaggaaga

SEQ ID NO: 604967 - DNA, 25 bp, Mus musculus
cgagacgaccctgagcaaaggaaga

SEQ ID NO: 604968 - DNA, 25 bp, Mus musculus
cgagacgggaccatcctcatccggg

SEQ ID NO: 604969 - DNA, 25 bp, Mus musculus
cgagacgggaccttcctcatccggg

SEQ ID NO: 604970 - DNA, 25 bp, Mus musculus
cgagacgtccggactggactgagac

SEQ ID NO: 604971 - DNA, 25 bp, Mus musculus
cgagacgtccggtctggactgagac

SEQ ID NO: 604972 - DNA, 25 bp, Mus musculus
cgagacgtgacgaggtccttaccaa

SEQ ID NO: 604973 - DNA, 25 bp, Mus musculus
cgagacgtgacgtggtccttaccaa

SEQ ID NO: 604974 - DNA, 25 bp, Mus musculus
cgagactataagaacccagtggaat

SEQ ID NO: 604975 - DNA, 25 bp, Mus musculus
cgagactataagtacccagtggaat

SEQ ID NO: 604976 - DNA, 25 bp, Mus musculus
cgagactcatccaaggactccaggg

SEQ ID NO: 604977 - DNA, 25 bp, Mus musculus
cgagactcatcctaggactccaggg

SEQ ID NO: 604978 - DNA, 25 bp, Mus musculus
cgagactcatctactgaaaaggatg

SEQ ID NO: 604979 - DNA, 25 bp, Mus musculus
cgagactcatcttctgaaaaggatg

SEQ ID NO: 604980 - DNA, 25 bp, Mus musculus
cgagactccgcacaaagcacatttt

SEQ ID NO: 604981 - DNA, 25 bp, Mus musculus
cgagactccgcagaaagcacatttt

SEQ ID NO: 604982 - DNA, 25 bp, Mus musculus
cgagactcttcccatcataataagt

SEQ ID NO: 604983 - DNA, 25 bp, Mus musculus
cgagactcttccgatcataataagt

SEQ ID NO: 604984 - DNA, 25 bp, Mus musculus
cgagactgcgccatgcaggaagcgc

SEQ ID NO: 604985 - DNA, 25 bp, Mus musculus
cgagactgcgccttgcaggaagcgc

SEQ ID NO: 604986 - DNA, 25 bp, Mus musculus
cgagactgttttacttgcttcctaa

SEQ ID NO: 604987 - DNA, 25 bp, Mus musculus
cgagactgtttttcttgcttcctaa

SEQ ID NO: 604988 - DNA, 25 bp, Mus musculus
cgagacttatgacgcccacatgaga

SEQ ID NO: 604989 - DNA, 25 bp, Mus musculus
cgagacttatgaggcccacatgaga

SEQ ID NO: 604990 - DNA, 25 bp, Mus musculus
cgagagacatccacttctagatgag

SEQ ID NO: 604991 - DNA, 25 bp, Mus musculus
cgagagacatcctcttctagatgag

SEQ ID NO: 604992 - DNA, 25 bp, Mus musculus
cgagagagccaaccaggtcacggct

SEQ ID NO: 604993 - DNA, 25 bp, Mus musculus
cgagagagccaagcaggtcacggct

SEQ ID NO: 604994 - DNA, 25 bp, Mus musculus
cgagagagtagcatcgcacgagcct

SEQ ID NO: 604995 - DNA, 25 bp, Mus musculus
cgagagagtagcttcgcacgagcct

SEQ ID NO: 604996 - DNA, 25 bp, Mus musculus
cgagagcacgtacggcctctaccgg

SEQ ID NO: 604997 - DNA, 25 bp, Mus musculus
cgagagcacgtagggcctctaccgg

SEQ ID NO: 604998 - DNA, 25 bp, Mus musculus
cgagagcagctcactacatcagaaa

SEQ ID NO: 604999 - DNA, 25 bp, Mus musculus
cgagagcagctctctacatcagaaa

SEQ ID NO: 605000 - DNA, 25 bp, Mus musculus
cgagagcagtagctacagccctgct

SEQ ID NO: 605001 - DNA, 25 bp, Mus musculus
cgagagcagtaggtacagccctgct

SEQ ID NO: 605002 - DNA, 25 bp, Mus musculus
cgagagcagttaatacgcaggctct

SEQ ID NO: 605003 - DNA, 25 bp, Mus musculus
cgagagcagttattacgcaggctct

SEQ ID NO: 605004 - DNA, 25 bp, Mus musculus
cgagagcctggaccacaccgagaag

SEQ ID NO: 605005 - DNA, 25 bp, Mus musculus
cgagagcctggagcacaccgagaag

SEQ ID NO: 605006 - DNA, 25 bp, Mus musculus
cgagagcgcaacaacgacaaagtgg

SEQ ID NO: 605007 - DNA, 25 bp, Mus musculus
cgagagcgcaactacgacaaagtgg

SEQ ID NO: 605008 - DNA, 25 bp, Mus musculus
cgagagcgcatgagtagttcaacca

SEQ ID NO: 605009 - DNA, 25 bp, Mus musculus
cgagagcgcatgtgtagttcaacca

SEQ ID NO: 605010 - DNA, 25 bp, Mus musculus
cgagagcgccccagagaagcgcctg

SEQ ID NO: 605011 - DNA, 25 bp, Mus musculus
cgagagcgcccctgagaagcgcctg

SEQ ID NO: 605012 - DNA, 25 bp, Mus musculus
cgagagcgtattcattatccctgga

SEQ ID NO: 605013 - DNA, 25 bp, Mus musculus
cgagagcgtattgattatccctgga

SEQ ID NO: 605014 - DNA, 25 bp, Mus musculus
cgagagcgtgtgatctccgaggacc

SEQ ID NO: 605015 - DNA, 25 bp, Mus musculus
cgagagcgtgtgttctccgaggacc

SEQ ID NO: 605016 - DNA, 25 bp, Mus musculus
cgagaggaacgtctccacgcgccag

SEQ ID NO: 605017 - DNA, 25 bp, Mus musculus
cgagaggaacgtgtccacgcgccag

SEQ ID NO: 605018 - DNA, 25 bp, Mus musculus
cgagaggaccttcctagtagaatac

SEQ ID NO: 605019 - DNA, 25 bp, Mus musculus
cgagaggaccttgctagtagaatac

SEQ ID NO: 605020 - DNA, 25 bp, Mus musculus
cgagaggcctttcgtctgcaactgg

SEQ ID NO: 605021 - DNA, 25 bp, Mus musculus
cgagaggcctttggtctgcaactgg

SEQ ID NO: 605022 - DNA, 25 bp, Mus musculus
cgagagggccctcttctcaagatct

SEQ ID NO: 605023 - DNA, 25 bp, Mus musculus
cgagagggccctgttctcaagatct

SEQ ID NO: 605024 - DNA, 25 bp, Mus musculus
cgagaggttttaaatcattgattgc

SEQ ID NO: 605025 - DNA, 25 bp, Mus musculus
cgagaggttttatatcattgattgc

SEQ ID NO: 605026 - DNA, 25 bp, Mus musculus
cgagagtcaaagaaagtactttcca

SEQ ID NO: 605027 - DNA, 25 bp, Mus musculus
cgagagtcaaagtaagtactttcca

SEQ ID NO: 605028 - DNA, 25 bp, Mus musculus
cgagagtgagacatcctgccccata

SEQ ID NO: 605029 - DNA, 25 bp, Mus musculus
cgagagtgagacttcctgccccata

SEQ ID NO: 605030 - DNA, 25 bp, Mus musculus
cgagagtgctcgagatccagtggaa

SEQ ID NO: 605031 - DNA, 25 bp, Mus musculus
cgagagtgctcgtgatccagtggaa

SEQ ID NO: 605032 - DNA, 25 bp, Mus musculus
cgagagtggtccagatgaaggccct

SEQ ID NO: 605033 - DNA, 25 bp, Mus musculus
cgagagtggtcctgatgaaggccct

SEQ ID NO: 605034 - DNA, 25 bp, Mus musculus
cgagagttcgagaacagcctgagct

SEQ ID NO: 605035 - DNA, 25 bp, Mus musculus
cgagagttcgagtacagcctgagct

SEQ ID NO: 605036 - DNA, 25 bp, Mus musculus
cgagagttgcgtctgctgaagcaca

SEQ ID NO: 605037 - DNA, 25 bp, Mus musculus
cgagagttgcgtgtgctgaagcaca

SEQ ID NO: 605038 - DNA, 25 bp, Mus musculus
cgagagtttgggaatcgatctccca

SEQ ID NO: 605039 - DNA, 25 bp, Mus musculus
cgagagtttgggtatcgatctccca

SEQ ID NO: 605040 - DNA, 25 bp, Mus musculus
cgagatagaccaacaaacagagaaa

SEQ ID NO: 605041 - DNA, 25 bp, Mus musculus
cgagatagaccatcaaacagagaaa

SEQ ID NO: 605042 - DNA, 25 bp, Mus musculus
cgagatatctgtcccaactcaggct

SEQ ID NO: 605043 - DNA, 25 bp, Mus musculus
cgagatatctgtgccaactcaggct

SEQ ID NO: 605044 - DNA, 25 bp, Mus musculus
cgagatcaagatctggaccgtgcca

SEQ ID NO: 605045 - DNA, 25 bp, Mus musculus
cgagatcaagatgtggaccgtgcca

SEQ ID NO: 605046 - DNA, 25 bp, Mus musculus
cgagatcagtctactcacaccagct

SEQ ID NO: 605047 - DNA, 25 bp, Mus musculus
cgagatcagtcttctcacaccagct

SEQ ID NO: 605048 - DNA, 25 bp, Mus musculus
cgagatcattgacggcacgcagaca

SEQ ID NO: 605049 - DNA, 25 bp, Mus musculus
cgagatcattgagggcacgcagaca

SEQ ID NO: 605050 - DNA, 25 bp, Mus musculus
cgagatccctctctcttggatgaca

SEQ ID NO: 605051 - DNA, 25 bp, Mus musculus
cgagatccctctgtcttggatgaca

SEQ ID NO: 605052 - DNA, 25 bp, Mus musculus
cgagatcgagctcaagaaccggcac

SEQ ID NO: 605053 - DNA, 25 bp, Mus musculus
cgagatcgagctgaagaaccggcac

SEQ ID NO: 605054 - DNA, 25 bp, Mus musculus
cgagatctatgccagagcggcgaac

SEQ ID NO: 605055 - DNA, 25 bp, Mus musculus
cgagatctatgcgagagcggcgaac

SEQ ID NO: 605056 - DNA, 25 bp, Mus musculus
cgagatctgattataggcaccctac

SEQ ID NO: 605057 - DNA, 25 bp, Mus musculus
cgagatctgattttaggcaccctac

SEQ ID NO: 605058 - DNA, 25 bp, Mus musculus
cgagatgaaatgctttcctggatgc

SEQ ID NO: 605059 - DNA, 25 bp, Mus musculus
cgagatgaaatggtttcctggatgc

SEQ ID NO: 605060 - DNA, 25 bp, Mus musculus
cgagatgactcaccggctaaaggcg

SEQ ID NO: 605061 - DNA, 25 bp, Mus musculus
cgagatgactcagcggctaaaggcg

SEQ ID NO: 605062 - DNA, 25 bp, Mus musculus
cgagatgagcgcagtgtaaagagca

SEQ ID NO: 605063 - DNA, 25 bp, Mus musculus
cgagatgagcgctgtgtaaagagca

SEQ ID NO: 605064 - DNA, 25 bp, Mus musculus
cgagatgaggagactgttaagacaa

SEQ ID NO: 605065 - DNA, 25 bp, Mus musculus
cgagatgaggagtctgttaagacaa

SEQ ID NO: 605066 - DNA, 25 bp, Mus musculus
cgagatgcctgaccgagcttcctct

SEQ ID NO: 605067 - DNA, 25 bp, Mus musculus
cgagatgcctgagcgagcttcctct

SEQ ID NO: 605068 - DNA, 25 bp, Mus musculus
cgagatgcggcaactactgagacta

SEQ ID NO: 605069 - DNA, 25 bp, Mus musculus
cgagatgcggcatctactgagacta

SEQ ID NO: 605070 - DNA, 25 bp, Mus musculus
cgagatgctgcgcttgttccaggcc

SEQ ID NO: 605071 - DNA, 25 bp, Mus musculus
cgagatgctgcggttgttccaggcc

SEQ ID NO: 605072 - DNA, 25 bp, Mus musculus
cgagatgctgttctcttggtgtttg

SEQ ID NO: 605073 - DNA, 25 bp, Mus musculus
cgagatgctgttgtcttggtgtttg

SEQ ID NO: 605074 - DNA, 25 bp, Mus musculus
cgagatggaataccaggaatgcccg

SEQ ID NO: 605075 - DNA, 25 bp, Mus musculus
cgagatggaatagcaggaatgcccg

SEQ ID NO: 605076 - DNA, 25 bp, Mus musculus
cgagatggacaacttgcccctggaa

SEQ ID NO: 605077 - DNA, 25 bp, Mus musculus
cgagatggacaagttgcccctggaa

SEQ ID NO: 605078 - DNA, 25 bp, Mus musculus
cgagatggacatctgcccagatgag

SEQ ID NO: 605079 - DNA, 25 bp, Mus musculus
cgagatggacatgtgcccagatgag

SEQ ID NO: 605080 - DNA, 25 bp, Mus musculus
cgagatggacctacgaggagaccag

SEQ ID NO: 605081 - DNA, 25 bp, Mus musculus
cgagatggaccttcgaggagaccag

SEQ ID NO: 605082 - DNA, 25 bp, Mus musculus
cgagatggatcacctggacagcaaa

SEQ ID NO: 605083 - DNA, 25 bp, Mus musculus
cgagatggatcagctggacagcaaa

SEQ ID NO: 605084 - DNA, 25 bp, Mus musculus
cgagatggcatcacgtagccggaga

SEQ ID NO: 605085 - DNA, 25 bp, Mus musculus
cgagatggcatctcgtagccggaga

SEQ ID NO: 605086 - DNA, 25 bp, Mus musculus
cgagatggctcaccccatagaggag

SEQ ID NO: 605087 - DNA, 25 bp, Mus musculus
cgagatggctcagcccatagaggag

SEQ ID NO: 605088 - DNA, 25 bp, Mus musculus
cgagatggctcgcagtacctgatcc

SEQ ID NO: 605089 - DNA, 25 bp, Mus musculus
cgagatggctcggagtacctgatcc

SEQ ID NO: 605090 - DNA, 25 bp, Mus musculus
cgagatggtcggcatccagtacttc

SEQ ID NO: 605091 - DNA, 25 bp, Mus musculus
cgagatggtcgggatccagtacttc

SEQ ID NO: 605092 - DNA, 25 bp, Mus musculus
cgagatgtggccaggatcgaaagca

SEQ ID NO: 605093 - DNA, 25 bp, Mus musculus
cgagatgtggcctggatcgaaagca

SEQ ID NO: 605094 - DNA, 25 bp, Mus musculus
cgagattggaaactttgaagttggc

SEQ ID NO: 605095 - DNA, 25 bp, Mus musculus
cgagattggaaagtttgaagttggc

SEQ ID NO: 605096 - DNA, 25 bp, Mus musculus
cgagatttatctcacaaggagaaac

SEQ ID NO: 605097 - DNA, 25 bp, Mus musculus
cgagatttatctgacaaggagaaac

SEQ ID NO: 605098 - DNA, 25 bp, Mus musculus
cgagatttcagacccgcgagatagc

SEQ ID NO: 605099 - DNA, 25 bp, Mus musculus
cgagatttcagagccgcgagatagc

SEQ ID NO: 605100 - DNA, 25 bp, Mus musculus
cgagcaaaactaagtaacttagaga

SEQ ID NO: 605101 - DNA, 25 bp, Mus musculus
cgagcaaaactatgtaacttagaga

SEQ ID NO: 605102 - DNA, 25 bp, Mus musculus
cgagcaactatgaacggctggagtc

SEQ ID NO: 605103 - DNA, 25 bp, Mus musculus
cgagcaactatgtacggctggagtc

SEQ ID NO: 605104 - DNA, 25 bp, Mus musculus
cgagcaactgaacaaccaaattaga

SEQ ID NO: 605105 - DNA, 25 bp, Mus musculus
cgagcaactgaagaaccaaattaga

SEQ ID NO: 605106 - DNA, 25 bp, Mus musculus
cgagcaagaaccagcaggatgacgg

SEQ ID NO: 605107 - DNA, 25 bp, Mus musculus
cgagcaagaacctgcaggatgacgg

SEQ ID NO: 605108 - DNA, 25 bp, Mus musculus
cgagcaagttaacagtcggcagaac

SEQ ID NO: 605109 - DNA, 25 bp, Mus musculus
cgagcaagttaagagtcggcagaac

SEQ ID NO: 605110 - DNA, 25 bp, Mus musculus
cgagcaattcttccagagctaacag

SEQ ID NO: 605111 - DNA, 25 bp, Mus musculus
cgagcaattcttgcagagctaacag

SEQ ID NO: 605112 - DNA, 25 bp, Mus musculus
cgagcacactcgaatcacacagaca

SEQ ID NO: 605113 - DNA, 25 bp, Mus musculus
cgagcacactcgtatcacacagaca

SEQ ID NO: 605114 - DNA, 25 bp, Mus musculus
cgagcaccgcgtaacagttaagtag

SEQ ID NO: 605115 - DNA, 25 bp, Mus musculus
cgagcaccgcgttacagttaagtag

SEQ ID NO: 605116 - DNA, 25 bp, Mus musculus
cgagcacgccataaaatagcagtag

SEQ ID NO: 605117 - DNA, 25 bp, Mus musculus
cgagcacgccattaaatagcagtag

SEQ ID NO: 605118 - DNA, 25 bp, Mus musculus
cgagcacggccaacaagatccagtt

SEQ ID NO: 605119 - DNA, 25 bp, Mus musculus
cgagcacggccatcaagatccagtt

SEQ ID NO: 605120 - DNA, 25 bp, Mus musculus
cgagcacgtgttagagagcgttcag

SEQ ID NO: 605121 - DNA, 25 bp, Mus musculus
cgagcacgtgtttgagagcgttcag

SEQ ID NO: 605122 - DNA, 25 bp, Mus musculus
cgagcactagttccacaagtcgcat

SEQ ID NO: 605123 - DNA, 25 bp, Mus musculus
cgagcactagttgcacaagtcgcat

SEQ ID NO: 605124 - DNA, 25 bp, Mus musculus
cgagcactgaacaacgcgtggtgga

SEQ ID NO: 605125 - DNA, 25 bp, Mus musculus
cgagcactgaactacgcgtggtgga

SEQ ID NO: 605126 - DNA, 25 bp, Mus musculus
cgagcactgtgtcaacacgccaggt

SEQ ID NO: 605127 - DNA, 25 bp, Mus musculus
cgagcactgtgtgaacacgccaggt

SEQ ID NO: 605128 - DNA, 25 bp, Mus musculus
cgagcagacctacctgctcagtaca

SEQ ID NO: 605129 - DNA, 25 bp, Mus musculus
cgagcagacctagctgctcagtaca

SEQ ID NO: 605130 - DNA, 25 bp, Mus musculus
cgagcagataaaagagttaatgagt

SEQ ID NO: 605131 - DNA, 25 bp, Mus musculus
cgagcagataaatgagttaatgagt

SEQ ID NO: 605132 - DNA, 25 bp, Mus musculus
cgagcagattgacaaggccctccaa

SEQ ID NO: 605133 - DNA, 25 bp, Mus musculus
cgagcagattgagaaggccctccaa

SEQ ID NO: 605134 - DNA, 25 bp, Mus musculus
cgagcagcacccagctcagaggaga

SEQ ID NO: 605135 - DNA, 25 bp, Mus musculus
cgagcagcaccctgctcagaggaga

SEQ ID NO: 605136 - DNA, 25 bp, Mus musculus
cgagcagcagggagcacacaaggca

SEQ ID NO: 605137 - DNA, 25 bp, Mus musculus
cgagcagcagggtgcacacaaggca

SEQ ID NO: 605138 - DNA, 25 bp, Mus musculus
cgagcagcccttcaagctgcggctt

SEQ ID NO: 605139 - DNA, 25 bp, Mus musculus
cgagcagcccttgaagctgcggctt

SEQ ID NO: 605140 - DNA, 25 bp, Mus musculus
cgagcagcggagatgcagcgctttt

SEQ ID NO: 605141 - DNA, 25 bp, Mus musculus
cgagcagcggagttgcagcgctttt

SEQ ID NO: 605142 - DNA, 25 bp, Mus musculus
cgagcagcgggaacatggctctaaa

SEQ ID NO: 605143 - DNA, 25 bp, Mus musculus
cgagcagcgggatcatggctctaaa

SEQ ID NO: 605144 - DNA, 25 bp, Mus musculus
cgagcagcgtccatggtacgtgagc

SEQ ID NO: 605145 - DNA, 25 bp, Mus musculus
cgagcagcgtccttggtacgtgagc

SEQ ID NO: 605146 - DNA, 25 bp, Mus musculus
cgagcagctgaaacggctcctggag

SEQ ID NO: 605147 - DNA, 25 bp, Mus musculus
cgagcagctgaatcggctcctggag

SEQ ID NO: 605148 - DNA, 25 bp, Mus musculus
cgagcaggccacagtgctgttgcca

SEQ ID NO: 605149 - DNA, 25 bp, Mus musculus
cgagcaggccactgtgctgttgcca

SEQ ID NO: 605150 - DNA, 25 bp, Mus musculus
cgagcaggttaaatcaggaggtgtc

SEQ ID NO: 605151 - DNA, 25 bp, Mus musculus
cgagcaggttaattcaggaggtgtc

SEQ ID NO: 605152 - DNA, 25 bp, Mus musculus
cgagcagttcttaaacatcggagat

SEQ ID NO: 605153 - DNA, 25 bp, Mus musculus
cgagcagttctttaacatcggagat

SEQ ID NO: 605154 - DNA, 25 bp, Mus musculus
cgagcatctaatcaagacggagaca

SEQ ID NO: 605155 - DNA, 25 bp, Mus musculus
cgagcatctaatgaagacggagaca

SEQ ID NO: 605156 - DNA, 25 bp, Mus musculus
cgagcatgccgcagccctgtgctgg

SEQ ID NO: 605157 - DNA, 25 bp, Mus musculus
cgagcatgccgctgccctgtgctgg

SEQ ID NO: 605158 - DNA, 25 bp, Mus musculus
cgagccagggctaccaggtagacct

SEQ ID NO: 605159 - DNA, 25 bp, Mus musculus
cgagccagggcttccaggtagacct

SEQ ID NO: 605160 - DNA, 25 bp, Mus musculus
cgagccatcagtcaagaccatgagc

SEQ ID NO: 605161 - DNA, 25 bp, Mus musculus
cgagccatcagtgaagaccatgagc

SEQ ID NO: 605162 - DNA, 25 bp, Mus musculus
cgagccatgaagagccaaggataag

SEQ ID NO: 605163 - DNA, 25 bp, Mus musculus
cgagccatgaagtgccaaggataag

SEQ ID NO: 605164 - DNA, 25 bp, Mus musculus
cgagccattgtcctgttcaaccctg

SEQ ID NO: 605165 - DNA, 25 bp, Mus musculus
cgagccattgtcgtgttcaaccctg

SEQ ID NO: 605166 - DNA, 25 bp, Mus musculus
cgagcccacccaaaaggcttggtct

SEQ ID NO: 605167 - DNA, 25 bp, Mus musculus
cgagcccacccataaggcttggtct

SEQ ID NO: 605168 - DNA, 25 bp, Mus musculus
cgagccccgctcagctgagatgctg

SEQ ID NO: 605169 - DNA, 25 bp, Mus musculus
cgagccccgctctgctgagatgctg

SEQ ID NO: 605170 - DNA, 25 bp, Mus musculus
cgagcccgttacagccttacaagct

SEQ ID NO: 605171 - DNA, 25 bp, Mus musculus
cgagcccgttactgccttacaagct

SEQ ID NO: 605172 - DNA, 25 bp, Mus musculus
cgagccgcacatacgcatggtggac

SEQ ID NO: 605173 - DNA, 25 bp, Mus musculus
cgagccgcacattcgcatggtggac

SEQ ID NO: 605174 - DNA, 25 bp, Mus musculus
cgagccggtcatctgcgtgttctta

SEQ ID NO: 605175 - DNA, 25 bp, Mus musculus
cgagccggtcatgtgcgtgttctta

SEQ ID NO: 605176 - DNA, 25 bp, Mus musculus
cgagcctaaaggaagattttacgag

SEQ ID NO: 605177 - DNA, 25 bp, Mus musculus
cgagcctaaaggtagattttacgag

SEQ ID NO: 605178 - DNA, 25 bp, Mus musculus
cgagcctcctgaaccacttcataaa

SEQ ID NO: 605179 - DNA, 25 bp, Mus musculus
cgagcctcctgatccacttcataaa

SEQ ID NO: 605180 - DNA, 25 bp, Mus musculus
cgagcctctcgtacccagcgtgcag

SEQ ID NO: 605181 - DNA, 25 bp, Mus musculus
cgagcctctcgttcccagcgtgcag

SEQ ID NO: 605182 - DNA, 25 bp, Mus musculus
cgagcctgaagtcgtcgctgtgcac

SEQ ID NO: 605183 - DNA, 25 bp, Mus musculus
cgagcctgaagtggtcgctgtgcac

SEQ ID NO: 605184 - DNA, 25 bp, Mus musculus
cgagcctgccgcaggtaaagagaca

SEQ ID NO: 605185 - DNA, 25 bp, Mus musculus
cgagcctgccgctggtaaagagaca

SEQ ID NO: 605186 - DNA, 25 bp, Mus musculus
cgagccttatttcgagattttggaa

SEQ ID NO: 605187 - DNA, 25 bp, Mus musculus
cgagccttatttggagattttggaa

SEQ ID NO: 605188 - DNA, 25 bp, Mus musculus
cgagcgaaagcgaaagcgcctgcgt

SEQ ID NO: 605189 - DNA, 25 bp, Mus musculus
cgagcgaaagcgtaagcgcctgcgt

SEQ ID NO: 605190 - DNA, 25 bp, Mus musculus
cgagcgacataacccagagcatcgt

SEQ ID NO: 605191 - DNA, 25 bp, Mus musculus
cgagcgacataagccagagcatcgt

SEQ ID NO: 605192 - DNA, 25 bp, Mus musculus
cgagcgagagaactggatccatgcc

SEQ ID NO: 605193 - DNA, 25 bp, Mus musculus
cgagcgagagaagtggatccatgcc

SEQ ID NO: 605194 - DNA, 25 bp, Mus musculus
cgagcgcctcgtagatatcatttgt

SEQ ID NO: 605195 - DNA, 25 bp, Mus musculus
cgagcgcctcgttgatatcatttgt

SEQ ID NO: 605196 - DNA, 25 bp, Mus musculus
cgagcgctacgaagccatgagcaga

SEQ ID NO: 605197 - DNA, 25 bp, Mus musculus
cgagcgctacgatgccatgagcaga

SEQ ID NO: 605198 - DNA, 25 bp, Mus musculus
cgagcgctctaaaatgatcgacaag

SEQ ID NO: 605199 - DNA, 25 bp, Mus musculus
cgagcgctctaatatgatcgacaag

SEQ ID NO: 605200 - DNA, 25 bp, Mus musculus
cgagcgcttaagcatttctggaacc

SEQ ID NO: 605201 - DNA, 25 bp, Mus musculus
cgagcgcttaaggatttctggaacc

SEQ ID NO: 605202 - DNA, 25 bp, Mus musculus
cgagcgcttgaaacattggtatgag

SEQ ID NO: 605203 - DNA, 25 bp, Mus musculus
cgagcgcttgaatcattggtatgag

SEQ ID NO: 605204 - DNA, 25 bp, Mus musculus
cgagcggcagccatgataaatttaa

SEQ ID NO: 605205 - DNA, 25 bp, Mus musculus
cgagcggcagccttgataaatttaa

SEQ ID NO: 605206 - DNA, 25 bp, Mus musculus
cgagcgtcctttcttggtgacagga

SEQ ID NO: 605207 - DNA, 25 bp, Mus musculus
cgagcgtcctttgttggtgacagga

SEQ ID NO: 605208 - DNA, 25 bp, Mus musculus
cgagcgttctctctactccgagtga

SEQ ID NO: 605209 - DNA, 25 bp, Mus musculus
cgagcgttctctgtactccgagtga

SEQ ID NO: 605210 - DNA, 25 bp, Mus musculus
cgagctaatctgctgggcgcaagct

SEQ ID NO: 605211 - DNA, 25 bp, Mus musculus
cgagctaatctggtgggcgcaagct

SEQ ID NO: 605212 - DNA, 25 bp, Mus musculus
cgagctaccttcaacctgaatgtgc

SEQ ID NO: 605213 - DNA, 25 bp, Mus musculus
cgagctaccttctacctgaatgtgc

SEQ ID NO: 605214 - DNA, 25 bp, Mus musculus
cgagctactcgccaagaagatttct

SEQ ID NO: 605215 - DNA, 25 bp, Mus musculus
cgagctactcgcgaagaagatttct

SEQ ID NO: 605216 - DNA, 25 bp, Mus musculus
cgagctagcctcatactgcatagta

SEQ ID NO: 605217 - DNA, 25 bp, Mus musculus
cgagctagcctcttactgcatagta

SEQ ID NO: 605218 - DNA, 25 bp, Mus musculus
cgagctcacatcataggctacttgg

SEQ ID NO: 605219 - DNA, 25 bp, Mus musculus
cgagctcacatcttaggctacttgg

SEQ ID NO: 605220 - DNA, 25 bp, Mus musculus
cgagctcacccgctctctagaggga

SEQ ID NO: 605221 - DNA, 25 bp, Mus musculus
cgagctcacccggtctctagaggga

SEQ ID NO: 605222 - DNA, 25 bp, Mus musculus
cgagctcataaccttccagtactgg

SEQ ID NO: 605223 - DNA, 25 bp, Mus musculus
cgagctcataacgttccagtactgg

SEQ ID NO: 605224 - DNA, 25 bp, Mus musculus
cgagctccaggacaccagtttgaca

SEQ ID NO: 605225 - DNA, 25 bp, Mus musculus
cgagctccaggagaccagtttgaca

SEQ ID NO: 605226 - DNA, 25 bp, Mus musculus
cgagctcctgagcatagtctgtcag

SEQ ID NO: 605227 - DNA, 25 bp, Mus musculus
cgagctcctgaggatagtctgtcag

SEQ ID NO: 605228 - DNA, 25 bp, Mus musculus
cgagctcctgttattccggaacact

SEQ ID NO: 605229 - DNA, 25 bp, Mus musculus
cgagctcctgtttttccggaacact

SEQ ID NO: 605230 - DNA, 25 bp, Mus musculus
cgagctcggctcaccacgtggactg

SEQ ID NO: 605231 - DNA, 25 bp, Mus musculus
cgagctcggctctccacgtggactg

SEQ ID NO: 605232 - DNA, 25 bp, Mus musculus
cgagctctccagaggcgggaccgca

SEQ ID NO: 605233 - DNA, 25 bp, Mus musculus
cgagctctccagtggcgggaccgca

SEQ ID NO: 605234 - DNA, 25 bp, Mus musculus
cgagctctgtcaagtgacccagtga

SEQ ID NO: 605235 - DNA, 25 bp, Mus musculus
cgagctctgtcatgtgacccagtga

SEQ ID NO: 605236 - DNA, 25 bp, Mus musculus
cgagctctgtgaagtgaaccggaag

SEQ ID NO: 605237 - DNA, 25 bp, Mus musculus
cgagctctgtgatgtgaaccggaag

SEQ ID NO: 605238 - DNA, 25 bp, Mus musculus
cgagctgaccagagatccggagact

SEQ ID NO: 605239 - DNA, 25 bp, Mus musculus
cgagctgaccagatccctcttcagg

SEQ ID NO: 605240 - DNA, 25 bp, Mus musculus
cgagctgaccagtgatccggagact

SEQ ID NO: 605241 - DNA, 25 bp, Mus musculus
cgagctgaccagttccctcttcagg

SEQ ID NO: 605242 - DNA, 25 bp, Mus musculus
cgagctgatcaaagagagcgaagtc

SEQ ID NO: 605243 - DNA, 25 bp, Mus musculus
cgagctgatcaatgagagcgaagtc

SEQ ID NO: 605244 - DNA, 25 bp, Mus musculus
cgagctgatcctcatggaggagatc

SEQ ID NO: 605245 - DNA, 25 bp, Mus musculus
cgagctgatcctgatggaggagatc

SEQ ID NO: 605246 - DNA, 25 bp, Mus musculus
cgagctgcaggaaatgatcaacgaa

SEQ ID NO: 605247 - DNA, 25 bp, Mus musculus
cgagctgcaggatatgatcaacgaa

SEQ ID NO: 605248 - DNA, 25 bp, Mus musculus
cgagctgcttctccagttgaagagc

SEQ ID NO: 605249 - DNA, 25 bp, Mus musculus
cgagctgcttctgcagttgaagagc

SEQ ID NO: 605250 - DNA, 25 bp, Mus musculus
cgagctggaagacatatttttgcac

SEQ ID NO: 605251 - DNA, 25 bp, Mus musculus
cgagctggaagagatatttttgcac

SEQ ID NO: 605252 - DNA, 25 bp, Mus musculus
cgagctggacaacttggaagagatt

SEQ ID NO: 605253 - DNA, 25 bp, Mus musculus
cgagctggacaagttggaagagatt

SEQ ID NO: 605254 - DNA, 25 bp, Mus musculus
cgagctggccccaatatctatgagc

SEQ ID NO: 605255 - DNA, 25 bp, Mus musculus
cgagctggcccctatatctatgagc

SEQ ID NO: 605256 - DNA, 25 bp, Mus musculus
cgagctgggactaaggccgtttcct

SEQ ID NO: 605257 - DNA, 25 bp, Mus musculus
cgagctgggacttaggccgtttcct

SEQ ID NO: 605258 - DNA, 25 bp, Mus musculus
cgagctgggagaagcaactgccatt

SEQ ID NO: 605259 - DNA, 25 bp, Mus musculus
cgagctgggagatgcaactgccatt

SEQ ID NO: 605260 - DNA, 25 bp, Mus musculus
cgagctgggctacatgtatttccgt

SEQ ID NO: 605261 - DNA, 25 bp, Mus musculus
cgagctgggctagatgtatttccgt

SEQ ID NO: 605262 - DNA, 25 bp, Mus musculus
cgagctggtgcaaccatcagtacac

SEQ ID NO: 605263 - DNA, 25 bp, Mus musculus
cgagctggtgcatccatcagtacac

SEQ ID NO: 605264 - DNA, 25 bp, Mus musculus
cgagctgtcaagaagcatgccaaag

SEQ ID NO: 605265 - DNA, 25 bp, Mus musculus
cgagctgtcaagtagcatgccaaag

SEQ ID NO: 605266 - DNA, 25 bp, Mus musculus
cgagcttcaagacgctctacgggaa

SEQ ID NO: 605267 - DNA, 25 bp, Mus musculus
cgagcttcaagaggctctacgggaa

SEQ ID NO: 605268 - DNA, 25 bp, Mus musculus
cgagcttctagacttatgctggaga

SEQ ID NO: 605269 - DNA, 25 bp, Mus musculus
cgagcttctagagttatgctggaga

SEQ ID NO: 605270 - DNA, 25 bp, Mus musculus
cgagcttggagacttaaatgaaatc

SEQ ID NO: 605271 - DNA, 25 bp, Mus musculus
cgagcttggagagttaaatgaaatc

SEQ ID NO: 605272 - DNA, 25 bp, Mus musculus
cgagctttgtctccgaaccgagcgt

SEQ ID NO: 605273 - DNA, 25 bp, Mus musculus
cgagctttgtctgcgaaccgagcgt

SEQ ID NO: 605274 - DNA, 25 bp, Mus musculus
cgaggaaataccaacgccgagaatc

SEQ ID NO: 605275 - DNA, 25 bp, Mus musculus
cgaggaaatacctacgccgagaatc

SEQ ID NO: 605276 - DNA, 25 bp, Mus musculus
cgaggaacacttcctgccgagaaca

SEQ ID NO: 605277 - DNA, 25 bp, Mus musculus
cgaggaacacttgctgccgagaaca

SEQ ID NO: 605278 - DNA, 25 bp, Mus musculus
cgaggaacgcttcaaagaaatggag

SEQ ID NO: 605279 - DNA, 25 bp, Mus musculus
cgaggaacgcttgaaagaaatggag

SEQ ID NO: 605280 - DNA, 25 bp, Mus musculus
cgaggaagaaatatttgcacctgaa

SEQ ID NO: 605281 - DNA, 25 bp, Mus musculus
cgaggaagaaatttttgcacctgaa

SEQ ID NO: 605282 - DNA, 25 bp, Mus musculus
cgaggaagagaacattgacgccatt

SEQ ID NO: 605283 - DNA, 25 bp, Mus musculus
cgaggaagagaagattgacgccatt

SEQ ID NO: 605284 - DNA, 25 bp, Mus musculus
cgaggaagctcacggtcacagagac

SEQ ID NO: 605285 - DNA, 25 bp, Mus musculus
cgaggaagctcagggtcacagagac

SEQ ID NO: 605286 - DNA, 25 bp, Mus musculus
cgaggaattcctagaaagcaataaa

SEQ ID NO: 605287 - DNA, 25 bp, Mus musculus
cgaggaattccttgaaagcaataaa

SEQ ID NO: 605288 - DNA, 25 bp, Mus musculus
cgaggacaatggagctcaagtccac

SEQ ID NO: 605289 - DNA, 25 bp, Mus musculus
cgaggacaatggtgctcaagtccac

SEQ ID NO: 605290 - DNA, 25 bp, Mus musculus
cgaggacatgggattagtgcccact

SEQ ID NO: 605291 - DNA, 25 bp, Mus musculus
cgaggacatgggtttagtgcccact

SEQ ID NO: 605292 - DNA, 25 bp, Mus musculus
cgaggaccgagaaaaggagattctc

SEQ ID NO: 605293 - DNA, 25 bp, Mus musculus
cgaggaccgagataaggagattctc

SEQ ID NO: 605294 - DNA, 25 bp, Mus musculus
cgaggacctcataggcaagcctggg

SEQ ID NO: 605295 - DNA, 25 bp, Mus musculus
cgaggacctcattggcaagcctggg

SEQ ID NO: 605296 - DNA, 25 bp, Mus musculus
cgaggaccttaactcgattgggagc

SEQ ID NO: 605297 - DNA, 25 bp, Mus musculus
cgaggaccttaagtcgattgggagc

SEQ ID NO: 605298 - DNA, 25 bp, Mus musculus
cgaggacgatgacgtccagctctcc

SEQ ID NO: 605299 - DNA, 25 bp, Mus musculus
cgaggacgatgaggtccagctctcc

SEQ ID NO: 605300 - DNA, 25 bp, Mus musculus
cgaggacgcagcagaagagttccat

SEQ ID NO: 605301 - DNA, 25 bp, Mus musculus
cgaggacgcagctgaagagttccat

SEQ ID NO: 605302 - DNA, 25 bp, Mus musculus
cgaggacgccatccagttcatccga

SEQ ID NO: 605303 - DNA, 25 bp, Mus musculus
cgaggacgccatgcagttcatccga

SEQ ID NO: 605304 - DNA, 25 bp, Mus musculus
cgaggacttcctaagtagcttccag

SEQ ID NO: 605305 - DNA, 25 bp, Mus musculus
cgaggacttccttagtagcttccag

SEQ ID NO: 605306 - DNA, 25 bp, Mus musculus
cgaggagaagggaccacagtttgac

SEQ ID NO: 605307 - DNA, 25 bp, Mus musculus
cgaggagaagggtccacagtttgac

SEQ ID NO: 605308 - DNA, 25 bp, Mus musculus
cgaggagaagtactgactctttata

SEQ ID NO: 605309 - DNA, 25 bp, Mus musculus
cgaggagaagtagtgactctttata

SEQ ID NO: 605310 - DNA, 25 bp, Mus musculus
cgaggagacataaagtgtctgtcca

SEQ ID NO: 605311 - DNA, 25 bp, Mus musculus
cgaggagacatatagtgtctgtcca

SEQ ID NO: 605312 - DNA, 25 bp, Mus musculus
cgaggagcacggctcctacctgcat

SEQ ID NO: 605313 - DNA, 25 bp, Mus musculus
cgaggagcacgggtcctacctgcat

SEQ ID NO: 605314 - DNA, 25 bp, Mus musculus
cgaggagcatccattgcacattgtc

SEQ ID NO: 605315 - DNA, 25 bp, Mus musculus
cgaggagcatcctttgcacattgtc

SEQ ID NO: 605316 - DNA, 25 bp, Mus musculus
cgaggagccttacatgcctgtctgt

SEQ ID NO: 605317 - DNA, 25 bp, Mus musculus
cgaggagccttagatgcctgtctgt

SEQ ID NO: 605318 - DNA, 25 bp, Mus musculus
cgaggaggacgcaaagaaatatttc

SEQ ID NO: 605319 - DNA, 25 bp, Mus musculus
cgaggaggacgctaagaaatatttc

SEQ ID NO: 605320 - DNA, 25 bp, Mus musculus
cgaggaggctccctgctgagaaact

SEQ ID NO: 605321 - DNA, 25 bp, Mus musculus
cgaggaggctccgtgctgagaaact

SEQ ID NO: 605322 - DNA, 25 bp, Mus musculus
cgaggaggcttcaccagtccctcag

SEQ ID NO: 605323 - DNA, 25 bp, Mus musculus
cgaggaggcttctccagtccctcag

SEQ ID NO: 605324 - DNA, 25 bp, Mus musculus
cgaggaggcttgaatgggccctcat

SEQ ID NO: 605325 - DNA, 25 bp, Mus musculus
cgaggaggcttgtatgggccctcat

SEQ ID NO: 605326 - DNA, 25 bp, Mus musculus
cgaggagtcacccagcactatggga

SEQ ID NO: 605327 - DNA, 25 bp, Mus musculus
cgaggagtcaccgagcactatggga

SEQ ID NO: 605328 - DNA, 25 bp, Mus musculus
cgaggagtgcccacggtggtcataa

SEQ ID NO: 605329 - DNA, 25 bp, Mus musculus
cgaggagtgccctcggtggtcataa

SEQ ID NO: 605330 - DNA, 25 bp, Mus musculus
cgaggatatgatcggaaaattgctg

SEQ ID NO: 605331 - DNA, 25 bp, Mus musculus
cgaggatatgatgggaaaattgctg

SEQ ID NO: 605332 - DNA, 25 bp, Mus musculus
cgaggcaactgtccccaaaatcaca

SEQ ID NO: 605333 - DNA, 25 bp, Mus musculus
cgaggcaactgtgcccaaaatcaca

SEQ ID NO: 605334 - DNA, 25 bp, Mus musculus
cgaggcaagcgccagggcttctttc

SEQ ID NO: 605335 - DNA, 25 bp, Mus musculus
cgaggcaagcgcgagggcttctttc

SEQ ID NO: 605336 - DNA, 25 bp, Mus musculus
cgaggcaagctgaaaagctcgaaga

SEQ ID NO: 605337 - DNA, 25 bp, Mus musculus
cgaggcaagctgtaaagctcgaaga

SEQ ID NO: 605338 - DNA, 25 bp, Mus musculus
cgaggcagaaagagccacgactcca

SEQ ID NO: 605339 - DNA, 25 bp, Mus musculus
cgaggcagaaagtgccacgactcca

SEQ ID NO: 605340 - DNA, 25 bp, Mus musculus
cgaggcagcggcaccttcgagcgtc

SEQ ID NO: 605341 - DNA, 25 bp, Mus musculus
cgaggcagcggctccttcgagcgtc

SEQ ID NO: 605342 - DNA, 25 bp, Mus musculus
cgaggcaggacgagcagctacagaa

SEQ ID NO: 605343 - DNA, 25 bp, Mus musculus
cgaggcaggacgtgcagctacagaa

SEQ ID NO: 605344 - DNA, 25 bp, Mus musculus
cgaggcatagatataaggactgttt

SEQ ID NO: 605345 - DNA, 25 bp, Mus musculus
cgaggcatagatttaaggactgttt

SEQ ID NO: 605346 - DNA, 25 bp, Mus musculus
cgaggccagcgaactcttcaaagac

SEQ ID NO: 605347 - DNA, 25 bp, Mus musculus
cgaggccagcgatctcttcaaagac

SEQ ID NO: 605348 - DNA, 25 bp, Mus musculus
cgaggcccagcgcttcatcaatgct

SEQ ID NO: 605349 - DNA, 25 bp, Mus musculus
cgaggcccagcggttcatcaatgct

SEQ ID NO: 605350 - DNA, 25 bp, Mus musculus
cgaggccccgttagaaaggcctgtg

SEQ ID NO: 605351 - DNA, 25 bp, Mus musculus
cgaggccccgtttgaaaggcctgtg

SEQ ID NO: 605352 - DNA, 25 bp, Mus musculus
cgaggcccgctaattgttaccagct

SEQ ID NO: 605353 - DNA, 25 bp, Mus musculus
cgaggcccgctatttgttaccagct

SEQ ID NO: 605354 - DNA, 25 bp, Mus musculus
cgaggccgttcacctgcacacagtg

SEQ ID NO: 605355 - DNA, 25 bp, Mus musculus
cgaggccgttcagctgcacacagtg

SEQ ID NO: 605356 - DNA, 25 bp, Mus musculus
cgaggcggccgcactgttgaacaac

SEQ ID NO: 605357 - DNA, 25 bp, Mus musculus
cgaggcggccgctctgttgaacaac

SEQ ID NO: 605358 - DNA, 25 bp, Mus musculus
cgaggcggcctgaagtgtgggagca

SEQ ID NO: 605359 - DNA, 25 bp, Mus musculus
cgaggcggcctgtagtgtgggagca

SEQ ID NO: 605360 - DNA, 25 bp, Mus musculus
cgaggcggctgcagcatccctgtgt

SEQ ID NO: 605361 - DNA, 25 bp, Mus musculus
cgaggcggctgctgcatccctgtgt

SEQ ID NO: 605362 - DNA, 25 bp, Mus musculus
cgaggcggtaaaccgcaagatccag

SEQ ID NO: 605363 - DNA, 25 bp, Mus musculus
cgaggcggtaaagcgcaagatccag

SEQ ID NO: 605364 - DNA, 25 bp, Mus musculus
cgaggcgtttctcactcatgacgct

SEQ ID NO: 605365 - DNA, 25 bp, Mus musculus
cgaggcgtttctgactcatgacgct

SEQ ID NO: 605366 - DNA, 25 bp, Mus musculus
cgaggctaatccattgaggaaactt

SEQ ID NO: 605367 - DNA, 25 bp, Mus musculus
cgaggctaatcctttgaggaaactt

SEQ ID NO: 605368 - DNA, 25 bp, Mus musculus
cgaggctacacactctacgggacaa

SEQ ID NO: 605369 - DNA, 25 bp, Mus musculus
cgaggctacacagtctacgggacaa

SEQ ID NO: 605370 - DNA, 25 bp, Mus musculus
cgaggctaggaaaaagcacgctatt

SEQ ID NO: 605371 - DNA, 25 bp, Mus musculus
cgaggctaggaataagcacgctatt

SEQ ID NO: 605372 - DNA, 25 bp, Mus musculus
cgaggctcagcgatctgaattgcgg

SEQ ID NO: 605373 - DNA, 25 bp, Mus musculus
cgaggctcagcgttctgaattgcgg

SEQ ID NO: 605374 - DNA, 25 bp, Mus musculus
cgaggctgttcactgtccggacata

SEQ ID NO: 605375 - DNA, 25 bp, Mus musculus
cgaggctgttcagtgtccggacata

SEQ ID NO: 605376 - DNA, 25 bp, Mus musculus
cgaggcttgctgagaactgactcta

SEQ ID NO: 605377 - DNA, 25 bp, Mus musculus
cgaggcttgctgtgaactgactcta

SEQ ID NO: 605378 - DNA, 25 bp, Mus musculus
cgaggctttgggatcagcctccgcg

SEQ ID NO: 605379 - DNA, 25 bp, Mus musculus
cgaggctttgggttcagcctccgcg

SEQ ID NO: 605380 - DNA, 25 bp, Mus musculus
cgagggacgaatctcagggtacacc

SEQ ID NO: 605381 - DNA, 25 bp, Mus musculus
cgagggacgaatgtcagggtacacc

SEQ ID NO: 605382 - DNA, 25 bp, Mus musculus
cgagggactcggattattgctggac

SEQ ID NO: 605383 - DNA, 25 bp, Mus musculus
cgagggactcggtttattgctggac

SEQ ID NO: 605384 - DNA, 25 bp, Mus musculus
cgagggagaaccacacttgggagcc

SEQ ID NO: 605385 - DNA, 25 bp, Mus musculus
cgagggagaacctcacttgggagcc

SEQ ID NO: 605386 - DNA, 25 bp, Mus musculus
cgagggagttcgagagaaggagaac

SEQ ID NO: 605387 - DNA, 25 bp, Mus musculus
cgagggagttcgtgagaaggagaac

SEQ ID NO: 605388 - DNA, 25 bp, Mus musculus
cgagggatgcggagagaccatatat

SEQ ID NO: 605389 - DNA, 25 bp, Mus musculus
cgagggatgcggtgagaccatatat

SEQ ID NO: 605390 - DNA, 25 bp, Mus musculus
cgagggatttgaccatctttcctgc

SEQ ID NO: 605391 - DNA, 25 bp, Mus musculus
cgagggatttgagcatctttcctgc

SEQ ID NO: 605392 - DNA, 25 bp, Mus musculus
cgagggcaaccactagaagcgttga

SEQ ID NO: 605393 - DNA, 25 bp, Mus musculus
cgagggcaaccagtagaagcgttga

SEQ ID NO: 605394 - DNA, 25 bp, Mus musculus
cgagggcaccatattctgagggagt

SEQ ID NO: 605395 - DNA, 25 bp, Mus musculus
cgagggcaccattttctgagggagt

SEQ ID NO: 605396 - DNA, 25 bp, Mus musculus
cgagggcatagactctgcaggacct

SEQ ID NO: 605397 - DNA, 25 bp, Mus musculus
cgagggcatagagtctgcaggacct

SEQ ID NO: 605398 - DNA, 25 bp, Mus musculus
cgagggcatccccatctcggtagag

SEQ ID NO: 605399 - DNA, 25 bp, Mus musculus
cgagggcatcccgatctcggtagag

SEQ ID NO: 605400 - DNA, 25 bp, Mus musculus
cgagggcgcactcgacactgtgaca

SEQ ID NO: 605401 - DNA, 25 bp, Mus musculus
cgagggcgcactggacactgtgaca

SEQ ID NO: 605402 - DNA, 25 bp, Mus musculus
cgagggctcagaatctaccaacagg

SEQ ID NO: 605403 - DNA, 25 bp, Mus musculus
cgagggctcagattctaccaacagg

SEQ ID NO: 605404 - DNA, 25 bp, Mus musculus
cgagggctggagcatctctttttac

SEQ ID NO: 605405 - DNA, 25 bp, Mus musculus
cgagggctggaggatctctttttac

SEQ ID NO: 605406 - DNA, 25 bp, Mus musculus
cgagggcttgctcgccatctttaag

SEQ ID NO: 605407 - DNA, 25 bp, Mus musculus
cgagggcttgctggccatctttaag

SEQ ID NO: 605408 - DNA, 25 bp, Mus musculus
cgagggtcaattacttagggcgaca

SEQ ID NO: 605409 - DNA, 25 bp, Mus musculus
cgagggtcaatttcttagggcgaca

SEQ ID NO: 605410 - DNA, 25 bp, Mus musculus
cgagggtgagccagtatgtaatgcc

SEQ ID NO: 605411 - DNA, 25 bp, Mus musculus
cgagggtgagcctgtatgtaatgcc

SEQ ID NO: 605412 - DNA, 25 bp, Mus musculus
cgaggtagtgagatcaaccgcatct

SEQ ID NO: 605413 - DNA, 25 bp, Mus musculus
cgaggtagtgagttcaaccgcatct

SEQ ID NO: 605414 - DNA, 25 bp, Mus musculus
cgaggtcatgatcgtatgagccaac

SEQ ID NO: 605415 - DNA, 25 bp, Mus musculus
cgaggtcatgatggtatgagccaac

SEQ ID NO: 605416 - DNA, 25 bp, Mus musculus
cgaggtctctataaacaaggacaac

SEQ ID NO: 605417 - DNA, 25 bp, Mus musculus
cgaggtctctattaacaaggacaac

SEQ ID NO: 605418 - DNA, 25 bp, Mus musculus
cgaggtcttgccctgagcccttgtg

SEQ ID NO: 605419 - DNA, 25 bp, Mus musculus
cgaggtcttgccgtgagcccttgtg

SEQ ID NO: 605420 - DNA, 25 bp, Mus musculus
cgaggtgacagtctttgaccccaac

SEQ ID NO: 605421 - DNA, 25 bp, Mus musculus
cgaggtgacagtgtttgaccccaac

SEQ ID NO: 605422 - DNA, 25 bp, Mus musculus
cgaggtgagctaagaggtcatcgca

SEQ ID NO: 605423 - DNA, 25 bp, Mus musculus
cgaggtgagctatgaggtcatcgca

SEQ ID NO: 605424 - DNA, 25 bp, Mus musculus
cgaggtggcagcattttgtcaatcc

SEQ ID NO: 605425 - DNA, 25 bp, Mus musculus
cgaggtggcagctttttgtcaatcc

SEQ ID NO: 605426 - DNA, 25 bp, Mus musculus
cgaggtggcctgaccttcccggagc

SEQ ID NO: 605427 - DNA, 25 bp, Mus musculus
cgaggtggcctgtccttcccggagc

SEQ ID NO: 605428 - DNA, 25 bp, Mus musculus
cgaggtggttgccaaagagaaacaa

SEQ ID NO: 605429 - DNA, 25 bp, Mus musculus
cgaggtggttgcgaaagagaaacaa

SEQ ID NO: 605430 - DNA, 25 bp, Mus musculus
cgaggtgtcgaacatgccatggcca

SEQ ID NO: 605431 - DNA, 25 bp, Mus musculus
cgaggtgtcgaagatgccatggcca

SEQ ID NO: 605432 - DNA, 25 bp, Mus musculus
cgaggttgacaacccagcccagggc

SEQ ID NO: 605433 - DNA, 25 bp, Mus musculus
cgaggttgacaagccagcccagggc

SEQ ID NO: 605434 - DNA, 25 bp, Mus musculus
cgaggttgactacgcgattctgtct

SEQ ID NO: 605435 - DNA, 25 bp, Mus musculus
cgaggttgactaggcgattctgtct

SEQ ID NO: 605436 - DNA, 25 bp, Mus musculus
cgaggtttgcaaagactgacttcaa

SEQ ID NO: 605437 - DNA, 25 bp, Mus musculus
cgaggtttgcaatgactgacttcaa

SEQ ID NO: 605438 - DNA, 25 bp, Mus musculus
cgagtaacagctatgaaattgcatt

SEQ ID NO: 605439 - DNA, 25 bp, Mus musculus
cgagtaacagctttgaaattgcatt

SEQ ID NO: 605440 - DNA, 25 bp, Mus musculus
cgagtaatagtacaattcagaggtg

SEQ ID NO: 605441 - DNA, 25 bp, Mus musculus
cgagtaatagtagaattcagaggtg

SEQ ID NO: 605442 - DNA, 25 bp, Mus musculus
cgagtacaatggacagcagccagtg

SEQ ID NO: 605443 - DNA, 25 bp, Mus musculus
cgagtacaatggtcagcagccagtg

SEQ ID NO: 605444 - DNA, 25 bp, Mus musculus
cgagtacacagaccccaaggtggtg

SEQ ID NO: 605445 - DNA, 25 bp, Mus musculus
cgagtacacagagcccaaggtggtg

SEQ ID NO: 605446 - DNA, 25 bp, Mus musculus
cgagtacagtctacctggactacat

SEQ ID NO: 605447 - DNA, 25 bp, Mus musculus
cgagtacagtcttcctggactacat

SEQ ID NO: 605448 - DNA, 25 bp, Mus musculus
cgagtacattttagaacgggaatct

SEQ ID NO: 605449 - DNA, 25 bp, Mus musculus
cgagtacatttttgaacgggaatct

SEQ ID NO: 605450 - DNA, 25 bp, Mus musculus
cgagtacggcttagtgagcagcaag

SEQ ID NO: 605451 - DNA, 25 bp, Mus musculus
cgagtacggctttgtgagcagcaag

SEQ ID NO: 605452 - DNA, 25 bp, Mus musculus
cgagtactacctccccgcgaatgat

SEQ ID NO: 605453 - DNA, 25 bp, Mus musculus
cgagtactacctgcccgcgaatgat

SEQ ID NO: 605454 - DNA, 25 bp, Mus musculus
cgagtactgcatcgcccgcatggca

SEQ ID NO: 605455 - DNA, 25 bp, Mus musculus
cgagtactgcatggcccgcatggca

SEQ ID NO: 605456 - DNA, 25 bp, Mus musculus
cgagtagcgtttacgtgagtggctt

SEQ ID NO: 605457 - DNA, 25 bp, Mus musculus
cgagtagcgttttcgtgagtggctt

SEQ ID NO: 605458 - DNA, 25 bp, Mus musculus
cgagtagctatgaggaaaaaagtgc

SEQ ID NO: 605459 - DNA, 25 bp, Mus musculus
cgagtagctatgtggaaaaaagtgc

SEQ ID NO: 605460 - DNA, 25 bp, Mus musculus
cgagtaggaccgagctgctgcagac

SEQ ID NO: 605461 - DNA, 25 bp, Mus musculus
cgagtaggaccgtgctgctgcagac

SEQ ID NO: 605462 - DNA, 25 bp, Mus musculus
cgagtagtgaggatacttgggaaca

SEQ ID NO: 605463 - DNA, 25 bp, Mus musculus
cgagtagtgaggttacttgggaaca

SEQ ID NO: 605464 - DNA, 25 bp, Mus musculus
cgagtagtggacaaactgttggccc

SEQ ID NO: 605465 - DNA, 25 bp, Mus musculus
cgagtagtggactaactgttggccc

SEQ ID NO: 605466 - DNA, 25 bp, Mus musculus
cgagtatgagttcccagaggatcca

SEQ ID NO: 605467 - DNA, 25 bp, Mus musculus
cgagtatgagttgccagaggatcca

SEQ ID NO: 605468 - DNA, 25 bp, Mus musculus
cgagtatgccgaaaacacttactac

SEQ ID NO: 605469 - DNA, 25 bp, Mus musculus
cgagtatgccgataacacttactac

SEQ ID NO: 605470 - DNA, 25 bp, Mus musculus
cgagtcaagtcacaggaggacaaga

SEQ ID NO: 605471 - DNA, 25 bp, Mus musculus
cgagtcaagtcacgccagggtctgc

SEQ ID NO: 605472 - DNA, 25 bp, Mus musculus
cgagtcaagtcagaggaggacaaga

SEQ ID NO: 605473 - DNA, 25 bp, Mus musculus
cgagtcaagtcaggccagggtctgc

SEQ ID NO: 605474 - DNA, 25 bp, Mus musculus
cgagtcaggcgtcggcaagaccaat

SEQ ID NO: 605475 - DNA, 25 bp, Mus musculus
cgagtcaggcgtgggcaagaccaat

SEQ ID NO: 605476 - DNA, 25 bp, Mus musculus
cgagtccagtggcttgtacaccttg

SEQ ID NO: 605477 - DNA, 25 bp, Mus musculus
cgagtccagtgggttgtacaccttg

SEQ ID NO: 605478 - DNA, 25 bp, Mus musculus
cgagtcctggaacacaattctgctt

SEQ ID NO: 605479 - DNA, 25 bp, Mus musculus
cgagtcctggaagacaattctgctt

SEQ ID NO: 605480 - DNA, 25 bp, Mus musculus
cgagtccttgagaggattggtgaaa

SEQ ID NO: 605481 - DNA, 25 bp, Mus musculus
cgagtccttgagtggattggtgaaa

SEQ ID NO: 605482 - DNA, 25 bp, Mus musculus
cgagtctctcggaactgagtggcac

SEQ ID NO: 605483 - DNA, 25 bp, Mus musculus
cgagtctctcggtactgagtggcac

SEQ ID NO: 605484 - DNA, 25 bp, Mus musculus
cgagtctgcatgcagaagggcatta

SEQ ID NO: 605485 - DNA, 25 bp, Mus musculus
cgagtctgcatggagaagggcatta

SEQ ID NO: 605486 - DNA, 25 bp, Mus musculus
cgagtctgccaaacattaggcggaa

SEQ ID NO: 605487 - DNA, 25 bp, Mus musculus
cgagtctgccaatcattaggcggaa

SEQ ID NO: 605488 - DNA, 25 bp, Mus musculus
cgagtctgggccacaagatggtgtc

SEQ ID NO: 605489 - DNA, 25 bp, Mus musculus
cgagtctgggcctcaagatggtgtc

SEQ ID NO: 605490 - DNA, 25 bp, Mus musculus
cgagtctgtgccaggagccctgtgc

SEQ ID NO: 605491 - DNA, 25 bp, Mus musculus
cgagtctgtgcctggagccctgtgc

SEQ ID NO: 605492 - DNA, 25 bp, Mus musculus
cgagtcttcagccaggtacctctct

SEQ ID NO: 605493 - DNA, 25 bp, Mus musculus
cgagtcttcagcgaggtacctctct

SEQ ID NO: 605494 - DNA, 25 bp, Mus musculus
cgagtcttcagtagagatgagtgga

SEQ ID NO: 605495 - DNA, 25 bp, Mus musculus
cgagtcttcagttgagatgagtgga

SEQ ID NO: 605496 - DNA, 25 bp, Mus musculus
cgagtcttgatgcaaagccgtgtga

SEQ ID NO: 605497 - DNA, 25 bp, Mus musculus
cgagtcttgatggaaagccgtgtga

SEQ ID NO: 605498 - DNA, 25 bp, Mus musculus
cgagtgaaaccccatgcttgtgggc

SEQ ID NO: 605499 - DNA, 25 bp, Mus musculus
cgagtgaaacccgatgcttgtgggc

SEQ ID NO: 605500 - DNA, 25 bp, Mus musculus
cgagtgaatggtatggatgaaagca

SEQ ID NO: 605501 - DNA, 25 bp, Mus musculus
cgagtgaatggtttggatgaaagca

SEQ ID NO: 605502 - DNA, 25 bp, Mus musculus
cgagtgactggactcttccctggga

SEQ ID NO: 605503 - DNA, 25 bp, Mus musculus
cgagtgactggagtcttccctggga

SEQ ID NO: 605504 - DNA, 25 bp, Mus musculus
cgagtgagagaaatcacagaaaacc

SEQ ID NO: 605505 - DNA, 25 bp, Mus musculus
cgagtgagagaattcacagaaaacc

SEQ ID NO: 605506 - DNA, 25 bp, Mus musculus
cgagtgaggctcaacagacacggtt

SEQ ID NO: 605507 - DNA, 25 bp, Mus musculus
cgagtgaggctctacagacacggtt

SEQ ID NO: 605508 - DNA, 25 bp, Mus musculus
cgagtgataacactagatgggaaca

SEQ ID NO: 605509 - DNA, 25 bp, Mus musculus
cgagtgataacagtagatgggaaca

SEQ ID NO: 605510 - DNA, 25 bp, Mus musculus
cgagtgatcgctcctaccgtggctg

SEQ ID NO: 605511 - DNA, 25 bp, Mus musculus
cgagtgatcgctgctaccgtggctg

SEQ ID NO: 605512 - DNA, 25 bp, Mus musculus
cgagtgcagcaacagtgtagacagc

SEQ ID NO: 605513 - DNA, 25 bp, Mus musculus
cgagtgcagcaagagtgtagacagc

SEQ ID NO: 605514 - DNA, 25 bp, Mus musculus
cgagtgccaggtcgttacactgtga

SEQ ID NO: 605515 - DNA, 25 bp, Mus musculus
cgagtgccaggtggttacactgtga

SEQ ID NO: 605516 - DNA, 25 bp, Mus musculus
cgagtgcgaaaacatgcagctttcc

SEQ ID NO: 605517 - DNA, 25 bp, Mus musculus
cgagtgcgaaaagatgcagctttcc

SEQ ID NO: 605518 - DNA, 25 bp, Mus musculus
cgagtgcgcaagagctcaaggagca

SEQ ID NO: 605519 - DNA, 25 bp, Mus musculus
cgagtgcgcaagtgctcaaggagca

SEQ ID NO: 605520 - DNA, 25 bp, Mus musculus
cgagtgctccggagctatggccgcc

SEQ ID NO: 605521 - DNA, 25 bp, Mus musculus
cgagtgctccggtgctatggccgcc

SEQ ID NO: 605522 - DNA, 25 bp, Mus musculus
cgagtggaaaccacgtcaaattgac

SEQ ID NO: 605523 - DNA, 25 bp, Mus musculus
cgagtggaaacctcgtcaaattgac

SEQ ID NO: 605524 - DNA, 25 bp, Mus musculus
cgagtggacagcaccaccttactgg

SEQ ID NO: 605525 - DNA, 25 bp, Mus musculus
cgagtggacagctccaccttactgg

SEQ ID NO: 605526 - DNA, 25 bp, Mus musculus
cgagtggcaatcctcagcgaaaagg

SEQ ID NO: 605527 - DNA, 25 bp, Mus musculus
cgagtggcaatcgtcagcgaaaagg

SEQ ID NO: 605528 - DNA, 25 bp, Mus musculus
cgagtggtagctcccatttactgtg

SEQ ID NO: 605529 - DNA, 25 bp, Mus musculus
cgagtggtagctgccatttactgtg

SEQ ID NO: 605530 - DNA, 25 bp, Mus musculus
cgagtggtcatgactacccacagca

SEQ ID NO: 605531 - DNA, 25 bp, Mus musculus
cgagtggtcatgtctacccacagca

SEQ ID NO: 605532 - DNA, 25 bp, Mus musculus
cgagtgtactgtcggcctagccctt

SEQ ID NO: 605533 - DNA, 25 bp, Mus musculus
cgagtgtactgtgggcctagccctt

SEQ ID NO: 605534 - DNA, 25 bp, Mus musculus
cgagtgtgacttctgcgtgacagca

SEQ ID NO: 605535 - DNA, 25 bp, Mus musculus
cgagtgtgacttgtgcgtgacagca

SEQ ID NO: 605536 - DNA, 25 bp, Mus musculus
cgagtgtgccacacaggtagccctg

SEQ ID NO: 605537 - DNA, 25 bp, Mus musculus
cgagtgtgccactcaggtagccctg

SEQ ID NO: 605538 - DNA, 25 bp, Mus musculus
cgagtgtggacacggcctgcttcta

SEQ ID NO: 605539 - DNA, 25 bp, Mus musculus
cgagtgtggacagggcctgcttcta

SEQ ID NO: 605540 - DNA, 25 bp, Mus musculus
cgagtgtggcacagatgccctacgc

SEQ ID NO: 605541 - DNA, 25 bp, Mus musculus
cgagtgtggcactgatgccctacgc

SEQ ID NO: 605542 - DNA, 25 bp, Mus musculus
cgagttaccaatcacaacccagagt

SEQ ID NO: 605543 - DNA, 25 bp, Mus musculus
cgagttaccaatgacaacccagagt

SEQ ID NO: 605544 - DNA, 25 bp, Mus musculus
cgagttacctgtctccatggagggc

SEQ ID NO: 605545 - DNA, 25 bp, Mus musculus
cgagttacctgtgtccatggagggc

SEQ ID NO: 605546 - DNA, 25 bp, Mus musculus
cgagttagaagcagcccctcaccga

SEQ ID NO: 605547 - DNA, 25 bp, Mus musculus
cgagttagaagctgcccctcaccga

SEQ ID NO: 605548 - DNA, 25 bp, Mus musculus
cgagttagcttgcatagatggcgtc

SEQ ID NO: 605549 - DNA, 25 bp, Mus musculus
cgagttagcttggatagatggcgtc

SEQ ID NO: 605550 - DNA, 25 bp, Mus musculus
cgagttcaagccagaatcacgagtg

SEQ ID NO: 605551 - DNA, 25 bp, Mus musculus
cgagttcaagcctgaatcacgagtg

SEQ ID NO: 605552 - DNA, 25 bp, Mus musculus
cgagttcaagtacttccaaagaatg

SEQ ID NO: 605553 - DNA, 25 bp, Mus musculus
cgagttcaagtagttccaaagaatg

SEQ ID NO: 605554 - DNA, 25 bp, Mus musculus
cgagttcaggaaagggacaagcaat

SEQ ID NO: 605555 - DNA, 25 bp, Mus musculus
cgagttcaggaatgggacaagcaat

SEQ ID NO: 605556 - DNA, 25 bp, Mus musculus
cgagttcagggtcttgtggttccca

SEQ ID NO: 605557 - DNA, 25 bp, Mus musculus
cgagttcagggtgttgtggttccca

SEQ ID NO: 605558 - DNA, 25 bp, Mus musculus
cgagttccgtctcctgtgtgaggac

SEQ ID NO: 605559 - DNA, 25 bp, Mus musculus
cgagttccgtctgctgtgtgaggac

SEQ ID NO: 605560 - DNA, 25 bp, Mus musculus
cgagttcctcgaccggccatattaa

SEQ ID NO: 605561 - DNA, 25 bp, Mus musculus
cgagttcctcgagcggccatattaa

SEQ ID NO: 605562 - DNA, 25 bp, Mus musculus
cgagttccttctcaagtggttaagc

SEQ ID NO: 605563 - DNA, 25 bp, Mus musculus
cgagttccttctgaagtggttaagc

SEQ ID NO: 605564 - DNA, 25 bp, Mus musculus
cgagttcgctgtcgctaatgacaca

SEQ ID NO: 605565 - DNA, 25 bp, Mus musculus
cgagttcgctgtggctaatgacaca

SEQ ID NO: 605566 - DNA, 25 bp, Mus musculus
cgagttctgagcaggatgctgtaga

SEQ ID NO: 605567 - DNA, 25 bp, Mus musculus
cgagttctgagctggatgctgtaga

SEQ ID NO: 605568 - DNA, 25 bp, Mus musculus
cgagttgaagatcctatacgcgtgg

SEQ ID NO: 605569 - DNA, 25 bp, Mus musculus
cgagttgaagatgctatacgcgtgg

SEQ ID NO: 605570 - DNA, 25 bp, Mus musculus
cgagttgaaggtcacagccgttaca

SEQ ID NO: 605571 - DNA, 25 bp, Mus musculus
cgagttgaaggtgacagccgttaca

SEQ ID NO: 605572 - DNA, 25 bp, Mus musculus
cgagttgatattcctcggagccaac

SEQ ID NO: 605573 - DNA, 25 bp, Mus musculus
cgagttgatattgctcggagccaac

SEQ ID NO: 605574 - DNA, 25 bp, Mus musculus
cgagttgatgagctgtcattccata

SEQ ID NO: 605575 - DNA, 25 bp, Mus musculus
cgagttgatgaggtgtcattccata

SEQ ID NO: 605576 - DNA, 25 bp, Mus musculus
cgagttgcctgtaaattctcacaag

SEQ ID NO: 605577 - DNA, 25 bp, Mus musculus
cgagttgcctgttaattctcacaag

SEQ ID NO: 605578 - DNA, 25 bp, Mus musculus
cgagttgctgcccaggaggtaccta

SEQ ID NO: 605579 - DNA, 25 bp, Mus musculus
cgagttgctgccgaggaggtaccta

SEQ ID NO: 605580 - DNA, 25 bp, Mus musculus
cgagttggatccattcggcgctccc

SEQ ID NO: 605581 - DNA, 25 bp, Mus musculus
cgagttggatcctttcggcgctccc

SEQ ID NO: 605582 - DNA, 25 bp, Mus musculus
cgagttgtgcagagtgtggaccatc

SEQ ID NO: 605583 - DNA, 25 bp, Mus musculus
cgagttgtgcagtgtgtggaccatc

SEQ ID NO: 605584 - DNA, 25 bp, Mus musculus
cgagttgtgcccaaaacctagaggc

SEQ ID NO: 605585 - DNA, 25 bp, Mus musculus
cgagttgtgccctaaacctagaggc

SEQ ID NO: 605586 - DNA, 25 bp, Mus musculus
cgagtttagtgaatacatttgtgcc

SEQ ID NO: 605587 - DNA, 25 bp, Mus musculus
cgagtttagtgattacatttgtgcc

SEQ ID NO: 605588 - DNA, 25 bp, Mus musculus
cgagtttctgggacggatcaatgag

SEQ ID NO: 605589 - DNA, 25 bp, Mus musculus
cgagtttctgggtcggatcaatgag

SEQ ID NO: 605590 - DNA, 25 bp, Mus musculus
cgagtttggaataattgaggcctcc

SEQ ID NO: 605591 - DNA, 25 bp, Mus musculus
cgagtttggaattattgaggcctcc

SEQ ID NO: 605592 - DNA, 25 bp, Mus musculus
cgataaagtcccagtctaacaggga

SEQ ID NO: 605593 - DNA, 25 bp, Mus musculus
cgataaagtccctgtctaacaggga

SEQ ID NO: 605594 - DNA, 25 bp, Mus musculus
cgataagctgtgcttctggctggaa

SEQ ID NO: 605595 - DNA, 25 bp, Mus musculus
cgataagctgtggttctggctggaa

SEQ ID NO: 605596 - DNA, 25 bp, Mus musculus
cgataagggaagaggtgagtctaat

SEQ ID NO: 605597 - DNA, 25 bp, Mus musculus
cgataagggaagtggtgagtctaat

SEQ ID NO: 605598 - DNA, 25 bp, Mus musculus
cgataattgcttctgtgtcaatggg

SEQ ID NO: 605599 - DNA, 25 bp, Mus musculus
cgataattgcttgtgtgtcaatggg

SEQ ID NO: 605600 - DNA, 25 bp, Mus musculus
cgataatttgttacacaagtggaac

SEQ ID NO: 605601 - DNA, 25 bp, Mus musculus
cgataatttgtttcacaagtggaac

SEQ ID NO: 605602 - DNA, 25 bp, Mus musculus
cgatacaggagaacaagcagaagat

SEQ ID NO: 605603 - DNA, 25 bp, Mus musculus
cgatacaggagatcaagcagaagat

SEQ ID NO: 605604 - DNA, 25 bp, Mus musculus
cgatacatgccacgcctttgaccag

SEQ ID NO: 605605 - DNA, 25 bp, Mus musculus
cgatacatgccaggcctttgaccag

SEQ ID NO: 605606 - DNA, 25 bp, Mus musculus
cgataccaagttcgaaaggtctgga

SEQ ID NO: 605607 - DNA, 25 bp, Mus musculus
cgataccaagttggaaaggtctgga

SEQ ID NO: 605608 - DNA, 25 bp, Mus musculus
cgatacgctcacatggtcaatggct

SEQ ID NO: 605609 - DNA, 25 bp, Mus musculus
cgatacgctcacttggtcaatggct

SEQ ID NO: 605610 - DNA, 25 bp, Mus musculus
cgatacggaagtccctggaccagct

SEQ ID NO: 605611 - DNA, 25 bp, Mus musculus
cgatacggaagtgcctggaccagct

SEQ ID NO: 605612 - DNA, 25 bp, Mus musculus
cgatacgggagcacaaagtgtgtct

SEQ ID NO: 605613 - DNA, 25 bp, Mus musculus
cgatacgggagctcaaagtgtgtct

SEQ ID NO: 605614 - DNA, 25 bp, Mus musculus
cgatactgtatcctgggtctggccc

SEQ ID NO: 605615 - DNA, 25 bp, Mus musculus
cgatactgtatcgtgggtctggccc

SEQ ID NO: 605616 - DNA, 25 bp, Mus musculus
cgatagagaacacgacccggagaca

SEQ ID NO: 605617 - DNA, 25 bp, Mus musculus
cgatagagaacaggacccggagaca

SEQ ID NO: 605618 - DNA, 25 bp, Mus musculus
cgatagagctgtagagcacttggtg

SEQ ID NO: 605619 - DNA, 25 bp, Mus musculus
cgatagagctgttgagcacttggtg

SEQ ID NO: 605620 - DNA, 25 bp, Mus musculus
cgatagcgttctaaaacagaggcct

SEQ ID NO: 605621 - DNA, 25 bp, Mus musculus
cgatagcgttcttaaacagaggcct

SEQ ID NO: 605622 - DNA, 25 bp, Mus musculus
cgataggaaactccggcctctccgg

SEQ ID NO: 605623 - DNA, 25 bp, Mus musculus
cgataggaaactgcggcctctccgg

SEQ ID NO: 605624 - DNA, 25 bp, Mus musculus
cgataggaacgcatggcagtaacat

SEQ ID NO: 605625 - DNA, 25 bp, Mus musculus
cgataggaacgcttggcagtaacat

SEQ ID NO: 605626 - DNA, 25 bp, Mus musculus
cgataggaggtgagctcttcagtct

SEQ ID NO: 605627 - DNA, 25 bp, Mus musculus
cgataggaggtgtgctcttcagtct

SEQ ID NO: 605628 - DNA, 25 bp, Mus musculus
cgataggtatagaggactggatcct

SEQ ID NO: 605629 - DNA, 25 bp, Mus musculus
cgataggtatagtggactggatcct

SEQ ID NO: 605630 - DNA, 25 bp, Mus musculus
cgatataagcgcaggaagtctgagg

SEQ ID NO: 605631 - DNA, 25 bp, Mus musculus
cgatataagcgctggaagtctgagg

SEQ ID NO: 605632 - DNA, 25 bp, Mus musculus
cgatatcaccagatactccaaggca

SEQ ID NO: 605633 - DNA, 25 bp, Mus musculus
cgatatcaccagttactccaaggca

SEQ ID NO: 605634 - DNA, 25 bp, Mus musculus
cgatattagccgagactcagatgga

SEQ ID NO: 605635 - DNA, 25 bp, Mus musculus
cgatattagccgtgactcagatgga

SEQ ID NO: 605636 - DNA, 25 bp, Mus musculus
cgatattttaacagtcgttctggcc

SEQ ID NO: 605637 - DNA, 25 bp, Mus musculus
cgatattttaactgtcgttctggcc

SEQ ID NO: 605638 - DNA, 25 bp, Mus musculus
cgatcaaagctccagtcagggagat

SEQ ID NO: 605639 - DNA, 25 bp, Mus musculus
cgatcaaagctcgagtcagggagat

SEQ ID NO: 605640 - DNA, 25 bp, Mus musculus
cgatcacagcgcacagatcgaggcc

SEQ ID NO: 605641 - DNA, 25 bp, Mus musculus
cgatcacagcgctcagatcgaggcc

SEQ ID NO: 605642 - DNA, 25 bp, Mus musculus
cgatcacattccagaccattggcta

SEQ ID NO: 605643 - DNA, 25 bp, Mus musculus
cgatcacattcctgaccattggcta

SEQ ID NO: 605644 - DNA, 25 bp, Mus musculus
cgatcactatttaccgagcgttgga

SEQ ID NO: 605645 - DNA, 25 bp, Mus musculus
cgatcactattttccgagcgttgga

SEQ ID NO: 605646 - DNA, 25 bp, Mus musculus
cgatcactctgactgatgtcaacga

SEQ ID NO: 605647 - DNA, 25 bp, Mus musculus
cgatcactctgagtgatgtcaacga

SEQ ID NO: 605648 - DNA, 25 bp, Mus musculus
cgatcagaagaaacgttggaaggac

SEQ ID NO: 605649 - DNA, 25 bp, Mus musculus
cgatcagaagaatcgttggaaggac

SEQ ID NO: 605650 - DNA, 25 bp, Mus musculus
cgatcaggagaccttccagctggag

SEQ ID NO: 605651 - DNA, 25 bp, Mus musculus
cgatcaggagacgttccagctggag

SEQ ID NO: 605652 - DNA, 25 bp, Mus musculus
cgatcatgttggaaactggcccaga

SEQ ID NO: 605653 - DNA, 25 bp, Mus musculus
cgatcatgttggtaactggcccaga

SEQ ID NO: 605654 - DNA, 25 bp, Mus musculus
cgatccaaggacagcggtgcatgca

SEQ ID NO: 605655 - DNA, 25 bp, Mus musculus
cgatccaaggactgcggtgcatgca

SEQ ID NO: 605656 - DNA, 25 bp, Mus musculus
cgatccacgtagcatctcagctgcg

SEQ ID NO: 605657 - DNA, 25 bp, Mus musculus
cgatccacgtaggatctcagctgcg

SEQ ID NO: 605658 - DNA, 25 bp, Mus musculus
cgatccagacgcaggagccgtccat

SEQ ID NO: 605659 - DNA, 25 bp, Mus musculus
cgatccagacgctggagccgtccat

SEQ ID NO: 605660 - DNA, 25 bp, Mus musculus
cgatcccagcccagagggagctgag

SEQ ID NO: 605661 - DNA, 25 bp, Mus musculus
cgatcccagccctgagggagctgag

SEQ ID NO: 605662 - DNA, 25 bp, Mus musculus
cgatcccagggcatgagtggagaca

SEQ ID NO: 605663 - DNA, 25 bp, Mus musculus
cgatcccagggcttgagtggagaca

SEQ ID NO: 605664 - DNA, 25 bp, Mus musculus
cgatccgcagccacacattcagtgg

SEQ ID NO: 605665 - DNA, 25 bp, Mus musculus
cgatccgcagcctcacattcagtgg

SEQ ID NO: 605666 - DNA, 25 bp, Mus musculus
cgatcctccctacggtcctagagaa

SEQ ID NO: 605667 - DNA, 25 bp, Mus musculus
cgatcctccctagggtcctagagaa

SEQ ID NO: 605668 - DNA, 25 bp, Mus musculus
cgatcctgaccgacagcttgtccta

SEQ ID NO: 605669 - DNA, 25 bp, Mus musculus
cgatcctgaccgtcagcttgtccta

SEQ ID NO: 605670 - DNA, 25 bp, Mus musculus
cgatcctgattaatcatttctgtct

SEQ ID NO: 605671 - DNA, 25 bp, Mus musculus
cgatcctgattattcatttctgtct

SEQ ID NO: 605672 - DNA, 25 bp, Mus musculus
cgatccttctgcctccaaacttggg

SEQ ID NO: 605673 - DNA, 25 bp, Mus musculus
cgatccttctgcgtccaaacttggg

SEQ ID NO: 605674 - DNA, 25 bp, Mus musculus
cgatcgaatgtcaaatatccttggg

SEQ ID NO: 605675 - DNA, 25 bp, Mus musculus
cgatcgaatgtctaatatccttggg

SEQ ID NO: 605676 - DNA, 25 bp, Mus musculus
cgatcgacccgaatctgtttgcaga

SEQ ID NO: 605677 - DNA, 25 bp, Mus musculus
cgatcgacccgattctgtttgcaga

SEQ ID NO: 605678 - DNA, 25 bp, Mus musculus
cgatcgatggaccaatcagagctaa

SEQ ID NO: 605679 - DNA, 25 bp, Mus musculus
cgatcgatggacgaatcagagctaa

SEQ ID NO: 605680 - DNA, 25 bp, Mus musculus
cgatcgcattaaacatcttcattca

SEQ ID NO: 605681 - DNA, 25 bp, Mus musculus
cgatcgcattaatcatcttcattca

SEQ ID NO: 605682 - DNA, 25 bp, Mus musculus
cgatcgctggcgattgccttagcca

SEQ ID NO: 605683 - DNA, 25 bp, Mus musculus
cgatcgctggcgtttgccttagcca

SEQ ID NO: 605684 - DNA, 25 bp, Mus musculus
cgatcggagtctcgagtcaaaccct

SEQ ID NO: 605685 - DNA, 25 bp, Mus musculus
cgatcggagtctggagtcaaaccct

SEQ ID NO: 605686 - DNA, 25 bp, Mus musculus
cgatcggagtggacttccccgtgaa

SEQ ID NO: 605687 - DNA, 25 bp, Mus musculus
cgatcggagtggtcttccccgtgaa

SEQ ID NO: 605688 - DNA, 25 bp, Mus musculus
cgatcggcaaggcttctctcggctc

SEQ ID NO: 605689 - DNA, 25 bp, Mus musculus
cgatcggcaagggttctctcggctc

SEQ ID NO: 605690 - DNA, 25 bp, Mus musculus
cgatcggcgtgcacctgggctgcac

SEQ ID NO: 605691 - DNA, 25 bp, Mus musculus
cgatcggcgtgctcctgggctgcac

SEQ ID NO: 605692 - DNA, 25 bp, Mus musculus
cgatcggctcttaccagtttggcta

SEQ ID NO: 605693 - DNA, 25 bp, Mus musculus
cgatcggctctttccagtttggcta

SEQ ID NO: 605694 - DNA, 25 bp, Mus musculus
cgatcggttgagaaaattgagaaaa

SEQ ID NO: 605695 - DNA, 25 bp, Mus musculus
cgatcggttgagtaaattgagaaaa

SEQ ID NO: 605696 - DNA, 25 bp, Mus musculus
cgatcgtctacaccgccaaattcag

SEQ ID NO: 605697 - DNA, 25 bp, Mus musculus
cgatcgtctacagcgccaaattcag

SEQ ID NO: 605698 - DNA, 25 bp, Mus musculus
cgatcgtgttcacttctattgtaag

SEQ ID NO: 605699 - DNA, 25 bp, Mus musculus
cgatcgtgttcagttctattgtaag

SEQ ID NO: 605700 - DNA, 25 bp, Mus musculus
cgatctaagtaccaccctgatgagg

SEQ ID NO: 605701 - DNA, 25 bp, Mus musculus
cgatctaagtacgaccctgatgagg

SEQ ID NO: 605702 - DNA, 25 bp, Mus musculus
cgatctacgagaagaagtacggcca

SEQ ID NO: 605703 - DNA, 25 bp, Mus musculus
cgatctacgagatgaagtacggcca

SEQ ID NO: 605704 - DNA, 25 bp, Mus musculus
cgatctagaggcacactttgtgcct

SEQ ID NO: 605705 - DNA, 25 bp, Mus musculus
cgatctagaggctcactttgtgcct

SEQ ID NO: 605706 - DNA, 25 bp, Mus musculus
cgatctatggaacaaacggttacga

SEQ ID NO: 605707 - DNA, 25 bp, Mus musculus
cgatctatggaagaaacggttacga

SEQ ID NO: 605708 - DNA, 25 bp, Mus musculus
cgatctccgagccaggcggcaagat

SEQ ID NO: 605709 - DNA, 25 bp, Mus musculus
cgatctccgagcgaggcggcaagat

SEQ ID NO: 605710 - DNA, 25 bp, Mus musculus
cgatctgatttgactggatgttgct

SEQ ID NO: 605711 - DNA, 25 bp, Mus musculus
cgatctgatttgtctggatgttgct

SEQ ID NO: 605712 - DNA, 25 bp, Mus musculus
cgatctggatgcatgctgaggaacg

SEQ ID NO: 605713 - DNA, 25 bp, Mus musculus
cgatctggatgcttgctgaggaacg

SEQ ID NO: 605714 - DNA, 25 bp, Mus musculus
cgatctggtgacaaaagccacagaa

SEQ ID NO: 605715 - DNA, 25 bp, Mus musculus
cgatctggtgactaaagccacagaa

SEQ ID NO: 605716 - DNA, 25 bp, Mus musculus
cgatcttggaagaaaacatccagga

SEQ ID NO: 605717 - DNA, 25 bp, Mus musculus
cgatcttggaagtaaacatccagga

SEQ ID NO: 605718 - DNA, 25 bp, Mus musculus
cgatcttggctaactatgctggtgc

SEQ ID NO: 605719 - DNA, 25 bp, Mus musculus
cgatcttggctatctatgctggtgc

SEQ ID NO: 605720 - DNA, 25 bp, Mus musculus
cgatgaacagaaaatcaaacccgtg

SEQ ID NO: 605721 - DNA, 25 bp, Mus musculus
cgatgaacagaatatcaaacccgtg

SEQ ID NO: 605722 - DNA, 25 bp, Mus musculus
cgatgaagacttaaaacgggagctt

SEQ ID NO: 605723 - DNA, 25 bp, Mus musculus
cgatgaagactttaaacgggagctt

SEQ ID NO: 605724 - DNA, 25 bp, Mus musculus
cgatgaagatgtaggcattaactac

SEQ ID NO: 605725 - DNA, 25 bp, Mus musculus
cgatgaagatgttggcattaactac

SEQ ID NO: 605726 - DNA, 25 bp, Mus musculus
cgatgacaagcgcaaggtgcccttt

SEQ ID NO: 605727 - DNA, 25 bp, Mus musculus
cgatgacaagcggaaggtgcccttt

SEQ ID NO: 605728 - DNA, 25 bp, Mus musculus
cgatgacaaggacggcatgattaac

SEQ ID NO: 605729 - DNA, 25 bp, Mus musculus
cgatgacaaggagggcatgattaac

SEQ ID NO: 605730 - DNA, 25 bp, Mus musculus
cgatgacaccgacctggaagaagat

SEQ ID NO: 605731 - DNA, 25 bp, Mus musculus
cgatgacaccgagctggaagaagat

SEQ ID NO: 605732 - DNA, 25 bp, Mus musculus
cgatgacagtcgatggcgtccggaa

SEQ ID NO: 605733 - DNA, 25 bp, Mus musculus
cgatgacagtcgttggcgtccggaa

SEQ ID NO: 605734 - DNA, 25 bp, Mus musculus
cgatgacataaacagagaggaccct

SEQ ID NO: 605735 - DNA, 25 bp, Mus musculus
cgatgacataaagagagaggaccct

SEQ ID NO: 605736 - DNA, 25 bp, Mus musculus
cgatgaccaggacttccgcagtttc

SEQ ID NO: 605737 - DNA, 25 bp, Mus musculus
cgatgaccaggagttccgcagtttc

SEQ ID NO: 605738 - DNA, 25 bp, Mus musculus
cgatgaccagtcctttcatgctgat

SEQ ID NO: 605739 - DNA, 25 bp, Mus musculus
cgatgaccagtcgtttcatgctgat

SEQ ID NO: 605740 - DNA, 25 bp, Mus musculus
cgatgaccccagactgcggcaaaga

SEQ ID NO: 605741 - DNA, 25 bp, Mus musculus
cgatgaccccagtctgcggcaaaga

SEQ ID NO: 605742 - DNA, 25 bp, Mus musculus
cgatgactgcggaggagatccagct

SEQ ID NO: 605743 - DNA, 25 bp, Mus musculus
cgatgactgcggtggagatccagct

SEQ ID NO: 605744 - DNA, 25 bp, Mus musculus
cgatgacttcagagttctgactgcg

SEQ ID NO: 605745 - DNA, 25 bp, Mus musculus
cgatgacttcagtgttctgactgcg

SEQ ID NO: 605746 - DNA, 25 bp, Mus musculus
cgatgacttgtacctcaatgccagc

SEQ ID NO: 605747 - DNA, 25 bp, Mus musculus
cgatgacttgtagctcaatgccagc

SEQ ID NO: 605748 - DNA, 25 bp, Mus musculus
cgatgagactgtaggcgggctggct

SEQ ID NO: 605749 - DNA, 25 bp, Mus musculus
cgatgagactgttggcgggctggct

SEQ ID NO: 605750 - DNA, 25 bp, Mus musculus
cgatgagagcctcgctgtgcgcctc

SEQ ID NO: 605751 - DNA, 25 bp, Mus musculus
cgatgagagcctggctgtgcgcctc

SEQ ID NO: 605752 - DNA, 25 bp, Mus musculus
cgatgagatcagcatggccatggac

SEQ ID NO: 605753 - DNA, 25 bp, Mus musculus
cgatgagatcaggatggccatggac

SEQ ID NO: 605754 - DNA, 25 bp, Mus musculus
cgatgagatgacattagcagactgt

SEQ ID NO: 605755 - DNA, 25 bp, Mus musculus
cgatgagatgactttagcagactgt

SEQ ID NO: 605756 - DNA, 25 bp, Mus musculus
cgatgagcggagcagccaatactat

SEQ ID NO: 605757 - DNA, 25 bp, Mus musculus
cgatgagcggaggagccaatactat

SEQ ID NO: 605758 - DNA, 25 bp, Mus musculus
cgatgagctaaacccttatgtggaa

SEQ ID NO: 605759 - DNA, 25 bp, Mus musculus
cgatgagctaaagccttatgtggaa

SEQ ID NO: 605760 - DNA, 25 bp, Mus musculus
cgatgaggaaaaccggcagaagacc

SEQ ID NO: 605761 - DNA, 25 bp, Mus musculus
cgatgaggaaaagcggcagaagacc

SEQ ID NO: 605762 - DNA, 25 bp, Mus musculus
cgatgaggaaccactgtccgcgagg

SEQ ID NO: 605763 - DNA, 25 bp, Mus musculus
cgatgaggaacctctgtccgcgagg

SEQ ID NO: 605764 - DNA, 25 bp, Mus musculus
cgatgaggacctcggcttgcctgct

SEQ ID NO: 605765 - DNA, 25 bp, Mus musculus
cgatgaggacctgggcttgcctgct

SEQ ID NO: 605766 - DNA, 25 bp, Mus musculus
cgatgagggattaccacccatccta

SEQ ID NO: 605767 - DNA, 25 bp, Mus musculus
cgatgagggatttccacccatccta

SEQ ID NO: 605768 - DNA, 25 bp, Mus musculus
cgatgagggcatagcgaagcacagt

SEQ ID NO: 605769 - DNA, 25 bp, Mus musculus
cgatgagggcattgcgaagcacagt

SEQ ID NO: 605770 - DNA, 25 bp, Mus musculus
cgatgaggtggaagaagatcccact

SEQ ID NO: 605771 - DNA, 25 bp, Mus musculus
cgatgaggtggatgaagatcccact

SEQ ID NO: 605772 - DNA, 25 bp, Mus musculus
cgatgagtacgaagcccctgcagta

SEQ ID NO: 605773 - DNA, 25 bp, Mus musculus
cgatgagtacgatgcccctgcagta

SEQ ID NO: 605774 - DNA, 25 bp, Mus musculus
cgatgagtcattcgccatgattaga

SEQ ID NO: 605775 - DNA, 25 bp, Mus musculus
cgatgagtcattggccatgattaga

SEQ ID NO: 605776 - DNA, 25 bp, Mus musculus
cgatgagtgccacacccggaatgga

SEQ ID NO: 605777 - DNA, 25 bp, Mus musculus
cgatgagtgccagacccggaatgga

SEQ ID NO: 605778 - DNA, 25 bp, Mus musculus
cgatgagtggttagtggattcgctc

SEQ ID NO: 605779 - DNA, 25 bp, Mus musculus
cgatgagtggtttgtggattcgctc

SEQ ID NO: 605780 - DNA, 25 bp, Mus musculus
cgatgatacctcaaacttcgatgaa

SEQ ID NO: 605781 - DNA, 25 bp, Mus musculus
cgatgatacctctaacttcgatgaa

SEQ ID NO: 605782 - DNA, 25 bp, Mus musculus
cgatgatactcaatcacgcattgaa

SEQ ID NO: 605783 - DNA, 25 bp, Mus musculus
cgatgatactcattcacgcattgaa

SEQ ID NO: 605784 - DNA, 25 bp, Mus musculus
cgatgatgacaaagacggagttcct

SEQ ID NO: 605785 - DNA, 25 bp, Mus musculus
cgatgatgacaacggctttgtggac

SEQ ID NO: 605786 - DNA, 25 bp, Mus musculus
cgatgatgacaagggctttgtggac

SEQ ID NO: 605787 - DNA, 25 bp, Mus musculus
cgatgatgacaatgacggagttcct

SEQ ID NO: 605788 - DNA, 25 bp, Mus musculus
cgatgatgaccacatgtgtaatgac

SEQ ID NO: 605789 - DNA, 25 bp, Mus musculus
cgatgatgaccagatgtgtaatgac

SEQ ID NO: 605790 - DNA, 25 bp, Mus musculus
cgatgatgatatctacaatgttctt

SEQ ID NO: 605791 - DNA, 25 bp, Mus musculus
cgatgatgatatgtacaatgttctt

SEQ ID NO: 605792 - DNA, 25 bp, Mus musculus
cgatgcaactaacttaaggccaaag

SEQ ID NO: 605793 - DNA, 25 bp, Mus musculus
cgatgcaactaagttaaggccaaag

SEQ ID NO: 605794 - DNA, 25 bp, Mus musculus
cgatgcaatggcagcaggccctgtg

SEQ ID NO: 605795 - DNA, 25 bp, Mus musculus
cgatgcaatggctgcaggccctgtg

SEQ ID NO: 605796 - DNA, 25 bp, Mus musculus
cgatgcactgtactaaggaagcaag

SEQ ID NO: 605797 - DNA, 25 bp, Mus musculus
cgatgcactgtagtaaggaagcaag

SEQ ID NO: 605798 - DNA, 25 bp, Mus musculus
cgatgcagagggagacccctccaag

SEQ ID NO: 605799 - DNA, 25 bp, Mus musculus
cgatgcagagggtgacccctccaag

SEQ ID NO: 605800 - DNA, 25 bp, Mus musculus
cgatgcagcaacacggagggctcgt

SEQ ID NO: 605801 - DNA, 25 bp, Mus musculus
cgatgcagcaactcggagggctcgt

SEQ ID NO: 605802 - DNA, 25 bp, Mus musculus
cgatgcagcactcgagaattactct

SEQ ID NO: 605803 - DNA, 25 bp, Mus musculus
cgatgcagcactggagaattactct

SEQ ID NO: 605804 - DNA, 25 bp, Mus musculus
cgatgcagctctcgccactgtagag

SEQ ID NO: 605805 - DNA, 25 bp, Mus musculus
cgatgcagctctggccactgtagag

SEQ ID NO: 605806 - DNA, 25 bp, Mus musculus
cgatgccacaagaggaccggcttct

SEQ ID NO: 605807 - DNA, 25 bp, Mus musculus
cgatgccacaagtggaccggcttct

SEQ ID NO: 605808 - DNA, 25 bp, Mus musculus
cgatgccagagacgctgttcagaag

SEQ ID NO: 605809 - DNA, 25 bp, Mus musculus
cgatgccagagaggctgttcagaag

SEQ ID NO: 605810 - DNA, 25 bp, Mus musculus
cgatgccagcgacaagaggttccag

SEQ ID NO: 605811 - DNA, 25 bp, Mus musculus
cgatgccagcgagaagaggttccag

SEQ ID NO: 605812 - DNA, 25 bp, Mus musculus
cgatgccagttcatgcctaatgagg

SEQ ID NO: 605813 - DNA, 25 bp, Mus musculus
cgatgccagttcttgcctaatgagg

SEQ ID NO: 605814 - DNA, 25 bp, Mus musculus
cgatgccatctaagagcaggagagc

SEQ ID NO: 605815 - DNA, 25 bp, Mus musculus
cgatgccatctatgagcaggagagc

SEQ ID NO: 605816 - DNA, 25 bp, Mus musculus
cgatgcccctgaacgggctgaagga

SEQ ID NO: 605817 - DNA, 25 bp, Mus musculus
cgatgcccctgatcgggctgaagga

SEQ ID NO: 605818 - DNA, 25 bp, Mus musculus
cgatgccgtcccagaaccagacatg

SEQ ID NO: 605819 - DNA, 25 bp, Mus musculus
cgatgccgtccctgaaccagacatg

SEQ ID NO: 605820 - DNA, 25 bp, Mus musculus
cgatgcctacccaaagactctggag

SEQ ID NO: 605821 - DNA, 25 bp, Mus musculus
cgatgcctaccctaagactctggag

SEQ ID NO: 605822 - DNA, 25 bp, Mus musculus
cgatgcctggtgatctatctctgct

SEQ ID NO: 605823 - DNA, 25 bp, Mus musculus
cgatgcctggtgttctatctctgct

SEQ ID NO: 605824 - DNA, 25 bp, Mus musculus
cgatgcgcgtccagtgactgggaca

SEQ ID NO: 605825 - DNA, 25 bp, Mus musculus
cgatgcgcgtcctgtgactgggaca

SEQ ID NO: 605826 - DNA, 25 bp, Mus musculus
cgatgcggcagtaggatctcgttct

SEQ ID NO: 605827 - DNA, 25 bp, Mus musculus
cgatgcggcagttggatctcgttct

SEQ ID NO: 605828 - DNA, 25 bp, Mus musculus
cgatgctagcgcagcgttgcggccc

SEQ ID NO: 605829 - DNA, 25 bp, Mus musculus
cgatgctagcgctgcgttgcggccc

SEQ ID NO: 605830 - DNA, 25 bp, Mus musculus
cgatgctctccgaccaacctaaggg

SEQ ID NO: 605831 - DNA, 25 bp, Mus musculus
cgatgctctccgtccaacctaaggg

SEQ ID NO: 605832 - DNA, 25 bp, Mus musculus
cgatgctctgttcccagtatcaaaa

SEQ ID NO: 605833 - DNA, 25 bp, Mus musculus
cgatgctctgttgccagtatcaaaa

SEQ ID NO: 605834 - DNA, 25 bp, Mus musculus
cgatgctggagcacttggacctgct

SEQ ID NO: 605835 - DNA, 25 bp, Mus musculus
cgatgctggagctcttggacctgct

SEQ ID NO: 605836 - DNA, 25 bp, Mus musculus
cgatgcttctgactatgagtgtgaa

SEQ ID NO: 605837 - DNA, 25 bp, Mus musculus
cgatgcttctgagtatgagtgtgaa

SEQ ID NO: 605838 - DNA, 25 bp, Mus musculus
cgatgctttccactgctgcttaccg

SEQ ID NO: 605839 - DNA, 25 bp, Mus musculus
cgatgctttccagtgctgcttaccg

SEQ ID NO: 605840 - DNA, 25 bp, Mus musculus
cgatggagaagcacatcaacacttt

SEQ ID NO: 605841 - DNA, 25 bp, Mus musculus
cgatggagaagctcatcaacacttt

SEQ ID NO: 605842 - DNA, 25 bp, Mus musculus
cgatggagaatcatttgagctaaag

SEQ ID NO: 605843 - DNA, 25 bp, Mus musculus
cgatggagaatcttttgagctaaag

SEQ ID NO: 605844 - DNA, 25 bp, Mus musculus
cgatggagttgcaacagagaaggca

SEQ ID NO: 605845 - DNA, 25 bp, Mus musculus
cgatggagttgctacagagaaggca

SEQ ID NO: 605846 - DNA, 25 bp, Mus musculus
cgatggataaatcaagcccaagaag

SEQ ID NO: 605847 - DNA, 25 bp, Mus musculus
cgatggataaatgaagcccaagaag

SEQ ID NO: 605848 - DNA, 25 bp, Mus musculus
cgatggatggtcagagacatttcca

SEQ ID NO: 605849 - DNA, 25 bp, Mus musculus
cgatggatggtctgagacatttcca

SEQ ID NO: 605850 - DNA, 25 bp, Mus musculus
cgatggcccactcctgcgtgaggaa

SEQ ID NO: 605851 - DNA, 25 bp, Mus musculus
cgatggcccactgctgcgtgaggaa

SEQ ID NO: 605852 - DNA, 25 bp, Mus musculus
cgatggccgggaatctggagcactc

SEQ ID NO: 605853 - DNA, 25 bp, Mus musculus
cgatggccgggattctggagcactc

SEQ ID NO: 605854 - DNA, 25 bp, Mus musculus
cgatggcctgtgaatatagggctaa

SEQ ID NO: 605855 - DNA, 25 bp, Mus musculus
cgatggcctgtgtatatagggctaa

SEQ ID NO: 605856 - DNA, 25 bp, Mus musculus
cgatggcggagtaggtcctgacact

SEQ ID NO: 605857 - DNA, 25 bp, Mus musculus
cgatggcggagttggtcctgacact

SEQ ID NO: 605858 - DNA, 25 bp, Mus musculus
cgatggcggctcagaccgatgtgca

SEQ ID NO: 605859 - DNA, 25 bp, Mus musculus
cgatggcggctctgaccgatgtgca

SEQ ID NO: 605860 - DNA, 25 bp, Mus musculus
cgatggctaaggagctggtcgacct

SEQ ID NO: 605861 - DNA, 25 bp, Mus musculus
cgatggctaaggtgctggtcgacct

SEQ ID NO: 605862 - DNA, 25 bp, Mus musculus
cgatggctatgaaattactcactta

SEQ ID NO: 605863 - DNA, 25 bp, Mus musculus
cgatggctatgatattactcactta

SEQ ID NO: 605864 - DNA, 25 bp, Mus musculus
cgatggctgaaacaactgagagatc

SEQ ID NO: 605865 - DNA, 25 bp, Mus musculus
cgatggctgaaagaactgagagatc

SEQ ID NO: 605866 - DNA, 25 bp, Mus musculus
cgatggctgcacagggcttgctagt

SEQ ID NO: 605867 - DNA, 25 bp, Mus musculus
cgatggctgcactgggcttgctagt

SEQ ID NO: 605868 - DNA, 25 bp, Mus musculus
cgatgggaactcaggaggtctcgct

SEQ ID NO: 605869 - DNA, 25 bp, Mus musculus
cgatgggaactctggaggtctcgct

SEQ ID NO: 605870 - DNA, 25 bp, Mus musculus
cgatgggcagagatggactgtgtac

SEQ ID NO: 605871 - DNA, 25 bp, Mus musculus
cgatgggcagagttggactgtgtac

SEQ ID NO: 605872 - DNA, 25 bp, Mus musculus
cgatgggtccagaagaagttccaga

SEQ ID NO: 605873 - DNA, 25 bp, Mus musculus
cgatgggtccagtagaagttccaga

SEQ ID NO: 605874 - DNA, 25 bp, Mus musculus
cgatgggtgttaactctgatggcaa

SEQ ID NO: 605875 - DNA, 25 bp, Mus musculus
cgatgggtgttatctctgatggcaa

SEQ ID NO: 605876 - DNA, 25 bp, Mus musculus
cgatggtgtctaagtttccagtgat

SEQ ID NO: 605877 - DNA, 25 bp, Mus musculus
cgatggtgtctatgtttccagtgat

SEQ ID NO: 605878 - DNA, 25 bp, Mus musculus
cgatggttatgtaagtgacagtgcc

SEQ ID NO: 605879 - DNA, 25 bp, Mus musculus
cgatggttatgttagtgacagtgcc

SEQ ID NO: 605880 - DNA, 25 bp, Mus musculus
cgatgtatgaggattgtggctgtct

SEQ ID NO: 605881 - DNA, 25 bp, Mus musculus
cgatgtatgaggtttgtggctgtct

SEQ ID NO: 605882 - DNA, 25 bp, Mus musculus
cgatgtattgacaaagcaacagatg

SEQ ID NO: 605883 - DNA, 25 bp, Mus musculus
cgatgtattgactaagcaacagatg

SEQ ID NO: 605884 - DNA, 25 bp, Mus musculus
cgatgtcccattaaagataggagac

SEQ ID NO: 605885 - DNA, 25 bp, Mus musculus
cgatgtcccatttaagataggagac

SEQ ID NO: 605886 - DNA, 25 bp, Mus musculus
cgatgtccggccactcaaaccgtgt

SEQ ID NO: 605887 - DNA, 25 bp, Mus musculus
cgatgtccggcctctcaaaccgtgt

SEQ ID NO: 605888 - DNA, 25 bp, Mus musculus
cgatgtcctggtctacctggcggat

SEQ ID NO: 605889 - DNA, 25 bp, Mus musculus
cgatgtcctggtgtacctggcggat

SEQ ID NO: 605890 - DNA, 25 bp, Mus musculus
cgatgtctttaccaaagaggaacag

SEQ ID NO: 605891 - DNA, 25 bp, Mus musculus
cgatgtctttacgaaagaggaacag

SEQ ID NO: 605892 - DNA, 25 bp, Mus musculus
cgatgtgaaggaatgctcctggtgc

SEQ ID NO: 605893 - DNA, 25 bp, Mus musculus
cgatgtgaaggattgctcctggtgc

SEQ ID NO: 605894 - DNA, 25 bp, Mus musculus
cgatgtgaccatctacaagacgtgg

SEQ ID NO: 605895 - DNA, 25 bp, Mus musculus
cgatgtgaccatgtacaagacgtgg

SEQ ID NO: 605896 - DNA, 25 bp, Mus musculus
cgatgtgcttgacaggaaccaagtg

SEQ ID NO: 605897 - DNA, 25 bp, Mus musculus
cgatgtgcttgagaggaaccaagtg

SEQ ID NO: 605898 - DNA, 25 bp, Mus musculus
cgatgtggaaagcttcgatttaaga

SEQ ID NO: 605899 - DNA, 25 bp, Mus musculus
cgatgtggaaaggttcgatttaaga

SEQ ID NO: 605900 - DNA, 25 bp, Mus musculus
cgatgtggacacattagacatggtc

SEQ ID NO: 605901 - DNA, 25 bp, Mus musculus
cgatgtggacactttagacatggtc

SEQ ID NO: 605902 - DNA, 25 bp, Mus musculus
cgatgtgtacttcgctaaaagtctg

SEQ ID NO: 605903 - DNA, 25 bp, Mus musculus
cgatgtgtacttggctaaaagtctg

SEQ ID NO: 605904 - DNA, 25 bp, Mus musculus
cgatgtgtgtgcaatctgtctggag

SEQ ID NO: 605905 - DNA, 25 bp, Mus musculus
cgatgtgtgtgctatctgtctggag

SEQ ID NO: 605906 - DNA, 25 bp, Mus musculus
cgatgttcttttcccgcacatgcct

SEQ ID NO: 605907 - DNA, 25 bp, Mus musculus
cgatgttcttttgccgcacatgcct

SEQ ID NO: 605908 - DNA, 25 bp, Mus musculus
cgatgttgccaacgtctttgggagc

SEQ ID NO: 605909 - DNA, 25 bp, Mus musculus
cgatgttgccaaggtctttgggagc

SEQ ID NO: 605910 - DNA, 25 bp, Mus musculus
cgatgttggcatcaagctgtcagga

SEQ ID NO: 605911 - DNA, 25 bp, Mus musculus
cgatgttggcatgaagctgtcagga

SEQ ID NO: 605912 - DNA, 25 bp, Mus musculus
cgatgtttacctagatgtctggcaa

SEQ ID NO: 605913 - DNA, 25 bp, Mus musculus
cgatgtttaccttgatgtctggcaa

SEQ ID NO: 605914 - DNA, 25 bp, Mus musculus
cgattaaagtctcaagaagcagatg

SEQ ID NO: 605915 - DNA, 25 bp, Mus musculus
cgattaaagtctgaagaagcagatg

SEQ ID NO: 605916 - DNA, 25 bp, Mus musculus
cgattaaagttaaaaacagcagtgc

SEQ ID NO: 605917 - DNA, 25 bp, Mus musculus
cgattaaagttataaacagcagtgc

SEQ ID NO: 605918 - DNA, 25 bp, Mus musculus
cgattaaatacgaaagccaacaaag

SEQ ID NO: 605919 - DNA, 25 bp, Mus musculus
cgattaaatacgtaagccaacaaag

SEQ ID NO: 605920 - DNA, 25 bp, Mus musculus
cgattagatttgatggtctctgtcc

SEQ ID NO: 605921 - DNA, 25 bp, Mus musculus
cgattagatttgttggtctctgtcc

SEQ ID NO: 605922 - DNA, 25 bp, Mus musculus
cgattagtcacaatggcaagggcgg

SEQ ID NO: 605923 - DNA, 25 bp, Mus musculus
cgattagtcacattggcaagggcgg

SEQ ID NO: 605924 - DNA, 25 bp, Mus musculus
cgattatggaaacctgggcgacacc

SEQ ID NO: 605925 - DNA, 25 bp, Mus musculus
cgattatggaaagctgggcgacacc

SEQ ID NO: 605926 - DNA, 25 bp, Mus musculus
cgattattgtagaacacctgagctg

SEQ ID NO: 605927 - DNA, 25 bp, Mus musculus
cgattattgtagtacacctgagctg

SEQ ID NO: 605928 - DNA, 25 bp, Mus musculus
cgattcacgacgcatgtgcagttag

SEQ ID NO: 605929 - DNA, 25 bp, Mus musculus
cgattcacgacggatgtgcagttag

SEQ ID NO: 605930 - DNA, 25 bp, Mus musculus
cgattcagaacaagagaagaatgtg

SEQ ID NO: 605931 - DNA, 25 bp, Mus musculus
cgattcagaacatgagaagaatgtg

SEQ ID NO: 605932 - DNA, 25 bp, Mus musculus
cgattcatcgggaaggacctcgtgt

SEQ ID NO: 605933 - DNA, 25 bp, Mus musculus
cgattcatcgggtaggacctcgtgt

SEQ ID NO: 605934 - DNA, 25 bp, Mus musculus
cgattccagcatccggtactttgag

SEQ ID NO: 605935 - DNA, 25 bp, Mus musculus
cgattccagcatgcggtactttgag

SEQ ID NO: 605936 - DNA, 25 bp, Mus musculus
cgattccagtccacgatggctatgt

SEQ ID NO: 605937 - DNA, 25 bp, Mus musculus
cgattccagtcctcgatggctatgt

SEQ ID NO: 605938 - DNA, 25 bp, Mus musculus
cgattccgggatatgctactgcctc

SEQ ID NO: 605939 - DNA, 25 bp, Mus musculus
cgattccgggatttgctactgcctc

SEQ ID NO: 605940 - DNA, 25 bp, Mus musculus
cgattcctacaaaaatggtttcctg

SEQ ID NO: 605941 - DNA, 25 bp, Mus musculus
cgattcctacaataatggtttcctg

SEQ ID NO: 605942 - DNA, 25 bp, Mus musculus
cgattcctggctaggaccggctgga

SEQ ID NO: 605943 - DNA, 25 bp, Mus musculus
cgattcctggcttggaccggctgga

SEQ ID NO: 605944 - DNA, 25 bp, Mus musculus
cgattctaaagcagctttgttaccg

SEQ ID NO: 605945 - DNA, 25 bp, Mus musculus
cgattctaaagctgctttgttaccg

SEQ ID NO: 605946 - DNA, 25 bp, Mus musculus
cgattctcattcaacgggacacgac

SEQ ID NO: 605947 - DNA, 25 bp, Mus musculus
cgattctcattctacgggacacgac

SEQ ID NO: 605948 - DNA, 25 bp, Mus musculus
cgattctgaatgacagtcctgggaa

SEQ ID NO: 605949 - DNA, 25 bp, Mus musculus
cgattctgaatgtcagtcctgggaa

SEQ ID NO: 605950 - DNA, 25 bp, Mus musculus
cgattgaagaagctgtgcgagccct

SEQ ID NO: 605951 - DNA, 25 bp, Mus musculus
cgattgaagaaggtgtgcgagccct

SEQ ID NO: 605952 - DNA, 25 bp, Mus musculus
cgattgaattacacagcatgaaacg

SEQ ID NO: 605953 - DNA, 25 bp, Mus musculus
cgattgaattactcagcatgaaacg

SEQ ID NO: 605954 - DNA, 25 bp, Mus musculus
cgattgcaattaagggacacagcag

SEQ ID NO: 605955 - DNA, 25 bp, Mus musculus
cgattgcaattatgggacacagcag

SEQ ID NO: 605956 - DNA, 25 bp, Mus musculus
cgattgctgagtaggacaccctgaa

SEQ ID NO: 605957 - DNA, 25 bp, Mus musculus
cgattgctgagttggacaccctgaa

SEQ ID NO: 605958 - DNA, 25 bp, Mus musculus
cgattggatcagctggaatctgact

SEQ ID NO: 605959 - DNA, 25 bp, Mus musculus
cgattggatcaggtggaatctgact

SEQ ID NO: 605960 - DNA, 25 bp, Mus musculus
cgattggtcagcctggctgcgctaa

SEQ ID NO: 605961 - DNA, 25 bp, Mus musculus
cgattggtcagcgtggctgcgctaa

SEQ ID NO: 605962 - DNA, 25 bp, Mus musculus
cgattgtaattcaccacaggctgca

SEQ ID NO: 605963 - DNA, 25 bp, Mus musculus
cgattgtaattctccacaggctgca

SEQ ID NO: 605964 - DNA, 25 bp, Mus musculus
cgattgtgactgacatcctgaattt

SEQ ID NO: 605965 - DNA, 25 bp, Mus musculus
cgattgtgactgtcatcctgaattt

SEQ ID NO: 605966 - DNA, 25 bp, Mus musculus
cgattgttttggacctctttggagc

SEQ ID NO: 605967 - DNA, 25 bp, Mus musculus
cgattgttttggtcctctttggagc

SEQ ID NO: 605968 - DNA, 25 bp, Mus musculus
cgatttatgatcatctcaggctcca

SEQ ID NO: 605969 - DNA, 25 bp, Mus musculus
cgatttatgatcttctcaggctcca

SEQ ID NO: 605970 - DNA, 25 bp, Mus musculus
cgatttatggtgattttgagaactc

SEQ ID NO: 605971 - DNA, 25 bp, Mus musculus
cgatttatggtgtttttgagaactc

SEQ ID NO: 605972 - DNA, 25 bp, Mus musculus
cgatttcacgaacagatcctgccca

SEQ ID NO: 605973 - DNA, 25 bp, Mus musculus
cgatttcacgaagagatcctgccca

SEQ ID NO: 605974 - DNA, 25 bp, Mus musculus
cgatttcccagtagcttccttctgc

SEQ ID NO: 605975 - DNA, 25 bp, Mus musculus
cgatttcccagttgcttccttctgc

SEQ ID NO: 605976 - DNA, 25 bp, Mus musculus
cgatttccgcaaagagtgaagaacc

SEQ ID NO: 605977 - DNA, 25 bp, Mus musculus
cgatttccgcaatgagtgaagaacc

SEQ ID NO: 605978 - DNA, 25 bp, Mus musculus
cgatttccgcagatctcagcccgat

SEQ ID NO: 605979 - DNA, 25 bp, Mus musculus
cgatttccgcagttctcagcccgat

SEQ ID NO: 605980 - DNA, 25 bp, Mus musculus
cgatttcctgaacactttcagctct

SEQ ID NO: 605981 - DNA, 25 bp, Mus musculus
cgatttcctgaagactttcagctct

SEQ ID NO: 605982 - DNA, 25 bp, Mus musculus
cgatttcgcgccaaacttgacggca

SEQ ID NO: 605983 - DNA, 25 bp, Mus musculus
cgatttcgcgcctaacttgacggca

SEQ ID NO: 605984 - DNA, 25 bp, Mus musculus
cgatttcgtagcctgccgagttcta

SEQ ID NO: 605985 - DNA, 25 bp, Mus musculus
cgatttcgtagcgtgccgagttcta

SEQ ID NO: 605986 - DNA, 25 bp, Mus musculus
cgatttctgaatattttggaatccc

SEQ ID NO: 605987 - DNA, 25 bp, Mus musculus
cgatttctgaattttttggaatccc

SEQ ID NO: 605988 - DNA, 25 bp, Mus musculus
cgatttctgattatgcctgacatgc

SEQ ID NO: 605989 - DNA, 25 bp, Mus musculus
cgatttctgattttgcctgacatgc

SEQ ID NO: 605990 - DNA, 25 bp, Mus musculus
cgatttgaaagactgacccgggaca

SEQ ID NO: 605991 - DNA, 25 bp, Mus musculus
cgatttgaaagagtgacccgggaca

SEQ ID NO: 605992 - DNA, 25 bp, Mus musculus
cgatttgactgcaactccatctcca

SEQ ID NO: 605993 - DNA, 25 bp, Mus musculus
cgatttgactgctactccatctcca

SEQ ID NO: 605994 - DNA, 25 bp, Mus musculus
cgatttgagtatcaagaccctttct

SEQ ID NO: 605995 - DNA, 25 bp, Mus musculus
cgatttgagtatgaagaccctttct

SEQ ID NO: 605996 - DNA, 25 bp, Mus musculus
cgatttgtggatcggctgaccttca

SEQ ID NO: 605997 - DNA, 25 bp, Mus musculus
cgatttgtggatgggctgaccttca

SEQ ID NO: 605998 - DNA, 25 bp, Mus musculus
cgattttatgggaaccgatgcagcc

SEQ ID NO: 605999 - DNA, 25 bp, Mus musculus
cgattttatgggtaccgatgcagcc

SEQ ID NO: 606000 - DNA, 25 bp, Mus musculus
cgcaaaaaccctagcagaacacaag

SEQ ID NO: 606001 - DNA, 25 bp, Mus musculus
cgcaaaaacccttgcagaacacaag

SEQ ID NO: 606002 - DNA, 25 bp, Mus musculus
cgcaaaaagcgcaacactgtggtgg

SEQ ID NO: 606003 - DNA, 25 bp, Mus musculus
cgcaaaaagcgctacactgtggtgg

SEQ ID NO: 606004 - DNA, 25 bp, Mus musculus
cgcaaaagaagcaccgcattcagag

SEQ ID NO: 606005 - DNA, 25 bp, Mus musculus
cgcaaaagaagctccgcattcagag

SEQ ID NO: 606006 - DNA, 25 bp, Mus musculus
cgcaaaagcgagctgtactatgaca

SEQ ID NO: 606007 - DNA, 25 bp, Mus musculus
cgcaaaagcgaggtgtactatgaca

SEQ ID NO: 606008 - DNA, 25 bp, Mus musculus
cgcaaaccgattcgtcagtgttgga

SEQ ID NO: 606009 - DNA, 25 bp, Mus musculus
cgcaaaccgattggtcagtgttgga

SEQ ID NO: 606010 - DNA, 25 bp, Mus musculus
cgcaaactacccatcccggatgaga

SEQ ID NO: 606011 - DNA, 25 bp, Mus musculus
cgcaaactacccttcccggatgaga

SEQ ID NO: 606012 - DNA, 25 bp, Mus musculus
cgcaaagacaggcaaactggaaatg

SEQ ID NO: 606013 - DNA, 25 bp, Mus musculus
cgcaaagacagggaaactggaaatg

SEQ ID NO: 606014 - DNA, 25 bp, Mus musculus
cgcaaagagatgcagtaagacccgc

SEQ ID NO: 606015 - DNA, 25 bp, Mus musculus
cgcaaagagatggagtaagacccgc

SEQ ID NO: 606016 - DNA, 25 bp, Mus musculus
cgcaaagagtgaagaaccaagggac

SEQ ID NO: 606017 - DNA, 25 bp, Mus musculus
cgcaaagagtgatgaaccaagggac

SEQ ID NO: 606018 - DNA, 25 bp, Mus musculus
cgcaaagcaattcagcgcggcactg

SEQ ID NO: 606019 - DNA, 25 bp, Mus musculus
cgcaaagcaattgagcgcggcactg

SEQ ID NO: 606020 - DNA, 25 bp, Mus musculus
cgcaaagcagaaagaaaaggcccca

SEQ ID NO: 606021 - DNA, 25 bp, Mus musculus
cgcaaagcagaatgaaaaggcccca

SEQ ID NO: 606022 - DNA, 25 bp, Mus musculus
cgcaaagcagacatgctcgagaagg

SEQ ID NO: 606023 - DNA, 25 bp, Mus musculus
cgcaaagcagacttgctcgagaagg

SEQ ID NO: 606024 - DNA, 25 bp, Mus musculus
cgcaaaggagatcgcacagcaacta

SEQ ID NO: 606025 - DNA, 25 bp, Mus musculus
cgcaaaggagatggcacagcaacta

SEQ ID NO: 606026 - DNA, 25 bp, Mus musculus
cgcaaatgaagacgagtataagaaa

SEQ ID NO: 606027 - DNA, 25 bp, Mus musculus
cgcaaatgaagaggagtataagaaa

SEQ ID NO: 606028 - DNA, 25 bp, Mus musculus
cgcaaattttgcactactggcattg

SEQ ID NO: 606029 - DNA, 25 bp, Mus musculus
cgcaaattttgctctactggcattg

SEQ ID NO: 606030 - DNA, 25 bp, Mus musculus
cgcaacaagggcaaggctcttaact

SEQ ID NO: 606031 - DNA, 25 bp, Mus musculus
cgcaacaagggctaggctcttaact

SEQ ID NO: 606032 - DNA, 25 bp, Mus musculus
cgcaacctccgcagagacaaagatc

SEQ ID NO: 606033 - DNA, 25 bp, Mus musculus
cgcaacctccgctgagacaaagatc

SEQ ID NO: 606034 - DNA, 25 bp, Mus musculus
cgcaacgacggcacgccttggtgta

SEQ ID NO: 606035 - DNA, 25 bp, Mus musculus
cgcaacgacggctcgccttggtgta

SEQ ID NO: 606036 - DNA, 25 bp, Mus musculus
cgcaacggaagacgccctgaaggaa

SEQ ID NO: 606037 - DNA, 25 bp, Mus musculus
cgcaacggaagaggccctgaaggaa

SEQ ID NO: 606038 - DNA, 25 bp, Mus musculus
cgcaacgggaagaggtcaacaagtt

SEQ ID NO: 606039 - DNA, 25 bp, Mus musculus
cgcaacgggaagtggtcaacaagtt

SEQ ID NO: 606040 - DNA, 25 bp, Mus musculus
cgcaactcagctattattatatggg

SEQ ID NO: 606041 - DNA, 25 bp, Mus musculus
cgcaactcagcttttattatatggg

SEQ ID NO: 606042 - DNA, 25 bp, Mus musculus
cgcaactgggcacacccgaaagtct

SEQ ID NO: 606043 - DNA, 25 bp, Mus musculus
cgcaactgggcagacccgaaagtct

SEQ ID NO: 606044 - DNA, 25 bp, Mus musculus
cgcaactgtgagagtgacatcgatg

SEQ ID NO: 606045 - DNA, 25 bp, Mus musculus
cgcaactgtgagtgtgacatcgatg

SEQ ID NO: 606046 - DNA, 25 bp, Mus musculus
cgcaactttattacatctggtgtaa

SEQ ID NO: 606047 - DNA, 25 bp, Mus musculus
cgcaactttatttcatctggtgtaa

SEQ ID NO: 606048 - DNA, 25 bp, Mus musculus
cgcaagaacaggaccaagtcggaag

SEQ ID NO: 606049 - DNA, 25 bp, Mus musculus
cgcaagaacaggtccaagtcggaag

SEQ ID NO: 606050 - DNA, 25 bp, Mus musculus
cgcaagaatgaaagggaggaccgtt

SEQ ID NO: 606051 - DNA, 25 bp, Mus musculus
cgcaagaatgaatgggaggaccgtt

SEQ ID NO: 606052 - DNA, 25 bp, Mus musculus
cgcaagaggtcaagaagcagctact

SEQ ID NO: 606053 - DNA, 25 bp, Mus musculus
cgcaagaggtcatgaagcagctact

SEQ ID NO: 606054 - DNA, 25 bp, Mus musculus
cgcaagatgaggagacgttcgagct

SEQ ID NO: 606055 - DNA, 25 bp, Mus musculus
cgcaagatgaggtgacgttcgagct

SEQ ID NO: 606056 - DNA, 25 bp, Mus musculus
cgcaagatggaaaacaagggcagca

SEQ ID NO: 606057 - DNA, 25 bp, Mus musculus
cgcaagatggaatacaagggcagca

SEQ ID NO: 606058 - DNA, 25 bp, Mus musculus
cgcaagatggcgacggcgactatag

SEQ ID NO: 606059 - DNA, 25 bp, Mus musculus
cgcaagatggcgtcggcgactatag

SEQ ID NO: 606060 - DNA, 25 bp, Mus musculus
cgcaagcactttctacagatgaagc

SEQ ID NO: 606061 - DNA, 25 bp, Mus musculus
cgcaagcactttgtacagatgaagc

SEQ ID NO: 606062 - DNA, 25 bp, Mus musculus
cgcaagctctaccaaaagaaaatct

SEQ ID NO: 606063 - DNA, 25 bp, Mus musculus
cgcaagctctacgaaaagaaaatct

SEQ ID NO: 606064 - DNA, 25 bp, Mus musculus
cgcaagctgatcagagctgccatcc

SEQ ID NO: 606065 - DNA, 25 bp, Mus musculus
cgcaagctgatctgagctgccatcc

SEQ ID NO: 606066 - DNA, 25 bp, Mus musculus
cgcaagctgtgtcttaaagagatga

SEQ ID NO: 606067 - DNA, 25 bp, Mus musculus
cgcaagctgtgtgttaaagagatga

SEQ ID NO: 606068 - DNA, 25 bp, Mus musculus
cgcaaggaccaccagtgcaagctct

SEQ ID NO: 606069 - DNA, 25 bp, Mus musculus
cgcaaggaccacgagtgcaagctct

SEQ ID NO: 606070 - DNA, 25 bp, Mus musculus
cgcaagggcgttcagtgccagcact

SEQ ID NO: 606071 - DNA, 25 bp, Mus musculus
cgcaagggcgttgagtgccagcact

SEQ ID NO: 606072 - DNA, 25 bp, Mus musculus
cgcaaggtagaaattacttttcata

SEQ ID NO: 606073 - DNA, 25 bp, Mus musculus
cgcaaggtagaatttacttttcata

SEQ ID NO: 606074 - DNA, 25 bp, Mus musculus
cgcaaggtcactcgaggaattcaat

SEQ ID NO: 606075 - DNA, 25 bp, Mus musculus
cgcaaggtcactggaggaattcaat

SEQ ID NO: 606076 - DNA, 25 bp, Mus musculus
cgcaaggtcctcctggaagtaccca

SEQ ID NO: 606077 - DNA, 25 bp, Mus musculus
cgcaaggtcctcgtggaagtaccca

SEQ ID NO: 606078 - DNA, 25 bp, Mus musculus
cgcaagtggaccacagcaccataca

SEQ ID NO: 606079 - DNA, 25 bp, Mus musculus
cgcaagtggacctcagcaccataca

SEQ ID NO: 606080 - DNA, 25 bp, Mus musculus
cgcaatcatgagcttcgtctccaga

SEQ ID NO: 606081 - DNA, 25 bp, Mus musculus
cgcaatcatgaggttcgtctccaga

SEQ ID NO: 606082 - DNA, 25 bp, Mus musculus
cgcaatccacgtcggctagagcata

SEQ ID NO: 606083 - DNA, 25 bp, Mus musculus
cgcaatccacgtgggctagagcata

SEQ ID NO: 606084 - DNA, 25 bp, Mus musculus
cgcaatctggcacaatgcctacaga

SEQ ID NO: 606085 - DNA, 25 bp, Mus musculus
cgcaatctggcagaatgcctacaga

SEQ ID NO: 606086 - DNA, 25 bp, Mus musculus
cgcaatgagtaaacagcagctggag

SEQ ID NO: 606087 - DNA, 25 bp, Mus musculus
cgcaatgagtaatcagcagctggag

SEQ ID NO: 606088 - DNA, 25 bp, Mus musculus
cgcaatgtggcgcttgtctacgaac

SEQ ID NO: 606089 - DNA, 25 bp, Mus musculus
cgcaatgtggcggttgtctacgaac

SEQ ID NO: 606090 - DNA, 25 bp, Mus musculus
cgcaattcaggtccctcaacttttc

SEQ ID NO: 606091 - DNA, 25 bp, Mus musculus
cgcaattcaggtgcctcaacttttc

SEQ ID NO: 606092 - DNA, 25 bp, Mus musculus
cgcaattgtaggcactttgacagat

SEQ ID NO: 606093 - DNA, 25 bp, Mus musculus
cgcaattgtagggactttgacagat

SEQ ID NO: 606094 - DNA, 25 bp, Mus musculus
cgcacaaggcgtccaacgacttatg

SEQ ID NO: 606095 - DNA, 25 bp, Mus musculus
cgcacaaggcgtgcaacgacttatg

SEQ ID NO: 606096 - DNA, 25 bp, Mus musculus
cgcacacggctgatagacagcgaga

SEQ ID NO: 606097 - DNA, 25 bp, Mus musculus
cgcacacggctgttagacagcgaga

SEQ ID NO: 606098 - DNA, 25 bp, Mus musculus
cgcacagaagacaaccaggactgga

SEQ ID NO: 606099 - DNA, 25 bp, Mus musculus
cgcacagaagactaccaggactgga

SEQ ID NO: 606100 - DNA, 25 bp, Mus musculus
cgcacagacctgaagaagaacagag

SEQ ID NO: 606101 - DNA, 25 bp, Mus musculus
cgcacagacctgtagaagaacagag

SEQ ID NO: 606102 - DNA, 25 bp, Mus musculus
cgcacagacttgactgactacctca

SEQ ID NO: 606103 - DNA, 25 bp, Mus musculus
cgcacagacttgtctgactacctca

SEQ ID NO: 606104 - DNA, 25 bp, Mus musculus
cgcacagagacgaagaacacggctc

SEQ ID NO: 606105 - DNA, 25 bp, Mus musculus
cgcacagagacgtagaacacggctc

SEQ ID NO: 606106 - DNA, 25 bp, Mus musculus
cgcacagagcagaggtatggaacac

SEQ ID NO: 606107 - DNA, 25 bp, Mus musculus
cgcacagagcagtggtatggaacac

SEQ ID NO: 606108 - DNA, 25 bp, Mus musculus
cgcacagccataccctctggaggta

SEQ ID NO: 606109 - DNA, 25 bp, Mus musculus
cgcacagccatagcctctggaggta

SEQ ID NO: 606110 - DNA, 25 bp, Mus musculus
cgcacagcctgccaatatggcggtg

SEQ ID NO: 606111 - DNA, 25 bp, Mus musculus
cgcacagcctgcgaatatggcggtg

SEQ ID NO: 606112 - DNA, 25 bp, Mus musculus
cgcacagcctggaacgtggtgctcc

SEQ ID NO: 606113 - DNA, 25 bp, Mus musculus
cgcacagcctggtacgtggtgctcc

SEQ ID NO: 606114 - DNA, 25 bp, Mus musculus
cgcacagcgtgtcggatacaagaag

SEQ ID NO: 606115 - DNA, 25 bp, Mus musculus
cgcacagcgtgtgggatacaagaag

SEQ ID NO: 606116 - DNA, 25 bp, Mus musculus
cgcacagtcgtccagcaagacagat

SEQ ID NO: 606117 - DNA, 25 bp, Mus musculus
cgcacagtcgtcgagcaagacagat

SEQ ID NO: 606118 - DNA, 25 bp, Mus musculus
cgcacagtgcacagtgaatgaccta

SEQ ID NO: 606119 - DNA, 25 bp, Mus musculus
cgcacagtgcactgtgaatgaccta

SEQ ID NO: 606120 - DNA, 25 bp, Mus musculus
cgcacagtgcatcgaggtgggcagg

SEQ ID NO: 606121 - DNA, 25 bp, Mus musculus
cgcacagtgcatggaggtgggcagg

SEQ ID NO: 606122 - DNA, 25 bp, Mus musculus
cgcacatccgttagttcttttcctc

SEQ ID NO: 606123 - DNA, 25 bp, Mus musculus
cgcacatccgtttgttcttttcctc

SEQ ID NO: 606124 - DNA, 25 bp, Mus musculus
cgcacatgcagccttacatccgctt

SEQ ID NO: 606125 - DNA, 25 bp, Mus musculus
cgcacatgcagcgttacatccgctt

SEQ ID NO: 606126 - DNA, 25 bp, Mus musculus
cgcaccacagttccgggcaggaacg

SEQ ID NO: 606127 - DNA, 25 bp, Mus musculus
cgcaccacagttgcgggcaggaacg

SEQ ID NO: 606128 - DNA, 25 bp, Mus musculus
cgcaccaggtggagacaccatccag

SEQ ID NO: 606129 - DNA, 25 bp, Mus musculus
cgcaccaggtggtgacaccatccag

SEQ ID NO: 606130 - DNA, 25 bp, Mus musculus
cgcacccaaagacgcaagagtttta

SEQ ID NO: 606131 - DNA, 25 bp, Mus musculus
cgcacccaaagaggcaagagtttta

SEQ ID NO: 606132 - DNA, 25 bp, Mus musculus
cgcacccgaaaacccaacaagatat

SEQ ID NO: 606133 - DNA, 25 bp, Mus musculus
cgcacccgaaaagccaacaagatat

SEQ ID NO: 606134 - DNA, 25 bp, Mus musculus
cgcacccttgtgaattatgacccca

SEQ ID NO: 606135 - DNA, 25 bp, Mus musculus
cgcacccttgtgtattatgacccca

SEQ ID NO: 606136 - DNA, 25 bp, Mus musculus
cgcaccgaggagacataaagtgtct

SEQ ID NO: 606137 - DNA, 25 bp, Mus musculus
cgcaccgaggagtcataaagtgtct

SEQ ID NO: 606138 - DNA, 25 bp, Mus musculus
cgcaccgtgcccaggagaagagaat

SEQ ID NO: 606139 - DNA, 25 bp, Mus musculus
cgcaccgtgccctggagaagagaat

SEQ ID NO: 606140 - DNA, 25 bp, Mus musculus
cgcaccgttccccagtataaatatg

SEQ ID NO: 606141 - DNA, 25 bp, Mus musculus
cgcaccgttcccgagtataaatatg

SEQ ID NO: 606142 - DNA, 25 bp, Mus musculus
cgcacctgcgagaaggagcacttct

SEQ ID NO: 606143 - DNA, 25 bp, Mus musculus
cgcacctgcgagtaggagcacttct

SEQ ID NO: 606144 - DNA, 25 bp, Mus musculus
cgcacgactagcagtgctgacccta

SEQ ID NO: 606145 - DNA, 25 bp, Mus musculus
cgcacgactagctgtgctgacccta

SEQ ID NO: 606146 - DNA, 25 bp, Mus musculus
cgcacgccatgtatggtaggaacca

SEQ ID NO: 606147 - DNA, 25 bp, Mus musculus
cgcacgccatgtttggtaggaacca

SEQ ID NO: 606148 - DNA, 25 bp, Mus musculus
cgcacgcccgaaagtctttttgaga

SEQ ID NO: 606149 - DNA, 25 bp, Mus musculus
cgcacgcccgaatgtctttttgaga

SEQ ID NO: 606150 - DNA, 25 bp, Mus musculus
cgcacgcgtgtaccctacttctgat

SEQ ID NO: 606151 - DNA, 25 bp, Mus musculus
cgcacgcgtgtagcctacttctgat

SEQ ID NO: 606152 - DNA, 25 bp, Mus musculus
cgcacgctgctcatcttctttgact

SEQ ID NO: 606153 - DNA, 25 bp, Mus musculus
cgcacgctgctcttcttctttgact

SEQ ID NO: 606154 - DNA, 25 bp, Mus musculus
cgcacggtttgactatattggagac

SEQ ID NO: 606155 - DNA, 25 bp, Mus musculus
cgcacggtttgagtatattggagac

SEQ ID NO: 606156 - DNA, 25 bp, Mus musculus
cgcactacgctcagagctcaggtat

SEQ ID NO: 606157 - DNA, 25 bp, Mus musculus
cgcactacgctctgagctcaggtat

SEQ ID NO: 606158 - DNA, 25 bp, Mus musculus
cgcactccagtcagacggttccggg

SEQ ID NO: 606159 - DNA, 25 bp, Mus musculus
cgcactccagtctgacggttccggg

SEQ ID NO: 606160 - DNA, 25 bp, Mus musculus
cgcactggacatcgagctccgagca

SEQ ID NO: 606161 - DNA, 25 bp, Mus musculus
cgcactggacatggagctccgagca

SEQ ID NO: 606162 - DNA, 25 bp, Mus musculus
cgcactgggctgctctatgatgaga

SEQ ID NO: 606163 - DNA, 25 bp, Mus musculus
cgcactgggctggtctatgatgaga

SEQ ID NO: 606164 - DNA, 25 bp, Mus musculus
cgcactggtatcaccgagggacaca

SEQ ID NO: 606165 - DNA, 25 bp, Mus musculus
cgcactggtatctccgagggacaca

SEQ ID NO: 606166 - DNA, 25 bp, Mus musculus
cgcactgtaatgctgggcaccgctg

SEQ ID NO: 606167 - DNA, 25 bp, Mus musculus
cgcactgtaatggtgggcaccgctg

SEQ ID NO: 606168 - DNA, 25 bp, Mus musculus
cgcactgtgactcatggatccgaat

SEQ ID NO: 606169 - DNA, 25 bp, Mus musculus
cgcactgtgactgatggatccgaat

SEQ ID NO: 606170 - DNA, 25 bp, Mus musculus
cgcacttacatgactgagaatgcca

SEQ ID NO: 606171 - DNA, 25 bp, Mus musculus
cgcacttacatgtctgagaatgcca

SEQ ID NO: 606172 - DNA, 25 bp, Mus musculus
cgcacttacctaccggcgacatgga

SEQ ID NO: 606173 - DNA, 25 bp, Mus musculus
cgcacttacctagcggcgacatgga

SEQ ID NO: 606174 - DNA, 25 bp, Mus musculus
cgcacttcgaaacgcgcgcttttcg

SEQ ID NO: 606175 - DNA, 25 bp, Mus musculus
cgcacttcgaaaggcgcgcttttcg

SEQ ID NO: 606176 - DNA, 25 bp, Mus musculus
cgcagaaaagttacaggaatttaag

SEQ ID NO: 606177 - DNA, 25 bp, Mus musculus
cgcagaaaagtttcaggaatttaag

SEQ ID NO: 606178 - DNA, 25 bp, Mus musculus
cgcagaacaacaccaagcgcagcat

SEQ ID NO: 606179 - DNA, 25 bp, Mus musculus
cgcagaacaacagcaagcgcagcat

SEQ ID NO: 606180 - DNA, 25 bp, Mus musculus
cgcagaactggcacgggctttgcta

SEQ ID NO: 606181 - DNA, 25 bp, Mus musculus
cgcagaactggctcgggctttgcta

SEQ ID NO: 606182 - DNA, 25 bp, Mus musculus
cgcagaagaaggacactgccgtcct

SEQ ID NO: 606183 - DNA, 25 bp, Mus musculus
cgcagaagaaggtcactgccgtcct

SEQ ID NO: 606184 - DNA, 25 bp, Mus musculus
cgcagaagacgtcgcatttacagct

SEQ ID NO: 606185 - DNA, 25 bp, Mus musculus
cgcagaagacgtggcatttacagct

SEQ ID NO: 606186 - DNA, 25 bp, Mus musculus
cgcagaagagaacaaatagaggcct

SEQ ID NO: 606187 - DNA, 25 bp, Mus musculus
cgcagaagagaagaaatagaggcct

SEQ ID NO: 606188 - DNA, 25 bp, Mus musculus
cgcagaagataacaaccaggacaga

SEQ ID NO: 606189 - DNA, 25 bp, Mus musculus
cgcagaagataagaaccaggacaga

SEQ ID NO: 606190 - DNA, 25 bp, Mus musculus
cgcagaattggcaaactctgtgcca

SEQ ID NO: 606191 - DNA, 25 bp, Mus musculus
cgcagaattggctaactctgtgcca

SEQ ID NO: 606192 - DNA, 25 bp, Mus musculus
cgcagacatggaccaaggctacgga

SEQ ID NO: 606193 - DNA, 25 bp, Mus musculus
cgcagacatggagcaaggctacgga

SEQ ID NO: 606194 - DNA, 25 bp, Mus musculus
cgcagaccaagacggttttcttctt

SEQ ID NO: 606195 - DNA, 25 bp, Mus musculus
cgcagaccaagagggttttcttctt

SEQ ID NO: 606196 - DNA, 25 bp, Mus musculus
cgcagactccgcacctggaggagga

SEQ ID NO: 606197 - DNA, 25 bp, Mus musculus
cgcagactccgctcctggaggagga

SEQ ID NO: 606198 - DNA, 25 bp, Mus musculus
cgcagacttaatcaagccctgaaga

SEQ ID NO: 606199 - DNA, 25 bp, Mus musculus
cgcagacttaatgaagccctgaaga

SEQ ID NO: 606200 - DNA, 25 bp, Mus musculus
cgcagactttggcttagctcgagac

SEQ ID NO: 606201 - DNA, 25 bp, Mus musculus
cgcagactttgggttagctcgagac

SEQ ID NO: 606202 - DNA, 25 bp, Mus musculus
cgcagagacctgcagatcgaaaggc

SEQ ID NO: 606203 - DNA, 25 bp, Mus musculus
cgcagagacctggagatcgaaaggc

SEQ ID NO: 606204 - DNA, 25 bp, Mus musculus
cgcagagagccaaggcgaaaaggca

SEQ ID NO: 606205 - DNA, 25 bp, Mus musculus
cgcagagagccatggcgaaaaggca

SEQ ID NO: 606206 - DNA, 25 bp, Mus musculus
cgcagagcacccagacaagcgagtt

SEQ ID NO: 606207 - DNA, 25 bp, Mus musculus
cgcagagcaccctgacaagcgagtt

SEQ ID NO: 606208 - DNA, 25 bp, Mus musculus
cgcagagcaggcacgagtggacaaa

SEQ ID NO: 606209 - DNA, 25 bp, Mus musculus
cgcagagcaggctcgagtggacaaa

SEQ ID NO: 606210 - DNA, 25 bp, Mus musculus
cgcagagccgctccctgaagatcgt

SEQ ID NO: 606211 - DNA, 25 bp, Mus musculus
cgcagagccgctgcctgaagatcgt

SEQ ID NO: 606212 - DNA, 25 bp, Mus musculus
cgcagagcgagccagaacccgaacg

SEQ ID NO: 606213 - DNA, 25 bp, Mus musculus
cgcagagcgagcgagaacccgaacg

SEQ ID NO: 606214 - DNA, 25 bp, Mus musculus
cgcagaggatggacctagaagatct

SEQ ID NO: 606215 - DNA, 25 bp, Mus musculus
cgcagaggatggtcctagaagatct

SEQ ID NO: 606216 - DNA, 25 bp, Mus musculus
cgcagaggccgtctaagaccagata

SEQ ID NO: 606217 - DNA, 25 bp, Mus musculus
cgcagaggccgtgtaagaccagata

SEQ ID NO: 606218 - DNA, 25 bp, Mus musculus
cgcagaggccttcgctccagatctg

SEQ ID NO: 606219 - DNA, 25 bp, Mus musculus
cgcagaggccttggctccagatctg

SEQ ID NO: 606220 - DNA, 25 bp, Mus musculus
cgcagaggctaccttggcaggctca

SEQ ID NO: 606221 - DNA, 25 bp, Mus musculus
cgcagaggctacgttggcaggctca

SEQ ID NO: 606222 - DNA, 25 bp, Mus musculus
cgcagagtacaacgcgtggttgctt

SEQ ID NO: 606223 - DNA, 25 bp, Mus musculus
cgcagagtacaaggcgtggttgctt

SEQ ID NO: 606224 - DNA, 25 bp, Mus musculus
cgcagagtagcgctctgtgtccacg

SEQ ID NO: 606225 - DNA, 25 bp, Mus musculus
cgcagagtagcggtctgtgtccacg

SEQ ID NO: 606226 - DNA, 25 bp, Mus musculus
cgcagagtgtccctgagagattaga

SEQ ID NO: 606227 - DNA, 25 bp, Mus musculus
cgcagagtgtccgtgagagattaga

SEQ ID NO: 606228 - DNA, 25 bp, Mus musculus
cgcagataccgacctaccaagaact

SEQ ID NO: 606229 - DNA, 25 bp, Mus musculus
cgcagataccgagctaccaagaact

SEQ ID NO: 606230 - DNA, 25 bp, Mus musculus
cgcagatatcttaagttgatgaggc

SEQ ID NO: 606231 - DNA, 25 bp, Mus musculus
cgcagatatctttagttgatgaggc

SEQ ID NO: 606232 - DNA, 25 bp, Mus musculus
cgcagatcaaaacctattcctggga

SEQ ID NO: 606233 - DNA, 25 bp, Mus musculus
cgcagatcaaaagctattcctggga

SEQ ID NO: 606234 - DNA, 25 bp, Mus musculus
cgcagatcttctactcactgggctt

SEQ ID NO: 606235 - DNA, 25 bp, Mus musculus
cgcagatcttcttctcactgggctt

SEQ ID NO: 606236 - DNA, 25 bp, Mus musculus
cgcagatcttgcaggcaatcccgac

SEQ ID NO: 606237 - DNA, 25 bp, Mus musculus
cgcagatcttgctggcaatcccgac

SEQ ID NO: 606238 - DNA, 25 bp, Mus musculus
cgcagatgccatcgccaggaaactg

SEQ ID NO: 606239 - DNA, 25 bp, Mus musculus
cgcagatgccatggccaggaaactg

SEQ ID NO: 606240 - DNA, 25 bp, Mus musculus
cgcagatggacacctgcacacactt

SEQ ID NO: 606241 - DNA, 25 bp, Mus musculus
cgcagatggacagctgcacacactt

SEQ ID NO: 606242 - DNA, 25 bp, Mus musculus
cgcagcaagtctccagctgactcag

SEQ ID NO: 606243 - DNA, 25 bp, Mus musculus
cgcagcaagtctgcagctgactcag

SEQ ID NO: 606244 - DNA, 25 bp, Mus musculus
cgcagcactgctcagcaactatgag

SEQ ID NO: 606245 - DNA, 25 bp, Mus musculus
cgcagcactgctgagcaactatgag

SEQ ID NO: 606246 - DNA, 25 bp, Mus musculus
cgcagcagcacgagtctggctgtgc

SEQ ID NO: 606247 - DNA, 25 bp, Mus musculus
cgcagcagcacgtgtctggctgtgc

SEQ ID NO: 606248 - DNA, 25 bp, Mus musculus
cgcagcatggcccttttcgtaggct

SEQ ID NO: 606249 - DNA, 25 bp, Mus musculus
cgcagcatggccgttttcgtaggct

SEQ ID NO: 606250 - DNA, 25 bp, Mus musculus
cgcagcatggtgattgcaaagcact

SEQ ID NO: 606251 - DNA, 25 bp, Mus musculus
cgcagcatggtgtttgcaaagcact

SEQ ID NO: 606252 - DNA, 25 bp, Mus musculus
cgcagcattaaacagcggctcatga

SEQ ID NO: 606253 - DNA, 25 bp, Mus musculus
cgcagcattaaagagcggctcatga

SEQ ID NO: 606254 - DNA, 25 bp, Mus musculus
cgcagccaagacacggtttgcaaga

SEQ ID NO: 606255 - DNA, 25 bp, Mus musculus
cgcagccaagactcggtttgcaaga

SEQ ID NO: 606256 - DNA, 25 bp, Mus musculus
cgcagccattgtaattatcctagta

SEQ ID NO: 606257 - DNA, 25 bp, Mus musculus
cgcagccattgttattatcctagta

SEQ ID NO: 606258 - DNA, 25 bp, Mus musculus
cgcagccattttagagcagatcctc

SEQ ID NO: 606259 - DNA, 25 bp, Mus musculus
cgcagccatttttgagcagatcctc

SEQ ID NO: 606260 - DNA, 25 bp, Mus musculus
cgcagcccagctcgccattttggtg

SEQ ID NO: 606261 - DNA, 25 bp, Mus musculus
cgcagcccagctggccattttggtg

SEQ ID NO: 606262 - DNA, 25 bp, Mus musculus
cgcagccggccgagaagatcggcaa

SEQ ID NO: 606263 - DNA, 25 bp, Mus musculus
cgcagccggccgtgaagatcggcaa

SEQ ID NO: 606264 - DNA, 25 bp, Mus musculus
cgcagccttgaacttcagtcctggc

SEQ ID NO: 606265 - DNA, 25 bp, Mus musculus
cgcagccttgaagttcagtcctggc

SEQ ID NO: 606266 - DNA, 25 bp, Mus musculus
cgcagcgcattgaggagtgcatact

SEQ ID NO: 606267 - DNA, 25 bp, Mus musculus
cgcagcgcattgtggagtgcatact

SEQ ID NO: 606268 - DNA, 25 bp, Mus musculus
cgcagcgctgctatccatcgggtct

SEQ ID NO: 606269 - DNA, 25 bp, Mus musculus
cgcagcgctgctttccatcgggtct

SEQ ID NO: 606270 - DNA, 25 bp, Mus musculus
cgcagcggaggaagtctggtatcac

SEQ ID NO: 606271 - DNA, 25 bp, Mus musculus
cgcagcggaggatgtctggtatcac

SEQ ID NO: 606272 - DNA, 25 bp, Mus musculus
cgcagcggaggtagttcttgcttcc

SEQ ID NO: 606273 - DNA, 25 bp, Mus musculus
cgcagcggaggttgttcttgcttcc

SEQ ID NO: 606274 - DNA, 25 bp, Mus musculus
cgcagcggatatactgggagaacaa

SEQ ID NO: 606275 - DNA, 25 bp, Mus musculus
cgcagcggatattctgggagaacaa

SEQ ID NO: 606276 - DNA, 25 bp, Mus musculus
cgcagcggctggactggcgtcaact

SEQ ID NO: 606277 - DNA, 25 bp, Mus musculus
cgcagcggctggtctggcgtcaact

SEQ ID NO: 606278 - DNA, 25 bp, Mus musculus
cgcagcgggaaactagagggaagcc

SEQ ID NO: 606279 - DNA, 25 bp, Mus musculus
cgcagcgggaaagtagagggaagcc

SEQ ID NO: 606280 - DNA, 25 bp, Mus musculus
cgcagctagtgtcaatgtcagctga

SEQ ID NO: 606281 - DNA, 25 bp, Mus musculus
cgcagctagtgtgaatgtcagctga

SEQ ID NO: 606282 - DNA, 25 bp, Mus musculus
cgcagctcacctcatttgacaggtg

SEQ ID NO: 606283 - DNA, 25 bp, Mus musculus
cgcagctcacctctgaggactatgg

SEQ ID NO: 606284 - DNA, 25 bp, Mus musculus
cgcagctcacctgatttgacaggtg

SEQ ID NO: 606285 - DNA, 25 bp, Mus musculus
cgcagctcacctgtgaggactatgg

SEQ ID NO: 606286 - DNA, 25 bp, Mus musculus
cgcagctcccggactgcggttcgag

SEQ ID NO: 606287 - DNA, 25 bp, Mus musculus
cgcagctcccggtctgcggttcgag

SEQ ID NO: 606288 - DNA, 25 bp, Mus musculus
cgcagctcctcaacgtgttggtggc

SEQ ID NO: 606289 - DNA, 25 bp, Mus musculus
cgcagctcctcatcgtgttggtggc

SEQ ID NO: 606290 - DNA, 25 bp, Mus musculus
cgcagctcgcttaggagcagatgaa

SEQ ID NO: 606291 - DNA, 25 bp, Mus musculus
cgcagctcgctttggagcagatgaa

SEQ ID NO: 606292 - DNA, 25 bp, Mus musculus
cgcagctctggcagatgagaccatg

SEQ ID NO: 606293 - DNA, 25 bp, Mus musculus
cgcagctctggctgatgagaccatg

SEQ ID NO: 606294 - DNA, 25 bp, Mus musculus
cgcagctgcagaagtgtgagatcct

SEQ ID NO: 606295 - DNA, 25 bp, Mus musculus
cgcagctgcagatgtgtgagatcct

SEQ ID NO: 606296 - DNA, 25 bp, Mus musculus
cgcagctggaaaagcagcggagacc

SEQ ID NO: 606297 - DNA, 25 bp, Mus musculus
cgcagctggaaatgcagcggagacc

SEQ ID NO: 606298 - DNA, 25 bp, Mus musculus
cgcagcttgaagacatccataagag

SEQ ID NO: 606299 - DNA, 25 bp, Mus musculus
cgcagcttgaagtcatccataagag

SEQ ID NO: 606300 - DNA, 25 bp, Mus musculus
cgcagctttgttcgcgtagtgacgc

SEQ ID NO: 606301 - DNA, 25 bp, Mus musculus
cgcagctttgttggcgtagtgacgc

SEQ ID NO: 606302 - DNA, 25 bp, Mus musculus
cgcaggactctgcaccgttgccaga

SEQ ID NO: 606303 - DNA, 25 bp, Mus musculus
cgcaggactctggaccgttgccaga

SEQ ID NO: 606304 - DNA, 25 bp, Mus musculus
cgcaggactgggagacagctcatca

SEQ ID NO: 606305 - DNA, 25 bp, Mus musculus
cgcaggactgggtgacagctcatca

SEQ ID NO: 606306 - DNA, 25 bp, Mus musculus
cgcaggattgcgaagttctctgaca

SEQ ID NO: 606307 - DNA, 25 bp, Mus musculus
cgcaggattgcgtagttctctgaca

SEQ ID NO: 606308 - DNA, 25 bp, Mus musculus
cgcaggcactggacatgaagcggca

SEQ ID NO: 606309 - DNA, 25 bp, Mus musculus
cgcaggcactggtcatgaagcggca

SEQ ID NO: 606310 - DNA, 25 bp, Mus musculus
cgcaggccacctcaaggtcagcaaa

SEQ ID NO: 606311 - DNA, 25 bp, Mus musculus
cgcaggccacctgaaggtcagcaaa

SEQ ID NO: 606312 - DNA, 25 bp, Mus musculus
cgcaggccagatcggtccagcttca

SEQ ID NO: 606313 - DNA, 25 bp, Mus musculus
cgcaggccagatgggtccagcttca

SEQ ID NO: 606314 - DNA, 25 bp, Mus musculus
cgcaggccccaccttgagggaagca

SEQ ID NO: 606315 - DNA, 25 bp, Mus musculus
cgcaggccccacgttgagggaagca

SEQ ID NO: 606316 - DNA, 25 bp, Mus musculus
cgcaggccgtgaatcagtacaggaa

SEQ ID NO: 606317 - DNA, 25 bp, Mus musculus
cgcaggccgtgattcagtacaggaa

SEQ ID NO: 606318 - DNA, 25 bp, Mus musculus
cgcaggcctaaccttcttgcttcag

SEQ ID NO: 606319 - DNA, 25 bp, Mus musculus
cgcaggcctaacgttcttgcttcag

SEQ ID NO: 606320 - DNA, 25 bp, Mus musculus
cgcaggcctccgacaaccgtgagat

SEQ ID NO: 606321 - DNA, 25 bp, Mus musculus
cgcaggcctccgtcaaccgtgagat

SEQ ID NO: 606322 - DNA, 25 bp, Mus musculus
cgcaggcgcagaacagagactgccg

SEQ ID NO: 606323 - DNA, 25 bp, Mus musculus
cgcaggcgcagatcagagactgccg

SEQ ID NO: 606324 - DNA, 25 bp, Mus musculus
cgcaggcgcgcactgatctctgagc

SEQ ID NO: 606325 - DNA, 25 bp, Mus musculus
cgcaggcgcgcagtgatctctgagc

SEQ ID NO: 606326 - DNA, 25 bp, Mus musculus
cgcaggcggaaaaagcgagcaccga

SEQ ID NO: 606327 - DNA, 25 bp, Mus musculus
cgcaggcggaaatagcgagcaccga

SEQ ID NO: 606328 - DNA, 25 bp, Mus musculus
cgcaggcggtagaacctccacctga

SEQ ID NO: 606329 - DNA, 25 bp, Mus musculus
cgcaggcggtagtacctccacctga

SEQ ID NO: 606330 - DNA, 25 bp, Mus musculus
cgcaggctctccctgttgaggcaga

SEQ ID NO: 606331 - DNA, 25 bp, Mus musculus
cgcaggctctccgtgttgaggcaga

SEQ ID NO: 606332 - DNA, 25 bp, Mus musculus
cgcaggctgatgaccctgggagaca

SEQ ID NO: 606333 - DNA, 25 bp, Mus musculus
cgcaggctgatgtccctgggagaca

SEQ ID NO: 606334 - DNA, 25 bp, Mus musculus
cgcaggctgccaacgtgaaagagaa

SEQ ID NO: 606335 - DNA, 25 bp, Mus musculus
cgcaggctgccatcgtgaaagagaa

SEQ ID NO: 606336 - DNA, 25 bp, Mus musculus
cgcagggaatacaggaaattcttta

SEQ ID NO: 606337 - DNA, 25 bp, Mus musculus
cgcagggaatactggaaattcttta

SEQ ID NO: 606338 - DNA, 25 bp, Mus musculus
cgcaggtaattgacatatcttgatt

SEQ ID NO: 606339 - DNA, 25 bp, Mus musculus
cgcaggtaattgtcatatcttgatt

SEQ ID NO: 606340 - DNA, 25 bp, Mus musculus
cgcaggtaggtcaccaggcagcctg

SEQ ID NO: 606341 - DNA, 25 bp, Mus musculus
cgcaggtaggtctccaggcagcctg

SEQ ID NO: 606342 - DNA, 25 bp, Mus musculus
cgcaggtcccctatgttgaaattct

SEQ ID NO: 606343 - DNA, 25 bp, Mus musculus
cgcaggtcccctttgttgaaattct

SEQ ID NO: 606344 - DNA, 25 bp, Mus musculus
cgcaggtggaaaaagtgactcggat

SEQ ID NO: 606345 - DNA, 25 bp, Mus musculus
cgcaggtggaaatagtgactcggat

SEQ ID NO: 606346 - DNA, 25 bp, Mus musculus
cgcaggttctacaacttcctcatgg

SEQ ID NO: 606347 - DNA, 25 bp, Mus musculus
cgcaggttctactacttcctcatgg

SEQ ID NO: 606348 - DNA, 25 bp, Mus musculus
cgcagtacaatgagctgtttgatat

SEQ ID NO: 606349 - DNA, 25 bp, Mus musculus
cgcagtacaatgtgctgtttgatat

SEQ ID NO: 606350 - DNA, 25 bp, Mus musculus
cgcagtacagtaatgccaccaaaaa

SEQ ID NO: 606351 - DNA, 25 bp, Mus musculus
cgcagtacagtattgccaccaaaaa

SEQ ID NO: 606352 - DNA, 25 bp, Mus musculus
cgcagtataccacgtgtctggagag

SEQ ID NO: 606353 - DNA, 25 bp, Mus musculus
cgcagtataccaggtgtctggagag

SEQ ID NO: 606354 - DNA, 25 bp, Mus musculus
cgcagtcagtgtcagagtctctcaa

SEQ ID NO: 606355 - DNA, 25 bp, Mus musculus
cgcagtcagtgtgagagtctctcaa

SEQ ID NO: 606356 - DNA, 25 bp, Mus musculus
cgcagtccgcctcttgatgaggaag

SEQ ID NO: 606357 - DNA, 25 bp, Mus musculus
cgcagtccgcctgttgatgaggaag

SEQ ID NO: 606358 - DNA, 25 bp, Mus musculus
cgcagtgactttcaccaattgtgca

SEQ ID NO: 606359 - DNA, 25 bp, Mus musculus
cgcagtgactttgaccaattgtgca

SEQ ID NO: 606360 - DNA, 25 bp, Mus musculus
cgcagtgatgaactgattgacttaa

SEQ ID NO: 606361 - DNA, 25 bp, Mus musculus
cgcagtgatgaagtgattgacttaa

SEQ ID NO: 606362 - DNA, 25 bp, Mus musculus
cgcagtgcagccagcgggcatgacc

SEQ ID NO: 606363 - DNA, 25 bp, Mus musculus
cgcagtgcagcctgcgggcatgacc

SEQ ID NO: 606364 - DNA, 25 bp, Mus musculus
cgcagtgccaacatcatggagcata

SEQ ID NO: 606365 - DNA, 25 bp, Mus musculus
cgcagtgccaacttcatggagcata

SEQ ID NO: 606366 - DNA, 25 bp, Mus musculus
cgcagtgcccagctaacggtccttt

SEQ ID NO: 606367 - DNA, 25 bp, Mus musculus
cgcagtgcccaggtaacggtccttt

SEQ ID NO: 606368 - DNA, 25 bp, Mus musculus
cgcagtggccctcggataccgcaaa

SEQ ID NO: 606369 - DNA, 25 bp, Mus musculus
cgcagtggccctgggataccgcaaa

SEQ ID NO: 606370 - DNA, 25 bp, Mus musculus
cgcagtgtgacccatgcttattacc

SEQ ID NO: 606371 - DNA, 25 bp, Mus musculus
cgcagtgtgaccgatgcttattacc

SEQ ID NO: 606372 - DNA, 25 bp, Mus musculus
cgcagtgttaacattaaggagatct

SEQ ID NO: 606373 - DNA, 25 bp, Mus musculus
cgcagtgttaactttaaggagatct

SEQ ID NO: 606374 - DNA, 25 bp, Mus musculus
cgcagtgtttcacagtcgtctttga

SEQ ID NO: 606375 - DNA, 25 bp, Mus musculus
cgcagtgtttcagagtcgtctttga

SEQ ID NO: 606376 - DNA, 25 bp, Mus musculus
cgcagttagagtaccgggtgtttcg

SEQ ID NO: 606377 - DNA, 25 bp, Mus musculus
cgcagttagagttccgggtgtttcg

SEQ ID NO: 606378 - DNA, 25 bp, Mus musculus
cgcagttgaaggagccagtctgcaa

SEQ ID NO: 606379 - DNA, 25 bp, Mus musculus
cgcagttgaaggtgccagtctgcaa

SEQ ID NO: 606380 - DNA, 25 bp, Mus musculus
cgcagttggccgagttccaggccga

SEQ ID NO: 606381 - DNA, 25 bp, Mus musculus
cgcagttggccgtgttccaggccga

SEQ ID NO: 606382 - DNA, 25 bp, Mus musculus
cgcagttggttccagccctggccaa

SEQ ID NO: 606383 - DNA, 25 bp, Mus musculus
cgcagttggttcgagccctggccaa

SEQ ID NO: 606384 - DNA, 25 bp, Mus musculus
cgcagttgtccacaagcgctttggc

SEQ ID NO: 606385 - DNA, 25 bp, Mus musculus
cgcagttgtccagaagcgctttggc

SEQ ID NO: 606386 - DNA, 25 bp, Mus musculus
cgcagtttgatccttttgattccaa

SEQ ID NO: 606387 - DNA, 25 bp, Mus musculus
cgcagtttgatcgttttgattccaa

SEQ ID NO: 606388 - DNA, 25 bp, Mus musculus
cgcataataataatgaaaactggtc

SEQ ID NO: 606389 - DNA, 25 bp, Mus musculus
cgcataataatattgaaaactggtc

SEQ ID NO: 606390 - DNA, 25 bp, Mus musculus
cgcataggcagtctaatgccctgac

SEQ ID NO: 606391 - DNA, 25 bp, Mus musculus
cgcataggcagtgtaatgccctgac

SEQ ID NO: 606392 - DNA, 25 bp, Mus musculus
cgcatagggactcgtatgggcccca

SEQ ID NO: 606393 - DNA, 25 bp, Mus musculus
cgcatagggactggtatgggcccca

SEQ ID NO: 606394 - DNA, 25 bp, Mus musculus
cgcatagtgcgcaaccgtaggtcgc

SEQ ID NO: 606395 - DNA, 25 bp, Mus musculus
cgcatagtgcgctaccgtaggtcgc

SEQ ID NO: 606396 - DNA, 25 bp, Mus musculus
cgcatagtggtgattgacctgttca

SEQ ID NO: 606397 - DNA, 25 bp, Mus musculus
cgcatagtggtgtttgacctgttca

SEQ ID NO: 606398 - DNA, 25 bp, Mus musculus
cgcatcagacttctgtagggctatt

SEQ ID NO: 606399 - DNA, 25 bp, Mus musculus
cgcatcagacttgtgtagggctatt

SEQ ID NO: 606400 - DNA, 25 bp, Mus musculus
cgcatccggtatcgctctgcaagat

SEQ ID NO: 606401 - DNA, 25 bp, Mus musculus
cgcatccggtatggctctgcaagat

SEQ ID NO: 606402 - DNA, 25 bp, Mus musculus
cgcatcctgggtatgccgccagtgt

SEQ ID NO: 606403 - DNA, 25 bp, Mus musculus
cgcatcctgggtttgccgccagtgt

SEQ ID NO: 606404 - DNA, 25 bp, Mus musculus
cgcatctcccaaattcagagaccga

SEQ ID NO: 606405 - DNA, 25 bp, Mus musculus
cgcatctcccaatttcagagaccga

SEQ ID NO: 606406 - DNA, 25 bp, Mus musculus
cgcatctccggaccggtacaggaga

SEQ ID NO: 606407 - DNA, 25 bp, Mus musculus
cgcatctccggagcggtacaggaga

SEQ ID NO: 606408 - DNA, 25 bp, Mus musculus
cgcatctcttttcgtctggccgaaa

SEQ ID NO: 606409 - DNA, 25 bp, Mus musculus
cgcatctcttttggtctggccgaaa

SEQ ID NO: 606410 - DNA, 25 bp, Mus musculus
cgcatcttcggcctcaagaagcgca

SEQ ID NO: 606411 - DNA, 25 bp, Mus musculus
cgcatcttcggcgtcaagaagcgca

SEQ ID NO: 606412 - DNA, 25 bp, Mus musculus
cgcatgaattatatccacagagatc

SEQ ID NO: 606413 - DNA, 25 bp, Mus musculus
cgcatgaattatttccacagagatc

SEQ ID NO: 606414 - DNA, 25 bp, Mus musculus
cgcatgactacaacagctgggagtc

SEQ ID NO: 606415 - DNA, 25 bp, Mus musculus
cgcatgactacatcagctgggagtc

SEQ ID NO: 606416 - DNA, 25 bp, Mus musculus
cgcatgcaagacacagacctcagtg

SEQ ID NO: 606417 - DNA, 25 bp, Mus musculus
cgcatgcaagactcagacctcagtg

SEQ ID NO: 606418 - DNA, 25 bp, Mus musculus
cgcatgcacgaaaccctgaagctct

SEQ ID NO: 606419 - DNA, 25 bp, Mus musculus
cgcatgcacgaatccctgaagctct

SEQ ID NO: 606420 - DNA, 25 bp, Mus musculus
cgcatgcaggccactcgccaggaag

SEQ ID NO: 606421 - DNA, 25 bp, Mus musculus
cgcatgcaggcctctcgccaggaag

SEQ ID NO: 606422 - DNA, 25 bp, Mus musculus
cgcatgctacaccatatgtgcttaa

SEQ ID NO: 606423 - DNA, 25 bp, Mus musculus
cgcatgctacacgatatgtgcttaa

SEQ ID NO: 606424 - DNA, 25 bp, Mus musculus
cgcatggactaacgcagagactgac

SEQ ID NO: 606425 - DNA, 25 bp, Mus musculus
cgcatggactaaggcagagactgac

SEQ ID NO: 606426 - DNA, 25 bp, Mus musculus
cgcatggactgtcctgcaggccact

SEQ ID NO: 606427 - DNA, 25 bp, Mus musculus
cgcatggactgtgctgcaggccact

SEQ ID NO: 606428 - DNA, 25 bp, Mus musculus
cgcatggcagtaacatacagcaagc

SEQ ID NO: 606429 - DNA, 25 bp, Mus musculus
cgcatggcagtatcatacagcaagc

SEQ ID NO: 606430 - DNA, 25 bp, Mus musculus
cgcatggccgccatctctgagagca

SEQ ID NO: 606431 - DNA, 25 bp, Mus musculus
cgcatggccgccttctctgagagca

SEQ ID NO: 606432 - DNA, 25 bp, Mus musculus
cgcatgggtgtcacctagtccagga

SEQ ID NO: 606433 - DNA, 25 bp, Mus musculus
cgcatgggtgtctcctagtccagga

SEQ ID NO: 606434 - DNA, 25 bp, Mus musculus
cgcatggtcaagcagggagtggaga

SEQ ID NO: 606435 - DNA, 25 bp, Mus musculus
cgcatggtcaaggagggagtggaga

SEQ ID NO: 606436 - DNA, 25 bp, Mus musculus
cgcatggtggttactttgcgctgta

SEQ ID NO: 606437 - DNA, 25 bp, Mus musculus
cgcatggtggtttctttgcgctgta

SEQ ID NO: 606438 - DNA, 25 bp, Mus musculus
cgcatggtgtggacccaagaccggc

SEQ ID NO: 606439 - DNA, 25 bp, Mus musculus
cgcatggtgtggtcccaagaccggc

SEQ ID NO: 606440 - DNA, 25 bp, Mus musculus
cgcatgtctgtgactcgtgttggcc

SEQ ID NO: 606441 - DNA, 25 bp, Mus musculus
cgcatgtctgtgctctgggagaaat

SEQ ID NO: 606442 - DNA, 25 bp, Mus musculus
cgcatgtctgtggtctgggagaaat

SEQ ID NO: 606443 - DNA, 25 bp, Mus musculus
cgcatgtctgtgtctcgtgttggcc

SEQ ID NO: 606444 - DNA, 25 bp, Mus musculus
cgcatgtgcagtcgaccttccaagg

SEQ ID NO: 606445 - DNA, 25 bp, Mus musculus
cgcatgtgcagtggaccttccaagg

SEQ ID NO: 606446 - DNA, 25 bp, Mus musculus
cgcatgtggcttaagatcaccattg

SEQ ID NO: 606447 - DNA, 25 bp, Mus musculus
cgcatgtggctttagatcaccattg

SEQ ID NO: 606448 - DNA, 25 bp, Mus musculus
cgcatgttcaggacgcagctagagg

SEQ ID NO: 606449 - DNA, 25 bp, Mus musculus
cgcatgttcaggtcgcagctagagg

SEQ ID NO: 606450 - DNA, 25 bp, Mus musculus
cgcatgttcgacatcgtgggcaccc

SEQ ID NO: 606451 - DNA, 25 bp, Mus musculus
cgcatgttcgacttcgtgggcaccc

SEQ ID NO: 606452 - DNA, 25 bp, Mus musculus
cgcattaaggagctaggtactctga

SEQ ID NO: 606453 - DNA, 25 bp, Mus musculus
cgcattaaggaggtaggtactctga

SEQ ID NO: 606454 - DNA, 25 bp, Mus musculus
cgcattagtcttagccccagggcaa

SEQ ID NO: 606455 - DNA, 25 bp, Mus musculus
cgcattagtctttgccccagggcaa

SEQ ID NO: 606456 - DNA, 25 bp, Mus musculus
cgcattatggagctcattgacgcca

SEQ ID NO: 606457 - DNA, 25 bp, Mus musculus
cgcattatggaggtcattgacgcca

SEQ ID NO: 606458 - DNA, 25 bp, Mus musculus
cgcattcacctaagagaagacgcta

SEQ ID NO: 606459 - DNA, 25 bp, Mus musculus
cgcattcacctatgagaagacgcta

SEQ ID NO: 606460 - DNA, 25 bp, Mus musculus
cgcattcccatgaagacagaaagga

SEQ ID NO: 606461 - DNA, 25 bp, Mus musculus
cgcattcccatgtagacagaaagga

SEQ ID NO: 606462 - DNA, 25 bp, Mus musculus
cgcattctgtccagggctcagatgc

SEQ ID NO: 606463 - DNA, 25 bp, Mus musculus
cgcattctgtcctgggctcagatgc

SEQ ID NO: 606464 - DNA, 25 bp, Mus musculus
cgcattcttaagcatctccctctaa

SEQ ID NO: 606465 - DNA, 25 bp, Mus musculus
cgcattcttaaggatctccctctaa

SEQ ID NO: 606466 - DNA, 25 bp, Mus musculus
cgcattgacactcgatgagttttgt

SEQ ID NO: 606467 - DNA, 25 bp, Mus musculus
cgcattgacactggatgagttttgt

SEQ ID NO: 606468 - DNA, 25 bp, Mus musculus
cgcattgagggccagctacaacaac

SEQ ID NO: 606469 - DNA, 25 bp, Mus musculus
cgcattgagggcgagctacaacaac

SEQ ID NO: 606470 - DNA, 25 bp, Mus musculus
cgcattggatttcctgaaagagctt

SEQ ID NO: 606471 - DNA, 25 bp, Mus musculus
cgcattggatttgctgaaagagctt

SEQ ID NO: 606472 - DNA, 25 bp, Mus musculus
cgcattggcactacaggcgggatag

SEQ ID NO: 606473 - DNA, 25 bp, Mus musculus
cgcattggcacttcaggcgggatag

SEQ ID NO: 606474 - DNA, 25 bp, Mus musculus
cgcatttacaaaaggaggcacggcc

SEQ ID NO: 606475 - DNA, 25 bp, Mus musculus
cgcatttacaaatggaggcacggcc

SEQ ID NO: 606476 - DNA, 25 bp, Mus musculus
cgcatttccacacccattgatgaca

SEQ ID NO: 606477 - DNA, 25 bp, Mus musculus
cgcatttccacagccattgatgaca

SEQ ID NO: 606478 - DNA, 25 bp, Mus musculus
cgcattttgtgtcacagaaccagac

SEQ ID NO: 606479 - DNA, 25 bp, Mus musculus
cgcattttgtgtgacagaaccagac

SEQ ID NO: 606480 - DNA, 25 bp, Mus musculus
cgccaaaggaaccataaagattcag

SEQ ID NO: 606481 - DNA, 25 bp, Mus musculus
cgccaaaggaacgataaagattcag

SEQ ID NO: 606482 - DNA, 25 bp, Mus musculus
cgccaaaggctgagactactgccag

SEQ ID NO: 606483 - DNA, 25 bp, Mus musculus
cgccaaaggctgtgactactgccag

SEQ ID NO: 606484 - DNA, 25 bp, Mus musculus
cgccaacagagtattttgtatttcc

SEQ ID NO: 606485 - DNA, 25 bp, Mus musculus
cgccaacagagttttttgtatttcc

SEQ ID NO: 606486 - DNA, 25 bp, Mus musculus
cgccaacatgccctggctgagggtc

SEQ ID NO: 606487 - DNA, 25 bp, Mus musculus
cgccaacatgccgtggctgagggtc

SEQ ID NO: 606488 - DNA, 25 bp, Mus musculus
cgccaacattgacgaggcctataag

SEQ ID NO: 606489 - DNA, 25 bp, Mus musculus
cgccaacattgaggaggcctataag

SEQ ID NO: 606490 - DNA, 25 bp, Mus musculus
cgccaaggaaatctaactgcaccag

SEQ ID NO: 606491 - DNA, 25 bp, Mus musculus
cgccaaggaaatgtaactgcaccag

SEQ ID NO: 606492 - DNA, 25 bp, Mus musculus
cgccaatagcggcatcggaaagatg

SEQ ID NO: 606493 - DNA, 25 bp, Mus musculus
cgccaatagcgggatcggaaagatg

SEQ ID NO: 606494 - DNA, 25 bp, Mus musculus
cgccaatcttggctgaagggctgtc

SEQ ID NO: 606495 - DNA, 25 bp, Mus musculus
cgccaatcttgggtgaagggctgtc

SEQ ID NO: 606496 - DNA, 25 bp, Mus musculus
cgccacaaggtgaagtcgggagcct

SEQ ID NO: 606497 - DNA, 25 bp, Mus musculus
cgccacaaggtgtagtcgggagcct

SEQ ID NO: 606498 - DNA, 25 bp, Mus musculus
cgccacagggctagatgccatatgg

SEQ ID NO: 606499 - DNA, 25 bp, Mus musculus
cgccacagggcttgatgccatatgg

SEQ ID NO: 606500 - DNA, 25 bp, Mus musculus
cgccacagttccagatggtgaatgc

SEQ ID NO: 606501 - DNA, 25 bp, Mus musculus
cgccacagttcctgatggtgaatgc

SEQ ID NO: 606502 - DNA, 25 bp, Mus musculus
cgccaccaacagacgacgagatcta

SEQ ID NO: 606503 - DNA, 25 bp, Mus musculus
cgccaccaacagtcgacgagatcta

SEQ ID NO: 606504 - DNA, 25 bp, Mus musculus
cgccaccaggagaacctgaagatgc

SEQ ID NO: 606505 - DNA, 25 bp, Mus musculus
cgccaccaggagtacctgaagatgc

SEQ ID NO: 606506 - DNA, 25 bp, Mus musculus
cgccaccatcgcagagaggaactgg

SEQ ID NO: 606507 - DNA, 25 bp, Mus musculus
cgccaccatcgctgagaggaactgg

SEQ ID NO: 606508 - DNA, 25 bp, Mus musculus
cgccacccaatgacagctgggcgag

SEQ ID NO: 606509 - DNA, 25 bp, Mus musculus
cgccacccaatgtcagctgggcgag

SEQ ID NO: 606510 - DNA, 25 bp, Mus musculus
cgccaccctctgaaaggtgtctgag

SEQ ID NO: 606511 - DNA, 25 bp, Mus musculus
cgccaccctctgtaaggtgtctgag

SEQ ID NO: 606512 - DNA, 25 bp, Mus musculus
cgccacccttgaagatataaaagaa

SEQ ID NO: 606513 - DNA, 25 bp, Mus musculus
cgccacccttgatgatataaaagaa

SEQ ID NO: 606514 - DNA, 25 bp, Mus musculus
cgccaccgcgacatggagctgagtg

SEQ ID NO: 606515 - DNA, 25 bp, Mus musculus
cgccaccgcgacttggagctgagtg

SEQ ID NO: 606516 - DNA, 25 bp, Mus musculus
cgccaccttgttagccttgggattg

SEQ ID NO: 606517 - DNA, 25 bp, Mus musculus
cgccaccttgtttgccttgggattg

SEQ ID NO: 606518 - DNA, 25 bp, Mus musculus
cgccacgaagtgcagataccatgga

SEQ ID NO: 606519 - DNA, 25 bp, Mus musculus
cgccacgaagtggagataccatgga

SEQ ID NO: 606520 - DNA, 25 bp, Mus musculus
cgccacgctacgcaagcagcgtaag

SEQ ID NO: 606521 - DNA, 25 bp, Mus musculus
cgccacgctacggaagcagcgtaag

SEQ ID NO: 606522 - DNA, 25 bp, Mus musculus
cgccacggagggaagagagtcctaa

SEQ ID NO: 606523 - DNA, 25 bp, Mus musculus
cgccacggagggtagagagtcctaa

SEQ ID NO: 606524 - DNA, 25 bp, Mus musculus
cgccactaagctcagcacgatgaca

SEQ ID NO: 606525 - DNA, 25 bp, Mus musculus
cgccactaagctgagcacgatgaca

SEQ ID NO: 606526 - DNA, 25 bp, Mus musculus
cgccactcaagaccagatctcggag

SEQ ID NO: 606527 - DNA, 25 bp, Mus musculus
cgccactcaagagcagatctcggag

SEQ ID NO: 606528 - DNA, 25 bp, Mus musculus
cgccactcgataagtatgcctgtca

SEQ ID NO: 606529 - DNA, 25 bp, Mus musculus
cgccactcgatatgtatgcctgtca

SEQ ID NO: 606530 - DNA, 25 bp, Mus musculus
cgccacttcgaaccgtcttggagca

SEQ ID NO: 606531 - DNA, 25 bp, Mus musculus
cgccacttcgaagcgtcttggagca

SEQ ID NO: 606532 - DNA, 25 bp, Mus musculus
cgccacttcggcatggctcttggtg

SEQ ID NO: 606533 - DNA, 25 bp, Mus musculus
cgccacttcggcttggctcttggtg

SEQ ID NO: 606534 - DNA, 25 bp, Mus musculus
cgccagagaaacacaaattaagtac

SEQ ID NO: 606535 - DNA, 25 bp, Mus musculus
cgccagagaaactcaaattaagtac

SEQ ID NO: 606536 - DNA, 25 bp, Mus musculus
cgccagaggataatatccaagatag

SEQ ID NO: 606537 - DNA, 25 bp, Mus musculus
cgccagaggatattatccaagatag

SEQ ID NO: 606538 - DNA, 25 bp, Mus musculus
cgccagcaccagaaatccatgtctg

SEQ ID NO: 606539 - DNA, 25 bp, Mus musculus
cgccagcaccagtaatccatgtctg

SEQ ID NO: 606540 - DNA, 25 bp, Mus musculus
cgccagccaatcagaaaggatattt

SEQ ID NO: 606541 - DNA, 25 bp, Mus musculus
cgccagccaatctgaaaggatattt

SEQ ID NO: 606542 - DNA, 25 bp, Mus musculus
cgccagccgtctcgctaaggaggaa

SEQ ID NO: 606543 - DNA, 25 bp, Mus musculus
cgccagccgtctggctaaggaggaa

SEQ ID NO: 606544 - DNA, 25 bp, Mus musculus
cgccagctgaagacgcgggacttaa

SEQ ID NO: 606545 - DNA, 25 bp, Mus musculus
cgccagctgaagtcgcgggacttaa

SEQ ID NO: 606546 - DNA, 25 bp, Mus musculus
cgccaggccaatcggtgcttgtgaa

SEQ ID NO: 606547 - DNA, 25 bp, Mus musculus
cgccaggccaatgggtgcttgtgaa

SEQ ID NO: 606548 - DNA, 25 bp, Mus musculus
cgccaggtcctacggcacaagttca

SEQ ID NO: 606549 - DNA, 25 bp, Mus musculus
cgccaggtcctagggcacaagttca

SEQ ID NO: 606550 - DNA, 25 bp, Mus musculus
cgccaggttagcagggcgcggagac

SEQ ID NO: 606551 - DNA, 25 bp, Mus musculus
cgccaggttagctgggcgcggagac

SEQ ID NO: 606552 - DNA, 25 bp, Mus musculus
cgccaggttccgattaatgaagtgc

SEQ ID NO: 606553 - DNA, 25 bp, Mus musculus
cgccaggttccgtttaatgaagtgc

SEQ ID NO: 606554 - DNA, 25 bp, Mus musculus
cgccagtagaacatcctaactgtaa

SEQ ID NO: 606555 - DNA, 25 bp, Mus musculus
cgccagtagaacttcctaactgtaa

SEQ ID NO: 606556 - DNA, 25 bp, Mus musculus
cgccagtgaagtcctcggaagcaga

SEQ ID NO: 606557 - DNA, 25 bp, Mus musculus
cgccagtgaagtgctcggaagcaga

SEQ ID NO: 606558 - DNA, 25 bp, Mus musculus
cgccagtgcttacagaactactaaa

SEQ ID NO: 606559 - DNA, 25 bp, Mus musculus
cgccagtgcttagagaactactaaa

SEQ ID NO: 606560 - DNA, 25 bp, Mus musculus
cgccagtgtacgctcagcttctagc

SEQ ID NO: 606561 - DNA, 25 bp, Mus musculus
cgccagtgtacggtcagcttctagc

SEQ ID NO: 606562 - DNA, 25 bp, Mus musculus
cgccagtgtgtcattgcaatcgcca

SEQ ID NO: 606563 - DNA, 25 bp, Mus musculus
cgccagtgtgtctttgcaatcgcca

SEQ ID NO: 606564 - DNA, 25 bp, Mus musculus
cgccataattgtccgagggcagccc

SEQ ID NO: 606565 - DNA, 25 bp, Mus musculus
cgccataattgtgcgagggcagccc

SEQ ID NO: 606566 - DNA, 25 bp, Mus musculus
cgccatacacgcacgcagtgcttag

SEQ ID NO: 606567 - DNA, 25 bp, Mus musculus
cgccatacacgctcgcagtgcttag

SEQ ID NO: 606568 - DNA, 25 bp, Mus musculus
cgccatatagagcaaggtctgggcc

SEQ ID NO: 606569 - DNA, 25 bp, Mus musculus
cgccatatagaggaaggtctgggcc

SEQ ID NO: 606570 - DNA, 25 bp, Mus musculus
cgccatatgggaattgcttagcaac

SEQ ID NO: 606571 - DNA, 25 bp, Mus musculus
cgccatatgggatttgcttagcaac

SEQ ID NO: 606572 - DNA, 25 bp, Mus musculus
cgccatcagcaaaatggatcccact

SEQ ID NO: 606573 - DNA, 25 bp, Mus musculus
cgccatcagcaactttgtgagcggg

SEQ ID NO: 606574 - DNA, 25 bp, Mus musculus
cgccatcagcaagtttgtgagcggg

SEQ ID NO: 606575 - DNA, 25 bp, Mus musculus
cgccatcagcaatatggatcccact

SEQ ID NO: 606576 - DNA, 25 bp, Mus musculus
cgccatcagtacctgaggaagaagc

SEQ ID NO: 606577 - DNA, 25 bp, Mus musculus
cgccatcagtacgtgaggaagaagc

SEQ ID NO: 606578 - DNA, 25 bp, Mus musculus
cgccatcatggcagatggtgtgtcc

SEQ ID NO: 606579 - DNA, 25 bp, Mus musculus
cgccatcatggctgatggtgtgtcc

SEQ ID NO: 606580 - DNA, 25 bp, Mus musculus
cgccatccggaccagaaaaagccag

SEQ ID NO: 606581 - DNA, 25 bp, Mus musculus
cgccatccggacgagaaaaagccag

SEQ ID NO: 606582 - DNA, 25 bp, Mus musculus
cgccatcgccacaaacggagtggtg

SEQ ID NO: 606583 - DNA, 25 bp, Mus musculus
cgccatcgccactaacggagtggtg

SEQ ID NO: 606584 - DNA, 25 bp, Mus musculus
cgccatctcacccaaggcgtgatgg

SEQ ID NO: 606585 - DNA, 25 bp, Mus musculus
cgccatctcaccgaaggcgtgatgg

SEQ ID NO: 606586 - DNA, 25 bp, Mus musculus
cgccatgaacatcaacggaggcaat

SEQ ID NO: 606587 - DNA, 25 bp, Mus musculus
cgccatgaacatgaacggaggcaat

SEQ ID NO: 606588 - DNA, 25 bp, Mus musculus
cgccatgacgtgcagcctgaaccag

SEQ ID NO: 606589 - DNA, 25 bp, Mus musculus
cgccatgacgtggagcctgaaccag

SEQ ID NO: 606590 - DNA, 25 bp, Mus musculus
cgccatgcaggaagcgccagctgcg

SEQ ID NO: 606591 - DNA, 25 bp, Mus musculus
cgccatgcaggatgcgccagctgcg

SEQ ID NO: 606592 - DNA, 25 bp, Mus musculus
cgccatgcagtgatcatggagctta

SEQ ID NO: 606593 - DNA, 25 bp, Mus musculus
cgccatgcagtgttcatggagctta

SEQ ID NO: 606594 - DNA, 25 bp, Mus musculus
cgccatggcccacaaagtaataaaa

SEQ ID NO: 606595 - DNA, 25 bp, Mus musculus
cgccatggcccagaaagtaataaaa

SEQ ID NO: 606596 - DNA, 25 bp, Mus musculus
cgccatgggtcgcaagcggttcatc

SEQ ID NO: 606597 - DNA, 25 bp, Mus musculus
cgccatgggtcggaagcggttcatc

SEQ ID NO: 606598 - DNA, 25 bp, Mus musculus
cgccatgtacatcgcccttctgtgt

SEQ ID NO: 606599 - DNA, 25 bp, Mus musculus
cgccatgtacatggcccttctgtgt

SEQ ID NO: 606600 - DNA, 25 bp, Mus musculus
cgccatgtggttcatgtacgtgctg

SEQ ID NO: 606601 - DNA, 25 bp, Mus musculus
cgccatgtggttgatgtacgtgctg

SEQ ID NO: 606602 - DNA, 25 bp, Mus musculus
cgccatgttgtaacctgagctctac

SEQ ID NO: 606603 - DNA, 25 bp, Mus musculus
cgccatgttgtatcctgagctctac

SEQ ID NO: 606604 - DNA, 25 bp, Mus musculus
cgccatgttgtgcttgatgaagtag

SEQ ID NO: 606605 - DNA, 25 bp, Mus musculus
cgccatgttgtggttgatgaagtag

SEQ ID NO: 606606 - DNA, 25 bp, Mus musculus
cgccattaaataccagtaggcctcc

SEQ ID NO: 606607 - DNA, 25 bp, Mus musculus
cgccattaaatagcagtaggcctcc

SEQ ID NO: 606608 - DNA, 25 bp, Mus musculus
cgccattcagacagtggcagatgga

SEQ ID NO: 606609 - DNA, 25 bp, Mus musculus
cgccattcagactgtggcagatgga

SEQ ID NO: 606610 - DNA, 25 bp, Mus musculus
cgccattccataagtatgcctgcca

SEQ ID NO: 606611 - DNA, 25 bp, Mus musculus
cgccattccatatgtatgcctgcca

SEQ ID NO: 606612 - DNA, 25 bp, Mus musculus
cgcccaacagcgagtccaaggtcag

SEQ ID NO: 606613 - DNA, 25 bp, Mus musculus
cgcccaacagcgtgtccaaggtcag

SEQ ID NO: 606614 - DNA, 25 bp, Mus musculus
cgcccaagaggtaccggtggctgaa

SEQ ID NO: 606615 - DNA, 25 bp, Mus musculus
cgcccaagaggttccggtggctgaa

SEQ ID NO: 606616 - DNA, 25 bp, Mus musculus
cgcccaatgtgtctgacctcaactg

SEQ ID NO: 606617 - DNA, 25 bp, Mus musculus
cgcccaatgtgtgtgacctcaactg

SEQ ID NO: 606618 - DNA, 25 bp, Mus musculus
cgcccacaacatcagcagcagtagt

SEQ ID NO: 606619 - DNA, 25 bp, Mus musculus
cgcccacaacatgagcagcagtagt

SEQ ID NO: 606620 - DNA, 25 bp, Mus musculus
cgcccaccaggaagcctactgtaat

SEQ ID NO: 606621 - DNA, 25 bp, Mus musculus
cgcccaccaggatgcctactgtaat

SEQ ID NO: 606622 - DNA, 25 bp, Mus musculus
cgcccaccagtacagattgaagaat

SEQ ID NO: 606623 - DNA, 25 bp, Mus musculus
cgcccaccagtagagattgaagaat

SEQ ID NO: 606624 - DNA, 25 bp, Mus musculus
cgcccacgggaacgaagatgtccaa

SEQ ID NO: 606625 - DNA, 25 bp, Mus musculus
cgcccacgggaaggaagatgtccaa

SEQ ID NO: 606626 - DNA, 25 bp, Mus musculus
cgcccagaaagaagctacaccttgg

SEQ ID NO: 606627 - DNA, 25 bp, Mus musculus
cgcccagaaagatgctacaccttgg

SEQ ID NO: 606628 - DNA, 25 bp, Mus musculus
cgcccagagaatcccattatttata

SEQ ID NO: 606629 - DNA, 25 bp, Mus musculus
cgcccagagaatgccattatttata

SEQ ID NO: 606630 - DNA, 25 bp, Mus musculus
cgcccagagcgcaggcaaatcggtg

SEQ ID NO: 606631 - DNA, 25 bp, Mus musculus
cgcccagagcgctggcaaatcggtg

SEQ ID NO: 606632 - DNA, 25 bp, Mus musculus
cgcccagagggtcgtgctgaagaag

SEQ ID NO: 606633 - DNA, 25 bp, Mus musculus
cgcccagagggtggtgctgaagaag

SEQ ID NO: 606634 - DNA, 25 bp, Mus musculus
cgcccagcggcactttgattttggt

SEQ ID NO: 606635 - DNA, 25 bp, Mus musculus
cgcccagcggcagtttgattttggt

SEQ ID NO: 606636 - DNA, 25 bp, Mus musculus
cgcccaggatgacaatggttatact

SEQ ID NO: 606637 - DNA, 25 bp, Mus musculus
cgcccaggatgagaatggttatact

SEQ ID NO: 606638 - DNA, 25 bp, Mus musculus
cgcccagggaggacctcacaggtaa

SEQ ID NO: 606639 - DNA, 25 bp, Mus musculus
cgcccagggaggtcctcacaggtaa

SEQ ID NO: 606640 - DNA, 25 bp, Mus musculus
cgcccagtatggacctggaaaccaa

SEQ ID NO: 606641 - DNA, 25 bp, Mus musculus
cgcccagtatggtcctggaaaccaa

SEQ ID NO: 606642 - DNA, 25 bp, Mus musculus
cgcccagtggatccagatggtctaa

SEQ ID NO: 606643 - DNA, 25 bp, Mus musculus
cgcccagtggatgcagatggtctaa

SEQ ID NO: 606644 - DNA, 25 bp, Mus musculus
cgcccagtggctacacaagctgtac

SEQ ID NO: 606645 - DNA, 25 bp, Mus musculus
cgcccagtggcttcacaagctgtac

SEQ ID NO: 606646 - DNA, 25 bp, Mus musculus
cgcccagtttgtagtgagccaggta

SEQ ID NO: 606647 - DNA, 25 bp, Mus musculus
cgcccagtttgttgtgagccaggta

SEQ ID NO: 606648 - DNA, 25 bp, Mus musculus
cgcccatcgacgagaagacggagga

SEQ ID NO: 606649 - DNA, 25 bp, Mus musculus
cgcccatcgacgtgaagacggagga

SEQ ID NO: 606650 - DNA, 25 bp, Mus musculus
cgcccatctgcgagcaagcggaata

SEQ ID NO: 606651 - DNA, 25 bp, Mus musculus
cgcccatctgcgtgcaagcggaata

SEQ ID NO: 606652 - DNA, 25 bp, Mus musculus
cgcccatgactacactttacgagag

SEQ ID NO: 606653 - DNA, 25 bp, Mus musculus
cgcccatgactagactttacgagag

SEQ ID NO: 606654 - DNA, 25 bp, Mus musculus
cgcccatgattgctggccttgggaa

SEQ ID NO: 606655 - DNA, 25 bp, Mus musculus
cgcccatgattggtggccttgggaa

SEQ ID NO: 606656 - DNA, 25 bp, Mus musculus
cgcccattgttcagccgagccaggg

SEQ ID NO: 606657 - DNA, 25 bp, Mus musculus
cgcccattgttctgccgagccaggg

SEQ ID NO: 606658 - DNA, 25 bp, Mus musculus
cgccccagagagacgtgaagtgtgc

SEQ ID NO: 606659 - DNA, 25 bp, Mus musculus
cgccccagagagtcgtgaagtgtgc

SEQ ID NO: 606660 - DNA, 25 bp, Mus musculus
cgccccgagatgatcgcgaccggag

SEQ ID NO: 606661 - DNA, 25 bp, Mus musculus
cgccccgagatgttcgcgaccggag

SEQ ID NO: 606662 - DNA, 25 bp, Mus musculus
cgccccgatgtgaagtgtgtgatcc

SEQ ID NO: 606663 - DNA, 25 bp, Mus musculus
cgccccgatgtgtagtgtgtgatcc

SEQ ID NO: 606664 - DNA, 25 bp, Mus musculus
cgccccgggaggatctgatctcaga

SEQ ID NO: 606665 - DNA, 25 bp, Mus musculus
cgccccgggaggttctgatctcaga

SEQ ID NO: 606666 - DNA, 25 bp, Mus musculus
cgcccctacgataagaacatcgatc

SEQ ID NO: 606667 - DNA, 25 bp, Mus musculus
cgcccctacgattagaacatcgatc

SEQ ID NO: 606668 - DNA, 25 bp, Mus musculus
cgcccctcggagagtggaatttgaa

SEQ ID NO: 606669 - DNA, 25 bp, Mus musculus
cgcccctcggagtgtggaatttgaa

SEQ ID NO: 606670 - DNA, 25 bp, Mus musculus
cgcccgagcccaaggagatcgtgcg

SEQ ID NO: 606671 - DNA, 25 bp, Mus musculus
cgcccgagcccatggagatcgtgcg

SEQ ID NO: 606672 - DNA, 25 bp, Mus musculus
cgcccgcagtctacgaggtgatgaa

SEQ ID NO: 606673 - DNA, 25 bp, Mus musculus
cgcccgcagtcttcgaggtgatgaa

SEQ ID NO: 606674 - DNA, 25 bp, Mus musculus
cgcccgcttgttccagacataagga

SEQ ID NO: 606675 - DNA, 25 bp, Mus musculus
cgcccgcttgttgcagacataagga

SEQ ID NO: 606676 - DNA, 25 bp, Mus musculus
cgcccggagcgaatggataagaaac

SEQ ID NO: 606677 - DNA, 25 bp, Mus musculus
cgcccggagcgattggataagaaac

SEQ ID NO: 606678 - DNA, 25 bp, Mus musculus
cgcccggaggacaggctctaggtta

SEQ ID NO: 606679 - DNA, 25 bp, Mus musculus
cgcccggaggactggctctaggtta

SEQ ID NO: 606680 - DNA, 25 bp, Mus musculus
cgcccggcgagacaatattttttat

SEQ ID NO: 606681 - DNA, 25 bp, Mus musculus
cgcccggcgagagaatattttttat

SEQ ID NO: 606682 - DNA, 25 bp, Mus musculus
cgcccgggatgactgcagaatatgc

SEQ ID NO: 606683 - DNA, 25 bp, Mus musculus
cgcccgggatgagtgcagaatatgc

SEQ ID NO: 606684 - DNA, 25 bp, Mus musculus
cgcccgggcaagatctccagagtta

SEQ ID NO: 606685 - DNA, 25 bp, Mus musculus
cgcccgggcaagttctccagagtta

SEQ ID NO: 606686 - DNA, 25 bp, Mus musculus
cgcccggtgccaatcatattggtaa

SEQ ID NO: 606687 - DNA, 25 bp, Mus musculus
cgcccggtgccattcatattggtaa

SEQ ID NO: 606688 - DNA, 25 bp, Mus musculus
cgcccggttaaaatgcaggttggag

SEQ ID NO: 606689 - DNA, 25 bp, Mus musculus
cgcccggttaaattgcaggttggag

SEQ ID NO: 606690 - DNA, 25 bp, Mus musculus
cgccctatttctagtgacgttccct

SEQ ID NO: 606691 - DNA, 25 bp, Mus musculus
cgccctatttcttgtgacgttccct

SEQ ID NO: 606692 - DNA, 25 bp, Mus musculus
cgccctcagcacattttctttggtg

SEQ ID NO: 606693 - DNA, 25 bp, Mus musculus
cgccctcagcactttttctttggtg

SEQ ID NO: 606694 - DNA, 25 bp, Mus musculus
cgccctcgatgaagtccactaagga

SEQ ID NO: 606695 - DNA, 25 bp, Mus musculus
cgccctcgatgatgtccactaagga

SEQ ID NO: 606696 - DNA, 25 bp, Mus musculus
cgccctcgcacgattggcagggaga

SEQ ID NO: 606697 - DNA, 25 bp, Mus musculus
cgccctcgcacgtttggcagggaga

SEQ ID NO: 606698 - DNA, 25 bp, Mus musculus
cgccctctggaaagagcgccaaacg

SEQ ID NO: 606699 - DNA, 25 bp, Mus musculus
cgccctctggaatgagcgccaaacg

SEQ ID NO: 606700 - DNA, 25 bp, Mus musculus
cgccctctgtgcactattgttggag

SEQ ID NO: 606701 - DNA, 25 bp, Mus musculus
cgccctctgtgctctattgttggag

SEQ ID NO: 606702 - DNA, 25 bp, Mus musculus
cgccctgaaggacgcagtcctggaa

SEQ ID NO: 606703 - DNA, 25 bp, Mus musculus
cgccctgaaggaggcagtcctggaa

SEQ ID NO: 606704 - DNA, 25 bp, Mus musculus
cgccctgaaggccaatggagtccag

SEQ ID NO: 606705 - DNA, 25 bp, Mus musculus
cgccctgaaggcgaatggagtccag

SEQ ID NO: 606706 - DNA, 25 bp, Mus musculus
cgccctgacaatcaggaagccatga

SEQ ID NO: 606707 - DNA, 25 bp, Mus musculus
cgccctgacaatgaggaagccatga

SEQ ID NO: 606708 - DNA, 25 bp, Mus musculus
cgccctgcagtgaccatcgtcagtg

SEQ ID NO: 606709 - DNA, 25 bp, Mus musculus
cgccctgcagtgtccatcgtcagtg

SEQ ID NO: 606710 - DNA, 25 bp, Mus musculus
cgccctgcgtgaagaacacagggag

SEQ ID NO: 606711 - DNA, 25 bp, Mus musculus
cgccctgcgtgatgaacacagggag

SEQ ID NO: 606712 - DNA, 25 bp, Mus musculus
cgccctggagcgactgaaggtcatg

SEQ ID NO: 606713 - DNA, 25 bp, Mus musculus
cgccctggagcgtctgaaggtcatg

SEQ ID NO: 606714 - DNA, 25 bp, Mus musculus
cgccctgtggagctcgtctgagaaa

SEQ ID NO: 606715 - DNA, 25 bp, Mus musculus
cgccctgtggaggtcgtctgagaaa

SEQ ID NO: 606716 - DNA, 25 bp, Mus musculus
cgccctgtggtgaggcctcaaccat

SEQ ID NO: 606717 - DNA, 25 bp, Mus musculus
cgccctgtggtgtggcctcaaccat

SEQ ID NO: 606718 - DNA, 25 bp, Mus musculus
cgcccttgagaaagatgaccggagt

SEQ ID NO: 606719 - DNA, 25 bp, Mus musculus
cgcccttgagaatgatgaccggagt

SEQ ID NO: 606720 - DNA, 25 bp, Mus musculus
cgcccttgctgacgcagcggctaaa

SEQ ID NO: 606721 - DNA, 25 bp, Mus musculus
cgcccttgctgaggcagcggctaaa

SEQ ID NO: 606722 - DNA, 25 bp, Mus musculus
cgcccttggaggataatcatttgca

SEQ ID NO: 606723 - DNA, 25 bp, Mus musculus
cgcccttggaggttaatcatttgca

SEQ ID NO: 606724 - DNA, 25 bp, Mus musculus
cgcccttgggaaataagagatgtaa

SEQ ID NO: 606725 - DNA, 25 bp, Mus musculus
cgcccttgggaattaagagatgtaa

SEQ ID NO: 606726 - DNA, 25 bp, Mus musculus
cgccgacgactcagtcagcttctca

SEQ ID NO: 606727 - DNA, 25 bp, Mus musculus
cgccgacgactctgtcagcttctca

SEQ ID NO: 606728 - DNA, 25 bp, Mus musculus
cgccgacttgctccccagttgggag

SEQ ID NO: 606729 - DNA, 25 bp, Mus musculus
cgccgacttgctgcccagttgggag

SEQ ID NO: 606730 - DNA, 25 bp, Mus musculus
cgccgagacctgaactttgagcgag

SEQ ID NO: 606731 - DNA, 25 bp, Mus musculus
cgccgagacctgtactttgagcgag

SEQ ID NO: 606732 - DNA, 25 bp, Mus musculus
cgccgaggctacacactctacggga

SEQ ID NO: 606733 - DNA, 25 bp, Mus musculus
cgccgaggctactcactctacggga

SEQ ID NO: 606734 - DNA, 25 bp, Mus musculus
cgccgaggtgatatcaacttgctga

SEQ ID NO: 606735 - DNA, 25 bp, Mus musculus
cgccgaggtgatttcaacttgctga

SEQ ID NO: 606736 - DNA, 25 bp, Mus musculus
cgccgagtgcgacctcaggagatta

SEQ ID NO: 606737 - DNA, 25 bp, Mus musculus
cgccgagtgcgagctcaggagatta

SEQ ID NO: 606738 - DNA, 25 bp, Mus musculus
cgccgcagaagacgtcgcatttaca

SEQ ID NO: 606739 - DNA, 25 bp, Mus musculus
cgccgcagaagaggtcgcatttaca

SEQ ID NO: 606740 - DNA, 25 bp, Mus musculus
cgccgcaggatcacgatgttccgga

SEQ ID NO: 606741 - DNA, 25 bp, Mus musculus
cgccgcaggatctcgatgttccgga

SEQ ID NO: 606742 - DNA, 25 bp, Mus musculus
cgccgcagggtaataagcagggatc

SEQ ID NO: 606743 - DNA, 25 bp, Mus musculus
cgccgcagggtattaagcagggatc

SEQ ID NO: 606744 - DNA, 25 bp, Mus musculus
cgccgcatggatccatctgaccggg

SEQ ID NO: 606745 - DNA, 25 bp, Mus musculus
cgccgcatggatgcatctgaccggg

SEQ ID NO: 606746 - DNA, 25 bp, Mus musculus
cgccgccaatcacaaaggatcaagt

SEQ ID NO: 606747 - DNA, 25 bp, Mus musculus
cgccgccaatcagaaaggatcaagt

SEQ ID NO: 606748 - DNA, 25 bp, Mus musculus
cgccgccatcttctgggagcgaaac

SEQ ID NO: 606749 - DNA, 25 bp, Mus musculus
cgccgccatcttgtgggagcgaaac

SEQ ID NO: 606750 - DNA, 25 bp, Mus musculus
cgccgcctctcgcagtgttgcaata

SEQ ID NO: 606751 - DNA, 25 bp, Mus musculus
cgccgcctctcggagtgttgcaata

SEQ ID NO: 606752 - DNA, 25 bp, Mus musculus
cgccgcgatattatctttccggtgg

SEQ ID NO: 606753 - DNA, 25 bp, Mus musculus
cgccgcgatattttctttccggtgg

SEQ ID NO: 606754 - DNA, 25 bp, Mus musculus
cgccgcggagggacaatttcagtca

SEQ ID NO: 606755 - DNA, 25 bp, Mus musculus
cgccgcggagggtcaatttcagtca

SEQ ID NO: 606756 - DNA, 25 bp, Mus musculus
cgccgctgcatcattgtaggcaatg

SEQ ID NO: 606757 - DNA, 25 bp, Mus musculus
cgccgctgcatctttgtaggcaatg

SEQ ID NO: 606758 - DNA, 25 bp, Mus musculus
cgccgctgtgagacagtcatcaatg

SEQ ID NO: 606759 - DNA, 25 bp, Mus musculus
cgccgctgtgagtcagtcatcaatg

SEQ ID NO: 606760 - DNA, 25 bp, Mus musculus
cgccggaaccggcaccataaatatg

SEQ ID NO: 606761 - DNA, 25 bp, Mus musculus
cgccggaaccgggaccataaatatg

SEQ ID NO: 606762 - DNA, 25 bp, Mus musculus
cgccggcgttcacggagatgcccat

SEQ ID NO: 606763 - DNA, 25 bp, Mus musculus
cgccggcgttcagggagatgcccat

SEQ ID NO: 606764 - DNA, 25 bp, Mus musculus
cgccgggaactgagcattgctgtct

SEQ ID NO: 606765 - DNA, 25 bp, Mus musculus
cgccgggaactgtgcattgctgtct

SEQ ID NO: 606766 - DNA, 25 bp, Mus musculus
cgccgggagtctacacaaaacttat

SEQ ID NO: 606767 - DNA, 25 bp, Mus musculus
cgccgggagtcttcacaaaacttat

SEQ ID NO: 606768 - DNA, 25 bp, Mus musculus
cgccgggtccaaatgcgtccgcttg

SEQ ID NO: 606769 - DNA, 25 bp, Mus musculus
cgccgggtccaattgcgtccgcttg

SEQ ID NO: 606770 - DNA, 25 bp, Mus musculus
cgccggtcctcgagagctaataaag

SEQ ID NO: 606771 - DNA, 25 bp, Mus musculus
cgccggtcctcgtgagctaataaag

SEQ ID NO: 606772 - DNA, 25 bp, Mus musculus
cgccggtgagcaactgctgcttgga

SEQ ID NO: 606773 - DNA, 25 bp, Mus musculus
cgccggtgagcatctgctgcttgga

SEQ ID NO: 606774 - DNA, 25 bp, Mus musculus
cgccgtacagcccaatagccgagga

SEQ ID NO: 606775 - DNA, 25 bp, Mus musculus
cgccgtacagccgaatagccgagga

SEQ ID NO: 606776 - DNA, 25 bp, Mus musculus
cgccgtagactgagggtctgaaatc

SEQ ID NO: 606777 - DNA, 25 bp, Mus musculus
cgccgtagactgtgggtctgaaatc

SEQ ID NO: 606778 - DNA, 25 bp, Mus musculus
cgccgtaggcggagcatccttccgg

SEQ ID NO: 606779 - DNA, 25 bp, Mus musculus
cgccgtaggcggtgcatccttccgg

SEQ ID NO: 606780 - DNA, 25 bp, Mus musculus
cgccgtcatggcagcttaggctgcg

SEQ ID NO: 606781 - DNA, 25 bp, Mus musculus
cgccgtcatggctgcttaggctgcg

SEQ ID NO: 606782 - DNA, 25 bp, Mus musculus
cgccgtcggatgactggaaaagcca

SEQ ID NO: 606783 - DNA, 25 bp, Mus musculus
cgccgtcggatgtctggaaaagcca

SEQ ID NO: 606784 - DNA, 25 bp, Mus musculus
cgccgtctttgccatatccactgat

SEQ ID NO: 606785 - DNA, 25 bp, Mus musculus
cgccgtctttgcgatatccactgat

SEQ ID NO: 606786 - DNA, 25 bp, Mus musculus
cgccgtgaggtgagttcctgtgtcc

SEQ ID NO: 606787 - DNA, 25 bp, Mus musculus
cgccgtgaggtgtgttcctgtgtcc

SEQ ID NO: 606788 - DNA, 25 bp, Mus musculus
cgccgtgggaggatctacagaaata

SEQ ID NO: 606789 - DNA, 25 bp, Mus musculus
cgccgtgggaggttctacagaaata

SEQ ID NO: 606790 - DNA, 25 bp, Mus musculus
cgccgtgtacaactgtaagaacggg

SEQ ID NO: 606791 - DNA, 25 bp, Mus musculus
cgccgtgtacaagtgtaagaacggg

SEQ ID NO: 606792 - DNA, 25 bp, Mus musculus
cgccgtgtatgaaaagctctatcca

SEQ ID NO: 606793 - DNA, 25 bp, Mus musculus
cgccgtgtatgataagctctatcca

SEQ ID NO: 606794 - DNA, 25 bp, Mus musculus
cgccgtgtgcaaaagggtgaccaca

SEQ ID NO: 606795 - DNA, 25 bp, Mus musculus
cgccgtgtgcaatagggtgaccaca

SEQ ID NO: 606796 - DNA, 25 bp, Mus musculus
cgcctaccagcgcaaccggatgaga

SEQ ID NO: 606797 - DNA, 25 bp, Mus musculus
cgcctaccagcggaaccggatgaga

SEQ ID NO: 606798 - DNA, 25 bp, Mus musculus
cgcctagaacgacgcctggagcaga

SEQ ID NO: 606799 - DNA, 25 bp, Mus musculus
cgcctagaacgaggcctggagcaga

SEQ ID NO: 606800 - DNA, 25 bp, Mus musculus
cgcctagaaggcatgtagcattatt

SEQ ID NO: 606801 - DNA, 25 bp, Mus musculus
cgcctagaaggcttgtagcattatt

SEQ ID NO: 606802 - DNA, 25 bp, Mus musculus
cgcctagaccgaacgcgagcgctga

SEQ ID NO: 606803 - DNA, 25 bp, Mus musculus
cgcctagaccgatcgcgagcgctga

SEQ ID NO: 606804 - DNA, 25 bp, Mus musculus
cgcctagaggagctgcgtgagcaca

SEQ ID NO: 606805 - DNA, 25 bp, Mus musculus
cgcctagaggaggtgcgtgagcaca

SEQ ID NO: 606806 - DNA, 25 bp, Mus musculus
cgcctagtagttccctgtcacaaag

SEQ ID NO: 606807 - DNA, 25 bp, Mus musculus
cgcctagtagttgcctgtcacaaag

SEQ ID NO: 606808 - DNA, 25 bp, Mus musculus
cgcctatcgcgccttatctttgcag

SEQ ID NO: 606809 - DNA, 25 bp, Mus musculus
cgcctatcgcgcgttatctttgcag

SEQ ID NO: 606810 - DNA, 25 bp, Mus musculus
cgcctatgtaccagtgctacagaga

SEQ ID NO: 606811 - DNA, 25 bp, Mus musculus
cgcctatgtacctgtgctacagaga

SEQ ID NO: 606812 - DNA, 25 bp, Mus musculus
cgcctcacctggagcgagctgttcg

SEQ ID NO: 606813 - DNA, 25 bp, Mus musculus
cgcctcacctggtgcgagctgttcg

SEQ ID NO: 606814 - DNA, 25 bp, Mus musculus
cgcctcacggagcaagagttgcata

SEQ ID NO: 606815 - DNA, 25 bp, Mus musculus
cgcctcacggaggaagagttgcata

SEQ ID NO: 606816 - DNA, 25 bp, Mus musculus
cgcctcacgtacagagcgtgctgtg

SEQ ID NO: 606817 - DNA, 25 bp, Mus musculus
cgcctcacgtactgagcgtgctgtg

SEQ ID NO: 606818 - DNA, 25 bp, Mus musculus
cgcctcagcgaccctgtagatctgg

SEQ ID NO: 606819 - DNA, 25 bp, Mus musculus
cgcctcagcgacgctgtagatctgg

SEQ ID NO: 606820 - DNA, 25 bp, Mus musculus
cgcctcagtgggaccgggacaagat

SEQ ID NO: 606821 - DNA, 25 bp, Mus musculus
cgcctcagtgggtccgggacaagat

SEQ ID NO: 606822 - DNA, 25 bp, Mus musculus
cgcctcataggccagtttgtctttg

SEQ ID NO: 606823 - DNA, 25 bp, Mus musculus
cgcctcataggcgagtttgtctttg

SEQ ID NO: 606824 - DNA, 25 bp, Mus musculus
cgcctcatggctaactctctgaaag

SEQ ID NO: 606825 - DNA, 25 bp, Mus musculus
cgcctcatggcttactctctgaaag

SEQ ID NO: 606826 - DNA, 25 bp, Mus musculus
cgcctccagtttcatgaattccaga

SEQ ID NO: 606827 - DNA, 25 bp, Mus musculus
cgcctccagtttgatgaattccaga

SEQ ID NO: 606828 - DNA, 25 bp, Mus musculus
cgcctccattagaatccccgttgtg

SEQ ID NO: 606829 - DNA, 25 bp, Mus musculus
cgcctccattagtatccccgttgtg

SEQ ID NO: 606830 - DNA, 25 bp, Mus musculus
cgcctccgctatatccagggatacg

SEQ ID NO: 606831 - DNA, 25 bp, Mus musculus
cgcctccgctatttccagggatacg

SEQ ID NO: 606832 - DNA, 25 bp, Mus musculus
cgcctccggagacgctttccgatag

SEQ ID NO: 606833 - DNA, 25 bp, Mus musculus
cgcctccggagaggctttccgatag

SEQ ID NO: 606834 - DNA, 25 bp, Mus musculus
cgcctccttggcattataacaaaaa

SEQ ID NO: 606835 - DNA, 25 bp, Mus musculus
cgcctccttggctttataacaaaaa

SEQ ID NO: 606836 - DNA, 25 bp, Mus musculus
cgcctctactggctggattccaagt

SEQ ID NO: 606837 - DNA, 25 bp, Mus musculus
cgcctctactgggtggattccaagt

SEQ ID NO: 606838 - DNA, 25 bp, Mus musculus
cgcctctatgggacggtgagtgact

SEQ ID NO: 606839 - DNA, 25 bp, Mus musculus
cgcctctatgggtcggtgagtgact

SEQ ID NO: 606840 - DNA, 25 bp, Mus musculus
cgcctctcaggaaggaaaactcatc

SEQ ID NO: 606841 - DNA, 25 bp, Mus musculus
cgcctctcaggatggaaaactcatc

SEQ ID NO: 606842 - DNA, 25 bp, Mus musculus
cgcctctcctggattgtaggagaag

SEQ ID NO: 606843 - DNA, 25 bp, Mus musculus
cgcctctcctggtttgtaggagaag

SEQ ID NO: 606844 - DNA, 25 bp, Mus musculus
cgcctgacaggaagagcagttcaga

SEQ ID NO: 606845 - DNA, 25 bp, Mus musculus
cgcctgacaggatgagcagttcaga

SEQ ID NO: 606846 - DNA, 25 bp, Mus musculus
cgcctgacaggtccggagcatgtac

SEQ ID NO: 606847 - DNA, 25 bp, Mus musculus
cgcctgacaggtgcggagcatgtac

SEQ ID NO: 606848 - DNA, 25 bp, Mus musculus
cgcctgacggagcaggtgatttccc

SEQ ID NO: 606849 - DNA, 25 bp, Mus musculus
cgcctgacggaggaggtgatttccc

SEQ ID NO: 606850 - DNA, 25 bp, Mus musculus
cgcctgagaccgcagcaccttgttt

SEQ ID NO: 606851 - DNA, 25 bp, Mus musculus
cgcctgagaccggagcaccttgttt

SEQ ID NO: 606852 - DNA, 25 bp, Mus musculus
cgcctgatgacaccttgcaactagt

SEQ ID NO: 606853 - DNA, 25 bp, Mus musculus
cgcctgatgacagcttgcaactagt

SEQ ID NO: 606854 - DNA, 25 bp, Mus musculus
cgcctgatgctacagagatctcgtg

SEQ ID NO: 606855 - DNA, 25 bp, Mus musculus
cgcctgatgctagagagatctcgtg

SEQ ID NO: 606856 - DNA, 25 bp, Mus musculus
cgcctgcattttactccgaaagggt

SEQ ID NO: 606857 - DNA, 25 bp, Mus musculus
cgcctgcatttttctccgaaagggt

SEQ ID NO: 606858 - DNA, 25 bp, Mus musculus
cgcctgcctgaacccagagggcaat

SEQ ID NO: 606859 - DNA, 25 bp, Mus musculus
cgcctgcctgaagccagagggcaat

SEQ ID NO: 606860 - DNA, 25 bp, Mus musculus
cgcctgcgcgagaacagcctcaagt

SEQ ID NO: 606861 - DNA, 25 bp, Mus musculus
cgcctgcgcgagtacagcctcaagt

SEQ ID NO: 606862 - DNA, 25 bp, Mus musculus
cgcctgctgaaccagatgaaccgct

SEQ ID NO: 606863 - DNA, 25 bp, Mus musculus
cgcctgctgaacgagatgaaccgct

SEQ ID NO: 606864 - DNA, 25 bp, Mus musculus
cgcctgctgtgaagttgagtgtgtc

SEQ ID NO: 606865 - DNA, 25 bp, Mus musculus
cgcctgctgtgatgttgagtgtgtc

SEQ ID NO: 606866 - DNA, 25 bp, Mus musculus
cgcctgctgtgtcgcaaagagactg

SEQ ID NO: 606867 - DNA, 25 bp, Mus musculus
cgcctgctgtgtggcaaagagactg

SEQ ID NO: 606868 - DNA, 25 bp, Mus musculus
cgcctgcttgggagcattcagcctt

SEQ ID NO: 606869 - DNA, 25 bp, Mus musculus
cgcctgcttgggtgcattcagcctt

SEQ ID NO: 606870 - DNA, 25 bp, Mus musculus
cgcctggaccgcagcaagatccggt

SEQ ID NO: 606871 - DNA, 25 bp, Mus musculus
cgcctggaccgctgcaagatccggt

SEQ ID NO: 606872 - DNA, 25 bp, Mus musculus
cgcctggatgacaagaacacggatg

SEQ ID NO: 606873 - DNA, 25 bp, Mus musculus
cgcctggatgactagaacacggatg

SEQ ID NO: 606874 - DNA, 25 bp, Mus musculus
cgcctgggaggcattgatgagaccc

SEQ ID NO: 606875 - DNA, 25 bp, Mus musculus
cgcctgggaggctttgatgagaccc

SEQ ID NO: 606876 - DNA, 25 bp, Mus musculus
cgcctgggatggatcagcttgcaca

SEQ ID NO: 606877 - DNA, 25 bp, Mus musculus
cgcctgggatggttcagcttgcaca

SEQ ID NO: 606878 - DNA, 25 bp, Mus musculus
cgcctgggcattaatggctccatta

SEQ ID NO: 606879 - DNA, 25 bp, Mus musculus
cgcctgggcatttatggctccatta

SEQ ID NO: 606880 - DNA, 25 bp, Mus musculus
cgcctggtcgttctgtggacctgca

SEQ ID NO: 606881 - DNA, 25 bp, Mus musculus
cgcctggtcgttgtgtggacctgca

SEQ ID NO: 606882 - DNA, 25 bp, Mus musculus
cgcctggtgctcagtaagacataca

SEQ ID NO: 606883 - DNA, 25 bp, Mus musculus
cgcctggtgctctgtaagacataca

SEQ ID NO: 606884 - DNA, 25 bp, Mus musculus
cgcctggtggatctaccagaaatag

SEQ ID NO: 606885 - DNA, 25 bp, Mus musculus
cgcctggtggatgtaccagaaatag

SEQ ID NO: 606886 - DNA, 25 bp, Mus musculus
cgcctgtagatgacccgcagagtgg

SEQ ID NO: 606887 - DNA, 25 bp, Mus musculus
cgcctgtagatgtcccgcagagtgg

SEQ ID NO: 606888 - DNA, 25 bp, Mus musculus
cgcctgtcaacaagctgctaaggat

SEQ ID NO: 606889 - DNA, 25 bp, Mus musculus
cgcctgtcaacatgctgctaaggat

SEQ ID NO: 606890 - DNA, 25 bp, Mus musculus
cgcctgtcagtgcaatgtcgccgca

SEQ ID NO: 606891 - DNA, 25 bp, Mus musculus
cgcctgtcagtggaatgtcgccgca

SEQ ID NO: 606892 - DNA, 25 bp, Mus musculus
cgcctgtcatgaacacatggtttta

SEQ ID NO: 606893 - DNA, 25 bp, Mus musculus
cgcctgtcatgatcacatggtttta

SEQ ID NO: 606894 - DNA, 25 bp, Mus musculus
cgcctgtgcctcagtgagcacagtt

SEQ ID NO: 606895 - DNA, 25 bp, Mus musculus
cgcctgtgcctctgtgagcacagtt

SEQ ID NO: 606896 - DNA, 25 bp, Mus musculus
cgcctgtgtggtccgagatgccact

SEQ ID NO: 606897 - DNA, 25 bp, Mus musculus
cgcctgtgtggtgcgagatgccact

SEQ ID NO: 606898 - DNA, 25 bp, Mus musculus
cgccttacagctcggtacgctttga

SEQ ID NO: 606899 - DNA, 25 bp, Mus musculus
cgccttacagctgggtacgctttga

SEQ ID NO: 606900 - DNA, 25 bp, Mus musculus
cgccttagcctccaagactcggtgg

SEQ ID NO: 606901 - DNA, 25 bp, Mus musculus
cgccttagcctcgaagactcggtgg

SEQ ID NO: 606902 - DNA, 25 bp, Mus musculus
cgccttcccgatagagagagctgca

SEQ ID NO: 606903 - DNA, 25 bp, Mus musculus
cgccttcccgattgagagagctgca

SEQ ID NO: 606904 - DNA, 25 bp, Mus musculus
cgccttcctgaactccagggtgtca

SEQ ID NO: 606905 - DNA, 25 bp, Mus musculus
cgccttcctgaagtccagggtgtca

SEQ ID NO: 606906 - DNA, 25 bp, Mus musculus
cgccttcgagacagtgagaatactc

SEQ ID NO: 606907 - DNA, 25 bp, Mus musculus
cgccttcgagactgtgagaatactc

SEQ ID NO: 606908 - DNA, 25 bp, Mus musculus
cgccttcgcagtatgatcgttttga

SEQ ID NO: 606909 - DNA, 25 bp, Mus musculus
cgccttcgcagtttgatcgttttga

SEQ ID NO: 606910 - DNA, 25 bp, Mus musculus
cgccttgaagacattagagctgaac

SEQ ID NO: 606911 - DNA, 25 bp, Mus musculus
cgccttgaagactttagagctgaac

SEQ ID NO: 606912 - DNA, 25 bp, Mus musculus
cgccttgaccggcagctgcagctag

SEQ ID NO: 606913 - DNA, 25 bp, Mus musculus
cgccttgaccgggagctgcagctag

SEQ ID NO: 606914 - DNA, 25 bp, Mus musculus
cgccttgagcgcatatgacttggtg

SEQ ID NO: 606915 - DNA, 25 bp, Mus musculus
cgccttgagcgcttatgacttggtg

SEQ ID NO: 606916 - DNA, 25 bp, Mus musculus
cgccttgcaggtagcataactgtga

SEQ ID NO: 606917 - DNA, 25 bp, Mus musculus
cgccttgcaggttgcataactgtga

SEQ ID NO: 606918 - DNA, 25 bp, Mus musculus
cgcgaaaagcaactagtagcggaat

SEQ ID NO: 606919 - DNA, 25 bp, Mus musculus
cgcgaaaagcaagtagtagcggaat

SEQ ID NO: 606920 - DNA, 25 bp, Mus musculus
cgcgaactttccagctttggttgtg

SEQ ID NO: 606921 - DNA, 25 bp, Mus musculus
cgcgaactttcctgctttggttgtg

SEQ ID NO: 606922 - DNA, 25 bp, Mus musculus
cgcgaataattactgggaggtgatt

SEQ ID NO: 606923 - DNA, 25 bp, Mus musculus
cgcgaataattagtgggaggtgatt

SEQ ID NO: 606924 - DNA, 25 bp, Mus musculus
cgcgaatgtttcagcttgatgtgtt

SEQ ID NO: 606925 - DNA, 25 bp, Mus musculus
cgcgaatgtttctgcttgatgtgtt

SEQ ID NO: 606926 - DNA, 25 bp, Mus musculus
cgcgaattaactcgcccagtgtgga

SEQ ID NO: 606927 - DNA, 25 bp, Mus musculus
cgcgaattaactggcccagtgtgga

SEQ ID NO: 606928 - DNA, 25 bp, Mus musculus
cgcgaatttcttcgaaaaaagctca

SEQ ID NO: 606929 - DNA, 25 bp, Mus musculus
cgcgaatttcttggaaaaaagctca

SEQ ID NO: 606930 - DNA, 25 bp, Mus musculus
cgcgacagcgatcctagcgctgcgt

SEQ ID NO: 606931 - DNA, 25 bp, Mus musculus
cgcgacagcgatgctagcgctgcgt

SEQ ID NO: 606932 - DNA, 25 bp, Mus musculus
cgcgacgacgagaacgactacctct

SEQ ID NO: 606933 - DNA, 25 bp, Mus musculus
cgcgacgacgagtacgactacctct

SEQ ID NO: 606934 - DNA, 25 bp, Mus musculus
cgcgagacattgacgtggttagacc

SEQ ID NO: 606935 - DNA, 25 bp, Mus musculus
cgcgagacattgtcgtggttagacc

SEQ ID NO: 606936 - DNA, 25 bp, Mus musculus
cgcgagagctgcagactacgtcgtg

SEQ ID NO: 606937 - DNA, 25 bp, Mus musculus
cgcgagagctgctgactacgtcgtg

SEQ ID NO: 606938 - DNA, 25 bp, Mus musculus
cgcgagatttggctcaagcttcttg

SEQ ID NO: 606939 - DNA, 25 bp, Mus musculus
cgcgagatttgggtcaagcttcttg

SEQ ID NO: 606940 - DNA, 25 bp, Mus musculus
cgcgagcaagaaccagcaggatgac

SEQ ID NO: 606941 - DNA, 25 bp, Mus musculus
cgcgagcaagaagcagcaggatgac

SEQ ID NO: 606942 - DNA, 25 bp, Mus musculus
cgcgagcgacacaggtgtctccgtg

SEQ ID NO: 606943 - DNA, 25 bp, Mus musculus
cgcgagcgacactggtgtctccgtg

SEQ ID NO: 606944 - DNA, 25 bp, Mus musculus
cgcgagctctcgctgcaatgcgcag

SEQ ID NO: 606945 - DNA, 25 bp, Mus musculus
cgcgagctctcggtgcaatgcgcag

SEQ ID NO: 606946 - DNA, 25 bp, Mus musculus
cgcgaggctcagaccacaggtagtg

SEQ ID NO: 606947 - DNA, 25 bp, Mus musculus
cgcgaggctcagtccacaggtagtg

SEQ ID NO: 606948 - DNA, 25 bp, Mus musculus
cgcgagggccgcaccgtagtgctca

SEQ ID NO: 606949 - DNA, 25 bp, Mus musculus
cgcgagggccgctccgtagtgctca

SEQ ID NO: 606950 - DNA, 25 bp, Mus musculus
cgcgatattttcattccggtggttg

SEQ ID NO: 606951 - DNA, 25 bp, Mus musculus
cgcgatattttctttccggtggttg

SEQ ID NO: 606952 - DNA, 25 bp, Mus musculus
cgcgatgagcatctgcagggcctta

SEQ ID NO: 606953 - DNA, 25 bp, Mus musculus
cgcgatgagcatgtgcagggcctta

SEQ ID NO: 606954 - DNA, 25 bp, Mus musculus
cgcgatgatgtgcagagcatcaact

SEQ ID NO: 606955 - DNA, 25 bp, Mus musculus
cgcgatgatgtggagagcatcaact

SEQ ID NO: 606956 - DNA, 25 bp, Mus musculus
cgcgatgctttccactgctgcttac

SEQ ID NO: 606957 - DNA, 25 bp, Mus musculus
cgcgatgctttcgactgctgcttac

SEQ ID NO: 606958 - DNA, 25 bp, Mus musculus
cgcgatgtcgtgctctccctctatt

SEQ ID NO: 606959 - DNA, 25 bp, Mus musculus
cgcgatgtcgtggtctccctctatt

SEQ ID NO: 606960 - DNA, 25 bp, Mus musculus
cgcgcaaacgtcagagatgagttag

SEQ ID NO: 606961 - DNA, 25 bp, Mus musculus
cgcgcaaacgtctgagatgagttag

SEQ ID NO: 606962 - DNA, 25 bp, Mus musculus
cgcgcacagactagactgactacct

SEQ ID NO: 606963 - DNA, 25 bp, Mus musculus
cgcgcacagacttgactgactacct

SEQ ID NO: 606964 - DNA, 25 bp, Mus musculus
cgcgcacaggtgagtatgaactgag

SEQ ID NO: 606965 - DNA, 25 bp, Mus musculus
cgcgcacaggtgtgtatgaactgag

SEQ ID NO: 606966 - DNA, 25 bp, Mus musculus
cgcgcagaagttctcagcgctcacg

SEQ ID NO: 606967 - DNA, 25 bp, Mus musculus
cgcgcagaagttgtcagcgctcacg

SEQ ID NO: 606968 - DNA, 25 bp, Mus musculus
cgcgcagaggcaaccggaagctcct

SEQ ID NO: 606969 - DNA, 25 bp, Mus musculus
cgcgcagaggcatccggaagctcct

SEQ ID NO: 606970 - DNA, 25 bp, Mus musculus
cgcgcaggccagatgggtccagctt

SEQ ID NO: 606971 - DNA, 25 bp, Mus musculus
cgcgcaggccagttgggtccagctt

SEQ ID NO: 606972 - DNA, 25 bp, Mus musculus
cgcgcagtgaatagccttcgagaca

SEQ ID NO: 606973 - DNA, 25 bp, Mus musculus
cgcgcagtgaattgccttcgagaca

SEQ ID NO: 606974 - DNA, 25 bp, Mus musculus
cgcgcatgtgcaccatccgtatgag

SEQ ID NO: 606975 - DNA, 25 bp, Mus musculus
cgcgcatgtgcagcatccgtatgag

SEQ ID NO: 606976 - DNA, 25 bp, Mus musculus
cgcgcattgcttattgtgcctggca

SEQ ID NO: 606977 - DNA, 25 bp, Mus musculus
cgcgcattgctttttgtgcctggca

SEQ ID NO: 606978 - DNA, 25 bp, Mus musculus
cgcgcccgcggcattgagatctatg

SEQ ID NO: 606979 - DNA, 25 bp, Mus musculus
cgcgcccgcggctttgagatctatg

SEQ ID NO: 606980 - DNA, 25 bp, Mus musculus
cgcgccctatttctagtgacgttcc

SEQ ID NO: 606981 - DNA, 25 bp, Mus musculus
cgcgccctatttgtagtgacgttcc

SEQ ID NO: 606982 - DNA, 25 bp, Mus musculus
cgcgccctttcgcagctaagcttaa

SEQ ID NO: 606983 - DNA, 25 bp, Mus musculus
cgcgccctttcggagctaagcttaa

SEQ ID NO: 606984 - DNA, 25 bp, Mus musculus
cgcgccgccataatgggaagcgcca

SEQ ID NO: 606985 - DNA, 25 bp, Mus musculus
cgcgccgccatattgggaagcgcca

SEQ ID NO: 606986 - DNA, 25 bp, Mus musculus
cgcgccgcccggaaggagattttcg

SEQ ID NO: 606987 - DNA, 25 bp, Mus musculus
cgcgccgcccggtaggagattttcg

SEQ ID NO: 606988 - DNA, 25 bp, Mus musculus
cgcgccgcggcgatctcggttacag

SEQ ID NO: 606989 - DNA, 25 bp, Mus musculus
cgcgccgcggcgttctcggttacag

SEQ ID NO: 606990 - DNA, 25 bp, Mus musculus
cgcgccgggcgtcaggagttaaaga

SEQ ID NO: 606991 - DNA, 25 bp, Mus musculus
cgcgccgggcgtgaggagttaaaga

SEQ ID NO: 606992 - DNA, 25 bp, Mus musculus
cgcgcctaccgacaactagttctta

SEQ ID NO: 606993 - DNA, 25 bp, Mus musculus
cgcgcctaccgagaactagttctta

SEQ ID NO: 606994 - DNA, 25 bp, Mus musculus
cgcgcctcttgcactcgactgttaa

SEQ ID NO: 606995 - DNA, 25 bp, Mus musculus
cgcgcctcttgctctcgactgttaa

SEQ ID NO: 606996 - DNA, 25 bp, Mus musculus
cgcgcctgagaaataacaagcggat

SEQ ID NO: 606997 - DNA, 25 bp, Mus musculus
cgcgcctgagaattaacaagcggat

SEQ ID NO: 606998 - DNA, 25 bp, Mus musculus
cgcgcgaaggctcagacaacctcag

SEQ ID NO: 606999 - DNA, 25 bp, Mus musculus
cgcgcgaaggctgagacaacctcag

SEQ ID NO: 607000 - DNA, 25 bp, Mus musculus
cgcgcgcgctagagttcttgactct

SEQ ID NO: 607001 - DNA, 25 bp, Mus musculus
cgcgcgcgctagtgttcttgactct

SEQ ID NO: 607002 - DNA, 25 bp, Mus musculus
cgcgcgctcggaaggtgagccacta

SEQ ID NO: 607003 - DNA, 25 bp, Mus musculus
cgcgcgctcggatggtgagccacta

SEQ ID NO: 607004 - DNA, 25 bp, Mus musculus
cgcgcggcccttcgacgaatgtgta

SEQ ID NO: 607005 - DNA, 25 bp, Mus musculus
cgcgcggcccttggacgaatgtgta

SEQ ID NO: 607006 - DNA, 25 bp, Mus musculus
cgcgcggttgccatgacgacaggca

SEQ ID NO: 607007 - DNA, 25 bp, Mus musculus
cgcgcggttgccttgacgacaggca

SEQ ID NO: 607008 - DNA, 25 bp, Mus musculus
cgcgcgtacacacgcagaggcagct

SEQ ID NO: 607009 - DNA, 25 bp, Mus musculus
cgcgcgtacacaggcagaggcagct

SEQ ID NO: 607010 - DNA, 25 bp, Mus musculus
cgcgcgtccccaaagcattgcaaga

SEQ ID NO: 607011 - DNA, 25 bp, Mus musculus
cgcgcgtccccatagcattgcaaga

SEQ ID NO: 607012 - DNA, 25 bp, Mus musculus
cgcgcgttcgaaagtggtgtttatg

SEQ ID NO: 607013 - DNA, 25 bp, Mus musculus
cgcgcgttcgaatgtggtgtttatg

SEQ ID NO: 607014 - DNA, 25 bp, Mus musculus
cgcgctagccagcactcggctttgt

SEQ ID NO: 607015 - DNA, 25 bp, Mus musculus
cgcgctagccaggactcggctttgt

SEQ ID NO: 607016 - DNA, 25 bp, Mus musculus
cgcgctcaatctcagaaggactggg

SEQ ID NO: 607017 - DNA, 25 bp, Mus musculus
cgcgctcaatctgagaaggactggg

SEQ ID NO: 607018 - DNA, 25 bp, Mus musculus
cgcgctccaagactgtatttgtgta

SEQ ID NO: 607019 - DNA, 25 bp, Mus musculus
cgcgctccaagagtgtatttgtgta

SEQ ID NO: 607020 - DNA, 25 bp, Mus musculus
cgcgctcgtgctcaggctgagcaaa

SEQ ID NO: 607021 - DNA, 25 bp, Mus musculus
cgcgctcgtgctgaggctgagcaaa

SEQ ID NO: 607022 - DNA, 25 bp, Mus musculus
cgcgctctgcctcctcttagtctgg

SEQ ID NO: 607023 - DNA, 25 bp, Mus musculus
cgcgctctgcctgctcttagtctgg

SEQ ID NO: 607024 - DNA, 25 bp, Mus musculus
cgcgctgcgtgcaggtctttgagca

SEQ ID NO: 607025 - DNA, 25 bp, Mus musculus
cgcgctgcgtgctggtctttgagca

SEQ ID NO: 607026 - DNA, 25 bp, Mus musculus
cgcgctgctcttccccgagaaggag

SEQ ID NO: 607027 - DNA, 25 bp, Mus musculus
cgcgctgctcttgcccgagaaggag

SEQ ID NO: 607028 - DNA, 25 bp, Mus musculus
cgcgctggcgcactggacgtggtca

SEQ ID NO: 607029 - DNA, 25 bp, Mus musculus
cgcgctggcgcagtggacgtggtca

SEQ ID NO: 607030 - DNA, 25 bp, Mus musculus
cgcgctggtggcatcaatgctactg

SEQ ID NO: 607031 - DNA, 25 bp, Mus musculus
cgcgctggtggcttcaatgctactg

SEQ ID NO: 607032 - DNA, 25 bp, Mus musculus
cgcgcttaatctcgcgcagggcaca

SEQ ID NO: 607033 - DNA, 25 bp, Mus musculus
cgcgcttaatctggcgcagggcaca

SEQ ID NO: 607034 - DNA, 25 bp, Mus musculus
cgcgcttcgtggctgaagtacagtc

SEQ ID NO: 607035 - DNA, 25 bp, Mus musculus
cgcgcttcgtgggtgaagtacagtc

SEQ ID NO: 607036 - DNA, 25 bp, Mus musculus
cgcgcttggctaagtacaggctcca

SEQ ID NO: 607037 - DNA, 25 bp, Mus musculus
cgcgcttggctatgtacaggctcca

SEQ ID NO: 607038 - DNA, 25 bp, Mus musculus
cgcgcttggctcctgtgaatgagca

SEQ ID NO: 607039 - DNA, 25 bp, Mus musculus
cgcgcttggctcgtgtgaatgagca

SEQ ID NO: 607040 - DNA, 25 bp, Mus musculus
cgcgcttttcggaggctgcggtccc

SEQ ID NO: 607041 - DNA, 25 bp, Mus musculus
cgcgcttttcggtggctgcggtccc

SEQ ID NO: 607042 - DNA, 25 bp, Mus musculus
cgcggaacaggcagctccgcagagc

SEQ ID NO: 607043 - DNA, 25 bp, Mus musculus
cgcggaacaggctgctccgcagagc

SEQ ID NO: 607044 - DNA, 25 bp, Mus musculus
cgcggaagcgtcactgaaagcggca

SEQ ID NO: 607045 - DNA, 25 bp, Mus musculus
cgcggaagcgtctctgaaagcggca

SEQ ID NO: 607046 - DNA, 25 bp, Mus musculus
cgcggaatcgtgcagaggttgtcat

SEQ ID NO: 607047 - DNA, 25 bp, Mus musculus
cgcggaatcgtggagaggttgtcat

SEQ ID NO: 607048 - DNA, 25 bp, Mus musculus
cgcggaccgtggctactttatccag

SEQ ID NO: 607049 - DNA, 25 bp, Mus musculus
cgcggaccgtgggtactttatccag

SEQ ID NO: 607050 - DNA, 25 bp, Mus musculus
cgcggacgggctctgatgactaaca

SEQ ID NO: 607051 - DNA, 25 bp, Mus musculus
cgcggacgggctgtgatgactaaca

SEQ ID NO: 607052 - DNA, 25 bp, Mus musculus
cgcggacgttgaccgtcctctggac

SEQ ID NO: 607053 - DNA, 25 bp, Mus musculus
cgcggacgttgagcgtcctctggac

SEQ ID NO: 607054 - DNA, 25 bp, Mus musculus
cgcggactagccaccttggttgtga

SEQ ID NO: 607055 - DNA, 25 bp, Mus musculus
cgcggactagcctccttggttgtga

SEQ ID NO: 607056 - DNA, 25 bp, Mus musculus
cgcggagatggtactgcctggcttc

SEQ ID NO: 607057 - DNA, 25 bp, Mus musculus
cgcggagatggttctgcctggcttc

SEQ ID NO: 607058 - DNA, 25 bp, Mus musculus
cgcggagcgtttcctggaaactgct

SEQ ID NO: 607059 - DNA, 25 bp, Mus musculus
cgcggagcgtttgctggaaactgct

SEQ ID NO: 607060 - DNA, 25 bp, Mus musculus
cgcggagtccttcgcgcgactacaa

SEQ ID NO: 607061 - DNA, 25 bp, Mus musculus
cgcggagtccttggcgcgactacaa

SEQ ID NO: 607062 - DNA, 25 bp, Mus musculus
cgcggattccgaagccccggaggca

SEQ ID NO: 607063 - DNA, 25 bp, Mus musculus
cgcggattccgatgccccggaggca

SEQ ID NO: 607064 - DNA, 25 bp, Mus musculus
cgcggcaagttcaaggtggagacct

SEQ ID NO: 607065 - DNA, 25 bp, Mus musculus
cgcggcaagttctaggtggagacct

SEQ ID NO: 607066 - DNA, 25 bp, Mus musculus
cgcggcaggattcgattcttccaaa

SEQ ID NO: 607067 - DNA, 25 bp, Mus musculus
cgcggcaggattggattcttccaaa

SEQ ID NO: 607068 - DNA, 25 bp, Mus musculus
cgcggcaggtagaccacttactctt

SEQ ID NO: 607069 - DNA, 25 bp, Mus musculus
cgcggcaggtagtccacttactctt

SEQ ID NO: 607070 - DNA, 25 bp, Mus musculus
cgcggcatcggcaggcagaataaaa

SEQ ID NO: 607071 - DNA, 25 bp, Mus musculus
cgcggcatcggctggcagaataaaa

SEQ ID NO: 607072 - DNA, 25 bp, Mus musculus
cgcggcatgagaacgtggtgctctt

SEQ ID NO: 607073 - DNA, 25 bp, Mus musculus
cgcggcatgagatcgtggtgctctt

SEQ ID NO: 607074 - DNA, 25 bp, Mus musculus
cgcggcattgagatctatgcggtag

SEQ ID NO: 607075 - DNA, 25 bp, Mus musculus
cgcggcattgagttctatgcggtag

SEQ ID NO: 607076 - DNA, 25 bp, Mus musculus
cgcggccgccaacaagtataacatg

SEQ ID NO: 607077 - DNA, 25 bp, Mus musculus
cgcggccgccaagaagtataacatg

SEQ ID NO: 607078 - DNA, 25 bp, Mus musculus
cgcggccgcgagagctgctgactac

SEQ ID NO: 607079 - DNA, 25 bp, Mus musculus
cgcggccgcgagtgctgctgactac

SEQ ID NO: 607080 - DNA, 25 bp, Mus musculus
cgcggccttcttcgcgcagcaagag

SEQ ID NO: 607081 - DNA, 25 bp, Mus musculus
cgcggccttcttggcgcagcaagag

SEQ ID NO: 607082 - DNA, 25 bp, Mus musculus
cgcggcgatttcattggaacagctt

SEQ ID NO: 607083 - DNA, 25 bp, Mus musculus
cgcggcgatttctttggaacagctt

SEQ ID NO: 607084 - DNA, 25 bp, Mus musculus
cgcggctgatgaaaccggctcggat

SEQ ID NO: 607085 - DNA, 25 bp, Mus musculus
cgcggctgatgataccggctcggat

SEQ ID NO: 607086 - DNA, 25 bp, Mus musculus
cgcggcttctcgctgactgtggaaa

SEQ ID NO: 607087 - DNA, 25 bp, Mus musculus
cgcggcttctcggtgactgtggaaa

SEQ ID NO: 607088 - DNA, 25 bp, Mus musculus
cgcggcttggatatcaaactggagg

SEQ ID NO: 607089 - DNA, 25 bp, Mus musculus
cgcggcttggatttcaaactggagg

SEQ ID NO: 607090 - DNA, 25 bp, Mus musculus
cgcgggagcgctcttgttctttctc

SEQ ID NO: 607091 - DNA, 25 bp, Mus musculus
cgcgggagcgctgttgttctttctc

SEQ ID NO: 607092 - DNA, 25 bp, Mus musculus
cgcgggcaagaaccgctttgaagtt

SEQ ID NO: 607093 - DNA, 25 bp, Mus musculus
cgcgggcaagaagcgctttgaagtt

SEQ ID NO: 607094 - DNA, 25 bp, Mus musculus
cgcgggtccttcatgtgcagataaa

SEQ ID NO: 607095 - DNA, 25 bp, Mus musculus
cgcgggtccttcttgtgcagataaa

SEQ ID NO: 607096 - DNA, 25 bp, Mus musculus
cgcgggtgcggtccatcaataccag

SEQ ID NO: 607097 - DNA, 25 bp, Mus musculus
cgcgggtgcggtgcatcaataccag

SEQ ID NO: 607098 - DNA, 25 bp, Mus musculus
cgcggtcgtgtcagaggagcccatt

SEQ ID NO: 607099 - DNA, 25 bp, Mus musculus
cgcggtcgtgtctgaggagcccatt

SEQ ID NO: 607100 - DNA, 25 bp, Mus musculus
cgcggtgaacaaagtggatgctgct

SEQ ID NO: 607101 - DNA, 25 bp, Mus musculus
cgcggtgaacaatgtggatgctgct

SEQ ID NO: 607102 - DNA, 25 bp, Mus musculus
cgcggtgaccacagcaggaaagtag

SEQ ID NO: 607103 - DNA, 25 bp, Mus musculus
cgcggtgaccactgcaggaaagtag

SEQ ID NO: 607104 - DNA, 25 bp, Mus musculus
cgcggtgcaggtcatcgcagatcct

SEQ ID NO: 607105 - DNA, 25 bp, Mus musculus
cgcggtgcaggtgatcgcagatcct

SEQ ID NO: 607106 - DNA, 25 bp, Mus musculus
cgcggtgtccagagcccggctcgga

SEQ ID NO: 607107 - DNA, 25 bp, Mus musculus
cgcggtgtccagtgcccggctcgga

SEQ ID NO: 607108 - DNA, 25 bp, Mus musculus
cgcggttcttgtaaagtgagcgagc

SEQ ID NO: 607109 - DNA, 25 bp, Mus musculus
cgcggttcttgttaagtgagcgagc

SEQ ID NO: 607110 - DNA, 25 bp, Mus musculus
cgcggtttccgccactctgttggtt

SEQ ID NO: 607111 - DNA, 25 bp, Mus musculus
cgcggtttccgcgactctgttggtt

SEQ ID NO: 607112 - DNA, 25 bp, Mus musculus
cgcgtacagtttaccctggaccact

SEQ ID NO: 607113 - DNA, 25 bp, Mus musculus
cgcgtacagttttccctggaccact

SEQ ID NO: 607114 - DNA, 25 bp, Mus musculus
cgcgtccggaggaccgacagctctg

SEQ ID NO: 607115 - DNA, 25 bp, Mus musculus
cgcgtccggaggtccgacagctctg

SEQ ID NO: 607116 - DNA, 25 bp, Mus musculus
cgcgtcgcaccgacgggctttgtca

SEQ ID NO: 607117 - DNA, 25 bp, Mus musculus
cgcgtcgcaccgtcgggctttgtca

SEQ ID NO: 607118 - DNA, 25 bp, Mus musculus
cgcgtcgcagacatggagcaaggct

SEQ ID NO: 607119 - DNA, 25 bp, Mus musculus
cgcgtcgcagacttggagcaaggct

SEQ ID NO: 607120 - DNA, 25 bp, Mus musculus
cgcgtctgctgtacatgaaggagaa

SEQ ID NO: 607121 - DNA, 25 bp, Mus musculus
cgcgtctgctgttcatgaaggagaa

SEQ ID NO: 607122 - DNA, 25 bp, Mus musculus
cgcgtgatggtacatgccaatgaag

SEQ ID NO: 607123 - DNA, 25 bp, Mus musculus
cgcgtgatggtagatgccaatgaag

SEQ ID NO: 607124 - DNA, 25 bp, Mus musculus
cgcgtgcggcttctggaaagatact

SEQ ID NO: 607125 - DNA, 25 bp, Mus musculus
cgcgtgcggcttgtggaaagatact

SEQ ID NO: 607126 - DNA, 25 bp, Mus musculus
cgcgtggagaccatcttgtatctgg

SEQ ID NO: 607127 - DNA, 25 bp, Mus musculus
cgcgtggagaccttcttgtatctgg

SEQ ID NO: 607128 - DNA, 25 bp, Mus musculus
cgcgtggagtaacgatgattccaag

SEQ ID NO: 607129 - DNA, 25 bp, Mus musculus
cgcgtggagtaaggatgattccaag

SEQ ID NO: 607130 - DNA, 25 bp, Mus musculus
cgcgtgtgtgaactgacctatgaca

SEQ ID NO: 607131 - DNA, 25 bp, Mus musculus
cgcgtgtgtgaagtgacctatgaca

SEQ ID NO: 607132 - DNA, 25 bp, Mus musculus
cgcgttcccaggccaagctggtgta

SEQ ID NO: 607133 - DNA, 25 bp, Mus musculus
cgcgttcccagggcaagctggtgta

SEQ ID NO: 607134 - DNA, 25 bp, Mus musculus
cgcgttcgaaagaggtgtttatggt

SEQ ID NO: 607135 - DNA, 25 bp, Mus musculus
cgcgttcgaaagtggtgtttatggt

SEQ ID NO: 607136 - DNA, 25 bp, Mus musculus
cgcgttgaatcacccacaggcctgt

SEQ ID NO: 607137 - DNA, 25 bp, Mus musculus
cgcgttgaatcagccacaggcctgt

SEQ ID NO: 607138 - DNA, 25 bp, Mus musculus
cgcgttggagaacaacttgaggact

SEQ ID NO: 607139 - DNA, 25 bp, Mus musculus
cgcgttggagaagaacttgaggact

SEQ ID NO: 607140 - DNA, 25 bp, Mus musculus
cgcgttgttgccatccagggagtga

SEQ ID NO: 607141 - DNA, 25 bp, Mus musculus
cgcgttgttgccttccagggagtga

SEQ ID NO: 607142 - DNA, 25 bp, Mus musculus
cgctaaaaatgtcagatgccgctag

SEQ ID NO: 607143 - DNA, 25 bp, Mus musculus
cgctaaaaatgtgagatgccgctag

SEQ ID NO: 607144 - DNA, 25 bp, Mus musculus
cgctaaagatgcaagaagaggtgga

SEQ ID NO: 607145 - DNA, 25 bp, Mus musculus
cgctaaagatgctagaagaggtgga

SEQ ID NO: 607146 - DNA, 25 bp, Mus musculus
cgctaaatgtgaataagatcatcgc

SEQ ID NO: 607147 - DNA, 25 bp, Mus musculus
cgctaaatgtgattaagatcatcgc

SEQ ID NO: 607148 - DNA, 25 bp, Mus musculus
cgctaaccttttcgaagacttgaga

SEQ ID NO: 607149 - DNA, 25 bp, Mus musculus
cgctaaccttttggaagacttgaga

SEQ ID NO: 607150 - DNA, 25 bp, Mus musculus
cgctaacgcagcagtacagccaggc

SEQ ID NO: 607151 - DNA, 25 bp, Mus musculus
cgctaacgcagctgtacagccaggc

SEQ ID NO: 607152 - DNA, 25 bp, Mus musculus
cgctacacggcaattgcctattggg

SEQ ID NO: 607153 - DNA, 25 bp, Mus musculus
cgctacacggcatttgcctattggg

SEQ ID NO: 607154 - DNA, 25 bp, Mus musculus
cgctacagaataacaccgcgggcga

SEQ ID NO: 607155 - DNA, 25 bp, Mus musculus
cgctacagaatatcaccgcgggcga

SEQ ID NO: 607156 - DNA, 25 bp, Mus musculus
cgctacagggaaagcctcgcggata

SEQ ID NO: 607157 - DNA, 25 bp, Mus musculus
cgctacagggaatgcctcgcggata

SEQ ID NO: 607158 - DNA, 25 bp, Mus musculus
cgctacctcaccatggttctgagca

SEQ ID NO: 607159 - DNA, 25 bp, Mus musculus
cgctacctcaccttggttctgagca

SEQ ID NO: 607160 - DNA, 25 bp, Mus musculus
cgctaccttactccgatgcatgggt

SEQ ID NO: 607161 - DNA, 25 bp, Mus musculus
cgctaccttactgcgatgcatgggt

SEQ ID NO: 607162 - DNA, 25 bp, Mus musculus
cgctacgaggaactctgcattgtca

SEQ ID NO: 607163 - DNA, 25 bp, Mus musculus
cgctacgaggaagtctgcattgtca

SEQ ID NO: 607164 - DNA, 25 bp, Mus musculus
cgctacggaagcagcgtaaggcgta

SEQ ID NO: 607165 - DNA, 25 bp, Mus musculus
cgctacggaagctgcgtaaggcgta

SEQ ID NO: 607166 - DNA, 25 bp, Mus musculus
cgctacgggcttccaggtcgccgtt

SEQ ID NO: 607167 - DNA, 25 bp, Mus musculus
cgctacgggcttgcaggtcgccgtt

SEQ ID NO: 607168 - DNA, 25 bp, Mus musculus
cgctactcacaacggccaaagattg

SEQ ID NO: 607169 - DNA, 25 bp, Mus musculus
cgctactcacaagggccaaagattg

SEQ ID NO: 607170 - DNA, 25 bp, Mus musculus
cgctacttccgaagcatttttgagg

SEQ ID NO: 607171 - DNA, 25 bp, Mus musculus
cgctacttccgatgcatttttgagg

SEQ ID NO: 607172 - DNA, 25 bp, Mus musculus
cgctactttgtgatcaggatccagg

SEQ ID NO: 607173 - DNA, 25 bp, Mus musculus
cgctactttgtgttcaggatccagg

SEQ ID NO: 607174 - DNA, 25 bp, Mus musculus
cgctagaccgtaacctgaacaacct

SEQ ID NO: 607175 - DNA, 25 bp, Mus musculus
cgctagaccgtatcctgaacaacct

SEQ ID NO: 607176 - DNA, 25 bp, Mus musculus
cgctagagcggcacgtggttcaagc

SEQ ID NO: 607177 - DNA, 25 bp, Mus musculus
cgctagagcggctcgtggttcaagc

SEQ ID NO: 607178 - DNA, 25 bp, Mus musculus
cgctagagcttcaacagaaggatgt

SEQ ID NO: 607179 - DNA, 25 bp, Mus musculus
cgctagagcttctacagaaggatgt

SEQ ID NO: 607180 - DNA, 25 bp, Mus musculus
cgctagaggaccaggagcgcacatc

SEQ ID NO: 607181 - DNA, 25 bp, Mus musculus
cgctagaggacctggagcgcacatc

SEQ ID NO: 607182 - DNA, 25 bp, Mus musculus
cgctagaggataaaccgaaggcttc

SEQ ID NO: 607183 - DNA, 25 bp, Mus musculus
cgctagaggatataccgaaggcttc

SEQ ID NO: 607184 - DNA, 25 bp, Mus musculus
cgctagcggatcacatgtctctgga

SEQ ID NO: 607185 - DNA, 25 bp, Mus musculus
cgctagcggatctcatgtctctgga

SEQ ID NO: 607186 - DNA, 25 bp, Mus musculus
cgctagctaaggattattcaatacc

SEQ ID NO: 607187 - DNA, 25 bp, Mus musculus
cgctagctaaggtttattcaatacc

SEQ ID NO: 607188 - DNA, 25 bp, Mus musculus
cgctagctgcatccctttccaggag

SEQ ID NO: 607189 - DNA, 25 bp, Mus musculus
cgctagctgcatgcctttccaggag

SEQ ID NO: 607190 - DNA, 25 bp, Mus musculus
cgctaggaaagaactgcgaggtgca

SEQ ID NO: 607191 - DNA, 25 bp, Mus musculus
cgctaggaaagatctgcgaggtgca

SEQ ID NO: 607192 - DNA, 25 bp, Mus musculus
cgctaggatgccaatcctggaaaag

SEQ ID NO: 607193 - DNA, 25 bp, Mus musculus
cgctaggatgcctatcctggaaaag

SEQ ID NO: 607194 - DNA, 25 bp, Mus musculus
cgctaggattttatgtgctcttttg

SEQ ID NO: 607195 - DNA, 25 bp, Mus musculus
cgctaggattttttgtgctcttttg

SEQ ID NO: 607196 - DNA, 25 bp, Mus musculus
cgctataatgcgaagaatgcctaca

SEQ ID NO: 607197 - DNA, 25 bp, Mus musculus
cgctataatgcgtagaatgcctaca

SEQ ID NO: 607198 - DNA, 25 bp, Mus musculus
cgctatccggcacagcaatcagatg

SEQ ID NO: 607199 - DNA, 25 bp, Mus musculus
cgctatccggcagagcaatcagatg

SEQ ID NO: 607200 - DNA, 25 bp, Mus musculus
cgctatgcccacaacaacgatgaca

SEQ ID NO: 607201 - DNA, 25 bp, Mus musculus
cgctatgcccactacaacgatgaca

SEQ ID NO: 607202 - DNA, 25 bp, Mus musculus
cgctatgcgcaaaagaagcaccgca

SEQ ID NO: 607203 - DNA, 25 bp, Mus musculus
cgctatgcgcaatagaagcaccgca

SEQ ID NO: 607204 - DNA, 25 bp, Mus musculus
cgctatgcttggctggagtacctca

SEQ ID NO: 607205 - DNA, 25 bp, Mus musculus
cgctatgcttgggtggagtacctca

SEQ ID NO: 607206 - DNA, 25 bp, Mus musculus
cgctatggacacagagacagactta

SEQ ID NO: 607207 - DNA, 25 bp, Mus musculus
cgctatggacactgagacagactta

SEQ ID NO: 607208 - DNA, 25 bp, Mus musculus
cgctatggaggcaggattgactgct

SEQ ID NO: 607209 - DNA, 25 bp, Mus musculus
cgctatggaggctggattgactgct

SEQ ID NO: 607210 - DNA, 25 bp, Mus musculus
cgctatggccttaaggatatcgatg

SEQ ID NO: 607211 - DNA, 25 bp, Mus musculus
cgctatggcctttaggatatcgatg

SEQ ID NO: 607212 - DNA, 25 bp, Mus musculus
cgctatggtacgagtccctgctcca

SEQ ID NO: 607213 - DNA, 25 bp, Mus musculus
cgctatggtacgtgtccctgctcca

SEQ ID NO: 607214 - DNA, 25 bp, Mus musculus
cgctatgtagtcagtgagccgctgg

SEQ ID NO: 607215 - DNA, 25 bp, Mus musculus
cgctatgtagtctgtgagccgctgg

SEQ ID NO: 607216 - DNA, 25 bp, Mus musculus
cgctattccagaagagagaactcca

SEQ ID NO: 607217 - DNA, 25 bp, Mus musculus
cgctattccagatgagagaactcca

SEQ ID NO: 607218 - DNA, 25 bp, Mus musculus
cgctattgcagtaatttgggcttac

SEQ ID NO: 607219 - DNA, 25 bp, Mus musculus
cgctattgcagttatttgggcttac

SEQ ID NO: 607220 - DNA, 25 bp, Mus musculus
cgctcaacaacaacccgaggaaggg

SEQ ID NO: 607221 - DNA, 25 bp, Mus musculus
cgctcaacaacatcccgaggaaggg

SEQ ID NO: 607222 - DNA, 25 bp, Mus musculus
cgctcaagctgaagtgggatccggc

SEQ ID NO: 607223 - DNA, 25 bp, Mus musculus
cgctcaagctgatgtgggatccggc

SEQ ID NO: 607224 - DNA, 25 bp, Mus musculus
cgctcaaggaggacgtattgcgcta

SEQ ID NO: 607225 - DNA, 25 bp, Mus musculus
cgctcaaggaggtcgtattgcgcta

SEQ ID NO: 607226 - DNA, 25 bp, Mus musculus
cgctcacacaaacaccgtggaggag

SEQ ID NO: 607227 - DNA, 25 bp, Mus musculus
cgctcacacaaagaccgtggaggag

SEQ ID NO: 607228 - DNA, 25 bp, Mus musculus
cgctcacccggtagaaagtcactgt

SEQ ID NO: 607229 - DNA, 25 bp, Mus musculus
cgctcacccggttgaaagtcactgt

SEQ ID NO: 607230 - DNA, 25 bp, Mus musculus
cgctcacgctgtaacacaagcagtg

SEQ ID NO: 607231 - DNA, 25 bp, Mus musculus
cgctcacgctgttacacaagcagtg

SEQ ID NO: 607232 - DNA, 25 bp, Mus musculus
cgctcacggagcatcgggaggcaca

SEQ ID NO: 607233 - DNA, 25 bp, Mus musculus
cgctcacggagcttcgggaggcaca

SEQ ID NO: 607234 - DNA, 25 bp, Mus musculus
cgctcactcacaaggtagtagtggt

SEQ ID NO: 607235 - DNA, 25 bp, Mus musculus
cgctcactcacatggtagtagtggt

SEQ ID NO: 607236 - DNA, 25 bp, Mus musculus
cgctcactgaccatggttgaggaca

SEQ ID NO: 607237 - DNA, 25 bp, Mus musculus
cgctcactgaccttggttgaggaca

SEQ ID NO: 607238 - DNA, 25 bp, Mus musculus
cgctcagaaagtacgaggtgtggac

SEQ ID NO: 607239 - DNA, 25 bp, Mus musculus
cgctcagaaagttcgaggtgtggac

SEQ ID NO: 607240 - DNA, 25 bp, Mus musculus
cgctcagaacaactgtaacttctat

SEQ ID NO: 607241 - DNA, 25 bp, Mus musculus
cgctcagaacaagtgtaacttctat

SEQ ID NO: 607242 - DNA, 25 bp, Mus musculus
cgctcagcctgcagagaaacatgat

SEQ ID NO: 607243 - DNA, 25 bp, Mus musculus
cgctcagcctgctgagaaacatgat

SEQ ID NO: 607244 - DNA, 25 bp, Mus musculus
cgctcagctgtgatgaagcggcatg

SEQ ID NO: 607245 - DNA, 25 bp, Mus musculus
cgctcagctgtgctgaatgctccag

SEQ ID NO: 607246 - DNA, 25 bp, Mus musculus
cgctcagctgtggtgaatgctccag

SEQ ID NO: 607247 - DNA, 25 bp, Mus musculus
cgctcagctgtgttgaagcggcatg

SEQ ID NO: 607248 - DNA, 25 bp, Mus musculus
cgctcaggagcaaggttcttcaaag

SEQ ID NO: 607249 - DNA, 25 bp, Mus musculus
cgctcaggagcatggttcttcaaag

SEQ ID NO: 607250 - DNA, 25 bp, Mus musculus
cgctcagggaaacttcgtgacgact

SEQ ID NO: 607251 - DNA, 25 bp, Mus musculus
cgctcagggaaagttcgtgacgact

SEQ ID NO: 607252 - DNA, 25 bp, Mus musculus
cgctcagggttacggcgccttcctg

SEQ ID NO: 607253 - DNA, 25 bp, Mus musculus
cgctcagggttagggcgccttcctg

SEQ ID NO: 607254 - DNA, 25 bp, Mus musculus
cgctcagttactctttaccatggag

SEQ ID NO: 607255 - DNA, 25 bp, Mus musculus
cgctcagttactgtttaccatggag

SEQ ID NO: 607256 - DNA, 25 bp, Mus musculus
cgctcatagaacagttgcttcagaa

SEQ ID NO: 607257 - DNA, 25 bp, Mus musculus
cgctcatagaactgttgcttcagaa

SEQ ID NO: 607258 - DNA, 25 bp, Mus musculus
cgctcatccttcaggtgcaggacct

SEQ ID NO: 607259 - DNA, 25 bp, Mus musculus
cgctcatccttctggtgcaggacct

SEQ ID NO: 607260 - DNA, 25 bp, Mus musculus
cgctcatcgtgtcgctgctggtgaa

SEQ ID NO: 607261 - DNA, 25 bp, Mus musculus
cgctcatcgtgtggctgctggtgaa

SEQ ID NO: 607262 - DNA, 25 bp, Mus musculus
cgctcatctcgacgaccatgatgaa

SEQ ID NO: 607263 - DNA, 25 bp, Mus musculus
cgctcatctcgaggaccatgatgaa

SEQ ID NO: 607264 - DNA, 25 bp, Mus musculus
cgctcatcttgacacaggtggaact

SEQ ID NO: 607265 - DNA, 25 bp, Mus musculus
cgctcatcttgagacaggtggaact

SEQ ID NO: 607266 - DNA, 25 bp, Mus musculus
cgctcatgaaggagcaactagtgga

SEQ ID NO: 607267 - DNA, 25 bp, Mus musculus
cgctcatgaaggtgcaactagtgga

SEQ ID NO: 607268 - DNA, 25 bp, Mus musculus
cgctcatgatccctgactggtggat

SEQ ID NO: 607269 - DNA, 25 bp, Mus musculus
cgctcatgatccgtgactggtggat

SEQ ID NO: 607270 - DNA, 25 bp, Mus musculus
cgctccacccagatggtgacactat

SEQ ID NO: 607271 - DNA, 25 bp, Mus musculus
cgctccacccagttggtgacactat

SEQ ID NO: 607272 - DNA, 25 bp, Mus musculus
cgctccagacttcacacaggtgctg

SEQ ID NO: 607273 - DNA, 25 bp, Mus musculus
cgctccagacttgacacaggtgctg

SEQ ID NO: 607274 - DNA, 25 bp, Mus musculus
cgctccaggttaccgctatcgtcaa

SEQ ID NO: 607275 - DNA, 25 bp, Mus musculus
cgctccaggttagcgctatcgtcaa

SEQ ID NO: 607276 - DNA, 25 bp, Mus musculus
cgctccatctacagtgactttgtct

SEQ ID NO: 607277 - DNA, 25 bp, Mus musculus
cgctccatctactgtgactttgtct

SEQ ID NO: 607278 - DNA, 25 bp, Mus musculus
cgctccatgcagctctttgaaaatg

SEQ ID NO: 607279 - DNA, 25 bp, Mus musculus
cgctccatgcaggtctttgaaaatg

SEQ ID NO: 607280 - DNA, 25 bp, Mus musculus
cgctcccgggtgacgttgatgtttg

SEQ ID NO: 607281 - DNA, 25 bp, Mus musculus
cgctcccgggtgtcgttgatgtttg

SEQ ID NO: 607282 - DNA, 25 bp, Mus musculus
cgctccctggctcaaagggcaagaa

SEQ ID NO: 607283 - DNA, 25 bp, Mus musculus
cgctccctggctgaaagggcaagaa

SEQ ID NO: 607284 - DNA, 25 bp, Mus musculus
cgctccgctagcctggatgtggcat

SEQ ID NO: 607285 - DNA, 25 bp, Mus musculus
cgctccgctagcgtggatgtggcat

SEQ ID NO: 607286 - DNA, 25 bp, Mus musculus
cgctccggcagtcggatgtccgtca

SEQ ID NO: 607287 - DNA, 25 bp, Mus musculus
cgctccggcagtgggatgtccgtca

SEQ ID NO: 607288 - DNA, 25 bp, Mus musculus
cgctccgtgtacacctgggacatcg

SEQ ID NO: 607289 - DNA, 25 bp, Mus musculus
cgctccgtgtactcctgggacatcg

SEQ ID NO: 607290 - DNA, 25 bp, Mus musculus
cgctcctggccaactttgtcttcta

SEQ ID NO: 607291 - DNA, 25 bp, Mus musculus
cgctcctggccatctttgtcttcta

SEQ ID NO: 607292 - DNA, 25 bp, Mus musculus
cgctcgacgtttccaagggtttccg

SEQ ID NO: 607293 - DNA, 25 bp, Mus musculus
cgctcgacgtttgcaagggtttccg

SEQ ID NO: 607294 - DNA, 25 bp, Mus musculus
cgctcgccgggaactgagcattgct

SEQ ID NO: 607295 - DNA, 25 bp, Mus musculus
cgctcgccgggatctgagcattgct

SEQ ID NO: 607296 - DNA, 25 bp, Mus musculus
cgctcgctgcgaaactattatgaga

SEQ ID NO: 607297 - DNA, 25 bp, Mus musculus
cgctcgctgcgatactattatgaga

SEQ ID NO: 607298 - DNA, 25 bp, Mus musculus
cgctcgcttggacaacatctttctg

SEQ ID NO: 607299 - DNA, 25 bp, Mus musculus
cgctcgcttggagaacatctttctg

SEQ ID NO: 607300 - DNA, 25 bp, Mus musculus
cgctcgggctgtcccgcgttgtcat

SEQ ID NO: 607301 - DNA, 25 bp, Mus musculus
cgctcgggctgtgccgcgttgtcat

SEQ ID NO: 607302 - DNA, 25 bp, Mus musculus
cgctcggtcttacgtgtctgagccc

SEQ ID NO: 607303 - DNA, 25 bp, Mus musculus
cgctcggtcttaggtgtctgagccc

SEQ ID NO: 607304 - DNA, 25 bp, Mus musculus
cgctcggtgtgcagaccggcgcaca

SEQ ID NO: 607305 - DNA, 25 bp, Mus musculus
cgctcggtgtgctgaccggcgcaca

SEQ ID NO: 607306 - DNA, 25 bp, Mus musculus
cgctcgtaggatcaaaacagagttc

SEQ ID NO: 607307 - DNA, 25 bp, Mus musculus
cgctcgtaggatgaaaacagagttc

SEQ ID NO: 607308 - DNA, 25 bp, Mus musculus
cgctcgttgcagaagccgctgcggc

SEQ ID NO: 607309 - DNA, 25 bp, Mus musculus
cgctcgttgcagtagccgctgcggc

SEQ ID NO: 607310 - DNA, 25 bp, Mus musculus
cgctcgttggctacagtgcagtggt

SEQ ID NO: 607311 - DNA, 25 bp, Mus musculus
cgctcgttggcttcagtgcagtggt

SEQ ID NO: 607312 - DNA, 25 bp, Mus musculus
cgctctacaggtatcttggaagtag

SEQ ID NO: 607313 - DNA, 25 bp, Mus musculus
cgctctacaggtttcttggaagtag

SEQ ID NO: 607314 - DNA, 25 bp, Mus musculus
cgctctcaatgtccgagcaggagat

SEQ ID NO: 607315 - DNA, 25 bp, Mus musculus
cgctctcaatgtgcgagcaggagat

SEQ ID NO: 607316 - DNA, 25 bp, Mus musculus
cgctctcagcgaagtcgaatcctag

SEQ ID NO: 607317 - DNA, 25 bp, Mus musculus
cgctctcagcgatgtcgaatcctag

SEQ ID NO: 607318 - DNA, 25 bp, Mus musculus
cgctctcagggactcacggtgttgc

SEQ ID NO: 607319 - DNA, 25 bp, Mus musculus
cgctctcagggagtcacggtgttgc

SEQ ID NO: 607320 - DNA, 25 bp, Mus musculus
cgctctcgccaaaggaaccataaag

SEQ ID NO: 607321 - DNA, 25 bp, Mus musculus
cgctctcgccaatggaaccataaag

SEQ ID NO: 607322 - DNA, 25 bp, Mus musculus
cgctctgagaaactccgttccctag

SEQ ID NO: 607323 - DNA, 25 bp, Mus musculus
cgctctgagaaagtccgttccctag

SEQ ID NO: 607324 - DNA, 25 bp, Mus musculus
cgctctgagagccactcgagatatt

SEQ ID NO: 607325 - DNA, 25 bp, Mus musculus
cgctctgagagcgactcgagatatt

SEQ ID NO: 607326 - DNA, 25 bp, Mus musculus
cgctctgcatggacataggcatgat

SEQ ID NO: 607327 - DNA, 25 bp, Mus musculus
cgctctgcatggtcataggcatgat

SEQ ID NO: 607328 - DNA, 25 bp, Mus musculus
cgctctggagccatggtagtcccgg

SEQ ID NO: 607329 - DNA, 25 bp, Mus musculus
cgctctggagccttggtagtcccgg

SEQ ID NO: 607330 - DNA, 25 bp, Mus musculus
cgctctgtgagaacgtggaaggctc

SEQ ID NO: 607331 - DNA, 25 bp, Mus musculus
cgctctgtgagatcgtggaaggctc

SEQ ID NO: 607332 - DNA, 25 bp, Mus musculus
cgctcttcaagcacacaaactctga

SEQ ID NO: 607333 - DNA, 25 bp, Mus musculus
cgctcttcaagctcacaaactctga

SEQ ID NO: 607334 - DNA, 25 bp, Mus musculus
cgctcttcagatcgctccagatgct

SEQ ID NO: 607335 - DNA, 25 bp, Mus musculus
cgctcttcagatggctccagatgct

SEQ ID NO: 607336 - DNA, 25 bp, Mus musculus
cgctcttcgaataggaattacagaa

SEQ ID NO: 607337 - DNA, 25 bp, Mus musculus
cgctcttcgaattggaattacagaa

SEQ ID NO: 607338 - DNA, 25 bp, Mus musculus
cgctcttctctccaatgttgccgaa

SEQ ID NO: 607339 - DNA, 25 bp, Mus musculus
cgctcttctctcgaatgttgccgaa

SEQ ID NO: 607340 - DNA, 25 bp, Mus musculus
cgctcttgctggactctggctcgct

SEQ ID NO: 607341 - DNA, 25 bp, Mus musculus
cgctcttgctggtctctggctcgct

SEQ ID NO: 607342 - DNA, 25 bp, Mus musculus
cgctcttgttctcggaggacctgat

SEQ ID NO: 607343 - DNA, 25 bp, Mus musculus
cgctcttgttctgggaggacctgat

SEQ ID NO: 607344 - DNA, 25 bp, Mus musculus
cgctcttgttttagacattggatcg

SEQ ID NO: 607345 - DNA, 25 bp, Mus musculus
cgctcttgtttttgacattggatcg

SEQ ID NO: 607346 - DNA, 25 bp, Mus musculus
cgctgaaacatccaaagtgctccgt

SEQ ID NO: 607347 - DNA, 25 bp, Mus musculus
cgctgaaacatcgaaagtgctccgt

SEQ ID NO: 607348 - DNA, 25 bp, Mus musculus
cgctgaaagtggaagaagatctgcc

SEQ ID NO: 607349 - DNA, 25 bp, Mus musculus
cgctgaaagtggtagaagatctgcc

SEQ ID NO: 607350 - DNA, 25 bp, Mus musculus
cgctgaacgaaacggacacggagca

SEQ ID NO: 607351 - DNA, 25 bp, Mus musculus
cgctgaacgaaagggacacggagca

SEQ ID NO: 607352 - DNA, 25 bp, Mus musculus
cgctgaagaacgctgaccaactgaa

SEQ ID NO: 607353 - DNA, 25 bp, Mus musculus
cgctgaagaacggtgaccaactgaa

SEQ ID NO: 607354 - DNA, 25 bp, Mus musculus
cgctgaagatgaaccagccttctgc

SEQ ID NO: 607355 - DNA, 25 bp, Mus musculus
cgctgaagatgatccagccttctgc

SEQ ID NO: 607356 - DNA, 25 bp, Mus musculus
cgctgaaggtggagtcagctcagca

SEQ ID NO: 607357 - DNA, 25 bp, Mus musculus
cgctgaaggtggtgtcagctcagca

SEQ ID NO: 607358 - DNA, 25 bp, Mus musculus
cgctgacaataaagatgtaccattt

SEQ ID NO: 607359 - DNA, 25 bp, Mus musculus
cgctgacaataatgatgtaccattt

SEQ ID NO: 607360 - DNA, 25 bp, Mus musculus
cgctgacacgagattcagagagact

SEQ ID NO: 607361 - DNA, 25 bp, Mus musculus
cgctgacacgagtttcagagagact

SEQ ID NO: 607362 - DNA, 25 bp, Mus musculus
cgctgacatgatctacacttttttc

SEQ ID NO: 607363 - DNA, 25 bp, Mus musculus
cgctgacatgatgtacacttttttc

SEQ ID NO: 607364 - DNA, 25 bp, Mus musculus
cgctgaccagccaatccagatctat

SEQ ID NO: 607365 - DNA, 25 bp, Mus musculus
cgctgaccagcctatccagatctat

SEQ ID NO: 607366 - DNA, 25 bp, Mus musculus
cgctgaccatgaatacttagggcaa

SEQ ID NO: 607367 - DNA, 25 bp, Mus musculus
cgctgaccatgattacttagggcaa

SEQ ID NO: 607368 - DNA, 25 bp, Mus musculus
cgctgaccgtggctatcctgctgat

SEQ ID NO: 607369 - DNA, 25 bp, Mus musculus
cgctgaccgtgggtatcctgctgat

SEQ ID NO: 607370 - DNA, 25 bp, Mus musculus
cgctgacgagatattgaagcccgca

SEQ ID NO: 607371 - DNA, 25 bp, Mus musculus
cgctgacgagattttgaagcccgca

SEQ ID NO: 607372 - DNA, 25 bp, Mus musculus
cgctgacgcatgcttgcgcacacaa

SEQ ID NO: 607373 - DNA, 25 bp, Mus musculus
cgctgacgcatggttgcgcacacaa

SEQ ID NO: 607374 - DNA, 25 bp, Mus musculus
cgctgagaattcctgagctcttgtc

SEQ ID NO: 607375 - DNA, 25 bp, Mus musculus
cgctgagaattcgtgagctcttgtc

SEQ ID NO: 607376 - DNA, 25 bp, Mus musculus
cgctgagagactatataaatccatg

SEQ ID NO: 607377 - DNA, 25 bp, Mus musculus
cgctgagagactttataaatccatg

SEQ ID NO: 607378 - DNA, 25 bp, Mus musculus
cgctgagcaaatcgactaacgtgat

SEQ ID NO: 607379 - DNA, 25 bp, Mus musculus
cgctgagcaaatggactaacgtgat

SEQ ID NO: 607380 - DNA, 25 bp, Mus musculus
cgctgagcagccaaaaccggaggtg

SEQ ID NO: 607381 - DNA, 25 bp, Mus musculus
cgctgagcagcctaaaccggaggtg

SEQ ID NO: 607382 - DNA, 25 bp, Mus musculus
cgctgagcagttaatggaagagaca

SEQ ID NO: 607383 - DNA, 25 bp, Mus musculus
cgctgagcagtttatggaagagaca

SEQ ID NO: 607384 - DNA, 25 bp, Mus musculus
cgctgagcccatcaggtaaaacgca

SEQ ID NO: 607385 - DNA, 25 bp, Mus musculus
cgctgagcccatgaggtaaaacgca

SEQ ID NO: 607386 - DNA, 25 bp, Mus musculus
cgctgaggaaaactcactaccggaa

SEQ ID NO: 607387 - DNA, 25 bp, Mus musculus
cgctgaggaaaagtcactaccggaa

SEQ ID NO: 607388 - DNA, 25 bp, Mus musculus
cgctgaggaaacagtaaaagctatg

SEQ ID NO: 607389 - DNA, 25 bp, Mus musculus
cgctgaggaaactgtaaaagctatg

SEQ ID NO: 607390 - DNA, 25 bp, Mus musculus
cgctgaggatgcaggagagtatacc

SEQ ID NO: 607391 - DNA, 25 bp, Mus musculus
cgctgaggatgctggagagtatacc

SEQ ID NO: 607392 - DNA, 25 bp, Mus musculus
cgctgagtgacccagagaccaaagt

SEQ ID NO: 607393 - DNA, 25 bp, Mus musculus
cgctgagtgaccgagagaccaaagt

SEQ ID NO: 607394 - DNA, 25 bp, Mus musculus
cgctgagttggacacagatcagcca

SEQ ID NO: 607395 - DNA, 25 bp, Mus musculus
cgctgagttggagacagatcagcca

SEQ ID NO: 607396 - DNA, 25 bp, Mus musculus
cgctgatacccgcacagtgctcggg

SEQ ID NO: 607397 - DNA, 25 bp, Mus musculus
cgctgatacccggacagtgctcggg

SEQ ID NO: 607398 - DNA, 25 bp, Mus musculus
cgctgatcgccaagacgggatggta

SEQ ID NO: 607399 - DNA, 25 bp, Mus musculus
cgctgatcgccatgacgggatggta

SEQ ID NO: 607400 - DNA, 25 bp, Mus musculus
cgctgatcggcgagactaccccttg

SEQ ID NO: 607401 - DNA, 25 bp, Mus musculus
cgctgatcggcgtgactaccccttg

SEQ ID NO: 607402 - DNA, 25 bp, Mus musculus
cgctgatggccaccttttggttaca

SEQ ID NO: 607403 - DNA, 25 bp, Mus musculus
cgctgatggccagcttttggttaca

SEQ ID NO: 607404 - DNA, 25 bp, Mus musculus
cgctgatgttcaactgctcctggta

SEQ ID NO: 607405 - DNA, 25 bp, Mus musculus
cgctgatgttcatctgctcctggta

SEQ ID NO: 607406 - DNA, 25 bp, Mus musculus
cgctgattgccccatgagattggtt

SEQ ID NO: 607407 - DNA, 25 bp, Mus musculus
cgctgattgcccgatgagattggtt

SEQ ID NO: 607408 - DNA, 25 bp, Mus musculus
cgctgcaaaatgcaacttgagagct

SEQ ID NO: 607409 - DNA, 25 bp, Mus musculus
cgctgcaaaatggaacttgagagct

SEQ ID NO: 607410 - DNA, 25 bp, Mus musculus
cgctgcaagacgagagagagctgtt

SEQ ID NO: 607411 - DNA, 25 bp, Mus musculus
cgctgcaagacgtgagagagctgtt

SEQ ID NO: 607412 - DNA, 25 bp, Mus musculus
cgctgcaatgggagctgattttcac

SEQ ID NO: 607413 - DNA, 25 bp, Mus musculus
cgctgcaatgggtgctgattttcac

SEQ ID NO: 607414 - DNA, 25 bp, Mus musculus
cgctgcacgagcatcgcgagcaggc

SEQ ID NO: 607415 - DNA, 25 bp, Mus musculus
cgctgcacgagcttcgcgagcaggc

SEQ ID NO: 607416 - DNA, 25 bp, Mus musculus
cgctgcaggataacagagactgtct

SEQ ID NO: 607417 - DNA, 25 bp, Mus musculus
cgctgcaggatatcagagactgtct

SEQ ID NO: 607418 - DNA, 25 bp, Mus musculus
cgctgcatcattctaggcaatggag

SEQ ID NO: 607419 - DNA, 25 bp, Mus musculus
cgctgcatcattgtaggcaatggag

SEQ ID NO: 607420 - DNA, 25 bp, Mus musculus
cgctgcattaccctgctgtggaaat

SEQ ID NO: 607421 - DNA, 25 bp, Mus musculus
cgctgcattaccgtgctgtggaaat

SEQ ID NO: 607422 - DNA, 25 bp, Mus musculus
cgctgccagagactgaagtcttgaa

SEQ ID NO: 607423 - DNA, 25 bp, Mus musculus
cgctgccagagagtgaagtcttgaa

SEQ ID NO: 607424 - DNA, 25 bp, Mus musculus
cgctgcccaggcctttacagagctg

SEQ ID NO: 607425 - DNA, 25 bp, Mus musculus
cgctgcccaggcgtttacagagctg

SEQ ID NO: 607426 - DNA, 25 bp, Mus musculus
cgctgccgctttaccaatacaatag

SEQ ID NO: 607427 - DNA, 25 bp, Mus musculus
cgctgccgcttttccaatacaatag

SEQ ID NO: 607428 - DNA, 25 bp, Mus musculus
cgctgcctacgtagggcttgggact

SEQ ID NO: 607429 - DNA, 25 bp, Mus musculus
cgctgcctacgttgggcttgggact

SEQ ID NO: 607430 - DNA, 25 bp, Mus musculus
cgctgcctccctccgaagggttgtg

SEQ ID NO: 607431 - DNA, 25 bp, Mus musculus
cgctgcctccctgcgaagggttgtg

SEQ ID NO: 607432 - DNA, 25 bp, Mus musculus
cgctgcctgaagatcgtcttaaaag

SEQ ID NO: 607433 - DNA, 25 bp, Mus musculus
cgctgcctgaagttcgtcttaaaag

SEQ ID NO: 607434 - DNA, 25 bp, Mus musculus
cgctgcctgatacagtgcaggacct

SEQ ID NO: 607435 - DNA, 25 bp, Mus musculus
cgctgcctgatagagtgcaggacct

SEQ ID NO: 607436 - DNA, 25 bp, Mus musculus
cgctgcctgttcaggtgactcgtca

SEQ ID NO: 607437 - DNA, 25 bp, Mus musculus
cgctgcctgttctggtgactcgtca

SEQ ID NO: 607438 - DNA, 25 bp, Mus musculus
cgctgcgcaaccatgtcggaagaga

SEQ ID NO: 607439 - DNA, 25 bp, Mus musculus
cgctgcgcaaccttgtcggaagaga

SEQ ID NO: 607440 - DNA, 25 bp, Mus musculus
cgctgcggttacaagccactattta

SEQ ID NO: 607441 - DNA, 25 bp, Mus musculus
cgctgcggttactagccactattta

SEQ ID NO: 607442 - DNA, 25 bp, Mus musculus
cgctgctacttcctcagaaccggga

SEQ ID NO: 607443 - DNA, 25 bp, Mus musculus
cgctgctacttcgtcagaaccggga

SEQ ID NO: 607444 - DNA, 25 bp, Mus musculus
cgctgctcttgaccatgtgccaaga

SEQ ID NO: 607445 - DNA, 25 bp, Mus musculus
cgctgctcttgagcatgtgccaaga

SEQ ID NO: 607446 - DNA, 25 bp, Mus musculus
cgctgctgcagcctgtatgctccag

SEQ ID NO: 607447 - DNA, 25 bp, Mus musculus
cgctgctgcagcgtgtatgctccag

SEQ ID NO: 607448 - DNA, 25 bp, Mus musculus
cgctgctgcttgaggtccccggagt

SEQ ID NO: 607449 - DNA, 25 bp, Mus musculus
cgctgctgcttgtggtccccggagt

SEQ ID NO: 607450 - DNA, 25 bp, Mus musculus
cgctgctggcctactccggttatgg

SEQ ID NO: 607451 - DNA, 25 bp, Mus musculus
cgctgctggccttctccggttatgg

SEQ ID NO: 607452 - DNA, 25 bp, Mus musculus
cgctgctggcttccttttggccgca

SEQ ID NO: 607453 - DNA, 25 bp, Mus musculus
cgctgctggcttgcttttggccgca

SEQ ID NO: 607454 - DNA, 25 bp, Mus musculus
cgctgctgggagaatctcatcctgg

SEQ ID NO: 607455 - DNA, 25 bp, Mus musculus
cgctgctgggagtatctcatcctgg

SEQ ID NO: 607456 - DNA, 25 bp, Mus musculus
cgctgctggtacatgctaggaatgt

SEQ ID NO: 607457 - DNA, 25 bp, Mus musculus
cgctgctggtacttgctaggaatgt

SEQ ID NO: 607458 - DNA, 25 bp, Mus musculus
cgctgcttggtgaagactgctttat

SEQ ID NO: 607459 - DNA, 25 bp, Mus musculus
cgctgcttggtgtagactgctttat

SEQ ID NO: 607460 - DNA, 25 bp, Mus musculus
cgctggaaaaagaagcctcagagtg

SEQ ID NO: 607461 - DNA, 25 bp, Mus musculus
cgctggaaaaagtagcctcagagtg

SEQ ID NO: 607462 - DNA, 25 bp, Mus musculus
cgctggaagacgagtacatggcatc

SEQ ID NO: 607463 - DNA, 25 bp, Mus musculus
cgctggaagacgtgtacatggcatc

SEQ ID NO: 607464 - DNA, 25 bp, Mus musculus
cgctggaagatcctcagaaggttct

SEQ ID NO: 607465 - DNA, 25 bp, Mus musculus
cgctggaagatcgtcagaaggttct

SEQ ID NO: 607466 - DNA, 25 bp, Mus musculus
cgctggaatcttaatagaggctgtc

SEQ ID NO: 607467 - DNA, 25 bp, Mus musculus
cgctggaatctttatagaggctgtc

SEQ ID NO: 607468 - DNA, 25 bp, Mus musculus
cgctggactattctgccaactgcca

SEQ ID NO: 607469 - DNA, 25 bp, Mus musculus
cgctggactattgtgccaactgcca

SEQ ID NO: 607470 - DNA, 25 bp, Mus musculus
cgctggagcaataacatgatggact

SEQ ID NO: 607471 - DNA, 25 bp, Mus musculus
cgctggagcaattacatgatggact

SEQ ID NO: 607472 - DNA, 25 bp, Mus musculus
cgctggagctgacttagttctgaga

SEQ ID NO: 607473 - DNA, 25 bp, Mus musculus
cgctggagctgagttagttctgaga

SEQ ID NO: 607474 - DNA, 25 bp, Mus musculus
cgctggaggcccacaagagaggtca

SEQ ID NO: 607475 - DNA, 25 bp, Mus musculus
cgctggaggccctcaagagaggtca

SEQ ID NO: 607476 - DNA, 25 bp, Mus musculus
cgctggaggctcacccaggaacatt

SEQ ID NO: 607477 - DNA, 25 bp, Mus musculus
cgctggaggctctcccaggaacatt

SEQ ID NO: 607478 - DNA, 25 bp, Mus musculus
cgctggaggtcacgacatgaacagc

SEQ ID NO: 607479 - DNA, 25 bp, Mus musculus
cgctggaggtcaggacatgaacagc

SEQ ID NO: 607480 - DNA, 25 bp, Mus musculus
cgctggaggtgaccaaacttatcta

SEQ ID NO: 607481 - DNA, 25 bp, Mus musculus
cgctggaggtgagcaaacttatcta

SEQ ID NO: 607482 - DNA, 25 bp, Mus musculus
cgctggaggtgccatgtcttccaag

SEQ ID NO: 607483 - DNA, 25 bp, Mus musculus
cgctggaggtgcgatgtcttccaag

SEQ ID NO: 607484 - DNA, 25 bp, Mus musculus
cgctggatctgccaaatgaatgcca

SEQ ID NO: 607485 - DNA, 25 bp, Mus musculus
cgctggatctgcgaaatgaatgcca

SEQ ID NO: 607486 - DNA, 25 bp, Mus musculus
cgctggattatgactcggatcgaat

SEQ ID NO: 607487 - DNA, 25 bp, Mus musculus
cgctggattatgtctcggatcgaat

SEQ ID NO: 607488 - DNA, 25 bp, Mus musculus
cgctggattgttatacaagatattc

SEQ ID NO: 607489 - DNA, 25 bp, Mus musculus
cgctggattgttttacaagatattc

SEQ ID NO: 607490 - DNA, 25 bp, Mus musculus
cgctggcactggcatggaactttac

SEQ ID NO: 607491 - DNA, 25 bp, Mus musculus
cgctggcactgggatggaactttac

SEQ ID NO: 607492 - DNA, 25 bp, Mus musculus
cgctggcacttgaacctactgctcg

SEQ ID NO: 607493 - DNA, 25 bp, Mus musculus
cgctggcacttgtacctactgctcg

SEQ ID NO: 607494 - DNA, 25 bp, Mus musculus
cgctggccacggaagacctcaggga

SEQ ID NO: 607495 - DNA, 25 bp, Mus musculus
cgctggccacggtagacctcaggga

SEQ ID NO: 607496 - DNA, 25 bp, Mus musculus
cgctggcccgtgagcgcgataccag

SEQ ID NO: 607497 - DNA, 25 bp, Mus musculus
cgctggcccgtgtgcgcgataccag

SEQ ID NO: 607498 - DNA, 25 bp, Mus musculus
cgctggccgactatgctgtgctgct

SEQ ID NO: 607499 - DNA, 25 bp, Mus musculus
cgctggccgactttgctgtgctgct

SEQ ID NO: 607500 - DNA, 25 bp, Mus musculus
cgctggccttggatcccttcagcat

SEQ ID NO: 607501 - DNA, 25 bp, Mus musculus
cgctggccttggttcccttcagcat

SEQ ID NO: 607502 - DNA, 25 bp, Mus musculus
cgctggcggcaaattgagagcaatt

SEQ ID NO: 607503 - DNA, 25 bp, Mus musculus
cgctggcggcaatttgagagcaatt

SEQ ID NO: 607504 - DNA, 25 bp, Mus musculus
cgctggctaaagcagctgtatgacc

SEQ ID NO: 607505 - DNA, 25 bp, Mus musculus
cgctggctaaaggagctgtatgacc

SEQ ID NO: 607506 - DNA, 25 bp, Mus musculus
cgctggctattaccaagctaatgag

SEQ ID NO: 607507 - DNA, 25 bp, Mus musculus
cgctggctattagcaagctaatgag

SEQ ID NO: 607508 - DNA, 25 bp, Mus musculus
cgctggcttcttcgagggaggcacc

SEQ ID NO: 607509 - DNA, 25 bp, Mus musculus
cgctggcttcttggagggaggcacc

SEQ ID NO: 607510 - DNA, 25 bp, Mus musculus
cgctggcttgttcgaggcccagacc

SEQ ID NO: 607511 - DNA, 25 bp, Mus musculus
cgctggcttgttggaggcccagacc

SEQ ID NO: 607512 - DNA, 25 bp, Mus musculus
cgctgggaagacctccacgtgatca

SEQ ID NO: 607513 - DNA, 25 bp, Mus musculus
cgctgggaagacgtccacgtgatca

SEQ ID NO: 607514 - DNA, 25 bp, Mus musculus
cgctgggacattcggatctttgcag

SEQ ID NO: 607515 - DNA, 25 bp, Mus musculus
cgctgggacattgggatctttgcag

SEQ ID NO: 607516 - DNA, 25 bp, Mus musculus
cgctgggaggccatcgactgcgtca

SEQ ID NO: 607517 - DNA, 25 bp, Mus musculus
cgctgggaggccttcgactgcgtca

SEQ ID NO: 607518 - DNA, 25 bp, Mus musculus
cgctgggcacagatttcctgtttgg

SEQ ID NO: 607519 - DNA, 25 bp, Mus musculus
cgctgggcacagttttcctgtttgg

SEQ ID NO: 607520 - DNA, 25 bp, Mus musculus
cgctgggcttggactcgtctgcgca

SEQ ID NO: 607521 - DNA, 25 bp, Mus musculus
cgctgggcttggtctcgtctgcgca

SEQ ID NO: 607522 - DNA, 25 bp, Mus musculus
cgctgggtcagcacataaagcaaat

SEQ ID NO: 607523 - DNA, 25 bp, Mus musculus
cgctgggtcagctcataaagcaaat

SEQ ID NO: 607524 - DNA, 25 bp, Mus musculus
cgctgggtcccaccattgcttctgg

SEQ ID NO: 607525 - DNA, 25 bp, Mus musculus
cgctgggtcccagcattgcttctgg

SEQ ID NO: 607526 - DNA, 25 bp, Mus musculus
cgctggtgaaatacaggacgtagta

SEQ ID NO: 607527 - DNA, 25 bp, Mus musculus
cgctggtgaaattcaggacgtagta

SEQ ID NO: 607528 - DNA, 25 bp, Mus musculus
cgctggtgccccagagtgctcacgg

SEQ ID NO: 607529 - DNA, 25 bp, Mus musculus
cgctggtgcccctgagtgctcacgg

SEQ ID NO: 607530 - DNA, 25 bp, Mus musculus
cgctggtgccctctattgtgaagga

SEQ ID NO: 607531 - DNA, 25 bp, Mus musculus
cgctggtgccctgtattgtgaagga

SEQ ID NO: 607532 - DNA, 25 bp, Mus musculus
cgctggttgaaaaatggcaaagagt

SEQ ID NO: 607533 - DNA, 25 bp, Mus musculus
cgctggttgaaatatggcaaagagt

SEQ ID NO: 607534 - DNA, 25 bp, Mus musculus
cgctggttttgtcgctttccggatt

SEQ ID NO: 607535 - DNA, 25 bp, Mus musculus
cgctggttttgtggctttccggatt

SEQ ID NO: 607536 - DNA, 25 bp, Mus musculus
cgctgtacgaggagcgttcgccacc

SEQ ID NO: 607537 - DNA, 25 bp, Mus musculus
cgctgtacgaggtgcgttcgccacc

SEQ ID NO: 607538 - DNA, 25 bp, Mus musculus
cgctgtagatgtcaaacgcttcaac

SEQ ID NO: 607539 - DNA, 25 bp, Mus musculus
cgctgtagatgtgaaacgcttcaac

SEQ ID NO: 607540 - DNA, 25 bp, Mus musculus
cgctgtatgcgtaccgctccgcgga

SEQ ID NO: 607541 - DNA, 25 bp, Mus musculus
cgctgtatgcgttccgctccgcgga

SEQ ID NO: 607542 - DNA, 25 bp, Mus musculus
cgctgtcaaaaaagtggcaagtcct

SEQ ID NO: 607543 - DNA, 25 bp, Mus musculus
cgctgtcaaaaatgtggcaagtcct

SEQ ID NO: 607544 - DNA, 25 bp, Mus musculus
cgctgtcaaggcacgaaagtccaag

SEQ ID NO: 607545 - DNA, 25 bp, Mus musculus
cgctgtcaaggctcgaaagtccaag

SEQ ID NO: 607546 - DNA, 25 bp, Mus musculus
cgctgtccgaagagtcctcagtgcc

SEQ ID NO: 607547 - DNA, 25 bp, Mus musculus
cgctgtccgaagtgtcctcagtgcc

SEQ ID NO: 607548 - DNA, 25 bp, Mus musculus
cgctgtcgacaacctgcagcaagag

SEQ ID NO: 607549 - DNA, 25 bp, Mus musculus
cgctgtcgacaagctgcagcaagag

SEQ ID NO: 607550 - DNA, 25 bp, Mus musculus
cgctgtcgccgcacgttgcagtagc

SEQ ID NO: 607551 - DNA, 25 bp, Mus musculus
cgctgtcgccgctcgttgcagtagc

SEQ ID NO: 607552 - DNA, 25 bp, Mus musculus
cgctgtctaagaagctggttgtacg

SEQ ID NO: 607553 - DNA, 25 bp, Mus musculus
cgctgtctaagatgctggttgtacg

SEQ ID NO: 607554 - DNA, 25 bp, Mus musculus
cgctgtcttaggaggaaagtatatc

SEQ ID NO: 607555 - DNA, 25 bp, Mus musculus
cgctgtcttaggtggaaagtatatc

SEQ ID NO: 607556 - DNA, 25 bp, Mus musculus
cgctgtgacattcgctacacaggac

SEQ ID NO: 607557 - DNA, 25 bp, Mus musculus
cgctgtgacattggctacacaggac

SEQ ID NO: 607558 - DNA, 25 bp, Mus musculus
cgctgtgacctgactgcaaaggaca

SEQ ID NO: 607559 - DNA, 25 bp, Mus musculus
cgctgtgacctgtctgcaaaggaca

SEQ ID NO: 607560 - DNA, 25 bp, Mus musculus
cgctgtgccggaagacaagttccaa

SEQ ID NO: 607561 - DNA, 25 bp, Mus musculus
cgctgtgccggatgacaagttccaa

SEQ ID NO: 607562 - DNA, 25 bp, Mus musculus
cgctgtgcgcacagcatctttgcca

SEQ ID NO: 607563 - DNA, 25 bp, Mus musculus
cgctgtgcgcactgcatctttgcca

SEQ ID NO: 607564 - DNA, 25 bp, Mus musculus
cgctgtggattgcatgacggacctc

SEQ ID NO: 607565 - DNA, 25 bp, Mus musculus
cgctgtggattggatgacggacctc

SEQ ID NO: 607566 - DNA, 25 bp, Mus musculus
cgctgtggcataatccacgttcggg

SEQ ID NO: 607567 - DNA, 25 bp, Mus musculus
cgctgtggcatattccacgttcggg

SEQ ID NO: 607568 - DNA, 25 bp, Mus musculus
cgctgtgggagcctccaacatggct

SEQ ID NO: 607569 - DNA, 25 bp, Mus musculus
cgctgtgggagcgtccaacatggct

SEQ ID NO: 607570 - DNA, 25 bp, Mus musculus
cgctgtgggccaagcaactcctttg

SEQ ID NO: 607571 - DNA, 25 bp, Mus musculus
cgctgtgggccatgcaactcctttg

SEQ ID NO: 607572 - DNA, 25 bp, Mus musculus
cgctgtggtccacgtgatgctgaac

SEQ ID NO: 607573 - DNA, 25 bp, Mus musculus
cgctgtggtccaggtgatgctgaac

SEQ ID NO: 607574 - DNA, 25 bp, Mus musculus
cgctgtggtccgcaacatcctgcgt

SEQ ID NO: 607575 - DNA, 25 bp, Mus musculus
cgctgtggtccggaacatcctgcgt

SEQ ID NO: 607576 - DNA, 25 bp, Mus musculus
cgctgtgtggacaggtcaattgcag

SEQ ID NO: 607577 - DNA, 25 bp, Mus musculus
cgctgtgtggactggtcaattgcag

SEQ ID NO: 607578 - DNA, 25 bp, Mus musculus
cgctgttaataacggtgggcccctg

SEQ ID NO: 607579 - DNA, 25 bp, Mus musculus
cgctgttaataagggtgggcccctg

SEQ ID NO: 607580 - DNA, 25 bp, Mus musculus
cgctgttacgaacagaagcagagcc

SEQ ID NO: 607581 - DNA, 25 bp, Mus musculus
cgctgttacgaagagaagcagagcc

SEQ ID NO: 607582 - DNA, 25 bp, Mus musculus
cgctgttatccaagaggtcagagac

SEQ ID NO: 607583 - DNA, 25 bp, Mus musculus
cgctgttatccatgaggtcagagac

SEQ ID NO: 607584 - DNA, 25 bp, Mus musculus
cgctgtttgcctaggaagcagctgg

SEQ ID NO: 607585 - DNA, 25 bp, Mus musculus
cgctgtttgccttggaagcagctgg

SEQ ID NO: 607586 - DNA, 25 bp, Mus musculus
cgctgtttggagatcctagagcaga

SEQ ID NO: 607587 - DNA, 25 bp, Mus musculus
cgctgtttggagttcctagagcaga

SEQ ID NO: 607588 - DNA, 25 bp, Mus musculus
cgcttaagaccgagctaggcaacaa

SEQ ID NO: 607589 - DNA, 25 bp, Mus musculus
cgcttaagaccgtgctaggcaacaa

SEQ ID NO: 607590 - DNA, 25 bp, Mus musculus
cgcttaaggactacgcgatcgaaaa

SEQ ID NO: 607591 - DNA, 25 bp, Mus musculus
cgcttaaggacttcgcgatcgaaaa

SEQ ID NO: 607592 - DNA, 25 bp, Mus musculus
cgcttaaggattactggaaccttca

SEQ ID NO: 607593 - DNA, 25 bp, Mus musculus
cgcttaaggatttctggaaccttca

SEQ ID NO: 607594 - DNA, 25 bp, Mus musculus
cgcttacgtgggaatcgcaggatta

SEQ ID NO: 607595 - DNA, 25 bp, Mus musculus
cgcttacgtgggtatcgcaggatta

SEQ ID NO: 607596 - DNA, 25 bp, Mus musculus
cgcttactgagaaccgtgtcctgca

SEQ ID NO: 607597 - DNA, 25 bp, Mus musculus
cgcttactgagatccgtgtcctgca

SEQ ID NO: 607598 - DNA, 25 bp, Mus musculus
cgcttagagaagctgtagccggtct

SEQ ID NO: 607599 - DNA, 25 bp, Mus musculus
cgcttagagaaggtgtagccggtct

SEQ ID NO: 607600 - DNA, 25 bp, Mus musculus
cgcttagcagaaccccatgctaaag

SEQ ID NO: 607601 - DNA, 25 bp, Mus musculus
cgcttagcagaagcccatgctaaag

SEQ ID NO: 607602 - DNA, 25 bp, Mus musculus
cgcttagcttttcacaacaaagtta

SEQ ID NO: 607603 - DNA, 25 bp, Mus musculus
cgcttagcttttgacaacaaagtta

SEQ ID NO: 607604 - DNA, 25 bp, Mus musculus
cgcttaggcggcaagcggtcctcag

SEQ ID NO: 607605 - DNA, 25 bp, Mus musculus
cgcttaggcggctagcggtcctcag

SEQ ID NO: 607606 - DNA, 25 bp, Mus musculus
cgcttatgaaccatctgacacagct

SEQ ID NO: 607607 - DNA, 25 bp, Mus musculus
cgcttatgaaccttctgacacagct

SEQ ID NO: 607608 - DNA, 25 bp, Mus musculus
cgcttatgacatatactcgaggctg

SEQ ID NO: 607609 - DNA, 25 bp, Mus musculus
cgcttatgacatttactcgaggctg

SEQ ID NO: 607610 - DNA, 25 bp, Mus musculus
cgcttatgacttcgtgctggctgag

SEQ ID NO: 607611 - DNA, 25 bp, Mus musculus
cgcttatgacttggtgctggctgag

SEQ ID NO: 607612 - DNA, 25 bp, Mus musculus
cgcttattgggtcccggcagtactg

SEQ ID NO: 607613 - DNA, 25 bp, Mus musculus
cgcttattgggtgccggcagtactg

SEQ ID NO: 607614 - DNA, 25 bp, Mus musculus
cgcttcaatggtccctacatcatct

SEQ ID NO: 607615 - DNA, 25 bp, Mus musculus
cgcttcaatggtgcctacatcatct

SEQ ID NO: 607616 - DNA, 25 bp, Mus musculus
cgcttcacctggagcatgaagacca

SEQ ID NO: 607617 - DNA, 25 bp, Mus musculus
cgcttcacctggtgcatgaagacca

SEQ ID NO: 607618 - DNA, 25 bp, Mus musculus
cgcttcaggactatcgcaagaagct

SEQ ID NO: 607619 - DNA, 25 bp, Mus musculus
cgcttcaggactttcgcaagaagct

SEQ ID NO: 607620 - DNA, 25 bp, Mus musculus
cgcttcccctggatccgactggtgg

SEQ ID NO: 607621 - DNA, 25 bp, Mus musculus
cgcttcccctggttccgactggtgg

SEQ ID NO: 607622 - DNA, 25 bp, Mus musculus
cgcttccgccgtcttgagcttctgg

SEQ ID NO: 607623 - DNA, 25 bp, Mus musculus
cgcttccgccgtgttgagcttctgg

SEQ ID NO: 607624 - DNA, 25 bp, Mus musculus
cgcttccggcgacagggaaatgaga

SEQ ID NO: 607625 - DNA, 25 bp, Mus musculus
cgcttccggcgagagggaaatgaga

SEQ ID NO: 607626 - DNA, 25 bp, Mus musculus
cgcttccttgcaccaatggcagcag

SEQ ID NO: 607627 - DNA, 25 bp, Mus musculus
cgcttccttgcagcaatggcagcag

SEQ ID NO: 607628 - DNA, 25 bp, Mus musculus
cgcttccttttgcacagaggtgcta

SEQ ID NO: 607629 - DNA, 25 bp, Mus musculus
cgcttccttttggacagaggtgcta

SEQ ID NO: 607630 - DNA, 25 bp, Mus musculus
cgcttcgtgcagcaatgcatccgca

SEQ ID NO: 607631 - DNA, 25 bp, Mus musculus
cgcttcgtgcaggaatgcatccgca

SEQ ID NO: 607632 - DNA, 25 bp, Mus musculus
cgcttcgtggctcaagtacagtcag

SEQ ID NO: 607633 - DNA, 25 bp, Mus musculus
cgcttcgtggctgaagtacagtcag

SEQ ID NO: 607634 - DNA, 25 bp, Mus musculus
cgcttctacgttctgatgtggaaac

SEQ ID NO: 607635 - DNA, 25 bp, Mus musculus
cgcttctacgttgtgatgtggaaac

SEQ ID NO: 607636 - DNA, 25 bp, Mus musculus
cgcttcttccggaagctttcctgca

SEQ ID NO: 607637 - DNA, 25 bp, Mus musculus
cgcttcttccggtagctttcctgca

SEQ ID NO: 607638 - DNA, 25 bp, Mus musculus
cgcttgacgtttacatacagtttgg

SEQ ID NO: 607639 - DNA, 25 bp, Mus musculus
cgcttgacgttttcatacagtttgg

SEQ ID NO: 607640 - DNA, 25 bp, Mus musculus
cgcttgagagcgctctaaagcggca

SEQ ID NO: 607641 - DNA, 25 bp, Mus musculus
cgcttgagagcggtctaaagcggca

SEQ ID NO: 607642 - DNA, 25 bp, Mus musculus
cgcttgcaatggctgcgtctttggt

SEQ ID NO: 607643 - DNA, 25 bp, Mus musculus
cgcttgcaatgggtgcgtctttggt

SEQ ID NO: 607644 - DNA, 25 bp, Mus musculus
cgcttgcatgtcactggtagagacc

SEQ ID NO: 607645 - DNA, 25 bp, Mus musculus
cgcttgcatgtctctggtagagacc

SEQ ID NO: 607646 - DNA, 25 bp, Mus musculus
cgcttgccaaccattgatccaaata

SEQ ID NO: 607647 - DNA, 25 bp, Mus musculus
cgcttgccaacctttgatccaaata

SEQ ID NO: 607648 - DNA, 25 bp, Mus musculus
cgcttgctcattcatcagggactgc

SEQ ID NO: 607649 - DNA, 25 bp, Mus musculus
cgcttgctcattgatcagggactgc

SEQ ID NO: 607650 - DNA, 25 bp, Mus musculus
cgcttgctgctcctaacctgattga

SEQ ID NO: 607651 - DNA, 25 bp, Mus musculus
cgcttgctgctcgtaacctgattga

SEQ ID NO: 607652 - DNA, 25 bp, Mus musculus
cgcttggaccacaaccgagcaaaat

SEQ ID NO: 607653 - DNA, 25 bp, Mus musculus
cgcttggaccactaccgagcaaaat

SEQ ID NO: 607654 - DNA, 25 bp, Mus musculus
cgcttggactggcaccggttaatga

SEQ ID NO: 607655 - DNA, 25 bp, Mus musculus
cgcttggactgggaccggttaatga

SEQ ID NO: 607656 - DNA, 25 bp, Mus musculus
cgcttggagagcagctctgctttct

SEQ ID NO: 607657 - DNA, 25 bp, Mus musculus
cgcttggagagctgctctgctttct

SEQ ID NO: 607658 - DNA, 25 bp, Mus musculus
cgcttggagcccagatcttccggag

SEQ ID NO: 607659 - DNA, 25 bp, Mus musculus
cgcttggagccctgatcttccggag

SEQ ID NO: 607660 - DNA, 25 bp, Mus musculus
cgcttggaggaactgtctgctatga

SEQ ID NO: 607661 - DNA, 25 bp, Mus musculus
cgcttggaggaagtgtctgctatga

SEQ ID NO: 607662 - DNA, 25 bp, Mus musculus
cgcttggagtttcggaagccagcct

SEQ ID NO: 607663 - DNA, 25 bp, Mus musculus
cgcttggagtttgggaagccagcct

SEQ ID NO: 607664 - DNA, 25 bp, Mus musculus
cgcttggctaagaacaggctccact

SEQ ID NO: 607665 - DNA, 25 bp, Mus musculus
cgcttggctaagtacaggctccact

SEQ ID NO: 607666 - DNA, 25 bp, Mus musculus
cgcttgggcagtatgtgtccctgca

SEQ ID NO: 607667 - DNA, 25 bp, Mus musculus
cgcttgggcagtttgtgtccctgca

SEQ ID NO: 607668 - DNA, 25 bp, Mus musculus
cgcttgtcaagtatgtacccctgac

SEQ ID NO: 607669 - DNA, 25 bp, Mus musculus
cgcttgtcaagtttgtacccctgac

SEQ ID NO: 607670 - DNA, 25 bp, Mus musculus
cgcttgtctccaaccaggcactgaa

SEQ ID NO: 607671 - DNA, 25 bp, Mus musculus
cgcttgtctccatccaggcactgaa

SEQ ID NO: 607672 - DNA, 25 bp, Mus musculus
cgcttgttcatcctgcatgagatct

SEQ ID NO: 607673 - DNA, 25 bp, Mus musculus
cgcttgttcatcgtgcatgagatct

SEQ ID NO: 607674 - DNA, 25 bp, Mus musculus
cgcttgttccagacataaggacatt

SEQ ID NO: 607675 - DNA, 25 bp, Mus musculus
cgcttgttccagtcataaggacatt

SEQ ID NO: 607676 - DNA, 25 bp, Mus musculus
cgctttaccgtgaacagctctaaaa

SEQ ID NO: 607677 - DNA, 25 bp, Mus musculus
cgctttaccgtgtacagctctaaaa

SEQ ID NO: 607678 - DNA, 25 bp, Mus musculus
cgctttacgttaacagcgctcggga

SEQ ID NO: 607679 - DNA, 25 bp, Mus musculus
cgctttacgttatcagcgctcggga

SEQ ID NO: 607680 - DNA, 25 bp, Mus musculus
cgctttcaggacagctgcagcggcg

SEQ ID NO: 607681 - DNA, 25 bp, Mus musculus
cgctttcaggactgctgcagcggcg

SEQ ID NO: 607682 - DNA, 25 bp, Mus musculus
cgctttctgcgtatcgtctgcaaga

SEQ ID NO: 607683 - DNA, 25 bp, Mus musculus
cgctttctgcgtttcgtctgcaaga

SEQ ID NO: 607684 - DNA, 25 bp, Mus musculus
cgctttctgctcaatgccatggaca

SEQ ID NO: 607685 - DNA, 25 bp, Mus musculus
cgctttctgctctatgccatggaca

SEQ ID NO: 607686 - DNA, 25 bp, Mus musculus
cgctttgacccgcagggagactgac

SEQ ID NO: 607687 - DNA, 25 bp, Mus musculus
cgctttgacccggagggagactgac

SEQ ID NO: 607688 - DNA, 25 bp, Mus musculus
cgctttgatgcccacaacgtcaagg

SEQ ID NO: 607689 - DNA, 25 bp, Mus musculus
cgctttgatgccgacaacgtcaagg

SEQ ID NO: 607690 - DNA, 25 bp, Mus musculus
cgctttggaaagatgagagcagctc

SEQ ID NO: 607691 - DNA, 25 bp, Mus musculus
cgctttggaaagttgagagcagctc

SEQ ID NO: 607692 - DNA, 25 bp, Mus musculus
cgctttggcgttctgcggtcatgcc

SEQ ID NO: 607693 - DNA, 25 bp, Mus musculus
cgctttggcgttgtgcggtcatgcc

SEQ ID NO: 607694 - DNA, 25 bp, Mus musculus
cgcttttacaagcagctcagcacga

SEQ ID NO: 607695 - DNA, 25 bp, Mus musculus
cgcttttacaaggagctcagcacga

SEQ ID NO: 607696 - DNA, 25 bp, Mus musculus
cgcttttaccaccttggtcactcat

SEQ ID NO: 607697 - DNA, 25 bp, Mus musculus
cgcttttaccacgttggtcactcat

SEQ ID NO: 607698 - DNA, 25 bp, Mus musculus
cgcttttcattaccgtacgcaccgg

SEQ ID NO: 607699 - DNA, 25 bp, Mus musculus
cgcttttcattagcgtacgcaccgg

SEQ ID NO: 607700 - DNA, 25 bp, Mus musculus
cgcttttccctgcaagatgaagtgc

SEQ ID NO: 607701 - DNA, 25 bp, Mus musculus
cgcttttccctggaagatgaagtgc

SEQ ID NO: 607702 - DNA, 25 bp, Mus musculus
cggaaaaacacgagacattagtgat

SEQ ID NO: 607703 - DNA, 25 bp, Mus musculus
cggaaaaacacgtgacattagtgat

SEQ ID NO: 607704 - DNA, 25 bp, Mus musculus
cggaaaaagcgaccaccgagcttct

SEQ ID NO: 607705 - DNA, 25 bp, Mus musculus
cggaaaaagcgagcaccgagcttct

SEQ ID NO: 607706 - DNA, 25 bp, Mus musculus
cggaaaaatgcgaagctgtaattgg

SEQ ID NO: 607707 - DNA, 25 bp, Mus musculus
cggaaaaatgcgtagctgtaattgg

SEQ ID NO: 607708 - DNA, 25 bp, Mus musculus
cggaaaaccctcagcccggatgctg

SEQ ID NO: 607709 - DNA, 25 bp, Mus musculus
cggaaaaccctctgcccggatgctg

SEQ ID NO: 607710 - DNA, 25 bp, Mus musculus
cggaaaatagggaagaagtgagcct

SEQ ID NO: 607711 - DNA, 25 bp, Mus musculus
cggaaaatagggtagaagtgagcct

SEQ ID NO: 607712 - DNA, 25 bp, Mus musculus
cggaaacaaggaaactgatggaaga

SEQ ID NO: 607713 - DNA, 25 bp, Mus musculus
cggaaacaaggatactgatggaaga

SEQ ID NO: 607714 - DNA, 25 bp, Mus musculus
cggaaacaatgacgagaccccagtc

SEQ ID NO: 607715 - DNA, 25 bp, Mus musculus
cggaaacaatgaggagaccccagtc

SEQ ID NO: 607716 - DNA, 25 bp, Mus musculus
cggaaacctgctagtcactccaggg

SEQ ID NO: 607717 - DNA, 25 bp, Mus musculus
cggaaacctgcttgtcactccaggg

SEQ ID NO: 607718 - DNA, 25 bp, Mus musculus
cggaaacgacggcaatcagcctcca

SEQ ID NO: 607719 - DNA, 25 bp, Mus musculus
cggaaacgacgggaatcagcctcca

SEQ ID NO: 607720 - DNA, 25 bp, Mus musculus
cggaaacgcaagcaggaggaacaaa

SEQ ID NO: 607721 - DNA, 25 bp, Mus musculus
cggaaacgcaaggaggaggaacaaa

SEQ ID NO: 607722 - DNA, 25 bp, Mus musculus
cggaaacgcgtgaccagaggttgat

SEQ ID NO: 607723 - DNA, 25 bp, Mus musculus
cggaaacgcgtgtccagaggttgat

SEQ ID NO: 607724 - DNA, 25 bp, Mus musculus
cggaaactcaggcactacgctgcga

SEQ ID NO: 607725 - DNA, 25 bp, Mus musculus
cggaaactcagggactacgctgcga

SEQ ID NO: 607726 - DNA, 25 bp, Mus musculus
cggaaagactgacatgcgggtcata

SEQ ID NO: 607727 - DNA, 25 bp, Mus musculus
cggaaagactgagatgcgggtcata

SEQ ID NO: 607728 - DNA, 25 bp, Mus musculus
cggaaagcctggcattcctggactc

SEQ ID NO: 607729 - DNA, 25 bp, Mus musculus
cggaaagcctgggattcctggactc

SEQ ID NO: 607730 - DNA, 25 bp, Mus musculus
cggaaaggtgcgagatccacagcta

SEQ ID NO: 607731 - DNA, 25 bp, Mus musculus
cggaaaggtgcgtgatccacagcta

SEQ ID NO: 607732 - DNA, 25 bp, Mus musculus
cggaaagttttcatcacccgcaagt

SEQ ID NO: 607733 - DNA, 25 bp, Mus musculus
cggaaagttttcttcacccgcaagt

SEQ ID NO: 607734 - DNA, 25 bp, Mus musculus
cggaaatcaaagcaggatccagaca

SEQ ID NO: 607735 - DNA, 25 bp, Mus musculus
cggaaatcaaaggaggatccagaca

SEQ ID NO: 607736 - DNA, 25 bp, Mus musculus
cggaaatcacgacctggaaaaggga

SEQ ID NO: 607737 - DNA, 25 bp, Mus musculus
cggaaatcacgagctggaaaaggga

SEQ ID NO: 607738 - DNA, 25 bp, Mus musculus
cggaaatgcagtatgtgaacgagga

SEQ ID NO: 607739 - DNA, 25 bp, Mus musculus
cggaaatgcagtttgtgaacgagga

SEQ ID NO: 607740 - DNA, 25 bp, Mus musculus
cggaaatgcgagagccaaataggtc

SEQ ID NO: 607741 - DNA, 25 bp, Mus musculus
cggaaatgcgagtgccaaataggtc

SEQ ID NO: 607742 - DNA, 25 bp, Mus musculus
cggaacaaacatccagcggctcggg

SEQ ID NO: 607743 - DNA, 25 bp, Mus musculus
cggaacaaacatgcagcggctcggg

SEQ ID NO: 607744 - DNA, 25 bp, Mus musculus
cggaacaagatcatgtacctgatcc

SEQ ID NO: 607745 - DNA, 25 bp, Mus musculus
cggaacaagatcttgtacctgatcc

SEQ ID NO: 607746 - DNA, 25 bp, Mus musculus
cggaacacaaacctggatcactttg

SEQ ID NO: 607747 - DNA, 25 bp, Mus musculus
cggaacacaaacgtggatcactttg

SEQ ID NO: 607748 - DNA, 25 bp, Mus musculus
cggaacagggccacagatctggatg

SEQ ID NO: 607749 - DNA, 25 bp, Mus musculus
cggaacagggcctcagatctggatg

SEQ ID NO: 607750 - DNA, 25 bp, Mus musculus
cggaacagtgctctgtggcctgacc

SEQ ID NO: 607751 - DNA, 25 bp, Mus musculus
cggaacagtgctgtgtggcctgacc

SEQ ID NO: 607752 - DNA, 25 bp, Mus musculus
cggaacagtgttatgctacaagact

SEQ ID NO: 607753 - DNA, 25 bp, Mus musculus
cggaacagtgttttgctacaagact

SEQ ID NO: 607754 - DNA, 25 bp, Mus musculus
cggaaccacagcctcctttcaataa

SEQ ID NO: 607755 - DNA, 25 bp, Mus musculus
cggaaccacagcgtcctttcaataa

SEQ ID NO: 607756 - DNA, 25 bp, Mus musculus
cggaaccattctcgccaatgccaat

SEQ ID NO: 607757 - DNA, 25 bp, Mus musculus
cggaaccattctggccaatgccaat

SEQ ID NO: 607758 - DNA, 25 bp, Mus musculus
cggaaccctcggaatctggagctct

SEQ ID NO: 607759 - DNA, 25 bp, Mus musculus
cggaaccctcggtatctggagctct

SEQ ID NO: 607760 - DNA, 25 bp, Mus musculus
cggaacctgcctcttcttggtggcg

SEQ ID NO: 607761 - DNA, 25 bp, Mus musculus
cggaacctgcctgttcttggtggcg

SEQ ID NO: 607762 - DNA, 25 bp, Mus musculus
cggaacctgtgcatctgctgggtgt

SEQ ID NO: 607763 - DNA, 25 bp, Mus musculus
cggaacctgtgcttctgctgggtgt

SEQ ID NO: 607764 - DNA, 25 bp, Mus musculus
cggaactcctgacggcgcaaggcct

SEQ ID NO: 607765 - DNA, 25 bp, Mus musculus
cggaactcctgagggcgcaaggcct

SEQ ID NO: 607766 - DNA, 25 bp, Mus musculus
cggaactggagtaaatctactctca

SEQ ID NO: 607767 - DNA, 25 bp, Mus musculus
cggaactggagttaatctactctca

SEQ ID NO: 607768 - DNA, 25 bp, Mus musculus
cggaacttcgatcgccttgaggaga

SEQ ID NO: 607769 - DNA, 25 bp, Mus musculus
cggaacttcgatggccttgaggaga

SEQ ID NO: 607770 - DNA, 25 bp, Mus musculus
cggaagaaactcacagactatgtca

SEQ ID NO: 607771 - DNA, 25 bp, Mus musculus
cggaagaaactctcagactatgtca

SEQ ID NO: 607772 - DNA, 25 bp, Mus musculus
cggaagacacggagagccagcccct

SEQ ID NO: 607773 - DNA, 25 bp, Mus musculus
cggaagacacggtgagccagcccct

SEQ ID NO: 607774 - DNA, 25 bp, Mus musculus
cggaagacctccattaagaagaaca

SEQ ID NO: 607775 - DNA, 25 bp, Mus musculus
cggaagacctcctttaagaagaaca

SEQ ID NO: 607776 - DNA, 25 bp, Mus musculus
cggaagagattgaccagcgcacacg

SEQ ID NO: 607777 - DNA, 25 bp, Mus musculus
cggaagagattgtccagcgcacacg

SEQ ID NO: 607778 - DNA, 25 bp, Mus musculus
cggaagaggcataagatgccctgaa

SEQ ID NO: 607779 - DNA, 25 bp, Mus musculus
cggaagaggcattagatgccctgaa

SEQ ID NO: 607780 - DNA, 25 bp, Mus musculus
cggaagagtatgatgttggctgcac

SEQ ID NO: 607781 - DNA, 25 bp, Mus musculus
cggaagagtatgttgttggctgcac

SEQ ID NO: 607782 - DNA, 25 bp, Mus musculus
cggaagatccctctcctggtgcaga

SEQ ID NO: 607783 - DNA, 25 bp, Mus musculus
cggaagatccctgtcctggtgcaga

SEQ ID NO: 607784 - DNA, 25 bp, Mus musculus
cggaagatgctacctaccgacctca

SEQ ID NO: 607785 - DNA, 25 bp, Mus musculus
cggaagatgctagctaccgacctca

SEQ ID NO: 607786 - DNA, 25 bp, Mus musculus
cggaagatgtcgacatgatgagcac

SEQ ID NO: 607787 - DNA, 25 bp, Mus musculus
cggaagatgtcgtcatgatgagcac

SEQ ID NO: 607788 - DNA, 25 bp, Mus musculus
cggaagcaaagcacagacttgaaga

SEQ ID NO: 607789 - DNA, 25 bp, Mus musculus
cggaagcaaagctcagacttgaaga

SEQ ID NO: 607790 - DNA, 25 bp, Mus musculus
cggaagcagttaagggtggccctca

SEQ ID NO: 607791 - DNA, 25 bp, Mus musculus
cggaagcagttatgggtggccctca

SEQ ID NO: 607792 - DNA, 25 bp, Mus musculus
cggaagccacagatgctatggagct

SEQ ID NO: 607793 - DNA, 25 bp, Mus musculus
cggaagccacagttgctatggagct

SEQ ID NO: 607794 - DNA, 25 bp, Mus musculus
cggaagcccaagaacctgaataaat

SEQ ID NO: 607795 - DNA, 25 bp, Mus musculus
cggaagcccaagtacctgaataaat

SEQ ID NO: 607796 - DNA, 25 bp, Mus musculus
cggaagcctgaaaaagctcgcctca

SEQ ID NO: 607797 - DNA, 25 bp, Mus musculus
cggaagcctgaataagctcgcctca

SEQ ID NO: 607798 - DNA, 25 bp, Mus musculus
cggaagctccggcaacaagtgaatt

SEQ ID NO: 607799 - DNA, 25 bp, Mus musculus
cggaagctccgggaacaagtgaatt

SEQ ID NO: 607800 - DNA, 25 bp, Mus musculus
cggaagctctttcatcttctcgatg

SEQ ID NO: 607801 - DNA, 25 bp, Mus musculus
cggaagctctttgatcttctcgatg

SEQ ID NO: 607802 - DNA, 25 bp, Mus musculus
cggaagctggacacaacagagtctg

SEQ ID NO: 607803 - DNA, 25 bp, Mus musculus
cggaagctggactcaacagagtctg

SEQ ID NO: 607804 - DNA, 25 bp, Mus musculus
cggaagcttattcttcaacccaaca

SEQ ID NO: 607805 - DNA, 25 bp, Mus musculus
cggaagcttattgttcaacccaaca

SEQ ID NO: 607806 - DNA, 25 bp, Mus musculus
cggaaggaagtgattgaaggctacc

SEQ ID NO: 607807 - DNA, 25 bp, Mus musculus
cggaaggaagtgtttgaaggctacc

SEQ ID NO: 607808 - DNA, 25 bp, Mus musculus
cggaaggactgcaaacagtgggtat

SEQ ID NO: 607809 - DNA, 25 bp, Mus musculus
cggaaggactgctaacagtgggtat

SEQ ID NO: 607810 - DNA, 25 bp, Mus musculus
cggaaggagccacagatcatgaaga

SEQ ID NO: 607811 - DNA, 25 bp, Mus musculus
cggaaggagccagagatcatgaaga

SEQ ID NO: 607812 - DNA, 25 bp, Mus musculus
cggaaggagttccagcaagtgttca

SEQ ID NO: 607813 - DNA, 25 bp, Mus musculus
cggaaggagttcgagcaagtgttca

SEQ ID NO: 607814 - DNA, 25 bp, Mus musculus
cggaaggatgtcagtaatcaatagt

SEQ ID NO: 607815 - DNA, 25 bp, Mus musculus
cggaaggatgtctgtaatcaatagt

SEQ ID NO: 607816 - DNA, 25 bp, Mus musculus
cggaaggctgccctcaaaacagcct

SEQ ID NO: 607817 - DNA, 25 bp, Mus musculus
cggaaggctgccgtcaaaacagcct

SEQ ID NO: 607818 - DNA, 25 bp, Mus musculus
cggaaggtctgtagccaattcgagg

SEQ ID NO: 607819 - DNA, 25 bp, Mus musculus
cggaaggtctgttgccaattcgagg

SEQ ID NO: 607820 - DNA, 25 bp, Mus musculus
cggaaggtgcccattactgagaagg

SEQ ID NO: 607821 - DNA, 25 bp, Mus musculus
cggaaggtgccctttactgagaagg

SEQ ID NO: 607822 - DNA, 25 bp, Mus musculus
cggaagtcaactcaaatgaactggc

SEQ ID NO: 607823 - DNA, 25 bp, Mus musculus
cggaagtcaactgaaatgaactggc

SEQ ID NO: 607824 - DNA, 25 bp, Mus musculus
cggaagtcttcacctagccgaccgg

SEQ ID NO: 607825 - DNA, 25 bp, Mus musculus
cggaagtcttcagctagccgaccgg

SEQ ID NO: 607826 - DNA, 25 bp, Mus musculus
cggaagtgaaggcagcttcccgcct

SEQ ID NO: 607827 - DNA, 25 bp, Mus musculus
cggaagtgaagggagcttcccgcct

SEQ ID NO: 607828 - DNA, 25 bp, Mus musculus
cggaagtgctaccaagctgcggaaa

SEQ ID NO: 607829 - DNA, 25 bp, Mus musculus
cggaagtgctacgaagctgcggaaa

SEQ ID NO: 607830 - DNA, 25 bp, Mus musculus
cggaagtgctgcacagaagccagat

SEQ ID NO: 607831 - DNA, 25 bp, Mus musculus
cggaagtgctgctcagaagccagat

SEQ ID NO: 607832 - DNA, 25 bp, Mus musculus
cggaagtggcagagacaacgatgtt

SEQ ID NO: 607833 - DNA, 25 bp, Mus musculus
cggaagtggcagtgacaacgatgtt

SEQ ID NO: 607834 - DNA, 25 bp, Mus musculus
cggaagtggtgcaccaacggcccgt

SEQ ID NO: 607835 - DNA, 25 bp, Mus musculus
cggaagtggtgctccaacggcccgt

SEQ ID NO: 607836 - DNA, 25 bp, Mus musculus
cggaagttcgagagcccatgctgag

SEQ ID NO: 607837 - DNA, 25 bp, Mus musculus
cggaagttcgagtgcccatgctgag

SEQ ID NO: 607838 - DNA, 25 bp, Mus musculus
cggaatagctgtcgcacctgtgtca

SEQ ID NO: 607839 - DNA, 25 bp, Mus musculus
cggaatagctgtggcacctgtgtca

SEQ ID NO: 607840 - DNA, 25 bp, Mus musculus
cggaatcagatccaggtaggaaatg

SEQ ID NO: 607841 - DNA, 25 bp, Mus musculus
cggaatcagatcgaggtaggaaatg

SEQ ID NO: 607842 - DNA, 25 bp, Mus musculus
cggaatcagttcattgatgagctca

SEQ ID NO: 607843 - DNA, 25 bp, Mus musculus
cggaatcagttctttgatgagctca

SEQ ID NO: 607844 - DNA, 25 bp, Mus musculus
cggaatcattttcgctggttccctg

SEQ ID NO: 607845 - DNA, 25 bp, Mus musculus
cggaatcattttggctggttccctg

SEQ ID NO: 607846 - DNA, 25 bp, Mus musculus
cggaatcgacaacccaggcagtctg

SEQ ID NO: 607847 - DNA, 25 bp, Mus musculus
cggaatcgacaagccaggcagtctg

SEQ ID NO: 607848 - DNA, 25 bp, Mus musculus
cggaatgagattccggagatgaacc

SEQ ID NO: 607849 - DNA, 25 bp, Mus musculus
cggaatgagattgcggagatgaacc

SEQ ID NO: 607850 - DNA, 25 bp, Mus musculus
cggaatgcatcgcaacaggtgaaga

SEQ ID NO: 607851 - DNA, 25 bp, Mus musculus
cggaatgcatcggaacaggtgaaga

SEQ ID NO: 607852 - DNA, 25 bp, Mus musculus
cggaatgccattaccacgggattga

SEQ ID NO: 607853 - DNA, 25 bp, Mus musculus
cggaatgccatttccacgggattga

SEQ ID NO: 607854 - DNA, 25 bp, Mus musculus
cggaatggaaatcagttgagatcac

SEQ ID NO: 607855 - DNA, 25 bp, Mus musculus
cggaatggaaatgagttgagatcac

SEQ ID NO: 607856 - DNA, 25 bp, Mus musculus
cggaatggacaaagagacaggcaca

SEQ ID NO: 607857 - DNA, 25 bp, Mus musculus
cggaatggacaatgagacaggcaca

SEQ ID NO: 607858 - DNA, 25 bp, Mus musculus
cggaatggcctcactggatcgaatc

SEQ ID NO: 607859 - DNA, 25 bp, Mus musculus
cggaatggcctctctggatcgaatc

SEQ ID NO: 607860 - DNA, 25 bp, Mus musculus
cggaatggctgcagataagaataag

SEQ ID NO: 607861 - DNA, 25 bp, Mus musculus
cggaatggctgctgataagaataag

SEQ ID NO: 607862 - DNA, 25 bp, Mus musculus
cggaattacactatctggcagtggt

SEQ ID NO: 607863 - DNA, 25 bp, Mus musculus
cggaattacactttctggcagtggt

SEQ ID NO: 607864 - DNA, 25 bp, Mus musculus
cggaattagactcgttcctccaaga

SEQ ID NO: 607865 - DNA, 25 bp, Mus musculus
cggaattagactggttcctccaaga

SEQ ID NO: 607866 - DNA, 25 bp, Mus musculus
cggaatttccggagtggctcgcatt

SEQ ID NO: 607867 - DNA, 25 bp, Mus musculus
cggaatttccggtgtggctcgcatt

SEQ ID NO: 607868 - DNA, 25 bp, Mus musculus
cggacaaagagaatgaggttctcta

SEQ ID NO: 607869 - DNA, 25 bp, Mus musculus
cggacaaagagattgaggttctcta

SEQ ID NO: 607870 - DNA, 25 bp, Mus musculus
cggacaactgcgatgattttcagtt

SEQ ID NO: 607871 - DNA, 25 bp, Mus musculus
cggacaactgcgttgattttcagtt

SEQ ID NO: 607872 - DNA, 25 bp, Mus musculus
cggacaagcgggaaattagagcccg

SEQ ID NO: 607873 - DNA, 25 bp, Mus musculus
cggacaagcgggtaattagagcccg

SEQ ID NO: 607874 - DNA, 25 bp, Mus musculus
cggacaaggaagcactgccgaagct

SEQ ID NO: 607875 - DNA, 25 bp, Mus musculus
cggacaaggaaggactgccgaagct

SEQ ID NO: 607876 - DNA, 25 bp, Mus musculus
cggacaagggcacctttgagaaagc

SEQ ID NO: 607877 - DNA, 25 bp, Mus musculus
cggacaagggcagctttgagaaagc

SEQ ID NO: 607878 - DNA, 25 bp, Mus musculus
cggacacaatgaacggcaaagcagt

SEQ ID NO: 607879 - DNA, 25 bp, Mus musculus
cggacacaatgatcggcaaagcagt

SEQ ID NO: 607880 - DNA, 25 bp, Mus musculus
cggacacagcgcagaataggaaata

SEQ ID NO: 607881 - DNA, 25 bp, Mus musculus
cggacacagcgctgaataggaaata

SEQ ID NO: 607882 - DNA, 25 bp, Mus musculus
cggacacccttgaggacagccatcg

SEQ ID NO: 607883 - DNA, 25 bp, Mus musculus
cggacacccttgtggacagccatcg

SEQ ID NO: 607884 - DNA, 25 bp, Mus musculus
cggacacgccatccactcgttaggt

SEQ ID NO: 607885 - DNA, 25 bp, Mus musculus
cggacacgccatgcactcgttaggt

SEQ ID NO: 607886 - DNA, 25 bp, Mus musculus
cggacacggttgagccaggctgctt

SEQ ID NO: 607887 - DNA, 25 bp, Mus musculus
cggacacggttgtgccaggctgctt

SEQ ID NO: 607888 - DNA, 25 bp, Mus musculus
cggacactctcaccactgtgttctt

SEQ ID NO: 607889 - DNA, 25 bp, Mus musculus
cggacactctcagcactgtgttctt

SEQ ID NO: 607890 - DNA, 25 bp, Mus musculus
cggacactttctctgatggactcag

SEQ ID NO: 607891 - DNA, 25 bp, Mus musculus
cggacactttctgtgatggactcag

SEQ ID NO: 607892 - DNA, 25 bp, Mus musculus
cggacagaagccatccggatggaga

SEQ ID NO: 607893 - DNA, 25 bp, Mus musculus
cggacagaagccctgagagcccttc

SEQ ID NO: 607894 - DNA, 25 bp, Mus musculus
cggacagaagccgtgagagcccttc

SEQ ID NO: 607895 - DNA, 25 bp, Mus musculus
cggacagaagccttccggatggaga

SEQ ID NO: 607896 - DNA, 25 bp, Mus musculus
cggacagaccccatggtgacctcat

SEQ ID NO: 607897 - DNA, 25 bp, Mus musculus
cggacagaccccttggtgacctcat

SEQ ID NO: 607898 - DNA, 25 bp, Mus musculus
cggacagcaggcattcatggagact

SEQ ID NO: 607899 - DNA, 25 bp, Mus musculus
cggacagcaggctttcatggagact

SEQ ID NO: 607900 - DNA, 25 bp, Mus musculus
cggacagccggaagggaaaccgcct

SEQ ID NO: 607901 - DNA, 25 bp, Mus musculus
cggacagccggatgggaaaccgcct

SEQ ID NO: 607902 - DNA, 25 bp, Mus musculus
cggacaggtgaccactatcaagaag

SEQ ID NO: 607903 - DNA, 25 bp, Mus musculus
cggacaggtgacgactatcaagaag

SEQ ID NO: 607904 - DNA, 25 bp, Mus musculus
cggacagtcgggacccagccagcga

SEQ ID NO: 607905 - DNA, 25 bp, Mus musculus
cggacagtcgggtcccagccagcga

SEQ ID NO: 607906 - DNA, 25 bp, Mus musculus
cggacagtctgcaggatgagatcaa

SEQ ID NO: 607907 - DNA, 25 bp, Mus musculus
cggacagtctgctggatgagatcaa

SEQ ID NO: 607908 - DNA, 25 bp, Mus musculus
cggacagtggtacatcaccgaaaga

SEQ ID NO: 607909 - DNA, 25 bp, Mus musculus
cggacagtggtagatcaccgaaaga

SEQ ID NO: 607910 - DNA, 25 bp, Mus musculus
cggacagttactatgcataaggaca

SEQ ID NO: 607911 - DNA, 25 bp, Mus musculus
cggacagttactttgcataaggaca

SEQ ID NO: 607912 - DNA, 25 bp, Mus musculus
cggacagtttggcacaatcaataat

SEQ ID NO: 607913 - DNA, 25 bp, Mus musculus
cggacagtttgggacaatcaataat

SEQ ID NO: 607914 - DNA, 25 bp, Mus musculus
cggacatcattgatttaagacacac

SEQ ID NO: 607915 - DNA, 25 bp, Mus musculus
cggacatcattgttttaagacacac

SEQ ID NO: 607916 - DNA, 25 bp, Mus musculus
cggacatcgatgcaaagttcctcta

SEQ ID NO: 607917 - DNA, 25 bp, Mus musculus
cggacatcgatggaaagttcctcta

SEQ ID NO: 607918 - DNA, 25 bp, Mus musculus
cggacatgaataacgatggaaggat

SEQ ID NO: 607919 - DNA, 25 bp, Mus musculus
cggacatgaatatcgatggaaggat

SEQ ID NO: 607920 - DNA, 25 bp, Mus musculus
cggacatgccatatatgccatcagg

SEQ ID NO: 607921 - DNA, 25 bp, Mus musculus
cggacatgccatttatgccatcagg

SEQ ID NO: 607922 - DNA, 25 bp, Mus musculus
cggacatggactacgactcgtatca

SEQ ID NO: 607923 - DNA, 25 bp, Mus musculus
cggacatggacttcgactcgtatca

SEQ ID NO: 607924 - DNA, 25 bp, Mus musculus
cggacatggtcaagtttagctacag

SEQ ID NO: 607925 - DNA, 25 bp, Mus musculus
cggacatggtcatgtttagctacag

SEQ ID NO: 607926 - DNA, 25 bp, Mus musculus
cggacattgaggcagcacacaggtt

SEQ ID NO: 607927 - DNA, 25 bp, Mus musculus
cggacattgagggagcacacaggtt

SEQ ID NO: 607928 - DNA, 25 bp, Mus musculus
cggacattttcccaagagcatttgc

SEQ ID NO: 607929 - DNA, 25 bp, Mus musculus
cggacattttccgaagagcatttgc

SEQ ID NO: 607930 - DNA, 25 bp, Mus musculus
cggaccaaatgaatggcagctataa

SEQ ID NO: 607931 - DNA, 25 bp, Mus musculus
cggaccaaatgattggcagctataa

SEQ ID NO: 607932 - DNA, 25 bp, Mus musculus
cggaccaagggtcagctggcttctt

SEQ ID NO: 607933 - DNA, 25 bp, Mus musculus
cggaccaagggtgagctggcttctt

SEQ ID NO: 607934 - DNA, 25 bp, Mus musculus
cggaccaaggtgctttcccagtttg

SEQ ID NO: 607935 - DNA, 25 bp, Mus musculus
cggaccaaggtggtttcccagtttg

SEQ ID NO: 607936 - DNA, 25 bp, Mus musculus
cggaccatcttcaccgcggtcgggt

SEQ ID NO: 607937 - DNA, 25 bp, Mus musculus
cggaccatcttctccgcggtcgggt

SEQ ID NO: 607938 - DNA, 25 bp, Mus musculus
cggacccagggcactatcagatgct

SEQ ID NO: 607939 - DNA, 25 bp, Mus musculus
cggacccagggctctatcagatgct

SEQ ID NO: 607940 - DNA, 25 bp, Mus musculus
cggacccctacacagctggattggc

SEQ ID NO: 607941 - DNA, 25 bp, Mus musculus
cggacccctacagagctggattggc

SEQ ID NO: 607942 - DNA, 25 bp, Mus musculus
cggaccccttggactatgttagcat

SEQ ID NO: 607943 - DNA, 25 bp, Mus musculus
cggaccccttggtctatgttagcat

SEQ ID NO: 607944 - DNA, 25 bp, Mus musculus
cggacccgtccgcatcagacttgtg

SEQ ID NO: 607945 - DNA, 25 bp, Mus musculus
cggacccgtccggatcagacttgtg

SEQ ID NO: 607946 - DNA, 25 bp, Mus musculus
cggaccctctgaatggcgggctcgc

SEQ ID NO: 607947 - DNA, 25 bp, Mus musculus
cggaccctctgattggcgggctcgc

SEQ ID NO: 607948 - DNA, 25 bp, Mus musculus
cggaccctgactacacatacagaaa

SEQ ID NO: 607949 - DNA, 25 bp, Mus musculus
cggaccctgacttcacatacagaaa

SEQ ID NO: 607950 - DNA, 25 bp, Mus musculus
cggaccgggcgcaccatgcacttgg

SEQ ID NO: 607951 - DNA, 25 bp, Mus musculus
cggaccgggcgctccatgcacttgg

SEQ ID NO: 607952 - DNA, 25 bp, Mus musculus
cggaccgtggagcagtcactgcaca

SEQ ID NO: 607953 - DNA, 25 bp, Mus musculus
cggaccgtggaggagtcactgcaca

SEQ ID NO: 607954 - DNA, 25 bp, Mus musculus
cggacctaagtcaaaggcaagtgaa

SEQ ID NO: 607955 - DNA, 25 bp, Mus musculus
cggacctaagtctaaggcaagtgaa

SEQ ID NO: 607956 - DNA, 25 bp, Mus musculus
cggacctaatgacgttccccagcag

SEQ ID NO: 607957 - DNA, 25 bp, Mus musculus
cggacctaatgaggttccccagcag

SEQ ID NO: 607958 - DNA, 25 bp, Mus musculus
cggacctcctgcaggatgctagcga

SEQ ID NO: 607959 - DNA, 25 bp, Mus musculus
cggacctcctgctggatgctagcga

SEQ ID NO: 607960 - DNA, 25 bp, Mus musculus
cggacctctatgctgtcaccaaaga

SEQ ID NO: 607961 - DNA, 25 bp, Mus musculus
cggacctctatggtgtcaccaaaga

SEQ ID NO: 607962 - DNA, 25 bp, Mus musculus
cggacgaggctccagacttcaagga

SEQ ID NO: 607963 - DNA, 25 bp, Mus musculus
cggacgaggctcgagacttcaagga

SEQ ID NO: 607964 - DNA, 25 bp, Mus musculus
cggacgagttgacgccatcaaggct

SEQ ID NO: 607965 - DNA, 25 bp, Mus musculus
cggacgagttgaggccatcaaggct

SEQ ID NO: 607966 - DNA, 25 bp, Mus musculus
cggacggacacgatccaagtggaga

SEQ ID NO: 607967 - DNA, 25 bp, Mus musculus
cggacggacacgttccaagtggaga

SEQ ID NO: 607968 - DNA, 25 bp, Mus musculus
cggacggcactcctagtctggaagc

SEQ ID NO: 607969 - DNA, 25 bp, Mus musculus
cggacggcactcgtagtctggaagc

SEQ ID NO: 607970 - DNA, 25 bp, Mus musculus
cggacggtatgcagccaagcgcttc

SEQ ID NO: 607971 - DNA, 25 bp, Mus musculus
cggacggtatgctgccaagcgcttc

SEQ ID NO: 607972 - DNA, 25 bp, Mus musculus
cggacgtgggccaactacagcgagt

SEQ ID NO: 607973 - DNA, 25 bp, Mus musculus
cggacgtgggcctactacagcgagt

SEQ ID NO: 607974 - DNA, 25 bp, Mus musculus
cggacgttgagcctcctctggacgc

SEQ ID NO: 607975 - DNA, 25 bp, Mus musculus
cggacgttgagcgtcctctggacgc

SEQ ID NO: 607976 - DNA, 25 bp, Mus musculus
cggacgttgatcaaagccttcggca

SEQ ID NO: 607977 - DNA, 25 bp, Mus musculus
cggacgttgatctaagccttcggca

SEQ ID NO: 607978 - DNA, 25 bp, Mus musculus
cggactaccttcaacacagcacttg

SEQ ID NO: 607979 - DNA, 25 bp, Mus musculus
cggactaccttctacacagcacttg

SEQ ID NO: 607980 - DNA, 25 bp, Mus musculus
cggactactacaaaagaggagattt

SEQ ID NO: 607981 - DNA, 25 bp, Mus musculus
cggactactacataagaggagattt

SEQ ID NO: 607982 - DNA, 25 bp, Mus musculus
cggactccaagaaggtgtgtgacgt

SEQ ID NO: 607983 - DNA, 25 bp, Mus musculus
cggactccaagatggtgtgtgacgt

SEQ ID NO: 607984 - DNA, 25 bp, Mus musculus
cggactcccagaactgcgagggcgc

SEQ ID NO: 607985 - DNA, 25 bp, Mus musculus
cggactcccagatctgcgagggcgc

SEQ ID NO: 607986 - DNA, 25 bp, Mus musculus
cggactccgccaacagcaggaggcg

SEQ ID NO: 607987 - DNA, 25 bp, Mus musculus
cggactccgccatcagcaggaggcg

SEQ ID NO: 607988 - DNA, 25 bp, Mus musculus
cggactcctccaaagccgtcaaaag

SEQ ID NO: 607989 - DNA, 25 bp, Mus musculus
cggactcctccatagccgtcaaaag

SEQ ID NO: 607990 - DNA, 25 bp, Mus musculus
cggactcctgatcaccctcaaggga

SEQ ID NO: 607991 - DNA, 25 bp, Mus musculus
cggactcctgatgaccctcaaggga

SEQ ID NO: 607992 - DNA, 25 bp, Mus musculus
cggactctccgtacctgcaaggctt

SEQ ID NO: 607993 - DNA, 25 bp, Mus musculus
cggactctccgttcctgcaaggctt

SEQ ID NO: 607994 - DNA, 25 bp, Mus musculus
cggactctggatacaccgacggcgg

SEQ ID NO: 607995 - DNA, 25 bp, Mus musculus
cggactctggattcaccgacggcgg

SEQ ID NO: 607996 - DNA, 25 bp, Mus musculus
cggactctgtgaccatgcctgtggc

SEQ ID NO: 607997 - DNA, 25 bp, Mus musculus
cggactctgtgagcatgcctgtggc

SEQ ID NO: 607998 - DNA, 25 bp, Mus musculus
cggactgtcgtaagaggtcagacaa

SEQ ID NO: 607999 - DNA, 25 bp, Mus musculus
cggactgtcgtatgaggtcagacaa

SEQ ID NO: 608000 - DNA, 25 bp, Mus musculus
cggactgtgaaaatctgcttaagaa

SEQ ID NO: 608001 - DNA, 25 bp, Mus musculus
cggactgtgaaattctgcttaagaa

SEQ ID NO: 608002 - DNA, 25 bp, Mus musculus
cggactgttctacctgttcgcgcgc

SEQ ID NO: 608003 - DNA, 25 bp, Mus musculus
cggactgttctagctgttcgcgcgc

SEQ ID NO: 608004 - DNA, 25 bp, Mus musculus
cggacttgaccacggagctggaaaa

SEQ ID NO: 608005 - DNA, 25 bp, Mus musculus
cggacttgaccagggagctggaaaa

SEQ ID NO: 608006 - DNA, 25 bp, Mus musculus
cggacttgtcctcgcttgcgtcagt

SEQ ID NO: 608007 - DNA, 25 bp, Mus musculus
cggacttgtcctggcttgcgtcagt

SEQ ID NO: 608008 - DNA, 25 bp, Mus musculus
cggactttgaggacctcaccaaagt

SEQ ID NO: 608009 - DNA, 25 bp, Mus musculus
cggactttgaggtcctcaccaaagt

SEQ ID NO: 608010 - DNA, 25 bp, Mus musculus
cggactttgatgacaagcagcaggt

SEQ ID NO: 608011 - DNA, 25 bp, Mus musculus
cggactttgatgtcaagcagcaggt

SEQ ID NO: 608012 - DNA, 25 bp, Mus musculus
cggactttgcctacgccatggcgct

SEQ ID NO: 608013 - DNA, 25 bp, Mus musculus
cggactttgccttcgccatggcgct

SEQ ID NO: 608014 - DNA, 25 bp, Mus musculus
cggagaaaagagagtcaacatggcc

SEQ ID NO: 608015 - DNA, 25 bp, Mus musculus
cggagaaaagagtgtcaacatggcc

SEQ ID NO: 608016 - DNA, 25 bp, Mus musculus
cggagaaagtgcacgccgtccaaga

SEQ ID NO: 608017 - DNA, 25 bp, Mus musculus
cggagaaagtgctcgccgtccaaga

SEQ ID NO: 608018 - DNA, 25 bp, Mus musculus
cggagaagctgacgacgcgtcctca

SEQ ID NO: 608019 - DNA, 25 bp, Mus musculus
cggagaagctgaggacgcgtcctca

SEQ ID NO: 608020 - DNA, 25 bp, Mus musculus
cggagaaggcaaaccctgtgtgttc

SEQ ID NO: 608021 - DNA, 25 bp, Mus musculus
cggagaaggcaatccctgtgtgttc

SEQ ID NO: 608022 - DNA, 25 bp, Mus musculus
cggagaagggtgatgggcctggcgg

SEQ ID NO: 608023 - DNA, 25 bp, Mus musculus
cggagaagggtgttgggcctggcgg

SEQ ID NO: 608024 - DNA, 25 bp, Mus musculus
cggagaattacaagcaccgcggaat

SEQ ID NO: 608025 - DNA, 25 bp, Mus musculus
cggagaattacatgcaccgcggaat

SEQ ID NO: 608026 - DNA, 25 bp, Mus musculus
cggagaccaaggatgtacagattcg

SEQ ID NO: 608027 - DNA, 25 bp, Mus musculus
cggagaccaaggttgtacagattcg

SEQ ID NO: 608028 - DNA, 25 bp, Mus musculus
cggagaccgagcaggctgttgctac

SEQ ID NO: 608029 - DNA, 25 bp, Mus musculus
cggagaccgagctggctgttgctac

SEQ ID NO: 608030 - DNA, 25 bp, Mus musculus
cggagacgtctaaggcttcctggtg

SEQ ID NO: 608031 - DNA, 25 bp, Mus musculus
cggagacgtctatggcttcctggtg

SEQ ID NO: 608032 - DNA, 25 bp, Mus musculus
cggagactgactcttagcacgtggc

SEQ ID NO: 608033 - DNA, 25 bp, Mus musculus
cggagactgactgttagcacgtggc

SEQ ID NO: 608034 - DNA, 25 bp, Mus musculus
cggagactgattaggaagactctga

SEQ ID NO: 608035 - DNA, 25 bp, Mus musculus
cggagactgatttggaagactctga

SEQ ID NO: 608036 - DNA, 25 bp, Mus musculus
cggagactgccgaggatgacatcag

SEQ ID NO: 608037 - DNA, 25 bp, Mus musculus
cggagactgccgtggatgacatcag

SEQ ID NO: 608038 - DNA, 25 bp, Mus musculus
cggagagacaacactcagtttaaaa

SEQ ID NO: 608039 - DNA, 25 bp, Mus musculus
cggagagacaactctcagtttaaaa

SEQ ID NO: 608040 - DNA, 25 bp, Mus musculus
cggagagcaaggctacggctttcac

SEQ ID NO: 608041 - DNA, 25 bp, Mus musculus
cggagagcaagggtacggctttcac

SEQ ID NO: 608042 - DNA, 25 bp, Mus musculus
cggagagcatttatgacctggacta

SEQ ID NO: 608043 - DNA, 25 bp, Mus musculus
cggagagcatttttgacctggacta

SEQ ID NO: 608044 - DNA, 25 bp, Mus musculus
cggagagccaatccccatttccaaa

SEQ ID NO: 608045 - DNA, 25 bp, Mus musculus
cggagagccaatgcccatttccaaa

SEQ ID NO: 608046 - DNA, 25 bp, Mus musculus
cggagagctacgcaaccactagtgt

SEQ ID NO: 608047 - DNA, 25 bp, Mus musculus
cggagagctacggaaccactagtgt

SEQ ID NO: 608048 - DNA, 25 bp, Mus musculus
cggagagctgtaccccacaatgatt

SEQ ID NO: 608049 - DNA, 25 bp, Mus musculus
cggagagctgtagcccacaatgatt

SEQ ID NO: 608050 - DNA, 25 bp, Mus musculus
cggagaggccgtaatccagcagtga

SEQ ID NO: 608051 - DNA, 25 bp, Mus musculus
cggagaggccgttatccagcagtga

SEQ ID NO: 608052 - DNA, 25 bp, Mus musculus
cggagagtgagcacaacttggagca

SEQ ID NO: 608053 - DNA, 25 bp, Mus musculus
cggagagtgagctcaacttggagca

SEQ ID NO: 608054 - DNA, 25 bp, Mus musculus
cggagagtgcgaaccagttatggct

SEQ ID NO: 608055 - DNA, 25 bp, Mus musculus
cggagagtgcgatccagttatggct

SEQ ID NO: 608056 - DNA, 25 bp, Mus musculus
cggagataatggagtcccaaatcag

SEQ ID NO: 608057 - DNA, 25 bp, Mus musculus
cggagataatggtgtcccaaatcag

SEQ ID NO: 608058 - DNA, 25 bp, Mus musculus
cggagatcgcgtctcctcttttgct

SEQ ID NO: 608059 - DNA, 25 bp, Mus musculus
cggagatcgcgtgtcctcttttgct

SEQ ID NO: 608060 - DNA, 25 bp, Mus musculus
cggagatcttccaacccatcgagga

SEQ ID NO: 608061 - DNA, 25 bp, Mus musculus
cggagatcttcctacccatcgagga

SEQ ID NO: 608062 - DNA, 25 bp, Mus musculus
cggagatcttggctctgcagaagca

SEQ ID NO: 608063 - DNA, 25 bp, Mus musculus
cggagatcttgggtctgcagaagca

SEQ ID NO: 608064 - DNA, 25 bp, Mus musculus
cggagatgatggacccctgcgttgc

SEQ ID NO: 608065 - DNA, 25 bp, Mus musculus
cggagatgatggtcccctgcgttgc

SEQ ID NO: 608066 - DNA, 25 bp, Mus musculus
cggagatgattactgggaagatcct

SEQ ID NO: 608067 - DNA, 25 bp, Mus musculus
cggagatgattagtgggaagatcct

SEQ ID NO: 608068 - DNA, 25 bp, Mus musculus
cggagattgtgtctgccctggacta

SEQ ID NO: 608069 - DNA, 25 bp, Mus musculus
cggagattgtgtgtgccctggacta

SEQ ID NO: 608070 - DNA, 25 bp, Mus musculus
cggagcaacagtacgggcccatggc

SEQ ID NO: 608071 - DNA, 25 bp, Mus musculus
cggagcaacagttcgggcccatggc

SEQ ID NO: 608072 - DNA, 25 bp, Mus musculus
cggagcaacggtcactttctggcaa

SEQ ID NO: 608073 - DNA, 25 bp, Mus musculus
cggagcaacggtgactttctggcaa

SEQ ID NO: 608074 - DNA, 25 bp, Mus musculus
cggagcacggcactgagtaccagtc

SEQ ID NO: 608075 - DNA, 25 bp, Mus musculus
cggagcacggcagtgagtaccagtc

SEQ ID NO: 608076 - DNA, 25 bp, Mus musculus
cggagcagaatgaaccagggacaca

SEQ ID NO: 608077 - DNA, 25 bp, Mus musculus
cggagcagaatgtaccagggacaca

SEQ ID NO: 608078 - DNA, 25 bp, Mus musculus
cggagcagagacaccacgatgaagg

SEQ ID NO: 608079 - DNA, 25 bp, Mus musculus
cggagcagagactccacgatgaagg

SEQ ID NO: 608080 - DNA, 25 bp, Mus musculus
cggagcagagcccaacagatgctta

SEQ ID NO: 608081 - DNA, 25 bp, Mus musculus
cggagcagagccgaacagatgctta

SEQ ID NO: 608082 - DNA, 25 bp, Mus musculus
cggagcagatcaataggcgaacgcg

SEQ ID NO: 608083 - DNA, 25 bp, Mus musculus
cggagcagatcattaggcgaacgcg

SEQ ID NO: 608084 - DNA, 25 bp, Mus musculus
cggagcagcacgcagatggaattat

SEQ ID NO: 608085 - DNA, 25 bp, Mus musculus
cggagcagcacggagatggaattat

SEQ ID NO: 608086 - DNA, 25 bp, Mus musculus
cggagcaggataatcggttcagcaa

SEQ ID NO: 608087 - DNA, 25 bp, Mus musculus
cggagcaggatattcggttcagcaa

SEQ ID NO: 608088 - DNA, 25 bp, Mus musculus
cggagcattgttagaaagtggaacg

SEQ ID NO: 608089 - DNA, 25 bp, Mus musculus
cggagcattgtttgaaagtggaacg

SEQ ID NO: 608090 - DNA, 25 bp, Mus musculus
cggagccacagcatggcctgggatc

SEQ ID NO: 608091 - DNA, 25 bp, Mus musculus
cggagccacagcttggcctgggatc

SEQ ID NO: 608092 - DNA, 25 bp, Mus musculus
cggagccagaggaccttaaaggagc

SEQ ID NO: 608093 - DNA, 25 bp, Mus musculus
cggagccagaggtccttaaaggagc

SEQ ID NO: 608094 - DNA, 25 bp, Mus musculus
cggagccctgacagccatggtggtt

SEQ ID NO: 608095 - DNA, 25 bp, Mus musculus
cggagccctgactgccatggtggtt

SEQ ID NO: 608096 - DNA, 25 bp, Mus musculus
cggagccctggactactacgacaaa

SEQ ID NO: 608097 - DNA, 25 bp, Mus musculus
cggagccctggagtactacgacaaa

SEQ ID NO: 608098 - DNA, 25 bp, Mus musculus
cggagccgcctacaaggcttgtagc

SEQ ID NO: 608099 - DNA, 25 bp, Mus musculus
cggagccgcctagaaggcttgtagc

SEQ ID NO: 608100 - DNA, 25 bp, Mus musculus
cggagccggtttacctgaagtggca

SEQ ID NO: 608101 - DNA, 25 bp, Mus musculus
cggagccggttttcctgaagtggca

SEQ ID NO: 608102 - DNA, 25 bp, Mus musculus
cggagcctgtatcgcacacctgatg

SEQ ID NO: 608103 - DNA, 25 bp, Mus musculus
cggagcctgtatggcacacctgatg

SEQ ID NO: 608104 - DNA, 25 bp, Mus musculus
cggagcctgtctcgctcactctgtg

SEQ ID NO: 608105 - DNA, 25 bp, Mus musculus
cggagcctgtctggctcactctgtg

SEQ ID NO: 608106 - DNA, 25 bp, Mus musculus
cggagccttcgaccgcttagatttc

SEQ ID NO: 608107 - DNA, 25 bp, Mus musculus
cggagccttcgagcgcttagatttc

SEQ ID NO: 608108 - DNA, 25 bp, Mus musculus
cggagcgaaaatcgagctattccac

SEQ ID NO: 608109 - DNA, 25 bp, Mus musculus
cggagcgaaaatggagctattccac

SEQ ID NO: 608110 - DNA, 25 bp, Mus musculus
cggagcgaacaaagaccgggccaga

SEQ ID NO: 608111 - DNA, 25 bp, Mus musculus
cggagcgaacaatgaccgggccaga

SEQ ID NO: 608112 - DNA, 25 bp, Mus musculus
cggagcgaccggctcagtttatcaa

SEQ ID NO: 608113 - DNA, 25 bp, Mus musculus
cggagcgaccgggtcagtttatcaa

SEQ ID NO: 608114 - DNA, 25 bp, Mus musculus
cggagcgctgcactgtcagatccgc

SEQ ID NO: 608115 - DNA, 25 bp, Mus musculus
cggagcgctgcagtgtcagatccgc

SEQ ID NO: 608116 - DNA, 25 bp, Mus musculus
cggagcggtcccaccgaagtagcgt

SEQ ID NO: 608117 - DNA, 25 bp, Mus musculus
cggagcggtccctccgaagtagcgt

SEQ ID NO: 608118 - DNA, 25 bp, Mus musculus
cggagcgtctcaacgggtttgccca

SEQ ID NO: 608119 - DNA, 25 bp, Mus musculus
cggagcgtctcatcgggtttgccca

SEQ ID NO: 608120 - DNA, 25 bp, Mus musculus
cggagctcggctcagtcagtcagtc

SEQ ID NO: 608121 - DNA, 25 bp, Mus musculus
cggagctcggctgagtcagtcagtc

SEQ ID NO: 608122 - DNA, 25 bp, Mus musculus
cggagctgagctaccgaagggcttc

SEQ ID NO: 608123 - DNA, 25 bp, Mus musculus
cggagctgagcttccgaagggcttc

SEQ ID NO: 608124 - DNA, 25 bp, Mus musculus
cggagctgaggacttctacttggaa

SEQ ID NO: 608125 - DNA, 25 bp, Mus musculus
cggagctgaggagttctacttggaa

SEQ ID NO: 608126 - DNA, 25 bp, Mus musculus
cggagctgatccctgaggacatcca

SEQ ID NO: 608127 - DNA, 25 bp, Mus musculus
cggagctgatccgtgaggacatcca

SEQ ID NO: 608128 - DNA, 25 bp, Mus musculus
cggagctgcaaaaaccaaagccacc

SEQ ID NO: 608129 - DNA, 25 bp, Mus musculus
cggagctgcaaataccaaagccacc

SEQ ID NO: 608130 - DNA, 25 bp, Mus musculus
cggagctgcgccacacgtttttggc

SEQ ID NO: 608131 - DNA, 25 bp, Mus musculus
cggagctgcgcctcacgtttttggc

SEQ ID NO: 608132 - DNA, 25 bp, Mus musculus
cggagctgtgtacgccttgacttaa

SEQ ID NO: 608133 - DNA, 25 bp, Mus musculus
cggagctgtgtaggccttgacttaa

SEQ ID NO: 608134 - DNA, 25 bp, Mus musculus
cggaggaaagctcaacccagacccg

SEQ ID NO: 608135 - DNA, 25 bp, Mus musculus
cggaggaaagctgaacccagacccg

SEQ ID NO: 608136 - DNA, 25 bp, Mus musculus
cggaggaagtctcgtatcacttccc

SEQ ID NO: 608137 - DNA, 25 bp, Mus musculus
cggaggaagtctggtatcacttccc

SEQ ID NO: 608138 - DNA, 25 bp, Mus musculus
cggaggacactgaaaatctggaact

SEQ ID NO: 608139 - DNA, 25 bp, Mus musculus
cggaggacactgtaaatctggaact

SEQ ID NO: 608140 - DNA, 25 bp, Mus musculus
cggaggaccgatcataaccgtgcag

SEQ ID NO: 608141 - DNA, 25 bp, Mus musculus
cggaggaccgatgataaccgtgcag

SEQ ID NO: 608142 - DNA, 25 bp, Mus musculus
cggaggacgtgtcctccttcttaga

SEQ ID NO: 608143 - DNA, 25 bp, Mus musculus
cggaggacgtgtgctccttcttaga

SEQ ID NO: 608144 - DNA, 25 bp, Mus musculus
cggaggagaaagagacggacaacac

SEQ ID NO: 608145 - DNA, 25 bp, Mus musculus
cggaggagaaagtgacggacaacac

SEQ ID NO: 608146 - DNA, 25 bp, Mus musculus
cggaggagaactacgtgaacgactt

SEQ ID NO: 608147 - DNA, 25 bp, Mus musculus
cggaggagaacttcgtgaacgactt

SEQ ID NO: 608148 - DNA, 25 bp, Mus musculus
cggaggagatgtacattcaacagaa

SEQ ID NO: 608149 - DNA, 25 bp, Mus musculus
cggaggagatgttcattcaacagaa

SEQ ID NO: 608150 - DNA, 25 bp, Mus musculus
cggaggagctcccaaaaactgtgga

SEQ ID NO: 608151 - DNA, 25 bp, Mus musculus
cggaggagctccgaaaaactgtgga

SEQ ID NO: 608152 - DNA, 25 bp, Mus musculus
cggaggaggcggaacccctcagaat

SEQ ID NO: 608153 - DNA, 25 bp, Mus musculus
cggaggaggcggtacccctcagaat

SEQ ID NO: 608154 - DNA, 25 bp, Mus musculus
cggaggagtgcacccgcctacagca

SEQ ID NO: 608155 - DNA, 25 bp, Mus musculus
cggaggagtgcagccgcctacagca

SEQ ID NO: 608156 - DNA, 25 bp, Mus musculus
cggaggatgaatcgtgccttgctca

SEQ ID NO: 608157 - DNA, 25 bp, Mus musculus
cggaggatgaatggtgccttgctca

SEQ ID NO: 608158 - DNA, 25 bp, Mus musculus
cggaggcaaaggagcttctgagaac

SEQ ID NO: 608159 - DNA, 25 bp, Mus musculus
cggaggcaaaggtgcttctgagaac

SEQ ID NO: 608160 - DNA, 25 bp, Mus musculus
cggaggcccatgagagcttcacggc

SEQ ID NO: 608161 - DNA, 25 bp, Mus musculus
cggaggcccatgtgagcttcacggc

SEQ ID NO: 608162 - DNA, 25 bp, Mus musculus
cggaggcgagcgagtccagtcccaa

SEQ ID NO: 608163 - DNA, 25 bp, Mus musculus
cggaggcgagcgtgtccagtcccaa

SEQ ID NO: 608164 - DNA, 25 bp, Mus musculus
cggaggcgcctgctgaatacttctt

SEQ ID NO: 608165 - DNA, 25 bp, Mus musculus
cggaggcgcctggtgaatacttctt

SEQ ID NO: 608166 - DNA, 25 bp, Mus musculus
cggaggcgcgctcgaggtggccatg

SEQ ID NO: 608167 - DNA, 25 bp, Mus musculus
cggaggcgcgctggaggtggccatg

SEQ ID NO: 608168 - DNA, 25 bp, Mus musculus
cggaggcgtgagaaccgcgttactt

SEQ ID NO: 608169 - DNA, 25 bp, Mus musculus
cggaggcgtgagtaccgcgttactt

SEQ ID NO: 608170 - DNA, 25 bp, Mus musculus
cggaggctcagaacaagccaaagct

SEQ ID NO: 608171 - DNA, 25 bp, Mus musculus
cggaggctcagatcaagccaaagct

SEQ ID NO: 608172 - DNA, 25 bp, Mus musculus
cggaggctggagaaagtcaccttga

SEQ ID NO: 608173 - DNA, 25 bp, Mus musculus
cggaggctggagtaagtcaccttga

SEQ ID NO: 608174 - DNA, 25 bp, Mus musculus
cggagggaggacagctaccacgttc

SEQ ID NO: 608175 - DNA, 25 bp, Mus musculus
cggagggaggactgctaccacgttc

SEQ ID NO: 608176 - DNA, 25 bp, Mus musculus
cggagggatcttcattgttgttatg

SEQ ID NO: 608177 - DNA, 25 bp, Mus musculus
cggagggatcttgattgttgttatg

SEQ ID NO: 608178 - DNA, 25 bp, Mus musculus
cggaggtacagaccaggatccagaa

SEQ ID NO: 608179 - DNA, 25 bp, Mus musculus
cggaggtacagagcaggatccagaa

SEQ ID NO: 608180 - DNA, 25 bp, Mus musculus
cggaggtagcccatcggcactcggc

SEQ ID NO: 608181 - DNA, 25 bp, Mus musculus
cggaggtagcccttcggcactcggc

SEQ ID NO: 608182 - DNA, 25 bp, Mus musculus
cggaggtcacggacttcacccagga

SEQ ID NO: 608183 - DNA, 25 bp, Mus musculus
cggaggtcacggtcttcacccagga

SEQ ID NO: 608184 - DNA, 25 bp, Mus musculus
cggaggttcgcgcacatccagaatg

SEQ ID NO: 608185 - DNA, 25 bp, Mus musculus
cggaggttcgcggacatccagaatg

SEQ ID NO: 608186 - DNA, 25 bp, Mus musculus
cggagtacgcccagccacgcagtga

SEQ ID NO: 608187 - DNA, 25 bp, Mus musculus
cggagtacgccctgccacgcagtga

SEQ ID NO: 608188 - DNA, 25 bp, Mus musculus
cggagtagagatcctgcctatgagc

SEQ ID NO: 608189 - DNA, 25 bp, Mus musculus
cggagtagagatgctgcctatgagc

SEQ ID NO: 608190 - DNA, 25 bp, Mus musculus
cggagtatggttaccgcaaagagag

SEQ ID NO: 608191 - DNA, 25 bp, Mus musculus
cggagtatggtttccgcaaagagag

SEQ ID NO: 608192 - DNA, 25 bp, Mus musculus
cggagtcacagacccctgccttgat

SEQ ID NO: 608193 - DNA, 25 bp, Mus musculus
cggagtcacagagccctgccttgat

SEQ ID NO: 608194 - DNA, 25 bp, Mus musculus
cggagtcagaccacggcttccctgg

SEQ ID NO: 608195 - DNA, 25 bp, Mus musculus
cggagtcagacctcggcttccctgg

SEQ ID NO: 608196 - DNA, 25 bp, Mus musculus
cggagtcagtaacaacattgcatca

SEQ ID NO: 608197 - DNA, 25 bp, Mus musculus
cggagtcagtaagaacattgcatca

SEQ ID NO: 608198 - DNA, 25 bp, Mus musculus
cggagtcagtgacaccattcttgcc

SEQ ID NO: 608199 - DNA, 25 bp, Mus musculus
cggagtcagtgagaccattcttgcc

SEQ ID NO: 608200 - DNA, 25 bp, Mus musculus
cggagtcctcccagttctccaaaat

SEQ ID NO: 608201 - DNA, 25 bp, Mus musculus
cggagtcctccctgttctccaaaat

SEQ ID NO: 608202 - DNA, 25 bp, Mus musculus
cggagtcggatgctcagtatcttct

SEQ ID NO: 608203 - DNA, 25 bp, Mus musculus
cggagtcggatggtcagtatcttct

SEQ ID NO: 608204 - DNA, 25 bp, Mus musculus
cggagtctaggcagataaagggctc

SEQ ID NO: 608205 - DNA, 25 bp, Mus musculus
cggagtctaggctgataaagggctc

SEQ ID NO: 608206 - DNA, 25 bp, Mus musculus
cggagtgatcgtctcagtcagcacc

SEQ ID NO: 608207 - DNA, 25 bp, Mus musculus
cggagtgatcgtgtcagtcagcacc

SEQ ID NO: 608208 - DNA, 25 bp, Mus musculus
cggagtgatgaaaggtgaatactac

SEQ ID NO: 608209 - DNA, 25 bp, Mus musculus
cggagtgatgaatggtgaatactac

SEQ ID NO: 608210 - DNA, 25 bp, Mus musculus
cggagtgtttgacatccacttataa

SEQ ID NO: 608211 - DNA, 25 bp, Mus musculus
cggagtgtttgagatccacttataa

SEQ ID NO: 608212 - DNA, 25 bp, Mus musculus
cggagttcagctcgccttcgcgtca

SEQ ID NO: 608213 - DNA, 25 bp, Mus musculus
cggagttcagctggccttcgcgtca

SEQ ID NO: 608214 - DNA, 25 bp, Mus musculus
cggagttccttccaagaactgcaga

SEQ ID NO: 608215 - DNA, 25 bp, Mus musculus
cggagttccttcgaagaactgcaga

SEQ ID NO: 608216 - DNA, 25 bp, Mus musculus
cggagttctctcagtgccatcttca

SEQ ID NO: 608217 - DNA, 25 bp, Mus musculus
cggagttctctctgtgccatcttca

SEQ ID NO: 608218 - DNA, 25 bp, Mus musculus
cggagttgactaccgaccttgcgcg

SEQ ID NO: 608219 - DNA, 25 bp, Mus musculus
cggagttgactagcgaccttgcgcg

SEQ ID NO: 608220 - DNA, 25 bp, Mus musculus
cggagttggcccaggctctgcgcca

SEQ ID NO: 608221 - DNA, 25 bp, Mus musculus
cggagttggccctggctctgcgcca

SEQ ID NO: 608222 - DNA, 25 bp, Mus musculus
cggagttgtcatagggattaggccc

SEQ ID NO: 608223 - DNA, 25 bp, Mus musculus
cggagttgtcattgggattaggccc

SEQ ID NO: 608224 - DNA, 25 bp, Mus musculus
cggagttttatcagcttgtaagtac

SEQ ID NO: 608225 - DNA, 25 bp, Mus musculus
cggagttttatctgcttgtaagtac

SEQ ID NO: 608226 - DNA, 25 bp, Mus musculus
cggagttttcgacgaggattcacaa

SEQ ID NO: 608227 - DNA, 25 bp, Mus musculus
cggagttttcgaggaggattcacaa

SEQ ID NO: 608228 - DNA, 25 bp, Mus musculus
cggataaagtctctaagagctacat

SEQ ID NO: 608229 - DNA, 25 bp, Mus musculus
cggataaagtctgtaagagctacat

SEQ ID NO: 608230 - DNA, 25 bp, Mus musculus
cggatacccaaacgaagcgcaggat

SEQ ID NO: 608231 - DNA, 25 bp, Mus musculus
cggatacccaaaggaagcgcaggat

SEQ ID NO: 608232 - DNA, 25 bp, Mus musculus
cggatatcagccctaaacatcgttg

SEQ ID NO: 608233 - DNA, 25 bp, Mus musculus
cggatatcagccgtaaacatcgttg

SEQ ID NO: 608234 - DNA, 25 bp, Mus musculus
cggatatgccgcctatgacacacac

SEQ ID NO: 608235 - DNA, 25 bp, Mus musculus
cggatatgccgcgtatgacacacac

SEQ ID NO: 608236 - DNA, 25 bp, Mus musculus
cggatcaatgagatcgtctacttcc

SEQ ID NO: 608237 - DNA, 25 bp, Mus musculus
cggatcaatgagttcgtctacttcc

SEQ ID NO: 608238 - DNA, 25 bp, Mus musculus
cggatcaccagtcctactccagggt

SEQ ID NO: 608239 - DNA, 25 bp, Mus musculus
cggatcaccagtgctactccagggt

SEQ ID NO: 608240 - DNA, 25 bp, Mus musculus
cggatcaggtccacgtgggctctga

SEQ ID NO: 608241 - DNA, 25 bp, Mus musculus
cggatcaggtcctcgtgggctctga

SEQ ID NO: 608242 - DNA, 25 bp, Mus musculus
cggatccactttatgtggatgtgac

SEQ ID NO: 608243 - DNA, 25 bp, Mus musculus
cggatccactttttgtggatgtgac

SEQ ID NO: 608244 - DNA, 25 bp, Mus musculus
cggatccaggatacctgacaggagt

SEQ ID NO: 608245 - DNA, 25 bp, Mus musculus
cggatccaggattcctgacaggagt

SEQ ID NO: 608246 - DNA, 25 bp, Mus musculus
cggatcccactcatgtggaaggata

SEQ ID NO: 608247 - DNA, 25 bp, Mus musculus
cggatcccactcttgtggaaggata

SEQ ID NO: 608248 - DNA, 25 bp, Mus musculus
cggatccgggagaaatcagacatta

SEQ ID NO: 608249 - DNA, 25 bp, Mus musculus
cggatccgggagtaatcagacatta

SEQ ID NO: 608250 - DNA, 25 bp, Mus musculus
cggatcctcaccagcaacatggaga

SEQ ID NO: 608251 - DNA, 25 bp, Mus musculus
cggatcctcacctgcaacatggaga

SEQ ID NO: 608252 - DNA, 25 bp, Mus musculus
cggatcctggagcttatcccacgca

SEQ ID NO: 608253 - DNA, 25 bp, Mus musculus
cggatcctggaggttatcccacgca

SEQ ID NO: 608254 - DNA, 25 bp, Mus musculus
cggatcgcctacagtgacgaagtac

SEQ ID NO: 608255 - DNA, 25 bp, Mus musculus
cggatcgcctactgtgacgaagtac

SEQ ID NO: 608256 - DNA, 25 bp, Mus musculus
cggatcgcggatccgggatcggaga

SEQ ID NO: 608257 - DNA, 25 bp, Mus musculus
cggatcgcggatgcgggatcggaga

SEQ ID NO: 608258 - DNA, 25 bp, Mus musculus
cggatcggcgatatagaggaacggg

SEQ ID NO: 608259 - DNA, 25 bp, Mus musculus
cggatcggcgatttagaggaacggg

SEQ ID NO: 608260 - DNA, 25 bp, Mus musculus
cggatctcaaagagcagcggaagga

SEQ ID NO: 608261 - DNA, 25 bp, Mus musculus
cggatctcaaagtgcagcggaagga

SEQ ID NO: 608262 - DNA, 25 bp, Mus musculus
cggatctcatgtctctggaggagtt

SEQ ID NO: 608263 - DNA, 25 bp, Mus musculus
cggatctcatgtgtctggaggagtt

SEQ ID NO: 608264 - DNA, 25 bp, Mus musculus
cggatctgggttcatgcagaagaaa

SEQ ID NO: 608265 - DNA, 25 bp, Mus musculus
cggatctgggttgatgcagaagaaa

SEQ ID NO: 608266 - DNA, 25 bp, Mus musculus
cggatgaacaccatcatcaagtatg

SEQ ID NO: 608267 - DNA, 25 bp, Mus musculus
cggatgaacaccttcatcaagtatg

SEQ ID NO: 608268 - DNA, 25 bp, Mus musculus
cggatgacgagcagcccttgaagct

SEQ ID NO: 608269 - DNA, 25 bp, Mus musculus
cggatgacgagctgcccttgaagct

SEQ ID NO: 608270 - DNA, 25 bp, Mus musculus
cggatgactccgaccccattggcgt

SEQ ID NO: 608271 - DNA, 25 bp, Mus musculus
cggatgactccgtccccattggcgt

SEQ ID NO: 608272 - DNA, 25 bp, Mus musculus
cggatgagacccaggctagagatgc

SEQ ID NO: 608273 - DNA, 25 bp, Mus musculus
cggatgagaccctggctagagatgc

SEQ ID NO: 608274 - DNA, 25 bp, Mus musculus
cggatgagatttccatacagaagtg

SEQ ID NO: 608275 - DNA, 25 bp, Mus musculus
cggatgagatttgcatacagaagtg

SEQ ID NO: 608276 - DNA, 25 bp, Mus musculus
cggatgagtacacccgcccgggatt

SEQ ID NO: 608277 - DNA, 25 bp, Mus musculus
cggatgagtacagccgcccgggatt

SEQ ID NO: 608278 - DNA, 25 bp, Mus musculus
cggatgagtataagaatgatgtaaa

SEQ ID NO: 608279 - DNA, 25 bp, Mus musculus
cggatgagtatatgaatgatgtaaa

SEQ ID NO: 608280 - DNA, 25 bp, Mus musculus
cggatgagtgggagcgcggagctgc

SEQ ID NO: 608281 - DNA, 25 bp, Mus musculus
cggatgagtgggtgcgcggagctgc

SEQ ID NO: 608282 - DNA, 25 bp, Mus musculus
cggatgattcttctagttgtactga

SEQ ID NO: 608283 - DNA, 25 bp, Mus musculus
cggatgattcttgtagttgtactga

SEQ ID NO: 608284 - DNA, 25 bp, Mus musculus
cggatgcagaaccaagagaacttcc

SEQ ID NO: 608285 - DNA, 25 bp, Mus musculus
cggatgcagaacgaagagaacttcc

SEQ ID NO: 608286 - DNA, 25 bp, Mus musculus
cggatgccatgcagaactacaatgg

SEQ ID NO: 608287 - DNA, 25 bp, Mus musculus
cggatgccatgctgaactacaatgg

SEQ ID NO: 608288 - DNA, 25 bp, Mus musculus
cggatgcccattctaatttctattg

SEQ ID NO: 608289 - DNA, 25 bp, Mus musculus
cggatgcccattgtaatttctattg

SEQ ID NO: 608290 - DNA, 25 bp, Mus musculus
cggatgcgagaaactgtttcccgga

SEQ ID NO: 608291 - DNA, 25 bp, Mus musculus
cggatgcgagaatctgtttcccgga

SEQ ID NO: 608292 - DNA, 25 bp, Mus musculus
cggatgctaatcagcgtgtctgggc

SEQ ID NO: 608293 - DNA, 25 bp, Mus musculus
cggatgctaatctgcgtgtctgggc

SEQ ID NO: 608294 - DNA, 25 bp, Mus musculus
cggatgctcaccagcccctggaaag

SEQ ID NO: 608295 - DNA, 25 bp, Mus musculus
cggatgctcacctgcccctggaaag

SEQ ID NO: 608296 - DNA, 25 bp, Mus musculus
cggatgctcagtatcttctactttg

SEQ ID NO: 608297 - DNA, 25 bp, Mus musculus
cggatgctcagtttcttctactttg

SEQ ID NO: 608298 - DNA, 25 bp, Mus musculus
cggatgctcttcagcgccgttgagt

SEQ ID NO: 608299 - DNA, 25 bp, Mus musculus
cggatgctcttctgcgccgttgagt

SEQ ID NO: 608300 - DNA, 25 bp, Mus musculus
cggatggacacgcacgtagtcaagc

SEQ ID NO: 608301 - DNA, 25 bp, Mus musculus
cggatggacacggacgtagtcaagc

SEQ ID NO: 608302 - DNA, 25 bp, Mus musculus
cggatggagcccagaaggaattgtc

SEQ ID NO: 608303 - DNA, 25 bp, Mus musculus
cggatggagccctgaaggaattgtc

SEQ ID NO: 608304 - DNA, 25 bp, Mus musculus
cggatggccttcaacattgctgagg

SEQ ID NO: 608305 - DNA, 25 bp, Mus musculus
cggatggccttctacattgctgagg

SEQ ID NO: 608306 - DNA, 25 bp, Mus musculus
cggatgtccggaatggccgctaccg

SEQ ID NO: 608307 - DNA, 25 bp, Mus musculus
cggatgtccggattggccgctaccg

SEQ ID NO: 608308 - DNA, 25 bp, Mus musculus
cggatgtctatcaactcaaggtgga

SEQ ID NO: 608309 - DNA, 25 bp, Mus musculus
cggatgtctatctactcaaggtgga

SEQ ID NO: 608310 - DNA, 25 bp, Mus musculus
cggatgtcttacatgctgtaccaga

SEQ ID NO: 608311 - DNA, 25 bp, Mus musculus
cggatgtcttacttgctgtaccaga

SEQ ID NO: 608312 - DNA, 25 bp, Mus musculus
cggatgttgccgcttacacacacag

SEQ ID NO: 608313 - DNA, 25 bp, Mus musculus
cggatgttgccggttacacacacag

SEQ ID NO: 608314 - DNA, 25 bp, Mus musculus
cggattattgctcgacattttggaa

SEQ ID NO: 608315 - DNA, 25 bp, Mus musculus
cggattattgctggacattttggaa

SEQ ID NO: 608316 - DNA, 25 bp, Mus musculus
cggattcaagtaataacagagaggg

SEQ ID NO: 608317 - DNA, 25 bp, Mus musculus
cggattcaagtattaacagagaggg

SEQ ID NO: 608318 - DNA, 25 bp, Mus musculus
cggattcaggatccccaagaaccag

SEQ ID NO: 608319 - DNA, 25 bp, Mus musculus
cggattcaggatgcccaagaaccag

SEQ ID NO: 608320 - DNA, 25 bp, Mus musculus
cggattccagagaagtgggttttgt

SEQ ID NO: 608321 - DNA, 25 bp, Mus musculus
cggattccagagtagtgggttttgt

SEQ ID NO: 608322 - DNA, 25 bp, Mus musculus
cggattccctggaaaatatcattag

SEQ ID NO: 608323 - DNA, 25 bp, Mus musculus
cggattccctggtaaatatcattag

SEQ ID NO: 608324 - DNA, 25 bp, Mus musculus
cggattcgacatatttatatgagaa

SEQ ID NO: 608325 - DNA, 25 bp, Mus musculus
cggattcgacatttttatatgagaa

SEQ ID NO: 608326 - DNA, 25 bp, Mus musculus
cggattctaacgcaagacactgaaa

SEQ ID NO: 608327 - DNA, 25 bp, Mus musculus
cggattctaacggaagacactgaaa

SEQ ID NO: 608328 - DNA, 25 bp, Mus musculus
cggattcttcctatttcaggcggta

SEQ ID NO: 608329 - DNA, 25 bp, Mus musculus
cggattcttcctttttcaggcggta

SEQ ID NO: 608330 - DNA, 25 bp, Mus musculus
cggattgaacatcgagatgcacaaa

SEQ ID NO: 608331 - DNA, 25 bp, Mus musculus
cggattgaacatggagatgcacaaa

SEQ ID NO: 608332 - DNA, 25 bp, Mus musculus
cggattgacgacaatgacattgtga

SEQ ID NO: 608333 - DNA, 25 bp, Mus musculus
cggattgacgactatgacattgtga

SEQ ID NO: 608334 - DNA, 25 bp, Mus musculus
cggattgcacataccacgagcttgg

SEQ ID NO: 608335 - DNA, 25 bp, Mus musculus
cggattgcacattccacgagcttgg

SEQ ID NO: 608336 - DNA, 25 bp, Mus musculus
cggattgcctggctgagtaatcttt

SEQ ID NO: 608337 - DNA, 25 bp, Mus musculus
cggattgcctgggtgagtaatcttt

SEQ ID NO: 608338 - DNA, 25 bp, Mus musculus
cggattggacgcctggcacctacag

SEQ ID NO: 608339 - DNA, 25 bp, Mus musculus
cggattggacgcgtggcacctacag

SEQ ID NO: 608340 - DNA, 25 bp, Mus musculus
cggattgtagtacctcagcgaggcc

SEQ ID NO: 608341 - DNA, 25 bp, Mus musculus
cggattgtagtagctcagcgaggcc

SEQ ID NO: 608342 - DNA, 25 bp, Mus musculus
cggatttaaactcgctgctctggga

SEQ ID NO: 608343 - DNA, 25 bp, Mus musculus
cggatttaaactggctgctctggga

SEQ ID NO: 608344 - DNA, 25 bp, Mus musculus
cggattttgacgagttttctgccag

SEQ ID NO: 608345 - DNA, 25 bp, Mus musculus
cggattttgacgtgttttctgccag

SEQ ID NO: 608346 - DNA, 25 bp, Mus musculus
cggattttggacaggttcggccact

SEQ ID NO: 608347 - DNA, 25 bp, Mus musculus
cggattttggactggttcggccact

SEQ ID NO: 608348 - DNA, 25 bp, Mus musculus
cggatttttacgctgcctacattaa

SEQ ID NO: 608349 - DNA, 25 bp, Mus musculus
cggatttttacggtgcctacattaa

SEQ ID NO: 608350 - DNA, 25 bp, Mus musculus
cggcaaacctaaccattctgtcggg

SEQ ID NO: 608351 - DNA, 25 bp, Mus musculus
cggcaaacctaagcattctgtcggg

SEQ ID NO: 608352 - DNA, 25 bp, Mus musculus
cggcaaacgcggaaaatacaaggag

SEQ ID NO: 608353 - DNA, 25 bp, Mus musculus
cggcaaacgcggtaaatacaaggag

SEQ ID NO: 608354 - DNA, 25 bp, Mus musculus
cggcaaagaagacatcaaagtcatt

SEQ ID NO: 608355 - DNA, 25 bp, Mus musculus
cggcaaagaagagatcaaagtcatt

SEQ ID NO: 608356 - DNA, 25 bp, Mus musculus
cggcaaagcagaccacgaggctcaa

SEQ ID NO: 608357 - DNA, 25 bp, Mus musculus
cggcaaagcagagcacgaggctcaa

SEQ ID NO: 608358 - DNA, 25 bp, Mus musculus
cggcaacagagcacgctcatagcag

SEQ ID NO: 608359 - DNA, 25 bp, Mus musculus
cggcaacagagctcgctcatagcag

SEQ ID NO: 608360 - DNA, 25 bp, Mus musculus
cggcaacatggccttgaacggtgca

SEQ ID NO: 608361 - DNA, 25 bp, Mus musculus
cggcaacatggcgttgaacggtgca

SEQ ID NO: 608362 - DNA, 25 bp, Mus musculus
cggcaactatccattgaaaaatagg

SEQ ID NO: 608363 - DNA, 25 bp, Mus musculus
cggcaactatcctttgaaaaatagg

SEQ ID NO: 608364 - DNA, 25 bp, Mus musculus
cggcaactttggctttgatgatcta

SEQ ID NO: 608365 - DNA, 25 bp, Mus musculus
cggcaactttgggtttgatgatcta

SEQ ID NO: 608366 - DNA, 25 bp, Mus musculus
cggcaagacatacaccatgacaggg

SEQ ID NO: 608367 - DNA, 25 bp, Mus musculus
cggcaagacatagaccatgacaggg

SEQ ID NO: 608368 - DNA, 25 bp, Mus musculus
cggcaagcccctcgtacgagcaggt

SEQ ID NO: 608369 - DNA, 25 bp, Mus musculus
cggcaagcccctggtacgagcaggt

SEQ ID NO: 608370 - DNA, 25 bp, Mus musculus
cggcaagccttaagtcatctcgtac

SEQ ID NO: 608371 - DNA, 25 bp, Mus musculus
cggcaagccttatgtcatctcgtac

SEQ ID NO: 608372 - DNA, 25 bp, Mus musculus
cggcaagcggcaagctgggctctat

SEQ ID NO: 608373 - DNA, 25 bp, Mus musculus
cggcaagcggcatgctgggctctat

SEQ ID NO: 608374 - DNA, 25 bp, Mus musculus
cggcaagctgacagaggctttcaag

SEQ ID NO: 608375 - DNA, 25 bp, Mus musculus
cggcaagctgactgaggctttcaag

SEQ ID NO: 608376 - DNA, 25 bp, Mus musculus
cggcaaggcgctcagcgatctctga

SEQ ID NO: 608377 - DNA, 25 bp, Mus musculus
cggcaaggcgctgagcgatctctga

SEQ ID NO: 608378 - DNA, 25 bp, Mus musculus
cggcaagggttccacgtgaaacctg

SEQ ID NO: 608379 - DNA, 25 bp, Mus musculus
cggcaagggttcgacgtgaaacctg

SEQ ID NO: 608380 - DNA, 25 bp, Mus musculus
cggcaatacgggaaagggagaatct

SEQ ID NO: 608381 - DNA, 25 bp, Mus musculus
cggcaatacgggtaagggagaatct

SEQ ID NO: 608382 - DNA, 25 bp, Mus musculus
cggcaatgctacctgccagatagcc

SEQ ID NO: 608383 - DNA, 25 bp, Mus musculus
cggcaatgctacgtgccagatagcc

SEQ ID NO: 608384 - DNA, 25 bp, Mus musculus
cggcaatgggaaatccagccccagg

SEQ ID NO: 608385 - DNA, 25 bp, Mus musculus
cggcaatgggaattccagccccagg

SEQ ID NO: 608386 - DNA, 25 bp, Mus musculus
cggcaatgtactccttcatgagatg

SEQ ID NO: 608387 - DNA, 25 bp, Mus musculus
cggcaatgtactgcttcatgagatg

SEQ ID NO: 608388 - DNA, 25 bp, Mus musculus
cggcacaacaatctagacctggtta

SEQ ID NO: 608389 - DNA, 25 bp, Mus musculus
cggcacaacaatgtagacctggtta

SEQ ID NO: 608390 - DNA, 25 bp, Mus musculus
cggcacagagaacgacgtcacagag

SEQ ID NO: 608391 - DNA, 25 bp, Mus musculus
cggcacagagaaggacgtcacagag

SEQ ID NO: 608392 - DNA, 25 bp, Mus musculus
cggcacaggcctcagctgattgagt

SEQ ID NO: 608393 - DNA, 25 bp, Mus musculus
cggcacaggcctgagctgattgagt

SEQ ID NO: 608394 - DNA, 25 bp, Mus musculus
cggcacagtagcacccaagggatat

SEQ ID NO: 608395 - DNA, 25 bp, Mus musculus
cggcacagtagctcccaagggatat

SEQ ID NO: 608396 - DNA, 25 bp, Mus musculus
cggcaccagcggcttttagaagcag

SEQ ID NO: 608397 - DNA, 25 bp, Mus musculus
cggcaccagcgggttttagaagcag

SEQ ID NO: 608398 - DNA, 25 bp, Mus musculus
cggcacggacacagaagaccgccta

SEQ ID NO: 608399 - DNA, 25 bp, Mus musculus
cggcacggacactgaagaccgccta

SEQ ID NO: 608400 - DNA, 25 bp, Mus musculus
cggcacggcggcaattcacgaagcc

SEQ ID NO: 608401 - DNA, 25 bp, Mus musculus
cggcacggcggctattcacgaagcc

SEQ ID NO: 608402 - DNA, 25 bp, Mus musculus
cggcactggagacgtaatccgagtt

SEQ ID NO: 608403 - DNA, 25 bp, Mus musculus
cggcactggagaggtaatccgagtt

SEQ ID NO: 608404 - DNA, 25 bp, Mus musculus
cggcagaagctgatggctataactg

SEQ ID NO: 608405 - DNA, 25 bp, Mus musculus
cggcagaagctgttggctataactg

SEQ ID NO: 608406 - DNA, 25 bp, Mus musculus
cggcagaaggctaccatccacgagg

SEQ ID NO: 608407 - DNA, 25 bp, Mus musculus
cggcagaaggcttccatccacgagg

SEQ ID NO: 608408 - DNA, 25 bp, Mus musculus
cggcagacaatccttgcaatgtgga

SEQ ID NO: 608409 - DNA, 25 bp, Mus musculus
cggcagacaatcgttgcaatgtgga

SEQ ID NO: 608410 - DNA, 25 bp, Mus musculus
cggcagataagtctagacgtggcaa

SEQ ID NO: 608411 - DNA, 25 bp, Mus musculus
cggcagataagtgtagacgtggcaa

SEQ ID NO: 608412 - DNA, 25 bp, Mus musculus
cggcagatcaatcacatccagttgt

SEQ ID NO: 608413 - DNA, 25 bp, Mus musculus
cggcagatcaatgacatccagttgt

SEQ ID NO: 608414 - DNA, 25 bp, Mus musculus
cggcagatcgagagcatagagactt

SEQ ID NO: 608415 - DNA, 25 bp, Mus musculus
cggcagatcgagtgcatagagactt

SEQ ID NO: 608416 - DNA, 25 bp, Mus musculus
cggcagcacgagctccagctgcaga

SEQ ID NO: 608417 - DNA, 25 bp, Mus musculus
cggcagcacgaggtccagctgcaga

SEQ ID NO: 608418 - DNA, 25 bp, Mus musculus
cggcagcatgccaccaatgttggca

SEQ ID NO: 608419 - DNA, 25 bp, Mus musculus
cggcagcatgcctccaatgttggca

SEQ ID NO: 608420 - DNA, 25 bp, Mus musculus
cggcagccatgaaaaatttaaaggg

SEQ ID NO: 608421 - DNA, 25 bp, Mus musculus
cggcagccatgataaatttaaaggg

SEQ ID NO: 608422 - DNA, 25 bp, Mus musculus
cggcagccgacaaatgacctgtttg

SEQ ID NO: 608423 - DNA, 25 bp, Mus musculus
cggcagccgacatatgacctgtttg

SEQ ID NO: 608424 - DNA, 25 bp, Mus musculus
cggcagcctcaaaggagatcatcca

SEQ ID NO: 608425 - DNA, 25 bp, Mus musculus
cggcagcctcaatggagatcatcca

SEQ ID NO: 608426 - DNA, 25 bp, Mus musculus
cggcagctgctgagcataccccggg

SEQ ID NO: 608427 - DNA, 25 bp, Mus musculus
cggcagctgctgtgcataccccggg

SEQ ID NO: 608428 - DNA, 25 bp, Mus musculus
cggcaggaaatgacgtccacagtgt

SEQ ID NO: 608429 - DNA, 25 bp, Mus musculus
cggcaggaaatgtcgtccacagtgt

SEQ ID NO: 608430 - DNA, 25 bp, Mus musculus
cggcaggaaccaccaattactggga

SEQ ID NO: 608431 - DNA, 25 bp, Mus musculus
cggcaggaaccagcaattactggga

SEQ ID NO: 608432 - DNA, 25 bp, Mus musculus
cggcaggatgaccaccagaggtctt

SEQ ID NO: 608433 - DNA, 25 bp, Mus musculus
cggcaggatgacgaccagaggtctt

SEQ ID NO: 608434 - DNA, 25 bp, Mus musculus
cggcaggctccgagcagtctctggt

SEQ ID NO: 608435 - DNA, 25 bp, Mus musculus
cggcaggctccgtgcagtctctggt

SEQ ID NO: 608436 - DNA, 25 bp, Mus musculus
cggcagggcttcatcaagccagagt

SEQ ID NO: 608437 - DNA, 25 bp, Mus musculus
cggcagggcttcttcaagccagagt

SEQ ID NO: 608438 - DNA, 25 bp, Mus musculus
cggcagtaccgaagatcccagtgtt

SEQ ID NO: 608439 - DNA, 25 bp, Mus musculus
cggcagtaccgatgatcccagtgtt

SEQ ID NO: 608440 - DNA, 25 bp, Mus musculus
cggcagtcccctctggacattgaca

SEQ ID NO: 608441 - DNA, 25 bp, Mus musculus
cggcagtcccctgtggacattgaca

SEQ ID NO: 608442 - DNA, 25 bp, Mus musculus
cggcagtgaagcagacatagacgag

SEQ ID NO: 608443 - DNA, 25 bp, Mus musculus
cggcagtgaagctgacatagacgag

SEQ ID NO: 608444 - DNA, 25 bp, Mus musculus
cggcagtgaggaatcagcctcttga

SEQ ID NO: 608445 - DNA, 25 bp, Mus musculus
cggcagtgaggattcagcctcttga

SEQ ID NO: 608446 - DNA, 25 bp, Mus musculus
cggcagtgggatctccgtcataagc

SEQ ID NO: 608447 - DNA, 25 bp, Mus musculus
cggcagtgggatgtccgtcataagc

SEQ ID NO: 608448 - DNA, 25 bp, Mus musculus
cggcagtttgatattggtctctgca

SEQ ID NO: 608449 - DNA, 25 bp, Mus musculus
cggcagtttgattttggtctctgca

SEQ ID NO: 608450 - DNA, 25 bp, Mus musculus
cggcataatcacctgaaggacttca

SEQ ID NO: 608451 - DNA, 25 bp, Mus musculus
cggcataatcacgtgaaggacttca

SEQ ID NO: 608452 - DNA, 25 bp, Mus musculus
cggcatcagatgagcgtcaggcgtt

SEQ ID NO: 608453 - DNA, 25 bp, Mus musculus
cggcatcagatgtgcgtcaggcgtt

SEQ ID NO: 608454 - DNA, 25 bp, Mus musculus
cggcatccactccttggtggctgct

SEQ ID NO: 608455 - DNA, 25 bp, Mus musculus
cggcatccactcgttggtggctgct

SEQ ID NO: 608456 - DNA, 25 bp, Mus musculus
cggcatccttctcggcgtgtgtgct

SEQ ID NO: 608457 - DNA, 25 bp, Mus musculus
cggcatccttctgggcgtgtgtgct

SEQ ID NO: 608458 - DNA, 25 bp, Mus musculus
cggcatcgacagaagcagaaacata

SEQ ID NO: 608459 - DNA, 25 bp, Mus musculus
cggcatcgacagtagcagaaacata

SEQ ID NO: 608460 - DNA, 25 bp, Mus musculus
cggcatgaatctcatgaatgagtta

SEQ ID NO: 608461 - DNA, 25 bp, Mus musculus
cggcatgaatctgatgaatgagtta

SEQ ID NO: 608462 - DNA, 25 bp, Mus musculus
cggcatggagctcatcattgaggat

SEQ ID NO: 608463 - DNA, 25 bp, Mus musculus
cggcatggagctgatcattgaggat

SEQ ID NO: 608464 - DNA, 25 bp, Mus musculus
cggcatggatgtagctgcgtctgaa

SEQ ID NO: 608465 - DNA, 25 bp, Mus musculus
cggcatggatgttgctgcgtctgaa

SEQ ID NO: 608466 - DNA, 25 bp, Mus musculus
cggcatgggacgacagctggataaa

SEQ ID NO: 608467 - DNA, 25 bp, Mus musculus
cggcatgggacgtcagctggataaa

SEQ ID NO: 608468 - DNA, 25 bp, Mus musculus
cggcattaactaccgaggagcgaac

SEQ ID NO: 608469 - DNA, 25 bp, Mus musculus
cggcattaactagcgaggagcgaac

SEQ ID NO: 608470 - DNA, 25 bp, Mus musculus
cggcatttgcggcaattctgagaca

SEQ ID NO: 608471 - DNA, 25 bp, Mus musculus
cggcatttgcgggaattctgagaca

SEQ ID NO: 608472 - DNA, 25 bp, Mus musculus
cggcattttgatcacgctgtttgct

SEQ ID NO: 608473 - DNA, 25 bp, Mus musculus
cggcattttgatgacgctgtttgct

SEQ ID NO: 608474 - DNA, 25 bp, Mus musculus
cggccaaacttgcatggagctggac

SEQ ID NO: 608475 - DNA, 25 bp, Mus musculus
cggccaaacttggatggagctggac

SEQ ID NO: 608476 - DNA, 25 bp, Mus musculus
cggccaaccagacagccattctagg

SEQ ID NO: 608477 - DNA, 25 bp, Mus musculus
cggccaaccagagagccattctagg

SEQ ID NO: 608478 - DNA, 25 bp, Mus musculus
cggccaacgagacgaacgtgtccac

SEQ ID NO: 608479 - DNA, 25 bp, Mus musculus
cggccaacgagaggaacgtgtccac

SEQ ID NO: 608480 - DNA, 25 bp, Mus musculus
cggccaagcaccatagagctcattc

SEQ ID NO: 608481 - DNA, 25 bp, Mus musculus
cggccaagcaccttagagctcattc

SEQ ID NO: 608482 - DNA, 25 bp, Mus musculus
cggccaatgcgaacggtgcgatcaa

SEQ ID NO: 608483 - DNA, 25 bp, Mus musculus
cggccaatgcgatcggtgcgatcaa

SEQ ID NO: 608484 - DNA, 25 bp, Mus musculus
cggccaatgctgaactagttcctag

SEQ ID NO: 608485 - DNA, 25 bp, Mus musculus
cggccaatgctgtactagttcctag

SEQ ID NO: 608486 - DNA, 25 bp, Mus musculus
cggccacaacagatctggtgcccat

SEQ ID NO: 608487 - DNA, 25 bp, Mus musculus
cggccacaacagttctggtgcccat

SEQ ID NO: 608488 - DNA, 25 bp, Mus musculus
cggccacatcctcgtatgaggagtt

SEQ ID NO: 608489 - DNA, 25 bp, Mus musculus
cggccacatcctggtatgaggagtt

SEQ ID NO: 608490 - DNA, 25 bp, Mus musculus
cggccacatttcactatcttcaaag

SEQ ID NO: 608491 - DNA, 25 bp, Mus musculus
cggccacatttctctatcttcaaag

SEQ ID NO: 608492 - DNA, 25 bp, Mus musculus
cggccacgaggacagcataccgagc

SEQ ID NO: 608493 - DNA, 25 bp, Mus musculus
cggccacgaggagagcataccgagc

SEQ ID NO: 608494 - DNA, 25 bp, Mus musculus
cggccacgtgtcagtctttgagttt

SEQ ID NO: 608495 - DNA, 25 bp, Mus musculus
cggccacgtgtctgtctttgagttt

SEQ ID NO: 608496 - DNA, 25 bp, Mus musculus
cggccagacgccacacgatgagtct

SEQ ID NO: 608497 - DNA, 25 bp, Mus musculus
cggccagacgcctcacgatgagtct

SEQ ID NO: 608498 - DNA, 25 bp, Mus musculus
cggccagagtatccagtcaattcta

SEQ ID NO: 608499 - DNA, 25 bp, Mus musculus
cggccagagtatgcagtcaattcta

SEQ ID NO: 608500 - DNA, 25 bp, Mus musculus
cggccagagtgtcagccctgtttta

SEQ ID NO: 608501 - DNA, 25 bp, Mus musculus
cggccagagtgtgagccctgtttta

SEQ ID NO: 608502 - DNA, 25 bp, Mus musculus
cggccagccagaacaatggctcgtt

SEQ ID NO: 608503 - DNA, 25 bp, Mus musculus
cggccagccagatcaatggctcgtt

SEQ ID NO: 608504 - DNA, 25 bp, Mus musculus
cggccagcccgtcgatgagtttaag

SEQ ID NO: 608505 - DNA, 25 bp, Mus musculus
cggccagcccgtggatgagtttaag

SEQ ID NO: 608506 - DNA, 25 bp, Mus musculus
cggccaggcggccagcggtgtttcg

SEQ ID NO: 608507 - DNA, 25 bp, Mus musculus
cggccaggcggcgagcggtgtttcg

SEQ ID NO: 608508 - DNA, 25 bp, Mus musculus
cggccagggaagatgtctgactatt

SEQ ID NO: 608509 - DNA, 25 bp, Mus musculus
cggccagggaagttgtctgactatt

SEQ ID NO: 608510 - DNA, 25 bp, Mus musculus
cggccagtagccaatatctcagatg

SEQ ID NO: 608511 - DNA, 25 bp, Mus musculus
cggccagtagcctatatctcagatg

SEQ ID NO: 608512 - DNA, 25 bp, Mus musculus
cggccagtcctcacatcaagataga

SEQ ID NO: 608513 - DNA, 25 bp, Mus musculus
cggccagtcctctcatcaagataga

SEQ ID NO: 608514 - DNA, 25 bp, Mus musculus
cggccataaactcggctctatagaa

SEQ ID NO: 608515 - DNA, 25 bp, Mus musculus
cggccataaactgggctctatagaa

SEQ ID NO: 608516 - DNA, 25 bp, Mus musculus
cggccatcttccaggcagagacggc

SEQ ID NO: 608517 - DNA, 25 bp, Mus musculus
cggccatcttcctggcagagacggc

SEQ ID NO: 608518 - DNA, 25 bp, Mus musculus
cggccattgagtactaggaatcgaa

SEQ ID NO: 608519 - DNA, 25 bp, Mus musculus
cggccattgagttctaggaatcgaa

SEQ ID NO: 608520 - DNA, 25 bp, Mus musculus
cggccattttggctggaagcgatca

SEQ ID NO: 608521 - DNA, 25 bp, Mus musculus
cggccattttgggtggaagcgatca

SEQ ID NO: 608522 - DNA, 25 bp, Mus musculus
cggcccaacagtcggattattgacc

SEQ ID NO: 608523 - DNA, 25 bp, Mus musculus
cggcccaacagtgggattattgacc

SEQ ID NO: 608524 - DNA, 25 bp, Mus musculus
cggcccacagacattgatttcctca

SEQ ID NO: 608525 - DNA, 25 bp, Mus musculus
cggcccacagactttgatttcctca

SEQ ID NO: 608526 - DNA, 25 bp, Mus musculus
cggcccagggaccagggctcttaca

SEQ ID NO: 608527 - DNA, 25 bp, Mus musculus
cggcccagggacgagggctcttaca

SEQ ID NO: 608528 - DNA, 25 bp, Mus musculus
cggccccagtggcacagttgcgaca

SEQ ID NO: 608529 - DNA, 25 bp, Mus musculus
cggccccagtgggacagttgcgaca

SEQ ID NO: 608530 - DNA, 25 bp, Mus musculus
cggcccctgattagttcaagacctc

SEQ ID NO: 608531 - DNA, 25 bp, Mus musculus
cggcccctgatttgttcaagacctc

SEQ ID NO: 608532 - DNA, 25 bp, Mus musculus
cggcccctgcgtatgtggatggcaa

SEQ ID NO: 608533 - DNA, 25 bp, Mus musculus
cggcccctgcgtttgtggatggcaa

SEQ ID NO: 608534 - DNA, 25 bp, Mus musculus
cggcccctgtggcaacaggtacaag

SEQ ID NO: 608535 - DNA, 25 bp, Mus musculus
cggcccctgtgggaacaggtacaag

SEQ ID NO: 608536 - DNA, 25 bp, Mus musculus
cggcccggttgcaaggacttggata

SEQ ID NO: 608537 - DNA, 25 bp, Mus musculus
cggcccggttgctaggacttggata

SEQ ID NO: 608538 - DNA, 25 bp, Mus musculus
cggcccgtggcaaggctctctatga

SEQ ID NO: 608539 - DNA, 25 bp, Mus musculus
cggcccgtggcatggctctctatga

SEQ ID NO: 608540 - DNA, 25 bp, Mus musculus
cggccctcaacaccaaaaagtgact

SEQ ID NO: 608541 - DNA, 25 bp, Mus musculus
cggccctcaacagcaaaaagtgact

SEQ ID NO: 608542 - DNA, 25 bp, Mus musculus
cggccctgtatgcaaggttcacaat

SEQ ID NO: 608543 - DNA, 25 bp, Mus musculus
cggccctgtatggaaggttcacaat

SEQ ID NO: 608544 - DNA, 25 bp, Mus musculus
cggcccttccagacgttcgtggtgg

SEQ ID NO: 608545 - DNA, 25 bp, Mus musculus
cggcccttccagtcgttcgtggtgg

SEQ ID NO: 608546 - DNA, 25 bp, Mus musculus
cggccgaacagacactgtgcgatct

SEQ ID NO: 608547 - DNA, 25 bp, Mus musculus
cggccgaacagagactgtgcgatct

SEQ ID NO: 608548 - DNA, 25 bp, Mus musculus
cggccgagaagaacggcaagatgaa

SEQ ID NO: 608549 - DNA, 25 bp, Mus musculus
cggccgagaagatcggcaagatgaa

SEQ ID NO: 608550 - DNA, 25 bp, Mus musculus
cggccgagcctgactcgcgagattt

SEQ ID NO: 608551 - DNA, 25 bp, Mus musculus
cggccgagcctgtctcgcgagattt

SEQ ID NO: 608552 - DNA, 25 bp, Mus musculus
cggccgagtgtgatcgccgccttca

SEQ ID NO: 608553 - DNA, 25 bp, Mus musculus
cggccgagtgtgttcgccgccttca

SEQ ID NO: 608554 - DNA, 25 bp, Mus musculus
cggccgagttcccatggtacagtag

SEQ ID NO: 608555 - DNA, 25 bp, Mus musculus
cggccgagttccgatggtacagtag

SEQ ID NO: 608556 - DNA, 25 bp, Mus musculus
cggccgcactgtagaacaacatgcg

SEQ ID NO: 608557 - DNA, 25 bp, Mus musculus
cggccgcactgttgaacaacatgcg

SEQ ID NO: 608558 - DNA, 25 bp, Mus musculus
cggccgcagcagcaagactaagaaa

SEQ ID NO: 608559 - DNA, 25 bp, Mus musculus
cggccgcagcaggaagactaagaaa

SEQ ID NO: 608560 - DNA, 25 bp, Mus musculus
cggccgccatctcgatacgcttaga

SEQ ID NO: 608561 - DNA, 25 bp, Mus musculus
cggccgccatctggatacgcttaga

SEQ ID NO: 608562 - DNA, 25 bp, Mus musculus
cggccgcgtttcattcctgtgcgag

SEQ ID NO: 608563 - DNA, 25 bp, Mus musculus
cggccgcgtttctttcctgtgcgag

SEQ ID NO: 608564 - DNA, 25 bp, Mus musculus
cggccggcgagactcctgggagaca

SEQ ID NO: 608565 - DNA, 25 bp, Mus musculus
cggccggcgagagtcctgggagaca

SEQ ID NO: 608566 - DNA, 25 bp, Mus musculus
cggccggtacgcaggtcactggaca

SEQ ID NO: 608567 - DNA, 25 bp, Mus musculus
cggccggtacgctggtcactggaca

SEQ ID NO: 608568 - DNA, 25 bp, Mus musculus
cggccgtagaccagtctgagtgttt

SEQ ID NO: 608569 - DNA, 25 bp, Mus musculus
cggccgtagacctgtctgagtgttt

SEQ ID NO: 608570 - DNA, 25 bp, Mus musculus
cggccgtgggaactatgatgctttt

SEQ ID NO: 608571 - DNA, 25 bp, Mus musculus
cggccgtgggaagtatgatgctttt

SEQ ID NO: 608572 - DNA, 25 bp, Mus musculus
cggccgtgttgaccgcggttctcca

SEQ ID NO: 608573 - DNA, 25 bp, Mus musculus
cggccgtgttgagcgcggttctcca

SEQ ID NO: 608574 - DNA, 25 bp, Mus musculus
cggcctaggcagagacaacagctag

SEQ ID NO: 608575 - DNA, 25 bp, Mus musculus
cggcctaggcagtgacaacagctag

SEQ ID NO: 608576 - DNA, 25 bp, Mus musculus
cggcctcatgtaccgcgcgctgtat

SEQ ID NO: 608577 - DNA, 25 bp, Mus musculus
cggcctcatgtagcgcgcgctgtat

SEQ ID NO: 608578 - DNA, 25 bp, Mus musculus
cggcctcattttcaccagctggtag

SEQ ID NO: 608579 - DNA, 25 bp, Mus musculus
cggcctcattttgaccagctggtag

SEQ ID NO: 608580 - DNA, 25 bp, Mus musculus
cggcctccaacgagtagcgacttca

SEQ ID NO: 608581 - DNA, 25 bp, Mus musculus
cggcctccaacgtgtagcgacttca

SEQ ID NO: 608582 - DNA, 25 bp, Mus musculus
cggcctccgcatcgcatggaggaac

SEQ ID NO: 608583 - DNA, 25 bp, Mus musculus
cggcctccgcatggcatggaggaac

SEQ ID NO: 608584 - DNA, 25 bp, Mus musculus
cggcctctcaggcttgctcgtcagg

SEQ ID NO: 608585 - DNA, 25 bp, Mus musculus
cggcctctcagggttgctcgtcagg

SEQ ID NO: 608586 - DNA, 25 bp, Mus musculus
cggcctctgcggcatgaactgtatt

SEQ ID NO: 608587 - DNA, 25 bp, Mus musculus
cggcctctgcgggatgaactgtatt

SEQ ID NO: 608588 - DNA, 25 bp, Mus musculus
cggcctctggctagatacagcatca

SEQ ID NO: 608589 - DNA, 25 bp, Mus musculus
cggcctctggcttgatacagcatca

SEQ ID NO: 608590 - DNA, 25 bp, Mus musculus
cggcctctgtggaggcgctaacgac

SEQ ID NO: 608591 - DNA, 25 bp, Mus musculus
cggcctctgtggtggcgctaacgac

SEQ ID NO: 608592 - DNA, 25 bp, Mus musculus
cggcctgcatgcagtgggctgtcaa

SEQ ID NO: 608593 - DNA, 25 bp, Mus musculus
cggcctgcatgctgtgggctgtcaa

SEQ ID NO: 608594 - DNA, 25 bp, Mus musculus
cggcctgccaggctatagagtttct

SEQ ID NO: 608595 - DNA, 25 bp, Mus musculus
cggcctgccagggtatagagtttct

SEQ ID NO: 608596 - DNA, 25 bp, Mus musculus
cggcctgggcccaggatgaagtaca

SEQ ID NO: 608597 - DNA, 25 bp, Mus musculus
cggcctgggccctggatgaagtaca

SEQ ID NO: 608598 - DNA, 25 bp, Mus musculus
cggcctgggtacagagagaccactg

SEQ ID NO: 608599 - DNA, 25 bp, Mus musculus
cggcctgggtactgagagaccactg

SEQ ID NO: 608600 - DNA, 25 bp, Mus musculus
cggcctgtgcccattcgcaggaaga

SEQ ID NO: 608601 - DNA, 25 bp, Mus musculus
cggcctgtgccctttcgcaggaaga

SEQ ID NO: 608602 - DNA, 25 bp, Mus musculus
cggccttattcaaggagctggagtc

SEQ ID NO: 608603 - DNA, 25 bp, Mus musculus
cggccttattcatggagctggagtc

SEQ ID NO: 608604 - DNA, 25 bp, Mus musculus
cggccttcaccaactcctatgtgta

SEQ ID NO: 608605 - DNA, 25 bp, Mus musculus
cggccttcaccatctcctatgtgta

SEQ ID NO: 608606 - DNA, 25 bp, Mus musculus
cggccttcccatcttcagctggaga

SEQ ID NO: 608607 - DNA, 25 bp, Mus musculus
cggccttcccatgttcagctggaga

SEQ ID NO: 608608 - DNA, 25 bp, Mus musculus
cggccttctattcttaaagaggata

SEQ ID NO: 608609 - DNA, 25 bp, Mus musculus
cggccttctattgttaaagaggata

SEQ ID NO: 608610 - DNA, 25 bp, Mus musculus
cggccttctcggattcccgggaatg

SEQ ID NO: 608611 - DNA, 25 bp, Mus musculus
cggccttctcggtttcccgggaatg

SEQ ID NO: 608612 - DNA, 25 bp, Mus musculus
cggccttctgcgaactccttctgga

SEQ ID NO: 608613 - DNA, 25 bp, Mus musculus
cggccttctgcgtactccttctgga

SEQ ID NO: 608614 - DNA, 25 bp, Mus musculus
cggccttgtggtcattgcccctgat

SEQ ID NO: 608615 - DNA, 25 bp, Mus musculus
cggccttgtggtgattgcccctgat

SEQ ID NO: 608616 - DNA, 25 bp, Mus musculus
cggccttgttttcctccggaatcgc

SEQ ID NO: 608617 - DNA, 25 bp, Mus musculus
cggccttgttttgctccggaatcgc

SEQ ID NO: 608618 - DNA, 25 bp, Mus musculus
cggcctttttctccgctacggagtg

SEQ ID NO: 608619 - DNA, 25 bp, Mus musculus
cggcctttttctgcgctacggagtg

SEQ ID NO: 608620 - DNA, 25 bp, Mus musculus
cggcgaaagcatccctggaaccttg

SEQ ID NO: 608621 - DNA, 25 bp, Mus musculus
cggcgaaagcatgcctggaaccttg

SEQ ID NO: 608622 - DNA, 25 bp, Mus musculus
cggcgaagctggcaacgatactgaa

SEQ ID NO: 608623 - DNA, 25 bp, Mus musculus
cggcgaagctgggaacgatactgaa

SEQ ID NO: 608624 - DNA, 25 bp, Mus musculus
cggcgaatttgacgactcggtgttc

SEQ ID NO: 608625 - DNA, 25 bp, Mus musculus
cggcgaatttgaggactcggtgttc

SEQ ID NO: 608626 - DNA, 25 bp, Mus musculus
cggcgacaatgtccagccaggtcat

SEQ ID NO: 608627 - DNA, 25 bp, Mus musculus
cggcgacaatgtgcagccaggtcat

SEQ ID NO: 608628 - DNA, 25 bp, Mus musculus
cggcgacttcgcaaggaagaaaaca

SEQ ID NO: 608629 - DNA, 25 bp, Mus musculus
cggcgacttcgctaggaagaaaaca

SEQ ID NO: 608630 - DNA, 25 bp, Mus musculus
cggcgagatggtaccgggcactacc

SEQ ID NO: 608631 - DNA, 25 bp, Mus musculus
cggcgagatggttccgggcactacc

SEQ ID NO: 608632 - DNA, 25 bp, Mus musculus
cggcgatggcttccaaaacagaatc

SEQ ID NO: 608633 - DNA, 25 bp, Mus musculus
cggcgatggcttgcaaaacagaatc

SEQ ID NO: 608634 - DNA, 25 bp, Mus musculus
cggcgcagagaacctgcctttcgaa

SEQ ID NO: 608635 - DNA, 25 bp, Mus musculus
cggcgcagagaagctgcctttcgaa

SEQ ID NO: 608636 - DNA, 25 bp, Mus musculus
cggcgcaggaagacacttagagcag

SEQ ID NO: 608637 - DNA, 25 bp, Mus musculus
cggcgcaggaagtcacttagagcag

SEQ ID NO: 608638 - DNA, 25 bp, Mus musculus
cggcgcagtgccatgctgtgtgtcc

SEQ ID NO: 608639 - DNA, 25 bp, Mus musculus
cggcgcagtgccttgctgtgtgtcc

SEQ ID NO: 608640 - DNA, 25 bp, Mus musculus
cggcgccccgggactcttattgtga

SEQ ID NO: 608641 - DNA, 25 bp, Mus musculus
cggcgccccgggtctcttattgtga

SEQ ID NO: 608642 - DNA, 25 bp, Mus musculus
cggcgctaccttcggtaagtggcca

SEQ ID NO: 608643 - DNA, 25 bp, Mus musculus
cggcgctaccttgggtaagtggcca

SEQ ID NO: 608644 - DNA, 25 bp, Mus musculus
cggcgctatgttccagatcgaagcg

SEQ ID NO: 608645 - DNA, 25 bp, Mus musculus
cggcgctatgttgcagatcgaagcg

SEQ ID NO: 608646 - DNA, 25 bp, Mus musculus
cggcgctctcgcagaaggttttcaa

SEQ ID NO: 608647 - DNA, 25 bp, Mus musculus
cggcgctctcgctgaaggttttcaa

SEQ ID NO: 608648 - DNA, 25 bp, Mus musculus
cggcgctgaccgactgctggaccga

SEQ ID NO: 608649 - DNA, 25 bp, Mus musculus
cggcgctgaccgtctgctggaccga

SEQ ID NO: 608650 - DNA, 25 bp, Mus musculus
cggcgctgcaggctctttctaactg

SEQ ID NO: 608651 - DNA, 25 bp, Mus musculus
cggcgctgcagggtctttctaactg

SEQ ID NO: 608652 - DNA, 25 bp, Mus musculus
cggcgctgcggtacactctggttcc

SEQ ID NO: 608653 - DNA, 25 bp, Mus musculus
cggcgctgcggttcactctggttcc

SEQ ID NO: 608654 - DNA, 25 bp, Mus musculus
cggcgctgctggacggtcgtttccc

SEQ ID NO: 608655 - DNA, 25 bp, Mus musculus
cggcgctgctggtcggtcgtttccc

SEQ ID NO: 608656 - DNA, 25 bp, Mus musculus
cggcgctggccacgtttcctgcaga

SEQ ID NO: 608657 - DNA, 25 bp, Mus musculus
cggcgctggccaggtttcctgcaga

SEQ ID NO: 608658 - DNA, 25 bp, Mus musculus
cggcggaaactgcagcgacatttaa

SEQ ID NO: 608659 - DNA, 25 bp, Mus musculus
cggcggaaactggagcgacatttaa

SEQ ID NO: 608660 - DNA, 25 bp, Mus musculus
cggcggaaccgaaggatctgctcca

SEQ ID NO: 608661 - DNA, 25 bp, Mus musculus
cggcggaaccgatggatctgctcca

SEQ ID NO: 608662 - DNA, 25 bp, Mus musculus
cggcggaatcgccttcgtgacgtac

SEQ ID NO: 608663 - DNA, 25 bp, Mus musculus
cggcggaatcgcgttcgtgacgtac

SEQ ID NO: 608664 - DNA, 25 bp, Mus musculus
cggcggaatggtcgactaccacgca

SEQ ID NO: 608665 - DNA, 25 bp, Mus musculus
cggcggaatggtggactaccacgca

SEQ ID NO: 608666 - DNA, 25 bp, Mus musculus
cggcggacaccaacggccagatgcg

SEQ ID NO: 608667 - DNA, 25 bp, Mus musculus
cggcggacaccatcggccagatgcg

SEQ ID NO: 608668 - DNA, 25 bp, Mus musculus
cggcggagagcacacccagtagtcc

SEQ ID NO: 608669 - DNA, 25 bp, Mus musculus
cggcggagagcagacccagtagtcc

SEQ ID NO: 608670 - DNA, 25 bp, Mus musculus
cggcggagctggacgcacaattatg

SEQ ID NO: 608671 - DNA, 25 bp, Mus musculus
cggcggagctggtcgcacaattatg

SEQ ID NO: 608672 - DNA, 25 bp, Mus musculus
cggcggcctcacaatcgctgggatc

SEQ ID NO: 608673 - DNA, 25 bp, Mus musculus
cggcggcctcactatcgctgggatc

SEQ ID NO: 608674 - DNA, 25 bp, Mus musculus
cggcggcggagaacgcgtctcctct

SEQ ID NO: 608675 - DNA, 25 bp, Mus musculus
cggcggcggagatcgcgtctcctct

SEQ ID NO: 608676 - DNA, 25 bp, Mus musculus
cggcggcgtgtcaacgatgccttaa

SEQ ID NO: 608677 - DNA, 25 bp, Mus musculus
cggcggcgtgtctacgatgccttaa

SEQ ID NO: 608678 - DNA, 25 bp, Mus musculus
cggcggctctcaagctggaaacaag

SEQ ID NO: 608679 - DNA, 25 bp, Mus musculus
cggcggctctcatgctggaaacaag

SEQ ID NO: 608680 - DNA, 25 bp, Mus musculus
cggcggctgcgtaggactgggtggc

SEQ ID NO: 608681 - DNA, 25 bp, Mus musculus
cggcggctgcgttggactgggtggc

SEQ ID NO: 608682 - DNA, 25 bp, Mus musculus
cggcgggaggcaagttgtcttctac

SEQ ID NO: 608683 - DNA, 25 bp, Mus musculus
cggcgggaggcatgttgtcttctac

SEQ ID NO: 608684 - DNA, 25 bp, Mus musculus
cggcggtctccgcagtgcagaatta

SEQ ID NO: 608685 - DNA, 25 bp, Mus musculus
cggcggtctccggagtgcagaatta

SEQ ID NO: 608686 - DNA, 25 bp, Mus musculus
cggcggtgttccatgctcgtgccca

SEQ ID NO: 608687 - DNA, 25 bp, Mus musculus
cggcggtgttccttgctcgtgccca

SEQ ID NO: 608688 - DNA, 25 bp, Mus musculus
cggcggtgttttcatgtggaacaat

SEQ ID NO: 608689 - DNA, 25 bp, Mus musculus
cggcggtgttttgatgtggaacaat

SEQ ID NO: 608690 - DNA, 25 bp, Mus musculus
cggcggttcgcgattctcgtgttgc

SEQ ID NO: 608691 - DNA, 25 bp, Mus musculus
cggcggttcgcgtttctcgtgttgc

SEQ ID NO: 608692 - DNA, 25 bp, Mus musculus
cggcgtagtctgctccgagacagct

SEQ ID NO: 608693 - DNA, 25 bp, Mus musculus
cggcgtagtctggtccgagacagct

SEQ ID NO: 608694 - DNA, 25 bp, Mus musculus
cggcgtccgagtacatggagaagcc

SEQ ID NO: 608695 - DNA, 25 bp, Mus musculus
cggcgtccgagttcatggagaagcc

SEQ ID NO: 608696 - DNA, 25 bp, Mus musculus
cggcgtccgccaatagccttcaaga

SEQ ID NO: 608697 - DNA, 25 bp, Mus musculus
cggcgtccgccattagccttcaaga

SEQ ID NO: 608698 - DNA, 25 bp, Mus musculus
cggcgtccgtgcaaggctcgctgct

SEQ ID NO: 608699 - DNA, 25 bp, Mus musculus
cggcgtccgtgctaggctcgctgct

SEQ ID NO: 608700 - DNA, 25 bp, Mus musculus
cggcgtcgctcccttcaactgggat

SEQ ID NO: 608701 - DNA, 25 bp, Mus musculus
cggcgtcgctccgttcaactgggat

SEQ ID NO: 608702 - DNA, 25 bp, Mus musculus
cggcgtgcaaatcagaacagcaata

SEQ ID NO: 608703 - DNA, 25 bp, Mus musculus
cggcgtgcaaatgagaacagcaata

SEQ ID NO: 608704 - DNA, 25 bp, Mus musculus
cggcgtggcgcgcaaacaaactttg

SEQ ID NO: 608705 - DNA, 25 bp, Mus musculus
cggcgtggcgcggaaacaaactttg

SEQ ID NO: 608706 - DNA, 25 bp, Mus musculus
cggcgtgtctaccatgccttaaatg

SEQ ID NO: 608707 - DNA, 25 bp, Mus musculus
cggcgtgtctacgatgccttaaatg

SEQ ID NO: 608708 - DNA, 25 bp, Mus musculus
cggcgtgtgttcattgtagagacca

SEQ ID NO: 608709 - DNA, 25 bp, Mus musculus
cggcgtgtgttctttgtagagacca

SEQ ID NO: 608710 - DNA, 25 bp, Mus musculus
cggcgttatgcacgcgaggcagggc

SEQ ID NO: 608711 - DNA, 25 bp, Mus musculus
cggcgttatgcaggcgaggcagggc

SEQ ID NO: 608712 - DNA, 25 bp, Mus musculus
cggctacaccggcattcgctgtgag

SEQ ID NO: 608713 - DNA, 25 bp, Mus musculus
cggctacaccgggattcgctgtgag

SEQ ID NO: 608714 - DNA, 25 bp, Mus musculus
cggctacatccacctatgaagtggg

SEQ ID NO: 608715 - DNA, 25 bp, Mus musculus
cggctacatccagctatgaagtggg

SEQ ID NO: 608716 - DNA, 25 bp, Mus musculus
cggctactgagaaaagaacttacca

SEQ ID NO: 608717 - DNA, 25 bp, Mus musculus
cggctactgagataagaacttacca

SEQ ID NO: 608718 - DNA, 25 bp, Mus musculus
cggctactggaacacctacacagag

SEQ ID NO: 608719 - DNA, 25 bp, Mus musculus
cggctactggaagacctacacagag

SEQ ID NO: 608720 - DNA, 25 bp, Mus musculus
cggctagagaagatggtcgccaagc

SEQ ID NO: 608721 - DNA, 25 bp, Mus musculus
cggctagagaagttggtcgccaagc

SEQ ID NO: 608722 - DNA, 25 bp, Mus musculus
cggctagtgacaccgaagacagagt

SEQ ID NO: 608723 - DNA, 25 bp, Mus musculus
cggctagtgacagcgaagacagagt

SEQ ID NO: 608724 - DNA, 25 bp, Mus musculus
cggctatcttcacgagctctctgac

SEQ ID NO: 608725 - DNA, 25 bp, Mus musculus
cggctatcttcaggagctctctgac

SEQ ID NO: 608726 - DNA, 25 bp, Mus musculus
cggctatgatatcgccctggtgcaa

SEQ ID NO: 608727 - DNA, 25 bp, Mus musculus
cggctatgatatggccctggtgcaa

SEQ ID NO: 608728 - DNA, 25 bp, Mus musculus
cggctattagccattcagaaagatg

SEQ ID NO: 608729 - DNA, 25 bp, Mus musculus
cggctattagcctttcagaaagatg

SEQ ID NO: 608730 - DNA, 25 bp, Mus musculus
cggctattgtggaacagcaatcatg

SEQ ID NO: 608731 - DNA, 25 bp, Mus musculus
cggctattgtggtacagcaatcatg

SEQ ID NO: 608732 - DNA, 25 bp, Mus musculus
cggctccagtgaacatgaggcgaac

SEQ ID NO: 608733 - DNA, 25 bp, Mus musculus
cggctccagtgatcatgaggcgaac

SEQ ID NO: 608734 - DNA, 25 bp, Mus musculus
cggctccgggcacagaacaagtcag

SEQ ID NO: 608735 - DNA, 25 bp, Mus musculus
cggctccgggcagagaacaagtcag

SEQ ID NO: 608736 - DNA, 25 bp, Mus musculus
cggctcctgagcagaactccatcat

SEQ ID NO: 608737 - DNA, 25 bp, Mus musculus
cggctcctgagctgaactccatcat

SEQ ID NO: 608738 - DNA, 25 bp, Mus musculus
cggctcggatgaacagtccctctgg

SEQ ID NO: 608739 - DNA, 25 bp, Mus musculus
cggctcggatgatcagtccctctgg

SEQ ID NO: 608740 - DNA, 25 bp, Mus musculus
cggctcgtccagagtaatttgatga

SEQ ID NO: 608741 - DNA, 25 bp, Mus musculus
cggctcgtccagtgtaatttgatga

SEQ ID NO: 608742 - DNA, 25 bp, Mus musculus
cggctcgtctacaagtttggcaaga

SEQ ID NO: 608743 - DNA, 25 bp, Mus musculus
cggctcgtctactagtttggcaaga

SEQ ID NO: 608744 - DNA, 25 bp, Mus musculus
cggctctccgctaagagaaggtgta

SEQ ID NO: 608745 - DNA, 25 bp, Mus musculus
cggctctccgcttagagaaggtgta

SEQ ID NO: 608746 - DNA, 25 bp, Mus musculus
cggctctccggtcaaggatactgct

SEQ ID NO: 608747 - DNA, 25 bp, Mus musculus
cggctctccggtgaaggatactgct

SEQ ID NO: 608748 - DNA, 25 bp, Mus musculus
cggctctgagctaattctctccagc

SEQ ID NO: 608749 - DNA, 25 bp, Mus musculus
cggctctgagcttattctctccagc

SEQ ID NO: 608750 - DNA, 25 bp, Mus musculus
cggctctgattgcaggtaaccagga

SEQ ID NO: 608751 - DNA, 25 bp, Mus musculus
cggctctgattggaggtaaccagga

SEQ ID NO: 608752 - DNA, 25 bp, Mus musculus
cggctctttgagcagttccgggact

SEQ ID NO: 608753 - DNA, 25 bp, Mus musculus
cggctctttgaggagttccgggact

SEQ ID NO: 608754 - DNA, 25 bp, Mus musculus
cggctctttgtccaagctagaggac

SEQ ID NO: 608755 - DNA, 25 bp, Mus musculus
cggctctttgtcgaagctagaggac

SEQ ID NO: 608756 - DNA, 25 bp, Mus musculus
cggctgaaccaaccggactagctgc

SEQ ID NO: 608757 - DNA, 25 bp, Mus musculus
cggctgaaccaagcggactagctgc

SEQ ID NO: 608758 - DNA, 25 bp, Mus musculus
cggctgaactggaccactttttatt

SEQ ID NO: 608759 - DNA, 25 bp, Mus musculus
cggctgaactggtccactttttatt

SEQ ID NO: 608760 - DNA, 25 bp, Mus musculus
cggctgaagcgcagaccaagccata

SEQ ID NO: 608761 - DNA, 25 bp, Mus musculus
cggctgaagcgctgaccaagccata

SEQ ID NO: 608762 - DNA, 25 bp, Mus musculus
cggctgaccaaacagcatcgctggg

SEQ ID NO: 608763 - DNA, 25 bp, Mus musculus
cggctgaccaaagagcatcgctggg

SEQ ID NO: 608764 - DNA, 25 bp, Mus musculus
cggctgactaagcaggccgcacctt

SEQ ID NO: 608765 - DNA, 25 bp, Mus musculus
cggctgactaaggaggccgcacctt

SEQ ID NO: 608766 - DNA, 25 bp, Mus musculus
cggctgaggctcagcgcacaacgca

SEQ ID NO: 608767 - DNA, 25 bp, Mus musculus
cggctgaggctctgcgcacaacgca

SEQ ID NO: 608768 - DNA, 25 bp, Mus musculus
cggctgcaatggagctgtatggaaa

SEQ ID NO: 608769 - DNA, 25 bp, Mus musculus
cggctgcaatggtgctgtatggaaa

SEQ ID NO: 608770 - DNA, 25 bp, Mus musculus
cggctgcaggagcacattactgcca

SEQ ID NO: 608771 - DNA, 25 bp, Mus musculus
cggctgcaggaggacattactgcca

SEQ ID NO: 608772 - DNA, 25 bp, Mus musculus
cggctgccacccaggacaaggcagg

SEQ ID NO: 608773 - DNA, 25 bp, Mus musculus
cggctgccaccctggacaaggcagg

SEQ ID NO: 608774 - DNA, 25 bp, Mus musculus
cggctgcccagtacgtgtcacagtg

SEQ ID NO: 608775 - DNA, 25 bp, Mus musculus
cggctgcccagttcgtgtcacagtg

SEQ ID NO: 608776 - DNA, 25 bp, Mus musculus
cggctgccgaggaaatttcaggaag

SEQ ID NO: 608777 - DNA, 25 bp, Mus musculus
cggctgccgaggtaatttcaggaag

SEQ ID NO: 608778 - DNA, 25 bp, Mus musculus
cggctgccgagtcatccagaaagct

SEQ ID NO: 608779 - DNA, 25 bp, Mus musculus
cggctgccgagtgatccagaaagct

SEQ ID NO: 608780 - DNA, 25 bp, Mus musculus
cggctgcctatgctcttgtctccaa

SEQ ID NO: 608781 - DNA, 25 bp, Mus musculus
cggctgcctatggtcttgtctccaa

SEQ ID NO: 608782 - DNA, 25 bp, Mus musculus
cggctgcgacggactggtcacgtca

SEQ ID NO: 608783 - DNA, 25 bp, Mus musculus
cggctgcgacggtctggtcacgtca

SEQ ID NO: 608784 - DNA, 25 bp, Mus musculus
cggctgcggagacaacatcgactat

SEQ ID NO: 608785 - DNA, 25 bp, Mus musculus
cggctgcggagagaacatcgactat

SEQ ID NO: 608786 - DNA, 25 bp, Mus musculus
cggctgctaaggaccgagtccggtc

SEQ ID NO: 608787 - DNA, 25 bp, Mus musculus
cggctgctaaggtccgagtccggtc

SEQ ID NO: 608788 - DNA, 25 bp, Mus musculus
cggctgctacccaaggaatcgttct

SEQ ID NO: 608789 - DNA, 25 bp, Mus musculus
cggctgctaccctaggaatcgttct

SEQ ID NO: 608790 - DNA, 25 bp, Mus musculus
cggctgctcgtccagaggctgttcc

SEQ ID NO: 608791 - DNA, 25 bp, Mus musculus
cggctgctcgtcgagaggctgttcc

SEQ ID NO: 608792 - DNA, 25 bp, Mus musculus
cggctgctgtaacgtctgcgctaaa

SEQ ID NO: 608793 - DNA, 25 bp, Mus musculus
cggctgctgtaaggtctgcgctaaa

SEQ ID NO: 608794 - DNA, 25 bp, Mus musculus
cggctgcttctcacgcgaggacgga

SEQ ID NO: 608795 - DNA, 25 bp, Mus musculus
cggctgcttctctcgcgaggacgga

SEQ ID NO: 608796 - DNA, 25 bp, Mus musculus
cggctggacattatgctggtgccat

SEQ ID NO: 608797 - DNA, 25 bp, Mus musculus
cggctggacattttgctggtgccat

SEQ ID NO: 608798 - DNA, 25 bp, Mus musculus
cggctggaccatcaacatctgggaa

SEQ ID NO: 608799 - DNA, 25 bp, Mus musculus
cggctggaccatgaacatctgggaa

SEQ ID NO: 608800 - DNA, 25 bp, Mus musculus
cggctggactgtactaccttgcaga

SEQ ID NO: 608801 - DNA, 25 bp, Mus musculus
cggctggactgttctaccttgcaga

SEQ ID NO: 608802 - DNA, 25 bp, Mus musculus
cggctggattgccaccatttccttc

SEQ ID NO: 608803 - DNA, 25 bp, Mus musculus
cggctggattgcgaccatttccttc

SEQ ID NO: 608804 - DNA, 25 bp, Mus musculus
cggctggcactaaagaacattgcaa

SEQ ID NO: 608805 - DNA, 25 bp, Mus musculus
cggctggcactatagaacattgcaa

SEQ ID NO: 608806 - DNA, 25 bp, Mus musculus
cggctggcagctccacggacagaca

SEQ ID NO: 608807 - DNA, 25 bp, Mus musculus
cggctggcagctgcacggacagaca

SEQ ID NO: 608808 - DNA, 25 bp, Mus musculus
cggctggccactcctgtagagatat

SEQ ID NO: 608809 - DNA, 25 bp, Mus musculus
cggctggccactgctgtagagatat

SEQ ID NO: 608810 - DNA, 25 bp, Mus musculus
cggctgggatatagggtatctcgac

SEQ ID NO: 608811 - DNA, 25 bp, Mus musculus
cggctgggatattgggtatctcgac

SEQ ID NO: 608812 - DNA, 25 bp, Mus musculus
cggctgtaagaactgcacatgcttg

SEQ ID NO: 608813 - DNA, 25 bp, Mus musculus
cggctgtaagaagtgcacatgcttg

SEQ ID NO: 608814 - DNA, 25 bp, Mus musculus
cggctgtccaaaacagagcgagaca

SEQ ID NO: 608815 - DNA, 25 bp, Mus musculus
cggctgtccaaatcagagcgagaca

SEQ ID NO: 608816 - DNA, 25 bp, Mus musculus
cggctgtgcgtcctacctgtggcaa

SEQ ID NO: 608817 - DNA, 25 bp, Mus musculus
cggctgtgcgtcgtacctgtggcaa

SEQ ID NO: 608818 - DNA, 25 bp, Mus musculus
cggctgttctcgagccctccttggg

SEQ ID NO: 608819 - DNA, 25 bp, Mus musculus
cggctgttctcgtgccctccttggg

SEQ ID NO: 608820 - DNA, 25 bp, Mus musculus
cggctgtttcctcttatccaagcca

SEQ ID NO: 608821 - DNA, 25 bp, Mus musculus
cggctgtttcctgttatccaagcca

SEQ ID NO: 608822 - DNA, 25 bp, Mus musculus
cggcttaagcaacagcagaagaaac

SEQ ID NO: 608823 - DNA, 25 bp, Mus musculus
cggcttaagcaagagcagaagaaac

SEQ ID NO: 608824 - DNA, 25 bp, Mus musculus
cggcttagaccgagctgagcgagct

SEQ ID NO: 608825 - DNA, 25 bp, Mus musculus
cggcttagaccgtgctgagcgagct

SEQ ID NO: 608826 - DNA, 25 bp, Mus musculus
cggcttataccgaatgattgatgaa

SEQ ID NO: 608827 - DNA, 25 bp, Mus musculus
cggcttataccgtatgattgatgaa

SEQ ID NO: 608828 - DNA, 25 bp, Mus musculus
cggcttcatcctacagatctgctgt

SEQ ID NO: 608829 - DNA, 25 bp, Mus musculus
cggcttcatccttcagatctgctgt

SEQ ID NO: 608830 - DNA, 25 bp, Mus musculus
cggcttccagaacatagtagatgct

SEQ ID NO: 608831 - DNA, 25 bp, Mus musculus
cggcttccagaagatagtagatgct

SEQ ID NO: 608832 - DNA, 25 bp, Mus musculus
cggcttccatcaatgcaaaagtggc

SEQ ID NO: 608833 - DNA, 25 bp, Mus musculus
cggcttccatcattgcaaaagtggc

SEQ ID NO: 608834 - DNA, 25 bp, Mus musculus
cggcttcccaagagaggctccgtga

SEQ ID NO: 608835 - DNA, 25 bp, Mus musculus
cggcttcccaagtgaggctccgtga

SEQ ID NO: 608836 - DNA, 25 bp, Mus musculus
cggcttcccagaacgctatcgggca

SEQ ID NO: 608837 - DNA, 25 bp, Mus musculus
cggcttcccagatcgctatcgggca

SEQ ID NO: 608838 - DNA, 25 bp, Mus musculus
cggcttccccaacaagttgctaaag

SEQ ID NO: 608839 - DNA, 25 bp, Mus musculus
cggcttccccaagaagttgctaaag

SEQ ID NO: 608840 - DNA, 25 bp, Mus musculus
cggcttcggtgaacccgagtgtgcc

SEQ ID NO: 608841 - DNA, 25 bp, Mus musculus
cggcttcggtgatcccgagtgtgcc

SEQ ID NO: 608842 - DNA, 25 bp, Mus musculus
cggcttctcaaaagttggcctatag

SEQ ID NO: 608843 - DNA, 25 bp, Mus musculus
cggcttctcaaatgttggcctatag

SEQ ID NO: 608844 - DNA, 25 bp, Mus musculus
cggcttctcatcatggcggacccta

SEQ ID NO: 608845 - DNA, 25 bp, Mus musculus
cggcttctcatcttggcggacccta

SEQ ID NO: 608846 - DNA, 25 bp, Mus musculus
cggcttgacaacacaaactatggga

SEQ ID NO: 608847 - DNA, 25 bp, Mus musculus
cggcttgacaactcaaactatggga

SEQ ID NO: 608848 - DNA, 25 bp, Mus musculus
cggcttgaggtcagcccgcggctct

SEQ ID NO: 608849 - DNA, 25 bp, Mus musculus
cggcttgaggtctgcccgcggctct

SEQ ID NO: 608850 - DNA, 25 bp, Mus musculus
cggcttgctgcacctggaacgatgt

SEQ ID NO: 608851 - DNA, 25 bp, Mus musculus
cggcttgctgcagctggaacgatgt

SEQ ID NO: 608852 - DNA, 25 bp, Mus musculus
cggcttggcaagaccatactctgct

SEQ ID NO: 608853 - DNA, 25 bp, Mus musculus
cggcttggcaagtccatactctgct

SEQ ID NO: 608854 - DNA, 25 bp, Mus musculus
cggcttggccctcacctgtttggag

SEQ ID NO: 608855 - DNA, 25 bp, Mus musculus
cggcttggccctgacctgtttggag

SEQ ID NO: 608856 - DNA, 25 bp, Mus musculus
cggcttgtaagtcagtcctttctct

SEQ ID NO: 608857 - DNA, 25 bp, Mus musculus
cggcttgtaagtgagtcctttctct

SEQ ID NO: 608858 - DNA, 25 bp, Mus musculus
cggcttgtgtgcacagtacctggag

SEQ ID NO: 608859 - DNA, 25 bp, Mus musculus
cggcttgtgtgctcagtacctggag

SEQ ID NO: 608860 - DNA, 25 bp, Mus musculus
cggctttattgacctgatggagctg

SEQ ID NO: 608861 - DNA, 25 bp, Mus musculus
cggctttattgagctgatggagctg

SEQ ID NO: 608862 - DNA, 25 bp, Mus musculus
cggctttctgttcactatggcaaaa

SEQ ID NO: 608863 - DNA, 25 bp, Mus musculus
cggctttctgttgactatggcaaaa

SEQ ID NO: 608864 - DNA, 25 bp, Mus musculus
cggctttgccccatcaaactggtct

SEQ ID NO: 608865 - DNA, 25 bp, Mus musculus
cggctttgccccttcaaactggtct

SEQ ID NO: 608866 - DNA, 25 bp, Mus musculus
cgggaaacagagacagcggagccat

SEQ ID NO: 608867 - DNA, 25 bp, Mus musculus
cgggaaacagagtcagcggagccat

SEQ ID NO: 608868 - DNA, 25 bp, Mus musculus
cgggaaacgaagagaagctaagact

SEQ ID NO: 608869 - DNA, 25 bp, Mus musculus
cgggaaacgaagtgaagctaagact

SEQ ID NO: 608870 - DNA, 25 bp, Mus musculus
cgggaaagactaccagccaaaatag

SEQ ID NO: 608871 - DNA, 25 bp, Mus musculus
cgggaaagactagcagccaaaatag

SEQ ID NO: 608872 - DNA, 25 bp, Mus musculus
cgggaaagcacaaggcacacggctt

SEQ ID NO: 608873 - DNA, 25 bp, Mus musculus
cgggaaagcacatggcacacggctt

SEQ ID NO: 608874 - DNA, 25 bp, Mus musculus
cgggaaatagaaacgtacaagcgag

SEQ ID NO: 608875 - DNA, 25 bp, Mus musculus
cgggaaatagaatcgtacaagcgag

SEQ ID NO: 608876 - DNA, 25 bp, Mus musculus
cgggaaatcaagcagctacttcgag

SEQ ID NO: 608877 - DNA, 25 bp, Mus musculus
cgggaaatcaaggagctacttcgag

SEQ ID NO: 608878 - DNA, 25 bp, Mus musculus
cgggaacaagaccttgtcatcacag

SEQ ID NO: 608879 - DNA, 25 bp, Mus musculus
cgggaacaagacgttgtcatcacag

SEQ ID NO: 608880 - DNA, 25 bp, Mus musculus
cgggaacagcaacgagctaaggacc

SEQ ID NO: 608881 - DNA, 25 bp, Mus musculus
cgggaacagcaaggagctaaggacc

SEQ ID NO: 608882 - DNA, 25 bp, Mus musculus
cgggaacagcttcctattgcagagt

SEQ ID NO: 608883 - DNA, 25 bp, Mus musculus
cgggaacagcttgctattgcagagt

SEQ ID NO: 608884 - DNA, 25 bp, Mus musculus
cgggaacatggcactaaaacggatc

SEQ ID NO: 608885 - DNA, 25 bp, Mus musculus
cgggaacatggctctaaaacggatc

SEQ ID NO: 608886 - DNA, 25 bp, Mus musculus
cgggaacattgtctaggcggaactc

SEQ ID NO: 608887 - DNA, 25 bp, Mus musculus
cgggaacattgtgtaggcggaactc

SEQ ID NO: 608888 - DNA, 25 bp, Mus musculus
cgggaaccgggcagacactgctgct

SEQ ID NO: 608889 - DNA, 25 bp, Mus musculus
cgggaaccgggctgacactgctgct

SEQ ID NO: 608890 - DNA, 25 bp, Mus musculus
cgggaacctcataaggatgcttgtt

SEQ ID NO: 608891 - DNA, 25 bp, Mus musculus
cgggaacctcattaggatgcttgtt

SEQ ID NO: 608892 - DNA, 25 bp, Mus musculus
cgggaactggcaaatcttgcttgct

SEQ ID NO: 608893 - DNA, 25 bp, Mus musculus
cgggaactggcaacggactcatggt

SEQ ID NO: 608894 - DNA, 25 bp, Mus musculus
cgggaactggcatatcttgcttgct

SEQ ID NO: 608895 - DNA, 25 bp, Mus musculus
cgggaactggcatcggactcatggt

SEQ ID NO: 608896 - DNA, 25 bp, Mus musculus
cgggaagagtatcacttacgaagga

SEQ ID NO: 608897 - DNA, 25 bp, Mus musculus
cgggaagagtatgacttacgaagga

SEQ ID NO: 608898 - DNA, 25 bp, Mus musculus
cgggaagcatttccggactgcacca

SEQ ID NO: 608899 - DNA, 25 bp, Mus musculus
cgggaagcatttgcggactgcacca

SEQ ID NO: 608900 - DNA, 25 bp, Mus musculus
cgggaagcctttactgagctggaca

SEQ ID NO: 608901 - DNA, 25 bp, Mus musculus
cgggaagccttttctgagctggaca

SEQ ID NO: 608902 - DNA, 25 bp, Mus musculus
cgggaagctagcaaagtcgcagcca

SEQ ID NO: 608903 - DNA, 25 bp, Mus musculus
cgggaagctagctaagtcgcagcca

SEQ ID NO: 608904 - DNA, 25 bp, Mus musculus
cgggaaggctctcctgttcagcaag

SEQ ID NO: 608905 - DNA, 25 bp, Mus musculus
cgggaaggctctgctgttcagcaag

SEQ ID NO: 608906 - DNA, 25 bp, Mus musculus
cgggaagggcctagaatctatgatc

SEQ ID NO: 608907 - DNA, 25 bp, Mus musculus
cgggaagggccttgaatctatgatc

SEQ ID NO: 608908 - DNA, 25 bp, Mus musculus
cgggaagtacacatttgcagcccac

SEQ ID NO: 608909 - DNA, 25 bp, Mus musculus
cgggaagtacacttttgcagcccac

SEQ ID NO: 608910 - DNA, 25 bp, Mus musculus
cgggaagtctaacggatatggcttt

SEQ ID NO: 608911 - DNA, 25 bp, Mus musculus
cgggaagtctaagggatatggcttt

SEQ ID NO: 608912 - DNA, 25 bp, Mus musculus
cgggaatcagccaccagctcatctt

SEQ ID NO: 608913 - DNA, 25 bp, Mus musculus
cgggaatcagcctccagctcatctt

SEQ ID NO: 608914 - DNA, 25 bp, Mus musculus
cgggaatctaaaaatggtgcacaca

SEQ ID NO: 608915 - DNA, 25 bp, Mus musculus
cgggaatctaaatatggtgcacaca

SEQ ID NO: 608916 - DNA, 25 bp, Mus musculus
cgggacaaggtgaagttcactgttc

SEQ ID NO: 608917 - DNA, 25 bp, Mus musculus
cgggacaaggtgtagttcactgttc

SEQ ID NO: 608918 - DNA, 25 bp, Mus musculus
cgggacaagtatccatacacgaagc

SEQ ID NO: 608919 - DNA, 25 bp, Mus musculus
cgggacaagtatgcatacacgaagc

SEQ ID NO: 608920 - DNA, 25 bp, Mus musculus
cgggacagcacgctttgaatgccac

SEQ ID NO: 608921 - DNA, 25 bp, Mus musculus
cgggacagcacggtttgaatgccac

SEQ ID NO: 608922 - DNA, 25 bp, Mus musculus
cgggacagcccaagatgacctccag

SEQ ID NO: 608923 - DNA, 25 bp, Mus musculus
cgggacagcccatgatgacctccag

SEQ ID NO: 608924 - DNA, 25 bp, Mus musculus
cgggacatgcagaccgacacgcagg

SEQ ID NO: 608925 - DNA, 25 bp, Mus musculus
cgggacatgcagtccgacacgcagg

SEQ ID NO: 608926 - DNA, 25 bp, Mus musculus
cgggaccatagtcgatgacgatgac

SEQ ID NO: 608927 - DNA, 25 bp, Mus musculus
cgggaccatagtggatgacgatgac

SEQ ID NO: 608928 - DNA, 25 bp, Mus musculus
cgggacgctgacaacattgctgctt

SEQ ID NO: 608929 - DNA, 25 bp, Mus musculus
cgggacgctgactacattgctgctt

SEQ ID NO: 608930 - DNA, 25 bp, Mus musculus
cgggacgtggacatcgaggctatct

SEQ ID NO: 608931 - DNA, 25 bp, Mus musculus
cgggacgtggacttcgaggctatct

SEQ ID NO: 608932 - DNA, 25 bp, Mus musculus
cgggactattctcctgatgatacca

SEQ ID NO: 608933 - DNA, 25 bp, Mus musculus
cgggactattctgctgatgatacca

SEQ ID NO: 608934 - DNA, 25 bp, Mus musculus
cgggactctaagatgaagttatggg

SEQ ID NO: 608935 - DNA, 25 bp, Mus musculus
cgggactctaagttgaagttatggg

SEQ ID NO: 608936 - DNA, 25 bp, Mus musculus
cgggactgtccaccgaacgagcaag

SEQ ID NO: 608937 - DNA, 25 bp, Mus musculus
cgggactgtccagcgaacgagcaag

SEQ ID NO: 608938 - DNA, 25 bp, Mus musculus
cgggactttactccgactggattgt

SEQ ID NO: 608939 - DNA, 25 bp, Mus musculus
cgggactttactgcgactggattgt

SEQ ID NO: 608940 - DNA, 25 bp, Mus musculus
cgggactttggcagggatccctgct

SEQ ID NO: 608941 - DNA, 25 bp, Mus musculus
cgggactttggctgggatccctgct

SEQ ID NO: 608942 - DNA, 25 bp, Mus musculus
cgggagaaaatgcaacggcgttcat

SEQ ID NO: 608943 - DNA, 25 bp, Mus musculus
cgggagaaaatggaacggcgttcat

SEQ ID NO: 608944 - DNA, 25 bp, Mus musculus
cgggagacgagaacacgctagctaa

SEQ ID NO: 608945 - DNA, 25 bp, Mus musculus
cgggagacgagatcacgctagctaa

SEQ ID NO: 608946 - DNA, 25 bp, Mus musculus
cgggagagccccagtactgtcagta

SEQ ID NO: 608947 - DNA, 25 bp, Mus musculus
cgggagagcccctgtactgtcagta

SEQ ID NO: 608948 - DNA, 25 bp, Mus musculus
cgggagatctatcaccgctatggcc

SEQ ID NO: 608949 - DNA, 25 bp, Mus musculus
cgggagatctatgaccgctatggcc

SEQ ID NO: 608950 - DNA, 25 bp, Mus musculus
cgggagattcgcagcagtcgagcca

SEQ ID NO: 608951 - DNA, 25 bp, Mus musculus
cgggagattcgctgcagtcgagcca

SEQ ID NO: 608952 - DNA, 25 bp, Mus musculus
cgggagcaccacctacgctattggc

SEQ ID NO: 608953 - DNA, 25 bp, Mus musculus
cgggagcaccacgtacgctattggc

SEQ ID NO: 608954 - DNA, 25 bp, Mus musculus
cgggagcactgaattttggagctga

SEQ ID NO: 608955 - DNA, 25 bp, Mus musculus
cgggagcactgatttttggagctga

SEQ ID NO: 608956 - DNA, 25 bp, Mus musculus
cgggagcagccgcttttgtatgcct

SEQ ID NO: 608957 - DNA, 25 bp, Mus musculus
cgggagcagccggttttgtatgcct

SEQ ID NO: 608958 - DNA, 25 bp, Mus musculus
cgggagcatctgcatgaggatggag

SEQ ID NO: 608959 - DNA, 25 bp, Mus musculus
cgggagcatctggatgaggatggag

SEQ ID NO: 608960 - DNA, 25 bp, Mus musculus
cgggagccatggagcccgacaacag

SEQ ID NO: 608961 - DNA, 25 bp, Mus musculus
cgggagccatggtgcccgacaacag

SEQ ID NO: 608962 - DNA, 25 bp, Mus musculus
cgggagctatgtcagcttgaccctg

SEQ ID NO: 608963 - DNA, 25 bp, Mus musculus
cgggagctatgtgagcttgaccctg

SEQ ID NO: 608964 - DNA, 25 bp, Mus musculus
cgggagctgaccatctgtaagaaga

SEQ ID NO: 608965 - DNA, 25 bp, Mus musculus
cgggagctgacccatgctgagttcc

SEQ ID NO: 608966 - DNA, 25 bp, Mus musculus
cgggagctgaccgatgctgagttcc

SEQ ID NO: 608967 - DNA, 25 bp, Mus musculus
cgggagctgaccttctgtaagaaga

SEQ ID NO: 608968 - DNA, 25 bp, Mus musculus
cgggagctttctcagaagaccccac

SEQ ID NO: 608969 - DNA, 25 bp, Mus musculus
cgggagctttctgagaagaccccac

SEQ ID NO: 608970 - DNA, 25 bp, Mus musculus
cgggaggaggccacataccttctgg

SEQ ID NO: 608971 - DNA, 25 bp, Mus musculus
cgggaggaggcctcataccttctgg

SEQ ID NO: 608972 - DNA, 25 bp, Mus musculus
cgggaggcatgtagtcttctaccca

SEQ ID NO: 608973 - DNA, 25 bp, Mus musculus
cgggaggcatgttgtcttctaccca

SEQ ID NO: 608974 - DNA, 25 bp, Mus musculus
cgggagggctacacttgcgactgct

SEQ ID NO: 608975 - DNA, 25 bp, Mus musculus
cgggagggctactcttgcgactgct

SEQ ID NO: 608976 - DNA, 25 bp, Mus musculus
cgggaggggcatcgccccaacacta

SEQ ID NO: 608977 - DNA, 25 bp, Mus musculus
cgggaggggcatggccccaacacta

SEQ ID NO: 608978 - DNA, 25 bp, Mus musculus
cgggaggtaagtaggacctctgtat

SEQ ID NO: 608979 - DNA, 25 bp, Mus musculus
cgggaggtaagttggacctctgtat

SEQ ID NO: 608980 - DNA, 25 bp, Mus musculus
cgggagtccgagcaacccatgatct

SEQ ID NO: 608981 - DNA, 25 bp, Mus musculus
cgggagtccgaggaacccatgatct

SEQ ID NO: 608982 - DNA, 25 bp, Mus musculus
cgggagttggtcactaaagacaagc

SEQ ID NO: 608983 - DNA, 25 bp, Mus musculus
cgggagttggtctctaaagacaagc

SEQ ID NO: 608984 - DNA, 25 bp, Mus musculus
cgggagttgtcgactataagaataa

SEQ ID NO: 608985 - DNA, 25 bp, Mus musculus
cgggagttgtcgtctataagaataa

SEQ ID NO: 608986 - DNA, 25 bp, Mus musculus
cgggatactcttcggcgcgtgctta

SEQ ID NO: 608987 - DNA, 25 bp, Mus musculus
cgggatactcttgggcgcgtgctta

SEQ ID NO: 608988 - DNA, 25 bp, Mus musculus
cgggatagaaaaacaatgtccgtct

SEQ ID NO: 608989 - DNA, 25 bp, Mus musculus
cgggatagaaaatcaatgtccgtct

SEQ ID NO: 608990 - DNA, 25 bp, Mus musculus
cgggatatccttacactctgcatgg

SEQ ID NO: 608991 - DNA, 25 bp, Mus musculus
cgggatatcctttcactctgcatgg

SEQ ID NO: 608992 - DNA, 25 bp, Mus musculus
cgggatatctctctctaaaggaata

SEQ ID NO: 608993 - DNA, 25 bp, Mus musculus
cgggatatctctgtctaaaggaata

SEQ ID NO: 608994 - DNA, 25 bp, Mus musculus
cgggatatgttactgtccggcagca

SEQ ID NO: 608995 - DNA, 25 bp, Mus musculus
cgggatatgttagtgtccggcagca

SEQ ID NO: 608996 - DNA, 25 bp, Mus musculus
cgggatattatactcgcacttaaaa

SEQ ID NO: 608997 - DNA, 25 bp, Mus musculus
cgggatattatagtcgcacttaaaa

SEQ ID NO: 608998 - DNA, 25 bp, Mus musculus
cgggatcagaccaagtcaattgttg

SEQ ID NO: 608999 - DNA, 25 bp, Mus musculus
cgggatcagacctagtcaattgttg

SEQ ID NO: 609000 - DNA, 25 bp, Mus musculus
cgggatcctccgaggaggtctcccg

SEQ ID NO: 609001 - DNA, 25 bp, Mus musculus
cgggatcctccgtggaggtctcccg

SEQ ID NO: 609002 - DNA, 25 bp, Mus musculus
cgggatcctcggctcttaaagtcac

SEQ ID NO: 609003 - DNA, 25 bp, Mus musculus
cgggatcctcgggtcttaaagtcac

SEQ ID NO: 609004 - DNA, 25 bp, Mus musculus
cgggatcgtactcagagtgagaccc

SEQ ID NO: 609005 - DNA, 25 bp, Mus musculus
cgggatcgtactgagagtgagaccc

SEQ ID NO: 609006 - DNA, 25 bp, Mus musculus
cgggatggacgaacaatccaggatg

SEQ ID NO: 609007 - DNA, 25 bp, Mus musculus
cgggatggacgatcaatccaggatg

SEQ ID NO: 609008 - DNA, 25 bp, Mus musculus
cgggatggcactaccgggcgtccta

SEQ ID NO: 609009 - DNA, 25 bp, Mus musculus
cgggatggcacttccgggcgtccta

SEQ ID NO: 609010 - DNA, 25 bp, Mus musculus
cgggatggcgacagttccacggccc

SEQ ID NO: 609011 - DNA, 25 bp, Mus musculus
cgggatggcgactgttccacggccc

SEQ ID NO: 609012 - DNA, 25 bp, Mus musculus
cgggatgtccagcaaatttttcgca

SEQ ID NO: 609013 - DNA, 25 bp, Mus musculus
cgggatgtccaggaaatttttcgca

SEQ ID NO: 609014 - DNA, 25 bp, Mus musculus
cgggatgtgctgcattgtcgcttcc

SEQ ID NO: 609015 - DNA, 25 bp, Mus musculus
cgggatgtgctggattgtcgcttcc

SEQ ID NO: 609016 - DNA, 25 bp, Mus musculus
cgggattaactaatgaggagattgt

SEQ ID NO: 609017 - DNA, 25 bp, Mus musculus
cgggattaactattgaggagattgt

SEQ ID NO: 609018 - DNA, 25 bp, Mus musculus
cgggattgccctacctggacatggt

SEQ ID NO: 609019 - DNA, 25 bp, Mus musculus
cgggattgcccttcctggacatggt

SEQ ID NO: 609020 - DNA, 25 bp, Mus musculus
cgggatttctaccagctgatgtaaa

SEQ ID NO: 609021 - DNA, 25 bp, Mus musculus
cgggatttctacgagctgatgtaaa

SEQ ID NO: 609022 - DNA, 25 bp, Mus musculus
cgggcaaatgcgagcagtaagtcga

SEQ ID NO: 609023 - DNA, 25 bp, Mus musculus
cgggcaaatgcgtgcagtaagtcga

SEQ ID NO: 609024 - DNA, 25 bp, Mus musculus
cgggcaacaccaccaccgattttga

SEQ ID NO: 609025 - DNA, 25 bp, Mus musculus
cgggcaacaccagcaccgattttga

SEQ ID NO: 609026 - DNA, 25 bp, Mus musculus
cgggcaagaaagatacagcgcttct

SEQ ID NO: 609027 - DNA, 25 bp, Mus musculus
cgggcaagaaagttacagcgcttct

SEQ ID NO: 609028 - DNA, 25 bp, Mus musculus
cgggcaaggtgcatcggctgcacat

SEQ ID NO: 609029 - DNA, 25 bp, Mus musculus
cgggcaaggtgcttcggctgcacat

SEQ ID NO: 609030 - DNA, 25 bp, Mus musculus
cgggcaatactaccaccgactttga

SEQ ID NO: 609031 - DNA, 25 bp, Mus musculus
cgggcaatactagcaccgactttga

SEQ ID NO: 609032 - DNA, 25 bp, Mus musculus
cgggcaccacgaaggtgcatgcact

SEQ ID NO: 609033 - DNA, 25 bp, Mus musculus
cgggcaccacgatggtgcatgcact

SEQ ID NO: 609034 - DNA, 25 bp, Mus musculus
cgggcacctatgaggtcagattctt

SEQ ID NO: 609035 - DNA, 25 bp, Mus musculus
cgggcacctatgtggtcagattctt

SEQ ID NO: 609036 - DNA, 25 bp, Mus musculus
cgggcacctcaaattccagattgag

SEQ ID NO: 609037 - DNA, 25 bp, Mus musculus
cgggcacctcaatttccagattgag

SEQ ID NO: 609038 - DNA, 25 bp, Mus musculus
cgggcacgggctaggtagccggaga

SEQ ID NO: 609039 - DNA, 25 bp, Mus musculus
cgggcacgggcttggtagccggaga

SEQ ID NO: 609040 - DNA, 25 bp, Mus musculus
cgggcacgttcgatatcgtattcct

SEQ ID NO: 609041 - DNA, 25 bp, Mus musculus
cgggcacgttcgttatcgtattcct

SEQ ID NO: 609042 - DNA, 25 bp, Mus musculus
cgggcactctctcgcgctgagactt

SEQ ID NO: 609043 - DNA, 25 bp, Mus musculus
cgggcactctctggcgctgagactt

SEQ ID NO: 609044 - DNA, 25 bp, Mus musculus
cgggcagaagaaaccctgctgagat

SEQ ID NO: 609045 - DNA, 25 bp, Mus musculus
cgggcagaagaatccctgctgagat

SEQ ID NO: 609046 - DNA, 25 bp, Mus musculus
cgggcagagtgaaataccagatcaa

SEQ ID NO: 609047 - DNA, 25 bp, Mus musculus
cgggcagagtgatataccagatcaa

SEQ ID NO: 609048 - DNA, 25 bp, Mus musculus
cgggcagatttacagaatgagatgc

SEQ ID NO: 609049 - DNA, 25 bp, Mus musculus
cgggcagatttagagaatgagatgc

SEQ ID NO: 609050 - DNA, 25 bp, Mus musculus
cgggcagcaggaagctgcttcaagc

SEQ ID NO: 609051 - DNA, 25 bp, Mus musculus
cgggcagcaggatgctgcttcaagc

SEQ ID NO: 609052 - DNA, 25 bp, Mus musculus
cgggcagccacacgctcttcgtgga

SEQ ID NO: 609053 - DNA, 25 bp, Mus musculus
cgggcagccacaggctcttcgtgga

SEQ ID NO: 609054 - DNA, 25 bp, Mus musculus
cgggcagcgaacagtgcctacagca

SEQ ID NO: 609055 - DNA, 25 bp, Mus musculus
cgggcagcgaactgtgcctacagca

SEQ ID NO: 609056 - DNA, 25 bp, Mus musculus
cgggcagctcatcccatcctaggag

SEQ ID NO: 609057 - DNA, 25 bp, Mus musculus
cgggcagctcatgccatcctaggag

SEQ ID NO: 609058 - DNA, 25 bp, Mus musculus
cgggcaggtgaacatctccattggg

SEQ ID NO: 609059 - DNA, 25 bp, Mus musculus
cgggcaggtgaagatctccattggg

SEQ ID NO: 609060 - DNA, 25 bp, Mus musculus
cgggcagtcgccagtctaaggagct

SEQ ID NO: 609061 - DNA, 25 bp, Mus musculus
cgggcagtcgcctgtctaaggagct

SEQ ID NO: 609062 - DNA, 25 bp, Mus musculus
cgggcataatgcaaacaatctagaa

SEQ ID NO: 609063 - DNA, 25 bp, Mus musculus
cgggcataatgctaacaatctagaa

SEQ ID NO: 609064 - DNA, 25 bp, Mus musculus
cgggcatcccagagaaccataggat

SEQ ID NO: 609065 - DNA, 25 bp, Mus musculus
cgggcatcccagtgaaccataggat

SEQ ID NO: 609066 - DNA, 25 bp, Mus musculus
cgggcatcgcagctaaccttgtcaa

SEQ ID NO: 609067 - DNA, 25 bp, Mus musculus
cgggcatcgcaggtaaccttgtcaa

SEQ ID NO: 609068 - DNA, 25 bp, Mus musculus
cgggcatcgtcgaggtggtcagcaa

SEQ ID NO: 609069 - DNA, 25 bp, Mus musculus
cgggcatcgtcgtggtggtcagcaa

SEQ ID NO: 609070 - DNA, 25 bp, Mus musculus
cgggcatgtttaaggaactctggaa

SEQ ID NO: 609071 - DNA, 25 bp, Mus musculus
cgggcatgtttatggaactctggaa

SEQ ID NO: 609072 - DNA, 25 bp, Mus musculus
cgggccaccggcaaacactacggag

SEQ ID NO: 609073 - DNA, 25 bp, Mus musculus
cgggccaccggctaacactacggag

SEQ ID NO: 609074 - DNA, 25 bp, Mus musculus
cgggccacctggaccgatcatctta

SEQ ID NO: 609075 - DNA, 25 bp, Mus musculus
cgggccacctggtccgatcatctta

SEQ ID NO: 609076 - DNA, 25 bp, Mus musculus
cgggccagattaagtaacttagcac

SEQ ID NO: 609077 - DNA, 25 bp, Mus musculus
cgggccagattatgtaacttagcac

SEQ ID NO: 609078 - DNA, 25 bp, Mus musculus
cgggccaggccgcagatctagactc

SEQ ID NO: 609079 - DNA, 25 bp, Mus musculus
cgggccaggccggagatctagactc

SEQ ID NO: 609080 - DNA, 25 bp, Mus musculus
cgggccatcgccatcaagtgtggca

SEQ ID NO: 609081 - DNA, 25 bp, Mus musculus
cgggccatcgccttcaagtgtggca

SEQ ID NO: 609082 - DNA, 25 bp, Mus musculus
cgggccatgagccagtaccacatgg

SEQ ID NO: 609083 - DNA, 25 bp, Mus musculus
cgggccatgagcgagtaccacatgg

SEQ ID NO: 609084 - DNA, 25 bp, Mus musculus
cgggcccatggaagacaaaagagag

SEQ ID NO: 609085 - DNA, 25 bp, Mus musculus
cgggcccatggatgacaaaagagag

SEQ ID NO: 609086 - DNA, 25 bp, Mus musculus
cgggcccctcatccactggtgatga

SEQ ID NO: 609087 - DNA, 25 bp, Mus musculus
cgggcccctcatgcactggtgatga

SEQ ID NO: 609088 - DNA, 25 bp, Mus musculus
cgggccctgaggacaatttacacga

SEQ ID NO: 609089 - DNA, 25 bp, Mus musculus
cgggccctgaggtcaatttacacga

SEQ ID NO: 609090 - DNA, 25 bp, Mus musculus
cgggccctgtgcaatctgaagatgc

SEQ ID NO: 609091 - DNA, 25 bp, Mus musculus
cgggccctgtgctatctgaagatgc

SEQ ID NO: 609092 - DNA, 25 bp, Mus musculus
cgggccgagcacagtgtgaacacgc

SEQ ID NO: 609093 - DNA, 25 bp, Mus musculus
cgggccgagcactgtgtgaacacgc

SEQ ID NO: 609094 - DNA, 25 bp, Mus musculus
cgggccggaggacaaaaacatcatt

SEQ ID NO: 609095 - DNA, 25 bp, Mus musculus
cgggccggaggagaaaaacatcatt

SEQ ID NO: 609096 - DNA, 25 bp, Mus musculus
cgggccgggcatcaaggtacttctc

SEQ ID NO: 609097 - DNA, 25 bp, Mus musculus
cgggccgggcatgaaggtacttctc

SEQ ID NO: 609098 - DNA, 25 bp, Mus musculus
cgggccgtaggcctgactcctcaga

SEQ ID NO: 609099 - DNA, 25 bp, Mus musculus
cgggccgtaggcgtgactcctcaga

SEQ ID NO: 609100 - DNA, 25 bp, Mus musculus
cgggcctacatcatggacgtgctga

SEQ ID NO: 609101 - DNA, 25 bp, Mus musculus
cgggcctacatcttggacgtgctga

SEQ ID NO: 609102 - DNA, 25 bp, Mus musculus
cgggcctaggcacgatccctaatct

SEQ ID NO: 609103 - DNA, 25 bp, Mus musculus
cgggcctaggcaggatccctaatct

SEQ ID NO: 609104 - DNA, 25 bp, Mus musculus
cgggcctatagacatcacatatcga

SEQ ID NO: 609105 - DNA, 25 bp, Mus musculus
cgggcctatagagatcacatatcga

SEQ ID NO: 609106 - DNA, 25 bp, Mus musculus
cgggcctccactagcaggatgctgc

SEQ ID NO: 609107 - DNA, 25 bp, Mus musculus
cgggcctccacttgcaggatgctgc

SEQ ID NO: 609108 - DNA, 25 bp, Mus musculus
cgggcctcgacaaggaagacgacga

SEQ ID NO: 609109 - DNA, 25 bp, Mus musculus
cgggcctcgacatggaagacgacga

SEQ ID NO: 609110 - DNA, 25 bp, Mus musculus
cgggcctgccatacctaatggacaa

SEQ ID NO: 609111 - DNA, 25 bp, Mus musculus
cgggcctgccattcctaatggacaa

SEQ ID NO: 609112 - DNA, 25 bp, Mus musculus
cgggcctgtgagcatctttggatat

SEQ ID NO: 609113 - DNA, 25 bp, Mus musculus
cgggcctgtgaggatctttggatat

SEQ ID NO: 609114 - DNA, 25 bp, Mus musculus
cgggccttcggacaagctgcctcag

SEQ ID NO: 609115 - DNA, 25 bp, Mus musculus
cgggccttcggagaagctgcctcag

SEQ ID NO: 609116 - DNA, 25 bp, Mus musculus
cgggcctttgcacgaaccggtctgt

SEQ ID NO: 609117 - DNA, 25 bp, Mus musculus
cgggcctttgcaggaaccggtctgt

SEQ ID NO: 609118 - DNA, 25 bp, Mus musculus
cgggcgaagtgaataccatgggctt

SEQ ID NO: 609119 - DNA, 25 bp, Mus musculus
cgggcgaagtgattaccatgggctt

SEQ ID NO: 609120 - DNA, 25 bp, Mus musculus
cgggcgaccccaagtggagtcaatt

SEQ ID NO: 609121 - DNA, 25 bp, Mus musculus
cgggcgaccccatgtggagtcaatt

SEQ ID NO: 609122 - DNA, 25 bp, Mus musculus
cgggcgactcctctctaagaaaagg

SEQ ID NO: 609123 - DNA, 25 bp, Mus musculus
cgggcgactcctgtctaagaaaagg

SEQ ID NO: 609124 - DNA, 25 bp, Mus musculus
cgggcgcagatgaacgagacattct

SEQ ID NO: 609125 - DNA, 25 bp, Mus musculus
cgggcgcagatgtacgagacattct

SEQ ID NO: 609126 - DNA, 25 bp, Mus musculus
cgggcgcaggacacgggtagaaggg

SEQ ID NO: 609127 - DNA, 25 bp, Mus musculus
cgggcgcaggactcgggtagaaggg

SEQ ID NO: 609128 - DNA, 25 bp, Mus musculus
cgggcgcctgtcatgaacacatggt

SEQ ID NO: 609129 - DNA, 25 bp, Mus musculus
cgggcgcctgtcttgaacacatggt

SEQ ID NO: 609130 - DNA, 25 bp, Mus musculus
cgggcgctgcgcatcctggagaagg

SEQ ID NO: 609131 - DNA, 25 bp, Mus musculus
cgggcgctgcgcttcctggagaagg

SEQ ID NO: 609132 - DNA, 25 bp, Mus musculus
cgggcggcctcgctgaactacttaa

SEQ ID NO: 609133 - DNA, 25 bp, Mus musculus
cgggcggcctcggtgaactacttaa

SEQ ID NO: 609134 - DNA, 25 bp, Mus musculus
cgggcgggtgcgaggtggactctga

SEQ ID NO: 609135 - DNA, 25 bp, Mus musculus
cgggcgggtgcgtggtggactctga

SEQ ID NO: 609136 - DNA, 25 bp, Mus musculus
cgggcgtgctcaacaccttggaaaa

SEQ ID NO: 609137 - DNA, 25 bp, Mus musculus
cgggcgtgctcatcaccttggaaaa

SEQ ID NO: 609138 - DNA, 25 bp, Mus musculus
cgggctagcgaaaggcggcggaatg

SEQ ID NO: 609139 - DNA, 25 bp, Mus musculus
cgggctagcgaatggcggcggaatg

SEQ ID NO: 609140 - DNA, 25 bp, Mus musculus
cgggctcagctgagaggatttggga

SEQ ID NO: 609141 - DNA, 25 bp, Mus musculus
cgggctcagctgtgaggatttggga

SEQ ID NO: 609142 - DNA, 25 bp, Mus musculus
cgggctcatttgagcagggattctc

SEQ ID NO: 609143 - DNA, 25 bp, Mus musculus
cgggctcatttgtgcagggattctc

SEQ ID NO: 609144 - DNA, 25 bp, Mus musculus
cgggctccgataaggcttccggcgt

SEQ ID NO: 609145 - DNA, 25 bp, Mus musculus
cgggctccgatatggcttccggcgt

SEQ ID NO: 609146 - DNA, 25 bp, Mus musculus
cgggctccggaacatgaactgcatt

SEQ ID NO: 609147 - DNA, 25 bp, Mus musculus
cgggctccggaagatgaactgcatt

SEQ ID NO: 609148 - DNA, 25 bp, Mus musculus
cgggctccgtccagtgtctgcagta

SEQ ID NO: 609149 - DNA, 25 bp, Mus musculus
cgggctccgtcctgtgtctgcagta

SEQ ID NO: 609150 - DNA, 25 bp, Mus musculus
cgggctcgctttcgagaccgaataa

SEQ ID NO: 609151 - DNA, 25 bp, Mus musculus
cgggctcgctttggagaccgaataa

SEQ ID NO: 609152 - DNA, 25 bp, Mus musculus
cgggctctaaagagatgaatccaat

SEQ ID NO: 609153 - DNA, 25 bp, Mus musculus
cgggctctaaagtgatgaatccaat

SEQ ID NO: 609154 - DNA, 25 bp, Mus musculus
cgggctctcagtccgattcttgaca

SEQ ID NO: 609155 - DNA, 25 bp, Mus musculus
cgggctctcagtgcgattcttgaca

SEQ ID NO: 609156 - DNA, 25 bp, Mus musculus
cgggctctctctccatacgaaaatg

SEQ ID NO: 609157 - DNA, 25 bp, Mus musculus
cgggctctctctgcatacgaaaatg

SEQ ID NO: 609158 - DNA, 25 bp, Mus musculus
cgggctcttttgatggctgcatcag

SEQ ID NO: 609159 - DNA, 25 bp, Mus musculus
cgggctcttttgttggctgcatcag

SEQ ID NO: 609160 - DNA, 25 bp, Mus musculus
cgggctgaacacactgcgcataaat

SEQ ID NO: 609161 - DNA, 25 bp, Mus musculus
cgggctgaacactctgcgcataaat

SEQ ID NO: 609162 - DNA, 25 bp, Mus musculus
cgggctgactcactccgttgtgata

SEQ ID NO: 609163 - DNA, 25 bp, Mus musculus
cgggctgactcagtccgttgtgata

SEQ ID NO: 609164 - DNA, 25 bp, Mus musculus
cgggctgcaggaagtacaacgtcaa

SEQ ID NO: 609165 - DNA, 25 bp, Mus musculus
cgggctgcaggatgtacaacgtcaa

SEQ ID NO: 609166 - DNA, 25 bp, Mus musculus
cgggctgccttaagggattcgccaa

SEQ ID NO: 609167 - DNA, 25 bp, Mus musculus
cgggctgccttatgggattcgccaa

SEQ ID NO: 609168 - DNA, 25 bp, Mus musculus
cgggctgctcggagctcgcagtcct

SEQ ID NO: 609169 - DNA, 25 bp, Mus musculus
cgggctgctcggtgctcgcagtcct

SEQ ID NO: 609170 - DNA, 25 bp, Mus musculus
cgggctgctgaacaggcgttttcac

SEQ ID NO: 609171 - DNA, 25 bp, Mus musculus
cgggctgctgaagaggcgttttcac

SEQ ID NO: 609172 - DNA, 25 bp, Mus musculus
cgggctggcttaaacctgcctggcc

SEQ ID NO: 609173 - DNA, 25 bp, Mus musculus
cgggctggcttatacctgcctggcc

SEQ ID NO: 609174 - DNA, 25 bp, Mus musculus
cgggctggtgcaacttcatctacaa

SEQ ID NO: 609175 - DNA, 25 bp, Mus musculus
cgggctggtgcatcttcatctacaa

SEQ ID NO: 609176 - DNA, 25 bp, Mus musculus
cgggctgtggaaagtttcctccgag

SEQ ID NO: 609177 - DNA, 25 bp, Mus musculus
cgggctgtggaatgtttcctccgag

SEQ ID NO: 609178 - DNA, 25 bp, Mus musculus
cgggcttcagtcagcactcagccat

SEQ ID NO: 609179 - DNA, 25 bp, Mus musculus
cgggcttcagtctgcactcagccat

SEQ ID NO: 609180 - DNA, 25 bp, Mus musculus
cgggcttccaggactgcggctctga

SEQ ID NO: 609181 - DNA, 25 bp, Mus musculus
cgggcttccaggtctgcggctctga

SEQ ID NO: 609182 - DNA, 25 bp, Mus musculus
cgggcttcccaaatgtgttctgtct

SEQ ID NO: 609183 - DNA, 25 bp, Mus musculus
cgggcttcccaattgtgttctgtct

SEQ ID NO: 609184 - DNA, 25 bp, Mus musculus
cgggcttggtcaatggtgtgctggt

SEQ ID NO: 609185 - DNA, 25 bp, Mus musculus
cgggcttggtcattggtgtgctggt

SEQ ID NO: 609186 - DNA, 25 bp, Mus musculus
cgggggccagacagcctcctttgca

SEQ ID NO: 609187 - DNA, 25 bp, Mus musculus
cgggggccagactgcctcctttgca

SEQ ID NO: 609188 - DNA, 25 bp, Mus musculus
cgggtaaaacgtcatcgctggagat

SEQ ID NO: 609189 - DNA, 25 bp, Mus musculus
cgggtaaaacgtgatcgctggagat

SEQ ID NO: 609190 - DNA, 25 bp, Mus musculus
cgggtaaaggctcaagggcatttct

SEQ ID NO: 609191 - DNA, 25 bp, Mus musculus
cgggtaaaggctgaagggcatttct

SEQ ID NO: 609192 - DNA, 25 bp, Mus musculus
cgggtaattctaacgggatatcctt

SEQ ID NO: 609193 - DNA, 25 bp, Mus musculus
cgggtaattctatcgggatatcctt

SEQ ID NO: 609194 - DNA, 25 bp, Mus musculus
cgggtacagcacatggacctgtcga

SEQ ID NO: 609195 - DNA, 25 bp, Mus musculus
cgggtacagcacttggacctgtcga

SEQ ID NO: 609196 - DNA, 25 bp, Mus musculus
cgggtaccgcctctttccaggactg

SEQ ID NO: 609197 - DNA, 25 bp, Mus musculus
cgggtaccgcctgtttccaggactg

SEQ ID NO: 609198 - DNA, 25 bp, Mus musculus
cgggtacctacaccggaggcaacaa

SEQ ID NO: 609199 - DNA, 25 bp, Mus musculus
cgggtacctacagcggaggcaacaa

SEQ ID NO: 609200 - DNA, 25 bp, Mus musculus
cgggtcaaggataggtggttcacct

SEQ ID NO: 609201 - DNA, 25 bp, Mus musculus
cgggtcaaggattggtggttcacct

SEQ ID NO: 609202 - DNA, 25 bp, Mus musculus
cgggtcacagacacctgcgtagtgg

SEQ ID NO: 609203 - DNA, 25 bp, Mus musculus
cgggtcacagactcctgcgtagtgg

SEQ ID NO: 609204 - DNA, 25 bp, Mus musculus
cgggtcacagtgaaacatctagaag

SEQ ID NO: 609205 - DNA, 25 bp, Mus musculus
cgggtcacagtgtaacatctagaag

SEQ ID NO: 609206 - DNA, 25 bp, Mus musculus
cgggtcaccatccaggaactcacag

SEQ ID NO: 609207 - DNA, 25 bp, Mus musculus
cgggtcaccatcgaggaactcacag

SEQ ID NO: 609208 - DNA, 25 bp, Mus musculus
cgggtcatctctacttggatccttc

SEQ ID NO: 609209 - DNA, 25 bp, Mus musculus
cgggtcatctcttcttggatccttc

SEQ ID NO: 609210 - DNA, 25 bp, Mus musculus
cgggtcatttgtccactgttcagtt

SEQ ID NO: 609211 - DNA, 25 bp, Mus musculus
cgggtcatttgtgcactgttcagtt

SEQ ID NO: 609212 - DNA, 25 bp, Mus musculus
cgggtcctgcgacagaggcttcaca

SEQ ID NO: 609213 - DNA, 25 bp, Mus musculus
cgggtcctgcgagagaggcttcaca

SEQ ID NO: 609214 - DNA, 25 bp, Mus musculus
cgggtcctgctgagctccatttggt

SEQ ID NO: 609215 - DNA, 25 bp, Mus musculus
cgggtcctgctgtgctccatttggt

SEQ ID NO: 609216 - DNA, 25 bp, Mus musculus
cgggtcgcggtgactcccagcagca

SEQ ID NO: 609217 - DNA, 25 bp, Mus musculus
cgggtcgcggtgtctcccagcagca

SEQ ID NO: 609218 - DNA, 25 bp, Mus musculus
cgggtcggactcagctctcgggctc

SEQ ID NO: 609219 - DNA, 25 bp, Mus musculus
cgggtcggactctgctctcgggctc

SEQ ID NO: 609220 - DNA, 25 bp, Mus musculus
cgggtcgtgaacaactgggctttcg

SEQ ID NO: 609221 - DNA, 25 bp, Mus musculus
cgggtcgtgaactactgggctttcg

SEQ ID NO: 609222 - DNA, 25 bp, Mus musculus
cgggtctacaccctccgagcagaga

SEQ ID NO: 609223 - DNA, 25 bp, Mus musculus
cgggtctacaccgtccgagcagaga

SEQ ID NO: 609224 - DNA, 25 bp, Mus musculus
cgggtctccttgcagctcttcgaat

SEQ ID NO: 609225 - DNA, 25 bp, Mus musculus
cgggtctccttggagctcttcgaat

SEQ ID NO: 609226 - DNA, 25 bp, Mus musculus
cgggtctgcttgcaacagtcattga

SEQ ID NO: 609227 - DNA, 25 bp, Mus musculus
cgggtctgcttggaacagtcattga

SEQ ID NO: 609228 - DNA, 25 bp, Mus musculus
cgggtctggctaagagaaaatggcc

SEQ ID NO: 609229 - DNA, 25 bp, Mus musculus
cgggtctggctatgagaaaatggcc

SEQ ID NO: 609230 - DNA, 25 bp, Mus musculus
cgggtcttaattaccaccctcatca

SEQ ID NO: 609231 - DNA, 25 bp, Mus musculus
cgggtcttaatttccaccctcatca

SEQ ID NO: 609232 - DNA, 25 bp, Mus musculus
cgggtgaacgtgaggccaccagcat

SEQ ID NO: 609233 - DNA, 25 bp, Mus musculus
cgggtgaacgtgtggccaccagcat

SEQ ID NO: 609234 - DNA, 25 bp, Mus musculus
cgggtgactgctccctcaggatgaa

SEQ ID NO: 609235 - DNA, 25 bp, Mus musculus
cgggtgactgctgcctcaggatgaa

SEQ ID NO: 609236 - DNA, 25 bp, Mus musculus
cgggtgataccacttaaagaagtgc

SEQ ID NO: 609237 - DNA, 25 bp, Mus musculus
cgggtgataccagttaaagaagtgc

SEQ ID NO: 609238 - DNA, 25 bp, Mus musculus
cgggtgccatatcagaaaatcagga

SEQ ID NO: 609239 - DNA, 25 bp, Mus musculus
cgggtgccatatgagaaaatcagga

SEQ ID NO: 609240 - DNA, 25 bp, Mus musculus
cgggtgcctctgcatgtctgcctca

SEQ ID NO: 609241 - DNA, 25 bp, Mus musculus
cgggtgcctctggatgtctgcctca

SEQ ID NO: 609242 - DNA, 25 bp, Mus musculus
cgggtgcctgtcaggccacacgctg

SEQ ID NO: 609243 - DNA, 25 bp, Mus musculus
cgggtgcctgtctggccacacgctg

SEQ ID NO: 609244 - DNA, 25 bp, Mus musculus
cgggtgctacttctatgtgggcttc

SEQ ID NO: 609245 - DNA, 25 bp, Mus musculus
cgggtgctacttgtatgtgggcttc

SEQ ID NO: 609246 - DNA, 25 bp, Mus musculus
cgggtgctctacattgatatcgaca

SEQ ID NO: 609247 - DNA, 25 bp, Mus musculus
cgggtgctctactttgatatcgaca

SEQ ID NO: 609248 - DNA, 25 bp, Mus musculus
cgggtgctgaagacttagagattct

SEQ ID NO: 609249 - DNA, 25 bp, Mus musculus
cgggtgctgaagtcttagagattct

SEQ ID NO: 609250 - DNA, 25 bp, Mus musculus
cgggtggactttctaaagctcctga

SEQ ID NO: 609251 - DNA, 25 bp, Mus musculus
cgggtggactttgtaaagctcctga

SEQ ID NO: 609252 - DNA, 25 bp, Mus musculus
cgggtggcaccacctggcaagaaat

SEQ ID NO: 609253 - DNA, 25 bp, Mus musculus
cgggtggcaccagctggcaagaaat

SEQ ID NO: 609254 - DNA, 25 bp, Mus musculus
cgggtggcggacaactgtgaaaaca

SEQ ID NO: 609255 - DNA, 25 bp, Mus musculus
cgggtggcggactactgtgaaaaca

SEQ ID NO: 609256 - DNA, 25 bp, Mus musculus
cgggtgggcctcagcccagacagtc

SEQ ID NO: 609257 - DNA, 25 bp, Mus musculus
cgggtgggcctctgcccagacagtc

SEQ ID NO: 609258 - DNA, 25 bp, Mus musculus
cgggtgtccgaaatatcgagatgga

SEQ ID NO: 609259 - DNA, 25 bp, Mus musculus
cgggtgtccgaattatcgagatgga

SEQ ID NO: 609260 - DNA, 25 bp, Mus musculus
cgggtgttactgagaacgttctgcg

SEQ ID NO: 609261 - DNA, 25 bp, Mus musculus
cgggtgttactgtgaacgttctgcg

SEQ ID NO: 609262 - DNA, 25 bp, Mus musculus
cgggtgttctctccggccatgagct

SEQ ID NO: 609263 - DNA, 25 bp, Mus musculus
cgggtgttctctgcggccatgagct

SEQ ID NO: 609264 - DNA, 25 bp, Mus musculus
cgggttaggattccagctccgttga

SEQ ID NO: 609265 - DNA, 25 bp, Mus musculus
cgggttaggattgcagctccgttga

SEQ ID NO: 609266 - DNA, 25 bp, Mus musculus
cgggttatcctaagcagctccagct

SEQ ID NO: 609267 - DNA, 25 bp, Mus musculus
cgggttatcctatgcagctccagct

SEQ ID NO: 609268 - DNA, 25 bp, Mus musculus
cgggttcattcacgagatagtgagc

SEQ ID NO: 609269 - DNA, 25 bp, Mus musculus
cgggttcattcaggagatagtgagc

SEQ ID NO: 609270 - DNA, 25 bp, Mus musculus
cgggttcccgaaacgctcaggagtg

SEQ ID NO: 609271 - DNA, 25 bp, Mus musculus
cgggttcccgaatcgctcaggagtg

SEQ ID NO: 609272 - DNA, 25 bp, Mus musculus
cgggttccgctacactcgtgaacct

SEQ ID NO: 609273 - DNA, 25 bp, Mus musculus
cgggttccgctagactcgtgaacct

SEQ ID NO: 609274 - DNA, 25 bp, Mus musculus
cgggttctcttaaagagcagacaac

SEQ ID NO: 609275 - DNA, 25 bp, Mus musculus
cgggttctcttatagagcagacaac

SEQ ID NO: 609276 - DNA, 25 bp, Mus musculus
cgggttgctggaaaacatccccaga

SEQ ID NO: 609277 - DNA, 25 bp, Mus musculus
cgggttgctggataacatccccaga

SEQ ID NO: 609278 - DNA, 25 bp, Mus musculus
cgggttgtctcaaccgagagaggcc

SEQ ID NO: 609279 - DNA, 25 bp, Mus musculus
cgggttgtctcatccgagagaggcc

SEQ ID NO: 609280 - DNA, 25 bp, Mus musculus
cggtaaaaataacgcagacaagaag

SEQ ID NO: 609281 - DNA, 25 bp, Mus musculus
cggtaaaaataaggcagacaagaag

SEQ ID NO: 609282 - DNA, 25 bp, Mus musculus
cggtaaatcctgcaagccaatccca

SEQ ID NO: 609283 - DNA, 25 bp, Mus musculus
cggtaaatcctggaagccaatccca

SEQ ID NO: 609284 - DNA, 25 bp, Mus musculus
cggtaaccgagacccggtgtctgct

SEQ ID NO: 609285 - DNA, 25 bp, Mus musculus
cggtaaccgagagccggtgtctgct

SEQ ID NO: 609286 - DNA, 25 bp, Mus musculus
cggtaagagactcaagaagaagaag

SEQ ID NO: 609287 - DNA, 25 bp, Mus musculus
cggtaagagactgaagaagaagaag

SEQ ID NO: 609288 - DNA, 25 bp, Mus musculus
cggtaaggtgccaaatctgcggagt

SEQ ID NO: 609289 - DNA, 25 bp, Mus musculus
cggtaaggtgcctaatctgcggagt

SEQ ID NO: 609290 - DNA, 25 bp, Mus musculus
cggtaatctcctccgagttgtagct

SEQ ID NO: 609291 - DNA, 25 bp, Mus musculus
cggtaatctcctgcgagttgtagct

SEQ ID NO: 609292 - DNA, 25 bp, Mus musculus
cggtacacagaaaattcacttcggg

SEQ ID NO: 609293 - DNA, 25 bp, Mus musculus
cggtacacagaatattcacttcggg

SEQ ID NO: 609294 - DNA, 25 bp, Mus musculus
cggtacccacggagcagccctgtgg

SEQ ID NO: 609295 - DNA, 25 bp, Mus musculus
cggtacccacggtgcagccctgtgg

SEQ ID NO: 609296 - DNA, 25 bp, Mus musculus
cggtaccctcgaaatgtcatcaaca

SEQ ID NO: 609297 - DNA, 25 bp, Mus musculus
cggtaccctcgatatgtcatcaaca

SEQ ID NO: 609298 - DNA, 25 bp, Mus musculus
cggtacctacgaagatttccatact

SEQ ID NO: 609299 - DNA, 25 bp, Mus musculus
cggtacctacgatgatttccatact

SEQ ID NO: 609300 - DNA, 25 bp, Mus musculus
cggtacctcgtgcttatcgctgaga

SEQ ID NO: 609301 - DNA, 25 bp, Mus musculus
cggtacctcgtggttatcgctgaga

SEQ ID NO: 609302 - DNA, 25 bp, Mus musculus
cggtacctgctgaaggcactggaca

SEQ ID NO: 609303 - DNA, 25 bp, Mus musculus
cggtacctgctgtaggcactggaca

SEQ ID NO: 609304 - DNA, 25 bp, Mus musculus
cggtacgtgagaagatacagtgctc

SEQ ID NO: 609305 - DNA, 25 bp, Mus musculus
cggtacgtgagatgatacagtgctc

SEQ ID NO: 609306 - DNA, 25 bp, Mus musculus
cggtacgtgagtcggcatgcttaca

SEQ ID NO: 609307 - DNA, 25 bp, Mus musculus
cggtacgtgagtgggcatgcttaca

SEQ ID NO: 609308 - DNA, 25 bp, Mus musculus
cggtacgtgcaacagaagatcgtgc

SEQ ID NO: 609309 - DNA, 25 bp, Mus musculus
cggtacgtgcaagagaagatcgtgc

SEQ ID NO: 609310 - DNA, 25 bp, Mus musculus
cggtactgggagcttttcagctgca

SEQ ID NO: 609311 - DNA, 25 bp, Mus musculus
cggtactgggaggttttcagctgca

SEQ ID NO: 609312 - DNA, 25 bp, Mus musculus
cggtagagtacaagttctcaaaaga

SEQ ID NO: 609313 - DNA, 25 bp, Mus musculus
cggtagagtacatgttctcaaaaga

SEQ ID NO: 609314 - DNA, 25 bp, Mus musculus
cggtagccgcggcaatggactttct

SEQ ID NO: 609315 - DNA, 25 bp, Mus musculus
cggtagccgcgggaatggactttct

SEQ ID NO: 609316 - DNA, 25 bp, Mus musculus
cggtatggctctccaagatctgcct

SEQ ID NO: 609317 - DNA, 25 bp, Mus musculus
cggtatggctctgcaagatctgcct

SEQ ID NO: 609318 - DNA, 25 bp, Mus musculus
cggtattgaggacatgattggctat

SEQ ID NO: 609319 - DNA, 25 bp, Mus musculus
cggtattgaggagatgattggctat

SEQ ID NO: 609320 - DNA, 25 bp, Mus musculus
cggtattttattctaccagacagct

SEQ ID NO: 609321 - DNA, 25 bp, Mus musculus
cggtattttattgtaccagacagct

SEQ ID NO: 609322 - DNA, 25 bp, Mus musculus
cggtattttcgaatgccagagctga

SEQ ID NO: 609323 - DNA, 25 bp, Mus musculus
cggtattttcgattgccagagctga

SEQ ID NO: 609324 - DNA, 25 bp, Mus musculus
cggtcaacagacagtgttcatcggg

SEQ ID NO: 609325 - DNA, 25 bp, Mus musculus
cggtcaacagactgtgttcatcggg

SEQ ID NO: 609326 - DNA, 25 bp, Mus musculus
cggtcaaggagtagaattcttctgg

SEQ ID NO: 609327 - DNA, 25 bp, Mus musculus
cggtcaaggagttgaattcttctgg

SEQ ID NO: 609328 - DNA, 25 bp, Mus musculus
cggtcaaggatactgcttttctgct

SEQ ID NO: 609329 - DNA, 25 bp, Mus musculus
cggtcaaggatagtgcttttctgct

SEQ ID NO: 609330 - DNA, 25 bp, Mus musculus
cggtcacacagcaaaagtatctact

SEQ ID NO: 609331 - DNA, 25 bp, Mus musculus
cggtcacacagctaaagtatctact

SEQ ID NO: 609332 - DNA, 25 bp, Mus musculus
cggtcactgctgctcgcttcctgag

SEQ ID NO: 609333 - DNA, 25 bp, Mus musculus
cggtcactgctggtcgcttcctgag

SEQ ID NO: 609334 - DNA, 25 bp, Mus musculus
cggtcactggaaacctgcagaccca

SEQ ID NO: 609335 - DNA, 25 bp, Mus musculus
cggtcactggaatcctgcagaccca

SEQ ID NO: 609336 - DNA, 25 bp, Mus musculus
cggtcagaatagagatgtttcgaaa

SEQ ID NO: 609337 - DNA, 25 bp, Mus musculus
cggtcagaatagtgatgtttcgaaa

SEQ ID NO: 609338 - DNA, 25 bp, Mus musculus
cggtcagaatgacagagtcaagctg

SEQ ID NO: 609339 - DNA, 25 bp, Mus musculus
cggtcagaatgagagagtcaagctg

SEQ ID NO: 609340 - DNA, 25 bp, Mus musculus
cggtcagctgcccaaccttgatctg

SEQ ID NO: 609341 - DNA, 25 bp, Mus musculus
cggtcagctgccgaaccttgatctg

SEQ ID NO: 609342 - DNA, 25 bp, Mus musculus
cggtcaggcggtagttcgcaagtct

SEQ ID NO: 609343 - DNA, 25 bp, Mus musculus
cggtcaggcggttgttcgcaagtct

SEQ ID NO: 609344 - DNA, 25 bp, Mus musculus
cggtcagtccaacgtgcctgagtct

SEQ ID NO: 609345 - DNA, 25 bp, Mus musculus
cggtcagtccaaggtgcctgagtct

SEQ ID NO: 609346 - DNA, 25 bp, Mus musculus
cggtcagtgctgagccttgtgctca

SEQ ID NO: 609347 - DNA, 25 bp, Mus musculus
cggtcagtgctgtgccttgtgctca

SEQ ID NO: 609348 - DNA, 25 bp, Mus musculus
cggtcagtgggcacaccaaccggga

SEQ ID NO: 609349 - DNA, 25 bp, Mus musculus
cggtcagtgggctcaccaaccggga

SEQ ID NO: 609350 - DNA, 25 bp, Mus musculus
cggtcatccgacaatgccttgcagg

SEQ ID NO: 609351 - DNA, 25 bp, Mus musculus
cggtcatccgactatgccttgcagg

SEQ ID NO: 609352 - DNA, 25 bp, Mus musculus
cggtcatctatgaggctggtgcctt

SEQ ID NO: 609353 - DNA, 25 bp, Mus musculus
cggtcatctatgtggctggtgcctt

SEQ ID NO: 609354 - DNA, 25 bp, Mus musculus
cggtcattttcaccagtgtgtgtta

SEQ ID NO: 609355 - DNA, 25 bp, Mus musculus
cggtcattttcagcagtgtgtgtta

SEQ ID NO: 609356 - DNA, 25 bp, Mus musculus
cggtccaagaagaatgacgatcaga

SEQ ID NO: 609357 - DNA, 25 bp, Mus musculus
cggtccaagaagtatgacgatcaga

SEQ ID NO: 609358 - DNA, 25 bp, Mus musculus
cggtccagttgactctgaggtccaa

SEQ ID NO: 609359 - DNA, 25 bp, Mus musculus
cggtccagttgagtctgaggtccaa

SEQ ID NO: 609360 - DNA, 25 bp, Mus musculus
cggtcccaccgaagtagcgtctctt

SEQ ID NO: 609361 - DNA, 25 bp, Mus musculus
cggtcccaccgatgtagcgtctctt

SEQ ID NO: 609362 - DNA, 25 bp, Mus musculus
cggtcccgcaggacccggatgttgc

SEQ ID NO: 609363 - DNA, 25 bp, Mus musculus
cggtcccgcaggtcccggatgttgc

SEQ ID NO: 609364 - DNA, 25 bp, Mus musculus
cggtccctaccaacgagtggcaaag

SEQ ID NO: 609365 - DNA, 25 bp, Mus musculus
cggtccctaccatcgagtggcaaag

SEQ ID NO: 609366 - DNA, 25 bp, Mus musculus
cggtccctggctcataactgacatg

SEQ ID NO: 609367 - DNA, 25 bp, Mus musculus
cggtccctggctgataactgacatg

SEQ ID NO: 609368 - DNA, 25 bp, Mus musculus
cggtccgcgactcggagaatgggca

SEQ ID NO: 609369 - DNA, 25 bp, Mus musculus
cggtccgcgactgggagaatgggca

SEQ ID NO: 609370 - DNA, 25 bp, Mus musculus
cggtccggtgttcgtggcggtgact

SEQ ID NO: 609371 - DNA, 25 bp, Mus musculus
cggtccggtgttggtggcggtgact

SEQ ID NO: 609372 - DNA, 25 bp, Mus musculus
cggtcctgacagcagatggctatat

SEQ ID NO: 609373 - DNA, 25 bp, Mus musculus
cggtcctgacaggagatggctatat

SEQ ID NO: 609374 - DNA, 25 bp, Mus musculus
cggtcctgagatctttgcggttgct

SEQ ID NO: 609375 - DNA, 25 bp, Mus musculus
cggtcctgagatgtttgcggttgct

SEQ ID NO: 609376 - DNA, 25 bp, Mus musculus
cggtccttgaaacagatggaagagt

SEQ ID NO: 609377 - DNA, 25 bp, Mus musculus
cggtccttgaaagagatggaagagt

SEQ ID NO: 609378 - DNA, 25 bp, Mus musculus
cggtccttgttcattggaggccaag

SEQ ID NO: 609379 - DNA, 25 bp, Mus musculus
cggtccttgttctttggaggccaag

SEQ ID NO: 609380 - DNA, 25 bp, Mus musculus
cggtcctttgtcagggagccgccat

SEQ ID NO: 609381 - DNA, 25 bp, Mus musculus
cggtcctttgtctgggagccgccat

SEQ ID NO: 609382 - DNA, 25 bp, Mus musculus
cggtcgcagctcacgccttgctgga

SEQ ID NO: 609383 - DNA, 25 bp, Mus musculus
cggtcgcagctctcgccttgctgga

SEQ ID NO: 609384 - DNA, 25 bp, Mus musculus
cggtcgcgtcatattctccgcagtg

SEQ ID NO: 609385 - DNA, 25 bp, Mus musculus
cggtcgcgtcattttctccgcagtg

SEQ ID NO: 609386 - DNA, 25 bp, Mus musculus
cggtcggaaacgctcacctgcggct

SEQ ID NO: 609387 - DNA, 25 bp, Mus musculus
cggtcggaaacggtcacctgcggct

SEQ ID NO: 609388 - DNA, 25 bp, Mus musculus
cggtcggcctcaccgcctatgtgat

SEQ ID NO: 609389 - DNA, 25 bp, Mus musculus
cggtcggcctcagcgcctatgtgat

SEQ ID NO: 609390 - DNA, 25 bp, Mus musculus
cggtcgtggctgcagctacttccga

SEQ ID NO: 609391 - DNA, 25 bp, Mus musculus
cggtcgtggctggagctacttccga

SEQ ID NO: 609392 - DNA, 25 bp, Mus musculus
cggtcgttggccacattcgagtcgt

SEQ ID NO: 609393 - DNA, 25 bp, Mus musculus
cggtcgttggcctcattcgagtcgt

SEQ ID NO: 609394 - DNA, 25 bp, Mus musculus
cggtctaccgacatgacaagaggat

SEQ ID NO: 609395 - DNA, 25 bp, Mus musculus
cggtctaccgacttgacaagaggat

SEQ ID NO: 609396 - DNA, 25 bp, Mus musculus
cggtctacctcccagaaatcactat

SEQ ID NO: 609397 - DNA, 25 bp, Mus musculus
cggtctacctccgagaaatcactat

SEQ ID NO: 609398 - DNA, 25 bp, Mus musculus
cggtctacctgaagctaggaggcaa

SEQ ID NO: 609399 - DNA, 25 bp, Mus musculus
cggtctacctgatgctaggaggcaa

SEQ ID NO: 609400 - DNA, 25 bp, Mus musculus
cggtctagttccagtgagcagcatg

SEQ ID NO: 609401 - DNA, 25 bp, Mus musculus
cggtctagttcctgtgagcagcatg

SEQ ID NO: 609402 - DNA, 25 bp, Mus musculus
cggtctatggagaacatcgagctgg

SEQ ID NO: 609403 - DNA, 25 bp, Mus musculus
cggtctatggagtacatcgagctgg

SEQ ID NO: 609404 - DNA, 25 bp, Mus musculus
cggtctcatcagctgcggccatgga

SEQ ID NO: 609405 - DNA, 25 bp, Mus musculus
cggtctcatcaggtgcggccatgga

SEQ ID NO: 609406 - DNA, 25 bp, Mus musculus
cggtctccagtcatcagtgccatgt

SEQ ID NO: 609407 - DNA, 25 bp, Mus musculus
cggtctccagtcttcagtgccatgt

SEQ ID NO: 609408 - DNA, 25 bp, Mus musculus
cggtctcggcttcaggagaagaatt

SEQ ID NO: 609409 - DNA, 25 bp, Mus musculus
cggtctcggcttgaggagaagaatt

SEQ ID NO: 609410 - DNA, 25 bp, Mus musculus
cggtctctgatacagcggaggcttc

SEQ ID NO: 609411 - DNA, 25 bp, Mus musculus
cggtctctgatagagcggaggcttc

SEQ ID NO: 609412 - DNA, 25 bp, Mus musculus
cggtctgagagtcatgcctccgaca

SEQ ID NO: 609413 - DNA, 25 bp, Mus musculus
cggtctgagagtgatgcctccgaca

SEQ ID NO: 609414 - DNA, 25 bp, Mus musculus
cggtctgagcaacctgtcgtctgga

SEQ ID NO: 609415 - DNA, 25 bp, Mus musculus
cggtctgagcaagctgtcgtctgga

SEQ ID NO: 609416 - DNA, 25 bp, Mus musculus
cggtctgatgcacccagaggaagac

SEQ ID NO: 609417 - DNA, 25 bp, Mus musculus
cggtctgatgcagccagaggaagac

SEQ ID NO: 609418 - DNA, 25 bp, Mus musculus
cggtctgggtctcgtaacctagcga

SEQ ID NO: 609419 - DNA, 25 bp, Mus musculus
cggtctgggtctggtaacctagcga

SEQ ID NO: 609420 - DNA, 25 bp, Mus musculus
cggtcttctcagatgttacggacaa

SEQ ID NO: 609421 - DNA, 25 bp, Mus musculus
cggtcttctcagttgttacggacaa

SEQ ID NO: 609422 - DNA, 25 bp, Mus musculus
cggtcttgactgatttgtggtcttc

SEQ ID NO: 609423 - DNA, 25 bp, Mus musculus
cggtcttgactgttttgtggtcttc

SEQ ID NO: 609424 - DNA, 25 bp, Mus musculus
cggtcttgcggaccggctagggcag

SEQ ID NO: 609425 - DNA, 25 bp, Mus musculus
cggtcttgcggagcggctagggcag

SEQ ID NO: 609426 - DNA, 25 bp, Mus musculus
cggtctttctctacccatggtagag

SEQ ID NO: 609427 - DNA, 25 bp, Mus musculus
cggtctttctcttcccatggtagag

SEQ ID NO: 609428 - DNA, 25 bp, Mus musculus
cggtgaacaatgaggatgctgctgt

SEQ ID NO: 609429 - DNA, 25 bp, Mus musculus
cggtgaacaatgtggatgctgctgt

SEQ ID NO: 609430 - DNA, 25 bp, Mus musculus
cggtgaacgagaaggacatgtgccc

SEQ ID NO: 609431 - DNA, 25 bp, Mus musculus
cggtgaacgagatggacatgtgccc

SEQ ID NO: 609432 - DNA, 25 bp, Mus musculus
cggtgaacgggaaaatgtctccatg

SEQ ID NO: 609433 - DNA, 25 bp, Mus musculus
cggtgaacgggataatgtctccatg

SEQ ID NO: 609434 - DNA, 25 bp, Mus musculus
cggtgaagctgcagggaagctacac

SEQ ID NO: 609435 - DNA, 25 bp, Mus musculus
cggtgaagctgctgggaagctacac

SEQ ID NO: 609436 - DNA, 25 bp, Mus musculus
cggtgaaggctaaggcatcagcgat

SEQ ID NO: 609437 - DNA, 25 bp, Mus musculus
cggtgaaggctatggcatcagcgat

SEQ ID NO: 609438 - DNA, 25 bp, Mus musculus
cggtgaagtctgaaggcatgattgc

SEQ ID NO: 609439 - DNA, 25 bp, Mus musculus
cggtgaagtctgtaggcatgattgc

SEQ ID NO: 609440 - DNA, 25 bp, Mus musculus
cggtgaagtggccaattttgctgca

SEQ ID NO: 609441 - DNA, 25 bp, Mus musculus
cggtgaagtggcgaattttgctgca

SEQ ID NO: 609442 - DNA, 25 bp, Mus musculus
cggtgaatccggcaagagcactatt

SEQ ID NO: 609443 - DNA, 25 bp, Mus musculus
cggtgaatccgggaagagcactatt

SEQ ID NO: 609444 - DNA, 25 bp, Mus musculus
cggtgaatgagcctctcgaacgtgc

SEQ ID NO: 609445 - DNA, 25 bp, Mus musculus
cggtgaatgagcgtctcgaacgtgc

SEQ ID NO: 609446 - DNA, 25 bp, Mus musculus
cggtgacgagtaagatttttacaga

SEQ ID NO: 609447 - DNA, 25 bp, Mus musculus
cggtgacgagtatgatttttacaga

SEQ ID NO: 609448 - DNA, 25 bp, Mus musculus
cggtgactcttaaaaaccacagaga

SEQ ID NO: 609449 - DNA, 25 bp, Mus musculus
cggtgactcttataaaccacagaga

SEQ ID NO: 609450 - DNA, 25 bp, Mus musculus
cggtgagaagcgaccggctgcttcc

SEQ ID NO: 609451 - DNA, 25 bp, Mus musculus
cggtgagaagcgtccggctgcttcc

SEQ ID NO: 609452 - DNA, 25 bp, Mus musculus
cggtgagacttcctggatcacactg

SEQ ID NO: 609453 - DNA, 25 bp, Mus musculus
cggtgagacttcgtggatcacactg

SEQ ID NO: 609454 - DNA, 25 bp, Mus musculus
cggtgagcagatctgtgagatcttc

SEQ ID NO: 609455 - DNA, 25 bp, Mus musculus
cggtgagcagatgtgtgagatcttc

SEQ ID NO: 609456 - DNA, 25 bp, Mus musculus
cggtgaggccaacaaaatggctcct

SEQ ID NO: 609457 - DNA, 25 bp, Mus musculus
cggtgaggccaagaaaatggctcct

SEQ ID NO: 609458 - DNA, 25 bp, Mus musculus
cggtgagtagggagcagacctctcc

SEQ ID NO: 609459 - DNA, 25 bp, Mus musculus
cggtgagtagggtgcagacctctcc

SEQ ID NO: 609460 - DNA, 25 bp, Mus musculus
cggtgagtaggtctacacactggac

SEQ ID NO: 609461 - DNA, 25 bp, Mus musculus
cggtgagtaggtgtacacactggac

SEQ ID NO: 609462 - DNA, 25 bp, Mus musculus
cggtgatcctcaattgtcagttatt

SEQ ID NO: 609463 - DNA, 25 bp, Mus musculus
cggtgatcctcatttgtcagttatt

SEQ ID NO: 609464 - DNA, 25 bp, Mus musculus
cggtgatgaagaatgtgcagagttc

SEQ ID NO: 609465 - DNA, 25 bp, Mus musculus
cggtgatgaagattgtgcagagttc

SEQ ID NO: 609466 - DNA, 25 bp, Mus musculus
cggtgatgcgcaaccgctttgactg

SEQ ID NO: 609467 - DNA, 25 bp, Mus musculus
cggtgatgcgcatccgctttgactg

SEQ ID NO: 609468 - DNA, 25 bp, Mus musculus
cggtgatgctatcgctgcaaaccaa

SEQ ID NO: 609469 - DNA, 25 bp, Mus musculus
cggtgatgctatggctgcaaaccaa

SEQ ID NO: 609470 - DNA, 25 bp, Mus musculus
cggtgatggcagatagcagtgtcct

SEQ ID NO: 609471 - DNA, 25 bp, Mus musculus
cggtgatggcagttagcagtgtcct

SEQ ID NO: 609472 - DNA, 25 bp, Mus musculus
cggtgcaacactccctgtgtatcag

SEQ ID NO: 609473 - DNA, 25 bp, Mus musculus
cggtgcaacactgcctgtgtatcag

SEQ ID NO: 609474 - DNA, 25 bp, Mus musculus
cggtgcaccgtgcaagagccatgtc

SEQ ID NO: 609475 - DNA, 25 bp, Mus musculus
cggtgcaccgtggaagagccatgtc

SEQ ID NO: 609476 - DNA, 25 bp, Mus musculus
cggtgcagagtaaatgaagagagca

SEQ ID NO: 609477 - DNA, 25 bp, Mus musculus
cggtgcagagtatatgaagagagca

SEQ ID NO: 609478 - DNA, 25 bp, Mus musculus
cggtgcaggaaacatgttcacttca

SEQ ID NO: 609479 - DNA, 25 bp, Mus musculus
cggtgcaggaaagatgttcacttca

SEQ ID NO: 609480 - DNA, 25 bp, Mus musculus
cggtgcaggtagcatgtcagtctcc

SEQ ID NO: 609481 - DNA, 25 bp, Mus musculus
cggtgcaggtaggatgtcagtctcc

SEQ ID NO: 609482 - DNA, 25 bp, Mus musculus
cggtgccacaggatacagggtttcc

SEQ ID NO: 609483 - DNA, 25 bp, Mus musculus
cggtgccacaggttacagggtttcc

SEQ ID NO: 609484 - DNA, 25 bp, Mus musculus
cggtgccagggaaacacccggatct

SEQ ID NO: 609485 - DNA, 25 bp, Mus musculus
cggtgccagggatacacccggatct

SEQ ID NO: 609486 - DNA, 25 bp, Mus musculus
cggtgccatcacacctgctggtgca

SEQ ID NO: 609487 - DNA, 25 bp, Mus musculus
cggtgccatcactcctgctggtgca

SEQ ID NO: 609488 - DNA, 25 bp, Mus musculus
cggtgcccacggaagaagcgatgca

SEQ ID NO: 609489 - DNA, 25 bp, Mus musculus
cggtgcccacggtagaagcgatgca

SEQ ID NO: 609490 - DNA, 25 bp, Mus musculus
cggtgcccacgtacacacaggttgg

SEQ ID NO: 609491 - DNA, 25 bp, Mus musculus
cggtgcccacgttcacacaggttgg

SEQ ID NO: 609492 - DNA, 25 bp, Mus musculus
cggtgcccctggcaggaagcgagag

SEQ ID NO: 609493 - DNA, 25 bp, Mus musculus
cggtgcccctgggaggaagcgagag

SEQ ID NO: 609494 - DNA, 25 bp, Mus musculus
cggtgccgaagccaagtaccgcagt

SEQ ID NO: 609495 - DNA, 25 bp, Mus musculus
cggtgccgaagcgaagtaccgcagt

SEQ ID NO: 609496 - DNA, 25 bp, Mus musculus
cggtgcctatggcacggtgtacaaa

SEQ ID NO: 609497 - DNA, 25 bp, Mus musculus
cggtgcctatgggacggtgtacaaa

SEQ ID NO: 609498 - DNA, 25 bp, Mus musculus
cggtgcgccctccttggccagtgaa

SEQ ID NO: 609499 - DNA, 25 bp, Mus musculus
cggtgcgccctcgttggccagtgaa

SEQ ID NO: 609500 - DNA, 25 bp, Mus musculus
cggtgcggcctacgcagtgacaaca

SEQ ID NO: 609501 - DNA, 25 bp, Mus musculus
cggtgcggcctaggcagtgacaaca

SEQ ID NO: 609502 - DNA, 25 bp, Mus musculus
cggtgcgtaacaccccaggagagca

SEQ ID NO: 609503 - DNA, 25 bp, Mus musculus
cggtgcgtaacagcccaggagagca

SEQ ID NO: 609504 - DNA, 25 bp, Mus musculus
cggtgctaccgaagctgtgacccca

SEQ ID NO: 609505 - DNA, 25 bp, Mus musculus
cggtgctaccgatgctgtgacccca

SEQ ID NO: 609506 - DNA, 25 bp, Mus musculus
cggtgctaccttattatagggtgcg

SEQ ID NO: 609507 - DNA, 25 bp, Mus musculus
cggtgctacctttttatagggtgcg

SEQ ID NO: 609508 - DNA, 25 bp, Mus musculus
cggtgctacggaactgggactgtct

SEQ ID NO: 609509 - DNA, 25 bp, Mus musculus
cggtgctacggatctgggactgtct

SEQ ID NO: 609510 - DNA, 25 bp, Mus musculus
cggtgctctggcatggttggttcct

SEQ ID NO: 609511 - DNA, 25 bp, Mus musculus
cggtgctctggcttggttggttcct

SEQ ID NO: 609512 - DNA, 25 bp, Mus musculus
cggtgctcttagcagacatccttcc

SEQ ID NO: 609513 - DNA, 25 bp, Mus musculus
cggtgctcttaggagacatccttcc

SEQ ID NO: 609514 - DNA, 25 bp, Mus musculus
cggtgctgagcgatgtcctacaggc

SEQ ID NO: 609515 - DNA, 25 bp, Mus musculus
cggtgctgagcgttgtcctacaggc

SEQ ID NO: 609516 - DNA, 25 bp, Mus musculus
cggtgctgcaggagaaagcgcttaa

SEQ ID NO: 609517 - DNA, 25 bp, Mus musculus
cggtgctgcaggtgaaagcgcttaa

SEQ ID NO: 609518 - DNA, 25 bp, Mus musculus
cggtgctggcagaacagaaaggaca

SEQ ID NO: 609519 - DNA, 25 bp, Mus musculus
cggtgctggcagtacagaaaggaca

SEQ ID NO: 609520 - DNA, 25 bp, Mus musculus
cggtgctggtggagagcattcctga

SEQ ID NO: 609521 - DNA, 25 bp, Mus musculus
cggtgctggtggtgagcattcctga

SEQ ID NO: 609522 - DNA, 25 bp, Mus musculus
cggtggaaacgacctggtctttcaa

SEQ ID NO: 609523 - DNA, 25 bp, Mus musculus
cggtggaaacgagctggtctttcaa

SEQ ID NO: 609524 - DNA, 25 bp, Mus musculus
cggtggaagttcagctgaaaggtca

SEQ ID NO: 609525 - DNA, 25 bp, Mus musculus
cggtggaagttctgctgaaaggtca

SEQ ID NO: 609526 - DNA, 25 bp, Mus musculus
cggtggacagcacaatagccaagca

SEQ ID NO: 609527 - DNA, 25 bp, Mus musculus
cggtggacagcagaatagccaagca

SEQ ID NO: 609528 - DNA, 25 bp, Mus musculus
cggtggagcgacagagctcactcag

SEQ ID NO: 609529 - DNA, 25 bp, Mus musculus
cggtggagcgactgagctcactcag

SEQ ID NO: 609530 - DNA, 25 bp, Mus musculus
cggtggcaaggcagccagggtctga

SEQ ID NO: 609531 - DNA, 25 bp, Mus musculus
cggtggcaaggctgccagggtctga

SEQ ID NO: 609532 - DNA, 25 bp, Mus musculus
cggtggcagagaacgacgcgctcta

SEQ ID NO: 609533 - DNA, 25 bp, Mus musculus
cggtggcagagatcgacgcgctcta

SEQ ID NO: 609534 - DNA, 25 bp, Mus musculus
cggtggccacggaaatccgttctct

SEQ ID NO: 609535 - DNA, 25 bp, Mus musculus
cggtggccacggtaatccgttctct

SEQ ID NO: 609536 - DNA, 25 bp, Mus musculus
cggtggccagcacagtcctacagta

SEQ ID NO: 609537 - DNA, 25 bp, Mus musculus
cggtggccagcagagtcctacagta

SEQ ID NO: 609538 - DNA, 25 bp, Mus musculus
cggtggcccacacggctaggatata

SEQ ID NO: 609539 - DNA, 25 bp, Mus musculus
cggtggcccacagggctaggatata

SEQ ID NO: 609540 - DNA, 25 bp, Mus musculus
cggtggccccttagctgctgtgtgt

SEQ ID NO: 609541 - DNA, 25 bp, Mus musculus
cggtggcccctttgctgctgtgtgt

SEQ ID NO: 609542 - DNA, 25 bp, Mus musculus
cggtggcgagccaaggtacccaaag

SEQ ID NO: 609543 - DNA, 25 bp, Mus musculus
cggtggcgagcctaggtacccaaag

SEQ ID NO: 609544 - DNA, 25 bp, Mus musculus
cggtggcgccgaagactttctggcc

SEQ ID NO: 609545 - DNA, 25 bp, Mus musculus
cggtggcgccgatgactttctggcc

SEQ ID NO: 609546 - DNA, 25 bp, Mus musculus
cggtggcttctcagccccagcagga

SEQ ID NO: 609547 - DNA, 25 bp, Mus musculus
cggtggcttctctgccccagcagga

SEQ ID NO: 609548 - DNA, 25 bp, Mus musculus
cggtggcttctgacccaaggaagga

SEQ ID NO: 609549 - DNA, 25 bp, Mus musculus
cggtggcttctgtcccaaggaagga

SEQ ID NO: 609550 - DNA, 25 bp, Mus musculus
cggtggcttggcacacggtgtcttc

SEQ ID NO: 609551 - DNA, 25 bp, Mus musculus
cggtggcttggctcacggtgtcttc

SEQ ID NO: 609552 - DNA, 25 bp, Mus musculus
cggtgggaaacaaaagcatgtcatt

SEQ ID NO: 609553 - DNA, 25 bp, Mus musculus
cggtgggaaacataagcatgtcatt

SEQ ID NO: 609554 - DNA, 25 bp, Mus musculus
cggtggtggaccaagtacaggacct

SEQ ID NO: 609555 - DNA, 25 bp, Mus musculus
cggtggtggacctagtacaggacct

SEQ ID NO: 609556 - DNA, 25 bp, Mus musculus
cggtggtgtagaccgacttgtcaaa

SEQ ID NO: 609557 - DNA, 25 bp, Mus musculus
cggtggtgtagagcgacttgtcaaa

SEQ ID NO: 609558 - DNA, 25 bp, Mus musculus
cggtggtgtccgcaaaagcgtgaca

SEQ ID NO: 609559 - DNA, 25 bp, Mus musculus
cggtggtgtccggaaaagcgtgaca

SEQ ID NO: 609560 - DNA, 25 bp, Mus musculus
cggtggtgtgacctcaggctcattc

SEQ ID NO: 609561 - DNA, 25 bp, Mus musculus
cggtggtgtgacgtcaggctcattc

SEQ ID NO: 609562 - DNA, 25 bp, Mus musculus
cggtgtacgaggatctgagatctct

SEQ ID NO: 609563 - DNA, 25 bp, Mus musculus
cggtgtacgaggttctgagatctct

SEQ ID NO: 609564 - DNA, 25 bp, Mus musculus
cggtgtactcggctcttagactcca

SEQ ID NO: 609565 - DNA, 25 bp, Mus musculus
cggtgtactcgggtcttagactcca

SEQ ID NO: 609566 - DNA, 25 bp, Mus musculus
cggtgtatccgcagtcccgtgggca

SEQ ID NO: 609567 - DNA, 25 bp, Mus musculus
cggtgtatccgctgtcccgtgggca

SEQ ID NO: 609568 - DNA, 25 bp, Mus musculus
cggtgtcaacatctccaaggaggcc

SEQ ID NO: 609569 - DNA, 25 bp, Mus musculus
cggtgtcaacatgtccaaggaggcc

SEQ ID NO: 609570 - DNA, 25 bp, Mus musculus
cggtgtcattcgctacctgacattt

SEQ ID NO: 609571 - DNA, 25 bp, Mus musculus
cggtgtcattcggtacctgacattt

SEQ ID NO: 609572 - DNA, 25 bp, Mus musculus
cggtgtgaacaaccatcagcagcct

SEQ ID NO: 609573 - DNA, 25 bp, Mus musculus
cggtgtgaacaagcatcagcagcct

SEQ ID NO: 609574 - DNA, 25 bp, Mus musculus
cggtgtgctcctcgattttacaggg

SEQ ID NO: 609575 - DNA, 25 bp, Mus musculus
cggtgtgctcctggattttacaggg

SEQ ID NO: 609576 - DNA, 25 bp, Mus musculus
cggtgtggaacaacgctcacgggac

SEQ ID NO: 609577 - DNA, 25 bp, Mus musculus
cggtgtggaacatcgctcacgggac

SEQ ID NO: 609578 - DNA, 25 bp, Mus musculus
cggtgtgtgagtcctgccctcctca

SEQ ID NO: 609579 - DNA, 25 bp, Mus musculus
cggtgtgtgagtgctgccctcctca

SEQ ID NO: 609580 - DNA, 25 bp, Mus musculus
cggtgtgtttgaaagcgaggccaaa

SEQ ID NO: 609581 - DNA, 25 bp, Mus musculus
cggtgtgtttgatagcgaggccaaa

SEQ ID NO: 609582 - DNA, 25 bp, Mus musculus
cggtgttggtaaccactgtgccaat

SEQ ID NO: 609583 - DNA, 25 bp, Mus musculus
cggtgttggtaagcactgtgccaat

SEQ ID NO: 609584 - DNA, 25 bp, Mus musculus
cggtgtttaagcacacgtatctaag

SEQ ID NO: 609585 - DNA, 25 bp, Mus musculus
cggtgtttaagctcacgtatctaag

SEQ ID NO: 609586 - DNA, 25 bp, Mus musculus
cggtgtttcggcagaggtaacctca

SEQ ID NO: 609587 - DNA, 25 bp, Mus musculus
cggtgtttcggctgaggtaacctca

SEQ ID NO: 609588 - DNA, 25 bp, Mus musculus
cggtgtttgccaccatgtgcagtgc

SEQ ID NO: 609589 - DNA, 25 bp, Mus musculus
cggtgtttgccagcatgtgcagtgc

SEQ ID NO: 609590 - DNA, 25 bp, Mus musculus
cggttaaaatgcaggttggaggcta

SEQ ID NO: 609591 - DNA, 25 bp, Mus musculus
cggttaaaatgctggttggaggcta

SEQ ID NO: 609592 - DNA, 25 bp, Mus musculus
cggttaatgaatcaaacaactgcag

SEQ ID NO: 609593 - DNA, 25 bp, Mus musculus
cggttaatgaatgaaacaactgcag

SEQ ID NO: 609594 - DNA, 25 bp, Mus musculus
cggttaattgttcatgaagccatca

SEQ ID NO: 609595 - DNA, 25 bp, Mus musculus
cggttaattgttgatgaagccatca

SEQ ID NO: 609596 - DNA, 25 bp, Mus musculus
cggttacagggaaagcagtgtcttg

SEQ ID NO: 609597 - DNA, 25 bp, Mus musculus
cggttacagggatagcagtgtcttg

SEQ ID NO: 609598 - DNA, 25 bp, Mus musculus
cggttactagcaacgttgagctcca

SEQ ID NO: 609599 - DNA, 25 bp, Mus musculus
cggttactagcatcgttgagctcca

SEQ ID NO: 609600 - DNA, 25 bp, Mus musculus
cggttactagccactatttatttga

SEQ ID NO: 609601 - DNA, 25 bp, Mus musculus
cggttactagcctctatttatttga

SEQ ID NO: 609602 - DNA, 25 bp, Mus musculus
cggttagagcccagtcgctgcttca

SEQ ID NO: 609603 - DNA, 25 bp, Mus musculus
cggttagagccctgtcgctgcttca

SEQ ID NO: 609604 - DNA, 25 bp, Mus musculus
cggttagtgacacttcaccaaggtg

SEQ ID NO: 609605 - DNA, 25 bp, Mus musculus
cggttagtgacagttcaccaaggtg

SEQ ID NO: 609606 - DNA, 25 bp, Mus musculus
cggttcactgttcctcatcttcaag

SEQ ID NO: 609607 - DNA, 25 bp, Mus musculus
cggttcactgttgctcatcttcaag

SEQ ID NO: 609608 - DNA, 25 bp, Mus musculus
cggttcatcactcccaatcagtatg

SEQ ID NO: 609609 - DNA, 25 bp, Mus musculus
cggttcatcactgccaatcagtatg

SEQ ID NO: 609610 - DNA, 25 bp, Mus musculus
cggttcccggctctgcctgtacgaa

SEQ ID NO: 609611 - DNA, 25 bp, Mus musculus
cggttcccggctgtgcctgtacgaa

SEQ ID NO: 609612 - DNA, 25 bp, Mus musculus
cggttcgagcgacacgtttcttggc

SEQ ID NO: 609613 - DNA, 25 bp, Mus musculus
cggttcgagcgagacgtttcttggc

SEQ ID NO: 609614 - DNA, 25 bp, Mus musculus
cggttcggcgcgacgactgtccaga

SEQ ID NO: 609615 - DNA, 25 bp, Mus musculus
cggttcggcgcgtcgactgtccaga

SEQ ID NO: 609616 - DNA, 25 bp, Mus musculus
cggttcggtgcgaaacagcccagga

SEQ ID NO: 609617 - DNA, 25 bp, Mus musculus
cggttcggtgcgtaacagcccagga

SEQ ID NO: 609618 - DNA, 25 bp, Mus musculus
cggttctagaggagcggcctgggtc

SEQ ID NO: 609619 - DNA, 25 bp, Mus musculus
cggttctagaggtgcggcctgggtc

SEQ ID NO: 609620 - DNA, 25 bp, Mus musculus
cggttctagcaaacagcaattgatt

SEQ ID NO: 609621 - DNA, 25 bp, Mus musculus
cggttctagcaatcagcaattgatt

SEQ ID NO: 609622 - DNA, 25 bp, Mus musculus
cggttcttatctcactatgatgagc

SEQ ID NO: 609623 - DNA, 25 bp, Mus musculus
cggttcttatctgactatgatgagc

SEQ ID NO: 609624 - DNA, 25 bp, Mus musculus
cggttctttgccaacatcgtgtggc

SEQ ID NO: 609625 - DNA, 25 bp, Mus musculus
cggttctttgcctacatcgtgtggc

SEQ ID NO: 609626 - DNA, 25 bp, Mus musculus
cggttgagggtcatacccactgagg

SEQ ID NO: 609627 - DNA, 25 bp, Mus musculus
cggttgagggtcttacccactgagg

SEQ ID NO: 609628 - DNA, 25 bp, Mus musculus
cggttgcacagactatttcgcctaa

SEQ ID NO: 609629 - DNA, 25 bp, Mus musculus
cggttgcacagagtatttcgcctaa

SEQ ID NO: 609630 - DNA, 25 bp, Mus musculus
cggttgcacctacctacgtagagaa

SEQ ID NO: 609631 - DNA, 25 bp, Mus musculus
cggttgcacctagctacgtagagaa

SEQ ID NO: 609632 - DNA, 25 bp, Mus musculus
cggttgcatctcaactggtgacaaa

SEQ ID NO: 609633 - DNA, 25 bp, Mus musculus
cggttgcatctctactggtgacaaa

SEQ ID NO: 609634 - DNA, 25 bp, Mus musculus
cggttgcctttgctccgatgaccaa

SEQ ID NO: 609635 - DNA, 25 bp, Mus musculus
cggttgcctttggtccgatgaccaa

SEQ ID NO: 609636 - DNA, 25 bp, Mus musculus
cggttgcgggtcaccttgcagctct

SEQ ID NO: 609637 - DNA, 25 bp, Mus musculus
cggttgcgggtctccttgcagctct

SEQ ID NO: 609638 - DNA, 25 bp, Mus musculus
cggttggacggacaaatacgttcat

SEQ ID NO: 609639 - DNA, 25 bp, Mus musculus
cggttggacggagaaatacgttcat

SEQ ID NO: 609640 - DNA, 25 bp, Mus musculus
cggttggattcacgctgcagccaga

SEQ ID NO: 609641 - DNA, 25 bp, Mus musculus
cggttggattcaggctgcagccaga

SEQ ID NO: 609642 - DNA, 25 bp, Mus musculus
cggttggcatcgatttcaaagtaaa

SEQ ID NO: 609643 - DNA, 25 bp, Mus musculus
cggttggcatcgttttcaaagtaaa

SEQ ID NO: 609644 - DNA, 25 bp, Mus musculus
cggttggccctgacggacagacaaa

SEQ ID NO: 609645 - DNA, 25 bp, Mus musculus
cggttggccctgtcggacagacaaa

SEQ ID NO: 609646 - DNA, 25 bp, Mus musculus
cggttgtcatggaaactactgtggt

SEQ ID NO: 609647 - DNA, 25 bp, Mus musculus
cggttgtcatggtaactactgtggt

SEQ ID NO: 609648 - DNA, 25 bp, Mus musculus
cggttgtggctgctagatgactcca

SEQ ID NO: 609649 - DNA, 25 bp, Mus musculus
cggttgtggctggtagatgactcca

SEQ ID NO: 609650 - DNA, 25 bp, Mus musculus
cggttgttcactatcattgctggct

SEQ ID NO: 609651 - DNA, 25 bp, Mus musculus
cggttgttcactttcattgctggct

SEQ ID NO: 609652 - DNA, 25 bp, Mus musculus
cggtttagttccactcaccgtgtgg

SEQ ID NO: 609653 - DNA, 25 bp, Mus musculus
cggtttagttcctctcaccgtgtgg

SEQ ID NO: 609654 - DNA, 25 bp, Mus musculus
cggtttatcatgctaatgggagcca

SEQ ID NO: 609655 - DNA, 25 bp, Mus musculus
cggtttatcatggtaatgggagcca

SEQ ID NO: 609656 - DNA, 25 bp, Mus musculus
cggtttcactacatcaatggcagtt

SEQ ID NO: 609657 - DNA, 25 bp, Mus musculus
cggtttcactacttcaatggcagtt

SEQ ID NO: 609658 - DNA, 25 bp, Mus musculus
cggtttcttctgctcaagagtgtga

SEQ ID NO: 609659 - DNA, 25 bp, Mus musculus
cggtttcttctggtcaagagtgtga

SEQ ID NO: 609660 - DNA, 25 bp, Mus musculus
cggtttgaatgcaattcaggcttca

SEQ ID NO: 609661 - DNA, 25 bp, Mus musculus
cggtttgaatgctattcaggcttca

SEQ ID NO: 609662 - DNA, 25 bp, Mus musculus
cggtttgagtctatcatggaagatg

SEQ ID NO: 609663 - DNA, 25 bp, Mus musculus
cggtttgagtctttcatggaagatg

SEQ ID NO: 609664 - DNA, 25 bp, Mus musculus
cggtttgatggacaaccaatcaatg

SEQ ID NO: 609665 - DNA, 25 bp, Mus musculus
cggtttgatggagaaccaatcaatg

SEQ ID NO: 609666 - DNA, 25 bp, Mus musculus
cggtttggagacaggatgttctacc

SEQ ID NO: 609667 - DNA, 25 bp, Mus musculus
cggtttggagactggatgttctacc

SEQ ID NO: 609668 - DNA, 25 bp, Mus musculus
cggtttgtttcgcaactgaggctca

SEQ ID NO: 609669 - DNA, 25 bp, Mus musculus
cggtttgtttcggaactgaggctca

SEQ ID NO: 609670 - DNA, 25 bp, Mus musculus
cggtttttctggacagccctgagca

SEQ ID NO: 609671 - DNA, 25 bp, Mus musculus
cggtttttctggtcagccctgagca

SEQ ID NO: 609672 - DNA, 25 bp, Mus musculus
cgtaaaagaaaccatgccaaagaag

SEQ ID NO: 609673 - DNA, 25 bp, Mus musculus
cgtaaaagaaacgatgccaaagaag

SEQ ID NO: 609674 - DNA, 25 bp, Mus musculus
cgtaaacagcagagtctcgagtgat

SEQ ID NO: 609675 - DNA, 25 bp, Mus musculus
cgtaaacagcagtgtctcgagtgat

SEQ ID NO: 609676 - DNA, 25 bp, Mus musculus
cgtaaactacttcagcttttgtgga

SEQ ID NO: 609677 - DNA, 25 bp, Mus musculus
cgtaaactacttgagcttttgtgga

SEQ ID NO: 609678 - DNA, 25 bp, Mus musculus
cgtaaactctttcctgatgccgaag

SEQ ID NO: 609679 - DNA, 25 bp, Mus musculus
cgtaaactctttgctgatgccgaag

SEQ ID NO: 609680 - DNA, 25 bp, Mus musculus
cgtaaacttgctatatgtcctgtta

SEQ ID NO: 609681 - DNA, 25 bp, Mus musculus
cgtaaacttgctttatgtcctgtta

SEQ ID NO: 609682 - DNA, 25 bp, Mus musculus
cgtaaagaggagcacactgttccaa

SEQ ID NO: 609683 - DNA, 25 bp, Mus musculus
cgtaaagaggaggacactgttccaa

SEQ ID NO: 609684 - DNA, 25 bp, Mus musculus
cgtaaagcgtgtcccgatgcgactc

SEQ ID NO: 609685 - DNA, 25 bp, Mus musculus
cgtaaagcgtgtgccgatgcgactc

SEQ ID NO: 609686 - DNA, 25 bp, Mus musculus
cgtaaagtgctaagggcttaaggtc

SEQ ID NO: 609687 - DNA, 25 bp, Mus musculus
cgtaaagtgctatgggcttaaggtc

SEQ ID NO: 609688 - DNA, 25 bp, Mus musculus
cgtaaatcaacacgcaggaccttat

SEQ ID NO: 609689 - DNA, 25 bp, Mus musculus
cgtaaatcaacaggcaggaccttat

SEQ ID NO: 609690 - DNA, 25 bp, Mus musculus
cgtaacaaggatcccactggtggct

SEQ ID NO: 609691 - DNA, 25 bp, Mus musculus
cgtaacaaggatgccactggtggct

SEQ ID NO: 609692 - DNA, 25 bp, Mus musculus
cgtaacacaggccagcagtgggact

SEQ ID NO: 609693 - DNA, 25 bp, Mus musculus
cgtaacacaggcgagcagtgggact

SEQ ID NO: 609694 - DNA, 25 bp, Mus musculus
cgtaaccagaatctgcctcctgaaa

SEQ ID NO: 609695 - DNA, 25 bp, Mus musculus
cgtaaccagaatgtgcctcctgaaa

SEQ ID NO: 609696 - DNA, 25 bp, Mus musculus
cgtaacctgcatcgacatataaaag

SEQ ID NO: 609697 - DNA, 25 bp, Mus musculus
cgtaacctgcatggacatataaaag

SEQ ID NO: 609698 - DNA, 25 bp, Mus musculus
cgtaactcggacagtgataagtggg

SEQ ID NO: 609699 - DNA, 25 bp, Mus musculus
cgtaactcggactgtgataagtggg

SEQ ID NO: 609700 - DNA, 25 bp, Mus musculus
cgtaacttcatccacatgaacctgt

SEQ ID NO: 609701 - DNA, 25 bp, Mus musculus
cgtaacttcatcgacatgaacctgt

SEQ ID NO: 609702 - DNA, 25 bp, Mus musculus
cgtaagacagccagccttgaggact

SEQ ID NO: 609703 - DNA, 25 bp, Mus musculus
cgtaagacagcctgccttgaggact

SEQ ID NO: 609704 - DNA, 25 bp, Mus musculus
cgtaagagtggcacctgtaggcagc

SEQ ID NO: 609705 - DNA, 25 bp, Mus musculus
cgtaagagtggctcctgtaggcagc

SEQ ID NO: 609706 - DNA, 25 bp, Mus musculus
cgtaagatgaaacctattggatggg

SEQ ID NO: 609707 - DNA, 25 bp, Mus musculus
cgtaagatgaaagctattggatggg

SEQ ID NO: 609708 - DNA, 25 bp, Mus musculus
cgtaagcctgtaagagaaggacaac

SEQ ID NO: 609709 - DNA, 25 bp, Mus musculus
cgtaagcctgtatgagaaggacaac

SEQ ID NO: 609710 - DNA, 25 bp, Mus musculus
cgtaagctgcctccttaagctgctt

SEQ ID NO: 609711 - DNA, 25 bp, Mus musculus
cgtaagctgcctgcttaagctgctt

SEQ ID NO: 609712 - DNA, 25 bp, Mus musculus
cgtaagctggtcctggtctcgtgtt

SEQ ID NO: 609713 - DNA, 25 bp, Mus musculus
cgtaagctggtcgtggtctcgtgtt

SEQ ID NO: 609714 - DNA, 25 bp, Mus musculus
cgtaaggctacacgcccttccgagg

SEQ ID NO: 609715 - DNA, 25 bp, Mus musculus
cgtaaggctacaggcccttccgagg

SEQ ID NO: 609716 - DNA, 25 bp, Mus musculus
cgtaagggaagacctcttgaaattt

SEQ ID NO: 609717 - DNA, 25 bp, Mus musculus
cgtaagggaagagctcttgaaattt

SEQ ID NO: 609718 - DNA, 25 bp, Mus musculus
cgtaagttgtcgctttgaagacttt

SEQ ID NO: 609719 - DNA, 25 bp, Mus musculus
cgtaagttgtcggtttgaagacttt

SEQ ID NO: 609720 - DNA, 25 bp, Mus musculus
cgtaatagaaccatggctcagtttc

SEQ ID NO: 609721 - DNA, 25 bp, Mus musculus
cgtaatagaaccttggctcagtttc

SEQ ID NO: 609722 - DNA, 25 bp, Mus musculus
cgtaatccaggaaatttagataatg

SEQ ID NO: 609723 - DNA, 25 bp, Mus musculus
cgtaatccaggatatttagataatg

SEQ ID NO: 609724 - DNA, 25 bp, Mus musculus
cgtaattcggatatgaagctcccca

SEQ ID NO: 609725 - DNA, 25 bp, Mus musculus
cgtaattcggatttgaagctcccca

SEQ ID NO: 609726 - DNA, 25 bp, Mus musculus
cgtaattttgcaaatgatgctacat

SEQ ID NO: 609727 - DNA, 25 bp, Mus musculus
cgtaattttgcatatgatgctacat

SEQ ID NO: 609728 - DNA, 25 bp, Mus musculus
cgtacaatttataagggagcttcaa

SEQ ID NO: 609729 - DNA, 25 bp, Mus musculus
cgtacaatttattagggagcttcaa

SEQ ID NO: 609730 - DNA, 25 bp, Mus musculus
cgtacactctatctcttcaattgga

SEQ ID NO: 609731 - DNA, 25 bp, Mus musculus
cgtacactctatgtcttcaattgga

SEQ ID NO: 609732 - DNA, 25 bp, Mus musculus
cgtacactttctagagaacatggga

SEQ ID NO: 609733 - DNA, 25 bp, Mus musculus
cgtacactttcttgagaacatggga

SEQ ID NO: 609734 - DNA, 25 bp, Mus musculus
cgtacagactgactcctaaactgat

SEQ ID NO: 609735 - DNA, 25 bp, Mus musculus
cgtacagactgagtcctaaactgat

SEQ ID NO: 609736 - DNA, 25 bp, Mus musculus
cgtacaggcatcctctggtccgaga

SEQ ID NO: 609737 - DNA, 25 bp, Mus musculus
cgtacaggcatcgtctggtccgaga

SEQ ID NO: 609738 - DNA, 25 bp, Mus musculus
cgtacatcaaggaccacctactttt

SEQ ID NO: 609739 - DNA, 25 bp, Mus musculus
cgtacatcaaggactgtgtcacccc

SEQ ID NO: 609740 - DNA, 25 bp, Mus musculus
cgtacatcaaggtccacctactttt

SEQ ID NO: 609741 - DNA, 25 bp, Mus musculus
cgtacatcaaggtctgtgtcacccc

SEQ ID NO: 609742 - DNA, 25 bp, Mus musculus
cgtacatcgagcatcttgtaaggca

SEQ ID NO: 609743 - DNA, 25 bp, Mus musculus
cgtacatcgagcttcttgtaaggca

SEQ ID NO: 609744 - DNA, 25 bp, Mus musculus
cgtacatcttgcctctcatgcggag

SEQ ID NO: 609745 - DNA, 25 bp, Mus musculus
cgtacatcttgcgtctcatgcggag

SEQ ID NO: 609746 - DNA, 25 bp, Mus musculus
cgtacatgagtcattgtcttttaag

SEQ ID NO: 609747 - DNA, 25 bp, Mus musculus
cgtacatgagtctttgtcttttaag

SEQ ID NO: 609748 - DNA, 25 bp, Mus musculus
cgtacatgcgcaacaccagtaagca

SEQ ID NO: 609749 - DNA, 25 bp, Mus musculus
cgtacatgcgcatcaccagtaagca

SEQ ID NO: 609750 - DNA, 25 bp, Mus musculus
cgtaccaagtgaacagtctctaggc

SEQ ID NO: 609751 - DNA, 25 bp, Mus musculus
cgtaccaagtgatcagtctctaggc

SEQ ID NO: 609752 - DNA, 25 bp, Mus musculus
cgtaccagaagacggacatcgatgg

SEQ ID NO: 609753 - DNA, 25 bp, Mus musculus
cgtaccagaagagggacatcgatgg

SEQ ID NO: 609754 - DNA, 25 bp, Mus musculus
cgtaccagtgaaccaataaaaaaga

SEQ ID NO: 609755 - DNA, 25 bp, Mus musculus
cgtaccagtgaagcaataaaaaaga

SEQ ID NO: 609756 - DNA, 25 bp, Mus musculus
cgtaccctggaaagacaaaccagca

SEQ ID NO: 609757 - DNA, 25 bp, Mus musculus
cgtaccctggaatgacaaaccagca

SEQ ID NO: 609758 - DNA, 25 bp, Mus musculus
cgtaccctggagatgagtctgttgc

SEQ ID NO: 609759 - DNA, 25 bp, Mus musculus
cgtaccctggagttgagtctgttgc

SEQ ID NO: 609760 - DNA, 25 bp, Mus musculus
cgtaccctgtgtcctgagccttcat

SEQ ID NO: 609761 - DNA, 25 bp, Mus musculus
cgtaccctgtgtgctgagccttcat

SEQ ID NO: 609762 - DNA, 25 bp, Mus musculus
cgtaccgtggcaatactggactgta

SEQ ID NO: 609763 - DNA, 25 bp, Mus musculus
cgtaccgtggcattactggactgta

SEQ ID NO: 609764 - DNA, 25 bp, Mus musculus
cgtacctcactcaggtcaccctgat

SEQ ID NO: 609765 - DNA, 25 bp, Mus musculus
cgtacctcactctggtcaccctgat

SEQ ID NO: 609766 - DNA, 25 bp, Mus musculus
cgtacctcaggtcaaagacatcata

SEQ ID NO: 609767 - DNA, 25 bp, Mus musculus
cgtacctcaggtgaaagacatcata

SEQ ID NO: 609768 - DNA, 25 bp, Mus musculus
cgtacctgagtactctgggaagcag

SEQ ID NO: 609769 - DNA, 25 bp, Mus musculus
cgtacctgagtagtctgggaagcag

SEQ ID NO: 609770 - DNA, 25 bp, Mus musculus
cgtacctgcagaacttgatagaaca

SEQ ID NO: 609771 - DNA, 25 bp, Mus musculus
cgtacctgcagatcttgatagaaca

SEQ ID NO: 609772 - DNA, 25 bp, Mus musculus
cgtacctgttgacaagccagctgga

SEQ ID NO: 609773 - DNA, 25 bp, Mus musculus
cgtacctgttgagaagccagctgga

SEQ ID NO: 609774 - DNA, 25 bp, Mus musculus
cgtaccttgcagcacgtgctcaggt

SEQ ID NO: 609775 - DNA, 25 bp, Mus musculus
cgtaccttgcaggacgtgctcaggt

SEQ ID NO: 609776 - DNA, 25 bp, Mus musculus
cgtaccttgggtcactccggcgctg

SEQ ID NO: 609777 - DNA, 25 bp, Mus musculus
cgtaccttgggtgactccggcgctg

SEQ ID NO: 609778 - DNA, 25 bp, Mus musculus
cgtacgagatgtagctgaagatcaa

SEQ ID NO: 609779 - DNA, 25 bp, Mus musculus
cgtacgagatgttgctgaagatcaa

SEQ ID NO: 609780 - DNA, 25 bp, Mus musculus
cgtacgatgatgctactgctgtgcc

SEQ ID NO: 609781 - DNA, 25 bp, Mus musculus
cgtacgatgatggtactgctgtgcc

SEQ ID NO: 609782 - DNA, 25 bp, Mus musculus
cgtacggaggatagctgaacgtcgt

SEQ ID NO: 609783 - DNA, 25 bp, Mus musculus
cgtacggaggattgctgaacgtcgt

SEQ ID NO: 609784 - DNA, 25 bp, Mus musculus
cgtacgggtctgcttggaacagtca

SEQ ID NO: 609785 - DNA, 25 bp, Mus musculus
cgtacgggtctggttggaacagtca

SEQ ID NO: 609786 - DNA, 25 bp, Mus musculus
cgtactatgccccttaaagaagcca

SEQ ID NO: 609787 - DNA, 25 bp, Mus musculus
cgtactatgcccgttaaagaagcca

SEQ ID NO: 609788 - DNA, 25 bp, Mus musculus
cgtactcgcagtctacagctccagg

SEQ ID NO: 609789 - DNA, 25 bp, Mus musculus
cgtactcgcagtgtacagctccagg

SEQ ID NO: 609790 - DNA, 25 bp, Mus musculus
cgtactctagccacggagtcctgga

SEQ ID NO: 609791 - DNA, 25 bp, Mus musculus
cgtactctagcctcggagtcctgga

SEQ ID NO: 609792 - DNA, 25 bp, Mus musculus
cgtactctctaactgtgtcagtgcc

SEQ ID NO: 609793 - DNA, 25 bp, Mus musculus
cgtactctctaagtgtgtcagtgcc

SEQ ID NO: 609794 - DNA, 25 bp, Mus musculus
cgtactgcaggcatcgagtaccttc

SEQ ID NO: 609795 - DNA, 25 bp, Mus musculus
cgtactgcaggcttcgagtaccttc

SEQ ID NO: 609796 - DNA, 25 bp, Mus musculus
cgtactgcaggtctctgattcccct

SEQ ID NO: 609797 - DNA, 25 bp, Mus musculus
cgtactgcaggtgtctgattcccct

SEQ ID NO: 609798 - DNA, 25 bp, Mus musculus
cgtactgccgatatgactctgtcag

SEQ ID NO: 609799 - DNA, 25 bp, Mus musculus
cgtactgccgatttgactctgtcag

SEQ ID NO: 609800 - DNA, 25 bp, Mus musculus
cgtactgggagaagacctttgacat

SEQ ID NO: 609801 - DNA, 25 bp, Mus musculus
cgtactgggagatgacctttgacat

SEQ ID NO: 609802 - DNA, 25 bp, Mus musculus
cgtactgggccaccctctacagatg

SEQ ID NO: 609803 - DNA, 25 bp, Mus musculus
cgtactgggccagcctctacagatg

SEQ ID NO: 609804 - DNA, 25 bp, Mus musculus
cgtactttgcgcagttataaatggg

SEQ ID NO: 609805 - DNA, 25 bp, Mus musculus
cgtactttgcgctgttataaatggg

SEQ ID NO: 609806 - DNA, 25 bp, Mus musculus
cgtagaagaacacaatctgaaggac

SEQ ID NO: 609807 - DNA, 25 bp, Mus musculus
cgtagaagaacagaatctgaaggac

SEQ ID NO: 609808 - DNA, 25 bp, Mus musculus
cgtagaagattaaaactacgggact

SEQ ID NO: 609809 - DNA, 25 bp, Mus musculus
cgtagaagattataactacgggact

SEQ ID NO: 609810 - DNA, 25 bp, Mus musculus
cgtagaccagtcagagtgtttgtcc

SEQ ID NO: 609811 - DNA, 25 bp, Mus musculus
cgtagaccagtctgagtgtttgtcc

SEQ ID NO: 609812 - DNA, 25 bp, Mus musculus
cgtagagccacaccctggtaagggc

SEQ ID NO: 609813 - DNA, 25 bp, Mus musculus
cgtagagccacagcctggtaagggc

SEQ ID NO: 609814 - DNA, 25 bp, Mus musculus
cgtagagtcagacgacagaaagctc

SEQ ID NO: 609815 - DNA, 25 bp, Mus musculus
cgtagagtcagaggacagaaagctc

SEQ ID NO: 609816 - DNA, 25 bp, Mus musculus
cgtagatgatccacgcaagtttgca

SEQ ID NO: 609817 - DNA, 25 bp, Mus musculus
cgtagatgatcctcgcaagtttgca

SEQ ID NO: 609818 - DNA, 25 bp, Mus musculus
cgtagcaacttcctgggcggatcct

SEQ ID NO: 609819 - DNA, 25 bp, Mus musculus
cgtagcaacttcgtgggcggatcct

SEQ ID NO: 609820 - DNA, 25 bp, Mus musculus
cgtagcaatgctagaacttacagga

SEQ ID NO: 609821 - DNA, 25 bp, Mus musculus
cgtagcaatgcttgaacttacagga

SEQ ID NO: 609822 - DNA, 25 bp, Mus musculus
cgtagcattaagagacggagtccac

SEQ ID NO: 609823 - DNA, 25 bp, Mus musculus
cgtagcattaagtgacggagtccac

SEQ ID NO: 609824 - DNA, 25 bp, Mus musculus
cgtagccatcacagctaaactcctg

SEQ ID NO: 609825 - DNA, 25 bp, Mus musculus
cgtagccatcactgctaaactcctg

SEQ ID NO: 609826 - DNA, 25 bp, Mus musculus
cgtagccctatcatgcagggtaaca

SEQ ID NO: 609827 - DNA, 25 bp, Mus musculus
cgtagccctatcttgcagggtaaca

SEQ ID NO: 609828 - DNA, 25 bp, Mus musculus
cgtagccggagacccgaacacagcg

SEQ ID NO: 609829 - DNA, 25 bp, Mus musculus
cgtagccggagagccgaacacagcg

SEQ ID NO: 609830 - DNA, 25 bp, Mus musculus
cgtagcctgacactccgagatctaa

SEQ ID NO: 609831 - DNA, 25 bp, Mus musculus
cgtagcctgacagtccgagatctaa

SEQ ID NO: 609832 - DNA, 25 bp, Mus musculus
cgtagcgccgccattcggcagaagc

SEQ ID NO: 609833 - DNA, 25 bp, Mus musculus
cgtagcgccgcctttcggcagaagc

SEQ ID NO: 609834 - DNA, 25 bp, Mus musculus
cgtaggaagaagaggtcgaagtcac

SEQ ID NO: 609835 - DNA, 25 bp, Mus musculus
cgtaggaagaagtggtcgaagtcac

SEQ ID NO: 609836 - DNA, 25 bp, Mus musculus
cgtaggatagtgctcaagtctctgg

SEQ ID NO: 609837 - DNA, 25 bp, Mus musculus
cgtaggatagtggtcaagtctctgg

SEQ ID NO: 609838 - DNA, 25 bp, Mus musculus
cgtaggatcgagcacctcaaggagc

SEQ ID NO: 609839 - DNA, 25 bp, Mus musculus
cgtaggatcgaggacctcaaggagc

SEQ ID NO: 609840 - DNA, 25 bp, Mus musculus
cgtaggatgggcaactgcgtcaagt

SEQ ID NO: 609841 - DNA, 25 bp, Mus musculus
cgtaggatgggctactgcgtcaagt

SEQ ID NO: 609842 - DNA, 25 bp, Mus musculus
cgtaggcggtgcatccttccggctg

SEQ ID NO: 609843 - DNA, 25 bp, Mus musculus
cgtaggcggtgcttccttccggctg

SEQ ID NO: 609844 - DNA, 25 bp, Mus musculus
cgtaggctgcagaataagctcattt

SEQ ID NO: 609845 - DNA, 25 bp, Mus musculus
cgtaggctgcagcatccagcatgga

SEQ ID NO: 609846 - DNA, 25 bp, Mus musculus
cgtaggctgcaggatccagcatgga

SEQ ID NO: 609847 - DNA, 25 bp, Mus musculus
cgtaggctgcagtataagctcattt

SEQ ID NO: 609848 - DNA, 25 bp, Mus musculus
cgtaggctgtgactagctccaggcc

SEQ ID NO: 609849 - DNA, 25 bp, Mus musculus
cgtaggctgtgagtagctccaggcc

SEQ ID NO: 609850 - DNA, 25 bp, Mus musculus
cgtagggaacacacatgggcagctg

SEQ ID NO: 609851 - DNA, 25 bp, Mus musculus
cgtagggaacactcatgggcagctg

SEQ ID NO: 609852 - DNA, 25 bp, Mus musculus
cgtagggttgctatccggcagcgaa

SEQ ID NO: 609853 - DNA, 25 bp, Mus musculus
cgtagggttgctttccggcagcgaa

SEQ ID NO: 609854 - DNA, 25 bp, Mus musculus
cgtaggtggtctcattcagaaggac

SEQ ID NO: 609855 - DNA, 25 bp, Mus musculus
cgtaggtggtctgattcagaaggac

SEQ ID NO: 609856 - DNA, 25 bp, Mus musculus
cgtaggttcagtcaccgctctctct

SEQ ID NO: 609857 - DNA, 25 bp, Mus musculus
cgtaggttcagtgaccgctctctct

SEQ ID NO: 609858 - DNA, 25 bp, Mus musculus
cgtagtagtgatcaaagttgttgga

SEQ ID NO: 609859 - DNA, 25 bp, Mus musculus
cgtagtagtgatgaaagttgttgga

SEQ ID NO: 609860 - DNA, 25 bp, Mus musculus
cgtagtcaagtaatatggcagctac

SEQ ID NO: 609861 - DNA, 25 bp, Mus musculus
cgtagtcaagtattatggcagctac

SEQ ID NO: 609862 - DNA, 25 bp, Mus musculus
cgtagtcctgcccagatcttgattt

SEQ ID NO: 609863 - DNA, 25 bp, Mus musculus
cgtagtcctgccgagatcttgattt

SEQ ID NO: 609864 - DNA, 25 bp, Mus musculus
cgtagtgaacttcaccctctgggaa

SEQ ID NO: 609865 - DNA, 25 bp, Mus musculus
cgtagtgaacttgaccctctgggaa

SEQ ID NO: 609866 - DNA, 25 bp, Mus musculus
cgtagtgctgatcaaccaatgacaa

SEQ ID NO: 609867 - DNA, 25 bp, Mus musculus
cgtagtgctgatgaaccaatgacaa

SEQ ID NO: 609868 - DNA, 25 bp, Mus musculus
cgtagttagctaagaccggtcctga

SEQ ID NO: 609869 - DNA, 25 bp, Mus musculus
cgtagttagctatgaccggtcctga

SEQ ID NO: 609870 - DNA, 25 bp, Mus musculus
cgtagttgtgaaaattctggcatta

SEQ ID NO: 609871 - DNA, 25 bp, Mus musculus
cgtagttgtgaatattctggcatta

SEQ ID NO: 609872 - DNA, 25 bp, Mus musculus
cgtataaccgcgatgggtcatatga

SEQ ID NO: 609873 - DNA, 25 bp, Mus musculus
cgtataaccgcgttgggtcatatga

SEQ ID NO: 609874 - DNA, 25 bp, Mus musculus
cgtatacagcgtatggagatctgga

SEQ ID NO: 609875 - DNA, 25 bp, Mus musculus
cgtatacagcgtttggagatctgga

SEQ ID NO: 609876 - DNA, 25 bp, Mus musculus
cgtatacggaaacctacatcagcac

SEQ ID NO: 609877 - DNA, 25 bp, Mus musculus
cgtatacggaaagctacatcagcac

SEQ ID NO: 609878 - DNA, 25 bp, Mus musculus
cgtatagctggcatcacagccatgt

SEQ ID NO: 609879 - DNA, 25 bp, Mus musculus
cgtatagctggcttcacagccatgt

SEQ ID NO: 609880 - DNA, 25 bp, Mus musculus
cgtatcaccctcaggaaccgggaca

SEQ ID NO: 609881 - DNA, 25 bp, Mus musculus
cgtatcaccctctggaaccgggaca

SEQ ID NO: 609882 - DNA, 25 bp, Mus musculus
cgtatccgtgccaagggaaccccag

SEQ ID NO: 609883 - DNA, 25 bp, Mus musculus
cgtatccgtgcctagggaaccccag

SEQ ID NO: 609884 - DNA, 25 bp, Mus musculus
cgtatgagcttcctcaaaggctggg

SEQ ID NO: 609885 - DNA, 25 bp, Mus musculus
cgtatgagcttcgtcaaaggctggg

SEQ ID NO: 609886 - DNA, 25 bp, Mus musculus
cgtatgagtaccagggaggccacat

SEQ ID NO: 609887 - DNA, 25 bp, Mus musculus
cgtatgagtacctgggaggccacat

SEQ ID NO: 609888 - DNA, 25 bp, Mus musculus
cgtatgatcgtacgaccattgttgg

SEQ ID NO: 609889 - DNA, 25 bp, Mus musculus
cgtatgatcgtaggaccattgttgg

SEQ ID NO: 609890 - DNA, 25 bp, Mus musculus
cgtatgcatgcacaacttgattaaa

SEQ ID NO: 609891 - DNA, 25 bp, Mus musculus
cgtatgcatgcagaacttgattaaa

SEQ ID NO: 609892 - DNA, 25 bp, Mus musculus
cgtatgcatgtcagcagcgtgtgtg

SEQ ID NO: 609893 - DNA, 25 bp, Mus musculus
cgtatgcatgtctgcagcgtgtgtg

SEQ ID NO: 609894 - DNA, 25 bp, Mus musculus
cgtatggctaagagcaacactggca

SEQ ID NO: 609895 - DNA, 25 bp, Mus musculus
cgtatggctaagtgcaacactggca

SEQ ID NO: 609896 - DNA, 25 bp, Mus musculus
cgtatgggcctgagatcgacagcca

SEQ ID NO: 609897 - DNA, 25 bp, Mus musculus
cgtatgggcctgtgatcgacagcca

SEQ ID NO: 609898 - DNA, 25 bp, Mus musculus
cgtatggtgaaaaggttcacagggc

SEQ ID NO: 609899 - DNA, 25 bp, Mus musculus
cgtatggtgaaatggttcacagggc

SEQ ID NO: 609900 - DNA, 25 bp, Mus musculus
cgtatgtcgcgaaggcagccagtgc

SEQ ID NO: 609901 - DNA, 25 bp, Mus musculus
cgtatgtcgcgatggcagccagtgc

SEQ ID NO: 609902 - DNA, 25 bp, Mus musculus
cgtatgtctgggagcccattgagca

SEQ ID NO: 609903 - DNA, 25 bp, Mus musculus
cgtatgtctgggtgcccattgagca

SEQ ID NO: 609904 - DNA, 25 bp, Mus musculus
cgtatgtgaccaaactgaagagttc

SEQ ID NO: 609905 - DNA, 25 bp, Mus musculus
cgtatgtgaccatactgaagagttc

SEQ ID NO: 609906 - DNA, 25 bp, Mus musculus
cgtatgtgggctactgtgacctcct

SEQ ID NO: 609907 - DNA, 25 bp, Mus musculus
cgtatgtgggcttctgtgacctcct

SEQ ID NO: 609908 - DNA, 25 bp, Mus musculus
cgtattccgttcaacatgtccacgg

SEQ ID NO: 609909 - DNA, 25 bp, Mus musculus
cgtattccgttctacatgtccacgg

SEQ ID NO: 609910 - DNA, 25 bp, Mus musculus
cgtattcctttacactttggaacag

SEQ ID NO: 609911 - DNA, 25 bp, Mus musculus
cgtattcctttagactttggaacag

SEQ ID NO: 609912 - DNA, 25 bp, Mus musculus
cgtattgcctttaggcttctcacag

SEQ ID NO: 609913 - DNA, 25 bp, Mus musculus
cgtattgccttttggcttctcacag

SEQ ID NO: 609914 - DNA, 25 bp, Mus musculus
cgtattgcgtgacacgaaccggacg

SEQ ID NO: 609915 - DNA, 25 bp, Mus musculus
cgtattgcgtgagacgaaccggacg

SEQ ID NO: 609916 - DNA, 25 bp, Mus musculus
cgtattggaaggagattacagcttc

SEQ ID NO: 609917 - DNA, 25 bp, Mus musculus
cgtattggaaggtgattacagcttc

SEQ ID NO: 609918 - DNA, 25 bp, Mus musculus
cgtatttcacacaaaatgcggattg

SEQ ID NO: 609919 - DNA, 25 bp, Mus musculus
cgtatttcacactaaatgcggattg

SEQ ID NO: 609920 - DNA, 25 bp, Mus musculus
cgtatttccactaaggaatgggcta

SEQ ID NO: 609921 - DNA, 25 bp, Mus musculus
cgtatttccacttaggaatgggcta

SEQ ID NO: 609922 - DNA, 25 bp, Mus musculus
cgtatttctacgaccccgatgtggg

SEQ ID NO: 609923 - DNA, 25 bp, Mus musculus
cgtatttctacgtccccgatgtggg

SEQ ID NO: 609924 - DNA, 25 bp, Mus musculus
cgtcaaagagggacgagcagaccga

SEQ ID NO: 609925 - DNA, 25 bp, Mus musculus
cgtcaaagagggtcgagcagaccga

SEQ ID NO: 609926 - DNA, 25 bp, Mus musculus
cgtcaaatcagactgtaagtttttc

SEQ ID NO: 609927 - DNA, 25 bp, Mus musculus
cgtcaaatcagagtgtaagtttttc

SEQ ID NO: 609928 - DNA, 25 bp, Mus musculus
cgtcaaattctgacgggtgaggagc

SEQ ID NO: 609929 - DNA, 25 bp, Mus musculus
cgtcaaattctgtcgggtgaggagc

SEQ ID NO: 609930 - DNA, 25 bp, Mus musculus
cgtcaacacaagcaaaggctctggc

SEQ ID NO: 609931 - DNA, 25 bp, Mus musculus
cgtcaacacaaggaaaggctctggc

SEQ ID NO: 609932 - DNA, 25 bp, Mus musculus
cgtcaacagcatagcgacttctaag

SEQ ID NO: 609933 - DNA, 25 bp, Mus musculus
cgtcaacagcattgcgacttctaag

SEQ ID NO: 609934 - DNA, 25 bp, Mus musculus
cgtcaacagccacttgacttctgga

SEQ ID NO: 609935 - DNA, 25 bp, Mus musculus
cgtcaacagccagttgacttctgga

SEQ ID NO: 609936 - DNA, 25 bp, Mus musculus
cgtcaaccagatagttcgaaatggg

SEQ ID NO: 609937 - DNA, 25 bp, Mus musculus
cgtcaaccagattgttcgaaatggg

SEQ ID NO: 609938 - DNA, 25 bp, Mus musculus
cgtcaacgtgtgctactctgtcaat

SEQ ID NO: 609939 - DNA, 25 bp, Mus musculus
cgtcaacgtgtggtactctgtcaat

SEQ ID NO: 609940 - DNA, 25 bp, Mus musculus
cgtcaagtacgtcttccgaactgag

SEQ ID NO: 609941 - DNA, 25 bp, Mus musculus
cgtcaagtacgtgttccgaactgag

SEQ ID NO: 609942 - DNA, 25 bp, Mus musculus
cgtcaagttcgactgaacgagctct

SEQ ID NO: 609943 - DNA, 25 bp, Mus musculus
cgtcaagttcgagtgaacgagctct

SEQ ID NO: 609944 - DNA, 25 bp, Mus musculus
cgtcaataatctatatagcatggta

SEQ ID NO: 609945 - DNA, 25 bp, Mus musculus
cgtcaataatctttatagcatggta

SEQ ID NO: 609946 - DNA, 25 bp, Mus musculus
cgtcaatgggaacatggccaccact

SEQ ID NO: 609947 - DNA, 25 bp, Mus musculus
cgtcaatgggaagatggccaccact

SEQ ID NO: 609948 - DNA, 25 bp, Mus musculus
cgtcacagatcccaaaagaattaaa

SEQ ID NO: 609949 - DNA, 25 bp, Mus musculus
cgtcacagatccgaaaagaattaaa

SEQ ID NO: 609950 - DNA, 25 bp, Mus musculus
cgtcacaggaagcagtaggtatcag

SEQ ID NO: 609951 - DNA, 25 bp, Mus musculus
cgtcacaggaaggagtaggtatcag

SEQ ID NO: 609952 - DNA, 25 bp, Mus musculus
cgtcaccaaaaaccgcaagctggag

SEQ ID NO: 609953 - DNA, 25 bp, Mus musculus
cgtcaccaaaaagcgcaagctggag

SEQ ID NO: 609954 - DNA, 25 bp, Mus musculus
cgtcaccatgcccaagagaggaaag

SEQ ID NO: 609955 - DNA, 25 bp, Mus musculus
cgtcaccatgccgaagagaggaaag

SEQ ID NO: 609956 - DNA, 25 bp, Mus musculus
cgtcacggagtcagctacgtgtctc

SEQ ID NO: 609957 - DNA, 25 bp, Mus musculus
cgtcacggagtctgctacgtgtctc

SEQ ID NO: 609958 - DNA, 25 bp, Mus musculus
cgtcacgtccgcacttgaacttgca

SEQ ID NO: 609959 - DNA, 25 bp, Mus musculus
cgtcacgtccgctcttgaacttgca

SEQ ID NO: 609960 - DNA, 25 bp, Mus musculus
cgtcactgcctccagggcactaaga

SEQ ID NO: 609961 - DNA, 25 bp, Mus musculus
cgtcactgcctcgagggcactaaga

SEQ ID NO: 609962 - DNA, 25 bp, Mus musculus
cgtcactgccttactttgtgctcat

SEQ ID NO: 609963 - DNA, 25 bp, Mus musculus
cgtcactgcctttctttgtgctcat

SEQ ID NO: 609964 - DNA, 25 bp, Mus musculus
cgtcactggaatcgagctaccatct

SEQ ID NO: 609965 - DNA, 25 bp, Mus musculus
cgtcactggaatggagctaccatct

SEQ ID NO: 609966 - DNA, 25 bp, Mus musculus
cgtcactggctaagttcgcttcctg

SEQ ID NO: 609967 - DNA, 25 bp, Mus musculus
cgtcactggctatgttcgcttcctg

SEQ ID NO: 609968 - DNA, 25 bp, Mus musculus
cgtcacttcgccagcagtagcagag

SEQ ID NO: 609969 - DNA, 25 bp, Mus musculus
cgtcacttcgcctgcagtagcagag

SEQ ID NO: 609970 - DNA, 25 bp, Mus musculus
cgtcacttctgcaacaaactctgga

SEQ ID NO: 609971 - DNA, 25 bp, Mus musculus
cgtcacttctgctacaaactctgga

SEQ ID NO: 609972 - DNA, 25 bp, Mus musculus
cgtcacttgtgaccggtgtggtcat

SEQ ID NO: 609973 - DNA, 25 bp, Mus musculus
cgtcacttgtgagcggtgtggtcat

SEQ ID NO: 609974 - DNA, 25 bp, Mus musculus
cgtcagaaagcaacgggagatcctc

SEQ ID NO: 609975 - DNA, 25 bp, Mus musculus
cgtcagaaagcatcgggagatcctc

SEQ ID NO: 609976 - DNA, 25 bp, Mus musculus
cgtcagaaccgtaacgatgggcagg

SEQ ID NO: 609977 - DNA, 25 bp, Mus musculus
cgtcagaaccgttacgatgggcagg

SEQ ID NO: 609978 - DNA, 25 bp, Mus musculus
cgtcagaagctgcactctcagcgtg

SEQ ID NO: 609979 - DNA, 25 bp, Mus musculus
cgtcagaagctggactctcagcgtg

SEQ ID NO: 609980 - DNA, 25 bp, Mus musculus
cgtcagaagtggacagattacccta

SEQ ID NO: 609981 - DNA, 25 bp, Mus musculus
cgtcagaagtggtcagattacccta

SEQ ID NO: 609982 - DNA, 25 bp, Mus musculus
cgtcagacgcgcagagtagcggtct

SEQ ID NO: 609983 - DNA, 25 bp, Mus musculus
cgtcagacgcgctgagtagcggtct

SEQ ID NO: 609984 - DNA, 25 bp, Mus musculus
cgtcagacttaacaggaagcttcag

SEQ ID NO: 609985 - DNA, 25 bp, Mus musculus
cgtcagacttaagaggaagcttcag

SEQ ID NO: 609986 - DNA, 25 bp, Mus musculus
cgtcagagcgaacacgtttgtggca

SEQ ID NO: 609987 - DNA, 25 bp, Mus musculus
cgtcagagcgaagacgtttgtggca

SEQ ID NO: 609988 - DNA, 25 bp, Mus musculus
cgtcagatatcaacaacccagtgga

SEQ ID NO: 609989 - DNA, 25 bp, Mus musculus
cgtcagatatcatcaacccagtgga

SEQ ID NO: 609990 - DNA, 25 bp, Mus musculus
cgtcagatcttcataaagctttgct

SEQ ID NO: 609991 - DNA, 25 bp, Mus musculus
cgtcagatcttcttaaagctttgct

SEQ ID NO: 609992 - DNA, 25 bp, Mus musculus
cgtcagcagatcctttcatggacct

SEQ ID NO: 609993 - DNA, 25 bp, Mus musculus
cgtcagcagatcgtttcatggacct

SEQ ID NO: 609994 - DNA, 25 bp, Mus musculus
cgtcagcagtgtcagcaagaaaggc

SEQ ID NO: 609995 - DNA, 25 bp, Mus musculus
cgtcagcagtgtgagcaagaaaggc

SEQ ID NO: 609996 - DNA, 25 bp, Mus musculus
cgtcagcccggacaatattaactaa

SEQ ID NO: 609997 - DNA, 25 bp, Mus musculus
cgtcagcccggagaatattaactaa

SEQ ID NO: 609998 - DNA, 25 bp, Mus musculus
cgtcagcctcatagagaatatcttg

SEQ ID NO: 609999 - DNA, 25 bp, Mus musculus
cgtcagcctcattgagaatatcttg

SEQ ID NO: 610000 - DNA, 25 bp, Mus musculus
cgtcagcgaccacgagagtcaggat

SEQ ID NO: 610001 - DNA, 25 bp, Mus musculus
cgtcagcgaccaggagagtcaggat

SEQ ID NO: 610002 - DNA, 25 bp, Mus musculus
cgtcagctacttccgaagagtgtac

SEQ ID NO: 610003 - DNA, 25 bp, Mus musculus
cgtcagctacttgcgaagagtgtac

SEQ ID NO: 610004 - DNA, 25 bp, Mus musculus
cgtcagctccgaaagagggagcgac

SEQ ID NO: 610005 - DNA, 25 bp, Mus musculus
cgtcagctccgatagagggagcgac

SEQ ID NO: 610006 - DNA, 25 bp, Mus musculus
cgtcaggaaggcaaaccacagccca

SEQ ID NO: 610007 - DNA, 25 bp, Mus musculus
cgtcaggaaggctaaccacagccca

SEQ ID NO: 610008 - DNA, 25 bp, Mus musculus
cgtcaggagaggagaacaccggcaa

SEQ ID NO: 610009 - DNA, 25 bp, Mus musculus
cgtcaggagaggtgaacaccggcaa

SEQ ID NO: 610010 - DNA, 25 bp, Mus musculus
cgtcaggagatgagtcagcactgtg

SEQ ID NO: 610011 - DNA, 25 bp, Mus musculus
cgtcaggagatgtgtcagcactgtg

SEQ ID NO: 610012 - DNA, 25 bp, Mus musculus
cgtcagtcaggtcaaagtaccgaaa

SEQ ID NO: 610013 - DNA, 25 bp, Mus musculus
cgtcagtcaggtgaaagtaccgaaa

SEQ ID NO: 610014 - DNA, 25 bp, Mus musculus
cgtcagtcccgcagggaagctgtca

SEQ ID NO: 610015 - DNA, 25 bp, Mus musculus
cgtcagtcccgctgggaagctgtca

SEQ ID NO: 610016 - DNA, 25 bp, Mus musculus
cgtcagtgacctcgttataggctta

SEQ ID NO: 610017 - DNA, 25 bp, Mus musculus
cgtcagtgacctggttataggctta

SEQ ID NO: 610018 - DNA, 25 bp, Mus musculus
cgtcagtgccaactgtgcctgggat

SEQ ID NO: 610019 - DNA, 25 bp, Mus musculus
cgtcagtgccaagtgtgcctgggat

SEQ ID NO: 610020 - DNA, 25 bp, Mus musculus
cgtcagtgcgcccaaagtattccag

SEQ ID NO: 610021 - DNA, 25 bp, Mus musculus
cgtcagtgcgccgaaagtattccag

SEQ ID NO: 610022 - DNA, 25 bp, Mus musculus
cgtcagttcgataggtcagcctggc

SEQ ID NO: 610023 - DNA, 25 bp, Mus musculus
cgtcagttcgattggtcagcctggc

SEQ ID NO: 610024 - DNA, 25 bp, Mus musculus
cgtcatcaacttcacctctagctgg

SEQ ID NO: 610025 - DNA, 25 bp, Mus musculus
cgtcatcaacttgacctctagctgg

SEQ ID NO: 610026 - DNA, 25 bp, Mus musculus
cgtcatcaagcaaactgaccctgtc

SEQ ID NO: 610027 - DNA, 25 bp, Mus musculus
cgtcatcaagcatactgaccctgtc

SEQ ID NO: 610028 - DNA, 25 bp, Mus musculus
cgtcatcacggaaacacagtgcaca

SEQ ID NO: 610029 - DNA, 25 bp, Mus musculus
cgtcatcacggatacacagtgcaca

SEQ ID NO: 610030 - DNA, 25 bp, Mus musculus
cgtcatcatcaaatcacagcaagcc

SEQ ID NO: 610031 - DNA, 25 bp, Mus musculus
cgtcatcatcaattcacagcaagcc

SEQ ID NO: 610032 - DNA, 25 bp, Mus musculus
cgtcatcatcatcttgctcacagct

SEQ ID NO: 610033 - DNA, 25 bp, Mus musculus
cgtcatcatcatgttgctcacagct

SEQ ID NO: 610034 - DNA, 25 bp, Mus musculus
cgtcatccatgcaagcgattctgtg

SEQ ID NO: 610035 - DNA, 25 bp, Mus musculus
cgtcatccatgctagcgattctgtg

SEQ ID NO: 610036 - DNA, 25 bp, Mus musculus
cgtcatccgctgctatctggaagaa

SEQ ID NO: 610037 - DNA, 25 bp, Mus musculus
cgtcatccgctggtatctggaagaa

SEQ ID NO: 610038 - DNA, 25 bp, Mus musculus
cgtcatcctgccaataagccggcga

SEQ ID NO: 610039 - DNA, 25 bp, Mus musculus
cgtcatcctgcctataagccggcga

SEQ ID NO: 610040 - DNA, 25 bp, Mus musculus
cgtcatccttccaagcaccatgaga

SEQ ID NO: 610041 - DNA, 25 bp, Mus musculus
cgtcatccttcctagcaccatgaga

SEQ ID NO: 610042 - DNA, 25 bp, Mus musculus
cgtcatcgtaggcaacactcatggg

SEQ ID NO: 610043 - DNA, 25 bp, Mus musculus
cgtcatcgtagggaacactcatggg

SEQ ID NO: 610044 - DNA, 25 bp, Mus musculus
cgtcatctactgagtgcagtgagtg

SEQ ID NO: 610045 - DNA, 25 bp, Mus musculus
cgtcatctactgtgtgcagtgagtg

SEQ ID NO: 610046 - DNA, 25 bp, Mus musculus
cgtcatctccacagtacatcagaag

SEQ ID NO: 610047 - DNA, 25 bp, Mus musculus
cgtcatctccactgtacatcagaag

SEQ ID NO: 610048 - DNA, 25 bp, Mus musculus
cgtcatcttctcactctaccaggaa

SEQ ID NO: 610049 - DNA, 25 bp, Mus musculus
cgtcatcttctctctctaccaggaa

SEQ ID NO: 610050 - DNA, 25 bp, Mus musculus
cgtcatgactaccttctgagtaaag

SEQ ID NO: 610051 - DNA, 25 bp, Mus musculus
cgtcatgactacgttctgagtaaag

SEQ ID NO: 610052 - DNA, 25 bp, Mus musculus
cgtcatgatcttcatcccagcgctt

SEQ ID NO: 610053 - DNA, 25 bp, Mus musculus
cgtcatgatcttgatcccagcgctt

SEQ ID NO: 610054 - DNA, 25 bp, Mus musculus
cgtcatgcgttgattccaggtgact

SEQ ID NO: 610055 - DNA, 25 bp, Mus musculus
cgtcatgcgttgtttccaggtgact

SEQ ID NO: 610056 - DNA, 25 bp, Mus musculus
cgtcatgctgaaaggctcggagcca

SEQ ID NO: 610057 - DNA, 25 bp, Mus musculus
cgtcatgctgaatggctcggagcca

SEQ ID NO: 610058 - DNA, 25 bp, Mus musculus
cgtcatgtcacgcatatgggtaacc

SEQ ID NO: 610059 - DNA, 25 bp, Mus musculus
cgtcatgtcacggatatgggtaacc

SEQ ID NO: 610060 - DNA, 25 bp, Mus musculus
cgtcatgtgactccccagagttggt

SEQ ID NO: 610061 - DNA, 25 bp, Mus musculus
cgtcatgtgactgcccagagttggt

SEQ ID NO: 610062 - DNA, 25 bp, Mus musculus
cgtcattatctcctgcacttgtgga

SEQ ID NO: 610063 - DNA, 25 bp, Mus musculus
cgtcattatctcgtgcacttgtgga

SEQ ID NO: 610064 - DNA, 25 bp, Mus musculus
cgtcattcagtcagatatcagcatg

SEQ ID NO: 610065 - DNA, 25 bp, Mus musculus
cgtcattcagtctgatatcagcatg

SEQ ID NO: 610066 - DNA, 25 bp, Mus musculus
cgtcattcgcgtcgataaggagttc

SEQ ID NO: 610067 - DNA, 25 bp, Mus musculus
cgtcattcgcgtggataaggagttc

SEQ ID NO: 610068 - DNA, 25 bp, Mus musculus
cgtcattgcttgatcacaggatggg

SEQ ID NO: 610069 - DNA, 25 bp, Mus musculus
cgtcattgcttgttcacaggatggg

SEQ ID NO: 610070 - DNA, 25 bp, Mus musculus
cgtcattttctgacatactcactca

SEQ ID NO: 610071 - DNA, 25 bp, Mus musculus
cgtcattttctgtcatactcactca

SEQ ID NO: 610072 - DNA, 25 bp, Mus musculus
cgtcatttttcccagtctcggaaca

SEQ ID NO: 610073 - DNA, 25 bp, Mus musculus
cgtcatttttccgagtctcggaaca

SEQ ID NO: 610074 - DNA, 25 bp, Mus musculus
cgtccaaagaacactgctagtctca

SEQ ID NO: 610075 - DNA, 25 bp, Mus musculus
cgtccaaagaactctgctagtctca

SEQ ID NO: 610076 - DNA, 25 bp, Mus musculus
cgtccaacttcgatagaggctctca

SEQ ID NO: 610077 - DNA, 25 bp, Mus musculus
cgtccaacttcgttagaggctctca

SEQ ID NO: 610078 - DNA, 25 bp, Mus musculus
cgtccaaggagacatacggctcaag

SEQ ID NO: 610079 - DNA, 25 bp, Mus musculus
cgtccaaggagagatacggctcaag

SEQ ID NO: 610080 - DNA, 25 bp, Mus musculus
cgtccaaggcgtcaattatgttagc

SEQ ID NO: 610081 - DNA, 25 bp, Mus musculus
cgtccaaggcgtgaattatgttagc

SEQ ID NO: 610082 - DNA, 25 bp, Mus musculus
cgtccaatctgaaggcgatttgtgt

SEQ ID NO: 610083 - DNA, 25 bp, Mus musculus
cgtccaatctgatggcgatttgtgt

SEQ ID NO: 610084 - DNA, 25 bp, Mus musculus
cgtccacaccggagcggagtccagg

SEQ ID NO: 610085 - DNA, 25 bp, Mus musculus
cgtccacaccggtgcggagtccagg

SEQ ID NO: 610086 - DNA, 25 bp, Mus musculus
cgtccacaggaaagtttgcaggtcc

SEQ ID NO: 610087 - DNA, 25 bp, Mus musculus
cgtccacaggaatgtttgcaggtcc

SEQ ID NO: 610088 - DNA, 25 bp, Mus musculus
cgtccacagtcaacacacttgggaa

SEQ ID NO: 610089 - DNA, 25 bp, Mus musculus
cgtccacagtcatcacacttgggaa

SEQ ID NO: 610090 - DNA, 25 bp, Mus musculus
cgtccacagttgcagaccgccttgt

SEQ ID NO: 610091 - DNA, 25 bp, Mus musculus
cgtccacagttggagaccgccttgt

SEQ ID NO: 610092 - DNA, 25 bp, Mus musculus
cgtccactacatcgtgtttgctgcc

SEQ ID NO: 610093 - DNA, 25 bp, Mus musculus
cgtccactacatggtgtttgctgcc

SEQ ID NO: 610094 - DNA, 25 bp, Mus musculus
cgtccagaggaccagaggttaattt

SEQ ID NO: 610095 - DNA, 25 bp, Mus musculus
cgtccagaggacgagaggttaattt

SEQ ID NO: 610096 - DNA, 25 bp, Mus musculus
cgtccagagtaaattgatgagaaat

SEQ ID NO: 610097 - DNA, 25 bp, Mus musculus
cgtccagagtaatttgatgagaaat

SEQ ID NO: 610098 - DNA, 25 bp, Mus musculus
cgtccaggatatctgtgagtgcatc

SEQ ID NO: 610099 - DNA, 25 bp, Mus musculus
cgtccaggatatgtgtgagtgcatc

SEQ ID NO: 610100 - DNA, 25 bp, Mus musculus
cgtccagttcgaagagggattacca

SEQ ID NO: 610101 - DNA, 25 bp, Mus musculus
cgtccagttcgatgagggattacca

SEQ ID NO: 610102 - DNA, 25 bp, Mus musculus
cgtccatggccacctcttggaaggg

SEQ ID NO: 610103 - DNA, 25 bp, Mus musculus
cgtccatggccagctcttggaaggg

SEQ ID NO: 610104 - DNA, 25 bp, Mus musculus
cgtccatgttcaacatctggtggtg

SEQ ID NO: 610105 - DNA, 25 bp, Mus musculus
cgtccatgttcatcatctggtggtg

SEQ ID NO: 610106 - DNA, 25 bp, Mus musculus
cgtccattggtcaaaaaggttgaag

SEQ ID NO: 610107 - DNA, 25 bp, Mus musculus
cgtccattggtctaaaaggttgaag

SEQ ID NO: 610108 - DNA, 25 bp, Mus musculus
cgtcccaacttccttctaggagtgg

SEQ ID NO: 610109 - DNA, 25 bp, Mus musculus
cgtcccaacttcgttctaggagtgg

SEQ ID NO: 610110 - DNA, 25 bp, Mus musculus
cgtcccaagttgcatttaggcttca

SEQ ID NO: 610111 - DNA, 25 bp, Mus musculus
cgtcccaagttggatttaggcttca

SEQ ID NO: 610112 - DNA, 25 bp, Mus musculus
cgtcccaattgcacacattaaagca

SEQ ID NO: 610113 - DNA, 25 bp, Mus musculus
cgtcccaattgctcacattaaagca

SEQ ID NO: 610114 - DNA, 25 bp, Mus musculus
cgtcccaattgtctatgagaagtat

SEQ ID NO: 610115 - DNA, 25 bp, Mus musculus
cgtcccaattgtgtatgagaagtat

SEQ ID NO: 610116 - DNA, 25 bp, Mus musculus
cgtcccagaaagctgagcaaggaat

SEQ ID NO: 610117 - DNA, 25 bp, Mus musculus
cgtcccagaaaggtgagcaaggaat

SEQ ID NO: 610118 - DNA, 25 bp, Mus musculus
cgtcccagcaggagcggcttcaagc

SEQ ID NO: 610119 - DNA, 25 bp, Mus musculus
cgtcccagcaggtgcggcttcaagc

SEQ ID NO: 610120 - DNA, 25 bp, Mus musculus
cgtccccgcccgaagacaagatgtt

SEQ ID NO: 610121 - DNA, 25 bp, Mus musculus
cgtccccgcccgtagacaagatgtt

SEQ ID NO: 610122 - DNA, 25 bp, Mus musculus
cgtccccgctgcagtgcgaagggct

SEQ ID NO: 610123 - DNA, 25 bp, Mus musculus
cgtccccgctgctgtgcgaagggct

SEQ ID NO: 610124 - DNA, 25 bp, Mus musculus
cgtcccctgcggacttggccttgag

SEQ ID NO: 610125 - DNA, 25 bp, Mus musculus
cgtcccctgcggtcttggccttgag

SEQ ID NO: 610126 - DNA, 25 bp, Mus musculus
cgtcccctgtcaataagcatgcgtg

SEQ ID NO: 610127 - DNA, 25 bp, Mus musculus
cgtcccctgtcattaagcatgcgtg

SEQ ID NO: 610128 - DNA, 25 bp, Mus musculus
cgtcccggaacgaagcagctccgga

SEQ ID NO: 610129 - DNA, 25 bp, Mus musculus
cgtcccggaacgtagcagctccgga

SEQ ID NO: 610130 - DNA, 25 bp, Mus musculus
cgtcccgtatacacgccatactggg

SEQ ID NO: 610131 - DNA, 25 bp, Mus musculus
cgtcccgtatactcgccatactggg

SEQ ID NO: 610132 - DNA, 25 bp, Mus musculus
cgtccctaaaatcaaccgctctatg

SEQ ID NO: 610133 - DNA, 25 bp, Mus musculus
cgtccctaaaatgaaccgctctatg

SEQ ID NO: 610134 - DNA, 25 bp, Mus musculus
cgtccctccggtagttgaatctggt

SEQ ID NO: 610135 - DNA, 25 bp, Mus musculus
cgtccctccggttgttgaatctggt

SEQ ID NO: 610136 - DNA, 25 bp, Mus musculus
cgtccctctctaaggagctgtgaga

SEQ ID NO: 610137 - DNA, 25 bp, Mus musculus
cgtccctctctatggagctgtgaga

SEQ ID NO: 610138 - DNA, 25 bp, Mus musculus
cgtccctctctgaggcgacagcaat

SEQ ID NO: 610139 - DNA, 25 bp, Mus musculus
cgtccctctctgtggcgacagcaat

SEQ ID NO: 610140 - DNA, 25 bp, Mus musculus
cgtccctgaaatcatagagttaata

SEQ ID NO: 610141 - DNA, 25 bp, Mus musculus
cgtccctgaaatgatagagttaata

SEQ ID NO: 610142 - DNA, 25 bp, Mus musculus
cgtccgagccggaggttgagcccca

SEQ ID NO: 610143 - DNA, 25 bp, Mus musculus
cgtccgagccggtggttgagcccca

SEQ ID NO: 610144 - DNA, 25 bp, Mus musculus
cgtccgaggctaaggagcagtgcat

SEQ ID NO: 610145 - DNA, 25 bp, Mus musculus
cgtccgaggctatggagcagtgcat

SEQ ID NO: 610146 - DNA, 25 bp, Mus musculus
cgtccgagtacaaggagaagccgag

SEQ ID NO: 610147 - DNA, 25 bp, Mus musculus
cgtccgagtacatggagaagccgag

SEQ ID NO: 610148 - DNA, 25 bp, Mus musculus
cgtccgcagctcctcatcgtgttgg

SEQ ID NO: 610149 - DNA, 25 bp, Mus musculus
cgtccgcagctcgtcatcgtgttgg

SEQ ID NO: 610150 - DNA, 25 bp, Mus musculus
cgtccgccaggtactaaataaagag

SEQ ID NO: 610151 - DNA, 25 bp, Mus musculus
cgtccgccaggttctaaataaagag

SEQ ID NO: 610152 - DNA, 25 bp, Mus musculus
cgtccgccttctacactagaaatgg

SEQ ID NO: 610153 - DNA, 25 bp, Mus musculus
cgtccgccttcttcactagaaatgg

SEQ ID NO: 610154 - DNA, 25 bp, Mus musculus
cgtccgcgatccacagaactgaaaa

SEQ ID NO: 610155 - DNA, 25 bp, Mus musculus
cgtccgcgatcctcagaactgaaaa

SEQ ID NO: 610156 - DNA, 25 bp, Mus musculus
cgtccgctgtgaacacgatggtgtc

SEQ ID NO: 610157 - DNA, 25 bp, Mus musculus
cgtccgctgtgatcacgatggtgtc

SEQ ID NO: 610158 - DNA, 25 bp, Mus musculus
cgtccggcctctaaaagtcacagct

SEQ ID NO: 610159 - DNA, 25 bp, Mus musculus
cgtccggcctcttaaagtcacagct

SEQ ID NO: 610160 - DNA, 25 bp, Mus musculus
cgtccggctcctccgtcaagatata

SEQ ID NO: 610161 - DNA, 25 bp, Mus musculus
cgtccggctcctgcgtcaagatata

SEQ ID NO: 610162 - DNA, 25 bp, Mus musculus
cgtccgtactgcaaccctcatggga

SEQ ID NO: 610163 - DNA, 25 bp, Mus musculus
cgtccgtactgctaccctcatggga

SEQ ID NO: 610164 - DNA, 25 bp, Mus musculus
cgtccgtctgtcagttatcgtctgt

SEQ ID NO: 610165 - DNA, 25 bp, Mus musculus
cgtccgtctgtctgttatcgtctgt

SEQ ID NO: 610166 - DNA, 25 bp, Mus musculus
cgtccgtgtgtaacagtgcgcccgg

SEQ ID NO: 610167 - DNA, 25 bp, Mus musculus
cgtccgtgtgtatcagtgcgcccgg

SEQ ID NO: 610168 - DNA, 25 bp, Mus musculus
cgtcctaactgaagtggaagggcct

SEQ ID NO: 610169 - DNA, 25 bp, Mus musculus
cgtcctaactgatgtggaagggcct

SEQ ID NO: 610170 - DNA, 25 bp, Mus musculus
cgtcctacctgtcgcaagaggcaca

SEQ ID NO: 610171 - DNA, 25 bp, Mus musculus
cgtcctacctgtggcaagaggcaca

SEQ ID NO: 610172 - DNA, 25 bp, Mus musculus
cgtcctacgggcactcggccgaggt

SEQ ID NO: 610173 - DNA, 25 bp, Mus musculus
cgtcctacgggctctcggccgaggt

SEQ ID NO: 610174 - DNA, 25 bp, Mus musculus
cgtcctactgaacctggatgaagat

SEQ ID NO: 610175 - DNA, 25 bp, Mus musculus
cgtcctactgaagctggatgaagat

SEQ ID NO: 610176 - DNA, 25 bp, Mus musculus
cgtcctagtgtgacagcaccaaatc

SEQ ID NO: 610177 - DNA, 25 bp, Mus musculus
cgtcctagtgtgtcagcaccaaatc

SEQ ID NO: 610178 - DNA, 25 bp, Mus musculus
cgtcctcagattcagttggagaagg

SEQ ID NO: 610179 - DNA, 25 bp, Mus musculus
cgtcctcagattgagttggagaagg

SEQ ID NO: 610180 - DNA, 25 bp, Mus musculus
cgtcctcagtaacgagtaagaaagg

SEQ ID NO: 610181 - DNA, 25 bp, Mus musculus
cgtcctcagtaaggagtaagaaagg

SEQ ID NO: 610182 - DNA, 25 bp, Mus musculus
cgtcctccagctaaacaacgtgaga

SEQ ID NO: 610183 - DNA, 25 bp, Mus musculus
cgtcctccagcttaacaacgtgaga

SEQ ID NO: 610184 - DNA, 25 bp, Mus musculus
cgtcctcccaagatagccgagttca

SEQ ID NO: 610185 - DNA, 25 bp, Mus musculus
cgtcctcccaagttagccgagttca

SEQ ID NO: 610186 - DNA, 25 bp, Mus musculus
cgtcctcgtccaaaaagatgggcag

SEQ ID NO: 610187 - DNA, 25 bp, Mus musculus
cgtcctcgtccataaagatgggcag

SEQ ID NO: 610188 - DNA, 25 bp, Mus musculus
cgtcctctgcaaaaacagagaggag

SEQ ID NO: 610189 - DNA, 25 bp, Mus musculus
cgtcctctgcaataacagagaggag

SEQ ID NO: 610190 - DNA, 25 bp, Mus musculus
cgtcctgagggcaattcctgcacct

SEQ ID NO: 610191 - DNA, 25 bp, Mus musculus
cgtcctgagggctattcctgcacct

SEQ ID NO: 610192 - DNA, 25 bp, Mus musculus
cgtcctgatcgacattggctctggc

SEQ ID NO: 610193 - DNA, 25 bp, Mus musculus
cgtcctgatcgagattggctctggc

SEQ ID NO: 610194 - DNA, 25 bp, Mus musculus
cgtcctgatgtaacgcttgtctcca

SEQ ID NO: 610195 - DNA, 25 bp, Mus musculus
cgtcctgatgtatcgcttgtctcca

SEQ ID NO: 610196 - DNA, 25 bp, Mus musculus
cgtcctgccaacatcgagtctataa

SEQ ID NO: 610197 - DNA, 25 bp, Mus musculus
cgtcctgccaacttcgagtctataa

SEQ ID NO: 610198 - DNA, 25 bp, Mus musculus
cgtcctggactaaggcagagtgcag

SEQ ID NO: 610199 - DNA, 25 bp, Mus musculus
cgtcctggactatggcagagtgcag

SEQ ID NO: 610200 - DNA, 25 bp, Mus musculus
cgtcctggactcactcatgagcgcg

SEQ ID NO: 610201 - DNA, 25 bp, Mus musculus
cgtcctggactctctcatgagcgcg

SEQ ID NO: 610202 - DNA, 25 bp, Mus musculus
cgtcctgttggaagataaccgaagc

SEQ ID NO: 610203 - DNA, 25 bp, Mus musculus
cgtcctgttggatgataaccgaagc

SEQ ID NO: 610204 - DNA, 25 bp, Mus musculus
cgtccttggtacctgagcaggcgcc

SEQ ID NO: 610205 - DNA, 25 bp, Mus musculus
cgtccttggtacgtgagcaggcgcc

SEQ ID NO: 610206 - DNA, 25 bp, Mus musculus
cgtcctttcacgagtcatgctggag

SEQ ID NO: 610207 - DNA, 25 bp, Mus musculus
cgtcctttcacgtgtcatgctggag

SEQ ID NO: 610208 - DNA, 25 bp, Mus musculus
cgtcctttccaacatgggtgttcag

SEQ ID NO: 610209 - DNA, 25 bp, Mus musculus
cgtcctttccaagatgggtgttcag

SEQ ID NO: 610210 - DNA, 25 bp, Mus musculus
cgtcctttcgatactagccactgag

SEQ ID NO: 610211 - DNA, 25 bp, Mus musculus
cgtcctttcgattctagccactgag

SEQ ID NO: 610212 - DNA, 25 bp, Mus musculus
cgtcgaaaggatcgcactgttatta

SEQ ID NO: 610213 - DNA, 25 bp, Mus musculus
cgtcgaaaggatggcactgttatta

SEQ ID NO: 610214 - DNA, 25 bp, Mus musculus
cgtcgaactcctatgatgtgatcag

SEQ ID NO: 610215 - DNA, 25 bp, Mus musculus
cgtcgaactcctttgatgtgatcag

SEQ ID NO: 610216 - DNA, 25 bp, Mus musculus
cgtcgaagctttcactagactgcca

SEQ ID NO: 610217 - DNA, 25 bp, Mus musculus
cgtcgaagctttgactagactgcca

SEQ ID NO: 610218 - DNA, 25 bp, Mus musculus
cgtcgagatcttatccacatgcaac

SEQ ID NO: 610219 - DNA, 25 bp, Mus musculus
cgtcgagatcttttccacatgcaac

SEQ ID NO: 610220 - DNA, 25 bp, Mus musculus
cgtcgcagacatcgagcaaggctac

SEQ ID NO: 610221 - DNA, 25 bp, Mus musculus
cgtcgcagacatggagcaaggctac

SEQ ID NO: 610222 - DNA, 25 bp, Mus musculus
cgtcgcagccagaaggagttttcct

SEQ ID NO: 610223 - DNA, 25 bp, Mus musculus
cgtcgcagccagtaggagttttcct

SEQ ID NO: 610224 - DNA, 25 bp, Mus musculus
cgtcgcatcgtgactcagttgttga

SEQ ID NO: 610225 - DNA, 25 bp, Mus musculus
cgtcgcatcgtgtctcagttgttga

SEQ ID NO: 610226 - DNA, 25 bp, Mus musculus
cgtcgccagcggcaactaaatcgta

SEQ ID NO: 610227 - DNA, 25 bp, Mus musculus
cgtcgccagcgggaactaaatcgta

SEQ ID NO: 610228 - DNA, 25 bp, Mus musculus
cgtcgcggcttgcatttcaaactgg

SEQ ID NO: 610229 - DNA, 25 bp, Mus musculus
cgtcgcggcttggatttcaaactgg

SEQ ID NO: 610230 - DNA, 25 bp, Mus musculus
cgtcgctccagcaagaactcctgag

SEQ ID NO: 610231 - DNA, 25 bp, Mus musculus
cgtcgctccagctagaactcctgag

SEQ ID NO: 610232 - DNA, 25 bp, Mus musculus
cgtcgcttgcatcccgggtcatggc

SEQ ID NO: 610233 - DNA, 25 bp, Mus musculus
cgtcgcttgcatgccgggtcatggc

SEQ ID NO: 610234 - DNA, 25 bp, Mus musculus
cgtcggaagtatcggactagaaact

SEQ ID NO: 610235 - DNA, 25 bp, Mus musculus
cgtcggaagtatgggactagaaact

SEQ ID NO: 610236 - DNA, 25 bp, Mus musculus
cgtcggaatatccaggccctgaaga

SEQ ID NO: 610237 - DNA, 25 bp, Mus musculus
cgtcggaatatcgaggccctgaaga

SEQ ID NO: 610238 - DNA, 25 bp, Mus musculus
cgtcggaatgtgagacatcgacatc

SEQ ID NO: 610239 - DNA, 25 bp, Mus musculus
cgtcggaatgtgtgacatcgacatc

SEQ ID NO: 610240 - DNA, 25 bp, Mus musculus
cgtcggacctaaagaggttccccag

SEQ ID NO: 610241 - DNA, 25 bp, Mus musculus
cgtcggacctaatgaggttccccag

SEQ ID NO: 610242 - DNA, 25 bp, Mus musculus
cgtcggatggccaagccctggtcct

SEQ ID NO: 610243 - DNA, 25 bp, Mus musculus
cgtcggatggcctagccctggtcct

SEQ ID NO: 610244 - DNA, 25 bp, Mus musculus
cgtcggatgtagacctggacaagta

SEQ ID NO: 610245 - DNA, 25 bp, Mus musculus
cgtcggatgtagtcctggacaagta

SEQ ID NO: 610246 - DNA, 25 bp, Mus musculus
cgtcggcaacgacacgttctttgtt

SEQ ID NO: 610247 - DNA, 25 bp, Mus musculus
cgtcggcaacgagacgttctttgtt

SEQ ID NO: 610248 - DNA, 25 bp, Mus musculus
cgtcggcagaacaccatcgtggtga

SEQ ID NO: 610249 - DNA, 25 bp, Mus musculus
cgtcggcagaactccatcgtggtga

SEQ ID NO: 610250 - DNA, 25 bp, Mus musculus
cgtcggcagagacatggcttcggaa

SEQ ID NO: 610251 - DNA, 25 bp, Mus musculus
cgtcggcagagagatggcttcggaa

SEQ ID NO: 610252 - DNA, 25 bp, Mus musculus
cgtcgggctgcaagatcggcccgtc

SEQ ID NO: 610253 - DNA, 25 bp, Mus musculus
cgtcgggctgcatgatcggcccgtc

SEQ ID NO: 610254 - DNA, 25 bp, Mus musculus
cgtcgggtaccgaagccatccttct

SEQ ID NO: 610255 - DNA, 25 bp, Mus musculus
cgtcgggtaccgtagccatccttct

SEQ ID NO: 610256 - DNA, 25 bp, Mus musculus
cgtcgggtgactcctccctcaggat

SEQ ID NO: 610257 - DNA, 25 bp, Mus musculus
cgtcgggtgactgctccctcaggat

SEQ ID NO: 610258 - DNA, 25 bp, Mus musculus
cgtcgggtggttaccgttcagacag

SEQ ID NO: 610259 - DNA, 25 bp, Mus musculus
cgtcgggtggtttccgttcagacag

SEQ ID NO: 610260 - DNA, 25 bp, Mus musculus
cgtcggtacacgaggagcagataac

SEQ ID NO: 610261 - DNA, 25 bp, Mus musculus
cgtcggtacacgtggagcagataac

SEQ ID NO: 610262 - DNA, 25 bp, Mus musculus
cgtcgtatcgctataaccctgacag

SEQ ID NO: 610263 - DNA, 25 bp, Mus musculus
cgtcgtatcgctttaaccctgacag

SEQ ID NO: 610264 - DNA, 25 bp, Mus musculus
cgtcgtcaggctccccaggagctgt

SEQ ID NO: 610265 - DNA, 25 bp, Mus musculus
cgtcgtcaggctgcccaggagctgt

SEQ ID NO: 610266 - DNA, 25 bp, Mus musculus
cgtcgtccacagcacatgatgtcag

SEQ ID NO: 610267 - DNA, 25 bp, Mus musculus
cgtcgtccacaggacatgatgtcag

SEQ ID NO: 610268 - DNA, 25 bp, Mus musculus
cgtcgtgcacttcacagagaaaatg

SEQ ID NO: 610269 - DNA, 25 bp, Mus musculus
cgtcgtgcacttgacagagaaaatg

SEQ ID NO: 610270 - DNA, 25 bp, Mus musculus
cgtcgtgcgcaacggcctacagtgc

SEQ ID NO: 610271 - DNA, 25 bp, Mus musculus
cgtcgtgcgcaagggcctacagtgc

SEQ ID NO: 610272 - DNA, 25 bp, Mus musculus
cgtcgtggagccattaaacaggcca

SEQ ID NO: 610273 - DNA, 25 bp, Mus musculus
cgtcgtggagcctttaaacaggcca

SEQ ID NO: 610274 - DNA, 25 bp, Mus musculus
cgtcgtggcagtcgctcagcttgta

SEQ ID NO: 610275 - DNA, 25 bp, Mus musculus
cgtcgtggcagtggctcagcttgta

SEQ ID NO: 610276 - DNA, 25 bp, Mus musculus
cgtcgtgtagacatccatgatgttc

SEQ ID NO: 610277 - DNA, 25 bp, Mus musculus
cgtcgtgtagacttccatgatgttc

SEQ ID NO: 610278 - DNA, 25 bp, Mus musculus
cgtcgtgtccgcaacataaatggca

SEQ ID NO: 610279 - DNA, 25 bp, Mus musculus
cgtcgtgtccgctacataaatggca

SEQ ID NO: 610280 - DNA, 25 bp, Mus musculus
cgtcgtgtcggcacgcgtgtcctcg

SEQ ID NO: 610281 - DNA, 25 bp, Mus musculus
cgtcgtgtcggctcgcgtgtcctcg

SEQ ID NO: 610282 - DNA, 25 bp, Mus musculus
cgtcgttgcgcgacctcagtattta

SEQ ID NO: 610283 - DNA, 25 bp, Mus musculus
cgtcgttgcgcgtcctcagtattta

SEQ ID NO: 610284 - DNA, 25 bp, Mus musculus
cgtcgttggagactcaaacagcgga

SEQ ID NO: 610285 - DNA, 25 bp, Mus musculus
cgtcgttggagagtcaaacagcgga

SEQ ID NO: 610286 - DNA, 25 bp, Mus musculus
cgtcgtttacagaggcctccaggga

SEQ ID NO: 610287 - DNA, 25 bp, Mus musculus
cgtcgtttacagtggcctccaggga

SEQ ID NO: 610288 - DNA, 25 bp, Mus musculus
cgtctacacccaaatttgcatatgg

SEQ ID NO: 610289 - DNA, 25 bp, Mus musculus
cgtctacacccatatttgcatatgg

SEQ ID NO: 610290 - DNA, 25 bp, Mus musculus
cgtctagagccccttctgtgagcca

SEQ ID NO: 610291 - DNA, 25 bp, Mus musculus
cgtctagagcccgttctgtgagcca

SEQ ID NO: 610292 - DNA, 25 bp, Mus musculus
cgtctagaggaaagtaagatgattt

SEQ ID NO: 610293 - DNA, 25 bp, Mus musculus
cgtctagaggaatgtaagatgattt

SEQ ID NO: 610294 - DNA, 25 bp, Mus musculus
cgtctagtctatatattgtcgcggg

SEQ ID NO: 610295 - DNA, 25 bp, Mus musculus
cgtctagtctatttattgtcgcggg

SEQ ID NO: 610296 - DNA, 25 bp, Mus musculus
cgtctagtgactacctgttaattat

SEQ ID NO: 610297 - DNA, 25 bp, Mus musculus
cgtctagtgacttcctgttaattat

SEQ ID NO: 610298 - DNA, 25 bp, Mus musculus
cgtctatctgtccatcgaggcagct

SEQ ID NO: 610299 - DNA, 25 bp, Mus musculus
cgtctatctgtcgatcgaggcagct

SEQ ID NO: 610300 - DNA, 25 bp, Mus musculus
cgtctattggcacagactcttacag

SEQ ID NO: 610301 - DNA, 25 bp, Mus musculus
cgtctattggcagagactcttacag

SEQ ID NO: 610302 - DNA, 25 bp, Mus musculus
cgtctcagggttcggtgcaagcata

SEQ ID NO: 610303 - DNA, 25 bp, Mus musculus
cgtctcagggttgggtgcaagcata

SEQ ID NO: 610304 - DNA, 25 bp, Mus musculus
cgtctcattgagatctacaagcatg

SEQ ID NO: 610305 - DNA, 25 bp, Mus musculus
cgtctcattgagttctacaagcatg

SEQ ID NO: 610306 - DNA, 25 bp, Mus musculus
cgtctccaggtgaatagcagcaggc

SEQ ID NO: 610307 - DNA, 25 bp, Mus musculus
cgtctccaggtgtatagcagcaggc

SEQ ID NO: 610308 - DNA, 25 bp, Mus musculus
cgtctcccaagcaggtcaggtggaa

SEQ ID NO: 610309 - DNA, 25 bp, Mus musculus
cgtctcccaagctggtcaggtggaa

SEQ ID NO: 610310 - DNA, 25 bp, Mus musculus
cgtctccccgtaatttgtggctttg

SEQ ID NO: 610311 - DNA, 25 bp, Mus musculus
cgtctccccgtattttgtggctttg

SEQ ID NO: 610312 - DNA, 25 bp, Mus musculus
cgtctccggcatcaccatgtgctat

SEQ ID NO: 610313 - DNA, 25 bp, Mus musculus
cgtctccggcatgaccatgtgctat

SEQ ID NO: 610314 - DNA, 25 bp, Mus musculus
cgtctcctgctcagggcaagaagag

SEQ ID NO: 610315 - DNA, 25 bp, Mus musculus
cgtctcctgctctgggcaagaagag

SEQ ID NO: 610316 - DNA, 25 bp, Mus musculus
cgtctcctggacctctacggctggg

SEQ ID NO: 610317 - DNA, 25 bp, Mus musculus
cgtctcctggacgtctacggctggg

SEQ ID NO: 610318 - DNA, 25 bp, Mus musculus
cgtctccttctaacagcccagagaa

SEQ ID NO: 610319 - DNA, 25 bp, Mus musculus
cgtctccttctatcagcccagagaa

SEQ ID NO: 610320 - DNA, 25 bp, Mus musculus
cgtctcggctggaccagaggcgatc

SEQ ID NO: 610321 - DNA, 25 bp, Mus musculus
cgtctcggctggtccagaggcgatc

SEQ ID NO: 610322 - DNA, 25 bp, Mus musculus
cgtctctcagtgctttgtgttgaaa

SEQ ID NO: 610323 - DNA, 25 bp, Mus musculus
cgtctctcagtggtttgtgttgaaa

SEQ ID NO: 610324 - DNA, 25 bp, Mus musculus
cgtctctggatgaggtagacgagaa

SEQ ID NO: 610325 - DNA, 25 bp, Mus musculus
cgtctctggatgcaactgggaacct

SEQ ID NO: 610326 - DNA, 25 bp, Mus musculus
cgtctctggatggaactgggaacct

SEQ ID NO: 610327 - DNA, 25 bp, Mus musculus
cgtctctggatgtggtagacgagaa

SEQ ID NO: 610328 - DNA, 25 bp, Mus musculus
cgtctctggcagaacgcgctgcttg

SEQ ID NO: 610329 - DNA, 25 bp, Mus musculus
cgtctctggcagtacgcgctgcttg

SEQ ID NO: 610330 - DNA, 25 bp, Mus musculus
cgtctctttctgctagaagacttgg

SEQ ID NO: 610331 - DNA, 25 bp, Mus musculus
cgtctctttctggtagaagacttgg

SEQ ID NO: 610332 - DNA, 25 bp, Mus musculus
cgtctgacaggccttgtgagggctt

SEQ ID NO: 610333 - DNA, 25 bp, Mus musculus
cgtctgacaggcgttgtgagggctt

SEQ ID NO: 610334 - DNA, 25 bp, Mus musculus
cgtctgattggccatgcggccaaga

SEQ ID NO: 610335 - DNA, 25 bp, Mus musculus
cgtctgattggcgatgcggccaaga

SEQ ID NO: 610336 - DNA, 25 bp, Mus musculus
cgtctgcagtgaacatgatggagct

SEQ ID NO: 610337 - DNA, 25 bp, Mus musculus
cgtctgcagtgatcatgatggagct

SEQ ID NO: 610338 - DNA, 25 bp, Mus musculus
cgtctgcatgaaatccaagcgccac

SEQ ID NO: 610339 - DNA, 25 bp, Mus musculus
cgtctgcatgaattccaagcgccac

SEQ ID NO: 610340 - DNA, 25 bp, Mus musculus
cgtctgcggccaagctgtgcctgaa

SEQ ID NO: 610341 - DNA, 25 bp, Mus musculus
cgtctgcggccatgctgtgcctgaa

SEQ ID NO: 610342 - DNA, 25 bp, Mus musculus
cgtctgcgtgggacactcagcagtg

SEQ ID NO: 610343 - DNA, 25 bp, Mus musculus
cgtctgcgtgggtcactcagcagtg

SEQ ID NO: 610344 - DNA, 25 bp, Mus musculus
cgtctgctccgcatgtccagggtgg

SEQ ID NO: 610345 - DNA, 25 bp, Mus musculus
cgtctgctccgcttgtccagggtgg

SEQ ID NO: 610346 - DNA, 25 bp, Mus musculus
cgtctgctccgtcccaggcgaggat

SEQ ID NO: 610347 - DNA, 25 bp, Mus musculus
cgtctgctccgtgccaggcgaggat

SEQ ID NO: 610348 - DNA, 25 bp, Mus musculus
cgtctgctcgggagttcagagcccc

SEQ ID NO: 610349 - DNA, 25 bp, Mus musculus
cgtctgctcgggtgttcagagcccc

SEQ ID NO: 610350 - DNA, 25 bp, Mus musculus
cgtctggaagtacgaggtcgcctca

SEQ ID NO: 610351 - DNA, 25 bp, Mus musculus
cgtctggaagtaggaggtcgcctca

SEQ ID NO: 610352 - DNA, 25 bp, Mus musculus
cgtctggaccggactcagcctggag

SEQ ID NO: 610353 - DNA, 25 bp, Mus musculus
cgtctggaccggtctcagcctggag

SEQ ID NO: 610354 - DNA, 25 bp, Mus musculus
cgtctggagtggcatggcttcttca

SEQ ID NO: 610355 - DNA, 25 bp, Mus musculus
cgtctggagtgggatggcttcttca

SEQ ID NO: 610356 - DNA, 25 bp, Mus musculus
cgtctgggcagaatgtcacgatgga

SEQ ID NO: 610357 - DNA, 25 bp, Mus musculus
cgtctgggcagattgtcacgatgga

SEQ ID NO: 610358 - DNA, 25 bp, Mus musculus
cgtctgtacctgcagagccaggaag

SEQ ID NO: 610359 - DNA, 25 bp, Mus musculus
cgtctgtacctggagagccaggaag

SEQ ID NO: 610360 - DNA, 25 bp, Mus musculus
cgtctgtagccaacccggtgactga

SEQ ID NO: 610361 - DNA, 25 bp, Mus musculus
cgtctgtagccatcccggtgactga

SEQ ID NO: 610362 - DNA, 25 bp, Mus musculus
cgtctgtcagcacacgaggacctgg

SEQ ID NO: 610363 - DNA, 25 bp, Mus musculus
cgtctgtcagcagacgaggacctgg

SEQ ID NO: 610364 - DNA, 25 bp, Mus musculus
cgtctgtctgttaacctgcccaagt

SEQ ID NO: 610365 - DNA, 25 bp, Mus musculus
cgtctgtctgtttacctgcccaagt

SEQ ID NO: 610366 - DNA, 25 bp, Mus musculus
cgtctgtgccatcttcttggttgga

SEQ ID NO: 610367 - DNA, 25 bp, Mus musculus
cgtctgtgccatgttcttggttgga

SEQ ID NO: 610368 - DNA, 25 bp, Mus musculus
cgtctgtggtcgaccggtatccgaa

SEQ ID NO: 610369 - DNA, 25 bp, Mus musculus
cgtctgtggtcgtccggtatccgaa

SEQ ID NO: 610370 - DNA, 25 bp, Mus musculus
cgtcttaacagacttagaacttggg

SEQ ID NO: 610371 - DNA, 25 bp, Mus musculus
cgtcttaacagagttagaacttggg

SEQ ID NO: 610372 - DNA, 25 bp, Mus musculus
cgtcttaaggcacagactagcaagg

SEQ ID NO: 610373 - DNA, 25 bp, Mus musculus
cgtcttaaggcagagactagcaagg

SEQ ID NO: 610374 - DNA, 25 bp, Mus musculus
cgtcttacgcagaagctacttggga

SEQ ID NO: 610375 - DNA, 25 bp, Mus musculus
cgtcttacgcagtagctacttggga

SEQ ID NO: 610376 - DNA, 25 bp, Mus musculus
cgtcttacttgactcagaaggtcac

SEQ ID NO: 610377 - DNA, 25 bp, Mus musculus
cgtcttacttgagtcagaaggtcac

SEQ ID NO: 610378 - DNA, 25 bp, Mus musculus
cgtcttaggaagcacccagcatcca

SEQ ID NO: 610379 - DNA, 25 bp, Mus musculus
cgtcttaggaaggacccagcatcca

SEQ ID NO: 610380 - DNA, 25 bp, Mus musculus
cgtcttagggtcagagcatgctcag

SEQ ID NO: 610381 - DNA, 25 bp, Mus musculus
cgtcttagggtctgagcatgctcag

SEQ ID NO: 610382 - DNA, 25 bp, Mus musculus
cgtcttcccaacaactggtactaca

SEQ ID NO: 610383 - DNA, 25 bp, Mus musculus
cgtcttcccaactactggtactaca

SEQ ID NO: 610384 - DNA, 25 bp, Mus musculus
cgtcttccggccctgcttgatgggt

SEQ ID NO: 610385 - DNA, 25 bp, Mus musculus
cgtcttccggccgtgcttgatgggt

SEQ ID NO: 610386 - DNA, 25 bp, Mus musculus
cgtcttctgggacctgtattgtgcg

SEQ ID NO: 610387 - DNA, 25 bp, Mus musculus
cgtcttctgggagctgtattgtgcg

SEQ ID NO: 610388 - DNA, 25 bp, Mus musculus
cgtcttctttggagactgtccctat

SEQ ID NO: 610389 - DNA, 25 bp, Mus musculus
cgtcttctttggtgactgtccctat

SEQ ID NO: 610390 - DNA, 25 bp, Mus musculus
cgtcttgaaggtccttatctctttt

SEQ ID NO: 610391 - DNA, 25 bp, Mus musculus
cgtcttgaaggtgcttatctctttt

SEQ ID NO: 610392 - DNA, 25 bp, Mus musculus
cgtcttgcacagagtggctgctgct

SEQ ID NO: 610393 - DNA, 25 bp, Mus musculus
cgtcttgcacagtgtggctgctgct

SEQ ID NO: 610394 - DNA, 25 bp, Mus musculus
cgtcttggcagtaagattgggagca

SEQ ID NO: 610395 - DNA, 25 bp, Mus musculus
cgtcttggcagttagattgggagca

SEQ ID NO: 610396 - DNA, 25 bp, Mus musculus
cgtcttggcttcaaatccgtcgaag

SEQ ID NO: 610397 - DNA, 25 bp, Mus musculus
cgtcttggcttctaatccgtcgaag

SEQ ID NO: 610398 - DNA, 25 bp, Mus musculus
cgtcttgtaacgaagggtggagctt

SEQ ID NO: 610399 - DNA, 25 bp, Mus musculus
cgtcttgtaacgtagggtggagctt

SEQ ID NO: 610400 - DNA, 25 bp, Mus musculus
cgtctttaatagagcagatgattct

SEQ ID NO: 610401 - DNA, 25 bp, Mus musculus
cgtctttaatagtgcagatgattct

SEQ ID NO: 610402 - DNA, 25 bp, Mus musculus
cgtctttcacaaaggccttcacaat

SEQ ID NO: 610403 - DNA, 25 bp, Mus musculus
cgtctttcacaatggccttcacaat

SEQ ID NO: 610404 - DNA, 25 bp, Mus musculus
cgtctttgtctacaatataactaca

SEQ ID NO: 610405 - DNA, 25 bp, Mus musculus
cgtctttgtctagaatataactaca

SEQ ID NO: 610406 - DNA, 25 bp, Mus musculus
cgtctttttgctctgctgagatttg

SEQ ID NO: 610407 - DNA, 25 bp, Mus musculus
cgtctttttgctgtgctgagatttg

SEQ ID NO: 610408 - DNA, 25 bp, Mus musculus
cgtgaaaactacaacttccagagct

SEQ ID NO: 610409 - DNA, 25 bp, Mus musculus
cgtgaaaactactacttccagagct

SEQ ID NO: 610410 - DNA, 25 bp, Mus musculus
cgtgaaaagatgcacctgacagcaa

SEQ ID NO: 610411 - DNA, 25 bp, Mus musculus
cgtgaaaagatggacctgacagcaa

SEQ ID NO: 610412 - DNA, 25 bp, Mus musculus
cgtgaaacctgaccaacattaaggc

SEQ ID NO: 610413 - DNA, 25 bp, Mus musculus
cgtgaaacctgagcaacattaaggc

SEQ ID NO: 610414 - DNA, 25 bp, Mus musculus
cgtgaaagagaacggaactgtgtac

SEQ ID NO: 610415 - DNA, 25 bp, Mus musculus
cgtgaaagagaagggaactgtgtac

SEQ ID NO: 610416 - DNA, 25 bp, Mus musculus
cgtgaaagggctcccactagaagaa

SEQ ID NO: 610417 - DNA, 25 bp, Mus musculus
cgtgaaagggctgccactagaagaa

SEQ ID NO: 610418 - DNA, 25 bp, Mus musculus
cgtgaaagtctacgaggacgaaaca

SEQ ID NO: 610419 - DNA, 25 bp, Mus musculus
cgtgaaagtctaggaggacgaaaca

SEQ ID NO: 610420 - DNA, 25 bp, Mus musculus
cgtgaacaggacaagtactactatc

SEQ ID NO: 610421 - DNA, 25 bp, Mus musculus
cgtgaacaggactagtactactatc

SEQ ID NO: 610422 - DNA, 25 bp, Mus musculus
cgtgaactcaagcaaacagagggct

SEQ ID NO: 610423 - DNA, 25 bp, Mus musculus
cgtgaactcaaggaaacagagggct

SEQ ID NO: 610424 - DNA, 25 bp, Mus musculus
cgtgaactctgacggagatcatgga

SEQ ID NO: 610425 - DNA, 25 bp, Mus musculus
cgtgaactctgagggagatcatgga

SEQ ID NO: 610426 - DNA, 25 bp, Mus musculus
cgtgaactgcggagctggacctagc

SEQ ID NO: 610427 - DNA, 25 bp, Mus musculus
cgtgaactgcggtgctggacctagc

SEQ ID NO: 610428 - DNA, 25 bp, Mus musculus
cgtgaactgtgaacgtgcccattct

SEQ ID NO: 610429 - DNA, 25 bp, Mus musculus
cgtgaactgtgatcgtgcccattct

SEQ ID NO: 610430 - DNA, 25 bp, Mus musculus
cgtgaagaagtacaaaggacaggca

SEQ ID NO: 610431 - DNA, 25 bp, Mus musculus
cgtgaagaagtagaaaggacaggca

SEQ ID NO: 610432 - DNA, 25 bp, Mus musculus
cgtgaagagaatactggaacagatg

SEQ ID NO: 610433 - DNA, 25 bp, Mus musculus
cgtgaagagaattctggaacagatg

SEQ ID NO: 610434 - DNA, 25 bp, Mus musculus
cgtgaagatgctaaaggaagaggcc

SEQ ID NO: 610435 - DNA, 25 bp, Mus musculus
cgtgaagatgcttaaggaagaggcc

SEQ ID NO: 610436 - DNA, 25 bp, Mus musculus
cgtgaagatggacccggaattccag

SEQ ID NO: 610437 - DNA, 25 bp, Mus musculus
cgtgaagatggagccggaattccag

SEQ ID NO: 610438 - DNA, 25 bp, Mus musculus
cgtgaagcaaacctgcaagctctga

SEQ ID NO: 610439 - DNA, 25 bp, Mus musculus
cgtgaagcaaacgtgcaagctctga

SEQ ID NO: 610440 - DNA, 25 bp, Mus musculus
cgtgaagcacatcctggctgcctct

SEQ ID NO: 610441 - DNA, 25 bp, Mus musculus
cgtgaagcacatgctggctgcctct

SEQ ID NO: 610442 - DNA, 25 bp, Mus musculus
cgtgaagcccgaatgtctggatgcc

SEQ ID NO: 610443 - DNA, 25 bp, Mus musculus
cgtgaagcccgattgtctggatgcc

SEQ ID NO: 610444 - DNA, 25 bp, Mus musculus
cgtgaagcgtttccagccgtcgttt

SEQ ID NO: 610445 - DNA, 25 bp, Mus musculus
cgtgaagcgtttgcagccgtcgttt

SEQ ID NO: 610446 - DNA, 25 bp, Mus musculus
cgtgaaggtgaacagttcaaacatc

SEQ ID NO: 610447 - DNA, 25 bp, Mus musculus
cgtgaaggtgaagagttcaaacatc

SEQ ID NO: 610448 - DNA, 25 bp, Mus musculus
cgtgaaggtgccaactttgactcca

SEQ ID NO: 610449 - DNA, 25 bp, Mus musculus
cgtgaaggtgcctactttgactcca

SEQ ID NO: 610450 - DNA, 25 bp, Mus musculus
cgtgaagtcggaagtcgccatgttg

SEQ ID NO: 610451 - DNA, 25 bp, Mus musculus
cgtgaagtcggatgtcgccatgttg

SEQ ID NO: 610452 - DNA, 25 bp, Mus musculus
cgtgaagttattatgtgtaaggatc

SEQ ID NO: 610453 - DNA, 25 bp, Mus musculus
cgtgaagttattttgtgtaaggatc

SEQ ID NO: 610454 - DNA, 25 bp, Mus musculus
cgtgaataggatctgtctggccgct

SEQ ID NO: 610455 - DNA, 25 bp, Mus musculus
cgtgaataggatgtgtctggccgct

SEQ ID NO: 610456 - DNA, 25 bp, Mus musculus
cgtgaatcccttactgaggaagagg

SEQ ID NO: 610457 - DNA, 25 bp, Mus musculus
cgtgaatccctttctgaggaagagg

SEQ ID NO: 610458 - DNA, 25 bp, Mus musculus
cgtgaatcttggctgtaaacttgac

SEQ ID NO: 610459 - DNA, 25 bp, Mus musculus
cgtgaatcttgggtgtaaacttgac

SEQ ID NO: 610460 - DNA, 25 bp, Mus musculus
cgtgaatgggatcaaaatctcaaag

SEQ ID NO: 610461 - DNA, 25 bp, Mus musculus
cgtgaatgggatgaaaatctcaaag

SEQ ID NO: 610462 - DNA, 25 bp, Mus musculus
cgtgaattaccacagcagcagaagc

SEQ ID NO: 610463 - DNA, 25 bp, Mus musculus
cgtgaattaccagagcagcagaagc

SEQ ID NO: 610464 - DNA, 25 bp, Mus musculus
cgtgacaaatcacgatgagggcccc

SEQ ID NO: 610465 - DNA, 25 bp, Mus musculus
cgtgacaaatcaggatgagggcccc

SEQ ID NO: 610466 - DNA, 25 bp, Mus musculus
cgtgacacacaaccgcctagaaaga

SEQ ID NO: 610467 - DNA, 25 bp, Mus musculus
cgtgacacacaagcgcctagaaaga

SEQ ID NO: 610468 - DNA, 25 bp, Mus musculus
cgtgacactacaccagcacatcagg

SEQ ID NO: 610469 - DNA, 25 bp, Mus musculus
cgtgacactacagcagcacatcagg

SEQ ID NO: 610470 - DNA, 25 bp, Mus musculus
cgtgacagcagtccgccctatgcag

SEQ ID NO: 610471 - DNA, 25 bp, Mus musculus
cgtgacagcagtgcgccctatgcag

SEQ ID NO: 610472 - DNA, 25 bp, Mus musculus
cgtgacattctactggaggcagaca

SEQ ID NO: 610473 - DNA, 25 bp, Mus musculus
cgtgacattctagtggaggcagaca

SEQ ID NO: 610474 - DNA, 25 bp, Mus musculus
cgtgaccaagcaccaaaattgatgg

SEQ ID NO: 610475 - DNA, 25 bp, Mus musculus
cgtgaccaagcagcaaaattgatgg

SEQ ID NO: 610476 - DNA, 25 bp, Mus musculus
cgtgaccccgacactacgtgagacg

SEQ ID NO: 610477 - DNA, 25 bp, Mus musculus
cgtgaccccgactctacgtgagacg

SEQ ID NO: 610478 - DNA, 25 bp, Mus musculus
cgtgaccctactcactttggtcttg

SEQ ID NO: 610479 - DNA, 25 bp, Mus musculus
cgtgaccctactgactttggtcttg

SEQ ID NO: 610480 - DNA, 25 bp, Mus musculus
cgtgaccctgatagggatgagtgtt

SEQ ID NO: 610481 - DNA, 25 bp, Mus musculus
cgtgaccctgattgggatgagtgtt

SEQ ID NO: 610482 - DNA, 25 bp, Mus musculus
cgtgaccgcttgcatctcaccgttt

SEQ ID NO: 610483 - DNA, 25 bp, Mus musculus
cgtgaccgcttggatctcaccgttt

SEQ ID NO: 610484 - DNA, 25 bp, Mus musculus
cgtgacctcatcagcaagtaccaga

SEQ ID NO: 610485 - DNA, 25 bp, Mus musculus
cgtgacctcatctgcaagtaccaga

SEQ ID NO: 610486 - DNA, 25 bp, Mus musculus
cgtgacctcgtgaggctggcatgca

SEQ ID NO: 610487 - DNA, 25 bp, Mus musculus
cgtgacctcgtgtggctggcatgca

SEQ ID NO: 610488 - DNA, 25 bp, Mus musculus
cgtgacctttgtccttttccgtggg

SEQ ID NO: 610489 - DNA, 25 bp, Mus musculus
cgtgacctttgtgcttttccgtggg

SEQ ID NO: 610490 - DNA, 25 bp, Mus musculus
cgtgacggtgccagcatgaagctaa

SEQ ID NO: 610491 - DNA, 25 bp, Mus musculus
cgtgacggtgcctgcatgaagctaa

SEQ ID NO: 610492 - DNA, 25 bp, Mus musculus
cgtgacgtgccaagctgtgaccaaa

SEQ ID NO: 610493 - DNA, 25 bp, Mus musculus
cgtgacgtgccatgctgtgaccaaa

SEQ ID NO: 610494 - DNA, 25 bp, Mus musculus
cgtgactgacttacatctagaccct

SEQ ID NO: 610495 - DNA, 25 bp, Mus musculus
cgtgactgactttcatctagaccct

SEQ ID NO: 610496 - DNA, 25 bp, Mus musculus
cgtgactggctcaaaaatgtcctgg

SEQ ID NO: 610497 - DNA, 25 bp, Mus musculus
cgtgactggctctaaaatgtcctgg

SEQ ID NO: 610498 - DNA, 25 bp, Mus musculus
cgtgactgttgccacgatcggctct

SEQ ID NO: 610499 - DNA, 25 bp, Mus musculus
cgtgactgttgcgacgatcggctct

SEQ ID NO: 610500 - DNA, 25 bp, Mus musculus
cgtgacttcaatccagccacggtca

SEQ ID NO: 610501 - DNA, 25 bp, Mus musculus
cgtgacttcaatgcagccacggtca

SEQ ID NO: 610502 - DNA, 25 bp, Mus musculus
cgtgacttctgacttccaggccagt

SEQ ID NO: 610503 - DNA, 25 bp, Mus musculus
cgtgacttctgagttccaggccagt

SEQ ID NO: 610504 - DNA, 25 bp, Mus musculus
cgtgacttgactatagagacagctg

SEQ ID NO: 610505 - DNA, 25 bp, Mus musculus
cgtgacttgactttagagacagctg

SEQ ID NO: 610506 - DNA, 25 bp, Mus musculus
cgtgacttgcgacaagtgacctcca

SEQ ID NO: 610507 - DNA, 25 bp, Mus musculus
cgtgacttgcgagaagtgacctcca

SEQ ID NO: 610508 - DNA, 25 bp, Mus musculus
cgtgagaagatacagtgctcgccca

SEQ ID NO: 610509 - DNA, 25 bp, Mus musculus
cgtgagaagatagagtgctcgccca

SEQ ID NO: 610510 - DNA, 25 bp, Mus musculus
cgtgagaatttcagccggaatcctg

SEQ ID NO: 610511 - DNA, 25 bp, Mus musculus
cgtgagaatttctgccggaatcctg

SEQ ID NO: 610512 - DNA, 25 bp, Mus musculus
cgtgagacgtaccagatgttgctga

SEQ ID NO: 610513 - DNA, 25 bp, Mus musculus
cgtgagacgtacgagatgttgctga

SEQ ID NO: 610514 - DNA, 25 bp, Mus musculus
cgtgagcacagtcggcatcgacttc

SEQ ID NO: 610515 - DNA, 25 bp, Mus musculus
cgtgagcacagtgggcatcgacttc

SEQ ID NO: 610516 - DNA, 25 bp, Mus musculus
cgtgagcactgcctgcgacttctgg

SEQ ID NO: 610517 - DNA, 25 bp, Mus musculus
cgtgagcactgcgtgcgacttctgg

SEQ ID NO: 610518 - DNA, 25 bp, Mus musculus
cgtgagccagagacagactaaataa

SEQ ID NO: 610519 - DNA, 25 bp, Mus musculus
cgtgagccagagtcagactaaataa

SEQ ID NO: 610520 - DNA, 25 bp, Mus musculus
cgtgagcctccacttgtacagtcca

SEQ ID NO: 610521 - DNA, 25 bp, Mus musculus
cgtgagcctccagttgtacagtcca

SEQ ID NO: 610522 - DNA, 25 bp, Mus musculus
cgtgagctcagacgctgaacggcac

SEQ ID NO: 610523 - DNA, 25 bp, Mus musculus
cgtgagctcagaggctgaacggcac

SEQ ID NO: 610524 - DNA, 25 bp, Mus musculus
cgtgagctccgacaaagaaagagag

SEQ ID NO: 610525 - DNA, 25 bp, Mus musculus
cgtgagctccgagaaagaaagagag

SEQ ID NO: 610526 - DNA, 25 bp, Mus musculus
cgtgagcttcatccacgaggaggca

SEQ ID NO: 610527 - DNA, 25 bp, Mus musculus
cgtgagcttcatgcacgaggaggca

SEQ ID NO: 610528 - DNA, 25 bp, Mus musculus
cgtgagcttggcatcaagaatgaag

SEQ ID NO: 610529 - DNA, 25 bp, Mus musculus
cgtgagcttggcttcaagaatgaag

SEQ ID NO: 610530 - DNA, 25 bp, Mus musculus
cgtgaggatggtacatatacttacg

SEQ ID NO: 610531 - DNA, 25 bp, Mus musculus
cgtgaggatggttcatatacttacg

SEQ ID NO: 610532 - DNA, 25 bp, Mus musculus
cgtgaggccggaccacacagcagca

SEQ ID NO: 610533 - DNA, 25 bp, Mus musculus
cgtgaggccggagcacacagcagca

SEQ ID NO: 610534 - DNA, 25 bp, Mus musculus
cgtgaggcgcgtcatatcccgcgtc

SEQ ID NO: 610535 - DNA, 25 bp, Mus musculus
cgtgaggcgcgtgatatcccgcgtc

SEQ ID NO: 610536 - DNA, 25 bp, Mus musculus
cgtgaggctgctatccggaacatca

SEQ ID NO: 610537 - DNA, 25 bp, Mus musculus
cgtgaggctgctttccggaacatca

SEQ ID NO: 610538 - DNA, 25 bp, Mus musculus
cgtgaggtacttaaatgctgaggag

SEQ ID NO: 610539 - DNA, 25 bp, Mus musculus
cgtgaggtactttaatgctgaggag

SEQ ID NO: 610540 - DNA, 25 bp, Mus musculus
cgtgaggtatcaacactacaaaagt

SEQ ID NO: 610541 - DNA, 25 bp, Mus musculus
cgtgaggtatcatcactacaaaagt

SEQ ID NO: 610542 - DNA, 25 bp, Mus musculus
cgtgaggtttgcattgatagagaca

SEQ ID NO: 610543 - DNA, 25 bp, Mus musculus
cgtgaggtttgctttgatagagaca

SEQ ID NO: 610544 - DNA, 25 bp, Mus musculus
cgtgagtcggcaagcttacaagcac

SEQ ID NO: 610545 - DNA, 25 bp, Mus musculus
cgtgagtcggcatgcttacaagcac

SEQ ID NO: 610546 - DNA, 25 bp, Mus musculus
cgtgagtctgctccgctccatgagg

SEQ ID NO: 610547 - DNA, 25 bp, Mus musculus
cgtgagtctgctgcgctccatgagg

SEQ ID NO: 610548 - DNA, 25 bp, Mus musculus
cgtgagtgttggacttagaatggct

SEQ ID NO: 610549 - DNA, 25 bp, Mus musculus
cgtgagtgttggtcttagaatggct

SEQ ID NO: 610550 - DNA, 25 bp, Mus musculus
cgtgatatatcacttccgtgggaaa

SEQ ID NO: 610551 - DNA, 25 bp, Mus musculus
cgtgatatatcagttccgtgggaaa

SEQ ID NO: 610552 - DNA, 25 bp, Mus musculus
cgtgatcatcccagtgggtaaggga

SEQ ID NO: 610553 - DNA, 25 bp, Mus musculus
cgtgatcatccctgtgggtaaggga

SEQ ID NO: 610554 - DNA, 25 bp, Mus musculus
cgtgatcctaggagtagctctgtgg

SEQ ID NO: 610555 - DNA, 25 bp, Mus musculus
cgtgatcctaggtgtagctctgtgg

SEQ ID NO: 610556 - DNA, 25 bp, Mus musculus
cgtgatcctccgagacattgcaaga

SEQ ID NO: 610557 - DNA, 25 bp, Mus musculus
cgtgatcctccgtgacattgcaaga

SEQ ID NO: 610558 - DNA, 25 bp, Mus musculus
cgtgatcgcactcagcgacatcagt

SEQ ID NO: 610559 - DNA, 25 bp, Mus musculus
cgtgatcgcactgagcgacatcagt

SEQ ID NO: 610560 - DNA, 25 bp, Mus musculus
cgtgatcgcgtgacagtgaacacca

SEQ ID NO: 610561 - DNA, 25 bp, Mus musculus
cgtgatcgcgtgtcagtgaacacca

SEQ ID NO: 610562 - DNA, 25 bp, Mus musculus
cgtgatcgtcacaaccttacctgat

SEQ ID NO: 610563 - DNA, 25 bp, Mus musculus
cgtgatcgtcactaccttacctgat

SEQ ID NO: 610564 - DNA, 25 bp, Mus musculus
cgtgatcgtggtccacgggctcttt

SEQ ID NO: 610565 - DNA, 25 bp, Mus musculus
cgtgatcgtggtgcacgggctcttt

SEQ ID NO: 610566 - DNA, 25 bp, Mus musculus
cgtgatggagaaacgcaggatgaac

SEQ ID NO: 610567 - DNA, 25 bp, Mus musculus
cgtgatggagaatcgcaggatgaac

SEQ ID NO: 610568 - DNA, 25 bp, Mus musculus
cgtgatggctcacttttgtggcgcc

SEQ ID NO: 610569 - DNA, 25 bp, Mus musculus
cgtgatggctcagttttgtggcgcc

SEQ ID NO: 610570 - DNA, 25 bp, Mus musculus
cgtgatgggaagctatatgatcacc

SEQ ID NO: 610571 - DNA, 25 bp, Mus musculus
cgtgatgggaaggtatatgatcacc

SEQ ID NO: 610572 - DNA, 25 bp, Mus musculus
cgtgatgggcgcatatatgcctcgg

SEQ ID NO: 610573 - DNA, 25 bp, Mus musculus
cgtgatgggcgcttatatgcctcgg

SEQ ID NO: 610574 - DNA, 25 bp, Mus musculus
cgtgatggttttcatcagcagctcc

SEQ ID NO: 610575 - DNA, 25 bp, Mus musculus
cgtgatggttttgatcagcagctcc

SEQ ID NO: 610576 - DNA, 25 bp, Mus musculus
cgtgcaaagataaggtgaagtttgg

SEQ ID NO: 610577 - DNA, 25 bp, Mus musculus
cgtgcaaagatatggtgaagtttgg

SEQ ID NO: 610578 - DNA, 25 bp, Mus musculus
cgtgcaaccgcaacaagaaggcatt

SEQ ID NO: 610579 - DNA, 25 bp, Mus musculus
cgtgcaaccgcatcaagaaggcatt

SEQ ID NO: 610580 - DNA, 25 bp, Mus musculus
cgtgcacaaggacctcaagtccaag

SEQ ID NO: 610581 - DNA, 25 bp, Mus musculus
cgtgcacaaggagctcaagtccaag

SEQ ID NO: 610582 - DNA, 25 bp, Mus musculus
cgtgcacacgcacgatcgacacgga

SEQ ID NO: 610583 - DNA, 25 bp, Mus musculus
cgtgcacacgcaggatcgacacgga

SEQ ID NO: 610584 - DNA, 25 bp, Mus musculus
cgtgcacactaaactgggcaatgtc

SEQ ID NO: 610585 - DNA, 25 bp, Mus musculus
cgtgcacactaatctgggcaatgtc

SEQ ID NO: 610586 - DNA, 25 bp, Mus musculus
cgtgcacagaaaaggtggcaagtcc

SEQ ID NO: 610587 - DNA, 25 bp, Mus musculus
cgtgcacagaaatggtggcaagtcc

SEQ ID NO: 610588 - DNA, 25 bp, Mus musculus
cgtgcacagaatcggccgggttctt

SEQ ID NO: 610589 - DNA, 25 bp, Mus musculus
cgtgcacagaatgggccgggttctt

SEQ ID NO: 610590 - DNA, 25 bp, Mus musculus
cgtgcacagccaagaacgcacatct

SEQ ID NO: 610591 - DNA, 25 bp, Mus musculus
cgtgcacagccatgaacgcacatct

SEQ ID NO: 610592 - DNA, 25 bp, Mus musculus
cgtgcaccgggtcgaaacacgacct

SEQ ID NO: 610593 - DNA, 25 bp, Mus musculus
cgtgcaccgggtggaaacacgacct

SEQ ID NO: 610594 - DNA, 25 bp, Mus musculus
cgtgcactacgaagggtaaccccaa

SEQ ID NO: 610595 - DNA, 25 bp, Mus musculus
cgtgcactacgatgggtaaccccaa

SEQ ID NO: 610596 - DNA, 25 bp, Mus musculus
cgtgcactactcctcctattcagag

SEQ ID NO: 610597 - DNA, 25 bp, Mus musculus
cgtgcactactcgtcctattcagag

SEQ ID NO: 610598 - DNA, 25 bp, Mus musculus
cgtgcagactcaactttgtaaagag

SEQ ID NO: 610599 - DNA, 25 bp, Mus musculus
cgtgcagactcatctttgtaaagag

SEQ ID NO: 610600 - DNA, 25 bp, Mus musculus
cgtgcagactttccgagacctggtc

SEQ ID NO: 610601 - DNA, 25 bp, Mus musculus
cgtgcagactttgcgagacctggtc

SEQ ID NO: 610602 - DNA, 25 bp, Mus musculus
cgtgcagcacggagtacctgttttt

SEQ ID NO: 610603 - DNA, 25 bp, Mus musculus
cgtgcagcacggtgtacctgttttt

SEQ ID NO: 610604 - DNA, 25 bp, Mus musculus
cgtgcagcctccagcttaggagaat

SEQ ID NO: 610605 - DNA, 25 bp, Mus musculus
cgtgcagcctcctgcttaggagaat

SEQ ID NO: 610606 - DNA, 25 bp, Mus musculus
cgtgcagtcaatcgaggcatgctct

SEQ ID NO: 610607 - DNA, 25 bp, Mus musculus
cgtgcagtcaatggaggcatgctct

SEQ ID NO: 610608 - DNA, 25 bp, Mus musculus
cgtgcagtggctatcaaggagctta

SEQ ID NO: 610609 - DNA, 25 bp, Mus musculus
cgtgcagtggctttcaaggagctta

SEQ ID NO: 610610 - DNA, 25 bp, Mus musculus
cgtgcagtgtgaaggcctttctgag

SEQ ID NO: 610611 - DNA, 25 bp, Mus musculus
cgtgcagtgtgatggcctttctgag

SEQ ID NO: 610612 - DNA, 25 bp, Mus musculus
cgtgcatcgacgagcttggcaggca

SEQ ID NO: 610613 - DNA, 25 bp, Mus musculus
cgtgcatcgacgtgcttggcaggca

SEQ ID NO: 610614 - DNA, 25 bp, Mus musculus
cgtgcatgttagagcctggtgcctg

SEQ ID NO: 610615 - DNA, 25 bp, Mus musculus
cgtgcatgttagtgcctggtgcctg

SEQ ID NO: 610616 - DNA, 25 bp, Mus musculus
cgtgcatgttgccttccctgtaaat

SEQ ID NO: 610617 - DNA, 25 bp, Mus musculus
cgtgcatgttgcgttccctgtaaat

SEQ ID NO: 610618 - DNA, 25 bp, Mus musculus
cgtgcattcttcagcccctcgtaag

SEQ ID NO: 610619 - DNA, 25 bp, Mus musculus
cgtgcattcttctgcccctcgtaag

SEQ ID NO: 610620 - DNA, 25 bp, Mus musculus
cgtgccaaccagcacaaggagcagc

SEQ ID NO: 610621 - DNA, 25 bp, Mus musculus
cgtgccaaccaggacaaggagcagc

SEQ ID NO: 610622 - DNA, 25 bp, Mus musculus
cgtgccaagctgagaccaaatatgt

SEQ ID NO: 610623 - DNA, 25 bp, Mus musculus
cgtgccaagctgtgaccaaatatgt

SEQ ID NO: 610624 - DNA, 25 bp, Mus musculus
cgtgccaaggctactcgtatctcca

SEQ ID NO: 610625 - DNA, 25 bp, Mus musculus
cgtgccaaggcttctcgtatctcca

SEQ ID NO: 610626 - DNA, 25 bp, Mus musculus
cgtgccaagttacagtccagcatcg

SEQ ID NO: 610627 - DNA, 25 bp, Mus musculus
cgtgccaagttagagtccagcatcg

SEQ ID NO: 610628 - DNA, 25 bp, Mus musculus
cgtgccacgttgaggaccatggtgg

SEQ ID NO: 610629 - DNA, 25 bp, Mus musculus
cgtgccacgttgtggaccatggtgg

SEQ ID NO: 610630 - DNA, 25 bp, Mus musculus
cgtgccatggcgctgaacctgagcc

SEQ ID NO: 610631 - DNA, 25 bp, Mus musculus
cgtgccatggcggtgaacctgagcc

SEQ ID NO: 610632 - DNA, 25 bp, Mus musculus
cgtgcccattctaaagcagttcagg

SEQ ID NO: 610633 - DNA, 25 bp, Mus musculus
cgtgcccattcttaagcagttcagg

SEQ ID NO: 610634 - DNA, 25 bp, Mus musculus
cgtgcccattttcttgttacacaag

SEQ ID NO: 610635 - DNA, 25 bp, Mus musculus
cgtgcccattttgttgttacacaag

SEQ ID NO: 610636 - DNA, 25 bp, Mus musculus
cgtgcccgggtgaggaagcactttc

SEQ ID NO: 610637 - DNA, 25 bp, Mus musculus
cgtgcccgggtgtggaagcactttc

SEQ ID NO: 610638 - DNA, 25 bp, Mus musculus
cgtgcccgttggaggagcgatctcc

SEQ ID NO: 610639 - DNA, 25 bp, Mus musculus
cgtgcccgttggtggagcgatctcc

SEQ ID NO: 610640 - DNA, 25 bp, Mus musculus
cgtgccctggaaatagggtacaggc

SEQ ID NO: 610641 - DNA, 25 bp, Mus musculus
cgtgccctggaattagggtacaggc

SEQ ID NO: 610642 - DNA, 25 bp, Mus musculus
cgtgcccttagcagttggcgccaaa

SEQ ID NO: 610643 - DNA, 25 bp, Mus musculus
cgtgcccttagctgttggcgccaaa

SEQ ID NO: 610644 - DNA, 25 bp, Mus musculus
cgtgcctacacacccaatgacgagt

SEQ ID NO: 610645 - DNA, 25 bp, Mus musculus
cgtgcctacacagccaatgacgagt

SEQ ID NO: 610646 - DNA, 25 bp, Mus musculus
cgtgcctaccgtctttgagaactat

SEQ ID NO: 610647 - DNA, 25 bp, Mus musculus
cgtgcctaccgtgtttgagaactat

SEQ ID NO: 610648 - DNA, 25 bp, Mus musculus
cgtgcctacgtgacctggatgacca

SEQ ID NO: 610649 - DNA, 25 bp, Mus musculus
cgtgcctacgtgtcctggatgacca

SEQ ID NO: 610650 - DNA, 25 bp, Mus musculus
cgtgcctctgacattttgtccttcg

SEQ ID NO: 610651 - DNA, 25 bp, Mus musculus
cgtgcctctgactttttgtccttcg

SEQ ID NO: 610652 - DNA, 25 bp, Mus musculus
cgtgcctgtccgaggtcaacgagtg

SEQ ID NO: 610653 - DNA, 25 bp, Mus musculus
cgtgcctgtccgtggtcaacgagtg

SEQ ID NO: 610654 - DNA, 25 bp, Mus musculus
cgtgccttccatctggacctggact

SEQ ID NO: 610655 - DNA, 25 bp, Mus musculus
cgtgccttccatgtggacctggact

SEQ ID NO: 610656 - DNA, 25 bp, Mus musculus
cgtgccttggccactaacagatatg

SEQ ID NO: 610657 - DNA, 25 bp, Mus musculus
cgtgccttggcctctaacagatatg

SEQ ID NO: 610658 - DNA, 25 bp, Mus musculus
cgtgcctttgggatgtctaactgtc

SEQ ID NO: 610659 - DNA, 25 bp, Mus musculus
cgtgcctttgggttgtctaactgtc

SEQ ID NO: 610660 - DNA, 25 bp, Mus musculus
cgtgcgacatttcccgaattctgca

SEQ ID NO: 610661 - DNA, 25 bp, Mus musculus
cgtgcgacatttgccgaattctgca

SEQ ID NO: 610662 - DNA, 25 bp, Mus musculus
cgtgcgaccgcaataaacagtcagc

SEQ ID NO: 610663 - DNA, 25 bp, Mus musculus
cgtgcgaccgcattaaacagtcagc

SEQ ID NO: 610664 - DNA, 25 bp, Mus musculus
cgtgcgagcgtccatatcgtcctgc

SEQ ID NO: 610665 - DNA, 25 bp, Mus musculus
cgtgcgagcgtcgatatcgtcctgc

SEQ ID NO: 610666 - DNA, 25 bp, Mus musculus
cgtgcgcacactcaggctgaacaga

SEQ ID NO: 610667 - DNA, 25 bp, Mus musculus
cgtgcgcacactgaggctgaacaga

SEQ ID NO: 610668 - DNA, 25 bp, Mus musculus
cgtgcgcatagacaaggacacggca

SEQ ID NO: 610669 - DNA, 25 bp, Mus musculus
cgtgcgcatagagaaggacacggca

SEQ ID NO: 610670 - DNA, 25 bp, Mus musculus
cgtgcgccagctattacagtcccag

SEQ ID NO: 610671 - DNA, 25 bp, Mus musculus
cgtgcgccagcttttacagtcccag

SEQ ID NO: 610672 - DNA, 25 bp, Mus musculus
cgtgcgcctgccagatggctgtcta

SEQ ID NO: 610673 - DNA, 25 bp, Mus musculus
cgtgcgcctgcctgatggctgtcta

SEQ ID NO: 610674 - DNA, 25 bp, Mus musculus
cgtgcgcgtcctccctagggtttgt

SEQ ID NO: 610675 - DNA, 25 bp, Mus musculus
cgtgcgcgtcctgcctagggtttgt

SEQ ID NO: 610676 - DNA, 25 bp, Mus musculus
cgtgcgctggcacttgtacctactg

SEQ ID NO: 610677 - DNA, 25 bp, Mus musculus
cgtgcgctggcagttgtacctactg

SEQ ID NO: 610678 - DNA, 25 bp, Mus musculus
cgtgcggcatcgactcagggaagta

SEQ ID NO: 610679 - DNA, 25 bp, Mus musculus
cgtgcggcatcgtctcagggaagta

SEQ ID NO: 610680 - DNA, 25 bp, Mus musculus
cgtgcggccatgctgatccgagctc

SEQ ID NO: 610681 - DNA, 25 bp, Mus musculus
cgtgcggccatggtgatccgagctc

SEQ ID NO: 610682 - DNA, 25 bp, Mus musculus
cgtgcggctacaccagagtcccagg

SEQ ID NO: 610683 - DNA, 25 bp, Mus musculus
cgtgcggctacagcagagtcccagg

SEQ ID NO: 610684 - DNA, 25 bp, Mus musculus
cgtgcgggttcaagtggatgcccct

SEQ ID NO: 610685 - DNA, 25 bp, Mus musculus
cgtgcgggttcatgtggatgcccct

SEQ ID NO: 610686 - DNA, 25 bp, Mus musculus
cgtgcgtctcatcgccgctagtaga

SEQ ID NO: 610687 - DNA, 25 bp, Mus musculus
cgtgcgtctcatggccgctagtaga

SEQ ID NO: 610688 - DNA, 25 bp, Mus musculus
cgtgcgttgcagaaaacaagatttc

SEQ ID NO: 610689 - DNA, 25 bp, Mus musculus
cgtgcgttgcagtaaacaagatttc

SEQ ID NO: 610690 - DNA, 25 bp, Mus musculus
cgtgctaagcaccatggccatgatc

SEQ ID NO: 610691 - DNA, 25 bp, Mus musculus
cgtgctaagcacgatggccatgatc

SEQ ID NO: 610692 - DNA, 25 bp, Mus musculus
cgtgctacacctcaaagctgttgtg

SEQ ID NO: 610693 - DNA, 25 bp, Mus musculus
cgtgctacacctgaaagctgttgtg

SEQ ID NO: 610694 - DNA, 25 bp, Mus musculus
cgtgctaggatcagactcgctctgg

SEQ ID NO: 610695 - DNA, 25 bp, Mus musculus
cgtgctaggatctgactcgctctgg

SEQ ID NO: 610696 - DNA, 25 bp, Mus musculus
cgtgctatgtgaagttgtgggccaa

SEQ ID NO: 610697 - DNA, 25 bp, Mus musculus
cgtgctatgtgatgttgtgggccaa

SEQ ID NO: 610698 - DNA, 25 bp, Mus musculus
cgtgctccgatgctggtccagcagc

SEQ ID NO: 610699 - DNA, 25 bp, Mus musculus
cgtgctccgatggtggtccagcagc

SEQ ID NO: 610700 - DNA, 25 bp, Mus musculus
cgtgctcctgcgacatcatgtggct

SEQ ID NO: 610701 - DNA, 25 bp, Mus musculus
cgtgctcctgcgtcatcatgtggct

SEQ ID NO: 610702 - DNA, 25 bp, Mus musculus
cgtgctcggcatcgcagcatccgtt

SEQ ID NO: 610703 - DNA, 25 bp, Mus musculus
cgtgctcggcatggcagcatccgtt

SEQ ID NO: 610704 - DNA, 25 bp, Mus musculus
cgtgctcgggttccgccatggaatc

SEQ ID NO: 610705 - DNA, 25 bp, Mus musculus
cgtgctcgggttgcgccatggaatc

SEQ ID NO: 610706 - DNA, 25 bp, Mus musculus
cgtgctgagaaactgttgagtgtac

SEQ ID NO: 610707 - DNA, 25 bp, Mus musculus
cgtgctgagaaagtgttgagtgtac

SEQ ID NO: 610708 - DNA, 25 bp, Mus musculus
cgtgctgattagaagacttgattgc

SEQ ID NO: 610709 - DNA, 25 bp, Mus musculus
cgtgctgattagtagacttgattgc

SEQ ID NO: 610710 - DNA, 25 bp, Mus musculus
cgtgctgattggcaagcccttcagt

SEQ ID NO: 610711 - DNA, 25 bp, Mus musculus
cgtgctgattgggaagcccttcagt

SEQ ID NO: 610712 - DNA, 25 bp, Mus musculus
cgtgctgcctgcctgcattcctgtt

SEQ ID NO: 610713 - DNA, 25 bp, Mus musculus
cgtgctgcctgcgtgcattcctgtt

SEQ ID NO: 610714 - DNA, 25 bp, Mus musculus
cgtgctggcaggcatggcaaaccat

SEQ ID NO: 610715 - DNA, 25 bp, Mus musculus
cgtgctggcagggatggcaaaccat

SEQ ID NO: 610716 - DNA, 25 bp, Mus musculus
cgtgctgtgcgcaaactgcaggcac

SEQ ID NO: 610717 - DNA, 25 bp, Mus musculus
cgtgctgtgcgctaactgcaggcac

SEQ ID NO: 610718 - DNA, 25 bp, Mus musculus
cgtgctgtgtaacaaggaccccttc

SEQ ID NO: 610719 - DNA, 25 bp, Mus musculus
cgtgctgtgtaagaaggaccccttc

SEQ ID NO: 610720 - DNA, 25 bp, Mus musculus
cgtgcttcccgaccccttggagaag

SEQ ID NO: 610721 - DNA, 25 bp, Mus musculus
cgtgcttcccgagcccttggagaag

SEQ ID NO: 610722 - DNA, 25 bp, Mus musculus
cgtgcttccggcagttggaaggaca

SEQ ID NO: 610723 - DNA, 25 bp, Mus musculus
cgtgcttccggctgttggaaggaca

SEQ ID NO: 610724 - DNA, 25 bp, Mus musculus
cgtgcttctgggagcttccaatgca

SEQ ID NO: 610725 - DNA, 25 bp, Mus musculus
cgtgcttctgggtgcttccaatgca

SEQ ID NO: 610726 - DNA, 25 bp, Mus musculus
cgtgcttgaggtcctgaagcataaa

SEQ ID NO: 610727 - DNA, 25 bp, Mus musculus
cgtgcttgaggtgctgaagcataaa

SEQ ID NO: 610728 - DNA, 25 bp, Mus musculus
cgtgcttgcagcacaggcaatttca

SEQ ID NO: 610729 - DNA, 25 bp, Mus musculus
cgtgcttgcagctcaggcaatttca

SEQ ID NO: 610730 - DNA, 25 bp, Mus musculus
cgtgcttggcgccatcctgatgagc

SEQ ID NO: 610731 - DNA, 25 bp, Mus musculus
cgtgcttggcgcgatcctgatgagc

SEQ ID NO: 610732 - DNA, 25 bp, Mus musculus
cgtgctttattacgactgtctcaag

SEQ ID NO: 610733 - DNA, 25 bp, Mus musculus
cgtgctttattaggactgtctcaag

SEQ ID NO: 610734 - DNA, 25 bp, Mus musculus
cgtgctttccttctcctgagcaaga

SEQ ID NO: 610735 - DNA, 25 bp, Mus musculus
cgtgctttccttgtcctgagcaaga

SEQ ID NO: 610736 - DNA, 25 bp, Mus musculus
cgtgctttgctgactgtcatggata

SEQ ID NO: 610737 - DNA, 25 bp, Mus musculus
cgtgctttgctgtctgtcatggata

SEQ ID NO: 610738 - DNA, 25 bp, Mus musculus
cgtgctttgtgcagctacatgaact

SEQ ID NO: 610739 - DNA, 25 bp, Mus musculus
cgtgctttgtgctgctacatgaact

SEQ ID NO: 610740 - DNA, 25 bp, Mus musculus
cgtggaacataacaatggacaacta

SEQ ID NO: 610741 - DNA, 25 bp, Mus musculus
cgtggaacataagaatggacaacta

SEQ ID NO: 610742 - DNA, 25 bp, Mus musculus
cgtggaagaaggattacaccctcag

SEQ ID NO: 610743 - DNA, 25 bp, Mus musculus
cgtggaagaaggtttacaccctcag

SEQ ID NO: 610744 - DNA, 25 bp, Mus musculus
cgtggaagcccacactggtcatcct

SEQ ID NO: 610745 - DNA, 25 bp, Mus musculus
cgtggaagcccagactggtcatcct

SEQ ID NO: 610746 - DNA, 25 bp, Mus musculus
cgtggaaggacacagtgttcactac

SEQ ID NO: 610747 - DNA, 25 bp, Mus musculus
cgtggaaggacagagtgttcactac

SEQ ID NO: 610748 - DNA, 25 bp, Mus musculus
cgtggaaggcaaagctcagctgtgc

SEQ ID NO: 610749 - DNA, 25 bp, Mus musculus
cgtggaaggcaatgctcagctgtgc

SEQ ID NO: 610750 - DNA, 25 bp, Mus musculus
cgtggaatgaagattgtcctgatca

SEQ ID NO: 610751 - DNA, 25 bp, Mus musculus
cgtggaatgaagtttgtcctgatca

SEQ ID NO: 610752 - DNA, 25 bp, Mus musculus
cgtggaatggcgagaagaatgcaac

SEQ ID NO: 610753 - DNA, 25 bp, Mus musculus
cgtggaatggcgtgaagaatgcaac

SEQ ID NO: 610754 - DNA, 25 bp, Mus musculus
cgtggaatttgtctgttaggcatca

SEQ ID NO: 610755 - DNA, 25 bp, Mus musculus
cgtggaatttgtgtgttaggcatca

SEQ ID NO: 610756 - DNA, 25 bp, Mus musculus
cgtggacaacaaaatgatggtttct

SEQ ID NO: 610757 - DNA, 25 bp, Mus musculus
cgtggacaacaatatgatggtttct

SEQ ID NO: 610758 - DNA, 25 bp, Mus musculus
cgtggacaccctagagagaaccttc

SEQ ID NO: 610759 - DNA, 25 bp, Mus musculus
cgtggacacccttgagagaaccttc

SEQ ID NO: 610760 - DNA, 25 bp, Mus musculus
cgtggacatcaacatctatgactgg

SEQ ID NO: 610761 - DNA, 25 bp, Mus musculus
cgtggacatcaagatctatgactgg

SEQ ID NO: 610762 - DNA, 25 bp, Mus musculus
cgtggacatcatcgacaggaacaat

SEQ ID NO: 610763 - DNA, 25 bp, Mus musculus
cgtggacatcatggacaggaacaat

SEQ ID NO: 610764 - DNA, 25 bp, Mus musculus
cgtggaccataaccataatcgaagg

SEQ ID NO: 610765 - DNA, 25 bp, Mus musculus
cgtggaccataagcataatcgaagg

SEQ ID NO: 610766 - DNA, 25 bp, Mus musculus
cgtggaccccaacgatgcgtcgata

SEQ ID NO: 610767 - DNA, 25 bp, Mus musculus
cgtggaccccaaggatgcgtcgata

SEQ ID NO: 610768 - DNA, 25 bp, Mus musculus
cgtggaccctccagaacttcctgtg

SEQ ID NO: 610769 - DNA, 25 bp, Mus musculus
cgtggaccctcctgaacttcctgtg

SEQ ID NO: 610770 - DNA, 25 bp, Mus musculus
cgtggaccctgtatccatgaataga

SEQ ID NO: 610771 - DNA, 25 bp, Mus musculus
cgtggaccctgtttccatgaataga

SEQ ID NO: 610772 - DNA, 25 bp, Mus musculus
cgtggacctgcaagtgtacgagatc

SEQ ID NO: 610773 - DNA, 25 bp, Mus musculus
cgtggacctgcatgtgtacgagatc

SEQ ID NO: 610774 - DNA, 25 bp, Mus musculus
cgtggacctggtccctgagaatgac

SEQ ID NO: 610775 - DNA, 25 bp, Mus musculus
cgtggacctggtgcctgagaatgac

SEQ ID NO: 610776 - DNA, 25 bp, Mus musculus
cgtggaccttgaagaacatttatga

SEQ ID NO: 610777 - DNA, 25 bp, Mus musculus
cgtggaccttgatgaacatttatga

SEQ ID NO: 610778 - DNA, 25 bp, Mus musculus
cgtggacgaggtcgtgcggaacgcc

SEQ ID NO: 610779 - DNA, 25 bp, Mus musculus
cgtggacgaggtggtgcggaacgcc

SEQ ID NO: 610780 - DNA, 25 bp, Mus musculus
cgtggacgcctgattgtgggtgctg

SEQ ID NO: 610781 - DNA, 25 bp, Mus musculus
cgtggacgcctgtttgtgggtgctg

SEQ ID NO: 610782 - DNA, 25 bp, Mus musculus
cgtggactactgacaggcctgcgga

SEQ ID NO: 610783 - DNA, 25 bp, Mus musculus
cgtggactactgtcaggcctgcgga

SEQ ID NO: 610784 - DNA, 25 bp, Mus musculus
cgtggagaacgtcggtctcagcatc

SEQ ID NO: 610785 - DNA, 25 bp, Mus musculus
cgtggagaacgtgggtctcagcatc

SEQ ID NO: 610786 - DNA, 25 bp, Mus musculus
cgtggagaacttcgcgctgctcaag

SEQ ID NO: 610787 - DNA, 25 bp, Mus musculus
cgtggagaacttggcgctgctcaag

SEQ ID NO: 610788 - DNA, 25 bp, Mus musculus
cgtggagaaggcacctaaagccagg

SEQ ID NO: 610789 - DNA, 25 bp, Mus musculus
cgtggagaaggctcctaaagccagg

SEQ ID NO: 610790 - DNA, 25 bp, Mus musculus
cgtggagatagaatattttgggctg

SEQ ID NO: 610791 - DNA, 25 bp, Mus musculus
cgtggagatagattattttgggctg

SEQ ID NO: 610792 - DNA, 25 bp, Mus musculus
cgtggagctgttcgcccgagacttt

SEQ ID NO: 610793 - DNA, 25 bp, Mus musculus
cgtggagctgttggcccgagacttt

SEQ ID NO: 610794 - DNA, 25 bp, Mus musculus
cgtggaggaagcattctacaaggtc

SEQ ID NO: 610795 - DNA, 25 bp, Mus musculus
cgtggaggaagctttctacaaggtc

SEQ ID NO: 610796 - DNA, 25 bp, Mus musculus
cgtggaggcatcctcagtcaggtca

SEQ ID NO: 610797 - DNA, 25 bp, Mus musculus
cgtggaggcatcgtcagtcaggtca

SEQ ID NO: 610798 - DNA, 25 bp, Mus musculus
cgtggagtcccgacccataggtggc

SEQ ID NO: 610799 - DNA, 25 bp, Mus musculus
cgtggagtcccgtcccataggtggc

SEQ ID NO: 610800 - DNA, 25 bp, Mus musculus
cgtggagttggcctttctggcaatt

SEQ ID NO: 610801 - DNA, 25 bp, Mus musculus
cgtggagttggcgtttctggcaatt

SEQ ID NO: 610802 - DNA, 25 bp, Mus musculus
cgtggataccgtctctgtgattgcc

SEQ ID NO: 610803 - DNA, 25 bp, Mus musculus
cgtggataccgtgtctgtgattgcc

SEQ ID NO: 610804 - DNA, 25 bp, Mus musculus
cgtggatccagcagtcagaaagcaa

SEQ ID NO: 610805 - DNA, 25 bp, Mus musculus
cgtggatccagctgtcagaaagcaa

SEQ ID NO: 610806 - DNA, 25 bp, Mus musculus
cgtggatgaatgaagcatgaacaac

SEQ ID NO: 610807 - DNA, 25 bp, Mus musculus
cgtggatgaatgtagcatgaacaac

SEQ ID NO: 610808 - DNA, 25 bp, Mus musculus
cgtggatgatgcctcccacgagaag

SEQ ID NO: 610809 - DNA, 25 bp, Mus musculus
cgtggatgatgcgtcccacgagaag

SEQ ID NO: 610810 - DNA, 25 bp, Mus musculus
cgtggatgtaaacccagcagcgtca

SEQ ID NO: 610811 - DNA, 25 bp, Mus musculus
cgtggatgtaaagccagcagcgtca

SEQ ID NO: 610812 - DNA, 25 bp, Mus musculus
cgtggatgtgcacaagatagtagaa

SEQ ID NO: 610813 - DNA, 25 bp, Mus musculus
cgtggatgtgcagaagatagtagaa

SEQ ID NO: 610814 - DNA, 25 bp, Mus musculus
cgtggatgtggtatttgccaaccgc

SEQ ID NO: 610815 - DNA, 25 bp, Mus musculus
cgtggatgtggtttttgccaaccgc

SEQ ID NO: 610816 - DNA, 25 bp, Mus musculus
cgtggattgggaagttcatcatggt

SEQ ID NO: 610817 - DNA, 25 bp, Mus musculus
cgtggattgggatgttcatcatggt

SEQ ID NO: 610818 - DNA, 25 bp, Mus musculus
cgtggcaaacacattaggagcgcga

SEQ ID NO: 610819 - DNA, 25 bp, Mus musculus
cgtggcaaacactttaggagcgcga

SEQ ID NO: 610820 - DNA, 25 bp, Mus musculus
cgtggcaagaaaaggacgatcagaa

SEQ ID NO: 610821 - DNA, 25 bp, Mus musculus
cgtggcaagaaatggacgatcagaa

SEQ ID NO: 610822 - DNA, 25 bp, Mus musculus
cgtggcacaccaaaaatcttgattt

SEQ ID NO: 610823 - DNA, 25 bp, Mus musculus
cgtggcacaccataaatcttgattt

SEQ ID NO: 610824 - DNA, 25 bp, Mus musculus
cgtggcactgaaacagctgcgagtg

SEQ ID NO: 610825 - DNA, 25 bp, Mus musculus
cgtggcactgaatcagctgcgagtg

SEQ ID NO: 610826 - DNA, 25 bp, Mus musculus
cgtggcagacttcaccgagcaatat

SEQ ID NO: 610827 - DNA, 25 bp, Mus musculus
cgtggcagacttgaccgagcaatat

SEQ ID NO: 610828 - DNA, 25 bp, Mus musculus
cgtggcagtggcacagcttgtagcc

SEQ ID NO: 610829 - DNA, 25 bp, Mus musculus
cgtggcagtggctcagcttgtagcc

SEQ ID NO: 610830 - DNA, 25 bp, Mus musculus
cgtggcatataacgatgccatctat

SEQ ID NO: 610831 - DNA, 25 bp, Mus musculus
cgtggcatataaggatgccatctat

SEQ ID NO: 610832 - DNA, 25 bp, Mus musculus
cgtggcatgcttacgcagccaccgg

SEQ ID NO: 610833 - DNA, 25 bp, Mus musculus
cgtggcatgctttcgcagccaccgg

SEQ ID NO: 610834 - DNA, 25 bp, Mus musculus
cgtggccaacaacgtggatctgatg

SEQ ID NO: 610835 - DNA, 25 bp, Mus musculus
cgtggccaacaaggtggatctgatg

SEQ ID NO: 610836 - DNA, 25 bp, Mus musculus
cgtggccacagacgccatcaggaag

SEQ ID NO: 610837 - DNA, 25 bp, Mus musculus
cgtggccacagaggccatcaggaag

SEQ ID NO: 610838 - DNA, 25 bp, Mus musculus
cgtggccattgcatatctgtgtgtc

SEQ ID NO: 610839 - DNA, 25 bp, Mus musculus
cgtggccattgcttatctgtgtgtc

SEQ ID NO: 610840 - DNA, 25 bp, Mus musculus
cgtggcccctatcatcaaccgtgtg

SEQ ID NO: 610841 - DNA, 25 bp, Mus musculus
cgtggcccctatgatcaaccgtgtg

SEQ ID NO: 610842 - DNA, 25 bp, Mus musculus
cgtggccctgaaatccgctgtctct

SEQ ID NO: 610843 - DNA, 25 bp, Mus musculus
cgtggccctgaattccgctgtctct

SEQ ID NO: 610844 - DNA, 25 bp, Mus musculus
cgtggccctgagcagtgtgacatcc

SEQ ID NO: 610845 - DNA, 25 bp, Mus musculus
cgtggccctgaggagtgtgacatcc

SEQ ID NO: 610846 - DNA, 25 bp, Mus musculus
cgtggccgcctcaatcatggtgctg

SEQ ID NO: 610847 - DNA, 25 bp, Mus musculus
cgtggccgcctctatcatggtgctg

SEQ ID NO: 610848 - DNA, 25 bp, Mus musculus
cgtggccgttgacttctctccggat

SEQ ID NO: 610849 - DNA, 25 bp, Mus musculus
cgtggccgttgagttctctccggat

SEQ ID NO: 610850 - DNA, 25 bp, Mus musculus
cgtggcctggagatcattctttacc

SEQ ID NO: 610851 - DNA, 25 bp, Mus musculus
cgtggcctggagttcattctttacc

SEQ ID NO: 610852 - DNA, 25 bp, Mus musculus
cgtggcctgtttcttgaatttcaat

SEQ ID NO: 610853 - DNA, 25 bp, Mus musculus
cgtggcctgtttgttgaatttcaat

SEQ ID NO: 610854 - DNA, 25 bp, Mus musculus
cgtggccttatgcagcaaggacacc

SEQ ID NO: 610855 - DNA, 25 bp, Mus musculus
cgtggccttatggagcaaggacacc

SEQ ID NO: 610856 - DNA, 25 bp, Mus musculus
cgtggccttggtcgctcaagtgatc

SEQ ID NO: 610857 - DNA, 25 bp, Mus musculus
cgtggccttggtggctcaagtgatc

SEQ ID NO: 610858 - DNA, 25 bp, Mus musculus
cgtggcgcactcaaactcatctaga

SEQ ID NO: 610859 - DNA, 25 bp, Mus musculus
cgtggcgcactctaactcatctaga

SEQ ID NO: 610860 - DNA, 25 bp, Mus musculus
cgtggcgcggaaacaaactttgccg

SEQ ID NO: 610861 - DNA, 25 bp, Mus musculus
cgtggcgcggaatcaaactttgccg

SEQ ID NO: 610862 - DNA, 25 bp, Mus musculus
cgtggcggtcctagtgagcatccta

SEQ ID NO: 610863 - DNA, 25 bp, Mus musculus
cgtggcggtccttgtgagcatccta

SEQ ID NO: 610864 - DNA, 25 bp, Mus musculus
cgtggcgtatttctacgaccccgat

SEQ ID NO: 610865 - DNA, 25 bp, Mus musculus
cgtggcgtatttgtacgaccccgat

SEQ ID NO: 610866 - DNA, 25 bp, Mus musculus
cgtggcgttcgcacgggtgtccctc

SEQ ID NO: 610867 - DNA, 25 bp, Mus musculus
cgtggcgttcgctcgggtgtccctc

SEQ ID NO: 610868 - DNA, 25 bp, Mus musculus
cgtggctacgtccagcctgttggtc

SEQ ID NO: 610869 - DNA, 25 bp, Mus musculus
cgtggctacgtcgagcctgttggtc

SEQ ID NO: 610870 - DNA, 25 bp, Mus musculus
cgtggctgccggagactctgtttga

SEQ ID NO: 610871 - DNA, 25 bp, Mus musculus
cgtggctgccggtgactctgtttga

SEQ ID NO: 610872 - DNA, 25 bp, Mus musculus
cgtggctgctgacctaacctggtgt

SEQ ID NO: 610873 - DNA, 25 bp, Mus musculus
cgtggctgctgagctaacctggtgt

SEQ ID NO: 610874 - DNA, 25 bp, Mus musculus
cgtggctgtcacagcgctggagcat

SEQ ID NO: 610875 - DNA, 25 bp, Mus musculus
cgtggctgtcactgcgctggagcat

SEQ ID NO: 610876 - DNA, 25 bp, Mus musculus
cgtggctgtcagataatctggatcc

SEQ ID NO: 610877 - DNA, 25 bp, Mus musculus
cgtggctgtcagttaatctggatcc

SEQ ID NO: 610878 - DNA, 25 bp, Mus musculus
cgtggctgtgatagtgtgtaccttg

SEQ ID NO: 610879 - DNA, 25 bp, Mus musculus
cgtggctgtgattgtgtgtaccttg

SEQ ID NO: 610880 - DNA, 25 bp, Mus musculus
cgtggcttcgggatgtcctgcgcaa

SEQ ID NO: 610881 - DNA, 25 bp, Mus musculus
cgtggcttcgggttgtcctgcgcaa

SEQ ID NO: 610882 - DNA, 25 bp, Mus musculus
cgtggcttgcaactgtgacatagga

SEQ ID NO: 610883 - DNA, 25 bp, Mus musculus
cgtggcttgcaagtgtgacatagga

SEQ ID NO: 610884 - DNA, 25 bp, Mus musculus
cgtggcttgtcgaaggattcctgta

SEQ ID NO: 610885 - DNA, 25 bp, Mus musculus
cgtggcttgtcgtaggattcctgta

SEQ ID NO: 610886 - DNA, 25 bp, Mus musculus
cgtgggaaccacaccaagacctact

SEQ ID NO: 610887 - DNA, 25 bp, Mus musculus
cgtgggaaccactccaagacctact

SEQ ID NO: 610888 - DNA, 25 bp, Mus musculus
cgtgggatagcaaattcagcaccat

SEQ ID NO: 610889 - DNA, 25 bp, Mus musculus
cgtgggatagcatattcagcaccat

SEQ ID NO: 610890 - DNA, 25 bp, Mus musculus
cgtgggcaaattcaagttgctttcc

SEQ ID NO: 610891 - DNA, 25 bp, Mus musculus
cgtgggcaaattgaagttgctttcc

SEQ ID NO: 610892 - DNA, 25 bp, Mus musculus
cgtgggcatggaagaatcagaaatc

SEQ ID NO: 610893 - DNA, 25 bp, Mus musculus
cgtgggcatggatgaatcagaaatc

SEQ ID NO: 610894 - DNA, 25 bp, Mus musculus
cgtgggcatgtcatacgagtatccg

SEQ ID NO: 610895 - DNA, 25 bp, Mus musculus
cgtgggcatgtcttacgagtatccg

SEQ ID NO: 610896 - DNA, 25 bp, Mus musculus
cgtgggcattgtacacacctgtagc

SEQ ID NO: 610897 - DNA, 25 bp, Mus musculus
cgtgggcattgttcacacctgtagc

SEQ ID NO: 610898 - DNA, 25 bp, Mus musculus
cgtgggccaactacagcgagtgcct

SEQ ID NO: 610899 - DNA, 25 bp, Mus musculus
cgtgggccaacttcagcgagtgcct

SEQ ID NO: 610900 - DNA, 25 bp, Mus musculus
cgtgggccagttcctcaattcgctg

SEQ ID NO: 610901 - DNA, 25 bp, Mus musculus
cgtgggccagttgctcaattcgctg

SEQ ID NO: 610902 - DNA, 25 bp, Mus musculus
cgtgggccggttctctgctttcctg

SEQ ID NO: 610903 - DNA, 25 bp, Mus musculus
cgtgggccggttgtctgctttcctg

SEQ ID NO: 610904 - DNA, 25 bp, Mus musculus
cgtgggcgcataccttgggacccct

SEQ ID NO: 610905 - DNA, 25 bp, Mus musculus
cgtgggcgcatagcttgggacccct

SEQ ID NO: 610906 - DNA, 25 bp, Mus musculus
cgtgggctcactcgctctagggaac

SEQ ID NO: 610907 - DNA, 25 bp, Mus musculus
cgtgggctcactggctctagggaac

SEQ ID NO: 610908 - DNA, 25 bp, Mus musculus
cgtgggctggaacgataaaacatcc

SEQ ID NO: 610909 - DNA, 25 bp, Mus musculus
cgtgggctggaaggataaaacatcc

SEQ ID NO: 610910 - DNA, 25 bp, Mus musculus
cgtggggaccgaaccgtccatgaag

SEQ ID NO: 610911 - DNA, 25 bp, Mus musculus
cgtggggaccgatccgtccatgaag

SEQ ID NO: 610912 - DNA, 25 bp, Mus musculus
cgtgggtccaacaccatgagggtct

SEQ ID NO: 610913 - DNA, 25 bp, Mus musculus
cgtgggtccaactccatgagggtct

SEQ ID NO: 610914 - DNA, 25 bp, Mus musculus
cgtggtatcagtcggaccactcaga

SEQ ID NO: 610915 - DNA, 25 bp, Mus musculus
cgtggtatcagtgggaccactcaga

SEQ ID NO: 610916 - DNA, 25 bp, Mus musculus
cgtggtatggatcgttcctgagaac

SEQ ID NO: 610917 - DNA, 25 bp, Mus musculus
cgtggtatggatggttcctgagaac

SEQ ID NO: 610918 - DNA, 25 bp, Mus musculus
cgtggtcatccacttgccgggcttg

SEQ ID NO: 610919 - DNA, 25 bp, Mus musculus
cgtggtcatccagttgccgggcttg

SEQ ID NO: 610920 - DNA, 25 bp, Mus musculus
cgtggtccagacaccatatgccaag

SEQ ID NO: 610921 - DNA, 25 bp, Mus musculus
cgtggtccagactccatatgccaag

SEQ ID NO: 610922 - DNA, 25 bp, Mus musculus
cgtggtcctccacgaagaggtccta

SEQ ID NO: 610923 - DNA, 25 bp, Mus musculus
cgtggtcctccaggaagaggtccta

SEQ ID NO: 610924 - DNA, 25 bp, Mus musculus
cgtggtccttggaggcatgcagttc

SEQ ID NO: 610925 - DNA, 25 bp, Mus musculus
cgtggtccttggtggcatgcagttc

SEQ ID NO: 610926 - DNA, 25 bp, Mus musculus
cgtggtctccctctattattattct

SEQ ID NO: 610927 - DNA, 25 bp, Mus musculus
cgtggtctccctgtattattattct

SEQ ID NO: 610928 - DNA, 25 bp, Mus musculus
cgtggtctcctgctcttcgcattgt

SEQ ID NO: 610929 - DNA, 25 bp, Mus musculus
cgtggtctcctggtcttcgcattgt

SEQ ID NO: 610930 - DNA, 25 bp, Mus musculus
cgtggtgaagcaccgcttcccgaag

SEQ ID NO: 610931 - DNA, 25 bp, Mus musculus
cgtggtgaagcagcgcttcccgaag

SEQ ID NO: 610932 - DNA, 25 bp, Mus musculus
cgtggtgaagctactgtctgcagtg

SEQ ID NO: 610933 - DNA, 25 bp, Mus musculus
cgtggtgaagcttctgtctgcagtg

SEQ ID NO: 610934 - DNA, 25 bp, Mus musculus
cgtggtgaagtaagacccgcacaca

SEQ ID NO: 610935 - DNA, 25 bp, Mus musculus
cgtggtgaagtatgacccgcacaca

SEQ ID NO: 610936 - DNA, 25 bp, Mus musculus
cgtggtgaatctccatgaggtgctt

SEQ ID NO: 610937 - DNA, 25 bp, Mus musculus
cgtggtgaatctgcatgaggtgctt

SEQ ID NO: 610938 - DNA, 25 bp, Mus musculus
cgtggtgaccagaggagatgagtgt

SEQ ID NO: 610939 - DNA, 25 bp, Mus musculus
cgtggtgaccagtggagatgagtgt

SEQ ID NO: 610940 - DNA, 25 bp, Mus musculus
cgtggtgagaagacgaagcaagact

SEQ ID NO: 610941 - DNA, 25 bp, Mus musculus
cgtggtgagaagtcgaagcaagact

SEQ ID NO: 610942 - DNA, 25 bp, Mus musculus
cgtggtgagcggcttaattatcaac

SEQ ID NO: 610943 - DNA, 25 bp, Mus musculus
cgtggtgagcgggttaattatcaac

SEQ ID NO: 610944 - DNA, 25 bp, Mus musculus
cgtggtgcaaggaacgggcctccta

SEQ ID NO: 610945 - DNA, 25 bp, Mus musculus
cgtggtgcaaggtacgggcctccta

SEQ ID NO: 610946 - DNA, 25 bp, Mus musculus
cgtggtgccaaccagtggatcaagt

SEQ ID NO: 610947 - DNA, 25 bp, Mus musculus
cgtggtgccaacgagtggatcaagt

SEQ ID NO: 610948 - DNA, 25 bp, Mus musculus
cgtggtgccaatcatctctgaagct

SEQ ID NO: 610949 - DNA, 25 bp, Mus musculus
cgtggtgccaatgatctctgaagct

SEQ ID NO: 610950 - DNA, 25 bp, Mus musculus
cgtggtgcctacagtaccgtggaga

SEQ ID NO: 610951 - DNA, 25 bp, Mus musculus
cgtggtgcctactgtaccgtggaga

SEQ ID NO: 610952 - DNA, 25 bp, Mus musculus
cgtggtggatgtcctttctttcgat

SEQ ID NO: 610953 - DNA, 25 bp, Mus musculus
cgtggtggatgtgctttctttcgat

SEQ ID NO: 610954 - DNA, 25 bp, Mus musculus
cgtggtggcagcactagacccggca

SEQ ID NO: 610955 - DNA, 25 bp, Mus musculus
cgtggtggcagctctagacccggca

SEQ ID NO: 610956 - DNA, 25 bp, Mus musculus
cgtggtggccgcctgggtgtcttct

SEQ ID NO: 610957 - DNA, 25 bp, Mus musculus
cgtggtggccgcgtgggtgtcttct

SEQ ID NO: 610958 - DNA, 25 bp, Mus musculus
cgtggtggccgtaaaacggtctcag

SEQ ID NO: 610959 - DNA, 25 bp, Mus musculus
cgtggtggccgttaaacggtctcag

SEQ ID NO: 610960 - DNA, 25 bp, Mus musculus
cgtggtgggcaacctcctgtatgct

SEQ ID NO: 610961 - DNA, 25 bp, Mus musculus
cgtggtgggcaagctcctgtatgct

SEQ ID NO: 610962 - DNA, 25 bp, Mus musculus
cgtggtgtccaactacttctggctg

SEQ ID NO: 610963 - DNA, 25 bp, Mus musculus
cgtggtgtccaagtacttctggctg

SEQ ID NO: 610964 - DNA, 25 bp, Mus musculus
cgtggtgtctgcatcaccaacttca

SEQ ID NO: 610965 - DNA, 25 bp, Mus musculus
cgtggtgtctgcttcaccaacttca

SEQ ID NO: 610966 - DNA, 25 bp, Mus musculus
cgtggtgttgatagacgatgatgta

SEQ ID NO: 610967 - DNA, 25 bp, Mus musculus
cgtggtgttgattgacgatgatgta

SEQ ID NO: 610968 - DNA, 25 bp, Mus musculus
cgtggttacaaacgtggtcacacca

SEQ ID NO: 610969 - DNA, 25 bp, Mus musculus
cgtggttacaaaggtggtcacacca

SEQ ID NO: 610970 - DNA, 25 bp, Mus musculus
cgtggttaccgcatgctgggcgaca

SEQ ID NO: 610971 - DNA, 25 bp, Mus musculus
cgtggttaccgcttgctgggcgaca

SEQ ID NO: 610972 - DNA, 25 bp, Mus musculus
cgtggttatggtaacaggccaggca

SEQ ID NO: 610973 - DNA, 25 bp, Mus musculus
cgtggttatggttacaggccaggca

SEQ ID NO: 610974 - DNA, 25 bp, Mus musculus
cgtggttcacgacctagttcctaca

SEQ ID NO: 610975 - DNA, 25 bp, Mus musculus
cgtggttcacgagctagttcctaca

SEQ ID NO: 610976 - DNA, 25 bp, Mus musculus
cgtggttcactaagatatctgagga

SEQ ID NO: 610977 - DNA, 25 bp, Mus musculus
cgtggttcactatgatatctgagga

SEQ ID NO: 610978 - DNA, 25 bp, Mus musculus
cgtggtttaccacaaccaatctgag

SEQ ID NO: 610979 - DNA, 25 bp, Mus musculus
cgtggtttaccagaaccaatctgag

SEQ ID NO: 610980 - DNA, 25 bp, Mus musculus
cgtggtttctatcgtcctggagtat

SEQ ID NO: 610981 - DNA, 25 bp, Mus musculus
cgtggtttctatggtcctggagtat

SEQ ID NO: 610982 - DNA, 25 bp, Mus musculus
cgtggttttctccaaatgaaaagat

SEQ ID NO: 610983 - DNA, 25 bp, Mus musculus
cgtggttttctcgaaatgaaaagat

SEQ ID NO: 610984 - DNA, 25 bp, Mus musculus
cgtgtaagaatgctggaacgtgcca

SEQ ID NO: 610985 - DNA, 25 bp, Mus musculus
cgtgtaagaatggtggaacgtgcca

SEQ ID NO: 610986 - DNA, 25 bp, Mus musculus
cgtgtacaagatatgcagagaaatg

SEQ ID NO: 610987 - DNA, 25 bp, Mus musculus
cgtgtacaagatttgcagagaaatg

SEQ ID NO: 610988 - DNA, 25 bp, Mus musculus
cgtgtacagcagacgagcggtgcca

SEQ ID NO: 610989 - DNA, 25 bp, Mus musculus
cgtgtacagcagtcgagcggtgcca

SEQ ID NO: 610990 - DNA, 25 bp, Mus musculus
cgtgtacagctcaaaaagccttaga

SEQ ID NO: 610991 - DNA, 25 bp, Mus musculus
cgtgtacagctctaaaagccttaga

SEQ ID NO: 610992 - DNA, 25 bp, Mus musculus
cgtgtacgtggtcaacaaagccggc

SEQ ID NO: 610993 - DNA, 25 bp, Mus musculus
cgtgtacgtggtgaacaaagccggc

SEQ ID NO: 610994 - DNA, 25 bp, Mus musculus
cgtgtactcgtacggcatcgtgctg

SEQ ID NO: 610995 - DNA, 25 bp, Mus musculus
cgtgtactcgtagggcatcgtgctg

SEQ ID NO: 610996 - DNA, 25 bp, Mus musculus
cgtgtactgaggacgcccagctcca

SEQ ID NO: 610997 - DNA, 25 bp, Mus musculus
cgtgtactgaggtcgcccagctcca

SEQ ID NO: 610998 - DNA, 25 bp, Mus musculus
cgtgtagaagagaaactgtagaaca

SEQ ID NO: 610999 - DNA, 25 bp, Mus musculus
cgtgtagaagagtaactgtagaaca

SEQ ID NO: 611000 - DNA, 25 bp, Mus musculus
cgtgtaggtgttccgtctacaatgg

SEQ ID NO: 611001 - DNA, 25 bp, Mus musculus
cgtgtaggtgttgcgtctacaatgg

SEQ ID NO: 611002 - DNA, 25 bp, Mus musculus
cgtgtagtggagaggagctctggcc

SEQ ID NO: 611003 - DNA, 25 bp, Mus musculus
cgtgtagtggagtggagctctggcc

SEQ ID NO: 611004 - DNA, 25 bp, Mus musculus
cgtgtatgaggacaacgagtgttcc

SEQ ID NO: 611005 - DNA, 25 bp, Mus musculus
cgtgtatgaggagaacgagtgttcc

SEQ ID NO: 611006 - DNA, 25 bp, Mus musculus
cgtgtcaaaaccactggtattatcg

SEQ ID NO: 611007 - DNA, 25 bp, Mus musculus
cgtgtcaaaacctctggtattatcg

SEQ ID NO: 611008 - DNA, 25 bp, Mus musculus
cgtgtcacccaacaggcagtttgct

SEQ ID NO: 611009 - DNA, 25 bp, Mus musculus
cgtgtcacccaagaggcagtttgct

SEQ ID NO: 611010 - DNA, 25 bp, Mus musculus
cgtgtcacctcaaggtggcttccca

SEQ ID NO: 611011 - DNA, 25 bp, Mus musculus
cgtgtcacctcatggtggcttccca

SEQ ID NO: 611012 - DNA, 25 bp, Mus musculus
cgtgtcagccgaagcattcctgact

SEQ ID NO: 611013 - DNA, 25 bp, Mus musculus
cgtgtcagccgatgcattcctgact

SEQ ID NO: 611014 - DNA, 25 bp, Mus musculus
cgtgtcagtactcgctgagcgctgc

SEQ ID NO: 611015 - DNA, 25 bp, Mus musculus
cgtgtcagtactggctgagcgctgc

SEQ ID NO: 611016 - DNA, 25 bp, Mus musculus
cgtgtcatatcaccaatttgccgac

SEQ ID NO: 611017 - DNA, 25 bp, Mus musculus
cgtgtcatatcagcaatttgccgac

SEQ ID NO: 611018 - DNA, 25 bp, Mus musculus
cgtgtcatcaaccaagagtataaaa

SEQ ID NO: 611019 - DNA, 25 bp, Mus musculus
cgtgtcatcaacgaagagtataaaa

SEQ ID NO: 611020 - DNA, 25 bp, Mus musculus
cgtgtcatgcttcgtaattgtatcg

SEQ ID NO: 611021 - DNA, 25 bp, Mus musculus
cgtgtcatgcttggtaattgtatcg

SEQ ID NO: 611022 - DNA, 25 bp, Mus musculus
cgtgtcatggacatacatctcaagc

SEQ ID NO: 611023 - DNA, 25 bp, Mus musculus
cgtgtcatggacttacatctcaagc

SEQ ID NO: 611024 - DNA, 25 bp, Mus musculus
cgtgtccaccagcaaatcgacgagg

SEQ ID NO: 611025 - DNA, 25 bp, Mus musculus
cgtgtccaccaggaaatcgacgagg

SEQ ID NO: 611026 - DNA, 25 bp, Mus musculus
cgtgtccaggcacaaagaaacaaaa

SEQ ID NO: 611027 - DNA, 25 bp, Mus musculus
cgtgtccaggcagaaagaaacaaaa

SEQ ID NO: 611028 - DNA, 25 bp, Mus musculus
cgtgtccatcacactctgtgtcctt

SEQ ID NO: 611029 - DNA, 25 bp, Mus musculus
cgtgtccatcactctctgtgtcctt

SEQ ID NO: 611030 - DNA, 25 bp, Mus musculus
cgtgtcccaaagacgccaagtgtcg

SEQ ID NO: 611031 - DNA, 25 bp, Mus musculus
cgtgtcccaaagtcgccaagtgtcg

SEQ ID NO: 611032 - DNA, 25 bp, Mus musculus
cgtgtcctcaccaccgattatgctt

SEQ ID NO: 611033 - DNA, 25 bp, Mus musculus
cgtgtcctcacctccgattatgctt

SEQ ID NO: 611034 - DNA, 25 bp, Mus musculus
cgtgtcctcttcagctaatcaattc

SEQ ID NO: 611035 - DNA, 25 bp, Mus musculus
cgtgtcctcttctgctaatcaattc

SEQ ID NO: 611036 - DNA, 25 bp, Mus musculus
cgtgtcctgggcatgaacagtatgc

SEQ ID NO: 611037 - DNA, 25 bp, Mus musculus
cgtgtcctgggcttgaacagtatgc

SEQ ID NO: 611038 - DNA, 25 bp, Mus musculus
cgtgtcggagacctctatggcttcc

SEQ ID NO: 611039 - DNA, 25 bp, Mus musculus
cgtgtcggagacgtctatggcttcc

SEQ ID NO: 611040 - DNA, 25 bp, Mus musculus
cgtgtcggatacaagaagagctgga

SEQ ID NO: 611041 - DNA, 25 bp, Mus musculus
cgtgtcggatactagaagagctgga

SEQ ID NO: 611042 - DNA, 25 bp, Mus musculus
cgtgtctaactgacaggttcaggag

SEQ ID NO: 611043 - DNA, 25 bp, Mus musculus
cgtgtctaactgtcaggttcaggag

SEQ ID NO: 611044 - DNA, 25 bp, Mus musculus
cgtgtctcagaaagatcttccttgg

SEQ ID NO: 611045 - DNA, 25 bp, Mus musculus
cgtgtctcagaatgatcttccttgg

SEQ ID NO: 611046 - DNA, 25 bp, Mus musculus
cgtgtctctcaaagcgtcagggaga

SEQ ID NO: 611047 - DNA, 25 bp, Mus musculus
cgtgtctctcaatgcgtcagggaga

SEQ ID NO: 611048 - DNA, 25 bp, Mus musculus
cgtgtctgacgaagaaatgatggag

SEQ ID NO: 611049 - DNA, 25 bp, Mus musculus
cgtgtctgacgatgaaatgatggag

SEQ ID NO: 611050 - DNA, 25 bp, Mus musculus
cgtgtctgagcaccttcatgagtgg

SEQ ID NO: 611051 - DNA, 25 bp, Mus musculus
cgtgtctgagcagcttcatgagtgg

SEQ ID NO: 611052 - DNA, 25 bp, Mus musculus
cgtgtctgccagaaaccaggtgacc

SEQ ID NO: 611053 - DNA, 25 bp, Mus musculus
cgtgtctgccagtaaccaggtgacc

SEQ ID NO: 611054 - DNA, 25 bp, Mus musculus
cgtgtctggagtacgatgagcacta

SEQ ID NO: 611055 - DNA, 25 bp, Mus musculus
cgtgtctggagttcgatgagcacta

SEQ ID NO: 611056 - DNA, 25 bp, Mus musculus
cgtgtcttgaccagcacctgagttc

SEQ ID NO: 611057 - DNA, 25 bp, Mus musculus
cgtgtcttgacctgcacctgagttc

SEQ ID NO: 611058 - DNA, 25 bp, Mus musculus
cgtgtcttgccgatgtgaacgtgcc

SEQ ID NO: 611059 - DNA, 25 bp, Mus musculus
cgtgtcttgccgttgtgaacgtgcc

SEQ ID NO: 611060 - DNA, 25 bp, Mus musculus
cgtgtctttcatcatttccgaaatg

SEQ ID NO: 611061 - DNA, 25 bp, Mus musculus
cgtgtctttcatgatttccgaaatg

SEQ ID NO: 611062 - DNA, 25 bp, Mus musculus
cgtgtgaagccaacgggaagcccca

SEQ ID NO: 611063 - DNA, 25 bp, Mus musculus
cgtgtgaagccatcgggaagcccca

SEQ ID NO: 611064 - DNA, 25 bp, Mus musculus
cgtgtgaagcttcaagggaaagaac

SEQ ID NO: 611065 - DNA, 25 bp, Mus musculus
cgtgtgaagcttgaagggaaagaac

SEQ ID NO: 611066 - DNA, 25 bp, Mus musculus
cgtgtgacccaaccaagaagaatcc

SEQ ID NO: 611067 - DNA, 25 bp, Mus musculus
cgtgtgacccaagcaagaagaatcc

SEQ ID NO: 611068 - DNA, 25 bp, Mus musculus
cgtgtgagtaacagaataaaatacc

SEQ ID NO: 611069 - DNA, 25 bp, Mus musculus
cgtgtgagtaactgaataaaatacc

SEQ ID NO: 611070 - DNA, 25 bp, Mus musculus
cgtgtgatatcacagtttgtaattc

SEQ ID NO: 611071 - DNA, 25 bp, Mus musculus
cgtgtgatatcagagtttgtaattc

SEQ ID NO: 611072 - DNA, 25 bp, Mus musculus
cgtgtgatcgctatctggatggagc

SEQ ID NO: 611073 - DNA, 25 bp, Mus musculus
cgtgtgatcgctttctggatggagc

SEQ ID NO: 611074 - DNA, 25 bp, Mus musculus
cgtgtgattggtccgcagagtccac

SEQ ID NO: 611075 - DNA, 25 bp, Mus musculus
cgtgtgattggtgcgcagagtccac

SEQ ID NO: 611076 - DNA, 25 bp, Mus musculus
cgtgtgcacggacctgtcggaaatc

SEQ ID NO: 611077 - DNA, 25 bp, Mus musculus
cgtgtgcacggagctgtcggaaatc

SEQ ID NO: 611078 - DNA, 25 bp, Mus musculus
cgtgtgcagaccagtgtcaatctca

SEQ ID NO: 611079 - DNA, 25 bp, Mus musculus
cgtgtgcagacctgtgtcaatctca

SEQ ID NO: 611080 - DNA, 25 bp, Mus musculus
cgtgtgccaagaagatcctggctat

SEQ ID NO: 611081 - DNA, 25 bp, Mus musculus
cgtgtgccaagatgatcctggctat

SEQ ID NO: 611082 - DNA, 25 bp, Mus musculus
cgtgtgccattgaccaggatccgta

SEQ ID NO: 611083 - DNA, 25 bp, Mus musculus
cgtgtgccattgtccaggatccgta

SEQ ID NO: 611084 - DNA, 25 bp, Mus musculus
cgtgtgcgacgcaaatgtgggttac

SEQ ID NO: 611085 - DNA, 25 bp, Mus musculus
cgtgtgcgacgctaatgtgggttac

SEQ ID NO: 611086 - DNA, 25 bp, Mus musculus
cgtgtgcgtgataacctagtcagga

SEQ ID NO: 611087 - DNA, 25 bp, Mus musculus
cgtgtgcgtgattacctagtcagga

SEQ ID NO: 611088 - DNA, 25 bp, Mus musculus
cgtgtgctacagaccccaaatgacc

SEQ ID NO: 611089 - DNA, 25 bp, Mus musculus
cgtgtgctacagtccccaaatgacc

SEQ ID NO: 611090 - DNA, 25 bp, Mus musculus
cgtgtgctcgggactgaatcgctga

SEQ ID NO: 611091 - DNA, 25 bp, Mus musculus
cgtgtgctcgggtctgaatcgctga

SEQ ID NO: 611092 - DNA, 25 bp, Mus musculus
cgtgtgctgtgccacttcagtgtgc

SEQ ID NO: 611093 - DNA, 25 bp, Mus musculus
cgtgtgctgtgcgacttcagtgtgc

SEQ ID NO: 611094 - DNA, 25 bp, Mus musculus
cgtgtggaagccaaaaggagctcac

SEQ ID NO: 611095 - DNA, 25 bp, Mus musculus
cgtgtggaagcctaaaggagctcac

SEQ ID NO: 611096 - DNA, 25 bp, Mus musculus
cgtgtggagcttcggcatcctcctc

SEQ ID NO: 611097 - DNA, 25 bp, Mus musculus
cgtgtggagcttgggcatcctcctc

SEQ ID NO: 611098 - DNA, 25 bp, Mus musculus
cgtgtggccaagactaaccgctgat

SEQ ID NO: 611099 - DNA, 25 bp, Mus musculus
cgtgtggccaagtctaaccgctgat

SEQ ID NO: 611100 - DNA, 25 bp, Mus musculus
cgtgtggcgctacttccgagactac

SEQ ID NO: 611101 - DNA, 25 bp, Mus musculus
cgtgtggcgctagttccgagactac

SEQ ID NO: 611102 - DNA, 25 bp, Mus musculus
cgtgtgggccctcaacaaaaggtca

SEQ ID NO: 611103 - DNA, 25 bp, Mus musculus
cgtgtgggccctgaacaaaaggtca

SEQ ID NO: 611104 - DNA, 25 bp, Mus musculus
cgtgtgggcctcagcgctttgtgaa

SEQ ID NO: 611105 - DNA, 25 bp, Mus musculus
cgtgtgggcctctgcgctttgtgaa

SEQ ID NO: 611106 - DNA, 25 bp, Mus musculus
cgtgtggtaccaccattggacctat

SEQ ID NO: 611107 - DNA, 25 bp, Mus musculus
cgtgtggtaccagcattggacctat

SEQ ID NO: 611108 - DNA, 25 bp, Mus musculus
cgtgtggtcatcatggacgagccca

SEQ ID NO: 611109 - DNA, 25 bp, Mus musculus
cgtgtggtcatcttggacgagccca

SEQ ID NO: 611110 - DNA, 25 bp, Mus musculus
cgtgtggttgtgatgtcacggcaga

SEQ ID NO: 611111 - DNA, 25 bp, Mus musculus
cgtgtggttgtgttgtcacggcaga

SEQ ID NO: 611112 - DNA, 25 bp, Mus musculus
cgtgtgtatccgagcacttgagagg

SEQ ID NO: 611113 - DNA, 25 bp, Mus musculus
cgtgtgtatccgtgcacttgagagg

SEQ ID NO: 611114 - DNA, 25 bp, Mus musculus
cgtgtgtcccctaggcgaattaagg

SEQ ID NO: 611115 - DNA, 25 bp, Mus musculus
cgtgtgtccccttggcgaattaagg

SEQ ID NO: 611116 - DNA, 25 bp, Mus musculus
cgtgtgtcgtcaccagcagtctctc

SEQ ID NO: 611117 - DNA, 25 bp, Mus musculus
cgtgtgtcgtcagcagcagtctctc

SEQ ID NO: 611118 - DNA, 25 bp, Mus musculus
cgtgtgtgaagtcacctatgacaag

SEQ ID NO: 611119 - DNA, 25 bp, Mus musculus
cgtgtgtgaagtgacctatgacaag

SEQ ID NO: 611120 - DNA, 25 bp, Mus musculus
cgtgtgtgacaccaatgctgtattg

SEQ ID NO: 611121 - DNA, 25 bp, Mus musculus
cgtgtgtgacacgaatgctgtattg

SEQ ID NO: 611122 - DNA, 25 bp, Mus musculus
cgtgtgtgtaccaggaactcaccag

SEQ ID NO: 611123 - DNA, 25 bp, Mus musculus
cgtgtgtgtacctggaactcaccag

SEQ ID NO: 611124 - DNA, 25 bp, Mus musculus
cgtgtgttgagcagtaaatggaata

SEQ ID NO: 611125 - DNA, 25 bp, Mus musculus
cgtgtgttgagctgtaaatggaata

SEQ ID NO: 611126 - DNA, 25 bp, Mus musculus
cgtgttcactatcccagaggatgat

SEQ ID NO: 611127 - DNA, 25 bp, Mus musculus
cgtgttcactatgccagaggatgat

SEQ ID NO: 611128 - DNA, 25 bp, Mus musculus
cgtgttcgaccccatccaaaggaag

SEQ ID NO: 611129 - DNA, 25 bp, Mus musculus
cgtgttcgacccgatccaaaggaag

SEQ ID NO: 611130 - DNA, 25 bp, Mus musculus
cgtgttcggccaagtcaaagagggc

SEQ ID NO: 611131 - DNA, 25 bp, Mus musculus
cgtgttcggccatgtcaaagagggc

SEQ ID NO: 611132 - DNA, 25 bp, Mus musculus
cgtgttctcaggacagagtggagcc

SEQ ID NO: 611133 - DNA, 25 bp, Mus musculus
cgtgttctcaggtcagagtggagcc

SEQ ID NO: 611134 - DNA, 25 bp, Mus musculus
cgtgttcttactcgatggctcgtcg

SEQ ID NO: 611135 - DNA, 25 bp, Mus musculus
cgtgttcttactggatggctcgtcg

SEQ ID NO: 611136 - DNA, 25 bp, Mus musculus
cgtgttcttggacaaggctgtgcca

SEQ ID NO: 611137 - DNA, 25 bp, Mus musculus
cgtgttcttggagaaggctgtgcca

SEQ ID NO: 611138 - DNA, 25 bp, Mus musculus
cgtgttctttcacctgggttgcagg

SEQ ID NO: 611139 - DNA, 25 bp, Mus musculus
cgtgttctttcagctgggttgcagg

SEQ ID NO: 611140 - DNA, 25 bp, Mus musculus
cgtgttgaccgaaaggtgcagctgt

SEQ ID NO: 611141 - DNA, 25 bp, Mus musculus
cgtgttgaccgataggtgcagctgt

SEQ ID NO: 611142 - DNA, 25 bp, Mus musculus
cgtgttgaggccattgactgtcagg

SEQ ID NO: 611143 - DNA, 25 bp, Mus musculus
cgtgttgaggcctttgactgtcagg

SEQ ID NO: 611144 - DNA, 25 bp, Mus musculus
cgtgttgcaatccatgaggctatgg

SEQ ID NO: 611145 - DNA, 25 bp, Mus musculus
cgtgttgcaatcgatgaggctatgg

SEQ ID NO: 611146 - DNA, 25 bp, Mus musculus
cgtgttgcccatcggctgcagagct

SEQ ID NO: 611147 - DNA, 25 bp, Mus musculus
cgtgttgcccatgggctgcagagct

SEQ ID NO: 611148 - DNA, 25 bp, Mus musculus
cgtgtttcatggctttgggtccctc

SEQ ID NO: 611149 - DNA, 25 bp, Mus musculus
cgtgtttcatgggtttgggtccctc

SEQ ID NO: 611150 - DNA, 25 bp, Mus musculus
cgtgtttcctgccaattacgtcaaa

SEQ ID NO: 611151 - DNA, 25 bp, Mus musculus
cgtgtttcctgcgaattacgtcaaa

SEQ ID NO: 611152 - DNA, 25 bp, Mus musculus
cgtgtttccttactgcatcgagcca

SEQ ID NO: 611153 - DNA, 25 bp, Mus musculus
cgtgtttccttagtgcatcgagcca

SEQ ID NO: 611154 - DNA, 25 bp, Mus musculus
cgtgtttgcctgatatgtgagcaaa

SEQ ID NO: 611155 - DNA, 25 bp, Mus musculus
cgtgtttgcctgttatgtgagcaaa

SEQ ID NO: 611156 - DNA, 25 bp, Mus musculus
cgtgtttgctcaagcgaatctggaa

SEQ ID NO: 611157 - DNA, 25 bp, Mus musculus
cgtgtttgctcatgcgaatctggaa

SEQ ID NO: 611158 - DNA, 25 bp, Mus musculus
cgtgttttatctccagcacctgtgg

SEQ ID NO: 611159 - DNA, 25 bp, Mus musculus
cgtgttttatctgcagcacctgtgg

SEQ ID NO: 611160 - DNA, 25 bp, Mus musculus
cgtgttttcaacagagagcaggttt

SEQ ID NO: 611161 - DNA, 25 bp, Mus musculus
cgtgttttcaactgagagcaggttt

SEQ ID NO: 611162 - DNA, 25 bp, Mus musculus
cgtgttttgaaacaagcccagtgac

SEQ ID NO: 611163 - DNA, 25 bp, Mus musculus
cgtgttttgaaagaagcccagtgac

SEQ ID NO: 611164 - DNA, 25 bp, Mus musculus
cgttaaatttccaattctgagcgca

SEQ ID NO: 611165 - DNA, 25 bp, Mus musculus
cgttaaatttcctattctgagcgca

SEQ ID NO: 611166 - DNA, 25 bp, Mus musculus
cgttaaccttttcgctgctgctttt

SEQ ID NO: 611167 - DNA, 25 bp, Mus musculus
cgttaaccttttggctgctgctttt

SEQ ID NO: 611168 - DNA, 25 bp, Mus musculus
cgttaagagccactcgtggcgcaca

SEQ ID NO: 611169 - DNA, 25 bp, Mus musculus
cgttaagagccagtcgtggcgcaca

SEQ ID NO: 611170 - DNA, 25 bp, Mus musculus
cgttaagtgtctcttcacagatgac

SEQ ID NO: 611171 - DNA, 25 bp, Mus musculus
cgttaagtgtctgttcacagatgac

SEQ ID NO: 611172 - DNA, 25 bp, Mus musculus
cgttaataagtgatgctctggttca

SEQ ID NO: 611173 - DNA, 25 bp, Mus musculus
cgttaataagtgttgctctggttca

SEQ ID NO: 611174 - DNA, 25 bp, Mus musculus
cgttaccaccctcaggagacgctga

SEQ ID NO: 611175 - DNA, 25 bp, Mus musculus
cgttaccaccctgaggagacgctga

SEQ ID NO: 611176 - DNA, 25 bp, Mus musculus
cgttaccagggacccatcgcacgga

SEQ ID NO: 611177 - DNA, 25 bp, Mus musculus
cgttaccagggagccatcgcacgga

SEQ ID NO: 611178 - DNA, 25 bp, Mus musculus
cgttaccatagaagagttcattgaa

SEQ ID NO: 611179 - DNA, 25 bp, Mus musculus
cgttaccatagatgagttcattgaa

SEQ ID NO: 611180 - DNA, 25 bp, Mus musculus
cgttacctggcactcttcacagaca

SEQ ID NO: 611181 - DNA, 25 bp, Mus musculus
cgttacctggcagtcttcacagaca

SEQ ID NO: 611182 - DNA, 25 bp, Mus musculus
cgttacctttcacgcccaggtggtg

SEQ ID NO: 611183 - DNA, 25 bp, Mus musculus
cgttacctttcaggcccaggtggtg

SEQ ID NO: 611184 - DNA, 25 bp, Mus musculus
cgttactcgaagacgggcggcggct

SEQ ID NO: 611185 - DNA, 25 bp, Mus musculus
cgttactcgaagtcgggcggcggct

SEQ ID NO: 611186 - DNA, 25 bp, Mus musculus
cgttactctgatcaacttctggcca

SEQ ID NO: 611187 - DNA, 25 bp, Mus musculus
cgttactctgatgaacttctggcca

SEQ ID NO: 611188 - DNA, 25 bp, Mus musculus
cgttactgcaggcttaagaagtgct

SEQ ID NO: 611189 - DNA, 25 bp, Mus musculus
cgttactgcagggttaagaagtgct

SEQ ID NO: 611190 - DNA, 25 bp, Mus musculus
cgttactggagccttgccgctcagg

SEQ ID NO: 611191 - DNA, 25 bp, Mus musculus
cgttactggagcgttgccgctcagg

SEQ ID NO: 611192 - DNA, 25 bp, Mus musculus
cgttacttggcccaggttgctgctg

SEQ ID NO: 611193 - DNA, 25 bp, Mus musculus
cgttacttggccgaggttgctgctg

SEQ ID NO: 611194 - DNA, 25 bp, Mus musculus
cgttagaggtgcaagggactgacta

SEQ ID NO: 611195 - DNA, 25 bp, Mus musculus
cgttagaggtgctagggactgacta

SEQ ID NO: 611196 - DNA, 25 bp, Mus musculus
cgttagcagccactggagcgtcatg

SEQ ID NO: 611197 - DNA, 25 bp, Mus musculus
cgttagcagccagtggagcgtcatg

SEQ ID NO: 611198 - DNA, 25 bp, Mus musculus
cgttagcctggcactagaaaggcca

SEQ ID NO: 611199 - DNA, 25 bp, Mus musculus
cgttagcctggctctagaaaggcca

SEQ ID NO: 611200 - DNA, 25 bp, Mus musculus
cgttaggcggccaggtcttagatct

SEQ ID NO: 611201 - DNA, 25 bp, Mus musculus
cgttaggcggcctggtcttagatct

SEQ ID NO: 611202 - DNA, 25 bp, Mus musculus
cgttagggatagacgggagtattca

SEQ ID NO: 611203 - DNA, 25 bp, Mus musculus
cgttagggatagtcgggagtattca

SEQ ID NO: 611204 - DNA, 25 bp, Mus musculus
cgttagtcacttagatatatttgca

SEQ ID NO: 611205 - DNA, 25 bp, Mus musculus
cgttagtcactttgatatatttgca

SEQ ID NO: 611206 - DNA, 25 bp, Mus musculus
cgttataaatatcccggtgccagcg

SEQ ID NO: 611207 - DNA, 25 bp, Mus musculus
cgttataaatatgccggtgccagcg

SEQ ID NO: 611208 - DNA, 25 bp, Mus musculus
cgttataggcttactcgatgcagaa

SEQ ID NO: 611209 - DNA, 25 bp, Mus musculus
cgttataggctttctcgatgcagaa

SEQ ID NO: 611210 - DNA, 25 bp, Mus musculus
cgttatattttgcacagagacctga

SEQ ID NO: 611211 - DNA, 25 bp, Mus musculus
cgttatattttggacagagacctga

SEQ ID NO: 611212 - DNA, 25 bp, Mus musculus
cgttatgtacctacaggtgttagaa

SEQ ID NO: 611213 - DNA, 25 bp, Mus musculus
cgttatgtaccttcaggtgttagaa

SEQ ID NO: 611214 - DNA, 25 bp, Mus musculus
cgttattcgtggattgctgaggtcc

SEQ ID NO: 611215 - DNA, 25 bp, Mus musculus
cgttattcgtggtttgctgaggtcc

SEQ ID NO: 611216 - DNA, 25 bp, Mus musculus
cgttattgatatatgtgcttctgcc

SEQ ID NO: 611217 - DNA, 25 bp, Mus musculus
cgttattgatatttgtgcttctgcc

SEQ ID NO: 611218 - DNA, 25 bp, Mus musculus
cgttattgattgagctgagaggacc

SEQ ID NO: 611219 - DNA, 25 bp, Mus musculus
cgttattgattgtgctgagaggacc

SEQ ID NO: 611220 - DNA, 25 bp, Mus musculus
cgttattggctccttcttttcaaca

SEQ ID NO: 611221 - DNA, 25 bp, Mus musculus
cgttattggctcgttcttttcaaca

SEQ ID NO: 611222 - DNA, 25 bp, Mus musculus
cgttattgggagctatgaatgtcgc

SEQ ID NO: 611223 - DNA, 25 bp, Mus musculus
cgttattgggaggtatgaatgtcgc

SEQ ID NO: 611224 - DNA, 25 bp, Mus musculus
cgttattgtgatcctctttgtatgc

SEQ ID NO: 611225 - DNA, 25 bp, Mus musculus
cgttattgtgatgctctttgtatgc

SEQ ID NO: 611226 - DNA, 25 bp, Mus musculus
cgttattgtgtgactgtctccctgc

SEQ ID NO: 611227 - DNA, 25 bp, Mus musculus
cgttattgtgtgtctgtctccctgc

SEQ ID NO: 611228 - DNA, 25 bp, Mus musculus
cgttcaaacaatctcaccagaggct

SEQ ID NO: 611229 - DNA, 25 bp, Mus musculus
cgttcaaacaatgtcaccagaggct

SEQ ID NO: 611230 - DNA, 25 bp, Mus musculus
cgttcaacgataccaacgtggtcca

SEQ ID NO: 611231 - DNA, 25 bp, Mus musculus
cgttcaacgatagcaacgtggtcca

SEQ ID NO: 611232 - DNA, 25 bp, Mus musculus
cgttcaagctatcagataattagta

SEQ ID NO: 611233 - DNA, 25 bp, Mus musculus
cgttcaagctatgagataattagta

SEQ ID NO: 611234 - DNA, 25 bp, Mus musculus
cgttcaatggctaatgaggcaaagc

SEQ ID NO: 611235 - DNA, 25 bp, Mus musculus
cgttcaatggcttatgaggcaaagc

SEQ ID NO: 611236 - DNA, 25 bp, Mus musculus
cgttcaattggaccagcagctaaga

SEQ ID NO: 611237 - DNA, 25 bp, Mus musculus
cgttcaattggagcagcagctaaga

SEQ ID NO: 611238 - DNA, 25 bp, Mus musculus
cgttcacagggtatgaggccttcta

SEQ ID NO: 611239 - DNA, 25 bp, Mus musculus
cgttcacagggtttgaggccttcta

SEQ ID NO: 611240 - DNA, 25 bp, Mus musculus
cgttcacccaaactacaacttctat

SEQ ID NO: 611241 - DNA, 25 bp, Mus musculus
cgttcacccaaagtacaacttctat

SEQ ID NO: 611242 - DNA, 25 bp, Mus musculus
cgttcacgggccctggttgttcaca

SEQ ID NO: 611243 - DNA, 25 bp, Mus musculus
cgttcacgggccgtggttgttcaca

SEQ ID NO: 611244 - DNA, 25 bp, Mus musculus
cgttcacttcggatttgcccatgta

SEQ ID NO: 611245 - DNA, 25 bp, Mus musculus
cgttcacttcggttttgcccatgta

SEQ ID NO: 611246 - DNA, 25 bp, Mus musculus
cgttcagacagacgccagttcagaa

SEQ ID NO: 611247 - DNA, 25 bp, Mus musculus
cgttcagacagaggccagttcagaa

SEQ ID NO: 611248 - DNA, 25 bp, Mus musculus
cgttcagagcgtctggcaaaataca

SEQ ID NO: 611249 - DNA, 25 bp, Mus musculus
cgttcagagcgtgtggcaaaataca

SEQ ID NO: 611250 - DNA, 25 bp, Mus musculus
cgttcagatctaccgggatggccag

SEQ ID NO: 611251 - DNA, 25 bp, Mus musculus
cgttcagatctagcgggatggccag

SEQ ID NO: 611252 - DNA, 25 bp, Mus musculus
cgttcagcttccagtccgacgtgta

SEQ ID NO: 611253 - DNA, 25 bp, Mus musculus
cgttcagcttcctgtccgacgtgta

SEQ ID NO: 611254 - DNA, 25 bp, Mus musculus
cgttcagtccaaagcattgatagtt

SEQ ID NO: 611255 - DNA, 25 bp, Mus musculus
cgttcagtccaatgcattgatagtt

SEQ ID NO: 611256 - DNA, 25 bp, Mus musculus
cgttcatagactactgtaaaatgca

SEQ ID NO: 611257 - DNA, 25 bp, Mus musculus
cgttcatagacttctgtaaaatgca

SEQ ID NO: 611258 - DNA, 25 bp, Mus musculus
cgttcatctttgagggccgctccta

SEQ ID NO: 611259 - DNA, 25 bp, Mus musculus
cgttcatctttgtgggccgctccta

SEQ ID NO: 611260 - DNA, 25 bp, Mus musculus
cgttcatgtctacagcaatggccga

SEQ ID NO: 611261 - DNA, 25 bp, Mus musculus
cgttcatgtctagagcaatggccga

SEQ ID NO: 611262 - DNA, 25 bp, Mus musculus
cgttcatgtgaaccatgggtcggca

SEQ ID NO: 611263 - DNA, 25 bp, Mus musculus
cgttcatgtgaagcatgggtcggca

SEQ ID NO: 611264 - DNA, 25 bp, Mus musculus
cgttcatgttcccacaatcagtgca

SEQ ID NO: 611265 - DNA, 25 bp, Mus musculus
cgttcatgttccgacaatcagtgca

SEQ ID NO: 611266 - DNA, 25 bp, Mus musculus
cgttcattctgaaaagacttaatgg

SEQ ID NO: 611267 - DNA, 25 bp, Mus musculus
cgttcattctgataagacttaatgg

SEQ ID NO: 611268 - DNA, 25 bp, Mus musculus
cgttccaatccactggctgttcttc

SEQ ID NO: 611269 - DNA, 25 bp, Mus musculus
cgttccaatccagtggctgttcttc

SEQ ID NO: 611270 - DNA, 25 bp, Mus musculus
cgttccacggcaacgtttccaagtg

SEQ ID NO: 611271 - DNA, 25 bp, Mus musculus
cgttccacggcatcgtttccaagtg

SEQ ID NO: 611272 - DNA, 25 bp, Mus musculus
cgttccatccaaatggacgggctgg

SEQ ID NO: 611273 - DNA, 25 bp, Mus musculus
cgttccatccaattggacgggctgg

SEQ ID NO: 611274 - DNA, 25 bp, Mus musculus
cgttccccaggcatcggaatcaaga

SEQ ID NO: 611275 - DNA, 25 bp, Mus musculus
cgttccccaggcttcggaatcaaga

SEQ ID NO: 611276 - DNA, 25 bp, Mus musculus
cgttccccagtaaaaatatgctgcg

SEQ ID NO: 611277 - DNA, 25 bp, Mus musculus
cgttccccagtataaatatgctgcg

SEQ ID NO: 611278 - DNA, 25 bp, Mus musculus
cgttcccgcaaactctggatccagt

SEQ ID NO: 611279 - DNA, 25 bp, Mus musculus
cgttcccgcaaagtctggatccagt

SEQ ID NO: 611280 - DNA, 25 bp, Mus musculus
cgttccctctttctccacaaggtgg

SEQ ID NO: 611281 - DNA, 25 bp, Mus musculus
cgttccctctttgtccacaaggtgg

SEQ ID NO: 611282 - DNA, 25 bp, Mus musculus
cgttccctttgcatcacccagtgtg

SEQ ID NO: 611283 - DNA, 25 bp, Mus musculus
cgttccctttgcttcacccagtgtg

SEQ ID NO: 611284 - DNA, 25 bp, Mus musculus
cgttccgaggtcacgcccaggcgga

SEQ ID NO: 611285 - DNA, 25 bp, Mus musculus
cgttccgaggtctcgcccaggcgga

SEQ ID NO: 611286 - DNA, 25 bp, Mus musculus
cgttccgggttgaggtgtctctaga

SEQ ID NO: 611287 - DNA, 25 bp, Mus musculus
cgttccgggttgtggtgtctctaga

SEQ ID NO: 611288 - DNA, 25 bp, Mus musculus
cgttccggtcgaatgtcccacatgt

SEQ ID NO: 611289 - DNA, 25 bp, Mus musculus
cgttccggtcgattgtcccacatgt

SEQ ID NO: 611290 - DNA, 25 bp, Mus musculus
cgttcctagaggcttaaccataata

SEQ ID NO: 611291 - DNA, 25 bp, Mus musculus
cgttcctagagggttaaccataata

SEQ ID NO: 611292 - DNA, 25 bp, Mus musculus
cgttcctcaaagaggcgtgcctgct

SEQ ID NO: 611293 - DNA, 25 bp, Mus musculus
cgttcctcaaagtggcgtgcctgct

SEQ ID NO: 611294 - DNA, 25 bp, Mus musculus
cgttcctctgatccaacccgtagaa

SEQ ID NO: 611295 - DNA, 25 bp, Mus musculus
cgttcctctgatgcaacccgtagaa

SEQ ID NO: 611296 - DNA, 25 bp, Mus musculus
cgttcctgagcgctgcgagtgttca

SEQ ID NO: 611297 - DNA, 25 bp, Mus musculus
cgttcctgagcggtgcgagtgttca

SEQ ID NO: 611298 - DNA, 25 bp, Mus musculus
cgttcctggctaagatttcttggtg

SEQ ID NO: 611299 - DNA, 25 bp, Mus musculus
cgttcctggctatgatttcttggtg

SEQ ID NO: 611300 - DNA, 25 bp, Mus musculus
cgttcctgtgtcagtacggcatggt

SEQ ID NO: 611301 - DNA, 25 bp, Mus musculus
cgttcctgtgtctgtacggcatggt

SEQ ID NO: 611302 - DNA, 25 bp, Mus musculus
cgttccttccgaagacagtgctcta

SEQ ID NO: 611303 - DNA, 25 bp, Mus musculus
cgttccttccgatgacagtgctcta

SEQ ID NO: 611304 - DNA, 25 bp, Mus musculus
cgttccttgattagtctcttccagt

SEQ ID NO: 611305 - DNA, 25 bp, Mus musculus
cgttccttgatttgtctcttccagt

SEQ ID NO: 611306 - DNA, 25 bp, Mus musculus
cgttcgaaagtgctgtttatggtgt

SEQ ID NO: 611307 - DNA, 25 bp, Mus musculus
cgttcgaaagtggtgtttatggtgt

SEQ ID NO: 611308 - DNA, 25 bp, Mus musculus
cgttcgacgcccacatctatgaagg

SEQ ID NO: 611309 - DNA, 25 bp, Mus musculus
cgttcgacgccctcatctatgaagg

SEQ ID NO: 611310 - DNA, 25 bp, Mus musculus
cgttcgaggtgcaccctatgattgg

SEQ ID NO: 611311 - DNA, 25 bp, Mus musculus
cgttcgaggtgctccctatgattgg

SEQ ID NO: 611312 - DNA, 25 bp, Mus musculus
cgttcgcttcaacggtgctattcaa

SEQ ID NO: 611313 - DNA, 25 bp, Mus musculus
cgttcgcttcaagggtgctattcaa

SEQ ID NO: 611314 - DNA, 25 bp, Mus musculus
cgttcggacgagcttcagagacata

SEQ ID NO: 611315 - DNA, 25 bp, Mus musculus
cgttcggacgaggttcagagacata

SEQ ID NO: 611316 - DNA, 25 bp, Mus musculus
cgttcggcggagattttcaataaga

SEQ ID NO: 611317 - DNA, 25 bp, Mus musculus
cgttcggcggagtttttcaataaga

SEQ ID NO: 611318 - DNA, 25 bp, Mus musculus
cgttcgtcgcgcactcacgatggct

SEQ ID NO: 611319 - DNA, 25 bp, Mus musculus
cgttcgtcgcgctctcacgatggct

SEQ ID NO: 611320 - DNA, 25 bp, Mus musculus
cgttcgttatcgaattcctttctgc

SEQ ID NO: 611321 - DNA, 25 bp, Mus musculus
cgttcgttatcgtattcctttctgc

SEQ ID NO: 611322 - DNA, 25 bp, Mus musculus
cgttctaagagcagggcctttgaga

SEQ ID NO: 611323 - DNA, 25 bp, Mus musculus
cgttctaagagctgggcctttgaga

SEQ ID NO: 611324 - DNA, 25 bp, Mus musculus
cgttctagaggcagccaggacctag

SEQ ID NO: 611325 - DNA, 25 bp, Mus musculus
cgttctagaggctgccaggacctag

SEQ ID NO: 611326 - DNA, 25 bp, Mus musculus
cgttctagggccctaccatgtgaag

SEQ ID NO: 611327 - DNA, 25 bp, Mus musculus
cgttctagggccgtaccatgtgaag

SEQ ID NO: 611328 - DNA, 25 bp, Mus musculus
cgttctagtgctcgccctggctatc

SEQ ID NO: 611329 - DNA, 25 bp, Mus musculus
cgttctagtgctggccctggctatc

SEQ ID NO: 611330 - DNA, 25 bp, Mus musculus
cgttctatgaggcaatgggccccgt

SEQ ID NO: 611331 - DNA, 25 bp, Mus musculus
cgttctatgagggaatgggccccgt

SEQ ID NO: 611332 - DNA, 25 bp, Mus musculus
cgttctcacagtattgtccagatcc

SEQ ID NO: 611333 - DNA, 25 bp, Mus musculus
cgttctcacagttttgtccagatcc

SEQ ID NO: 611334 - DNA, 25 bp, Mus musculus
cgttctcagggacaggagtcacgcc

SEQ ID NO: 611335 - DNA, 25 bp, Mus musculus
cgttctcagggagaggagtcacgcc

SEQ ID NO: 611336 - DNA, 25 bp, Mus musculus
cgttctcctgctaggaccagagtcc

SEQ ID NO: 611337 - DNA, 25 bp, Mus musculus
cgttctcctgcttggaccagagtcc

SEQ ID NO: 611338 - DNA, 25 bp, Mus musculus
cgttctcggcagagtcggcctgcag

SEQ ID NO: 611339 - DNA, 25 bp, Mus musculus
cgttctcggcagtgtcggcctgcag

SEQ ID NO: 611340 - DNA, 25 bp, Mus musculus
cgttctcgtgctcctgagataagtt

SEQ ID NO: 611341 - DNA, 25 bp, Mus musculus
cgttctcgtgctgctgagataagtt

SEQ ID NO: 611342 - DNA, 25 bp, Mus musculus
cgttctctgtacaccgagtgatcgc

SEQ ID NO: 611343 - DNA, 25 bp, Mus musculus
cgttctctgtactccgagtgatcgc

SEQ ID NO: 611344 - DNA, 25 bp, Mus musculus
cgttctcttctgcagatcatttccc

SEQ ID NO: 611345 - DNA, 25 bp, Mus musculus
cgttctcttctggagatcatttccc

SEQ ID NO: 611346 - DNA, 25 bp, Mus musculus
cgttctgagcgtcactgctcgtgca

SEQ ID NO: 611347 - DNA, 25 bp, Mus musculus
cgttctgagcgtgactgctcgtgca

SEQ ID NO: 611348 - DNA, 25 bp, Mus musculus
cgttctgcacgaccgtttccctatg

SEQ ID NO: 611349 - DNA, 25 bp, Mus musculus
cgttctgcacgagcgtttccctatg

SEQ ID NO: 611350 - DNA, 25 bp, Mus musculus
cgttctgcgtagacgccctacagga

SEQ ID NO: 611351 - DNA, 25 bp, Mus musculus
cgttctgcgtagtcgccctacagga

SEQ ID NO: 611352 - DNA, 25 bp, Mus musculus
cgttctggcgtccttgaatccggtg

SEQ ID NO: 611353 - DNA, 25 bp, Mus musculus
cgttctggcgtcgttgaatccggtg

SEQ ID NO: 611354 - DNA, 25 bp, Mus musculus
cgttctgggacgactcttccacagc

SEQ ID NO: 611355 - DNA, 25 bp, Mus musculus
cgttctgggacgtctcttccacagc

SEQ ID NO: 611356 - DNA, 25 bp, Mus musculus
cgttctgggatacaaacagtgggaa

SEQ ID NO: 611357 - DNA, 25 bp, Mus musculus
cgttctgggatagaaacagtgggaa

SEQ ID NO: 611358 - DNA, 25 bp, Mus musculus
cgttctgtccatagagacttccaac

SEQ ID NO: 611359 - DNA, 25 bp, Mus musculus
cgttctgtccattgagacttccaac

SEQ ID NO: 611360 - DNA, 25 bp, Mus musculus
cgttctgttgaactaaagcatggca

SEQ ID NO: 611361 - DNA, 25 bp, Mus musculus
cgttctgttgaagtaaagcatggca

SEQ ID NO: 611362 - DNA, 25 bp, Mus musculus
cgttcttatcggcagcacagccaga

SEQ ID NO: 611363 - DNA, 25 bp, Mus musculus
cgttcttatcgggagcacagccaga

SEQ ID NO: 611364 - DNA, 25 bp, Mus musculus
cgttcttcagttctaatgctatgcc

SEQ ID NO: 611365 - DNA, 25 bp, Mus musculus
cgttcttcagttgtaatgctatgcc

SEQ ID NO: 611366 - DNA, 25 bp, Mus musculus
cgttcttgctccaccggatgtacag

SEQ ID NO: 611367 - DNA, 25 bp, Mus musculus
cgttcttgctcctccggatgtacag

SEQ ID NO: 611368 - DNA, 25 bp, Mus musculus
cgttcttggagcaacatccccttta

SEQ ID NO: 611369 - DNA, 25 bp, Mus musculus
cgttcttggagctacatccccttta

SEQ ID NO: 611370 - DNA, 25 bp, Mus musculus
cgttcttggcacattcgccatccag

SEQ ID NO: 611371 - DNA, 25 bp, Mus musculus
cgttcttggcactttcgccatccag

SEQ ID NO: 611372 - DNA, 25 bp, Mus musculus
cgttcttgtcatccctcagggcttc

SEQ ID NO: 611373 - DNA, 25 bp, Mus musculus
cgttcttgtcatgcctcagggcttc

SEQ ID NO: 611374 - DNA, 25 bp, Mus musculus
cgttctttgattcttaccaccattt

SEQ ID NO: 611375 - DNA, 25 bp, Mus musculus
cgttctttgattgttaccaccattt

SEQ ID NO: 611376 - DNA, 25 bp, Mus musculus
cgttgaaacaagcaccattgctgtc

SEQ ID NO: 611377 - DNA, 25 bp, Mus musculus
cgttgaaacaaggaccattgctgtc

SEQ ID NO: 611378 - DNA, 25 bp, Mus musculus
cgttgaaaggtacatgaagcaggcc

SEQ ID NO: 611379 - DNA, 25 bp, Mus musculus
cgttgaaaggtagatgaagcaggcc

SEQ ID NO: 611380 - DNA, 25 bp, Mus musculus
cgttgaagatgtaagatgtgggaaa

SEQ ID NO: 611381 - DNA, 25 bp, Mus musculus
cgttgaagatgttagatgtgggaaa

SEQ ID NO: 611382 - DNA, 25 bp, Mus musculus
cgttgactgggcagacagttgccat

SEQ ID NO: 611383 - DNA, 25 bp, Mus musculus
cgttgactgggctgacagttgccat

SEQ ID NO: 611384 - DNA, 25 bp, Mus musculus
cgttgacttcctctattaccacact

SEQ ID NO: 611385 - DNA, 25 bp, Mus musculus
cgttgacttcctgtattaccacact

SEQ ID NO: 611386 - DNA, 25 bp, Mus musculus
cgttgacttctcaccggatgagtgg

SEQ ID NO: 611387 - DNA, 25 bp, Mus musculus
cgttgacttctctccggatgagtgg

SEQ ID NO: 611388 - DNA, 25 bp, Mus musculus
cgttgagatgatccaaggagttgct

SEQ ID NO: 611389 - DNA, 25 bp, Mus musculus
cgttgagatgatgcaaggagttgct

SEQ ID NO: 611390 - DNA, 25 bp, Mus musculus
cgttgagcatacctacataggaaac

SEQ ID NO: 611391 - DNA, 25 bp, Mus musculus
cgttgagcatacgtacataggaaac

SEQ ID NO: 611392 - DNA, 25 bp, Mus musculus
cgttgagcattaaagagcaggaaag

SEQ ID NO: 611393 - DNA, 25 bp, Mus musculus
cgttgagcattatagagcaggaaag

SEQ ID NO: 611394 - DNA, 25 bp, Mus musculus
cgttgaggcttaaatgggaaataca

SEQ ID NO: 611395 - DNA, 25 bp, Mus musculus
cgttgaggcttatatgggaaataca

SEQ ID NO: 611396 - DNA, 25 bp, Mus musculus
cgttgagtgccaaagcattctcaag

SEQ ID NO: 611397 - DNA, 25 bp, Mus musculus
cgttgagtgccatagcattctcaag

SEQ ID NO: 611398 - DNA, 25 bp, Mus musculus
cgttgataaaaaactgctctttggc

SEQ ID NO: 611399 - DNA, 25 bp, Mus musculus
cgttgataaaaatctgctctttggc

SEQ ID NO: 611400 - DNA, 25 bp, Mus musculus
cgttgatagctgaaactaggtgcgc

SEQ ID NO: 611401 - DNA, 25 bp, Mus musculus
cgttgatagctgtaactaggtgcgc

SEQ ID NO: 611402 - DNA, 25 bp, Mus musculus
cgttgatgccctcttcaccacaaag

SEQ ID NO: 611403 - DNA, 25 bp, Mus musculus
cgttgatgccctgttcaccacaaag

SEQ ID NO: 611404 - DNA, 25 bp, Mus musculus
cgttgatgctctcccagtgcgcgct

SEQ ID NO: 611405 - DNA, 25 bp, Mus musculus
cgttgatgctctgccagtgcgcgct

SEQ ID NO: 611406 - DNA, 25 bp, Mus musculus
cgttgcaagaagacctgaagaagct

SEQ ID NO: 611407 - DNA, 25 bp, Mus musculus
cgttgcaagaagtcctgaagaagct

SEQ ID NO: 611408 - DNA, 25 bp, Mus musculus
cgttgcacccagacatccgtatatt

SEQ ID NO: 611409 - DNA, 25 bp, Mus musculus
cgttgcacccagtcatccgtatatt

SEQ ID NO: 611410 - DNA, 25 bp, Mus musculus
cgttgcagacatcgcggcgtccctg

SEQ ID NO: 611411 - DNA, 25 bp, Mus musculus
cgttgcagacatggcggcgtccctg

SEQ ID NO: 611412 - DNA, 25 bp, Mus musculus
cgttgcagggttagcagacactgct

SEQ ID NO: 611413 - DNA, 25 bp, Mus musculus
cgttgcagggtttgcagacactgct

SEQ ID NO: 611414 - DNA, 25 bp, Mus musculus
cgttgcagtcaacaattttggcgtg

SEQ ID NO: 611415 - DNA, 25 bp, Mus musculus
cgttgcagtcaagaattttggcgtg

SEQ ID NO: 611416 - DNA, 25 bp, Mus musculus
cgttgcagttttcagtcccgcctat

SEQ ID NO: 611417 - DNA, 25 bp, Mus musculus
cgttgcagttttgagtcccgcctat

SEQ ID NO: 611418 - DNA, 25 bp, Mus musculus
cgttgccctacacgctacactggat

SEQ ID NO: 611419 - DNA, 25 bp, Mus musculus
cgttgccctacaggctacactggat

SEQ ID NO: 611420 - DNA, 25 bp, Mus musculus
cgttgcctacagccctcagcagttt

SEQ ID NO: 611421 - DNA, 25 bp, Mus musculus
cgttgcctacaggcctcagcagttt

SEQ ID NO: 611422 - DNA, 25 bp, Mus musculus
cgttgcctgagacaagccttgagtg

SEQ ID NO: 611423 - DNA, 25 bp, Mus musculus
cgttgcctgagagaagccttgagtg

SEQ ID NO: 611424 - DNA, 25 bp, Mus musculus
cgttgcgacatgcagggcgcgatgg

SEQ ID NO: 611425 - DNA, 25 bp, Mus musculus
cgttgcgacatggagggcgcgatgg

SEQ ID NO: 611426 - DNA, 25 bp, Mus musculus
cgttgcgatacacagcgatgctggc

SEQ ID NO: 611427 - DNA, 25 bp, Mus musculus
cgttgcgatacagagcgatgctggc

SEQ ID NO: 611428 - DNA, 25 bp, Mus musculus
cgttgcggaggcacccgaagcagcc

SEQ ID NO: 611429 - DNA, 25 bp, Mus musculus
cgttgcggaggctcccgaagcagcc

SEQ ID NO: 611430 - DNA, 25 bp, Mus musculus
cgttgctaaagcagactccaaactc

SEQ ID NO: 611431 - DNA, 25 bp, Mus musculus
cgttgctaaagctgactccaaactc

SEQ ID NO: 611432 - DNA, 25 bp, Mus musculus
cgttgctgatgaaggtctcccagag

SEQ ID NO: 611433 - DNA, 25 bp, Mus musculus
cgttgctgatgatggtctcccagag

SEQ ID NO: 611434 - DNA, 25 bp, Mus musculus
cgttgctgggcaacttcctttgctg

SEQ ID NO: 611435 - DNA, 25 bp, Mus musculus
cgttgctgggcatcttcctttgctg

SEQ ID NO: 611436 - DNA, 25 bp, Mus musculus
cgttgcttagttaccaccaagtact

SEQ ID NO: 611437 - DNA, 25 bp, Mus musculus
cgttgcttagtttccaccaagtact

SEQ ID NO: 611438 - DNA, 25 bp, Mus musculus
cgttgcttatccaccgagatctgct

SEQ ID NO: 611439 - DNA, 25 bp, Mus musculus
cgttgcttatcctccgagatctgct

SEQ ID NO: 611440 - DNA, 25 bp, Mus musculus
cgttgcttgtgaaaccatctgacct

SEQ ID NO: 611441 - DNA, 25 bp, Mus musculus
cgttgcttgtgataccatctgacct

SEQ ID NO: 611442 - DNA, 25 bp, Mus musculus
cgttggaaaacgcacctattggaca

SEQ ID NO: 611443 - DNA, 25 bp, Mus musculus
cgttggaaaacggacctattggaca

SEQ ID NO: 611444 - DNA, 25 bp, Mus musculus
cgttggaattgtcggcaaccagccc

SEQ ID NO: 611445 - DNA, 25 bp, Mus musculus
cgttggaattgtgggcaaccagccc

SEQ ID NO: 611446 - DNA, 25 bp, Mus musculus
cgttggaggcaaaaccataggccag

SEQ ID NO: 611447 - DNA, 25 bp, Mus musculus
cgttggaggcaataccataggccag

SEQ ID NO: 611448 - DNA, 25 bp, Mus musculus
cgttggagtgctcggtgtaacttct

SEQ ID NO: 611449 - DNA, 25 bp, Mus musculus
cgttggagtgctgggtgtaacttct

SEQ ID NO: 611450 - DNA, 25 bp, Mus musculus
cgttggatccttaggtgtggacaag

SEQ ID NO: 611451 - DNA, 25 bp, Mus musculus
cgttggatcctttggtgtggacaag

SEQ ID NO: 611452 - DNA, 25 bp, Mus musculus
cgttggcattgcacatccatccact

SEQ ID NO: 611453 - DNA, 25 bp, Mus musculus
cgttggcattgctcatccatccact

SEQ ID NO: 611454 - DNA, 25 bp, Mus musculus
cgttggccaaagagcttcgagcagt

SEQ ID NO: 611455 - DNA, 25 bp, Mus musculus
cgttggccaaagtgcttcgagcagt

SEQ ID NO: 611456 - DNA, 25 bp, Mus musculus
cgttgggaaaagcaccatctccacg

SEQ ID NO: 611457 - DNA, 25 bp, Mus musculus
cgttgggaaaaggaccatctccacg

SEQ ID NO: 611458 - DNA, 25 bp, Mus musculus
cgttgggctggcctactttgcagct

SEQ ID NO: 611459 - DNA, 25 bp, Mus musculus
cgttgggctggcgtactttgcagct

SEQ ID NO: 611460 - DNA, 25 bp, Mus musculus
cgttggtagaggagaatggcatttt

SEQ ID NO: 611461 - DNA, 25 bp, Mus musculus
cgttggtagaggtgaatggcatttt

SEQ ID NO: 611462 - DNA, 25 bp, Mus musculus
cgttggtgtggccattgcagcacct

SEQ ID NO: 611463 - DNA, 25 bp, Mus musculus
cgttggtgtggcgattgcagcacct

SEQ ID NO: 611464 - DNA, 25 bp, Mus musculus
cgttgtcacaaccagcgtcggaatg

SEQ ID NO: 611465 - DNA, 25 bp, Mus musculus
cgttgtcacaacgagcgtcggaatg

SEQ ID NO: 611466 - DNA, 25 bp, Mus musculus
cgttgtcacggacccagacggtagt

SEQ ID NO: 611467 - DNA, 25 bp, Mus musculus
cgttgtcacggagccagacggtagt

SEQ ID NO: 611468 - DNA, 25 bp, Mus musculus
cgttgtcagcacacagcgttcacaa

SEQ ID NO: 611469 - DNA, 25 bp, Mus musculus
cgttgtcagcactcagcgttcacaa

SEQ ID NO: 611470 - DNA, 25 bp, Mus musculus
cgttgtcatgataatactgagctgc

SEQ ID NO: 611471 - DNA, 25 bp, Mus musculus
cgttgtcatgattatactgagctgc

SEQ ID NO: 611472 - DNA, 25 bp, Mus musculus
cgttgtctccatcaagctaaaagca

SEQ ID NO: 611473 - DNA, 25 bp, Mus musculus
cgttgtctccatgaagctaaaagca

SEQ ID NO: 611474 - DNA, 25 bp, Mus musculus
cgttgtgaaactcgatgttcaacca

SEQ ID NO: 611475 - DNA, 25 bp, Mus musculus
cgttgtgaaactggatgttcaacca

SEQ ID NO: 611476 - DNA, 25 bp, Mus musculus
cgttgtgacctcagtgagagggaaa

SEQ ID NO: 611477 - DNA, 25 bp, Mus musculus
cgttgtgacctctgtgagagggaaa

SEQ ID NO: 611478 - DNA, 25 bp, Mus musculus
cgttgtgagccaatcacctccaaga

SEQ ID NO: 611479 - DNA, 25 bp, Mus musculus
cgttgtgagccattcacctccaaga

SEQ ID NO: 611480 - DNA, 25 bp, Mus musculus
cgttgtggcgttagactatgataga

SEQ ID NO: 611481 - DNA, 25 bp, Mus musculus
cgttgtggcgtttgactatgataga

SEQ ID NO: 611482 - DNA, 25 bp, Mus musculus
cgttgtgtgcttcaccaggcatgag

SEQ ID NO: 611483 - DNA, 25 bp, Mus musculus
cgttgtgtgcttgaccaggcatgag

SEQ ID NO: 611484 - DNA, 25 bp, Mus musculus
cgttgtgttttcctcccagatgcag

SEQ ID NO: 611485 - DNA, 25 bp, Mus musculus
cgttgtgttttcgtcccagatgcag

SEQ ID NO: 611486 - DNA, 25 bp, Mus musculus
cgttgttccgagaatatctgatgag

SEQ ID NO: 611487 - DNA, 25 bp, Mus musculus
cgttgttccgagtatatctgatgag

SEQ ID NO: 611488 - DNA, 25 bp, Mus musculus
cgttgttctctacactggcagagaa

SEQ ID NO: 611489 - DNA, 25 bp, Mus musculus
cgttgttctctagactggcagagaa

SEQ ID NO: 611490 - DNA, 25 bp, Mus musculus
cgttgttcttgaagctgtggtgacc

SEQ ID NO: 611491 - DNA, 25 bp, Mus musculus
cgttgttcttgatgctgtggtgacc

SEQ ID NO: 611492 - DNA, 25 bp, Mus musculus
cgttgttgctgactggatccagcga

SEQ ID NO: 611493 - DNA, 25 bp, Mus musculus
cgttgttgctgagtggatccagcga

SEQ ID NO: 611494 - DNA, 25 bp, Mus musculus
cgtttaaacaaacatgagtatgagt

SEQ ID NO: 611495 - DNA, 25 bp, Mus musculus
cgtttaaacaaagatgagtatgagt

SEQ ID NO: 611496 - DNA, 25 bp, Mus musculus
cgtttaaaggctcaaatgaatgaca

SEQ ID NO: 611497 - DNA, 25 bp, Mus musculus
cgtttaaaggctgaaatgaatgaca

SEQ ID NO: 611498 - DNA, 25 bp, Mus musculus
cgtttaatgaagagcgattaccacc

SEQ ID NO: 611499 - DNA, 25 bp, Mus musculus
cgtttaatgaagtgcgattaccacc

SEQ ID NO: 611500 - DNA, 25 bp, Mus musculus
cgtttactacttagtcattatgaga

SEQ ID NO: 611501 - DNA, 25 bp, Mus musculus
cgtttactactttgtcattatgaga

SEQ ID NO: 611502 - DNA, 25 bp, Mus musculus
cgtttactttagagtgcccagtgta

SEQ ID NO: 611503 - DNA, 25 bp, Mus musculus
cgtttactttagtgtgcccagtgta

SEQ ID NO: 611504 - DNA, 25 bp, Mus musculus
cgtttaggcaaactaatgaggccca

SEQ ID NO: 611505 - DNA, 25 bp, Mus musculus
cgtttaggcaaagtaatgaggccca

SEQ ID NO: 611506 - DNA, 25 bp, Mus musculus
cgtttatgccaaaaaatcctcagct

SEQ ID NO: 611507 - DNA, 25 bp, Mus musculus
cgtttatgccaataaatcctcagct

SEQ ID NO: 611508 - DNA, 25 bp, Mus musculus
cgtttatggtgcaacagatcatcaa

SEQ ID NO: 611509 - DNA, 25 bp, Mus musculus
cgtttatggtgctacagatcatcaa

SEQ ID NO: 611510 - DNA, 25 bp, Mus musculus
cgtttatgtgcaccagcctgtctcc

SEQ ID NO: 611511 - DNA, 25 bp, Mus musculus
cgtttatgtgcagcagcctgtctcc

SEQ ID NO: 611512 - DNA, 25 bp, Mus musculus
cgtttatgtgttcaaaggagatgaa

SEQ ID NO: 611513 - DNA, 25 bp, Mus musculus
cgtttatgtgttgaaaggagatgaa

SEQ ID NO: 611514 - DNA, 25 bp, Mus musculus
cgtttattctcgagagaagatctct

SEQ ID NO: 611515 - DNA, 25 bp, Mus musculus
cgtttattctcgtgagaagatctct

SEQ ID NO: 611516 - DNA, 25 bp, Mus musculus
cgtttattggcaacggcttcacgga

SEQ ID NO: 611517 - DNA, 25 bp, Mus musculus
cgtttattggcatcggcttcacgga

SEQ ID NO: 611518 - DNA, 25 bp, Mus musculus
cgtttatttcatcattgccagagtg

SEQ ID NO: 611519 - DNA, 25 bp, Mus musculus
cgtttatttcatgattgccagagtg

SEQ ID NO: 611520 - DNA, 25 bp, Mus musculus
cgtttcacccaaaagggcaaggcat

SEQ ID NO: 611521 - DNA, 25 bp, Mus musculus
cgtttcacccaatagggcaaggcat

SEQ ID NO: 611522 - DNA, 25 bp, Mus musculus
cgtttcagtataaatggtggttatc

SEQ ID NO: 611523 - DNA, 25 bp, Mus musculus
cgtttcagtatatatggtggttatc

SEQ ID NO: 611524 - DNA, 25 bp, Mus musculus
cgtttcatactccattcagccaact

SEQ ID NO: 611525 - DNA, 25 bp, Mus musculus
cgtttcatactcgattcagccaact

SEQ ID NO: 611526 - DNA, 25 bp, Mus musculus
cgtttccaaagtcctgctgggacca

SEQ ID NO: 611527 - DNA, 25 bp, Mus musculus
cgtttccaaagtgctgctgggacca

SEQ ID NO: 611528 - DNA, 25 bp, Mus musculus
cgtttccaagtgatttgagcctcat

SEQ ID NO: 611529 - DNA, 25 bp, Mus musculus
cgtttccaagtgttttgagcctcat

SEQ ID NO: 611530 - DNA, 25 bp, Mus musculus
cgtttccacggtaagctcgcgacct

SEQ ID NO: 611531 - DNA, 25 bp, Mus musculus
cgtttccacggttagctcgcgacct

SEQ ID NO: 611532 - DNA, 25 bp, Mus musculus
cgtttccgaagaagatgggctcagc

SEQ ID NO: 611533 - DNA, 25 bp, Mus musculus
cgtttccgaagatgatgggctcagc

SEQ ID NO: 611534 - DNA, 25 bp, Mus musculus
cgtttccgaggcaacagtatccctg

SEQ ID NO: 611535 - DNA, 25 bp, Mus musculus
cgtttccgaggctacagtatccctg

SEQ ID NO: 611536 - DNA, 25 bp, Mus musculus
cgtttccgtaacatggacaagaggg

SEQ ID NO: 611537 - DNA, 25 bp, Mus musculus
cgtttccgtaacttggacaagaggg

SEQ ID NO: 611538 - DNA, 25 bp, Mus musculus
cgtttcctggatctgcccttatgca

SEQ ID NO: 611539 - DNA, 25 bp, Mus musculus
cgtttcctggatgtgcccttatgca

SEQ ID NO: 611540 - DNA, 25 bp, Mus musculus
cgtttcgctcaaaaaatctgactat

SEQ ID NO: 611541 - DNA, 25 bp, Mus musculus
cgtttcgctcaataaatctgactat

SEQ ID NO: 611542 - DNA, 25 bp, Mus musculus
cgtttcggggccacagcctgttgct

SEQ ID NO: 611543 - DNA, 25 bp, Mus musculus
cgtttcggggcctcagcctgttgct

SEQ ID NO: 611544 - DNA, 25 bp, Mus musculus
cgtttctacctgctgtttgagaaga

SEQ ID NO: 611545 - DNA, 25 bp, Mus musculus
cgtttctacctggtgtttgagaaga

SEQ ID NO: 611546 - DNA, 25 bp, Mus musculus
cgtttctactctcggtctgcatagt

SEQ ID NO: 611547 - DNA, 25 bp, Mus musculus
cgtttctactctgggtctgcatagt

SEQ ID NO: 611548 - DNA, 25 bp, Mus musculus
cgtttctatacgaaccagctgctag

SEQ ID NO: 611549 - DNA, 25 bp, Mus musculus
cgtttctatacgtaccagctgctag

SEQ ID NO: 611550 - DNA, 25 bp, Mus musculus
cgtttctcactcatgacgctgcgga

SEQ ID NO: 611551 - DNA, 25 bp, Mus musculus
cgtttctcactcttgacgctgcgga

SEQ ID NO: 611552 - DNA, 25 bp, Mus musculus
cgtttctccaagctaattgtggccg

SEQ ID NO: 611553 - DNA, 25 bp, Mus musculus
cgtttctccaaggtaattgtggccg

SEQ ID NO: 611554 - DNA, 25 bp, Mus musculus
cgtttctctcctaggaataggacga

SEQ ID NO: 611555 - DNA, 25 bp, Mus musculus
cgtttctctccttggaataggacga

SEQ ID NO: 611556 - DNA, 25 bp, Mus musculus
cgtttctgaccgagtcttcctgcct

SEQ ID NO: 611557 - DNA, 25 bp, Mus musculus
cgtttctgaccgtgtcttcctgcct

SEQ ID NO: 611558 - DNA, 25 bp, Mus musculus
cgtttctgagcactttccagctgcc

SEQ ID NO: 611559 - DNA, 25 bp, Mus musculus
cgtttctgagcagtttccagctgcc

SEQ ID NO: 611560 - DNA, 25 bp, Mus musculus
cgtttctgggatcaattgcaatggc

SEQ ID NO: 611561 - DNA, 25 bp, Mus musculus
cgtttctgggatgaattgcaatggc

SEQ ID NO: 611562 - DNA, 25 bp, Mus musculus
cgtttctttcctctgcgaggccggg

SEQ ID NO: 611563 - DNA, 25 bp, Mus musculus
cgtttctttcctgtgcgaggccggg

SEQ ID NO: 611564 - DNA, 25 bp, Mus musculus
cgtttctttgagacctgtgacctag

SEQ ID NO: 611565 - DNA, 25 bp, Mus musculus
cgtttctttgagtcctgtgacctag

SEQ ID NO: 611566 - DNA, 25 bp, Mus musculus
cgtttgaaaggcctgtggattccag

SEQ ID NO: 611567 - DNA, 25 bp, Mus musculus
cgtttgaaaggcgtgtggattccag

SEQ ID NO: 611568 - DNA, 25 bp, Mus musculus
cgtttgaagagacggataaatgtcc

SEQ ID NO: 611569 - DNA, 25 bp, Mus musculus
cgtttgaagagagggataaatgtcc

SEQ ID NO: 611570 - DNA, 25 bp, Mus musculus
cgtttgaagatgaagatgcgtttta

SEQ ID NO: 611571 - DNA, 25 bp, Mus musculus
cgtttgaagatgtagatgcgtttta

SEQ ID NO: 611572 - DNA, 25 bp, Mus musculus
cgtttgaatcaacccattgaaagaa

SEQ ID NO: 611573 - DNA, 25 bp, Mus musculus
cgtttgaatcaagccattgaaagaa

SEQ ID NO: 611574 - DNA, 25 bp, Mus musculus
cgtttgacgtcaacgtgcgtgtggt

SEQ ID NO: 611575 - DNA, 25 bp, Mus musculus
cgtttgacgtcatcgtgcgtgtggt

SEQ ID NO: 611576 - DNA, 25 bp, Mus musculus
cgtttgagtacaacagttacgacaa

SEQ ID NO: 611577 - DNA, 25 bp, Mus musculus
cgtttgagtacatcagttacgacaa

SEQ ID NO: 611578 - DNA, 25 bp, Mus musculus
cgtttgcaagagctggtaccgcctc

SEQ ID NO: 611579 - DNA, 25 bp, Mus musculus
cgtttgcaagaggtggtaccgcctc

SEQ ID NO: 611580 - DNA, 25 bp, Mus musculus
cgtttgcagcgacagatgtgcagca

SEQ ID NO: 611581 - DNA, 25 bp, Mus musculus
cgtttgcagcgagagatgtgcagca

SEQ ID NO: 611582 - DNA, 25 bp, Mus musculus
cgtttgcctagaagtgtctgaccca

SEQ ID NO: 611583 - DNA, 25 bp, Mus musculus
cgtttgcctagatgtgtctgaccca

SEQ ID NO: 611584 - DNA, 25 bp, Mus musculus
cgtttgccttccaggcgagccagga

SEQ ID NO: 611585 - DNA, 25 bp, Mus musculus
cgtttgccttcctggcgagccagga

SEQ ID NO: 611586 - DNA, 25 bp, Mus musculus
cgtttgcggtggatccccaggcgcc

SEQ ID NO: 611587 - DNA, 25 bp, Mus musculus
cgtttgcggtggttccccaggcgcc

SEQ ID NO: 611588 - DNA, 25 bp, Mus musculus
cgtttgctctggagcgacgaagcca

SEQ ID NO: 611589 - DNA, 25 bp, Mus musculus
cgtttgctctggtgcgacgaagcca

SEQ ID NO: 611590 - DNA, 25 bp, Mus musculus
cgtttgctgccaattgatggagcaa

SEQ ID NO: 611591 - DNA, 25 bp, Mus musculus
cgtttgctgccatttgatggagcaa

SEQ ID NO: 611592 - DNA, 25 bp, Mus musculus
cgtttgctggaaactgctggcatca

SEQ ID NO: 611593 - DNA, 25 bp, Mus musculus
cgtttgctggaatctgctggcatca

SEQ ID NO: 611594 - DNA, 25 bp, Mus musculus
cgtttggacaataagtcatttggaa

SEQ ID NO: 611595 - DNA, 25 bp, Mus musculus
cgtttggacaattagtcatttggaa

SEQ ID NO: 611596 - DNA, 25 bp, Mus musculus
cgtttggagcagctatcagtgcaga

SEQ ID NO: 611597 - DNA, 25 bp, Mus musculus
cgtttggagcaggtatcagtgcaga

SEQ ID NO: 611598 - DNA, 25 bp, Mus musculus
cgtttgggacagagttcacggacca

SEQ ID NO: 611599 - DNA, 25 bp, Mus musculus
cgtttgggacagtgttcacggacca

SEQ ID NO: 611600 - DNA, 25 bp, Mus musculus
cgtttggtcactataaagccgcata

SEQ ID NO: 611601 - DNA, 25 bp, Mus musculus
cgtttggtcactttaaagccgcata

SEQ ID NO: 611602 - DNA, 25 bp, Mus musculus
cgtttggtgagacccatggcactca

SEQ ID NO: 611603 - DNA, 25 bp, Mus musculus
cgtttggtgagagccatggcactca

SEQ ID NO: 611604 - DNA, 25 bp, Mus musculus
cgtttgtaacagataccttgtggtt

SEQ ID NO: 611605 - DNA, 25 bp, Mus musculus
cgtttgtaacagttaccttgtggtt

SEQ ID NO: 611606 - DNA, 25 bp, Mus musculus
cgtttgtagctaaaccagttggcaa

SEQ ID NO: 611607 - DNA, 25 bp, Mus musculus
cgtttgtagctataccagttggcaa

SEQ ID NO: 611608 - DNA, 25 bp, Mus musculus
cgtttgtcaggtatcgttcaagcta

SEQ ID NO: 611609 - DNA, 25 bp, Mus musculus
cgtttgtcaggtttcgttcaagcta

SEQ ID NO: 611610 - DNA, 25 bp, Mus musculus
cgtttgtgttcaatgggatggatga

SEQ ID NO: 611611 - DNA, 25 bp, Mus musculus
cgtttgtgttcattgggatggatga

SEQ ID NO: 611612 - DNA, 25 bp, Mus musculus
cgtttgttcgagacatgcctactga

SEQ ID NO: 611613 - DNA, 25 bp, Mus musculus
cgtttgttcgagtcatgcctactga

SEQ ID NO: 611614 - DNA, 25 bp, Mus musculus
cgttttcagcaaaagggtcttcaca

SEQ ID NO: 611615 - DNA, 25 bp, Mus musculus
cgttttcagcaatagggtcttcaca

SEQ ID NO: 611616 - DNA, 25 bp, Mus musculus
cgttttccaaatcgtctgcatcagg

SEQ ID NO: 611617 - DNA, 25 bp, Mus musculus
cgttttccaaatggtctgcatcagg

SEQ ID NO: 611618 - DNA, 25 bp, Mus musculus
cgttttccagaacggcctgggctgc

SEQ ID NO: 611619 - DNA, 25 bp, Mus musculus
cgttttccagaagggcctgggctgc

SEQ ID NO: 611620 - DNA, 25 bp, Mus musculus
cgttttctgcgtatggtaacatcct

SEQ ID NO: 611621 - DNA, 25 bp, Mus musculus
cgttttctgcgtttggtaacatcct

SEQ ID NO: 611622 - DNA, 25 bp, Mus musculus
cgttttgaggtacctaggatgctct

SEQ ID NO: 611623 - DNA, 25 bp, Mus musculus
cgttttgaggtagctaggatgctct

SEQ ID NO: 611624 - DNA, 25 bp, Mus musculus
cgttttgcctctagggctctggaga

SEQ ID NO: 611625 - DNA, 25 bp, Mus musculus
cgttttgcctcttgggctctggaga

SEQ ID NO: 611626 - DNA, 25 bp, Mus musculus
cgttttggacagagaatcgccaaat

SEQ ID NO: 611627 - DNA, 25 bp, Mus musculus
cgttttggacagtgaatcgccaaat

SEQ ID NO: 611628 - DNA, 25 bp, Mus musculus
cgttttgtccagcatcactttgacc

SEQ ID NO: 611629 - DNA, 25 bp, Mus musculus
cgttttgtccaggatcactttgacc

SEQ ID NO: 611630 - DNA, 25 bp, Mus musculus
cgtttttatacaatcccgcgcggag

SEQ ID NO: 611631 - DNA, 25 bp, Mus musculus
cgtttttatacattcccgcgcggag

SEQ ID NO: 611632 - DNA, 25 bp, Mus musculus
cgtttttctttgactgatggcactc

SEQ ID NO: 611633 - DNA, 25 bp, Mus musculus
cgtttttctttgtctgatggcactc

SEQ ID NO: 611634 - DNA, 25 bp, Mus musculus
cgtttttgagacagtattccccagc

SEQ ID NO: 611635 - DNA, 25 bp, Mus musculus
cgtttttgagactgtattccccagc

SEQ ID NO: 611636 - DNA, 25 bp, Mus musculus
cgttttttctatcagcggctggtgg

SEQ ID NO: 611637 - DNA, 25 bp, Mus musculus
cgttttttctatgagcggctggtgg

SEQ ID NO: 611638 - DNA, 25 bp, Mus musculus
ctaaaaaacttgattaatgacgctg

SEQ ID NO: 611639 - DNA, 25 bp, Mus musculus
ctaaaaaacttgtttaatgacgctg

SEQ ID NO: 611640 - DNA, 25 bp, Mus musculus
ctaaaaaagcacagaagacccaggg

SEQ ID NO: 611641 - DNA, 25 bp, Mus musculus
ctaaaaaagcactgaagacccaggg

SEQ ID NO: 611642 - DNA, 25 bp, Mus musculus
ctaaaaagagccctccttgtgcttg

SEQ ID NO: 611643 - DNA, 25 bp, Mus musculus
ctaaaaagagccgtccttgtgcttg

SEQ ID NO: 611644 - DNA, 25 bp, Mus musculus
ctaaaaatgatcatgctgttgtgga

SEQ ID NO: 611645 - DNA, 25 bp, Mus musculus
ctaaaaatgatcttgctgttgtgga

SEQ ID NO: 611646 - DNA, 25 bp, Mus musculus
ctaaaacattgacccctggtgatag

SEQ ID NO: 611647 - DNA, 25 bp, Mus musculus
ctaaaacattgagccctggtgatag

SEQ ID NO: 611648 - DNA, 25 bp, Mus musculus
ctaaaaccatagaggcacccaaggg

SEQ ID NO: 611649 - DNA, 25 bp, Mus musculus
ctaaaaccatagtggcacccaaggg

SEQ ID NO: 611650 - DNA, 25 bp, Mus musculus
ctaaaactgcagctgggtatgtcca

SEQ ID NO: 611651 - DNA, 25 bp, Mus musculus
ctaaaactgcaggtgggtatgtcca

SEQ ID NO: 611652 - DNA, 25 bp, Mus musculus
ctaaaatagcttagatgggacattc

SEQ ID NO: 611653 - DNA, 25 bp, Mus musculus
ctaaaatagctttgatgggacattc

SEQ ID NO: 611654 - DNA, 25 bp, Mus musculus
ctaaaatagggcacagtggctggaa

SEQ ID NO: 611655 - DNA, 25 bp, Mus musculus
ctaaaatagggctcagtggctggaa

SEQ ID NO: 611656 - DNA, 25 bp, Mus musculus
ctaaaatcttccaggacaagttcga

SEQ ID NO: 611657 - DNA, 25 bp, Mus musculus
ctaaaatcttcctggacaagttcga

SEQ ID NO: 611658 - DNA, 25 bp, Mus musculus
ctaaacaaaatgaaccagaggtgca

SEQ ID NO: 611659 - DNA, 25 bp, Mus musculus
ctaaacaaaatgtaccagaggtgca

SEQ ID NO: 611660 - DNA, 25 bp, Mus musculus
ctaaacactgggatccgagacgcac

SEQ ID NO: 611661 - DNA, 25 bp, Mus musculus
ctaaacactgggttccgagacgcac

SEQ ID NO: 611662 - DNA, 25 bp, Mus musculus
ctaaacagtcagaggtgggtgcccg

SEQ ID NO: 611663 - DNA, 25 bp, Mus musculus
ctaaacagtcagtggtgggtgcccg

SEQ ID NO: 611664 - DNA, 25 bp, Mus musculus
ctaaactcctgcagcagaagctgag

SEQ ID NO: 611665 - DNA, 25 bp, Mus musculus
ctaaactcctgctgcagaagctgag

SEQ ID NO: 611666 - DNA, 25 bp, Mus musculus
ctaaactgaatcctagccaaaaggc

SEQ ID NO: 611667 - DNA, 25 bp, Mus musculus
ctaaactgaatcgtagccaaaaggc

SEQ ID NO: 611668 - DNA, 25 bp, Mus musculus
ctaaactgtagtagtctgccctgtg

SEQ ID NO: 611669 - DNA, 25 bp, Mus musculus
ctaaactgtagttgtctgccctgtg

SEQ ID NO: 611670 - DNA, 25 bp, Mus musculus
ctaaactgtgtaacatattcagcac

SEQ ID NO: 611671 - DNA, 25 bp, Mus musculus
ctaaactgtgtatcatattcagcac

SEQ ID NO: 611672 - DNA, 25 bp, Mus musculus
ctaaagaccaagaagtgggtggatg

SEQ ID NO: 611673 - DNA, 25 bp, Mus musculus
ctaaagaccaagtagtgggtggatg

SEQ ID NO: 611674 - DNA, 25 bp, Mus musculus
ctaaagcagatccagcacactctga

SEQ ID NO: 611675 - DNA, 25 bp, Mus musculus
ctaaagcagatcgagcacactctga

SEQ ID NO: 611676 - DNA, 25 bp, Mus musculus
ctaaagccagagaacatcctatgtg

SEQ ID NO: 611677 - DNA, 25 bp, Mus musculus
ctaaagccagagtacatcctatgtg

SEQ ID NO: 611678 - DNA, 25 bp, Mus musculus
ctaaaggcgcttccggccaacctga

SEQ ID NO: 611679 - DNA, 25 bp, Mus musculus
ctaaaggcgcttgcggccaacctga

SEQ ID NO: 611680 - DNA, 25 bp, Mus musculus
ctaaaggtgtggctgattgatgaca

SEQ ID NO: 611681 - DNA, 25 bp, Mus musculus
ctaaaggtgtgggtgattgatgaca

SEQ ID NO: 611682 - DNA, 25 bp, Mus musculus
ctaaagtacgctacccagccactag

SEQ ID NO: 611683 - DNA, 25 bp, Mus musculus
ctaaagtacgcttcccagccactag

SEQ ID NO: 611684 - DNA, 25 bp, Mus musculus
ctaaagtggtaaagcagccttgtcc

SEQ ID NO: 611685 - DNA, 25 bp, Mus musculus
ctaaagtggtaatgcagccttgtcc

SEQ ID NO: 611686 - DNA, 25 bp, Mus musculus
ctaaagttaatgctgtggatgatgc

SEQ ID NO: 611687 - DNA, 25 bp, Mus musculus
ctaaagttaatggtgtggatgatgc

SEQ ID NO: 611688 - DNA, 25 bp, Mus musculus
ctaaataaatgacctgttgccactt

SEQ ID NO: 611689 - DNA, 25 bp, Mus musculus
ctaaataaatgagctgttgccactt

SEQ ID NO: 611690 - DNA, 25 bp, Mus musculus
ctaaatacatctcccagtataaggg

SEQ ID NO: 611691 - DNA, 25 bp, Mus musculus
ctaaatacatctgccagtataaggg

SEQ ID NO: 611692 - DNA, 25 bp, Mus musculus
ctaaatacggagactacactgtgag

SEQ ID NO: 611693 - DNA, 25 bp, Mus musculus
ctaaatacggagtctacactgtgag

SEQ ID NO: 611694 - DNA, 25 bp, Mus musculus
ctaaatcggcccctgcgtatgtgga

SEQ ID NO: 611695 - DNA, 25 bp, Mus musculus
ctaaatcggcccgtgcgtatgtgga

SEQ ID NO: 611696 - DNA, 25 bp, Mus musculus
ctaaatcgtagaaagtaccaggcac

SEQ ID NO: 611697 - DNA, 25 bp, Mus musculus
ctaaatcgtagatagtaccaggcac

SEQ ID NO: 611698 - DNA, 25 bp, Mus musculus
ctaaatctgtcccttctattccttg

SEQ ID NO: 611699 - DNA, 25 bp, Mus musculus
ctaaatctgtccgttctattccttg

SEQ ID NO: 611700 - DNA, 25 bp, Mus musculus
ctaaatgcactcatcgctagcccgg

SEQ ID NO: 611701 - DNA, 25 bp, Mus musculus
ctaaatgcactcttcgctagcccgg

SEQ ID NO: 611702 - DNA, 25 bp, Mus musculus
ctaaatggacttcctgtcaaacttc

SEQ ID NO: 611703 - DNA, 25 bp, Mus musculus
ctaaatggacttgctgtcaaacttc

SEQ ID NO: 611704 - DNA, 25 bp, Mus musculus
ctaaatggtatcaacacacctcaca

SEQ ID NO: 611705 - DNA, 25 bp, Mus musculus
ctaaatggtatctacacacctcaca

SEQ ID NO: 611706 - DNA, 25 bp, Mus musculus
ctaaatgtcctgctgacaatatctg

SEQ ID NO: 611707 - DNA, 25 bp, Mus musculus
ctaaatgtcctggtgacaatatctg

SEQ ID NO: 611708 - DNA, 25 bp, Mus musculus
ctaaattcatggcttccccagaaat

SEQ ID NO: 611709 - DNA, 25 bp, Mus musculus
ctaaattcatgggttccccagaaat

SEQ ID NO: 611710 - DNA, 25 bp, Mus musculus
ctaaattgacaaagggccagccaca

SEQ ID NO: 611711 - DNA, 25 bp, Mus musculus
ctaaattgacaatgggccagccaca

SEQ ID NO: 611712 - DNA, 25 bp, Mus musculus
ctaaattggaaaaaactgagaatct

SEQ ID NO: 611713 - DNA, 25 bp, Mus musculus
ctaaattggaaataactgagaatct

SEQ ID NO: 611714 - DNA, 25 bp, Mus musculus
ctaaatttttgcactgttcaggaca

SEQ ID NO: 611715 - DNA, 25 bp, Mus musculus
ctaaatttttgctctgttcaggaca

SEQ ID NO: 611716 - DNA, 25 bp, Mus musculus
ctaacaaaggccaagtagattcggc

SEQ ID NO: 611717 - DNA, 25 bp, Mus musculus
ctaacaaaggcctagtagattcggc

SEQ ID NO: 611718 - DNA, 25 bp, Mus musculus
ctaacaaagggaatcggactgcgcg

SEQ ID NO: 611719 - DNA, 25 bp, Mus musculus
ctaacaaagggattcggactgcgcg

SEQ ID NO: 611720 - DNA, 25 bp, Mus musculus
ctaacaaggtttagcagtcattgca

SEQ ID NO: 611721 - DNA, 25 bp, Mus musculus
ctaacaaggttttgcagtcattgca

SEQ ID NO: 611722 - DNA, 25 bp, Mus musculus
ctaacaccagcacccgttgtgtggg

SEQ ID NO: 611723 - DNA, 25 bp, Mus musculus
ctaacaccagcagccgttgtgtggg

SEQ ID NO: 611724 - DNA, 25 bp, Mus musculus
ctaacagaacggaacacaaacctgg

SEQ ID NO: 611725 - DNA, 25 bp, Mus musculus
ctaacagaacggtacacaaacctgg

SEQ ID NO: 611726 - DNA, 25 bp, Mus musculus
ctaacagacgagaagtcttgccaag

SEQ ID NO: 611727 - DNA, 25 bp, Mus musculus
ctaacagacgagtagtcttgccaag

SEQ ID NO: 611728 - DNA, 25 bp, Mus musculus
ctaacagccaggcagcggatcagtc

SEQ ID NO: 611729 - DNA, 25 bp, Mus musculus
ctaacagccagggagcggatcagtc

SEQ ID NO: 611730 - DNA, 25 bp, Mus musculus
ctaacagcccttcgcacggatgtgc

SEQ ID NO: 611731 - DNA, 25 bp, Mus musculus
ctaacagcccttggcacggatgtgc

SEQ ID NO: 611732 - DNA, 25 bp, Mus musculus
ctaacatacatgctggccatgcctt

SEQ ID NO: 611733 - DNA, 25 bp, Mus musculus
ctaacatacatggtggccatgcctt

SEQ ID NO: 611734 - DNA, 25 bp, Mus musculus
ctaacatggaggacgtatacgcggt

SEQ ID NO: 611735 - DNA, 25 bp, Mus musculus
ctaacatggaggtcgtatacgcggt

SEQ ID NO: 611736 - DNA, 25 bp, Mus musculus
ctaaccagagctatgagggcagcag

SEQ ID NO: 611737 - DNA, 25 bp, Mus musculus
ctaaccagagctttgagggcagcag

SEQ ID NO: 611738 - DNA, 25 bp, Mus musculus
ctaaccatgtggcatgctgttctca

SEQ ID NO: 611739 - DNA, 25 bp, Mus musculus
ctaaccatgtgggatgctgttctca

SEQ ID NO: 611740 - DNA, 25 bp, Mus musculus
ctaaccctttcaaggagcgaatctg

SEQ ID NO: 611741 - DNA, 25 bp, Mus musculus
ctaaccctttcatggagcgaatctg

SEQ ID NO: 611742 - DNA, 25 bp, Mus musculus
ctaaccttgcaactgggagagccaa

SEQ ID NO: 611743 - DNA, 25 bp, Mus musculus
ctaaccttgcaagtgggagagccaa

SEQ ID NO: 611744 - DNA, 25 bp, Mus musculus
ctaacggactaccaagtgactgtgg

SEQ ID NO: 611745 - DNA, 25 bp, Mus musculus
ctaacggactacgaagtgactgtgg

SEQ ID NO: 611746 - DNA, 25 bp, Mus musculus
ctaacggagagaccccatcgtggcg

SEQ ID NO: 611747 - DNA, 25 bp, Mus musculus
ctaacggagagagcccatcgtggcg

SEQ ID NO: 611748 - DNA, 25 bp, Mus musculus
ctaacgtcctgacccaggagagtaa

SEQ ID NO: 611749 - DNA, 25 bp, Mus musculus
ctaacgtcctgagccaggagagtaa

SEQ ID NO: 611750 - DNA, 25 bp, Mus musculus
ctaacgtgatgaagggatggcagta

SEQ ID NO: 611751 - DNA, 25 bp, Mus musculus
ctaacgtgatgatgggatggcagta

SEQ ID NO: 611752 - DNA, 25 bp, Mus musculus
ctaactaaggatccctgtccccaga

SEQ ID NO: 611753 - DNA, 25 bp, Mus musculus
ctaactaaggatgcctgtccccaga

SEQ ID NO: 611754 - DNA, 25 bp, Mus musculus
ctaactatgtgacgcttaaagattc

SEQ ID NO: 611755 - DNA, 25 bp, Mus musculus
ctaactatgtgaggcttaaagattc

SEQ ID NO: 611756 - DNA, 25 bp, Mus musculus
ctaactccaaggagatgcaagaaga

SEQ ID NO: 611757 - DNA, 25 bp, Mus musculus
ctaactccaaggtgatgcaagaaga

SEQ ID NO: 611758 - DNA, 25 bp, Mus musculus
ctaactccccacatctggaatcgtt

SEQ ID NO: 611759 - DNA, 25 bp, Mus musculus
ctaactccccacttctggaatcgtt

SEQ ID NO: 611760 - DNA, 25 bp, Mus musculus
ctaactgacacgagcaaataaacaa

SEQ ID NO: 611761 - DNA, 25 bp, Mus musculus
ctaactgacacgtgcaaataaacaa

SEQ ID NO: 611762 - DNA, 25 bp, Mus musculus
ctaactggaccaccgagaagtaggg

SEQ ID NO: 611763 - DNA, 25 bp, Mus musculus
ctaactggaccagcgagaagtaggg

SEQ ID NO: 611764 - DNA, 25 bp, Mus musculus
ctaactgggttgaccgccatcaggg

SEQ ID NO: 611765 - DNA, 25 bp, Mus musculus
ctaactgggttgtccgccatcaggg

SEQ ID NO: 611766 - DNA, 25 bp, Mus musculus
ctaacttataggaatgggtgggatc

SEQ ID NO: 611767 - DNA, 25 bp, Mus musculus
ctaacttataggtatgggtgggatc

SEQ ID NO: 611768 - DNA, 25 bp, Mus musculus
ctaactttctaaagaagcatgagaa

SEQ ID NO: 611769 - DNA, 25 bp, Mus musculus
ctaactttctaatgaagcatgagaa

SEQ ID NO: 611770 - DNA, 25 bp, Mus musculus
ctaagaaaagacacaggcactgtgc

SEQ ID NO: 611771 - DNA, 25 bp, Mus musculus
ctaagaaaagactcaggcactgtgc

SEQ ID NO: 611772 - DNA, 25 bp, Mus musculus
ctaagaaatcacagccccgtgggag

SEQ ID NO: 611773 - DNA, 25 bp, Mus musculus
ctaagaaatcactgccccgtgggag

SEQ ID NO: 611774 - DNA, 25 bp, Mus musculus
ctaagaacctggatctctgtgtctg

SEQ ID NO: 611775 - DNA, 25 bp, Mus musculus
ctaagaacctggttctctgtgtctg

SEQ ID NO: 611776 - DNA, 25 bp, Mus musculus
ctaagaacggtaagaatgccaagaa

SEQ ID NO: 611777 - DNA, 25 bp, Mus musculus
ctaagaacggtatgaatgccaagaa

SEQ ID NO: 611778 - DNA, 25 bp, Mus musculus
ctaagaatgaaacaaccgtgtctgt

SEQ ID NO: 611779 - DNA, 25 bp, Mus musculus
ctaagaatgaaagaaccgtgtctgt

SEQ ID NO: 611780 - DNA, 25 bp, Mus musculus
ctaagaatgaagaaaactacgcgac

SEQ ID NO: 611781 - DNA, 25 bp, Mus musculus
ctaagaatgaagtaaactacgcgac

SEQ ID NO: 611782 - DNA, 25 bp, Mus musculus
ctaagaatggatatacagcggacgt

SEQ ID NO: 611783 - DNA, 25 bp, Mus musculus
ctaagaatggatttacagcggacgt

SEQ ID NO: 611784 - DNA, 25 bp, Mus musculus
ctaagaatgggcatcccagccacca

SEQ ID NO: 611785 - DNA, 25 bp, Mus musculus
ctaagaatgggcttcccagccacca

SEQ ID NO: 611786 - DNA, 25 bp, Mus musculus
ctaagacaacccagcttgagcaggg

SEQ ID NO: 611787 - DNA, 25 bp, Mus musculus
ctaagacaaccctgcttgagcaggg

SEQ ID NO: 611788 - DNA, 25 bp, Mus musculus
ctaagaccacgacagaaaaagctgg

SEQ ID NO: 611789 - DNA, 25 bp, Mus musculus
ctaagaccacgagagaaaaagctgg

SEQ ID NO: 611790 - DNA, 25 bp, Mus musculus
ctaagactggacaagcgcgcacaga

SEQ ID NO: 611791 - DNA, 25 bp, Mus musculus
ctaagactggactagcgcgcacaga

SEQ ID NO: 611792 - DNA, 25 bp, Mus musculus
ctaagagaattgctgaagcataaac

SEQ ID NO: 611793 - DNA, 25 bp, Mus musculus
ctaagagaattggtgaagcataaac

SEQ ID NO: 611794 - DNA, 25 bp, Mus musculus
ctaagagtaaggcatttttctggtg

SEQ ID NO: 611795 - DNA, 25 bp, Mus musculus
ctaagagtaagggatttttctggtg

SEQ ID NO: 611796 - DNA, 25 bp, Mus musculus
ctaagagtcgcgctgtaagaagcaa

SEQ ID NO: 611797 - DNA, 25 bp, Mus musculus
ctaagagtcgcggtgtaagaagcaa

SEQ ID NO: 611798 - DNA, 25 bp, Mus musculus
ctaagatcgtggagctgaaggccga

SEQ ID NO: 611799 - DNA, 25 bp, Mus musculus
ctaagatcgtggtgctgaaggccga

SEQ ID NO: 611800 - DNA, 25 bp, Mus musculus
ctaagatggctgacgtctcagcaga

SEQ ID NO: 611801 - DNA, 25 bp, Mus musculus
ctaagatggctgtcgtctcagcaga

SEQ ID NO: 611802 - DNA, 25 bp, Mus musculus
ctaagatgttagaaattgttcacct

SEQ ID NO: 611803 - DNA, 25 bp, Mus musculus
ctaagatgttagtaattgttcacct

SEQ ID NO: 611804 - DNA, 25 bp, Mus musculus
ctaagcagtacccagcactggatgt

SEQ ID NO: 611805 - DNA, 25 bp, Mus musculus
ctaagcagtaccgagcactggatgt

SEQ ID NO: 611806 - DNA, 25 bp, Mus musculus
ctaagcagtgaccaggacctggaaa

SEQ ID NO: 611807 - DNA, 25 bp, Mus musculus
ctaagcagtgacgaggacctggaaa

SEQ ID NO: 611808 - DNA, 25 bp, Mus musculus
ctaagcatcgaacgctgccagccag

SEQ ID NO: 611809 - DNA, 25 bp, Mus musculus
ctaagcatcgaaggctgccagccag

SEQ ID NO: 611810 - DNA, 25 bp, Mus musculus
ctaagcatcgtcattcagctacttc

SEQ ID NO: 611811 - DNA, 25 bp, Mus musculus
ctaagcatcgtctttcagctacttc

SEQ ID NO: 611812 - DNA, 25 bp, Mus musculus
ctaagcatggcactgcacatgattc

SEQ ID NO: 611813 - DNA, 25 bp, Mus musculus
ctaagcatggcagtgcacatgattc

SEQ ID NO: 611814 - DNA, 25 bp, Mus musculus
ctaagccgggcaagttgcctttggt

SEQ ID NO: 611815 - DNA, 25 bp, Mus musculus
ctaagccgggcatgttgcctttggt

SEQ ID NO: 611816 - DNA, 25 bp, Mus musculus
ctaagctctctaccatagggaagat

SEQ ID NO: 611817 - DNA, 25 bp, Mus musculus
ctaagctctctagcatagggaagat

SEQ ID NO: 611818 - DNA, 25 bp, Mus musculus
ctaagctggaccaagccttggtggc

SEQ ID NO: 611819 - DNA, 25 bp, Mus musculus
ctaagctggacctagccttggtggc

SEQ ID NO: 611820 - DNA, 25 bp, Mus musculus
ctaagctggcccaggactttctgga

SEQ ID NO: 611821 - DNA, 25 bp, Mus musculus
ctaagctggccctggactttctgga

SEQ ID NO: 611822 - DNA, 25 bp, Mus musculus
ctaagcttgcttagcagggcagaca

SEQ ID NO: 611823 - DNA, 25 bp, Mus musculus
ctaagcttgctttgcagggcagaca

SEQ ID NO: 611824 - DNA, 25 bp, Mus musculus
ctaaggaaacagaacacggacttct

SEQ ID NO: 611825 - DNA, 25 bp, Mus musculus
ctaaggaaacagtacacggacttct

SEQ ID NO: 611826 - DNA, 25 bp, Mus musculus
ctaaggactctcacctgcatgggaa

SEQ ID NO: 611827 - DNA, 25 bp, Mus musculus
ctaaggactctctcctgcatgggaa

SEQ ID NO: 611828 - DNA, 25 bp, Mus musculus
ctaaggatgcctcctacccgtgctt

SEQ ID NO: 611829 - DNA, 25 bp, Mus musculus
ctaaggatgcctgctacccgtgctt

SEQ ID NO: 611830 - DNA, 25 bp, Mus musculus
ctaaggatgtcaagcagaatgcccc

SEQ ID NO: 611831 - DNA, 25 bp, Mus musculus
ctaaggatgtcatgcagaatgcccc

SEQ ID NO: 611832 - DNA, 25 bp, Mus musculus
ctaaggcacactctggacgcatgcg

SEQ ID NO: 611833 - DNA, 25 bp, Mus musculus
ctaaggcacactgtggacgcatgcg

SEQ ID NO: 611834 - DNA, 25 bp, Mus musculus
ctaaggcctagccagtacagagtgc

SEQ ID NO: 611835 - DNA, 25 bp, Mus musculus
ctaaggcctagcgagtacagagtgc

SEQ ID NO: 611836 - DNA, 25 bp, Mus musculus
ctaaggctttgtcttgagttaatgt

SEQ ID NO: 611837 - DNA, 25 bp, Mus musculus
ctaaggctttgtgttgagttaatgt

SEQ ID NO: 611838 - DNA, 25 bp, Mus musculus
ctaagggcagcaaggaacatttcac

SEQ ID NO: 611839 - DNA, 25 bp, Mus musculus
ctaagggcagcatggaacatttcac

SEQ ID NO: 611840 - DNA, 25 bp, Mus musculus
ctaaggtgccatagctggaggaaca

SEQ ID NO: 611841 - DNA, 25 bp, Mus musculus
ctaaggtgccattgctggaggaaca

SEQ ID NO: 611842 - DNA, 25 bp, Mus musculus
ctaaggtgccggctaccaacgccag

SEQ ID NO: 611843 - DNA, 25 bp, Mus musculus
ctaaggtgccgggtaccaacgccag

SEQ ID NO: 611844 - DNA, 25 bp, Mus musculus
ctaaggtgggaaccttgctgcaagt

SEQ ID NO: 611845 - DNA, 25 bp, Mus musculus
ctaaggtgggaagcttgctgcaagt

SEQ ID NO: 611846 - DNA, 25 bp, Mus musculus
ctaagtcaaaggctgaaaggttgct

SEQ ID NO: 611847 - DNA, 25 bp, Mus musculus
ctaagtcaaagggtgaaaggttgct

SEQ ID NO: 611848 - DNA, 25 bp, Mus musculus
ctaagtcttaagactctttcctaga

SEQ ID NO: 611849 - DNA, 25 bp, Mus musculus
ctaagtcttaagtctctttcctaga

SEQ ID NO: 611850 - DNA, 25 bp, Mus musculus
ctaagtggaaaacagtgactatggt

SEQ ID NO: 611851 - DNA, 25 bp, Mus musculus
ctaagtggaaaagagtgactatggt

SEQ ID NO: 611852 - DNA, 25 bp, Mus musculus
ctaagtggacgcaagccccaaaaga

SEQ ID NO: 611853 - DNA, 25 bp, Mus musculus
ctaagtggacgctagccccaaaaga

SEQ ID NO: 611854 - DNA, 25 bp, Mus musculus
ctaagtgggaagctgtcagaacaag

SEQ ID NO: 611855 - DNA, 25 bp, Mus musculus
ctaagtgggaaggtgtcagaacaag

SEQ ID NO: 611856 - DNA, 25 bp, Mus musculus
ctaagtgggtcaccacttgcgtgga

SEQ ID NO: 611857 - DNA, 25 bp, Mus musculus
ctaagtgggtcagcacttgcgtgga

SEQ ID NO: 611858 - DNA, 25 bp, Mus musculus
ctaagtgtcaagctgatgagagact

SEQ ID NO: 611859 - DNA, 25 bp, Mus musculus
ctaagtgtcaaggtgatgagagact

SEQ ID NO: 611860 - DNA, 25 bp, Mus musculus
ctaagtgtcctgacagaagaccggc

SEQ ID NO: 611861 - DNA, 25 bp, Mus musculus
ctaagtgtcctgtcagaagaccggc

SEQ ID NO: 611862 - DNA, 25 bp, Mus musculus
ctaagttgtccgctagagggcagcc

SEQ ID NO: 611863 - DNA, 25 bp, Mus musculus
ctaagttgtccggtagagggcagcc

SEQ ID NO: 611864 - DNA, 25 bp, Mus musculus
ctaataattttcaagacccagattc

SEQ ID NO: 611865 - DNA, 25 bp, Mus musculus
ctaataattttctagacccagattc

SEQ ID NO: 611866 - DNA, 25 bp, Mus musculus
ctaatactttggataatcagactcg

SEQ ID NO: 611867 - DNA, 25 bp, Mus musculus
ctaatactttggttaatcagactcg

SEQ ID NO: 611868 - DNA, 25 bp, Mus musculus
ctaatagagaaaaactcccagctgg

SEQ ID NO: 611869 - DNA, 25 bp, Mus musculus
ctaatagagaaatactcccagctgg

SEQ ID NO: 611870 - DNA, 25 bp, Mus musculus
ctaatatcaacaccaatggcagcat

SEQ ID NO: 611871 - DNA, 25 bp, Mus musculus
ctaatatcaacagcaatggcagcat

SEQ ID NO: 611872 - DNA, 25 bp, Mus musculus
ctaatccagtgcctgtttgggccac

SEQ ID NO: 611873 - DNA, 25 bp, Mus musculus
ctaatccagtgcgtgtttgggccac

SEQ ID NO: 611874 - DNA, 25 bp, Mus musculus
ctaatcgttggaacctttggtgtgg

SEQ ID NO: 611875 - DNA, 25 bp, Mus musculus
ctaatcgttggatcctttggtgtgg

SEQ ID NO: 611876 - DNA, 25 bp, Mus musculus
ctaatctacatacgatgggtgcaca

SEQ ID NO: 611877 - DNA, 25 bp, Mus musculus
ctaatctacataggatgggtgcaca

SEQ ID NO: 611878 - DNA, 25 bp, Mus musculus
ctaatgaaattgaaagcctgggatc

SEQ ID NO: 611879 - DNA, 25 bp, Mus musculus
ctaatgaaattgtaagcctgggatc

SEQ ID NO: 611880 - DNA, 25 bp, Mus musculus
ctaatgaagactctaagccacggca

SEQ ID NO: 611881 - DNA, 25 bp, Mus musculus
ctaatgaagactgtaagccacggca

SEQ ID NO: 611882 - DNA, 25 bp, Mus musculus
ctaatgagcaagcagggcttccggc

SEQ ID NO: 611883 - DNA, 25 bp, Mus musculus
ctaatgagcaaggagggcttccggc

SEQ ID NO: 611884 - DNA, 25 bp, Mus musculus
ctaatgagctatcaagttccggaat

SEQ ID NO: 611885 - DNA, 25 bp, Mus musculus
ctaatgagctatgaagttccggaat

SEQ ID NO: 611886 - DNA, 25 bp, Mus musculus
ctaatgatcctgactgtaacccaga

SEQ ID NO: 611887 - DNA, 25 bp, Mus musculus
ctaatgatcctgtctgtaacccaga

SEQ ID NO: 611888 - DNA, 25 bp, Mus musculus
ctaatgatgaggatgatggacctca

SEQ ID NO: 611889 - DNA, 25 bp, Mus musculus
ctaatgatgaggttgatggacctca

SEQ ID NO: 611890 - DNA, 25 bp, Mus musculus
ctaatgctgagcaccgactgaggac

SEQ ID NO: 611891 - DNA, 25 bp, Mus musculus
ctaatgctgagctccgactgaggac

SEQ ID NO: 611892 - DNA, 25 bp, Mus musculus
ctaatgctggctcggggacagataa

SEQ ID NO: 611893 - DNA, 25 bp, Mus musculus
ctaatgctggctgggggacagataa

SEQ ID NO: 611894 - DNA, 25 bp, Mus musculus
ctaatggcccatccgctgaagcgca

SEQ ID NO: 611895 - DNA, 25 bp, Mus musculus
ctaatggcccatgcgctgaagcgca

SEQ ID NO: 611896 - DNA, 25 bp, Mus musculus
ctaatggcgcagagcaggctcgagt

SEQ ID NO: 611897 - DNA, 25 bp, Mus musculus
ctaatggcgcagtgcaggctcgagt

SEQ ID NO: 611898 - DNA, 25 bp, Mus musculus
ctaatgggtcatatcacaactgtcc

SEQ ID NO: 611899 - DNA, 25 bp, Mus musculus
ctaatgggtcatttcacaactgtcc

SEQ ID NO: 611900 - DNA, 25 bp, Mus musculus
ctaatggtgtgtagcttaggaagct

SEQ ID NO: 611901 - DNA, 25 bp, Mus musculus
ctaatggtgtgttgcttaggaagct

SEQ ID NO: 611902 - DNA, 25 bp, Mus musculus
ctaatgtctgtcacaagacacagga

SEQ ID NO: 611903 - DNA, 25 bp, Mus musculus
ctaatgtctgtctcaagacacagga

SEQ ID NO: 611904 - DNA, 25 bp, Mus musculus
ctaatgtgaaagcaagtcctaagag

SEQ ID NO: 611905 - DNA, 25 bp, Mus musculus
ctaatgtgaaaggaagtcctaagag

SEQ ID NO: 611906 - DNA, 25 bp, Mus musculus
ctaatgtgggttactgttgctcaga

SEQ ID NO: 611907 - DNA, 25 bp, Mus musculus
ctaatgtgggtttctgttgctcaga

SEQ ID NO: 611908 - DNA, 25 bp, Mus musculus
ctaattcattttatgggagcagctc

SEQ ID NO: 611909 - DNA, 25 bp, Mus musculus
ctaattcattttttgggagcagctc

SEQ ID NO: 611910 - DNA, 25 bp, Mus musculus
ctaattctttgtcgtgtttgtgcat

SEQ ID NO: 611911 - DNA, 25 bp, Mus musculus
ctaattctttgtggtgtttgtgcat

SEQ ID NO: 611912 - DNA, 25 bp, Mus musculus
ctaattgagattagtcggaccaaag

SEQ ID NO: 611913 - DNA, 25 bp, Mus musculus
ctaattgagatttgtcggaccaaag

SEQ ID NO: 611914 - DNA, 25 bp, Mus musculus
ctaattgatgttcccatgtctggtc

SEQ ID NO: 611915 - DNA, 25 bp, Mus musculus
ctaattgatgttgccatgtctggtc

SEQ ID NO: 611916 - DNA, 25 bp, Mus musculus
ctaattgcacagcactgcgggccgc

SEQ ID NO: 611917 - DNA, 25 bp, Mus musculus
ctaattgcacaggactgcgggccgc

SEQ ID NO: 611918 - DNA, 25 bp, Mus musculus
ctaattggagctctaaaacaccacc

SEQ ID NO: 611919 - DNA, 25 bp, Mus musculus
ctaattggagctgtaaaacaccacc

SEQ ID NO: 611920 - DNA, 25 bp, Mus musculus
ctaattttttggaaccagagttcag

SEQ ID NO: 611921 - DNA, 25 bp, Mus musculus
ctaattttttggtaccagagttcag

SEQ ID NO: 611922 - DNA, 25 bp, Mus musculus
ctacaaactcctaggagggcttgcg

SEQ ID NO: 611923 - DNA, 25 bp, Mus musculus
ctacaaactccttggagggcttgcg

SEQ ID NO: 611924 - DNA, 25 bp, Mus musculus
ctacaaactgctcagcactgaagga

SEQ ID NO: 611925 - DNA, 25 bp, Mus musculus
ctacaaactgctgagcactgaagga

SEQ ID NO: 611926 - DNA, 25 bp, Mus musculus
ctacaaagcgaactgaagaaattaa

SEQ ID NO: 611927 - DNA, 25 bp, Mus musculus
ctacaaagcgaagtgaagaaattaa

SEQ ID NO: 611928 - DNA, 25 bp, Mus musculus
ctacaaagtggacgagtcgggctat

SEQ ID NO: 611929 - DNA, 25 bp, Mus musculus
ctacaaagtggaggagtcgggctat

SEQ ID NO: 611930 - DNA, 25 bp, Mus musculus
ctacaaatggaaagtcagaggccat

SEQ ID NO: 611931 - DNA, 25 bp, Mus musculus
ctacaaatggaaccggcaggtgacc

SEQ ID NO: 611932 - DNA, 25 bp, Mus musculus
ctacaaatggaagcggcaggtgacc

SEQ ID NO: 611933 - DNA, 25 bp, Mus musculus
ctacaaatggaatgtcagaggccat

SEQ ID NO: 611934 - DNA, 25 bp, Mus musculus
ctacaaattgccattgcttgggccc

SEQ ID NO: 611935 - DNA, 25 bp, Mus musculus
ctacaaattgcctttgcttgggccc

SEQ ID NO: 611936 - DNA, 25 bp, Mus musculus
ctacaacagagacggggactcctat

SEQ ID NO: 611937 - DNA, 25 bp, Mus musculus
ctacaacagagagggggactcctat

SEQ ID NO: 611938 - DNA, 25 bp, Mus musculus
ctacaacgaggcctccaatttgcag

SEQ ID NO: 611939 - DNA, 25 bp, Mus musculus
ctacaacgaggcgtccaatttgcag

SEQ ID NO: 611940 - DNA, 25 bp, Mus musculus
ctacaactgaggcaggtgaccgtct

SEQ ID NO: 611941 - DNA, 25 bp, Mus musculus
ctacaactgagggaggtgaccgtct

SEQ ID NO: 611942 - DNA, 25 bp, Mus musculus
ctacaagaacgtcgtaggtgcccgc

SEQ ID NO: 611943 - DNA, 25 bp, Mus musculus
ctacaagaacgtggtaggtgcccgc

SEQ ID NO: 611944 - DNA, 25 bp, Mus musculus
ctacaagacgctcaccatggccaag

SEQ ID NO: 611945 - DNA, 25 bp, Mus musculus
ctacaagacgctgaccatggccaag

SEQ ID NO: 611946 - DNA, 25 bp, Mus musculus
ctacaagctacgcttcacagtggat

SEQ ID NO: 611947 - DNA, 25 bp, Mus musculus
ctacaagctacggttcacagtggat

SEQ ID NO: 611948 - DNA, 25 bp, Mus musculus
ctacaaggaacccacgacctggtga

SEQ ID NO: 611949 - DNA, 25 bp, Mus musculus
ctacaaggaaccgacgacctggtga

SEQ ID NO: 611950 - DNA, 25 bp, Mus musculus
ctacaaggagacagggcgaaccaca

SEQ ID NO: 611951 - DNA, 25 bp, Mus musculus
ctacaaggagactgggcgaaccaca

SEQ ID NO: 611952 - DNA, 25 bp, Mus musculus
ctacaagtgagtcagaaagattaca

SEQ ID NO: 611953 - DNA, 25 bp, Mus musculus
ctacaagtgagtgagaaagattaca

SEQ ID NO: 611954 - DNA, 25 bp, Mus musculus
ctacaagttcagctctttatagaga

SEQ ID NO: 611955 - DNA, 25 bp, Mus musculus
ctacaagttcaggtctttatagaga

SEQ ID NO: 611956 - DNA, 25 bp, Mus musculus
ctacaatccgggagagccgctgtgg

SEQ ID NO: 611957 - DNA, 25 bp, Mus musculus
ctacaatccgggtgagccgctgtgg

SEQ ID NO: 611958 - DNA, 25 bp, Mus musculus
ctacaatgccaaagtcaagacagat

SEQ ID NO: 611959 - DNA, 25 bp, Mus musculus
ctacaatgccaatgtcaagacagat

SEQ ID NO: 611960 - DNA, 25 bp, Mus musculus
ctacaatgcgggagccctcacctgg

SEQ ID NO: 611961 - DNA, 25 bp, Mus musculus
ctacaatgcgggtgccctcacctgg

SEQ ID NO: 611962 - DNA, 25 bp, Mus musculus
ctacaatgggaaaagatgcccaacg

SEQ ID NO: 611963 - DNA, 25 bp, Mus musculus
ctacaatgggaatagatgcccaacg

SEQ ID NO: 611964 - DNA, 25 bp, Mus musculus
ctacaatgggtcctatccttcctgg

SEQ ID NO: 611965 - DNA, 25 bp, Mus musculus
ctacaatgggtcgtatccttcctgg

SEQ ID NO: 611966 - DNA, 25 bp, Mus musculus
ctacacactctacttaatcatcggg

SEQ ID NO: 611967 - DNA, 25 bp, Mus musculus
ctacacactctagttaatcatcggg

SEQ ID NO: 611968 - DNA, 25 bp, Mus musculus
ctacacatgactaccagtccaaagg

SEQ ID NO: 611969 - DNA, 25 bp, Mus musculus
ctacacatgacttccagtccaaagg

SEQ ID NO: 611970 - DNA, 25 bp, Mus musculus
ctacacattgtgcattccctggagc

SEQ ID NO: 611971 - DNA, 25 bp, Mus musculus
ctacacattgtggattccctggagc

SEQ ID NO: 611972 - DNA, 25 bp, Mus musculus
ctacaccacaacacgggcgaggaga

SEQ ID NO: 611973 - DNA, 25 bp, Mus musculus
ctacaccacaactcgggcgaggaga

SEQ ID NO: 611974 - DNA, 25 bp, Mus musculus
ctacaccacccgagtgggcattggg

SEQ ID NO: 611975 - DNA, 25 bp, Mus musculus
ctacaccacccgtgtgggcattggg

SEQ ID NO: 611976 - DNA, 25 bp, Mus musculus
ctacacccaaatatgcatatggaaa

SEQ ID NO: 611977 - DNA, 25 bp, Mus musculus
ctacacccaaatttgcatatggaaa

SEQ ID NO: 611978 - DNA, 25 bp, Mus musculus
ctacaccctaccagaaggcgtgctg

SEQ ID NO: 611979 - DNA, 25 bp, Mus musculus
ctacaccctacctgaaggcgtgctg

SEQ ID NO: 611980 - DNA, 25 bp, Mus musculus
ctacaccgtttacctagagctggag

SEQ ID NO: 611981 - DNA, 25 bp, Mus musculus
ctacaccgtttagctagagctggag

SEQ ID NO: 611982 - DNA, 25 bp, Mus musculus
ctacacggcggacaagtgcatccac

SEQ ID NO: 611983 - DNA, 25 bp, Mus musculus
ctacacggcggagaagtgcatccac

SEQ ID NO: 611984 - DNA, 25 bp, Mus musculus
ctacactatggtcgagagccttgtg

SEQ ID NO: 611985 - DNA, 25 bp, Mus musculus
ctacactatggtggagagccttgtg

SEQ ID NO: 611986 - DNA, 25 bp, Mus musculus
ctacactctacaacgtagcacggat

SEQ ID NO: 611987 - DNA, 25 bp, Mus musculus
ctacactctacatcgtagcacggat

SEQ ID NO: 611988 - DNA, 25 bp, Mus musculus
ctacactgtctgagcagcttcagtg

SEQ ID NO: 611989 - DNA, 25 bp, Mus musculus
ctacactgtctgtgcagcttcagtg

SEQ ID NO: 611990 - DNA, 25 bp, Mus musculus
ctacacttgtctcgcctgtgaggag

SEQ ID NO: 611991 - DNA, 25 bp, Mus musculus
ctacacttgtctggcctgtgaggag

SEQ ID NO: 611992 - DNA, 25 bp, Mus musculus
ctacagaaacatcagcgggcacatt

SEQ ID NO: 611993 - DNA, 25 bp, Mus musculus
ctacagaaacatgagcgggcacatt

SEQ ID NO: 611994 - DNA, 25 bp, Mus musculus
ctacagaatatcaccgcgggcgacc

SEQ ID NO: 611995 - DNA, 25 bp, Mus musculus
ctacagaatatctccgcgggcgacc

SEQ ID NO: 611996 - DNA, 25 bp, Mus musculus
ctacagagagttccgcctcctcaaa

SEQ ID NO: 611997 - DNA, 25 bp, Mus musculus
ctacagagagttgcgcctcctcaaa

SEQ ID NO: 611998 - DNA, 25 bp, Mus musculus
ctacagagccccacgcgtgcggagt

SEQ ID NO: 611999 - DNA, 25 bp, Mus musculus
ctacagagcccctcgcgtgcggagt

SEQ ID NO: 612000 - DNA, 25 bp, Mus musculus
ctacagcacagacggcttgaagcct

SEQ ID NO: 612001 - DNA, 25 bp, Mus musculus
ctacagcacagagggcttgaagcct

SEQ ID NO: 612002 - DNA, 25 bp, Mus musculus
ctacagcacaggacggatggaaaag

SEQ ID NO: 612003 - DNA, 25 bp, Mus musculus
ctacagcacaggtcggatggaaaag

SEQ ID NO: 612004 - DNA, 25 bp, Mus musculus
ctacagcagggacgagttcaccaac

SEQ ID NO: 612005 - DNA, 25 bp, Mus musculus
ctacagcagggaggagttcaccaac

SEQ ID NO: 612006 - DNA, 25 bp, Mus musculus
ctacagcatgcgagccgccgatgtg

SEQ ID NO: 612007 - DNA, 25 bp, Mus musculus
ctacagcatgcgtgccgccgatgtg

SEQ ID NO: 612008 - DNA, 25 bp, Mus musculus
ctacagccacggagagtaatgaagc

SEQ ID NO: 612009 - DNA, 25 bp, Mus musculus
ctacagccacggtgagtaatgaagc

SEQ ID NO: 612010 - DNA, 25 bp, Mus musculus
ctacagccatcccagtccatgatgg

SEQ ID NO: 612011 - DNA, 25 bp, Mus musculus
ctacagccatccgagtccatgatgg

SEQ ID NO: 612012 - DNA, 25 bp, Mus musculus
ctacagccctcactatgtggaggct

SEQ ID NO: 612013 - DNA, 25 bp, Mus musculus
ctacagccctcagtatgtggaggct

SEQ ID NO: 612014 - DNA, 25 bp, Mus musculus
ctacagcgacatcatttctgccttg

SEQ ID NO: 612015 - DNA, 25 bp, Mus musculus
ctacagcgacatgatttctgccttg

SEQ ID NO: 612016 - DNA, 25 bp, Mus musculus
ctacagctacctccgggaccgggag

SEQ ID NO: 612017 - DNA, 25 bp, Mus musculus
ctacagctacctgcgggaccgggag

SEQ ID NO: 612018 - DNA, 25 bp, Mus musculus
ctacagctatgaccaggaggtggca

SEQ ID NO: 612019 - DNA, 25 bp, Mus musculus
ctacagctatgagcaggaggtggca

SEQ ID NO: 612020 - DNA, 25 bp, Mus musculus
ctacagctggtgctgccgagaagtc

SEQ ID NO: 612021 - DNA, 25 bp, Mus musculus
ctacagctggtggtgccgagaagtc

SEQ ID NO: 612022 - DNA, 25 bp, Mus musculus
ctacagctgttgataccacccaggg

SEQ ID NO: 612023 - DNA, 25 bp, Mus musculus
ctacagctgttgttaccacccaggg

SEQ ID NO: 612024 - DNA, 25 bp, Mus musculus
ctacaggaccgacgccagattcaga

SEQ ID NO: 612025 - DNA, 25 bp, Mus musculus
ctacaggaccgaggccagattcaga

SEQ ID NO: 612026 - DNA, 25 bp, Mus musculus
ctacaggatctccagtcacagccag

SEQ ID NO: 612027 - DNA, 25 bp, Mus musculus
ctacaggatctcgagtcacagccag

SEQ ID NO: 612028 - DNA, 25 bp, Mus musculus
ctacaggcaagacactggcccttta

SEQ ID NO: 612029 - DNA, 25 bp, Mus musculus
ctacaggcaagagactggcccttta

SEQ ID NO: 612030 - DNA, 25 bp, Mus musculus
ctacaggctgaaccaggccagaggc

SEQ ID NO: 612031 - DNA, 25 bp, Mus musculus
ctacaggctgaagcaggccagaggc

SEQ ID NO: 612032 - DNA, 25 bp, Mus musculus
ctacagggaagtcacttttgttcct

SEQ ID NO: 612033 - DNA, 25 bp, Mus musculus
ctacagggaagtgacttttgttcct

SEQ ID NO: 612034 - DNA, 25 bp, Mus musculus
ctacagggcctaagcttacgagcgc

SEQ ID NO: 612035 - DNA, 25 bp, Mus musculus
ctacagggcctatgcttacgagcgc

SEQ ID NO: 612036 - DNA, 25 bp, Mus musculus
ctacaggtacatacaaagccaaagt

SEQ ID NO: 612037 - DNA, 25 bp, Mus musculus
ctacaggtacattcaaagccaaagt

SEQ ID NO: 612038 - DNA, 25 bp, Mus musculus
ctacaggtgcttcaagacaagttcc

SEQ ID NO: 612039 - DNA, 25 bp, Mus musculus
ctacaggtgcttgaagacaagttcc

SEQ ID NO: 612040 - DNA, 25 bp, Mus musculus
ctacagtaacacacagtatgtctgc

SEQ ID NO: 612041 - DNA, 25 bp, Mus musculus
ctacagtaacactcagtatgtctgc

SEQ ID NO: 612042 - DNA, 25 bp, Mus musculus
ctacagtctaaacaagtagaacttc

SEQ ID NO: 612043 - DNA, 25 bp, Mus musculus
ctacagtctaaagaagtagaacttc

SEQ ID NO: 612044 - DNA, 25 bp, Mus musculus
ctacagtggtccagcgtggccttac

SEQ ID NO: 612045 - DNA, 25 bp, Mus musculus
ctacagtggtcctgcgtggccttac

SEQ ID NO: 612046 - DNA, 25 bp, Mus musculus
ctacagtgttagctaagtttggaaa

SEQ ID NO: 612047 - DNA, 25 bp, Mus musculus
ctacagtgttaggtaagtttggaaa

SEQ ID NO: 612048 - DNA, 25 bp, Mus musculus
ctacatacagccaggcagggaggag

SEQ ID NO: 612049 - DNA, 25 bp, Mus musculus
ctacatacagcctggcagggaggag

SEQ ID NO: 612050 - DNA, 25 bp, Mus musculus
ctacataggtgtagctatttgcgta

SEQ ID NO: 612051 - DNA, 25 bp, Mus musculus
ctacataggtgttgctatttgcgta

SEQ ID NO: 612052 - DNA, 25 bp, Mus musculus
ctacatcaagcacctgtcattcggg

SEQ ID NO: 612053 - DNA, 25 bp, Mus musculus
ctacatcaagcagctgtcattcggg

SEQ ID NO: 612054 - DNA, 25 bp, Mus musculus
ctacatcagtggaccccgagtgcaa

SEQ ID NO: 612055 - DNA, 25 bp, Mus musculus
ctacatcagtggtccccgagtgcaa

SEQ ID NO: 612056 - DNA, 25 bp, Mus musculus
ctacatcccacactgtggagaatgc

SEQ ID NO: 612057 - DNA, 25 bp, Mus musculus
ctacatcccacagtgtggagaatgc

SEQ ID NO: 612058 - DNA, 25 bp, Mus musculus
ctacatcctggacggacggcaaggc

SEQ ID NO: 612059 - DNA, 25 bp, Mus musculus
ctacatcctggagggacggcaaggc

SEQ ID NO: 612060 - DNA, 25 bp, Mus musculus
ctacatcggccacaaaacaaaggac

SEQ ID NO: 612061 - DNA, 25 bp, Mus musculus
ctacatcggccagaaaacaaaggac

SEQ ID NO: 612062 - DNA, 25 bp, Mus musculus
ctacatcgtagcacggatcataaag

SEQ ID NO: 612063 - DNA, 25 bp, Mus musculus
ctacatcgtagctcggatcataaag

SEQ ID NO: 612064 - DNA, 25 bp, Mus musculus
ctacatctggctcatggacaaggct

SEQ ID NO: 612065 - DNA, 25 bp, Mus musculus
ctacatctggctgatggacaaggct

SEQ ID NO: 612066 - DNA, 25 bp, Mus musculus
ctacatcttccaccctgatatgctg

SEQ ID NO: 612067 - DNA, 25 bp, Mus musculus
ctacatcttccagcctgatatgctg

SEQ ID NO: 612068 - DNA, 25 bp, Mus musculus
ctacatgagctcagggcctgtggtg

SEQ ID NO: 612069 - DNA, 25 bp, Mus musculus
ctacatgagctctgggcctgtggtg

SEQ ID NO: 612070 - DNA, 25 bp, Mus musculus
ctacatggcccgacagcttcaggaa

SEQ ID NO: 612071 - DNA, 25 bp, Mus musculus
ctacatggcccgtcagcttcaggaa

SEQ ID NO: 612072 - DNA, 25 bp, Mus musculus
ctacatggcggtccagacaagcgag

SEQ ID NO: 612073 - DNA, 25 bp, Mus musculus
ctacatggcggtgcagacaagcgag

SEQ ID NO: 612074 - DNA, 25 bp, Mus musculus
ctacatgtttgacgcccgcgaattt

SEQ ID NO: 612075 - DNA, 25 bp, Mus musculus
ctacatgtttgaggcccgcgaattt

SEQ ID NO: 612076 - DNA, 25 bp, Mus musculus
ctacattaagaacttggatgacacc

SEQ ID NO: 612077 - DNA, 25 bp, Mus musculus
ctacattaagaagttggatgacacc

SEQ ID NO: 612078 - DNA, 25 bp, Mus musculus
ctacattgcataagcccatagtacc

SEQ ID NO: 612079 - DNA, 25 bp, Mus musculus
ctacattgcatatgcccatagtacc

SEQ ID NO: 612080 - DNA, 25 bp, Mus musculus
ctacattgcgacaggagatcattga

SEQ ID NO: 612081 - DNA, 25 bp, Mus musculus
ctacattgcgactggagatcattga

SEQ ID NO: 612082 - DNA, 25 bp, Mus musculus
ctaccaacgcatccaagtgtcagag

SEQ ID NO: 612083 - DNA, 25 bp, Mus musculus
ctaccaacgcatgcaagtgtcagag

SEQ ID NO: 612084 - DNA, 25 bp, Mus musculus
ctaccaagtaggcaaggagagcaat

SEQ ID NO: 612085 - DNA, 25 bp, Mus musculus
ctaccaagtagggaaggagagcaat

SEQ ID NO: 612086 - DNA, 25 bp, Mus musculus
ctaccaagttggcttgatccccagt

SEQ ID NO: 612087 - DNA, 25 bp, Mus musculus
ctaccaagttgggttgatccccagt

SEQ ID NO: 612088 - DNA, 25 bp, Mus musculus
ctaccaccggctctggcttaacggt

SEQ ID NO: 612089 - DNA, 25 bp, Mus musculus
ctaccaccggctgtggcttaacggt

SEQ ID NO: 612090 - DNA, 25 bp, Mus musculus
ctaccacctgggatgcaattgcaag

SEQ ID NO: 612091 - DNA, 25 bp, Mus musculus
ctaccacctgggttgcaattgcaag

SEQ ID NO: 612092 - DNA, 25 bp, Mus musculus
ctaccactatatatttacgactctg

SEQ ID NO: 612093 - DNA, 25 bp, Mus musculus
ctaccactatatttttacgactctg

SEQ ID NO: 612094 - DNA, 25 bp, Mus musculus
ctaccactctgcaggtatgtgggcc

SEQ ID NO: 612095 - DNA, 25 bp, Mus musculus
ctaccactctgctggtatgtgggcc

SEQ ID NO: 612096 - DNA, 25 bp, Mus musculus
ctaccagagcacagagaggccatgg

SEQ ID NO: 612097 - DNA, 25 bp, Mus musculus
ctaccagagcactgagaggccatgg

SEQ ID NO: 612098 - DNA, 25 bp, Mus musculus
ctaccagatcctccgagggctgaag

SEQ ID NO: 612099 - DNA, 25 bp, Mus musculus
ctaccagatcctgcgagggctgaag

SEQ ID NO: 612100 - DNA, 25 bp, Mus musculus
ctaccagcagatagatatgagagga

SEQ ID NO: 612101 - DNA, 25 bp, Mus musculus
ctaccagcagattgatatgagagga

SEQ ID NO: 612102 - DNA, 25 bp, Mus musculus
ctaccagctgcgctactatgaccag

SEQ ID NO: 612103 - DNA, 25 bp, Mus musculus
ctaccagctgcggtactatgaccag

SEQ ID NO: 612104 - DNA, 25 bp, Mus musculus
ctaccagctggtcagtttacataat

SEQ ID NO: 612105 - DNA, 25 bp, Mus musculus
ctaccagctggtgagtttacataat

SEQ ID NO: 612106 - DNA, 25 bp, Mus musculus
ctaccaggtggaaggatttgttgac

SEQ ID NO: 612107 - DNA, 25 bp, Mus musculus
ctaccaggtggatggatttgttgac

SEQ ID NO: 612108 - DNA, 25 bp, Mus musculus
ctaccagtatctccgtgtctaactg

SEQ ID NO: 612109 - DNA, 25 bp, Mus musculus
ctaccagtatctgcgtgtctaactg

SEQ ID NO: 612110 - DNA, 25 bp, Mus musculus
ctaccagtctttaggtaaggacatg

SEQ ID NO: 612111 - DNA, 25 bp, Mus musculus
ctaccagtcttttggtaaggacatg

SEQ ID NO: 612112 - DNA, 25 bp, Mus musculus
ctaccagtgccccagctgtaatggc

SEQ ID NO: 612113 - DNA, 25 bp, Mus musculus
ctaccagtgcccgagctgtaatggc

SEQ ID NO: 612114 - DNA, 25 bp, Mus musculus
ctaccagtgcgtagcagaaaacagc

SEQ ID NO: 612115 - DNA, 25 bp, Mus musculus
ctaccagtgcgttgcagaaaacagc

SEQ ID NO: 612116 - DNA, 25 bp, Mus musculus
ctaccagtgtgcatgcccagagcaa

SEQ ID NO: 612117 - DNA, 25 bp, Mus musculus
ctaccagtgtgcttgcccagagcaa

SEQ ID NO: 612118 - DNA, 25 bp, Mus musculus
ctaccagttactattacatgtgatg

SEQ ID NO: 612119 - DNA, 25 bp, Mus musculus
ctaccagttacttttacatgtgatg

SEQ ID NO: 612120 - DNA, 25 bp, Mus musculus
ctaccatcatggacgtgtttcaggg

SEQ ID NO: 612121 - DNA, 25 bp, Mus musculus
ctaccatcatggtcgtgtttcaggg

SEQ ID NO: 612122 - DNA, 25 bp, Mus musculus
ctaccatggcttcgatagaaaaggc

SEQ ID NO: 612123 - DNA, 25 bp, Mus musculus
ctaccatggcttggatagaaaaggc

SEQ ID NO: 612124 - DNA, 25 bp, Mus musculus
ctaccattacttcaatcagtctggg

SEQ ID NO: 612125 - DNA, 25 bp, Mus musculus
ctaccattacttgaatcagtctggg

SEQ ID NO: 612126 - DNA, 25 bp, Mus musculus
ctacccacaggtcagcttctaggaa

SEQ ID NO: 612127 - DNA, 25 bp, Mus musculus
ctacccacaggtgagcttctaggaa

SEQ ID NO: 612128 - DNA, 25 bp, Mus musculus
ctacccaccagcagctactgaagga

SEQ ID NO: 612129 - DNA, 25 bp, Mus musculus
ctacccaccagctgctactgaagga

SEQ ID NO: 612130 - DNA, 25 bp, Mus musculus
ctacccacgctgaacgaaagggaca

SEQ ID NO: 612131 - DNA, 25 bp, Mus musculus
ctacccacgctgtacgaaagggaca

SEQ ID NO: 612132 - DNA, 25 bp, Mus musculus
ctacccagcttccagttgagtctgc

SEQ ID NO: 612133 - DNA, 25 bp, Mus musculus
ctacccagcttcgagttgagtctgc

SEQ ID NO: 612134 - DNA, 25 bp, Mus musculus
ctacccatcgagaagcgaagttcag

SEQ ID NO: 612135 - DNA, 25 bp, Mus musculus
ctacccatcgagtagcgaagttcag

SEQ ID NO: 612136 - DNA, 25 bp, Mus musculus
ctaccccaagtgaagactcccatgt

SEQ ID NO: 612137 - DNA, 25 bp, Mus musculus
ctaccccaagtgtagactcccatgt

SEQ ID NO: 612138 - DNA, 25 bp, Mus musculus
ctaccccgtgtacaccgtggtgcag

SEQ ID NO: 612139 - DNA, 25 bp, Mus musculus
ctaccccgtgtagaccgtggtgcag

SEQ ID NO: 612140 - DNA, 25 bp, Mus musculus
ctacccctttatcgcagcgtgtgtt

SEQ ID NO: 612141 - DNA, 25 bp, Mus musculus
ctacccctttatggcagcgtgtgtt

SEQ ID NO: 612142 - DNA, 25 bp, Mus musculus
ctacccgtgcttacgggcctcggtg

SEQ ID NO: 612143 - DNA, 25 bp, Mus musculus
ctacccgtgctttcgggcctcggtg

SEQ ID NO: 612144 - DNA, 25 bp, Mus musculus
ctacccttcagcagacgccggagag

SEQ ID NO: 612145 - DNA, 25 bp, Mus musculus
ctacccttcagctgacgccggagag

SEQ ID NO: 612146 - DNA, 25 bp, Mus musculus
ctaccgacacccatggttctgcaga

SEQ ID NO: 612147 - DNA, 25 bp, Mus musculus
ctaccgacacccttggttctgcaga

SEQ ID NO: 612148 - DNA, 25 bp, Mus musculus
ctaccgacatgacaagaggatcaag

SEQ ID NO: 612149 - DNA, 25 bp, Mus musculus
ctaccgacatgagaagaggatcaag

SEQ ID NO: 612150 - DNA, 25 bp, Mus musculus
ctaccgaggacgagtgcagggccac

SEQ ID NO: 612151 - DNA, 25 bp, Mus musculus
ctaccgaggacgtgtgcagggccac

SEQ ID NO: 612152 - DNA, 25 bp, Mus musculus
ctaccgcatcaacgagattgcccag

SEQ ID NO: 612153 - DNA, 25 bp, Mus musculus
ctaccgcatcaaggagattgcccag

SEQ ID NO: 612154 - DNA, 25 bp, Mus musculus
ctaccgccgtggcttcattcacaat

SEQ ID NO: 612155 - DNA, 25 bp, Mus musculus
ctaccgccgtgggttcattcacaat

SEQ ID NO: 612156 - DNA, 25 bp, Mus musculus
ctaccgggactgcttcagcagccag

SEQ ID NO: 612157 - DNA, 25 bp, Mus musculus
ctaccgggactggttcagcagccag

SEQ ID NO: 612158 - DNA, 25 bp, Mus musculus
ctaccggttcggagcggcctaggca

SEQ ID NO: 612159 - DNA, 25 bp, Mus musculus
ctaccggttcggtgcggcctaggca

SEQ ID NO: 612160 - DNA, 25 bp, Mus musculus
ctaccgtaagacagaggacttcttc

SEQ ID NO: 612161 - DNA, 25 bp, Mus musculus
ctaccgtaagactgaggacttcttc

SEQ ID NO: 612162 - DNA, 25 bp, Mus musculus
ctaccgtcagcgagaagccgccggg

SEQ ID NO: 612163 - DNA, 25 bp, Mus musculus
ctaccgtcagcgtgaagccgccggg

SEQ ID NO: 612164 - DNA, 25 bp, Mus musculus
ctaccgtgcggacctgaaatatgac

SEQ ID NO: 612165 - DNA, 25 bp, Mus musculus
ctaccgtgcggagctgaaatatgac

SEQ ID NO: 612166 - DNA, 25 bp, Mus musculus
ctaccgttaataagtgttgctctgg

SEQ ID NO: 612167 - DNA, 25 bp, Mus musculus
ctaccgttaatatgtgttgctctgg

SEQ ID NO: 612168 - DNA, 25 bp, Mus musculus
ctacctaaagcacggcaagtactct

SEQ ID NO: 612169 - DNA, 25 bp, Mus musculus
ctacctaaagcagggcaagtactct

SEQ ID NO: 612170 - DNA, 25 bp, Mus musculus
ctacctactggaagggatgagagcg

SEQ ID NO: 612171 - DNA, 25 bp, Mus musculus
ctacctactggatgggatgagagcg

SEQ ID NO: 612172 - DNA, 25 bp, Mus musculus
ctacctaggtcgctctggccaacat

SEQ ID NO: 612173 - DNA, 25 bp, Mus musculus
ctacctaggtcggtctggccaacat

SEQ ID NO: 612174 - DNA, 25 bp, Mus musculus
ctacctcaacagacattacaaagcc

SEQ ID NO: 612175 - DNA, 25 bp, Mus musculus
ctacctcaacagtcattacaaagcc

SEQ ID NO: 612176 - DNA, 25 bp, Mus musculus
ctacctcaacgtcgtgggtatggtg

SEQ ID NO: 612177 - DNA, 25 bp, Mus musculus
ctacctcaacgtggtgggtatggtg

SEQ ID NO: 612178 - DNA, 25 bp, Mus musculus
ctacctcaatctcagtggaaacaaa

SEQ ID NO: 612179 - DNA, 25 bp, Mus musculus
ctacctcaatctgagtggaaacaaa

SEQ ID NO: 612180 - DNA, 25 bp, Mus musculus
ctacctcagcagagaacagagcagg

SEQ ID NO: 612181 - DNA, 25 bp, Mus musculus
ctacctcagcagtgaacagagcagg

SEQ ID NO: 612182 - DNA, 25 bp, Mus musculus
ctacctcatcgtcggtgtgcatacg

SEQ ID NO: 612183 - DNA, 25 bp, Mus musculus
ctacctcatcgtgggtgtgcatacg

SEQ ID NO: 612184 - DNA, 25 bp, Mus musculus
ctacctctatgaaagtggagaaaca

SEQ ID NO: 612185 - DNA, 25 bp, Mus musculus
ctacctctatgatagtggagaaaca

SEQ ID NO: 612186 - DNA, 25 bp, Mus musculus
ctacctgaaaaacataatggaagca

SEQ ID NO: 612187 - DNA, 25 bp, Mus musculus
ctacctgaaaaagataatggaagca

SEQ ID NO: 612188 - DNA, 25 bp, Mus musculus
ctacctgaacccagagatgaaagaa

SEQ ID NO: 612189 - DNA, 25 bp, Mus musculus
ctacctgaaccctgagatgaaagaa

SEQ ID NO: 612190 - DNA, 25 bp, Mus musculus
ctacctgaaggtagagtttgatgat

SEQ ID NO: 612191 - DNA, 25 bp, Mus musculus
ctacctgaaggttgagtttgatgat

SEQ ID NO: 612192 - DNA, 25 bp, Mus musculus
ctacctgaagtcatctattaatggg

SEQ ID NO: 612193 - DNA, 25 bp, Mus musculus
ctacctgaagtcttctattaatggg

SEQ ID NO: 612194 - DNA, 25 bp, Mus musculus
ctacctgattgacgaagtgagtgcg

SEQ ID NO: 612195 - DNA, 25 bp, Mus musculus
ctacctgattgaggaagtgagtgcg

SEQ ID NO: 612196 - DNA, 25 bp, Mus musculus
ctacctgcccacctttcttgtggat

SEQ ID NO: 612197 - DNA, 25 bp, Mus musculus
ctacctgcccacgtttcttgtggat

SEQ ID NO: 612198 - DNA, 25 bp, Mus musculus
ctacctgctcctacgggagaagctg

SEQ ID NO: 612199 - DNA, 25 bp, Mus musculus
ctacctgctccttcgggagaagctg

SEQ ID NO: 612200 - DNA, 25 bp, Mus musculus
ctacctggcagtaagtgacctcaca

SEQ ID NO: 612201 - DNA, 25 bp, Mus musculus
ctacctggcagttagtgacctcaca

SEQ ID NO: 612202 - DNA, 25 bp, Mus musculus
ctacctggcggacaggtcagtcctg

SEQ ID NO: 612203 - DNA, 25 bp, Mus musculus
ctacctggcggagaggtcagtcctg

SEQ ID NO: 612204 - DNA, 25 bp, Mus musculus
ctacctggctgtctgaagtgtggct

SEQ ID NO: 612205 - DNA, 25 bp, Mus musculus
ctacctggctgtgtgaagtgtggct

SEQ ID NO: 612206 - DNA, 25 bp, Mus musculus
ctacctggtgatcccattcatgggc

SEQ ID NO: 612207 - DNA, 25 bp, Mus musculus
ctacctggtgatgccattcatgggc

SEQ ID NO: 612208 - DNA, 25 bp, Mus musculus
ctacctggtgttatgtctgtcaggc

SEQ ID NO: 612209 - DNA, 25 bp, Mus musculus
ctacctggtgttttgtctgtcaggc

SEQ ID NO: 612210 - DNA, 25 bp, Mus musculus
ctacctgtgaaactaagtcacacac

SEQ ID NO: 612211 - DNA, 25 bp, Mus musculus
ctacctgtgaaagtaagtcacacac

SEQ ID NO: 612212 - DNA, 25 bp, Mus musculus
ctacctgttcctacttgctttggac

SEQ ID NO: 612213 - DNA, 25 bp, Mus musculus
ctacctgttccttcttgctttggac

SEQ ID NO: 612214 - DNA, 25 bp, Mus musculus
ctacctgtttgcagccccgtactat

SEQ ID NO: 612215 - DNA, 25 bp, Mus musculus
ctacctgtttgctgccccgtactat

SEQ ID NO: 612216 - DNA, 25 bp, Mus musculus
ctaccttgacttcgagaagtgggaa

SEQ ID NO: 612217 - DNA, 25 bp, Mus musculus
ctaccttgacttggagaagtgggaa

SEQ ID NO: 612218 - DNA, 25 bp, Mus musculus
ctacctttctgcagccgagcggtcg

SEQ ID NO: 612219 - DNA, 25 bp, Mus musculus
ctacctttctgctgccgagcggtcg

SEQ ID NO: 612220 - DNA, 25 bp, Mus musculus
ctacgaagcgctcaaagagaatgag

SEQ ID NO: 612221 - DNA, 25 bp, Mus musculus
ctacgaagcgctgaaagagaatgag

SEQ ID NO: 612222 - DNA, 25 bp, Mus musculus
ctacgaatgtcactgtcacccaggg

SEQ ID NO: 612223 - DNA, 25 bp, Mus musculus
ctacgaatgtcagtgtcacccaggg

SEQ ID NO: 612224 - DNA, 25 bp, Mus musculus
ctacgacaagcaaaaaagcaatgtg

SEQ ID NO: 612225 - DNA, 25 bp, Mus musculus
ctacgacaagcataaaagcaatgtg

SEQ ID NO: 612226 - DNA, 25 bp, Mus musculus
ctacgaccccgaagtgggcaacttc

SEQ ID NO: 612227 - DNA, 25 bp, Mus musculus
ctacgaccccgatgtgggcaacttc

SEQ ID NO: 612228 - DNA, 25 bp, Mus musculus
ctacgaccgctaagttatccacaga

SEQ ID NO: 612229 - DNA, 25 bp, Mus musculus
ctacgaccgctatgttatccacaga

SEQ ID NO: 612230 - DNA, 25 bp, Mus musculus
ctacgacggagacctgcaggcctgc

SEQ ID NO: 612231 - DNA, 25 bp, Mus musculus
ctacgacggagagctgcaggcctgc

SEQ ID NO: 612232 - DNA, 25 bp, Mus musculus
ctacgactgcgtacaaggagggttt

SEQ ID NO: 612233 - DNA, 25 bp, Mus musculus
ctacgactgcgttcaaggagggttt

SEQ ID NO: 612234 - DNA, 25 bp, Mus musculus
ctacgagaggttcaccacctgctac

SEQ ID NO: 612235 - DNA, 25 bp, Mus musculus
ctacgagaggttgaccacctgctac

SEQ ID NO: 612236 - DNA, 25 bp, Mus musculus
ctacgagataaacctgatggaggaa

SEQ ID NO: 612237 - DNA, 25 bp, Mus musculus
ctacgagataaagctgatggaggaa

SEQ ID NO: 612238 - DNA, 25 bp, Mus musculus
ctacgagcagaacaccaagagggcg

SEQ ID NO: 612239 - DNA, 25 bp, Mus musculus
ctacgagcagaagaccaagagggcg

SEQ ID NO: 612240 - DNA, 25 bp, Mus musculus
ctacgagcgggaccgggttgtggcc

SEQ ID NO: 612241 - DNA, 25 bp, Mus musculus
ctacgagcgggagcgggttgtggcc

SEQ ID NO: 612242 - DNA, 25 bp, Mus musculus
ctacgaggaactctgcattgtcatg

SEQ ID NO: 612243 - DNA, 25 bp, Mus musculus
ctacgaggaactgtgcattgtcatg

SEQ ID NO: 612244 - DNA, 25 bp, Mus musculus
ctacgaggagaaccaccaggcagac

SEQ ID NO: 612245 - DNA, 25 bp, Mus musculus
ctacgaggagaagcaccaggcagac

SEQ ID NO: 612246 - DNA, 25 bp, Mus musculus
ctacgataaggacggcaaatttggt

SEQ ID NO: 612247 - DNA, 25 bp, Mus musculus
ctacgataaggagggcaaatttggt

SEQ ID NO: 612248 - DNA, 25 bp, Mus musculus
ctacgatgagctcctagctgcagag

SEQ ID NO: 612249 - DNA, 25 bp, Mus musculus
ctacgatgagctgctagctgcagag

SEQ ID NO: 612250 - DNA, 25 bp, Mus musculus
ctacgatgagtcctgcgatctatgg

SEQ ID NO: 612251 - DNA, 25 bp, Mus musculus
ctacgatgagtcgtgcgatctatgg

SEQ ID NO: 612252 - DNA, 25 bp, Mus musculus
ctacgcagaactcgccaatacaagg

SEQ ID NO: 612253 - DNA, 25 bp, Mus musculus
ctacgcagaactggccaatacaagg

SEQ ID NO: 612254 - DNA, 25 bp, Mus musculus
ctacgcagcatcatctcccaaatgg

SEQ ID NO: 612255 - DNA, 25 bp, Mus musculus
ctacgcagcatcttctcccaaatgg

SEQ ID NO: 612256 - DNA, 25 bp, Mus musculus
ctacgccacccacctacaaagtggg

SEQ ID NO: 612257 - DNA, 25 bp, Mus musculus
ctacgccacccagctacaaagtggg

SEQ ID NO: 612258 - DNA, 25 bp, Mus musculus
ctacgcccagttagaggagagcatg

SEQ ID NO: 612259 - DNA, 25 bp, Mus musculus
ctacgcccagtttgaggagagcatg

SEQ ID NO: 612260 - DNA, 25 bp, Mus musculus
ctacgccctgctccgtgtggaacat

SEQ ID NO: 612261 - DNA, 25 bp, Mus musculus
ctacgccctgctgcgtgtggaacat

SEQ ID NO: 612262 - DNA, 25 bp, Mus musculus
ctacgcgattctctctgagtggttt

SEQ ID NO: 612263 - DNA, 25 bp, Mus musculus
ctacgcgattctgtctgagtggttt

SEQ ID NO: 612264 - DNA, 25 bp, Mus musculus
ctacgcgctcatcggtgccttggac

SEQ ID NO: 612265 - DNA, 25 bp, Mus musculus
ctacgcgctcatgggtgccttggac

SEQ ID NO: 612266 - DNA, 25 bp, Mus musculus
ctacgctgtctaccctcaggcaacc

SEQ ID NO: 612267 - DNA, 25 bp, Mus musculus
ctacgctgtctagcctcaggcaacc

SEQ ID NO: 612268 - DNA, 25 bp, Mus musculus
ctacggaatgagatctgaaatggcc

SEQ ID NO: 612269 - DNA, 25 bp, Mus musculus
ctacggaatgagttctgaaatggcc

SEQ ID NO: 612270 - DNA, 25 bp, Mus musculus
ctacggacatatccccaacggtgga

SEQ ID NO: 612271 - DNA, 25 bp, Mus musculus
ctacggacatatgcccaacggtgga

SEQ ID NO: 612272 - DNA, 25 bp, Mus musculus
ctacggagttcacgcatgtgaaggc

SEQ ID NO: 612273 - DNA, 25 bp, Mus musculus
ctacggagttcaggcatgtgaaggc

SEQ ID NO: 612274 - DNA, 25 bp, Mus musculus
ctacggattgaacatcgagatgcac

SEQ ID NO: 612275 - DNA, 25 bp, Mus musculus
ctacggattgaagatcgagatgcac

SEQ ID NO: 612276 - DNA, 25 bp, Mus musculus
ctacggattttgcagagaacgagct

SEQ ID NO: 612277 - DNA, 25 bp, Mus musculus
ctacggattttggagagaacgagct

SEQ ID NO: 612278 - DNA, 25 bp, Mus musculus
ctacggcagtgtcatcgtagcagga

SEQ ID NO: 612279 - DNA, 25 bp, Mus musculus
ctacggcagtgtgatcgtagcagga

SEQ ID NO: 612280 - DNA, 25 bp, Mus musculus
ctacggcatcttcggagccctggtt

SEQ ID NO: 612281 - DNA, 25 bp, Mus musculus
ctacggcatcttgggagccctggtt

SEQ ID NO: 612282 - DNA, 25 bp, Mus musculus
ctacggccaggcagggtccgagcat

SEQ ID NO: 612283 - DNA, 25 bp, Mus musculus
ctacggccaggctgggtccgagcat

SEQ ID NO: 612284 - DNA, 25 bp, Mus musculus
ctacgggaagggattccagacatgg

SEQ ID NO: 612285 - DNA, 25 bp, Mus musculus
ctacgggaagggtttccagacatgg

SEQ ID NO: 612286 - DNA, 25 bp, Mus musculus
ctacgggcattgagaagcttggtga

SEQ ID NO: 612287 - DNA, 25 bp, Mus musculus
ctacgggcattgtgaagcttggtga

SEQ ID NO: 612288 - DNA, 25 bp, Mus musculus
ctacggttggaaccatggtgttcag

SEQ ID NO: 612289 - DNA, 25 bp, Mus musculus
ctacggttggaagcatggtgttcag

SEQ ID NO: 612290 - DNA, 25 bp, Mus musculus
ctacgtactcaaaatgtttcagccg

SEQ ID NO: 612291 - DNA, 25 bp, Mus musculus
ctacgtactcaatatgtttcagccg

SEQ ID NO: 612292 - DNA, 25 bp, Mus musculus
ctacgtactgtgagtggcctggcgc

SEQ ID NO: 612293 - DNA, 25 bp, Mus musculus
ctacgtactgtgtgtggcctggcgc

SEQ ID NO: 612294 - DNA, 25 bp, Mus musculus
ctacgtattttcacgtaacaataag

SEQ ID NO: 612295 - DNA, 25 bp, Mus musculus
ctacgtattttctcgtaacaataag

SEQ ID NO: 612296 - DNA, 25 bp, Mus musculus
ctacgtcatcgtccggtgtttgaac

SEQ ID NO: 612297 - DNA, 25 bp, Mus musculus
ctacgtcatcgtgcggtgtttgaac

SEQ ID NO: 612298 - DNA, 25 bp, Mus musculus
ctacgtgaatggcatgaaaatctca

SEQ ID NO: 612299 - DNA, 25 bp, Mus musculus
ctacgtgaatgggatgaaaatctca

SEQ ID NO: 612300 - DNA, 25 bp, Mus musculus
ctacgtgcagaacgacctcaagaat

SEQ ID NO: 612301 - DNA, 25 bp, Mus musculus
ctacgtgcagaaggacctcaagaat

SEQ ID NO: 612302 - DNA, 25 bp, Mus musculus
ctacgtggattccttcatggagctg

SEQ ID NO: 612303 - DNA, 25 bp, Mus musculus
ctacgtggattcgttcatggagctg

SEQ ID NO: 612304 - DNA, 25 bp, Mus musculus
ctacgtggccaacttgatcaaggag

SEQ ID NO: 612305 - DNA, 25 bp, Mus musculus
ctacgtggccaagttgatcaaggag

SEQ ID NO: 612306 - DNA, 25 bp, Mus musculus
ctacgtggctaccaggtggtaccga

SEQ ID NO: 612307 - DNA, 25 bp, Mus musculus
ctacgtggctacgaggtggtaccga

SEQ ID NO: 612308 - DNA, 25 bp, Mus musculus
ctacgtgggagcctatgtcttcatc

SEQ ID NO: 612309 - DNA, 25 bp, Mus musculus
ctacgtgggagcgtatgtcttcatc

SEQ ID NO: 612310 - DNA, 25 bp, Mus musculus
ctacgtgtgctgctggtagccaaga

SEQ ID NO: 612311 - DNA, 25 bp, Mus musculus
ctacgtgtgctggtggtagccaaga

SEQ ID NO: 612312 - DNA, 25 bp, Mus musculus
ctacgttcgtgacaactgcaaacct

SEQ ID NO: 612313 - DNA, 25 bp, Mus musculus
ctacgttcgtgagaactgcaaacct

SEQ ID NO: 612314 - DNA, 25 bp, Mus musculus
ctacgttgggctagggactgatgct

SEQ ID NO: 612315 - DNA, 25 bp, Mus musculus
ctacgttgggcttgggactgatgct

SEQ ID NO: 612316 - DNA, 25 bp, Mus musculus
ctactaaagtcacacccttctcggg

SEQ ID NO: 612317 - DNA, 25 bp, Mus musculus
ctactaaagtcagacccttctcggg

SEQ ID NO: 612318 - DNA, 25 bp, Mus musculus
ctactaactcggctgctgcaggtca

SEQ ID NO: 612319 - DNA, 25 bp, Mus musculus
ctactaactcgggtgctgcaggtca

SEQ ID NO: 612320 - DNA, 25 bp, Mus musculus
ctactaagaagacagaacgagccac

SEQ ID NO: 612321 - DNA, 25 bp, Mus musculus
ctactaagaagagagaacgagccac

SEQ ID NO: 612322 - DNA, 25 bp, Mus musculus
ctactaagcaaaaatagagaaggag

SEQ ID NO: 612323 - DNA, 25 bp, Mus musculus
ctactaagcaaatatagagaaggag

SEQ ID NO: 612324 - DNA, 25 bp, Mus musculus
ctactacaaaacagagggcgaggaa

SEQ ID NO: 612325 - DNA, 25 bp, Mus musculus
ctactacaaaactgagggcgaggaa

SEQ ID NO: 612326 - DNA, 25 bp, Mus musculus
ctactacaactacgccaagcacctg

SEQ ID NO: 612327 - DNA, 25 bp, Mus musculus
ctactacaactaggccaagcacctg

SEQ ID NO: 612328 - DNA, 25 bp, Mus musculus
ctactacattcaccaaatgttgggc

SEQ ID NO: 612329 - DNA, 25 bp, Mus musculus
ctactacattcagcaaatgttgggc

SEQ ID NO: 612330 - DNA, 25 bp, Mus musculus
ctactactacccctctgttgggctg

SEQ ID NO: 612331 - DNA, 25 bp, Mus musculus
ctactactacccgtctgttgggctg

SEQ ID NO: 612332 - DNA, 25 bp, Mus musculus
ctactatcgctaacccacgggagag

SEQ ID NO: 612333 - DNA, 25 bp, Mus musculus
ctactatcgctatcccacgggagag

SEQ ID NO: 612334 - DNA, 25 bp, Mus musculus
ctactatctgcccaacaagaatcaa

SEQ ID NO: 612335 - DNA, 25 bp, Mus musculus
ctactatctgccgaacaagaatcaa

SEQ ID NO: 612336 - DNA, 25 bp, Mus musculus
ctactatgagctcggagaagacact

SEQ ID NO: 612337 - DNA, 25 bp, Mus musculus
ctactatgagctgggagaagacact

SEQ ID NO: 612338 - DNA, 25 bp, Mus musculus
ctactatgagtgcactggaatatat

SEQ ID NO: 612339 - DNA, 25 bp, Mus musculus
ctactatgagtggactggaatatat

SEQ ID NO: 612340 - DNA, 25 bp, Mus musculus
ctactatggcggctggcacgagcat

SEQ ID NO: 612341 - DNA, 25 bp, Mus musculus
ctactatggcgggtggcacgagcat

SEQ ID NO: 612342 - DNA, 25 bp, Mus musculus
ctactatgtcgacacagctgtgcgc

SEQ ID NO: 612343 - DNA, 25 bp, Mus musculus
ctactatgtcgagacagctgtgcgc

SEQ ID NO: 612344 - DNA, 25 bp, Mus musculus
ctactcatcccacagagaagagtgg

SEQ ID NO: 612345 - DNA, 25 bp, Mus musculus
ctactcatcccagagagaagagtgg

SEQ ID NO: 612346 - DNA, 25 bp, Mus musculus
ctactcattcccagtcgtgatcaag

SEQ ID NO: 612347 - DNA, 25 bp, Mus musculus
ctactcattccctgtcgtgatcaag

SEQ ID NO: 612348 - DNA, 25 bp, Mus musculus
ctactccctgccctggtagtgtgat

SEQ ID NO: 612349 - DNA, 25 bp, Mus musculus
ctactccctgccgtggtagtgtgat

SEQ ID NO: 612350 - DNA, 25 bp, Mus musculus
ctactcctcaggcaaagggcagcag

SEQ ID NO: 612351 - DNA, 25 bp, Mus musculus
ctactcctcagggaaagggcagcag

SEQ ID NO: 612352 - DNA, 25 bp, Mus musculus
ctactccttaaacttttgcctgatg

SEQ ID NO: 612353 - DNA, 25 bp, Mus musculus
ctactccttaaagttttgcctgatg

SEQ ID NO: 612354 - DNA, 25 bp, Mus musculus
ctactccttcgtctggtgggactgg

SEQ ID NO: 612355 - DNA, 25 bp, Mus musculus
ctactccttcgtgtggtgggactgg

SEQ ID NO: 612356 - DNA, 25 bp, Mus musculus
ctactcgggaacagccggcagtggt

SEQ ID NO: 612357 - DNA, 25 bp, Mus musculus
ctactcgggaactgccggcagtggt

SEQ ID NO: 612358 - DNA, 25 bp, Mus musculus
ctactcggtggcacggcagttcaac

SEQ ID NO: 612359 - DNA, 25 bp, Mus musculus
ctactcggtggctcggcagttcaac

SEQ ID NO: 612360 - DNA, 25 bp, Mus musculus
ctactcgtctttatgctgtgctgag

SEQ ID NO: 612361 - DNA, 25 bp, Mus musculus
ctactcgtctttttgctgtgctgag

SEQ ID NO: 612362 - DNA, 25 bp, Mus musculus
ctactctcatgaaggtgccttcctg

SEQ ID NO: 612363 - DNA, 25 bp, Mus musculus
ctactctcatgatggtgccttcctg

SEQ ID NO: 612364 - DNA, 25 bp, Mus musculus
ctactctggtggagtttgtaatagc

SEQ ID NO: 612365 - DNA, 25 bp, Mus musculus
ctactctggtggtgtttgtaatagc

SEQ ID NO: 612366 - DNA, 25 bp, Mus musculus
ctactctgtccacgctgaaaggtgc

SEQ ID NO: 612367 - DNA, 25 bp, Mus musculus
ctactctgtccaggctgaaaggtgc

SEQ ID NO: 612368 - DNA, 25 bp, Mus musculus
ctactgaggaagcagtgcagtgacc

SEQ ID NO: 612369 - DNA, 25 bp, Mus musculus
ctactgaggaaggagtgcagtgacc

SEQ ID NO: 612370 - DNA, 25 bp, Mus musculus
ctactgaggagtcatcacccagcct

SEQ ID NO: 612371 - DNA, 25 bp, Mus musculus
ctactgaggagtgatcacccagcct

SEQ ID NO: 612372 - DNA, 25 bp, Mus musculus
ctactgaggccaagaagacctctct

SEQ ID NO: 612373 - DNA, 25 bp, Mus musculus
ctactgaggccatgaagacctctct

SEQ ID NO: 612374 - DNA, 25 bp, Mus musculus
ctactgaggtgactggaggcctaca

SEQ ID NO: 612375 - DNA, 25 bp, Mus musculus
ctactgaggtgagtggaggcctaca

SEQ ID NO: 612376 - DNA, 25 bp, Mus musculus
ctactgatcaaactgtctgtattcg

SEQ ID NO: 612377 - DNA, 25 bp, Mus musculus
ctactgatcaaagtgtctgtattcg

SEQ ID NO: 612378 - DNA, 25 bp, Mus musculus
ctactgcaagatcgtgctccacggc

SEQ ID NO: 612379 - DNA, 25 bp, Mus musculus
ctactgcaagatggtgctccacggc

SEQ ID NO: 612380 - DNA, 25 bp, Mus musculus
ctactgcaggccattgcgcgtgacg

SEQ ID NO: 612381 - DNA, 25 bp, Mus musculus
ctactgcaggcctttgcgcgtgacg

SEQ ID NO: 612382 - DNA, 25 bp, Mus musculus
ctactgctacctcggcagacgctga

SEQ ID NO: 612383 - DNA, 25 bp, Mus musculus
ctactgctacctgggcagacgctga

SEQ ID NO: 612384 - DNA, 25 bp, Mus musculus
ctactgctgccaccggtgtcaggag

SEQ ID NO: 612385 - DNA, 25 bp, Mus musculus
ctactgctgccagcggtgtcaggag

SEQ ID NO: 612386 - DNA, 25 bp, Mus musculus
ctactgcttcgtcggacacctttct

SEQ ID NO: 612387 - DNA, 25 bp, Mus musculus
ctactgcttcgtgggacacctttct

SEQ ID NO: 612388 - DNA, 25 bp, Mus musculus
ctactggaaccacggctacggctac

SEQ ID NO: 612389 - DNA, 25 bp, Mus musculus
ctactggaaccagggctacggctac

SEQ ID NO: 612390 - DNA, 25 bp, Mus musculus
ctactggacataccctggctctctg

SEQ ID NO: 612391 - DNA, 25 bp, Mus musculus
ctactggacatagcctggctctctg

SEQ ID NO: 612392 - DNA, 25 bp, Mus musculus
ctactggaccctagtgcaaaggaag

SEQ ID NO: 612393 - DNA, 25 bp, Mus musculus
ctactggacccttgtgcaaaggaag

SEQ ID NO: 612394 - DNA, 25 bp, Mus musculus
ctactggatcaaccaaggaagcggg

SEQ ID NO: 612395 - DNA, 25 bp, Mus musculus
ctactggatcaagcaaggaagcggg

SEQ ID NO: 612396 - DNA, 25 bp, Mus musculus
ctactggcttctcgtggagggtctc

SEQ ID NO: 612397 - DNA, 25 bp, Mus musculus
ctactggcttctggtggagggtctc

SEQ ID NO: 612398 - DNA, 25 bp, Mus musculus
ctactgggaatcagcggatgtagtg

SEQ ID NO: 612399 - DNA, 25 bp, Mus musculus
ctactgggaatctgcggatgtagtg

SEQ ID NO: 612400 - DNA, 25 bp, Mus musculus
ctactgggcacacgcaacgggtcca

SEQ ID NO: 612401 - DNA, 25 bp, Mus musculus
ctactgggcacaggcaacgggtcca

SEQ ID NO: 612402 - DNA, 25 bp, Mus musculus
ctactgggccaactttggagaattc

SEQ ID NO: 612403 - DNA, 25 bp, Mus musculus
ctactgggccaagtttggagaattc

SEQ ID NO: 612404 - DNA, 25 bp, Mus musculus
ctactgggtggccttctcggcctag

SEQ ID NO: 612405 - DNA, 25 bp, Mus musculus
ctactgggtggcgttctcggcctag

SEQ ID NO: 612406 - DNA, 25 bp, Mus musculus
ctactggtggaacggagacaagtac

SEQ ID NO: 612407 - DNA, 25 bp, Mus musculus
ctactggtggaagggagacaagtac

SEQ ID NO: 612408 - DNA, 25 bp, Mus musculus
ctactggttctgcaagggccaaaat

SEQ ID NO: 612409 - DNA, 25 bp, Mus musculus
ctactggttctggaagggccaaaat

SEQ ID NO: 612410 - DNA, 25 bp, Mus musculus
ctactgtcagtaagatgtcaatgag

SEQ ID NO: 612411 - DNA, 25 bp, Mus musculus
ctactgtcagtatgatgtcaatgag

SEQ ID NO: 612412 - DNA, 25 bp, Mus musculus
ctactgtctccaactgtaagaagtg

SEQ ID NO: 612413 - DNA, 25 bp, Mus musculus
ctactgtctccatctgtaagaagtg

SEQ ID NO: 612414 - DNA, 25 bp, Mus musculus
ctactgtcttcaatccgggctggaa

SEQ ID NO: 612415 - DNA, 25 bp, Mus musculus
ctactgtcttcattccgggctggaa

SEQ ID NO: 612416 - DNA, 25 bp, Mus musculus
ctactgtggcttatcagttaagatt

SEQ ID NO: 612417 - DNA, 25 bp, Mus musculus
ctactgtggcttttcagttaagatt

SEQ ID NO: 612418 - DNA, 25 bp, Mus musculus
ctactgtgggaaacagtcttgggcg

SEQ ID NO: 612419 - DNA, 25 bp, Mus musculus
ctactgtgggaatcagtcttgggcg

SEQ ID NO: 612420 - DNA, 25 bp, Mus musculus
ctactgttacaaatagtttatggga

SEQ ID NO: 612421 - DNA, 25 bp, Mus musculus
ctactgttacaattagtttatggga

SEQ ID NO: 612422 - DNA, 25 bp, Mus musculus
ctactgttagaaatcctggaggaga

SEQ ID NO: 612423 - DNA, 25 bp, Mus musculus
ctactgttagaattcctggaggaga

SEQ ID NO: 612424 - DNA, 25 bp, Mus musculus
ctacttcggaggagcccgacgcggc

SEQ ID NO: 612425 - DNA, 25 bp, Mus musculus
ctacttcggaggtgcccgacgcggc

SEQ ID NO: 612426 - DNA, 25 bp, Mus musculus
ctacttgaaagacccagcaagaaca

SEQ ID NO: 612427 - DNA, 25 bp, Mus musculus
ctacttgaaagagccagcaagaaca

SEQ ID NO: 612428 - DNA, 25 bp, Mus musculus
ctacttgagcttatgtggaataaat

SEQ ID NO: 612429 - DNA, 25 bp, Mus musculus
ctacttgagcttttgtggaataaat

SEQ ID NO: 612430 - DNA, 25 bp, Mus musculus
ctacttggagagctggcaaaggccc

SEQ ID NO: 612431 - DNA, 25 bp, Mus musculus
ctacttggagaggtggcaaaggccc

SEQ ID NO: 612432 - DNA, 25 bp, Mus musculus
ctacttggccctacgctttgtcttg

SEQ ID NO: 612433 - DNA, 25 bp, Mus musculus
ctacttggcccttcgctttgtcttg

SEQ ID NO: 612434 - DNA, 25 bp, Mus musculus
ctacttggtccgaggccttacactc

SEQ ID NO: 612435 - DNA, 25 bp, Mus musculus
ctacttggtccgtggccttacactc

SEQ ID NO: 612436 - DNA, 25 bp, Mus musculus
ctactttccagacccggcaaggacg

SEQ ID NO: 612437 - DNA, 25 bp, Mus musculus
ctactttccagagccggcaaggacg

SEQ ID NO: 612438 - DNA, 25 bp, Mus musculus
ctactttgacatcgagtggtgtgac

SEQ ID NO: 612439 - DNA, 25 bp, Mus musculus
ctactttgacatggagtggtgtgac

SEQ ID NO: 612440 - DNA, 25 bp, Mus musculus
ctactttgacgtctatgcccagcac

SEQ ID NO: 612441 - DNA, 25 bp, Mus musculus
ctactttgacgtgtatgcccagcac

SEQ ID NO: 612442 - DNA, 25 bp, Mus musculus
ctactttgatctcctgggagagctg

SEQ ID NO: 612443 - DNA, 25 bp, Mus musculus
ctactttgatctgctgggagagctg

SEQ ID NO: 612444 - DNA, 25 bp, Mus musculus
ctactttgcacaagtcgactgcaga

SEQ ID NO: 612445 - DNA, 25 bp, Mus musculus
ctactttgcacatgtcgactgcaga

SEQ ID NO: 612446 - DNA, 25 bp, Mus musculus
ctactttgttgtcccaggaaagatc

SEQ ID NO: 612447 - DNA, 25 bp, Mus musculus
ctactttgttgtgccaggaaagatc

SEQ ID NO: 612448 - DNA, 25 bp, Mus musculus
ctacttttaagcagctggtggaagc

SEQ ID NO: 612449 - DNA, 25 bp, Mus musculus
ctacttttaagctgctggtggaagc

SEQ ID NO: 612450 - DNA, 25 bp, Mus musculus
ctacttttctggctgtgccaaagca

SEQ ID NO: 612451 - DNA, 25 bp, Mus musculus
ctacttttctgggtgtgccaaagca

SEQ ID NO: 612452 - DNA, 25 bp, Mus musculus
ctacttttggatcaacttctgcaaa

SEQ ID NO: 612453 - DNA, 25 bp, Mus musculus
ctacttttggatgaacttctgcaaa

SEQ ID NO: 612454 - DNA, 25 bp, Mus musculus
ctactttttgagatgtctcctggct

SEQ ID NO: 612455 - DNA, 25 bp, Mus musculus
ctactttttgagttgtctcctggct

SEQ ID NO: 612456 - DNA, 25 bp, Mus musculus
ctagaaaacggacggaattgctgtg

SEQ ID NO: 612457 - DNA, 25 bp, Mus musculus
ctagaaaacggagggaattgctgtg

SEQ ID NO: 612458 - DNA, 25 bp, Mus musculus
ctagaaaagtcacagcccaggcaag

SEQ ID NO: 612459 - DNA, 25 bp, Mus musculus
ctagaaaagtcagagcccaggcaag

SEQ ID NO: 612460 - DNA, 25 bp, Mus musculus
ctagaaaatgaactgatgtatggag

SEQ ID NO: 612461 - DNA, 25 bp, Mus musculus
ctagaaaatgaagtgatgtatggag

SEQ ID NO: 612462 - DNA, 25 bp, Mus musculus
ctagaaaatgcccaagctcaacttg

SEQ ID NO: 612463 - DNA, 25 bp, Mus musculus
ctagaaaatgccgaagctcaacttg

SEQ ID NO: 612464 - DNA, 25 bp, Mus musculus
ctagaaacaactatgcagctgtggc

SEQ ID NO: 612465 - DNA, 25 bp, Mus musculus
ctagaaacaactttgcagctgtggc

SEQ ID NO: 612466 - DNA, 25 bp, Mus musculus
ctagaaagactacccctaacactcg

SEQ ID NO: 612467 - DNA, 25 bp, Mus musculus
ctagaaagactagccctaacactcg

SEQ ID NO: 612468 - DNA, 25 bp, Mus musculus
ctagaaatgtttccccaaacacctg

SEQ ID NO: 612469 - DNA, 25 bp, Mus musculus
ctagaaatgtttgcccaaacacctg

SEQ ID NO: 612470 - DNA, 25 bp, Mus musculus
ctagaactgcgcatcagccgagcgg

SEQ ID NO: 612471 - DNA, 25 bp, Mus musculus
ctagaactgcgcttcagccgagcgg

SEQ ID NO: 612472 - DNA, 25 bp, Mus musculus
ctagaagacaacagtatccagatga

SEQ ID NO: 612473 - DNA, 25 bp, Mus musculus
ctagaagacaactgtatccagatga

SEQ ID NO: 612474 - DNA, 25 bp, Mus musculus
ctagaagacactcagtgtcaagagg

SEQ ID NO: 612475 - DNA, 25 bp, Mus musculus
ctagaagacactgagtgtcaagagg

SEQ ID NO: 612476 - DNA, 25 bp, Mus musculus
ctagaagcattgaaagcttttgtgg

SEQ ID NO: 612477 - DNA, 25 bp, Mus musculus
ctagaagcattgtaagcttttgtgg

SEQ ID NO: 612478 - DNA, 25 bp, Mus musculus
ctagaagcccctccgtgagaagcct

SEQ ID NO: 612479 - DNA, 25 bp, Mus musculus
ctagaagcccctgcgtgagaagcct

SEQ ID NO: 612480 - DNA, 25 bp, Mus musculus
ctagaaggacatccggaaaaagaag

SEQ ID NO: 612481 - DNA, 25 bp, Mus musculus
ctagaaggacatgcggaaaaagaag

SEQ ID NO: 612482 - DNA, 25 bp, Mus musculus
ctagaaggctggactgaggccagac

SEQ ID NO: 612483 - DNA, 25 bp, Mus musculus
ctagaaggctggtctgaggccagac

SEQ ID NO: 612484 - DNA, 25 bp, Mus musculus
ctagaagttgaactaatcctcctgc

SEQ ID NO: 612485 - DNA, 25 bp, Mus musculus
ctagaagttgaagtaatcctcctgc

SEQ ID NO: 612486 - DNA, 25 bp, Mus musculus
ctagaatgctatctccagcggaggg

SEQ ID NO: 612487 - DNA, 25 bp, Mus musculus
ctagaatgctatgtccagcggaggg

SEQ ID NO: 612488 - DNA, 25 bp, Mus musculus
ctagaattagtgagtccggagccgc

SEQ ID NO: 612489 - DNA, 25 bp, Mus musculus
ctagaattagtgtgtccggagccgc

SEQ ID NO: 612490 - DNA, 25 bp, Mus musculus
ctagaatttagacctcgggtgggtc

SEQ ID NO: 612491 - DNA, 25 bp, Mus musculus
ctagaatttagagctcgggtgggtc

SEQ ID NO: 612492 - DNA, 25 bp, Mus musculus
ctagacaagaacctccgtttggcca

SEQ ID NO: 612493 - DNA, 25 bp, Mus musculus
ctagacaagaacgtccgtttggcca

SEQ ID NO: 612494 - DNA, 25 bp, Mus musculus
ctagacacctctctgctgcagacgg

SEQ ID NO: 612495 - DNA, 25 bp, Mus musculus
ctagacacctctgtgctgcagacgg

SEQ ID NO: 612496 - DNA, 25 bp, Mus musculus
ctagaccagggaaagcagcgggcaa

SEQ ID NO: 612497 - DNA, 25 bp, Mus musculus
ctagaccagggatagcagcgggcaa

SEQ ID NO: 612498 - DNA, 25 bp, Mus musculus
ctagaccccagcaagaggaatgtgg

SEQ ID NO: 612499 - DNA, 25 bp, Mus musculus
ctagaccccagctagaggaatgtgg

SEQ ID NO: 612500 - DNA, 25 bp, Mus musculus
ctagacccctttagtgaatttcact

SEQ ID NO: 612501 - DNA, 25 bp, Mus musculus
ctagaccccttttgtgaatttcact

SEQ ID NO: 612502 - DNA, 25 bp, Mus musculus
ctagacctcgggacccgcgagcagg

SEQ ID NO: 612503 - DNA, 25 bp, Mus musculus
ctagacctcgggtcccgcgagcagg

SEQ ID NO: 612504 - DNA, 25 bp, Mus musculus
ctagacctgcggaggtgatagcagc

SEQ ID NO: 612505 - DNA, 25 bp, Mus musculus
ctagacctgcggtggtgatagcagc

SEQ ID NO: 612506 - DNA, 25 bp, Mus musculus
ctagacgataaacgccaaatactga

SEQ ID NO: 612507 - DNA, 25 bp, Mus musculus
ctagacgataaaggccaaatactga

SEQ ID NO: 612508 - DNA, 25 bp, Mus musculus
ctagagaaaaacagtcaattgtggg

SEQ ID NO: 612509 - DNA, 25 bp, Mus musculus
ctagagaaaaactgtcaattgtggg

SEQ ID NO: 612510 - DNA, 25 bp, Mus musculus
ctagagaaagaacgcacatgatcct

SEQ ID NO: 612511 - DNA, 25 bp, Mus musculus
ctagagaaagaaggcacatgatcct

SEQ ID NO: 612512 - DNA, 25 bp, Mus musculus
ctagagaaagtcatcgagatccaga

SEQ ID NO: 612513 - DNA, 25 bp, Mus musculus
ctagagaaagtcttcgagatccaga

SEQ ID NO: 612514 - DNA, 25 bp, Mus musculus
ctagagaacactcttcacttcagtc

SEQ ID NO: 612515 - DNA, 25 bp, Mus musculus
ctagagaacactgttcacttcagtc

SEQ ID NO: 612516 - DNA, 25 bp, Mus musculus
ctagagaacgtccttatgtcctggg

SEQ ID NO: 612517 - DNA, 25 bp, Mus musculus
ctagagaacgtcgttatgtcctggg

SEQ ID NO: 612518 - DNA, 25 bp, Mus musculus
ctagagaagattagaagagtggtac

SEQ ID NO: 612519 - DNA, 25 bp, Mus musculus
ctagagaagatttgaagagtggtac

SEQ ID NO: 612520 - DNA, 25 bp, Mus musculus
ctagagacgcttccagaggaaatgg

SEQ ID NO: 612521 - DNA, 25 bp, Mus musculus
ctagagacgcttgcagaggaaatgg

SEQ ID NO: 612522 - DNA, 25 bp, Mus musculus
ctagagagaagtcaaattacctggg

SEQ ID NO: 612523 - DNA, 25 bp, Mus musculus
ctagagagaagtgaaattacctggg

SEQ ID NO: 612524 - DNA, 25 bp, Mus musculus
ctagagagctggctgactgctcaat

SEQ ID NO: 612525 - DNA, 25 bp, Mus musculus
ctagagagctgggtgactgctcaat

SEQ ID NO: 612526 - DNA, 25 bp, Mus musculus
ctagagaggctgactattcctgact

SEQ ID NO: 612527 - DNA, 25 bp, Mus musculus
ctagagaggctgtctattcctgact

SEQ ID NO: 612528 - DNA, 25 bp, Mus musculus
ctagagatcaagatccagtaccggg

SEQ ID NO: 612529 - DNA, 25 bp, Mus musculus
ctagagatcaagttccagtaccggg

SEQ ID NO: 612530 - DNA, 25 bp, Mus musculus
ctagagatcgtaatctgcaaacgga

SEQ ID NO: 612531 - DNA, 25 bp, Mus musculus
ctagagatcgtattctgcaaacgga

SEQ ID NO: 612532 - DNA, 25 bp, Mus musculus
ctagagatggttcgtcatcctggga

SEQ ID NO: 612533 - DNA, 25 bp, Mus musculus
ctagagatggttggtcatcctggga

SEQ ID NO: 612534 - DNA, 25 bp, Mus musculus
ctagagcacaagcagattgacggcc

SEQ ID NO: 612535 - DNA, 25 bp, Mus musculus
ctagagcacaaggagattgacggcc

SEQ ID NO: 612536 - DNA, 25 bp, Mus musculus
ctagagcagtgcaggtcaataggct

SEQ ID NO: 612537 - DNA, 25 bp, Mus musculus
ctagagcagtgctggtcaataggct

SEQ ID NO: 612538 - DNA, 25 bp, Mus musculus
ctagagcataggctcagaagactcc

SEQ ID NO: 612539 - DNA, 25 bp, Mus musculus
ctagagcatagggtcagaagactcc

SEQ ID NO: 612540 - DNA, 25 bp, Mus musculus
ctagagctaaaaatgaccttggact

SEQ ID NO: 612541 - DNA, 25 bp, Mus musculus
ctagagctaaaattgaccttggact

SEQ ID NO: 612542 - DNA, 25 bp, Mus musculus
ctagagctagctactgaccaccacg

SEQ ID NO: 612543 - DNA, 25 bp, Mus musculus
ctagagctagcttctgaccaccacg

SEQ ID NO: 612544 - DNA, 25 bp, Mus musculus
ctagagcttggtcggattgcagcca

SEQ ID NO: 612545 - DNA, 25 bp, Mus musculus
ctagagcttggtgggattgcagcca

SEQ ID NO: 612546 - DNA, 25 bp, Mus musculus
ctagaggcttaaccataataaaatc

SEQ ID NO: 612547 - DNA, 25 bp, Mus musculus
ctagaggcttaagcataataaaatc

SEQ ID NO: 612548 - DNA, 25 bp, Mus musculus
ctagaggtgcgacccgcgccataag

SEQ ID NO: 612549 - DNA, 25 bp, Mus musculus
ctagaggtgcgagccgcgccataag

SEQ ID NO: 612550 - DNA, 25 bp, Mus musculus
ctagagtaaggaaccacaaggcctt

SEQ ID NO: 612551 - DNA, 25 bp, Mus musculus
ctagagtaaggatccacaaggcctt

SEQ ID NO: 612552 - DNA, 25 bp, Mus musculus
ctagagtctagtaatcaggcacctg

SEQ ID NO: 612553 - DNA, 25 bp, Mus musculus
ctagagtctagttatcaggcacctg

SEQ ID NO: 612554 - DNA, 25 bp, Mus musculus
ctagataagactcagtttgccagta

SEQ ID NO: 612555 - DNA, 25 bp, Mus musculus
ctagataagactgagtttgccagta

SEQ ID NO: 612556 - DNA, 25 bp, Mus musculus
ctagatccaaagacggagaaggctg

SEQ ID NO: 612557 - DNA, 25 bp, Mus musculus
ctagatccaaagtcggagaaggctg

SEQ ID NO: 612558 - DNA, 25 bp, Mus musculus
ctagatcctaaaattgctcagaacc

SEQ ID NO: 612559 - DNA, 25 bp, Mus musculus
ctagatcctaaatttgctcagaacc

SEQ ID NO: 612560 - DNA, 25 bp, Mus musculus
ctagatccttgaatggagagaaaag

SEQ ID NO: 612561 - DNA, 25 bp, Mus musculus
ctagatccttgattggagagaaaag

SEQ ID NO: 612562 - DNA, 25 bp, Mus musculus
ctagatcgggcacaagagcgcagac

SEQ ID NO: 612563 - DNA, 25 bp, Mus musculus
ctagatcgggcagaagagcgcagac

SEQ ID NO: 612564 - DNA, 25 bp, Mus musculus
ctagatctccagatgtattttgtca

SEQ ID NO: 612565 - DNA, 25 bp, Mus musculus
ctagatctccagttgtattttgtca

SEQ ID NO: 612566 - DNA, 25 bp, Mus musculus
ctagatgacagacggctcaggctcc

SEQ ID NO: 612567 - DNA, 25 bp, Mus musculus
ctagatgacagagggctcaggctcc

SEQ ID NO: 612568 - DNA, 25 bp, Mus musculus
ctagatgagggcatgcagatcccat

SEQ ID NO: 612569 - DNA, 25 bp, Mus musculus
ctagatgagggcttgcagatcccat

SEQ ID NO: 612570 - DNA, 25 bp, Mus musculus
ctagatgattccataaatatgaaac

SEQ ID NO: 612571 - DNA, 25 bp, Mus musculus
ctagatgattccttaaatatgaaac

SEQ ID NO: 612572 - DNA, 25 bp, Mus musculus
ctagatgcccggcagcagagcaccg

SEQ ID NO: 612573 - DNA, 25 bp, Mus musculus
ctagatgcccgggagcagagcaccg

SEQ ID NO: 612574 - DNA, 25 bp, Mus musculus
ctagatgcctggagccagagttaca

SEQ ID NO: 612575 - DNA, 25 bp, Mus musculus
ctagatgcctggtgccagagttaca

SEQ ID NO: 612576 - DNA, 25 bp, Mus musculus
ctagatggcaaacaaataaagcaac

SEQ ID NO: 612577 - DNA, 25 bp, Mus musculus
ctagatggcaaagaaataaagcaac

SEQ ID NO: 612578 - DNA, 25 bp, Mus musculus
ctagatgtgcctcacctgctgacca

SEQ ID NO: 612579 - DNA, 25 bp, Mus musculus
ctagatgtgcctgacctgctgacca

SEQ ID NO: 612580 - DNA, 25 bp, Mus musculus
ctagattctagcaaatcatgtgtga

SEQ ID NO: 612581 - DNA, 25 bp, Mus musculus
ctagattctagctaatcatgtgtga

SEQ ID NO: 612582 - DNA, 25 bp, Mus musculus
ctagattctgttcgtgaaatcttcc

SEQ ID NO: 612583 - DNA, 25 bp, Mus musculus
ctagattctgttggtgaaatcttcc

SEQ ID NO: 612584 - DNA, 25 bp, Mus musculus
ctagcaaaagttctagcgccaggct

SEQ ID NO: 612585 - DNA, 25 bp, Mus musculus
ctagcaaaagttgtagcgccaggct

SEQ ID NO: 612586 - DNA, 25 bp, Mus musculus
ctagcaacggtgctgtgttactgag

SEQ ID NO: 612587 - DNA, 25 bp, Mus musculus
ctagcaacggtggtgtgttactgag

SEQ ID NO: 612588 - DNA, 25 bp, Mus musculus
ctagcaagactgatgtggatgatga

SEQ ID NO: 612589 - DNA, 25 bp, Mus musculus
ctagcaagactgttgtggatgatga

SEQ ID NO: 612590 - DNA, 25 bp, Mus musculus
ctagcaagcggaccgacgagctcag

SEQ ID NO: 612591 - DNA, 25 bp, Mus musculus
ctagcaagcggagcgacgagctcag

SEQ ID NO: 612592 - DNA, 25 bp, Mus musculus
ctagcaaggaagattcgttcagacc

SEQ ID NO: 612593 - DNA, 25 bp, Mus musculus
ctagcaaggaagtttcgttcagacc

SEQ ID NO: 612594 - DNA, 25 bp, Mus musculus
ctagcacgttctcacagtattgtcc

SEQ ID NO: 612595 - DNA, 25 bp, Mus musculus
ctagcacgttctgacagtattgtcc

SEQ ID NO: 612596 - DNA, 25 bp, Mus musculus
ctagcactactacggagagccacca

SEQ ID NO: 612597 - DNA, 25 bp, Mus musculus
ctagcactactagggagagccacca

SEQ ID NO: 612598 - DNA, 25 bp, Mus musculus
ctagcagagaccaccaagggactct

SEQ ID NO: 612599 - DNA, 25 bp, Mus musculus
ctagcagagacctccaagggactct

SEQ ID NO: 612600 - DNA, 25 bp, Mus musculus
ctagcagccaaaatagatctacctg

SEQ ID NO: 612601 - DNA, 25 bp, Mus musculus
ctagcagccaaattagatctacctg

SEQ ID NO: 612602 - DNA, 25 bp, Mus musculus
ctagcagccacaaagagacccgggc

SEQ ID NO: 612603 - DNA, 25 bp, Mus musculus
ctagcagccacatagagacccgggc

SEQ ID NO: 612604 - DNA, 25 bp, Mus musculus
ctagcagtaaccaacaccaccatga

SEQ ID NO: 612605 - DNA, 25 bp, Mus musculus
ctagcagtaacctacaccaccatga

SEQ ID NO: 612606 - DNA, 25 bp, Mus musculus
ctagcatctcagacttcaagctgtg

SEQ ID NO: 612607 - DNA, 25 bp, Mus musculus
ctagcatctcagtcttcaagctgtg

SEQ ID NO: 612608 - DNA, 25 bp, Mus musculus
ctagcattaaagcaaaacatcaaaa

SEQ ID NO: 612609 - DNA, 25 bp, Mus musculus
ctagcattaaaggaaaacatcaaaa

SEQ ID NO: 612610 - DNA, 25 bp, Mus musculus
ctagccactcttcgaggaagccaag

SEQ ID NO: 612611 - DNA, 25 bp, Mus musculus
ctagccactcttggaggaagccaag

SEQ ID NO: 612612 - DNA, 25 bp, Mus musculus
ctagcccgatatctcttccagtcag

SEQ ID NO: 612613 - DNA, 25 bp, Mus musculus
ctagcccgatatgtcttccagtcag

SEQ ID NO: 612614 - DNA, 25 bp, Mus musculus
ctagccgaccggcaagtagctgaag

SEQ ID NO: 612615 - DNA, 25 bp, Mus musculus
ctagccgaccgggaagtagctgaag

SEQ ID NO: 612616 - DNA, 25 bp, Mus musculus
ctagccgggaggatgaaaggcctca

SEQ ID NO: 612617 - DNA, 25 bp, Mus musculus
ctagccgggaggttgaaaggcctca

SEQ ID NO: 612618 - DNA, 25 bp, Mus musculus
ctagcctgacctcccgaggtgctga

SEQ ID NO: 612619 - DNA, 25 bp, Mus musculus
ctagcctgacctgccgaggtgctga

SEQ ID NO: 612620 - DNA, 25 bp, Mus musculus
ctagccttcctcaaccagtcggtta

SEQ ID NO: 612621 - DNA, 25 bp, Mus musculus
ctagccttcctctaccagtcggtta

SEQ ID NO: 612622 - DNA, 25 bp, Mus musculus
ctagcgacctccagagggccaggat

SEQ ID NO: 612623 - DNA, 25 bp, Mus musculus
ctagcgacctcctgagggccaggat

SEQ ID NO: 612624 - DNA, 25 bp, Mus musculus
ctagcgagacagcaggatattactt

SEQ ID NO: 612625 - DNA, 25 bp, Mus musculus
ctagcgagacaggaggatattactt

SEQ ID NO: 612626 - DNA, 25 bp, Mus musculus
ctagcgcgtccactgtaggccctgt

SEQ ID NO: 612627 - DNA, 25 bp, Mus musculus
ctagcgcgtccagtgtaggccctgt

SEQ ID NO: 612628 - DNA, 25 bp, Mus musculus
ctagcggctacacaggaattgcatc

SEQ ID NO: 612629 - DNA, 25 bp, Mus musculus
ctagcggctacagaggaattgcatc

SEQ ID NO: 612630 - DNA, 25 bp, Mus musculus
ctagcgggagtcaccaagagtagcg

SEQ ID NO: 612631 - DNA, 25 bp, Mus musculus
ctagcgggagtctccaagagtagcg

SEQ ID NO: 612632 - DNA, 25 bp, Mus musculus
ctagcgggctggcttttatctccac

SEQ ID NO: 612633 - DNA, 25 bp, Mus musculus
ctagcgggctgggttttatctccac

SEQ ID NO: 612634 - DNA, 25 bp, Mus musculus
ctagctaccttaaaggagctgaagc

SEQ ID NO: 612635 - DNA, 25 bp, Mus musculus
ctagctaccttataggagctgaagc

SEQ ID NO: 612636 - DNA, 25 bp, Mus musculus
ctagctaggaaaagcgcgtgcaggt

SEQ ID NO: 612637 - DNA, 25 bp, Mus musculus
ctagctaggaaatgcgcgtgcaggt

SEQ ID NO: 612638 - DNA, 25 bp, Mus musculus
ctagctcagattcatacaaggtcgg

SEQ ID NO: 612639 - DNA, 25 bp, Mus musculus
ctagctcagattgatacaaggtcgg

SEQ ID NO: 612640 - DNA, 25 bp, Mus musculus
ctagctcctgtaagttcagtcccca

SEQ ID NO: 612641 - DNA, 25 bp, Mus musculus
ctagctcctgtatgttcagtcccca

SEQ ID NO: 612642 - DNA, 25 bp, Mus musculus
ctagctctgcatacttgaccacgtc

SEQ ID NO: 612643 - DNA, 25 bp, Mus musculus
ctagctctgcattcttgaccacgtc

SEQ ID NO: 612644 - DNA, 25 bp, Mus musculus
ctagctgagttaaccacagggtaca

SEQ ID NO: 612645 - DNA, 25 bp, Mus musculus
ctagctgagttatccacagggtaca

SEQ ID NO: 612646 - DNA, 25 bp, Mus musculus
ctagctgcggagcatctgaaggccc

SEQ ID NO: 612647 - DNA, 25 bp, Mus musculus
ctagctgcggaggatctgaaggccc

SEQ ID NO: 612648 - DNA, 25 bp, Mus musculus
ctagctggagttcgtactattgtcc

SEQ ID NO: 612649 - DNA, 25 bp, Mus musculus
ctagctggagttggtactattgtcc

SEQ ID NO: 612650 - DNA, 25 bp, Mus musculus
ctagctgggctcagcttgagacggc

SEQ ID NO: 612651 - DNA, 25 bp, Mus musculus
ctagctgggctctgcttgagacggc

SEQ ID NO: 612652 - DNA, 25 bp, Mus musculus
ctagctggggcgctgaaccatcatg

SEQ ID NO: 612653 - DNA, 25 bp, Mus musculus
ctagctggggcggtgaaccatcatg

SEQ ID NO: 612654 - DNA, 25 bp, Mus musculus
ctagctgtctcccaatagaggaata

SEQ ID NO: 612655 - DNA, 25 bp, Mus musculus
ctagctgtctccgaatagaggaata

SEQ ID NO: 612656 - DNA, 25 bp, Mus musculus
ctagctgtgctaagtgaaaggagga

SEQ ID NO: 612657 - DNA, 25 bp, Mus musculus
ctagctgtgctatgtgaaaggagga

SEQ ID NO: 612658 - DNA, 25 bp, Mus musculus
ctagctgtgttacccgtcttgttta

SEQ ID NO: 612659 - DNA, 25 bp, Mus musculus
ctagctgtgttagccgtcttgttta

SEQ ID NO: 612660 - DNA, 25 bp, Mus musculus
ctagcttatttaaagtctgtctgac

SEQ ID NO: 612661 - DNA, 25 bp, Mus musculus
ctagcttatttatagtctgtctgac

SEQ ID NO: 612662 - DNA, 25 bp, Mus musculus
ctagcttcctcgcttacaaccgaaa

SEQ ID NO: 612663 - DNA, 25 bp, Mus musculus
ctagcttcctcggttacaaccgaaa

SEQ ID NO: 612664 - DNA, 25 bp, Mus musculus
ctagcttggctactggcttataatg

SEQ ID NO: 612665 - DNA, 25 bp, Mus musculus
ctagcttggctagtggcttataatg

SEQ ID NO: 612666 - DNA, 25 bp, Mus musculus
ctaggaaaaggtcgagaaagtgctc

SEQ ID NO: 612667 - DNA, 25 bp, Mus musculus
ctaggaaaaggtggagaaagtgctc

SEQ ID NO: 612668 - DNA, 25 bp, Mus musculus
ctaggaaacaggagcctaaagctgc

SEQ ID NO: 612669 - DNA, 25 bp, Mus musculus
ctaggaaacaggtgcctaaagctgc

SEQ ID NO: 612670 - DNA, 25 bp, Mus musculus
ctaggaaagatgaagctccttcatt

SEQ ID NO: 612671 - DNA, 25 bp, Mus musculus
ctaggaaagatgtagctccttcatt

SEQ ID NO: 612672 - DNA, 25 bp, Mus musculus
ctaggaacaaaaccccacagtgtgc

SEQ ID NO: 612673 - DNA, 25 bp, Mus musculus
ctaggaacaaaagcccacagtgtgc

SEQ ID NO: 612674 - DNA, 25 bp, Mus musculus
ctaggaaccgacactggccatccat

SEQ ID NO: 612675 - DNA, 25 bp, Mus musculus
ctaggaaccgactctggccatccat

SEQ ID NO: 612676 - DNA, 25 bp, Mus musculus
ctaggaatccatactatgcgtgcct

SEQ ID NO: 612677 - DNA, 25 bp, Mus musculus
ctaggaatccattctatgcgtgcct

SEQ ID NO: 612678 - DNA, 25 bp, Mus musculus
ctaggaatgagaatctacagtggga

SEQ ID NO: 612679 - DNA, 25 bp, Mus musculus
ctaggaatgagattctacagtggga

SEQ ID NO: 612680 - DNA, 25 bp, Mus musculus
ctaggacagagcacgggcaactgct

SEQ ID NO: 612681 - DNA, 25 bp, Mus musculus
ctaggacagagctcgggcaactgct

SEQ ID NO: 612682 - DNA, 25 bp, Mus musculus
ctaggactccacccggtctggtcag

SEQ ID NO: 612683 - DNA, 25 bp, Mus musculus
ctaggactccacgcggtctggtcag

SEQ ID NO: 612684 - DNA, 25 bp, Mus musculus
ctaggactgggacattacagaggca

SEQ ID NO: 612685 - DNA, 25 bp, Mus musculus
ctaggactgggagattacagaggca

SEQ ID NO: 612686 - DNA, 25 bp, Mus musculus
ctaggacttggaaaagcgtggcgtt

SEQ ID NO: 612687 - DNA, 25 bp, Mus musculus
ctaggacttggataagcgtggcgtt

SEQ ID NO: 612688 - DNA, 25 bp, Mus musculus
ctaggagaagatccaataaaaaact

SEQ ID NO: 612689 - DNA, 25 bp, Mus musculus
ctaggagaagatgcaataaaaaact

SEQ ID NO: 612690 - DNA, 25 bp, Mus musculus
ctaggagccagcctcggtggtcatc

SEQ ID NO: 612691 - DNA, 25 bp, Mus musculus
ctaggagccagcgtcggtggtcatc

SEQ ID NO: 612692 - DNA, 25 bp, Mus musculus
ctaggagctccgcttctgtcggagc

SEQ ID NO: 612693 - DNA, 25 bp, Mus musculus
ctaggagctccggttctgtcggagc

SEQ ID NO: 612694 - DNA, 25 bp, Mus musculus
ctaggaggccatccttgaatccagc

SEQ ID NO: 612695 - DNA, 25 bp, Mus musculus
ctaggaggccatgcttgaatccagc

SEQ ID NO: 612696 - DNA, 25 bp, Mus musculus
ctaggagggccgaggaatagaaata

SEQ ID NO: 612697 - DNA, 25 bp, Mus musculus
ctaggagggccgtggaatagaaata

SEQ ID NO: 612698 - DNA, 25 bp, Mus musculus
ctaggagtgttcctgcagctgatgc

SEQ ID NO: 612699 - DNA, 25 bp, Mus musculus
ctaggagtgttcgtgcagctgatgc

SEQ ID NO: 612700 - DNA, 25 bp, Mus musculus
ctaggagttgctccatataaactgg

SEQ ID NO: 612701 - DNA, 25 bp, Mus musculus
ctaggagttgctgcatataaactgg

SEQ ID NO: 612702 - DNA, 25 bp, Mus musculus
ctaggatccgggagtttgtgccacc

SEQ ID NO: 612703 - DNA, 25 bp, Mus musculus
ctaggatccgggtgtttgtgccacc

SEQ ID NO: 612704 - DNA, 25 bp, Mus musculus
ctaggcacctacatgggccacactg

SEQ ID NO: 612705 - DNA, 25 bp, Mus musculus
ctaggcacctacttgggccacactg

SEQ ID NO: 612706 - DNA, 25 bp, Mus musculus
ctaggcaggcatcaaagtaaggaag

SEQ ID NO: 612707 - DNA, 25 bp, Mus musculus
ctaggcaggcatgaaagtaaggaag

SEQ ID NO: 612708 - DNA, 25 bp, Mus musculus
ctaggcaggctcattgcatccttcc

SEQ ID NO: 612709 - DNA, 25 bp, Mus musculus
ctaggcaggctctttgcatccttcc

SEQ ID NO: 612710 - DNA, 25 bp, Mus musculus
ctaggccttggcatgtggcttggct

SEQ ID NO: 612711 - DNA, 25 bp, Mus musculus
ctaggccttggcttgtggcttggct

SEQ ID NO: 612712 - DNA, 25 bp, Mus musculus
ctaggctgtaagcatctcgtgggct

SEQ ID NO: 612713 - DNA, 25 bp, Mus musculus
ctaggctgtaaggatctcgtgggct

SEQ ID NO: 612714 - DNA, 25 bp, Mus musculus
ctaggctgtgtgctttatgccatga

SEQ ID NO: 612715 - DNA, 25 bp, Mus musculus
ctaggctgtgtggtttatgccatga

SEQ ID NO: 612716 - DNA, 25 bp, Mus musculus
ctagggaagcggacacgtcagtgcc

SEQ ID NO: 612717 - DNA, 25 bp, Mus musculus
ctagggaagcggtcacgtcagtgcc

SEQ ID NO: 612718 - DNA, 25 bp, Mus musculus
ctagggacccagactgcagagaatg

SEQ ID NO: 612719 - DNA, 25 bp, Mus musculus
ctagggacccagtctgcagagaatg

SEQ ID NO: 612720 - DNA, 25 bp, Mus musculus
ctagggagaggccaactcggatacc

SEQ ID NO: 612721 - DNA, 25 bp, Mus musculus
ctagggagaggcgaactcggatacc

SEQ ID NO: 612722 - DNA, 25 bp, Mus musculus
ctagggatatgtaagccacagtttc

SEQ ID NO: 612723 - DNA, 25 bp, Mus musculus
ctagggatatgttagccacagtttc

SEQ ID NO: 612724 - DNA, 25 bp, Mus musculus
ctagggccagcccttgccaacagtt

SEQ ID NO: 612725 - DNA, 25 bp, Mus musculus
ctagggccagccgttgccaacagtt

SEQ ID NO: 612726 - DNA, 25 bp, Mus musculus
ctagggccagggaacagctgtgact

SEQ ID NO: 612727 - DNA, 25 bp, Mus musculus
ctagggccagggtacagctgtgact

SEQ ID NO: 612728 - DNA, 25 bp, Mus musculus
ctagggcgttcaccacaagcatgga

SEQ ID NO: 612729 - DNA, 25 bp, Mus musculus
ctagggcgttcagcacaagcatgga

SEQ ID NO: 612730 - DNA, 25 bp, Mus musculus
ctagggctgcagataaggctgttgc

SEQ ID NO: 612731 - DNA, 25 bp, Mus musculus
ctagggctgcagttaaggctgttgc

SEQ ID NO: 612732 - DNA, 25 bp, Mus musculus
ctagggtactcgagccccgaagtgg

SEQ ID NO: 612733 - DNA, 25 bp, Mus musculus
ctagggtactcgtgccccgaagtgg

SEQ ID NO: 612734 - DNA, 25 bp, Mus musculus
ctagggtatggaccaattccactaa

SEQ ID NO: 612735 - DNA, 25 bp, Mus musculus
ctagggtatggagcaattccactaa

SEQ ID NO: 612736 - DNA, 25 bp, Mus musculus
ctagggtcactacagctaagcttgc

SEQ ID NO: 612737 - DNA, 25 bp, Mus musculus
ctagggtcactagagctaagcttgc

SEQ ID NO: 612738 - DNA, 25 bp, Mus musculus
ctagggtgcacacctggacatttgg

SEQ ID NO: 612739 - DNA, 25 bp, Mus musculus
ctagggtgcacagctggacatttgg

SEQ ID NO: 612740 - DNA, 25 bp, Mus musculus
ctagggtgtttaactctgatgataa

SEQ ID NO: 612741 - DNA, 25 bp, Mus musculus
ctagggtgtttatctctgatgataa

SEQ ID NO: 612742 - DNA, 25 bp, Mus musculus
ctaggtacatctatacaatgctcag

SEQ ID NO: 612743 - DNA, 25 bp, Mus musculus
ctaggtacatctttacaatgctcag

SEQ ID NO: 612744 - DNA, 25 bp, Mus musculus
ctaggtattaaactggagtagctat

SEQ ID NO: 612745 - DNA, 25 bp, Mus musculus
ctaggtattaaagtggagtagctat

SEQ ID NO: 612746 - DNA, 25 bp, Mus musculus
ctaggtcttatactggaagaggcag

SEQ ID NO: 612747 - DNA, 25 bp, Mus musculus
ctaggtcttatagtggaagaggcag

SEQ ID NO: 612748 - DNA, 25 bp, Mus musculus
ctaggtgccatgctgcgcaggacct

SEQ ID NO: 612749 - DNA, 25 bp, Mus musculus
ctaggtgccatggtgcgcaggacct

SEQ ID NO: 612750 - DNA, 25 bp, Mus musculus
ctaggtgctcttccgtcacttggca

SEQ ID NO: 612751 - DNA, 25 bp, Mus musculus
ctaggtgctcttgcgtcacttggca

SEQ ID NO: 612752 - DNA, 25 bp, Mus musculus
ctaggtggctgcatgggacattccc

SEQ ID NO: 612753 - DNA, 25 bp, Mus musculus
ctaggtggctgcttgggacattccc

SEQ ID NO: 612754 - DNA, 25 bp, Mus musculus
ctaggtggttgcctatctgaacggt

SEQ ID NO: 612755 - DNA, 25 bp, Mus musculus
ctaggtggttgcgtatctgaacggt

SEQ ID NO: 612756 - DNA, 25 bp, Mus musculus
ctaggttaggagagcccagagcagc

SEQ ID NO: 612757 - DNA, 25 bp, Mus musculus
ctaggttaggagtgcccagagcagc

SEQ ID NO: 612758 - DNA, 25 bp, Mus musculus
ctaggtttggatcttgctatgacaa

SEQ ID NO: 612759 - DNA, 25 bp, Mus musculus
ctaggtttggatgttgctatgacaa

SEQ ID NO: 612760 - DNA, 25 bp, Mus musculus
ctagtaaatggacccaggattccag

SEQ ID NO: 612761 - DNA, 25 bp, Mus musculus
ctagtaaatggagccaggattccag

SEQ ID NO: 612762 - DNA, 25 bp, Mus musculus
ctagtaactgcacaacaagaggccc

SEQ ID NO: 612763 - DNA, 25 bp, Mus musculus
ctagtaactgcagaacaagaggccc

SEQ ID NO: 612764 - DNA, 25 bp, Mus musculus
ctagtaagcgctacgaagtgcccct

SEQ ID NO: 612765 - DNA, 25 bp, Mus musculus
ctagtaagcgcttcgaagtgcccct

SEQ ID NO: 612766 - DNA, 25 bp, Mus musculus
ctagtaccgctacaagctgctggcg

SEQ ID NO: 612767 - DNA, 25 bp, Mus musculus
ctagtaccgctagaagctgctggcg

SEQ ID NO: 612768 - DNA, 25 bp, Mus musculus
ctagtactgactaataggagggtcc

SEQ ID NO: 612769 - DNA, 25 bp, Mus musculus
ctagtactgacttataggagggtcc

SEQ ID NO: 612770 - DNA, 25 bp, Mus musculus
ctagtagaataccacacccgaatcc

SEQ ID NO: 612771 - DNA, 25 bp, Mus musculus
ctagtagaatacgacacccgaatcc

SEQ ID NO: 612772 - DNA, 25 bp, Mus musculus
ctagtagagacactgggcccagcac

SEQ ID NO: 612773 - DNA, 25 bp, Mus musculus
ctagtagagacagtgggcccagcac

SEQ ID NO: 612774 - DNA, 25 bp, Mus musculus
ctagtagtttccagggcgctgacgc

SEQ ID NO: 612775 - DNA, 25 bp, Mus musculus
ctagtagtttcctgggcgctgacgc

SEQ ID NO: 612776 - DNA, 25 bp, Mus musculus
ctagtatcagatatgagaagtagca

SEQ ID NO: 612777 - DNA, 25 bp, Mus musculus
ctagtatcagatttgagaagtagca

SEQ ID NO: 612778 - DNA, 25 bp, Mus musculus
ctagtatggccaatgaagaagatga

SEQ ID NO: 612779 - DNA, 25 bp, Mus musculus
ctagtatggccattgaagaagatga

SEQ ID NO: 612780 - DNA, 25 bp, Mus musculus
ctagtatgtttcacagtggtctctc

SEQ ID NO: 612781 - DNA, 25 bp, Mus musculus
ctagtatgtttctcagtggtctctc

SEQ ID NO: 612782 - DNA, 25 bp, Mus musculus
ctagtcaaaggaccagatctcagag

SEQ ID NO: 612783 - DNA, 25 bp, Mus musculus
ctagtcaaaggagcagatctcagag

SEQ ID NO: 612784 - DNA, 25 bp, Mus musculus
ctagtccaggctatcactgaagatc

SEQ ID NO: 612785 - DNA, 25 bp, Mus musculus
ctagtccaggctttcactgaagatc

SEQ ID NO: 612786 - DNA, 25 bp, Mus musculus
ctagtctatcttaaggcgtggtggc

SEQ ID NO: 612787 - DNA, 25 bp, Mus musculus
ctagtctatctttaggcgtggtggc

SEQ ID NO: 612788 - DNA, 25 bp, Mus musculus
ctagtctcttgaaggatatccttcc

SEQ ID NO: 612789 - DNA, 25 bp, Mus musculus
ctagtctcttgatggatatccttcc

SEQ ID NO: 612790 - DNA, 25 bp, Mus musculus
ctagtctgtactcctcagagggtgg

SEQ ID NO: 612791 - DNA, 25 bp, Mus musculus
ctagtctgtactgctcagagggtgg

SEQ ID NO: 612792 - DNA, 25 bp, Mus musculus
ctagtgaatggcataataccgaggg

SEQ ID NO: 612793 - DNA, 25 bp, Mus musculus
ctagtgaatggcttaataccgaggg

SEQ ID NO: 612794 - DNA, 25 bp, Mus musculus
ctagtgaggaatctcaaggaagcag

SEQ ID NO: 612795 - DNA, 25 bp, Mus musculus
ctagtgaggaatgtcaaggaagcag

SEQ ID NO: 612796 - DNA, 25 bp, Mus musculus
ctagtgaggcccagcaacctgccag

SEQ ID NO: 612797 - DNA, 25 bp, Mus musculus
ctagtgaggccctgcaacctgccag

SEQ ID NO: 612798 - DNA, 25 bp, Mus musculus
ctagtgattcaacttcatccacaga

SEQ ID NO: 612799 - DNA, 25 bp, Mus musculus
ctagtgattcaagttcatccacaga

SEQ ID NO: 612800 - DNA, 25 bp, Mus musculus
ctagtgcgcttccttctgtccaggg

SEQ ID NO: 612801 - DNA, 25 bp, Mus musculus
ctagtgcgcttcgttctgtccaggg

SEQ ID NO: 612802 - DNA, 25 bp, Mus musculus
ctagtgcggtgcagtgagaagtatc

SEQ ID NO: 612803 - DNA, 25 bp, Mus musculus
ctagtgcggtgctgtgagaagtatc

SEQ ID NO: 612804 - DNA, 25 bp, Mus musculus
ctagtgctgaagacaccagccctgc

SEQ ID NO: 612805 - DNA, 25 bp, Mus musculus
ctagtgctgaagtcaccagccctgc

SEQ ID NO: 612806 - DNA, 25 bp, Mus musculus
ctagtggagctgctgcctcagtatc

SEQ ID NO: 612807 - DNA, 25 bp, Mus musculus
ctagtggagctggtgcctcagtatc

SEQ ID NO: 612808 - DNA, 25 bp, Mus musculus
ctagtggcaaggatagtgggtcctt

SEQ ID NO: 612809 - DNA, 25 bp, Mus musculus
ctagtggcaaggttagtgggtcctt

SEQ ID NO: 612810 - DNA, 25 bp, Mus musculus
ctagtggcctggaaccacccctgag

SEQ ID NO: 612811 - DNA, 25 bp, Mus musculus
ctagtggcctggtaccacccctgag

SEQ ID NO: 612812 - DNA, 25 bp, Mus musculus
ctagtggtcaagcagaacctgacct

SEQ ID NO: 612813 - DNA, 25 bp, Mus musculus
ctagtggtcaaggagaacctgacct

SEQ ID NO: 612814 - DNA, 25 bp, Mus musculus
ctagtggtggttcgcaagaaccaga

SEQ ID NO: 612815 - DNA, 25 bp, Mus musculus
ctagtggtggttggcaagaaccaga

SEQ ID NO: 612816 - DNA, 25 bp, Mus musculus
ctagtgtcccggcaagccagcgata

SEQ ID NO: 612817 - DNA, 25 bp, Mus musculus
ctagtgtcccgggaagccagcgata

SEQ ID NO: 612818 - DNA, 25 bp, Mus musculus
ctagtgtctttgatattacttggca

SEQ ID NO: 612819 - DNA, 25 bp, Mus musculus
ctagtgtctttgttattacttggca

SEQ ID NO: 612820 - DNA, 25 bp, Mus musculus
ctagtgtgacttaattcaatgcata

SEQ ID NO: 612821 - DNA, 25 bp, Mus musculus
ctagtgtgactttattcaatgcata

SEQ ID NO: 612822 - DNA, 25 bp, Mus musculus
ctagtgtgtcagcaccaaatccccg

SEQ ID NO: 612823 - DNA, 25 bp, Mus musculus
ctagtgtgtcaggaccaaatccccg

SEQ ID NO: 612824 - DNA, 25 bp, Mus musculus
ctagtgtgttagaagatggatttac

SEQ ID NO: 612825 - DNA, 25 bp, Mus musculus
ctagtgtgttagtagatggatttac

SEQ ID NO: 612826 - DNA, 25 bp, Mus musculus
ctagtgttgaagatgaggagtcccg

SEQ ID NO: 612827 - DNA, 25 bp, Mus musculus
ctagtgttgaagttgaggagtcccg

SEQ ID NO: 612828 - DNA, 25 bp, Mus musculus
ctagtgttgtgtcagcctgagtcgc

SEQ ID NO: 612829 - DNA, 25 bp, Mus musculus
ctagtgttgtgtgagcctgagtcgc

SEQ ID NO: 612830 - DNA, 25 bp, Mus musculus
ctagttaagaacaccagagccagcc

SEQ ID NO: 612831 - DNA, 25 bp, Mus musculus
ctagttaagaactccagagccagcc

SEQ ID NO: 612832 - DNA, 25 bp, Mus musculus
ctagttaaggaacacaaagatgccc

SEQ ID NO: 612833 - DNA, 25 bp, Mus musculus
ctagttaaggaagacaaagatgccc

SEQ ID NO: 612834 - DNA, 25 bp, Mus musculus
ctagttcgcgggaccaactgctggg

SEQ ID NO: 612835 - DNA, 25 bp, Mus musculus
ctagttcgcgggtccaactgctggg

SEQ ID NO: 612836 - DNA, 25 bp, Mus musculus
ctagttgatcaactcaaagggaaaa

SEQ ID NO: 612837 - DNA, 25 bp, Mus musculus
ctagttgatcaagtcaaagggaaaa

SEQ ID NO: 612838 - DNA, 25 bp, Mus musculus
ctagttggctatcgctttacaggaa

SEQ ID NO: 612839 - DNA, 25 bp, Mus musculus
ctagttggctatggctttacaggaa

SEQ ID NO: 612840 - DNA, 25 bp, Mus musculus
ctagttggtttgaggccattgcttt

SEQ ID NO: 612841 - DNA, 25 bp, Mus musculus
ctagttggtttgtggccattgcttt

SEQ ID NO: 612842 - DNA, 25 bp, Mus musculus
ctagttgtagatacagttcctctcc

SEQ ID NO: 612843 - DNA, 25 bp, Mus musculus
ctagttgtagattcagttcctctcc

SEQ ID NO: 612844 - DNA, 25 bp, Mus musculus
ctagttgtgtctcagaaattgatgc

SEQ ID NO: 612845 - DNA, 25 bp, Mus musculus
ctagttgtgtctgagaaattgatgc

SEQ ID NO: 612846 - DNA, 25 bp, Mus musculus
ctagtttgggccagccctgaggagc

SEQ ID NO: 612847 - DNA, 25 bp, Mus musculus
ctagtttgggcctgccctgaggagc

SEQ ID NO: 612848 - DNA, 25 bp, Mus musculus
ctataaaactcactgcccaacttgt

SEQ ID NO: 612849 - DNA, 25 bp, Mus musculus
ctataaaactcagtgcccaacttgt

SEQ ID NO: 612850 - DNA, 25 bp, Mus musculus
ctataaagaagaccaagccccagca

SEQ ID NO: 612851 - DNA, 25 bp, Mus musculus
ctataaagaagagcaagccccagca

SEQ ID NO: 612852 - DNA, 25 bp, Mus musculus
ctataaatgacgaaaatcaagatgg

SEQ ID NO: 612853 - DNA, 25 bp, Mus musculus
ctataaatgacgtaaatcaagatgg

SEQ ID NO: 612854 - DNA, 25 bp, Mus musculus
ctataaatgcttacatgcggtgggt

SEQ ID NO: 612855 - DNA, 25 bp, Mus musculus
ctataaatgctttcatgcggtgggt

SEQ ID NO: 612856 - DNA, 25 bp, Mus musculus
ctataacacattaggtcaaactggg

SEQ ID NO: 612857 - DNA, 25 bp, Mus musculus
ctataacacatttggtcaaactggg

SEQ ID NO: 612858 - DNA, 25 bp, Mus musculus
ctataactaagaatactaggacatg

SEQ ID NO: 612859 - DNA, 25 bp, Mus musculus
ctataactaagattactaggacatg

SEQ ID NO: 612860 - DNA, 25 bp, Mus musculus
ctataagaacttcgtgcctaagcct

SEQ ID NO: 612861 - DNA, 25 bp, Mus musculus
ctataagaacttggtgcctaagcct

SEQ ID NO: 612862 - DNA, 25 bp, Mus musculus
ctataagacggtctggtggtatccg

SEQ ID NO: 612863 - DNA, 25 bp, Mus musculus
ctataagacggtgtggtggtatccg

SEQ ID NO: 612864 - DNA, 25 bp, Mus musculus
ctataagagagcaagacaatcttca

SEQ ID NO: 612865 - DNA, 25 bp, Mus musculus
ctataagagagctagacaatcttca

SEQ ID NO: 612866 - DNA, 25 bp, Mus musculus
ctataagaggagctgcttggcccca

SEQ ID NO: 612867 - DNA, 25 bp, Mus musculus
ctataagaggaggtgcttggcccca

SEQ ID NO: 612868 - DNA, 25 bp, Mus musculus
ctataagctctcagtcggttcccag

SEQ ID NO: 612869 - DNA, 25 bp, Mus musculus
ctataagctctctgtcggttcccag

SEQ ID NO: 612870 - DNA, 25 bp, Mus musculus
ctataagtgtaactgtgctacttcc

SEQ ID NO: 612871 - DNA, 25 bp, Mus musculus
ctataagtgtaagtgtgctacttcc

SEQ ID NO: 612872 - DNA, 25 bp, Mus musculus
ctataatgatgactactatgaggag

SEQ ID NO: 612873 - DNA, 25 bp, Mus musculus
ctataatgatgagtactatgaggag

SEQ ID NO: 612874 - DNA, 25 bp, Mus musculus
ctataatgtggacttttttcgacag

SEQ ID NO: 612875 - DNA, 25 bp, Mus musculus
ctataatgtggagttttttcgacag

SEQ ID NO: 612876 - DNA, 25 bp, Mus musculus
ctatacacccagctgtagtcatatt

SEQ ID NO: 612877 - DNA, 25 bp, Mus musculus
ctatacacccaggtgtagtcatatt

SEQ ID NO: 612878 - DNA, 25 bp, Mus musculus
ctatacactggtcagcggatccctg

SEQ ID NO: 612879 - DNA, 25 bp, Mus musculus
ctatacactggtgagcggatccctg

SEQ ID NO: 612880 - DNA, 25 bp, Mus musculus
ctataccagatgatgaagttcaaca

SEQ ID NO: 612881 - DNA, 25 bp, Mus musculus
ctataccagatgttgaagttcaaca

SEQ ID NO: 612882 - DNA, 25 bp, Mus musculus
ctatacctcgcccacaaggatgtgg

SEQ ID NO: 612883 - DNA, 25 bp, Mus musculus
ctatacctcgccgacaaggatgtgg

SEQ ID NO: 612884 - DNA, 25 bp, Mus musculus
ctatacctgtgtagttgagaacaag

SEQ ID NO: 612885 - DNA, 25 bp, Mus musculus
ctatacctgtgttgttgagaacaag

SEQ ID NO: 612886 - DNA, 25 bp, Mus musculus
ctatactgatgcaccacctgcatat

SEQ ID NO: 612887 - DNA, 25 bp, Mus musculus
ctatactgatgctccacctgcatat

SEQ ID NO: 612888 - DNA, 25 bp, Mus musculus
ctatagatcctgagcccctgtgtga

SEQ ID NO: 612889 - DNA, 25 bp, Mus musculus
ctatagatcctgtgcccctgtgtga

SEQ ID NO: 612890 - DNA, 25 bp, Mus musculus
ctatagcattttctgggacttgaag

SEQ ID NO: 612891 - DNA, 25 bp, Mus musculus
ctatagcattttgtgggacttgaag

SEQ ID NO: 612892 - DNA, 25 bp, Mus musculus
ctatagcgagctccaggacgcgtgt

SEQ ID NO: 612893 - DNA, 25 bp, Mus musculus
ctatagcgagctgcaggacgcgtgt

SEQ ID NO: 612894 - DNA, 25 bp, Mus musculus
ctatagctctcgaaagtgagtccct

SEQ ID NO: 612895 - DNA, 25 bp, Mus musculus
ctatagctctcgtaagtgagtccct

SEQ ID NO: 612896 - DNA, 25 bp, Mus musculus
ctatagtccctacaagagggaggag

SEQ ID NO: 612897 - DNA, 25 bp, Mus musculus
ctatagtccctagaagagggaggag

SEQ ID NO: 612898 - DNA, 25 bp, Mus musculus
ctatagtttggccaaggagcagcga

SEQ ID NO: 612899 - DNA, 25 bp, Mus musculus
ctatagtttggcgaaggagcagcga

SEQ ID NO: 612900 - DNA, 25 bp, Mus musculus
ctatatccgggtcgcatccttgctg

SEQ ID NO: 612901 - DNA, 25 bp, Mus musculus
ctatatccgggtggcatccttgctg

SEQ ID NO: 612902 - DNA, 25 bp, Mus musculus
ctatattgtcagcatatcacccaca

SEQ ID NO: 612903 - DNA, 25 bp, Mus musculus
ctatattgtcaggatatcacccaca

SEQ ID NO: 612904 - DNA, 25 bp, Mus musculus
ctatatttgggcaggaagcccactg

SEQ ID NO: 612905 - DNA, 25 bp, Mus musculus
ctatatttgggctggaagcccactg

SEQ ID NO: 612906 - DNA, 25 bp, Mus musculus
ctatcaaagactcataagagactcc

SEQ ID NO: 612907 - DNA, 25 bp, Mus musculus
ctatcaaagactgataagagactcc

SEQ ID NO: 612908 - DNA, 25 bp, Mus musculus
ctatcaagaaggacgaagaggtgct

SEQ ID NO: 612909 - DNA, 25 bp, Mus musculus
ctatcaagaaggtcgaagaggtgct

SEQ ID NO: 612910 - DNA, 25 bp, Mus musculus
ctatcaagggagagtgtgccaaccg

SEQ ID NO: 612911 - DNA, 25 bp, Mus musculus
ctatcaagggagtgtgtgccaaccg

SEQ ID NO: 612912 - DNA, 25 bp, Mus musculus
ctatcaatttaaatgctgtgagcac

SEQ ID NO: 612913 - DNA, 25 bp, Mus musculus
ctatcaatttaattgctgtgagcac

SEQ ID NO: 612914 - DNA, 25 bp, Mus musculus
ctatcaccaatgagaccctgagctg

SEQ ID NO: 612915 - DNA, 25 bp, Mus musculus
ctatcaccaatgtgaccctgagctg

SEQ ID NO: 612916 - DNA, 25 bp, Mus musculus
ctatcactacatcctggagtcaaac

SEQ ID NO: 612917 - DNA, 25 bp, Mus musculus
ctatcactacatgctggagtcaaac

SEQ ID NO: 612918 - DNA, 25 bp, Mus musculus
ctatcagaacgtcagtgcacccctg

SEQ ID NO: 612919 - DNA, 25 bp, Mus musculus
ctatcagaacgtgagtgcacccctg

SEQ ID NO: 612920 - DNA, 25 bp, Mus musculus
ctatcagctgagatccagccatcag

SEQ ID NO: 612921 - DNA, 25 bp, Mus musculus
ctatcagctgagttccagccatcag

SEQ ID NO: 612922 - DNA, 25 bp, Mus musculus
ctatcagggtctcccaggctctcat

SEQ ID NO: 612923 - DNA, 25 bp, Mus musculus
ctatcagggtctgccaggctctcat

SEQ ID NO: 612924 - DNA, 25 bp, Mus musculus
ctatcagtaacaccatctaagaggt

SEQ ID NO: 612925 - DNA, 25 bp, Mus musculus
ctatcagtaacagcatctaagaggt

SEQ ID NO: 612926 - DNA, 25 bp, Mus musculus
ctatcattacctccgttcaactgtg

SEQ ID NO: 612927 - DNA, 25 bp, Mus musculus
ctatcattacctgcgttcaactgtg

SEQ ID NO: 612928 - DNA, 25 bp, Mus musculus
ctatccagaaagcattacaggcatc

SEQ ID NO: 612929 - DNA, 25 bp, Mus musculus
ctatccagaaaggattacaggcatc

SEQ ID NO: 612930 - DNA, 25 bp, Mus musculus
ctatccagatatccgagtacctgcg

SEQ ID NO: 612931 - DNA, 25 bp, Mus musculus
ctatccagatatgcgagtacctgcg

SEQ ID NO: 612932 - DNA, 25 bp, Mus musculus
ctatcccattatcgagagcacttga

SEQ ID NO: 612933 - DNA, 25 bp, Mus musculus
ctatcccattatggagagcacttga

SEQ ID NO: 612934 - DNA, 25 bp, Mus musculus
ctatccccgtatccggtggattaca

SEQ ID NO: 612935 - DNA, 25 bp, Mus musculus
ctatccccgtatgcggtggattaca

SEQ ID NO: 612936 - DNA, 25 bp, Mus musculus
ctatccgtgaggctgccaccagcaa

SEQ ID NO: 612937 - DNA, 25 bp, Mus musculus
ctatccgtgagggtgccaccagcaa

SEQ ID NO: 612938 - DNA, 25 bp, Mus musculus
ctatcctcggaacgcagtgcacgtc

SEQ ID NO: 612939 - DNA, 25 bp, Mus musculus
ctatcctcggaaggcagtgcacgtc

SEQ ID NO: 612940 - DNA, 25 bp, Mus musculus
ctatcctgatggcagagtctgcatc

SEQ ID NO: 612941 - DNA, 25 bp, Mus musculus
ctatcctgatgggagagtctgcatc

SEQ ID NO: 612942 - DNA, 25 bp, Mus musculus
ctatcctgggttacgtgaacaagca

SEQ ID NO: 612943 - DNA, 25 bp, Mus musculus
ctatcctgggtttcgtgaacaagca

SEQ ID NO: 612944 - DNA, 25 bp, Mus musculus
ctatccttatttaggccccagcaca

SEQ ID NO: 612945 - DNA, 25 bp, Mus musculus
ctatccttattttggccccagcaca

SEQ ID NO: 612946 - DNA, 25 bp, Mus musculus
ctatcgaaagcaaaagaagcacctg

SEQ ID NO: 612947 - DNA, 25 bp, Mus musculus
ctatcgaaagcataagaagcacctg

SEQ ID NO: 612948 - DNA, 25 bp, Mus musculus
ctatcgacttcactgcctccaatgg

SEQ ID NO: 612949 - DNA, 25 bp, Mus musculus
ctatcgacttcagtgcctccaatgg

SEQ ID NO: 612950 - DNA, 25 bp, Mus musculus
ctatcgccgtcgaggctgggccttc

SEQ ID NO: 612951 - DNA, 25 bp, Mus musculus
ctatcgccgtcgtggctgggccttc

SEQ ID NO: 612952 - DNA, 25 bp, Mus musculus
ctatcgcggagcaatgggtttcctg

SEQ ID NO: 612953 - DNA, 25 bp, Mus musculus
ctatcgcggagctatgggtttcctg

SEQ ID NO: 612954 - DNA, 25 bp, Mus musculus
ctatcgctgggaacctcttcatctt

SEQ ID NO: 612955 - DNA, 25 bp, Mus musculus
ctatcgctgggatcctcttcatctt

SEQ ID NO: 612956 - DNA, 25 bp, Mus musculus
ctatcggataaactctctaagagct

SEQ ID NO: 612957 - DNA, 25 bp, Mus musculus
ctatcggataaagtctctaagagct

SEQ ID NO: 612958 - DNA, 25 bp, Mus musculus
ctatcggtgtccagaccagcggcgg

SEQ ID NO: 612959 - DNA, 25 bp, Mus musculus
ctatcggtgtcctgaccagcggcgg

SEQ ID NO: 612960 - DNA, 25 bp, Mus musculus
ctatcgtgacctagaggacctggag

SEQ ID NO: 612961 - DNA, 25 bp, Mus musculus
ctatcgtgaccttgaggacctggag

SEQ ID NO: 612962 - DNA, 25 bp, Mus musculus
ctatctcggcggcttttcctgcaag

SEQ ID NO: 612963 - DNA, 25 bp, Mus musculus
ctatctcggcgggttttcctgcaag

SEQ ID NO: 612964 - DNA, 25 bp, Mus musculus
ctatctcgtggaccctcatgtacct

SEQ ID NO: 612965 - DNA, 25 bp, Mus musculus
ctatctcgtggagcctcatgtacct

SEQ ID NO: 612966 - DNA, 25 bp, Mus musculus
ctatctctaagaatggagcttcccc

SEQ ID NO: 612967 - DNA, 25 bp, Mus musculus
ctatctctaagattggagcttcccc

SEQ ID NO: 612968 - DNA, 25 bp, Mus musculus
ctatctctgggtcctgtccactggc

SEQ ID NO: 612969 - DNA, 25 bp, Mus musculus
ctatctctgggtgctgtccactggc

SEQ ID NO: 612970 - DNA, 25 bp, Mus musculus
ctatctcttgctcgcagccagtggc

SEQ ID NO: 612971 - DNA, 25 bp, Mus musculus
ctatctcttgctggcagccagtggc

SEQ ID NO: 612972 - DNA, 25 bp, Mus musculus
ctatctcttgtacgcggtgataact

SEQ ID NO: 612973 - DNA, 25 bp, Mus musculus
ctatctcttgtaggcggtgataact

SEQ ID NO: 612974 - DNA, 25 bp, Mus musculus
ctatctggataaccgtagcaagccc

SEQ ID NO: 612975 - DNA, 25 bp, Mus musculus
ctatctggataagcgtagcaagccc

SEQ ID NO: 612976 - DNA, 25 bp, Mus musculus
ctatctgtccatcgaggcagcttcg

SEQ ID NO: 612977 - DNA, 25 bp, Mus musculus
ctatctgtccatggaggcagcttcg

SEQ ID NO: 612978 - DNA, 25 bp, Mus musculus
ctatctgtctggaggagtatgaaga

SEQ ID NO: 612979 - DNA, 25 bp, Mus musculus
ctatctgtctggtggagtatgaaga

SEQ ID NO: 612980 - DNA, 25 bp, Mus musculus
ctatgaaagtaaattgtagggctga

SEQ ID NO: 612981 - DNA, 25 bp, Mus musculus
ctatgaaagtaatttgtagggctga

SEQ ID NO: 612982 - DNA, 25 bp, Mus musculus
ctatgaacggcacggctcggaaaga

SEQ ID NO: 612983 - DNA, 25 bp, Mus musculus
ctatgaacggcagggctcggaaaga

SEQ ID NO: 612984 - DNA, 25 bp, Mus musculus
ctatgaactggaagcggaccccaag

SEQ ID NO: 612985 - DNA, 25 bp, Mus musculus
ctatgaactggatgcggaccccaag

SEQ ID NO: 612986 - DNA, 25 bp, Mus musculus
ctatgaagaaacagtgggtgtcaac

SEQ ID NO: 612987 - DNA, 25 bp, Mus musculus
ctatgaagaaactgtgggtgtcaac

SEQ ID NO: 612988 - DNA, 25 bp, Mus musculus
ctatgaaggaagatggacggctgct

SEQ ID NO: 612989 - DNA, 25 bp, Mus musculus
ctatgaaggaagttggacggctgct

SEQ ID NO: 612990 - DNA, 25 bp, Mus musculus
ctatgaaggctacggacagaccgag

SEQ ID NO: 612991 - DNA, 25 bp, Mus musculus
ctatgaaggctagggacagaccgag

SEQ ID NO: 612992 - DNA, 25 bp, Mus musculus
ctatgaagggaacatgtggccgtac

SEQ ID NO: 612993 - DNA, 25 bp, Mus musculus
ctatgaagggaagatgtggccgtac

SEQ ID NO: 612994 - DNA, 25 bp, Mus musculus
ctatgaagttagactctgtgtggct

SEQ ID NO: 612995 - DNA, 25 bp, Mus musculus
ctatgaagttagtctctgtgtggct

SEQ ID NO: 612996 - DNA, 25 bp, Mus musculus
ctatgaattaaacaatcgtgttggg

SEQ ID NO: 612997 - DNA, 25 bp, Mus musculus
ctatgaattaaagaatcgtgttggg

SEQ ID NO: 612998 - DNA, 25 bp, Mus musculus
ctatgaattgtaccgccgctgtaag

SEQ ID NO: 612999 - DNA, 25 bp, Mus musculus
ctatgaattgtagcgccgctgtaag

SEQ ID NO: 613000 - DNA, 25 bp, Mus musculus
ctatgaattgttaaccatgtgtaca

SEQ ID NO: 613001 - DNA, 25 bp, Mus musculus
ctatgaattgtttaccatgtgtaca

SEQ ID NO: 613002 - DNA, 25 bp, Mus musculus
ctatgacaccctcccagtggtcgtt

SEQ ID NO: 613003 - DNA, 25 bp, Mus musculus
ctatgacaccctgccagtggtcgtt

SEQ ID NO: 613004 - DNA, 25 bp, Mus musculus
ctatgacacgtaagagaggccccgg

SEQ ID NO: 613005 - DNA, 25 bp, Mus musculus
ctatgacacgtatgagaggccccgg

SEQ ID NO: 613006 - DNA, 25 bp, Mus musculus
ctatgacagctaaaacaacggagga

SEQ ID NO: 613007 - DNA, 25 bp, Mus musculus
ctatgacagctataacaacggagga

SEQ ID NO: 613008 - DNA, 25 bp, Mus musculus
ctatgacaggaacgctcagatgtgc

SEQ ID NO: 613009 - DNA, 25 bp, Mus musculus
ctatgacaggaaggctcagatgtgc

SEQ ID NO: 613010 - DNA, 25 bp, Mus musculus
ctatgacatggtccattatggccac

SEQ ID NO: 613011 - DNA, 25 bp, Mus musculus
ctatgacatggtgcattatggccac

SEQ ID NO: 613012 - DNA, 25 bp, Mus musculus
ctatgaccaggtcctccacgaggac

SEQ ID NO: 613013 - DNA, 25 bp, Mus musculus
ctatgaccaggtgctccacgaggac

SEQ ID NO: 613014 - DNA, 25 bp, Mus musculus
ctatgacgacgaagagaagaaagtg

SEQ ID NO: 613015 - DNA, 25 bp, Mus musculus
ctatgacgacgatgagaagaaagtg

SEQ ID NO: 613016 - DNA, 25 bp, Mus musculus
ctatgacttcgtctatgatcaggca

SEQ ID NO: 613017 - DNA, 25 bp, Mus musculus
ctatgacttcgtgtatgatcaggca

SEQ ID NO: 613018 - DNA, 25 bp, Mus musculus
ctatgagatgtcctacggattgaac

SEQ ID NO: 613019 - DNA, 25 bp, Mus musculus
ctatgagatgtcgtacggattgaac

SEQ ID NO: 613020 - DNA, 25 bp, Mus musculus
ctatgagcaggacctgctaccaggg

SEQ ID NO: 613021 - DNA, 25 bp, Mus musculus
ctatgagcaggagctgctaccaggg

SEQ ID NO: 613022 - DNA, 25 bp, Mus musculus
ctatgagcagttcgtgctgcacccc

SEQ ID NO: 613023 - DNA, 25 bp, Mus musculus
ctatgagcagttggtgctgcacccc

SEQ ID NO: 613024 - DNA, 25 bp, Mus musculus
ctatgagccactaggcttggaggct

SEQ ID NO: 613025 - DNA, 25 bp, Mus musculus
ctatgagccacttggcttggaggct

SEQ ID NO: 613026 - DNA, 25 bp, Mus musculus
ctatgagctctgagatgtctatttg

SEQ ID NO: 613027 - DNA, 25 bp, Mus musculus
ctatgagctctgtgatgtctatttg

SEQ ID NO: 613028 - DNA, 25 bp, Mus musculus
ctatgaggagagatatttgaccacc

SEQ ID NO: 613029 - DNA, 25 bp, Mus musculus
ctatgaggagagttatttgaccacc

SEQ ID NO: 613030 - DNA, 25 bp, Mus musculus
ctatgagggaatcggccccgtcctt

SEQ ID NO: 613031 - DNA, 25 bp, Mus musculus
ctatgagggaatgggccccgtcctt

SEQ ID NO: 613032 - DNA, 25 bp, Mus musculus
ctatgagtggatatcctacaaagag

SEQ ID NO: 613033 - DNA, 25 bp, Mus musculus
ctatgagtggatttcctacaaagag

SEQ ID NO: 613034 - DNA, 25 bp, Mus musculus
ctatgatcccagctatggtagcaca

SEQ ID NO: 613035 - DNA, 25 bp, Mus musculus
ctatgatcccaggtatggtagcaca

SEQ ID NO: 613036 - DNA, 25 bp, Mus musculus
ctatgatgaagaaagctcagaagaa

SEQ ID NO: 613037 - DNA, 25 bp, Mus musculus
ctatgatgaagatagctcagaagaa

SEQ ID NO: 613038 - DNA, 25 bp, Mus musculus
ctatgatgagttaggtttccgtgtg

SEQ ID NO: 613039 - DNA, 25 bp, Mus musculus
ctatgatgagtttggtttccgtgtg

SEQ ID NO: 613040 - DNA, 25 bp, Mus musculus
ctatgatgcctacggaccaagtgat

SEQ ID NO: 613041 - DNA, 25 bp, Mus musculus
ctatgatgcctagggaccaagtgat

SEQ ID NO: 613042 - DNA, 25 bp, Mus musculus
ctatgatggcccacgggacatgcca

SEQ ID NO: 613043 - DNA, 25 bp, Mus musculus
ctatgatggccctcgggacatgcca

SEQ ID NO: 613044 - DNA, 25 bp, Mus musculus
ctatgatggcggcaacagtggtatc

SEQ ID NO: 613045 - DNA, 25 bp, Mus musculus
ctatgatggcgggaacagtggtatc

SEQ ID NO: 613046 - DNA, 25 bp, Mus musculus
ctatgatgggtgcaataaggtctac

SEQ ID NO: 613047 - DNA, 25 bp, Mus musculus
ctatgatgggtggaataaggtctac

SEQ ID NO: 613048 - DNA, 25 bp, Mus musculus
ctatgatttgccagctgagctagca

SEQ ID NO: 613049 - DNA, 25 bp, Mus musculus
ctatgatttgcctgctgagctagca

SEQ ID NO: 613050 - DNA, 25 bp, Mus musculus
ctatgcaaaacgctctcagaggatg

SEQ ID NO: 613051 - DNA, 25 bp, Mus musculus
ctatgcaaaacggtctcagaggatg

SEQ ID NO: 613052 - DNA, 25 bp, Mus musculus
ctatgcaaagagctctttgtggtcc

SEQ ID NO: 613053 - DNA, 25 bp, Mus musculus
ctatgcaaagaggtctttgtggtcc

SEQ ID NO: 613054 - DNA, 25 bp, Mus musculus
ctatgcaggagcacagacacaagca

SEQ ID NO: 613055 - DNA, 25 bp, Mus musculus
ctatgcaggagctcagacacaagca

SEQ ID NO: 613056 - DNA, 25 bp, Mus musculus
ctatgccaatacctgtgaggagtgt

SEQ ID NO: 613057 - DNA, 25 bp, Mus musculus
ctatgccaatacgtgtgaggagtgt

SEQ ID NO: 613058 - DNA, 25 bp, Mus musculus
ctatgccagacacagggctgcgagt

SEQ ID NO: 613059 - DNA, 25 bp, Mus musculus
ctatgccagacagagggctgcgagt

SEQ ID NO: 613060 - DNA, 25 bp, Mus musculus
ctatgcccacttaggcatccacgag

SEQ ID NO: 613061 - DNA, 25 bp, Mus musculus
ctatgcccactttggcatccacgag

SEQ ID NO: 613062 - DNA, 25 bp, Mus musculus
ctatgcctgttccttcgggagacgg

SEQ ID NO: 613063 - DNA, 25 bp, Mus musculus
ctatgcctgttcgttcgggagacgg

SEQ ID NO: 613064 - DNA, 25 bp, Mus musculus
ctatgcgccatgcagcccagtgtgt

SEQ ID NO: 613065 - DNA, 25 bp, Mus musculus
ctatgcgccatggagcccagtgtgt

SEQ ID NO: 613066 - DNA, 25 bp, Mus musculus
ctatgctactggagacaacttcggg

SEQ ID NO: 613067 - DNA, 25 bp, Mus musculus
ctatgctactggaggatgggagact

SEQ ID NO: 613068 - DNA, 25 bp, Mus musculus
ctatgctactggtgacaacttcggg

SEQ ID NO: 613069 - DNA, 25 bp, Mus musculus
ctatgctactggtggatgggagact

SEQ ID NO: 613070 - DNA, 25 bp, Mus musculus
ctatgctattgaaaaagtccgtgag

SEQ ID NO: 613071 - DNA, 25 bp, Mus musculus
ctatgctattgataaagtccgtgag

SEQ ID NO: 613072 - DNA, 25 bp, Mus musculus
ctatgctccttaagatgtcaaggtc

SEQ ID NO: 613073 - DNA, 25 bp, Mus musculus
ctatgctccttatgatgtcaaggtc

SEQ ID NO: 613074 - DNA, 25 bp, Mus musculus
ctatgctcggccagccgagccggag

SEQ ID NO: 613075 - DNA, 25 bp, Mus musculus
ctatgctcggcctgccgagccggag

SEQ ID NO: 613076 - DNA, 25 bp, Mus musculus
ctatgctctgtgactcagggagctg

SEQ ID NO: 613077 - DNA, 25 bp, Mus musculus
ctatgctctgtgtctcagggagctg

SEQ ID NO: 613078 - DNA, 25 bp, Mus musculus
ctatgctgtggacactagggacgca

SEQ ID NO: 613079 - DNA, 25 bp, Mus musculus
ctatgctgtggagactagggacgca

SEQ ID NO: 613080 - DNA, 25 bp, Mus musculus
ctatgcttgttgaaggatctcagtg

SEQ ID NO: 613081 - DNA, 25 bp, Mus musculus
ctatgcttgttgtaggatctcagtg

SEQ ID NO: 613082 - DNA, 25 bp, Mus musculus
ctatggaaggcaagacagaggagca

SEQ ID NO: 613083 - DNA, 25 bp, Mus musculus
ctatggaaggcatgacagaggagca

SEQ ID NO: 613084 - DNA, 25 bp, Mus musculus
ctatggacgtatcgtgcaatggtca

SEQ ID NO: 613085 - DNA, 25 bp, Mus musculus
ctatggacgtatggtgcaatggtca

SEQ ID NO: 613086 - DNA, 25 bp, Mus musculus
ctatggagtcaaaatccgggcccct

SEQ ID NO: 613087 - DNA, 25 bp, Mus musculus
ctatggagtcaatatccgggcccct

SEQ ID NO: 613088 - DNA, 25 bp, Mus musculus
ctatggagtgccaattgagacttcc

SEQ ID NO: 613089 - DNA, 25 bp, Mus musculus
ctatggagtgcctattgagacttcc

SEQ ID NO: 613090 - DNA, 25 bp, Mus musculus
ctatggataccacgcgccgcagaag

SEQ ID NO: 613091 - DNA, 25 bp, Mus musculus
ctatggataccaggcgccgcagaag

SEQ ID NO: 613092 - DNA, 25 bp, Mus musculus
ctatggattgtcagcccttggccct

SEQ ID NO: 613093 - DNA, 25 bp, Mus musculus
ctatggattgtctgcccttggccct

SEQ ID NO: 613094 - DNA, 25 bp, Mus musculus
ctatggcaagctaagcagtgacgag

SEQ ID NO: 613095 - DNA, 25 bp, Mus musculus
ctatggcaagcttagcagtgacgag

SEQ ID NO: 613096 - DNA, 25 bp, Mus musculus
ctatggcaatgtcttcagcctacag

SEQ ID NO: 613097 - DNA, 25 bp, Mus musculus
ctatggcaatgtgttcagcctacag

SEQ ID NO: 613098 - DNA, 25 bp, Mus musculus
ctatggcacggtcatgagctgcgcc

SEQ ID NO: 613099 - DNA, 25 bp, Mus musculus
ctatggcacggtgatgagctgcgcc

SEQ ID NO: 613100 - DNA, 25 bp, Mus musculus
ctatggcccggcctacacggagtag

SEQ ID NO: 613101 - DNA, 25 bp, Mus musculus
ctatggcccggcgtacacggagtag

SEQ ID NO: 613102 - DNA, 25 bp, Mus musculus
ctatggctattacggctacggcccc

SEQ ID NO: 613103 - DNA, 25 bp, Mus musculus
ctatggctattagggctacggcccc

SEQ ID NO: 613104 - DNA, 25 bp, Mus musculus
ctatggctcaacctgcctcactgtg

SEQ ID NO: 613105 - DNA, 25 bp, Mus musculus
ctatggctcaacgtgcctcactgtg

SEQ ID NO: 613106 - DNA, 25 bp, Mus musculus
ctatggctcgtgctacaaggcaggc

SEQ ID NO: 613107 - DNA, 25 bp, Mus musculus
ctatggctcgtggtacaaggcaggc

SEQ ID NO: 613108 - DNA, 25 bp, Mus musculus
ctatggctgatgatctggagcagca

SEQ ID NO: 613109 - DNA, 25 bp, Mus musculus
ctatggctgatgttctggagcagca

SEQ ID NO: 613110 - DNA, 25 bp, Mus musculus
ctatggcttcaactccagctacctg

SEQ ID NO: 613111 - DNA, 25 bp, Mus musculus
ctatggcttcaagtccagctacctg

SEQ ID NO: 613112 - DNA, 25 bp, Mus musculus
ctatggcttctacggctgctactgt

SEQ ID NO: 613113 - DNA, 25 bp, Mus musculus
ctatggcttctagggctgctactgt

SEQ ID NO: 613114 - DNA, 25 bp, Mus musculus
ctatgggctacactgccgagctctc

SEQ ID NO: 613115 - DNA, 25 bp, Mus musculus
ctatgggctacagtgccgagctctc

SEQ ID NO: 613116 - DNA, 25 bp, Mus musculus
ctatggtacatacccggattacata

SEQ ID NO: 613117 - DNA, 25 bp, Mus musculus
ctatggtacatagccggattacata

SEQ ID NO: 613118 - DNA, 25 bp, Mus musculus
ctatggtgccgcagtccaggctggt

SEQ ID NO: 613119 - DNA, 25 bp, Mus musculus
ctatggtgccgctgtccaggctggt

SEQ ID NO: 613120 - DNA, 25 bp, Mus musculus
ctatggtgcgatcagtaaggattcc

SEQ ID NO: 613121 - DNA, 25 bp, Mus musculus
ctatggtgcgatgagtaaggattcc

SEQ ID NO: 613122 - DNA, 25 bp, Mus musculus
ctatggtggttaaagctggctgccc

SEQ ID NO: 613123 - DNA, 25 bp, Mus musculus
ctatggtggttatagctggctgccc

SEQ ID NO: 613124 - DNA, 25 bp, Mus musculus
ctatggtgtggcagcccgtcttgca

SEQ ID NO: 613125 - DNA, 25 bp, Mus musculus
ctatggtgtggctgcccgtcttgca

SEQ ID NO: 613126 - DNA, 25 bp, Mus musculus
ctatggtttttgctcacagaatgga

SEQ ID NO: 613127 - DNA, 25 bp, Mus musculus
ctatggtttttggtcacagaatgga

SEQ ID NO: 613128 - DNA, 25 bp, Mus musculus
ctatgtatggccctcaggtctcgtt

SEQ ID NO: 613129 - DNA, 25 bp, Mus musculus
ctatgtatggccgtcaggtctcgtt

SEQ ID NO: 613130 - DNA, 25 bp, Mus musculus
ctatgtccaggacaacgagccatcg

SEQ ID NO: 613131 - DNA, 25 bp, Mus musculus
ctatgtccaggagaacgagccatcg

SEQ ID NO: 613132 - DNA, 25 bp, Mus musculus
ctatgtccagggaagaggccatcgg

SEQ ID NO: 613133 - DNA, 25 bp, Mus musculus
ctatgtccagggtagaggccatcgg

SEQ ID NO: 613134 - DNA, 25 bp, Mus musculus
ctatgtcgcacgaccgcggcctggg

SEQ ID NO: 613135 - DNA, 25 bp, Mus musculus
ctatgtcgcacgtccgcggcctggg

SEQ ID NO: 613136 - DNA, 25 bp, Mus musculus
ctatgtctggaaccgcactgaactg

SEQ ID NO: 613137 - DNA, 25 bp, Mus musculus
ctatgtctggaagcgcactgaactg

SEQ ID NO: 613138 - DNA, 25 bp, Mus musculus
ctatgtctgggtcggtggcagctgc

SEQ ID NO: 613139 - DNA, 25 bp, Mus musculus
ctatgtctgggtgggtggcagctgc

SEQ ID NO: 613140 - DNA, 25 bp, Mus musculus
ctatgtgaaaacctctgagaaactt

SEQ ID NO: 613141 - DNA, 25 bp, Mus musculus
ctatgtgaaaacgtctgagaaactt

SEQ ID NO: 613142 - DNA, 25 bp, Mus musculus
ctatgtgaagctacatctgctgcct

SEQ ID NO: 613143 - DNA, 25 bp, Mus musculus
ctatgtgaagcttcatctgctgcct

SEQ ID NO: 613144 - DNA, 25 bp, Mus musculus
ctatgtgagtctacaggattctgga

SEQ ID NO: 613145 - DNA, 25 bp, Mus musculus
ctatgtgagtcttcaggattctgga

SEQ ID NO: 613146 - DNA, 25 bp, Mus musculus
ctatgtgatgaaagaccctgagacc

SEQ ID NO: 613147 - DNA, 25 bp, Mus musculus
ctatgtgatgaatgaccctgagacc

SEQ ID NO: 613148 - DNA, 25 bp, Mus musculus
ctatgtgctgggatgttacgggtat

SEQ ID NO: 613149 - DNA, 25 bp, Mus musculus
ctatgtgctgggttgttacgggtat

SEQ ID NO: 613150 - DNA, 25 bp, Mus musculus
ctatgtggacgacatgcaggtcctg

SEQ ID NO: 613151 - DNA, 25 bp, Mus musculus
ctatgtggacgagatgcaggtcctg

SEQ ID NO: 613152 - DNA, 25 bp, Mus musculus
ctatgtggccaacaactttgcccag

SEQ ID NO: 613153 - DNA, 25 bp, Mus musculus
ctatgtggccaagaactttgcccag

SEQ ID NO: 613154 - DNA, 25 bp, Mus musculus
ctatgtggccccagagaacctgcct

SEQ ID NO: 613155 - DNA, 25 bp, Mus musculus
ctatgtggcccctgagaacctgcct

SEQ ID NO: 613156 - DNA, 25 bp, Mus musculus
ctatgtgtatcaagatgggctgtgg

SEQ ID NO: 613157 - DNA, 25 bp, Mus musculus
ctatgtgtatcatgatgggctgtgg

SEQ ID NO: 613158 - DNA, 25 bp, Mus musculus
ctatgtgtatgacgccgctcagacg

SEQ ID NO: 613159 - DNA, 25 bp, Mus musculus
ctatgtgtatgaggccgctcagacg

SEQ ID NO: 613160 - DNA, 25 bp, Mus musculus
ctatgtgtcggcatataccgtatga

SEQ ID NO: 613161 - DNA, 25 bp, Mus musculus
ctatgtgtcggcttataccgtatga

SEQ ID NO: 613162 - DNA, 25 bp, Mus musculus
ctatgtgtgtgaacttgaaggcaac

SEQ ID NO: 613163 - DNA, 25 bp, Mus musculus
ctatgtgtgtgatcttgaaggcaac

SEQ ID NO: 613164 - DNA, 25 bp, Mus musculus
ctatgtgtgtggctacctgcaccag

SEQ ID NO: 613165 - DNA, 25 bp, Mus musculus
ctatgtgtgtgggtacctgcaccag

SEQ ID NO: 613166 - DNA, 25 bp, Mus musculus
ctatgttcaggcaccctaccctggg

SEQ ID NO: 613167 - DNA, 25 bp, Mus musculus
ctatgttcaggctccctaccctggg

SEQ ID NO: 613168 - DNA, 25 bp, Mus musculus
ctatgttcggccacgggccgccaga

SEQ ID NO: 613169 - DNA, 25 bp, Mus musculus
ctatgttcggcctcgggccgccaga

SEQ ID NO: 613170 - DNA, 25 bp, Mus musculus
ctatgttgctagagtaaggatccac

SEQ ID NO: 613171 - DNA, 25 bp, Mus musculus
ctatgttgctagtgtaaggatccac

SEQ ID NO: 613172 - DNA, 25 bp, Mus musculus
ctattaaagcgacagcagaagctgg

SEQ ID NO: 613173 - DNA, 25 bp, Mus musculus
ctattaaagcgagagcagaagctgg

SEQ ID NO: 613174 - DNA, 25 bp, Mus musculus
ctattactgacccaaggagcacttt

SEQ ID NO: 613175 - DNA, 25 bp, Mus musculus
ctattactgaccgaaggagcacttt

SEQ ID NO: 613176 - DNA, 25 bp, Mus musculus
ctattagacctgcttggcaaagaag

SEQ ID NO: 613177 - DNA, 25 bp, Mus musculus
ctattagacctggttggcaaagaag

SEQ ID NO: 613178 - DNA, 25 bp, Mus musculus
ctattagttcaacagccagatggac

SEQ ID NO: 613179 - DNA, 25 bp, Mus musculus
ctattagttcaagagccagatggac

SEQ ID NO: 613180 - DNA, 25 bp, Mus musculus
ctattatctacgacagactccccag

SEQ ID NO: 613181 - DNA, 25 bp, Mus musculus
ctattatctacgtcagactccccag

SEQ ID NO: 613182 - DNA, 25 bp, Mus musculus
ctattcaccgccactacgaggagtg

SEQ ID NO: 613183 - DNA, 25 bp, Mus musculus
ctattcaccgcctctacgaggagtg

SEQ ID NO: 613184 - DNA, 25 bp, Mus musculus
ctattccaaagacccaatgcacttg

SEQ ID NO: 613185 - DNA, 25 bp, Mus musculus
ctattccaaagagccaatgcacttg

SEQ ID NO: 613186 - DNA, 25 bp, Mus musculus
ctattccttctgatcagcctgctgc

SEQ ID NO: 613187 - DNA, 25 bp, Mus musculus
ctattccttctgttcagcctgctgc

SEQ ID NO: 613188 - DNA, 25 bp, Mus musculus
ctattcggtgagaagggtgcagacc

SEQ ID NO: 613189 - DNA, 25 bp, Mus musculus
ctattcggtgagtagggtgcagacc

SEQ ID NO: 613190 - DNA, 25 bp, Mus musculus
ctattctacaaaagaagagttcaga

SEQ ID NO: 613191 - DNA, 25 bp, Mus musculus
ctattctacaaatgaagagttcaga

SEQ ID NO: 613192 - DNA, 25 bp, Mus musculus
ctattctcatgcaatcaagtttacc

SEQ ID NO: 613193 - DNA, 25 bp, Mus musculus
ctattctcatgctatcaagtttacc

SEQ ID NO: 613194 - DNA, 25 bp, Mus musculus
ctattcttgcagcatcggaagtttg

SEQ ID NO: 613195 - DNA, 25 bp, Mus musculus
ctattcttgcaggatcggaagtttg

SEQ ID NO: 613196 - DNA, 25 bp, Mus musculus
ctattcttgggaagagtgtatgaac

SEQ ID NO: 613197 - DNA, 25 bp, Mus musculus
ctattcttgggatgagtgtatgaac

SEQ ID NO: 613198 - DNA, 25 bp, Mus musculus
ctattgaaagagactcactcttggc

SEQ ID NO: 613199 - DNA, 25 bp, Mus musculus
ctattgaaagagtctcactcttggc

SEQ ID NO: 613200 - DNA, 25 bp, Mus musculus
ctattgagatcaaggtggtgaaccc

SEQ ID NO: 613201 - DNA, 25 bp, Mus musculus
ctattgagatcatggtggtgaaccc

SEQ ID NO: 613202 - DNA, 25 bp, Mus musculus
ctattgagctgtaccatgcaggagc

SEQ ID NO: 613203 - DNA, 25 bp, Mus musculus
ctattgagctgttccatgcaggagc

SEQ ID NO: 613204 - DNA, 25 bp, Mus musculus
ctattgatgacacatggcttcaaac

SEQ ID NO: 613205 - DNA, 25 bp, Mus musculus
ctattgatgacagatggcttcaaac

SEQ ID NO: 613206 - DNA, 25 bp, Mus musculus
ctattgcagagaaaaaccgtcggga

SEQ ID NO: 613207 - DNA, 25 bp, Mus musculus
ctattgcagagataaaccgtcggga

SEQ ID NO: 613208 - DNA, 25 bp, Mus musculus
ctattgctcaggagattggtcggga

SEQ ID NO: 613209 - DNA, 25 bp, Mus musculus
ctattgctcaggtgattggtcggga

SEQ ID NO: 613210 - DNA, 25 bp, Mus musculus
ctattgctcgagagttttgcggagg

SEQ ID NO: 613211 - DNA, 25 bp, Mus musculus
ctattgctcgagtgttttgcggagg

SEQ ID NO: 613212 - DNA, 25 bp, Mus musculus
ctattggaaaagagcatccatgcag

SEQ ID NO: 613213 - DNA, 25 bp, Mus musculus
ctattggaaaagtgcatccatgcag

SEQ ID NO: 613214 - DNA, 25 bp, Mus musculus
ctattgggacctccgcacaagtaca

SEQ ID NO: 613215 - DNA, 25 bp, Mus musculus
ctattgggacctgcgcacaagtaca

SEQ ID NO: 613216 - DNA, 25 bp, Mus musculus
ctattggttggtatgagttcgtgca

SEQ ID NO: 613217 - DNA, 25 bp, Mus musculus
ctattggttggtttgagttcgtgca

SEQ ID NO: 613218 - DNA, 25 bp, Mus musculus
ctattgttggctatagtggtggacc

SEQ ID NO: 613219 - DNA, 25 bp, Mus musculus
ctattgttggctttagtggtggacc

SEQ ID NO: 613220 - DNA, 25 bp, Mus musculus
ctatttaaccccagggattagagat

SEQ ID NO: 613221 - DNA, 25 bp, Mus musculus
ctatttaacccctgggattagagat

SEQ ID NO: 613222 - DNA, 25 bp, Mus musculus
ctatttaacgagaccacatcttggg

SEQ ID NO: 613223 - DNA, 25 bp, Mus musculus
ctatttaacgagtccacatcttggg

SEQ ID NO: 613224 - DNA, 25 bp, Mus musculus
ctatttacagatcgtgggcattggg

SEQ ID NO: 613225 - DNA, 25 bp, Mus musculus
ctatttacagatggtgggcattggg

SEQ ID NO: 613226 - DNA, 25 bp, Mus musculus
ctatttcaggcgctatcttgggcat

SEQ ID NO: 613227 - DNA, 25 bp, Mus musculus
ctatttcaggcggtatcttgggcat

SEQ ID NO: 613228 - DNA, 25 bp, Mus musculus
ctatttccagtgagaaggacatgag

SEQ ID NO: 613229 - DNA, 25 bp, Mus musculus
ctatttccagtgtgaaggacatgag

SEQ ID NO: 613230 - DNA, 25 bp, Mus musculus
ctatttccggcccaatggacgcttc

SEQ ID NO: 613231 - DNA, 25 bp, Mus musculus
ctatttccggccgaatggacgcttc

SEQ ID NO: 613232 - DNA, 25 bp, Mus musculus
ctatttcttctcaggcgcggtcctc

SEQ ID NO: 613233 - DNA, 25 bp, Mus musculus
ctatttcttctctggcgcggtcctc

SEQ ID NO: 613234 - DNA, 25 bp, Mus musculus
ctatttcttcttccgcgagtccgct

SEQ ID NO: 613235 - DNA, 25 bp, Mus musculus
ctatttcttcttgcgcgagtccgct

SEQ ID NO: 613236 - DNA, 25 bp, Mus musculus
ctatttgaaaatcaagggtgactac

SEQ ID NO: 613237 - DNA, 25 bp, Mus musculus
ctatttgaaaatgaagggtgactac

SEQ ID NO: 613238 - DNA, 25 bp, Mus musculus
ctatttgagcaacattacagtgcca

SEQ ID NO: 613239 - DNA, 25 bp, Mus musculus
ctatttgagcaagattacagtgcca

SEQ ID NO: 613240 - DNA, 25 bp, Mus musculus
ctatttgcatgcaaagaacatcatc

SEQ ID NO: 613241 - DNA, 25 bp, Mus musculus
ctatttgcatgctaagaacatcatc

SEQ ID NO: 613242 - DNA, 25 bp, Mus musculus
ctatttgctggtcccacagcaatgc

SEQ ID NO: 613243 - DNA, 25 bp, Mus musculus
ctatttgctggtgccacagcaatgc

SEQ ID NO: 613244 - DNA, 25 bp, Mus musculus
ctatttggaccaaatcagcgcccag

SEQ ID NO: 613245 - DNA, 25 bp, Mus musculus
ctatttggaccatatcagcgcccag

SEQ ID NO: 613246 - DNA, 25 bp, Mus musculus
ctatttggagcactgcttagcagtc

SEQ ID NO: 613247 - DNA, 25 bp, Mus musculus
ctatttggagcagtgcttagcagtc

SEQ ID NO: 613248 - DNA, 25 bp, Mus musculus
ctatttgtagtgacctgcaggtctt

SEQ ID NO: 613249 - DNA, 25 bp, Mus musculus
ctatttgtagtgtcctgcaggtctt

SEQ ID NO: 613250 - DNA, 25 bp, Mus musculus
ctattttgctgacccatacttacgg

SEQ ID NO: 613251 - DNA, 25 bp, Mus musculus
ctattttgctgagccatacttacgg

SEQ ID NO: 613252 - DNA, 25 bp, Mus musculus
ctattttgtggtcgtacacgtacct

SEQ ID NO: 613253 - DNA, 25 bp, Mus musculus
ctattttgtggtggtacacgtacct

SEQ ID NO: 613254 - DNA, 25 bp, Mus musculus
ctatttttgatacgccagatgagga

SEQ ID NO: 613255 - DNA, 25 bp, Mus musculus
ctatttttgataggccagatgagga

SEQ ID NO: 613256 - DNA, 25 bp, Mus musculus
ctatttttggatcaagtcctacacc

SEQ ID NO: 613257 - DNA, 25 bp, Mus musculus
ctatttttggatgaagtcctacacc

SEQ ID NO: 613258 - DNA, 25 bp, Mus musculus
ctcaaaaacaaacttatggttatag

SEQ ID NO: 613259 - DNA, 25 bp, Mus musculus
ctcaaaaacaaagttatggttatag

SEQ ID NO: 613260 - DNA, 25 bp, Mus musculus
ctcaaaatcgagagatcatgaaaca

SEQ ID NO: 613261 - DNA, 25 bp, Mus musculus
ctcaaaatcgagtgatcatgaaaca

SEQ ID NO: 613262 - DNA, 25 bp, Mus musculus
ctcaaaatttcacggccttcatttc

SEQ ID NO: 613263 - DNA, 25 bp, Mus musculus
ctcaaaatttcagggccttcatttc

SEQ ID NO: 613264 - DNA, 25 bp, Mus musculus
ctcaaacaggctcgaatctctgggc

SEQ ID NO: 613265 - DNA, 25 bp, Mus musculus
ctcaaacaggctggaatctctgggc

SEQ ID NO: 613266 - DNA, 25 bp, Mus musculus
ctcaaacgtcaaagtagtgtcaaac

SEQ ID NO: 613267 - DNA, 25 bp, Mus musculus
ctcaaacgtcaatgtagtgtcaaac

SEQ ID NO: 613268 - DNA, 25 bp, Mus musculus
ctcaaactacatctccaaaggcagc

SEQ ID NO: 613269 - DNA, 25 bp, Mus musculus
ctcaaactacatgtccaaaggcagc

SEQ ID NO: 613270 - DNA, 25 bp, Mus musculus
ctcaaactccagctgctgtgatcac

SEQ ID NO: 613271 - DNA, 25 bp, Mus musculus
ctcaaactccaggtgctgtgatcac

SEQ ID NO: 613272 - DNA, 25 bp, Mus musculus
ctcaaacttaccacttccatggaag

SEQ ID NO: 613273 - DNA, 25 bp, Mus musculus
ctcaaacttacctcttccatggaag

SEQ ID NO: 613274 - DNA, 25 bp, Mus musculus
ctcaaacttaggcagagatcctcag

SEQ ID NO: 613275 - DNA, 25 bp, Mus musculus
ctcaaacttagggagagatcctcag

SEQ ID NO: 613276 - DNA, 25 bp, Mus musculus
ctcaaactttgcaagctatcgtttc

SEQ ID NO: 613277 - DNA, 25 bp, Mus musculus
ctcaaactttgctagctatcgtttc

SEQ ID NO: 613278 - DNA, 25 bp, Mus musculus
ctcaaagacccgcaagtaggcctgg

SEQ ID NO: 613279 - DNA, 25 bp, Mus musculus
ctcaaagacccggaagtaggcctgg

SEQ ID NO: 613280 - DNA, 25 bp, Mus musculus
ctcaaagactgaaagaagagaaggg

SEQ ID NO: 613281 - DNA, 25 bp, Mus musculus
ctcaaagactgatagaagagaaggg

SEQ ID NO: 613282 - DNA, 25 bp, Mus musculus
ctcaaagattagaacgactccgcaa

SEQ ID NO: 613283 - DNA, 25 bp, Mus musculus
ctcaaagattagtacgactccgcaa

SEQ ID NO: 613284 - DNA, 25 bp, Mus musculus
ctcaaagcaatgcacctcactggtt

SEQ ID NO: 613285 - DNA, 25 bp, Mus musculus
ctcaaagcaatggacctcactggtt

SEQ ID NO: 613286 - DNA, 25 bp, Mus musculus
ctcaaagcacttagaagcctcctgt

SEQ ID NO: 613287 - DNA, 25 bp, Mus musculus
ctcaaagcactttgaagcctcctgt

SEQ ID NO: 613288 - DNA, 25 bp, Mus musculus
ctcaaaggccttacactttcactgg

SEQ ID NO: 613289 - DNA, 25 bp, Mus musculus
ctcaaaggcctttcactttcactgg

SEQ ID NO: 613290 - DNA, 25 bp, Mus musculus
ctcaaagggttgaggtcctggacaa

SEQ ID NO: 613291 - DNA, 25 bp, Mus musculus
ctcaaagggttgtggtcctggacaa

SEQ ID NO: 613292 - DNA, 25 bp, Mus musculus
ctcaaagtcacacctagtaaatgga

SEQ ID NO: 613293 - DNA, 25 bp, Mus musculus
ctcaaagtcacagctagtaaatgga

SEQ ID NO: 613294 - DNA, 25 bp, Mus musculus
ctcaaagtccaaccggcttaacatt

SEQ ID NO: 613295 - DNA, 25 bp, Mus musculus
ctcaaagtccaagcggcttaacatt

SEQ ID NO: 613296 - DNA, 25 bp, Mus musculus
ctcaaagtgattaaagtgggctgct

SEQ ID NO: 613297 - DNA, 25 bp, Mus musculus
ctcaaagtgatttaagtgggctgct

SEQ ID NO: 613298 - DNA, 25 bp, Mus musculus
ctcaaagtgggaactcagacgactc

SEQ ID NO: 613299 - DNA, 25 bp, Mus musculus
ctcaaagtgggatctcagacgactc

SEQ ID NO: 613300 - DNA, 25 bp, Mus musculus
ctcaaatatgagatcgacatcgagt

SEQ ID NO: 613301 - DNA, 25 bp, Mus musculus
ctcaaatatgagttcgacatcgagt

SEQ ID NO: 613302 - DNA, 25 bp, Mus musculus
ctcaacaagaagcacgttttctccg

SEQ ID NO: 613303 - DNA, 25 bp, Mus musculus
ctcaacaagaaggacgttttctccg

SEQ ID NO: 613304 - DNA, 25 bp, Mus musculus
ctcaacaagcaacgctacaaatgca

SEQ ID NO: 613305 - DNA, 25 bp, Mus musculus
ctcaacaagcaaggctacaaatgca

SEQ ID NO: 613306 - DNA, 25 bp, Mus musculus
ctcaacagcctgagctccgttgtgc

SEQ ID NO: 613307 - DNA, 25 bp, Mus musculus
ctcaacagcctgtgctccgttgtgc

SEQ ID NO: 613308 - DNA, 25 bp, Mus musculus
ctcaacaggcagatcttgtttcaaa

SEQ ID NO: 613309 - DNA, 25 bp, Mus musculus
ctcaacaggcagttcttgtttcaaa

SEQ ID NO: 613310 - DNA, 25 bp, Mus musculus
ctcaacagggatcaaaacatactgt

SEQ ID NO: 613311 - DNA, 25 bp, Mus musculus
ctcaacagggatgaaaacatactgt

SEQ ID NO: 613312 - DNA, 25 bp, Mus musculus
ctcaacatcaaacagaacaacaagc

SEQ ID NO: 613313 - DNA, 25 bp, Mus musculus
ctcaacatcaaagagaacaacaagc

SEQ ID NO: 613314 - DNA, 25 bp, Mus musculus
ctcaacatgcggaaccgaaccctgt

SEQ ID NO: 613315 - DNA, 25 bp, Mus musculus
ctcaacatgcggtaccgaaccctgt

SEQ ID NO: 613316 - DNA, 25 bp, Mus musculus
ctcaacattaacaaccaggatgctg

SEQ ID NO: 613317 - DNA, 25 bp, Mus musculus
ctcaacattaactaccaggatgctg

SEQ ID NO: 613318 - DNA, 25 bp, Mus musculus
ctcaaccgcttgctgtatgcagtgg

SEQ ID NO: 613319 - DNA, 25 bp, Mus musculus
ctcaaccgcttggtgtatgcagtgg

SEQ ID NO: 613320 - DNA, 25 bp, Mus musculus
ctcaacgagaccaggtgtcagtacg

SEQ ID NO: 613321 - DNA, 25 bp, Mus musculus
ctcaacgagacctggtgtcagtacg

SEQ ID NO: 613322 - DNA, 25 bp, Mus musculus
ctcaacgagggcacccggaggaaag

SEQ ID NO: 613323 - DNA, 25 bp, Mus musculus
ctcaacgagggctcccggaggaaag

SEQ ID NO: 613324 - DNA, 25 bp, Mus musculus
ctcaacgcaaagacaggcaaactgg

SEQ ID NO: 613325 - DNA, 25 bp, Mus musculus
ctcaacgcaaagtcaggcaaactgg

SEQ ID NO: 613326 - DNA, 25 bp, Mus musculus
ctcaacgtatgaaaaaatgtgggca

SEQ ID NO: 613327 - DNA, 25 bp, Mus musculus
ctcaacgtatgataaaatgtgggca

SEQ ID NO: 613328 - DNA, 25 bp, Mus musculus
ctcaacgtggtcaccgccttctatg

SEQ ID NO: 613329 - DNA, 25 bp, Mus musculus
ctcaacgtggtctccgccttctatg

SEQ ID NO: 613330 - DNA, 25 bp, Mus musculus
ctcaactcccggcagtatagagcta

SEQ ID NO: 613331 - DNA, 25 bp, Mus musculus
ctcaactcccgggagtatagagcta

SEQ ID NO: 613332 - DNA, 25 bp, Mus musculus
ctcaactctccaacgggtcgaggct

SEQ ID NO: 613333 - DNA, 25 bp, Mus musculus
ctcaactctccatcgggtcgaggct

SEQ ID NO: 613334 - DNA, 25 bp, Mus musculus
ctcaactctgagacggcttccgagt

SEQ ID NO: 613335 - DNA, 25 bp, Mus musculus
ctcaactctgagtcggcttccgagt

SEQ ID NO: 613336 - DNA, 25 bp, Mus musculus
ctcaacttggagcagtactactttg

SEQ ID NO: 613337 - DNA, 25 bp, Mus musculus
ctcaacttggaggagtactactttg

SEQ ID NO: 613338 - DNA, 25 bp, Mus musculus
ctcaagacagctatccagccggtgc

SEQ ID NO: 613339 - DNA, 25 bp, Mus musculus
ctcaagacagctttccagccggtgc

SEQ ID NO: 613340 - DNA, 25 bp, Mus musculus
ctcaagaccaacacagctgtccgga

SEQ ID NO: 613341 - DNA, 25 bp, Mus musculus
ctcaagaccaactcagctgtccgga

SEQ ID NO: 613342 - DNA, 25 bp, Mus musculus
ctcaagagcagaactcggagtccta

SEQ ID NO: 613343 - DNA, 25 bp, Mus musculus
ctcaagagcagatctcggagtccta

SEQ ID NO: 613344 - DNA, 25 bp, Mus musculus
ctcaagagcgtgagcgggtgaccaa

SEQ ID NO: 613345 - DNA, 25 bp, Mus musculus
ctcaagagcgtgtgcgggtgaccaa

SEQ ID NO: 613346 - DNA, 25 bp, Mus musculus
ctcaagaggctgcagaccagtgtga

SEQ ID NO: 613347 - DNA, 25 bp, Mus musculus
ctcaagaggctggagaccagtgtga

SEQ ID NO: 613348 - DNA, 25 bp, Mus musculus
ctcaagatcggccaaatgctcagta

SEQ ID NO: 613349 - DNA, 25 bp, Mus musculus
ctcaagatcggcgaaatgctcagta

SEQ ID NO: 613350 - DNA, 25 bp, Mus musculus
ctcaagatgagtctgggcctgccag

SEQ ID NO: 613351 - DNA, 25 bp, Mus musculus
ctcaagatgagtgtgggcctgccag

SEQ ID NO: 613352 - DNA, 25 bp, Mus musculus
ctcaagcacatcagagtaagtgttt

SEQ ID NO: 613353 - DNA, 25 bp, Mus musculus
ctcaagcacatctgagtaagtgttt

SEQ ID NO: 613354 - DNA, 25 bp, Mus musculus
ctcaagccagccagcaccagatgag

SEQ ID NO: 613355 - DNA, 25 bp, Mus musculus
ctcaagccagcctgcaccagatgag

SEQ ID NO: 613356 - DNA, 25 bp, Mus musculus
ctcaagcccggacaggaacaggaaa

SEQ ID NO: 613357 - DNA, 25 bp, Mus musculus
ctcaagcccggagaggaacaggaaa

SEQ ID NO: 613358 - DNA, 25 bp, Mus musculus
ctcaagcccgtgacattacttcctg

SEQ ID NO: 613359 - DNA, 25 bp, Mus musculus
ctcaagcccgtgtcattacttcctg

SEQ ID NO: 613360 - DNA, 25 bp, Mus musculus
ctcaagctcttgaggatggcctaca

SEQ ID NO: 613361 - DNA, 25 bp, Mus musculus
ctcaagctcttgtggatggcctaca

SEQ ID NO: 613362 - DNA, 25 bp, Mus musculus
ctcaagctggcaacatattatttgt

SEQ ID NO: 613363 - DNA, 25 bp, Mus musculus
ctcaagctggcatcatattatttgt

SEQ ID NO: 613364 - DNA, 25 bp, Mus musculus
ctcaaggaagaaatgtgaaaagtcg

SEQ ID NO: 613365 - DNA, 25 bp, Mus musculus
ctcaaggaagaattgtgaaaagtcg

SEQ ID NO: 613366 - DNA, 25 bp, Mus musculus
ctcaaggaatccaaatccaggatcg

SEQ ID NO: 613367 - DNA, 25 bp, Mus musculus
ctcaaggaatcctaatccaggatcg

SEQ ID NO: 613368 - DNA, 25 bp, Mus musculus
ctcaaggagaccaccatgtgccgag

SEQ ID NO: 613369 - DNA, 25 bp, Mus musculus
ctcaaggagacctccatgtgccgag

SEQ ID NO: 613370 - DNA, 25 bp, Mus musculus
ctcaaggaggagaactgggactgct

SEQ ID NO: 613371 - DNA, 25 bp, Mus musculus
ctcaaggaggagtactgggactgct

SEQ ID NO: 613372 - DNA, 25 bp, Mus musculus
ctcaaggatagaatggtgaacagca

SEQ ID NO: 613373 - DNA, 25 bp, Mus musculus
ctcaaggatagattggtgaacagca

SEQ ID NO: 613374 - DNA, 25 bp, Mus musculus
ctcaaggatgaacgcctgttcagct

SEQ ID NO: 613375 - DNA, 25 bp, Mus musculus
ctcaaggatgaaggcctgttcagct

SEQ ID NO: 613376 - DNA, 25 bp, Mus musculus
ctcaaggccctcaggaccattgtct

SEQ ID NO: 613377 - DNA, 25 bp, Mus musculus
ctcaaggccctctggaccattgtct

SEQ ID NO: 613378 - DNA, 25 bp, Mus musculus
ctcaagggcattcggctaacgctgg

SEQ ID NO: 613379 - DNA, 25 bp, Mus musculus
ctcaagggcattgggctaacgctgg

SEQ ID NO: 613380 - DNA, 25 bp, Mus musculus
ctcaaggtgatacctcggatgcatc

SEQ ID NO: 613381 - DNA, 25 bp, Mus musculus
ctcaaggtgatagctcggatgcatc

SEQ ID NO: 613382 - DNA, 25 bp, Mus musculus
ctcaagtacctgctggacaaccatg

SEQ ID NO: 613383 - DNA, 25 bp, Mus musculus
ctcaagtacctggtggacaaccatg

SEQ ID NO: 613384 - DNA, 25 bp, Mus musculus
ctcaagtatcagctgcagctgccag

SEQ ID NO: 613385 - DNA, 25 bp, Mus musculus
ctcaagtatcaggtgcagctgccag

SEQ ID NO: 613386 - DNA, 25 bp, Mus musculus
ctcaagtcaggaagttgcggaggct

SEQ ID NO: 613387 - DNA, 25 bp, Mus musculus
ctcaagtcaggatgttgcggaggct

SEQ ID NO: 613388 - DNA, 25 bp, Mus musculus
ctcaagtccagaaggcgagtggtgt

SEQ ID NO: 613389 - DNA, 25 bp, Mus musculus
ctcaagtccagatggcgagtggtgt

SEQ ID NO: 613390 - DNA, 25 bp, Mus musculus
ctcaagtgaacgagtccgggaggaa

SEQ ID NO: 613391 - DNA, 25 bp, Mus musculus
ctcaagtgaacgtgtccgggaggaa

SEQ ID NO: 613392 - DNA, 25 bp, Mus musculus
ctcaagtgccgtccgaatggcagtg

SEQ ID NO: 613393 - DNA, 25 bp, Mus musculus
ctcaagtgccgtgcgaatggcagtg

SEQ ID NO: 613394 - DNA, 25 bp, Mus musculus
ctcaagtttctgcttgatggaaaat

SEQ ID NO: 613395 - DNA, 25 bp, Mus musculus
ctcaagtttctggttgatggaaaat

SEQ ID NO: 613396 - DNA, 25 bp, Mus musculus
ctcaatcagctacatggcccgacag

SEQ ID NO: 613397 - DNA, 25 bp, Mus musculus
ctcaatcagctagatggcccgacag

SEQ ID NO: 613398 - DNA, 25 bp, Mus musculus
ctcaatctaggtcggaggtggcgaa

SEQ ID NO: 613399 - DNA, 25 bp, Mus musculus
ctcaatctaggtgggaggtggcgaa

SEQ ID NO: 613400 - DNA, 25 bp, Mus musculus
ctcaatgaactgaagcgccgtggca

SEQ ID NO: 613401 - DNA, 25 bp, Mus musculus
ctcaatgaactgtagcgccgtggca

SEQ ID NO: 613402 - DNA, 25 bp, Mus musculus
ctcaatgagatgatcaatccaaact

SEQ ID NO: 613403 - DNA, 25 bp, Mus musculus
ctcaatgagatgttcaatccaaact

SEQ ID NO: 613404 - DNA, 25 bp, Mus musculus
ctcaatgctgaacatggaaacagct

SEQ ID NO: 613405 - DNA, 25 bp, Mus musculus
ctcaatgctgaagatggaaacagct

SEQ ID NO: 613406 - DNA, 25 bp, Mus musculus
ctcaatggtcctcggatcgggaagt

SEQ ID NO: 613407 - DNA, 25 bp, Mus musculus
ctcaatggtcctgggatcgggaagt

SEQ ID NO: 613408 - DNA, 25 bp, Mus musculus
ctcaatgtgagtataaactgtgaaa

SEQ ID NO: 613409 - DNA, 25 bp, Mus musculus
ctcaatgtgagtttaaactgtgaaa

SEQ ID NO: 613410 - DNA, 25 bp, Mus musculus
ctcaatgttaagcttttctgggaga

SEQ ID NO: 613411 - DNA, 25 bp, Mus musculus
ctcaatgttaaggttttctgggaga

SEQ ID NO: 613412 - DNA, 25 bp, Mus musculus
ctcaattggaaacgcgcctgtcaac

SEQ ID NO: 613413 - DNA, 25 bp, Mus musculus
ctcaattggaaaggcgcctgtcaac

SEQ ID NO: 613414 - DNA, 25 bp, Mus musculus
ctcaattttgccagaatcgccacag

SEQ ID NO: 613415 - DNA, 25 bp, Mus musculus
ctcaattttgcctgaatcgccacag

SEQ ID NO: 613416 - DNA, 25 bp, Mus musculus
ctcacaaaccggcaacgtgggaatg

SEQ ID NO: 613417 - DNA, 25 bp, Mus musculus
ctcacaaaccgggaacgtgggaatg

SEQ ID NO: 613418 - DNA, 25 bp, Mus musculus
ctcacaaagcaacgtggtctccttc

SEQ ID NO: 613419 - DNA, 25 bp, Mus musculus
ctcacaaagcaaggtggtctccttc

SEQ ID NO: 613420 - DNA, 25 bp, Mus musculus
ctcacaaggttaatggcccattcct

SEQ ID NO: 613421 - DNA, 25 bp, Mus musculus
ctcacaaggttattggcccattcct

SEQ ID NO: 613422 - DNA, 25 bp, Mus musculus
ctcacaatggagaataaggtagcag

SEQ ID NO: 613423 - DNA, 25 bp, Mus musculus
ctcacaatggagtataaggtagcag

SEQ ID NO: 613424 - DNA, 25 bp, Mus musculus
ctcacacacagaccgagcgtttctg

SEQ ID NO: 613425 - DNA, 25 bp, Mus musculus
ctcacacacagagcgagcgtttctg

SEQ ID NO: 613426 - DNA, 25 bp, Mus musculus
ctcacacagaacagctgcgaggacc

SEQ ID NO: 613427 - DNA, 25 bp, Mus musculus
ctcacacagaactgctgcgaggacc

SEQ ID NO: 613428 - DNA, 25 bp, Mus musculus
ctcacacggagcaagtcccacgagt

SEQ ID NO: 613429 - DNA, 25 bp, Mus musculus
ctcacacggagctagtcccacgagt

SEQ ID NO: 613430 - DNA, 25 bp, Mus musculus
ctcacagagaggatccgttccatcg

SEQ ID NO: 613431 - DNA, 25 bp, Mus musculus
ctcacagagaggttccgttccatcg

SEQ ID NO: 613432 - DNA, 25 bp, Mus musculus
ctcacagagtacctgaatgaagaat

SEQ ID NO: 613433 - DNA, 25 bp, Mus musculus
ctcacagagtacgtgaatgaagaat

SEQ ID NO: 613434 - DNA, 25 bp, Mus musculus
ctcacagcaccgataccaagtctgt

SEQ ID NO: 613435 - DNA, 25 bp, Mus musculus
ctcacagcaccgttaccaagtctgt

SEQ ID NO: 613436 - DNA, 25 bp, Mus musculus
ctcacagcgattagaaagagctttg

SEQ ID NO: 613437 - DNA, 25 bp, Mus musculus
ctcacagcgatttgaaagagctttg

SEQ ID NO: 613438 - DNA, 25 bp, Mus musculus
ctcacagtatatcacttcgagcagg

SEQ ID NO: 613439 - DNA, 25 bp, Mus musculus
ctcacagtatatgacttcgagcagg

SEQ ID NO: 613440 - DNA, 25 bp, Mus musculus
ctcacatacagacccgctggaagca

SEQ ID NO: 613441 - DNA, 25 bp, Mus musculus
ctcacatacagagccgctggaagca

SEQ ID NO: 613442 - DNA, 25 bp, Mus musculus
ctcacatgagtcagagcacagccca

SEQ ID NO: 613443 - DNA, 25 bp, Mus musculus
ctcacatgagtctgagcacagccca

SEQ ID NO: 613444 - DNA, 25 bp, Mus musculus
ctcacattttgaactcccctcagat

SEQ ID NO: 613445 - DNA, 25 bp, Mus musculus
ctcacattttgatctcccctcagat

SEQ ID NO: 613446 - DNA, 25 bp, Mus musculus
ctcaccaaagtacatgaccaaatct

SEQ ID NO: 613447 - DNA, 25 bp, Mus musculus
ctcaccaaagtagatgaccaaatct

SEQ ID NO: 613448 - DNA, 25 bp, Mus musculus
ctcaccaaattaaaaaggcgttctg

SEQ ID NO: 613449 - DNA, 25 bp, Mus musculus
ctcaccaaattataaaggcgttctg

SEQ ID NO: 613450 - DNA, 25 bp, Mus musculus
ctcaccacgatgacttgtacctcaa

SEQ ID NO: 613451 - DNA, 25 bp, Mus musculus
ctcaccacgatgtcttgtacctcaa

SEQ ID NO: 613452 - DNA, 25 bp, Mus musculus
ctcaccatcaggctgggagtgtgtt

SEQ ID NO: 613453 - DNA, 25 bp, Mus musculus
ctcaccatcagggtgggagtgtgtt

SEQ ID NO: 613454 - DNA, 25 bp, Mus musculus
ctcaccatgggcatcagggtcacta

SEQ ID NO: 613455 - DNA, 25 bp, Mus musculus
ctcaccatgggcttcagggtcacta

SEQ ID NO: 613456 - DNA, 25 bp, Mus musculus
ctcacccagactaacgtcatgatct

SEQ ID NO: 613457 - DNA, 25 bp, Mus musculus
ctcacccagacttacgtcatgatct

SEQ ID NO: 613458 - DNA, 25 bp, Mus musculus
ctcaccctggagcagagaaaatttt

SEQ ID NO: 613459 - DNA, 25 bp, Mus musculus
ctcaccctggaggagagaaaatttt

SEQ ID NO: 613460 - DNA, 25 bp, Mus musculus
ctcaccgaatggacaagcgcttgct

SEQ ID NO: 613461 - DNA, 25 bp, Mus musculus
ctcaccgaatggtcaagcgcttgct

SEQ ID NO: 613462 - DNA, 25 bp, Mus musculus
ctcaccgctgtgagcatggagtgct

SEQ ID NO: 613463 - DNA, 25 bp, Mus musculus
ctcaccgctgtgtgcatggagtgct

SEQ ID NO: 613464 - DNA, 25 bp, Mus musculus
ctcaccggctgcactttaaaaggaa

SEQ ID NO: 613465 - DNA, 25 bp, Mus musculus
ctcaccggctgctctttaaaaggaa

SEQ ID NO: 613466 - DNA, 25 bp, Mus musculus
ctcaccgtataaccgctgcaagggc

SEQ ID NO: 613467 - DNA, 25 bp, Mus musculus
ctcaccgtataagcgctgcaagggc

SEQ ID NO: 613468 - DNA, 25 bp, Mus musculus
ctcaccgtggagcaaggaaagtctg

SEQ ID NO: 613469 - DNA, 25 bp, Mus musculus
ctcaccgtggaggaaggaaagtctg

SEQ ID NO: 613470 - DNA, 25 bp, Mus musculus
ctcaccgtgggtctcctgcaggctg

SEQ ID NO: 613471 - DNA, 25 bp, Mus musculus
ctcaccgtgggtgtcctgcaggctg

SEQ ID NO: 613472 - DNA, 25 bp, Mus musculus
ctcacctattgcactgttcctctgt

SEQ ID NO: 613473 - DNA, 25 bp, Mus musculus
ctcacctattgctctgttcctctgt

SEQ ID NO: 613474 - DNA, 25 bp, Mus musculus
ctcacctcaagccactgtcaagtgg

SEQ ID NO: 613475 - DNA, 25 bp, Mus musculus
ctcacctcaagcgactgtcaagtgg

SEQ ID NO: 613476 - DNA, 25 bp, Mus musculus
ctcacctgacttcaataaaatgctt

SEQ ID NO: 613477 - DNA, 25 bp, Mus musculus
ctcacctgacttgaataaaatgctt

SEQ ID NO: 613478 - DNA, 25 bp, Mus musculus
ctcacctgcggacgcacatggagat

SEQ ID NO: 613479 - DNA, 25 bp, Mus musculus
ctcacctgcggaggcacatggagat

SEQ ID NO: 613480 - DNA, 25 bp, Mus musculus
ctcaccttcagtcacttcaatgcag

SEQ ID NO: 613481 - DNA, 25 bp, Mus musculus
ctcaccttcagtgacttcaatgcag

SEQ ID NO: 613482 - DNA, 25 bp, Mus musculus
ctcaccttctagcaggtctgttact

SEQ ID NO: 613483 - DNA, 25 bp, Mus musculus
ctcaccttctaggaggtctgttact

SEQ ID NO: 613484 - DNA, 25 bp, Mus musculus
ctcacgccaagacggcttaccggga

SEQ ID NO: 613485 - DNA, 25 bp, Mus musculus
ctcacgccaagagggcttaccggga

SEQ ID NO: 613486 - DNA, 25 bp, Mus musculus
ctcacgccggatccgggttgtccct

SEQ ID NO: 613487 - DNA, 25 bp, Mus musculus
ctcacgccggatgcgggttgtccct

SEQ ID NO: 613488 - DNA, 25 bp, Mus musculus
ctcacggtggaacctgagaactgac

SEQ ID NO: 613489 - DNA, 25 bp, Mus musculus
ctcacggtggaagctgagaactgac

SEQ ID NO: 613490 - DNA, 25 bp, Mus musculus
ctcacgtccatgaccgtggcggtgg

SEQ ID NO: 613491 - DNA, 25 bp, Mus musculus
ctcacgtccatgtccgtggcggtgg

SEQ ID NO: 613492 - DNA, 25 bp, Mus musculus
ctcacgtgcctgctggagaagatga

SEQ ID NO: 613493 - DNA, 25 bp, Mus musculus
ctcacgtgcctggtggagaagatga

SEQ ID NO: 613494 - DNA, 25 bp, Mus musculus
ctcacgtgctacagagggagcgaaa

SEQ ID NO: 613495 - DNA, 25 bp, Mus musculus
ctcacgtgctactgagggagcgaaa

SEQ ID NO: 613496 - DNA, 25 bp, Mus musculus
ctcacgtggagaatgcgatgcagaa

SEQ ID NO: 613497 - DNA, 25 bp, Mus musculus
ctcacgtggagattgcgatgcagaa

SEQ ID NO: 613498 - DNA, 25 bp, Mus musculus
ctcacgtggtccaggccggactcgg

SEQ ID NO: 613499 - DNA, 25 bp, Mus musculus
ctcacgtggtcctggccggactcgg

SEQ ID NO: 613500 - DNA, 25 bp, Mus musculus
ctcactaaacagacagaggtgggtg

SEQ ID NO: 613501 - DNA, 25 bp, Mus musculus
ctcactaaacagtcagaggtgggtg

SEQ ID NO: 613502 - DNA, 25 bp, Mus musculus
ctcactaacctgctggtgaagctgt

SEQ ID NO: 613503 - DNA, 25 bp, Mus musculus
ctcactaacctggtggtgaagctgt

SEQ ID NO: 613504 - DNA, 25 bp, Mus musculus
ctcactaccaataaggtttggccta

SEQ ID NO: 613505 - DNA, 25 bp, Mus musculus
ctcactaccaattaggtttggccta

SEQ ID NO: 613506 - DNA, 25 bp, Mus musculus
ctcactactcccagaagatcagttc

SEQ ID NO: 613507 - DNA, 25 bp, Mus musculus
ctcactactccctgaagatcagttc

SEQ ID NO: 613508 - DNA, 25 bp, Mus musculus
ctcactagtagccagtggagcgtca

SEQ ID NO: 613509 - DNA, 25 bp, Mus musculus
ctcactagtagcgagtggagcgtca

SEQ ID NO: 613510 - DNA, 25 bp, Mus musculus
ctcactatcaaactctgtggctgtg

SEQ ID NO: 613511 - DNA, 25 bp, Mus musculus
ctcactatcaaagtctgtggctgtg

SEQ ID NO: 613512 - DNA, 25 bp, Mus musculus
ctcactatctggcaggagcgaggcc

SEQ ID NO: 613513 - DNA, 25 bp, Mus musculus
ctcactatctgggaggagcgaggcc

SEQ ID NO: 613514 - DNA, 25 bp, Mus musculus
ctcactcgaagtcgagcgcagtcgg

SEQ ID NO: 613515 - DNA, 25 bp, Mus musculus
ctcactcgaagtggagcgcagtcgg

SEQ ID NO: 613516 - DNA, 25 bp, Mus musculus
ctcactcttaccacctgtggtggac

SEQ ID NO: 613517 - DNA, 25 bp, Mus musculus
ctcactcttacctcctgtggtggac

SEQ ID NO: 613518 - DNA, 25 bp, Mus musculus
ctcactgaaccgcatctgagaatct

SEQ ID NO: 613519 - DNA, 25 bp, Mus musculus
ctcactgaaccggatctgagaatct

SEQ ID NO: 613520 - DNA, 25 bp, Mus musculus
ctcactgaaggactgcgcaggcgca

SEQ ID NO: 613521 - DNA, 25 bp, Mus musculus
ctcactgaaggagtgcgcaggcgca

SEQ ID NO: 613522 - DNA, 25 bp, Mus musculus
ctcactgacggtctggtgagtgata

SEQ ID NO: 613523 - DNA, 25 bp, Mus musculus
ctcactgacggtgtggtgagtgata

SEQ ID NO: 613524 - DNA, 25 bp, Mus musculus
ctcactgccctcagcttgcagagga

SEQ ID NO: 613525 - DNA, 25 bp, Mus musculus
ctcactgccctctgcttgcagagga

SEQ ID NO: 613526 - DNA, 25 bp, Mus musculus
ctcactgggaaacattgccagaaag

SEQ ID NO: 613527 - DNA, 25 bp, Mus musculus
ctcactgggaaagattgccagaaag

SEQ ID NO: 613528 - DNA, 25 bp, Mus musculus
ctcactgggatgctgatcgggctca

SEQ ID NO: 613529 - DNA, 25 bp, Mus musculus
ctcactgggatggtgatcgggctca

SEQ ID NO: 613530 - DNA, 25 bp, Mus musculus
ctcactgggcttcggttttggcagc

SEQ ID NO: 613531 - DNA, 25 bp, Mus musculus
ctcactgggcttgggttttggcagc

SEQ ID NO: 613532 - DNA, 25 bp, Mus musculus
ctcactgtggatcggaggctctgcc

SEQ ID NO: 613533 - DNA, 25 bp, Mus musculus
ctcactgtggatgggaggctctgcc

SEQ ID NO: 613534 - DNA, 25 bp, Mus musculus
ctcactgtgtgtaagaaagtggtaa

SEQ ID NO: 613535 - DNA, 25 bp, Mus musculus
ctcactgtgtgttagaaagtggtaa

SEQ ID NO: 613536 - DNA, 25 bp, Mus musculus
ctcactgttcagaagggagctgtag

SEQ ID NO: 613537 - DNA, 25 bp, Mus musculus
ctcactgttcagtagggagctgtag

SEQ ID NO: 613538 - DNA, 25 bp, Mus musculus
ctcacttaccgcacgcagttttact

SEQ ID NO: 613539 - DNA, 25 bp, Mus musculus
ctcacttaccgctcgcagttttact

SEQ ID NO: 613540 - DNA, 25 bp, Mus musculus
ctcacttcaattcctgagaagaaag

SEQ ID NO: 613541 - DNA, 25 bp, Mus musculus
ctcacttcaattgctgagaagaaag

SEQ ID NO: 613542 - DNA, 25 bp, Mus musculus
ctcacttcaggtacaacgggcagat

SEQ ID NO: 613543 - DNA, 25 bp, Mus musculus
ctcacttcaggttcaacgggcagat

SEQ ID NO: 613544 - DNA, 25 bp, Mus musculus
ctcacttcatgacattccaccagag

SEQ ID NO: 613545 - DNA, 25 bp, Mus musculus
ctcacttcatgagattccaccagag

SEQ ID NO: 613546 - DNA, 25 bp, Mus musculus
ctcacttgattcagttgaaagtggg

SEQ ID NO: 613547 - DNA, 25 bp, Mus musculus
ctcacttgattctgttgaaagtggg

SEQ ID NO: 613548 - DNA, 25 bp, Mus musculus
ctcactttgtggaagtccactgcac

SEQ ID NO: 613549 - DNA, 25 bp, Mus musculus
ctcactttgtggtagtccactgcac

SEQ ID NO: 613550 - DNA, 25 bp, Mus musculus
ctcagaacattacagggtggcctgt

SEQ ID NO: 613551 - DNA, 25 bp, Mus musculus
ctcagaacattagagggtggcctgt

SEQ ID NO: 613552 - DNA, 25 bp, Mus musculus
ctcagaaccaaaagacagaggcaca

SEQ ID NO: 613553 - DNA, 25 bp, Mus musculus
ctcagaaccaaatgacagaggcaca

SEQ ID NO: 613554 - DNA, 25 bp, Mus musculus
ctcagaagagaacactaagaatggc

SEQ ID NO: 613555 - DNA, 25 bp, Mus musculus
ctcagaagagaagactaagaatggc

SEQ ID NO: 613556 - DNA, 25 bp, Mus musculus
ctcagaagaggactgccggcagtac

SEQ ID NO: 613557 - DNA, 25 bp, Mus musculus
ctcagaagaggagtgccggcagtac

SEQ ID NO: 613558 - DNA, 25 bp, Mus musculus
ctcagaagagggacactactgggtg

SEQ ID NO: 613559 - DNA, 25 bp, Mus musculus
ctcagaagagggtcactactgggtg

SEQ ID NO: 613560 - DNA, 25 bp, Mus musculus
ctcagaaggaggaagacttgggccc

SEQ ID NO: 613561 - DNA, 25 bp, Mus musculus
ctcagaaggaggtagacttgggccc

SEQ ID NO: 613562 - DNA, 25 bp, Mus musculus
ctcagaaggcatcacaatccctggg

SEQ ID NO: 613563 - DNA, 25 bp, Mus musculus
ctcagaaggcatgacaatccctggg

SEQ ID NO: 613564 - DNA, 25 bp, Mus musculus
ctcagaagggagattcttattcaca

SEQ ID NO: 613565 - DNA, 25 bp, Mus musculus
ctcagaagggagtttcttattcaca

SEQ ID NO: 613566 - DNA, 25 bp, Mus musculus
ctcagaagtctaagcagccagcacg

SEQ ID NO: 613567 - DNA, 25 bp, Mus musculus
ctcagaagtctatgcagccagcacg

SEQ ID NO: 613568 - DNA, 25 bp, Mus musculus
ctcagacacatgacatggaagcagt

SEQ ID NO: 613569 - DNA, 25 bp, Mus musculus
ctcagacacatgtcatggaagcagt

SEQ ID NO: 613570 - DNA, 25 bp, Mus musculus
ctcagacatgatatgtggctatgct

SEQ ID NO: 613571 - DNA, 25 bp, Mus musculus
ctcagacatgatttgtggctatgct

SEQ ID NO: 613572 - DNA, 25 bp, Mus musculus
ctcagaccgtgaaggaggtgctgct

SEQ ID NO: 613573 - DNA, 25 bp, Mus musculus
ctcagaccgtgatggaggtgctgct

SEQ ID NO: 613574 - DNA, 25 bp, Mus musculus
ctcagacctcagagaccccatgtgg

SEQ ID NO: 613575 - DNA, 25 bp, Mus musculus
ctcagacctcagtgaccccatgtgg

SEQ ID NO: 613576 - DNA, 25 bp, Mus musculus
ctcagacctctaataaaactcggtt

SEQ ID NO: 613577 - DNA, 25 bp, Mus musculus
ctcagacctctattaaaactcggtt

SEQ ID NO: 613578 - DNA, 25 bp, Mus musculus
ctcagactcagccactatgacaggg

SEQ ID NO: 613579 - DNA, 25 bp, Mus musculus
ctcagactcagcgactatgacaggg

SEQ ID NO: 613580 - DNA, 25 bp, Mus musculus
ctcagactctggctaagcgaagctc

SEQ ID NO: 613581 - DNA, 25 bp, Mus musculus
ctcagactctgggtaagcgaagctc

SEQ ID NO: 613582 - DNA, 25 bp, Mus musculus
ctcagactttgacccgtctcagaac

SEQ ID NO: 613583 - DNA, 25 bp, Mus musculus
ctcagactttgagccgtctcagaac

SEQ ID NO: 613584 - DNA, 25 bp, Mus musculus
ctcagagaagtcagtccttccgcag

SEQ ID NO: 613585 - DNA, 25 bp, Mus musculus
ctcagagaagtctgtccttccgcag

SEQ ID NO: 613586 - DNA, 25 bp, Mus musculus
ctcagagacttaattggacatatag

SEQ ID NO: 613587 - DNA, 25 bp, Mus musculus
ctcagagacttatttggacatatag

SEQ ID NO: 613588 - DNA, 25 bp, Mus musculus
ctcagagaggtcacatggcttgctc

SEQ ID NO: 613589 - DNA, 25 bp, Mus musculus
ctcagagaggtctcatggcttgctc

SEQ ID NO: 613590 - DNA, 25 bp, Mus musculus
ctcagagatcctctgtgctgcctta

SEQ ID NO: 613591 - DNA, 25 bp, Mus musculus
ctcagagatcctgtgtgctgcctta

SEQ ID NO: 613592 - DNA, 25 bp, Mus musculus
ctcagagcaaggcatgacctcatca

SEQ ID NO: 613593 - DNA, 25 bp, Mus musculus
ctcagagcaagggatgacctcatca

SEQ ID NO: 613594 - DNA, 25 bp, Mus musculus
ctcagagcaggtcgcagctgtgaaa

SEQ ID NO: 613595 - DNA, 25 bp, Mus musculus
ctcagagcaggtggcagctgtgaaa

SEQ ID NO: 613596 - DNA, 25 bp, Mus musculus
ctcagagcatgaccgccagtacctg

SEQ ID NO: 613597 - DNA, 25 bp, Mus musculus
ctcagagcatgagcgccagtacctg

SEQ ID NO: 613598 - DNA, 25 bp, Mus musculus
ctcagagccggtacggcgcgtcgac

SEQ ID NO: 613599 - DNA, 25 bp, Mus musculus
ctcagagccggttcggcgcgtcgac

SEQ ID NO: 613600 - DNA, 25 bp, Mus musculus
ctcagaggcttgcaaggccctcctg

SEQ ID NO: 613601 - DNA, 25 bp, Mus musculus
ctcagaggcttggaaggccctcctg

SEQ ID NO: 613602 - DNA, 25 bp, Mus musculus
ctcagagtctggactgctgtgggca

SEQ ID NO: 613603 - DNA, 25 bp, Mus musculus
ctcagagtctggtctgctgtgggca

SEQ ID NO: 613604 - DNA, 25 bp, Mus musculus
ctcagagtgatgcaaaaagttcaac

SEQ ID NO: 613605 - DNA, 25 bp, Mus musculus
ctcagagtgatggaaaaagttcaac

SEQ ID NO: 613606 - DNA, 25 bp, Mus musculus
ctcagagtgcgaagctgaagtggct

SEQ ID NO: 613607 - DNA, 25 bp, Mus musculus
ctcagagtgcgatgctgaagtggct

SEQ ID NO: 613608 - DNA, 25 bp, Mus musculus
ctcagagttacacgatgacctggaa

SEQ ID NO: 613609 - DNA, 25 bp, Mus musculus
ctcagagttacaggatgacctggaa

SEQ ID NO: 613610 - DNA, 25 bp, Mus musculus
ctcagatgacccatgggatgataac

SEQ ID NO: 613611 - DNA, 25 bp, Mus musculus
ctcagatgacccttgggatgataac

SEQ ID NO: 613612 - DNA, 25 bp, Mus musculus
ctcagatgacttcagggccctgctt

SEQ ID NO: 613613 - DNA, 25 bp, Mus musculus
ctcagatgacttgagggccctgctt

SEQ ID NO: 613614 - DNA, 25 bp, Mus musculus
ctcagatgaggacgcccttaaggct

SEQ ID NO: 613615 - DNA, 25 bp, Mus musculus
ctcagatgaggaggcccttaaggct

SEQ ID NO: 613616 - DNA, 25 bp, Mus musculus
ctcagatgtgaaattgggtgaacac

SEQ ID NO: 613617 - DNA, 25 bp, Mus musculus
ctcagatgtgaatttgggtgaacac

SEQ ID NO: 613618 - DNA, 25 bp, Mus musculus
ctcagattatgtcggctccgggcct

SEQ ID NO: 613619 - DNA, 25 bp, Mus musculus
ctcagattatgtgggctccgggcct

SEQ ID NO: 613620 - DNA, 25 bp, Mus musculus
ctcagcaaatgcatggaagacttat

SEQ ID NO: 613621 - DNA, 25 bp, Mus musculus
ctcagcaaatgcttggaagacttat

SEQ ID NO: 613622 - DNA, 25 bp, Mus musculus
ctcagcaagtgccatgctgcagcct

SEQ ID NO: 613623 - DNA, 25 bp, Mus musculus
ctcagcaagtgcgatgctgcagcct

SEQ ID NO: 613624 - DNA, 25 bp, Mus musculus
ctcagcaccaggcaggatctgactc

SEQ ID NO: 613625 - DNA, 25 bp, Mus musculus
ctcagcaccagggaggatctgactc

SEQ ID NO: 613626 - DNA, 25 bp, Mus musculus
ctcagcaccatgaggcacgaggctc

SEQ ID NO: 613627 - DNA, 25 bp, Mus musculus
ctcagcaccatgtggcacgaggctc

SEQ ID NO: 613628 - DNA, 25 bp, Mus musculus
ctcagcaccgacagggctcgtatca

SEQ ID NO: 613629 - DNA, 25 bp, Mus musculus
ctcagcaccgactgggctcgtatca

SEQ ID NO: 613630 - DNA, 25 bp, Mus musculus
ctcagcacgaaacggtttgcaggtg

SEQ ID NO: 613631 - DNA, 25 bp, Mus musculus
ctcagcacgaaagggtttgcaggtg

SEQ ID NO: 613632 - DNA, 25 bp, Mus musculus
ctcagcacgacacgtgaggcggact

SEQ ID NO: 613633 - DNA, 25 bp, Mus musculus
ctcagcacgacaggtgaggcggact

SEQ ID NO: 613634 - DNA, 25 bp, Mus musculus
ctcagcactgcaatcgttaaagaaa

SEQ ID NO: 613635 - DNA, 25 bp, Mus musculus
ctcagcactgcattcgttaaagaaa

SEQ ID NO: 613636 - DNA, 25 bp, Mus musculus
ctcagcagagtgcaaccagcagaca

SEQ ID NO: 613637 - DNA, 25 bp, Mus musculus
ctcagcagagtggaaccagcagaca

SEQ ID NO: 613638 - DNA, 25 bp, Mus musculus
ctcagcagcccgaggtactggacgg

SEQ ID NO: 613639 - DNA, 25 bp, Mus musculus
ctcagcagcccgtggtactggacgg

SEQ ID NO: 613640 - DNA, 25 bp, Mus musculus
ctcagcagggcacatgaggacctca

SEQ ID NO: 613641 - DNA, 25 bp, Mus musculus
ctcagcagggcagatgaggacctca

SEQ ID NO: 613642 - DNA, 25 bp, Mus musculus
ctcagccagtggcatgctcccagtt

SEQ ID NO: 613643 - DNA, 25 bp, Mus musculus
ctcagccagtgggatgctcccagtt

SEQ ID NO: 613644 - DNA, 25 bp, Mus musculus
ctcagccctgcaacctcttttattt

SEQ ID NO: 613645 - DNA, 25 bp, Mus musculus
ctcagccctgcatcctcttttattt

SEQ ID NO: 613646 - DNA, 25 bp, Mus musculus
ctcagccgaaggattgcatttccag

SEQ ID NO: 613647 - DNA, 25 bp, Mus musculus
ctcagccgaaggtttgcatttccag

SEQ ID NO: 613648 - DNA, 25 bp, Mus musculus
ctcagccgggacataagccgctcag

SEQ ID NO: 613649 - DNA, 25 bp, Mus musculus
ctcagccgggacttaagccgctcag

SEQ ID NO: 613650 - DNA, 25 bp, Mus musculus
ctcagcctagacaagaacctccgtt

SEQ ID NO: 613651 - DNA, 25 bp, Mus musculus
ctcagcctagactagaacctccgtt

SEQ ID NO: 613652 - DNA, 25 bp, Mus musculus
ctcagcctcagacggcgacgaggac

SEQ ID NO: 613653 - DNA, 25 bp, Mus musculus
ctcagcctcagagggcgacgaggac

SEQ ID NO: 613654 - DNA, 25 bp, Mus musculus
ctcagcctcctgatgttattggtcc

SEQ ID NO: 613655 - DNA, 25 bp, Mus musculus
ctcagcctcctgttgttattggtcc

SEQ ID NO: 613656 - DNA, 25 bp, Mus musculus
ctcagcctgtatctatattttcgac

SEQ ID NO: 613657 - DNA, 25 bp, Mus musculus
ctcagcctgtatgtatattttcgac

SEQ ID NO: 613658 - DNA, 25 bp, Mus musculus
ctcagcctgtctaagcacaaatatg

SEQ ID NO: 613659 - DNA, 25 bp, Mus musculus
ctcagcctgtcttagcacaaatatg

SEQ ID NO: 613660 - DNA, 25 bp, Mus musculus
ctcagcctgtggacctgatgccaac

SEQ ID NO: 613661 - DNA, 25 bp, Mus musculus
ctcagcctgtggtcctgatgccaac

SEQ ID NO: 613662 - DNA, 25 bp, Mus musculus
ctcagcgatgcgattgcccgggtga

SEQ ID NO: 613663 - DNA, 25 bp, Mus musculus
ctcagcgatgcgtttgcccgggtga

SEQ ID NO: 613664 - DNA, 25 bp, Mus musculus
ctcagctcatccctaagaccaagat

SEQ ID NO: 613665 - DNA, 25 bp, Mus musculus
ctcagctcatccgtaagaccaagat

SEQ ID NO: 613666 - DNA, 25 bp, Mus musculus
ctcagctccagtcgcaagagcagca

SEQ ID NO: 613667 - DNA, 25 bp, Mus musculus
ctcagctccagtggcaagagcagca

SEQ ID NO: 613668 - DNA, 25 bp, Mus musculus
ctcagctccgaaatacgtatagaaa

SEQ ID NO: 613669 - DNA, 25 bp, Mus musculus
ctcagctccgaattacgtatagaaa

SEQ ID NO: 613670 - DNA, 25 bp, Mus musculus
ctcagctctgacatggcccactgaa

SEQ ID NO: 613671 - DNA, 25 bp, Mus musculus
ctcagctctgacttggcccactgaa

SEQ ID NO: 613672 - DNA, 25 bp, Mus musculus
ctcagctgtgatagagggacctccc

SEQ ID NO: 613673 - DNA, 25 bp, Mus musculus
ctcagctgtgattgagggacctccc

SEQ ID NO: 613674 - DNA, 25 bp, Mus musculus
ctcagcttctaccagcagcaggagg

SEQ ID NO: 613675 - DNA, 25 bp, Mus musculus
ctcagcttctacgagcagcaggagg

SEQ ID NO: 613676 - DNA, 25 bp, Mus musculus
ctcagctttcctattgggaggaagt

SEQ ID NO: 613677 - DNA, 25 bp, Mus musculus
ctcagctttccttttgggaggaagt

SEQ ID NO: 613678 - DNA, 25 bp, Mus musculus
ctcagctttgtgctaaaggagaatg

SEQ ID NO: 613679 - DNA, 25 bp, Mus musculus
ctcagctttgtggtaaaggagaatg

SEQ ID NO: 613680 - DNA, 25 bp, Mus musculus
ctcaggaaaatgcaaacagcggcgg

SEQ ID NO: 613681 - DNA, 25 bp, Mus musculus
ctcaggaaaatggaaacagcggcgg

SEQ ID NO: 613682 - DNA, 25 bp, Mus musculus
ctcaggaactccacagttataacat

SEQ ID NO: 613683 - DNA, 25 bp, Mus musculus
ctcaggaactcctcagttataacat

SEQ ID NO: 613684 - DNA, 25 bp, Mus musculus
ctcaggacacggaagcgcaagtcag

SEQ ID NO: 613685 - DNA, 25 bp, Mus musculus
ctcaggacacggtagcgcaagtcag

SEQ ID NO: 613686 - DNA, 25 bp, Mus musculus
ctcaggaccgataaaggaaggaaat

SEQ ID NO: 613687 - DNA, 25 bp, Mus musculus
ctcaggaccgattaaggaaggaaat

SEQ ID NO: 613688 - DNA, 25 bp, Mus musculus
ctcaggactgttcgccctggtgtct

SEQ ID NO: 613689 - DNA, 25 bp, Mus musculus
ctcaggactgttggccctggtgtct

SEQ ID NO: 613690 - DNA, 25 bp, Mus musculus
ctcaggagagaacgcttcctacaag

SEQ ID NO: 613691 - DNA, 25 bp, Mus musculus
ctcaggagagaaggcttcctacaag

SEQ ID NO: 613692 - DNA, 25 bp, Mus musculus
ctcaggagagccctgcaggaccatt

SEQ ID NO: 613693 - DNA, 25 bp, Mus musculus
ctcaggagagccgtgcaggaccatt

SEQ ID NO: 613694 - DNA, 25 bp, Mus musculus
ctcaggagagcgagggcctcgtaca

SEQ ID NO: 613695 - DNA, 25 bp, Mus musculus
ctcaggagagcgtgggcctcgtaca

SEQ ID NO: 613696 - DNA, 25 bp, Mus musculus
ctcaggagatgaagcggcccgcata

SEQ ID NO: 613697 - DNA, 25 bp, Mus musculus
ctcaggagatgatgcggcccgcata

SEQ ID NO: 613698 - DNA, 25 bp, Mus musculus
ctcaggagcaagcagccacagaaca

SEQ ID NO: 613699 - DNA, 25 bp, Mus musculus
ctcaggagcaaggagccacagaaca

SEQ ID NO: 613700 - DNA, 25 bp, Mus musculus
ctcaggagggccagtgtgacaagaa

SEQ ID NO: 613701 - DNA, 25 bp, Mus musculus
ctcaggagggcctgtgtgacaagaa

SEQ ID NO: 613702 - DNA, 25 bp, Mus musculus
ctcaggagtcatctgcaggcataat

SEQ ID NO: 613703 - DNA, 25 bp, Mus musculus
ctcaggagtcatgtgcaggcataat

SEQ ID NO: 613704 - DNA, 25 bp, Mus musculus
ctcaggcaatttcacgatttgcttc

SEQ ID NO: 613705 - DNA, 25 bp, Mus musculus
ctcaggcaatttgacgatttgcttc

SEQ ID NO: 613706 - DNA, 25 bp, Mus musculus
ctcaggcacggtacttggacaagga

SEQ ID NO: 613707 - DNA, 25 bp, Mus musculus
ctcaggcacggttcttggacaagga

SEQ ID NO: 613708 - DNA, 25 bp, Mus musculus
ctcaggctgctgaggttcatgccac

SEQ ID NO: 613709 - DNA, 25 bp, Mus musculus
ctcaggctgctgtggttcatgccac

SEQ ID NO: 613710 - DNA, 25 bp, Mus musculus
ctcaggctggagagacacccttttc

SEQ ID NO: 613711 - DNA, 25 bp, Mus musculus
ctcaggctggagtgacacccttttc

SEQ ID NO: 613712 - DNA, 25 bp, Mus musculus
ctcaggctggccaggttctgcccaa

SEQ ID NO: 613713 - DNA, 25 bp, Mus musculus
ctcaggctggcctggttctgcccaa

SEQ ID NO: 613714 - DNA, 25 bp, Mus musculus
ctcagggatgagacatggacaggtc

SEQ ID NO: 613715 - DNA, 25 bp, Mus musculus
ctcagggatgagtcatggacaggtc

SEQ ID NO: 613716 - DNA, 25 bp, Mus musculus
ctcagggcaagaagagtccgcgact

SEQ ID NO: 613717 - DNA, 25 bp, Mus musculus
ctcagggcaagatgagtccgcgact

SEQ ID NO: 613718 - DNA, 25 bp, Mus musculus
ctcaggggctcacggtgctgttttc

SEQ ID NO: 613719 - DNA, 25 bp, Mus musculus
ctcaggggctcagggtgctgttttc

SEQ ID NO: 613720 - DNA, 25 bp, Mus musculus
ctcagggtatggatctgttggcata

SEQ ID NO: 613721 - DNA, 25 bp, Mus musculus
ctcagggtatggttctgttggcata

SEQ ID NO: 613722 - DNA, 25 bp, Mus musculus
ctcagggtccgaagttcgcgagcgt

SEQ ID NO: 613723 - DNA, 25 bp, Mus musculus
ctcagggtccgatgttcgcgagcgt

SEQ ID NO: 613724 - DNA, 25 bp, Mus musculus
ctcaggtcaacccaaagcagcaaag

SEQ ID NO: 613725 - DNA, 25 bp, Mus musculus
ctcaggtcaaccgaaagcagcaaag

SEQ ID NO: 613726 - DNA, 25 bp, Mus musculus
ctcaggtcacctcgagagcacttca

SEQ ID NO: 613727 - DNA, 25 bp, Mus musculus
ctcaggtcacctggagagcacttca

SEQ ID NO: 613728 - DNA, 25 bp, Mus musculus
ctcaggtggagtattatcagggctc

SEQ ID NO: 613729 - DNA, 25 bp, Mus musculus
ctcaggtggagttttatcagggctc

SEQ ID NO: 613730 - DNA, 25 bp, Mus musculus
ctcaggttggacagagtcactggcc

SEQ ID NO: 613731 - DNA, 25 bp, Mus musculus
ctcaggttggactgagtcactggcc

SEQ ID NO: 613732 - DNA, 25 bp, Mus musculus
ctcagtacaaggaagctgaccccat

SEQ ID NO: 613733 - DNA, 25 bp, Mus musculus
ctcagtacaaggtagctgaccccat

SEQ ID NO: 613734 - DNA, 25 bp, Mus musculus
ctcagtatcatgaaggaatttaaaa

SEQ ID NO: 613735 - DNA, 25 bp, Mus musculus
ctcagtatcatgtaggaatttaaaa

SEQ ID NO: 613736 - DNA, 25 bp, Mus musculus
ctcagtatggaacatactacgttga

SEQ ID NO: 613737 - DNA, 25 bp, Mus musculus
ctcagtatggaagatactacgttga

SEQ ID NO: 613738 - DNA, 25 bp, Mus musculus
ctcagtcaacaccagccaggagcta

SEQ ID NO: 613739 - DNA, 25 bp, Mus musculus
ctcagtcaacacgagccaggagcta

SEQ ID NO: 613740 - DNA, 25 bp, Mus musculus
ctcagtcatcttcccgagaaagatc

SEQ ID NO: 613741 - DNA, 25 bp, Mus musculus
ctcagtcatcttgccgagaaagatc

SEQ ID NO: 613742 - DNA, 25 bp, Mus musculus
ctcagtcatgaactccgggtagcga

SEQ ID NO: 613743 - DNA, 25 bp, Mus musculus
ctcagtcatgaagtccgggtagcga

SEQ ID NO: 613744 - DNA, 25 bp, Mus musculus
ctcagtcctatgacacagacctcag

SEQ ID NO: 613745 - DNA, 25 bp, Mus musculus
ctcagtcctatgtcacagacctcag

SEQ ID NO: 613746 - DNA, 25 bp, Mus musculus
ctcagtcgacttctgcaggcaatcg

SEQ ID NO: 613747 - DNA, 25 bp, Mus musculus
ctcagtcgacttgtgcaggcaatcg

SEQ ID NO: 613748 - DNA, 25 bp, Mus musculus
ctcagtctcgcacagcatcgaggag

SEQ ID NO: 613749 - DNA, 25 bp, Mus musculus
ctcagtctcgcagagcatcgaggag

SEQ ID NO: 613750 - DNA, 25 bp, Mus musculus
ctcagtgaacctctttgtagtgaac

SEQ ID NO: 613751 - DNA, 25 bp, Mus musculus
ctcagtgaacctgtttgtagtgaac

SEQ ID NO: 613752 - DNA, 25 bp, Mus musculus
ctcagtgaagccaagaactactttg

SEQ ID NO: 613753 - DNA, 25 bp, Mus musculus
ctcagtgaagcctagaactactttg

SEQ ID NO: 613754 - DNA, 25 bp, Mus musculus
ctcagtgaccttaccagtgtgcagc

SEQ ID NO: 613755 - DNA, 25 bp, Mus musculus
ctcagtgacctttccagtgtgcagc

SEQ ID NO: 613756 - DNA, 25 bp, Mus musculus
ctcagtgcagaaattttggaacaac

SEQ ID NO: 613757 - DNA, 25 bp, Mus musculus
ctcagtgcagaatttttggaacaac

SEQ ID NO: 613758 - DNA, 25 bp, Mus musculus
ctcagtgcctccatgaggagtataa

SEQ ID NO: 613759 - DNA, 25 bp, Mus musculus
ctcagtgcctccttgaggagtataa

SEQ ID NO: 613760 - DNA, 25 bp, Mus musculus
ctcagtgcgattcttgacattgaac

SEQ ID NO: 613761 - DNA, 25 bp, Mus musculus
ctcagtgcgattgttgacattgaac

SEQ ID NO: 613762 - DNA, 25 bp, Mus musculus
ctcagtgctatgctttcaatggtca

SEQ ID NO: 613763 - DNA, 25 bp, Mus musculus
ctcagtgctatggtttcaatggtca

SEQ ID NO: 613764 - DNA, 25 bp, Mus musculus
ctcagtggatctcagtcctccatgt

SEQ ID NO: 613765 - DNA, 25 bp, Mus musculus
ctcagtggatctgagtcctccatgt

SEQ ID NO: 613766 - DNA, 25 bp, Mus musculus
ctcagtggcgctcgctacagttgtc

SEQ ID NO: 613767 - DNA, 25 bp, Mus musculus
ctcagtggcgctggctacagttgtc

SEQ ID NO: 613768 - DNA, 25 bp, Mus musculus
ctcagtggctgtcgctggaccatga

SEQ ID NO: 613769 - DNA, 25 bp, Mus musculus
ctcagtggctgtggctggaccatga

SEQ ID NO: 613770 - DNA, 25 bp, Mus musculus
ctcagtggtgatagtgggttctgta

SEQ ID NO: 613771 - DNA, 25 bp, Mus musculus
ctcagtggtgattgtgggttctgta

SEQ ID NO: 613772 - DNA, 25 bp, Mus musculus
ctcagtgtctatcggccggatgtgt

SEQ ID NO: 613773 - DNA, 25 bp, Mus musculus
ctcagtgtctatgggccggatgtgt

SEQ ID NO: 613774 - DNA, 25 bp, Mus musculus
ctcagtgtggccactgtgcgcccag

SEQ ID NO: 613775 - DNA, 25 bp, Mus musculus
ctcagtgtggcctctgtgcgcccag

SEQ ID NO: 613776 - DNA, 25 bp, Mus musculus
ctcagtgtgtgcaacagcgctgctg

SEQ ID NO: 613777 - DNA, 25 bp, Mus musculus
ctcagtgtgtgctacagcgctgctg

SEQ ID NO: 613778 - DNA, 25 bp, Mus musculus
ctcagtgtttagagagcgagaagca

SEQ ID NO: 613779 - DNA, 25 bp, Mus musculus
ctcagtgtttagtgagcgagaagca

SEQ ID NO: 613780 - DNA, 25 bp, Mus musculus
ctcagtgtttcaagttgtcataaaa

SEQ ID NO: 613781 - DNA, 25 bp, Mus musculus
ctcagtgtttcatgttgtcataaaa

SEQ ID NO: 613782 - DNA, 25 bp, Mus musculus
ctcagttaactgaaccggcacctcg

SEQ ID NO: 613783 - DNA, 25 bp, Mus musculus
ctcagttaactgtaccggcacctcg

SEQ ID NO: 613784 - DNA, 25 bp, Mus musculus
ctcagttctgacaccagggatggac

SEQ ID NO: 613785 - DNA, 25 bp, Mus musculus
ctcagttctgactccagggatggac

SEQ ID NO: 613786 - DNA, 25 bp, Mus musculus
ctcagttgaagtaattcatccagga

SEQ ID NO: 613787 - DNA, 25 bp, Mus musculus
ctcagttgaagttattcatccagga

SEQ ID NO: 613788 - DNA, 25 bp, Mus musculus
ctcagttgcgaaagagtcatgaaac

SEQ ID NO: 613789 - DNA, 25 bp, Mus musculus
ctcagttgcgaatgagtcatgaaac

SEQ ID NO: 613790 - DNA, 25 bp, Mus musculus
ctcagttgcgatcgaagcaggcccc

SEQ ID NO: 613791 - DNA, 25 bp, Mus musculus
ctcagttgcgatggaagcaggcccc

SEQ ID NO: 613792 - DNA, 25 bp, Mus musculus
ctcagttgggtaccacagcttgtcc

SEQ ID NO: 613793 - DNA, 25 bp, Mus musculus
ctcagttgggtagcacagcttgtcc

SEQ ID NO: 613794 - DNA, 25 bp, Mus musculus
ctcagtttgaaaatccagtggagga

SEQ ID NO: 613795 - DNA, 25 bp, Mus musculus
ctcagtttgaaattccagtggagga

SEQ ID NO: 613796 - DNA, 25 bp, Mus musculus
ctcataccaaggatgtcgccttcct

SEQ ID NO: 613797 - DNA, 25 bp, Mus musculus
ctcataccaaggttgtcgccttcct

SEQ ID NO: 613798 - DNA, 25 bp, Mus musculus
ctcatacggaccaggagtaggagcg

SEQ ID NO: 613799 - DNA, 25 bp, Mus musculus
ctcatacggacctggagtaggagcg

SEQ ID NO: 613800 - DNA, 25 bp, Mus musculus
ctcatactttggagcttctgtctgc

SEQ ID NO: 613801 - DNA, 25 bp, Mus musculus
ctcatactttggtgcttctgtctgc

SEQ ID NO: 613802 - DNA, 25 bp, Mus musculus
ctcatagccttgctgctggaggctc

SEQ ID NO: 613803 - DNA, 25 bp, Mus musculus
ctcatagccttggtgctggaggctc

SEQ ID NO: 613804 - DNA, 25 bp, Mus musculus
ctcataggatggatggaatgtaaag

SEQ ID NO: 613805 - DNA, 25 bp, Mus musculus
ctcataggatggttggaatgtaaag

SEQ ID NO: 613806 - DNA, 25 bp, Mus musculus
ctcatatctcacacctagctggtgc

SEQ ID NO: 613807 - DNA, 25 bp, Mus musculus
ctcatatctcactcctagctggtgc

SEQ ID NO: 613808 - DNA, 25 bp, Mus musculus
ctcatcaaaccaaaggtcatggagg

SEQ ID NO: 613809 - DNA, 25 bp, Mus musculus
ctcatcaaaccataggtcatggagg

SEQ ID NO: 613810 - DNA, 25 bp, Mus musculus
ctcatcaactgtcctgttggcatgg

SEQ ID NO: 613811 - DNA, 25 bp, Mus musculus
ctcatcaactgtgctgttggcatgg

SEQ ID NO: 613812 - DNA, 25 bp, Mus musculus
ctcatcaatgagattgaccttccag

SEQ ID NO: 613813 - DNA, 25 bp, Mus musculus
ctcatcaatgagtttgaccttccag

SEQ ID NO: 613814 - DNA, 25 bp, Mus musculus
ctcatcaatgccctttccaatatca

SEQ ID NO: 613815 - DNA, 25 bp, Mus musculus
ctcatcaatgccgtttccaatatca

SEQ ID NO: 613816 - DNA, 25 bp, Mus musculus
ctcatcaccaatcatgaggcctatg

SEQ ID NO: 613817 - DNA, 25 bp, Mus musculus
ctcatcaccaatgatgaggcctatg

SEQ ID NO: 613818 - DNA, 25 bp, Mus musculus
ctcatcagaacaagctagaagaaat

SEQ ID NO: 613819 - DNA, 25 bp, Mus musculus
ctcatcagaacatgctagaagaaat

SEQ ID NO: 613820 - DNA, 25 bp, Mus musculus
ctcatcagtggcaccaatgcccggt

SEQ ID NO: 613821 - DNA, 25 bp, Mus musculus
ctcatcagtggctccaatgcccggt

SEQ ID NO: 613822 - DNA, 25 bp, Mus musculus
ctcatcatacagagcaggtctgttc

SEQ ID NO: 613823 - DNA, 25 bp, Mus musculus
ctcatcatacagtgcaggtctgttc

SEQ ID NO: 613824 - DNA, 25 bp, Mus musculus
ctcatcatggcgcaccctagagata

SEQ ID NO: 613825 - DNA, 25 bp, Mus musculus
ctcatcatggcggaccctagagata

SEQ ID NO: 613826 - DNA, 25 bp, Mus musculus
ctcatccagcctaatggcgaatggt

SEQ ID NO: 613827 - DNA, 25 bp, Mus musculus
ctcatccagccttatggcgaatggt

SEQ ID NO: 613828 - DNA, 25 bp, Mus musculus
ctcatccagtccagtggcctcggag

SEQ ID NO: 613829 - DNA, 25 bp, Mus musculus
ctcatccagtcctgtggcctcggag

SEQ ID NO: 613830 - DNA, 25 bp, Mus musculus
ctcatccattgaatttgggtacatg

SEQ ID NO: 613831 - DNA, 25 bp, Mus musculus
ctcatccattgattttgggtacatg

SEQ ID NO: 613832 - DNA, 25 bp, Mus musculus
ctcatccgggcgacgcgggccttaa

SEQ ID NO: 613833 - DNA, 25 bp, Mus musculus
ctcatccgggcgtcgcgggccttaa

SEQ ID NO: 613834 - DNA, 25 bp, Mus musculus
ctcatcctgggacgccgagaggaca

SEQ ID NO: 613835 - DNA, 25 bp, Mus musculus
ctcatcctgggaggccgagaggaca

SEQ ID NO: 613836 - DNA, 25 bp, Mus musculus
ctcatcgattatcgaaagctgggcg

SEQ ID NO: 613837 - DNA, 25 bp, Mus musculus
ctcatcgattatggaaagctgggcg

SEQ ID NO: 613838 - DNA, 25 bp, Mus musculus
ctcatcggagcccaagtcccaggga

SEQ ID NO: 613839 - DNA, 25 bp, Mus musculus
ctcatcggagccgaagtcccaggga

SEQ ID NO: 613840 - DNA, 25 bp, Mus musculus
ctcatcggtgaacctgcagggaagc

SEQ ID NO: 613841 - DNA, 25 bp, Mus musculus
ctcatcggtgaagctgcagggaagc

SEQ ID NO: 613842 - DNA, 25 bp, Mus musculus
ctcatcgtggacagggatgtgcacc

SEQ ID NO: 613843 - DNA, 25 bp, Mus musculus
ctcatcgtggactgggatgtgcacc

SEQ ID NO: 613844 - DNA, 25 bp, Mus musculus
ctcatcgtgggtctgcatacggatg

SEQ ID NO: 613845 - DNA, 25 bp, Mus musculus
ctcatcgtgggtgtgcatacggatg

SEQ ID NO: 613846 - DNA, 25 bp, Mus musculus
ctcatctatgagcactgcatggacc

SEQ ID NO: 613847 - DNA, 25 bp, Mus musculus
ctcatctatgaggactgcatggacc

SEQ ID NO: 613848 - DNA, 25 bp, Mus musculus
ctcatctctggtctgcttagctaca

SEQ ID NO: 613849 - DNA, 25 bp, Mus musculus
ctcatctctggtgtgcttagctaca

SEQ ID NO: 613850 - DNA, 25 bp, Mus musculus
ctcatctgaggacccggtgcttacc

SEQ ID NO: 613851 - DNA, 25 bp, Mus musculus
ctcatctgaggagccggtgcttacc

SEQ ID NO: 613852 - DNA, 25 bp, Mus musculus
ctcatctttttcagctctaggaatg

SEQ ID NO: 613853 - DNA, 25 bp, Mus musculus
ctcatctttttctgctctaggaatg

SEQ ID NO: 613854 - DNA, 25 bp, Mus musculus
ctcatctttttgaagagtgctacaa

SEQ ID NO: 613855 - DNA, 25 bp, Mus musculus
ctcatctttttgtagagtgctacaa

SEQ ID NO: 613856 - DNA, 25 bp, Mus musculus
ctcatgaatgcccacagtatgggca

SEQ ID NO: 613857 - DNA, 25 bp, Mus musculus
ctcatgaatgccgacagtatgggca

SEQ ID NO: 613858 - DNA, 25 bp, Mus musculus
ctcatgacagctctgaacatacggg

SEQ ID NO: 613859 - DNA, 25 bp, Mus musculus
ctcatgacagctgtgaacatacggg

SEQ ID NO: 613860 - DNA, 25 bp, Mus musculus
ctcatgacctctctgacagtccata

SEQ ID NO: 613861 - DNA, 25 bp, Mus musculus
ctcatgacctctgtgacagtccata

SEQ ID NO: 613862 - DNA, 25 bp, Mus musculus
ctcatgacgaacaatttctatgcag

SEQ ID NO: 613863 - DNA, 25 bp, Mus musculus
ctcatgacgaactatttctatgcag

SEQ ID NO: 613864 - DNA, 25 bp, Mus musculus
ctcatgacttttccccagtatggag

SEQ ID NO: 613865 - DNA, 25 bp, Mus musculus
ctcatgacttttgcccagtatggag

SEQ ID NO: 613866 - DNA, 25 bp, Mus musculus
ctcatgagctggcactcctggtgat

SEQ ID NO: 613867 - DNA, 25 bp, Mus musculus
ctcatgagctgggactcctggtgat

SEQ ID NO: 613868 - DNA, 25 bp, Mus musculus
ctcatgcaacggagctggcatgcag

SEQ ID NO: 613869 - DNA, 25 bp, Mus musculus
ctcatgcaacggtgctggcatgcag

SEQ ID NO: 613870 - DNA, 25 bp, Mus musculus
ctcatgcacactcaccagactgtgg

SEQ ID NO: 613871 - DNA, 25 bp, Mus musculus
ctcatgcacactgaccagactgtgg

SEQ ID NO: 613872 - DNA, 25 bp, Mus musculus
ctcatgcaccttcggaagaaaacgg

SEQ ID NO: 613873 - DNA, 25 bp, Mus musculus
ctcatgcaccttgggaagaaaacgg

SEQ ID NO: 613874 - DNA, 25 bp, Mus musculus
ctcatgcagcgacctgtgcagcaga

SEQ ID NO: 613875 - DNA, 25 bp, Mus musculus
ctcatgcagcgagctgtgcagcaga

SEQ ID NO: 613876 - DNA, 25 bp, Mus musculus
ctcatgcagtccaaggcactgactg

SEQ ID NO: 613877 - DNA, 25 bp, Mus musculus
ctcatgcagtcctaggcactgactg

SEQ ID NO: 613878 - DNA, 25 bp, Mus musculus
ctcatgcccatacgaagatgcctgg

SEQ ID NO: 613879 - DNA, 25 bp, Mus musculus
ctcatgcccataggaagatgcctgg

SEQ ID NO: 613880 - DNA, 25 bp, Mus musculus
ctcatgcgccataactgcctgtgct

SEQ ID NO: 613881 - DNA, 25 bp, Mus musculus
ctcatgcgccattactgcctgtgct

SEQ ID NO: 613882 - DNA, 25 bp, Mus musculus
ctcatgctgcctcatggtatcactg

SEQ ID NO: 613883 - DNA, 25 bp, Mus musculus
ctcatgctgcctgatggtatcactg

SEQ ID NO: 613884 - DNA, 25 bp, Mus musculus
ctcatgctggacaaggacgggcaca

SEQ ID NO: 613885 - DNA, 25 bp, Mus musculus
ctcatgctggactaggacgggcaca

SEQ ID NO: 613886 - DNA, 25 bp, Mus musculus
ctcatggaccaaacggtgagagaag

SEQ ID NO: 613887 - DNA, 25 bp, Mus musculus
ctcatggaccaatcggtgagagaag

SEQ ID NO: 613888 - DNA, 25 bp, Mus musculus
ctcatggaccgacgaggatgtgaac

SEQ ID NO: 613889 - DNA, 25 bp, Mus musculus
ctcatggaccgaggaggatgtgaac

SEQ ID NO: 613890 - DNA, 25 bp, Mus musculus
ctcatggattgaccaggcggcagca

SEQ ID NO: 613891 - DNA, 25 bp, Mus musculus
ctcatggattgagcaggcggcagca

SEQ ID NO: 613892 - DNA, 25 bp, Mus musculus
ctcatgggcttaagagtgggccgaa

SEQ ID NO: 613893 - DNA, 25 bp, Mus musculus
ctcatgggcttatgagtgggccgaa

SEQ ID NO: 613894 - DNA, 25 bp, Mus musculus
ctcatgtacaccatctgcacagact

SEQ ID NO: 613895 - DNA, 25 bp, Mus musculus
ctcatgtacaccttctgcacagact

SEQ ID NO: 613896 - DNA, 25 bp, Mus musculus
ctcatgtcatagagcattgtgctgc

SEQ ID NO: 613897 - DNA, 25 bp, Mus musculus
ctcatgtcatagtgcattgtgctgc

SEQ ID NO: 613898 - DNA, 25 bp, Mus musculus
ctcatgtggaagcatacagagtatt

SEQ ID NO: 613899 - DNA, 25 bp, Mus musculus
ctcatgtggaaggatacagagtatt

SEQ ID NO: 613900 - DNA, 25 bp, Mus musculus
ctcatgtggaccagtatgaaaccaa

SEQ ID NO: 613901 - DNA, 25 bp, Mus musculus
ctcatgtggacctgtatgaaaccaa

SEQ ID NO: 613902 - DNA, 25 bp, Mus musculus
ctcatgtgtcccaagctggttttgg

SEQ ID NO: 613903 - DNA, 25 bp, Mus musculus
ctcatgtgtccctagctggttttgg

SEQ ID NO: 613904 - DNA, 25 bp, Mus musculus
ctcatgttaatgcaggtccacttta

SEQ ID NO: 613905 - DNA, 25 bp, Mus musculus
ctcatgttaatggaggtccacttta

SEQ ID NO: 613906 - DNA, 25 bp, Mus musculus
ctcattacgtatctggagctgccac

SEQ ID NO: 613907 - DNA, 25 bp, Mus musculus
ctcattacgtatgtggagctgccac

SEQ ID NO: 613908 - DNA, 25 bp, Mus musculus
ctcattagctgtccgctcgggctcg

SEQ ID NO: 613909 - DNA, 25 bp, Mus musculus
ctcattagctgtgcgctcgggctcg

SEQ ID NO: 613910 - DNA, 25 bp, Mus musculus
ctcattccaggtctgttctcctggc

SEQ ID NO: 613911 - DNA, 25 bp, Mus musculus
ctcattccaggtgtgttctcctggc

SEQ ID NO: 613912 - DNA, 25 bp, Mus musculus
ctcattcgcttgcaagagctcatca

SEQ ID NO: 613913 - DNA, 25 bp, Mus musculus
ctcattcgcttggaagagctcatca

SEQ ID NO: 613914 - DNA, 25 bp, Mus musculus
ctcattcggagtccccggcgtgtcg

SEQ ID NO: 613915 - DNA, 25 bp, Mus musculus
ctcattcggagtgcccggcgtgtcg

SEQ ID NO: 613916 - DNA, 25 bp, Mus musculus
ctcattcggcgacggcgacgagaac

SEQ ID NO: 613917 - DNA, 25 bp, Mus musculus
ctcattcggcgagggcgacgagaac

SEQ ID NO: 613918 - DNA, 25 bp, Mus musculus
ctcattctagtgagtgcttggcact

SEQ ID NO: 613919 - DNA, 25 bp, Mus musculus
ctcattctagtgtgtgcttggcact

SEQ ID NO: 613920 - DNA, 25 bp, Mus musculus
ctcattgaagacatagttcgagatg

SEQ ID NO: 613921 - DNA, 25 bp, Mus musculus
ctcattgaagacttagttcgagatg

SEQ ID NO: 613922 - DNA, 25 bp, Mus musculus
ctcattgaccctattgacctggatg

SEQ ID NO: 613923 - DNA, 25 bp, Mus musculus
ctcattgacccttttgacctggatg

SEQ ID NO: 613924 - DNA, 25 bp, Mus musculus
ctcattgccaagctgccgtgcgttg

SEQ ID NO: 613925 - DNA, 25 bp, Mus musculus
ctcattgccaaggtgccgtgcgttg

SEQ ID NO: 613926 - DNA, 25 bp, Mus musculus
ctcattgctcggcatgctaaaattg

SEQ ID NO: 613927 - DNA, 25 bp, Mus musculus
ctcattgctcgggatgctaaaattg

SEQ ID NO: 613928 - DNA, 25 bp, Mus musculus
ctcattggctaaccatcgaaggctg

SEQ ID NO: 613929 - DNA, 25 bp, Mus musculus
ctcattggctaagcatcgaaggctg

SEQ ID NO: 613930 - DNA, 25 bp, Mus musculus
ctcattgtccaaaggagtggatatc

SEQ ID NO: 613931 - DNA, 25 bp, Mus musculus
ctcattgtccaatggagtggatatc

SEQ ID NO: 613932 - DNA, 25 bp, Mus musculus
ctcattgtgcaacatctggtaaacc

SEQ ID NO: 613933 - DNA, 25 bp, Mus musculus
ctcattgtgcaagatctggtaaacc

SEQ ID NO: 613934 - DNA, 25 bp, Mus musculus
ctcattgtgggaccacagaagacag

SEQ ID NO: 613935 - DNA, 25 bp, Mus musculus
ctcattgtgggagcacagaagacag

SEQ ID NO: 613936 - DNA, 25 bp, Mus musculus
ctcatttctcgtcgaaagaaagtta

SEQ ID NO: 613937 - DNA, 25 bp, Mus musculus
ctcatttctcgtggaaagaaagtta

SEQ ID NO: 613938 - DNA, 25 bp, Mus musculus
ctcatttgtcagagaacctagttaa

SEQ ID NO: 613939 - DNA, 25 bp, Mus musculus
ctcatttgtcagtgaacctagttaa

SEQ ID NO: 613940 - DNA, 25 bp, Mus musculus
ctccaaaaaaccaccatcaaagctg

SEQ ID NO: 613941 - DNA, 25 bp, Mus musculus
ctccaaaaaacctccatcaaagctg

SEQ ID NO: 613942 - DNA, 25 bp, Mus musculus
ctccaaagcaagcacgatgcagcca

SEQ ID NO: 613943 - DNA, 25 bp, Mus musculus
ctccaaagcaaggacgatgcagcca

SEQ ID NO: 613944 - DNA, 25 bp, Mus musculus
ctccaaaggatcaaagaatcaaaac

SEQ ID NO: 613945 - DNA, 25 bp, Mus musculus
ctccaaaggatctaagaatcaaaac

SEQ ID NO: 613946 - DNA, 25 bp, Mus musculus
ctccaaaggcgacgtgtatgatggt

SEQ ID NO: 613947 - DNA, 25 bp, Mus musculus
ctccaaaggcgaggtgtatgatggt

SEQ ID NO: 613948 - DNA, 25 bp, Mus musculus
ctccaaagtgaaagacgtggctgga

SEQ ID NO: 613949 - DNA, 25 bp, Mus musculus
ctccaaagtgaatgacgtggctgga

SEQ ID NO: 613950 - DNA, 25 bp, Mus musculus
ctccaacaagctaggaagagcttcc

SEQ ID NO: 613951 - DNA, 25 bp, Mus musculus
ctccaacaagcttggaagagcttcc

SEQ ID NO: 613952 - DNA, 25 bp, Mus musculus
ctccaacaccggaaatgagtcaaag

SEQ ID NO: 613953 - DNA, 25 bp, Mus musculus
ctccaacaccggtaatgagtcaaag

SEQ ID NO: 613954 - DNA, 25 bp, Mus musculus
ctccaacagacaataacagaactgt

SEQ ID NO: 613955 - DNA, 25 bp, Mus musculus
ctccaacagacattaacagaactgt

SEQ ID NO: 613956 - DNA, 25 bp, Mus musculus
ctccaacaggatcggacgctttgtg

SEQ ID NO: 613957 - DNA, 25 bp, Mus musculus
ctccaacaggatgggacgctttgtg

SEQ ID NO: 613958 - DNA, 25 bp, Mus musculus
ctccaaccaggaatgtaacacgaag

SEQ ID NO: 613959 - DNA, 25 bp, Mus musculus
ctccaaccaggattgtaacacgaag

SEQ ID NO: 613960 - DNA, 25 bp, Mus musculus
ctccaacgacagaggcatctacgtc

SEQ ID NO: 613961 - DNA, 25 bp, Mus musculus
ctccaacgacagtggcatctacgtc

SEQ ID NO: 613962 - DNA, 25 bp, Mus musculus
ctccaactctcactttaaggagtcg

SEQ ID NO: 613963 - DNA, 25 bp, Mus musculus
ctccaactctcagtttaaggagtcg

SEQ ID NO: 613964 - DNA, 25 bp, Mus musculus
ctccaagcatatcgccccaggagat

SEQ ID NO: 613965 - DNA, 25 bp, Mus musculus
ctccaagcatatggccccaggagat

SEQ ID NO: 613966 - DNA, 25 bp, Mus musculus
ctccaaggagaaccggcgcatcgta

SEQ ID NO: 613967 - DNA, 25 bp, Mus musculus
ctccaaggagaagcggcgcatcgta

SEQ ID NO: 613968 - DNA, 25 bp, Mus musculus
ctccaaggtctgagcaaactcagcc

SEQ ID NO: 613969 - DNA, 25 bp, Mus musculus
ctccaaggtctgtgcaaactcagcc

SEQ ID NO: 613970 - DNA, 25 bp, Mus musculus
ctccaagtatagcaagaatgaaggc

SEQ ID NO: 613971 - DNA, 25 bp, Mus musculus
ctccaagtataggaagaatgaaggc

SEQ ID NO: 613972 - DNA, 25 bp, Mus musculus
ctccaagtgaccctggctatccagg

SEQ ID NO: 613973 - DNA, 25 bp, Mus musculus
ctccaagtgaccgtggctatccagg

SEQ ID NO: 613974 - DNA, 25 bp, Mus musculus
ctccaagtgaggcatcagctcctgg

SEQ ID NO: 613975 - DNA, 25 bp, Mus musculus
ctccaagtgagggatcagctcctgg

SEQ ID NO: 613976 - DNA, 25 bp, Mus musculus
ctccaagtgtctctggcccagcggg

SEQ ID NO: 613977 - DNA, 25 bp, Mus musculus
ctccaagtgtctgtggcccagcggg

SEQ ID NO: 613978 - DNA, 25 bp, Mus musculus
ctccaatctccgagggtcgtgcggc

SEQ ID NO: 613979 - DNA, 25 bp, Mus musculus
ctccaatctccgtgggtcgtgcggc

SEQ ID NO: 613980 - DNA, 25 bp, Mus musculus
ctccaattcctaagccatcaagaag

SEQ ID NO: 613981 - DNA, 25 bp, Mus musculus
ctccaattcctatgccatcaagaag

SEQ ID NO: 613982 - DNA, 25 bp, Mus musculus
ctccacaagctcatggtctggagag

SEQ ID NO: 613983 - DNA, 25 bp, Mus musculus
ctccacaagctcttggtctggagag

SEQ ID NO: 613984 - DNA, 25 bp, Mus musculus
ctccacaattgccttggcccttggg

SEQ ID NO: 613985 - DNA, 25 bp, Mus musculus
ctccacaattgcgttggcccttggg

SEQ ID NO: 613986 - DNA, 25 bp, Mus musculus
ctccacacaagacggctagtcattg

SEQ ID NO: 613987 - DNA, 25 bp, Mus musculus
ctccacacaagagggctagtcattg

SEQ ID NO: 613988 - DNA, 25 bp, Mus musculus
ctccacacaggtactacaagcctgg

SEQ ID NO: 613989 - DNA, 25 bp, Mus musculus
ctccacacaggttctacaagcctgg

SEQ ID NO: 613990 - DNA, 25 bp, Mus musculus
ctccaccaaagcagggcaagaaaga

SEQ ID NO: 613991 - DNA, 25 bp, Mus musculus
ctccaccaaagctgggcaagaaaga

SEQ ID NO: 613992 - DNA, 25 bp, Mus musculus
ctccaccagatgacattcccatgtt

SEQ ID NO: 613993 - DNA, 25 bp, Mus musculus
ctccaccagatgtcattcccatgtt

SEQ ID NO: 613994 - DNA, 25 bp, Mus musculus
ctccacctattgacaatggagacat

SEQ ID NO: 613995 - DNA, 25 bp, Mus musculus
ctccacctattgtcaatggagacat

SEQ ID NO: 613996 - DNA, 25 bp, Mus musculus
ctccacgaagagactcaacattaac

SEQ ID NO: 613997 - DNA, 25 bp, Mus musculus
ctccacgaagagtctcaacattaac

SEQ ID NO: 613998 - DNA, 25 bp, Mus musculus
ctccacgcagtgcactagggatcgg

SEQ ID NO: 613999 - DNA, 25 bp, Mus musculus
ctccacgcagtggactagggatcgg

SEQ ID NO: 614000 - DNA, 25 bp, Mus musculus
ctccacggtggcatctgtcccaagg

SEQ ID NO: 614001 - DNA, 25 bp, Mus musculus
ctccacggtggcttctgtcccaagg

SEQ ID NO: 614002 - DNA, 25 bp, Mus musculus
ctccacgtgggaagtcaggctcaca

SEQ ID NO: 614003 - DNA, 25 bp, Mus musculus
ctccacgtgggatgtcaggctcaca

SEQ ID NO: 614004 - DNA, 25 bp, Mus musculus
ctccactccaggaatgaaggcgtgg

SEQ ID NO: 614005 - DNA, 25 bp, Mus musculus
ctccactccaggtatgaaggcgtgg

SEQ ID NO: 614006 - DNA, 25 bp, Mus musculus
ctccactgacatcaggagaatggcc

SEQ ID NO: 614007 - DNA, 25 bp, Mus musculus
ctccactgacatgaggagaatggcc

SEQ ID NO: 614008 - DNA, 25 bp, Mus musculus
ctccacttttgaactgaaccagtca

SEQ ID NO: 614009 - DNA, 25 bp, Mus musculus
ctccacttttgatctgaaccagtca

SEQ ID NO: 614010 - DNA, 25 bp, Mus musculus
ctccagaaagacattgcacagcact

SEQ ID NO: 614011 - DNA, 25 bp, Mus musculus
ctccagaaagactttgcacagcact

SEQ ID NO: 614012 - DNA, 25 bp, Mus musculus
ctccagaacccgaagatcttgcgat

SEQ ID NO: 614013 - DNA, 25 bp, Mus musculus
ctccagaacccgtagatcttgcgat

SEQ ID NO: 614014 - DNA, 25 bp, Mus musculus
ctccagaagaccctgtacaacgtgc

SEQ ID NO: 614015 - DNA, 25 bp, Mus musculus
ctccagaagaccgtgtacaacgtgc

SEQ ID NO: 614016 - DNA, 25 bp, Mus musculus
ctccagaaggaacgcgaggcttccg

SEQ ID NO: 614017 - DNA, 25 bp, Mus musculus
ctccagaaggaaggcgaggcttccg

SEQ ID NO: 614018 - DNA, 25 bp, Mus musculus
ctccagacaaccaccaggatggctg

SEQ ID NO: 614019 - DNA, 25 bp, Mus musculus
ctccagacaacctccaggatggctg

SEQ ID NO: 614020 - DNA, 25 bp, Mus musculus
ctccagaccatacggtttgtacagg

SEQ ID NO: 614021 - DNA, 25 bp, Mus musculus
ctccagaccatagggtttgtacagg

SEQ ID NO: 614022 - DNA, 25 bp, Mus musculus
ctccagactcagaacagcctttgac

SEQ ID NO: 614023 - DNA, 25 bp, Mus musculus
ctccagactcagtacagcctttgac

SEQ ID NO: 614024 - DNA, 25 bp, Mus musculus
ctccagagaatgctaccaggcctga

SEQ ID NO: 614025 - DNA, 25 bp, Mus musculus
ctccagagaatggtaccaggcctga

SEQ ID NO: 614026 - DNA, 25 bp, Mus musculus
ctccagagagaccagtccagccgaa

SEQ ID NO: 614027 - DNA, 25 bp, Mus musculus
ctccagagagacgagtccagccgaa

SEQ ID NO: 614028 - DNA, 25 bp, Mus musculus
ctccagagagcaacatgtacaggaa

SEQ ID NO: 614029 - DNA, 25 bp, Mus musculus
ctccagagagcatcatgtacaggaa

SEQ ID NO: 614030 - DNA, 25 bp, Mus musculus
ctccagagagtaaagaagccgacct

SEQ ID NO: 614031 - DNA, 25 bp, Mus musculus
ctccagagagtatagaagccgacct

SEQ ID NO: 614032 - DNA, 25 bp, Mus musculus
ctccagagcaaacggaagggaagtc

SEQ ID NO: 614033 - DNA, 25 bp, Mus musculus
ctccagagcaaagggaagggaagtc

SEQ ID NO: 614034 - DNA, 25 bp, Mus musculus
ctccagaggagtaggttcctgagga

SEQ ID NO: 614035 - DNA, 25 bp, Mus musculus
ctccagaggagttggttcctgagga

SEQ ID NO: 614036 - DNA, 25 bp, Mus musculus
ctccagattctacaacttagagaaa

SEQ ID NO: 614037 - DNA, 25 bp, Mus musculus
ctccagattctagaacttagagaaa

SEQ ID NO: 614038 - DNA, 25 bp, Mus musculus
ctccagcaaattccgccacgtgttt

SEQ ID NO: 614039 - DNA, 25 bp, Mus musculus
ctccagcaaattgcgccacgtgttt

SEQ ID NO: 614040 - DNA, 25 bp, Mus musculus
ctccagcataggcatccctctgtta

SEQ ID NO: 614041 - DNA, 25 bp, Mus musculus
ctccagcatagggatccctctgtta

SEQ ID NO: 614042 - DNA, 25 bp, Mus musculus
ctccagcatgatagcagatgcagtg

SEQ ID NO: 614043 - DNA, 25 bp, Mus musculus
ctccagcatgattgcagatgcagtg

SEQ ID NO: 614044 - DNA, 25 bp, Mus musculus
ctccagccaaaaccatgatgagttc

SEQ ID NO: 614045 - DNA, 25 bp, Mus musculus
ctccagccaaaagcatgatgagttc

SEQ ID NO: 614046 - DNA, 25 bp, Mus musculus
ctccagccaatgaggatgcttcagt

SEQ ID NO: 614047 - DNA, 25 bp, Mus musculus
ctccagccaatgtggatgcttcagt

SEQ ID NO: 614048 - DNA, 25 bp, Mus musculus
ctccagcccagtaggagttcctagc

SEQ ID NO: 614049 - DNA, 25 bp, Mus musculus
ctccagcccagttggagttcctagc

SEQ ID NO: 614050 - DNA, 25 bp, Mus musculus
ctccagccctgtagaatatctttct

SEQ ID NO: 614051 - DNA, 25 bp, Mus musculus
ctccagccctgttgaatatctttct

SEQ ID NO: 614052 - DNA, 25 bp, Mus musculus
ctccagccgagcaggaccctatgaa

SEQ ID NO: 614053 - DNA, 25 bp, Mus musculus
ctccagccgagctggaccctatgaa

SEQ ID NO: 614054 - DNA, 25 bp, Mus musculus
ctccagcggcagatcttcgatttcc

SEQ ID NO: 614055 - DNA, 25 bp, Mus musculus
ctccagcggcagttcttcgatttcc

SEQ ID NO: 614056 - DNA, 25 bp, Mus musculus
ctccagcggcccaggtaaagatgcc

SEQ ID NO: 614057 - DNA, 25 bp, Mus musculus
ctccagcggccctggtaaagatgcc

SEQ ID NO: 614058 - DNA, 25 bp, Mus musculus
ctccagctccacagaatttaacaca

SEQ ID NO: 614059 - DNA, 25 bp, Mus musculus
ctccagctccactgaatttaacaca

SEQ ID NO: 614060 - DNA, 25 bp, Mus musculus
ctccagctgactcaggtaacgacca

SEQ ID NO: 614061 - DNA, 25 bp, Mus musculus
ctccagctgactgaggtaacgacca

SEQ ID NO: 614062 - DNA, 25 bp, Mus musculus
ctccagctgagccacaaatagtatt

SEQ ID NO: 614063 - DNA, 25 bp, Mus musculus
ctccagctgagcgacaaatagtatt

SEQ ID NO: 614064 - DNA, 25 bp, Mus musculus
ctccagctgggcacaagagggagca

SEQ ID NO: 614065 - DNA, 25 bp, Mus musculus
ctccagctgggctcaagagggagca

SEQ ID NO: 614066 - DNA, 25 bp, Mus musculus
ctccaggaaaagcaccagaaataca

SEQ ID NO: 614067 - DNA, 25 bp, Mus musculus
ctccaggaaaaggaccagaaataca

SEQ ID NO: 614068 - DNA, 25 bp, Mus musculus
ctccaggaaccaatccttggaagag

SEQ ID NO: 614069 - DNA, 25 bp, Mus musculus
ctccaggaaccattccttggaagag

SEQ ID NO: 614070 - DNA, 25 bp, Mus musculus
ctccaggatcgcagagggcttcggt

SEQ ID NO: 614071 - DNA, 25 bp, Mus musculus
ctccaggatcgctgagggcttcggt

SEQ ID NO: 614072 - DNA, 25 bp, Mus musculus
ctccaggctgcgacggcagtggtca

SEQ ID NO: 614073 - DNA, 25 bp, Mus musculus
ctccaggctgcgtcggcagtggtca

SEQ ID NO: 614074 - DNA, 25 bp, Mus musculus
ctccaggctggaccggataaagatg

SEQ ID NO: 614075 - DNA, 25 bp, Mus musculus
ctccaggctggagcggataaagatg

SEQ ID NO: 614076 - DNA, 25 bp, Mus musculus
ctccaggctggcatcggcttgctaa

SEQ ID NO: 614077 - DNA, 25 bp, Mus musculus
ctccaggctggcttcggcttgctaa

SEQ ID NO: 614078 - DNA, 25 bp, Mus musculus
ctccaggctgggacggcccaagtca

SEQ ID NO: 614079 - DNA, 25 bp, Mus musculus
ctccaggctgggtcggcccaagtca

SEQ ID NO: 614080 - DNA, 25 bp, Mus musculus
ctccaggctgtgctgattggctgat

SEQ ID NO: 614081 - DNA, 25 bp, Mus musculus
ctccaggctgtggtgattggctgat

SEQ ID NO: 614082 - DNA, 25 bp, Mus musculus
ctccagggtaatcgcctagccaggg

SEQ ID NO: 614083 - DNA, 25 bp, Mus musculus
ctccagggtaatggcctagccaggg

SEQ ID NO: 614084 - DNA, 25 bp, Mus musculus
ctccagggtcggaggcatcatcaca

SEQ ID NO: 614085 - DNA, 25 bp, Mus musculus
ctccagggtcggtggcatcatcaca

SEQ ID NO: 614086 - DNA, 25 bp, Mus musculus
ctccagggtgacagagagctgcgtt

SEQ ID NO: 614087 - DNA, 25 bp, Mus musculus
ctccagggtgactgagagctgcgtt

SEQ ID NO: 614088 - DNA, 25 bp, Mus musculus
ctccagtacatgatggtcatggttg

SEQ ID NO: 614089 - DNA, 25 bp, Mus musculus
ctccagtacatgttggtcatggttg

SEQ ID NO: 614090 - DNA, 25 bp, Mus musculus
ctccagtgacctagcgccttgtcat

SEQ ID NO: 614091 - DNA, 25 bp, Mus musculus
ctccagtgaccttgcgccttgtcat

SEQ ID NO: 614092 - DNA, 25 bp, Mus musculus
ctccagtgatcaagaggcgaacctt

SEQ ID NO: 614093 - DNA, 25 bp, Mus musculus
ctccagtgatcatgaggcgaacctt

SEQ ID NO: 614094 - DNA, 25 bp, Mus musculus
ctccagtggtgtcatgaagctacag

SEQ ID NO: 614095 - DNA, 25 bp, Mus musculus
ctccagtggtgtgatgaagctacag

SEQ ID NO: 614096 - DNA, 25 bp, Mus musculus
ctccataggaatcgcctgtaggcct

SEQ ID NO: 614097 - DNA, 25 bp, Mus musculus
ctccataggaatggcctgtaggcct

SEQ ID NO: 614098 - DNA, 25 bp, Mus musculus
ctccatcaggctagggttgctcaca

SEQ ID NO: 614099 - DNA, 25 bp, Mus musculus
ctccatcaggcttgggttgctcaca

SEQ ID NO: 614100 - DNA, 25 bp, Mus musculus
ctccatcattttaatgcctgacaga

SEQ ID NO: 614101 - DNA, 25 bp, Mus musculus
ctccatcatttttatgcctgacaga

SEQ ID NO: 614102 - DNA, 25 bp, Mus musculus
ctccatccacggagtcaaggaggcc

SEQ ID NO: 614103 - DNA, 25 bp, Mus musculus
ctccatccacggtgtcaaggaggcc

SEQ ID NO: 614104 - DNA, 25 bp, Mus musculus
ctccatcctacactagagggcatag

SEQ ID NO: 614105 - DNA, 25 bp, Mus musculus
ctccatcctacagtagagggcatag

SEQ ID NO: 614106 - DNA, 25 bp, Mus musculus
ctccatcgaattcctggagtcagag

SEQ ID NO: 614107 - DNA, 25 bp, Mus musculus
ctccatcgaattgctggagtcagag

SEQ ID NO: 614108 - DNA, 25 bp, Mus musculus
ctccatcgaggacggcatcggcctg

SEQ ID NO: 614109 - DNA, 25 bp, Mus musculus
ctccatcgaggagggcatcggcctg

SEQ ID NO: 614110 - DNA, 25 bp, Mus musculus
ctccatcgggagatgtcgtctataa

SEQ ID NO: 614111 - DNA, 25 bp, Mus musculus
ctccatcgggagttgtcgtctataa

SEQ ID NO: 614112 - DNA, 25 bp, Mus musculus
ctccatcgggctcgtgtccttcggg

SEQ ID NO: 614113 - DNA, 25 bp, Mus musculus
ctccatcgggctggtgtccttcggg

SEQ ID NO: 614114 - DNA, 25 bp, Mus musculus
ctccatctggaaaccgaggccggga

SEQ ID NO: 614115 - DNA, 25 bp, Mus musculus
ctccatctggaatccgaggccggga

SEQ ID NO: 614116 - DNA, 25 bp, Mus musculus
ctccatctgtacacaagggctgcca

SEQ ID NO: 614117 - DNA, 25 bp, Mus musculus
ctccatctgtactcaagggctgcca

SEQ ID NO: 614118 - DNA, 25 bp, Mus musculus
ctccatgaaagaaatgcagggatta

SEQ ID NO: 614119 - DNA, 25 bp, Mus musculus
ctccatgaaagatatgcagggatta

SEQ ID NO: 614120 - DNA, 25 bp, Mus musculus
ctccatgaatatcaaggcccatatc

SEQ ID NO: 614121 - DNA, 25 bp, Mus musculus
ctccatgaatatgaaggcccatatc

SEQ ID NO: 614122 - DNA, 25 bp, Mus musculus
ctccatgcacagaaaagatccgctt

SEQ ID NO: 614123 - DNA, 25 bp, Mus musculus
ctccatgcacagtaaagatccgctt

SEQ ID NO: 614124 - DNA, 25 bp, Mus musculus
ctccatgcaggcatcaagcagatcc

SEQ ID NO: 614125 - DNA, 25 bp, Mus musculus
ctccatgcaggcttcaagcagatcc

SEQ ID NO: 614126 - DNA, 25 bp, Mus musculus
ctccatgcagtcagtggaaatagcg

SEQ ID NO: 614127 - DNA, 25 bp, Mus musculus
ctccatgcagtctgtggaaatagcg

SEQ ID NO: 614128 - DNA, 25 bp, Mus musculus
ctccatggagctatagtggtaaaag

SEQ ID NO: 614129 - DNA, 25 bp, Mus musculus
ctccatggagctttagtggtaaaag

SEQ ID NO: 614130 - DNA, 25 bp, Mus musculus
ctccatggatggcagagaacctggc

SEQ ID NO: 614131 - DNA, 25 bp, Mus musculus
ctccatggatgggagagaacctggc

SEQ ID NO: 614132 - DNA, 25 bp, Mus musculus
ctccatggcgttcacccggaagagg

SEQ ID NO: 614133 - DNA, 25 bp, Mus musculus
ctccatggcgttgacccggaagagg

SEQ ID NO: 614134 - DNA, 25 bp, Mus musculus
ctccatgggagacgcggtaccctac

SEQ ID NO: 614135 - DNA, 25 bp, Mus musculus
ctccatgggagaggcggtaccctac

SEQ ID NO: 614136 - DNA, 25 bp, Mus musculus
ctccatgggcagaccccactggtga

SEQ ID NO: 614137 - DNA, 25 bp, Mus musculus
ctccatgggcagtccccactggtga

SEQ ID NO: 614138 - DNA, 25 bp, Mus musculus
ctccatgggcatacttgtggtcgga

SEQ ID NO: 614139 - DNA, 25 bp, Mus musculus
ctccatgggcattcttgtggtcgga

SEQ ID NO: 614140 - DNA, 25 bp, Mus musculus
ctccatgtcctgcaagccagaaatg

SEQ ID NO: 614141 - DNA, 25 bp, Mus musculus
ctccatgtcctggaagccagaaatg

SEQ ID NO: 614142 - DNA, 25 bp, Mus musculus
ctccattatcgacttccagcccaca

SEQ ID NO: 614143 - DNA, 25 bp, Mus musculus
ctccattatcgagttccagcccaca

SEQ ID NO: 614144 - DNA, 25 bp, Mus musculus
ctccattcaggaatacatacgacag

SEQ ID NO: 614145 - DNA, 25 bp, Mus musculus
ctccattcaggattacatacgacag

SEQ ID NO: 614146 - DNA, 25 bp, Mus musculus
ctccattgagggaggcccgcaggtc

SEQ ID NO: 614147 - DNA, 25 bp, Mus musculus
ctccattgagggtggcccgcaggtc

SEQ ID NO: 614148 - DNA, 25 bp, Mus musculus
ctccattgccccagtgtatcagcat

SEQ ID NO: 614149 - DNA, 25 bp, Mus musculus
ctccattgcccctgtgtatcagcat

SEQ ID NO: 614150 - DNA, 25 bp, Mus musculus
ctccattgccgtcgctgccctgtgc

SEQ ID NO: 614151 - DNA, 25 bp, Mus musculus
ctccattgccgtggctgccctgtgc

SEQ ID NO: 614152 - DNA, 25 bp, Mus musculus
ctccatttaacccagtgactgtgag

SEQ ID NO: 614153 - DNA, 25 bp, Mus musculus
ctccatttaaccgagtgactgtgag

SEQ ID NO: 614154 - DNA, 25 bp, Mus musculus
ctcccaagaagaacacgtcctggtt

SEQ ID NO: 614155 - DNA, 25 bp, Mus musculus
ctcccaagaagatcacgtcctggtt

SEQ ID NO: 614156 - DNA, 25 bp, Mus musculus
ctcccaaggtgcaaggctgaggcca

SEQ ID NO: 614157 - DNA, 25 bp, Mus musculus
ctcccaaggtgctaggctgaggcca

SEQ ID NO: 614158 - DNA, 25 bp, Mus musculus
ctcccaaggtttacggaggagcagg

SEQ ID NO: 614159 - DNA, 25 bp, Mus musculus
ctcccaaggttttcggaggagcagg

SEQ ID NO: 614160 - DNA, 25 bp, Mus musculus
ctcccaatacagatctggcctgcag

SEQ ID NO: 614161 - DNA, 25 bp, Mus musculus
ctcccaatacagttctggcctgcag

SEQ ID NO: 614162 - DNA, 25 bp, Mus musculus
ctcccacaaggacttcgagccagtg

SEQ ID NO: 614163 - DNA, 25 bp, Mus musculus
ctcccacaaggagttcgagccagtg

SEQ ID NO: 614164 - DNA, 25 bp, Mus musculus
ctcccaccatggcacttcaagaggg

SEQ ID NO: 614165 - DNA, 25 bp, Mus musculus
ctcccaccatgggacttcaagaggg

SEQ ID NO: 614166 - DNA, 25 bp, Mus musculus
ctcccactccacaggcaagagatgt

SEQ ID NO: 614167 - DNA, 25 bp, Mus musculus
ctcccactccactggcaagagatgt

SEQ ID NO: 614168 - DNA, 25 bp, Mus musculus
ctcccactttccctatgtggagctg

SEQ ID NO: 614169 - DNA, 25 bp, Mus musculus
ctcccactttccgtatgtggagctg

SEQ ID NO: 614170 - DNA, 25 bp, Mus musculus
ctcccagaaagccttgggctctggg

SEQ ID NO: 614171 - DNA, 25 bp, Mus musculus
ctcccagaaagcgttgggctctggg

SEQ ID NO: 614172 - DNA, 25 bp, Mus musculus
ctcccagaagacctggttgaagtga

SEQ ID NO: 614173 - DNA, 25 bp, Mus musculus
ctcccagaagacgtggttgaagtga

SEQ ID NO: 614174 - DNA, 25 bp, Mus musculus
ctcccagatcagaagtactccatgg

SEQ ID NO: 614175 - DNA, 25 bp, Mus musculus
ctcccagatcagctgaaactctact

SEQ ID NO: 614176 - DNA, 25 bp, Mus musculus
ctcccagatcaggtgaaactctact

SEQ ID NO: 614177 - DNA, 25 bp, Mus musculus
ctcccagatcagtagtactccatgg

SEQ ID NO: 614178 - DNA, 25 bp, Mus musculus
ctcccagctgctagaaagaggatga

SEQ ID NO: 614179 - DNA, 25 bp, Mus musculus
ctcccagctgcttgaaagaggatga

SEQ ID NO: 614180 - DNA, 25 bp, Mus musculus
ctcccaggtcctagagtatttcagg

SEQ ID NO: 614181 - DNA, 25 bp, Mus musculus
ctcccaggtccttgagtatttcagg

SEQ ID NO: 614182 - DNA, 25 bp, Mus musculus
ctcccagttaatcaagactgtgcat

SEQ ID NO: 614183 - DNA, 25 bp, Mus musculus
ctcccagttaatgaagactgtgcat

SEQ ID NO: 614184 - DNA, 25 bp, Mus musculus
ctcccatgatgaccctgatctcagt

SEQ ID NO: 614185 - DNA, 25 bp, Mus musculus
ctcccatgatgagcctgatctcagt

SEQ ID NO: 614186 - DNA, 25 bp, Mus musculus
ctccccacacctaggaagttcgtga

SEQ ID NO: 614187 - DNA, 25 bp, Mus musculus
ctccccacaccttggaagttcgtga

SEQ ID NO: 614188 - DNA, 25 bp, Mus musculus
ctccccacagatcggccagtatgga

SEQ ID NO: 614189 - DNA, 25 bp, Mus musculus
ctccccacagatgggccagtatgga

SEQ ID NO: 614190 - DNA, 25 bp, Mus musculus
ctccccacaggcacgggcgatatgg

SEQ ID NO: 614191 - DNA, 25 bp, Mus musculus
ctccccacaggctcgggcgatatgg

SEQ ID NO: 614192 - DNA, 25 bp, Mus musculus
ctccccacagggagatgctgagttc

SEQ ID NO: 614193 - DNA, 25 bp, Mus musculus
ctccccacagggtgatgctgagttc

SEQ ID NO: 614194 - DNA, 25 bp, Mus musculus
ctccccagaagaagagaatgcagac

SEQ ID NO: 614195 - DNA, 25 bp, Mus musculus
ctccccagaagatgagaatgcagac

SEQ ID NO: 614196 - DNA, 25 bp, Mus musculus
ctccccagggctccaaggattcggg

SEQ ID NO: 614197 - DNA, 25 bp, Mus musculus
ctccccagggctgcaaggattcggg

SEQ ID NO: 614198 - DNA, 25 bp, Mus musculus
ctccccatggcaccgggtgctgttg

SEQ ID NO: 614199 - DNA, 25 bp, Mus musculus
ctccccatggcagcgggtgctgttg

SEQ ID NO: 614200 - DNA, 25 bp, Mus musculus
ctccccctatctcacttggaggtga

SEQ ID NO: 614201 - DNA, 25 bp, Mus musculus
ctccccctatctgacttggaggtga

SEQ ID NO: 614202 - DNA, 25 bp, Mus musculus
ctccccgggagcaatggtttgaggt

SEQ ID NO: 614203 - DNA, 25 bp, Mus musculus
ctccccgggagctatggtttgaggt

SEQ ID NO: 614204 - DNA, 25 bp, Mus musculus
ctccccgtgggtcgtgcctatggat

SEQ ID NO: 614205 - DNA, 25 bp, Mus musculus
ctccccgtgggtggtgcctatggat

SEQ ID NO: 614206 - DNA, 25 bp, Mus musculus
ctcccctagggacgctgctagtttg

SEQ ID NO: 614207 - DNA, 25 bp, Mus musculus
ctcccctagggaggctgctagtttg

SEQ ID NO: 614208 - DNA, 25 bp, Mus musculus
ctcccctgtggaacgggcaatgcgc

SEQ ID NO: 614209 - DNA, 25 bp, Mus musculus
ctcccctgtggatcgggcaatgcgc

SEQ ID NO: 614210 - DNA, 25 bp, Mus musculus
ctcccgaaatctcctaccagagatt

SEQ ID NO: 614211 - DNA, 25 bp, Mus musculus
ctcccgaaatctgctaccagagatt

SEQ ID NO: 614212 - DNA, 25 bp, Mus musculus
ctcccgaatctcagaggatgagaca

SEQ ID NO: 614213 - DNA, 25 bp, Mus musculus
ctcccgaatctctgaggatgagaca

SEQ ID NO: 614214 - DNA, 25 bp, Mus musculus
ctcccgatcccacggcatgagtgga

SEQ ID NO: 614215 - DNA, 25 bp, Mus musculus
ctcccgatcccagggcatgagtgga

SEQ ID NO: 614216 - DNA, 25 bp, Mus musculus
ctcccgatctcgattctacagtggt

SEQ ID NO: 614217 - DNA, 25 bp, Mus musculus
ctcccgatctcgtttctacagtggt

SEQ ID NO: 614218 - DNA, 25 bp, Mus musculus
ctcccgcgaagaccctggtggacat

SEQ ID NO: 614219 - DNA, 25 bp, Mus musculus
ctcccgcgaagagcctggtggacat

SEQ ID NO: 614220 - DNA, 25 bp, Mus musculus
ctcccggaacgcagccgacaaggag

SEQ ID NO: 614221 - DNA, 25 bp, Mus musculus
ctcccggaacgctgccgacaaggag

SEQ ID NO: 614222 - DNA, 25 bp, Mus musculus
ctcccggaccgcagagagatcatct

SEQ ID NO: 614223 - DNA, 25 bp, Mus musculus
ctcccggaccgctgagagatcatct

SEQ ID NO: 614224 - DNA, 25 bp, Mus musculus
ctcccggcgctaagttgcagatcga

SEQ ID NO: 614225 - DNA, 25 bp, Mus musculus
ctcccggcgctatgttgcagatcga

SEQ ID NO: 614226 - DNA, 25 bp, Mus musculus
ctcccgggctacaagggccttcagg

SEQ ID NO: 614227 - DNA, 25 bp, Mus musculus
ctcccgggctactagggccttcagg

SEQ ID NO: 614228 - DNA, 25 bp, Mus musculus
ctcccgggctgtatgccatggttgg

SEQ ID NO: 614229 - DNA, 25 bp, Mus musculus
ctcccgggctgtttgccatggttgg

SEQ ID NO: 614230 - DNA, 25 bp, Mus musculus
ctcccgggttgtactgggagagact

SEQ ID NO: 614231 - DNA, 25 bp, Mus musculus
ctcccgggttgttctgggagagact

SEQ ID NO: 614232 - DNA, 25 bp, Mus musculus
ctcccggtgcgaccgaggaggcggt

SEQ ID NO: 614233 - DNA, 25 bp, Mus musculus
ctcccggtgcgagcgaggaggcggt

SEQ ID NO: 614234 - DNA, 25 bp, Mus musculus
ctccctagtgaacgagcagtgggta

SEQ ID NO: 614235 - DNA, 25 bp, Mus musculus
ctccctagtgaaggagcagtgggta

SEQ ID NO: 614236 - DNA, 25 bp, Mus musculus
ctccctagtgcacacaaaggaaatg

SEQ ID NO: 614237 - DNA, 25 bp, Mus musculus
ctccctagtgcagacaaaggaaatg

SEQ ID NO: 614238 - DNA, 25 bp, Mus musculus
ctccctcaggatcaaggtcgatgtg

SEQ ID NO: 614239 - DNA, 25 bp, Mus musculus
ctccctcaggatgaaggtcgatgtg

SEQ ID NO: 614240 - DNA, 25 bp, Mus musculus
ctccctcatctgagaaggcagagtt

SEQ ID NO: 614241 - DNA, 25 bp, Mus musculus
ctccctcatctgtgaaggcagagtt

SEQ ID NO: 614242 - DNA, 25 bp, Mus musculus
ctccctccaaagcatctaagaatca

SEQ ID NO: 614243 - DNA, 25 bp, Mus musculus
ctccctccaaaggatctaagaatca

SEQ ID NO: 614244 - DNA, 25 bp, Mus musculus
ctccctcggcagaggttggctggca

SEQ ID NO: 614245 - DNA, 25 bp, Mus musculus
ctccctcggcagtggttggctggca

SEQ ID NO: 614246 - DNA, 25 bp, Mus musculus
ctccctcgggtgatgagtgagctag

SEQ ID NO: 614247 - DNA, 25 bp, Mus musculus
ctccctcgggtgttgagtgagctag

SEQ ID NO: 614248 - DNA, 25 bp, Mus musculus
ctccctcgtggacgccatgaacggg

SEQ ID NO: 614249 - DNA, 25 bp, Mus musculus
ctccctcgtggaggccatgaacggg

SEQ ID NO: 614250 - DNA, 25 bp, Mus musculus
ctccctctacaacgtctcaggagaa

SEQ ID NO: 614251 - DNA, 25 bp, Mus musculus
ctccctctacaaggtctcaggagaa

SEQ ID NO: 614252 - DNA, 25 bp, Mus musculus
ctccctctggaaatcctgctggctt

SEQ ID NO: 614253 - DNA, 25 bp, Mus musculus
ctccctctggaattcctgctggctt

SEQ ID NO: 614254 - DNA, 25 bp, Mus musculus
ctccctctgtgcagtccccgggtct

SEQ ID NO: 614255 - DNA, 25 bp, Mus musculus
ctccctctgtgctgtccccgggtct

SEQ ID NO: 614256 - DNA, 25 bp, Mus musculus
ctccctgactggagggtccagcagc

SEQ ID NO: 614257 - DNA, 25 bp, Mus musculus
ctccctgactggtgggtccagcagc

SEQ ID NO: 614258 - DNA, 25 bp, Mus musculus
ctccctgatccgagcagcaaatgac

SEQ ID NO: 614259 - DNA, 25 bp, Mus musculus
ctccctgatccgtgcagcaaatgac

SEQ ID NO: 614260 - DNA, 25 bp, Mus musculus
ctccctgccagacatcgaggaagtg

SEQ ID NO: 614261 - DNA, 25 bp, Mus musculus
ctccctgccagagatcgaggaagtg

SEQ ID NO: 614262 - DNA, 25 bp, Mus musculus
ctccctggacttcgatggtatcatt

SEQ ID NO: 614263 - DNA, 25 bp, Mus musculus
ctccctggacttggatggtatcatt

SEQ ID NO: 614264 - DNA, 25 bp, Mus musculus
ctccctggtccaagatggcggacga

SEQ ID NO: 614265 - DNA, 25 bp, Mus musculus
ctccctggtccatgatggcggacga

SEQ ID NO: 614266 - DNA, 25 bp, Mus musculus
ctccctgtccaccatgattgacggg

SEQ ID NO: 614267 - DNA, 25 bp, Mus musculus
ctccctgtccacgatgattgacggg

SEQ ID NO: 614268 - DNA, 25 bp, Mus musculus
ctccctgttatgcttgctgggcgat

SEQ ID NO: 614269 - DNA, 25 bp, Mus musculus
ctccctgttatggttgctgggcgat

SEQ ID NO: 614270 - DNA, 25 bp, Mus musculus
ctcccttaggaaagacagcagtagc

SEQ ID NO: 614271 - DNA, 25 bp, Mus musculus
ctcccttaggaatgacagcagtagc

SEQ ID NO: 614272 - DNA, 25 bp, Mus musculus
ctcccttctcagcataagcaactgg

SEQ ID NO: 614273 - DNA, 25 bp, Mus musculus
ctcccttctcaggataagcaactgg

SEQ ID NO: 614274 - DNA, 25 bp, Mus musculus
ctcccttgacccaggtacagtcatg

SEQ ID NO: 614275 - DNA, 25 bp, Mus musculus
ctcccttgaccctggtacagtcatg

SEQ ID NO: 614276 - DNA, 25 bp, Mus musculus
ctccgaaagaggcagcgactgcagc

SEQ ID NO: 614277 - DNA, 25 bp, Mus musculus
ctccgaaagagggagcgactgcagc

SEQ ID NO: 614278 - DNA, 25 bp, Mus musculus
ctccgaaagggtattgctgagaaca

SEQ ID NO: 614279 - DNA, 25 bp, Mus musculus
ctccgaaagggttttgctgagaaca

SEQ ID NO: 614280 - DNA, 25 bp, Mus musculus
ctccgaagacgtagtcagtgagaac

SEQ ID NO: 614281 - DNA, 25 bp, Mus musculus
ctccgaagacgttgtcagtgagaac

SEQ ID NO: 614282 - DNA, 25 bp, Mus musculus
ctccgaagagcgaagcgacccctga

SEQ ID NO: 614283 - DNA, 25 bp, Mus musculus
ctccgaagagcgtagcgacccctga

SEQ ID NO: 614284 - DNA, 25 bp, Mus musculus
ctccgaagctttccttttggaagag

SEQ ID NO: 614285 - DNA, 25 bp, Mus musculus
ctccgaagctttgcttttggaagag

SEQ ID NO: 614286 - DNA, 25 bp, Mus musculus
ctccgaaggcggacgtgaagaactt

SEQ ID NO: 614287 - DNA, 25 bp, Mus musculus
ctccgaaggcggtcgtgaagaactt

SEQ ID NO: 614288 - DNA, 25 bp, Mus musculus
ctccgaataggacatcaagaatttg

SEQ ID NO: 614289 - DNA, 25 bp, Mus musculus
ctccgaataggagatcaagaatttg

SEQ ID NO: 614290 - DNA, 25 bp, Mus musculus
ctccgactacctatggcactgaaga

SEQ ID NO: 614291 - DNA, 25 bp, Mus musculus
ctccgactacctttggcactgaaga

SEQ ID NO: 614292 - DNA, 25 bp, Mus musculus
ctccgactgtgacgcggctcgtaga

SEQ ID NO: 614293 - DNA, 25 bp, Mus musculus
ctccgactgtgaggcggctcgtaga

SEQ ID NO: 614294 - DNA, 25 bp, Mus musculus
ctccgagcggccatcgtcgggctgt

SEQ ID NO: 614295 - DNA, 25 bp, Mus musculus
ctccgagcggccttcgtcgggctgt

SEQ ID NO: 614296 - DNA, 25 bp, Mus musculus
ctccgaggcccacgtggacatctgt

SEQ ID NO: 614297 - DNA, 25 bp, Mus musculus
ctccgaggcccaggtggacatctgt

SEQ ID NO: 614298 - DNA, 25 bp, Mus musculus
ctccgattaaatacgaaagccaaca

SEQ ID NO: 614299 - DNA, 25 bp, Mus musculus
ctccgattaaattcgaaagccaaca

SEQ ID NO: 614300 - DNA, 25 bp, Mus musculus
ctccgcaaagagagacaaaaccaga

SEQ ID NO: 614301 - DNA, 25 bp, Mus musculus
ctccgcaaagagtgacaaaaccaga

SEQ ID NO: 614302 - DNA, 25 bp, Mus musculus
ctccgcaccgtgcaacaggagcaga

SEQ ID NO: 614303 - DNA, 25 bp, Mus musculus
ctccgcaccgtggaacaggagcaga

SEQ ID NO: 614304 - DNA, 25 bp, Mus musculus
ctccgcagagacaaagatcggagga

SEQ ID NO: 614305 - DNA, 25 bp, Mus musculus
ctccgcagagactaagatcggagga

SEQ ID NO: 614306 - DNA, 25 bp, Mus musculus
ctccgcagcagcaggccgtgatgag

SEQ ID NO: 614307 - DNA, 25 bp, Mus musculus
ctccgcagcagctggccgtgatgag

SEQ ID NO: 614308 - DNA, 25 bp, Mus musculus
ctccgccagcacctcgagagaagga

SEQ ID NO: 614309 - DNA, 25 bp, Mus musculus
ctccgccagcacgtcgagagaagga

SEQ ID NO: 614310 - DNA, 25 bp, Mus musculus
ctccgcccgagaacggctggagaga

SEQ ID NO: 614311 - DNA, 25 bp, Mus musculus
ctccgcccgagatcggctggagaga

SEQ ID NO: 614312 - DNA, 25 bp, Mus musculus
ctccgccttgatacaggcatggaca

SEQ ID NO: 614313 - DNA, 25 bp, Mus musculus
ctccgccttgattcaggcatggaca

SEQ ID NO: 614314 - DNA, 25 bp, Mus musculus
ctccgccttttccatcagggtggga

SEQ ID NO: 614315 - DNA, 25 bp, Mus musculus
ctccgccttttcgatcagggtggga

SEQ ID NO: 614316 - DNA, 25 bp, Mus musculus
ctccgctacgggaagaccaagcagt

SEQ ID NO: 614317 - DNA, 25 bp, Mus musculus
ctccgctacgggtagaccaagcagt

SEQ ID NO: 614318 - DNA, 25 bp, Mus musculus
ctccggaaaaggacagagtttgctg

SEQ ID NO: 614319 - DNA, 25 bp, Mus musculus
ctccggaaaaggtcagagtttgctg

SEQ ID NO: 614320 - DNA, 25 bp, Mus musculus
ctccggaactcacgacagagactag

SEQ ID NO: 614321 - DNA, 25 bp, Mus musculus
ctccggaactcaggacagagactag

SEQ ID NO: 614322 - DNA, 25 bp, Mus musculus
ctccggaagctgacggatgacgagc

SEQ ID NO: 614323 - DNA, 25 bp, Mus musculus
ctccggaagctgtcggatgacgagc

SEQ ID NO: 614324 - DNA, 25 bp, Mus musculus
ctccggaagtagaagctgtgaccgg

SEQ ID NO: 614325 - DNA, 25 bp, Mus musculus
ctccggaagtagtagctgtgaccgg

SEQ ID NO: 614326 - DNA, 25 bp, Mus musculus
ctccggagaggtagatgagctgttc

SEQ ID NO: 614327 - DNA, 25 bp, Mus musculus
ctccggagaggttgatgagctgttc

SEQ ID NO: 614328 - DNA, 25 bp, Mus musculus
ctccggagcggtacaggagaatgca

SEQ ID NO: 614329 - DNA, 25 bp, Mus musculus
ctccggagcggttcaggagaatgca

SEQ ID NO: 614330 - DNA, 25 bp, Mus musculus
ctccggcagatgcagctagacaccg

SEQ ID NO: 614331 - DNA, 25 bp, Mus musculus
ctccggcagatggagctagacaccg

SEQ ID NO: 614332 - DNA, 25 bp, Mus musculus
ctccggcagtggcatgtccgtcata

SEQ ID NO: 614333 - DNA, 25 bp, Mus musculus
ctccggcagtgggatgtccgtcata

SEQ ID NO: 614334 - DNA, 25 bp, Mus musculus
ctccggcctatcagttcatgcatca

SEQ ID NO: 614335 - DNA, 25 bp, Mus musculus
ctccggcctatctgttcatgcatca

SEQ ID NO: 614336 - DNA, 25 bp, Mus musculus
ctccggcgtgagctagaaaaggcta

SEQ ID NO: 614337 - DNA, 25 bp, Mus musculus
ctccggcgtgaggtagaaaaggcta

SEQ ID NO: 614338 - DNA, 25 bp, Mus musculus
ctccgggacacacctgatggtacct

SEQ ID NO: 614339 - DNA, 25 bp, Mus musculus
ctccgggacacagctgatggtacct

SEQ ID NO: 614340 - DNA, 25 bp, Mus musculus
ctccgggacgcacatgcaaacctgg

SEQ ID NO: 614341 - DNA, 25 bp, Mus musculus
ctccgggacgcagatgcaaacctgg

SEQ ID NO: 614342 - DNA, 25 bp, Mus musculus
ctccgggagtgtcaactgagtcccg

SEQ ID NO: 614343 - DNA, 25 bp, Mus musculus
ctccgggagtgtgaactgagtcccg

SEQ ID NO: 614344 - DNA, 25 bp, Mus musculus
ctccggtaaaagcacagattccctg

SEQ ID NO: 614345 - DNA, 25 bp, Mus musculus
ctccggtaaaaggacagattccctg

SEQ ID NO: 614346 - DNA, 25 bp, Mus musculus
ctccggtatctaacagtgtgttata

SEQ ID NO: 614347 - DNA, 25 bp, Mus musculus
ctccggtatctatcagtgtgttata

SEQ ID NO: 614348 - DNA, 25 bp, Mus musculus
ctccggtgtggtagtctctcactct

SEQ ID NO: 614349 - DNA, 25 bp, Mus musculus
ctccggtgtggttgtctctcactct

SEQ ID NO: 614350 - DNA, 25 bp, Mus musculus
ctccgtaactgcaccaagaggatcc

SEQ ID NO: 614351 - DNA, 25 bp, Mus musculus
ctccgtaactgctccaagaggatcc

SEQ ID NO: 614352 - DNA, 25 bp, Mus musculus
ctccgtccgaggcagaggcaaatgc

SEQ ID NO: 614353 - DNA, 25 bp, Mus musculus
ctccgtccgagggagaggcaaatgc

SEQ ID NO: 614354 - DNA, 25 bp, Mus musculus
ctccgtggttgcatcgaagcgtttg

SEQ ID NO: 614355 - DNA, 25 bp, Mus musculus
ctccgtggttgcttcgaagcgtttg

SEQ ID NO: 614356 - DNA, 25 bp, Mus musculus
ctccgttatcctaagtgttgtggtc

SEQ ID NO: 614357 - DNA, 25 bp, Mus musculus
ctccgttatccttagtgttgtggtc

SEQ ID NO: 614358 - DNA, 25 bp, Mus musculus
ctcctaagaccacgagagaaaaagc

SEQ ID NO: 614359 - DNA, 25 bp, Mus musculus
ctcctaagaccaggagagaaaaagc

SEQ ID NO: 614360 - DNA, 25 bp, Mus musculus
ctcctaatagtacagcagaagcagc

SEQ ID NO: 614361 - DNA, 25 bp, Mus musculus
ctcctaatagtagagcagaagcagc

SEQ ID NO: 614362 - DNA, 25 bp, Mus musculus
ctcctactacggactcgtgcggctg

SEQ ID NO: 614363 - DNA, 25 bp, Mus musculus
ctcctactacggtctcgtgcggctg

SEQ ID NO: 614364 - DNA, 25 bp, Mus musculus
ctcctactcggaagacaagatgtac

SEQ ID NO: 614365 - DNA, 25 bp, Mus musculus
ctcctactcggatgacaagatgtac

SEQ ID NO: 614366 - DNA, 25 bp, Mus musculus
ctcctactctggcacatcaagtttc

SEQ ID NO: 614367 - DNA, 25 bp, Mus musculus
ctcctactctgggacatcaagtttc

SEQ ID NO: 614368 - DNA, 25 bp, Mus musculus
ctcctactgaggagtcatcacccag

SEQ ID NO: 614369 - DNA, 25 bp, Mus musculus
ctcctactgaggtgtcatcacccag

SEQ ID NO: 614370 - DNA, 25 bp, Mus musculus
ctcctacttagtccctgagcttgat

SEQ ID NO: 614371 - DNA, 25 bp, Mus musculus
ctcctacttagtgcctgagcttgat

SEQ ID NO: 614372 - DNA, 25 bp, Mus musculus
ctcctagagaatcccctgtgtggtg

SEQ ID NO: 614373 - DNA, 25 bp, Mus musculus
ctcctagagaatgccctgtgtggtg

SEQ ID NO: 614374 - DNA, 25 bp, Mus musculus
ctcctagataggcagaaggaatgag

SEQ ID NO: 614375 - DNA, 25 bp, Mus musculus
ctcctagatagggagaaggaatgag

SEQ ID NO: 614376 - DNA, 25 bp, Mus musculus
ctcctagtggagctggtgcctcagt

SEQ ID NO: 614377 - DNA, 25 bp, Mus musculus
ctcctagtggaggtggtgcctcagt

SEQ ID NO: 614378 - DNA, 25 bp, Mus musculus
ctcctatactgtcggctatgaagaa

SEQ ID NO: 614379 - DNA, 25 bp, Mus musculus
ctcctatactgtgggctatgaagaa

SEQ ID NO: 614380 - DNA, 25 bp, Mus musculus
ctcctatcagagattgtttctaatg

SEQ ID NO: 614381 - DNA, 25 bp, Mus musculus
ctcctatcagagtttgtttctaatg

SEQ ID NO: 614382 - DNA, 25 bp, Mus musculus
ctcctatgacctacgggaaggacag

SEQ ID NO: 614383 - DNA, 25 bp, Mus musculus
ctcctatgaccttcgggaaggacag

SEQ ID NO: 614384 - DNA, 25 bp, Mus musculus
ctcctattccatctgtttcttcggg

SEQ ID NO: 614385 - DNA, 25 bp, Mus musculus
ctcctattccatgtgtttcttcggg

SEQ ID NO: 614386 - DNA, 25 bp, Mus musculus
ctcctcaaagctcataggagcatga

SEQ ID NO: 614387 - DNA, 25 bp, Mus musculus
ctcctcaaagctgataggagcatga

SEQ ID NO: 614388 - DNA, 25 bp, Mus musculus
ctcctcaatggacaaactagacaag

SEQ ID NO: 614389 - DNA, 25 bp, Mus musculus
ctcctcaatggagaaactagacaag

SEQ ID NO: 614390 - DNA, 25 bp, Mus musculus
ctcctcagagaaaatattcgaatac

SEQ ID NO: 614391 - DNA, 25 bp, Mus musculus
ctcctcagagaatatattcgaatac

SEQ ID NO: 614392 - DNA, 25 bp, Mus musculus
ctcctcaggagtctgaatcggaggt

SEQ ID NO: 614393 - DNA, 25 bp, Mus musculus
ctcctcaggagtgtgaatcggaggt

SEQ ID NO: 614394 - DNA, 25 bp, Mus musculus
ctcctcatctatacagtgtcactgt

SEQ ID NO: 614395 - DNA, 25 bp, Mus musculus
ctcctcatctattcagtgtcactgt

SEQ ID NO: 614396 - DNA, 25 bp, Mus musculus
ctcctccaagcaaagtgaataatcc

SEQ ID NO: 614397 - DNA, 25 bp, Mus musculus
ctcctccaagcatagtgaataatcc

SEQ ID NO: 614398 - DNA, 25 bp, Mus musculus
ctcctcccaggtcaccagatggtgg

SEQ ID NO: 614399 - DNA, 25 bp, Mus musculus
ctcctcccaggtgaccagatggtgg

SEQ ID NO: 614400 - DNA, 25 bp, Mus musculus
ctcctccctcatctgagaaggcaga

SEQ ID NO: 614401 - DNA, 25 bp, Mus musculus
ctcctccctcatgtgagaaggcaga

SEQ ID NO: 614402 - DNA, 25 bp, Mus musculus
ctcctcctaggtctgaagagccatc

SEQ ID NO: 614403 - DNA, 25 bp, Mus musculus
ctcctcctaggtgtgaagagccatc

SEQ ID NO: 614404 - DNA, 25 bp, Mus musculus
ctcctccttgcacgtgggaatccta

SEQ ID NO: 614405 - DNA, 25 bp, Mus musculus
ctcctccttgcaggtgggaatccta

SEQ ID NO: 614406 - DNA, 25 bp, Mus musculus
ctcctcgaagatagactctcatggt

SEQ ID NO: 614407 - DNA, 25 bp, Mus musculus
ctcctcgaagattgactctcatggt

SEQ ID NO: 614408 - DNA, 25 bp, Mus musculus
ctcctcgagtggacatgtctaccca

SEQ ID NO: 614409 - DNA, 25 bp, Mus musculus
ctcctcgagtggtcatgtctaccca

SEQ ID NO: 614410 - DNA, 25 bp, Mus musculus
ctcctcggaggacaaagagacggac

SEQ ID NO: 614411 - DNA, 25 bp, Mus musculus
ctcctcggaggagaaagagacggac

SEQ ID NO: 614412 - DNA, 25 bp, Mus musculus
ctcctcggattaaattgtggaaaga

SEQ ID NO: 614413 - DNA, 25 bp, Mus musculus
ctcctcggattatattgtggaaaga

SEQ ID NO: 614414 - DNA, 25 bp, Mus musculus
ctcctcggtgacactaggatgcctg

SEQ ID NO: 614415 - DNA, 25 bp, Mus musculus
ctcctcggtgacagatccgacgacg

SEQ ID NO: 614416 - DNA, 25 bp, Mus musculus
ctcctcggtgactctaggatgcctg

SEQ ID NO: 614417 - DNA, 25 bp, Mus musculus
ctcctcggtgactgatccgacgacg

SEQ ID NO: 614418 - DNA, 25 bp, Mus musculus
ctcctcgtttgaagatgtagatgcg

SEQ ID NO: 614419 - DNA, 25 bp, Mus musculus
ctcctcgtttgatgatgtagatgcg

SEQ ID NO: 614420 - DNA, 25 bp, Mus musculus
ctcctctagacaagaaccaattccg

SEQ ID NO: 614421 - DNA, 25 bp, Mus musculus
ctcctctagacatgaaccaattccg

SEQ ID NO: 614422 - DNA, 25 bp, Mus musculus
ctcctctccaggagttccggcttga

SEQ ID NO: 614423 - DNA, 25 bp, Mus musculus
ctcctctccaggtgttccggcttga

SEQ ID NO: 614424 - DNA, 25 bp, Mus musculus
ctcctctccggaagctgtgccaggg

SEQ ID NO: 614425 - DNA, 25 bp, Mus musculus
ctcctctccggatgctgtgccaggg

SEQ ID NO: 614426 - DNA, 25 bp, Mus musculus
ctcctctccggcagaggccgggatt

SEQ ID NO: 614427 - DNA, 25 bp, Mus musculus
ctcctctccggctgaggccgggatt

SEQ ID NO: 614428 - DNA, 25 bp, Mus musculus
ctcctctctttgacagaggacaaag

SEQ ID NO: 614429 - DNA, 25 bp, Mus musculus
ctcctctctttgtcagaggacaaag

SEQ ID NO: 614430 - DNA, 25 bp, Mus musculus
ctcctctgcgcactgaggctacaga

SEQ ID NO: 614431 - DNA, 25 bp, Mus musculus
ctcctctgcgcagtgaggctacaga

SEQ ID NO: 614432 - DNA, 25 bp, Mus musculus
ctcctctgctctagtgggaagtggt

SEQ ID NO: 614433 - DNA, 25 bp, Mus musculus
ctcctctgctcttgtgggaagtggt

SEQ ID NO: 614434 - DNA, 25 bp, Mus musculus
ctcctctggtcacccaataaggtgt

SEQ ID NO: 614435 - DNA, 25 bp, Mus musculus
ctcctctggtcagccaataaggtgt

SEQ ID NO: 614436 - DNA, 25 bp, Mus musculus
ctcctgaagatcaggatggctctgg

SEQ ID NO: 614437 - DNA, 25 bp, Mus musculus
ctcctgaagatcctcacgtatttac

SEQ ID NO: 614438 - DNA, 25 bp, Mus musculus
ctcctgaagatcgtcacgtatttac

SEQ ID NO: 614439 - DNA, 25 bp, Mus musculus
ctcctgaagatctggatggctctgg

SEQ ID NO: 614440 - DNA, 25 bp, Mus musculus
ctcctgagagagcaaatagggccag

SEQ ID NO: 614441 - DNA, 25 bp, Mus musculus
ctcctgagagaggaaatagggccag

SEQ ID NO: 614442 - DNA, 25 bp, Mus musculus
ctcctgagcagaatgtcatcatggc

SEQ ID NO: 614443 - DNA, 25 bp, Mus musculus
ctcctgagcagattgtcatcatggc

SEQ ID NO: 614444 - DNA, 25 bp, Mus musculus
ctcctgagggcgcaaggccttgctc

SEQ ID NO: 614445 - DNA, 25 bp, Mus musculus
ctcctgagggcggaaggccttgctc

SEQ ID NO: 614446 - DNA, 25 bp, Mus musculus
ctcctgaggttgagtctgcgggaac

SEQ ID NO: 614447 - DNA, 25 bp, Mus musculus
ctcctgaggttgtgtctgcgggaac

SEQ ID NO: 614448 - DNA, 25 bp, Mus musculus
ctcctgagtcagaactttgatgatg

SEQ ID NO: 614449 - DNA, 25 bp, Mus musculus
ctcctgagtcagtactttgatgatg

SEQ ID NO: 614450 - DNA, 25 bp, Mus musculus
ctcctgataggaacctttgtggcag

SEQ ID NO: 614451 - DNA, 25 bp, Mus musculus
ctcctgataggatcctttgtggcag

SEQ ID NO: 614452 - DNA, 25 bp, Mus musculus
ctcctgatgaccctcaagggacttc

SEQ ID NO: 614453 - DNA, 25 bp, Mus musculus
ctcctgatgaccgtcaagggacttc

SEQ ID NO: 614454 - DNA, 25 bp, Mus musculus
ctcctgatggttagatctctctact

SEQ ID NO: 614455 - DNA, 25 bp, Mus musculus
ctcctgatggtttgatctctctact

SEQ ID NO: 614456 - DNA, 25 bp, Mus musculus
ctcctgatttgcctgaatatgaaga

SEQ ID NO: 614457 - DNA, 25 bp, Mus musculus
ctcctgatttgcgtgaatatgaaga

SEQ ID NO: 614458 - DNA, 25 bp, Mus musculus
ctcctgcaaaagatgttcctatgaa

SEQ ID NO: 614459 - DNA, 25 bp, Mus musculus
ctcctgcaaaagttgttcctatgaa

SEQ ID NO: 614460 - DNA, 25 bp, Mus musculus
ctcctgcacactcgacagaagatgc

SEQ ID NO: 614461 - DNA, 25 bp, Mus musculus
ctcctgcacactggacagaagatgc

SEQ ID NO: 614462 - DNA, 25 bp, Mus musculus
ctcctgcagaatccgaaagtcacag

SEQ ID NO: 614463 - DNA, 25 bp, Mus musculus
ctcctgcagaatgcgaaagtcacag

SEQ ID NO: 614464 - DNA, 25 bp, Mus musculus
ctcctgcatctcagcaaggacggtc

SEQ ID NO: 614465 - DNA, 25 bp, Mus musculus
ctcctgcatctctgcaaggacggtc

SEQ ID NO: 614466 - DNA, 25 bp, Mus musculus
ctcctgccagcgattgtgttcattg

SEQ ID NO: 614467 - DNA, 25 bp, Mus musculus
ctcctgccagcgtttgtgttcattg

SEQ ID NO: 614468 - DNA, 25 bp, Mus musculus
ctcctgccagggaggacatgtatgc

SEQ ID NO: 614469 - DNA, 25 bp, Mus musculus
ctcctgccagggtggacatgtatgc

SEQ ID NO: 614470 - DNA, 25 bp, Mus musculus
ctcctgccctgtcgctgtaaaactg

SEQ ID NO: 614471 - DNA, 25 bp, Mus musculus
ctcctgccctgtggctgtaaaactg

SEQ ID NO: 614472 - DNA, 25 bp, Mus musculus
ctcctgcgtttgacattatttatac

SEQ ID NO: 614473 - DNA, 25 bp, Mus musculus
ctcctgcgtttgtcattatttatac

SEQ ID NO: 614474 - DNA, 25 bp, Mus musculus
ctcctgctgactatctttcagggca

SEQ ID NO: 614475 - DNA, 25 bp, Mus musculus
ctcctgctgactttctttcagggca

SEQ ID NO: 614476 - DNA, 25 bp, Mus musculus
ctcctgctgattcgacaactggaag

SEQ ID NO: 614477 - DNA, 25 bp, Mus musculus
ctcctgctgattggacaactggaag

SEQ ID NO: 614478 - DNA, 25 bp, Mus musculus
ctcctgctggcacatgtctgcttga

SEQ ID NO: 614479 - DNA, 25 bp, Mus musculus
ctcctgctggcagatgtctgcttga

SEQ ID NO: 614480 - DNA, 25 bp, Mus musculus
ctcctggaacaactgaacgccctgg

SEQ ID NO: 614481 - DNA, 25 bp, Mus musculus
ctcctggaacaagtgaacgccctgg

SEQ ID NO: 614482 - DNA, 25 bp, Mus musculus
ctcctggaagctcggtagttcctgc

SEQ ID NO: 614483 - DNA, 25 bp, Mus musculus
ctcctggaagctgggtagttcctgc

SEQ ID NO: 614484 - DNA, 25 bp, Mus musculus
ctcctggaaggaccctgaagctgaa

SEQ ID NO: 614485 - DNA, 25 bp, Mus musculus
ctcctggaaggagcctgaagctgaa

SEQ ID NO: 614486 - DNA, 25 bp, Mus musculus
ctcctggaagtgactcgaattgtgg

SEQ ID NO: 614487 - DNA, 25 bp, Mus musculus
ctcctggaagtgtctcgaattgtgg

SEQ ID NO: 614488 - DNA, 25 bp, Mus musculus
ctcctggaatccctcctgtggtgta

SEQ ID NO: 614489 - DNA, 25 bp, Mus musculus
ctcctggaatccgtcctgtggtgta

SEQ ID NO: 614490 - DNA, 25 bp, Mus musculus
ctcctggagacccaggcaagccagg

SEQ ID NO: 614491 - DNA, 25 bp, Mus musculus
ctcctggagaccgaggcaagccagg

SEQ ID NO: 614492 - DNA, 25 bp, Mus musculus
ctcctggaggaacctaagaagatgg

SEQ ID NO: 614493 - DNA, 25 bp, Mus musculus
ctcctggaggaagctaagaagatgg

SEQ ID NO: 614494 - DNA, 25 bp, Mus musculus
ctcctggatgagctatgcggcagcc

SEQ ID NO: 614495 - DNA, 25 bp, Mus musculus
ctcctggatgaggtatgcggcagcc

SEQ ID NO: 614496 - DNA, 25 bp, Mus musculus
ctcctggattggcagccgctgtaga

SEQ ID NO: 614497 - DNA, 25 bp, Mus musculus
ctcctggattgggagccgctgtaga

SEQ ID NO: 614498 - DNA, 25 bp, Mus musculus
ctcctggcatcaagggaaaggctcc

SEQ ID NO: 614499 - DNA, 25 bp, Mus musculus
ctcctggcatcatgggaaaggctcc

SEQ ID NO: 614500 - DNA, 25 bp, Mus musculus
ctcctggcggagacggcagatatga

SEQ ID NO: 614501 - DNA, 25 bp, Mus musculus
ctcctggcggagtcggcagatatga

SEQ ID NO: 614502 - DNA, 25 bp, Mus musculus
ctcctggctgctcccggagttgcag

SEQ ID NO: 614503 - DNA, 25 bp, Mus musculus
ctcctggctgctgccggagttgcag

SEQ ID NO: 614504 - DNA, 25 bp, Mus musculus
ctcctggctttgcagtgttgggaaa

SEQ ID NO: 614505 - DNA, 25 bp, Mus musculus
ctcctggctttggagtgttgggaaa

SEQ ID NO: 614506 - DNA, 25 bp, Mus musculus
ctcctgggcaatatgatcgtgattg

SEQ ID NO: 614507 - DNA, 25 bp, Mus musculus
ctcctgggcaatttgatcgtgattg

SEQ ID NO: 614508 - DNA, 25 bp, Mus musculus
ctcctgggcaccaacaagcgcttgt

SEQ ID NO: 614509 - DNA, 25 bp, Mus musculus
ctcctgggcacctacaagcgcttgt

SEQ ID NO: 614510 - DNA, 25 bp, Mus musculus
ctcctgggctccacgaagagactca

SEQ ID NO: 614511 - DNA, 25 bp, Mus musculus
ctcctgggctcctcgaagagactca

SEQ ID NO: 614512 - DNA, 25 bp, Mus musculus
ctcctgggtattccctgcatggtca

SEQ ID NO: 614513 - DNA, 25 bp, Mus musculus
ctcctgggtattgcctgcatggtca

SEQ ID NO: 614514 - DNA, 25 bp, Mus musculus
ctcctgggtcatcaggtgggacacc

SEQ ID NO: 614515 - DNA, 25 bp, Mus musculus
ctcctgggtcatgaggtgggacacc

SEQ ID NO: 614516 - DNA, 25 bp, Mus musculus
ctcctggtgatgaggatggccgaat

SEQ ID NO: 614517 - DNA, 25 bp, Mus musculus
ctcctggtgatgtggatggccgaat

SEQ ID NO: 614518 - DNA, 25 bp, Mus musculus
ctcctggtgcagctgggtagcccct

SEQ ID NO: 614519 - DNA, 25 bp, Mus musculus
ctcctggtgcaggtgggtagcccct

SEQ ID NO: 614520 - DNA, 25 bp, Mus musculus
ctcctggttactagaccttcttcac

SEQ ID NO: 614521 - DNA, 25 bp, Mus musculus
ctcctggttacttgaccttcttcac

SEQ ID NO: 614522 - DNA, 25 bp, Mus musculus
ctcctgtgaccgcatcaaagatgag

SEQ ID NO: 614523 - DNA, 25 bp, Mus musculus
ctcctgtgaccggatcaaagatgag

SEQ ID NO: 614524 - DNA, 25 bp, Mus musculus
ctcctgtgtccaaggtcaggtgccc

SEQ ID NO: 614525 - DNA, 25 bp, Mus musculus
ctcctgtgtccatggtcaggtgccc

SEQ ID NO: 614526 - DNA, 25 bp, Mus musculus
ctcctgtgtccgagatgtcctcaac

SEQ ID NO: 614527 - DNA, 25 bp, Mus musculus
ctcctgtgtccgtgatgtcctcaac

SEQ ID NO: 614528 - DNA, 25 bp, Mus musculus
ctcctgtgtgagagttatctgtgaa

SEQ ID NO: 614529 - DNA, 25 bp, Mus musculus
ctcctgtgtgagtgttatctgtgaa

SEQ ID NO: 614530 - DNA, 25 bp, Mus musculus
ctcctgttaatgcacctgcaagaca

SEQ ID NO: 614531 - DNA, 25 bp, Mus musculus
ctcctgttaatggacctgcaagaca

SEQ ID NO: 614532 - DNA, 25 bp, Mus musculus
ctcctgttgttaatggtcctcgtac

SEQ ID NO: 614533 - DNA, 25 bp, Mus musculus
ctcctgttgttattggtcctcgtac

SEQ ID NO: 614534 - DNA, 25 bp, Mus musculus
ctccttaaacttcgtgacacctaag

SEQ ID NO: 614535 - DNA, 25 bp, Mus musculus
ctccttaaacttggtgacacctaag

SEQ ID NO: 614536 - DNA, 25 bp, Mus musculus
ctccttacccaactgggtggtgaat

SEQ ID NO: 614537 - DNA, 25 bp, Mus musculus
ctccttacccaagtgggtggtgaat

SEQ ID NO: 614538 - DNA, 25 bp, Mus musculus
ctccttacggacagcaactcagaaa

SEQ ID NO: 614539 - DNA, 25 bp, Mus musculus
ctccttacggactgcaactcagaaa

SEQ ID NO: 614540 - DNA, 25 bp, Mus musculus
ctccttattcatcgaacggcagatg

SEQ ID NO: 614541 - DNA, 25 bp, Mus musculus
ctccttattcatggaacggcagatg

SEQ ID NO: 614542 - DNA, 25 bp, Mus musculus
ctccttcagggcagcaacggtgaca

SEQ ID NO: 614543 - DNA, 25 bp, Mus musculus
ctccttcagggctgcaacggtgaca

SEQ ID NO: 614544 - DNA, 25 bp, Mus musculus
ctccttccaggaagtagggccgcag

SEQ ID NO: 614545 - DNA, 25 bp, Mus musculus
ctccttccaggatgtagggccgcag

SEQ ID NO: 614546 - DNA, 25 bp, Mus musculus
ctccttccgtggagacgcggcggct

SEQ ID NO: 614547 - DNA, 25 bp, Mus musculus
ctccttccgtggtgacgcggcggct

SEQ ID NO: 614548 - DNA, 25 bp, Mus musculus
ctccttctaggcctataggttgcaa

SEQ ID NO: 614549 - DNA, 25 bp, Mus musculus
ctccttctaggcgtataggttgcaa

SEQ ID NO: 614550 - DNA, 25 bp, Mus musculus
ctccttctgggcacgttgttgtggc

SEQ ID NO: 614551 - DNA, 25 bp, Mus musculus
ctccttctgggctcgttgttgtggc

SEQ ID NO: 614552 - DNA, 25 bp, Mus musculus
ctccttctttttctctgcagagccg

SEQ ID NO: 614553 - DNA, 25 bp, Mus musculus
ctccttctttttgtctgcagagccg

SEQ ID NO: 614554 - DNA, 25 bp, Mus musculus
ctccttgagcgcagagcggcagctg

SEQ ID NO: 614555 - DNA, 25 bp, Mus musculus
ctccttgagcgctgagcggcagctg

SEQ ID NO: 614556 - DNA, 25 bp, Mus musculus
ctccttgcaggtcggaatcctagat

SEQ ID NO: 614557 - DNA, 25 bp, Mus musculus
ctccttgcaggtgggaatcctagat

SEQ ID NO: 614558 - DNA, 25 bp, Mus musculus
ctccttgcccaccagaaggtgtcta

SEQ ID NO: 614559 - DNA, 25 bp, Mus musculus
ctccttgcccacgagaaggtgtcta

SEQ ID NO: 614560 - DNA, 25 bp, Mus musculus
ctccttggccagagaactcgcgctg

SEQ ID NO: 614561 - DNA, 25 bp, Mus musculus
ctccttggccagtgaactcgcgctg

SEQ ID NO: 614562 - DNA, 25 bp, Mus musculus
ctccttgggaggctctgctaggaat

SEQ ID NO: 614563 - DNA, 25 bp, Mus musculus
ctccttgggagggtctgctaggaat

SEQ ID NO: 614564 - DNA, 25 bp, Mus musculus
ctccttggtccactttcccttgtgg

SEQ ID NO: 614565 - DNA, 25 bp, Mus musculus
ctccttggtccagtttcccttgtgg

SEQ ID NO: 614566 - DNA, 25 bp, Mus musculus
ctccttgtagttccaaccagtctat

SEQ ID NO: 614567 - DNA, 25 bp, Mus musculus
ctccttgtagttgcaaccagtctat

SEQ ID NO: 614568 - DNA, 25 bp, Mus musculus
ctccttgtcgtgaccctgattggga

SEQ ID NO: 614569 - DNA, 25 bp, Mus musculus
ctccttgtcgtgtccctgattggga

SEQ ID NO: 614570 - DNA, 25 bp, Mus musculus
ctccttgtgtagcagtgggtgtcca

SEQ ID NO: 614571 - DNA, 25 bp, Mus musculus
ctccttgtgtaggagtgggtgtcca

SEQ ID NO: 614572 - DNA, 25 bp, Mus musculus
ctcctttactacatcaaagatggcg

SEQ ID NO: 614573 - DNA, 25 bp, Mus musculus
ctcctttactacttcaaagatggcg

SEQ ID NO: 614574 - DNA, 25 bp, Mus musculus
ctcctttatgggaatcacactattg

SEQ ID NO: 614575 - DNA, 25 bp, Mus musculus
ctcctttatgggtatcacactattg

SEQ ID NO: 614576 - DNA, 25 bp, Mus musculus
ctcctttcttgcatgttgggaccca

SEQ ID NO: 614577 - DNA, 25 bp, Mus musculus
ctcctttcttgcttgttgggaccca

SEQ ID NO: 614578 - DNA, 25 bp, Mus musculus
ctcctttggctaagggcactgtgca

SEQ ID NO: 614579 - DNA, 25 bp, Mus musculus
ctcctttggctatgggcactgtgca

SEQ ID NO: 614580 - DNA, 25 bp, Mus musculus
ctccttttgagtccctgggtgccgc

SEQ ID NO: 614581 - DNA, 25 bp, Mus musculus
ctccttttgagtgcctgggtgccgc

SEQ ID NO: 614582 - DNA, 25 bp, Mus musculus
ctccttttgggcatctggtgagcac

SEQ ID NO: 614583 - DNA, 25 bp, Mus musculus
ctccttttgggcttctggtgagcac

SEQ ID NO: 614584 - DNA, 25 bp, Mus musculus
ctccttttgtttcgcagctcttttg

SEQ ID NO: 614585 - DNA, 25 bp, Mus musculus
ctccttttgtttggcagctcttttg

SEQ ID NO: 614586 - DNA, 25 bp, Mus musculus
ctcgaaaccttacccggccggatgg

SEQ ID NO: 614587 - DNA, 25 bp, Mus musculus
ctcgaaaccttagccggccggatgg

SEQ ID NO: 614588 - DNA, 25 bp, Mus musculus
ctcgaaagcgccagaaagagacttc

SEQ ID NO: 614589 - DNA, 25 bp, Mus musculus
ctcgaaagcgcctgaaagagacttc

SEQ ID NO: 614590 - DNA, 25 bp, Mus musculus
ctcgaaatcttgaggatcaaggaaa

SEQ ID NO: 614591 - DNA, 25 bp, Mus musculus
ctcgaaatcttgtggatcaaggaaa

SEQ ID NO: 614592 - DNA, 25 bp, Mus musculus
ctcgaaatgagtataatctggaaag

SEQ ID NO: 614593 - DNA, 25 bp, Mus musculus
ctcgaaatgagtttaatctggaaag

SEQ ID NO: 614594 - DNA, 25 bp, Mus musculus
ctcgaaatggcaaggatgttgctgt

SEQ ID NO: 614595 - DNA, 25 bp, Mus musculus
ctcgaaatggcatggatgttgctgt

SEQ ID NO: 614596 - DNA, 25 bp, Mus musculus
ctcgaaatgtgacgcgccagagtga

SEQ ID NO: 614597 - DNA, 25 bp, Mus musculus
ctcgaaatgtgaggcgccagagtga

SEQ ID NO: 614598 - DNA, 25 bp, Mus musculus
ctcgaaccaaccctagcgttatgat

SEQ ID NO: 614599 - DNA, 25 bp, Mus musculus
ctcgaaccaaccgtagcgttatgat

SEQ ID NO: 614600 - DNA, 25 bp, Mus musculus
ctcgaagaaaggatgacgcccagca

SEQ ID NO: 614601 - DNA, 25 bp, Mus musculus
ctcgaagaaaggttgacgcccagca

SEQ ID NO: 614602 - DNA, 25 bp, Mus musculus
ctcgaagaggatccgttagactcag

SEQ ID NO: 614603 - DNA, 25 bp, Mus musculus
ctcgaagaggatgcgttagactcag

SEQ ID NO: 614604 - DNA, 25 bp, Mus musculus
ctcgaaggaaggactcccgggctgc

SEQ ID NO: 614605 - DNA, 25 bp, Mus musculus
ctcgaaggaaggtctcccgggctgc

SEQ ID NO: 614606 - DNA, 25 bp, Mus musculus
ctcgacaacggcaggccggacgtgt

SEQ ID NO: 614607 - DNA, 25 bp, Mus musculus
ctcgacaacggctggccggacgtgt

SEQ ID NO: 614608 - DNA, 25 bp, Mus musculus
ctcgacatcagccagacagcaggag

SEQ ID NO: 614609 - DNA, 25 bp, Mus musculus
ctcgacatcagcgagacagcaggag

SEQ ID NO: 614610 - DNA, 25 bp, Mus musculus
ctcgaccgatcaacagacttctctg

SEQ ID NO: 614611 - DNA, 25 bp, Mus musculus
ctcgaccgatcatcagacttctctg

SEQ ID NO: 614612 - DNA, 25 bp, Mus musculus
ctcgacctggttagatacttatgaa

SEQ ID NO: 614613 - DNA, 25 bp, Mus musculus
ctcgacctggtttgatacttatgaa

SEQ ID NO: 614614 - DNA, 25 bp, Mus musculus
ctcgacggtccacggctgaggcctt

SEQ ID NO: 614615 - DNA, 25 bp, Mus musculus
ctcgacggtccagggctgaggcctt

SEQ ID NO: 614616 - DNA, 25 bp, Mus musculus
ctcgactgcaatactgatgaattca

SEQ ID NO: 614617 - DNA, 25 bp, Mus musculus
ctcgactgcaattctgatgaattca

SEQ ID NO: 614618 - DNA, 25 bp, Mus musculus
ctcgactgtataaggatgacttctg

SEQ ID NO: 614619 - DNA, 25 bp, Mus musculus
ctcgactgtatatggatgacttctg

SEQ ID NO: 614620 - DNA, 25 bp, Mus musculus
ctcgacttctgtatgaagactggac

SEQ ID NO: 614621 - DNA, 25 bp, Mus musculus
ctcgacttctgtttgaagactggac

SEQ ID NO: 614622 - DNA, 25 bp, Mus musculus
ctcgagaagaaaaccaggaagtaag

SEQ ID NO: 614623 - DNA, 25 bp, Mus musculus
ctcgagaagaaatccaggaagtaag

SEQ ID NO: 614624 - DNA, 25 bp, Mus musculus
ctcgagaatcggcaaggaagacaca

SEQ ID NO: 614625 - DNA, 25 bp, Mus musculus
ctcgagaatcgggaaggaagacaca

SEQ ID NO: 614626 - DNA, 25 bp, Mus musculus
ctcgagacatggcaggctacagcac

SEQ ID NO: 614627 - DNA, 25 bp, Mus musculus
ctcgagacatgggaggctacagcac

SEQ ID NO: 614628 - DNA, 25 bp, Mus musculus
ctcgagagcatcctgggactaatct

SEQ ID NO: 614629 - DNA, 25 bp, Mus musculus
ctcgagagcatcgtgggactaatct

SEQ ID NO: 614630 - DNA, 25 bp, Mus musculus
ctcgagaggtgtctctggtccagtt

SEQ ID NO: 614631 - DNA, 25 bp, Mus musculus
ctcgagaggtgtgtctggtccagtt

SEQ ID NO: 614632 - DNA, 25 bp, Mus musculus
ctcgagatgcagacgagcgagagaa

SEQ ID NO: 614633 - DNA, 25 bp, Mus musculus
ctcgagatgcagtcgagcgagagaa

SEQ ID NO: 614634 - DNA, 25 bp, Mus musculus
ctcgagcagtacatcacggcgcgta

SEQ ID NO: 614635 - DNA, 25 bp, Mus musculus
ctcgagcagtacttcacggcgcgta

SEQ ID NO: 614636 - DNA, 25 bp, Mus musculus
ctcgagccgcaacggactgcagatg

SEQ ID NO: 614637 - DNA, 25 bp, Mus musculus
ctcgagccgcaagggactgcagatg

SEQ ID NO: 614638 - DNA, 25 bp, Mus musculus
ctcgaggaacatcctgaagctgtgg

SEQ ID NO: 614639 - DNA, 25 bp, Mus musculus
ctcgaggaacatgctgaagctgtgg

SEQ ID NO: 614640 - DNA, 25 bp, Mus musculus
ctcgaggaccgcagcggcctctgtg

SEQ ID NO: 614641 - DNA, 25 bp, Mus musculus
ctcgaggaccgctgcggcctctgtg

SEQ ID NO: 614642 - DNA, 25 bp, Mus musculus
ctcgaggactggagcttgaaaatga

SEQ ID NO: 614643 - DNA, 25 bp, Mus musculus
ctcgaggactggtgcttgaaaatga

SEQ ID NO: 614644 - DNA, 25 bp, Mus musculus
ctcgaggctgttccgggaacgcatc

SEQ ID NO: 614645 - DNA, 25 bp, Mus musculus
ctcgaggctgttgcgggaacgcatc

SEQ ID NO: 614646 - DNA, 25 bp, Mus musculus
ctcgagtcaaggcttattagggtag

SEQ ID NO: 614647 - DNA, 25 bp, Mus musculus
ctcgagtcaagggttattagggtag

SEQ ID NO: 614648 - DNA, 25 bp, Mus musculus
ctcgagtccttgagtggattggtga

SEQ ID NO: 614649 - DNA, 25 bp, Mus musculus
ctcgagtccttgtgtggattggtga

SEQ ID NO: 614650 - DNA, 25 bp, Mus musculus
ctcgagtgggaactatgatagcccc

SEQ ID NO: 614651 - DNA, 25 bp, Mus musculus
ctcgagtgggaagtatgatagcccc

SEQ ID NO: 614652 - DNA, 25 bp, Mus musculus
ctcgagttattactgggaaatagaa

SEQ ID NO: 614653 - DNA, 25 bp, Mus musculus
ctcgagttattagtgggaaatagaa

SEQ ID NO: 614654 - DNA, 25 bp, Mus musculus
ctcgagttgcttaccggctgattcg

SEQ ID NO: 614655 - DNA, 25 bp, Mus musculus
ctcgagttgctttccggctgattcg

SEQ ID NO: 614656 - DNA, 25 bp, Mus musculus
ctcgagtttctgcaccaggtttgga

SEQ ID NO: 614657 - DNA, 25 bp, Mus musculus
ctcgagtttctggaccaggtttgga

SEQ ID NO: 614658 - DNA, 25 bp, Mus musculus
ctcgatatggctcggtaacaagtac

SEQ ID NO: 614659 - DNA, 25 bp, Mus musculus
ctcgatatggctgggtaacaagtac

SEQ ID NO: 614660 - DNA, 25 bp, Mus musculus
ctcgatcccgaactagcggccatgg

SEQ ID NO: 614661 - DNA, 25 bp, Mus musculus
ctcgatcccgaagtagcggccatgg

SEQ ID NO: 614662 - DNA, 25 bp, Mus musculus
ctcgatgggaagatcattgctgtgg

SEQ ID NO: 614663 - DNA, 25 bp, Mus musculus
ctcgatgggaagttcattgctgtgg

SEQ ID NO: 614664 - DNA, 25 bp, Mus musculus
ctcgcagagctaagagcagaacatc

SEQ ID NO: 614665 - DNA, 25 bp, Mus musculus
ctcgcagagctatgagcagaacatc

SEQ ID NO: 614666 - DNA, 25 bp, Mus musculus
ctcgcagccgagcttcctaaagtgt

SEQ ID NO: 614667 - DNA, 25 bp, Mus musculus
ctcgcagccgaggttcctaaagtgt

SEQ ID NO: 614668 - DNA, 25 bp, Mus musculus
ctcgcagcggccaccgaggagatgc

SEQ ID NO: 614669 - DNA, 25 bp, Mus musculus
ctcgcagcggcctccgaggagatgc

SEQ ID NO: 614670 - DNA, 25 bp, Mus musculus
ctcgcaggacaaaggagacgaggct

SEQ ID NO: 614671 - DNA, 25 bp, Mus musculus
ctcgcaggacaatggagacgaggct

SEQ ID NO: 614672 - DNA, 25 bp, Mus musculus
ctcgcagggaggatgagagctacgg

SEQ ID NO: 614673 - DNA, 25 bp, Mus musculus
ctcgcagggaggttgagagctacgg

SEQ ID NO: 614674 - DNA, 25 bp, Mus musculus
ctcgcagtggccctgggataccgca

SEQ ID NO: 614675 - DNA, 25 bp, Mus musculus
ctcgcagtggccgtgggataccgca

SEQ ID NO: 614676 - DNA, 25 bp, Mus musculus
ctcgcagttccacgttttggttgct

SEQ ID NO: 614677 - DNA, 25 bp, Mus musculus
ctcgcagttccaggttttggttgct

SEQ ID NO: 614678 - DNA, 25 bp, Mus musculus
ctcgccaaggttattcatgaaaact

SEQ ID NO: 614679 - DNA, 25 bp, Mus musculus
ctcgccaaggtttttcatgaaaact

SEQ ID NO: 614680 - DNA, 25 bp, Mus musculus
ctcgcccgaggacccaagaatgtgt

SEQ ID NO: 614681 - DNA, 25 bp, Mus musculus
ctcgcccgaggagccaagaatgtgt

SEQ ID NO: 614682 - DNA, 25 bp, Mus musculus
ctcgcccgcttgatccagacataag

SEQ ID NO: 614683 - DNA, 25 bp, Mus musculus
ctcgcccgcttgttccagacataag

SEQ ID NO: 614684 - DNA, 25 bp, Mus musculus
ctcgccctgtccattacatctgaaa

SEQ ID NO: 614685 - DNA, 25 bp, Mus musculus
ctcgccctgtcctttacatctgaaa

SEQ ID NO: 614686 - DNA, 25 bp, Mus musculus
ctcgccgggaacagagcattgctgt

SEQ ID NO: 614687 - DNA, 25 bp, Mus musculus
ctcgccgggaactgagcattgctgt

SEQ ID NO: 614688 - DNA, 25 bp, Mus musculus
ctcgcctagatcacaagtttgatct

SEQ ID NO: 614689 - DNA, 25 bp, Mus musculus
ctcgcctagatctcaagtttgatct

SEQ ID NO: 614690 - DNA, 25 bp, Mus musculus
ctcgccttacccagatgctggctgt

SEQ ID NO: 614691 - DNA, 25 bp, Mus musculus
ctcgccttaccctgatgctggctgt

SEQ ID NO: 614692 - DNA, 25 bp, Mus musculus
ctcgcgacgcttccgcactagggaa

SEQ ID NO: 614693 - DNA, 25 bp, Mus musculus
ctcgcgacgcttgcgcactagggaa

SEQ ID NO: 614694 - DNA, 25 bp, Mus musculus
ctcgcgcggccactgagctcagtga

SEQ ID NO: 614695 - DNA, 25 bp, Mus musculus
ctcgcgcggccagtgagctcagtga

SEQ ID NO: 614696 - DNA, 25 bp, Mus musculus
ctcgcgcggctgcacattgtgcttg

SEQ ID NO: 614697 - DNA, 25 bp, Mus musculus
ctcgcgcggctggacattgtgcttg

SEQ ID NO: 614698 - DNA, 25 bp, Mus musculus
ctcgcgcgttgtcctggagattgac

SEQ ID NO: 614699 - DNA, 25 bp, Mus musculus
ctcgcgcgttgtgctggagattgac

SEQ ID NO: 614700 - DNA, 25 bp, Mus musculus
ctcgcggatgcccacgctggaagac

SEQ ID NO: 614701 - DNA, 25 bp, Mus musculus
ctcgcggatgccgacgctggaagac

SEQ ID NO: 614702 - DNA, 25 bp, Mus musculus
ctcgcggtttctcggtttcagagca

SEQ ID NO: 614703 - DNA, 25 bp, Mus musculus
ctcgcggtttctgggtttcagagca

SEQ ID NO: 614704 - DNA, 25 bp, Mus musculus
ctcgcgtaggatactgggagacgct

SEQ ID NO: 614705 - DNA, 25 bp, Mus musculus
ctcgcgtaggattctgggagacgct

SEQ ID NO: 614706 - DNA, 25 bp, Mus musculus
ctcgctaaaggacaggcaccgcgga

SEQ ID NO: 614707 - DNA, 25 bp, Mus musculus
ctcgctaaaggagaggcaccgcgga

SEQ ID NO: 614708 - DNA, 25 bp, Mus musculus
ctcgctcagcagaatgcacatccta

SEQ ID NO: 614709 - DNA, 25 bp, Mus musculus
ctcgctcagcagtatgcacatccta

SEQ ID NO: 614710 - DNA, 25 bp, Mus musculus
ctcgctcagccgctgctatgatata

SEQ ID NO: 614711 - DNA, 25 bp, Mus musculus
ctcgctcagccggtgctatgatata

SEQ ID NO: 614712 - DNA, 25 bp, Mus musculus
ctcgctcctagaaggcacctgtgac

SEQ ID NO: 614713 - DNA, 25 bp, Mus musculus
ctcgctcctagatggcacctgtgac

SEQ ID NO: 614714 - DNA, 25 bp, Mus musculus
ctcgctcggcagacagcatctgtgg

SEQ ID NO: 614715 - DNA, 25 bp, Mus musculus
ctcgctcggcagtcagcatctgtgg

SEQ ID NO: 614716 - DNA, 25 bp, Mus musculus
ctcgctgaaggtcgccacggtgatc

SEQ ID NO: 614717 - DNA, 25 bp, Mus musculus
ctcgctgaaggtggccacggtgatc

SEQ ID NO: 614718 - DNA, 25 bp, Mus musculus
ctcgctgcaaaacgaagagttgcgg

SEQ ID NO: 614719 - DNA, 25 bp, Mus musculus
ctcgctgcaaaaggaagagttgcgg

SEQ ID NO: 614720 - DNA, 25 bp, Mus musculus
ctcgctgcaggaacggtggcacctg

SEQ ID NO: 614721 - DNA, 25 bp, Mus musculus
ctcgctgcaggatcggtggcacctg

SEQ ID NO: 614722 - DNA, 25 bp, Mus musculus
ctcgctgccttgactggctggaccg

SEQ ID NO: 614723 - DNA, 25 bp, Mus musculus
ctcgctgccttgtctggctggaccg

SEQ ID NO: 614724 - DNA, 25 bp, Mus musculus
ctcgctggctggctcaacaacttgc

SEQ ID NO: 614725 - DNA, 25 bp, Mus musculus
ctcgctggctgggtcaacaacttgc

SEQ ID NO: 614726 - DNA, 25 bp, Mus musculus
ctcgctgggaagactccctgggcag

SEQ ID NO: 614727 - DNA, 25 bp, Mus musculus
ctcgctgggaagtctccctgggcag

SEQ ID NO: 614728 - DNA, 25 bp, Mus musculus
ctcgctggtttaacacttgtgtccg

SEQ ID NO: 614729 - DNA, 25 bp, Mus musculus
ctcgctggtttatcacttgtgtccg

SEQ ID NO: 614730 - DNA, 25 bp, Mus musculus
ctcgctgttcagaagtatgaggagc

SEQ ID NO: 614731 - DNA, 25 bp, Mus musculus
ctcgctgttcagtagtatgaggagc

SEQ ID NO: 614732 - DNA, 25 bp, Mus musculus
ctcgcttatggtcgcccgcagtatt

SEQ ID NO: 614733 - DNA, 25 bp, Mus musculus
ctcgcttatggtggcccgcagtatt

SEQ ID NO: 614734 - DNA, 25 bp, Mus musculus
ctcgctttggagcagatgaactctg

SEQ ID NO: 614735 - DNA, 25 bp, Mus musculus
ctcgctttggaggagatgaactctg

SEQ ID NO: 614736 - DNA, 25 bp, Mus musculus
ctcggaaaaacacgagacattagtg

SEQ ID NO: 614737 - DNA, 25 bp, Mus musculus
ctcggaaaaacaggagacattagtg

SEQ ID NO: 614738 - DNA, 25 bp, Mus musculus
ctcggaagcacaccgtcatgatgac

SEQ ID NO: 614739 - DNA, 25 bp, Mus musculus
ctcggaagcacagcgtcatgatgac

SEQ ID NO: 614740 - DNA, 25 bp, Mus musculus
ctcggaaggaggagaatgatgtctt

SEQ ID NO: 614741 - DNA, 25 bp, Mus musculus
ctcggaaggaggtgaatgatgtctt

SEQ ID NO: 614742 - DNA, 25 bp, Mus musculus
ctcggaaggcctccaatgatgccac

SEQ ID NO: 614743 - DNA, 25 bp, Mus musculus
ctcggaaggcctgcaatgatgccac

SEQ ID NO: 614744 - DNA, 25 bp, Mus musculus
ctcggacaccgtctgtgcggactgt

SEQ ID NO: 614745 - DNA, 25 bp, Mus musculus
ctcggacaccgtgtgtgcggactgt

SEQ ID NO: 614746 - DNA, 25 bp, Mus musculus
ctcggactgtgaagaaacattcaac

SEQ ID NO: 614747 - DNA, 25 bp, Mus musculus
ctcggactgtgatgaaacattcaac

SEQ ID NO: 614748 - DNA, 25 bp, Mus musculus
ctcggagaaggaattgatcactaac

SEQ ID NO: 614749 - DNA, 25 bp, Mus musculus
ctcggagaaggatttgatcactaac

SEQ ID NO: 614750 - DNA, 25 bp, Mus musculus
ctcggagactccagcaggagcgcag

SEQ ID NO: 614751 - DNA, 25 bp, Mus musculus
ctcggagactcctgcaggagcgcag

SEQ ID NO: 614752 - DNA, 25 bp, Mus musculus
ctcggagagtatcaggatgtgtcca

SEQ ID NO: 614753 - DNA, 25 bp, Mus musculus
ctcggagagtatgaggatgtgtcca

SEQ ID NO: 614754 - DNA, 25 bp, Mus musculus
ctcggagcagtgagtaaagcacccc

SEQ ID NO: 614755 - DNA, 25 bp, Mus musculus
ctcggagcagtgtgtaaagcacccc

SEQ ID NO: 614756 - DNA, 25 bp, Mus musculus
ctcggagcgcgcatggagcccagat

SEQ ID NO: 614757 - DNA, 25 bp, Mus musculus
ctcggagcgcgcttggagcccagat

SEQ ID NO: 614758 - DNA, 25 bp, Mus musculus
ctcggaggagaaagagacggacaac

SEQ ID NO: 614759 - DNA, 25 bp, Mus musculus
ctcggaggagaatgagacggacaac

SEQ ID NO: 614760 - DNA, 25 bp, Mus musculus
ctcggaggcggcaagggtcaccaca

SEQ ID NO: 614761 - DNA, 25 bp, Mus musculus
ctcggaggcggctagggtcaccaca

SEQ ID NO: 614762 - DNA, 25 bp, Mus musculus
ctcggatcccctctatcggtgcggg

SEQ ID NO: 614763 - DNA, 25 bp, Mus musculus
ctcggatcccctgtatcggtgcggg

SEQ ID NO: 614764 - DNA, 25 bp, Mus musculus
ctcggatgaagcacagatgcgactt

SEQ ID NO: 614765 - DNA, 25 bp, Mus musculus
ctcggatgaagctcagatgcgactt

SEQ ID NO: 614766 - DNA, 25 bp, Mus musculus
ctcggatgcaggctcccagggcact

SEQ ID NO: 614767 - DNA, 25 bp, Mus musculus
ctcggatgcagggtcccagggcact

SEQ ID NO: 614768 - DNA, 25 bp, Mus musculus
ctcggatgggcaaatctgtgctgga

SEQ ID NO: 614769 - DNA, 25 bp, Mus musculus
ctcggatgggcatatctgtgctgga

SEQ ID NO: 614770 - DNA, 25 bp, Mus musculus
ctcggattggcgaagcagaggccaa

SEQ ID NO: 614771 - DNA, 25 bp, Mus musculus
ctcggattggcgtagcagaggccaa

SEQ ID NO: 614772 - DNA, 25 bp, Mus musculus
ctcggcagaagaagcgcgagtgcca

SEQ ID NO: 614773 - DNA, 25 bp, Mus musculus
ctcggcagaagatgcgcgagtgcca

SEQ ID NO: 614774 - DNA, 25 bp, Mus musculus
ctcggcatgtaccagcctcactgtg

SEQ ID NO: 614775 - DNA, 25 bp, Mus musculus
ctcggcatgtacgagcctcactgtg

SEQ ID NO: 614776 - DNA, 25 bp, Mus musculus
ctcggccagtgcacgctgtgtttgt

SEQ ID NO: 614777 - DNA, 25 bp, Mus musculus
ctcggccagtgctcgctgtgtttgt

SEQ ID NO: 614778 - DNA, 25 bp, Mus musculus
ctcggccatggcagcttccgggagt

SEQ ID NO: 614779 - DNA, 25 bp, Mus musculus
ctcggccatggctgcttccgggagt

SEQ ID NO: 614780 - DNA, 25 bp, Mus musculus
ctcggcccaacaaaatggcgtcggc

SEQ ID NO: 614781 - DNA, 25 bp, Mus musculus
ctcggcccaacataatggcgtcggc

SEQ ID NO: 614782 - DNA, 25 bp, Mus musculus
ctcggccgcttgctcatggtgcacg

SEQ ID NO: 614783 - DNA, 25 bp, Mus musculus
ctcggccgcttggtcatggtgcacg

SEQ ID NO: 614784 - DNA, 25 bp, Mus musculus
ctcggccgggacagcaagtcgtcgc

SEQ ID NO: 614785 - DNA, 25 bp, Mus musculus
ctcggccgggactgcaagtcgtcgc

SEQ ID NO: 614786 - DNA, 25 bp, Mus musculus
ctcggccgttgaagctctcccagtg

SEQ ID NO: 614787 - DNA, 25 bp, Mus musculus
ctcggccgttgatgctctcccagtg

SEQ ID NO: 614788 - DNA, 25 bp, Mus musculus
ctcggcctgctactcgacctcctgg

SEQ ID NO: 614789 - DNA, 25 bp, Mus musculus
ctcggcctgctagtcgacctcctgg

SEQ ID NO: 614790 - DNA, 25 bp, Mus musculus
ctcggccttcagagacagagccagc

SEQ ID NO: 614791 - DNA, 25 bp, Mus musculus
ctcggccttcagtgacagagccagc

SEQ ID NO: 614792 - DNA, 25 bp, Mus musculus
ctcggcgctgcgagaggtcctccga

SEQ ID NO: 614793 - DNA, 25 bp, Mus musculus
ctcggcgctgcgtgaggtcctccga

SEQ ID NO: 614794 - DNA, 25 bp, Mus musculus
ctcggcggaacccaaggatctgctc

SEQ ID NO: 614795 - DNA, 25 bp, Mus musculus
ctcggcggaaccgaaggatctgctc

SEQ ID NO: 614796 - DNA, 25 bp, Mus musculus
ctcggcggccctcagtcagtttgtg

SEQ ID NO: 614797 - DNA, 25 bp, Mus musculus
ctcggcggccctgagtcagtttgtg

SEQ ID NO: 614798 - DNA, 25 bp, Mus musculus
ctcggcgtataactagcggcgcgtc

SEQ ID NO: 614799 - DNA, 25 bp, Mus musculus
ctcggcgtataagtagcggcgcgtc

SEQ ID NO: 614800 - DNA, 25 bp, Mus musculus
ctcggctacaaaagaggtcggctgc

SEQ ID NO: 614801 - DNA, 25 bp, Mus musculus
ctcggctacaaatgaggtcggctgc

SEQ ID NO: 614802 - DNA, 25 bp, Mus musculus
ctcggctcagaaagctggaggtaga

SEQ ID NO: 614803 - DNA, 25 bp, Mus musculus
ctcggctcagaatgctggaggtaga

SEQ ID NO: 614804 - DNA, 25 bp, Mus musculus
ctcggctcagcaacgcgggcgtcag

SEQ ID NO: 614805 - DNA, 25 bp, Mus musculus
ctcggctcagcatcgcgggcgtcag

SEQ ID NO: 614806 - DNA, 25 bp, Mus musculus
ctcggctcagtgcttctgagatgaa

SEQ ID NO: 614807 - DNA, 25 bp, Mus musculus
ctcggctcagtggttctgagatgaa

SEQ ID NO: 614808 - DNA, 25 bp, Mus musculus
ctcggctcgctgcaaccatgtgtgg

SEQ ID NO: 614809 - DNA, 25 bp, Mus musculus
ctcggctcgctggaaccatgtgtgg

SEQ ID NO: 614810 - DNA, 25 bp, Mus musculus
ctcggctgctgcaggtcatgaagaa

SEQ ID NO: 614811 - DNA, 25 bp, Mus musculus
ctcggctgctgctggtcatgaagaa

SEQ ID NO: 614812 - DNA, 25 bp, Mus musculus
ctcggcttagcccacctacagggag

SEQ ID NO: 614813 - DNA, 25 bp, Mus musculus
ctcggcttagccgacctacagggag

SEQ ID NO: 614814 - DNA, 25 bp, Mus musculus
ctcggctttggactcctgcatctca

SEQ ID NO: 614815 - DNA, 25 bp, Mus musculus
ctcggctttggagtcctgcatctca

SEQ ID NO: 614816 - DNA, 25 bp, Mus musculus
ctcggctttgggaaggccaagatgt

SEQ ID NO: 614817 - DNA, 25 bp, Mus musculus
ctcggctttgggtaggccaagatgt

SEQ ID NO: 614818 - DNA, 25 bp, Mus musculus
ctcggcttttgccttcttatcctgg

SEQ ID NO: 614819 - DNA, 25 bp, Mus musculus
ctcggcttttgcgttcttatcctgg

SEQ ID NO: 614820 - DNA, 25 bp, Mus musculus
ctcgggaaaaggaggtgaagctctt

SEQ ID NO: 614821 - DNA, 25 bp, Mus musculus
ctcgggaaaaggtggtgaagctctt

SEQ ID NO: 614822 - DNA, 25 bp, Mus musculus
ctcgggagaaagatgtgaagctgct

SEQ ID NO: 614823 - DNA, 25 bp, Mus musculus
ctcgggagaaagttgtgaagctgct

SEQ ID NO: 614824 - DNA, 25 bp, Mus musculus
ctcgggagtcctccgttaccaggtg

SEQ ID NO: 614825 - DNA, 25 bp, Mus musculus
ctcgggagtcctgcgttaccaggtg

SEQ ID NO: 614826 - DNA, 25 bp, Mus musculus
ctcgggatccacagacacacaggat

SEQ ID NO: 614827 - DNA, 25 bp, Mus musculus
ctcgggatccactgacacacaggat

SEQ ID NO: 614828 - DNA, 25 bp, Mus musculus
ctcgggcagtctatgtggacctgga

SEQ ID NO: 614829 - DNA, 25 bp, Mus musculus
ctcgggcagtctttgtggacctgga

SEQ ID NO: 614830 - DNA, 25 bp, Mus musculus
ctcgggcatctcctgacgcagagtg

SEQ ID NO: 614831 - DNA, 25 bp, Mus musculus
ctcgggcatctcgtgacgcagagtg

SEQ ID NO: 614832 - DNA, 25 bp, Mus musculus
ctcgggccaatcaatcagtggtggc

SEQ ID NO: 614833 - DNA, 25 bp, Mus musculus
ctcgggccaatctatcagtggtggc

SEQ ID NO: 614834 - DNA, 25 bp, Mus musculus
ctcgggccatcaagtaccgtcagga

SEQ ID NO: 614835 - DNA, 25 bp, Mus musculus
ctcgggccatcatgtaccgtcagga

SEQ ID NO: 614836 - DNA, 25 bp, Mus musculus
ctcgggccctagcagtggattgcct

SEQ ID NO: 614837 - DNA, 25 bp, Mus musculus
ctcgggccctaggagtggattgcct

SEQ ID NO: 614838 - DNA, 25 bp, Mus musculus
ctcgggccctccagcgaggaaacag

SEQ ID NO: 614839 - DNA, 25 bp, Mus musculus
ctcgggccctcctgcgaggaaacag

SEQ ID NO: 614840 - DNA, 25 bp, Mus musculus
ctcgggcgacggcactcagggtgag

SEQ ID NO: 614841 - DNA, 25 bp, Mus musculus
ctcgggcgacgggactcagggtgag

SEQ ID NO: 614842 - DNA, 25 bp, Mus musculus
ctcgggcggccccttgatctgcaat

SEQ ID NO: 614843 - DNA, 25 bp, Mus musculus
ctcgggcggcccgttgatctgcaat

SEQ ID NO: 614844 - DNA, 25 bp, Mus musculus
ctcgggctcctgagtaccgcagctt

SEQ ID NO: 614845 - DNA, 25 bp, Mus musculus
ctcgggctcctgtgtaccgcagctt

SEQ ID NO: 614846 - DNA, 25 bp, Mus musculus
ctcgggtcccaacgagtggatgaaa

SEQ ID NO: 614847 - DNA, 25 bp, Mus musculus
ctcgggtcccaaggagtggatgaaa

SEQ ID NO: 614848 - DNA, 25 bp, Mus musculus
ctcgggtgacgtcatgagcctctca

SEQ ID NO: 614849 - DNA, 25 bp, Mus musculus
ctcgggtgacgtgatgagcctctca

SEQ ID NO: 614850 - DNA, 25 bp, Mus musculus
ctcgggttgcggagaagaccaagac

SEQ ID NO: 614851 - DNA, 25 bp, Mus musculus
ctcgggttgcggtgaagaccaagac

SEQ ID NO: 614852 - DNA, 25 bp, Mus musculus
ctcggtaaatccagcaagccaatcc

SEQ ID NO: 614853 - DNA, 25 bp, Mus musculus
ctcggtaaatcctgcaagccaatcc

SEQ ID NO: 614854 - DNA, 25 bp, Mus musculus
ctcggtattataaattcaagatcgc

SEQ ID NO: 614855 - DNA, 25 bp, Mus musculus
ctcggtattatatattcaagatcgc

SEQ ID NO: 614856 - DNA, 25 bp, Mus musculus
ctcggtcactggcatgctgtccaag

SEQ ID NO: 614857 - DNA, 25 bp, Mus musculus
ctcggtcactgggatgctgtccaag

SEQ ID NO: 614858 - DNA, 25 bp, Mus musculus
ctcggtccgggacaagtttatcttg

SEQ ID NO: 614859 - DNA, 25 bp, Mus musculus
ctcggtccgggagaagtttatcttg

SEQ ID NO: 614860 - DNA, 25 bp, Mus musculus
ctcggtctccagacttcagtgccat

SEQ ID NO: 614861 - DNA, 25 bp, Mus musculus
ctcggtctccagtcttcagtgccat

SEQ ID NO: 614862 - DNA, 25 bp, Mus musculus
ctcggtgatcaaatccagtggacag

SEQ ID NO: 614863 - DNA, 25 bp, Mus musculus
ctcggtgatcaattccagtggacag

SEQ ID NO: 614864 - DNA, 25 bp, Mus musculus
ctcggtgccagcctcggtacagact

SEQ ID NO: 614865 - DNA, 25 bp, Mus musculus
ctcggtgccagcgtcggtacagact

SEQ ID NO: 614866 - DNA, 25 bp, Mus musculus
ctcggtggaggcacaagcccaggtc

SEQ ID NO: 614867 - DNA, 25 bp, Mus musculus
ctcggtggaggctcaagcccaggtc

SEQ ID NO: 614868 - DNA, 25 bp, Mus musculus
ctcggtgtgctacgcaccatcatgg

SEQ ID NO: 614869 - DNA, 25 bp, Mus musculus
ctcggtgtgctaggcaccatcatgg

SEQ ID NO: 614870 - DNA, 25 bp, Mus musculus
ctcggtgtggtgactagcattcaca

SEQ ID NO: 614871 - DNA, 25 bp, Mus musculus
ctcggtgtggtgtctagcattcaca

SEQ ID NO: 614872 - DNA, 25 bp, Mus musculus
ctcggttggaaaacatgtggatgcc

SEQ ID NO: 614873 - DNA, 25 bp, Mus musculus
ctcggttggaaatcatgtggatgcc

SEQ ID NO: 614874 - DNA, 25 bp, Mus musculus
ctcggttggtcactgagcggaatct

SEQ ID NO: 614875 - DNA, 25 bp, Mus musculus
ctcggttggtcagtgagcggaatct

SEQ ID NO: 614876 - DNA, 25 bp, Mus musculus
ctcggtttgcatctctcacatggag

SEQ ID NO: 614877 - DNA, 25 bp, Mus musculus
ctcggtttgcatgtctcacatggag

SEQ ID NO: 614878 - DNA, 25 bp, Mus musculus
ctcgtaaagcgtctgccgatgcgac

SEQ ID NO: 614879 - DNA, 25 bp, Mus musculus
ctcgtaaagcgtgtgccgatgcgac

SEQ ID NO: 614880 - DNA, 25 bp, Mus musculus
ctcgtaagtgagaccctcgcggcca

SEQ ID NO: 614881 - DNA, 25 bp, Mus musculus
ctcgtaagtgagtccctcgcggcca

SEQ ID NO: 614882 - DNA, 25 bp, Mus musculus
ctcgtagtgctgatgaaccaatgac

SEQ ID NO: 614883 - DNA, 25 bp, Mus musculus
ctcgtagtgctgttgaaccaatgac

SEQ ID NO: 614884 - DNA, 25 bp, Mus musculus
ctcgtatgtcctagcaagaaagatg

SEQ ID NO: 614885 - DNA, 25 bp, Mus musculus
ctcgtatgtccttgcaagaaagatg

SEQ ID NO: 614886 - DNA, 25 bp, Mus musculus
ctcgtcagcctcattgagaatatct

SEQ ID NO: 614887 - DNA, 25 bp, Mus musculus
ctcgtcagcctctttgagaatatct

SEQ ID NO: 614888 - DNA, 25 bp, Mus musculus
ctcgtcctcgtccaaaaagatgggc

SEQ ID NO: 614889 - DNA, 25 bp, Mus musculus
ctcgtcctcgtcgaaaaagatgggc

SEQ ID NO: 614890 - DNA, 25 bp, Mus musculus
ctcgtctttttgctgtgctgagatt

SEQ ID NO: 614891 - DNA, 25 bp, Mus musculus
ctcgtctttttggtgtgctgagatt

SEQ ID NO: 614892 - DNA, 25 bp, Mus musculus
ctcgtgaggctgctttccggaacat

SEQ ID NO: 614893 - DNA, 25 bp, Mus musculus
ctcgtgaggctggtttccggaacat

SEQ ID NO: 614894 - DNA, 25 bp, Mus musculus
ctcgtgatgcgcaatatgtttagtc

SEQ ID NO: 614895 - DNA, 25 bp, Mus musculus
ctcgtgatgcgctatatgtttagtc

SEQ ID NO: 614896 - DNA, 25 bp, Mus musculus
ctcgtgcagggtacaagcaggacca

SEQ ID NO: 614897 - DNA, 25 bp, Mus musculus
ctcgtgcagggttcaagcaggacca

SEQ ID NO: 614898 - DNA, 25 bp, Mus musculus
ctcgtgctgctgagataagtttgaa

SEQ ID NO: 614899 - DNA, 25 bp, Mus musculus
ctcgtgctgctgtgataagtttgaa

SEQ ID NO: 614900 - DNA, 25 bp, Mus musculus
ctcgtggctgctccttttgctatgc

SEQ ID NO: 614901 - DNA, 25 bp, Mus musculus
ctcgtggctgctgcttttgctatgc

SEQ ID NO: 614902 - DNA, 25 bp, Mus musculus
ctcgtgggctcactcgctctaggga

SEQ ID NO: 614903 - DNA, 25 bp, Mus musculus
ctcgtgggctcagtcgctctaggga

SEQ ID NO: 614904 - DNA, 25 bp, Mus musculus
ctcgtggtgaagctcatgcccaatg

SEQ ID NO: 614905 - DNA, 25 bp, Mus musculus
ctcgtggtgaaggtcatgcccaatg

SEQ ID NO: 614906 - DNA, 25 bp, Mus musculus
ctcgtgtctgttacagaatgaaaag

SEQ ID NO: 614907 - DNA, 25 bp, Mus musculus
ctcgtgtctgtttcagaatgaaaag

SEQ ID NO: 614908 - DNA, 25 bp, Mus musculus
ctcgttagccttcgcccctgaggag

SEQ ID NO: 614909 - DNA, 25 bp, Mus musculus
ctcgttagccttggcccctgaggag

SEQ ID NO: 614910 - DNA, 25 bp, Mus musculus
ctcgttaggaaacgctcgcacggca

SEQ ID NO: 614911 - DNA, 25 bp, Mus musculus
ctcgttaggaaaggctcgcacggca

SEQ ID NO: 614912 - DNA, 25 bp, Mus musculus
ctcgttatgccgctgcactctacag

SEQ ID NO: 614913 - DNA, 25 bp, Mus musculus
ctcgttatgccggtgcactctacag

SEQ ID NO: 614914 - DNA, 25 bp, Mus musculus
ctcgttccaagtatggcgagaggga

SEQ ID NO: 614915 - DNA, 25 bp, Mus musculus
ctcgttccaagtttggcgagaggga

SEQ ID NO: 614916 - DNA, 25 bp, Mus musculus
ctcgttcctagacgcttaaccataa

SEQ ID NO: 614917 - DNA, 25 bp, Mus musculus
ctcgttcctagaggcttaaccataa

SEQ ID NO: 614918 - DNA, 25 bp, Mus musculus
ctcgttcggttaccgcccagcttgg

SEQ ID NO: 614919 - DNA, 25 bp, Mus musculus
ctcgttcggttagcgcccagcttgg

SEQ ID NO: 614920 - DNA, 25 bp, Mus musculus
ctcgttctagggactgtctgggaac

SEQ ID NO: 614921 - DNA, 25 bp, Mus musculus
ctcgttctagggtctgtctgggaac

SEQ ID NO: 614922 - DNA, 25 bp, Mus musculus
ctcgtttgaagaagtagatgcgttt

SEQ ID NO: 614923 - DNA, 25 bp, Mus musculus
ctcgtttgaagatgtagatgcgttt

SEQ ID NO: 614924 - DNA, 25 bp, Mus musculus
ctctaaaatggaagtggagcggact

SEQ ID NO: 614925 - DNA, 25 bp, Mus musculus
ctctaaaatggatgtggagcggact

SEQ ID NO: 614926 - DNA, 25 bp, Mus musculus
ctctaaacacgacgcaacagaaaat

SEQ ID NO: 614927 - DNA, 25 bp, Mus musculus
ctctaaacacgaggcaacagaaaat

SEQ ID NO: 614928 - DNA, 25 bp, Mus musculus
ctctaaagcatgaattccaaaaaca

SEQ ID NO: 614929 - DNA, 25 bp, Mus musculus
ctctaaagcatgtattccaaaaaca

SEQ ID NO: 614930 - DNA, 25 bp, Mus musculus
ctctaactcagtcacagcagagatc

SEQ ID NO: 614931 - DNA, 25 bp, Mus musculus
ctctaactcagtgacagcagagatc

SEQ ID NO: 614932 - DNA, 25 bp, Mus musculus
ctctaagctagtcggctccatttcc

SEQ ID NO: 614933 - DNA, 25 bp, Mus musculus
ctctaagctagtgggctccatttcc

SEQ ID NO: 614934 - DNA, 25 bp, Mus musculus
ctctaagctgcgagcagacgcgggc

SEQ ID NO: 614935 - DNA, 25 bp, Mus musculus
ctctaagctgcgtgcagacgcgggc

SEQ ID NO: 614936 - DNA, 25 bp, Mus musculus
ctctaagggcttcctgagtgaagca

SEQ ID NO: 614937 - DNA, 25 bp, Mus musculus
ctctaagggcttgctgagtgaagca

SEQ ID NO: 614938 - DNA, 25 bp, Mus musculus
ctctaaggtaagagccctgccgcct

SEQ ID NO: 614939 - DNA, 25 bp, Mus musculus
ctctaaggtaagtgccctgccgcct

SEQ ID NO: 614940 - DNA, 25 bp, Mus musculus
ctctaaggtatgaggttatgctgac

SEQ ID NO: 614941 - DNA, 25 bp, Mus musculus
ctctaaggtatgtggttatgctgac

SEQ ID NO: 614942 - DNA, 25 bp, Mus musculus
ctctaagtacatcccgaatgtcaag

SEQ ID NO: 614943 - DNA, 25 bp, Mus musculus
ctctaagtacatgccgaatgtcaag

SEQ ID NO: 614944 - DNA, 25 bp, Mus musculus
ctctaatcagacacagcatcctggg

SEQ ID NO: 614945 - DNA, 25 bp, Mus musculus
ctctaatcagactcagcatcctggg

SEQ ID NO: 614946 - DNA, 25 bp, Mus musculus
ctctacaacggacatgtggacatgg

SEQ ID NO: 614947 - DNA, 25 bp, Mus musculus
ctctacaacggagatgtggacatgg

SEQ ID NO: 614948 - DNA, 25 bp, Mus musculus
ctctacaactccagaggaggtcttg

SEQ ID NO: 614949 - DNA, 25 bp, Mus musculus
ctctacaactcctgaggaggtcttg

SEQ ID NO: 614950 - DNA, 25 bp, Mus musculus
ctctacaagaatcctcgggagcggg

SEQ ID NO: 614951 - DNA, 25 bp, Mus musculus
ctctacaagaatgctcgggagcggg

SEQ ID NO: 614952 - DNA, 25 bp, Mus musculus
ctctacagtagacgaagccgttgcc

SEQ ID NO: 614953 - DNA, 25 bp, Mus musculus
ctctacagtagaggaagccgttgcc

SEQ ID NO: 614954 - DNA, 25 bp, Mus musculus
ctctacatcagactgtgctttcctc

SEQ ID NO: 614955 - DNA, 25 bp, Mus musculus
ctctacatcagagtgtgctttcctc

SEQ ID NO: 614956 - DNA, 25 bp, Mus musculus
ctctacatcgtaccacggatcataa

SEQ ID NO: 614957 - DNA, 25 bp, Mus musculus
ctctacatcgtagcacggatcataa

SEQ ID NO: 614958 - DNA, 25 bp, Mus musculus
ctctacattacgagcgccacagcag

SEQ ID NO: 614959 - DNA, 25 bp, Mus musculus
ctctacattacgtgcgccacagcag

SEQ ID NO: 614960 - DNA, 25 bp, Mus musculus
ctctaccaaagcatgaactcccagt

SEQ ID NO: 614961 - DNA, 25 bp, Mus musculus
ctctaccaaagcttgaactcccagt

SEQ ID NO: 614962 - DNA, 25 bp, Mus musculus
ctctaccaaggcatcctgatcattg

SEQ ID NO: 614963 - DNA, 25 bp, Mus musculus
ctctaccaaggcttcctgatcattg

SEQ ID NO: 614964 - DNA, 25 bp, Mus musculus
ctctaccccaagagcctacagagtg

SEQ ID NO: 614965 - DNA, 25 bp, Mus musculus
ctctaccccaagtgcctacagagtg

SEQ ID NO: 614966 - DNA, 25 bp, Mus musculus
ctctaccgacagatgtcatcatgag

SEQ ID NO: 614967 - DNA, 25 bp, Mus musculus
ctctaccgacagttgtcatcatgag

SEQ ID NO: 614968 - DNA, 25 bp, Mus musculus
ctctacgaagcgctgaaagagaatg

SEQ ID NO: 614969 - DNA, 25 bp, Mus musculus
ctctacgaagcggtgaaagagaatg

SEQ ID NO: 614970 - DNA, 25 bp, Mus musculus
ctctacgacgagatgccgccatcag

SEQ ID NO: 614971 - DNA, 25 bp, Mus musculus
ctctacgacgagttgccgccatcag

SEQ ID NO: 614972 - DNA, 25 bp, Mus musculus
ctctacgggacaacccactgcggag

SEQ ID NO: 614973 - DNA, 25 bp, Mus musculus
ctctacgggacatcccactgcggag

SEQ ID NO: 614974 - DNA, 25 bp, Mus musculus
ctctactggttcagtttgaccaggg

SEQ ID NO: 614975 - DNA, 25 bp, Mus musculus
ctctactggttctgtttgaccaggg

SEQ ID NO: 614976 - DNA, 25 bp, Mus musculus
ctctacttcttcatgttgctaacac

SEQ ID NO: 614977 - DNA, 25 bp, Mus musculus
ctctacttcttcttgttgctaacac

SEQ ID NO: 614978 - DNA, 25 bp, Mus musculus
ctctacttgcttcagggaatccaaa

SEQ ID NO: 614979 - DNA, 25 bp, Mus musculus
ctctacttgcttgagggaatccaaa

SEQ ID NO: 614980 - DNA, 25 bp, Mus musculus
ctctagacctataagcagactcaag

SEQ ID NO: 614981 - DNA, 25 bp, Mus musculus
ctctagacctattagcagactcaag

SEQ ID NO: 614982 - DNA, 25 bp, Mus musculus
ctctagagggagctttacagtgtga

SEQ ID NO: 614983 - DNA, 25 bp, Mus musculus
ctctagagggaggtttacagtgtga

SEQ ID NO: 614984 - DNA, 25 bp, Mus musculus
ctctagcaaaaacaagatgctgtct

SEQ ID NO: 614985 - DNA, 25 bp, Mus musculus
ctctagcaaaaagaagatgctgtct

SEQ ID NO: 614986 - DNA, 25 bp, Mus musculus
ctctagcaagacagttgtggatgat

SEQ ID NO: 614987 - DNA, 25 bp, Mus musculus
ctctagcaagactgttgtggatgat

SEQ ID NO: 614988 - DNA, 25 bp, Mus musculus
ctctagcagtgaagatgagttctat

SEQ ID NO: 614989 - DNA, 25 bp, Mus musculus
ctctagcagtgatgatgagttctat

SEQ ID NO: 614990 - DNA, 25 bp, Mus musculus
ctctagcttgtgacaggtcaacata

SEQ ID NO: 614991 - DNA, 25 bp, Mus musculus
ctctagcttgtgtcaggtcaacata

SEQ ID NO: 614992 - DNA, 25 bp, Mus musculus
ctctagctttgtcttcctgctctgc

SEQ ID NO: 614993 - DNA, 25 bp, Mus musculus
ctctagctttgtgttcctgctctgc

SEQ ID NO: 614994 - DNA, 25 bp, Mus musculus
ctctaggaatgaatccaccccctga

SEQ ID NO: 614995 - DNA, 25 bp, Mus musculus
ctctaggaatgattccaccccctga

SEQ ID NO: 614996 - DNA, 25 bp, Mus musculus
ctctaggacctgcactggaacccgg

SEQ ID NO: 614997 - DNA, 25 bp, Mus musculus
ctctaggacctggactggaacccgg

SEQ ID NO: 614998 - DNA, 25 bp, Mus musculus
ctctaggcacaaagtcaagggttta

SEQ ID NO: 614999 - DNA, 25 bp, Mus musculus
ctctaggcacaatgtcaagggttta

SEQ ID NO: 615000 - DNA, 25 bp, Mus musculus
ctctagggatatcttagccacagtt

SEQ ID NO: 615001 - DNA, 25 bp, Mus musculus
ctctagggatatgttagccacagtt

SEQ ID NO: 615002 - DNA, 25 bp, Mus musculus
ctctagggctgcagataaggctgtt

SEQ ID NO: 615003 - DNA, 25 bp, Mus musculus
ctctagggctgctgataaggctgtt

SEQ ID NO: 615004 - DNA, 25 bp, Mus musculus
ctctaggtttggatgttgctatgac

SEQ ID NO: 615005 - DNA, 25 bp, Mus musculus
ctctaggtttggttgttgctatgac

SEQ ID NO: 615006 - DNA, 25 bp, Mus musculus
ctctagtccagcacgcagaggccat

SEQ ID NO: 615007 - DNA, 25 bp, Mus musculus
ctctagtccagctcgcagaggccat

SEQ ID NO: 615008 - DNA, 25 bp, Mus musculus
ctctagtctgttctaaggaagctgc

SEQ ID NO: 615009 - DNA, 25 bp, Mus musculus
ctctagtctgttgtaaggaagctgc

SEQ ID NO: 615010 - DNA, 25 bp, Mus musculus
ctctagtgctgaagacaccagccct

SEQ ID NO: 615011 - DNA, 25 bp, Mus musculus
ctctagtgctgatgacaccagccct

SEQ ID NO: 615012 - DNA, 25 bp, Mus musculus
ctctagttcagacccctggtgggca

SEQ ID NO: 615013 - DNA, 25 bp, Mus musculus
ctctagttcagagccctggtgggca

SEQ ID NO: 615014 - DNA, 25 bp, Mus musculus
ctctatagccgaaaagaaggacaga

SEQ ID NO: 615015 - DNA, 25 bp, Mus musculus
ctctatagccgataagaaggacaga

SEQ ID NO: 615016 - DNA, 25 bp, Mus musculus
ctctatagcttcacccactgtggag

SEQ ID NO: 615017 - DNA, 25 bp, Mus musculus
ctctatagcttctcccactgtggag

SEQ ID NO: 615018 - DNA, 25 bp, Mus musculus
ctctatatggcgacggctctgtcgg

SEQ ID NO: 615019 - DNA, 25 bp, Mus musculus
ctctatatggcgtcggctctgtcgg

SEQ ID NO: 615020 - DNA, 25 bp, Mus musculus
ctctatccttatataggccccagca

SEQ ID NO: 615021 - DNA, 25 bp, Mus musculus
ctctatccttatttaggccccagca

SEQ ID NO: 615022 - DNA, 25 bp, Mus musculus
ctctatctttctcaaagggctccca

SEQ ID NO: 615023 - DNA, 25 bp, Mus musculus
ctctatctttctgaaagggctccca

SEQ ID NO: 615024 - DNA, 25 bp, Mus musculus
ctctatgaactgcatgcggacccca

SEQ ID NO: 615025 - DNA, 25 bp, Mus musculus
ctctatgaactggatgcggacccca

SEQ ID NO: 615026 - DNA, 25 bp, Mus musculus
ctctatgcccatagtcaacaagaaa

SEQ ID NO: 615027 - DNA, 25 bp, Mus musculus
ctctatgcccattgtcaacaagaaa

SEQ ID NO: 615028 - DNA, 25 bp, Mus musculus
ctctatggaggaacgtctagctcgt

SEQ ID NO: 615029 - DNA, 25 bp, Mus musculus
ctctatggaggatcgtctagctcgt

SEQ ID NO: 615030 - DNA, 25 bp, Mus musculus
ctctattatacacagtggtgtggct

SEQ ID NO: 615031 - DNA, 25 bp, Mus musculus
ctctattatacagagtggtgtggct

SEQ ID NO: 615032 - DNA, 25 bp, Mus musculus
ctctattcagagcttatccggagac

SEQ ID NO: 615033 - DNA, 25 bp, Mus musculus
ctctattcagaggttatccggagac

SEQ ID NO: 615034 - DNA, 25 bp, Mus musculus
ctctattcctcaaagtgacctcctg

SEQ ID NO: 615035 - DNA, 25 bp, Mus musculus
ctctattcctcatagtgacctcctg

SEQ ID NO: 615036 - DNA, 25 bp, Mus musculus
ctctattgactcagtgactttgacc

SEQ ID NO: 615037 - DNA, 25 bp, Mus musculus
ctctattgactctgtgactttgacc

SEQ ID NO: 615038 - DNA, 25 bp, Mus musculus
ctctattggcttcgcaacttcctct

SEQ ID NO: 615039 - DNA, 25 bp, Mus musculus
ctctattggcttggcaacttcctct

SEQ ID NO: 615040 - DNA, 25 bp, Mus musculus
ctctcaaaagcaatagctgtctgcc

SEQ ID NO: 615041 - DNA, 25 bp, Mus musculus
ctctcaaaagcattagctgtctgcc

SEQ ID NO: 615042 - DNA, 25 bp, Mus musculus
ctctcaaaccctcctgaggtggagg

SEQ ID NO: 615043 - DNA, 25 bp, Mus musculus
ctctcaaaccctgctgaggtggagg

SEQ ID NO: 615044 - DNA, 25 bp, Mus musculus
ctctcaaactccaggtgctgtgatc

SEQ ID NO: 615045 - DNA, 25 bp, Mus musculus
ctctcaaactcctggtgctgtgatc

SEQ ID NO: 615046 - DNA, 25 bp, Mus musculus
ctctcaaagaagctgtgattttgcc

SEQ ID NO: 615047 - DNA, 25 bp, Mus musculus
ctctcaaagaaggtgtgattttgcc

SEQ ID NO: 615048 - DNA, 25 bp, Mus musculus
ctctcaaagttcaaaagatgtatct

SEQ ID NO: 615049 - DNA, 25 bp, Mus musculus
ctctcaaagttctaaagatgtatct

SEQ ID NO: 615050 - DNA, 25 bp, Mus musculus
ctctcaaatgaaacaagtgtcagtc

SEQ ID NO: 615051 - DNA, 25 bp, Mus musculus
ctctcaaatgaatcaagtgtcagtc

SEQ ID NO: 615052 - DNA, 25 bp, Mus musculus
ctctcaacatggctgaggccttgtg

SEQ ID NO: 615053 - DNA, 25 bp, Mus musculus
ctctcaacatgggtgaggccttgtg

SEQ ID NO: 615054 - DNA, 25 bp, Mus musculus
ctctcaactacaacatcgtgtccgg

SEQ ID NO: 615055 - DNA, 25 bp, Mus musculus
ctctcaactacatcatcgtgtccgg

SEQ ID NO: 615056 - DNA, 25 bp, Mus musculus
ctctcaatgggacggacagctgaaa

SEQ ID NO: 615057 - DNA, 25 bp, Mus musculus
ctctcaatgggagggacagctgaaa

SEQ ID NO: 615058 - DNA, 25 bp, Mus musculus
ctctcacaggatacgaggtatggtt

SEQ ID NO: 615059 - DNA, 25 bp, Mus musculus
ctctcacaggattcgaggtatggtt

SEQ ID NO: 615060 - DNA, 25 bp, Mus musculus
ctctcacatggacgttcgtccaggg

SEQ ID NO: 615061 - DNA, 25 bp, Mus musculus
ctctcacatggaggttcgtccaggg

SEQ ID NO: 615062 - DNA, 25 bp, Mus musculus
ctctcacatttgctggctcagcagc

SEQ ID NO: 615063 - DNA, 25 bp, Mus musculus
ctctcacatttggtggctcagcagc

SEQ ID NO: 615064 - DNA, 25 bp, Mus musculus
ctctcaccagccagaataccaagga

SEQ ID NO: 615065 - DNA, 25 bp, Mus musculus
ctctcaccagcctgaataccaagga

SEQ ID NO: 615066 - DNA, 25 bp, Mus musculus
ctctcacgggaaaggtcgcggcctg

SEQ ID NO: 615067 - DNA, 25 bp, Mus musculus
ctctcacgggaatggtcgcggcctg

SEQ ID NO: 615068 - DNA, 25 bp, Mus musculus
ctctcagatgaaaggcttggactgt

SEQ ID NO: 615069 - DNA, 25 bp, Mus musculus
ctctcagatgaatggcttggactgt

SEQ ID NO: 615070 - DNA, 25 bp, Mus musculus
ctctcagcctgtatctatattttcg

SEQ ID NO: 615071 - DNA, 25 bp, Mus musculus
ctctcagcctgtttctatattttcg

SEQ ID NO: 615072 - DNA, 25 bp, Mus musculus
ctctcagcgcaaaggtgaatggtga

SEQ ID NO: 615073 - DNA, 25 bp, Mus musculus
ctctcagcgcaatggtgaatggtga

SEQ ID NO: 615074 - DNA, 25 bp, Mus musculus
ctctcagcgtctcggctctcagaag

SEQ ID NO: 615075 - DNA, 25 bp, Mus musculus
ctctcagcgtctgggctctcagaag

SEQ ID NO: 615076 - DNA, 25 bp, Mus musculus
ctctcagcgttcctctgtgcgcagt

SEQ ID NO: 615077 - DNA, 25 bp, Mus musculus
ctctcagcgttcgtctgtgcgcagt

SEQ ID NO: 615078 - DNA, 25 bp, Mus musculus
ctctcaggaaatcgtgttcttctca

SEQ ID NO: 615079 - DNA, 25 bp, Mus musculus
ctctcaggaaatggtgttcttctca

SEQ ID NO: 615080 - DNA, 25 bp, Mus musculus
ctctcaggaactccacagttataac

SEQ ID NO: 615081 - DNA, 25 bp, Mus musculus
ctctcaggaactgcacagttataac

SEQ ID NO: 615082 - DNA, 25 bp, Mus musculus
ctctcagggctgcaaatccatttcc

SEQ ID NO: 615083 - DNA, 25 bp, Mus musculus
ctctcagggctggaaatccatttcc

SEQ ID NO: 615084 - DNA, 25 bp, Mus musculus
ctctcagtgaaacgttacaatgaca

SEQ ID NO: 615085 - DNA, 25 bp, Mus musculus
ctctcagtgaaaggttacaatgaca

SEQ ID NO: 615086 - DNA, 25 bp, Mus musculus
ctctcagtgggaccgcaccggaaag

SEQ ID NO: 615087 - DNA, 25 bp, Mus musculus
ctctcagtgggagcgcaccggaaag

SEQ ID NO: 615088 - DNA, 25 bp, Mus musculus
ctctcatctcaactggcaggaatga

SEQ ID NO: 615089 - DNA, 25 bp, Mus musculus
ctctcatctcaagtggcaggaatga

SEQ ID NO: 615090 - DNA, 25 bp, Mus musculus
ctctcatctttgagggaggatacca

SEQ ID NO: 615091 - DNA, 25 bp, Mus musculus
ctctcatctttgtgggaggatacca

SEQ ID NO: 615092 - DNA, 25 bp, Mus musculus
ctctcatgcaaaagtgccttcttag

SEQ ID NO: 615093 - DNA, 25 bp, Mus musculus
ctctcatgcaaatgtgccttcttag

SEQ ID NO: 615094 - DNA, 25 bp, Mus musculus
ctctcattcagacgcagcagcgtgc

SEQ ID NO: 615095 - DNA, 25 bp, Mus musculus
ctctcattcagaggcagcagcgtgc

SEQ ID NO: 615096 - DNA, 25 bp, Mus musculus
ctctcattgagaccgggactgctgg

SEQ ID NO: 615097 - DNA, 25 bp, Mus musculus
ctctcattgagagcgggactgctgg

SEQ ID NO: 615098 - DNA, 25 bp, Mus musculus
ctctccaaagttcgaacgtgggact

SEQ ID NO: 615099 - DNA, 25 bp, Mus musculus
ctctccaaagttggaacgtgggact

SEQ ID NO: 615100 - DNA, 25 bp, Mus musculus
ctctccaactctcagtttaaggagt

SEQ ID NO: 615101 - DNA, 25 bp, Mus musculus
ctctccaactctgagtttaaggagt

SEQ ID NO: 615102 - DNA, 25 bp, Mus musculus
ctctccacgtggcaagtcaggctca

SEQ ID NO: 615103 - DNA, 25 bp, Mus musculus
ctctccacgtgggaagtcaggctca

SEQ ID NO: 615104 - DNA, 25 bp, Mus musculus
ctctccacttttcatctgaaccagt

SEQ ID NO: 615105 - DNA, 25 bp, Mus musculus
ctctccacttttgatctgaaccagt

SEQ ID NO: 615106 - DNA, 25 bp, Mus musculus
ctctccagctggaagtcttgctgac

SEQ ID NO: 615107 - DNA, 25 bp, Mus musculus
ctctccagctggtagtcttgctgac

SEQ ID NO: 615108 - DNA, 25 bp, Mus musculus
ctctccaggagtaccggcttgatag

SEQ ID NO: 615109 - DNA, 25 bp, Mus musculus
ctctccaggagttccggcttgatag

SEQ ID NO: 615110 - DNA, 25 bp, Mus musculus
ctctccagtgtaaggcacagacatg

SEQ ID NO: 615111 - DNA, 25 bp, Mus musculus
ctctccagtgtatggcacagacatg

SEQ ID NO: 615112 - DNA, 25 bp, Mus musculus
ctctccatcctgcaagattactgtg

SEQ ID NO: 615113 - DNA, 25 bp, Mus musculus
ctctccatcctggaagattactgtg

SEQ ID NO: 615114 - DNA, 25 bp, Mus musculus
ctctccatggacaggtatggcaaat

SEQ ID NO: 615115 - DNA, 25 bp, Mus musculus
ctctccatggactggtatggcaaat

SEQ ID NO: 615116 - DNA, 25 bp, Mus musculus
ctctccatggctagggcaccagttc

SEQ ID NO: 615117 - DNA, 25 bp, Mus musculus
ctctccatggcttgggcaccagttc

SEQ ID NO: 615118 - DNA, 25 bp, Mus musculus
ctctcccagacaacaagcaagtttg

SEQ ID NO: 615119 - DNA, 25 bp, Mus musculus
ctctcccagacatcaagcaagtttg

SEQ ID NO: 615120 - DNA, 25 bp, Mus musculus
ctctccccaggcagggttgagagca

SEQ ID NO: 615121 - DNA, 25 bp, Mus musculus
ctctccccaggctgggttgagagca

SEQ ID NO: 615122 - DNA, 25 bp, Mus musculus
ctctccctatggacagccaggatat

SEQ ID NO: 615123 - DNA, 25 bp, Mus musculus
ctctccctatggtcagccaggatat

SEQ ID NO: 615124 - DNA, 25 bp, Mus musculus
ctctccctgcggagctcggctgagt

SEQ ID NO: 615125 - DNA, 25 bp, Mus musculus
ctctccctgcggtgctcggctgagt

SEQ ID NO: 615126 - DNA, 25 bp, Mus musculus
ctctccgctggcaaaaacgggtgga

SEQ ID NO: 615127 - DNA, 25 bp, Mus musculus
ctctccgctggctaaaacgggtgga

SEQ ID NO: 615128 - DNA, 25 bp, Mus musculus
ctctccggaggacccttgggtcaag

SEQ ID NO: 615129 - DNA, 25 bp, Mus musculus
ctctccggaggagccttgggtcaag

SEQ ID NO: 615130 - DNA, 25 bp, Mus musculus
ctctccggctgacgccgggatttgc

SEQ ID NO: 615131 - DNA, 25 bp, Mus musculus
ctctccggctgaggccgggatttgc

SEQ ID NO: 615132 - DNA, 25 bp, Mus musculus
ctctccgggacaacatctctacagt

SEQ ID NO: 615133 - DNA, 25 bp, Mus musculus
ctctccgggacatcatctctacagt

SEQ ID NO: 615134 - DNA, 25 bp, Mus musculus
ctctccgggattctggtgggtgtcg

SEQ ID NO: 615135 - DNA, 25 bp, Mus musculus
ctctccgggattgtggtgggtgtcg

SEQ ID NO: 615136 - DNA, 25 bp, Mus musculus
ctctccggtaaaagcacagattccc

SEQ ID NO: 615137 - DNA, 25 bp, Mus musculus
ctctccggtaaatgcacagattccc

SEQ ID NO: 615138 - DNA, 25 bp, Mus musculus
ctctccggttccctgggttgtggca

SEQ ID NO: 615139 - DNA, 25 bp, Mus musculus
ctctccggttccgtgggttgtggca

SEQ ID NO: 615140 - DNA, 25 bp, Mus musculus
ctctccgttttcattcagcagtggg

SEQ ID NO: 615141 - DNA, 25 bp, Mus musculus
ctctccgttttctttcagcagtggg

SEQ ID NO: 615142 - DNA, 25 bp, Mus musculus
ctctcctgaaccaggctgagcggct

SEQ ID NO: 615143 - DNA, 25 bp, Mus musculus
ctctcctgaacctggctgagcggct

SEQ ID NO: 615144 - DNA, 25 bp, Mus musculus
ctctcctgatgccagctgttctgct

SEQ ID NO: 615145 - DNA, 25 bp, Mus musculus
ctctcctgatgcgagctgttctgct

SEQ ID NO: 615146 - DNA, 25 bp, Mus musculus
ctctcctgcagacatcgagtgcctg

SEQ ID NO: 615147 - DNA, 25 bp, Mus musculus
ctctcctgcagagatcgagtgcctg

SEQ ID NO: 615148 - DNA, 25 bp, Mus musculus
ctctcctggattctaggagaagcgg

SEQ ID NO: 615149 - DNA, 25 bp, Mus musculus
ctctcctggattgtaggagaagcgg

SEQ ID NO: 615150 - DNA, 25 bp, Mus musculus
ctctcgaagaggatgcgttagactc

SEQ ID NO: 615151 - DNA, 25 bp, Mus musculus
ctctcgaagaggttgcgttagactc

SEQ ID NO: 615152 - DNA, 25 bp, Mus musculus
ctctcgaaggagcaaagcttacacc

SEQ ID NO: 615153 - DNA, 25 bp, Mus musculus
ctctcgaaggaggaaagcttacacc

SEQ ID NO: 615154 - DNA, 25 bp, Mus musculus
ctctcgactgttaatggcgggtggt

SEQ ID NO: 615155 - DNA, 25 bp, Mus musculus
ctctcgactgtttatggcgggtggt

SEQ ID NO: 615156 - DNA, 25 bp, Mus musculus
ctctcgccaaggatattcatgaaaa

SEQ ID NO: 615157 - DNA, 25 bp, Mus musculus
ctctcgccaaggttattcatgaaaa

SEQ ID NO: 615158 - DNA, 25 bp, Mus musculus
ctctcgcgaggacggacgccattat

SEQ ID NO: 615159 - DNA, 25 bp, Mus musculus
ctctcgcgaggagggacgccattat

SEQ ID NO: 615160 - DNA, 25 bp, Mus musculus
ctctcgcgcctgaggatgctcagcg

SEQ ID NO: 615161 - DNA, 25 bp, Mus musculus
ctctcgcgcctgtggatgctcagcg

SEQ ID NO: 615162 - DNA, 25 bp, Mus musculus
ctctcggagccacccaggtgatggt

SEQ ID NO: 615163 - DNA, 25 bp, Mus musculus
ctctcggagccagccaggtgatggt

SEQ ID NO: 615164 - DNA, 25 bp, Mus musculus
ctctcggatgttcccggttacacac

SEQ ID NO: 615165 - DNA, 25 bp, Mus musculus
ctctcggatgttgccggttacacac

SEQ ID NO: 615166 - DNA, 25 bp, Mus musculus
ctctcggcagatcaatgacatccag

SEQ ID NO: 615167 - DNA, 25 bp, Mus musculus
ctctcggcagatgaatgacatccag

SEQ ID NO: 615168 - DNA, 25 bp, Mus musculus
ctctcgggcatgactttggctagca

SEQ ID NO: 615169 - DNA, 25 bp, Mus musculus
ctctcgggcatgtctttggctagca

SEQ ID NO: 615170 - DNA, 25 bp, Mus musculus
ctctcggtgcagctgagcgatgcta

SEQ ID NO: 615171 - DNA, 25 bp, Mus musculus
ctctcggtgcaggtgagcgatgcta

SEQ ID NO: 615172 - DNA, 25 bp, Mus musculus
ctctcgtaagtgagtccctcgcggc

SEQ ID NO: 615173 - DNA, 25 bp, Mus musculus
ctctcgtaagtgtgtccctcgcggc

SEQ ID NO: 615174 - DNA, 25 bp, Mus musculus
ctctcgttccttctcaggtgggagc

SEQ ID NO: 615175 - DNA, 25 bp, Mus musculus
ctctcgttccttgtcaggtgggagc

SEQ ID NO: 615176 - DNA, 25 bp, Mus musculus
ctctctacttaaacatggaatatgc

SEQ ID NO: 615177 - DNA, 25 bp, Mus musculus
ctctctacttaatcatggaatatgc

SEQ ID NO: 615178 - DNA, 25 bp, Mus musculus
ctctctagggacagggccttctgaa

SEQ ID NO: 615179 - DNA, 25 bp, Mus musculus
ctctctagggactgggccttctgaa

SEQ ID NO: 615180 - DNA, 25 bp, Mus musculus
ctctctcaaaagaaaggcgggaacg

SEQ ID NO: 615181 - DNA, 25 bp, Mus musculus
ctctctcaaaagtaaggcgggaacg

SEQ ID NO: 615182 - DNA, 25 bp, Mus musculus
ctctctcagcgtctgggctctcaga

SEQ ID NO: 615183 - DNA, 25 bp, Mus musculus
ctctctcagcgtgtgggctctcaga

SEQ ID NO: 615184 - DNA, 25 bp, Mus musculus
ctctctccagagagggtgcaagccc

SEQ ID NO: 615185 - DNA, 25 bp, Mus musculus
ctctctccagagtgggtgcaagccc

SEQ ID NO: 615186 - DNA, 25 bp, Mus musculus
ctctctccatgacgcatgccttggg

SEQ ID NO: 615187 - DNA, 25 bp, Mus musculus
ctctctccatgaggcatgccttggg

SEQ ID NO: 615188 - DNA, 25 bp, Mus musculus
ctctctccttggcacaggaggatac

SEQ ID NO: 615189 - DNA, 25 bp, Mus musculus
ctctctccttgggacaggaggatac

SEQ ID NO: 615190 - DNA, 25 bp, Mus musculus
ctctctcgaagtcccaggcactagt

SEQ ID NO: 615191 - DNA, 25 bp, Mus musculus
ctctctcgaagtgccaggcactagt

SEQ ID NO: 615192 - DNA, 25 bp, Mus musculus
ctctctctcgagcaaatccttacag

SEQ ID NO: 615193 - DNA, 25 bp, Mus musculus
ctctctctcgaggaaatccttacag

SEQ ID NO: 615194 - DNA, 25 bp, Mus musculus
ctctctctgcagctgattatagagc

SEQ ID NO: 615195 - DNA, 25 bp, Mus musculus
ctctctctgcaggtgattatagagc

SEQ ID NO: 615196 - DNA, 25 bp, Mus musculus
ctctctctttggaagcacctgccag

SEQ ID NO: 615197 - DNA, 25 bp, Mus musculus
ctctctctttggtagcacctgccag

SEQ ID NO: 615198 - DNA, 25 bp, Mus musculus
ctctctgaagctctggacttgattg

SEQ ID NO: 615199 - DNA, 25 bp, Mus musculus
ctctctgaagctgtggacttgattg

SEQ ID NO: 615200 - DNA, 25 bp, Mus musculus
ctctctgacacacagtcgcagggaa

SEQ ID NO: 615201 - DNA, 25 bp, Mus musculus
ctctctgacacagagtcgcagggaa

SEQ ID NO: 615202 - DNA, 25 bp, Mus musculus
ctctctgagaacaggatctgtttct

SEQ ID NO: 615203 - DNA, 25 bp, Mus musculus
ctctctgagaactggatctgtttct

SEQ ID NO: 615204 - DNA, 25 bp, Mus musculus
ctctctgagatgactgtcaccctga

SEQ ID NO: 615205 - DNA, 25 bp, Mus musculus
ctctctgagatgtctgtcaccctga

SEQ ID NO: 615206 - DNA, 25 bp, Mus musculus
ctctctgaggcgacagcaatcggcc

SEQ ID NO: 615207 - DNA, 25 bp, Mus musculus
ctctctgaggcgtcagcaatcggcc

SEQ ID NO: 615208 - DNA, 25 bp, Mus musculus
ctctctgatcagacagtgctgttcc

SEQ ID NO: 615209 - DNA, 25 bp, Mus musculus
ctctctgatcagtcagtgctgttcc

SEQ ID NO: 615210 - DNA, 25 bp, Mus musculus
ctctctgcacctctccctggaatcc

SEQ ID NO: 615211 - DNA, 25 bp, Mus musculus
ctctctgcacctgtccctggaatcc

SEQ ID NO: 615212 - DNA, 25 bp, Mus musculus
ctctctgctacacaggtaggcagtg

SEQ ID NO: 615213 - DNA, 25 bp, Mus musculus
ctctctgctacagaggtaggcagtg

SEQ ID NO: 615214 - DNA, 25 bp, Mus musculus
ctctctgtgaataggcagatcggga

SEQ ID NO: 615215 - DNA, 25 bp, Mus musculus
ctctctgtgaattggcagatcggga

SEQ ID NO: 615216 - DNA, 25 bp, Mus musculus
ctctctgtgtggatacggagttata

SEQ ID NO: 615217 - DNA, 25 bp, Mus musculus
ctctctgtgtggttacggagttata

SEQ ID NO: 615218 - DNA, 25 bp, Mus musculus
ctctcttagtagcaggtgcccacac

SEQ ID NO: 615219 - DNA, 25 bp, Mus musculus
ctctcttagtaggaggtgcccacac

SEQ ID NO: 615220 - DNA, 25 bp, Mus musculus
ctctcttcactaatcctaggaggaa

SEQ ID NO: 615221 - DNA, 25 bp, Mus musculus
ctctcttcactattcctaggaggaa

SEQ ID NO: 615222 - DNA, 25 bp, Mus musculus
ctctcttcagctctcacagcggatg

SEQ ID NO: 615223 - DNA, 25 bp, Mus musculus
ctctcttcagctgtcacagcggatg

SEQ ID NO: 615224 - DNA, 25 bp, Mus musculus
ctctcttgaatgacagccagttcag

SEQ ID NO: 615225 - DNA, 25 bp, Mus musculus
ctctcttgaatgtcagccagttcag

SEQ ID NO: 615226 - DNA, 25 bp, Mus musculus
ctctcttgccacagtgccatggaga

SEQ ID NO: 615227 - DNA, 25 bp, Mus musculus
ctctcttgccactgtgccatggaga

SEQ ID NO: 615228 - DNA, 25 bp, Mus musculus
ctctcttggcctagggcatggtggt

SEQ ID NO: 615229 - DNA, 25 bp, Mus musculus
ctctcttggccttgggcatggtggt

SEQ ID NO: 615230 - DNA, 25 bp, Mus musculus
ctctctttgaaaccagaatattcta

SEQ ID NO: 615231 - DNA, 25 bp, Mus musculus
ctctctttgaaagcagaatattcta

SEQ ID NO: 615232 - DNA, 25 bp, Mus musculus
ctctctttgacacaggacaaaggtg

SEQ ID NO: 615233 - DNA, 25 bp, Mus musculus
ctctctttgacagaggacaaaggtg

SEQ ID NO: 615234 - DNA, 25 bp, Mus musculus
ctctgaaaatcactgactttggaat

SEQ ID NO: 615235 - DNA, 25 bp, Mus musculus
ctctgaaaatcagtgactttggaat

SEQ ID NO: 615236 - DNA, 25 bp, Mus musculus
ctctgaaaccaaatgaccagatctt

SEQ ID NO: 615237 - DNA, 25 bp, Mus musculus
ctctgaaaccaattgaccagatctt

SEQ ID NO: 615238 - DNA, 25 bp, Mus musculus
ctctgaaagaatcaagtgagtaatt

SEQ ID NO: 615239 - DNA, 25 bp, Mus musculus
ctctgaaagaatgaagtgagtaatt

SEQ ID NO: 615240 - DNA, 25 bp, Mus musculus
ctctgaacaatgaggaagtctgcag

SEQ ID NO: 615241 - DNA, 25 bp, Mus musculus
ctctgaacaatgtggaagtctgcag

SEQ ID NO: 615242 - DNA, 25 bp, Mus musculus
ctctgaagaaagaggacaccacctt

SEQ ID NO: 615243 - DNA, 25 bp, Mus musculus
ctctgaagaaagtggacaccacctt

SEQ ID NO: 615244 - DNA, 25 bp, Mus musculus
ctctgaagaactctggcctgggctc

SEQ ID NO: 615245 - DNA, 25 bp, Mus musculus
ctctgaagaactgtggcctgggctc

SEQ ID NO: 615246 - DNA, 25 bp, Mus musculus
ctctgaagacaaagatgagcaaggg

SEQ ID NO: 615247 - DNA, 25 bp, Mus musculus
ctctgaagacaatgatgagcaaggg

SEQ ID NO: 615248 - DNA, 25 bp, Mus musculus
ctctgaagatccaccctgcaagtgc

SEQ ID NO: 615249 - DNA, 25 bp, Mus musculus
ctctgaagatcctccctgcaagtgc

SEQ ID NO: 615250 - DNA, 25 bp, Mus musculus
ctctgacagcggaagctgtcctggg

SEQ ID NO: 615251 - DNA, 25 bp, Mus musculus
ctctgacagcggtagctgtcctggg

SEQ ID NO: 615252 - DNA, 25 bp, Mus musculus
ctctgacaggaacaatgattgtcgc

SEQ ID NO: 615253 - DNA, 25 bp, Mus musculus
ctctgacaggaagaatgattgtcgc

SEQ ID NO: 615254 - DNA, 25 bp, Mus musculus
ctctgacatcctagttgtaccccag

SEQ ID NO: 615255 - DNA, 25 bp, Mus musculus
ctctgacatccttgttgtaccccag

SEQ ID NO: 615256 - DNA, 25 bp, Mus musculus
ctctgacattagcaaggtgaacctt

SEQ ID NO: 615257 - DNA, 25 bp, Mus musculus
ctctgacattaggaaggtgaacctt

SEQ ID NO: 615258 - DNA, 25 bp, Mus musculus
ctctgacccggaccagattgggagc

SEQ ID NO: 615259 - DNA, 25 bp, Mus musculus
ctctgacccggagcagattgggagc

SEQ ID NO: 615260 - DNA, 25 bp, Mus musculus
ctctgacggcacagagttcatctca

SEQ ID NO: 615261 - DNA, 25 bp, Mus musculus
ctctgacggcactgagttcatctca

SEQ ID NO: 615262 - DNA, 25 bp, Mus musculus
ctctgactacatccgtggaggcatc

SEQ ID NO: 615263 - DNA, 25 bp, Mus musculus
ctctgactacatgcgtggaggcatc

SEQ ID NO: 615264 - DNA, 25 bp, Mus musculus
ctctgactacgccttcctgggtaca

SEQ ID NO: 615265 - DNA, 25 bp, Mus musculus
ctctgactacgcgttcctgggtaca

SEQ ID NO: 615266 - DNA, 25 bp, Mus musculus
ctctgactcgagcagcacgggtcct

SEQ ID NO: 615267 - DNA, 25 bp, Mus musculus
ctctgactcgaggagcacgggtcct

SEQ ID NO: 615268 - DNA, 25 bp, Mus musculus
ctctgactctaaatccattggaagg

SEQ ID NO: 615269 - DNA, 25 bp, Mus musculus
ctctgactctaattccattggaagg

SEQ ID NO: 615270 - DNA, 25 bp, Mus musculus
ctctgactggtaagggcctgagagt

SEQ ID NO: 615271 - DNA, 25 bp, Mus musculus
ctctgactggtatgggcctgagagt

SEQ ID NO: 615272 - DNA, 25 bp, Mus musculus
ctctgagaatctcggacctcaacag

SEQ ID NO: 615273 - DNA, 25 bp, Mus musculus
ctctgagaatctgggacctcaacag

SEQ ID NO: 615274 - DNA, 25 bp, Mus musculus
ctctgagacagacggcctggtgttc

SEQ ID NO: 615275 - DNA, 25 bp, Mus musculus
ctctgagacagagggcctggtgttc

SEQ ID NO: 615276 - DNA, 25 bp, Mus musculus
ctctgagacaggacccacgggtgtt

SEQ ID NO: 615277 - DNA, 25 bp, Mus musculus
ctctgagacaggtcccacgggtgtt

SEQ ID NO: 615278 - DNA, 25 bp, Mus musculus
ctctgagacagtcctctgcgaggtg

SEQ ID NO: 615279 - DNA, 25 bp, Mus musculus
ctctgagacagtgctctgcgaggtg

SEQ ID NO: 615280 - DNA, 25 bp, Mus musculus
ctctgagatggaacactatttggtt

SEQ ID NO: 615281 - DNA, 25 bp, Mus musculus
ctctgagatggatcactatttggtt

SEQ ID NO: 615282 - DNA, 25 bp, Mus musculus
ctctgagccatgattcatgcaatga

SEQ ID NO: 615283 - DNA, 25 bp, Mus musculus
ctctgagccatgtttcatgcaatga

SEQ ID NO: 615284 - DNA, 25 bp, Mus musculus
ctctgagcgtgcagccttgggacct

SEQ ID NO: 615285 - DNA, 25 bp, Mus musculus
ctctgagcgtgctgccttgggacct

SEQ ID NO: 615286 - DNA, 25 bp, Mus musculus
ctctgagctcttcaacgattgtggg

SEQ ID NO: 615287 - DNA, 25 bp, Mus musculus
ctctgagctcttgaacgattgtggg

SEQ ID NO: 615288 - DNA, 25 bp, Mus musculus
ctctgagctgggacataaggaaggc

SEQ ID NO: 615289 - DNA, 25 bp, Mus musculus
ctctgagctgggtcataaggaaggc

SEQ ID NO: 615290 - DNA, 25 bp, Mus musculus
ctctgaggaaacaaggtgtgggcat

SEQ ID NO: 615291 - DNA, 25 bp, Mus musculus
ctctgaggaaactaggtgtgggcat

SEQ ID NO: 615292 - DNA, 25 bp, Mus musculus
ctctgaggaagaagttatggagatc

SEQ ID NO: 615293 - DNA, 25 bp, Mus musculus
ctctgaggaagatgttatggagatc

SEQ ID NO: 615294 - DNA, 25 bp, Mus musculus
ctctgaggacccacaataacttcct

SEQ ID NO: 615295 - DNA, 25 bp, Mus musculus
ctctgaggaccctcaataacttcct

SEQ ID NO: 615296 - DNA, 25 bp, Mus musculus
ctctgaggccagatgagaaggccat

SEQ ID NO: 615297 - DNA, 25 bp, Mus musculus
ctctgaggccagttgagaaggccat

SEQ ID NO: 615298 - DNA, 25 bp, Mus musculus
ctctgaggtaataggctcctggctc

SEQ ID NO: 615299 - DNA, 25 bp, Mus musculus
ctctgaggtaattggctcctggctc

SEQ ID NO: 615300 - DNA, 25 bp, Mus musculus
ctctgaggtcatcgcaccccaaaaa

SEQ ID NO: 615301 - DNA, 25 bp, Mus musculus
ctctgaggtcatggcaccccaaaaa

SEQ ID NO: 615302 - DNA, 25 bp, Mus musculus
ctctgagtacgtcgcacgatgcctg

SEQ ID NO: 615303 - DNA, 25 bp, Mus musculus
ctctgagtacgtggcacgatgcctg

SEQ ID NO: 615304 - DNA, 25 bp, Mus musculus
ctctgagtatgcaggctctcccagc

SEQ ID NO: 615305 - DNA, 25 bp, Mus musculus
ctctgagtatgctggctctcccagc

SEQ ID NO: 615306 - DNA, 25 bp, Mus musculus
ctctgagtgaggctgctgatcccac

SEQ ID NO: 615307 - DNA, 25 bp, Mus musculus
ctctgagtgagggtgctgatcccac

SEQ ID NO: 615308 - DNA, 25 bp, Mus musculus
ctctgatagagcaccctggccactg

SEQ ID NO: 615309 - DNA, 25 bp, Mus musculus
ctctgatagagctccctggccactg

SEQ ID NO: 615310 - DNA, 25 bp, Mus musculus
ctctgatcagggactgttccccgtt

SEQ ID NO: 615311 - DNA, 25 bp, Mus musculus
ctctgatcagggtctgttccccgtt

SEQ ID NO: 615312 - DNA, 25 bp, Mus musculus
ctctgatcagtcctggactggagtg

SEQ ID NO: 615313 - DNA, 25 bp, Mus musculus
ctctgatcagtcgtggactggagtg

SEQ ID NO: 615314 - DNA, 25 bp, Mus musculus
ctctgatccccaagtcaaatgatcc

SEQ ID NO: 615315 - DNA, 25 bp, Mus musculus
ctctgatccccatgtcaaatgatcc

SEQ ID NO: 615316 - DNA, 25 bp, Mus musculus
ctctgatcgtctcatagaagaaaca

SEQ ID NO: 615317 - DNA, 25 bp, Mus musculus
ctctgatcgtctgatagaagaaaca

SEQ ID NO: 615318 - DNA, 25 bp, Mus musculus
ctctgatcttctctccacgtgggaa

SEQ ID NO: 615319 - DNA, 25 bp, Mus musculus
ctctgatcttctgtccacgtgggaa

SEQ ID NO: 615320 - DNA, 25 bp, Mus musculus
ctctgatgagatccccgtggagcac

SEQ ID NO: 615321 - DNA, 25 bp, Mus musculus
ctctgatgagatgcccgtggagcac

SEQ ID NO: 615322 - DNA, 25 bp, Mus musculus
ctctgatgaggaagggtcgtcagat

SEQ ID NO: 615323 - DNA, 25 bp, Mus musculus
ctctgatgaggactacctgagcccc

SEQ ID NO: 615324 - DNA, 25 bp, Mus musculus
ctctgatgaggagtacctgagcccc

SEQ ID NO: 615325 - DNA, 25 bp, Mus musculus
ctctgatgaggatgggtcgtcagat

SEQ ID NO: 615326 - DNA, 25 bp, Mus musculus
ctctgatgagtgaacttggcaacat

SEQ ID NO: 615327 - DNA, 25 bp, Mus musculus
ctctgatgagtgtacttggcaacat

SEQ ID NO: 615328 - DNA, 25 bp, Mus musculus
ctctgatgccatctacatctttggg

SEQ ID NO: 615329 - DNA, 25 bp, Mus musculus
ctctgatgccatgtacatctttggg

SEQ ID NO: 615330 - DNA, 25 bp, Mus musculus
ctctgatgctgccacagttgctgac

SEQ ID NO: 615331 - DNA, 25 bp, Mus musculus
ctctgatgctgcgacagttgctgac

SEQ ID NO: 615332 - DNA, 25 bp, Mus musculus
ctctgatggttaccgctttggactg

SEQ ID NO: 615333 - DNA, 25 bp, Mus musculus
ctctgatggttagcgctttggactg

SEQ ID NO: 615334 - DNA, 25 bp, Mus musculus
ctctgattctagcactttcaagtga

SEQ ID NO: 615335 - DNA, 25 bp, Mus musculus
ctctgattctaggactttcaagtga

SEQ ID NO: 615336 - DNA, 25 bp, Mus musculus
ctctgattggagaagaactgcaagt

SEQ ID NO: 615337 - DNA, 25 bp, Mus musculus
ctctgattggagtagaactgcaagt

SEQ ID NO: 615338 - DNA, 25 bp, Mus musculus
ctctgatttggaaagttcttcatac

SEQ ID NO: 615339 - DNA, 25 bp, Mus musculus
ctctgatttggatagttcttcatac

SEQ ID NO: 615340 - DNA, 25 bp, Mus musculus
ctctgcaagcgacggcatggcctct

SEQ ID NO: 615341 - DNA, 25 bp, Mus musculus
ctctgcaagcgagggcatggcctct

SEQ ID NO: 615342 - DNA, 25 bp, Mus musculus
ctctgcacaagacgcctccaagaga

SEQ ID NO: 615343 - DNA, 25 bp, Mus musculus
ctctgcacaagaggcctccaagaga

SEQ ID NO: 615344 - DNA, 25 bp, Mus musculus
ctctgcaccagaatacaaggatgag

SEQ ID NO: 615345 - DNA, 25 bp, Mus musculus
ctctgcaccagattacaaggatgag

SEQ ID NO: 615346 - DNA, 25 bp, Mus musculus
ctctgcactagaccgggatacgaac

SEQ ID NO: 615347 - DNA, 25 bp, Mus musculus
ctctgcactagagcgggatacgaac

SEQ ID NO: 615348 - DNA, 25 bp, Mus musculus
ctctgcagaggtagtttgaccaaca

SEQ ID NO: 615349 - DNA, 25 bp, Mus musculus
ctctgcagaggttgtttgaccaaca

SEQ ID NO: 615350 - DNA, 25 bp, Mus musculus
ctctgcagctgtattttgacctgta

SEQ ID NO: 615351 - DNA, 25 bp, Mus musculus
ctctgcagctgttttttgacctgta

SEQ ID NO: 615352 - DNA, 25 bp, Mus musculus
ctctgcagggctcaaggtcactcca

SEQ ID NO: 615353 - DNA, 25 bp, Mus musculus
ctctgcagggctgaaggtcactcca

SEQ ID NO: 615354 - DNA, 25 bp, Mus musculus
ctctgcaggtatctgggccctcagg

SEQ ID NO: 615355 - DNA, 25 bp, Mus musculus
ctctgcaggtatgtgggccctcagg

SEQ ID NO: 615356 - DNA, 25 bp, Mus musculus
ctctgcagtagacagccgcactggc

SEQ ID NO: 615357 - DNA, 25 bp, Mus musculus
ctctgcagtagagagccgcactggc

SEQ ID NO: 615358 - DNA, 25 bp, Mus musculus
ctctgcatacgaaaatgtggtggtg

SEQ ID NO: 615359 - DNA, 25 bp, Mus musculus
ctctgcatacgataatgtggtggtg

SEQ ID NO: 615360 - DNA, 25 bp, Mus musculus
ctctgcatggtgcatattatttttc

SEQ ID NO: 615361 - DNA, 25 bp, Mus musculus
ctctgcatggtggatattatttttc

SEQ ID NO: 615362 - DNA, 25 bp, Mus musculus
ctctgcatgtgacttctgaggtcta

SEQ ID NO: 615363 - DNA, 25 bp, Mus musculus
ctctgcatgtgagttctgaggtcta

SEQ ID NO: 615364 - DNA, 25 bp, Mus musculus
ctctgccaaggcatattcagctcca

SEQ ID NO: 615365 - DNA, 25 bp, Mus musculus
ctctgccaaggcttattcagctcca

SEQ ID NO: 615366 - DNA, 25 bp, Mus musculus
ctctgccacagaaggtccgggtgtc

SEQ ID NO: 615367 - DNA, 25 bp, Mus musculus
ctctgccacagatggtccgggtgtc

SEQ ID NO: 615368 - DNA, 25 bp, Mus musculus
ctctgccacaggatccgagtccgag

SEQ ID NO: 615369 - DNA, 25 bp, Mus musculus
ctctgccacaggttccgagtccgag

SEQ ID NO: 615370 - DNA, 25 bp, Mus musculus
ctctgccagtacaagtgcagcgacg

SEQ ID NO: 615371 - DNA, 25 bp, Mus musculus
ctctgccagtactagtgcagcgacg

SEQ ID NO: 615372 - DNA, 25 bp, Mus musculus
ctctgccagtgacgaccagggactg

SEQ ID NO: 615373 - DNA, 25 bp, Mus musculus
ctctgccagtgaggaccagggactg

SEQ ID NO: 615374 - DNA, 25 bp, Mus musculus
ctctgccctggcctatggtcacatt

SEQ ID NO: 615375 - DNA, 25 bp, Mus musculus
ctctgccctggcgtatggtcacatt

SEQ ID NO: 615376 - DNA, 25 bp, Mus musculus
ctctgcctcatgcatttaggactaa

SEQ ID NO: 615377 - DNA, 25 bp, Mus musculus
ctctgcctcatggatttaggactaa

SEQ ID NO: 615378 - DNA, 25 bp, Mus musculus
ctctgcctgaagctaccgaggacac

SEQ ID NO: 615379 - DNA, 25 bp, Mus musculus
ctctgcctgaaggtaccgaggacac

SEQ ID NO: 615380 - DNA, 25 bp, Mus musculus
ctctgcctgctgcacttccttgtgg

SEQ ID NO: 615381 - DNA, 25 bp, Mus musculus
ctctgcctgctggacttccttgtgg

SEQ ID NO: 615382 - DNA, 25 bp, Mus musculus
ctctgcctggtgacctactgaggag

SEQ ID NO: 615383 - DNA, 25 bp, Mus musculus
ctctgcctggtgtcctactgaggag

SEQ ID NO: 615384 - DNA, 25 bp, Mus musculus
ctctgccttcggacctacagctgga

SEQ ID NO: 615385 - DNA, 25 bp, Mus musculus
ctctgccttcggtcctacagctgga

SEQ ID NO: 615386 - DNA, 25 bp, Mus musculus
ctctgccttcttaccggtttccgcg

SEQ ID NO: 615387 - DNA, 25 bp, Mus musculus
ctctgccttctttccggtttccgcg

SEQ ID NO: 615388 - DNA, 25 bp, Mus musculus
ctctgcgaggctacagaggactcgc

SEQ ID NO: 615389 - DNA, 25 bp, Mus musculus
ctctgcgaggcttcagaggactcgc

SEQ ID NO: 615390 - DNA, 25 bp, Mus musculus
ctctgcgagtccagaaagcccgggc

SEQ ID NO: 615391 - DNA, 25 bp, Mus musculus
ctctgcgagtcctgaaagcccgggc

SEQ ID NO: 615392 - DNA, 25 bp, Mus musculus
ctctgcgatggtagagattataaat

SEQ ID NO: 615393 - DNA, 25 bp, Mus musculus
ctctgcgatggttgagattataaat

SEQ ID NO: 615394 - DNA, 25 bp, Mus musculus
ctctgcgctcccagttggccaagat

SEQ ID NO: 615395 - DNA, 25 bp, Mus musculus
ctctgcgctccctgttggccaagat

SEQ ID NO: 615396 - DNA, 25 bp, Mus musculus
ctctgcggataaagagagacttgcc

SEQ ID NO: 615397 - DNA, 25 bp, Mus musculus
ctctgcggataatgagagacttgcc

SEQ ID NO: 615398 - DNA, 25 bp, Mus musculus
ctctgcggtggcctcagtgaccaca

SEQ ID NO: 615399 - DNA, 25 bp, Mus musculus
ctctgcggtggcgtcagtgaccaca

SEQ ID NO: 615400 - DNA, 25 bp, Mus musculus
ctctgctagagacagggagtaccta

SEQ ID NO: 615401 - DNA, 25 bp, Mus musculus
ctctgctagagagagggagtaccta

SEQ ID NO: 615402 - DNA, 25 bp, Mus musculus
ctctgctaggagatgctgcatataa

SEQ ID NO: 615403 - DNA, 25 bp, Mus musculus
ctctgctaggagttgctgcatataa

SEQ ID NO: 615404 - DNA, 25 bp, Mus musculus
ctctgctatgggatataaaatgtac

SEQ ID NO: 615405 - DNA, 25 bp, Mus musculus
ctctgctatgggttataaaatgtac

SEQ ID NO: 615406 - DNA, 25 bp, Mus musculus
ctctgctctgcgcagactggccctc

SEQ ID NO: 615407 - DNA, 25 bp, Mus musculus
ctctgctctgcggagactggccctc

SEQ ID NO: 615408 - DNA, 25 bp, Mus musculus
ctctgctctgggatcataaactggg

SEQ ID NO: 615409 - DNA, 25 bp, Mus musculus
ctctgctctgggttcataaactggg

SEQ ID NO: 615410 - DNA, 25 bp, Mus musculus
ctctgctgctagctggccaagaagg

SEQ ID NO: 615411 - DNA, 25 bp, Mus musculus
ctctgctgctaggtggccaagaagg

SEQ ID NO: 615412 - DNA, 25 bp, Mus musculus
ctctgctggtgtaccgtgtcttcag

SEQ ID NO: 615413 - DNA, 25 bp, Mus musculus
ctctgctggtgttccgtgtcttcag

SEQ ID NO: 615414 - DNA, 25 bp, Mus musculus
ctctgcttccctcaatgaatgtact

SEQ ID NO: 615415 - DNA, 25 bp, Mus musculus
ctctgcttccctgaatgaatgtact

SEQ ID NO: 615416 - DNA, 25 bp, Mus musculus
ctctgcttctaacgcaacaatggag

SEQ ID NO: 615417 - DNA, 25 bp, Mus musculus
ctctgcttctaaggcaacaatggag

SEQ ID NO: 615418 - DNA, 25 bp, Mus musculus
ctctgcttttgcagtctcctccaaa

SEQ ID NO: 615419 - DNA, 25 bp, Mus musculus
ctctgcttttgctgtctcctccaaa

SEQ ID NO: 615420 - DNA, 25 bp, Mus musculus
ctctggaaaggtcttccccactagc

SEQ ID NO: 615421 - DNA, 25 bp, Mus musculus
ctctggaaaggtgttccccactagc

SEQ ID NO: 615422 - DNA, 25 bp, Mus musculus
ctctggaaatccagctggcttcagg

SEQ ID NO: 615423 - DNA, 25 bp, Mus musculus
ctctggaaatcctgctggcttcagg

SEQ ID NO: 615424 - DNA, 25 bp, Mus musculus
ctctggaagaaacacggtatccagg

SEQ ID NO: 615425 - DNA, 25 bp, Mus musculus
ctctggaagaaagacggtatccagg

SEQ ID NO: 615426 - DNA, 25 bp, Mus musculus
ctctggaaggcactggtaatgaata

SEQ ID NO: 615427 - DNA, 25 bp, Mus musculus
ctctggaaggcagtggtaatgaata

SEQ ID NO: 615428 - DNA, 25 bp, Mus musculus
ctctggaattctctctattgtcaca

SEQ ID NO: 615429 - DNA, 25 bp, Mus musculus
ctctggaattctgtctattgtcaca

SEQ ID NO: 615430 - DNA, 25 bp, Mus musculus
ctctggacagttccccaaaccagtt

SEQ ID NO: 615431 - DNA, 25 bp, Mus musculus
ctctggacagttgcccaaaccagtt

SEQ ID NO: 615432 - DNA, 25 bp, Mus musculus
ctctggaccctaccggttcggtgcg

SEQ ID NO: 615433 - DNA, 25 bp, Mus musculus
ctctggaccctagcggttcggtgcg

SEQ ID NO: 615434 - DNA, 25 bp, Mus musculus
ctctggagacaaaacctctaagatt

SEQ ID NO: 615435 - DNA, 25 bp, Mus musculus
ctctggagacaatacctctaagatt

SEQ ID NO: 615436 - DNA, 25 bp, Mus musculus
ctctggagctttacgggacccgtgg

SEQ ID NO: 615437 - DNA, 25 bp, Mus musculus
ctctggagcttttcgggacccgtgg

SEQ ID NO: 615438 - DNA, 25 bp, Mus musculus
ctctggaggaaaacacctgtccacg

SEQ ID NO: 615439 - DNA, 25 bp, Mus musculus
ctctggaggaaatcacctgtccacg

SEQ ID NO: 615440 - DNA, 25 bp, Mus musculus
ctctggaggttaagaccatcctgtg

SEQ ID NO: 615441 - DNA, 25 bp, Mus musculus
ctctggaggttatgaccatcctgtg

SEQ ID NO: 615442 - DNA, 25 bp, Mus musculus
ctctggagtagacaaatggagactg

SEQ ID NO: 615443 - DNA, 25 bp, Mus musculus
ctctggagtagagaaatggagactg

SEQ ID NO: 615444 - DNA, 25 bp, Mus musculus
ctctggagtccgctgaaatggctgt

SEQ ID NO: 615445 - DNA, 25 bp, Mus musculus
ctctggagtccggtgaaatggctgt

SEQ ID NO: 615446 - DNA, 25 bp, Mus musculus
ctctggagtctaagtgtgtgaagga

SEQ ID NO: 615447 - DNA, 25 bp, Mus musculus
ctctggagtctatgtgtgtgaagga

SEQ ID NO: 615448 - DNA, 25 bp, Mus musculus
ctctggagtggtagcttgggacatc

SEQ ID NO: 615449 - DNA, 25 bp, Mus musculus
ctctggagtggttgcttgggacatc

SEQ ID NO: 615450 - DNA, 25 bp, Mus musculus
ctctggatacatcggtgtggatctg

SEQ ID NO: 615451 - DNA, 25 bp, Mus musculus
ctctggatacatgggtgtggatctg

SEQ ID NO: 615452 - DNA, 25 bp, Mus musculus
ctctggatagacagttaactggcaa

SEQ ID NO: 615453 - DNA, 25 bp, Mus musculus
ctctggatagactgttaactggcaa

SEQ ID NO: 615454 - DNA, 25 bp, Mus musculus
ctctggatcccaagaagcagtttgc

SEQ ID NO: 615455 - DNA, 25 bp, Mus musculus
ctctggatcccatgaagcagtttgc

SEQ ID NO: 615456 - DNA, 25 bp, Mus musculus
ctctggatggtcattttaagaagag

SEQ ID NO: 615457 - DNA, 25 bp, Mus musculus
ctctggatggtctttttaagaagag

SEQ ID NO: 615458 - DNA, 25 bp, Mus musculus
ctctggattcttcggctctaagcct

SEQ ID NO: 615459 - DNA, 25 bp, Mus musculus
ctctggattcttgggctctaagcct

SEQ ID NO: 615460 - DNA, 25 bp, Mus musculus
ctctggattgaacagtatggcaacg

SEQ ID NO: 615461 - DNA, 25 bp, Mus musculus
ctctggattgaagagtatggcaacg

SEQ ID NO: 615462 - DNA, 25 bp, Mus musculus
ctctggcaaacaatgacgatgttgt

SEQ ID NO: 615463 - DNA, 25 bp, Mus musculus
ctctggcaaacattgacgatgttgt

SEQ ID NO: 615464 - DNA, 25 bp, Mus musculus
ctctggcactatcgtcatggcggag

SEQ ID NO: 615465 - DNA, 25 bp, Mus musculus
ctctggcactatggtcatggcggag

SEQ ID NO: 615466 - DNA, 25 bp, Mus musculus
ctctggccaagacgcgcaagcagaa

SEQ ID NO: 615467 - DNA, 25 bp, Mus musculus
ctctggccaagaggcgcaagcagaa

SEQ ID NO: 615468 - DNA, 25 bp, Mus musculus
ctctggccctgtcgcagagcaggaa

SEQ ID NO: 615469 - DNA, 25 bp, Mus musculus
ctctggccctgtggcagagcaggaa

SEQ ID NO: 615470 - DNA, 25 bp, Mus musculus
ctctggccggttaccgctctggaga

SEQ ID NO: 615471 - DNA, 25 bp, Mus musculus
ctctggccggtttccgctctggaga

SEQ ID NO: 615472 - DNA, 25 bp, Mus musculus
ctctggcctgggagccgcctgaagc

SEQ ID NO: 615473 - DNA, 25 bp, Mus musculus
ctctggcctgggtgccgcctgaagc

SEQ ID NO: 615474 - DNA, 25 bp, Mus musculus
ctctggctaaataggagctgtggca

SEQ ID NO: 615475 - DNA, 25 bp, Mus musculus
ctctggctaaattggagctgtggca

SEQ ID NO: 615476 - DNA, 25 bp, Mus musculus
ctctggctctcgacattatggatga

SEQ ID NO: 615477 - DNA, 25 bp, Mus musculus
ctctggctctcgtcattatggatga

SEQ ID NO: 615478 - DNA, 25 bp, Mus musculus
ctctggctgaatctggaactgcttc

SEQ ID NO: 615479 - DNA, 25 bp, Mus musculus
ctctggctgaatgtggaactgcttc

SEQ ID NO: 615480 - DNA, 25 bp, Mus musculus
ctctggctgaggacatcgaccctga

SEQ ID NO: 615481 - DNA, 25 bp, Mus musculus
ctctggctgaggtcatcgaccctga

SEQ ID NO: 615482 - DNA, 25 bp, Mus musculus
ctctggctgttacaaagtagctgga

SEQ ID NO: 615483 - DNA, 25 bp, Mus musculus
ctctggctgttagaaagtagctgga

SEQ ID NO: 615484 - DNA, 25 bp, Mus musculus
ctctggctgttcctaccagcagatc

SEQ ID NO: 615485 - DNA, 25 bp, Mus musculus
ctctggctgttcgtaccagcagatc

SEQ ID NO: 615486 - DNA, 25 bp, Mus musculus
ctctggcttctgctatgtcaatgac

SEQ ID NO: 615487 - DNA, 25 bp, Mus musculus
ctctggcttctggtatgtcaatgac

SEQ ID NO: 615488 - DNA, 25 bp, Mus musculus
ctctgggaacttcgcaaaggaggca

SEQ ID NO: 615489 - DNA, 25 bp, Mus musculus
ctctgggaacttggcaaaggaggca

SEQ ID NO: 615490 - DNA, 25 bp, Mus musculus
ctctgggaagcacgcttactcaaga

SEQ ID NO: 615491 - DNA, 25 bp, Mus musculus
ctctgggaagcaggcttactcaaga

SEQ ID NO: 615492 - DNA, 25 bp, Mus musculus
ctctgggaagctctacctcattgga

SEQ ID NO: 615493 - DNA, 25 bp, Mus musculus
ctctgggaagctgtacctcattgga

SEQ ID NO: 615494 - DNA, 25 bp, Mus musculus
ctctgggagattaccacagggcgga

SEQ ID NO: 615495 - DNA, 25 bp, Mus musculus
ctctgggagatttccacagggcgga

SEQ ID NO: 615496 - DNA, 25 bp, Mus musculus
ctctgggaggtgatcagcaaccctg

SEQ ID NO: 615497 - DNA, 25 bp, Mus musculus
ctctgggaggtgttcagcaaccctg

SEQ ID NO: 615498 - DNA, 25 bp, Mus musculus
ctctgggatgaaccacgtggagacc

SEQ ID NO: 615499 - DNA, 25 bp, Mus musculus
ctctgggatgaagcacgtggagacc

SEQ ID NO: 615500 - DNA, 25 bp, Mus musculus
ctctgggatggtatcaagggcatga

SEQ ID NO: 615501 - DNA, 25 bp, Mus musculus
ctctgggatggtttcaagggcatga

SEQ ID NO: 615502 - DNA, 25 bp, Mus musculus
ctctgggcaaggacctcttccacag

SEQ ID NO: 615503 - DNA, 25 bp, Mus musculus
ctctgggcaaggtcctcttccacag

SEQ ID NO: 615504 - DNA, 25 bp, Mus musculus
ctctgggcacaacaagtggatcatc

SEQ ID NO: 615505 - DNA, 25 bp, Mus musculus
ctctgggcacaagaagtggatcatc

SEQ ID NO: 615506 - DNA, 25 bp, Mus musculus
ctctgggccaaaaaggaggagcagt

SEQ ID NO: 615507 - DNA, 25 bp, Mus musculus
ctctgggccaaataggaggagcagt

SEQ ID NO: 615508 - DNA, 25 bp, Mus musculus
ctctgggcctttcggaggacaacct

SEQ ID NO: 615509 - DNA, 25 bp, Mus musculus
ctctgggcctttgggaggacaacct

SEQ ID NO: 615510 - DNA, 25 bp, Mus musculus
ctctgggctgctaattggatctgga

SEQ ID NO: 615511 - DNA, 25 bp, Mus musculus
ctctgggctgcttattggatctgga

SEQ ID NO: 615512 - DNA, 25 bp, Mus musculus
ctctgggtagccaatgatgagaact

SEQ ID NO: 615513 - DNA, 25 bp, Mus musculus
ctctgggtagcctatgatgagaact

SEQ ID NO: 615514 - DNA, 25 bp, Mus musculus
ctctgggtcgcgctggtcttcgaac

SEQ ID NO: 615515 - DNA, 25 bp, Mus musculus
ctctgggtcgcggtggtcttcgaac

SEQ ID NO: 615516 - DNA, 25 bp, Mus musculus
ctctgggtgataaaacaaatctctg

SEQ ID NO: 615517 - DNA, 25 bp, Mus musculus
ctctgggtgatataacaaatctctg

SEQ ID NO: 615518 - DNA, 25 bp, Mus musculus
ctctggtcccttatagataacctag

SEQ ID NO: 615519 - DNA, 25 bp, Mus musculus
ctctggtcccttttagataacctag

SEQ ID NO: 615520 - DNA, 25 bp, Mus musculus
ctctggtgaagtcctggtcaggaca

SEQ ID NO: 615521 - DNA, 25 bp, Mus musculus
ctctggtgaagtgctggtcaggaca

SEQ ID NO: 615522 - DNA, 25 bp, Mus musculus
ctctggtgcaagagtggtagctatc

SEQ ID NO: 615523 - DNA, 25 bp, Mus musculus
ctctggtgcaagtgtggtagctatc

SEQ ID NO: 615524 - DNA, 25 bp, Mus musculus
ctctggtgccagagaaagacagccc

SEQ ID NO: 615525 - DNA, 25 bp, Mus musculus
ctctggtgccagtgaaagacagccc

SEQ ID NO: 615526 - DNA, 25 bp, Mus musculus
ctctggtggcccatgcttaataaag

SEQ ID NO: 615527 - DNA, 25 bp, Mus musculus
ctctggtggcccttgcttaataaag

SEQ ID NO: 615528 - DNA, 25 bp, Mus musculus
ctctggtgtggtaccagcctgatgg

SEQ ID NO: 615529 - DNA, 25 bp, Mus musculus
ctctggtgtggttccagcctgatgg

SEQ ID NO: 615530 - DNA, 25 bp, Mus musculus
ctctggttaaaaccaccgtggctga

SEQ ID NO: 615531 - DNA, 25 bp, Mus musculus
ctctggttaaaagcaccgtggctga

SEQ ID NO: 615532 - DNA, 25 bp, Mus musculus
ctctggttctggcaatagactggat

SEQ ID NO: 615533 - DNA, 25 bp, Mus musculus
ctctggttctgggaatagactggat

SEQ ID NO: 615534 - DNA, 25 bp, Mus musculus
ctctgtaaaactcagaagtttggtt

SEQ ID NO: 615535 - DNA, 25 bp, Mus musculus
ctctgtaaaactgagaagtttggtt

SEQ ID NO: 615536 - DNA, 25 bp, Mus musculus
ctctgtaacagacccagactggttt

SEQ ID NO: 615537 - DNA, 25 bp, Mus musculus
ctctgtaacagagccagactggttt

SEQ ID NO: 615538 - DNA, 25 bp, Mus musculus
ctctgtactgcacacttaaataaag

SEQ ID NO: 615539 - DNA, 25 bp, Mus musculus
ctctgtactgcagacttaaataaag

SEQ ID NO: 615540 - DNA, 25 bp, Mus musculus
ctctgtattgacacgggctcctcct

SEQ ID NO: 615541 - DNA, 25 bp, Mus musculus
ctctgtattgactcgggctcctcct

SEQ ID NO: 615542 - DNA, 25 bp, Mus musculus
ctctgtcaatgtactccgtggctgc

SEQ ID NO: 615543 - DNA, 25 bp, Mus musculus
ctctgtcaatgttctccgtggctgc

SEQ ID NO: 615544 - DNA, 25 bp, Mus musculus
ctctgtcaccacagcggtggcggag

SEQ ID NO: 615545 - DNA, 25 bp, Mus musculus
ctctgtcaccactgcggtggcggag

SEQ ID NO: 615546 - DNA, 25 bp, Mus musculus
ctctgtcagaaacgatggcagccct

SEQ ID NO: 615547 - DNA, 25 bp, Mus musculus
ctctgtcagaaaggatggcagccct

SEQ ID NO: 615548 - DNA, 25 bp, Mus musculus
ctctgtcagtgaaggaattctggca

SEQ ID NO: 615549 - DNA, 25 bp, Mus musculus
ctctgtcagtgatggaattctggca

SEQ ID NO: 615550 - DNA, 25 bp, Mus musculus
ctctgtccaggcagaaaggtgccct

SEQ ID NO: 615551 - DNA, 25 bp, Mus musculus
ctctgtccaggctgaaaggtgccct

SEQ ID NO: 615552 - DNA, 25 bp, Mus musculus
ctctgtccagggacagtatggagca

SEQ ID NO: 615553 - DNA, 25 bp, Mus musculus
ctctgtccagggtcagtatggagca

SEQ ID NO: 615554 - DNA, 25 bp, Mus musculus
ctctgtcccaaaaacaagcggaatt

SEQ ID NO: 615555 - DNA, 25 bp, Mus musculus
ctctgtcccaaatacaagcggaatt

SEQ ID NO: 615556 - DNA, 25 bp, Mus musculus
ctctgtcccagacactgacctgata

SEQ ID NO: 615557 - DNA, 25 bp, Mus musculus
ctctgtcccagagactgacctgata

SEQ ID NO: 615558 - DNA, 25 bp, Mus musculus
ctctgtcctcctattgtttggcagc

SEQ ID NO: 615559 - DNA, 25 bp, Mus musculus
ctctgtcctccttttgtttggcagc

SEQ ID NO: 615560 - DNA, 25 bp, Mus musculus
ctctgtcctgacaggaatctgctgt

SEQ ID NO: 615561 - DNA, 25 bp, Mus musculus
ctctgtcctgactggaatctgctgt

SEQ ID NO: 615562 - DNA, 25 bp, Mus musculus
ctctgtcctgccagccggagagaag

SEQ ID NO: 615563 - DNA, 25 bp, Mus musculus
ctctgtcctgcctgccggagagaag

SEQ ID NO: 615564 - DNA, 25 bp, Mus musculus
ctctgtcgggtcaggctgtccggct

SEQ ID NO: 615565 - DNA, 25 bp, Mus musculus
ctctgtcgggtctggctgtccggct

SEQ ID NO: 615566 - DNA, 25 bp, Mus musculus
ctctgtctgtcaacccagggtctta

SEQ ID NO: 615567 - DNA, 25 bp, Mus musculus
ctctgtctgtcatcccagggtctta

SEQ ID NO: 615568 - DNA, 25 bp, Mus musculus
ctctgtctgtggatggagcagcctg

SEQ ID NO: 615569 - DNA, 25 bp, Mus musculus
ctctgtctgtggttggagcagcctg

SEQ ID NO: 615570 - DNA, 25 bp, Mus musculus
ctctgtctttagcaacacaatgaag

SEQ ID NO: 615571 - DNA, 25 bp, Mus musculus
ctctgtctttaggaacacaatgaag

SEQ ID NO: 615572 - DNA, 25 bp, Mus musculus
ctctgtgaattcattgaggactgtg

SEQ ID NO: 615573 - DNA, 25 bp, Mus musculus
ctctgtgaattctttgaggactgtg

SEQ ID NO: 615574 - DNA, 25 bp, Mus musculus
ctctgtgacaaaattagtggccatc

SEQ ID NO: 615575 - DNA, 25 bp, Mus musculus
ctctgtgacaaatttagtggccatc

SEQ ID NO: 615576 - DNA, 25 bp, Mus musculus
ctctgtgatacaaggcatgggagac

SEQ ID NO: 615577 - DNA, 25 bp, Mus musculus
ctctgtgatacatggcatgggagac

SEQ ID NO: 615578 - DNA, 25 bp, Mus musculus
ctctgtgattggagcattttcagtc

SEQ ID NO: 615579 - DNA, 25 bp, Mus musculus
ctctgtgattggtgcattttcagtc

SEQ ID NO: 615580 - DNA, 25 bp, Mus musculus
ctctgtgcaaatcttccaggatcct

SEQ ID NO: 615581 - DNA, 25 bp, Mus musculus
ctctgtgcaaatgttccaggatcct

SEQ ID NO: 615582 - DNA, 25 bp, Mus musculus
ctctgtgcagtacctagttgagtgg

SEQ ID NO: 615583 - DNA, 25 bp, Mus musculus
ctctgtgcagtagctagttgagtgg

SEQ ID NO: 615584 - DNA, 25 bp, Mus musculus
ctctgtgcgcccagctgtcttgcag

SEQ ID NO: 615585 - DNA, 25 bp, Mus musculus
ctctgtgcgccctgctgtcttgcag

SEQ ID NO: 615586 - DNA, 25 bp, Mus musculus
ctctgtgctgaaccaagaccgggag

SEQ ID NO: 615587 - DNA, 25 bp, Mus musculus
ctctgtgctgaagcaagaccgggag

SEQ ID NO: 615588 - DNA, 25 bp, Mus musculus
ctctgtgcttccatgagccagaggg

SEQ ID NO: 615589 - DNA, 25 bp, Mus musculus
ctctgtgcttccttgagccagaggg

SEQ ID NO: 615590 - DNA, 25 bp, Mus musculus
ctctgtggaaggagttaaccatgac

SEQ ID NO: 615591 - DNA, 25 bp, Mus musculus
ctctgtggaaggtgttaaccatgac

SEQ ID NO: 615592 - DNA, 25 bp, Mus musculus
ctctgtggagttcgccctctgatgt

SEQ ID NO: 615593 - DNA, 25 bp, Mus musculus
ctctgtggagttggccctctgatgt

SEQ ID NO: 615594 - DNA, 25 bp, Mus musculus
ctctgtgggccgagctgttggtcac

SEQ ID NO: 615595 - DNA, 25 bp, Mus musculus
ctctgtgggccgtgctgttggtcac

SEQ ID NO: 615596 - DNA, 25 bp, Mus musculus
ctctgtgggtgacgacagcatccct

SEQ ID NO: 615597 - DNA, 25 bp, Mus musculus
ctctgtgggtgaggacagcatccct

SEQ ID NO: 615598 - DNA, 25 bp, Mus musculus
ctctgtgggtggcatgatctcttcc

SEQ ID NO: 615599 - DNA, 25 bp, Mus musculus
ctctgtgggtgggatgatctcttcc

SEQ ID NO: 615600 - DNA, 25 bp, Mus musculus
ctctgtggtgggagatcaaaggccc

SEQ ID NO: 615601 - DNA, 25 bp, Mus musculus
ctctgtggtgggtgatcaaaggccc

SEQ ID NO: 615602 - DNA, 25 bp, Mus musculus
ctctgtgtaatgactctgctttgga

SEQ ID NO: 615603 - DNA, 25 bp, Mus musculus
ctctgtgtaatgtctctgctttgga

SEQ ID NO: 615604 - DNA, 25 bp, Mus musculus
ctctgtgtcagaatatgatgatctc

SEQ ID NO: 615605 - DNA, 25 bp, Mus musculus
ctctgtgtcagattatgatgatctc

SEQ ID NO: 615606 - DNA, 25 bp, Mus musculus
ctctgtgtgctcatcccgaagtgac

SEQ ID NO: 615607 - DNA, 25 bp, Mus musculus
ctctgtgtgctcttcccgaagtgac

SEQ ID NO: 615608 - DNA, 25 bp, Mus musculus
ctctgtgtggctcgcagacccatga

SEQ ID NO: 615609 - DNA, 25 bp, Mus musculus
ctctgtgtggctggcagacccatga

SEQ ID NO: 615610 - DNA, 25 bp, Mus musculus
ctctgtgttgaacggccgcatcgca

SEQ ID NO: 615611 - DNA, 25 bp, Mus musculus
ctctgtgttgaagggccgcatcgca

SEQ ID NO: 615612 - DNA, 25 bp, Mus musculus
ctctgtgtttgtccccacaggccag

SEQ ID NO: 615613 - DNA, 25 bp, Mus musculus
ctctgtgtttgtgcccacaggccag

SEQ ID NO: 615614 - DNA, 25 bp, Mus musculus
ctctgttccccacggcctgctgaag

SEQ ID NO: 615615 - DNA, 25 bp, Mus musculus
ctctgttccccagggcctgctgaag

SEQ ID NO: 615616 - DNA, 25 bp, Mus musculus
ctctgttggatacccgagagtctcg

SEQ ID NO: 615617 - DNA, 25 bp, Mus musculus
ctctgttggatagccgagagtctcg

SEQ ID NO: 615618 - DNA, 25 bp, Mus musculus
ctctgtttcttcacctgtcgcctgg

SEQ ID NO: 615619 - DNA, 25 bp, Mus musculus
ctctgtttcttctcctgtcgcctgg

SEQ ID NO: 615620 - DNA, 25 bp, Mus musculus
ctctgtttgaaactaacctgctgga

SEQ ID NO: 615621 - DNA, 25 bp, Mus musculus
ctctgtttgaaagtaacctgctgga

SEQ ID NO: 615622 - DNA, 25 bp, Mus musculus
ctctgtttgttaccctgcgaaggcc

SEQ ID NO: 615623 - DNA, 25 bp, Mus musculus
ctctgtttgttagcctgcgaaggcc

SEQ ID NO: 615624 - DNA, 25 bp, Mus musculus
ctcttaaagaagaacatgtgtaact

SEQ ID NO: 615625 - DNA, 25 bp, Mus musculus
ctcttaaagaagtacatgtgtaact

SEQ ID NO: 615626 - DNA, 25 bp, Mus musculus
ctcttaagtatacgatcacgtggcc

SEQ ID NO: 615627 - DNA, 25 bp, Mus musculus
ctcttaagtataggatcacgtggcc

SEQ ID NO: 615628 - DNA, 25 bp, Mus musculus
ctcttacaattacgtggctgacgag

SEQ ID NO: 615629 - DNA, 25 bp, Mus musculus
ctcttacaattaggtggctgacgag

SEQ ID NO: 615630 - DNA, 25 bp, Mus musculus
ctcttactgtgactttatcatggaa

SEQ ID NO: 615631 - DNA, 25 bp, Mus musculus
ctcttactgtgagtttatcatggaa

SEQ ID NO: 615632 - DNA, 25 bp, Mus musculus
ctcttactgttgaaagactaaaagc

SEQ ID NO: 615633 - DNA, 25 bp, Mus musculus
ctcttactgttgtaagactaaaagc

SEQ ID NO: 615634 - DNA, 25 bp, Mus musculus
ctcttagagcaacggaaggctaaga

SEQ ID NO: 615635 - DNA, 25 bp, Mus musculus
ctcttagagcaagggaaggctaaga

SEQ ID NO: 615636 - DNA, 25 bp, Mus musculus
ctcttagatggtatgggtgggaaca

SEQ ID NO: 615637 - DNA, 25 bp, Mus musculus
ctcttagatggtttgggtgggaaca

SEQ ID NO: 615638 - DNA, 25 bp, Mus musculus
ctcttagctgctccagagagactgc

SEQ ID NO: 615639 - DNA, 25 bp, Mus musculus
ctcttagctgctgcagagagactgc

SEQ ID NO: 615640 - DNA, 25 bp, Mus musculus
ctcttcaaggatcggaaacttaagt

SEQ ID NO: 615641 - DNA, 25 bp, Mus musculus
ctcttcaaggatgggaaacttaagt

SEQ ID NO: 615642 - DNA, 25 bp, Mus musculus
ctcttcaagtgtaagccgatcagca

SEQ ID NO: 615643 - DNA, 25 bp, Mus musculus
ctcttcaagtgttagccgatcagca

SEQ ID NO: 615644 - DNA, 25 bp, Mus musculus
ctcttcaatcagctcatcaagtgag

SEQ ID NO: 615645 - DNA, 25 bp, Mus musculus
ctcttcaatcaggtcatcaagtgag

SEQ ID NO: 615646 - DNA, 25 bp, Mus musculus
ctcttcaatgctctaggcgatggca

SEQ ID NO: 615647 - DNA, 25 bp, Mus musculus
ctcttcaatgctgtaggcgatggca

SEQ ID NO: 615648 - DNA, 25 bp, Mus musculus
ctcttcacaaatagggatacccctg

SEQ ID NO: 615649 - DNA, 25 bp, Mus musculus
ctcttcacaaattgggatacccctg

SEQ ID NO: 615650 - DNA, 25 bp, Mus musculus
ctcttcacagacacaggctacatct

SEQ ID NO: 615651 - DNA, 25 bp, Mus musculus
ctcttcacagactcaggctacatct

SEQ ID NO: 615652 - DNA, 25 bp, Mus musculus
ctcttcacttgacacgcctgaggga

SEQ ID NO: 615653 - DNA, 25 bp, Mus musculus
ctcttcacttgagacgcctgaggga

SEQ ID NO: 615654 - DNA, 25 bp, Mus musculus
ctcttcaggctccagaaacaacttc

SEQ ID NO: 615655 - DNA, 25 bp, Mus musculus
ctcttcaggctcgagaaacaacttc

SEQ ID NO: 615656 - DNA, 25 bp, Mus musculus
ctcttcattgcgactaacatctgtg

SEQ ID NO: 615657 - DNA, 25 bp, Mus musculus
ctcttcattgcgtctaacatctgtg

SEQ ID NO: 615658 - DNA, 25 bp, Mus musculus
ctcttccataagacaggtgctttgg

SEQ ID NO: 615659 - DNA, 25 bp, Mus musculus
ctcttccataagtcaggtgctttgg

SEQ ID NO: 615660 - DNA, 25 bp, Mus musculus
ctcttccatcttcgcgtagttctac

SEQ ID NO: 615661 - DNA, 25 bp, Mus musculus
ctcttccatcttggcgtagttctac

SEQ ID NO: 615662 - DNA, 25 bp, Mus musculus
ctcttcccagaactgtgccggatca

SEQ ID NO: 615663 - DNA, 25 bp, Mus musculus
ctcttcccagaagtgtgccggatca

SEQ ID NO: 615664 - DNA, 25 bp, Mus musculus
ctcttccctgctcggaagtactgtg

SEQ ID NO: 615665 - DNA, 25 bp, Mus musculus
ctcttccctgctgggaagtactgtg

SEQ ID NO: 615666 - DNA, 25 bp, Mus musculus
ctcttccgaaggctgtggtgaaact

SEQ ID NO: 615667 - DNA, 25 bp, Mus musculus
ctcttccgaagggtgtggtgaaact

SEQ ID NO: 615668 - DNA, 25 bp, Mus musculus
ctcttccgagagatcctgcaggtgt

SEQ ID NO: 615669 - DNA, 25 bp, Mus musculus
ctcttccgagagttcctgcaggtgt

SEQ ID NO: 615670 - DNA, 25 bp, Mus musculus
ctcttccgatttctgcgcgaggcgc

SEQ ID NO: 615671 - DNA, 25 bp, Mus musculus
ctcttccgatttgtgcgcgaggcgc

SEQ ID NO: 615672 - DNA, 25 bp, Mus musculus
ctcttccgtaatccgggatgtgctg

SEQ ID NO: 615673 - DNA, 25 bp, Mus musculus
ctcttccgtaatgcgggatgtgctg

SEQ ID NO: 615674 - DNA, 25 bp, Mus musculus
ctcttcggaaagaatgcatagggct

SEQ ID NO: 615675 - DNA, 25 bp, Mus musculus
ctcttcggaaagtatgcatagggct

SEQ ID NO: 615676 - DNA, 25 bp, Mus musculus
ctcttcgggacaaccgaactaccag

SEQ ID NO: 615677 - DNA, 25 bp, Mus musculus
ctcttcgggacatccgaactaccag

SEQ ID NO: 615678 - DNA, 25 bp, Mus musculus
ctcttcgtggcacaccagcggagtc

SEQ ID NO: 615679 - DNA, 25 bp, Mus musculus
ctcttcgtggcagaccagcggagtc

SEQ ID NO: 615680 - DNA, 25 bp, Mus musculus
ctcttctaccgtctctggtctctgg

SEQ ID NO: 615681 - DNA, 25 bp, Mus musculus
ctcttctaccgtgtctggtctctgg

SEQ ID NO: 615682 - DNA, 25 bp, Mus musculus
ctcttctacctgcagcccaagtatg

SEQ ID NO: 615683 - DNA, 25 bp, Mus musculus
ctcttctacctggagcccaagtatg

SEQ ID NO: 615684 - DNA, 25 bp, Mus musculus
ctcttctctagaccgcaggcgggcg

SEQ ID NO: 615685 - DNA, 25 bp, Mus musculus
ctcttctctagagcgcaggcgggcg

SEQ ID NO: 615686 - DNA, 25 bp, Mus musculus
ctcttctgatctccaggtaaccatc

SEQ ID NO: 615687 - DNA, 25 bp, Mus musculus
ctcttctgatctgcaggtaaccatc

SEQ ID NO: 615688 - DNA, 25 bp, Mus musculus
ctcttctgcactctgtacaggcaca

SEQ ID NO: 615689 - DNA, 25 bp, Mus musculus
ctcttctgcactgtgtacaggcaca

SEQ ID NO: 615690 - DNA, 25 bp, Mus musculus
ctcttctgctctagcgcatagttga

SEQ ID NO: 615691 - DNA, 25 bp, Mus musculus
ctcttctgctcttgcgcatagttga

SEQ ID NO: 615692 - DNA, 25 bp, Mus musculus
ctcttctggaaaagtactgcggttt

SEQ ID NO: 615693 - DNA, 25 bp, Mus musculus
ctcttctggaaatgtactgcggttt

SEQ ID NO: 615694 - DNA, 25 bp, Mus musculus
ctcttctgtcggaaactggtgtctt

SEQ ID NO: 615695 - DNA, 25 bp, Mus musculus
ctcttctgtcggtaactggtgtctt

SEQ ID NO: 615696 - DNA, 25 bp, Mus musculus
ctcttcttcaatcggacagaaacct

SEQ ID NO: 615697 - DNA, 25 bp, Mus musculus
ctcttcttcaatgggacagaaacct

SEQ ID NO: 615698 - DNA, 25 bp, Mus musculus
ctcttcttgagaaaggtcctctcag

SEQ ID NO: 615699 - DNA, 25 bp, Mus musculus
ctcttcttgagataggtcctctcag

SEQ ID NO: 615700 - DNA, 25 bp, Mus musculus
ctcttctttagaagaggaaggcaag

SEQ ID NO: 615701 - DNA, 25 bp, Mus musculus
ctcttctttagatgaggaaggcaag

SEQ ID NO: 615702 - DNA, 25 bp, Mus musculus
ctcttctttgtaacctggccttagt

SEQ ID NO: 615703 - DNA, 25 bp, Mus musculus
ctcttctttgtatcctggccttagt

SEQ ID NO: 615704 - DNA, 25 bp, Mus musculus
ctcttcttttagatgttccggaagc

SEQ ID NO: 615705 - DNA, 25 bp, Mus musculus
ctcttcttttagttgttccggaagc

SEQ ID NO: 615706 - DNA, 25 bp, Mus musculus
ctcttgaaattactgtgccctggga

SEQ ID NO: 615707 - DNA, 25 bp, Mus musculus
ctcttgaaattagtgtgccctggga

SEQ ID NO: 615708 - DNA, 25 bp, Mus musculus
ctcttgaccctgataaatgtgacag

SEQ ID NO: 615709 - DNA, 25 bp, Mus musculus
ctcttgaccctgttaaatgtgacag

SEQ ID NO: 615710 - DNA, 25 bp, Mus musculus
ctcttgactgggatgagcaccgcca

SEQ ID NO: 615711 - DNA, 25 bp, Mus musculus
ctcttgactgggttgagcaccgcca

SEQ ID NO: 615712 - DNA, 25 bp, Mus musculus
ctcttgcaagccaggctaccaaggg

SEQ ID NO: 615713 - DNA, 25 bp, Mus musculus
ctcttgcaagcctggctaccaaggg

SEQ ID NO: 615714 - DNA, 25 bp, Mus musculus
ctcttgcacagcaaccggaggaggg

SEQ ID NO: 615715 - DNA, 25 bp, Mus musculus
ctcttgcacagctaccggaggaggg

SEQ ID NO: 615716 - DNA, 25 bp, Mus musculus
ctcttgcagcagaggaatatggtca

SEQ ID NO: 615717 - DNA, 25 bp, Mus musculus
ctcttgcagcagtggaatatggtca

SEQ ID NO: 615718 - DNA, 25 bp, Mus musculus
ctcttgcagtggaaaggactggaca

SEQ ID NO: 615719 - DNA, 25 bp, Mus musculus
ctcttgcagtggtaaggactggaca

SEQ ID NO: 615720 - DNA, 25 bp, Mus musculus
ctcttgccacagagccatggagaag

SEQ ID NO: 615721 - DNA, 25 bp, Mus musculus
ctcttgccacagtgccatggagaag

SEQ ID NO: 615722 - DNA, 25 bp, Mus musculus
ctcttgcccctcatggaagtggaga

SEQ ID NO: 615723 - DNA, 25 bp, Mus musculus
ctcttgcccctcttggaagtggaga

SEQ ID NO: 615724 - DNA, 25 bp, Mus musculus
ctcttgcccgagaaggagctaggga

SEQ ID NO: 615725 - DNA, 25 bp, Mus musculus
ctcttgcccgagtaggagctaggga

SEQ ID NO: 615726 - DNA, 25 bp, Mus musculus
ctcttgctcagccatggaaaactta

SEQ ID NO: 615727 - DNA, 25 bp, Mus musculus
ctcttgctcagcgatggaaaactta

SEQ ID NO: 615728 - DNA, 25 bp, Mus musculus
ctcttgctctcgactgttaatggcg

SEQ ID NO: 615729 - DNA, 25 bp, Mus musculus
ctcttgctctcgtctgttaatggcg

SEQ ID NO: 615730 - DNA, 25 bp, Mus musculus
ctcttgctgcatcacggactgaccg

SEQ ID NO: 615731 - DNA, 25 bp, Mus musculus
ctcttgctgcatgacggactgaccg

SEQ ID NO: 615732 - DNA, 25 bp, Mus musculus
ctcttgctgcccaggatgcgctcaa

SEQ ID NO: 615733 - DNA, 25 bp, Mus musculus
ctcttgctgccctggatgcgctcaa

SEQ ID NO: 615734 - DNA, 25 bp, Mus musculus
ctcttggaattacggctgggccttc

SEQ ID NO: 615735 - DNA, 25 bp, Mus musculus
ctcttggaattagggctgggccttc

SEQ ID NO: 615736 - DNA, 25 bp, Mus musculus
ctcttggagaggacctagtttttgt

SEQ ID NO: 615737 - DNA, 25 bp, Mus musculus
ctcttggagaggtcctagtttttgt

SEQ ID NO: 615738 - DNA, 25 bp, Mus musculus
ctcttggagcaaagaagtgttctgt

SEQ ID NO: 615739 - DNA, 25 bp, Mus musculus
ctcttggagcaatgaagtgttctgt

SEQ ID NO: 615740 - DNA, 25 bp, Mus musculus
ctcttggagccaaacgagatgggaa

SEQ ID NO: 615741 - DNA, 25 bp, Mus musculus
ctcttggagccatacgagatgggaa

SEQ ID NO: 615742 - DNA, 25 bp, Mus musculus
ctcttggagcgcacgcccggaggac

SEQ ID NO: 615743 - DNA, 25 bp, Mus musculus
ctcttggagcgctcgcccggaggac

SEQ ID NO: 615744 - DNA, 25 bp, Mus musculus
ctcttggaggtgacaagctgccgcg

SEQ ID NO: 615745 - DNA, 25 bp, Mus musculus
ctcttggaggtgtcaagctgccgcg

SEQ ID NO: 615746 - DNA, 25 bp, Mus musculus
ctcttggagtacagggaaggagacc

SEQ ID NO: 615747 - DNA, 25 bp, Mus musculus
ctcttggagtactgggaaggagacc

SEQ ID NO: 615748 - DNA, 25 bp, Mus musculus
ctcttggctccacgatttgtgcagg

SEQ ID NO: 615749 - DNA, 25 bp, Mus musculus
ctcttggctccaggatttgtgcagg

SEQ ID NO: 615750 - DNA, 25 bp, Mus musculus
ctcttgggaaatcgctagctctgac

SEQ ID NO: 615751 - DNA, 25 bp, Mus musculus
ctcttgggaaatggctagctctgac

SEQ ID NO: 615752 - DNA, 25 bp, Mus musculus
ctcttgggagaaataatggagcaat

SEQ ID NO: 615753 - DNA, 25 bp, Mus musculus
ctcttgggagaattaatggagcaat

SEQ ID NO: 615754 - DNA, 25 bp, Mus musculus
ctcttgggagccaggctttgatggt

SEQ ID NO: 615755 - DNA, 25 bp, Mus musculus
ctcttgggagcctggctttgatggt

SEQ ID NO: 615756 - DNA, 25 bp, Mus musculus
ctcttgggaggaagctgtgagctgg

SEQ ID NO: 615757 - DNA, 25 bp, Mus musculus
ctcttgggaggatgctgtgagctgg

SEQ ID NO: 615758 - DNA, 25 bp, Mus musculus
ctcttgggataaagcccaggttatc

SEQ ID NO: 615759 - DNA, 25 bp, Mus musculus
ctcttgggataatgcccaggttatc

SEQ ID NO: 615760 - DNA, 25 bp, Mus musculus
ctcttgggcattatcattgtctgga

SEQ ID NO: 615761 - DNA, 25 bp, Mus musculus
ctcttgggcattttcattgtctgga

SEQ ID NO: 615762 - DNA, 25 bp, Mus musculus
ctcttggtatttctgcgcaatctgc

SEQ ID NO: 615763 - DNA, 25 bp, Mus musculus
ctcttggtatttgtgcgcaatctgc

SEQ ID NO: 615764 - DNA, 25 bp, Mus musculus
ctcttggtgggcagatctgaaggca

SEQ ID NO: 615765 - DNA, 25 bp, Mus musculus
ctcttggtgggctgatctgaaggca

SEQ ID NO: 615766 - DNA, 25 bp, Mus musculus
ctcttggtgtatcctggagctttca

SEQ ID NO: 615767 - DNA, 25 bp, Mus musculus
ctcttggtgtatgctggagctttca

SEQ ID NO: 615768 - DNA, 25 bp, Mus musculus
ctcttgtgctccagagctcagggaa

SEQ ID NO: 615769 - DNA, 25 bp, Mus musculus
ctcttgtgctcctgagctcagggaa

SEQ ID NO: 615770 - DNA, 25 bp, Mus musculus
ctcttgttcgtaccggtagcatctc

SEQ ID NO: 615771 - DNA, 25 bp, Mus musculus
ctcttgttcgtagcggtagcatctc

SEQ ID NO: 615772 - DNA, 25 bp, Mus musculus
ctcttgttcttgctgccacaaacat

SEQ ID NO: 615773 - DNA, 25 bp, Mus musculus
ctcttgttcttggtgccacaaacat

SEQ ID NO: 615774 - DNA, 25 bp, Mus musculus
ctcttgttggagctacaactcctgt

SEQ ID NO: 615775 - DNA, 25 bp, Mus musculus
ctcttgttggaggtacaactcctgt

SEQ ID NO: 615776 - DNA, 25 bp, Mus musculus
ctctttacaaggaacccctgcttgg

SEQ ID NO: 615777 - DNA, 25 bp, Mus musculus
ctctttacaaggtacccctgcttgg

SEQ ID NO: 615778 - DNA, 25 bp, Mus musculus
ctctttacactgctggtggagacct

SEQ ID NO: 615779 - DNA, 25 bp, Mus musculus
ctctttacactggtggtggagacct

SEQ ID NO: 615780 - DNA, 25 bp, Mus musculus
ctctttagccgtctgtgaagacatc

SEQ ID NO: 615781 - DNA, 25 bp, Mus musculus
ctctttagccgtgtgtgaagacatc

SEQ ID NO: 615782 - DNA, 25 bp, Mus musculus
ctctttatctggagccgccttctgc

SEQ ID NO: 615783 - DNA, 25 bp, Mus musculus
ctctttatctggtgccgccttctgc

SEQ ID NO: 615784 - DNA, 25 bp, Mus musculus
ctctttattcagaggtgtcaggacc

SEQ ID NO: 615785 - DNA, 25 bp, Mus musculus
ctctttattcagtggtgtcaggacc

SEQ ID NO: 615786 - DNA, 25 bp, Mus musculus
ctctttattctaccctttggaagga

SEQ ID NO: 615787 - DNA, 25 bp, Mus musculus
ctctttattctagcctttggaagga

SEQ ID NO: 615788 - DNA, 25 bp, Mus musculus
ctctttctacatcctgaggaccgac

SEQ ID NO: 615789 - DNA, 25 bp, Mus musculus
ctctttctacatgctgaggaccgac

SEQ ID NO: 615790 - DNA, 25 bp, Mus musculus
ctctttctacccagagtcactgctg

SEQ ID NO: 615791 - DNA, 25 bp, Mus musculus
ctctttctaccctgagtcactgctg

SEQ ID NO: 615792 - DNA, 25 bp, Mus musculus
ctctttctcagtccgagctgggtac

SEQ ID NO: 615793 - DNA, 25 bp, Mus musculus
ctctttctcagtgcgagctgggtac

SEQ ID NO: 615794 - DNA, 25 bp, Mus musculus
ctctttgacagacgacaaaggtgtg

SEQ ID NO: 615795 - DNA, 25 bp, Mus musculus
ctctttgacagaggacaaaggtgtg

SEQ ID NO: 615796 - DNA, 25 bp, Mus musculus
ctctttgagagacccgtgaaggact

SEQ ID NO: 615797 - DNA, 25 bp, Mus musculus
ctctttgagagagccgtgaaggact

SEQ ID NO: 615798 - DNA, 25 bp, Mus musculus
ctctttgcagcaactacaccagtgt

SEQ ID NO: 615799 - DNA, 25 bp, Mus musculus
ctctttgcagcatctacaccagtgt

SEQ ID NO: 615800 - DNA, 25 bp, Mus musculus
ctctttgcctgcactattgtggata

SEQ ID NO: 615801 - DNA, 25 bp, Mus musculus
ctctttgcctgctctattgtggata

SEQ ID NO: 615802 - DNA, 25 bp, Mus musculus
ctctttggagggaccaggccttgtc

SEQ ID NO: 615803 - DNA, 25 bp, Mus musculus
ctctttggagggtccaggccttgtc

SEQ ID NO: 615804 - DNA, 25 bp, Mus musculus
ctctttggattactggtgaaggaca

SEQ ID NO: 615805 - DNA, 25 bp, Mus musculus
ctctttggattagtggtgaaggaca

SEQ ID NO: 615806 - DNA, 25 bp, Mus musculus
ctctttggcaaaatcaaggatatca

SEQ ID NO: 615807 - DNA, 25 bp, Mus musculus
ctctttggcaaattcaaggatatca

SEQ ID NO: 615808 - DNA, 25 bp, Mus musculus
ctctttggcacacttggaaactgca

SEQ ID NO: 615809 - DNA, 25 bp, Mus musculus
ctctttggcacagttggaaactgca

SEQ ID NO: 615810 - DNA, 25 bp, Mus musculus
ctctttggtggaacaaggaaggatt

SEQ ID NO: 615811 - DNA, 25 bp, Mus musculus
ctctttggtggatcaaggaaggatt

SEQ ID NO: 615812 - DNA, 25 bp, Mus musculus
ctctttgtccctaggactcagacag

SEQ ID NO: 615813 - DNA, 25 bp, Mus musculus
ctctttgtcccttggactcagacag

SEQ ID NO: 615814 - DNA, 25 bp, Mus musculus
ctctttgtcgaacctagaggaccgg

SEQ ID NO: 615815 - DNA, 25 bp, Mus musculus
ctctttgtcgaagctagaggaccgg

SEQ ID NO: 615816 - DNA, 25 bp, Mus musculus
ctctttgttgctcgcttaattgtcc

SEQ ID NO: 615817 - DNA, 25 bp, Mus musculus
ctctttgttgctggcttaattgtcc

SEQ ID NO: 615818 - DNA, 25 bp, Mus musculus
ctcttttcagttccattagcagaaa

SEQ ID NO: 615819 - DNA, 25 bp, Mus musculus
ctcttttcagttgcattagcagaaa

SEQ ID NO: 615820 - DNA, 25 bp, Mus musculus
ctcttttctccacgaggaaaaaatg

SEQ ID NO: 615821 - DNA, 25 bp, Mus musculus
ctcttttctccaggaggaaaaaatg

SEQ ID NO: 615822 - DNA, 25 bp, Mus musculus
ctcttttgccatacccttgattgaa

SEQ ID NO: 615823 - DNA, 25 bp, Mus musculus
ctcttttgccattcccttgattgaa

SEQ ID NO: 615824 - DNA, 25 bp, Mus musculus
ctcttttggaacagcagaacaccat

SEQ ID NO: 615825 - DNA, 25 bp, Mus musculus
ctcttttggaacatggagatgtttc

SEQ ID NO: 615826 - DNA, 25 bp, Mus musculus
ctcttttggaactgcagaacaccat

SEQ ID NO: 615827 - DNA, 25 bp, Mus musculus
ctcttttggaacttggagatgtttc

SEQ ID NO: 615828 - DNA, 25 bp, Mus musculus
ctcttttgtgacaggaacagcttgt

SEQ ID NO: 615829 - DNA, 25 bp, Mus musculus
ctcttttgtgactggaacagcttgt

SEQ ID NO: 615830 - DNA, 25 bp, Mus musculus
ctgaaaaaacaccatcgctaactaa

SEQ ID NO: 615831 - DNA, 25 bp, Mus musculus
ctgaaaaaacacgatcgctaactaa

SEQ ID NO: 615832 - DNA, 25 bp, Mus musculus
ctgaaaaagataaggaggaactcct

SEQ ID NO: 615833 - DNA, 25 bp, Mus musculus
ctgaaaaagatatggaggaactcct

SEQ ID NO: 615834 - DNA, 25 bp, Mus musculus
ctgaaaacaatacccgccaagcaag

SEQ ID NO: 615835 - DNA, 25 bp, Mus musculus
ctgaaaacaatagccgccaagcaag

SEQ ID NO: 615836 - DNA, 25 bp, Mus musculus
ctgaaaaccctcagagaggagtctt

SEQ ID NO: 615837 - DNA, 25 bp, Mus musculus
ctgaaaaccctctgagaggagtctt

SEQ ID NO: 615838 - DNA, 25 bp, Mus musculus
ctgaaaacctctacggcccagatgg

SEQ ID NO: 615839 - DNA, 25 bp, Mus musculus
ctgaaaacctcttcggcccagatgg

SEQ ID NO: 615840 - DNA, 25 bp, Mus musculus
ctgaaaactcggcatgacctggcaa

SEQ ID NO: 615841 - DNA, 25 bp, Mus musculus
ctgaaaactcgggatgacctggcaa

SEQ ID NO: 615842 - DNA, 25 bp, Mus musculus
ctgaaaagaccacaggaggcttggt

SEQ ID NO: 615843 - DNA, 25 bp, Mus musculus
ctgaaaagaccagaggaggcttggt

SEQ ID NO: 615844 - DNA, 25 bp, Mus musculus
ctgaaaagatcacgagaatcgttga

SEQ ID NO: 615845 - DNA, 25 bp, Mus musculus
ctgaaaagatcaggagaatcgttga

SEQ ID NO: 615846 - DNA, 25 bp, Mus musculus
ctgaaaagcaagaatgaggacctca

SEQ ID NO: 615847 - DNA, 25 bp, Mus musculus
ctgaaaagcaagtatgaggacctca

SEQ ID NO: 615848 - DNA, 25 bp, Mus musculus
ctgaaaagccctaggaaaggagaat

SEQ ID NO: 615849 - DNA, 25 bp, Mus musculus
ctgaaaagcccttggaaaggagaat

SEQ ID NO: 615850 - DNA, 25 bp, Mus musculus
ctgaaaaggaggctgggcctctcca

SEQ ID NO: 615851 - DNA, 25 bp, Mus musculus
ctgaaaaggagggtgggcctctcca

SEQ ID NO: 615852 - DNA, 25 bp, Mus musculus
ctgaaaattgagaagaccctgaaag

SEQ ID NO: 615853 - DNA, 25 bp, Mus musculus
ctgaaaattgagtagaccctgaaag

SEQ ID NO: 615854 - DNA, 25 bp, Mus musculus
ctgaaacaggaccactggacctttc

SEQ ID NO: 615855 - DNA, 25 bp, Mus musculus
ctgaaacaggacgactggacctttc

SEQ ID NO: 615856 - DNA, 25 bp, Mus musculus
ctgaaacatccaaagtgctccgtgg

SEQ ID NO: 615857 - DNA, 25 bp, Mus musculus
ctgaaacatccatagtgctccgtgg

SEQ ID NO: 615858 - DNA, 25 bp, Mus musculus
ctgaaaccaaatcaccagatcttgg

SEQ ID NO: 615859 - DNA, 25 bp, Mus musculus
ctgaaaccaaatgaccagatcttgg

SEQ ID NO: 615860 - DNA, 25 bp, Mus musculus
ctgaaaccgaagagggaacagtgca

SEQ ID NO: 615861 - DNA, 25 bp, Mus musculus
ctgaaaccgaagtgggaacagtgca

SEQ ID NO: 615862 - DNA, 25 bp, Mus musculus
ctgaaactaggtccgcctcaggccg

SEQ ID NO: 615863 - DNA, 25 bp, Mus musculus
ctgaaactaggtgcgcctcaggccg

SEQ ID NO: 615864 - DNA, 25 bp, Mus musculus
ctgaaactccagcagttagctgaaa

SEQ ID NO: 615865 - DNA, 25 bp, Mus musculus
ctgaaactccaggagttagctgaaa

SEQ ID NO: 615866 - DNA, 25 bp, Mus musculus
ctgaaactgacacctgtggcatatg

SEQ ID NO: 615867 - DNA, 25 bp, Mus musculus
ctgaaactgacagctgtggcatatg

SEQ ID NO: 615868 - DNA, 25 bp, Mus musculus
ctgaaacttcctctgctgggcccaa

SEQ ID NO: 615869 - DNA, 25 bp, Mus musculus
ctgaaacttcctgtgctgggcccaa

SEQ ID NO: 615870 - DNA, 25 bp, Mus musculus
ctgaaagacctgcttcaggtagaca

SEQ ID NO: 615871 - DNA, 25 bp, Mus musculus
ctgaaagacctggttcaggtagaca

SEQ ID NO: 615872 - DNA, 25 bp, Mus musculus
ctgaaagacgaacctgatgcggatc

SEQ ID NO: 615873 - DNA, 25 bp, Mus musculus
ctgaaagacgaagctgatgcggatc

SEQ ID NO: 615874 - DNA, 25 bp, Mus musculus
ctgaaagagaagaatggagatgtta

SEQ ID NO: 615875 - DNA, 25 bp, Mus musculus
ctgaaagagaagtatggagatgtta

SEQ ID NO: 615876 - DNA, 25 bp, Mus musculus
ctgaaagagctgattgagaaacatg

SEQ ID NO: 615877 - DNA, 25 bp, Mus musculus
ctgaaagagctgtttgagaaacatg

SEQ ID NO: 615878 - DNA, 25 bp, Mus musculus
ctgaaagaggcacggcgtctaacac

SEQ ID NO: 615879 - DNA, 25 bp, Mus musculus
ctgaaagaggcagggcgtctaacac

SEQ ID NO: 615880 - DNA, 25 bp, Mus musculus
ctgaaagagtgactcctgggtcagc

SEQ ID NO: 615881 - DNA, 25 bp, Mus musculus
ctgaaagagtgagtcctgggtcagc

SEQ ID NO: 615882 - DNA, 25 bp, Mus musculus
ctgaaagattctccattcaacagtc

SEQ ID NO: 615883 - DNA, 25 bp, Mus musculus
ctgaaagattctgcattcaacagtc

SEQ ID NO: 615884 - DNA, 25 bp, Mus musculus
ctgaaagcaaagaccgagtggagac

SEQ ID NO: 615885 - DNA, 25 bp, Mus musculus
ctgaaagcaaagtccgagtggagac

SEQ ID NO: 615886 - DNA, 25 bp, Mus musculus
ctgaaagccggtccctggccgtgct

SEQ ID NO: 615887 - DNA, 25 bp, Mus musculus
ctgaaagccggtgcctggccgtgct

SEQ ID NO: 615888 - DNA, 25 bp, Mus musculus
ctgaaagggcaacaacgcgcagact

SEQ ID NO: 615889 - DNA, 25 bp, Mus musculus
ctgaaagggcaagaacgcgcagact

SEQ ID NO: 615890 - DNA, 25 bp, Mus musculus
ctgaaagttcttcttctaatagaca

SEQ ID NO: 615891 - DNA, 25 bp, Mus musculus
ctgaaagttcttgttctaatagaca

SEQ ID NO: 615892 - DNA, 25 bp, Mus musculus
ctgaaatacgaaagcctccctggct

SEQ ID NO: 615893 - DNA, 25 bp, Mus musculus
ctgaaatacgaatgcctccctggct

SEQ ID NO: 615894 - DNA, 25 bp, Mus musculus
ctgaaatatgtgagagcatgcccat

SEQ ID NO: 615895 - DNA, 25 bp, Mus musculus
ctgaaatatgtgtgagcatgcccat

SEQ ID NO: 615896 - DNA, 25 bp, Mus musculus
ctgaaatcaagacggactatgaaag

SEQ ID NO: 615897 - DNA, 25 bp, Mus musculus
ctgaaatcaagagggactatgaaag

SEQ ID NO: 615898 - DNA, 25 bp, Mus musculus
ctgaaatcatgcacaacccaaactt

SEQ ID NO: 615899 - DNA, 25 bp, Mus musculus
ctgaaatcatgctcaacccaaactt

SEQ ID NO: 615900 - DNA, 25 bp, Mus musculus
ctgaaatggctgagttgtactctga

SEQ ID NO: 615901 - DNA, 25 bp, Mus musculus
ctgaaatggctgtgttgtactctga

SEQ ID NO: 615902 - DNA, 25 bp, Mus musculus
ctgaaattgtctacctgggtacggg

SEQ ID NO: 615903 - DNA, 25 bp, Mus musculus
ctgaaattgtcttcctgggtacggg

SEQ ID NO: 615904 - DNA, 25 bp, Mus musculus
ctgaaattgtgtctagcgcccctcc

SEQ ID NO: 615905 - DNA, 25 bp, Mus musculus
ctgaaattgtgtgtagcgcccctcc

SEQ ID NO: 615906 - DNA, 25 bp, Mus musculus
ctgaacaagttactgagcggctgga

SEQ ID NO: 615907 - DNA, 25 bp, Mus musculus
ctgaacaagttagtgagcggctgga

SEQ ID NO: 615908 - DNA, 25 bp, Mus musculus
ctgaacaatgtgcaagtctgcagtg

SEQ ID NO: 615909 - DNA, 25 bp, Mus musculus
ctgaacaatgtggaagtctgcagtg

SEQ ID NO: 615910 - DNA, 25 bp, Mus musculus
ctgaacacactgaacccaaaaccct

SEQ ID NO: 615911 - DNA, 25 bp, Mus musculus
ctgaacacactgtacccaaaaccct

SEQ ID NO: 615912 - DNA, 25 bp, Mus musculus
ctgaacagacgcatccagctggttg

SEQ ID NO: 615913 - DNA, 25 bp, Mus musculus
ctgaacagacgcttccagctggttg

SEQ ID NO: 615914 - DNA, 25 bp, Mus musculus
ctgaacagcaaccacacaggctacg

SEQ ID NO: 615915 - DNA, 25 bp, Mus musculus
ctgaacagcaacgacacaggctacg

SEQ ID NO: 615916 - DNA, 25 bp, Mus musculus
ctgaacatagaaccagaatactttc

SEQ ID NO: 615917 - DNA, 25 bp, Mus musculus
ctgaacatagaagcagaatactttc

SEQ ID NO: 615918 - DNA, 25 bp, Mus musculus
ctgaacatccctccgagaaggttgg

SEQ ID NO: 615919 - DNA, 25 bp, Mus musculus
ctgaacatccctgcgagaaggttgg

SEQ ID NO: 615920 - DNA, 25 bp, Mus musculus
ctgaacatcgagagtcgaatatgtg

SEQ ID NO: 615921 - DNA, 25 bp, Mus musculus
ctgaacatcgagtgtcgaatatgtg

SEQ ID NO: 615922 - DNA, 25 bp, Mus musculus
ctgaaccacaccaagtgccggttag

SEQ ID NO: 615923 - DNA, 25 bp, Mus musculus
ctgaaccacacctagtgccggttag

SEQ ID NO: 615924 - DNA, 25 bp, Mus musculus
ctgaaccatgcacccagtgtccaga

SEQ ID NO: 615925 - DNA, 25 bp, Mus musculus
ctgaaccatgcagccagtgtccaga

SEQ ID NO: 615926 - DNA, 25 bp, Mus musculus
ctgaacccagagatgaaagaaaatt

SEQ ID NO: 615927 - DNA, 25 bp, Mus musculus
ctgaacccagagttgaaagaaaatt

SEQ ID NO: 615928 - DNA, 25 bp, Mus musculus
ctgaaccctctgagactgtggagat

SEQ ID NO: 615929 - DNA, 25 bp, Mus musculus
ctgaaccctctgtgactgtggagat

SEQ ID NO: 615930 - DNA, 25 bp, Mus musculus
ctgaacctcacccagaaaatcaaga

SEQ ID NO: 615931 - DNA, 25 bp, Mus musculus
ctgaacctcaccgagaaaatcaaga

SEQ ID NO: 615932 - DNA, 25 bp, Mus musculus
ctgaacctgtatacgggcgcctggt

SEQ ID NO: 615933 - DNA, 25 bp, Mus musculus
ctgaacctgtattcgggcgcctggt

SEQ ID NO: 615934 - DNA, 25 bp, Mus musculus
ctgaacctttgacccgagagcgatc

SEQ ID NO: 615935 - DNA, 25 bp, Mus musculus
ctgaacctttgagccgagagcgatc

SEQ ID NO: 615936 - DNA, 25 bp, Mus musculus
ctgaacgaagggacggacgcagccc

SEQ ID NO: 615937 - DNA, 25 bp, Mus musculus
ctgaacgaagggtcggacgcagccc

SEQ ID NO: 615938 - DNA, 25 bp, Mus musculus
ctgaacgagatgaaccgcttgggtg

SEQ ID NO: 615939 - DNA, 25 bp, Mus musculus
ctgaacgagatgtaccgcttgggtg

SEQ ID NO: 615940 - DNA, 25 bp, Mus musculus
ctgaacgcaggtaccgcggtatggc

SEQ ID NO: 615941 - DNA, 25 bp, Mus musculus
ctgaacgcaggttccgcggtatggc

SEQ ID NO: 615942 - DNA, 25 bp, Mus musculus
ctgaacgtcccgacctcgtggagag

SEQ ID NO: 615943 - DNA, 25 bp, Mus musculus
ctgaacgtcccgtcctcgtggagag

SEQ ID NO: 615944 - DNA, 25 bp, Mus musculus
ctgaacgtctggaggccgaccgcat

SEQ ID NO: 615945 - DNA, 25 bp, Mus musculus
ctgaacgtctggtggccgaccgcat

SEQ ID NO: 615946 - DNA, 25 bp, Mus musculus
ctgaactcactgactctttgcagca

SEQ ID NO: 615947 - DNA, 25 bp, Mus musculus
ctgaactcactgtctctttgcagca

SEQ ID NO: 615948 - DNA, 25 bp, Mus musculus
ctgaactcagcacctgtgaagggct

SEQ ID NO: 615949 - DNA, 25 bp, Mus musculus
ctgaactcagcagctgtgaagggct

SEQ ID NO: 615950 - DNA, 25 bp, Mus musculus
ctgaactctccacaggcaccgtgat

SEQ ID NO: 615951 - DNA, 25 bp, Mus musculus
ctgaactctccagaggcaccgtgat

SEQ ID NO: 615952 - DNA, 25 bp, Mus musculus
ctgaactgcatgaaagatctggtgg

SEQ ID NO: 615953 - DNA, 25 bp, Mus musculus
ctgaactgcatgtaagatctggtgg

SEQ ID NO: 615954 - DNA, 25 bp, Mus musculus
ctgaactgcttcaatattcttgctg

SEQ ID NO: 615955 - DNA, 25 bp, Mus musculus
ctgaactgcttctatattcttgctg

SEQ ID NO: 615956 - DNA, 25 bp, Mus musculus
ctgaacttcgagcaggttaaatccc

SEQ ID NO: 615957 - DNA, 25 bp, Mus musculus
ctgaacttcgaggaggttaaatccc

SEQ ID NO: 615958 - DNA, 25 bp, Mus musculus
ctgaactttgcccagattggtagca

SEQ ID NO: 615959 - DNA, 25 bp, Mus musculus
ctgaactttgccgagattggtagca

SEQ ID NO: 615960 - DNA, 25 bp, Mus musculus
ctgaagaaaatgaaacgataccaag

SEQ ID NO: 615961 - DNA, 25 bp, Mus musculus
ctgaagaaaatgtaacgataccaag

SEQ ID NO: 615962 - DNA, 25 bp, Mus musculus
ctgaagaaagagcacaccacctttg

SEQ ID NO: 615963 - DNA, 25 bp, Mus musculus
ctgaagaaagaggacaccacctttg

SEQ ID NO: 615964 - DNA, 25 bp, Mus musculus
ctgaagaaagcgatgcccagcaggc

SEQ ID NO: 615965 - DNA, 25 bp, Mus musculus
ctgaagaaagcgttgcccagcaggc

SEQ ID NO: 615966 - DNA, 25 bp, Mus musculus
ctgaagaacatgacgcagcgcatcg

SEQ ID NO: 615967 - DNA, 25 bp, Mus musculus
ctgaagaacatgtcgcagcgcatcg

SEQ ID NO: 615968 - DNA, 25 bp, Mus musculus
ctgaagaaccgtcatgtcatcaccc

SEQ ID NO: 615969 - DNA, 25 bp, Mus musculus
ctgaagaaccgtgatgtcatcaccc

SEQ ID NO: 615970 - DNA, 25 bp, Mus musculus
ctgaagaacgctcaccaactgaaag

SEQ ID NO: 615971 - DNA, 25 bp, Mus musculus
ctgaagaacgctgaccaactgaaag

SEQ ID NO: 615972 - DNA, 25 bp, Mus musculus
ctgaagaactccagctgcggtgggc

SEQ ID NO: 615973 - DNA, 25 bp, Mus musculus
ctgaagaactcctgctgcggtgggc

SEQ ID NO: 615974 - DNA, 25 bp, Mus musculus
ctgaagaactgtcgcctgggctcct

SEQ ID NO: 615975 - DNA, 25 bp, Mus musculus
ctgaagaactgtggcctgggctcct

SEQ ID NO: 615976 - DNA, 25 bp, Mus musculus
ctgaagaagtctacactagagttgt

SEQ ID NO: 615977 - DNA, 25 bp, Mus musculus
ctgaagaagtcttcactagagttgt

SEQ ID NO: 615978 - DNA, 25 bp, Mus musculus
ctgaagaatacgctgatggaatgtg

SEQ ID NO: 615979 - DNA, 25 bp, Mus musculus
ctgaagaatacggtgatggaatgtg

SEQ ID NO: 615980 - DNA, 25 bp, Mus musculus
ctgaagaattctaccgattggaaaa

SEQ ID NO: 615981 - DNA, 25 bp, Mus musculus
ctgaagaattcttccgattggaaaa

SEQ ID NO: 615982 - DNA, 25 bp, Mus musculus
ctgaagacacttcttttgagtttgg

SEQ ID NO: 615983 - DNA, 25 bp, Mus musculus
ctgaagacacttgttttgagtttgg

SEQ ID NO: 615984 - DNA, 25 bp, Mus musculus
ctgaagacagcacggccgcagtctc

SEQ ID NO: 615985 - DNA, 25 bp, Mus musculus
ctgaagacagcagggccgcagtctc

SEQ ID NO: 615986 - DNA, 25 bp, Mus musculus
ctgaagacattactgtggagtggca

SEQ ID NO: 615987 - DNA, 25 bp, Mus musculus
ctgaagacattagtgtggagtggca

SEQ ID NO: 615988 - DNA, 25 bp, Mus musculus
ctgaagaccaagagcaacggtgcag

SEQ ID NO: 615989 - DNA, 25 bp, Mus musculus
ctgaagaccaagtgcaacggtgcag

SEQ ID NO: 615990 - DNA, 25 bp, Mus musculus
ctgaagacgaaaccgggctgaattc

SEQ ID NO: 615991 - DNA, 25 bp, Mus musculus
ctgaagacgaaagcgggctgaattc

SEQ ID NO: 615992 - DNA, 25 bp, Mus musculus
ctgaagacgattcaggaggagaaca

SEQ ID NO: 615993 - DNA, 25 bp, Mus musculus
ctgaagacgattgaggaggagaaca

SEQ ID NO: 615994 - DNA, 25 bp, Mus musculus
ctgaagacgcaaccctacaggttgg

SEQ ID NO: 615995 - DNA, 25 bp, Mus musculus
ctgaagacgcaagcctacaggttgg

SEQ ID NO: 615996 - DNA, 25 bp, Mus musculus
ctgaagactattacacgcggccagt

SEQ ID NO: 615997 - DNA, 25 bp, Mus musculus
ctgaagactatttcacgcggccagt

SEQ ID NO: 615998 - DNA, 25 bp, Mus musculus
ctgaagactgtaatatgcaaagcac

SEQ ID NO: 615999 - DNA, 25 bp, Mus musculus
ctgaagactgtattatgcaaagcac

SEQ ID NO: 616000 - DNA, 25 bp, Mus musculus
ctgaagagaagaagcccacatggca

SEQ ID NO: 616001 - DNA, 25 bp, Mus musculus
ctgaagagaagatgcccacatggca

SEQ ID NO: 616002 - DNA, 25 bp, Mus musculus
ctgaagagagaactaagaaaatgga

SEQ ID NO: 616003 - DNA, 25 bp, Mus musculus
ctgaagagagaagtaagaaaatgga

SEQ ID NO: 616004 - DNA, 25 bp, Mus musculus
ctgaagagaggaaagggaaagccaa

SEQ ID NO: 616005 - DNA, 25 bp, Mus musculus
ctgaagagaggatagggaaagccaa

SEQ ID NO: 616006 - DNA, 25 bp, Mus musculus
ctgaagagcagccagctgacagttt

SEQ ID NO: 616007 - DNA, 25 bp, Mus musculus
ctgaagagcagcgagctgacagttt

SEQ ID NO: 616008 - DNA, 25 bp, Mus musculus
ctgaagagccatctggagtacttga

SEQ ID NO: 616009 - DNA, 25 bp, Mus musculus
ctgaagagccatgtggagtacttga

SEQ ID NO: 616010 - DNA, 25 bp, Mus musculus
ctgaagagccgaatgcctcgcggga

SEQ ID NO: 616011 - DNA, 25 bp, Mus musculus
ctgaagagccgattgcctcgcggga

SEQ ID NO: 616012 - DNA, 25 bp, Mus musculus
ctgaagagctttcaccagttcacct

SEQ ID NO: 616013 - DNA, 25 bp, Mus musculus
ctgaagagctttgaccagttcacct

SEQ ID NO: 616014 - DNA, 25 bp, Mus musculus
ctgaagaggactcgtattgcccggt

SEQ ID NO: 616015 - DNA, 25 bp, Mus musculus
ctgaagaggactggtattgcccggt

SEQ ID NO: 616016 - DNA, 25 bp, Mus musculus
ctgaagaggtagagggatccttgct

SEQ ID NO: 616017 - DNA, 25 bp, Mus musculus
ctgaagaggtagtgggatccttgct

SEQ ID NO: 616018 - DNA, 25 bp, Mus musculus
ctgaagatcagtaccctcagggacc

SEQ ID NO: 616019 - DNA, 25 bp, Mus musculus
ctgaagatcagttccctcagggacc

SEQ ID NO: 616020 - DNA, 25 bp, Mus musculus
ctgaagatgattctccatcgattga

SEQ ID NO: 616021 - DNA, 25 bp, Mus musculus
ctgaagatgattgtccatcgattga

SEQ ID NO: 616022 - DNA, 25 bp, Mus musculus
ctgaagatgctgaccggaagtatga

SEQ ID NO: 616023 - DNA, 25 bp, Mus musculus
ctgaagatgctgtccggaagtatga

SEQ ID NO: 616024 - DNA, 25 bp, Mus musculus
ctgaagatgtccacacgccccattt

SEQ ID NO: 616025 - DNA, 25 bp, Mus musculus
ctgaagatgtcctcacgccccattt

SEQ ID NO: 616026 - DNA, 25 bp, Mus musculus
ctgaagcaattgaccaagtacatcg

SEQ ID NO: 616027 - DNA, 25 bp, Mus musculus
ctgaagcaattgtccaagtacatcg

SEQ ID NO: 616028 - DNA, 25 bp, Mus musculus
ctgaagcaccgcagggagttctggt

SEQ ID NO: 616029 - DNA, 25 bp, Mus musculus
ctgaagcaccgctgggagttctggt

SEQ ID NO: 616030 - DNA, 25 bp, Mus musculus
ctgaagcactgactcctggacgctg

SEQ ID NO: 616031 - DNA, 25 bp, Mus musculus
ctgaagcactgagtcctggacgctg

SEQ ID NO: 616032 - DNA, 25 bp, Mus musculus
ctgaagcagcaacgagacttcctgg

SEQ ID NO: 616033 - DNA, 25 bp, Mus musculus
ctgaagcagcaaggagacttcctgg

SEQ ID NO: 616034 - DNA, 25 bp, Mus musculus
ctgaagcagccactttttgcctgtt

SEQ ID NO: 616035 - DNA, 25 bp, Mus musculus
ctgaagcagccagtttttgcctgtt

SEQ ID NO: 616036 - DNA, 25 bp, Mus musculus
ctgaagcagtcgcagctgttggctt

SEQ ID NO: 616037 - DNA, 25 bp, Mus musculus
ctgaagcagtcggagctgttggctt

SEQ ID NO: 616038 - DNA, 25 bp, Mus musculus
ctgaagcataaactgaagatagggc

SEQ ID NO: 616039 - DNA, 25 bp, Mus musculus
ctgaagcataaagtgaagatagggc

SEQ ID NO: 616040 - DNA, 25 bp, Mus musculus
ctgaagccagagacagtagcccgga

SEQ ID NO: 616041 - DNA, 25 bp, Mus musculus
ctgaagccagagtcagtagcccgga

SEQ ID NO: 616042 - DNA, 25 bp, Mus musculus
ctgaagccattgatcctcgggaaaa

SEQ ID NO: 616043 - DNA, 25 bp, Mus musculus
ctgaagccattgttcctcgggaaaa

SEQ ID NO: 616044 - DNA, 25 bp, Mus musculus
ctgaagccctgcatctaccaggact

SEQ ID NO: 616045 - DNA, 25 bp, Mus musculus
ctgaagccctgcttctaccaggact

SEQ ID NO: 616046 - DNA, 25 bp, Mus musculus
ctgaagccgataccgggatttatta

SEQ ID NO: 616047 - DNA, 25 bp, Mus musculus
ctgaagccgatagcgggatttatta

SEQ ID NO: 616048 - DNA, 25 bp, Mus musculus
ctgaagcctggaactaaaacctagg

SEQ ID NO: 616049 - DNA, 25 bp, Mus musculus
ctgaagcctggatctaaaacctagg

SEQ ID NO: 616050 - DNA, 25 bp, Mus musculus
ctgaagcggtttcatgagccaggtt

SEQ ID NO: 616051 - DNA, 25 bp, Mus musculus
ctgaagcggtttgatgagccaggtt

SEQ ID NO: 616052 - DNA, 25 bp, Mus musculus
ctgaagctacagcagagcagaggct

SEQ ID NO: 616053 - DNA, 25 bp, Mus musculus
ctgaagctacaggagagcagaggct

SEQ ID NO: 616054 - DNA, 25 bp, Mus musculus
ctgaagctcacactgcgctgcctgg

SEQ ID NO: 616055 - DNA, 25 bp, Mus musculus
ctgaagctcacagtgcgctgcctgg

SEQ ID NO: 616056 - DNA, 25 bp, Mus musculus
ctgaagctctggctatcctgtgtcc

SEQ ID NO: 616057 - DNA, 25 bp, Mus musculus
ctgaagctctgggtatcctgtgtcc

SEQ ID NO: 616058 - DNA, 25 bp, Mus musculus
ctgaagctcttccacagcatctgca

SEQ ID NO: 616059 - DNA, 25 bp, Mus musculus
ctgaagctcttcgacagcatctgca

SEQ ID NO: 616060 - DNA, 25 bp, Mus musculus
ctgaagctgacgagcaggaagttgt

SEQ ID NO: 616061 - DNA, 25 bp, Mus musculus
ctgaagctgacgtgcaggaagttgt

SEQ ID NO: 616062 - DNA, 25 bp, Mus musculus
ctgaagctgctgaagggtccttcgt

SEQ ID NO: 616063 - DNA, 25 bp, Mus musculus
ctgaagctgctgtagggtccttcgt

SEQ ID NO: 616064 - DNA, 25 bp, Mus musculus
ctgaagctggaaaacctgagcctga

SEQ ID NO: 616065 - DNA, 25 bp, Mus musculus
ctgaagctggaatacctgagcctga

SEQ ID NO: 616066 - DNA, 25 bp, Mus musculus
ctgaagctggagaacgtcttacttg

SEQ ID NO: 616067 - DNA, 25 bp, Mus musculus
ctgaagctggagtacgtcttacttg

SEQ ID NO: 616068 - DNA, 25 bp, Mus musculus
ctgaagcttaccatataacagcatg

SEQ ID NO: 616069 - DNA, 25 bp, Mus musculus
ctgaagcttaccttataacagcatg

SEQ ID NO: 616070 - DNA, 25 bp, Mus musculus
ctgaaggaacagcacggaggttaca

SEQ ID NO: 616071 - DNA, 25 bp, Mus musculus
ctgaaggaacaggacggaggttaca

SEQ ID NO: 616072 - DNA, 25 bp, Mus musculus
ctgaaggaagggaccaaggaagcac

SEQ ID NO: 616073 - DNA, 25 bp, Mus musculus
ctgaaggaagggtccaaggaagcac

SEQ ID NO: 616074 - DNA, 25 bp, Mus musculus
ctgaaggaagtgaatgtctacatgt

SEQ ID NO: 616075 - DNA, 25 bp, Mus musculus
ctgaaggaagtgtatgtctacatgt

SEQ ID NO: 616076 - DNA, 25 bp, Mus musculus
ctgaaggaatcacagggcttcctgg

SEQ ID NO: 616077 - DNA, 25 bp, Mus musculus
ctgaaggaatcagagggcttcctgg

SEQ ID NO: 616078 - DNA, 25 bp, Mus musculus
ctgaaggacttactgaaagatatga

SEQ ID NO: 616079 - DNA, 25 bp, Mus musculus
ctgaaggacttagtgaaagatatga

SEQ ID NO: 616080 - DNA, 25 bp, Mus musculus
ctgaaggagattcacggcttcgtcc

SEQ ID NO: 616081 - DNA, 25 bp, Mus musculus
ctgaaggagattgacggcttcgtcc

SEQ ID NO: 616082 - DNA, 25 bp, Mus musculus
ctgaaggagcgtctatccctgccct

SEQ ID NO: 616083 - DNA, 25 bp, Mus musculus
ctgaaggagcgtgtatccctgccct

SEQ ID NO: 616084 - DNA, 25 bp, Mus musculus
ctgaaggaggctaggctgcaccctt

SEQ ID NO: 616085 - DNA, 25 bp, Mus musculus
ctgaaggaggcttggctgcaccctt

SEQ ID NO: 616086 - DNA, 25 bp, Mus musculus
ctgaaggaggttacacctgctcctg

SEQ ID NO: 616087 - DNA, 25 bp, Mus musculus
ctgaaggaggtttcacctgctcctg

SEQ ID NO: 616088 - DNA, 25 bp, Mus musculus
ctgaaggatacaaaatctgcagatc

SEQ ID NO: 616089 - DNA, 25 bp, Mus musculus
ctgaaggatacataatctgcagatc

SEQ ID NO: 616090 - DNA, 25 bp, Mus musculus
ctgaaggatacccatctgggctatc

SEQ ID NO: 616091 - DNA, 25 bp, Mus musculus
ctgaaggataccgatctgggctatc

SEQ ID NO: 616092 - DNA, 25 bp, Mus musculus
ctgaaggatgaacgaaatggagact

SEQ ID NO: 616093 - DNA, 25 bp, Mus musculus
ctgaaggatgaaggaaatggagact

SEQ ID NO: 616094 - DNA, 25 bp, Mus musculus
ctgaaggcaaaaagaatgaggaaac

SEQ ID NO: 616095 - DNA, 25 bp, Mus musculus
ctgaaggcaaaatgaatgaggaaac

SEQ ID NO: 616096 - DNA, 25 bp, Mus musculus
ctgaaggctatgcaccaggagatca

SEQ ID NO: 616097 - DNA, 25 bp, Mus musculus
ctgaaggctatggaccaggagatca

SEQ ID NO: 616098 - DNA, 25 bp, Mus musculus
ctgaaggtagagacctaaaggaagc

SEQ ID NO: 616099 - DNA, 25 bp, Mus musculus
ctgaaggtagagtcctaaaggaagc

SEQ ID NO: 616100 - DNA, 25 bp, Mus musculus
ctgaaggtggctcgctacgccgcac

SEQ ID NO: 616101 - DNA, 25 bp, Mus musculus
ctgaaggtggctggctacgccgcac

SEQ ID NO: 616102 - DNA, 25 bp, Mus musculus
ctgaaggtttcaattagaaggtgga

SEQ ID NO: 616103 - DNA, 25 bp, Mus musculus
ctgaaggtttcatttagaaggtgga

SEQ ID NO: 616104 - DNA, 25 bp, Mus musculus
ctgaagtaagaacaaagctgggaga

SEQ ID NO: 616105 - DNA, 25 bp, Mus musculus
ctgaagtaagaagaaagctgggaga

SEQ ID NO: 616106 - DNA, 25 bp, Mus musculus
ctgaagtactggcatgacaaagcac

SEQ ID NO: 616107 - DNA, 25 bp, Mus musculus
ctgaagtactgggatgacaaagcac

SEQ ID NO: 616108 - DNA, 25 bp, Mus musculus
ctgaagtacttgaacaactaagtgg

SEQ ID NO: 616109 - DNA, 25 bp, Mus musculus
ctgaagtacttgtacaactaagtgg

SEQ ID NO: 616110 - DNA, 25 bp, Mus musculus
ctgaagtatcctagtgggacagttg

SEQ ID NO: 616111 - DNA, 25 bp, Mus musculus
ctgaagtatccttgtgggacagttg

SEQ ID NO: 616112 - DNA, 25 bp, Mus musculus
ctgaagtccctacagggtctggctc

SEQ ID NO: 616113 - DNA, 25 bp, Mus musculus
ctgaagtccctagagggtctggctc

SEQ ID NO: 616114 - DNA, 25 bp, Mus musculus
ctgaagtcctgtctggaattggccg

SEQ ID NO: 616115 - DNA, 25 bp, Mus musculus
ctgaagtcctgtgtggaattggccg

SEQ ID NO: 616116 - DNA, 25 bp, Mus musculus
ctgaagtgacagcaggtgtctgaac

SEQ ID NO: 616117 - DNA, 25 bp, Mus musculus
ctgaagtgacaggaggtgtctgaac

SEQ ID NO: 616118 - DNA, 25 bp, Mus musculus
ctgaagtggcatcgtcagacgcgcc

SEQ ID NO: 616119 - DNA, 25 bp, Mus musculus
ctgaagtggcatggtcagacgcgcc

SEQ ID NO: 616120 - DNA, 25 bp, Mus musculus
ctgaagtggtataagggaacatcat

SEQ ID NO: 616121 - DNA, 25 bp, Mus musculus
ctgaagtggtattagggaacatcat

SEQ ID NO: 616122 - DNA, 25 bp, Mus musculus
ctgaagtggttaagcagagggcaca

SEQ ID NO: 616123 - DNA, 25 bp, Mus musculus
ctgaagtggttatgcagagggcaca

SEQ ID NO: 616124 - DNA, 25 bp, Mus musculus
ctgaagtgtctgagtgctgctgaag

SEQ ID NO: 616125 - DNA, 25 bp, Mus musculus
ctgaagtgtctgtgtgctgctgaag

SEQ ID NO: 616126 - DNA, 25 bp, Mus musculus
ctgaagtgtgaaaaaggagctcgta

SEQ ID NO: 616127 - DNA, 25 bp, Mus musculus
ctgaagtgtgaataaggagctcgta

SEQ ID NO: 616128 - DNA, 25 bp, Mus musculus
ctgaagtgtggaaagcactgagacg

SEQ ID NO: 616129 - DNA, 25 bp, Mus musculus
ctgaagtgtggatagcactgagacg

SEQ ID NO: 616130 - DNA, 25 bp, Mus musculus
ctgaagttacggagtgacctgcccc

SEQ ID NO: 616131 - DNA, 25 bp, Mus musculus
ctgaagttacggtgtgacctgcccc

SEQ ID NO: 616132 - DNA, 25 bp, Mus musculus
ctgaagttccatcggatggtgaagc

SEQ ID NO: 616133 - DNA, 25 bp, Mus musculus
ctgaagttccatgggatggtgaagc

SEQ ID NO: 616134 - DNA, 25 bp, Mus musculus
ctgaagttccccacgggcagtgtga

SEQ ID NO: 616135 - DNA, 25 bp, Mus musculus
ctgaagttcccctcgggcagtgtga

SEQ ID NO: 616136 - DNA, 25 bp, Mus musculus
ctgaagttcgtgaaccggagtccct

SEQ ID NO: 616137 - DNA, 25 bp, Mus musculus
ctgaagttcgtgtaccggagtccct

SEQ ID NO: 616138 - DNA, 25 bp, Mus musculus
ctgaagttgatgatttcctgaaaga

SEQ ID NO: 616139 - DNA, 25 bp, Mus musculus
ctgaagttgatgttttcctgaaaga

SEQ ID NO: 616140 - DNA, 25 bp, Mus musculus
ctgaagttgcagatgaacctcccac

SEQ ID NO: 616141 - DNA, 25 bp, Mus musculus
ctgaagttgcagttgaacctcccac

SEQ ID NO: 616142 - DNA, 25 bp, Mus musculus
ctgaagttgcatccggagaaaataa

SEQ ID NO: 616143 - DNA, 25 bp, Mus musculus
ctgaagttgcatgcggagaaaataa

SEQ ID NO: 616144 - DNA, 25 bp, Mus musculus
ctgaagtttcagaaacaggatatga

SEQ ID NO: 616145 - DNA, 25 bp, Mus musculus
ctgaagtttcagtaacaggatatga

SEQ ID NO: 616146 - DNA, 25 bp, Mus musculus
ctgaataaatctaagacgccagcag

SEQ ID NO: 616147 - DNA, 25 bp, Mus musculus
ctgaataaatcttagacgccagcag

SEQ ID NO: 616148 - DNA, 25 bp, Mus musculus
ctgaataaccccattaatgagtact

SEQ ID NO: 616149 - DNA, 25 bp, Mus musculus
ctgaataacccctttaatgagtact

SEQ ID NO: 616150 - DNA, 25 bp, Mus musculus
ctgaataatcccctatttgctggaa

SEQ ID NO: 616151 - DNA, 25 bp, Mus musculus
ctgaataatcccgtatttgctggaa

SEQ ID NO: 616152 - DNA, 25 bp, Mus musculus
ctgaatagtaatcacacaggctacg

SEQ ID NO: 616153 - DNA, 25 bp, Mus musculus
ctgaatagtaatgacacaggctacg

SEQ ID NO: 616154 - DNA, 25 bp, Mus musculus
ctgaatatcttgctgcagagagagc

SEQ ID NO: 616155 - DNA, 25 bp, Mus musculus
ctgaatatcttggtgcagagagagc

SEQ ID NO: 616156 - DNA, 25 bp, Mus musculus
ctgaatatgagacgaacgggagata

SEQ ID NO: 616157 - DNA, 25 bp, Mus musculus
ctgaatatgagacgatgctgactga

SEQ ID NO: 616158 - DNA, 25 bp, Mus musculus
ctgaatatgagaggaacgggagata

SEQ ID NO: 616159 - DNA, 25 bp, Mus musculus
ctgaatatgagaggatgctgactga

SEQ ID NO: 616160 - DNA, 25 bp, Mus musculus
ctgaatcacttgcacagcctcaagg

SEQ ID NO: 616161 - DNA, 25 bp, Mus musculus
ctgaatcacttggacagcctcaagg

SEQ ID NO: 616162 - DNA, 25 bp, Mus musculus
ctgaatcaggttaccaacaacatca

SEQ ID NO: 616163 - DNA, 25 bp, Mus musculus
ctgaatcaggtttccaacaacatca

SEQ ID NO: 616164 - DNA, 25 bp, Mus musculus
ctgaatccatcaatgcagctgcatg

SEQ ID NO: 616165 - DNA, 25 bp, Mus musculus
ctgaatccatcattgcagctgcatg

SEQ ID NO: 616166 - DNA, 25 bp, Mus musculus
ctgaatctctggctgactacatcac

SEQ ID NO: 616167 - DNA, 25 bp, Mus musculus
ctgaatctctgggtgactacatcac

SEQ ID NO: 616168 - DNA, 25 bp, Mus musculus
ctgaatctttctcgccaccaagacg

SEQ ID NO: 616169 - DNA, 25 bp, Mus musculus
ctgaatctttctggccaccaagacg

SEQ ID NO: 616170 - DNA, 25 bp, Mus musculus
ctgaatgagttacgcctggaccctc

SEQ ID NO: 616171 - DNA, 25 bp, Mus musculus
ctgaatgagttaggcctggaccctc

SEQ ID NO: 616172 - DNA, 25 bp, Mus musculus
ctgaatgcccagcaatcagccaaga

SEQ ID NO: 616173 - DNA, 25 bp, Mus musculus
ctgaatgcccaggaatcagccaaga

SEQ ID NO: 616174 - DNA, 25 bp, Mus musculus
ctgaatgcttctcccagggcgtgct

SEQ ID NO: 616175 - DNA, 25 bp, Mus musculus
ctgaatgcttctgccagggcgtgct

SEQ ID NO: 616176 - DNA, 25 bp, Mus musculus
ctgaatggagtgagtgttatatgga

SEQ ID NO: 616177 - DNA, 25 bp, Mus musculus
ctgaatggagtgtgtgttatatgga

SEQ ID NO: 616178 - DNA, 25 bp, Mus musculus
ctgaatggcatcaacctggctctgg

SEQ ID NO: 616179 - DNA, 25 bp, Mus musculus
ctgaatggcatctacctggctctgg

SEQ ID NO: 616180 - DNA, 25 bp, Mus musculus
ctgaatgggattagcgcccaggttc

SEQ ID NO: 616181 - DNA, 25 bp, Mus musculus
ctgaatgggatttgcgcccaggttc

SEQ ID NO: 616182 - DNA, 25 bp, Mus musculus
ctgaattaaaatatatcctgcgaaa

SEQ ID NO: 616183 - DNA, 25 bp, Mus musculus
ctgaattaaaatttatcctgcgaaa

SEQ ID NO: 616184 - DNA, 25 bp, Mus musculus
ctgaattagaagctgttcggttggc

SEQ ID NO: 616185 - DNA, 25 bp, Mus musculus
ctgaattagaaggtgttcggttggc

SEQ ID NO: 616186 - DNA, 25 bp, Mus musculus
ctgaattccggccagtgagcaggac

SEQ ID NO: 616187 - DNA, 25 bp, Mus musculus
ctgaattccggcgagtgagcaggac

SEQ ID NO: 616188 - DNA, 25 bp, Mus musculus
ctgaattgatacaaaagtacagagg

SEQ ID NO: 616189 - DNA, 25 bp, Mus musculus
ctgaattgatactaaagtacagagg

SEQ ID NO: 616190 - DNA, 25 bp, Mus musculus
ctgaattgcatcatcagcagatggc

SEQ ID NO: 616191 - DNA, 25 bp, Mus musculus
ctgaattgcatcttcagcagatggc

SEQ ID NO: 616192 - DNA, 25 bp, Mus musculus
ctgaattgctttccctaaggaagca

SEQ ID NO: 616193 - DNA, 25 bp, Mus musculus
ctgaattgctttgcctaaggaagca

SEQ ID NO: 616194 - DNA, 25 bp, Mus musculus
ctgaattggaggctcagctgcagca

SEQ ID NO: 616195 - DNA, 25 bp, Mus musculus
ctgaattggagggtcagctgcagca

SEQ ID NO: 616196 - DNA, 25 bp, Mus musculus
ctgaattttctcagttcggcatgaa

SEQ ID NO: 616197 - DNA, 25 bp, Mus musculus
ctgaattttctctgttcggcatgaa

SEQ ID NO: 616198 - DNA, 25 bp, Mus musculus
ctgacaaaactgcaaacgatcaatc

SEQ ID NO: 616199 - DNA, 25 bp, Mus musculus
ctgacaaaactggaaacgatcaatc

SEQ ID NO: 616200 - DNA, 25 bp, Mus musculus
ctgacaaagggcacgagccggtgcc

SEQ ID NO: 616201 - DNA, 25 bp, Mus musculus
ctgacaaagggctcgagccggtgcc

SEQ ID NO: 616202 - DNA, 25 bp, Mus musculus
ctgacaaccagacagccaccgtgat

SEQ ID NO: 616203 - DNA, 25 bp, Mus musculus
ctgacaaccagagagccaccgtgat

SEQ ID NO: 616204 - DNA, 25 bp, Mus musculus
ctgacaacggcaccctgggcaagta

SEQ ID NO: 616205 - DNA, 25 bp, Mus musculus
ctgacaacggcagcctgggcaagta

SEQ ID NO: 616206 - DNA, 25 bp, Mus musculus
ctgacaagaggaacttcaccacccg

SEQ ID NO: 616207 - DNA, 25 bp, Mus musculus
ctgacaagaggatcttcaccacccg

SEQ ID NO: 616208 - DNA, 25 bp, Mus musculus
ctgacaagattcagcgggccagggc

SEQ ID NO: 616209 - DNA, 25 bp, Mus musculus
ctgacaagattctgcgggccagggc

SEQ ID NO: 616210 - DNA, 25 bp, Mus musculus
ctgacaaggccgatgagcttctgga

SEQ ID NO: 616211 - DNA, 25 bp, Mus musculus
ctgacaaggccgttgagcttctgga

SEQ ID NO: 616212 - DNA, 25 bp, Mus musculus
ctgacaaggtggatgcagctcaaat

SEQ ID NO: 616213 - DNA, 25 bp, Mus musculus
ctgacaaggtggttgcagctcaaat

SEQ ID NO: 616214 - DNA, 25 bp, Mus musculus
ctgacaagtaaccacggacaggcct

SEQ ID NO: 616215 - DNA, 25 bp, Mus musculus
ctgacaagtaacgacggacaggcct

SEQ ID NO: 616216 - DNA, 25 bp, Mus musculus
ctgacacagaggacagtttctctac

SEQ ID NO: 616217 - DNA, 25 bp, Mus musculus
ctgacacagaggtcagtttctctac

SEQ ID NO: 616218 - DNA, 25 bp, Mus musculus
ctgacacagcccatcgtggtcacaa

SEQ ID NO: 616219 - DNA, 25 bp, Mus musculus
ctgacacagcccttcgtggtcacaa

SEQ ID NO: 616220 - DNA, 25 bp, Mus musculus
ctgacacaggcacgatggcattgaa

SEQ ID NO: 616221 - DNA, 25 bp, Mus musculus
ctgacacaggcaggatggcattgaa

SEQ ID NO: 616222 - DNA, 25 bp, Mus musculus
ctgacacagggaaaaacgtacgggc

SEQ ID NO: 616223 - DNA, 25 bp, Mus musculus
ctgacacagggataaacgtacgggc

SEQ ID NO: 616224 - DNA, 25 bp, Mus musculus
ctgacagaacagaacgatgaaatca

SEQ ID NO: 616225 - DNA, 25 bp, Mus musculus
ctgacagaacagtacgatgaaatca

SEQ ID NO: 616226 - DNA, 25 bp, Mus musculus
ctgacagactttcgactttgcaagg

SEQ ID NO: 616227 - DNA, 25 bp, Mus musculus
ctgacagactttggactttgcaagg

SEQ ID NO: 616228 - DNA, 25 bp, Mus musculus
ctgacagagactcgcgtcgtcagcc

SEQ ID NO: 616229 - DNA, 25 bp, Mus musculus
ctgacagagactggcgtcgtcagcc

SEQ ID NO: 616230 - DNA, 25 bp, Mus musculus
ctgacagagagcagcgtgaacctgg

SEQ ID NO: 616231 - DNA, 25 bp, Mus musculus
ctgacagagagctgcgtgaacctgg

SEQ ID NO: 616232 - DNA, 25 bp, Mus musculus
ctgacagagctgcagatctttgcaa

SEQ ID NO: 616233 - DNA, 25 bp, Mus musculus
ctgacagagctggagatctttgcaa

SEQ ID NO: 616234 - DNA, 25 bp, Mus musculus
ctgacagggagcctgaggccatcct

SEQ ID NO: 616235 - DNA, 25 bp, Mus musculus
ctgacagggagcgtgaggccatcct

SEQ ID NO: 616236 - DNA, 25 bp, Mus musculus
ctgacaggttctcaccagttatgtc

SEQ ID NO: 616237 - DNA, 25 bp, Mus musculus
ctgacaggttctgaccagttatgtc

SEQ ID NO: 616238 - DNA, 25 bp, Mus musculus
ctgacagtcaatagtatgaagttgg

SEQ ID NO: 616239 - DNA, 25 bp, Mus musculus
ctgacagtcaattgtatgaagttgg

SEQ ID NO: 616240 - DNA, 25 bp, Mus musculus
ctgacagtgagacggaccccgaaga

SEQ ID NO: 616241 - DNA, 25 bp, Mus musculus
ctgacagtgagagggaccccgaaga

SEQ ID NO: 616242 - DNA, 25 bp, Mus musculus
ctgacagttcagcacttggctgcct

SEQ ID NO: 616243 - DNA, 25 bp, Mus musculus
ctgacagttcaggacttggctgcct

SEQ ID NO: 616244 - DNA, 25 bp, Mus musculus
ctgacatcaagcactttgggaaatg

SEQ ID NO: 616245 - DNA, 25 bp, Mus musculus
ctgacatcaagctctttgggaaatg

SEQ ID NO: 616246 - DNA, 25 bp, Mus musculus
ctgacatccaagagatccgagtcag

SEQ ID NO: 616247 - DNA, 25 bp, Mus musculus
ctgacatccaagtgatccgagtcag

SEQ ID NO: 616248 - DNA, 25 bp, Mus musculus
ctgacatcttccagcacatctctga

SEQ ID NO: 616249 - DNA, 25 bp, Mus musculus
ctgacatcttcctgcacatctctga

SEQ ID NO: 616250 - DNA, 25 bp, Mus musculus
ctgacatgaggacccctttttgtgg

SEQ ID NO: 616251 - DNA, 25 bp, Mus musculus
ctgacatgaggagccctttttgtgg

SEQ ID NO: 616252 - DNA, 25 bp, Mus musculus
ctgacatgatgtatccgcaaagccg

SEQ ID NO: 616253 - DNA, 25 bp, Mus musculus
ctgacatgatgtttccgcaaagccg

SEQ ID NO: 616254 - DNA, 25 bp, Mus musculus
ctgacattgctgatcaattgctcag

SEQ ID NO: 616255 - DNA, 25 bp, Mus musculus
ctgacattgctgttcaattgctcag

SEQ ID NO: 616256 - DNA, 25 bp, Mus musculus
ctgaccaaagatcgcccaaaagtgt

SEQ ID NO: 616257 - DNA, 25 bp, Mus musculus
ctgaccaaagatggcccaaaagtgt

SEQ ID NO: 616258 - DNA, 25 bp, Mus musculus
ctgaccaagcagctgcttcactgta

SEQ ID NO: 616259 - DNA, 25 bp, Mus musculus
ctgaccaagcaggtgcttcactgta

SEQ ID NO: 616260 - DNA, 25 bp, Mus musculus
ctgaccaagcttactcttgaggaag

SEQ ID NO: 616261 - DNA, 25 bp, Mus musculus
ctgaccaagctttctcttgaggaag

SEQ ID NO: 616262 - DNA, 25 bp, Mus musculus
ctgaccacaaagaaagtagtagact

SEQ ID NO: 616263 - DNA, 25 bp, Mus musculus
ctgaccacaaagtaagtagtagact

SEQ ID NO: 616264 - DNA, 25 bp, Mus musculus
ctgaccacaagtctagcagcccaga

SEQ ID NO: 616265 - DNA, 25 bp, Mus musculus
ctgaccacaagtgtagcagcccaga

SEQ ID NO: 616266 - DNA, 25 bp, Mus musculus
ctgaccacaggcagtggacccagca

SEQ ID NO: 616267 - DNA, 25 bp, Mus musculus
ctgaccacaggctgtggacccagca

SEQ ID NO: 616268 - DNA, 25 bp, Mus musculus
ctgaccagaggactcgatggcagtt

SEQ ID NO: 616269 - DNA, 25 bp, Mus musculus
ctgaccagaggagtcgatggcagtt

SEQ ID NO: 616270 - DNA, 25 bp, Mus musculus
ctgaccatgtccatgctgggatggc

SEQ ID NO: 616271 - DNA, 25 bp, Mus musculus
ctgaccatgtccttgctgggatggc

SEQ ID NO: 616272 - DNA, 25 bp, Mus musculus
ctgacccaagtgacggaccggaagt

SEQ ID NO: 616273 - DNA, 25 bp, Mus musculus
ctgacccaagtgtcggaccggaagt

SEQ ID NO: 616274 - DNA, 25 bp, Mus musculus
ctgacccacatcaatgaggtctggc

SEQ ID NO: 616275 - DNA, 25 bp, Mus musculus
ctgacccacatctatgaggtctggc

SEQ ID NO: 616276 - DNA, 25 bp, Mus musculus
ctgacccagttgaaggctggcgtag

SEQ ID NO: 616277 - DNA, 25 bp, Mus musculus
ctgacccagttgtaggctggcgtag

SEQ ID NO: 616278 - DNA, 25 bp, Mus musculus
ctgacccatggcaatgacgactggg

SEQ ID NO: 616279 - DNA, 25 bp, Mus musculus
ctgacccatggctatgacgactggg

SEQ ID NO: 616280 - DNA, 25 bp, Mus musculus
ctgaccccactgcagcctttgggaa

SEQ ID NO: 616281 - DNA, 25 bp, Mus musculus
ctgaccccactggagcctttgggaa

SEQ ID NO: 616282 - DNA, 25 bp, Mus musculus
ctgaccccagccagcgtagacagtt

SEQ ID NO: 616283 - DNA, 25 bp, Mus musculus
ctgaccccagcctgcgtagacagtt

SEQ ID NO: 616284 - DNA, 25 bp, Mus musculus
ctgaccctcaatctcaagagtgaaa

SEQ ID NO: 616285 - DNA, 25 bp, Mus musculus
ctgaccctcaatgtcaagagtgaaa

SEQ ID NO: 616286 - DNA, 25 bp, Mus musculus
ctgaccctgcgtatttcatggagag

SEQ ID NO: 616287 - DNA, 25 bp, Mus musculus
ctgaccctgcgtttttcatggagag

SEQ ID NO: 616288 - DNA, 25 bp, Mus musculus
ctgaccctgggtccgcctgggagat

SEQ ID NO: 616289 - DNA, 25 bp, Mus musculus
ctgaccctgggtgcgcctgggagat

SEQ ID NO: 616290 - DNA, 25 bp, Mus musculus
ctgaccctgtggagaggcgcccaaa

SEQ ID NO: 616291 - DNA, 25 bp, Mus musculus
ctgaccctgtggtgaggcgcccaaa

SEQ ID NO: 616292 - DNA, 25 bp, Mus musculus
ctgaccgacggaacccacatgaggt

SEQ ID NO: 616293 - DNA, 25 bp, Mus musculus
ctgaccgacggatcccacatgaggt

SEQ ID NO: 616294 - DNA, 25 bp, Mus musculus
ctgaccgaggaaaaggagaccgctt

SEQ ID NO: 616295 - DNA, 25 bp, Mus musculus
ctgaccgaggaataggagaccgctt

SEQ ID NO: 616296 - DNA, 25 bp, Mus musculus
ctgaccgctgagcaaactgtaaaag

SEQ ID NO: 616297 - DNA, 25 bp, Mus musculus
ctgaccgctgaggaaactgtaaaag

SEQ ID NO: 616298 - DNA, 25 bp, Mus musculus
ctgaccggatggcaatcgctaaagg

SEQ ID NO: 616299 - DNA, 25 bp, Mus musculus
ctgaccggatgggaatcgctaaagg

SEQ ID NO: 616300 - DNA, 25 bp, Mus musculus
ctgaccgggaagaaattccaatgag

SEQ ID NO: 616301 - DNA, 25 bp, Mus musculus
ctgaccgggaagtaattccaatgag

SEQ ID NO: 616302 - DNA, 25 bp, Mus musculus
ctgacctaggatccctggccttgga

SEQ ID NO: 616303 - DNA, 25 bp, Mus musculus
ctgacctaggatgcctggccttgga

SEQ ID NO: 616304 - DNA, 25 bp, Mus musculus
ctgacctccaggatcctcgatacag

SEQ ID NO: 616305 - DNA, 25 bp, Mus musculus
ctgacctccaggttcctcgatacag

SEQ ID NO: 616306 - DNA, 25 bp, Mus musculus
ctgacctctttgaccgcagcggcta

SEQ ID NO: 616307 - DNA, 25 bp, Mus musculus
ctgacctctttgtccgcagcggcta

SEQ ID NO: 616308 - DNA, 25 bp, Mus musculus
ctgacctgaggacagtagtgaagct

SEQ ID NO: 616309 - DNA, 25 bp, Mus musculus
ctgacctgaggagagtagtgaagct

SEQ ID NO: 616310 - DNA, 25 bp, Mus musculus
ctgacctggaagaagggcccccgag

SEQ ID NO: 616311 - DNA, 25 bp, Mus musculus
ctgacctggaagtagggcccccgag

SEQ ID NO: 616312 - DNA, 25 bp, Mus musculus
ctgacctggcttactcgggatttct

SEQ ID NO: 616313 - DNA, 25 bp, Mus musculus
ctgacctggctttctcgggatttct

SEQ ID NO: 616314 - DNA, 25 bp, Mus musculus
ctgacctggtggcaccgagtgacag

SEQ ID NO: 616315 - DNA, 25 bp, Mus musculus
ctgacctggtgggaccgagtgacag

SEQ ID NO: 616316 - DNA, 25 bp, Mus musculus
ctgacctgtaataggagtttttcaa

SEQ ID NO: 616317 - DNA, 25 bp, Mus musculus
ctgacctgtaattggagtttttcaa

SEQ ID NO: 616318 - DNA, 25 bp, Mus musculus
ctgaccttcaggcagaatgccaaag

SEQ ID NO: 616319 - DNA, 25 bp, Mus musculus
ctgaccttcagggagaatgccaaag

SEQ ID NO: 616320 - DNA, 25 bp, Mus musculus
ctgacgacaggtctcgagcctggct

SEQ ID NO: 616321 - DNA, 25 bp, Mus musculus
ctgacgacaggtgtcgagcctggct

SEQ ID NO: 616322 - DNA, 25 bp, Mus musculus
ctgacgacgggcatggtccaagctc

SEQ ID NO: 616323 - DNA, 25 bp, Mus musculus
ctgacgacgggcttggtccaagctc

SEQ ID NO: 616324 - DNA, 25 bp, Mus musculus
ctgacgagatatagaagcccgcaaa

SEQ ID NO: 616325 - DNA, 25 bp, Mus musculus
ctgacgagatattgaagcccgcaaa

SEQ ID NO: 616326 - DNA, 25 bp, Mus musculus
ctgacgagtcatacagcacccaggg

SEQ ID NO: 616327 - DNA, 25 bp, Mus musculus
ctgacgagtcattcagcacccaggg

SEQ ID NO: 616328 - DNA, 25 bp, Mus musculus
ctgacgatctgactctcacatctgg

SEQ ID NO: 616329 - DNA, 25 bp, Mus musculus
ctgacgatctgagtctcacatctgg

SEQ ID NO: 616330 - DNA, 25 bp, Mus musculus
ctgacgatgtggatgacatggatga

SEQ ID NO: 616331 - DNA, 25 bp, Mus musculus
ctgacgatgtggttgacatggatga

SEQ ID NO: 616332 - DNA, 25 bp, Mus musculus
ctgacgatttctctagggctctgca

SEQ ID NO: 616333 - DNA, 25 bp, Mus musculus
ctgacgatttctgtagggctctgca

SEQ ID NO: 616334 - DNA, 25 bp, Mus musculus
ctgacgcacagaagaataagcttcg

SEQ ID NO: 616335 - DNA, 25 bp, Mus musculus
ctgacgcacagatgaataagcttcg

SEQ ID NO: 616336 - DNA, 25 bp, Mus musculus
ctgacgccacccatgatgatataaa

SEQ ID NO: 616337 - DNA, 25 bp, Mus musculus
ctgacgccacccttgatgatataaa

SEQ ID NO: 616338 - DNA, 25 bp, Mus musculus
ctgacgcgttctcagtcttcccagg

SEQ ID NO: 616339 - DNA, 25 bp, Mus musculus
ctgacgcgttctgagtcttcccagg

SEQ ID NO: 616340 - DNA, 25 bp, Mus musculus
ctgacggcggcgcagctcaacacag

SEQ ID NO: 616341 - DNA, 25 bp, Mus musculus
ctgacggcggcggagctcaacacag

SEQ ID NO: 616342 - DNA, 25 bp, Mus musculus
ctgacggcggtccaagagtctcctt

SEQ ID NO: 616343 - DNA, 25 bp, Mus musculus
ctgacggcggtcgaagagtctcctt

SEQ ID NO: 616344 - DNA, 25 bp, Mus musculus
ctgacgggcaacactctgagggaag

SEQ ID NO: 616345 - DNA, 25 bp, Mus musculus
ctgacgggcaactctctgagggaag

SEQ ID NO: 616346 - DNA, 25 bp, Mus musculus
ctgacgtcctggcaaagtttgaaaa

SEQ ID NO: 616347 - DNA, 25 bp, Mus musculus
ctgacgtcctgggaaagtttgaaaa

SEQ ID NO: 616348 - DNA, 25 bp, Mus musculus
ctgacgtcgtccaagtctccgctgg

SEQ ID NO: 616349 - DNA, 25 bp, Mus musculus
ctgacgtcgtcctagtctccgctgg

SEQ ID NO: 616350 - DNA, 25 bp, Mus musculus
ctgacgtctaggacctccatgggca

SEQ ID NO: 616351 - DNA, 25 bp, Mus musculus
ctgacgtctaggtcctccatgggca

SEQ ID NO: 616352 - DNA, 25 bp, Mus musculus
ctgacgttcaccctgcatcctggaa

SEQ ID NO: 616353 - DNA, 25 bp, Mus musculus
ctgacgttcaccgtgcatcctggaa

SEQ ID NO: 616354 - DNA, 25 bp, Mus musculus
ctgactacactgagagggccctttc

SEQ ID NO: 616355 - DNA, 25 bp, Mus musculus
ctgactacactgtgagggccctttc

SEQ ID NO: 616356 - DNA, 25 bp, Mus musculus
ctgactatcaaacggcaagggcctg

SEQ ID NO: 616357 - DNA, 25 bp, Mus musculus
ctgactatcaaagggcaagggcctg

SEQ ID NO: 616358 - DNA, 25 bp, Mus musculus
ctgactatctttcagggcaaagagc

SEQ ID NO: 616359 - DNA, 25 bp, Mus musculus
ctgactatctttgagggcaaagagc

SEQ ID NO: 616360 - DNA, 25 bp, Mus musculus
ctgactatgaagaaagaaggcatcc

SEQ ID NO: 616361 - DNA, 25 bp, Mus musculus
ctgactatgaagtaagaaggcatcc

SEQ ID NO: 616362 - DNA, 25 bp, Mus musculus
ctgactatgatgagctctcaggctg

SEQ ID NO: 616363 - DNA, 25 bp, Mus musculus
ctgactatgatgtgctctcaggctg

SEQ ID NO: 616364 - DNA, 25 bp, Mus musculus
ctgactcagacgaggtggaaaacaa

SEQ ID NO: 616365 - DNA, 25 bp, Mus musculus
ctgactcagacgtggtggaaaacaa

SEQ ID NO: 616366 - DNA, 25 bp, Mus musculus
ctgactcagtctcggattgatctaa

SEQ ID NO: 616367 - DNA, 25 bp, Mus musculus
ctgactcagtctgggattgatctaa

SEQ ID NO: 616368 - DNA, 25 bp, Mus musculus
ctgactccaaccaccaaagtttata

SEQ ID NO: 616369 - DNA, 25 bp, Mus musculus
ctgactccaacctccaaagtttata

SEQ ID NO: 616370 - DNA, 25 bp, Mus musculus
ctgactccaagcatatggccccagg

SEQ ID NO: 616371 - DNA, 25 bp, Mus musculus
ctgactccaagcttatggccccagg

SEQ ID NO: 616372 - DNA, 25 bp, Mus musculus
ctgactccatctattggtccctgca

SEQ ID NO: 616373 - DNA, 25 bp, Mus musculus
ctgactccatcttttggtccctgca

SEQ ID NO: 616374 - DNA, 25 bp, Mus musculus
ctgactcctatcacctgctgcgtga

SEQ ID NO: 616375 - DNA, 25 bp, Mus musculus
ctgactcctatctcctgctgcgtga

SEQ ID NO: 616376 - DNA, 25 bp, Mus musculus
ctgactcgaggaccacgggtcctac

SEQ ID NO: 616377 - DNA, 25 bp, Mus musculus
ctgactcgaggagcacgggtcctac

SEQ ID NO: 616378 - DNA, 25 bp, Mus musculus
ctgactcgggatcgccggccagtga

SEQ ID NO: 616379 - DNA, 25 bp, Mus musculus
ctgactcgggatggccggccagtga

SEQ ID NO: 616380 - DNA, 25 bp, Mus musculus
ctgactctagcacagcgctggagtt

SEQ ID NO: 616381 - DNA, 25 bp, Mus musculus
ctgactctagcagagcgctggagtt

SEQ ID NO: 616382 - DNA, 25 bp, Mus musculus
ctgactctccacatttgatctgaac

SEQ ID NO: 616383 - DNA, 25 bp, Mus musculus
ctgactctccacttttgatctgaac

SEQ ID NO: 616384 - DNA, 25 bp, Mus musculus
ctgactctgcagatgctagtgctgg

SEQ ID NO: 616385 - DNA, 25 bp, Mus musculus
ctgactctgcagttgctagtgctgg

SEQ ID NO: 616386 - DNA, 25 bp, Mus musculus
ctgactcttctgcaataccctgaaa

SEQ ID NO: 616387 - DNA, 25 bp, Mus musculus
ctgactcttctggaataccctgaaa

SEQ ID NO: 616388 - DNA, 25 bp, Mus musculus
ctgactcttgacacttgtttttctt

SEQ ID NO: 616389 - DNA, 25 bp, Mus musculus
ctgactcttgactcttgtttttctt

SEQ ID NO: 616390 - DNA, 25 bp, Mus musculus
ctgactgaaagtcaggatgcagacc

SEQ ID NO: 616391 - DNA, 25 bp, Mus musculus
ctgactgaaagtgaggatgcagacc

SEQ ID NO: 616392 - DNA, 25 bp, Mus musculus
ctgactgaactccaactcagatcta

SEQ ID NO: 616393 - DNA, 25 bp, Mus musculus
ctgactgaactcgaactcagatcta

SEQ ID NO: 616394 - DNA, 25 bp, Mus musculus
ctgactgaagagcaacaaattagaa

SEQ ID NO: 616395 - DNA, 25 bp, Mus musculus
ctgactgaagaggaacaaattagaa

SEQ ID NO: 616396 - DNA, 25 bp, Mus musculus
ctgactgaagatactgggatggcac

SEQ ID NO: 616397 - DNA, 25 bp, Mus musculus
ctgactgaagattctgggatggcac

SEQ ID NO: 616398 - DNA, 25 bp, Mus musculus
ctgactgaagctcggatgggtcccc

SEQ ID NO: 616399 - DNA, 25 bp, Mus musculus
ctgactgaagctgggatgggtcccc

SEQ ID NO: 616400 - DNA, 25 bp, Mus musculus
ctgactgactgcacacacgaccttg

SEQ ID NO: 616401 - DNA, 25 bp, Mus musculus
ctgactgactgctcacacgaccttg

SEQ ID NO: 616402 - DNA, 25 bp, Mus musculus
ctgactgagatcatgtccatgggct

SEQ ID NO: 616403 - DNA, 25 bp, Mus musculus
ctgactgagatcttgtccatgggct

SEQ ID NO: 616404 - DNA, 25 bp, Mus musculus
ctgactgagcggagtgtgccctaca

SEQ ID NO: 616405 - DNA, 25 bp, Mus musculus
ctgactgagcggtgtgtgccctaca

SEQ ID NO: 616406 - DNA, 25 bp, Mus musculus
ctgactgagctcagccgggtagaac

SEQ ID NO: 616407 - DNA, 25 bp, Mus musculus
ctgactgagctctgccgggtagaac

SEQ ID NO: 616408 - DNA, 25 bp, Mus musculus
ctgactgcagagctataagaggata

SEQ ID NO: 616409 - DNA, 25 bp, Mus musculus
ctgactgcagaggtataagaggata

SEQ ID NO: 616410 - DNA, 25 bp, Mus musculus
ctgactgcctgcctcgcttcgaggg

SEQ ID NO: 616411 - DNA, 25 bp, Mus musculus
ctgactgcctgcgtcgcttcgaggg

SEQ ID NO: 616412 - DNA, 25 bp, Mus musculus
ctgactgctcagaggtggacgcttg

SEQ ID NO: 616413 - DNA, 25 bp, Mus musculus
ctgactgctcagtggtggacgcttg

SEQ ID NO: 616414 - DNA, 25 bp, Mus musculus
ctgactgctggacactgccttttgc

SEQ ID NO: 616415 - DNA, 25 bp, Mus musculus
ctgactgctggagactgccttttgc

SEQ ID NO: 616416 - DNA, 25 bp, Mus musculus
ctgactgctgtccaccttgtggatt

SEQ ID NO: 616417 - DNA, 25 bp, Mus musculus
ctgactgctgtcgaccttgtggatt

SEQ ID NO: 616418 - DNA, 25 bp, Mus musculus
ctgactggcctcatccgaaacctgt

SEQ ID NO: 616419 - DNA, 25 bp, Mus musculus
ctgactggcctcttccgaaacctgt

SEQ ID NO: 616420 - DNA, 25 bp, Mus musculus
ctgactggcttgagggccatggcat

SEQ ID NO: 616421 - DNA, 25 bp, Mus musculus
ctgactggcttgtgggccatggcat

SEQ ID NO: 616422 - DNA, 25 bp, Mus musculus
ctgactgtgatgagataccagctct

SEQ ID NO: 616423 - DNA, 25 bp, Mus musculus
ctgactgtgatgtgataccagctct

SEQ ID NO: 616424 - DNA, 25 bp, Mus musculus
ctgactgtggccaggccctcagtta

SEQ ID NO: 616425 - DNA, 25 bp, Mus musculus
ctgactgtggcctggccctcagtta

SEQ ID NO: 616426 - DNA, 25 bp, Mus musculus
ctgactgtggttctactggaggctc

SEQ ID NO: 616427 - DNA, 25 bp, Mus musculus
ctgactgtggttgtactggaggctc

SEQ ID NO: 616428 - DNA, 25 bp, Mus musculus
ctgacttaaacccatgaaatacttc

SEQ ID NO: 616429 - DNA, 25 bp, Mus musculus
ctgacttaaaccgatgaaatacttc

SEQ ID NO: 616430 - DNA, 25 bp, Mus musculus
ctgacttcataaaccgcgggctgcc

SEQ ID NO: 616431 - DNA, 25 bp, Mus musculus
ctgacttcataatccgcgggctgcc

SEQ ID NO: 616432 - DNA, 25 bp, Mus musculus
ctgacttgaaggacctgctgcggaa

SEQ ID NO: 616433 - DNA, 25 bp, Mus musculus
ctgacttgaaggtcctgctgcggaa

SEQ ID NO: 616434 - DNA, 25 bp, Mus musculus
ctgacttgaatgcagcaaaaagttg

SEQ ID NO: 616435 - DNA, 25 bp, Mus musculus
ctgacttgaatggagcaaaaagttg

SEQ ID NO: 616436 - DNA, 25 bp, Mus musculus
ctgactttgagtcatggagaatctg

SEQ ID NO: 616437 - DNA, 25 bp, Mus musculus
ctgactttgagtgatggagaatctg

SEQ ID NO: 616438 - DNA, 25 bp, Mus musculus
ctgactttggcgctggaggcctcat

SEQ ID NO: 616439 - DNA, 25 bp, Mus musculus
ctgactttggcggtggaggcctcat

SEQ ID NO: 616440 - DNA, 25 bp, Mus musculus
ctgactttggtcatggcgagggttt

SEQ ID NO: 616441 - DNA, 25 bp, Mus musculus
ctgactttggtcttggcgagggttt

SEQ ID NO: 616442 - DNA, 25 bp, Mus musculus
ctgactttgtgaagttgggtggcat

SEQ ID NO: 616443 - DNA, 25 bp, Mus musculus
ctgactttgtgatgttgggtggcat

SEQ ID NO: 616444 - DNA, 25 bp, Mus musculus
ctgacttttaatccccaccctggag

SEQ ID NO: 616445 - DNA, 25 bp, Mus musculus
ctgacttttaatgcccaccctggag

SEQ ID NO: 616446 - DNA, 25 bp, Mus musculus
ctgactttttgaaggcagggtgtga

SEQ ID NO: 616447 - DNA, 25 bp, Mus musculus
ctgactttttgatggcagggtgtga

SEQ ID NO: 616448 - DNA, 25 bp, Mus musculus
ctgagaaactaacaggcccaatgga

SEQ ID NO: 616449 - DNA, 25 bp, Mus musculus
ctgagaaactaagaggcccaatgga

SEQ ID NO: 616450 - DNA, 25 bp, Mus musculus
ctgagaaataatcgcctcttagatg

SEQ ID NO: 616451 - DNA, 25 bp, Mus musculus
ctgagaaataatggcctcttagatg

SEQ ID NO: 616452 - DNA, 25 bp, Mus musculus
ctgagaaatccaatgcacaactgaa

SEQ ID NO: 616453 - DNA, 25 bp, Mus musculus
ctgagaaatccattgcacaactgaa

SEQ ID NO: 616454 - DNA, 25 bp, Mus musculus
ctgagaacaagtcattaagggtgac

SEQ ID NO: 616455 - DNA, 25 bp, Mus musculus
ctgagaacaagtgattaagggtgac

SEQ ID NO: 616456 - DNA, 25 bp, Mus musculus
ctgagaacttcacggtgagtctgat

SEQ ID NO: 616457 - DNA, 25 bp, Mus musculus
ctgagaacttcagggtgagtctgat

SEQ ID NO: 616458 - DNA, 25 bp, Mus musculus
ctgagaagacggagggtgaggctgg

SEQ ID NO: 616459 - DNA, 25 bp, Mus musculus
ctgagaagacggtgggtgaggctgg

SEQ ID NO: 616460 - DNA, 25 bp, Mus musculus
ctgagaagctataagaatcttggat

SEQ ID NO: 616461 - DNA, 25 bp, Mus musculus
ctgagaagctattagaatcttggat

SEQ ID NO: 616462 - DNA, 25 bp, Mus musculus
ctgagaatatggagagactatgtgc

SEQ ID NO: 616463 - DNA, 25 bp, Mus musculus
ctgagaatatggtgagactatgtgc

SEQ ID NO: 616464 - DNA, 25 bp, Mus musculus
ctgagaatgcagacaagatgggcgc

SEQ ID NO: 616465 - DNA, 25 bp, Mus musculus
ctgagaatgcagtcaagatgggcgc

SEQ ID NO: 616466 - DNA, 25 bp, Mus musculus
ctgagaattaacaagcggatcctgc

SEQ ID NO: 616467 - DNA, 25 bp, Mus musculus
ctgagaattaactagcggatcctgc

SEQ ID NO: 616468 - DNA, 25 bp, Mus musculus
ctgagacaacctcagaggcgaaggc

SEQ ID NO: 616469 - DNA, 25 bp, Mus musculus
ctgagacaacctgagaggcgaaggc

SEQ ID NO: 616470 - DNA, 25 bp, Mus musculus
ctgagacaagctcaaatcgaaaacc

SEQ ID NO: 616471 - DNA, 25 bp, Mus musculus
ctgagacaagctgaaatcgaaaacc

SEQ ID NO: 616472 - DNA, 25 bp, Mus musculus
ctgagacacacacaagggaagtgat

SEQ ID NO: 616473 - DNA, 25 bp, Mus musculus
ctgagacacacagaagggaagtgat

SEQ ID NO: 616474 - DNA, 25 bp, Mus musculus
ctgagacagtcaatacatctgtagg

SEQ ID NO: 616475 - DNA, 25 bp, Mus musculus
ctgagacagtcattacatctgtagg

SEQ ID NO: 616476 - DNA, 25 bp, Mus musculus
ctgagaccaggaaaccgggagagtc

SEQ ID NO: 616477 - DNA, 25 bp, Mus musculus
ctgagaccaggataccgggagagtc

SEQ ID NO: 616478 - DNA, 25 bp, Mus musculus
ctgagaccatttctccttgtagcca

SEQ ID NO: 616479 - DNA, 25 bp, Mus musculus
ctgagaccatttgtccttgtagcca

SEQ ID NO: 616480 - DNA, 25 bp, Mus musculus
ctgagaccgatgcacgcacaggcat

SEQ ID NO: 616481 - DNA, 25 bp, Mus musculus
ctgagaccgatggacgcacaggcat

SEQ ID NO: 616482 - DNA, 25 bp, Mus musculus
ctgagaccgtggaacctgggaaccg

SEQ ID NO: 616483 - DNA, 25 bp, Mus musculus
ctgagaccgtggtacctgggaaccg

SEQ ID NO: 616484 - DNA, 25 bp, Mus musculus
ctgagacctgccacaatatccaggg

SEQ ID NO: 616485 - DNA, 25 bp, Mus musculus
ctgagacctgcctcaatatccaggg

SEQ ID NO: 616486 - DNA, 25 bp, Mus musculus
ctgagaccttcaagtgtgttaccaa

SEQ ID NO: 616487 - DNA, 25 bp, Mus musculus
ctgagaccttcatgtgtgttaccaa

SEQ ID NO: 616488 - DNA, 25 bp, Mus musculus
ctgagacgttatcggccacgcactg

SEQ ID NO: 616489 - DNA, 25 bp, Mus musculus
ctgagacgttatgggccacgcactg

SEQ ID NO: 616490 - DNA, 25 bp, Mus musculus
ctgagactccacaggaaaggaaaga

SEQ ID NO: 616491 - DNA, 25 bp, Mus musculus
ctgagactccactggaaaggaaaga

SEQ ID NO: 616492 - DNA, 25 bp, Mus musculus
ctgagactctaacggtggacattgg

SEQ ID NO: 616493 - DNA, 25 bp, Mus musculus
ctgagactctaagggtggacattgg

SEQ ID NO: 616494 - DNA, 25 bp, Mus musculus
ctgagactgaggagagtctggcaaa

SEQ ID NO: 616495 - DNA, 25 bp, Mus musculus
ctgagactgaggtgagtctggcaaa

SEQ ID NO: 616496 - DNA, 25 bp, Mus musculus
ctgagactgctgagcgaggctaccg

SEQ ID NO: 616497 - DNA, 25 bp, Mus musculus
ctgagactgctgtgcgaggctaccg

SEQ ID NO: 616498 - DNA, 25 bp, Mus musculus
ctgagagacgaacgcatgcccattg

SEQ ID NO: 616499 - DNA, 25 bp, Mus musculus
ctgagagacgaaggcatgcccattg

SEQ ID NO: 616500 - DNA, 25 bp, Mus musculus
ctgagagacgacctggagctgtatt

SEQ ID NO: 616501 - DNA, 25 bp, Mus musculus
ctgagagacgacgtggagctgtatt

SEQ ID NO: 616502 - DNA, 25 bp, Mus musculus
ctgagagagagactactccgcggga

SEQ ID NO: 616503 - DNA, 25 bp, Mus musculus
ctgagagagagagtactccgcggga

SEQ ID NO: 616504 - DNA, 25 bp, Mus musculus
ctgagagagcgacacatagagagct

SEQ ID NO: 616505 - DNA, 25 bp, Mus musculus
ctgagagagcgagacatagagagct

SEQ ID NO: 616506 - DNA, 25 bp, Mus musculus
ctgagagaggccattccaggaagca

SEQ ID NO: 616507 - DNA, 25 bp, Mus musculus
ctgagagaggcctttccaggaagca

SEQ ID NO: 616508 - DNA, 25 bp, Mus musculus
ctgagagaggtacaactgaaaatcg

SEQ ID NO: 616509 - DNA, 25 bp, Mus musculus
ctgagagaggtagaactgaaaatcg

SEQ ID NO: 616510 - DNA, 25 bp, Mus musculus
ctgagagatcatcctgatagtaaca

SEQ ID NO: 616511 - DNA, 25 bp, Mus musculus
ctgagagatcatgctgatagtaaca

SEQ ID NO: 616512 - DNA, 25 bp, Mus musculus
ctgagagatgtcaaaagctacctga

SEQ ID NO: 616513 - DNA, 25 bp, Mus musculus
ctgagagatgtctaaagctacctga

SEQ ID NO: 616514 - DNA, 25 bp, Mus musculus
ctgagagcaagccaacaggcaggca

SEQ ID NO: 616515 - DNA, 25 bp, Mus musculus
ctgagagcaagcgaacaggcaggca

SEQ ID NO: 616516 - DNA, 25 bp, Mus musculus
ctgagagcgcctcgtacacagggaa

SEQ ID NO: 616517 - DNA, 25 bp, Mus musculus
ctgagagcgcctggtacacagggaa

SEQ ID NO: 616518 - DNA, 25 bp, Mus musculus
ctgagaggacatagggaatacctgt

SEQ ID NO: 616519 - DNA, 25 bp, Mus musculus
ctgagaggacattgggaatacctgt

SEQ ID NO: 616520 - DNA, 25 bp, Mus musculus
ctgagaggcagtcggtaaacaaaga

SEQ ID NO: 616521 - DNA, 25 bp, Mus musculus
ctgagaggcagtgggtaaacaaaga

SEQ ID NO: 616522 - DNA, 25 bp, Mus musculus
ctgagaggccgcaagatcagccctc

SEQ ID NO: 616523 - DNA, 25 bp, Mus musculus
ctgagaggccgctagatcagccctc

SEQ ID NO: 616524 - DNA, 25 bp, Mus musculus
ctgagaggtaccagccagctgtact

SEQ ID NO: 616525 - DNA, 25 bp, Mus musculus
ctgagaggtacctgccagctgtact

SEQ ID NO: 616526 - DNA, 25 bp, Mus musculus
ctgagagtggtgaggccttcattcc

SEQ ID NO: 616527 - DNA, 25 bp, Mus musculus
ctgagagtggtgtggccttcattcc

SEQ ID NO: 616528 - DNA, 25 bp, Mus musculus
ctgagatacagcagtgagagtcgga

SEQ ID NO: 616529 - DNA, 25 bp, Mus musculus
ctgagatacagctgtgagagtcgga

SEQ ID NO: 616530 - DNA, 25 bp, Mus musculus
ctgagatacgctctggtgctcaacg

SEQ ID NO: 616531 - DNA, 25 bp, Mus musculus
ctgagatacgctgtggtgctcaacg

SEQ ID NO: 616532 - DNA, 25 bp, Mus musculus
ctgagatcaatgcaaaaaggaagag

SEQ ID NO: 616533 - DNA, 25 bp, Mus musculus
ctgagatcaatggaaaaaggaagag

SEQ ID NO: 616534 - DNA, 25 bp, Mus musculus
ctgagatcactaacactactgaaca

SEQ ID NO: 616535 - DNA, 25 bp, Mus musculus
ctgagatcactatcactactgaaca

SEQ ID NO: 616536 - DNA, 25 bp, Mus musculus
ctgagatcctaacagcagaaggcga

SEQ ID NO: 616537 - DNA, 25 bp, Mus musculus
ctgagatcctaagagcagaaggcga

SEQ ID NO: 616538 - DNA, 25 bp, Mus musculus
ctgagatctggacctggcttcggaa

SEQ ID NO: 616539 - DNA, 25 bp, Mus musculus
ctgagatctggagctggcttcggaa

SEQ ID NO: 616540 - DNA, 25 bp, Mus musculus
ctgagatggcatccgctagtgagcc

SEQ ID NO: 616541 - DNA, 25 bp, Mus musculus
ctgagatggcatgcgctagtgagcc

SEQ ID NO: 616542 - DNA, 25 bp, Mus musculus
ctgagatggtggatgatccggaaac

SEQ ID NO: 616543 - DNA, 25 bp, Mus musculus
ctgagatggtggttgatccggaaac

SEQ ID NO: 616544 - DNA, 25 bp, Mus musculus
ctgagatgtgaaaagaattgtgagg

SEQ ID NO: 616545 - DNA, 25 bp, Mus musculus
ctgagatgtgaatagaattgtgagg

SEQ ID NO: 616546 - DNA, 25 bp, Mus musculus
ctgagattcggaatggcatggccgt

SEQ ID NO: 616547 - DNA, 25 bp, Mus musculus
ctgagattcggattggcatggccgt

SEQ ID NO: 616548 - DNA, 25 bp, Mus musculus
ctgagattgcggacatgggagcaaa

SEQ ID NO: 616549 - DNA, 25 bp, Mus musculus
ctgagattgcggtcatgggagcaaa

SEQ ID NO: 616550 - DNA, 25 bp, Mus musculus
ctgagatttctgctaagtgatgtta

SEQ ID NO: 616551 - DNA, 25 bp, Mus musculus
ctgagatttctggtaagtgatgtta

SEQ ID NO: 616552 - DNA, 25 bp, Mus musculus
ctgagcaagaggaggacctatgctg

SEQ ID NO: 616553 - DNA, 25 bp, Mus musculus
ctgagcaagaggtggacctatgctg

SEQ ID NO: 616554 - DNA, 25 bp, Mus musculus
ctgagcaagcggaggctgataagaa

SEQ ID NO: 616555 - DNA, 25 bp, Mus musculus
ctgagcaagcggtggctgataagaa

SEQ ID NO: 616556 - DNA, 25 bp, Mus musculus
ctgagcacactcaagtctgaagatg

SEQ ID NO: 616557 - DNA, 25 bp, Mus musculus
ctgagcacactctagtctgaagatg

SEQ ID NO: 616558 - DNA, 25 bp, Mus musculus
ctgagcaccatacccactgtgaggg

SEQ ID NO: 616559 - DNA, 25 bp, Mus musculus
ctgagcaccatagccactgtgaggg

SEQ ID NO: 616560 - DNA, 25 bp, Mus musculus
ctgagcacgcagaaagtgtgtgatc

SEQ ID NO: 616561 - DNA, 25 bp, Mus musculus
ctgagcacgcagtaagtgtgtgatc

SEQ ID NO: 616562 - DNA, 25 bp, Mus musculus
ctgagcacgtgcagtacatggcgga

SEQ ID NO: 616563 - DNA, 25 bp, Mus musculus
ctgagcacgtgctgtacatggcgga

SEQ ID NO: 616564 - DNA, 25 bp, Mus musculus
ctgagcacttctacgtggtttactg

SEQ ID NO: 616565 - DNA, 25 bp, Mus musculus
ctgagcacttcttcgtggtttactg

SEQ ID NO: 616566 - DNA, 25 bp, Mus musculus
ctgagcagagccagcagaccttgca

SEQ ID NO: 616567 - DNA, 25 bp, Mus musculus
ctgagcagagcctgcagaccttgca

SEQ ID NO: 616568 - DNA, 25 bp, Mus musculus
ctgagcagcaacattgagcaggtga

SEQ ID NO: 616569 - DNA, 25 bp, Mus musculus
ctgagcagcaactttgagcaggtga

SEQ ID NO: 616570 - DNA, 25 bp, Mus musculus
ctgagcagcaatcactcctgggaac

SEQ ID NO: 616571 - DNA, 25 bp, Mus musculus
ctgagcagcaatgactcctgggaac

SEQ ID NO: 616572 - DNA, 25 bp, Mus musculus
ctgagcaggtgcagtgagatcactc

SEQ ID NO: 616573 - DNA, 25 bp, Mus musculus
ctgagcaggtgctgtgagatcactc

SEQ ID NO: 616574 - DNA, 25 bp, Mus musculus
ctgagcagtaacacccagagcagct

SEQ ID NO: 616575 - DNA, 25 bp, Mus musculus
ctgagcagtaactcccagagcagct

SEQ ID NO: 616576 - DNA, 25 bp, Mus musculus
ctgagcagtccaccgttggtaccca

SEQ ID NO: 616577 - DNA, 25 bp, Mus musculus
ctgagcagtccagcgttggtaccca

SEQ ID NO: 616578 - DNA, 25 bp, Mus musculus
ctgagcagtcttctccagtattgta

SEQ ID NO: 616579 - DNA, 25 bp, Mus musculus
ctgagcagtcttgtccagtattgta

SEQ ID NO: 616580 - DNA, 25 bp, Mus musculus
ctgagcagtggcatactgaacgtgc

SEQ ID NO: 616581 - DNA, 25 bp, Mus musculus
ctgagcagtggcttactgaacgtgc

SEQ ID NO: 616582 - DNA, 25 bp, Mus musculus
ctgagcagttagagctggagcgcat

SEQ ID NO: 616583 - DNA, 25 bp, Mus musculus
ctgagcagttagtgctggagcgcat

SEQ ID NO: 616584 - DNA, 25 bp, Mus musculus
ctgagccaccttacatccaagagct

SEQ ID NO: 616585 - DNA, 25 bp, Mus musculus
ctgagccacctttcatccaagagct

SEQ ID NO: 616586 - DNA, 25 bp, Mus musculus
ctgagccacgcaactaagacctgtc

SEQ ID NO: 616587 - DNA, 25 bp, Mus musculus
ctgagccacgcacggcagaaggcaa

SEQ ID NO: 616588 - DNA, 25 bp, Mus musculus
ctgagccacgcagggcagaaggcaa

SEQ ID NO: 616589 - DNA, 25 bp, Mus musculus
ctgagccacgcatctaagacctgtc

SEQ ID NO: 616590 - DNA, 25 bp, Mus musculus
ctgagccacggtctgttcgccgagc

SEQ ID NO: 616591 - DNA, 25 bp, Mus musculus
ctgagccacggtgtgttcgccgagc

SEQ ID NO: 616592 - DNA, 25 bp, Mus musculus
ctgagccactaaaaactgggaccct

SEQ ID NO: 616593 - DNA, 25 bp, Mus musculus
ctgagccactaataactgggaccct

SEQ ID NO: 616594 - DNA, 25 bp, Mus musculus
ctgagccaggctcaaactcccagaa

SEQ ID NO: 616595 - DNA, 25 bp, Mus musculus
ctgagccaggctgaaactcccagaa

SEQ ID NO: 616596 - DNA, 25 bp, Mus musculus
ctgagccagggcagcaaggacatcg

SEQ ID NO: 616597 - DNA, 25 bp, Mus musculus
ctgagccagggctgcaaggacatcg

SEQ ID NO: 616598 - DNA, 25 bp, Mus musculus
ctgagccagtttctgagcctttctc

SEQ ID NO: 616599 - DNA, 25 bp, Mus musculus
ctgagccagtttgtgagcctttctc

SEQ ID NO: 616600 - DNA, 25 bp, Mus musculus
ctgagccattcgcaggccaccatga

SEQ ID NO: 616601 - DNA, 25 bp, Mus musculus
ctgagccattcggaggccaccatga

SEQ ID NO: 616602 - DNA, 25 bp, Mus musculus
ctgagcccagctacaatgccgggac

SEQ ID NO: 616603 - DNA, 25 bp, Mus musculus
ctgagcccagcttcaatgccgggac

SEQ ID NO: 616604 - DNA, 25 bp, Mus musculus
ctgagcccaggtcatgtgatgcttc

SEQ ID NO: 616605 - DNA, 25 bp, Mus musculus
ctgagcccaggtgatgtgatgcttc

SEQ ID NO: 616606 - DNA, 25 bp, Mus musculus
ctgagccccaataaccatgaggtgc

SEQ ID NO: 616607 - DNA, 25 bp, Mus musculus
ctgagccccaattaccatgaggtgc

SEQ ID NO: 616608 - DNA, 25 bp, Mus musculus
ctgagcccgttcaaagggtccaggg

SEQ ID NO: 616609 - DNA, 25 bp, Mus musculus
ctgagcccgttctaagggtccaggg

SEQ ID NO: 616610 - DNA, 25 bp, Mus musculus
ctgagccggcagcacctggagaaat

SEQ ID NO: 616611 - DNA, 25 bp, Mus musculus
ctgagccggcaggacctggagaaat

SEQ ID NO: 616612 - DNA, 25 bp, Mus musculus
ctgagcctcctcagcctgttgcaga

SEQ ID NO: 616613 - DNA, 25 bp, Mus musculus
ctgagcctcctctgcctgttgcaga

SEQ ID NO: 616614 - DNA, 25 bp, Mus musculus
ctgagcctgctgcacaactacctga

SEQ ID NO: 616615 - DNA, 25 bp, Mus musculus
ctgagcctgctggacaactacctga

SEQ ID NO: 616616 - DNA, 25 bp, Mus musculus
ctgagcgactggacctcagcgccgg

SEQ ID NO: 616617 - DNA, 25 bp, Mus musculus
ctgagcgactggtcctcagcgccgg

SEQ ID NO: 616618 - DNA, 25 bp, Mus musculus
ctgagcgagcagaccttggtggaaa

SEQ ID NO: 616619 - DNA, 25 bp, Mus musculus
ctgagcgagcagtccttggtggaaa

SEQ ID NO: 616620 - DNA, 25 bp, Mus musculus
ctgagcgagtggacagcaccacctt

SEQ ID NO: 616621 - DNA, 25 bp, Mus musculus
ctgagcgagtggtcagcaccacctt

SEQ ID NO: 616622 - DNA, 25 bp, Mus musculus
ctgagcgccctgagctgccggcatg

SEQ ID NO: 616623 - DNA, 25 bp, Mus musculus
ctgagcgccctgtgctgccggcatg

SEQ ID NO: 616624 - DNA, 25 bp, Mus musculus
ctgagcggagcgaccccattcctgg

SEQ ID NO: 616625 - DNA, 25 bp, Mus musculus
ctgagcggagcgtccccattcctgg

SEQ ID NO: 616626 - DNA, 25 bp, Mus musculus
ctgagcggatgaagcttaaggctga

SEQ ID NO: 616627 - DNA, 25 bp, Mus musculus
ctgagcggatgatgcttaaggctga

SEQ ID NO: 616628 - DNA, 25 bp, Mus musculus
ctgagcggctccatgccatcagaga

SEQ ID NO: 616629 - DNA, 25 bp, Mus musculus
ctgagcggctccttgccatcagaga

SEQ ID NO: 616630 - DNA, 25 bp, Mus musculus
ctgagcgggctcacctggcaacaca

SEQ ID NO: 616631 - DNA, 25 bp, Mus musculus
ctgagcgggctctcctggcaacaca

SEQ ID NO: 616632 - DNA, 25 bp, Mus musculus
ctgagcgtggcccactataccaggg

SEQ ID NO: 616633 - DNA, 25 bp, Mus musculus
ctgagcgtggccgactataccaggg

SEQ ID NO: 616634 - DNA, 25 bp, Mus musculus
ctgagcgtgggcaaggtcctcatcg

SEQ ID NO: 616635 - DNA, 25 bp, Mus musculus
ctgagcgtgggctaggtcctcatcg

SEQ ID NO: 616636 - DNA, 25 bp, Mus musculus
ctgagctaacctcgtgtggtggcta

SEQ ID NO: 616637 - DNA, 25 bp, Mus musculus
ctgagctaacctggtgtggtggcta

SEQ ID NO: 616638 - DNA, 25 bp, Mus musculus
ctgagctacaacagagggaggtgac

SEQ ID NO: 616639 - DNA, 25 bp, Mus musculus
ctgagctacaactgagggaggtgac

SEQ ID NO: 616640 - DNA, 25 bp, Mus musculus
ctgagctacagtcaccgccaggaag

SEQ ID NO: 616641 - DNA, 25 bp, Mus musculus
ctgagctacagtgaccgccaggaag

SEQ ID NO: 616642 - DNA, 25 bp, Mus musculus
ctgagctactgaagatgttcggtat

SEQ ID NO: 616643 - DNA, 25 bp, Mus musculus
ctgagctactgatgatgttcggtat

SEQ ID NO: 616644 - DNA, 25 bp, Mus musculus
ctgagctccaggctatcccaggcag

SEQ ID NO: 616645 - DNA, 25 bp, Mus musculus
ctgagctccagggtatcccaggcag

SEQ ID NO: 616646 - DNA, 25 bp, Mus musculus
ctgagctccatgagggacgagaagc

SEQ ID NO: 616647 - DNA, 25 bp, Mus musculus
ctgagctccatgtgggacgagaagc

SEQ ID NO: 616648 - DNA, 25 bp, Mus musculus
ctgagctcctatagctcaccgctgg

SEQ ID NO: 616649 - DNA, 25 bp, Mus musculus
ctgagctcctattgctcaccgctgg

SEQ ID NO: 616650 - DNA, 25 bp, Mus musculus
ctgagctctactccggcctctgtgg

SEQ ID NO: 616651 - DNA, 25 bp, Mus musculus
ctgagctctactgcggcctctgtgg

SEQ ID NO: 616652 - DNA, 25 bp, Mus musculus
ctgagctctgtgagagcccagggat

SEQ ID NO: 616653 - DNA, 25 bp, Mus musculus
ctgagctctgtgtgagcccagggat

SEQ ID NO: 616654 - DNA, 25 bp, Mus musculus
ctgagctgagtgactgccagggccc

SEQ ID NO: 616655 - DNA, 25 bp, Mus musculus
ctgagctgagtgtctgccagggccc

SEQ ID NO: 616656 - DNA, 25 bp, Mus musculus
ctgagctgctgtcgcgtgcagaact

SEQ ID NO: 616657 - DNA, 25 bp, Mus musculus
ctgagctgctgtggcgtgcagaact

SEQ ID NO: 616658 - DNA, 25 bp, Mus musculus
ctgagctggcgtcggactctcctat

SEQ ID NO: 616659 - DNA, 25 bp, Mus musculus
ctgagctggcgtgggactctcctat

SEQ ID NO: 616660 - DNA, 25 bp, Mus musculus
ctgagctgtcagaaagcgcctttgg

SEQ ID NO: 616661 - DNA, 25 bp, Mus musculus
ctgagctgtcagctcgattgcggca

SEQ ID NO: 616662 - DNA, 25 bp, Mus musculus
ctgagctgtcaggtcgattgcggca

SEQ ID NO: 616663 - DNA, 25 bp, Mus musculus
ctgagctgtcagtaagcgcctttgg

SEQ ID NO: 616664 - DNA, 25 bp, Mus musculus
ctgagctgtcctactacagcagctg

SEQ ID NO: 616665 - DNA, 25 bp, Mus musculus
ctgagctgtccttctacagcagctg

SEQ ID NO: 616666 - DNA, 25 bp, Mus musculus
ctgagctgttctccaacaaacccta

SEQ ID NO: 616667 - DNA, 25 bp, Mus musculus
ctgagctgttctgcaacaaacccta

SEQ ID NO: 616668 - DNA, 25 bp, Mus musculus
ctgagctgttgaccggaagaacgtt

SEQ ID NO: 616669 - DNA, 25 bp, Mus musculus
ctgagctgttgagcggaagaacgtt

SEQ ID NO: 616670 - DNA, 25 bp, Mus musculus
ctgagctgtttgcagaagtgcctga

SEQ ID NO: 616671 - DNA, 25 bp, Mus musculus
ctgagctgtttggagaagtgcctga

SEQ ID NO: 616672 - DNA, 25 bp, Mus musculus
ctgagcttcgcaaggatgacttcaa

SEQ ID NO: 616673 - DNA, 25 bp, Mus musculus
ctgagcttcgcatggatgacttcaa

SEQ ID NO: 616674 - DNA, 25 bp, Mus musculus
ctgagcttgctgaggagtgtacagt

SEQ ID NO: 616675 - DNA, 25 bp, Mus musculus
ctgagcttgctgtggagtgtacagt

SEQ ID NO: 616676 - DNA, 25 bp, Mus musculus
ctgagcttgttgctggcatttctgg

SEQ ID NO: 616677 - DNA, 25 bp, Mus musculus
ctgagcttgttggtggcatttctgg

SEQ ID NO: 616678 - DNA, 25 bp, Mus musculus
ctgaggaaacgtctgaagcttgaag

SEQ ID NO: 616679 - DNA, 25 bp, Mus musculus
ctgaggaaacgtgtgaagcttgaag

SEQ ID NO: 616680 - DNA, 25 bp, Mus musculus
ctgaggaaactgaaaaagctatgct

SEQ ID NO: 616681 - DNA, 25 bp, Mus musculus
ctgaggaaactgtaaaagctatgct

SEQ ID NO: 616682 - DNA, 25 bp, Mus musculus
ctgaggaaccggaagctgttctgtg

SEQ ID NO: 616683 - DNA, 25 bp, Mus musculus
ctgaggaaccggtagctgttctgtg

SEQ ID NO: 616684 - DNA, 25 bp, Mus musculus
ctgaggaagaagatatggagatcac

SEQ ID NO: 616685 - DNA, 25 bp, Mus musculus
ctgaggaagaagttatggagatcac

SEQ ID NO: 616686 - DNA, 25 bp, Mus musculus
ctgaggaagctaatcccaatatcac

SEQ ID NO: 616687 - DNA, 25 bp, Mus musculus
ctgaggaagctattcccaatatcac

SEQ ID NO: 616688 - DNA, 25 bp, Mus musculus
ctgaggaaggtgacattcaagttaa

SEQ ID NO: 616689 - DNA, 25 bp, Mus musculus
ctgaggaaggtgtcattcaagttaa

SEQ ID NO: 616690 - DNA, 25 bp, Mus musculus
ctgaggaattggaccagggcatcga

SEQ ID NO: 616691 - DNA, 25 bp, Mus musculus
ctgaggaattggtccagggcatcga

SEQ ID NO: 616692 - DNA, 25 bp, Mus musculus
ctgaggacatgaccctatcagctgg

SEQ ID NO: 616693 - DNA, 25 bp, Mus musculus
ctgaggacatgagcctatcagctgg

SEQ ID NO: 616694 - DNA, 25 bp, Mus musculus
ctgaggacgccgcagcagaatgtac

SEQ ID NO: 616695 - DNA, 25 bp, Mus musculus
ctgaggacgccggagcagaatgtac

SEQ ID NO: 616696 - DNA, 25 bp, Mus musculus
ctgaggactgcacgctaatgcttga

SEQ ID NO: 616697 - DNA, 25 bp, Mus musculus
ctgaggactgcaggctaatgcttga

SEQ ID NO: 616698 - DNA, 25 bp, Mus musculus
ctgaggactggcacgtggagtcttt

SEQ ID NO: 616699 - DNA, 25 bp, Mus musculus
ctgaggactggctcgtggagtcttt

SEQ ID NO: 616700 - DNA, 25 bp, Mus musculus
ctgaggacttgcaagcgccgcggat

SEQ ID NO: 616701 - DNA, 25 bp, Mus musculus
ctgaggacttgctagcgccgcggat

SEQ ID NO: 616702 - DNA, 25 bp, Mus musculus
ctgaggagaatcagttgttggtgct

SEQ ID NO: 616703 - DNA, 25 bp, Mus musculus
ctgaggagaatctgttgttggtgct

SEQ ID NO: 616704 - DNA, 25 bp, Mus musculus
ctgaggagacagcttgggttctaca

SEQ ID NO: 616705 - DNA, 25 bp, Mus musculus
ctgaggagacaggttgggttctaca

SEQ ID NO: 616706 - DNA, 25 bp, Mus musculus
ctgaggagaccaaaaagcttctgaa

SEQ ID NO: 616707 - DNA, 25 bp, Mus musculus
ctgaggagaccataaagcttctgaa

SEQ ID NO: 616708 - DNA, 25 bp, Mus musculus
ctgaggagatccctcgaatcaacca

SEQ ID NO: 616709 - DNA, 25 bp, Mus musculus
ctgaggagatccgtcgaatcaacca

SEQ ID NO: 616710 - DNA, 25 bp, Mus musculus
ctgaggagcccactaggagtgtacc

SEQ ID NO: 616711 - DNA, 25 bp, Mus musculus
ctgaggagcccagtaggagtgtacc

SEQ ID NO: 616712 - DNA, 25 bp, Mus musculus
ctgaggagcctgaattcagggccaa

SEQ ID NO: 616713 - DNA, 25 bp, Mus musculus
ctgaggagcctgtattcagggccaa

SEQ ID NO: 616714 - DNA, 25 bp, Mus musculus
ctgaggaggctgagcgtcaacgcca

SEQ ID NO: 616715 - DNA, 25 bp, Mus musculus
ctgaggaggctgtgcgtcaacgcca

SEQ ID NO: 616716 - DNA, 25 bp, Mus musculus
ctgaggagtcatcacccagcctggg

SEQ ID NO: 616717 - DNA, 25 bp, Mus musculus
ctgaggagtcatgacccagcctggg

SEQ ID NO: 616718 - DNA, 25 bp, Mus musculus
ctgaggatattcaaatgggtgcctg

SEQ ID NO: 616719 - DNA, 25 bp, Mus musculus
ctgaggatattctaatgggtgcctg

SEQ ID NO: 616720 - DNA, 25 bp, Mus musculus
ctgaggatcaagcactagtactgac

SEQ ID NO: 616721 - DNA, 25 bp, Mus musculus
ctgaggatcaaggactagtactgac

SEQ ID NO: 616722 - DNA, 25 bp, Mus musculus
ctgaggatgagtaaagctcttctac

SEQ ID NO: 616723 - DNA, 25 bp, Mus musculus
ctgaggatgagttaagctcttctac

SEQ ID NO: 616724 - DNA, 25 bp, Mus musculus
ctgaggatgcagacactgggcaaga

SEQ ID NO: 616725 - DNA, 25 bp, Mus musculus
ctgaggatgcagtcactgggcaaga

SEQ ID NO: 616726 - DNA, 25 bp, Mus musculus
ctgaggatgtgaaggactttctgga

SEQ ID NO: 616727 - DNA, 25 bp, Mus musculus
ctgaggatgtgatggactttctgga

SEQ ID NO: 616728 - DNA, 25 bp, Mus musculus
ctgaggattacgacagtgtggctgc

SEQ ID NO: 616729 - DNA, 25 bp, Mus musculus
ctgaggattacgtcagtgtggctgc

SEQ ID NO: 616730 - DNA, 25 bp, Mus musculus
ctgaggatttccatggagctggaca

SEQ ID NO: 616731 - DNA, 25 bp, Mus musculus
ctgaggatttccttggagctggaca

SEQ ID NO: 616732 - DNA, 25 bp, Mus musculus
ctgaggcaaaagctgtggcttccgc

SEQ ID NO: 616733 - DNA, 25 bp, Mus musculus
ctgaggcaaaaggtgtggcttccgc

SEQ ID NO: 616734 - DNA, 25 bp, Mus musculus
ctgaggcacagcaactgagcaagga

SEQ ID NO: 616735 - DNA, 25 bp, Mus musculus
ctgaggcacagctactgagcaagga

SEQ ID NO: 616736 - DNA, 25 bp, Mus musculus
ctgaggcactaacgttgcaagggca

SEQ ID NO: 616737 - DNA, 25 bp, Mus musculus
ctgaggcactaaggttgcaagggca

SEQ ID NO: 616738 - DNA, 25 bp, Mus musculus
ctgaggcagccaacaaactgcccaa

SEQ ID NO: 616739 - DNA, 25 bp, Mus musculus
ctgaggcagccatcaaactgcccaa

SEQ ID NO: 616740 - DNA, 25 bp, Mus musculus
ctgaggcagtttcacctggcctggc

SEQ ID NO: 616741 - DNA, 25 bp, Mus musculus
ctgaggcagtttgacctggcctggc

SEQ ID NO: 616742 - DNA, 25 bp, Mus musculus
ctgaggcatggcaccatctctgtga

SEQ ID NO: 616743 - DNA, 25 bp, Mus musculus
ctgaggcatggctccatctctgtga

SEQ ID NO: 616744 - DNA, 25 bp, Mus musculus
ctgaggccagatacacagatatcat

SEQ ID NO: 616745 - DNA, 25 bp, Mus musculus
ctgaggccagattcacagatatcat

SEQ ID NO: 616746 - DNA, 25 bp, Mus musculus
ctgaggcccatcaacggacgtggca

SEQ ID NO: 616747 - DNA, 25 bp, Mus musculus
ctgaggcccatctacggacgtggca

SEQ ID NO: 616748 - DNA, 25 bp, Mus musculus
ctgaggccctgacgatttccttgga

SEQ ID NO: 616749 - DNA, 25 bp, Mus musculus
ctgaggccctgaggatttccttgga

SEQ ID NO: 616750 - DNA, 25 bp, Mus musculus
ctgaggccgctgcttccatcttctg

SEQ ID NO: 616751 - DNA, 25 bp, Mus musculus
ctgaggccgctggttccatcttctg

SEQ ID NO: 616752 - DNA, 25 bp, Mus musculus
ctgaggccgcttacgcgtcgcgctt

SEQ ID NO: 616753 - DNA, 25 bp, Mus musculus
ctgaggccgctttcgcgtcgcgctt

SEQ ID NO: 616754 - DNA, 25 bp, Mus musculus
ctgaggccgggaattgctcccgacc

SEQ ID NO: 616755 - DNA, 25 bp, Mus musculus
ctgaggccgggatttgctcccgacc

SEQ ID NO: 616756 - DNA, 25 bp, Mus musculus
ctgaggcctagcacagggccccgtg

SEQ ID NO: 616757 - DNA, 25 bp, Mus musculus
ctgaggcctagctcagggccccgtg

SEQ ID NO: 616758 - DNA, 25 bp, Mus musculus
ctgaggccttggagctccccagttt

SEQ ID NO: 616759 - DNA, 25 bp, Mus musculus
ctgaggccttggtgctccccagttt

SEQ ID NO: 616760 - DNA, 25 bp, Mus musculus
ctgaggcgctgcaccaggccaggct

SEQ ID NO: 616761 - DNA, 25 bp, Mus musculus
ctgaggcgctgctccaggccaggct

SEQ ID NO: 616762 - DNA, 25 bp, Mus musculus
ctgaggcggaacaggccaggcacca

SEQ ID NO: 616763 - DNA, 25 bp, Mus musculus
ctgaggcggaactggccaggcacca

SEQ ID NO: 616764 - DNA, 25 bp, Mus musculus
ctgaggctcactccaagccggtggc

SEQ ID NO: 616765 - DNA, 25 bp, Mus musculus
ctgaggctcactgcaagccggtggc

SEQ ID NO: 616766 - DNA, 25 bp, Mus musculus
ctgaggctctacattgatgatgcgg

SEQ ID NO: 616767 - DNA, 25 bp, Mus musculus
ctgaggctctactttgatgatgcgg

SEQ ID NO: 616768 - DNA, 25 bp, Mus musculus
ctgaggctgctacccgtcacaaggt

SEQ ID NO: 616769 - DNA, 25 bp, Mus musculus
ctgaggctgctagccgtcacaaggt

SEQ ID NO: 616770 - DNA, 25 bp, Mus musculus
ctgaggctggtcctgtgaaccttga

SEQ ID NO: 616771 - DNA, 25 bp, Mus musculus
ctgaggctggtcgtgtgaaccttga

SEQ ID NO: 616772 - DNA, 25 bp, Mus musculus
ctgaggcttgtgaacatagtgtatt

SEQ ID NO: 616773 - DNA, 25 bp, Mus musculus
ctgaggcttgtgtacatagtgtatt

SEQ ID NO: 616774 - DNA, 25 bp, Mus musculus
ctgagggaaaccaccaggcaggatg

SEQ ID NO: 616775 - DNA, 25 bp, Mus musculus
ctgagggaaacctccaggcaggatg

SEQ ID NO: 616776 - DNA, 25 bp, Mus musculus
ctgagggaccacagcgctccatcgg

SEQ ID NO: 616777 - DNA, 25 bp, Mus musculus
ctgagggaccactgcgctccatcgg

SEQ ID NO: 616778 - DNA, 25 bp, Mus musculus
ctgagggagcttagccgtatagtga

SEQ ID NO: 616779 - DNA, 25 bp, Mus musculus
ctgagggagctttgccgtatagtga

SEQ ID NO: 616780 - DNA, 25 bp, Mus musculus
ctgagggccagcctatcaagagcag

SEQ ID NO: 616781 - DNA, 25 bp, Mus musculus
ctgagggccagcgtatcaagagcag

SEQ ID NO: 616782 - DNA, 25 bp, Mus musculus
ctgagggccagtcctgtgagtccaa

SEQ ID NO: 616783 - DNA, 25 bp, Mus musculus
ctgagggccagtgctgtgagtccaa

SEQ ID NO: 616784 - DNA, 25 bp, Mus musculus
ctgagggcgcaacgccttgctctct

SEQ ID NO: 616785 - DNA, 25 bp, Mus musculus
ctgagggcgcaaggccttgctctct

SEQ ID NO: 616786 - DNA, 25 bp, Mus musculus
ctgagggctcctctccggaagctgt

SEQ ID NO: 616787 - DNA, 25 bp, Mus musculus
ctgagggctcctgtccggaagctgt

SEQ ID NO: 616788 - DNA, 25 bp, Mus musculus
ctgaggtcaactccctctcattcaa

SEQ ID NO: 616789 - DNA, 25 bp, Mus musculus
ctgaggtcaactgcctctcattcaa

SEQ ID NO: 616790 - DNA, 25 bp, Mus musculus
ctgaggtcagccagaagacgggcct

SEQ ID NO: 616791 - DNA, 25 bp, Mus musculus
ctgaggtcagcctgaagacgggcct

SEQ ID NO: 616792 - DNA, 25 bp, Mus musculus
ctgaggtcatcgcaccccaaaaaac

SEQ ID NO: 616793 - DNA, 25 bp, Mus musculus
ctgaggtcatcggaccccaaaaaac

SEQ ID NO: 616794 - DNA, 25 bp, Mus musculus
ctgaggtcgcggattccgaagcccc

SEQ ID NO: 616795 - DNA, 25 bp, Mus musculus
ctgaggtcgcggtttccgaagcccc

SEQ ID NO: 616796 - DNA, 25 bp, Mus musculus
ctgaggtctaccagaaatctaagac

SEQ ID NO: 616797 - DNA, 25 bp, Mus musculus
ctgaggtctacctgaaatctaagac

SEQ ID NO: 616798 - DNA, 25 bp, Mus musculus
ctgaggtctatgctcagtgagctcg

SEQ ID NO: 616799 - DNA, 25 bp, Mus musculus
ctgaggtctatggtcagtgagctcg

SEQ ID NO: 616800 - DNA, 25 bp, Mus musculus
ctgaggtgcacgaccagaaggcaga

SEQ ID NO: 616801 - DNA, 25 bp, Mus musculus
ctgaggtgcacgtccagaaggcaga

SEQ ID NO: 616802 - DNA, 25 bp, Mus musculus
ctgaggtggccacctttaggaaaga

SEQ ID NO: 616803 - DNA, 25 bp, Mus musculus
ctgaggtggccagctttaggaaaga

SEQ ID NO: 616804 - DNA, 25 bp, Mus musculus
ctgagtaccaggcagaaccggatga

SEQ ID NO: 616805 - DNA, 25 bp, Mus musculus
ctgagtaccagggagaaccggatga

SEQ ID NO: 616806 - DNA, 25 bp, Mus musculus
ctgagtaccatgcagaaacggagga

SEQ ID NO: 616807 - DNA, 25 bp, Mus musculus
ctgagtaccatggagaaacggagga

SEQ ID NO: 616808 - DNA, 25 bp, Mus musculus
ctgagtacttaaagccaaaacgaga

SEQ ID NO: 616809 - DNA, 25 bp, Mus musculus
ctgagtacttaatgccaaaacgaga

SEQ ID NO: 616810 - DNA, 25 bp, Mus musculus
ctgagtatccgacaagtggaggact

SEQ ID NO: 616811 - DNA, 25 bp, Mus musculus
ctgagtatccgagaagtggaggact

SEQ ID NO: 616812 - DNA, 25 bp, Mus musculus
ctgagtcagcgacgctcctcactga

SEQ ID NO: 616813 - DNA, 25 bp, Mus musculus
ctgagtcagcgaggctcctcactga

SEQ ID NO: 616814 - DNA, 25 bp, Mus musculus
ctgagtcagctcctcaacccgaggc

SEQ ID NO: 616815 - DNA, 25 bp, Mus musculus
ctgagtcagctcgtcaacccgaggc

SEQ ID NO: 616816 - DNA, 25 bp, Mus musculus
ctgagtccaacacgctggtcacagc

SEQ ID NO: 616817 - DNA, 25 bp, Mus musculus
ctgagtccaacaggctggtcacagc

SEQ ID NO: 616818 - DNA, 25 bp, Mus musculus
ctgagtccaggcatccagccagggc

SEQ ID NO: 616819 - DNA, 25 bp, Mus musculus
ctgagtccaggcttccagccagggc

SEQ ID NO: 616820 - DNA, 25 bp, Mus musculus
ctgagtccccgtacacacactggaa

SEQ ID NO: 616821 - DNA, 25 bp, Mus musculus
ctgagtccccgttcacacactggaa

SEQ ID NO: 616822 - DNA, 25 bp, Mus musculus
ctgagtcctgagagcgctgaggaat

SEQ ID NO: 616823 - DNA, 25 bp, Mus musculus
ctgagtcctgagtgcgctgaggaat

SEQ ID NO: 616824 - DNA, 25 bp, Mus musculus
ctgagtcgctggatcctttggcggc

SEQ ID NO: 616825 - DNA, 25 bp, Mus musculus
ctgagtcgctggttcctttggcggc

SEQ ID NO: 616826 - DNA, 25 bp, Mus musculus
ctgagtcggattacccaccaggcat

SEQ ID NO: 616827 - DNA, 25 bp, Mus musculus
ctgagtcggatttcccaccaggcat

SEQ ID NO: 616828 - DNA, 25 bp, Mus musculus
ctgagtctgaggcaaatcttcatct

SEQ ID NO: 616829 - DNA, 25 bp, Mus musculus
ctgagtctgagggaaatcttcatct

SEQ ID NO: 616830 - DNA, 25 bp, Mus musculus
ctgagtgaggatactggtcaaacca

SEQ ID NO: 616831 - DNA, 25 bp, Mus musculus
ctgagtgaggattctggtcaaacca

SEQ ID NO: 616832 - DNA, 25 bp, Mus musculus
ctgagtgatcgcactcgtgaacgca

SEQ ID NO: 616833 - DNA, 25 bp, Mus musculus
ctgagtgatcgctctcgtgaacgca

SEQ ID NO: 616834 - DNA, 25 bp, Mus musculus
ctgagtgcatcaaggagaaggttgc

SEQ ID NO: 616835 - DNA, 25 bp, Mus musculus
ctgagtgcatcatggagaaggttgc

SEQ ID NO: 616836 - DNA, 25 bp, Mus musculus
ctgagtgcggaactggcctccaatc

SEQ ID NO: 616837 - DNA, 25 bp, Mus musculus
ctgagtgcggaagtggcctccaatc

SEQ ID NO: 616838 - DNA, 25 bp, Mus musculus
ctgagtggatccagcgaagcaggct

SEQ ID NO: 616839 - DNA, 25 bp, Mus musculus
ctgagtggatcctgcgaagcaggct

SEQ ID NO: 616840 - DNA, 25 bp, Mus musculus
ctgagtggcaccctggcccagacag

SEQ ID NO: 616841 - DNA, 25 bp, Mus musculus
ctgagtggcaccgtggcccagacag

SEQ ID NO: 616842 - DNA, 25 bp, Mus musculus
ctgagtggcgtaatggtgctgtctt

SEQ ID NO: 616843 - DNA, 25 bp, Mus musculus
ctgagtggcgtattggtgctgtctt

SEQ ID NO: 616844 - DNA, 25 bp, Mus musculus
ctgagtggtccaagtgcttctagag

SEQ ID NO: 616845 - DNA, 25 bp, Mus musculus
ctgagtggtccatgtgcttctagag

SEQ ID NO: 616846 - DNA, 25 bp, Mus musculus
ctgagtggtcctcgccaactggtgt

SEQ ID NO: 616847 - DNA, 25 bp, Mus musculus
ctgagtggtcctggccaactggtgt

SEQ ID NO: 616848 - DNA, 25 bp, Mus musculus
ctgagtgtgaccagtaccgcaccat

SEQ ID NO: 616849 - DNA, 25 bp, Mus musculus
ctgagtgtgacctgtaccgcaccat

SEQ ID NO: 616850 - DNA, 25 bp, Mus musculus
ctgagtgtgcatcgtgtcacctacc

SEQ ID NO: 616851 - DNA, 25 bp, Mus musculus
ctgagtgtgcatggtgtcacctacc

SEQ ID NO: 616852 - DNA, 25 bp, Mus musculus
ctgagtgtgtgccccttctcagtga

SEQ ID NO: 616853 - DNA, 25 bp, Mus musculus
ctgagtgtgtgcgccttctcagtga

SEQ ID NO: 616854 - DNA, 25 bp, Mus musculus
ctgagtgttcgacagaagaacagga

SEQ ID NO: 616855 - DNA, 25 bp, Mus musculus
ctgagtgttcgagagaagaacagga

SEQ ID NO: 616856 - DNA, 25 bp, Mus musculus
ctgagttccagcagccactattctt

SEQ ID NO: 616857 - DNA, 25 bp, Mus musculus
ctgagttccagctgccactattctt

SEQ ID NO: 616858 - DNA, 25 bp, Mus musculus
ctgagttgcttccattggcccaggg

SEQ ID NO: 616859 - DNA, 25 bp, Mus musculus
ctgagttgcttcgattggcccaggg

SEQ ID NO: 616860 - DNA, 25 bp, Mus musculus
ctgagttgtcagcagccctggaaga

SEQ ID NO: 616861 - DNA, 25 bp, Mus musculus
ctgagttgtcaggagccctggaaga

SEQ ID NO: 616862 - DNA, 25 bp, Mus musculus
ctgagtttacaacgagataccaaaa

SEQ ID NO: 616863 - DNA, 25 bp, Mus musculus
ctgagtttacaaggagataccaaaa

SEQ ID NO: 616864 - DNA, 25 bp, Mus musculus
ctgataaggccaccctgctggcctt

SEQ ID NO: 616865 - DNA, 25 bp, Mus musculus
ctgataaggccagcctgctggcctt

SEQ ID NO: 616866 - DNA, 25 bp, Mus musculus
ctgataatggagctattggccaagc

SEQ ID NO: 616867 - DNA, 25 bp, Mus musculus
ctgataatggaggtattggccaagc

SEQ ID NO: 616868 - DNA, 25 bp, Mus musculus
ctgataccgtccactgctcgggcag

SEQ ID NO: 616869 - DNA, 25 bp, Mus musculus
ctgataccgtcctctgctcgggcag

SEQ ID NO: 616870 - DNA, 25 bp, Mus musculus
ctgataccttctcggaagtaaccct

SEQ ID NO: 616871 - DNA, 25 bp, Mus musculus
ctgataccttctgggaagtaaccct

SEQ ID NO: 616872 - DNA, 25 bp, Mus musculus
ctgatagaacacaggtacagaacga

SEQ ID NO: 616873 - DNA, 25 bp, Mus musculus
ctgatagaacactggtacagaacga

SEQ ID NO: 616874 - DNA, 25 bp, Mus musculus
ctgatagataggaaaacctgtggag

SEQ ID NO: 616875 - DNA, 25 bp, Mus musculus
ctgatagataggtaaacctgtggag

SEQ ID NO: 616876 - DNA, 25 bp, Mus musculus
ctgatagatattactcgagagggcc

SEQ ID NO: 616877 - DNA, 25 bp, Mus musculus
ctgatagatatttctcgagagggcc

SEQ ID NO: 616878 - DNA, 25 bp, Mus musculus
ctgatagcccgactagtgaggatac

SEQ ID NO: 616879 - DNA, 25 bp, Mus musculus
ctgatagcccgagtagtgaggatac

SEQ ID NO: 616880 - DNA, 25 bp, Mus musculus
ctgatagccgggacaactgccgctt

SEQ ID NO: 616881 - DNA, 25 bp, Mus musculus
ctgatagccgggtcaactgccgctt

SEQ ID NO: 616882 - DNA, 25 bp, Mus musculus
ctgataggtcccacgtcagggaagg

SEQ ID NO: 616883 - DNA, 25 bp, Mus musculus
ctgataggtccctcgtcagggaagg

SEQ ID NO: 616884 - DNA, 25 bp, Mus musculus
ctgatatctttcatagacgagctca

SEQ ID NO: 616885 - DNA, 25 bp, Mus musculus
ctgatatctttcttagacgagctca

SEQ ID NO: 616886 - DNA, 25 bp, Mus musculus
ctgatatgaaaaaggagcaagacca

SEQ ID NO: 616887 - DNA, 25 bp, Mus musculus
ctgatatgaaaatggagcaagacca

SEQ ID NO: 616888 - DNA, 25 bp, Mus musculus
ctgatattagctacatgtgtagcag

SEQ ID NO: 616889 - DNA, 25 bp, Mus musculus
ctgatattagcttcatgtgtagcag

SEQ ID NO: 616890 - DNA, 25 bp, Mus musculus
ctgatattgatgcttctgagcacca

SEQ ID NO: 616891 - DNA, 25 bp, Mus musculus
ctgatattgatggttctgagcacca

SEQ ID NO: 616892 - DNA, 25 bp, Mus musculus
ctgatcaaagagaagctattagacc

SEQ ID NO: 616893 - DNA, 25 bp, Mus musculus
ctgatcaaagagtagctattagacc

SEQ ID NO: 616894 - DNA, 25 bp, Mus musculus
ctgatcaagaagagtctcctgacag

SEQ ID NO: 616895 - DNA, 25 bp, Mus musculus
ctgatcaagaagtgtctcctgacag

SEQ ID NO: 616896 - DNA, 25 bp, Mus musculus
ctgatcacagggaaatgggagaaac

SEQ ID NO: 616897 - DNA, 25 bp, Mus musculus
ctgatcacagggtaatgggagaaac

SEQ ID NO: 616898 - DNA, 25 bp, Mus musculus
ctgatcatttcaaacctttgtgggc

SEQ ID NO: 616899 - DNA, 25 bp, Mus musculus
ctgatcatttcatacctttgtgggc

SEQ ID NO: 616900 - DNA, 25 bp, Mus musculus
ctgatccaaattactgctgaaaata

SEQ ID NO: 616901 - DNA, 25 bp, Mus musculus
ctgatccaaatttctgctgaaaata

SEQ ID NO: 616902 - DNA, 25 bp, Mus musculus
ctgatccacccgagattcgtgctga

SEQ ID NO: 616903 - DNA, 25 bp, Mus musculus
ctgatccacccgtgattcgtgctga

SEQ ID NO: 616904 - DNA, 25 bp, Mus musculus
ctgatcccaggaccgtactgggcaa

SEQ ID NO: 616905 - DNA, 25 bp, Mus musculus
ctgatcccaggagcgtactgggcaa

SEQ ID NO: 616906 - DNA, 25 bp, Mus musculus
ctgatccgagcaccaaatgaccgag

SEQ ID NO: 616907 - DNA, 25 bp, Mus musculus
ctgatccgagcagcaaatgaccgag

SEQ ID NO: 616908 - DNA, 25 bp, Mus musculus
ctgatcgaatccaaagtcggcatgt

SEQ ID NO: 616909 - DNA, 25 bp, Mus musculus
ctgatcgaatcctaagtcggcatgt

SEQ ID NO: 616910 - DNA, 25 bp, Mus musculus
ctgatctccaggaaaccatcttgga

SEQ ID NO: 616911 - DNA, 25 bp, Mus musculus
ctgatctccaggtaaccatcttgga

SEQ ID NO: 616912 - DNA, 25 bp, Mus musculus
ctgatctcccgtatcagggccatga

SEQ ID NO: 616913 - DNA, 25 bp, Mus musculus
ctgatctcccgtttcagggccatga

SEQ ID NO: 616914 - DNA, 25 bp, Mus musculus
ctgatcttgctacgaccgcttatag

SEQ ID NO: 616915 - DNA, 25 bp, Mus musculus
ctgatcttgctaggaccgcttatag

SEQ ID NO: 616916 - DNA, 25 bp, Mus musculus
ctgatgaagacacagcggccaaggc

SEQ ID NO: 616917 - DNA, 25 bp, Mus musculus
ctgatgaagacagagcggccaaggc

SEQ ID NO: 616918 - DNA, 25 bp, Mus musculus
ctgatgaagcccataatatagtcaa

SEQ ID NO: 616919 - DNA, 25 bp, Mus musculus
ctgatgaagcccttaatatagtcaa

SEQ ID NO: 616920 - DNA, 25 bp, Mus musculus
ctgatgaatcccatggtccctgggt

SEQ ID NO: 616921 - DNA, 25 bp, Mus musculus
ctgatgaatcccttggtccctgggt

SEQ ID NO: 616922 - DNA, 25 bp, Mus musculus
ctgatgaatgtacatgtcatgccac

SEQ ID NO: 616923 - DNA, 25 bp, Mus musculus
ctgatgaatgtagatgtcatgccac

SEQ ID NO: 616924 - DNA, 25 bp, Mus musculus
ctgatgacagatctgctcgtgtttc

SEQ ID NO: 616925 - DNA, 25 bp, Mus musculus
ctgatgacagatgtgctcgtgtttc

SEQ ID NO: 616926 - DNA, 25 bp, Mus musculus
ctgatgacagctatggcaccaccga

SEQ ID NO: 616927 - DNA, 25 bp, Mus musculus
ctgatgacagctttggcaccaccga

SEQ ID NO: 616928 - DNA, 25 bp, Mus musculus
ctgatgagatttacccaaatactgc

SEQ ID NO: 616929 - DNA, 25 bp, Mus musculus
ctgatgagattttcccaaatactgc

SEQ ID NO: 616930 - DNA, 25 bp, Mus musculus
ctgatgagcatcagtggctgcagat

SEQ ID NO: 616931 - DNA, 25 bp, Mus musculus
ctgatgagcatctgtggctgcagat

SEQ ID NO: 616932 - DNA, 25 bp, Mus musculus
ctgatgagccctcagacggcaggat

SEQ ID NO: 616933 - DNA, 25 bp, Mus musculus
ctgatgagccctgagacggcaggat

SEQ ID NO: 616934 - DNA, 25 bp, Mus musculus
ctgatgaggtctctgggtgtccact

SEQ ID NO: 616935 - DNA, 25 bp, Mus musculus
ctgatgaggtctgtgggtgtccact

SEQ ID NO: 616936 - DNA, 25 bp, Mus musculus
ctgatgagtacaatgagaaactggc

SEQ ID NO: 616937 - DNA, 25 bp, Mus musculus
ctgatgagtacacccagaacttcta

SEQ ID NO: 616938 - DNA, 25 bp, Mus musculus
ctgatgagtacagccagaacttcta

SEQ ID NO: 616939 - DNA, 25 bp, Mus musculus
ctgatgagtacattgagaaactggc

SEQ ID NO: 616940 - DNA, 25 bp, Mus musculus
ctgatgataagcaatccgtgtggga

SEQ ID NO: 616941 - DNA, 25 bp, Mus musculus
ctgatgataagctatccgtgtggga

SEQ ID NO: 616942 - DNA, 25 bp, Mus musculus
ctgatgatgatgagtcagagatgcc

SEQ ID NO: 616943 - DNA, 25 bp, Mus musculus
ctgatgatgatgtgtcagagatgcc

SEQ ID NO: 616944 - DNA, 25 bp, Mus musculus
ctgatgatgtccagcctatcgccag

SEQ ID NO: 616945 - DNA, 25 bp, Mus musculus
ctgatgatgtcctgcctatcgccag

SEQ ID NO: 616946 - DNA, 25 bp, Mus musculus
ctgatgattacgatctgggagaaga

SEQ ID NO: 616947 - DNA, 25 bp, Mus musculus
ctgatgattacgttctgggagaaga

SEQ ID NO: 616948 - DNA, 25 bp, Mus musculus
ctgatgcagctcaggttggactgag

SEQ ID NO: 616949 - DNA, 25 bp, Mus musculus
ctgatgcagctctggttggactgag

SEQ ID NO: 616950 - DNA, 25 bp, Mus musculus
ctgatgcatcgcagctgggccttgg

SEQ ID NO: 616951 - DNA, 25 bp, Mus musculus
ctgatgcatcgctgctgggccttgg

SEQ ID NO: 616952 - DNA, 25 bp, Mus musculus
ctgatgccagcgctgcctgtcactg

SEQ ID NO: 616953 - DNA, 25 bp, Mus musculus
ctgatgccagcggtgcctgtcactg

SEQ ID NO: 616954 - DNA, 25 bp, Mus musculus
ctgatgccattgatgtgaagctgaa

SEQ ID NO: 616955 - DNA, 25 bp, Mus musculus
ctgatgccattgttgtgaagctgaa

SEQ ID NO: 616956 - DNA, 25 bp, Mus musculus
ctgatgcccgctctatctacgttgg

SEQ ID NO: 616957 - DNA, 25 bp, Mus musculus
ctgatgcccgctgtatctacgttgg

SEQ ID NO: 616958 - DNA, 25 bp, Mus musculus
ctgatgccgcccacttgctagcaga

SEQ ID NO: 616959 - DNA, 25 bp, Mus musculus
ctgatgccgccctcttgctagcaga

SEQ ID NO: 616960 - DNA, 25 bp, Mus musculus
ctgatgctaaacagataacactggc

SEQ ID NO: 616961 - DNA, 25 bp, Mus musculus
ctgatgctaaactgataacactggc

SEQ ID NO: 616962 - DNA, 25 bp, Mus musculus
ctgatgctaatcagcagtgtgttgg

SEQ ID NO: 616963 - DNA, 25 bp, Mus musculus
ctgatgctaatctgcagtgtgttgg

SEQ ID NO: 616964 - DNA, 25 bp, Mus musculus
ctgatgctgaggatttagaacattc

SEQ ID NO: 616965 - DNA, 25 bp, Mus musculus
ctgatgctgaggttttagaacattc

SEQ ID NO: 616966 - DNA, 25 bp, Mus musculus
ctgatgctgggtatcggaagcatgc

SEQ ID NO: 616967 - DNA, 25 bp, Mus musculus
ctgatgctgggtttcggaagcatgc

SEQ ID NO: 616968 - DNA, 25 bp, Mus musculus
ctgatggaattgcaaaagcatatgc

SEQ ID NO: 616969 - DNA, 25 bp, Mus musculus
ctgatggaattggaaaagcatatgc

SEQ ID NO: 616970 - DNA, 25 bp, Mus musculus
ctgatggaccctcttgtcaaaactg

SEQ ID NO: 616971 - DNA, 25 bp, Mus musculus
ctgatggaccctgttgtcaaaactg

SEQ ID NO: 616972 - DNA, 25 bp, Mus musculus
ctgatggactgcatggtatggagta

SEQ ID NO: 616973 - DNA, 25 bp, Mus musculus
ctgatggactgcttggtatggagta

SEQ ID NO: 616974 - DNA, 25 bp, Mus musculus
ctgatggagaaacaactcttggacc

SEQ ID NO: 616975 - DNA, 25 bp, Mus musculus
ctgatggagaaagaactcttggacc

SEQ ID NO: 616976 - DNA, 25 bp, Mus musculus
ctgatggagctgaaaaaccacccac

SEQ ID NO: 616977 - DNA, 25 bp, Mus musculus
ctgatggagctgtaaaaccacccac

SEQ ID NO: 616978 - DNA, 25 bp, Mus musculus
ctgatggagtgcctttgtacccgcc

SEQ ID NO: 616979 - DNA, 25 bp, Mus musculus
ctgatggagtgcgtttgtacccgcc

SEQ ID NO: 616980 - DNA, 25 bp, Mus musculus
ctgatggatgtcaaggaaacgggca

SEQ ID NO: 616981 - DNA, 25 bp, Mus musculus
ctgatggatgtctaggaaacgggca

SEQ ID NO: 616982 - DNA, 25 bp, Mus musculus
ctgatggattctcgacgagctccaa

SEQ ID NO: 616983 - DNA, 25 bp, Mus musculus
ctgatggattctggacgagctccaa

SEQ ID NO: 616984 - DNA, 25 bp, Mus musculus
ctgatggccctcaaggatgtggcct

SEQ ID NO: 616985 - DNA, 25 bp, Mus musculus
ctgatggccctctaggatgtggcct

SEQ ID NO: 616986 - DNA, 25 bp, Mus musculus
ctgatgggaaatacctggccagcgg

SEQ ID NO: 616987 - DNA, 25 bp, Mus musculus
ctgatgggaaattcctggccagcgg

SEQ ID NO: 616988 - DNA, 25 bp, Mus musculus
ctgatgggctcacgcctccgaaagc

SEQ ID NO: 616989 - DNA, 25 bp, Mus musculus
ctgatgggctcaggcctccgaaagc

SEQ ID NO: 616990 - DNA, 25 bp, Mus musculus
ctgatgggtcagctggaagaaaaca

SEQ ID NO: 616991 - DNA, 25 bp, Mus musculus
ctgatgggtcaggtggaagaaaaca

SEQ ID NO: 616992 - DNA, 25 bp, Mus musculus
ctgatggtattccaagatcagcagt

SEQ ID NO: 616993 - DNA, 25 bp, Mus musculus
ctgatggtattcgaagatcagcagt

SEQ ID NO: 616994 - DNA, 25 bp, Mus musculus
ctgatggtcccgcagggaaagctca

SEQ ID NO: 616995 - DNA, 25 bp, Mus musculus
ctgatggtcccggagggaaagctca

SEQ ID NO: 616996 - DNA, 25 bp, Mus musculus
ctgatggtgaatcctgcccacggtg

SEQ ID NO: 616997 - DNA, 25 bp, Mus musculus
ctgatggtgaatgctgcccacggtg

SEQ ID NO: 616998 - DNA, 25 bp, Mus musculus
ctgatggtgataaccggaagtgaga

SEQ ID NO: 616999 - DNA, 25 bp, Mus musculus
ctgatggtgatatccggaagtgaga

SEQ ID NO: 617000 - DNA, 25 bp, Mus musculus
ctgatggtgcttccagtgaagtaga

SEQ ID NO: 617001 - DNA, 25 bp, Mus musculus
ctgatggtgcttgcagtgaagtaga

SEQ ID NO: 617002 - DNA, 25 bp, Mus musculus
ctgatgtaaaccagagagtggctga

SEQ ID NO: 617003 - DNA, 25 bp, Mus musculus
ctgatgtaaacctgagagtggctga

SEQ ID NO: 617004 - DNA, 25 bp, Mus musculus
ctgatgtactgcaggcaccgggtgc

SEQ ID NO: 617005 - DNA, 25 bp, Mus musculus
ctgatgtactgctggcaccgggtgc

SEQ ID NO: 617006 - DNA, 25 bp, Mus musculus
ctgatgtcacggctgggcttccaga

SEQ ID NO: 617007 - DNA, 25 bp, Mus musculus
ctgatgtcacgggtgggcttccaga

SEQ ID NO: 617008 - DNA, 25 bp, Mus musculus
ctgatgtcgtgtagggaaggaccct

SEQ ID NO: 617009 - DNA, 25 bp, Mus musculus
ctgatgtcgtgttgggaaggaccct

SEQ ID NO: 617010 - DNA, 25 bp, Mus musculus
ctgatgtgaactatgaagagctggc

SEQ ID NO: 617011 - DNA, 25 bp, Mus musculus
ctgatgtgaactttgaagagctggc

SEQ ID NO: 617012 - DNA, 25 bp, Mus musculus
ctgatgtgggtaccatggaatcact

SEQ ID NO: 617013 - DNA, 25 bp, Mus musculus
ctgatgtgggtagcatggaatcact

SEQ ID NO: 617014 - DNA, 25 bp, Mus musculus
ctgatgtgtttgagctggtggccaa

SEQ ID NO: 617015 - DNA, 25 bp, Mus musculus
ctgatgtgtttgtgctggtggccaa

SEQ ID NO: 617016 - DNA, 25 bp, Mus musculus
ctgatgttgttgataagcggcaaga

SEQ ID NO: 617017 - DNA, 25 bp, Mus musculus
ctgatgttgttgttaagcggcaaga

SEQ ID NO: 617018 - DNA, 25 bp, Mus musculus
ctgattagtctgctcaataaagctg

SEQ ID NO: 617019 - DNA, 25 bp, Mus musculus
ctgattagtctggtcaataaagctg

SEQ ID NO: 617020 - DNA, 25 bp, Mus musculus
ctgattatggagctgcctcggagca

SEQ ID NO: 617021 - DNA, 25 bp, Mus musculus
ctgattatggaggtgcctcggagca

SEQ ID NO: 617022 - DNA, 25 bp, Mus musculus
ctgattcagaacctctattagtttc

SEQ ID NO: 617023 - DNA, 25 bp, Mus musculus
ctgattcagaacgtctattagtttc

SEQ ID NO: 617024 - DNA, 25 bp, Mus musculus
ctgattcagaagacgaagacgatca

SEQ ID NO: 617025 - DNA, 25 bp, Mus musculus
ctgattcagaagtcgaagacgatca

SEQ ID NO: 617026 - DNA, 25 bp, Mus musculus
ctgattcagctaaggagtgtggttg

SEQ ID NO: 617027 - DNA, 25 bp, Mus musculus
ctgattcagctatggagtgtggttg

SEQ ID NO: 617028 - DNA, 25 bp, Mus musculus
ctgattcgtcgactgaggccgtcaa

SEQ ID NO: 617029 - DNA, 25 bp, Mus musculus
ctgattcgtcgagtgaggccgtcaa

SEQ ID NO: 617030 - DNA, 25 bp, Mus musculus
ctgattctaataaacagagaaaggg

SEQ ID NO: 617031 - DNA, 25 bp, Mus musculus
ctgattctaatatacagagaaaggg

SEQ ID NO: 617032 - DNA, 25 bp, Mus musculus
ctgattgaagcacggttacagaggc

SEQ ID NO: 617033 - DNA, 25 bp, Mus musculus
ctgattgaagcagggttacagaggc

SEQ ID NO: 617034 - DNA, 25 bp, Mus musculus
ctgattgacaagaactgcccgggca

SEQ ID NO: 617035 - DNA, 25 bp, Mus musculus
ctgattgacaagtactgcccgggca

SEQ ID NO: 617036 - DNA, 25 bp, Mus musculus
ctgattgacatcatggcatctctct

SEQ ID NO: 617037 - DNA, 25 bp, Mus musculus
ctgattgacatcttggcatctctct

SEQ ID NO: 617038 - DNA, 25 bp, Mus musculus
ctgattgagtcaagtttgggaagca

SEQ ID NO: 617039 - DNA, 25 bp, Mus musculus
ctgattgagtcatgtttgggaagca

SEQ ID NO: 617040 - DNA, 25 bp, Mus musculus
ctgattgcaaaaaactaatggacac

SEQ ID NO: 617041 - DNA, 25 bp, Mus musculus
ctgattgcaaaatactaatggacac

SEQ ID NO: 617042 - DNA, 25 bp, Mus musculus
ctgattgcagtcatcattgcaggca

SEQ ID NO: 617043 - DNA, 25 bp, Mus musculus
ctgattgcagtcttcattgcaggca

SEQ ID NO: 617044 - DNA, 25 bp, Mus musculus
ctgattgtagagatagttcgtcgga

SEQ ID NO: 617045 - DNA, 25 bp, Mus musculus
ctgattgtagagttagttcgtcgga

SEQ ID NO: 617046 - DNA, 25 bp, Mus musculus
ctgattgtctgtccgcaagtccaca

SEQ ID NO: 617047 - DNA, 25 bp, Mus musculus
ctgattgtctgtgcgcaagtccaca

SEQ ID NO: 617048 - DNA, 25 bp, Mus musculus
ctgattgtgacaaatcactgtaagg

SEQ ID NO: 617049 - DNA, 25 bp, Mus musculus
ctgattgtgacatatcactgtaagg

SEQ ID NO: 617050 - DNA, 25 bp, Mus musculus
ctgattgttggactgacatcactgg

SEQ ID NO: 617051 - DNA, 25 bp, Mus musculus
ctgattgttggagtgacatcactgg

SEQ ID NO: 617052 - DNA, 25 bp, Mus musculus
ctgatttcatcacttgacccacagt

SEQ ID NO: 617053 - DNA, 25 bp, Mus musculus
ctgatttcatcagttgacccacagt

SEQ ID NO: 617054 - DNA, 25 bp, Mus musculus
ctgatttgaaggcagactcaatcaa

SEQ ID NO: 617055 - DNA, 25 bp, Mus musculus
ctgatttgaagggagactcaatcaa

SEQ ID NO: 617056 - DNA, 25 bp, Mus musculus
ctgatttgtctccagggtacctggg

SEQ ID NO: 617057 - DNA, 25 bp, Mus musculus
ctgatttgtctcgagggtacctggg

SEQ ID NO: 617058 - DNA, 25 bp, Mus musculus
ctgcaaaagttgatcctatgaaagc

SEQ ID NO: 617059 - DNA, 25 bp, Mus musculus
ctgcaaaagttgttcctatgaaagc

SEQ ID NO: 617060 - DNA, 25 bp, Mus musculus
ctgcaaacacaactaccctgagcag

SEQ ID NO: 617061 - DNA, 25 bp, Mus musculus
ctgcaaacacaagtaccctgagcag

SEQ ID NO: 617062 - DNA, 25 bp, Mus musculus
ctgcaaagaaggagaacactgctca

SEQ ID NO: 617063 - DNA, 25 bp, Mus musculus
ctgcaaagaaggtgaacactgctca

SEQ ID NO: 617064 - DNA, 25 bp, Mus musculus
ctgcaaagagacagggagaatgtgt

SEQ ID NO: 617065 - DNA, 25 bp, Mus musculus
ctgcaaagagactgggagaatgtgt

SEQ ID NO: 617066 - DNA, 25 bp, Mus musculus
ctgcaaagggggacactcatcctgc

SEQ ID NO: 617067 - DNA, 25 bp, Mus musculus
ctgcaaagggggtcactcatcctgc

SEQ ID NO: 617068 - DNA, 25 bp, Mus musculus
ctgcaaattgggagaagcttctgac

SEQ ID NO: 617069 - DNA, 25 bp, Mus musculus
ctgcaaattgggtgaagcttctgac

SEQ ID NO: 617070 - DNA, 25 bp, Mus musculus
ctgcaacctgggagccggacgtgtc

SEQ ID NO: 617071 - DNA, 25 bp, Mus musculus
ctgcaacctgggtgccggacgtgtc

SEQ ID NO: 617072 - DNA, 25 bp, Mus musculus
ctgcaacgtgagcagaataatatct

SEQ ID NO: 617073 - DNA, 25 bp, Mus musculus
ctgcaacgtgaggagaataatatct

SEQ ID NO: 617074 - DNA, 25 bp, Mus musculus
ctgcaactgacactctgcctggctt

SEQ ID NO: 617075 - DNA, 25 bp, Mus musculus
ctgcaactgacagtctgcctggctt

SEQ ID NO: 617076 - DNA, 25 bp, Mus musculus
ctgcaagcatagaggaacagtctat

SEQ ID NO: 617077 - DNA, 25 bp, Mus musculus
ctgcaagcatagtggaacagtctat

SEQ ID NO: 617078 - DNA, 25 bp, Mus musculus
ctgcaagcctcccagtcaaaacctt

SEQ ID NO: 617079 - DNA, 25 bp, Mus musculus
ctgcaagcctccgagtcaaaacctt

SEQ ID NO: 617080 - DNA, 25 bp, Mus musculus
ctgcaagctgcaccgccggttgaga

SEQ ID NO: 617081 - DNA, 25 bp, Mus musculus
ctgcaagctgcagcgccggttgaga

SEQ ID NO: 617082 - DNA, 25 bp, Mus musculus
ctgcaaggcctgacatgatgacgtc

SEQ ID NO: 617083 - DNA, 25 bp, Mus musculus
ctgcaaggcctgtcatgatgacgtc

SEQ ID NO: 617084 - DNA, 25 bp, Mus musculus
ctgcaagtccttagaatccattaac

SEQ ID NO: 617085 - DNA, 25 bp, Mus musculus
ctgcaagtcctttgaatccattaac

SEQ ID NO: 617086 - DNA, 25 bp, Mus musculus
ctgcaagtgcctctggatcagagtg

SEQ ID NO: 617087 - DNA, 25 bp, Mus musculus
ctgcaagtgcctgtggatcagagtg

SEQ ID NO: 617088 - DNA, 25 bp, Mus musculus
ctgcaagtgcttccggagaggtctc

SEQ ID NO: 617089 - DNA, 25 bp, Mus musculus
ctgcaagtgcttgcggagaggtctc

SEQ ID NO: 617090 - DNA, 25 bp, Mus musculus
ctgcaatgatgccacgctggttcag

SEQ ID NO: 617091 - DNA, 25 bp, Mus musculus
ctgcaatgatgcgacgctggttcag

SEQ ID NO: 617092 - DNA, 25 bp, Mus musculus
ctgcaattaaagatccgagaggtcc

SEQ ID NO: 617093 - DNA, 25 bp, Mus musculus
ctgcaattaaagttccgagaggtcc

SEQ ID NO: 617094 - DNA, 25 bp, Mus musculus
ctgcaattccttagcccctgcggga

SEQ ID NO: 617095 - DNA, 25 bp, Mus musculus
ctgcaattcctttgcccctgcggga

SEQ ID NO: 617096 - DNA, 25 bp, Mus musculus
ctgcaatttagaaagccaggcaatg

SEQ ID NO: 617097 - DNA, 25 bp, Mus musculus
ctgcaatttagatagccaggcaatg

SEQ ID NO: 617098 - DNA, 25 bp, Mus musculus
ctgcacaaaactcgatttttgccct

SEQ ID NO: 617099 - DNA, 25 bp, Mus musculus
ctgcacaaaactggatttttgccct

SEQ ID NO: 617100 - DNA, 25 bp, Mus musculus
ctgcacaaaggaattcctcacacca

SEQ ID NO: 617101 - DNA, 25 bp, Mus musculus
ctgcacaaaggatttcctcacacca

SEQ ID NO: 617102 - DNA, 25 bp, Mus musculus
ctgcacaaggacagtggcttccggg

SEQ ID NO: 617103 - DNA, 25 bp, Mus musculus
ctgcacaaggactgtggcttccggg

SEQ ID NO: 617104 - DNA, 25 bp, Mus musculus
ctgcacactggacagaagatgcctc

SEQ ID NO: 617105 - DNA, 25 bp, Mus musculus
ctgcacactggagagaagatgcctc

SEQ ID NO: 617106 - DNA, 25 bp, Mus musculus
ctgcacagccaccatgaattacggg

SEQ ID NO: 617107 - DNA, 25 bp, Mus musculus
ctgcacagccacgatgaattacggg

SEQ ID NO: 617108 - DNA, 25 bp, Mus musculus
ctgcacaggtgccaacactggtata

SEQ ID NO: 617109 - DNA, 25 bp, Mus musculus
ctgcacaggtgcgaacactggtata

SEQ ID NO: 617110 - DNA, 25 bp, Mus musculus
ctgcacattcgcactcagcactggg

SEQ ID NO: 617111 - DNA, 25 bp, Mus musculus
ctgcacattcgctctcagcactggg

SEQ ID NO: 617112 - DNA, 25 bp, Mus musculus
ctgcaccactaaaggccgctcggat

SEQ ID NO: 617113 - DNA, 25 bp, Mus musculus
ctgcaccactaatggccgctcggat

SEQ ID NO: 617114 - DNA, 25 bp, Mus musculus
ctgcaccagcggacatcagccagaa

SEQ ID NO: 617115 - DNA, 25 bp, Mus musculus
ctgcaccagcggtcatcagccagaa

SEQ ID NO: 617116 - DNA, 25 bp, Mus musculus
ctgcaccagggccacggccttgagt

SEQ ID NO: 617117 - DNA, 25 bp, Mus musculus
ctgcaccagggcgacggccttgagt

SEQ ID NO: 617118 - DNA, 25 bp, Mus musculus
ctgcaccatctcacaacggacagaa

SEQ ID NO: 617119 - DNA, 25 bp, Mus musculus
ctgcaccatctctcaacggacagaa

SEQ ID NO: 617120 - DNA, 25 bp, Mus musculus
ctgcacccagtacaactaaagcctt

SEQ ID NO: 617121 - DNA, 25 bp, Mus musculus
ctgcacccagtagaactaaagcctt

SEQ ID NO: 617122 - DNA, 25 bp, Mus musculus
ctgcaccccaagagacacgtggcat

SEQ ID NO: 617123 - DNA, 25 bp, Mus musculus
ctgcaccccaagtgacacgtggcat

SEQ ID NO: 617124 - DNA, 25 bp, Mus musculus
ctgcaccccgagacccagattgtgg

SEQ ID NO: 617125 - DNA, 25 bp, Mus musculus
ctgcaccccgagtcccagattgtgg

SEQ ID NO: 617126 - DNA, 25 bp, Mus musculus
ctgcaccgatgacgtgtttgcctgc

SEQ ID NO: 617127 - DNA, 25 bp, Mus musculus
ctgcaccgatgaggtgtttgcctgc

SEQ ID NO: 617128 - DNA, 25 bp, Mus musculus
ctgcacctgccactgagtgaagcaa

SEQ ID NO: 617129 - DNA, 25 bp, Mus musculus
ctgcacctgccagtgagtgaagcaa

SEQ ID NO: 617130 - DNA, 25 bp, Mus musculus
ctgcaccttgctatggcagaggaag

SEQ ID NO: 617131 - DNA, 25 bp, Mus musculus
ctgcaccttgctttggcagaggaag

SEQ ID NO: 617132 - DNA, 25 bp, Mus musculus
ctgcacgagattccagggttggaat

SEQ ID NO: 617133 - DNA, 25 bp, Mus musculus
ctgcacgagattgcagggttggaat

SEQ ID NO: 617134 - DNA, 25 bp, Mus musculus
ctgcacgaggcacaattccatgctg

SEQ ID NO: 617135 - DNA, 25 bp, Mus musculus
ctgcacgaggcagaattccatgctg

SEQ ID NO: 617136 - DNA, 25 bp, Mus musculus
ctgcacgcagctccgaggtgcttgc

SEQ ID NO: 617137 - DNA, 25 bp, Mus musculus
ctgcacgcagctgcgaggtgcttgc

SEQ ID NO: 617138 - DNA, 25 bp, Mus musculus
ctgcacgcctggcaaatgaagccct

SEQ ID NO: 617139 - DNA, 25 bp, Mus musculus
ctgcacgcctgggaaatgaagccct

SEQ ID NO: 617140 - DNA, 25 bp, Mus musculus
ctgcacgctcccaggccaagaaaga

SEQ ID NO: 617141 - DNA, 25 bp, Mus musculus
ctgcacgctccctggccaagaaaga

SEQ ID NO: 617142 - DNA, 25 bp, Mus musculus
ctgcacgctgcactgaggcagtcca

SEQ ID NO: 617143 - DNA, 25 bp, Mus musculus
ctgcacgctgcagtgaggcagtcca

SEQ ID NO: 617144 - DNA, 25 bp, Mus musculus
ctgcacgtggacacagtggctgctg

SEQ ID NO: 617145 - DNA, 25 bp, Mus musculus
ctgcacgtggactcagtggctgctg

SEQ ID NO: 617146 - DNA, 25 bp, Mus musculus
ctgcacgtggtccttcgctgcagag

SEQ ID NO: 617147 - DNA, 25 bp, Mus musculus
ctgcacgtggtcgttcgctgcagag

SEQ ID NO: 617148 - DNA, 25 bp, Mus musculus
ctgcactcagctcgcattttcaggc

SEQ ID NO: 617149 - DNA, 25 bp, Mus musculus
ctgcactcagctggcattttcaggc

SEQ ID NO: 617150 - DNA, 25 bp, Mus musculus
ctgcactccatgaccacctggatgg

SEQ ID NO: 617151 - DNA, 25 bp, Mus musculus
ctgcactccatgtccacctggatgg

SEQ ID NO: 617152 - DNA, 25 bp, Mus musculus
ctgcactgaggaccctcggatccgg

SEQ ID NO: 617153 - DNA, 25 bp, Mus musculus
ctgcactgaggagcctcggatccgg

SEQ ID NO: 617154 - DNA, 25 bp, Mus musculus
ctgcactgcaccatcttagcatcgg

SEQ ID NO: 617155 - DNA, 25 bp, Mus musculus
ctgcactgcaccttcttagcatcgg

SEQ ID NO: 617156 - DNA, 25 bp, Mus musculus
ctgcactgctacattgtccgggcag

SEQ ID NO: 617157 - DNA, 25 bp, Mus musculus
ctgcactgctactttgtccgggcag

SEQ ID NO: 617158 - DNA, 25 bp, Mus musculus
ctgcagaaatgccaggaacaaaaag

SEQ ID NO: 617159 - DNA, 25 bp, Mus musculus
ctgcagaaatgcctctttggctttg

SEQ ID NO: 617160 - DNA, 25 bp, Mus musculus
ctgcagaaatgcgaggaacaaaaag

SEQ ID NO: 617161 - DNA, 25 bp, Mus musculus
ctgcagaaatgcgtctttggctttg

SEQ ID NO: 617162 - DNA, 25 bp, Mus musculus
ctgcagaactctaggtcggcctttc

SEQ ID NO: 617163 - DNA, 25 bp, Mus musculus
ctgcagaactcttggtcggcctttc

SEQ ID NO: 617164 - DNA, 25 bp, Mus musculus
ctgcagaactggatggaggcgcttt

SEQ ID NO: 617165 - DNA, 25 bp, Mus musculus
ctgcagaactggttggaggcgcttt

SEQ ID NO: 617166 - DNA, 25 bp, Mus musculus
ctgcagaagaagaacatcgactcca

SEQ ID NO: 617167 - DNA, 25 bp, Mus musculus
ctgcagaagaagtacatcgactcca

SEQ ID NO: 617168 - DNA, 25 bp, Mus musculus
ctgcagaagagacattggaacatcc

SEQ ID NO: 617169 - DNA, 25 bp, Mus musculus
ctgcagaagagagattggaacatcc

SEQ ID NO: 617170 - DNA, 25 bp, Mus musculus
ctgcagaagagcctcaagaactgga

SEQ ID NO: 617171 - DNA, 25 bp, Mus musculus
ctgcagaagagcgtcaagaactgga

SEQ ID NO: 617172 - DNA, 25 bp, Mus musculus
ctgcagaagatcacggatgctaatc

SEQ ID NO: 617173 - DNA, 25 bp, Mus musculus
ctgcagaagatctcggatgctaatc

SEQ ID NO: 617174 - DNA, 25 bp, Mus musculus
ctgcagaagccgattccatgcctgt

SEQ ID NO: 617175 - DNA, 25 bp, Mus musculus
ctgcagaagccgtttccatgcctgt

SEQ ID NO: 617176 - DNA, 25 bp, Mus musculus
ctgcagaaggaaattaaacgccaca

SEQ ID NO: 617177 - DNA, 25 bp, Mus musculus
ctgcagaaggaatttaaacgccaca

SEQ ID NO: 617178 - DNA, 25 bp, Mus musculus
ctgcagaaggcgatcccgggccctg

SEQ ID NO: 617179 - DNA, 25 bp, Mus musculus
ctgcagaaggcgttcccgggccctg

SEQ ID NO: 617180 - DNA, 25 bp, Mus musculus
ctgcagacctggcttcaatgtgctc

SEQ ID NO: 617181 - DNA, 25 bp, Mus musculus
ctgcagacctgggttcaatgtgctc

SEQ ID NO: 617182 - DNA, 25 bp, Mus musculus
ctgcagagagagcaccgacagcagc

SEQ ID NO: 617183 - DNA, 25 bp, Mus musculus
ctgcagagagaggaccgacagcagc

SEQ ID NO: 617184 - DNA, 25 bp, Mus musculus
ctgcagagcacactccagcaggtgc

SEQ ID NO: 617185 - DNA, 25 bp, Mus musculus
ctgcagagcacagtccagcaggtgc

SEQ ID NO: 617186 - DNA, 25 bp, Mus musculus
ctgcagagcagacccgaaagctgac

SEQ ID NO: 617187 - DNA, 25 bp, Mus musculus
ctgcagagcagagccgaaagctgac

SEQ ID NO: 617188 - DNA, 25 bp, Mus musculus
ctgcagagcaggagaccaagttgga

SEQ ID NO: 617189 - DNA, 25 bp, Mus musculus
ctgcagagcaggcaaagttcctgat

SEQ ID NO: 617190 - DNA, 25 bp, Mus musculus
ctgcagagcagggaaagttcctgat

SEQ ID NO: 617191 - DNA, 25 bp, Mus musculus
ctgcagagcaggtgaccaagttgga

SEQ ID NO: 617192 - DNA, 25 bp, Mus musculus
ctgcagagctagctggcacaccatg

SEQ ID NO: 617193 - DNA, 25 bp, Mus musculus
ctgcagagctaggtggcacaccatg

SEQ ID NO: 617194 - DNA, 25 bp, Mus musculus
ctgcagaggaagatgcccggaaccg

SEQ ID NO: 617195 - DNA, 25 bp, Mus musculus
ctgcagaggaagttgcccggaaccg

SEQ ID NO: 617196 - DNA, 25 bp, Mus musculus
ctgcagaggctgaggcccaccgcat

SEQ ID NO: 617197 - DNA, 25 bp, Mus musculus
ctgcagaggctgtggcccaccgcat

SEQ ID NO: 617198 - DNA, 25 bp, Mus musculus
ctgcagaggtataagaggataaggc

SEQ ID NO: 617199 - DNA, 25 bp, Mus musculus
ctgcagaggtattagaggataaggc

SEQ ID NO: 617200 - DNA, 25 bp, Mus musculus
ctgcagaggttgattgaccaacagc

SEQ ID NO: 617201 - DNA, 25 bp, Mus musculus
ctgcagaggttgtttgaccaacagc

SEQ ID NO: 617202 - DNA, 25 bp, Mus musculus
ctgcagatagcaccatctaccttca

SEQ ID NO: 617203 - DNA, 25 bp, Mus musculus
ctgcagatagcagcatctaccttca

SEQ ID NO: 617204 - DNA, 25 bp, Mus musculus
ctgcagatcttgcactggacattgg

SEQ ID NO: 617205 - DNA, 25 bp, Mus musculus
ctgcagatcttggactggacattgg

SEQ ID NO: 617206 - DNA, 25 bp, Mus musculus
ctgcagatgaagacctcatcaccgg

SEQ ID NO: 617207 - DNA, 25 bp, Mus musculus
ctgcagatgaagtcctcatcaccgg

SEQ ID NO: 617208 - DNA, 25 bp, Mus musculus
ctgcagatgcatcctgaggtggcct

SEQ ID NO: 617209 - DNA, 25 bp, Mus musculus
ctgcagatgcatgctgaggtggcct

SEQ ID NO: 617210 - DNA, 25 bp, Mus musculus
ctgcagcaacaacggaagaaatcga

SEQ ID NO: 617211 - DNA, 25 bp, Mus musculus
ctgcagcaacaagggaagaaatcga

SEQ ID NO: 617212 - DNA, 25 bp, Mus musculus
ctgcagcactctcccgggaatacaa

SEQ ID NO: 617213 - DNA, 25 bp, Mus musculus
ctgcagcactctgccgggaatacaa

SEQ ID NO: 617214 - DNA, 25 bp, Mus musculus
ctgcagcagagtcgccaagcgatga

SEQ ID NO: 617215 - DNA, 25 bp, Mus musculus
ctgcagcagagtggccaagcgatga

SEQ ID NO: 617216 - DNA, 25 bp, Mus musculus
ctgcagcagctcatgacgtggacca

SEQ ID NO: 617217 - DNA, 25 bp, Mus musculus
ctgcagcagctcttgacgtggacca

SEQ ID NO: 617218 - DNA, 25 bp, Mus musculus
ctgcagcagggacaggacttgctcc

SEQ ID NO: 617219 - DNA, 25 bp, Mus musculus
ctgcagcagggagaggacttgctcc

SEQ ID NO: 617220 - DNA, 25 bp, Mus musculus
ctgcagcagggcaggtggtatccct

SEQ ID NO: 617221 - DNA, 25 bp, Mus musculus
ctgcagcagggctggtggtatccct

SEQ ID NO: 617222 - DNA, 25 bp, Mus musculus
ctgcagccacgacctctggaaggct

SEQ ID NO: 617223 - DNA, 25 bp, Mus musculus
ctgcagccacgagctctggaaggct

SEQ ID NO: 617224 - DNA, 25 bp, Mus musculus
ctgcagccatgtctgcggctcggac

SEQ ID NO: 617225 - DNA, 25 bp, Mus musculus
ctgcagccatgtgtgcggctcggac

SEQ ID NO: 617226 - DNA, 25 bp, Mus musculus
ctgcagcccggaaatcagccctaaa

SEQ ID NO: 617227 - DNA, 25 bp, Mus musculus
ctgcagcccggatatcagccctaaa

SEQ ID NO: 617228 - DNA, 25 bp, Mus musculus
ctgcagccctttaccagggcagaac

SEQ ID NO: 617229 - DNA, 25 bp, Mus musculus
ctgcagcccttttccagggcagaac

SEQ ID NO: 617230 - DNA, 25 bp, Mus musculus
ctgcagccgacacgccctggaaaag

SEQ ID NO: 617231 - DNA, 25 bp, Mus musculus
ctgcagccgacaggccctggaaaag

SEQ ID NO: 617232 - DNA, 25 bp, Mus musculus
ctgcagccgagacggatgtgtatac

SEQ ID NO: 617233 - DNA, 25 bp, Mus musculus
ctgcagccgagagggatgtgtatac

SEQ ID NO: 617234 - DNA, 25 bp, Mus musculus
ctgcagcgccacacgcagagcatga

SEQ ID NO: 617235 - DNA, 25 bp, Mus musculus
ctgcagcgccactcgcagagcatga

SEQ ID NO: 617236 - DNA, 25 bp, Mus musculus
ctgcagcggcagaagtgaaccttgt

SEQ ID NO: 617237 - DNA, 25 bp, Mus musculus
ctgcagcggcagtagtgaaccttgt

SEQ ID NO: 617238 - DNA, 25 bp, Mus musculus
ctgcagcggtctcgaagaggtctct

SEQ ID NO: 617239 - DNA, 25 bp, Mus musculus
ctgcagcggtctggaagaggtctct

SEQ ID NO: 617240 - DNA, 25 bp, Mus musculus
ctgcagctaagaacagaggtggaga

SEQ ID NO: 617241 - DNA, 25 bp, Mus musculus
ctgcagctaagacgccgggcaaacc

SEQ ID NO: 617242 - DNA, 25 bp, Mus musculus
ctgcagctaagaggccgggcaaacc

SEQ ID NO: 617243 - DNA, 25 bp, Mus musculus
ctgcagctaagatcagaggtggaga

SEQ ID NO: 617244 - DNA, 25 bp, Mus musculus
ctgcagctcgccacgcttgaggcgg

SEQ ID NO: 617245 - DNA, 25 bp, Mus musculus
ctgcagctcgcctcgcttgaggcgg

SEQ ID NO: 617246 - DNA, 25 bp, Mus musculus
ctgcagctgaacaacctgggcaact

SEQ ID NO: 617247 - DNA, 25 bp, Mus musculus
ctgcagctgaactacctgggcaact

SEQ ID NO: 617248 - DNA, 25 bp, Mus musculus
ctgcagctgcagagttggttccgta

SEQ ID NO: 617249 - DNA, 25 bp, Mus musculus
ctgcagctgcagtgttggttccgta

SEQ ID NO: 617250 - DNA, 25 bp, Mus musculus
ctgcagctgcggcaagcaacacagc

SEQ ID NO: 617251 - DNA, 25 bp, Mus musculus
ctgcagctgcgggaagcaacacagc

SEQ ID NO: 617252 - DNA, 25 bp, Mus musculus
ctgcagctgggtagcattgctctcc

SEQ ID NO: 617253 - DNA, 25 bp, Mus musculus
ctgcagctgggttgcattgctctcc

SEQ ID NO: 617254 - DNA, 25 bp, Mus musculus
ctgcaggaacaacgcaacctgccaa

SEQ ID NO: 617255 - DNA, 25 bp, Mus musculus
ctgcaggaacaaggcaacctgccaa

SEQ ID NO: 617256 - DNA, 25 bp, Mus musculus
ctgcaggaacagaagtcagccaaga

SEQ ID NO: 617257 - DNA, 25 bp, Mus musculus
ctgcaggaacagtagtcagccaaga

SEQ ID NO: 617258 - DNA, 25 bp, Mus musculus
ctgcaggaaccgaggctgctgagct

SEQ ID NO: 617259 - DNA, 25 bp, Mus musculus
ctgcaggaaccgtggctgctgagct

SEQ ID NO: 617260 - DNA, 25 bp, Mus musculus
ctgcaggaacggcagcagcgccttc

SEQ ID NO: 617261 - DNA, 25 bp, Mus musculus
ctgcaggaacgggagcagcgccttc

SEQ ID NO: 617262 - DNA, 25 bp, Mus musculus
ctgcaggacagtatggtaccagtgg

SEQ ID NO: 617263 - DNA, 25 bp, Mus musculus
ctgcaggacagtttggtaccagtgg

SEQ ID NO: 617264 - DNA, 25 bp, Mus musculus
ctgcaggacatgattaatgaggtgg

SEQ ID NO: 617265 - DNA, 25 bp, Mus musculus
ctgcaggacatgtttaatgaggtgg

SEQ ID NO: 617266 - DNA, 25 bp, Mus musculus
ctgcaggagaaaccgcttaagttta

SEQ ID NO: 617267 - DNA, 25 bp, Mus musculus
ctgcaggagaaagcgcttaagttta

SEQ ID NO: 617268 - DNA, 25 bp, Mus musculus
ctgcaggagatacatcgctacgcca

SEQ ID NO: 617269 - DNA, 25 bp, Mus musculus
ctgcaggagatacgcgtgaacaagc

SEQ ID NO: 617270 - DNA, 25 bp, Mus musculus
ctgcaggagatagatcgctacgcca

SEQ ID NO: 617271 - DNA, 25 bp, Mus musculus
ctgcaggagataggcgtgaacaagc

SEQ ID NO: 617272 - DNA, 25 bp, Mus musculus
ctgcaggaggaacgcaagctgcaca

SEQ ID NO: 617273 - DNA, 25 bp, Mus musculus
ctgcaggaggaaggcaagctgcaca

SEQ ID NO: 617274 - DNA, 25 bp, Mus musculus
ctgcaggatgttccacgggatccca

SEQ ID NO: 617275 - DNA, 25 bp, Mus musculus
ctgcaggatgttgcacgggatccca

SEQ ID NO: 617276 - DNA, 25 bp, Mus musculus
ctgcaggcaatgattctaccttgat

SEQ ID NO: 617277 - DNA, 25 bp, Mus musculus
ctgcaggcaatgtttctaccttgat

SEQ ID NO: 617278 - DNA, 25 bp, Mus musculus
ctgcaggctgtgacactgtggttcg

SEQ ID NO: 617279 - DNA, 25 bp, Mus musculus
ctgcaggctgtgtcactgtggttcg

SEQ ID NO: 617280 - DNA, 25 bp, Mus musculus
ctgcaggcttaacaagtgcttccgg

SEQ ID NO: 617281 - DNA, 25 bp, Mus musculus
ctgcaggcttaagaagtgcttccgg

SEQ ID NO: 617282 - DNA, 25 bp, Mus musculus
ctgcagggagtaaagaaaatgttaa

SEQ ID NO: 617283 - DNA, 25 bp, Mus musculus
ctgcagggagtatagaaaatgttaa

SEQ ID NO: 617284 - DNA, 25 bp, Mus musculus
ctgcagggatggatttcgggctctc

SEQ ID NO: 617285 - DNA, 25 bp, Mus musculus
ctgcagggatggttttcgggctctc

SEQ ID NO: 617286 - DNA, 25 bp, Mus musculus
ctgcagggcgctcagaccaagatga

SEQ ID NO: 617287 - DNA, 25 bp, Mus musculus
ctgcagggcgctgagaccaagatga

SEQ ID NO: 617288 - DNA, 25 bp, Mus musculus
ctgcaggtcctgctgtcttcgtcgc

SEQ ID NO: 617289 - DNA, 25 bp, Mus musculus
ctgcaggtcctggtgtcttcgtcgc

SEQ ID NO: 617290 - DNA, 25 bp, Mus musculus
ctgcaggtcggacacccttgaggac

SEQ ID NO: 617291 - DNA, 25 bp, Mus musculus
ctgcaggtcggagacccttgaggac

SEQ ID NO: 617292 - DNA, 25 bp, Mus musculus
ctgcaggtgctcctgaagggacaaa

SEQ ID NO: 617293 - DNA, 25 bp, Mus musculus
ctgcaggtgctcgtgaagggacaaa

SEQ ID NO: 617294 - DNA, 25 bp, Mus musculus
ctgcaggtggctcccgacttcgacg

SEQ ID NO: 617295 - DNA, 25 bp, Mus musculus
ctgcaggtggctgccgacttcgacg

SEQ ID NO: 617296 - DNA, 25 bp, Mus musculus
ctgcagtcctggacccctgaggact

SEQ ID NO: 617297 - DNA, 25 bp, Mus musculus
ctgcagtcctggtcccctgaggact

SEQ ID NO: 617298 - DNA, 25 bp, Mus musculus
ctgcagtcgcagatctcagacacat

SEQ ID NO: 617299 - DNA, 25 bp, Mus musculus
ctgcagtcgcagttctcagacacat

SEQ ID NO: 617300 - DNA, 25 bp, Mus musculus
ctgcagtctgacctctacactctga

SEQ ID NO: 617301 - DNA, 25 bp, Mus musculus
ctgcagtctgacgtctacactctga

SEQ ID NO: 617302 - DNA, 25 bp, Mus musculus
ctgcagtggctaagactgcttctga

SEQ ID NO: 617303 - DNA, 25 bp, Mus musculus
ctgcagtggctatgactgcttctga

SEQ ID NO: 617304 - DNA, 25 bp, Mus musculus
ctgcagtgggtgatcagcgccacca

SEQ ID NO: 617305 - DNA, 25 bp, Mus musculus
ctgcagtgggtgttcagcgccacca

SEQ ID NO: 617306 - DNA, 25 bp, Mus musculus
ctgcagtgtaacctcacttccagct

SEQ ID NO: 617307 - DNA, 25 bp, Mus musculus
ctgcagtgtaacgtcacttccagct

SEQ ID NO: 617308 - DNA, 25 bp, Mus musculus
ctgcagttcaacctgctgggcgtgc

SEQ ID NO: 617309 - DNA, 25 bp, Mus musculus
ctgcagttcaacgtgctgggcgtgc

SEQ ID NO: 617310 - DNA, 25 bp, Mus musculus
ctgcagttcatcatgagccatctta

SEQ ID NO: 617311 - DNA, 25 bp, Mus musculus
ctgcagttcatcttgagccatctta

SEQ ID NO: 617312 - DNA, 25 bp, Mus musculus
ctgcagttccggcagcaggaggtgc

SEQ ID NO: 617313 - DNA, 25 bp, Mus musculus
ctgcagttccgggagcaggaggtgc

SEQ ID NO: 617314 - DNA, 25 bp, Mus musculus
ctgcagttctcgctcatgctctgtg

SEQ ID NO: 617315 - DNA, 25 bp, Mus musculus
ctgcagttctcggtcatgctctgtg

SEQ ID NO: 617316 - DNA, 25 bp, Mus musculus
ctgcagttcttacagacattcctgg

SEQ ID NO: 617317 - DNA, 25 bp, Mus musculus
ctgcagttcttagagacattcctgg

SEQ ID NO: 617318 - DNA, 25 bp, Mus musculus
ctgcagttgaacatggagcatattg

SEQ ID NO: 617319 - DNA, 25 bp, Mus musculus
ctgcagttgaacttggagcatattg

SEQ ID NO: 617320 - DNA, 25 bp, Mus musculus
ctgcagttgtggacgtgttaaaccg

SEQ ID NO: 617321 - DNA, 25 bp, Mus musculus
ctgcagttgtggtcgtgttaaaccg

SEQ ID NO: 617322 - DNA, 25 bp, Mus musculus
ctgcagtttaaacacgcagaaatga

SEQ ID NO: 617323 - DNA, 25 bp, Mus musculus
ctgcagtttaaagacgcagaaatga

SEQ ID NO: 617324 - DNA, 25 bp, Mus musculus
ctgcataatctcctgctccatcagg

SEQ ID NO: 617325 - DNA, 25 bp, Mus musculus
ctgcataatctcgtgctccatcagg

SEQ ID NO: 617326 - DNA, 25 bp, Mus musculus
ctgcataggacacactttcgccatg

SEQ ID NO: 617327 - DNA, 25 bp, Mus musculus
ctgcataggacagactttcgccatg

SEQ ID NO: 617328 - DNA, 25 bp, Mus musculus
ctgcatagtgaaaggccaccacaca

SEQ ID NO: 617329 - DNA, 25 bp, Mus musculus
ctgcatagtgaatggccaccacaca

SEQ ID NO: 617330 - DNA, 25 bp, Mus musculus
ctgcatagtgacaagtcccggcctg

SEQ ID NO: 617331 - DNA, 25 bp, Mus musculus
ctgcatagtgactagtcccggcctg

SEQ ID NO: 617332 - DNA, 25 bp, Mus musculus
ctgcatcaacaaattgggtggctat

SEQ ID NO: 617333 - DNA, 25 bp, Mus musculus
ctgcatcaacaatttgggtggctat

SEQ ID NO: 617334 - DNA, 25 bp, Mus musculus
ctgcatcagagccatgtgctgcacc

SEQ ID NO: 617335 - DNA, 25 bp, Mus musculus
ctgcatcagagcgatgtgctgcacc

SEQ ID NO: 617336 - DNA, 25 bp, Mus musculus
ctgcatcatggcagagctgttgacc

SEQ ID NO: 617337 - DNA, 25 bp, Mus musculus
ctgcatcatggctgagctgttgacc

SEQ ID NO: 617338 - DNA, 25 bp, Mus musculus
ctgcatcattgtaggcaatggaggg

SEQ ID NO: 617339 - DNA, 25 bp, Mus musculus
ctgcatcattgttggcaatggaggg

SEQ ID NO: 617340 - DNA, 25 bp, Mus musculus
ctgcatccgctccaatgccgagaag

SEQ ID NO: 617341 - DNA, 25 bp, Mus musculus
ctgcatccgctcgaatgccgagaag

SEQ ID NO: 617342 - DNA, 25 bp, Mus musculus
ctgcatcgtgaccaaagagggcatc

SEQ ID NO: 617343 - DNA, 25 bp, Mus musculus
ctgcatcgtgacgaaagagggcatc

SEQ ID NO: 617344 - DNA, 25 bp, Mus musculus
ctgcatctcagcaaggacggtccta

SEQ ID NO: 617345 - DNA, 25 bp, Mus musculus
ctgcatctcagctaggacggtccta

SEQ ID NO: 617346 - DNA, 25 bp, Mus musculus
ctgcatctcctacgccgtgggtttg

SEQ ID NO: 617347 - DNA, 25 bp, Mus musculus
ctgcatctcctaggccgtgggtttg

SEQ ID NO: 617348 - DNA, 25 bp, Mus musculus
ctgcatctgaagatgcagatgaacc

SEQ ID NO: 617349 - DNA, 25 bp, Mus musculus
ctgcatctgaagttgcagatgaacc

SEQ ID NO: 617350 - DNA, 25 bp, Mus musculus
ctgcatctgagcctgtgataccctc

SEQ ID NO: 617351 - DNA, 25 bp, Mus musculus
ctgcatctgagcgtgtgataccctc

SEQ ID NO: 617352 - DNA, 25 bp, Mus musculus
ctgcatctgtatcgcacacagggca

SEQ ID NO: 617353 - DNA, 25 bp, Mus musculus
ctgcatctgtatggcacacagggca

SEQ ID NO: 617354 - DNA, 25 bp, Mus musculus
ctgcatgacagacattggtttaatg

SEQ ID NO: 617355 - DNA, 25 bp, Mus musculus
ctgcatgacagagattggtttaatg

SEQ ID NO: 617356 - DNA, 25 bp, Mus musculus
ctgcatgagaaaattgaccgtctga

SEQ ID NO: 617357 - DNA, 25 bp, Mus musculus
ctgcatgagaaatttgaccgtctga

SEQ ID NO: 617358 - DNA, 25 bp, Mus musculus
ctgcatgagttgcaaggtgatcatt

SEQ ID NO: 617359 - DNA, 25 bp, Mus musculus
ctgcatgagttggaaggtgatcatt

SEQ ID NO: 617360 - DNA, 25 bp, Mus musculus
ctgcatggtaccaaaagccttggat

SEQ ID NO: 617361 - DNA, 25 bp, Mus musculus
ctgcatggtacctaaagccttggat

SEQ ID NO: 617362 - DNA, 25 bp, Mus musculus
ctgcatggtatgcagtaaagtaggc

SEQ ID NO: 617363 - DNA, 25 bp, Mus musculus
ctgcatggtatggagtaaagtaggc

SEQ ID NO: 617364 - DNA, 25 bp, Mus musculus
ctgcatgtactgagccgcaaggaca

SEQ ID NO: 617365 - DNA, 25 bp, Mus musculus
ctgcatgtactgtgccgcaaggaca

SEQ ID NO: 617366 - DNA, 25 bp, Mus musculus
ctgcatgtggtgactccagcctcaa

SEQ ID NO: 617367 - DNA, 25 bp, Mus musculus
ctgcatgtggtgtctccagcctcaa

SEQ ID NO: 617368 - DNA, 25 bp, Mus musculus
ctgcattaaagacgtggccatcaag

SEQ ID NO: 617369 - DNA, 25 bp, Mus musculus
ctgcattaaagaggtggccatcaag

SEQ ID NO: 617370 - DNA, 25 bp, Mus musculus
ctgcattgaaggagtagtcctgcga

SEQ ID NO: 617371 - DNA, 25 bp, Mus musculus
ctgcattgaaggtgtagtcctgcga

SEQ ID NO: 617372 - DNA, 25 bp, Mus musculus
ctgcattgacatcctcaacgccaag

SEQ ID NO: 617373 - DNA, 25 bp, Mus musculus
ctgcattgacatgctcaacgccaag

SEQ ID NO: 617374 - DNA, 25 bp, Mus musculus
ctgcattgcagcctgaagtagataa

SEQ ID NO: 617375 - DNA, 25 bp, Mus musculus
ctgcattgcagcgtgaagtagataa

SEQ ID NO: 617376 - DNA, 25 bp, Mus musculus
ctgcattggcggaggttagtctgta

SEQ ID NO: 617377 - DNA, 25 bp, Mus musculus
ctgcattggcggtggttagtctgta

SEQ ID NO: 617378 - DNA, 25 bp, Mus musculus
ctgcattgtgatcgctcaccgcctg

SEQ ID NO: 617379 - DNA, 25 bp, Mus musculus
ctgcattgtgatggctcaccgcctg

SEQ ID NO: 617380 - DNA, 25 bp, Mus musculus
ctgcattgtggaaactaacagagcc

SEQ ID NO: 617381 - DNA, 25 bp, Mus musculus
ctgcattgtggatactaacagagcc

SEQ ID NO: 617382 - DNA, 25 bp, Mus musculus
ctgcattgtgttcctacagattgct

SEQ ID NO: 617383 - DNA, 25 bp, Mus musculus
ctgcattgtgttgctacagattgct

SEQ ID NO: 617384 - DNA, 25 bp, Mus musculus
ctgcatttgtctcagctgctggttg

SEQ ID NO: 617385 - DNA, 25 bp, Mus musculus
ctgcatttgtctgagctgctggttg

SEQ ID NO: 617386 - DNA, 25 bp, Mus musculus
ctgccaaaagttatgctccagagct

SEQ ID NO: 617387 - DNA, 25 bp, Mus musculus
ctgccaaaagttttgctccagagct

SEQ ID NO: 617388 - DNA, 25 bp, Mus musculus
ctgccaaacggacacccaaggaagc

SEQ ID NO: 617389 - DNA, 25 bp, Mus musculus
ctgccaaacggagacccaaggaagc

SEQ ID NO: 617390 - DNA, 25 bp, Mus musculus
ctgccaaagtggctgcgtctgactg

SEQ ID NO: 617391 - DNA, 25 bp, Mus musculus
ctgccaaagtgggtgcgtctgactg

SEQ ID NO: 617392 - DNA, 25 bp, Mus musculus
ctgccaacactaaaggatatggact

SEQ ID NO: 617393 - DNA, 25 bp, Mus musculus
ctgccaacactataggatatggact

SEQ ID NO: 617394 - DNA, 25 bp, Mus musculus
ctgccaacgtgcagctctcggagca

SEQ ID NO: 617395 - DNA, 25 bp, Mus musculus
ctgccaacgtgctgctctcggagca

SEQ ID NO: 617396 - DNA, 25 bp, Mus musculus
ctgccaagatttctgacttcagctg

SEQ ID NO: 617397 - DNA, 25 bp, Mus musculus
ctgccaagatttgtgacttcagctg

SEQ ID NO: 617398 - DNA, 25 bp, Mus musculus
ctgccaagctaaaaaggaagtactg

SEQ ID NO: 617399 - DNA, 25 bp, Mus musculus
ctgccaagctaataaggaagtactg

SEQ ID NO: 617400 - DNA, 25 bp, Mus musculus
ctgccaagtttgctgtgcttgctgc

SEQ ID NO: 617401 - DNA, 25 bp, Mus musculus
ctgccaagtttggtgtgcttgctgc

SEQ ID NO: 617402 - DNA, 25 bp, Mus musculus
ctgccaataaagagttttgattgcc

SEQ ID NO: 617403 - DNA, 25 bp, Mus musculus
ctgccaataaagtgttttgattgcc

SEQ ID NO: 617404 - DNA, 25 bp, Mus musculus
ctgccaatcagtatgagatggtgta

SEQ ID NO: 617405 - DNA, 25 bp, Mus musculus
ctgccaatcagtttgagatggtgta

SEQ ID NO: 617406 - DNA, 25 bp, Mus musculus
ctgccacaagaaaacgtcagctgtt

SEQ ID NO: 617407 - DNA, 25 bp, Mus musculus
ctgccacaagaatacgtcagctgtt

SEQ ID NO: 617408 - DNA, 25 bp, Mus musculus
ctgccacaataaaggtttgctgaca

SEQ ID NO: 617409 - DNA, 25 bp, Mus musculus
ctgccacaataatggtttgctgaca

SEQ ID NO: 617410 - DNA, 25 bp, Mus musculus
ctgccaccaattcggatgaactaga

SEQ ID NO: 617411 - DNA, 25 bp, Mus musculus
ctgccaccaattgggatgaactaga

SEQ ID NO: 617412 - DNA, 25 bp, Mus musculus
ctgccaccagcactgggtcctaaga

SEQ ID NO: 617413 - DNA, 25 bp, Mus musculus
ctgccaccagcagtgggtcctaaga

SEQ ID NO: 617414 - DNA, 25 bp, Mus musculus
ctgccactggagagggactagatgt

SEQ ID NO: 617415 - DNA, 25 bp, Mus musculus
ctgccactggagtgggactagatgt

SEQ ID NO: 617416 - DNA, 25 bp, Mus musculus
ctgccactggtgaccggatatgccg

SEQ ID NO: 617417 - DNA, 25 bp, Mus musculus
ctgccactggtgtccggatatgccg

SEQ ID NO: 617418 - DNA, 25 bp, Mus musculus
ctgccacttccccaaagataagaaa

SEQ ID NO: 617419 - DNA, 25 bp, Mus musculus
ctgccacttcccgaaagataagaaa

SEQ ID NO: 617420 - DNA, 25 bp, Mus musculus
ctgccagaaggccaaggtctccttc

SEQ ID NO: 617421 - DNA, 25 bp, Mus musculus
ctgccagaaggcgaaggtctccttc

SEQ ID NO: 617422 - DNA, 25 bp, Mus musculus
ctgccagaccctccattggagagtg

SEQ ID NO: 617423 - DNA, 25 bp, Mus musculus
ctgccagaccctgcattggagagtg

SEQ ID NO: 617424 - DNA, 25 bp, Mus musculus
ctgccagagctgatccacaagatag

SEQ ID NO: 617425 - DNA, 25 bp, Mus musculus
ctgccagagctgttccacaagatag

SEQ ID NO: 617426 - DNA, 25 bp, Mus musculus
ctgccagaggacacatttactgtgg

SEQ ID NO: 617427 - DNA, 25 bp, Mus musculus
ctgccagaggactcatttactgtgg

SEQ ID NO: 617428 - DNA, 25 bp, Mus musculus
ctgccagagtggcacaacatcgttt

SEQ ID NO: 617429 - DNA, 25 bp, Mus musculus
ctgccagagtgggacaacatcgttt

SEQ ID NO: 617430 - DNA, 25 bp, Mus musculus
ctgccagatggcagtctactgcaag

SEQ ID NO: 617431 - DNA, 25 bp, Mus musculus
ctgccagatggctgtctactgcaag

SEQ ID NO: 617432 - DNA, 25 bp, Mus musculus
ctgccagcactgcagggacctctgg

SEQ ID NO: 617433 - DNA, 25 bp, Mus musculus
ctgccagcactggagggacctctgg

SEQ ID NO: 617434 - DNA, 25 bp, Mus musculus
ctgccagcagagctgttcaagggca

SEQ ID NO: 617435 - DNA, 25 bp, Mus musculus
ctgccagcagaggtgttcaagggca

SEQ ID NO: 617436 - DNA, 25 bp, Mus musculus
ctgccagcagctctgtgcaaatgtt

SEQ ID NO: 617437 - DNA, 25 bp, Mus musculus
ctgccagcagctgtgtgcaaatgtt

SEQ ID NO: 617438 - DNA, 25 bp, Mus musculus
ctgccagcgtttctgttcattggga

SEQ ID NO: 617439 - DNA, 25 bp, Mus musculus
ctgccagcgtttgtgttcattggga

SEQ ID NO: 617440 - DNA, 25 bp, Mus musculus
ctgccaggccggctatacaggtcgc

SEQ ID NO: 617441 - DNA, 25 bp, Mus musculus
ctgccaggccgggtatacaggtcgc

SEQ ID NO: 617442 - DNA, 25 bp, Mus musculus
ctgccaggcgcaacatcttgccaaa

SEQ ID NO: 617443 - DNA, 25 bp, Mus musculus
ctgccaggcgcacctgggcgacatt

SEQ ID NO: 617444 - DNA, 25 bp, Mus musculus
ctgccaggcgcagctgggcgacatt

SEQ ID NO: 617445 - DNA, 25 bp, Mus musculus
ctgccaggcgcatcatcttgccaaa

SEQ ID NO: 617446 - DNA, 25 bp, Mus musculus
ctgccaggtcggaggaaggtctcca

SEQ ID NO: 617447 - DNA, 25 bp, Mus musculus
ctgccaggtcggtggaaggtctcca

SEQ ID NO: 617448 - DNA, 25 bp, Mus musculus
ctgccaggtggacgagcatgtcccc

SEQ ID NO: 617449 - DNA, 25 bp, Mus musculus
ctgccaggtggaggagcatgtcccc

SEQ ID NO: 617450 - DNA, 25 bp, Mus musculus
ctgccagtgaggaccagggactgcc

SEQ ID NO: 617451 - DNA, 25 bp, Mus musculus
ctgccagtgaggtccagggactgcc

SEQ ID NO: 617452 - DNA, 25 bp, Mus musculus
ctgccagtgcagactgtgttagagg

SEQ ID NO: 617453 - DNA, 25 bp, Mus musculus
ctgccagtgcagtctgtgttagagg

SEQ ID NO: 617454 - DNA, 25 bp, Mus musculus
ctgccagttctccagcttcaagtac

SEQ ID NO: 617455 - DNA, 25 bp, Mus musculus
ctgccagttctcgagcttcaagtac

SEQ ID NO: 617456 - DNA, 25 bp, Mus musculus
ctgccagtttgtcggttggaacatt

SEQ ID NO: 617457 - DNA, 25 bp, Mus musculus
ctgccagtttgtgggttggaacatt

SEQ ID NO: 617458 - DNA, 25 bp, Mus musculus
ctgccatagattatacaagacacac

SEQ ID NO: 617459 - DNA, 25 bp, Mus musculus
ctgccatagattttacaagacacac

SEQ ID NO: 617460 - DNA, 25 bp, Mus musculus
ctgccatcacggctctacctgtgtg

SEQ ID NO: 617461 - DNA, 25 bp, Mus musculus
ctgccatcacgggtctacctgtgtg

SEQ ID NO: 617462 - DNA, 25 bp, Mus musculus
ctgccatcgcatcccatgagggtgt

SEQ ID NO: 617463 - DNA, 25 bp, Mus musculus
ctgccatcgcatgccatgagggtgt

SEQ ID NO: 617464 - DNA, 25 bp, Mus musculus
ctgccatcttggaactcagttccct

SEQ ID NO: 617465 - DNA, 25 bp, Mus musculus
ctgccatcttggtactcagttccct

SEQ ID NO: 617466 - DNA, 25 bp, Mus musculus
ctgccatgcctaagactattttaaa

SEQ ID NO: 617467 - DNA, 25 bp, Mus musculus
ctgccatgcctatgactattttaaa

SEQ ID NO: 617468 - DNA, 25 bp, Mus musculus
ctgccatggacacgctagtagaaga

SEQ ID NO: 617469 - DNA, 25 bp, Mus musculus
ctgccatggacaggctagtagaaga

SEQ ID NO: 617470 - DNA, 25 bp, Mus musculus
ctgccatggagcatcggaggaaagt

SEQ ID NO: 617471 - DNA, 25 bp, Mus musculus
ctgccatggagcttcggaggaaagt

SEQ ID NO: 617472 - DNA, 25 bp, Mus musculus
ctgccattcacgcaggctgcattgg

SEQ ID NO: 617473 - DNA, 25 bp, Mus musculus
ctgccattcacggaggctgcattgg

SEQ ID NO: 617474 - DNA, 25 bp, Mus musculus
ctgccatttattatgtaaaccagaa

SEQ ID NO: 617475 - DNA, 25 bp, Mus musculus
ctgccatttattttgtaaaccagaa

SEQ ID NO: 617476 - DNA, 25 bp, Mus musculus
ctgcccaaactaactccatggtgac

SEQ ID NO: 617477 - DNA, 25 bp, Mus musculus
ctgcccaaactatctccatggtgac

SEQ ID NO: 617478 - DNA, 25 bp, Mus musculus
ctgcccaaactccaaaatgatgata

SEQ ID NO: 617479 - DNA, 25 bp, Mus musculus
ctgcccaaactcgaaaatgatgata

SEQ ID NO: 617480 - DNA, 25 bp, Mus musculus
ctgcccaaactgctgtgcgtcttct

SEQ ID NO: 617481 - DNA, 25 bp, Mus musculus
ctgcccaaactggtgtgcgtcttct

SEQ ID NO: 617482 - DNA, 25 bp, Mus musculus
ctgcccaagcggacagtaaagctga

SEQ ID NO: 617483 - DNA, 25 bp, Mus musculus
ctgcccaagcggtcagtaaagctga

SEQ ID NO: 617484 - DNA, 25 bp, Mus musculus
ctgcccacgctgaggtgctctgcgt

SEQ ID NO: 617485 - DNA, 25 bp, Mus musculus
ctgcccacgctgtggtgctctgcgt

SEQ ID NO: 617486 - DNA, 25 bp, Mus musculus
ctgcccactgaaaatgactctcggg

SEQ ID NO: 617487 - DNA, 25 bp, Mus musculus
ctgcccactgaatatgactctcggg

SEQ ID NO: 617488 - DNA, 25 bp, Mus musculus
ctgcccagatctagatttccttaga

SEQ ID NO: 617489 - DNA, 25 bp, Mus musculus
ctgcccagatcttgatttccttaga

SEQ ID NO: 617490 - DNA, 25 bp, Mus musculus
ctgcccagatggaagctcccggcgt

SEQ ID NO: 617491 - DNA, 25 bp, Mus musculus
ctgcccagatggtagctcccggcgt

SEQ ID NO: 617492 - DNA, 25 bp, Mus musculus
ctgcccagcgtcacagtgaggagaa

SEQ ID NO: 617493 - DNA, 25 bp, Mus musculus
ctgcccagcgtctcagtgaggagaa

SEQ ID NO: 617494 - DNA, 25 bp, Mus musculus
ctgcccagggacaagatacattttt

SEQ ID NO: 617495 - DNA, 25 bp, Mus musculus
ctgcccagggactagatacattttt

SEQ ID NO: 617496 - DNA, 25 bp, Mus musculus
ctgcccatgcttacaggtgctgtgc

SEQ ID NO: 617497 - DNA, 25 bp, Mus musculus
ctgcccatgctttcaggtgctgtgc

SEQ ID NO: 617498 - DNA, 25 bp, Mus musculus
ctgcccatggagagaaatgcagagg

SEQ ID NO: 617499 - DNA, 25 bp, Mus musculus
ctgcccatggagtgaaatgcagagg

SEQ ID NO: 617500 - DNA, 25 bp, Mus musculus
ctgccccaaagtattcagcaatttc

SEQ ID NO: 617501 - DNA, 25 bp, Mus musculus
ctgccccaaagttttcagcaatttc

SEQ ID NO: 617502 - DNA, 25 bp, Mus musculus
ctgccccacatcagaagactgtgaa

SEQ ID NO: 617503 - DNA, 25 bp, Mus musculus
ctgccccacatctgaagactgtgaa

SEQ ID NO: 617504 - DNA, 25 bp, Mus musculus
ctgccccagaagaaggcacggaagg

SEQ ID NO: 617505 - DNA, 25 bp, Mus musculus
ctgccccagaagtaggcacggaagg

SEQ ID NO: 617506 - DNA, 25 bp, Mus musculus
ctgccccagcttagcaaattgatgg

SEQ ID NO: 617507 - DNA, 25 bp, Mus musculus
ctgccccagctttgcaaattgatgg

SEQ ID NO: 617508 - DNA, 25 bp, Mus musculus
ctgccccatggacgtgcttcgcgat

SEQ ID NO: 617509 - DNA, 25 bp, Mus musculus
ctgccccatggaggtgcttcgcgat

SEQ ID NO: 617510 - DNA, 25 bp, Mus musculus
ctgcccctccagatgtgcttgcttt

SEQ ID NO: 617511 - DNA, 25 bp, Mus musculus
ctgcccctccagttgtgcttgcttt

SEQ ID NO: 617512 - DNA, 25 bp, Mus musculus
ctgcccctcctcatgggacttggta

SEQ ID NO: 617513 - DNA, 25 bp, Mus musculus
ctgcccctcctcttgggacttggta

SEQ ID NO: 617514 - DNA, 25 bp, Mus musculus
ctgcccgagtgtatgggacaggttc

SEQ ID NO: 617515 - DNA, 25 bp, Mus musculus
ctgcccgagtgtttgggacaggttc

SEQ ID NO: 617516 - DNA, 25 bp, Mus musculus
ctgcccgccgagctgagtactttga

SEQ ID NO: 617517 - DNA, 25 bp, Mus musculus
ctgcccgccgaggtgagtactttga

SEQ ID NO: 617518 - DNA, 25 bp, Mus musculus
ctgcccggcaatccatctggtcatg

SEQ ID NO: 617519 - DNA, 25 bp, Mus musculus
ctgcccggcaatgcatctggtcatg

SEQ ID NO: 617520 - DNA, 25 bp, Mus musculus
ctgcccggctggcaaagggtaccat

SEQ ID NO: 617521 - DNA, 25 bp, Mus musculus
ctgcccggctgggaaagggtaccat

SEQ ID NO: 617522 - DNA, 25 bp, Mus musculus
ctgcccgggcccaggtgtgtcaacg

SEQ ID NO: 617523 - DNA, 25 bp, Mus musculus
ctgcccgggccctggtgtgtcaacg

SEQ ID NO: 617524 - DNA, 25 bp, Mus musculus
ctgcccgtgaccctactgactttgg

SEQ ID NO: 617525 - DNA, 25 bp, Mus musculus
ctgcccgtgaccgtactgactttgg

SEQ ID NO: 617526 - DNA, 25 bp, Mus musculus
ctgcccgttcgcagagcgcgcggat

SEQ ID NO: 617527 - DNA, 25 bp, Mus musculus
ctgcccgttcgctgagcgcgcggat

SEQ ID NO: 617528 - DNA, 25 bp, Mus musculus
ctgccctcgtgtccggtgttgtctg

SEQ ID NO: 617529 - DNA, 25 bp, Mus musculus
ctgccctcgtgtgcggtgttgtctg

SEQ ID NO: 617530 - DNA, 25 bp, Mus musculus
ctgccctctttaaaatctgccagaa

SEQ ID NO: 617531 - DNA, 25 bp, Mus musculus
ctgccctctttataatctgccagaa

SEQ ID NO: 617532 - DNA, 25 bp, Mus musculus
ctgccctgagctcgatcaattggtt

SEQ ID NO: 617533 - DNA, 25 bp, Mus musculus
ctgccctgagctggatcaattggtt

SEQ ID NO: 617534 - DNA, 25 bp, Mus musculus
ctgccctgatggcatgctgctggcc

SEQ ID NO: 617535 - DNA, 25 bp, Mus musculus
ctgccctgatgggatgctgctggcc

SEQ ID NO: 617536 - DNA, 25 bp, Mus musculus
ctgccctgctgccagagaccttggg

SEQ ID NO: 617537 - DNA, 25 bp, Mus musculus
ctgccctgctgcgagagaccttggg

SEQ ID NO: 617538 - DNA, 25 bp, Mus musculus
ctgccctggtctctactggtgttgt

SEQ ID NO: 617539 - DNA, 25 bp, Mus musculus
ctgccctggtctgtactggtgttgt

SEQ ID NO: 617540 - DNA, 25 bp, Mus musculus
ctgccctggttaccctggtacacag

SEQ ID NO: 617541 - DNA, 25 bp, Mus musculus
ctgccctggttagcctggtacacag

SEQ ID NO: 617542 - DNA, 25 bp, Mus musculus
ctgccctgtgctcgacggacggcta

SEQ ID NO: 617543 - DNA, 25 bp, Mus musculus
ctgccctgtgctggacggacggcta

SEQ ID NO: 617544 - DNA, 25 bp, Mus musculus
ctgcccttcttgaggcctggaggct

SEQ ID NO: 617545 - DNA, 25 bp, Mus musculus
ctgcccttcttgtggcctggaggct

SEQ ID NO: 617546 - DNA, 25 bp, Mus musculus
ctgcccttgcaacaggaggagaacc

SEQ ID NO: 617547 - DNA, 25 bp, Mus musculus
ctgcccttgcaagaggaggagaacc

SEQ ID NO: 617548 - DNA, 25 bp, Mus musculus
ctgccctttgccactccggaagagt

SEQ ID NO: 617549 - DNA, 25 bp, Mus musculus
ctgccctttgcctctccggaagagt

SEQ ID NO: 617550 - DNA, 25 bp, Mus musculus
ctgccgaaggagcaaagaatggaaa

SEQ ID NO: 617551 - DNA, 25 bp, Mus musculus
ctgccgaaggaggaaagaatggaaa

SEQ ID NO: 617552 - DNA, 25 bp, Mus musculus
ctgccgacgcacagaggactgtggc

SEQ ID NO: 617553 - DNA, 25 bp, Mus musculus
ctgccgacgcactgaggactgtggc

SEQ ID NO: 617554 - DNA, 25 bp, Mus musculus
ctgccgaggatgacatcagcgatgt

SEQ ID NO: 617555 - DNA, 25 bp, Mus musculus
ctgccgaggatgtcatcagcgatgt

SEQ ID NO: 617556 - DNA, 25 bp, Mus musculus
ctgccgcagctcagagaggactacc

SEQ ID NO: 617557 - DNA, 25 bp, Mus musculus
ctgccgcagctctgagaggactacc

SEQ ID NO: 617558 - DNA, 25 bp, Mus musculus
ctgccgcatgccattgtgaattgtg

SEQ ID NO: 617559 - DNA, 25 bp, Mus musculus
ctgccgcatgcctttgtgaattgtg

SEQ ID NO: 617560 - DNA, 25 bp, Mus musculus
ctgccgcgacacagaagaaaccgtc

SEQ ID NO: 617561 - DNA, 25 bp, Mus musculus
ctgccgcgacactgaagaaaccgtc

SEQ ID NO: 617562 - DNA, 25 bp, Mus musculus
ctgccgcgacggacgctcggagatc

SEQ ID NO: 617563 - DNA, 25 bp, Mus musculus
ctgccgcgacggtcgctcggagatc

SEQ ID NO: 617564 - DNA, 25 bp, Mus musculus
ctgccgctatcaccagcatgcaaat

SEQ ID NO: 617565 - DNA, 25 bp, Mus musculus
ctgccgctatcagcagcatgcaaat

SEQ ID NO: 617566 - DNA, 25 bp, Mus musculus
ctgccgctctcaagtgccaagtgtg

SEQ ID NO: 617567 - DNA, 25 bp, Mus musculus
ctgccgctctcatgtgccaagtgtg

SEQ ID NO: 617568 - DNA, 25 bp, Mus musculus
ctgccggaggaaagggagaataacc

SEQ ID NO: 617569 - DNA, 25 bp, Mus musculus
ctgccggaggaatgggagaataacc

SEQ ID NO: 617570 - DNA, 25 bp, Mus musculus
ctgccggagtgaaacaagtaaaggg

SEQ ID NO: 617571 - DNA, 25 bp, Mus musculus
ctgccggagtgatacaagtaaaggg

SEQ ID NO: 617572 - DNA, 25 bp, Mus musculus
ctgccggcaagcagactgttgtcat

SEQ ID NO: 617573 - DNA, 25 bp, Mus musculus
ctgccggcaagctgactgttgtcat

SEQ ID NO: 617574 - DNA, 25 bp, Mus musculus
ctgccggctgtcatcgtggctgtgt

SEQ ID NO: 617575 - DNA, 25 bp, Mus musculus
ctgccggctgtcttcgtggctgtgt

SEQ ID NO: 617576 - DNA, 25 bp, Mus musculus
ctgccgggacgcactgagcagaagc

SEQ ID NO: 617577 - DNA, 25 bp, Mus musculus
ctgccgggacgctctgagcagaagc

SEQ ID NO: 617578 - DNA, 25 bp, Mus musculus
ctgccgggcaggaagagtctctgca

SEQ ID NO: 617579 - DNA, 25 bp, Mus musculus
ctgccgggcaggtagagtctctgca

SEQ ID NO: 617580 - DNA, 25 bp, Mus musculus
ctgccggtgcgcagatgaactttgt

SEQ ID NO: 617581 - DNA, 25 bp, Mus musculus
ctgccggtgcgctgatgaactttgt

SEQ ID NO: 617582 - DNA, 25 bp, Mus musculus
ctgccggttttgctcgcctcgagga

SEQ ID NO: 617583 - DNA, 25 bp, Mus musculus
ctgccggttttggtcgcctcgagga

SEQ ID NO: 617584 - DNA, 25 bp, Mus musculus
ctgccgtacgtaccttgtccggtta

SEQ ID NO: 617585 - DNA, 25 bp, Mus musculus
ctgccgtacgtagcttgtccggtta

SEQ ID NO: 617586 - DNA, 25 bp, Mus musculus
ctgccgtcaagtcagttgggagata

SEQ ID NO: 617587 - DNA, 25 bp, Mus musculus
ctgccgtcaagtgagttgggagata

SEQ ID NO: 617588 - DNA, 25 bp, Mus musculus
ctgccgtcaggtctgtcgtgttgtt

SEQ ID NO: 617589 - DNA, 25 bp, Mus musculus
ctgccgtcaggtgtgtcgtgttgtt

SEQ ID NO: 617590 - DNA, 25 bp, Mus musculus
ctgccgtcctgcaggctcggaggtc

SEQ ID NO: 617591 - DNA, 25 bp, Mus musculus
ctgccgtcctgctggctcggaggtc

SEQ ID NO: 617592 - DNA, 25 bp, Mus musculus
ctgccgtgcgacaggatttggccca

SEQ ID NO: 617593 - DNA, 25 bp, Mus musculus
ctgccgtgcgactggatttggccca

SEQ ID NO: 617594 - DNA, 25 bp, Mus musculus
ctgcctaaaccacgtaatgaaatat

SEQ ID NO: 617595 - DNA, 25 bp, Mus musculus
ctgcctaaaccaggtaatgaaatat

SEQ ID NO: 617596 - DNA, 25 bp, Mus musculus
ctgcctactggaccattcctgaagt

SEQ ID NO: 617597 - DNA, 25 bp, Mus musculus
ctgcctactggagcattcctgaagt

SEQ ID NO: 617598 - DNA, 25 bp, Mus musculus
ctgcctacttcgcagcctgtatggc

SEQ ID NO: 617599 - DNA, 25 bp, Mus musculus
ctgcctacttcggagcctgtatggc

SEQ ID NO: 617600 - DNA, 25 bp, Mus musculus
ctgcctactttaacaccgtccatga

SEQ ID NO: 617601 - DNA, 25 bp, Mus musculus
ctgcctactttatcaccgtccatga

SEQ ID NO: 617602 - DNA, 25 bp, Mus musculus
ctgcctagtagccaatcacgccaag

SEQ ID NO: 617603 - DNA, 25 bp, Mus musculus
ctgcctagtagcgaatcacgccaag

SEQ ID NO: 617604 - DNA, 25 bp, Mus musculus
ctgcctatgacaacccgagaaccag

SEQ ID NO: 617605 - DNA, 25 bp, Mus musculus
ctgcctatgacatcccgagaaccag

SEQ ID NO: 617606 - DNA, 25 bp, Mus musculus
ctgcctatgcgaaggagagaactgc

SEQ ID NO: 617607 - DNA, 25 bp, Mus musculus
ctgcctatgcgatggagagaactgc

SEQ ID NO: 617608 - DNA, 25 bp, Mus musculus
ctgcctatggatctttgagtaatga

SEQ ID NO: 617609 - DNA, 25 bp, Mus musculus
ctgcctatggatgtttgagtaatga

SEQ ID NO: 617610 - DNA, 25 bp, Mus musculus
ctgcctcagtacagcagacaaagct

SEQ ID NO: 617611 - DNA, 25 bp, Mus musculus
ctgcctcagtactgcagacaaagct

SEQ ID NO: 617612 - DNA, 25 bp, Mus musculus
ctgcctcagtgaattgaagtaggca

SEQ ID NO: 617613 - DNA, 25 bp, Mus musculus
ctgcctcagtgatttgaagtaggca

SEQ ID NO: 617614 - DNA, 25 bp, Mus musculus
ctgcctcattcaagcctgtcctgtg

SEQ ID NO: 617615 - DNA, 25 bp, Mus musculus
ctgcctcattcatgcctgtcctgtg

SEQ ID NO: 617616 - DNA, 25 bp, Mus musculus
ctgcctccacccagcattggaagag

SEQ ID NO: 617617 - DNA, 25 bp, Mus musculus
ctgcctccaccctgcattggaagag

SEQ ID NO: 617618 - DNA, 25 bp, Mus musculus
ctgcctccagagcatcaggaacgtt

SEQ ID NO: 617619 - DNA, 25 bp, Mus musculus
ctgcctccagaggatcaggaacgtt

SEQ ID NO: 617620 - DNA, 25 bp, Mus musculus
ctgcctcctggacgctgacagatac

SEQ ID NO: 617621 - DNA, 25 bp, Mus musculus
ctgcctcctggaggctgacagatac

SEQ ID NO: 617622 - DNA, 25 bp, Mus musculus
ctgcctccttctccagcggaagatg

SEQ ID NO: 617623 - DNA, 25 bp, Mus musculus
ctgcctccttctgcagcggaagatg

SEQ ID NO: 617624 - DNA, 25 bp, Mus musculus
ctgcctcttgagctcgagaacctga

SEQ ID NO: 617625 - DNA, 25 bp, Mus musculus
ctgcctcttgaggtcgagaacctga

SEQ ID NO: 617626 - DNA, 25 bp, Mus musculus
ctgcctgaccatcgcgacagtggcg

SEQ ID NO: 617627 - DNA, 25 bp, Mus musculus
ctgcctgaccatggcgacagtggcg

SEQ ID NO: 617628 - DNA, 25 bp, Mus musculus
ctgcctgagcttccccggagactgg

SEQ ID NO: 617629 - DNA, 25 bp, Mus musculus
ctgcctgagcttgcccggagactgg

SEQ ID NO: 617630 - DNA, 25 bp, Mus musculus
ctgcctgaggcactaaggttgcaag

SEQ ID NO: 617631 - DNA, 25 bp, Mus musculus
ctgcctgaggcagtaaggttgcaag

SEQ ID NO: 617632 - DNA, 25 bp, Mus musculus
ctgcctgagggcatattttggctgc

SEQ ID NO: 617633 - DNA, 25 bp, Mus musculus
ctgcctgagggcttattttggctgc

SEQ ID NO: 617634 - DNA, 25 bp, Mus musculus
ctgcctgatgaaacggcgcagggct

SEQ ID NO: 617635 - DNA, 25 bp, Mus musculus
ctgcctgatgaatcggcgcagggct

SEQ ID NO: 617636 - DNA, 25 bp, Mus musculus
ctgcctgcatgactgttaaatttat

SEQ ID NO: 617637 - DNA, 25 bp, Mus musculus
ctgcctgcatgagtgttaaatttat

SEQ ID NO: 617638 - DNA, 25 bp, Mus musculus
ctgcctgccgctctgcagtgaggat

SEQ ID NO: 617639 - DNA, 25 bp, Mus musculus
ctgcctgccgctgtgcagtgaggat

SEQ ID NO: 617640 - DNA, 25 bp, Mus musculus
ctgcctgcctggcaggttgtagaaa

SEQ ID NO: 617641 - DNA, 25 bp, Mus musculus
ctgcctgcctgggaggttgtagaaa

SEQ ID NO: 617642 - DNA, 25 bp, Mus musculus
ctgcctggtggcctgctggtcaact

SEQ ID NO: 617643 - DNA, 25 bp, Mus musculus
ctgcctggtggcgtgctggtcaact

SEQ ID NO: 617644 - DNA, 25 bp, Mus musculus
ctgcctgtacatcctggatcggagg

SEQ ID NO: 617645 - DNA, 25 bp, Mus musculus
ctgcctgtacatgctggatcggagg

SEQ ID NO: 617646 - DNA, 25 bp, Mus musculus
ctgccttaagtgagaaagtaatgac

SEQ ID NO: 617647 - DNA, 25 bp, Mus musculus
ctgccttaagtgtgaaagtaatgac

SEQ ID NO: 617648 - DNA, 25 bp, Mus musculus
ctgccttacactccctggccagcct

SEQ ID NO: 617649 - DNA, 25 bp, Mus musculus
ctgccttacactgcctggccagcct

SEQ ID NO: 617650 - DNA, 25 bp, Mus musculus
ctgccttcaaggatggaggctctac

SEQ ID NO: 617651 - DNA, 25 bp, Mus musculus
ctgccttcaaggttggaggctctac

SEQ ID NO: 617652 - DNA, 25 bp, Mus musculus
ctgccttccagaacctgatgaagga

SEQ ID NO: 617653 - DNA, 25 bp, Mus musculus
ctgccttccagatcctgatgaagga

SEQ ID NO: 617654 - DNA, 25 bp, Mus musculus
ctgccttccagcctgaagtggtgga

SEQ ID NO: 617655 - DNA, 25 bp, Mus musculus
ctgccttccagcgtgaagtggtgga

SEQ ID NO: 617656 - DNA, 25 bp, Mus musculus
ctgccttccatactcctgtgttcaa

SEQ ID NO: 617657 - DNA, 25 bp, Mus musculus
ctgccttccatagtcctgtgttcaa

SEQ ID NO: 617658 - DNA, 25 bp, Mus musculus
ctgccttcggaacgtgactggcctg

SEQ ID NO: 617659 - DNA, 25 bp, Mus musculus
ctgccttcggaaggtgactggcctg

SEQ ID NO: 617660 - DNA, 25 bp, Mus musculus
ctgccttgataaacttggtgaccaa

SEQ ID NO: 617661 - DNA, 25 bp, Mus musculus
ctgccttgataatcttggtgaccaa

SEQ ID NO: 617662 - DNA, 25 bp, Mus musculus
ctgccttgcggcagctcacagagat

SEQ ID NO: 617663 - DNA, 25 bp, Mus musculus
ctgccttgcggctgctcacagagat

SEQ ID NO: 617664 - DNA, 25 bp, Mus musculus
ctgccttggagaaaaataaaggaca

SEQ ID NO: 617665 - DNA, 25 bp, Mus musculus
ctgccttggagataaataaaggaca

SEQ ID NO: 617666 - DNA, 25 bp, Mus musculus
ctgccttggaggccaacaaggagca

SEQ ID NO: 617667 - DNA, 25 bp, Mus musculus
ctgccttggagggcaacaaggagca

SEQ ID NO: 617668 - DNA, 25 bp, Mus musculus
ctgccttgtgatcctgtttgcctgt

SEQ ID NO: 617669 - DNA, 25 bp, Mus musculus
ctgccttgtgatgctgtttgcctgt

SEQ ID NO: 617670 - DNA, 25 bp, Mus musculus
ctgcctttggaaacatcttgtcctg

SEQ ID NO: 617671 - DNA, 25 bp, Mus musculus
ctgcctttggaatcatcttgtcctg

SEQ ID NO: 617672 - DNA, 25 bp, Mus musculus
ctgcgaagaaacagcccgtggctgt

SEQ ID NO: 617673 - DNA, 25 bp, Mus musculus
ctgcgaagaaactgcccgtggctgt

SEQ ID NO: 617674 - DNA, 25 bp, Mus musculus
ctgcgacatcgacagcaccaagaag

SEQ ID NO: 617675 - DNA, 25 bp, Mus musculus
ctgcgacatcgagagcaccaagaag

SEQ ID NO: 617676 - DNA, 25 bp, Mus musculus
ctgcgacgcagacggactttccgga

SEQ ID NO: 617677 - DNA, 25 bp, Mus musculus
ctgcgacgcagagggactttccgga

SEQ ID NO: 617678 - DNA, 25 bp, Mus musculus
ctgcgactagttcttccccgagacg

SEQ ID NO: 617679 - DNA, 25 bp, Mus musculus
ctgcgactagttgttccccgagacg

SEQ ID NO: 617680 - DNA, 25 bp, Mus musculus
ctgcgagaaaccatgcgtgcgatgg

SEQ ID NO: 617681 - DNA, 25 bp, Mus musculus
ctgcgagaaaccttgcgtgcgatgg

SEQ ID NO: 617682 - DNA, 25 bp, Mus musculus
ctgcgagaacctccagggctcctat

SEQ ID NO: 617683 - DNA, 25 bp, Mus musculus
ctgcgagaacctgcagggctcctat

SEQ ID NO: 617684 - DNA, 25 bp, Mus musculus
ctgcgagaatggaaagccagctgaa

SEQ ID NO: 617685 - DNA, 25 bp, Mus musculus
ctgcgagaatggtaagccagctgaa

SEQ ID NO: 617686 - DNA, 25 bp, Mus musculus
ctgcgagactggctgtatgaacaca

SEQ ID NO: 617687 - DNA, 25 bp, Mus musculus
ctgcgagactgggtgtatgaacaca

SEQ ID NO: 617688 - DNA, 25 bp, Mus musculus
ctgcgaggactgcaaattagagctg

SEQ ID NO: 617689 - DNA, 25 bp, Mus musculus
ctgcgaggactggaaattagagctg

SEQ ID NO: 617690 - DNA, 25 bp, Mus musculus
ctgcgagtgcgtccccaactgcgag

SEQ ID NO: 617691 - DNA, 25 bp, Mus musculus
ctgcgagtgcgtgcccaactgcgag

SEQ ID NO: 617692 - DNA, 25 bp, Mus musculus
ctgcgagtggctcctctgatcagtc

SEQ ID NO: 617693 - DNA, 25 bp, Mus musculus
ctgcgagtggctgctctgatcagtc

SEQ ID NO: 617694 - DNA, 25 bp, Mus musculus
ctgcgatgggctatgctctacatga

SEQ ID NO: 617695 - DNA, 25 bp, Mus musculus
ctgcgatgggctttgctctacatga

SEQ ID NO: 617696 - DNA, 25 bp, Mus musculus
ctgcgcaacactcggaaccctgtgt

SEQ ID NO: 617697 - DNA, 25 bp, Mus musculus
ctgcgcaacactgggaaccctgtgt

SEQ ID NO: 617698 - DNA, 25 bp, Mus musculus
ctgcgcaacaggagtgcaccacact

SEQ ID NO: 617699 - DNA, 25 bp, Mus musculus
ctgcgcaacaggtgtgcaccacact

SEQ ID NO: 617700 - DNA, 25 bp, Mus musculus
ctgcgcacaggtcggcgggaaggcg

SEQ ID NO: 617701 - DNA, 25 bp, Mus musculus
ctgcgcacaggtgggcgggaaggcg

SEQ ID NO: 617702 - DNA, 25 bp, Mus musculus
ctgcgcagactgaatgaaacctggg

SEQ ID NO: 617703 - DNA, 25 bp, Mus musculus
ctgcgcagactgtatgaaacctggg

SEQ ID NO: 617704 - DNA, 25 bp, Mus musculus
ctgcgcagagtcctccgagcactgg

SEQ ID NO: 617705 - DNA, 25 bp, Mus musculus
ctgcgcagagtcgtccgagcactgg

SEQ ID NO: 617706 - DNA, 25 bp, Mus musculus
ctgcgccaggccaggacagtgctgc

SEQ ID NO: 617707 - DNA, 25 bp, Mus musculus
ctgcgccaggcctggacagtgctgc

SEQ ID NO: 617708 - DNA, 25 bp, Mus musculus
ctgcgcccaggcacaggatgtgccg

SEQ ID NO: 617709 - DNA, 25 bp, Mus musculus
ctgcgcccaggctcaggatgtgccg

SEQ ID NO: 617710 - DNA, 25 bp, Mus musculus
ctgcgccgtggcatggcgaaccctg

SEQ ID NO: 617711 - DNA, 25 bp, Mus musculus
ctgcgccgtggcttggcgaaccctg

SEQ ID NO: 617712 - DNA, 25 bp, Mus musculus
ctgcgcgtgggcaggaacaggacca

SEQ ID NO: 617713 - DNA, 25 bp, Mus musculus
ctgcgcgtgggctggaacaggacca

SEQ ID NO: 617714 - DNA, 25 bp, Mus musculus
ctgcgctacctgaagtggagaagga

SEQ ID NO: 617715 - DNA, 25 bp, Mus musculus
ctgcgctacctgtagtggagaagga

SEQ ID NO: 617716 - DNA, 25 bp, Mus musculus
ctgcgctcagaacaagtgtaacttc

SEQ ID NO: 617717 - DNA, 25 bp, Mus musculus
ctgcgctcagaagaagtgtaacttc

SEQ ID NO: 617718 - DNA, 25 bp, Mus musculus
ctgcgctccagcaccgtgctgggag

SEQ ID NO: 617719 - DNA, 25 bp, Mus musculus
ctgcgctccagctccgtgctgggag

SEQ ID NO: 617720 - DNA, 25 bp, Mus musculus
ctgcgctgagcgcttacgacatggt

SEQ ID NO: 617721 - DNA, 25 bp, Mus musculus
ctgcgctgagcggttacgacatggt

SEQ ID NO: 617722 - DNA, 25 bp, Mus musculus
ctgcgctggccgagataaagggctt

SEQ ID NO: 617723 - DNA, 25 bp, Mus musculus
ctgcgctggccgtgataaagggctt

SEQ ID NO: 617724 - DNA, 25 bp, Mus musculus
ctgcgcttcaccaggagcatgaaga

SEQ ID NO: 617725 - DNA, 25 bp, Mus musculus
ctgcgcttcacctggagcatgaaga

SEQ ID NO: 617726 - DNA, 25 bp, Mus musculus
ctgcgcttcagcagcaaggaggaga

SEQ ID NO: 617727 - DNA, 25 bp, Mus musculus
ctgcgcttcagctgcaaggaggaga

SEQ ID NO: 617728 - DNA, 25 bp, Mus musculus
ctgcgctttggccagctctgcgcag

SEQ ID NO: 617729 - DNA, 25 bp, Mus musculus
ctgcgctttggcgagctctgcgcag

SEQ ID NO: 617730 - DNA, 25 bp, Mus musculus
ctgcggaactttagggcccggctcg

SEQ ID NO: 617731 - DNA, 25 bp, Mus musculus
ctgcggaacttttgggcccggctcg

SEQ ID NO: 617732 - DNA, 25 bp, Mus musculus
ctgcggaagttccagtgcccatgct

SEQ ID NO: 617733 - DNA, 25 bp, Mus musculus
ctgcggaagttcgagtgcccatgct

SEQ ID NO: 617734 - DNA, 25 bp, Mus musculus
ctgcggacgccaagctaaaagccaa

SEQ ID NO: 617735 - DNA, 25 bp, Mus musculus
ctgcggacgccatgctaaaagccaa

SEQ ID NO: 617736 - DNA, 25 bp, Mus musculus
ctgcggataaagagagacttgccag

SEQ ID NO: 617737 - DNA, 25 bp, Mus musculus
ctgcggataaagtgagacttgccag

SEQ ID NO: 617738 - DNA, 25 bp, Mus musculus
ctgcggcacgtccttagggattttt

SEQ ID NO: 617739 - DNA, 25 bp, Mus musculus
ctgcggcacgtcgttagggattttt

SEQ ID NO: 617740 - DNA, 25 bp, Mus musculus
ctgcggcagaagaactgccaggagt

SEQ ID NO: 617741 - DNA, 25 bp, Mus musculus
ctgcggcagaagtactgccaggagt

SEQ ID NO: 617742 - DNA, 25 bp, Mus musculus
ctgcggctcagcaggagtgagctct

SEQ ID NO: 617743 - DNA, 25 bp, Mus musculus
ctgcggctcagctggagtgagctct

SEQ ID NO: 617744 - DNA, 25 bp, Mus musculus
ctgcggctggctcgacctgatgatc

SEQ ID NO: 617745 - DNA, 25 bp, Mus musculus
ctgcggctggctggacctgatgatc

SEQ ID NO: 617746 - DNA, 25 bp, Mus musculus
ctgcgggttctcaggagccagaccc

SEQ ID NO: 617747 - DNA, 25 bp, Mus musculus
ctgcgggttctctggagccagaccc

SEQ ID NO: 617748 - DNA, 25 bp, Mus musculus
ctgcggtgcaccctggaagagccat

SEQ ID NO: 617749 - DNA, 25 bp, Mus musculus
ctgcggtgcaccgtggaagagccat

SEQ ID NO: 617750 - DNA, 25 bp, Mus musculus
ctgcggttcatgaatggtgtttgcc

SEQ ID NO: 617751 - DNA, 25 bp, Mus musculus
ctgcggttcatgtatggtgtttgcc

SEQ ID NO: 617752 - DNA, 25 bp, Mus musculus
ctgcggtttggacacaggatgttct

SEQ ID NO: 617753 - DNA, 25 bp, Mus musculus
ctgcggtttggagacaggatgttct

SEQ ID NO: 617754 - DNA, 25 bp, Mus musculus
ctgcgtactccaagaccgtcatcat

SEQ ID NO: 617755 - DNA, 25 bp, Mus musculus
ctgcgtactccatgaccgtcatcat

SEQ ID NO: 617756 - DNA, 25 bp, Mus musculus
ctgcgtagcagcacgtggcttcagg

SEQ ID NO: 617757 - DNA, 25 bp, Mus musculus
ctgcgtagcagctcgtggcttcagg

SEQ ID NO: 617758 - DNA, 25 bp, Mus musculus
ctgcgtaggaccagggaccggaagt

SEQ ID NO: 617759 - DNA, 25 bp, Mus musculus
ctgcgtaggacctgggaccggaagt

SEQ ID NO: 617760 - DNA, 25 bp, Mus musculus
ctgcgtctttggacgggaagaagat

SEQ ID NO: 617761 - DNA, 25 bp, Mus musculus
ctgcgtctttggtcgggaagaagat

SEQ ID NO: 617762 - DNA, 25 bp, Mus musculus
ctgcgtgagtgacacagactgctga

SEQ ID NO: 617763 - DNA, 25 bp, Mus musculus
ctgcgtgagtgagacagactgctga

SEQ ID NO: 617764 - DNA, 25 bp, Mus musculus
ctgcgtgtggccacggagcagtcct

SEQ ID NO: 617765 - DNA, 25 bp, Mus musculus
ctgcgtgtggcctcggagcagtcct

SEQ ID NO: 617766 - DNA, 25 bp, Mus musculus
ctgcgttaccagctgtgggttctac

SEQ ID NO: 617767 - DNA, 25 bp, Mus musculus
ctgcgttaccaggtgtgggttctac

SEQ ID NO: 617768 - DNA, 25 bp, Mus musculus
ctgcgtttggtaacatcctttcatg

SEQ ID NO: 617769 - DNA, 25 bp, Mus musculus
ctgcgtttggtatcatcctttcatg

SEQ ID NO: 617770 - DNA, 25 bp, Mus musculus
ctgctaaagcctccctatatcagac

SEQ ID NO: 617771 - DNA, 25 bp, Mus musculus
ctgctaaagcctgcctatatcagac

SEQ ID NO: 617772 - DNA, 25 bp, Mus musculus
ctgctaatgcctccagtaaccacag

SEQ ID NO: 617773 - DNA, 25 bp, Mus musculus
ctgctaatgcctgcagtaaccacag

SEQ ID NO: 617774 - DNA, 25 bp, Mus musculus
ctgctacaaggcaagggcatgggat

SEQ ID NO: 617775 - DNA, 25 bp, Mus musculus
ctgctacaaggctagggcatgggat

SEQ ID NO: 617776 - DNA, 25 bp, Mus musculus
ctgctacaccgacgccaacgtgtgt

SEQ ID NO: 617777 - DNA, 25 bp, Mus musculus
ctgctacaccgaggccaacgtgtgt

SEQ ID NO: 617778 - DNA, 25 bp, Mus musculus
ctgctacagctgagaagacacagct

SEQ ID NO: 617779 - DNA, 25 bp, Mus musculus
ctgctacagctgtgaagacacagct

SEQ ID NO: 617780 - DNA, 25 bp, Mus musculus
ctgctaccaaatagctgtgaaccta

SEQ ID NO: 617781 - DNA, 25 bp, Mus musculus
ctgctaccaaattgctgtgaaccta

SEQ ID NO: 617782 - DNA, 25 bp, Mus musculus
ctgctacggcgcagagtcagaagac

SEQ ID NO: 617783 - DNA, 25 bp, Mus musculus
ctgctacggcgctgagtcagaagac

SEQ ID NO: 617784 - DNA, 25 bp, Mus musculus
ctgctactcccaaagaactaagact

SEQ ID NO: 617785 - DNA, 25 bp, Mus musculus
ctgctactcccatagaactaagact

SEQ ID NO: 617786 - DNA, 25 bp, Mus musculus
ctgctactgcgccatggacccaggg

SEQ ID NO: 617787 - DNA, 25 bp, Mus musculus
ctgctactgcgcgatggacccaggg

SEQ ID NO: 617788 - DNA, 25 bp, Mus musculus
ctgctagcagcacatatcccaactc

SEQ ID NO: 617789 - DNA, 25 bp, Mus musculus
ctgctagcagcagatatcccaactc

SEQ ID NO: 617790 - DNA, 25 bp, Mus musculus
ctgctaggctgtaaggatctcgtgg

SEQ ID NO: 617791 - DNA, 25 bp, Mus musculus
ctgctaggctgttaggatctcgtgg

SEQ ID NO: 617792 - DNA, 25 bp, Mus musculus
ctgctagtgttcctgctggaagcca

SEQ ID NO: 617793 - DNA, 25 bp, Mus musculus
ctgctagtgttcgtgctggaagcca

SEQ ID NO: 617794 - DNA, 25 bp, Mus musculus
ctgctatctcttctaggcggtgata

SEQ ID NO: 617795 - DNA, 25 bp, Mus musculus
ctgctatctcttgtaggcggtgata

SEQ ID NO: 617796 - DNA, 25 bp, Mus musculus
ctgctatcttccaggccatgctctg

SEQ ID NO: 617797 - DNA, 25 bp, Mus musculus
ctgctatcttcctggccatgctctg

SEQ ID NO: 617798 - DNA, 25 bp, Mus musculus
ctgctatgaagactgaaaattgtgt

SEQ ID NO: 617799 - DNA, 25 bp, Mus musculus
ctgctatgaagagtgaaaattgtgt

SEQ ID NO: 617800 - DNA, 25 bp, Mus musculus
ctgctatgaggcataactgctgtca

SEQ ID NO: 617801 - DNA, 25 bp, Mus musculus
ctgctatgaggcttaactgctgtca

SEQ ID NO: 617802 - DNA, 25 bp, Mus musculus
ctgctatgatgactttggtttccgt

SEQ ID NO: 617803 - DNA, 25 bp, Mus musculus
ctgctatgatgagtttggtttccgt

SEQ ID NO: 617804 - DNA, 25 bp, Mus musculus
ctgctatgtctgcaacctgacaggg

SEQ ID NO: 617805 - DNA, 25 bp, Mus musculus
ctgctatgtctggaacctgacaggg

SEQ ID NO: 617806 - DNA, 25 bp, Mus musculus
ctgctatgtgaacaaccatgctgtg

SEQ ID NO: 617807 - DNA, 25 bp, Mus musculus
ctgctatgtgaagaaccatgctgtg

SEQ ID NO: 617808 - DNA, 25 bp, Mus musculus
ctgctattgttgaattttaggaact

SEQ ID NO: 617809 - DNA, 25 bp, Mus musculus
ctgctattgttgtattttaggaact

SEQ ID NO: 617810 - DNA, 25 bp, Mus musculus
ctgctcaaaatcaggaagtcccgat

SEQ ID NO: 617811 - DNA, 25 bp, Mus musculus
ctgctcaaaatctggaagtcccgat

SEQ ID NO: 617812 - DNA, 25 bp, Mus musculus
ctgctcaaatccagtcctcttctga

SEQ ID NO: 617813 - DNA, 25 bp, Mus musculus
ctgctcaaatcctgtcctcttctga

SEQ ID NO: 617814 - DNA, 25 bp, Mus musculus
ctgctcaaatctcgagacacagaga

SEQ ID NO: 617815 - DNA, 25 bp, Mus musculus
ctgctcaaatctggagacacagaga

SEQ ID NO: 617816 - DNA, 25 bp, Mus musculus
ctgctcaatggacaccctaaggagg

SEQ ID NO: 617817 - DNA, 25 bp, Mus musculus
ctgctcaatggagaccctaaggagg

SEQ ID NO: 617818 - DNA, 25 bp, Mus musculus
ctgctcacagaaaatgcaaccccag

SEQ ID NO: 617819 - DNA, 25 bp, Mus musculus
ctgctcacagaatatgcaaccccag

SEQ ID NO: 617820 - DNA, 25 bp, Mus musculus
ctgctcactcagagaccagagcttc

SEQ ID NO: 617821 - DNA, 25 bp, Mus musculus
ctgctcactcagtgaccagagcttc

SEQ ID NO: 617822 - DNA, 25 bp, Mus musculus
ctgctcagcagaccctatacttcgg

SEQ ID NO: 617823 - DNA, 25 bp, Mus musculus
ctgctcagcagagcctatacttcgg

SEQ ID NO: 617824 - DNA, 25 bp, Mus musculus
ctgctcagctgccaaaacgtcgtct

SEQ ID NO: 617825 - DNA, 25 bp, Mus musculus
ctgctcagctgcgaaaacgtcgtct

SEQ ID NO: 617826 - DNA, 25 bp, Mus musculus
ctgctcaggagacccgtgcaggacc

SEQ ID NO: 617827 - DNA, 25 bp, Mus musculus
ctgctcaggagagccgtgcaggacc

SEQ ID NO: 617828 - DNA, 25 bp, Mus musculus
ctgctcagggcaagaagagtccgcg

SEQ ID NO: 617829 - DNA, 25 bp, Mus musculus
ctgctcagggcatgaagagtccgcg

SEQ ID NO: 617830 - DNA, 25 bp, Mus musculus
ctgctcatcaagaccactcaaaagg

SEQ ID NO: 617831 - DNA, 25 bp, Mus musculus
ctgctcatcaagtccactcaaaagg

SEQ ID NO: 617832 - DNA, 25 bp, Mus musculus
ctgctcatgaccaggagctactgag

SEQ ID NO: 617833 - DNA, 25 bp, Mus musculus
ctgctcatgacctggagctactgag

SEQ ID NO: 617834 - DNA, 25 bp, Mus musculus
ctgctccaacatctgtatatttggg

SEQ ID NO: 617835 - DNA, 25 bp, Mus musculus
ctgctccaacatgtgtatatttggg

SEQ ID NO: 617836 - DNA, 25 bp, Mus musculus
ctgctccaaggactgcacggtgaag

SEQ ID NO: 617837 - DNA, 25 bp, Mus musculus
ctgctccaaggagtgcacggtgaag

SEQ ID NO: 617838 - DNA, 25 bp, Mus musculus
ctgctccaggctcgtcactgaacag

SEQ ID NO: 617839 - DNA, 25 bp, Mus musculus
ctgctccaggctggtcactgaacag

SEQ ID NO: 617840 - DNA, 25 bp, Mus musculus
ctgctcccagggaagtcatcaggac

SEQ ID NO: 617841 - DNA, 25 bp, Mus musculus
ctgctcccagggtagtcatcaggac

SEQ ID NO: 617842 - DNA, 25 bp, Mus musculus
ctgctcccgggaacaccctagatga

SEQ ID NO: 617843 - DNA, 25 bp, Mus musculus
ctgctcccgggatcaccctagatga

SEQ ID NO: 617844 - DNA, 25 bp, Mus musculus
ctgctccgcggcagcagtgggttcc

SEQ ID NO: 617845 - DNA, 25 bp, Mus musculus
ctgctccgcggctgcagtgggttcc

SEQ ID NO: 617846 - DNA, 25 bp, Mus musculus
ctgctccgctggctgctgcacgtgt

SEQ ID NO: 617847 - DNA, 25 bp, Mus musculus
ctgctccgctgggtgctgcacgtgt

SEQ ID NO: 617848 - DNA, 25 bp, Mus musculus
ctgctcctaggaacgggccctggga

SEQ ID NO: 617849 - DNA, 25 bp, Mus musculus
ctgctcctaggatcgggccctggga

SEQ ID NO: 617850 - DNA, 25 bp, Mus musculus
ctgctcctgcaactctgtggacagc

SEQ ID NO: 617851 - DNA, 25 bp, Mus musculus
ctgctcctgcaagtctgtggacagc

SEQ ID NO: 617852 - DNA, 25 bp, Mus musculus
ctgctcctgcccacttcacttctgg

SEQ ID NO: 617853 - DNA, 25 bp, Mus musculus
ctgctcctgccctcttcacttctgg

SEQ ID NO: 617854 - DNA, 25 bp, Mus musculus
ctgctcctggtactttcagtttgga

SEQ ID NO: 617855 - DNA, 25 bp, Mus musculus
ctgctcctggtagtttcagtttgga

SEQ ID NO: 617856 - DNA, 25 bp, Mus musculus
ctgctccttgggatgagaaagataa

SEQ ID NO: 617857 - DNA, 25 bp, Mus musculus
ctgctccttgggttgagaaagataa

SEQ ID NO: 617858 - DNA, 25 bp, Mus musculus
ctgctcgcttgtcggcaactggaac

SEQ ID NO: 617859 - DNA, 25 bp, Mus musculus
ctgctcgcttgtgggcaactggaac

SEQ ID NO: 617860 - DNA, 25 bp, Mus musculus
ctgctcggcttgcaaaggagaagtc

SEQ ID NO: 617861 - DNA, 25 bp, Mus musculus
ctgctcggcttggaaaggagaagtc

SEQ ID NO: 617862 - DNA, 25 bp, Mus musculus
ctgctcgtcgagctgtgacttggac

SEQ ID NO: 617863 - DNA, 25 bp, Mus musculus
ctgctcgtcgaggtgtgacttggac

SEQ ID NO: 617864 - DNA, 25 bp, Mus musculus
ctgctctacgcgatcgccgaggcaa

SEQ ID NO: 617865 - DNA, 25 bp, Mus musculus
ctgctctacgcgttcgccgaggcaa

SEQ ID NO: 617866 - DNA, 25 bp, Mus musculus
ctgctctcaactacaacatcgtgtc

SEQ ID NO: 617867 - DNA, 25 bp, Mus musculus
ctgctctcaacttcaacatcgtgtc

SEQ ID NO: 617868 - DNA, 25 bp, Mus musculus
ctgctctccgctcgcaaaaacgggt

SEQ ID NO: 617869 - DNA, 25 bp, Mus musculus
ctgctctccgctggcaaaaacgggt

SEQ ID NO: 617870 - DNA, 25 bp, Mus musculus
ctgctctctagacggaaggtctgtg

SEQ ID NO: 617871 - DNA, 25 bp, Mus musculus
ctgctctctagagggaaggtctgtg

SEQ ID NO: 617872 - DNA, 25 bp, Mus musculus
ctgctctgagccatcctcatggatg

SEQ ID NO: 617873 - DNA, 25 bp, Mus musculus
ctgctctgagccttcctcatggatg

SEQ ID NO: 617874 - DNA, 25 bp, Mus musculus
ctgctctgaggaccccggacgtttg

SEQ ID NO: 617875 - DNA, 25 bp, Mus musculus
ctgctctgaggagcccggacgtttg

SEQ ID NO: 617876 - DNA, 25 bp, Mus musculus
ctgctctgcctcatggatttaggac

SEQ ID NO: 617877 - DNA, 25 bp, Mus musculus
ctgctctgcctcttggatttaggac

SEQ ID NO: 617878 - DNA, 25 bp, Mus musculus
ctgctctgcgagcagtccgcgtgtt

SEQ ID NO: 617879 - DNA, 25 bp, Mus musculus
ctgctctgcgaggagtccgcgtgtt

SEQ ID NO: 617880 - DNA, 25 bp, Mus musculus
ctgctctgcgctaacatcattgtgg

SEQ ID NO: 617881 - DNA, 25 bp, Mus musculus
ctgctctgcgcttacatcattgtgg

SEQ ID NO: 617882 - DNA, 25 bp, Mus musculus
ctgctctggaaactttatgcccatc

SEQ ID NO: 617883 - DNA, 25 bp, Mus musculus
ctgctctggaaagtttatgcccatc

SEQ ID NO: 617884 - DNA, 25 bp, Mus musculus
ctgctctgtcgtcttcggaagtcgc

SEQ ID NO: 617885 - DNA, 25 bp, Mus musculus
ctgctctgtcgtgttcggaagtcgc

SEQ ID NO: 617886 - DNA, 25 bp, Mus musculus
ctgctcttaaagatggcaaagtagt

SEQ ID NO: 617887 - DNA, 25 bp, Mus musculus
ctgctcttaaagttggcaaagtagt

SEQ ID NO: 617888 - DNA, 25 bp, Mus musculus
ctgctcttcaccatgatcttcgtca

SEQ ID NO: 617889 - DNA, 25 bp, Mus musculus
ctgctcttcaccttgatcttcgtca

SEQ ID NO: 617890 - DNA, 25 bp, Mus musculus
ctgctcttcaggcaggtcagttttt

SEQ ID NO: 617891 - DNA, 25 bp, Mus musculus
ctgctcttcagggaggtcagttttt

SEQ ID NO: 617892 - DNA, 25 bp, Mus musculus
ctgctcttccgcaatagacctgttc

SEQ ID NO: 617893 - DNA, 25 bp, Mus musculus
ctgctcttccgctatagacctgttc

SEQ ID NO: 617894 - DNA, 25 bp, Mus musculus
ctgctctttcggaccctgcctgagg

SEQ ID NO: 617895 - DNA, 25 bp, Mus musculus
ctgctctttcggtccctgcctgagg

SEQ ID NO: 617896 - DNA, 25 bp, Mus musculus
ctgctgaaaaaacaccatcgctaac

SEQ ID NO: 617897 - DNA, 25 bp, Mus musculus
ctgctgaaaaaagaccatcgctaac

SEQ ID NO: 617898 - DNA, 25 bp, Mus musculus
ctgctgaaagagagagtcctgggtc

SEQ ID NO: 617899 - DNA, 25 bp, Mus musculus
ctgctgaaagagtgagtcctgggtc

SEQ ID NO: 617900 - DNA, 25 bp, Mus musculus
ctgctgaaattgaaagccgggttcg

SEQ ID NO: 617901 - DNA, 25 bp, Mus musculus
ctgctgaaattgtaagccgggttcg

SEQ ID NO: 617902 - DNA, 25 bp, Mus musculus
ctgctgaacgcacgttccgcggtat

SEQ ID NO: 617903 - DNA, 25 bp, Mus musculus
ctgctgaacgcaggttccgcggtat

SEQ ID NO: 617904 - DNA, 25 bp, Mus musculus
ctgctgaagcagcaaggagacttcc

SEQ ID NO: 617905 - DNA, 25 bp, Mus musculus
ctgctgaagcaggaaggagacttcc

SEQ ID NO: 617906 - DNA, 25 bp, Mus musculus
ctgctgaatcacaggccgatgactg

SEQ ID NO: 617907 - DNA, 25 bp, Mus musculus
ctgctgaatcactggccgatgactg

SEQ ID NO: 617908 - DNA, 25 bp, Mus musculus
ctgctgacacagaggacagtttctc

SEQ ID NO: 617909 - DNA, 25 bp, Mus musculus
ctgctgacacagtggacagtttctc

SEQ ID NO: 617910 - DNA, 25 bp, Mus musculus
ctgctgacaggtcaagagtcagtac

SEQ ID NO: 617911 - DNA, 25 bp, Mus musculus
ctgctgacaggtgaagagtcagtac

SEQ ID NO: 617912 - DNA, 25 bp, Mus musculus
ctgctgaccgagaatgctgaggtga

SEQ ID NO: 617913 - DNA, 25 bp, Mus musculus
ctgctgaccgagtatgctgaggtga

SEQ ID NO: 617914 - DNA, 25 bp, Mus musculus
ctgctgacctgacctttgaccgcgg

SEQ ID NO: 617915 - DNA, 25 bp, Mus musculus
ctgctgacctgagctttgaccgcgg

SEQ ID NO: 617916 - DNA, 25 bp, Mus musculus
ctgctgacggcgctccaagagtctc

SEQ ID NO: 617917 - DNA, 25 bp, Mus musculus
ctgctgacggcggtccaagagtctc

SEQ ID NO: 617918 - DNA, 25 bp, Mus musculus
ctgctgactatcattcagggcaaag

SEQ ID NO: 617919 - DNA, 25 bp, Mus musculus
ctgctgactatctttcagggcaaag

SEQ ID NO: 617920 - DNA, 25 bp, Mus musculus
ctgctgagagtcacgggcgtttgca

SEQ ID NO: 617921 - DNA, 25 bp, Mus musculus
ctgctgagagtctcgggcgtttgca

SEQ ID NO: 617922 - DNA, 25 bp, Mus musculus
ctgctgagcggtcactcctgccggt

SEQ ID NO: 617923 - DNA, 25 bp, Mus musculus
ctgctgagcggtgactcctgccggt

SEQ ID NO: 617924 - DNA, 25 bp, Mus musculus
ctgctgagctgactcgcagggagca

SEQ ID NO: 617925 - DNA, 25 bp, Mus musculus
ctgctgagctgagtcgcagggagca

SEQ ID NO: 617926 - DNA, 25 bp, Mus musculus
ctgctgagcttgatggctccgcgga

SEQ ID NO: 617927 - DNA, 25 bp, Mus musculus
ctgctgagcttgttggctccgcgga

SEQ ID NO: 617928 - DNA, 25 bp, Mus musculus
ctgctgatagagcagttggagattc

SEQ ID NO: 617929 - DNA, 25 bp, Mus musculus
ctgctgatagaggagttggagattc

SEQ ID NO: 617930 - DNA, 25 bp, Mus musculus
ctgctgatgaccagactgaccctgc

SEQ ID NO: 617931 - DNA, 25 bp, Mus musculus
ctgctgatgacctgactgaccctgc

SEQ ID NO: 617932 - DNA, 25 bp, Mus musculus
ctgctgcaaaaaagagtgcctcaga

SEQ ID NO: 617933 - DNA, 25 bp, Mus musculus
ctgctgcaaaaatgagtgcctcaga

SEQ ID NO: 617934 - DNA, 25 bp, Mus musculus
ctgctgcacgtgacccagggaagtc

SEQ ID NO: 617935 - DNA, 25 bp, Mus musculus
ctgctgcacgtgtcccagggaagtc

SEQ ID NO: 617936 - DNA, 25 bp, Mus musculus
ctgctgcagcagatcttatgaggct

SEQ ID NO: 617937 - DNA, 25 bp, Mus musculus
ctgctgcagcagttcttatgaggct

SEQ ID NO: 617938 - DNA, 25 bp, Mus musculus
ctgctgcagctcaatggtgacttct

SEQ ID NO: 617939 - DNA, 25 bp, Mus musculus
ctgctgcagctctatggtgacttct

SEQ ID NO: 617940 - DNA, 25 bp, Mus musculus
ctgctgcatctgagcctgtgatacc

SEQ ID NO: 617941 - DNA, 25 bp, Mus musculus
ctgctgcatctgtgcctgtgatacc

SEQ ID NO: 617942 - DNA, 25 bp, Mus musculus
ctgctgccaaagagaggaccccagg

SEQ ID NO: 617943 - DNA, 25 bp, Mus musculus
ctgctgccaaagtgaggaccccagg

SEQ ID NO: 617944 - DNA, 25 bp, Mus musculus
ctgctgccacttacactggtgtctg

SEQ ID NO: 617945 - DNA, 25 bp, Mus musculus
ctgctgccactttcactggtgtctg

SEQ ID NO: 617946 - DNA, 25 bp, Mus musculus
ctgctgccagagaccttgggccagc

SEQ ID NO: 617947 - DNA, 25 bp, Mus musculus
ctgctgccagagtccttgggccagc

SEQ ID NO: 617948 - DNA, 25 bp, Mus musculus
ctgctgccccggaccaagggcttta

SEQ ID NO: 617949 - DNA, 25 bp, Mus musculus
ctgctgccccggtccaagggcttta

SEQ ID NO: 617950 - DNA, 25 bp, Mus musculus
ctgctgccgggaaaaggatgacaaa

SEQ ID NO: 617951 - DNA, 25 bp, Mus musculus
ctgctgccgggataaggatgacaaa

SEQ ID NO: 617952 - DNA, 25 bp, Mus musculus
ctgctgcctgggaaggtgctagtcc

SEQ ID NO: 617953 - DNA, 25 bp, Mus musculus
ctgctgcctgggtaggtgctagtcc

SEQ ID NO: 617954 - DNA, 25 bp, Mus musculus
ctgctgcgggcgactttcctgcttc

SEQ ID NO: 617955 - DNA, 25 bp, Mus musculus
ctgctgcgggcgtctttcctgcttc

SEQ ID NO: 617956 - DNA, 25 bp, Mus musculus
ctgctgcgtatgagtatatggctgc

SEQ ID NO: 617957 - DNA, 25 bp, Mus musculus
ctgctgcgtatgtgtatatggctgc

SEQ ID NO: 617958 - DNA, 25 bp, Mus musculus
ctgctgcgtgtgcaacatgggcccc

SEQ ID NO: 617959 - DNA, 25 bp, Mus musculus
ctgctgcgtgtggaacatgggcccc

SEQ ID NO: 617960 - DNA, 25 bp, Mus musculus
ctgctgctacaacgcgtagaactct

SEQ ID NO: 617961 - DNA, 25 bp, Mus musculus
ctgctgctacaaggcgtagaactct

SEQ ID NO: 617962 - DNA, 25 bp, Mus musculus
ctgctgctacagcagtagatgggtc

SEQ ID NO: 617963 - DNA, 25 bp, Mus musculus
ctgctgctacaggagtagatgggtc

SEQ ID NO: 617964 - DNA, 25 bp, Mus musculus
ctgctgctaccaatctgcccaaggg

SEQ ID NO: 617965 - DNA, 25 bp, Mus musculus
ctgctgctaccattctgcccaaggg

SEQ ID NO: 617966 - DNA, 25 bp, Mus musculus
ctgctgctaccgaggacgagtgcag

SEQ ID NO: 617967 - DNA, 25 bp, Mus musculus
ctgctgctaccgtggacgagtgcag

SEQ ID NO: 617968 - DNA, 25 bp, Mus musculus
ctgctgctagagaccctcggagcgg

SEQ ID NO: 617969 - DNA, 25 bp, Mus musculus
ctgctgctagagtccctcggagcgg

SEQ ID NO: 617970 - DNA, 25 bp, Mus musculus
ctgctgctcagtctttaaatgtaca

SEQ ID NO: 617971 - DNA, 25 bp, Mus musculus
ctgctgctcagtgtttaaatgtaca

SEQ ID NO: 617972 - DNA, 25 bp, Mus musculus
ctgctgctcattcggattgctgcct

SEQ ID NO: 617973 - DNA, 25 bp, Mus musculus
ctgctgctcattgggattgctgcct

SEQ ID NO: 617974 - DNA, 25 bp, Mus musculus
ctgctgctcttcactctgccaggga

SEQ ID NO: 617975 - DNA, 25 bp, Mus musculus
ctgctgctcttctctctgccaggga

SEQ ID NO: 617976 - DNA, 25 bp, Mus musculus
ctgctgctggcgattgaccccaaca

SEQ ID NO: 617977 - DNA, 25 bp, Mus musculus
ctgctgctggcgtttgaccccaaca

SEQ ID NO: 617978 - DNA, 25 bp, Mus musculus
ctgctgctgtagattgacggccccg

SEQ ID NO: 617979 - DNA, 25 bp, Mus musculus
ctgctgctgtagtttgacggccccg

SEQ ID NO: 617980 - DNA, 25 bp, Mus musculus
ctgctgcttagcaggtgaatgaagg

SEQ ID NO: 617981 - DNA, 25 bp, Mus musculus
ctgctgcttagctggtgaatgaagg

SEQ ID NO: 617982 - DNA, 25 bp, Mus musculus
ctgctgcttcatcccgttctgcgta

SEQ ID NO: 617983 - DNA, 25 bp, Mus musculus
ctgctgcttcatgccgttctgcgta

SEQ ID NO: 617984 - DNA, 25 bp, Mus musculus
ctgctgcttgtgctccccggagtcg

SEQ ID NO: 617985 - DNA, 25 bp, Mus musculus
ctgctgcttgtggtccccggagtcg

SEQ ID NO: 617986 - DNA, 25 bp, Mus musculus
ctgctgcttttgagtatcttcctcc

SEQ ID NO: 617987 - DNA, 25 bp, Mus musculus
ctgctgcttttgtgtatcttcctcc

SEQ ID NO: 617988 - DNA, 25 bp, Mus musculus
ctgctggaaaacaggatggccattt

SEQ ID NO: 617989 - DNA, 25 bp, Mus musculus
ctgctggaaaactggatggccattt

SEQ ID NO: 617990 - DNA, 25 bp, Mus musculus
ctgctggacaaactttgtgaacccg

SEQ ID NO: 617991 - DNA, 25 bp, Mus musculus
ctgctggacaaagtttgtgaacccg

SEQ ID NO: 617992 - DNA, 25 bp, Mus musculus
ctgctggacggccatgaagtcatca

SEQ ID NO: 617993 - DNA, 25 bp, Mus musculus
ctgctggacggcgatgaagtcatca

SEQ ID NO: 617994 - DNA, 25 bp, Mus musculus
ctgctggagcccagcgacaccaagt

SEQ ID NO: 617995 - DNA, 25 bp, Mus musculus
ctgctggagccctgcgacaccaagt

SEQ ID NO: 617996 - DNA, 25 bp, Mus musculus
ctgctggagcctcgaatgatcgtgc

SEQ ID NO: 617997 - DNA, 25 bp, Mus musculus
ctgctggagcctggaatgatcgtgc

SEQ ID NO: 617998 - DNA, 25 bp, Mus musculus
ctgctggagttgaggagtgtccctc

SEQ ID NO: 617999 - DNA, 25 bp, Mus musculus
ctgctggagttgtggagtgtccctc

SEQ ID NO: 618000 - DNA, 25 bp, Mus musculus
ctgctggcaatcacattcttagttg

SEQ ID NO: 618001 - DNA, 25 bp, Mus musculus
ctgctggcaatctcattcttagttg

SEQ ID NO: 618002 - DNA, 25 bp, Mus musculus
ctgctggcttccatttggccgcaga

SEQ ID NO: 618003 - DNA, 25 bp, Mus musculus
ctgctggcttccttttggccgcaga

SEQ ID NO: 618004 - DNA, 25 bp, Mus musculus
ctgctgggaaacaggatcctgtgtc

SEQ ID NO: 618005 - DNA, 25 bp, Mus musculus
ctgctgggaaactggatcctgtgtc

SEQ ID NO: 618006 - DNA, 25 bp, Mus musculus
ctgctgggaggaacccctaccgggt

SEQ ID NO: 618007 - DNA, 25 bp, Mus musculus
ctgctgggaggacacccttcctttc

SEQ ID NO: 618008 - DNA, 25 bp, Mus musculus
ctgctgggaggagacccttcctttc

SEQ ID NO: 618009 - DNA, 25 bp, Mus musculus
ctgctgggaggatcccctaccgggt

SEQ ID NO: 618010 - DNA, 25 bp, Mus musculus
ctgctgggtaagagcccgactcctc

SEQ ID NO: 618011 - DNA, 25 bp, Mus musculus
ctgctgggtaagtgcccgactcctc

SEQ ID NO: 618012 - DNA, 25 bp, Mus musculus
ctgctgggtatcacggacaggtgac

SEQ ID NO: 618013 - DNA, 25 bp, Mus musculus
ctgctgggtatctcggacaggtgac

SEQ ID NO: 618014 - DNA, 25 bp, Mus musculus
ctgctgggtcaaaccagggcctgta

SEQ ID NO: 618015 - DNA, 25 bp, Mus musculus
ctgctgggtcaatccagggcctgta

SEQ ID NO: 618016 - DNA, 25 bp, Mus musculus
ctgctgggtcccagagcaggacttc

SEQ ID NO: 618017 - DNA, 25 bp, Mus musculus
ctgctgggtccctgagcaggacttc

SEQ ID NO: 618018 - DNA, 25 bp, Mus musculus
ctgctgggttctctggacgagttct

SEQ ID NO: 618019 - DNA, 25 bp, Mus musculus
ctgctgggttctgtggacgagttct

SEQ ID NO: 618020 - DNA, 25 bp, Mus musculus
ctgctggtagaccagtacttccctc

SEQ ID NO: 618021 - DNA, 25 bp, Mus musculus
ctgctggtagacgagtacttccctc

SEQ ID NO: 618022 - DNA, 25 bp, Mus musculus
ctgctggtctataagcagagacagg

SEQ ID NO: 618023 - DNA, 25 bp, Mus musculus
ctgctggtctattagcagagacagg

SEQ ID NO: 618024 - DNA, 25 bp, Mus musculus
ctgctggtgcatctatgcacacgcc

SEQ ID NO: 618025 - DNA, 25 bp, Mus musculus
ctgctggtgcatgtatgcacacgcc

SEQ ID NO: 618026 - DNA, 25 bp, Mus musculus
ctgctggtgtccacgggcatcggtc

SEQ ID NO: 618027 - DNA, 25 bp, Mus musculus
ctgctggtgtcctcgggcatcggtc

SEQ ID NO: 618028 - DNA, 25 bp, Mus musculus
ctgctggttcctcgacgaggcagct

SEQ ID NO: 618029 - DNA, 25 bp, Mus musculus
ctgctggttcctggacgaggcagct

SEQ ID NO: 618030 - DNA, 25 bp, Mus musculus
ctgctgtatcttcgacgggactatc

SEQ ID NO: 618031 - DNA, 25 bp, Mus musculus
ctgctgtatcttggacgggactatc

SEQ ID NO: 618032 - DNA, 25 bp, Mus musculus
ctgctgtccctgaggaatttaagga

SEQ ID NO: 618033 - DNA, 25 bp, Mus musculus
ctgctgtccctgtggaatttaagga

SEQ ID NO: 618034 - DNA, 25 bp, Mus musculus
ctgctgtgaagaaggcgctgtccag

SEQ ID NO: 618035 - DNA, 25 bp, Mus musculus
ctgctgtgaagatggcgctgtccag

SEQ ID NO: 618036 - DNA, 25 bp, Mus musculus
ctgctgtgagctcagacccggtcaa

SEQ ID NO: 618037 - DNA, 25 bp, Mus musculus
ctgctgtgagctgagacccggtcaa

SEQ ID NO: 618038 - DNA, 25 bp, Mus musculus
ctgctgtgagtgctttggctaaatt

SEQ ID NO: 618039 - DNA, 25 bp, Mus musculus
ctgctgtgagtggtttggctaaatt

SEQ ID NO: 618040 - DNA, 25 bp, Mus musculus
ctgctgtgatggcacagacgagtac

SEQ ID NO: 618041 - DNA, 25 bp, Mus musculus
ctgctgtgatgggacagacgagtac

SEQ ID NO: 618042 - DNA, 25 bp, Mus musculus
ctgctgtggtctatgggagcagcat

SEQ ID NO: 618043 - DNA, 25 bp, Mus musculus
ctgctgtggtctttgggagcagcat

SEQ ID NO: 618044 - DNA, 25 bp, Mus musculus
ctgctgtggtggaaggacatttgat

SEQ ID NO: 618045 - DNA, 25 bp, Mus musculus
ctgctgtggtggtaggacatttgat

SEQ ID NO: 618046 - DNA, 25 bp, Mus musculus
ctgctgttccgtcgacagggcagat

SEQ ID NO: 618047 - DNA, 25 bp, Mus musculus
ctgctgttccgtggacagggcagat

SEQ ID NO: 618048 - DNA, 25 bp, Mus musculus
ctgctgttgagaactgtccaggcct

SEQ ID NO: 618049 - DNA, 25 bp, Mus musculus
ctgctgttgagatctgtccaggcct

SEQ ID NO: 618050 - DNA, 25 bp, Mus musculus
ctgctgttgcgtcactggccccggt

SEQ ID NO: 618051 - DNA, 25 bp, Mus musculus
ctgctgttgcgtgactggccccggt

SEQ ID NO: 618052 - DNA, 25 bp, Mus musculus
ctgctgttgctcctttcggccgcgg

SEQ ID NO: 618053 - DNA, 25 bp, Mus musculus
ctgctgttgctcgtttcggccgcgg

SEQ ID NO: 618054 - DNA, 25 bp, Mus musculus
ctgctgtttcaaaagctatgaactc

SEQ ID NO: 618055 - DNA, 25 bp, Mus musculus
ctgctgtttcaatagctatgaactc

SEQ ID NO: 618056 - DNA, 25 bp, Mus musculus
ctgcttaccgagacgtggaacgaga

SEQ ID NO: 618057 - DNA, 25 bp, Mus musculus
ctgcttaccgagtcgtggaacgaga

SEQ ID NO: 618058 - DNA, 25 bp, Mus musculus
ctgcttagctcccaactagtgtagc

SEQ ID NO: 618059 - DNA, 25 bp, Mus musculus
ctgcttagctccgaactagtgtagc

SEQ ID NO: 618060 - DNA, 25 bp, Mus musculus
ctgcttaggtgtcactgatgacggc

SEQ ID NO: 618061 - DNA, 25 bp, Mus musculus
ctgcttaggtgtgactgatgacggc

SEQ ID NO: 618062 - DNA, 25 bp, Mus musculus
ctgcttagtacacattgcctcagtc

SEQ ID NO: 618063 - DNA, 25 bp, Mus musculus
ctgcttagtacagattgcctcagtc

SEQ ID NO: 618064 - DNA, 25 bp, Mus musculus
ctgcttatctcaataacaggatgcc

SEQ ID NO: 618065 - DNA, 25 bp, Mus musculus
ctgcttatctcattaacaggatgcc

SEQ ID NO: 618066 - DNA, 25 bp, Mus musculus
ctgcttcagataccctcaggaaaat

SEQ ID NO: 618067 - DNA, 25 bp, Mus musculus
ctgcttcagatagcctcaggaaaat

SEQ ID NO: 618068 - DNA, 25 bp, Mus musculus
ctgcttcaggtacacacggcgctga

SEQ ID NO: 618069 - DNA, 25 bp, Mus musculus
ctgcttcaggtagacacggcgctga

SEQ ID NO: 618070 - DNA, 25 bp, Mus musculus
ctgcttccagggaacgtgtcgggaa

SEQ ID NO: 618071 - DNA, 25 bp, Mus musculus
ctgcttccagggtacgtgtcgggaa

SEQ ID NO: 618072 - DNA, 25 bp, Mus musculus
ctgcttcctggacgtctgtgggact

SEQ ID NO: 618073 - DNA, 25 bp, Mus musculus
ctgcttcctggaggtctgtgggact

SEQ ID NO: 618074 - DNA, 25 bp, Mus musculus
ctgcttccttgccaagaagatagca

SEQ ID NO: 618075 - DNA, 25 bp, Mus musculus
ctgcttccttgcgaagaagatagca

SEQ ID NO: 618076 - DNA, 25 bp, Mus musculus
ctgcttcggcgcacgcgaggctttg

SEQ ID NO: 618077 - DNA, 25 bp, Mus musculus
ctgcttcggcgctcgcgaggctttg

SEQ ID NO: 618078 - DNA, 25 bp, Mus musculus
ctgcttcgggcacgtggtgttggct

SEQ ID NO: 618079 - DNA, 25 bp, Mus musculus
ctgcttcgggcaggtggtgttggct

SEQ ID NO: 618080 - DNA, 25 bp, Mus musculus
ctgcttctaccacgacttctctgat

SEQ ID NO: 618081 - DNA, 25 bp, Mus musculus
ctgcttctaccaggacttctctgat

SEQ ID NO: 618082 - DNA, 25 bp, Mus musculus
ctgcttctgcttatcgtggcagcag

SEQ ID NO: 618083 - DNA, 25 bp, Mus musculus
ctgcttctgcttttcgtggcagcag

SEQ ID NO: 618084 - DNA, 25 bp, Mus musculus
ctgcttctggatcaaagtaaatgaa

SEQ ID NO: 618085 - DNA, 25 bp, Mus musculus
ctgcttctggatgaaagtaaatgaa

SEQ ID NO: 618086 - DNA, 25 bp, Mus musculus
ctgcttcttatgactggtgctaggc

SEQ ID NO: 618087 - DNA, 25 bp, Mus musculus
ctgcttcttatgtctggtgctaggc

SEQ ID NO: 618088 - DNA, 25 bp, Mus musculus
ctgcttgcgatacgcacgcgatgga

SEQ ID NO: 618089 - DNA, 25 bp, Mus musculus
ctgcttgcgataggcacgcgatgga

SEQ ID NO: 618090 - DNA, 25 bp, Mus musculus
ctgcttggagcaccaagacaagatg

SEQ ID NO: 618091 - DNA, 25 bp, Mus musculus
ctgcttggagcagcaagacaagatg

SEQ ID NO: 618092 - DNA, 25 bp, Mus musculus
ctgcttggaggccttaataaaggcg

SEQ ID NO: 618093 - DNA, 25 bp, Mus musculus
ctgcttggaggcgttaataaaggcg

SEQ ID NO: 618094 - DNA, 25 bp, Mus musculus
ctgcttgggaatcatgtcagctgct

SEQ ID NO: 618095 - DNA, 25 bp, Mus musculus
ctgcttgggaatgatgtcagctgct

SEQ ID NO: 618096 - DNA, 25 bp, Mus musculus
ctgcttggtcacaggtggccccgtc

SEQ ID NO: 618097 - DNA, 25 bp, Mus musculus
ctgcttggtcactggtggccccgtc

SEQ ID NO: 618098 - DNA, 25 bp, Mus musculus
ctgcttggttgtagctaacttggta

SEQ ID NO: 618099 - DNA, 25 bp, Mus musculus
ctgcttggttgttgctaacttggta

SEQ ID NO: 618100 - DNA, 25 bp, Mus musculus
ctgcttgtcaaccagcttggcctct

SEQ ID NO: 618101 - DNA, 25 bp, Mus musculus
ctgcttgtcaacgagcttggcctct

SEQ ID NO: 618102 - DNA, 25 bp, Mus musculus
ctgcttgttcgtactggaggtgtga

SEQ ID NO: 618103 - DNA, 25 bp, Mus musculus
ctgcttgttcgttctggaggtgtga

SEQ ID NO: 618104 - DNA, 25 bp, Mus musculus
ctgctttcctcaaactcccagttaa

SEQ ID NO: 618105 - DNA, 25 bp, Mus musculus
ctgctttcctcatactcccagttaa

SEQ ID NO: 618106 - DNA, 25 bp, Mus musculus
ctgctttgagaacacagctctcttg

SEQ ID NO: 618107 - DNA, 25 bp, Mus musculus
ctgctttgagaagacagctctcttg

SEQ ID NO: 618108 - DNA, 25 bp, Mus musculus
ctgctttgaggcacagcccgacgga

SEQ ID NO: 618109 - DNA, 25 bp, Mus musculus
ctgctttgaggctcagcccgacgga

SEQ ID NO: 618110 - DNA, 25 bp, Mus musculus
ctgctttgggcaagtggttcgtgca

SEQ ID NO: 618111 - DNA, 25 bp, Mus musculus
ctgctttgggcatgtggttcgtgca

SEQ ID NO: 618112 - DNA, 25 bp, Mus musculus
ctgctttgtggacgctggcaatgct

SEQ ID NO: 618113 - DNA, 25 bp, Mus musculus
ctgctttgtggaggctggcaatgct

SEQ ID NO: 618114 - DNA, 25 bp, Mus musculus
ctgctttgtgtaaggccaggactgg

SEQ ID NO: 618115 - DNA, 25 bp, Mus musculus
ctgctttgtgtatggccaggactgg

SEQ ID NO: 618116 - DNA, 25 bp, Mus musculus
ctgcttttaatgaaagtatgccttc

SEQ ID NO: 618117 - DNA, 25 bp, Mus musculus
ctgcttttaatgtaagtatgccttc

SEQ ID NO: 618118 - DNA, 25 bp, Mus musculus
ctgcttttcatcaggtagttgctag

SEQ ID NO: 618119 - DNA, 25 bp, Mus musculus
ctgcttttcatctggtagttgctag

SEQ ID NO: 618120 - DNA, 25 bp, Mus musculus
ctgcttttgaatatcatgggatact

SEQ ID NO: 618121 - DNA, 25 bp, Mus musculus
ctgcttttgaatttcatgggatact

SEQ ID NO: 618122 - DNA, 25 bp, Mus musculus
ctgcttttgcctctacactggcttc

SEQ ID NO: 618123 - DNA, 25 bp, Mus musculus
ctgcttttgcctgtacactggcttc

SEQ ID NO: 618124 - DNA, 25 bp, Mus musculus
ctggaaaaactcagacaaatacttc

SEQ ID NO: 618125 - DNA, 25 bp, Mus musculus
ctggaaaaactctgacaaatacttc

SEQ ID NO: 618126 - DNA, 25 bp, Mus musculus
ctggaaaaagcaaggacgccaattt

SEQ ID NO: 618127 - DNA, 25 bp, Mus musculus
ctggaaaaagcatggacgccaattt

SEQ ID NO: 618128 - DNA, 25 bp, Mus musculus
ctggaaaaagtgctcctgaaatcca

SEQ ID NO: 618129 - DNA, 25 bp, Mus musculus
ctggaaaaagtggtcctgaaatcca

SEQ ID NO: 618130 - DNA, 25 bp, Mus musculus
ctggaaaagcagctgaacgtggcct

SEQ ID NO: 618131 - DNA, 25 bp, Mus musculus
ctggaaaagcaggtgaacgtggcct

SEQ ID NO: 618132 - DNA, 25 bp, Mus musculus
ctggaaaagctgatggagaacatgc

SEQ ID NO: 618133 - DNA, 25 bp, Mus musculus
ctggaaaagctgttggagaacatgc

SEQ ID NO: 618134 - DNA, 25 bp, Mus musculus
ctggaaaagttgagtctgggtttgc

SEQ ID NO: 618135 - DNA, 25 bp, Mus musculus
ctggaaaagttgtgtctgggtttgc

SEQ ID NO: 618136 - DNA, 25 bp, Mus musculus
ctggaaacaagcctggtgccactgt

SEQ ID NO: 618137 - DNA, 25 bp, Mus musculus
ctggaaacaagcgtggtgccactgt

SEQ ID NO: 618138 - DNA, 25 bp, Mus musculus
ctggaaacatgccacgcggcacagc

SEQ ID NO: 618139 - DNA, 25 bp, Mus musculus
ctggaaacatgcgacgcggcacagc

SEQ ID NO: 618140 - DNA, 25 bp, Mus musculus
ctggaaagtaggacttaggagagca

SEQ ID NO: 618141 - DNA, 25 bp, Mus musculus
ctggaaagtaggtcttaggagagca

SEQ ID NO: 618142 - DNA, 25 bp, Mus musculus
ctggaaagttcaagtgcagaagcgg

SEQ ID NO: 618143 - DNA, 25 bp, Mus musculus
ctggaaagttcatgtgcagaagcgg

SEQ ID NO: 618144 - DNA, 25 bp, Mus musculus
ctggaaataattacaggcggatccc

SEQ ID NO: 618145 - DNA, 25 bp, Mus musculus
ctggaaataatttcaggcggatccc

SEQ ID NO: 618146 - DNA, 25 bp, Mus musculus
ctggaaatatggcaggacctaaaga

SEQ ID NO: 618147 - DNA, 25 bp, Mus musculus
ctggaaatatgggaggacctaaaga

SEQ ID NO: 618148 - DNA, 25 bp, Mus musculus
ctggaaatcaaaccccaatcctctg

SEQ ID NO: 618149 - DNA, 25 bp, Mus musculus
ctggaaatcaaagcccaatcctctg

SEQ ID NO: 618150 - DNA, 25 bp, Mus musculus
ctggaaatcagtcgtgggcttgacc

SEQ ID NO: 618151 - DNA, 25 bp, Mus musculus
ctggaaatcagtggtgggcttgacc

SEQ ID NO: 618152 - DNA, 25 bp, Mus musculus
ctggaaatgctcagattgctgatga

SEQ ID NO: 618153 - DNA, 25 bp, Mus musculus
ctggaaatgctctgattgctgatga

SEQ ID NO: 618154 - DNA, 25 bp, Mus musculus
ctggaaatgttcacaggaatgaagc

SEQ ID NO: 618155 - DNA, 25 bp, Mus musculus
ctggaaatgttctcaggaatgaagc

SEQ ID NO: 618156 - DNA, 25 bp, Mus musculus
ctggaacaaagccttcggaccttgg

SEQ ID NO: 618157 - DNA, 25 bp, Mus musculus
ctggaacaaagcgttcggaccttgg

SEQ ID NO: 618158 - DNA, 25 bp, Mus musculus
ctggaacaactcagtgccatgggat

SEQ ID NO: 618159 - DNA, 25 bp, Mus musculus
ctggaacaactctgtgccatgggat

SEQ ID NO: 618160 - DNA, 25 bp, Mus musculus
ctggaacaagtgaacgccctggtgc

SEQ ID NO: 618161 - DNA, 25 bp, Mus musculus
ctggaacaagtgtacgccctggtgc

SEQ ID NO: 618162 - DNA, 25 bp, Mus musculus
ctggaacaattcctcatggatacag

SEQ ID NO: 618163 - DNA, 25 bp, Mus musculus
ctggaacaattcgtcatggatacag

SEQ ID NO: 618164 - DNA, 25 bp, Mus musculus
ctggaacaggctatccctgtgcggc

SEQ ID NO: 618165 - DNA, 25 bp, Mus musculus
ctggaacaggctttccctgtgcggc

SEQ ID NO: 618166 - DNA, 25 bp, Mus musculus
ctggaaccaaggatttaataactat

SEQ ID NO: 618167 - DNA, 25 bp, Mus musculus
ctggaaccaaggttttaataactat

SEQ ID NO: 618168 - DNA, 25 bp, Mus musculus
ctggaaccacagcttggcatggctc

SEQ ID NO: 618169 - DNA, 25 bp, Mus musculus
ctggaaccacaggttggcatggctc

SEQ ID NO: 618170 - DNA, 25 bp, Mus musculus
ctggaaccagggactccacaatcgc

SEQ ID NO: 618171 - DNA, 25 bp, Mus musculus
ctggaaccagggtctccacaatcgc

SEQ ID NO: 618172 - DNA, 25 bp, Mus musculus
ctggaaccatgtctgggtcggcact

SEQ ID NO: 618173 - DNA, 25 bp, Mus musculus
ctggaaccatgtgtgggtcggcact

SEQ ID NO: 618174 - DNA, 25 bp, Mus musculus
ctggaacccaatcaaaccttgattt

SEQ ID NO: 618175 - DNA, 25 bp, Mus musculus
ctggaacccaatgaaaccttgattt

SEQ ID NO: 618176 - DNA, 25 bp, Mus musculus
ctggaacccgaaccgatcgctggcg

SEQ ID NO: 618177 - DNA, 25 bp, Mus musculus
ctggaacccgaagcgatcgctggcg

SEQ ID NO: 618178 - DNA, 25 bp, Mus musculus
ctggaaccgcacagaactgctggcc

SEQ ID NO: 618179 - DNA, 25 bp, Mus musculus
ctggaaccgcactgaactgctggcc

SEQ ID NO: 618180 - DNA, 25 bp, Mus musculus
ctggaaccggaactgaaggcagctt

SEQ ID NO: 618181 - DNA, 25 bp, Mus musculus
ctggaaccggaagtgaaggcagctt

SEQ ID NO: 618182 - DNA, 25 bp, Mus musculus
ctggaaccttgaaggctgttgggaa

SEQ ID NO: 618183 - DNA, 25 bp, Mus musculus
ctggaaccttgatggctgttgggaa

SEQ ID NO: 618184 - DNA, 25 bp, Mus musculus
ctggaacgatcccttcggacagcca

SEQ ID NO: 618185 - DNA, 25 bp, Mus musculus
ctggaacgatccgttcggacagcca

SEQ ID NO: 618186 - DNA, 25 bp, Mus musculus
ctggaacgatggacgacagagagcc

SEQ ID NO: 618187 - DNA, 25 bp, Mus musculus
ctggaacgatggtcgacagagagcc

SEQ ID NO: 618188 - DNA, 25 bp, Mus musculus
ctggaacgttgtagctcgcgccgcc

SEQ ID NO: 618189 - DNA, 25 bp, Mus musculus
ctggaacgttgttgctcgcgccgcc

SEQ ID NO: 618190 - DNA, 25 bp, Mus musculus
ctggaactactacggacagtgccca

SEQ ID NO: 618191 - DNA, 25 bp, Mus musculus
ctggaactactagggacagtgccca

SEQ ID NO: 618192 - DNA, 25 bp, Mus musculus
ctggaactcatacccttgctgctgg

SEQ ID NO: 618193 - DNA, 25 bp, Mus musculus
ctggaactcatagccttgctgctgg

SEQ ID NO: 618194 - DNA, 25 bp, Mus musculus
ctggaactgctcatatctcgctttt

SEQ ID NO: 618195 - DNA, 25 bp, Mus musculus
ctggaactgctcttatctcgctttt

SEQ ID NO: 618196 - DNA, 25 bp, Mus musculus
ctggaactgtttcctcgcctgcgcg

SEQ ID NO: 618197 - DNA, 25 bp, Mus musculus
ctggaactgtttgctcgcctgcgcg

SEQ ID NO: 618198 - DNA, 25 bp, Mus musculus
ctggaacttggtccctgaggcccgc

SEQ ID NO: 618199 - DNA, 25 bp, Mus musculus
ctggaacttggtgcctgaggcccgc

SEQ ID NO: 618200 - DNA, 25 bp, Mus musculus
ctggaagaagccatagaaaggattc

SEQ ID NO: 618201 - DNA, 25 bp, Mus musculus
ctggaagaagccttagaaaggattc

SEQ ID NO: 618202 - DNA, 25 bp, Mus musculus
ctggaagagggcatggaacctgtct

SEQ ID NO: 618203 - DNA, 25 bp, Mus musculus
ctggaagagggcttggaacctgtct

SEQ ID NO: 618204 - DNA, 25 bp, Mus musculus
ctggaagagtatacgaagacaatcg

SEQ ID NO: 618205 - DNA, 25 bp, Mus musculus
ctggaagagtattcgaagacaatcg

SEQ ID NO: 618206 - DNA, 25 bp, Mus musculus
ctggaagagttacaagtgaattagc

SEQ ID NO: 618207 - DNA, 25 bp, Mus musculus
ctggaagagttagaagtgaattagc

SEQ ID NO: 618208 - DNA, 25 bp, Mus musculus
ctggaagatcttctggtaaaaagcc

SEQ ID NO: 618209 - DNA, 25 bp, Mus musculus
ctggaagatcttgtggtaaaaagcc

SEQ ID NO: 618210 - DNA, 25 bp, Mus musculus
ctggaagatgagctggtgtcactgc

SEQ ID NO: 618211 - DNA, 25 bp, Mus musculus
ctggaagatgaggtggtgtcactgc

SEQ ID NO: 618212 - DNA, 25 bp, Mus musculus
ctggaagatgttaggcatgcactgt

SEQ ID NO: 618213 - DNA, 25 bp, Mus musculus
ctggaagatgtttggcatgcactgt

SEQ ID NO: 618214 - DNA, 25 bp, Mus musculus
ctggaagcactgagaccagctcacc

SEQ ID NO: 618215 - DNA, 25 bp, Mus musculus
ctggaagcactgtgaccagctcacc

SEQ ID NO: 618216 - DNA, 25 bp, Mus musculus
ctggaagcagacagtgttctacatg

SEQ ID NO: 618217 - DNA, 25 bp, Mus musculus
ctggaagcagactgtgttctacatg

SEQ ID NO: 618218 - DNA, 25 bp, Mus musculus
ctggaagcatggaccctaggactga

SEQ ID NO: 618219 - DNA, 25 bp, Mus musculus
ctggaagcatggtccctaggactga

SEQ ID NO: 618220 - DNA, 25 bp, Mus musculus
ctggaagccaatcggcctcacaggg

SEQ ID NO: 618221 - DNA, 25 bp, Mus musculus
ctggaagccaatgggcctcacaggg

SEQ ID NO: 618222 - DNA, 25 bp, Mus musculus
ctggaagccctgcagaacaagactc

SEQ ID NO: 618223 - DNA, 25 bp, Mus musculus
ctggaagccctggagaacaagactc

SEQ ID NO: 618224 - DNA, 25 bp, Mus musculus
ctggaagcgctcaggagcatggttc

SEQ ID NO: 618225 - DNA, 25 bp, Mus musculus
ctggaagcgctctggagcatggttc

SEQ ID NO: 618226 - DNA, 25 bp, Mus musculus
ctggaagctattccccaagtcaaat

SEQ ID NO: 618227 - DNA, 25 bp, Mus musculus
ctggaagctattgcccaagtcaaat

SEQ ID NO: 618228 - DNA, 25 bp, Mus musculus
ctggaagctcacaaagaagttttct

SEQ ID NO: 618229 - DNA, 25 bp, Mus musculus
ctggaagctcactaagaagttttct

SEQ ID NO: 618230 - DNA, 25 bp, Mus musculus
ctggaagctgcccaccaaaatggtg

SEQ ID NO: 618231 - DNA, 25 bp, Mus musculus
ctggaagctgccgaccaaaatggtg

SEQ ID NO: 618232 - DNA, 25 bp, Mus musculus
ctggaagctgtgactgcgcgggcgg

SEQ ID NO: 618233 - DNA, 25 bp, Mus musculus
ctggaagctgtgtctgcgcgggcgg

SEQ ID NO: 618234 - DNA, 25 bp, Mus musculus
ctggaagcttatcggcccatccgta

SEQ ID NO: 618235 - DNA, 25 bp, Mus musculus
ctggaagcttatgggcccatccgta

SEQ ID NO: 618236 - DNA, 25 bp, Mus musculus
ctggaaggagctcatcatgtgtaat

SEQ ID NO: 618237 - DNA, 25 bp, Mus musculus
ctggaaggagctgatcatgtgtaat

SEQ ID NO: 618238 - DNA, 25 bp, Mus musculus
ctggaaggcagcaacaagtgtgagt

SEQ ID NO: 618239 - DNA, 25 bp, Mus musculus
ctggaaggcagctacaagtgtgagt

SEQ ID NO: 618240 - DNA, 25 bp, Mus musculus
ctggaaggcccaagtgactaagaac

SEQ ID NO: 618241 - DNA, 25 bp, Mus musculus
ctggaaggcccatgtgactaagaac

SEQ ID NO: 618242 - DNA, 25 bp, Mus musculus
ctggaaggcctgcagctctcagacc

SEQ ID NO: 618243 - DNA, 25 bp, Mus musculus
ctggaaggcctggagctctcagacc

SEQ ID NO: 618244 - DNA, 25 bp, Mus musculus
ctggaaggtgataccatcactttga

SEQ ID NO: 618245 - DNA, 25 bp, Mus musculus
ctggaaggtgattccatcactttga

SEQ ID NO: 618246 - DNA, 25 bp, Mus musculus
ctggaagtacccaggcaaaaggcga

SEQ ID NO: 618247 - DNA, 25 bp, Mus musculus
ctggaagtaccctggcaaaaggcga

SEQ ID NO: 618248 - DNA, 25 bp, Mus musculus
ctggaagtcaggctgtgcgctcact

SEQ ID NO: 618249 - DNA, 25 bp, Mus musculus
ctggaagtcagggtgtgcgctcact

SEQ ID NO: 618250 - DNA, 25 bp, Mus musculus
ctggaagtcttgctgacgccatgtc

SEQ ID NO: 618251 - DNA, 25 bp, Mus musculus
ctggaagtcttggtgacgccatgtc

SEQ ID NO: 618252 - DNA, 25 bp, Mus musculus
ctggaagtgacacaaggaagaactc

SEQ ID NO: 618253 - DNA, 25 bp, Mus musculus
ctggaagtgacagaaggaagaactc

SEQ ID NO: 618254 - DNA, 25 bp, Mus musculus
ctggaagtgattattgcagacctgg

SEQ ID NO: 618255 - DNA, 25 bp, Mus musculus
ctggaagtgatttttgcagacctgg

SEQ ID NO: 618256 - DNA, 25 bp, Mus musculus
ctggaatccctcctgtggtgtaccc

SEQ ID NO: 618257 - DNA, 25 bp, Mus musculus
ctggaatccctcgtgtggtgtaccc

SEQ ID NO: 618258 - DNA, 25 bp, Mus musculus
ctggaatgattcagccactgcctgc

SEQ ID NO: 618259 - DNA, 25 bp, Mus musculus
ctggaatgattctgccactgcctgc

SEQ ID NO: 618260 - DNA, 25 bp, Mus musculus
ctggaatgtgacattgatccccgag

SEQ ID NO: 618261 - DNA, 25 bp, Mus musculus
ctggaatgtgactttgatccccgag

SEQ ID NO: 618262 - DNA, 25 bp, Mus musculus
ctggaattaaacaggcagcagaaac

SEQ ID NO: 618263 - DNA, 25 bp, Mus musculus
ctggaattaaactggcagcagaaac

SEQ ID NO: 618264 - DNA, 25 bp, Mus musculus
ctggaattagggaacaggcagttgt

SEQ ID NO: 618265 - DNA, 25 bp, Mus musculus
ctggaattagggtacaggcagttgt

SEQ ID NO: 618266 - DNA, 25 bp, Mus musculus
ctggaattctaaactgagtgggcat

SEQ ID NO: 618267 - DNA, 25 bp, Mus musculus
ctggaattctaacttggcccacaag

SEQ ID NO: 618268 - DNA, 25 bp, Mus musculus
ctggaattctaagttggcccacaag

SEQ ID NO: 618269 - DNA, 25 bp, Mus musculus
ctggaattctaatctgagtgggcat

SEQ ID NO: 618270 - DNA, 25 bp, Mus musculus
ctggaattctgtctattgtcacaga

SEQ ID NO: 618271 - DNA, 25 bp, Mus musculus
ctggaattctgtgtattgtcacaga

SEQ ID NO: 618272 - DNA, 25 bp, Mus musculus
ctggaattgtttctaaatataagtc

SEQ ID NO: 618273 - DNA, 25 bp, Mus musculus
ctggaattgtttgtaaatataagtc

SEQ ID NO: 618274 - DNA, 25 bp, Mus musculus
ctggaattttggaggtgaatacttc

SEQ ID NO: 618275 - DNA, 25 bp, Mus musculus
ctggaattttggtggtgaatacttc

SEQ ID NO: 618276 - DNA, 25 bp, Mus musculus
ctggacaaagaaacagagaagtcct

SEQ ID NO: 618277 - DNA, 25 bp, Mus musculus
ctggacaaagaatcagagaagtcct

SEQ ID NO: 618278 - DNA, 25 bp, Mus musculus
ctggacaagaggaacggaagagcat

SEQ ID NO: 618279 - DNA, 25 bp, Mus musculus
ctggacaagaggtacggaagagcat

SEQ ID NO: 618280 - DNA, 25 bp, Mus musculus
ctggacaaggtgctaacttggaccg

SEQ ID NO: 618281 - DNA, 25 bp, Mus musculus
ctggacaaggtggtaacttggaccg

SEQ ID NO: 618282 - DNA, 25 bp, Mus musculus
ctggacaatactcagcagttgaaga

SEQ ID NO: 618283 - DNA, 25 bp, Mus musculus
ctggacaatactgagcagttgaaga

SEQ ID NO: 618284 - DNA, 25 bp, Mus musculus
ctggacaatgtcaagagtgagatca

SEQ ID NO: 618285 - DNA, 25 bp, Mus musculus
ctggacaatgtctagagtgagatca

SEQ ID NO: 618286 - DNA, 25 bp, Mus musculus
ctggacacaagcagcggagtcctgc

SEQ ID NO: 618287 - DNA, 25 bp, Mus musculus
ctggacacaagctgcggagtcctgc

SEQ ID NO: 618288 - DNA, 25 bp, Mus musculus
ctggacacagagcatatatcttcta

SEQ ID NO: 618289 - DNA, 25 bp, Mus musculus
ctggacacagaggatatatcttcta

SEQ ID NO: 618290 - DNA, 25 bp, Mus musculus
ctggacacccaaagaaacctcatcg

SEQ ID NO: 618291 - DNA, 25 bp, Mus musculus
ctggacacccaatgaaacctcatcg

SEQ ID NO: 618292 - DNA, 25 bp, Mus musculus
ctggacaccgacagcatgccaaaag

SEQ ID NO: 618293 - DNA, 25 bp, Mus musculus
ctggacaccgactgcatgccaaaag

SEQ ID NO: 618294 - DNA, 25 bp, Mus musculus
ctggacacgacaaccgagtcagctg

SEQ ID NO: 618295 - DNA, 25 bp, Mus musculus
ctggacacgacatccgagtcagctg

SEQ ID NO: 618296 - DNA, 25 bp, Mus musculus
ctggacacgggcagcttctactgca

SEQ ID NO: 618297 - DNA, 25 bp, Mus musculus
ctggacacgggctgcttctactgca

SEQ ID NO: 618298 - DNA, 25 bp, Mus musculus
ctggacagagaacacctgagccagc

SEQ ID NO: 618299 - DNA, 25 bp, Mus musculus
ctggacagagaagacctgagccagc

SEQ ID NO: 618300 - DNA, 25 bp, Mus musculus
ctggacagaggacaagcgcaagcat

SEQ ID NO: 618301 - DNA, 25 bp, Mus musculus
ctggacagaggagaagcgcaagcat

SEQ ID NO: 618302 - DNA, 25 bp, Mus musculus
ctggacagcaaacggcaggatgtat

SEQ ID NO: 618303 - DNA, 25 bp, Mus musculus
ctggacagcaaagggcaggatgtat

SEQ ID NO: 618304 - DNA, 25 bp, Mus musculus
ctggacagcaggctggcccgccaaa

SEQ ID NO: 618305 - DNA, 25 bp, Mus musculus
ctggacagcagggtggcccgccaaa

SEQ ID NO: 618306 - DNA, 25 bp, Mus musculus
ctggacagctccactagtgggacgc

SEQ ID NO: 618307 - DNA, 25 bp, Mus musculus
ctggacagctcctctagtgggacgc

SEQ ID NO: 618308 - DNA, 25 bp, Mus musculus
ctggacaggaagaagaccactcctg

SEQ ID NO: 618309 - DNA, 25 bp, Mus musculus
ctggacaggaagtagaccactcctg

SEQ ID NO: 618310 - DNA, 25 bp, Mus musculus
ctggacagggatccgtggacctcct

SEQ ID NO: 618311 - DNA, 25 bp, Mus musculus
ctggacagggatgcgtggacctcct

SEQ ID NO: 618312 - DNA, 25 bp, Mus musculus
ctggacaggtaccacttgtcttctg

SEQ ID NO: 618313 - DNA, 25 bp, Mus musculus
ctggacaggtacgacttgtcttctg

SEQ ID NO: 618314 - DNA, 25 bp, Mus musculus
ctggacagtgctccgatccagttct

SEQ ID NO: 618315 - DNA, 25 bp, Mus musculus
ctggacagtgctgcgatccagttct

SEQ ID NO: 618316 - DNA, 25 bp, Mus musculus
ctggacataaagaaccacatgttct

SEQ ID NO: 618317 - DNA, 25 bp, Mus musculus
ctggacataaagtaccacatgttct

SEQ ID NO: 618318 - DNA, 25 bp, Mus musculus
ctggacattcaaagaactatttttc

SEQ ID NO: 618319 - DNA, 25 bp, Mus musculus
ctggacattcaatgaactatttttc

SEQ ID NO: 618320 - DNA, 25 bp, Mus musculus
ctggacattcttcaatggaagctgt

SEQ ID NO: 618321 - DNA, 25 bp, Mus musculus
ctggacattcttgaatggaagctgt

SEQ ID NO: 618322 - DNA, 25 bp, Mus musculus
ctggaccaaagacggacaggccttg

SEQ ID NO: 618323 - DNA, 25 bp, Mus musculus
ctggaccaaagagggacaggccttg

SEQ ID NO: 618324 - DNA, 25 bp, Mus musculus
ctggaccaagccatggtggcagagc

SEQ ID NO: 618325 - DNA, 25 bp, Mus musculus
ctggaccaagcccagactgttctgg

SEQ ID NO: 618326 - DNA, 25 bp, Mus musculus
ctggaccaagccgagactgttctgg

SEQ ID NO: 618327 - DNA, 25 bp, Mus musculus
ctggaccaagccttggtggcagagc

SEQ ID NO: 618328 - DNA, 25 bp, Mus musculus
ctggaccacgccctcaatgacatga

SEQ ID NO: 618329 - DNA, 25 bp, Mus musculus
ctggaccacgccgtcaatgacatga

SEQ ID NO: 618330 - DNA, 25 bp, Mus musculus
ctggaccagaatccgagacagaact

SEQ ID NO: 618331 - DNA, 25 bp, Mus musculus
ctggaccagaatgcgagacagaact

SEQ ID NO: 618332 - DNA, 25 bp, Mus musculus
ctggaccagactacgaactttgagg

SEQ ID NO: 618333 - DNA, 25 bp, Mus musculus
ctggaccagacttcgaactttgagg

SEQ ID NO: 618334 - DNA, 25 bp, Mus musculus
ctggaccagcagctggattggaact

SEQ ID NO: 618335 - DNA, 25 bp, Mus musculus
ctggaccagcaggtggattggaact

SEQ ID NO: 618336 - DNA, 25 bp, Mus musculus
ctggaccagtttcgcgaagttgccg

SEQ ID NO: 618337 - DNA, 25 bp, Mus musculus
ctggaccagtttggcgaagttgccg

SEQ ID NO: 618338 - DNA, 25 bp, Mus musculus
ctggacccaccgaagaaagcagtcc

SEQ ID NO: 618339 - DNA, 25 bp, Mus musculus
ctggacccaccgtagaaagcagtcc

SEQ ID NO: 618340 - DNA, 25 bp, Mus musculus
ctggaccccatgcttgctgaggcgc

SEQ ID NO: 618341 - DNA, 25 bp, Mus musculus
ctggaccccatggttgctgaggcgc

SEQ ID NO: 618342 - DNA, 25 bp, Mus musculus
ctggaccctaggacagagcacgggc

SEQ ID NO: 618343 - DNA, 25 bp, Mus musculus
ctggaccctaggtcagagcacgggc

SEQ ID NO: 618344 - DNA, 25 bp, Mus musculus
ctggaccctctccaggtgatggagt

SEQ ID NO: 618345 - DNA, 25 bp, Mus musculus
ctggaccctctcgaggtgatggagt

SEQ ID NO: 618346 - DNA, 25 bp, Mus musculus
ctggaccctttgacacccggaggct

SEQ ID NO: 618347 - DNA, 25 bp, Mus musculus
ctggaccctttgtcacccggaggct

SEQ ID NO: 618348 - DNA, 25 bp, Mus musculus
ctggacctcacccagagcaaggtct

SEQ ID NO: 618349 - DNA, 25 bp, Mus musculus
ctggacctcaccgagagcaaggtct

SEQ ID NO: 618350 - DNA, 25 bp, Mus musculus
ctggacctgagactgatttcttgac

SEQ ID NO: 618351 - DNA, 25 bp, Mus musculus
ctggacctgagagtgatttcttgac

SEQ ID NO: 618352 - DNA, 25 bp, Mus musculus
ctggacctgcagagctaggtggcac

SEQ ID NO: 618353 - DNA, 25 bp, Mus musculus
ctggacctgcagtgctaggtggcac

SEQ ID NO: 618354 - DNA, 25 bp, Mus musculus
ctggacctgggtaggacccgcagtt

SEQ ID NO: 618355 - DNA, 25 bp, Mus musculus
ctggacctgggttggacccgcagtt

SEQ ID NO: 618356 - DNA, 25 bp, Mus musculus
ctggacgacaggaaccattgtctcc

SEQ ID NO: 618357 - DNA, 25 bp, Mus musculus
ctggacgacaggtaccattgtctcc

SEQ ID NO: 618358 - DNA, 25 bp, Mus musculus
ctggacgagccaacagtgaagacca

SEQ ID NO: 618359 - DNA, 25 bp, Mus musculus
ctggacgagccatcagtgaagacca

SEQ ID NO: 618360 - DNA, 25 bp, Mus musculus
ctggacgatactcaaaccggctcta

SEQ ID NO: 618361 - DNA, 25 bp, Mus musculus
ctggacgatactgaaaccggctcta

SEQ ID NO: 618362 - DNA, 25 bp, Mus musculus
ctggacgccatcaccgggaggctgc

SEQ ID NO: 618363 - DNA, 25 bp, Mus musculus
ctggacgccatctccgggaggctgc

SEQ ID NO: 618364 - DNA, 25 bp, Mus musculus
ctggacgctagtcactccagttcta

SEQ ID NO: 618365 - DNA, 25 bp, Mus musculus
ctggacgctagtgactccagttcta

SEQ ID NO: 618366 - DNA, 25 bp, Mus musculus
ctggacgggctcaggacgaccatca

SEQ ID NO: 618367 - DNA, 25 bp, Mus musculus
ctggacgggctctggacgaccatca

SEQ ID NO: 618368 - DNA, 25 bp, Mus musculus
ctggacggtcctcaggaagtgttac

SEQ ID NO: 618369 - DNA, 25 bp, Mus musculus
ctggacggtcctgaggaagtgttac

SEQ ID NO: 618370 - DNA, 25 bp, Mus musculus
ctggacgtccctcaaggcctctagg

SEQ ID NO: 618371 - DNA, 25 bp, Mus musculus
ctggacgtccctgaaggcctctagg

SEQ ID NO: 618372 - DNA, 25 bp, Mus musculus
ctggacgtcctcatccacaatgcag

SEQ ID NO: 618373 - DNA, 25 bp, Mus musculus
ctggacgtcctcttccacaatgcag

SEQ ID NO: 618374 - DNA, 25 bp, Mus musculus
ctggactagcttcctttcctgacat

SEQ ID NO: 618375 - DNA, 25 bp, Mus musculus
ctggactagcttgctttcctgacat

SEQ ID NO: 618376 - DNA, 25 bp, Mus musculus
ctggactcgaatagggtcttggtgc

SEQ ID NO: 618377 - DNA, 25 bp, Mus musculus
ctggactcgaattgggtcttggtgc

SEQ ID NO: 618378 - DNA, 25 bp, Mus musculus
ctggactcgaggaggcatccagccc

SEQ ID NO: 618379 - DNA, 25 bp, Mus musculus
ctggactcgaggtggcatccagccc

SEQ ID NO: 618380 - DNA, 25 bp, Mus musculus
ctggactctccccaggcctggcttt

SEQ ID NO: 618381 - DNA, 25 bp, Mus musculus
ctggactctcccgaggcctggcttt

SEQ ID NO: 618382 - DNA, 25 bp, Mus musculus
ctggactctgctaaagttaatggtg

SEQ ID NO: 618383 - DNA, 25 bp, Mus musculus
ctggactctgcttaagttaatggtg

SEQ ID NO: 618384 - DNA, 25 bp, Mus musculus
ctggactgaagtccccaggtacttt

SEQ ID NO: 618385 - DNA, 25 bp, Mus musculus
ctggactgaagtgcccaggtacttt

SEQ ID NO: 618386 - DNA, 25 bp, Mus musculus
ctggacttaattctgatatgatgga

SEQ ID NO: 618387 - DNA, 25 bp, Mus musculus
ctggacttaattgtgatatgatgga

SEQ ID NO: 618388 - DNA, 25 bp, Mus musculus
ctggacttcgcacgcctacaggaca

SEQ ID NO: 618389 - DNA, 25 bp, Mus musculus
ctggacttcgcaggcctacaggaca

SEQ ID NO: 618390 - DNA, 25 bp, Mus musculus
ctggactttttaaggactgatgaag

SEQ ID NO: 618391 - DNA, 25 bp, Mus musculus
ctggactttttatggactgatgaag

SEQ ID NO: 618392 - DNA, 25 bp, Mus musculus
ctggagaaaccgctcgctttgctgt

SEQ ID NO: 618393 - DNA, 25 bp, Mus musculus
ctggagaaaccggtcgctttgctgt

SEQ ID NO: 618394 - DNA, 25 bp, Mus musculus
ctggagaaatatcaggatcaataac

SEQ ID NO: 618395 - DNA, 25 bp, Mus musculus
ctggagaaatatgaggatcaataac

SEQ ID NO: 618396 - DNA, 25 bp, Mus musculus
ctggagaacaaaccagggatctcct

SEQ ID NO: 618397 - DNA, 25 bp, Mus musculus
ctggagaacaaagcagggatctcct

SEQ ID NO: 618398 - DNA, 25 bp, Mus musculus
ctggagaactacctgggaatcatac

SEQ ID NO: 618399 - DNA, 25 bp, Mus musculus
ctggagaactacgtgggaatcatac

SEQ ID NO: 618400 - DNA, 25 bp, Mus musculus
ctggagaagaaaattaacaaatcgg

SEQ ID NO: 618401 - DNA, 25 bp, Mus musculus
ctggagaagaaatttaacaaatcgg

SEQ ID NO: 618402 - DNA, 25 bp, Mus musculus
ctggagaagactacaccaagccacc

SEQ ID NO: 618403 - DNA, 25 bp, Mus musculus
ctggagaagacttcaccaagccacc

SEQ ID NO: 618404 - DNA, 25 bp, Mus musculus
ctggagaagagtatcctatggatat

SEQ ID NO: 618405 - DNA, 25 bp, Mus musculus
ctggagaagagtttcctatggatat

SEQ ID NO: 618406 - DNA, 25 bp, Mus musculus
ctggagaagcacatggcagcggcca

SEQ ID NO: 618407 - DNA, 25 bp, Mus musculus
ctggagaagcacttggcagcggcca

SEQ ID NO: 618408 - DNA, 25 bp, Mus musculus
ctggagaagtgtccgatgacagccc

SEQ ID NO: 618409 - DNA, 25 bp, Mus musculus
ctggagaagtgtgcgatgacagccc

SEQ ID NO: 618410 - DNA, 25 bp, Mus musculus
ctggagaatcagcaaaaagcaccat

SEQ ID NO: 618411 - DNA, 25 bp, Mus musculus
ctggagaatcaggaaaaagcaccat

SEQ ID NO: 618412 - DNA, 25 bp, Mus musculus
ctggagaatctgaatgagcggaagc

SEQ ID NO: 618413 - DNA, 25 bp, Mus musculus
ctggagaatctgtatgagcggaagc

SEQ ID NO: 618414 - DNA, 25 bp, Mus musculus
ctggagacaccaatgccttagtagc

SEQ ID NO: 618415 - DNA, 25 bp, Mus musculus
ctggagacaccattgccttagtagc

SEQ ID NO: 618416 - DNA, 25 bp, Mus musculus
ctggagacatcaagaactgggtgga

SEQ ID NO: 618417 - DNA, 25 bp, Mus musculus
ctggagacatcatgaactgggtgga

SEQ ID NO: 618418 - DNA, 25 bp, Mus musculus
ctggagacatttacaaggacaatgt

SEQ ID NO: 618419 - DNA, 25 bp, Mus musculus
ctggagacattttcaaggacaatgt

SEQ ID NO: 618420 - DNA, 25 bp, Mus musculus
ctggagaccaggacaaggctgccaa

SEQ ID NO: 618421 - DNA, 25 bp, Mus musculus
ctggagaccaggtcaaggctgccaa

SEQ ID NO: 618422 - DNA, 25 bp, Mus musculus
ctggagacctaaagaattctgttga

SEQ ID NO: 618423 - DNA, 25 bp, Mus musculus
ctggagacctaatgaattctgttga

SEQ ID NO: 618424 - DNA, 25 bp, Mus musculus
ctggagactccacgctttcacagga

SEQ ID NO: 618425 - DNA, 25 bp, Mus musculus
ctggagactccaggctttcacagga

SEQ ID NO: 618426 - DNA, 25 bp, Mus musculus
ctggagactggcactgggctctacg

SEQ ID NO: 618427 - DNA, 25 bp, Mus musculus
ctggagactggctctgggctctacg

SEQ ID NO: 618428 - DNA, 25 bp, Mus musculus
ctggagagactcaaggagtacagct

SEQ ID NO: 618429 - DNA, 25 bp, Mus musculus
ctggagagactctaggagtacagct

SEQ ID NO: 618430 - DNA, 25 bp, Mus musculus
ctggagagactgcatgtaagctcgc

SEQ ID NO: 618431 - DNA, 25 bp, Mus musculus
ctggagagactggatgtaagctcgc

SEQ ID NO: 618432 - DNA, 25 bp, Mus musculus
ctggagagagatcacggaagtacaa

SEQ ID NO: 618433 - DNA, 25 bp, Mus musculus
ctggagagagatgacggaagtacaa

SEQ ID NO: 618434 - DNA, 25 bp, Mus musculus
ctggagagattcaagaagtagccac

SEQ ID NO: 618435 - DNA, 25 bp, Mus musculus
ctggagagattctagaagtagccac

SEQ ID NO: 618436 - DNA, 25 bp, Mus musculus
ctggagagcagacgagttatgttat

SEQ ID NO: 618437 - DNA, 25 bp, Mus musculus
ctggagagcagaggagttatgttat

SEQ ID NO: 618438 - DNA, 25 bp, Mus musculus
ctggagagcgcgcagctgctgcaga

SEQ ID NO: 618439 - DNA, 25 bp, Mus musculus
ctggagagcgcggagctgctgcaga

SEQ ID NO: 618440 - DNA, 25 bp, Mus musculus
ctggagagttccagttgccctttga

SEQ ID NO: 618441 - DNA, 25 bp, Mus musculus
ctggagagttcctgttgccctttga

SEQ ID NO: 618442 - DNA, 25 bp, Mus musculus
ctggagatcaccactgagagagggt

SEQ ID NO: 618443 - DNA, 25 bp, Mus musculus
ctggagatcacctctgagagagggt

SEQ ID NO: 618444 - DNA, 25 bp, Mus musculus
ctggagatggaccaggccaaagcca

SEQ ID NO: 618445 - DNA, 25 bp, Mus musculus
ctggagatggacgaggccaaagcca

SEQ ID NO: 618446 - DNA, 25 bp, Mus musculus
ctggagatggagatcaaacgcggcc

SEQ ID NO: 618447 - DNA, 25 bp, Mus musculus
ctggagatggagttcaaacgcggcc

SEQ ID NO: 618448 - DNA, 25 bp, Mus musculus
ctggagatggcgagaaccgctgcat

SEQ ID NO: 618449 - DNA, 25 bp, Mus musculus
ctggagatggcgtgaaccgctgcat

SEQ ID NO: 618450 - DNA, 25 bp, Mus musculus
ctggagattcctatcaaatgccatc

SEQ ID NO: 618451 - DNA, 25 bp, Mus musculus
ctggagattcctttcaaatgccatc

SEQ ID NO: 618452 - DNA, 25 bp, Mus musculus
ctggagattgcccacctggccgact

SEQ ID NO: 618453 - DNA, 25 bp, Mus musculus
ctggagattgccgacctggccgact

SEQ ID NO: 618454 - DNA, 25 bp, Mus musculus
ctggagcagcagagctgggtacttt

SEQ ID NO: 618455 - DNA, 25 bp, Mus musculus
ctggagcagcagtgctgggtacttt

SEQ ID NO: 618456 - DNA, 25 bp, Mus musculus
ctggagcagctgctcaaattgcata

SEQ ID NO: 618457 - DNA, 25 bp, Mus musculus
ctggagcagctggtcaaattgcata

SEQ ID NO: 618458 - DNA, 25 bp, Mus musculus
ctggagcaggagcttctctgcatca

SEQ ID NO: 618459 - DNA, 25 bp, Mus musculus
ctggagcaggaggttctctgcatca

SEQ ID NO: 618460 - DNA, 25 bp, Mus musculus
ctggagcatgagacattccggaatg

SEQ ID NO: 618461 - DNA, 25 bp, Mus musculus
ctggagcatgagtcattccggaatg

SEQ ID NO: 618462 - DNA, 25 bp, Mus musculus
ctggagccatggctatgcaaggcat

SEQ ID NO: 618463 - DNA, 25 bp, Mus musculus
ctggagccatgggtatgcaaggcat

SEQ ID NO: 618464 - DNA, 25 bp, Mus musculus
ctggagccattaaggcacgcatcgc

SEQ ID NO: 618465 - DNA, 25 bp, Mus musculus
ctggagccattatggcacgcatcgc

SEQ ID NO: 618466 - DNA, 25 bp, Mus musculus
ctggagcccatgcttcctgtgtgcc

SEQ ID NO: 618467 - DNA, 25 bp, Mus musculus
ctggagcccatggttcctgtgtgcc

SEQ ID NO: 618468 - DNA, 25 bp, Mus musculus
ctggagcccttgatgactgattgga

SEQ ID NO: 618469 - DNA, 25 bp, Mus musculus
ctggagcccttgttgactgattgga

SEQ ID NO: 618470 - DNA, 25 bp, Mus musculus
ctggagcgactcatcttccaccttg

SEQ ID NO: 618471 - DNA, 25 bp, Mus musculus
ctggagcgactcttcttccaccttg

SEQ ID NO: 618472 - DNA, 25 bp, Mus musculus
ctggagcgacttctgcgagcagcac

SEQ ID NO: 618473 - DNA, 25 bp, Mus musculus
ctggagcgacttgtgcgagcagcac

SEQ ID NO: 618474 - DNA, 25 bp, Mus musculus
ctggagcgagagcactaaattcgga

SEQ ID NO: 618475 - DNA, 25 bp, Mus musculus
ctggagcgagaggactaaattcgga

SEQ ID NO: 618476 - DNA, 25 bp, Mus musculus
ctggagcgaggcacagcgttctgaa

SEQ ID NO: 618477 - DNA, 25 bp, Mus musculus
ctggagcgaggctcagcgttctgaa

SEQ ID NO: 618478 - DNA, 25 bp, Mus musculus
ctggagcgatacagcgccatctgcc

SEQ ID NO: 618479 - DNA, 25 bp, Mus musculus
ctggagcgatactgcgccatctgcc

SEQ ID NO: 618480 - DNA, 25 bp, Mus musculus
ctggagcgcacaactggccgaggtc

SEQ ID NO: 618481 - DNA, 25 bp, Mus musculus
ctggagcgcacatctggccgaggtc

SEQ ID NO: 618482 - DNA, 25 bp, Mus musculus
ctggagcgtcagacttaacaggaag

SEQ ID NO: 618483 - DNA, 25 bp, Mus musculus
ctggagcgtcagtcttaacaggaag

SEQ ID NO: 618484 - DNA, 25 bp, Mus musculus
ctggagctagctaagttggagctga

SEQ ID NO: 618485 - DNA, 25 bp, Mus musculus
ctggagctagcttagttggagctga

SEQ ID NO: 618486 - DNA, 25 bp, Mus musculus
ctggagctaggacgcaagaacccgt

SEQ ID NO: 618487 - DNA, 25 bp, Mus musculus
ctggagctaggaggcaagaacccgt

SEQ ID NO: 618488 - DNA, 25 bp, Mus musculus
ctggagctgcacagccagaccagag

SEQ ID NO: 618489 - DNA, 25 bp, Mus musculus
ctggagctgcactgccagaccagag

SEQ ID NO: 618490 - DNA, 25 bp, Mus musculus
ctggagctggttcgccaagcaccct

SEQ ID NO: 618491 - DNA, 25 bp, Mus musculus
ctggagctggttcggaccttctctt

SEQ ID NO: 618492 - DNA, 25 bp, Mus musculus
ctggagctggttggccaagcaccct

SEQ ID NO: 618493 - DNA, 25 bp, Mus musculus
ctggagctggttgggaccttctctt

SEQ ID NO: 618494 - DNA, 25 bp, Mus musculus
ctggagctgtggcacacctggtaca

SEQ ID NO: 618495 - DNA, 25 bp, Mus musculus
ctggagctgtgggacacctggtaca

SEQ ID NO: 618496 - DNA, 25 bp, Mus musculus
ctggaggaaaacacctgtccacggt

SEQ ID NO: 618497 - DNA, 25 bp, Mus musculus
ctggaggaaaactcctgtccacggt

SEQ ID NO: 618498 - DNA, 25 bp, Mus musculus
ctggaggaaatcagggaagctcgat

SEQ ID NO: 618499 - DNA, 25 bp, Mus musculus
ctggaggaaatctgggaagctcgat

SEQ ID NO: 618500 - DNA, 25 bp, Mus musculus
ctggaggaactgaggaacgaacatt

SEQ ID NO: 618501 - DNA, 25 bp, Mus musculus
ctggaggaactgtggaacgaacatt

SEQ ID NO: 618502 - DNA, 25 bp, Mus musculus
ctggaggaagacatgtttgatggac

SEQ ID NO: 618503 - DNA, 25 bp, Mus musculus
ctggaggaagacttgtttgatggac

SEQ ID NO: 618504 - DNA, 25 bp, Mus musculus
ctggaggaagagaacgaccacctgc

SEQ ID NO: 618505 - DNA, 25 bp, Mus musculus
ctggaggaagagtacgaccacctgc

SEQ ID NO: 618506 - DNA, 25 bp, Mus musculus
ctggaggaattgcagcatatcacat

SEQ ID NO: 618507 - DNA, 25 bp, Mus musculus
ctggaggaattggagcatatcacat

SEQ ID NO: 618508 - DNA, 25 bp, Mus musculus
ctggaggacaagcagggcacgttgc

SEQ ID NO: 618509 - DNA, 25 bp, Mus musculus
ctggaggacaaggagggcacgttgc

SEQ ID NO: 618510 - DNA, 25 bp, Mus musculus
ctggaggaccgtaccctgatctcta

SEQ ID NO: 618511 - DNA, 25 bp, Mus musculus
ctggaggaccgttccctgatctcta

SEQ ID NO: 618512 - DNA, 25 bp, Mus musculus
ctggaggacgaacagcagatgctca

SEQ ID NO: 618513 - DNA, 25 bp, Mus musculus
ctggaggacgaagagcagatgctca

SEQ ID NO: 618514 - DNA, 25 bp, Mus musculus
ctggaggacttcatcaacaacatca

SEQ ID NO: 618515 - DNA, 25 bp, Mus musculus
ctggaggacttcttcaacaacatca

SEQ ID NO: 618516 - DNA, 25 bp, Mus musculus
ctggaggagaaactactgcctgtgc

SEQ ID NO: 618517 - DNA, 25 bp, Mus musculus
ctggaggagaaagtactgcctgtgc

SEQ ID NO: 618518 - DNA, 25 bp, Mus musculus
ctggaggagcacaagtactttgagg

SEQ ID NO: 618519 - DNA, 25 bp, Mus musculus
ctggaggagcactagtactttgagg

SEQ ID NO: 618520 - DNA, 25 bp, Mus musculus
ctggaggaggacatgaaggaggtgc

SEQ ID NO: 618521 - DNA, 25 bp, Mus musculus
ctggaggaggacttgaaggaggtgc

SEQ ID NO: 618522 - DNA, 25 bp, Mus musculus
ctggaggagtaaaagggacttgttc

SEQ ID NO: 618523 - DNA, 25 bp, Mus musculus
ctggaggagtaatagggacttgttc

SEQ ID NO: 618524 - DNA, 25 bp, Mus musculus
ctggaggagtcacaacgcacgtgct

SEQ ID NO: 618525 - DNA, 25 bp, Mus musculus
ctggaggagtcagaacgcacgtgct

SEQ ID NO: 618526 - DNA, 25 bp, Mus musculus
ctggaggatgtgcaaattttcagga

SEQ ID NO: 618527 - DNA, 25 bp, Mus musculus
ctggaggatgtggaaattttcagga

SEQ ID NO: 618528 - DNA, 25 bp, Mus musculus
ctggaggcccacaagagaggtcaca

SEQ ID NO: 618529 - DNA, 25 bp, Mus musculus
ctggaggcccactagagaggtcaca

SEQ ID NO: 618530 - DNA, 25 bp, Mus musculus
ctggaggccctacagaaacagatgg

SEQ ID NO: 618531 - DNA, 25 bp, Mus musculus
ctggaggccctagagaaacagatgg

SEQ ID NO: 618532 - DNA, 25 bp, Mus musculus
ctggaggcctcgattccgctattat

SEQ ID NO: 618533 - DNA, 25 bp, Mus musculus
ctggaggcctcgtttccgctattat

SEQ ID NO: 618534 - DNA, 25 bp, Mus musculus
ctggaggcggccatgctgaaatagt

SEQ ID NO: 618535 - DNA, 25 bp, Mus musculus
ctggaggcggccttgctgaaatagt

SEQ ID NO: 618536 - DNA, 25 bp, Mus musculus
ctggaggctaatcaccaatttctta

SEQ ID NO: 618537 - DNA, 25 bp, Mus musculus
ctggaggctaatgaccaatttctta

SEQ ID NO: 618538 - DNA, 25 bp, Mus musculus
ctggaggctatcagctgaatgaggc

SEQ ID NO: 618539 - DNA, 25 bp, Mus musculus
ctggaggctatctgctgaatgaggc

SEQ ID NO: 618540 - DNA, 25 bp, Mus musculus
ctggaggctgccacgggctacctac

SEQ ID NO: 618541 - DNA, 25 bp, Mus musculus
ctggaggctgcctcgggctacctac

SEQ ID NO: 618542 - DNA, 25 bp, Mus musculus
ctggagggcggaagacctcccttcg

SEQ ID NO: 618543 - DNA, 25 bp, Mus musculus
ctggagggcggatgacctcccttcg

SEQ ID NO: 618544 - DNA, 25 bp, Mus musculus
ctggaggtcactccagatctggcag

SEQ ID NO: 618545 - DNA, 25 bp, Mus musculus
ctggaggtcactgcagatctggcag

SEQ ID NO: 618546 - DNA, 25 bp, Mus musculus
ctggaggtccccaggctttaccgca

SEQ ID NO: 618547 - DNA, 25 bp, Mus musculus
ctggaggtcccctggctttaccgca

SEQ ID NO: 618548 - DNA, 25 bp, Mus musculus
ctggaggtggctagtgtatctgtca

SEQ ID NO: 618549 - DNA, 25 bp, Mus musculus
ctggaggtggcttgtgtatctgtca

SEQ ID NO: 618550 - DNA, 25 bp, Mus musculus
ctggagtaaggacaaacagttccgg

SEQ ID NO: 618551 - DNA, 25 bp, Mus musculus
ctggagtaaggagaaacagttccgg

SEQ ID NO: 618552 - DNA, 25 bp, Mus musculus
ctggagtacgcaccttgccgctcag

SEQ ID NO: 618553 - DNA, 25 bp, Mus musculus
ctggagtacgcagcttgccgctcag

SEQ ID NO: 618554 - DNA, 25 bp, Mus musculus
ctggagtatgaaccacggaatcaga

SEQ ID NO: 618555 - DNA, 25 bp, Mus musculus
ctggagtatgaagcacggaatcaga

SEQ ID NO: 618556 - DNA, 25 bp, Mus musculus
ctggagtatgagaaggtgccctact

SEQ ID NO: 618557 - DNA, 25 bp, Mus musculus
ctggagtatgagtaggtgccctact

SEQ ID NO: 618558 - DNA, 25 bp, Mus musculus
ctggagtcaaagcaaagctaggcag

SEQ ID NO: 618559 - DNA, 25 bp, Mus musculus
ctggagtcaaaggaaagctaggcag

SEQ ID NO: 618560 - DNA, 25 bp, Mus musculus
ctggagtcacatctagtagtggacc

SEQ ID NO: 618561 - DNA, 25 bp, Mus musculus
ctggagtcacatgtagtagtggacc

SEQ ID NO: 618562 - DNA, 25 bp, Mus musculus
ctggagtgagagctgagctctttat

SEQ ID NO: 618563 - DNA, 25 bp, Mus musculus
ctggagtgagaggtgagctctttat

SEQ ID NO: 618564 - DNA, 25 bp, Mus musculus
ctggagtggagtcaccaaataagca

SEQ ID NO: 618565 - DNA, 25 bp, Mus musculus
ctggagtggagtgaccaaataagca

SEQ ID NO: 618566 - DNA, 25 bp, Mus musculus
ctggagttcaacaaggcggagaaac

SEQ ID NO: 618567 - DNA, 25 bp, Mus musculus
ctggagttcaactaggcggagaaac

SEQ ID NO: 618568 - DNA, 25 bp, Mus musculus
ctggagttcctgatgtggaaggtta

SEQ ID NO: 618569 - DNA, 25 bp, Mus musculus
ctggagttcctgttgtggaaggtta

SEQ ID NO: 618570 - DNA, 25 bp, Mus musculus
ctggagttctgtcaaaagctgttac

SEQ ID NO: 618571 - DNA, 25 bp, Mus musculus
ctggagttctgtgaaaagctgttac

SEQ ID NO: 618572 - DNA, 25 bp, Mus musculus
ctggagttgcaacgatccaattcga

SEQ ID NO: 618573 - DNA, 25 bp, Mus musculus
ctggagttgcaaggatccaattcga

SEQ ID NO: 618574 - DNA, 25 bp, Mus musculus
ctggagttgctcaacctcgggatct

SEQ ID NO: 618575 - DNA, 25 bp, Mus musculus
ctggagttgctctacctcgggatct

SEQ ID NO: 618576 - DNA, 25 bp, Mus musculus
ctggagttggtactattgtccatga

SEQ ID NO: 618577 - DNA, 25 bp, Mus musculus
ctggagttggtagtattgtccatga

SEQ ID NO: 618578 - DNA, 25 bp, Mus musculus
ctggagtttgatcaggagcgagccc

SEQ ID NO: 618579 - DNA, 25 bp, Mus musculus
ctggagtttgatgaggagcgagccc

SEQ ID NO: 618580 - DNA, 25 bp, Mus musculus
ctggagttttatccctccaacctct

SEQ ID NO: 618581 - DNA, 25 bp, Mus musculus
ctggagttttatgcctccaacctct

SEQ ID NO: 618582 - DNA, 25 bp, Mus musculus
ctggagttttctcataagtagaggg

SEQ ID NO: 618583 - DNA, 25 bp, Mus musculus
ctggagttttctgataagtagaggg

SEQ ID NO: 618584 - DNA, 25 bp, Mus musculus
ctggataacacgcagaggctggaaa

SEQ ID NO: 618585 - DNA, 25 bp, Mus musculus
ctggataacacggagaggctggaaa

SEQ ID NO: 618586 - DNA, 25 bp, Mus musculus
ctggataccacacgagagacctctg

SEQ ID NO: 618587 - DNA, 25 bp, Mus musculus
ctggataccacaggagagacctctg

SEQ ID NO: 618588 - DNA, 25 bp, Mus musculus
ctggatacctggcaagcagcggcca

SEQ ID NO: 618589 - DNA, 25 bp, Mus musculus
ctggatacctgggaagcagcggcca

SEQ ID NO: 618590 - DNA, 25 bp, Mus musculus
ctggatagagggactcacgggcctc

SEQ ID NO: 618591 - DNA, 25 bp, Mus musculus
ctggatagagggtctcacgggcctc

SEQ ID NO: 618592 - DNA, 25 bp, Mus musculus
ctggatatagtgaatgttgtaagac

SEQ ID NO: 618593 - DNA, 25 bp, Mus musculus
ctggatatagtgtatgttgtaagac

SEQ ID NO: 618594 - DNA, 25 bp, Mus musculus
ctggatatccaaaggcggcaggagt

SEQ ID NO: 618595 - DNA, 25 bp, Mus musculus
ctggatatccaatggcggcaggagt

SEQ ID NO: 618596 - DNA, 25 bp, Mus musculus
ctggatcagatcatccaggaagact

SEQ ID NO: 618597 - DNA, 25 bp, Mus musculus
ctggatcagatcttccaggaagact

SEQ ID NO: 618598 - DNA, 25 bp, Mus musculus
ctggatcaggcaagctccagcacag

SEQ ID NO: 618599 - DNA, 25 bp, Mus musculus
ctggatcaggcatgctccagcacag

SEQ ID NO: 618600 - DNA, 25 bp, Mus musculus
ctggatcatctcatcaaaggaaggc

SEQ ID NO: 618601 - DNA, 25 bp, Mus musculus
ctggatcatctcttcaaaggaaggc

SEQ ID NO: 618602 - DNA, 25 bp, Mus musculus
ctggatcatctgcacccaagggtga

SEQ ID NO: 618603 - DNA, 25 bp, Mus musculus
ctggatcatctggacccaagggtga

SEQ ID NO: 618604 - DNA, 25 bp, Mus musculus
ctggatccacatatgcaccaattgg

SEQ ID NO: 618605 - DNA, 25 bp, Mus musculus
ctggatccacatttgcaccaattgg

SEQ ID NO: 618606 - DNA, 25 bp, Mus musculus
ctggatcctatgctcagaagtatgg

SEQ ID NO: 618607 - DNA, 25 bp, Mus musculus
ctggatcctatggtcagaagtatgg

SEQ ID NO: 618608 - DNA, 25 bp, Mus musculus
ctggatcgattgcagttcgaggact

SEQ ID NO: 618609 - DNA, 25 bp, Mus musculus
ctggatcgattggagttcgaggact

SEQ ID NO: 618610 - DNA, 25 bp, Mus musculus
ctggatctcatcaagaaaggcgtgg

SEQ ID NO: 618611 - DNA, 25 bp, Mus musculus
ctggatctcatctagaaaggcgtgg

SEQ ID NO: 618612 - DNA, 25 bp, Mus musculus
ctggatctgagtacctgaagctcgg

SEQ ID NO: 618613 - DNA, 25 bp, Mus musculus
ctggatctgagttcctgaagctcgg

SEQ ID NO: 618614 - DNA, 25 bp, Mus musculus
ctggatctgcagcatcaggccaagg

SEQ ID NO: 618615 - DNA, 25 bp, Mus musculus
ctggatctgcaggatcaggccaagg

SEQ ID NO: 618616 - DNA, 25 bp, Mus musculus
ctggatctggctcgtgacacagttc

SEQ ID NO: 618617 - DNA, 25 bp, Mus musculus
ctggatctggctggtgacacagttc

SEQ ID NO: 618618 - DNA, 25 bp, Mus musculus
ctggatcttgtaagccgagcaggac

SEQ ID NO: 618619 - DNA, 25 bp, Mus musculus
ctggatcttgtatgccgagcaggac

SEQ ID NO: 618620 - DNA, 25 bp, Mus musculus
ctggatgaaaggcagcacaccatcg

SEQ ID NO: 618621 - DNA, 25 bp, Mus musculus
ctggatgaaagggagcacaccatcg

SEQ ID NO: 618622 - DNA, 25 bp, Mus musculus
ctggatgaagccaaccgagaggccc

SEQ ID NO: 618623 - DNA, 25 bp, Mus musculus
ctggatgaagcctaccgagaggccc

SEQ ID NO: 618624 - DNA, 25 bp, Mus musculus
ctggatgacaatatccggactgtcg

SEQ ID NO: 618625 - DNA, 25 bp, Mus musculus
ctggatgacaatttccggactgtcg

SEQ ID NO: 618626 - DNA, 25 bp, Mus musculus
ctggatgaccgcaacgaggagaagc

SEQ ID NO: 618627 - DNA, 25 bp, Mus musculus
ctggatgaccgctacgaggagaagc

SEQ ID NO: 618628 - DNA, 25 bp, Mus musculus
ctggatgagcgaagcagaagagtcc

SEQ ID NO: 618629 - DNA, 25 bp, Mus musculus
ctggatgagcgatgcagaagagtcc

SEQ ID NO: 618630 - DNA, 25 bp, Mus musculus
ctggatgagcttctgaagtgtgcat

SEQ ID NO: 618631 - DNA, 25 bp, Mus musculus
ctggatgagcttgtgaagtgtgcat

SEQ ID NO: 618632 - DNA, 25 bp, Mus musculus
ctggatgagttcacccgcagctaca

SEQ ID NO: 618633 - DNA, 25 bp, Mus musculus
ctggatgagttctcccgcagctaca

SEQ ID NO: 618634 - DNA, 25 bp, Mus musculus
ctggatgagttgaaggagcgcattt

SEQ ID NO: 618635 - DNA, 25 bp, Mus musculus
ctggatgagttgtaggagcgcattt

SEQ ID NO: 618636 - DNA, 25 bp, Mus musculus
ctggatgatcagaacattcaggtga

SEQ ID NO: 618637 - DNA, 25 bp, Mus musculus
ctggatgatcagtacattcaggtga

SEQ ID NO: 618638 - DNA, 25 bp, Mus musculus
ctggatgcaatgcaccaagttggtc

SEQ ID NO: 618639 - DNA, 25 bp, Mus musculus
ctggatgcaatggaccaagttggtc

SEQ ID NO: 618640 - DNA, 25 bp, Mus musculus
ctggatgccccgcatgatgttgact

SEQ ID NO: 618641 - DNA, 25 bp, Mus musculus
ctggatgccccggatgatgttgact

SEQ ID NO: 618642 - DNA, 25 bp, Mus musculus
ctggatgccggtattggctggaact

SEQ ID NO: 618643 - DNA, 25 bp, Mus musculus
ctggatgccggttttggctggaact

SEQ ID NO: 618644 - DNA, 25 bp, Mus musculus
ctggatggagatactcatcttgggc

SEQ ID NO: 618645 - DNA, 25 bp, Mus musculus
ctggatggagatacttgaaagaccc

SEQ ID NO: 618646 - DNA, 25 bp, Mus musculus
ctggatggagattctcatcttgggc

SEQ ID NO: 618647 - DNA, 25 bp, Mus musculus
ctggatggagattcttgaaagaccc

SEQ ID NO: 618648 - DNA, 25 bp, Mus musculus
ctggatgggtctctcagacatgcat

SEQ ID NO: 618649 - DNA, 25 bp, Mus musculus
ctggatgggtctgtcagacatgcat

SEQ ID NO: 618650 - DNA, 25 bp, Mus musculus
ctggatggtcatattaagaagagtg

SEQ ID NO: 618651 - DNA, 25 bp, Mus musculus
ctggatggtcattttaagaagagtg

SEQ ID NO: 618652 - DNA, 25 bp, Mus musculus
ctggatgtataaaggtgaacaagaa

SEQ ID NO: 618653 - DNA, 25 bp, Mus musculus
ctggatgtataatggtgaacaagaa

SEQ ID NO: 618654 - DNA, 25 bp, Mus musculus
ctggatgtctccatgaacaggttta

SEQ ID NO: 618655 - DNA, 25 bp, Mus musculus
ctggatgtctccttgaacaggttta

SEQ ID NO: 618656 - DNA, 25 bp, Mus musculus
ctggatgtctttcttcggaaacaag

SEQ ID NO: 618657 - DNA, 25 bp, Mus musculus
ctggatgtctttgttcggaaacaag

SEQ ID NO: 618658 - DNA, 25 bp, Mus musculus
ctggatgtggacacctgtggacctg

SEQ ID NO: 618659 - DNA, 25 bp, Mus musculus
ctggatgtggactcctgtggacctg

SEQ ID NO: 618660 - DNA, 25 bp, Mus musculus
ctggatgttatgacacctatgcggc

SEQ ID NO: 618661 - DNA, 25 bp, Mus musculus
ctggatgttatgtcacctatgcggc

SEQ ID NO: 618662 - DNA, 25 bp, Mus musculus
ctggattatatcatgggtggctgcc

SEQ ID NO: 618663 - DNA, 25 bp, Mus musculus
ctggattatatcttgggtggctgcc

SEQ ID NO: 618664 - DNA, 25 bp, Mus musculus
ctggatttagaacagcgcctggcaa

SEQ ID NO: 618665 - DNA, 25 bp, Mus musculus
ctggatttagaagagcgcctggcaa

SEQ ID NO: 618666 - DNA, 25 bp, Mus musculus
ctggatttgggaagtaatgaattca

SEQ ID NO: 618667 - DNA, 25 bp, Mus musculus
ctggatttgggaatgagtgtgcttc

SEQ ID NO: 618668 - DNA, 25 bp, Mus musculus
ctggatttgggatgtaatgaattca

SEQ ID NO: 618669 - DNA, 25 bp, Mus musculus
ctggatttgggattgagtgtgcttc

SEQ ID NO: 618670 - DNA, 25 bp, Mus musculus
ctggcaaacattcacgatgttgtga

SEQ ID NO: 618671 - DNA, 25 bp, Mus musculus
ctggcaaacattgacgatgttgtga

SEQ ID NO: 618672 - DNA, 25 bp, Mus musculus
ctggcaaacggactgttgcttccca

SEQ ID NO: 618673 - DNA, 25 bp, Mus musculus
ctggcaaacggagtgttgcttccca

SEQ ID NO: 618674 - DNA, 25 bp, Mus musculus
ctggcaaactgtactgtgaggcagc

SEQ ID NO: 618675 - DNA, 25 bp, Mus musculus
ctggcaaactgttctgtgaggcagc

SEQ ID NO: 618676 - DNA, 25 bp, Mus musculus
ctggcaaagatgatcttcctcttcc

SEQ ID NO: 618677 - DNA, 25 bp, Mus musculus
ctggcaaagatgttcttcctcttcc

SEQ ID NO: 618678 - DNA, 25 bp, Mus musculus
ctggcaaaggcccaagagaaacacc

SEQ ID NO: 618679 - DNA, 25 bp, Mus musculus
ctggcaaaggccgaagagaaacacc

SEQ ID NO: 618680 - DNA, 25 bp, Mus musculus
ctggcaaatcggagggacccacctc

SEQ ID NO: 618681 - DNA, 25 bp, Mus musculus
ctggcaaatcggtgggacccacctc

SEQ ID NO: 618682 - DNA, 25 bp, Mus musculus
ctggcaacagaaaggcagtggccgt

SEQ ID NO: 618683 - DNA, 25 bp, Mus musculus
ctggcaacagaacgtcaggtttgcc

SEQ ID NO: 618684 - DNA, 25 bp, Mus musculus
ctggcaacagaaggtcaggtttgcc

SEQ ID NO: 618685 - DNA, 25 bp, Mus musculus
ctggcaacagaatggcagtggccgt

SEQ ID NO: 618686 - DNA, 25 bp, Mus musculus
ctggcaaccgaaagctggcccagca

SEQ ID NO: 618687 - DNA, 25 bp, Mus musculus
ctggcaaccgaatgctggcccagca

SEQ ID NO: 618688 - DNA, 25 bp, Mus musculus
ctggcaagcaaaccggcagttcccg

SEQ ID NO: 618689 - DNA, 25 bp, Mus musculus
ctggcaagcaaagcggcagttcccg

SEQ ID NO: 618690 - DNA, 25 bp, Mus musculus
ctggcaagcacaagggctatggttt

SEQ ID NO: 618691 - DNA, 25 bp, Mus musculus
ctggcaagcacatgggctatggttt

SEQ ID NO: 618692 - DNA, 25 bp, Mus musculus
ctggcaagctggcaaacggactgtt

SEQ ID NO: 618693 - DNA, 25 bp, Mus musculus
ctggcaagctgggaaacggactgtt

SEQ ID NO: 618694 - DNA, 25 bp, Mus musculus
ctggcaaggaggacggcagctcctc

SEQ ID NO: 618695 - DNA, 25 bp, Mus musculus
ctggcaaggaggtcggcagctcctc

SEQ ID NO: 618696 - DNA, 25 bp, Mus musculus
ctggcaaggccaatggagtgctgac

SEQ ID NO: 618697 - DNA, 25 bp, Mus musculus
ctggcaaggccattggagtgctgac

SEQ ID NO: 618698 - DNA, 25 bp, Mus musculus
ctggcaataacactgactgatcttt

SEQ ID NO: 618699 - DNA, 25 bp, Mus musculus
ctggcaataacagtgactgatcttt

SEQ ID NO: 618700 - DNA, 25 bp, Mus musculus
ctggcaatgggcagtgggcctctgt

SEQ ID NO: 618701 - DNA, 25 bp, Mus musculus
ctggcaatgggctgtgggcctctgt

SEQ ID NO: 618702 - DNA, 25 bp, Mus musculus
ctggcaattacgcttctcatcgaag

SEQ ID NO: 618703 - DNA, 25 bp, Mus musculus
ctggcaattacggttctcatcgaag

SEQ ID NO: 618704 - DNA, 25 bp, Mus musculus
ctggcacaacaaacccgggagggac

SEQ ID NO: 618705 - DNA, 25 bp, Mus musculus
ctggcacaacaatcccgggagggac

SEQ ID NO: 618706 - DNA, 25 bp, Mus musculus
ctggcacaagacctgcttccgctgt

SEQ ID NO: 618707 - DNA, 25 bp, Mus musculus
ctggcacaagacgtgcttccgctgt

SEQ ID NO: 618708 - DNA, 25 bp, Mus musculus
ctggcacaccatcatcgtggacgga

SEQ ID NO: 618709 - DNA, 25 bp, Mus musculus
ctggcacaccatgatcgtggacgga

SEQ ID NO: 618710 - DNA, 25 bp, Mus musculus
ctggcacagaagacgtgaaggccaa

SEQ ID NO: 618711 - DNA, 25 bp, Mus musculus
ctggcacagaagtcgtgaaggccaa

SEQ ID NO: 618712 - DNA, 25 bp, Mus musculus
ctggcaccaggtagatatgtggtgc

SEQ ID NO: 618713 - DNA, 25 bp, Mus musculus
ctggcaccaggttgatatgtggtgc

SEQ ID NO: 618714 - DNA, 25 bp, Mus musculus
ctggcaccatgaagatctggacttc

SEQ ID NO: 618715 - DNA, 25 bp, Mus musculus
ctggcaccatgatgatctggacttc

SEQ ID NO: 618716 - DNA, 25 bp, Mus musculus
ctggcaccccgtacttatgtctctg

SEQ ID NO: 618717 - DNA, 25 bp, Mus musculus
ctggcaccccgttcttatgtctctg

SEQ ID NO: 618718 - DNA, 25 bp, Mus musculus
ctggcacctgttcgatctgtgagcc

SEQ ID NO: 618719 - DNA, 25 bp, Mus musculus
ctggcacctgttggatctgtgagcc

SEQ ID NO: 618720 - DNA, 25 bp, Mus musculus
ctggcacgaatccaagagtggaaga

SEQ ID NO: 618721 - DNA, 25 bp, Mus musculus
ctggcacgaatcgaagagtggaaga

SEQ ID NO: 618722 - DNA, 25 bp, Mus musculus
ctggcactacatcagctttggcctg

SEQ ID NO: 618723 - DNA, 25 bp, Mus musculus
ctggcactacatgagctttggcctg

SEQ ID NO: 618724 - DNA, 25 bp, Mus musculus
ctggcactaggcatggagctgagcc

SEQ ID NO: 618725 - DNA, 25 bp, Mus musculus
ctggcactaggcttggagctgagcc

SEQ ID NO: 618726 - DNA, 25 bp, Mus musculus
ctggcactctctactccaaggcttt

SEQ ID NO: 618727 - DNA, 25 bp, Mus musculus
ctggcactctcttctccaaggcttt

SEQ ID NO: 618728 - DNA, 25 bp, Mus musculus
ctggcactgggacgcctggcatcta

SEQ ID NO: 618729 - DNA, 25 bp, Mus musculus
ctggcactgggaggcctggcatcta

SEQ ID NO: 618730 - DNA, 25 bp, Mus musculus
ctggcagaaaatctcttcgggcaat

SEQ ID NO: 618731 - DNA, 25 bp, Mus musculus
ctggcagaaaatgtcttcgggcaat

SEQ ID NO: 618732 - DNA, 25 bp, Mus musculus
ctggcagaaagccactttgcctcca

SEQ ID NO: 618733 - DNA, 25 bp, Mus musculus
ctggcagaaagcgactttgcctcca

SEQ ID NO: 618734 - DNA, 25 bp, Mus musculus
ctggcagaaattcattttcggcaag

SEQ ID NO: 618735 - DNA, 25 bp, Mus musculus
ctggcagaaattgattttcggcaag

SEQ ID NO: 618736 - DNA, 25 bp, Mus musculus
ctggcagacacacggcaactagctg

SEQ ID NO: 618737 - DNA, 25 bp, Mus musculus
ctggcagacacagggcaactagctg

SEQ ID NO: 618738 - DNA, 25 bp, Mus musculus
ctggcagagaacagcggagtgtcat

SEQ ID NO: 618739 - DNA, 25 bp, Mus musculus
ctggcagagaactgcggagtgtcat

SEQ ID NO: 618740 - DNA, 25 bp, Mus musculus
ctggcagagctcagggcaagcacag

SEQ ID NO: 618741 - DNA, 25 bp, Mus musculus
ctggcagagctctgggcaagcacag

SEQ ID NO: 618742 - DNA, 25 bp, Mus musculus
ctggcagaggtgagctgcacctcga

SEQ ID NO: 618743 - DNA, 25 bp, Mus musculus
ctggcagaggtgtgctgcacctcga

SEQ ID NO: 618744 - DNA, 25 bp, Mus musculus
ctggcagatgtgaagatcatcagga

SEQ ID NO: 618745 - DNA, 25 bp, Mus musculus
ctggcagatgtgtagatcatcagga

SEQ ID NO: 618746 - DNA, 25 bp, Mus musculus
ctggcagcattcatcacagtgatgc

SEQ ID NO: 618747 - DNA, 25 bp, Mus musculus
ctggcagcattcttcacagtgatgc

SEQ ID NO: 618748 - DNA, 25 bp, Mus musculus
ctggcagcgaaacaacatgcagctt

SEQ ID NO: 618749 - DNA, 25 bp, Mus musculus
ctggcagcgaaagaacatgcagctt

SEQ ID NO: 618750 - DNA, 25 bp, Mus musculus
ctggcagcgtgtacgcaggcgtcct

SEQ ID NO: 618751 - DNA, 25 bp, Mus musculus
ctggcagcgtgttcgcaggcgtcct

SEQ ID NO: 618752 - DNA, 25 bp, Mus musculus
ctggcagctcggcactcagtgcaag

SEQ ID NO: 618753 - DNA, 25 bp, Mus musculus
ctggcagctcgggactcagtgcaag

SEQ ID NO: 618754 - DNA, 25 bp, Mus musculus
ctggcagcttcaaggagagcgacat

SEQ ID NO: 618755 - DNA, 25 bp, Mus musculus
ctggcagcttcatggagagcgacat

SEQ ID NO: 618756 - DNA, 25 bp, Mus musculus
ctggcaggaatcctcatgaccaaag

SEQ ID NO: 618757 - DNA, 25 bp, Mus musculus
ctggcaggaatcgtcatgaccaaag

SEQ ID NO: 618758 - DNA, 25 bp, Mus musculus
ctggcaggcagacagccaacggctt

SEQ ID NO: 618759 - DNA, 25 bp, Mus musculus
ctggcaggcagagagccaacggctt

SEQ ID NO: 618760 - DNA, 25 bp, Mus musculus
ctggcaggcagcactaactggggct

SEQ ID NO: 618761 - DNA, 25 bp, Mus musculus
ctggcaggcagctctaactggggct

SEQ ID NO: 618762 - DNA, 25 bp, Mus musculus
ctggcaggcagtcaacgagccgact

SEQ ID NO: 618763 - DNA, 25 bp, Mus musculus
ctggcaggcagtgaacgagccgact

SEQ ID NO: 618764 - DNA, 25 bp, Mus musculus
ctggcaggcatcagtatcctagtga

SEQ ID NO: 618765 - DNA, 25 bp, Mus musculus
ctggcaggcatctgtatcctagtga

SEQ ID NO: 618766 - DNA, 25 bp, Mus musculus
ctggcaggcggtagtacgtgctcca

SEQ ID NO: 618767 - DNA, 25 bp, Mus musculus
ctggcaggcggttgtacgtgctcca

SEQ ID NO: 618768 - DNA, 25 bp, Mus musculus
ctggcaggtgttctgtcccagagct

SEQ ID NO: 618769 - DNA, 25 bp, Mus musculus
ctggcaggtgttgtgtcccagagct

SEQ ID NO: 618770 - DNA, 25 bp, Mus musculus
ctggcagtagatcaacgaatgtcta

SEQ ID NO: 618771 - DNA, 25 bp, Mus musculus
ctggcagtagatgaacgaatgtcta

SEQ ID NO: 618772 - DNA, 25 bp, Mus musculus
ctggcagtgcggctggacctcatca

SEQ ID NO: 618773 - DNA, 25 bp, Mus musculus
ctggcagtgcgggtggacctcatca

SEQ ID NO: 618774 - DNA, 25 bp, Mus musculus
ctggcagtttgactcctacaggacc

SEQ ID NO: 618775 - DNA, 25 bp, Mus musculus
ctggcagtttgagtcctacaggacc

SEQ ID NO: 618776 - DNA, 25 bp, Mus musculus
ctggcatagccgctgcctcaagtgc

SEQ ID NO: 618777 - DNA, 25 bp, Mus musculus
ctggcatagccggtgcctcaagtgc

SEQ ID NO: 618778 - DNA, 25 bp, Mus musculus
ctggcatcacgtcccaggaacctga

SEQ ID NO: 618779 - DNA, 25 bp, Mus musculus
ctggcatcacgtgccaggaacctga

SEQ ID NO: 618780 - DNA, 25 bp, Mus musculus
ctggcatccagaacccataccgtgg

SEQ ID NO: 618781 - DNA, 25 bp, Mus musculus
ctggcatccagatcccataccgtgg

SEQ ID NO: 618782 - DNA, 25 bp, Mus musculus
ctggcatcctctccatgtttgctgc

SEQ ID NO: 618783 - DNA, 25 bp, Mus musculus
ctggcatcctctcctacgtgggagc

SEQ ID NO: 618784 - DNA, 25 bp, Mus musculus
ctggcatcctctgcatgtttgctgc

SEQ ID NO: 618785 - DNA, 25 bp, Mus musculus
ctggcatcctctgctacgtgggagc

SEQ ID NO: 618786 - DNA, 25 bp, Mus musculus
ctggcatctcagacaagctgatggt

SEQ ID NO: 618787 - DNA, 25 bp, Mus musculus
ctggcatctcagtcaagctgatggt

SEQ ID NO: 618788 - DNA, 25 bp, Mus musculus
ctggcatgcagtcccctctcagaga

SEQ ID NO: 618789 - DNA, 25 bp, Mus musculus
ctggcatgcagtgccctctcagaga

SEQ ID NO: 618790 - DNA, 25 bp, Mus musculus
ctggcatgttggctcatggagtcta

SEQ ID NO: 618791 - DNA, 25 bp, Mus musculus
ctggcatgttgggtcatggagtcta

SEQ ID NO: 618792 - DNA, 25 bp, Mus musculus
ctggcattgatgcagccatgacaat

SEQ ID NO: 618793 - DNA, 25 bp, Mus musculus
ctggcattgatggagccatgacaat

SEQ ID NO: 618794 - DNA, 25 bp, Mus musculus
ctggcattgctcctgtgcctcttgc

SEQ ID NO: 618795 - DNA, 25 bp, Mus musculus
ctggcattgctcgtgtgcctcttgc

SEQ ID NO: 618796 - DNA, 25 bp, Mus musculus
ctggcatttcagatttttgcggaag

SEQ ID NO: 618797 - DNA, 25 bp, Mus musculus
ctggcatttcagttttttgcggaag

SEQ ID NO: 618798 - DNA, 25 bp, Mus musculus
ctggcattttcacgcccaaagctgg

SEQ ID NO: 618799 - DNA, 25 bp, Mus musculus
ctggcattttcaggcccaaagctgg

SEQ ID NO: 618800 - DNA, 25 bp, Mus musculus
ctggccaagccaaggatgagctgta

SEQ ID NO: 618801 - DNA, 25 bp, Mus musculus
ctggccaagccatggatgagctgta

SEQ ID NO: 618802 - DNA, 25 bp, Mus musculus
ctggccaaggagaggtgcttcaaac

SEQ ID NO: 618803 - DNA, 25 bp, Mus musculus
ctggccaaggagtggtgcttcaaac

SEQ ID NO: 618804 - DNA, 25 bp, Mus musculus
ctggccaatcacaattgcgaagatg

SEQ ID NO: 618805 - DNA, 25 bp, Mus musculus
ctggccaatcactattgcgaagatg

SEQ ID NO: 618806 - DNA, 25 bp, Mus musculus
ctggccacaattaggagtaggagct

SEQ ID NO: 618807 - DNA, 25 bp, Mus musculus
ctggccacaatttggagtaggagct

SEQ ID NO: 618808 - DNA, 25 bp, Mus musculus
ctggccacaggtctcaacgatgggc

SEQ ID NO: 618809 - DNA, 25 bp, Mus musculus
ctggccacaggtgtcaacgatgggc

SEQ ID NO: 618810 - DNA, 25 bp, Mus musculus
ctggccacgggtaccttggtgagca

SEQ ID NO: 618811 - DNA, 25 bp, Mus musculus
ctggccacgggttccttggtgagca

SEQ ID NO: 618812 - DNA, 25 bp, Mus musculus
ctggccacggtgaacgagatggaca

SEQ ID NO: 618813 - DNA, 25 bp, Mus musculus
ctggccacggtgtacgagatggaca

SEQ ID NO: 618814 - DNA, 25 bp, Mus musculus
ctggccactggtcagaactacagga

SEQ ID NO: 618815 - DNA, 25 bp, Mus musculus
ctggccactggtgagaactacagga

SEQ ID NO: 618816 - DNA, 25 bp, Mus musculus
ctggccagactcatgcatgggcaga

SEQ ID NO: 618817 - DNA, 25 bp, Mus musculus
ctggccagactcttgcatgggcaga

SEQ ID NO: 618818 - DNA, 25 bp, Mus musculus
ctggccagcggaaccggctgacctg

SEQ ID NO: 618819 - DNA, 25 bp, Mus musculus
ctggccagcggatccggctgacctg

SEQ ID NO: 618820 - DNA, 25 bp, Mus musculus
ctggccagctatcgctggtacatcc

SEQ ID NO: 618821 - DNA, 25 bp, Mus musculus
ctggccagctatggctggtacatcc

SEQ ID NO: 618822 - DNA, 25 bp, Mus musculus
ctggccaggaagcacctcgtggact

SEQ ID NO: 618823 - DNA, 25 bp, Mus musculus
ctggccaggaaggacctcgtggact

SEQ ID NO: 618824 - DNA, 25 bp, Mus musculus
ctggccaggacaccgggtacaagct

SEQ ID NO: 618825 - DNA, 25 bp, Mus musculus
ctggccaggacagcgggtacaagct

SEQ ID NO: 618826 - DNA, 25 bp, Mus musculus
ctggccagggatatcaacaacatag

SEQ ID NO: 618827 - DNA, 25 bp, Mus musculus
ctggccagggatttcaacaacatag

SEQ ID NO: 618828 - DNA, 25 bp, Mus musculus
ctggccatagaaccgagcggctaga

SEQ ID NO: 618829 - DNA, 25 bp, Mus musculus
ctggccatagaagcgagcggctaga

SEQ ID NO: 618830 - DNA, 25 bp, Mus musculus
ctggccatagtaaaatccccaaagg

SEQ ID NO: 618831 - DNA, 25 bp, Mus musculus
ctggccatagtataatccccaaagg

SEQ ID NO: 618832 - DNA, 25 bp, Mus musculus
ctggccatctgtccttcggactcat

SEQ ID NO: 618833 - DNA, 25 bp, Mus musculus
ctggccatctgtgcttcggactcat

SEQ ID NO: 618834 - DNA, 25 bp, Mus musculus
ctggccatgaggatggatgcctcat

SEQ ID NO: 618835 - DNA, 25 bp, Mus musculus
ctggccatgaggttggatgcctcat

SEQ ID NO: 618836 - DNA, 25 bp, Mus musculus
ctggccatggacaggaagtcctcat

SEQ ID NO: 618837 - DNA, 25 bp, Mus musculus
ctggccatggactggaagtcctcat

SEQ ID NO: 618838 - DNA, 25 bp, Mus musculus
ctggcccaacctattcttgggagat

SEQ ID NO: 618839 - DNA, 25 bp, Mus musculus
ctggcccaaccttttcttgggagat

SEQ ID NO: 618840 - DNA, 25 bp, Mus musculus
ctggcccagtggaattagatgaatt

SEQ ID NO: 618841 - DNA, 25 bp, Mus musculus
ctggcccagtggtattagatgaatt

SEQ ID NO: 618842 - DNA, 25 bp, Mus musculus
ctggcccatggaacggaggaagtat

SEQ ID NO: 618843 - DNA, 25 bp, Mus musculus
ctggcccatggatcggaggaagtat

SEQ ID NO: 618844 - DNA, 25 bp, Mus musculus
ctggcccatgtgcagattctatgaa

SEQ ID NO: 618845 - DNA, 25 bp, Mus musculus
ctggcccatgtggagattctatgaa

SEQ ID NO: 618846 - DNA, 25 bp, Mus musculus
ctggcccattctatgttcaccagtg

SEQ ID NO: 618847 - DNA, 25 bp, Mus musculus
ctggcccattctttgttcaccagtg

SEQ ID NO: 618848 - DNA, 25 bp, Mus musculus
ctggccccaagaccggacgctggtt

SEQ ID NO: 618849 - DNA, 25 bp, Mus musculus
ctggccccaagagcggacgctggtt

SEQ ID NO: 618850 - DNA, 25 bp, Mus musculus
ctggcccctgagaataccctgatgt

SEQ ID NO: 618851 - DNA, 25 bp, Mus musculus
ctggcccctgagtataccctgatgt

SEQ ID NO: 618852 - DNA, 25 bp, Mus musculus
ctggcccgaggacccaataaagaac

SEQ ID NO: 618853 - DNA, 25 bp, Mus musculus
ctggcccgaggagccaataaagaac

SEQ ID NO: 618854 - DNA, 25 bp, Mus musculus
ctggcccgagtgcttcacaagaagg

SEQ ID NO: 618855 - DNA, 25 bp, Mus musculus
ctggcccgagtggttcacaagaagg

SEQ ID NO: 618856 - DNA, 25 bp, Mus musculus
ctggcccggcatcctgcctgctgct

SEQ ID NO: 618857 - DNA, 25 bp, Mus musculus
ctggcccggcatgctgcctgctgct

SEQ ID NO: 618858 - DNA, 25 bp, Mus musculus
ctggcccggctgcaacagaaacagc

SEQ ID NO: 618859 - DNA, 25 bp, Mus musculus
ctggcccggctggaacagaaacagc

SEQ ID NO: 618860 - DNA, 25 bp, Mus musculus
ctggcccgtcctacaccgagatggg

SEQ ID NO: 618861 - DNA, 25 bp, Mus musculus
ctggcccgtccttcaccgagatggg

SEQ ID NO: 618862 - DNA, 25 bp, Mus musculus
ctggcccgttctcttctgcagatca

SEQ ID NO: 618863 - DNA, 25 bp, Mus musculus
ctggcccgttctgttctgcagatca

SEQ ID NO: 618864 - DNA, 25 bp, Mus musculus
ctggccctaatgcagcaacagagga

SEQ ID NO: 618865 - DNA, 25 bp, Mus musculus
ctggccctaatggagcaacagagga

SEQ ID NO: 618866 - DNA, 25 bp, Mus musculus
ctggccctgaagagctgtctggcta

SEQ ID NO: 618867 - DNA, 25 bp, Mus musculus
ctggccctgaagtgctgtctggcta

SEQ ID NO: 618868 - DNA, 25 bp, Mus musculus
ctggccctgcttactatgtggaata

SEQ ID NO: 618869 - DNA, 25 bp, Mus musculus
ctggccctgctttctatgtggaata

SEQ ID NO: 618870 - DNA, 25 bp, Mus musculus
ctggccctggcgagtatttatgatg

SEQ ID NO: 618871 - DNA, 25 bp, Mus musculus
ctggccctggcgtgtatttatgatg

SEQ ID NO: 618872 - DNA, 25 bp, Mus musculus
ctggccctttccaccatgctgtgta

SEQ ID NO: 618873 - DNA, 25 bp, Mus musculus
ctggccctttcctccatgctgtgta

SEQ ID NO: 618874 - DNA, 25 bp, Mus musculus
ctggccgatgacaacagcatcgtca

SEQ ID NO: 618875 - DNA, 25 bp, Mus musculus
ctggccgatgactacagcatcgtca

SEQ ID NO: 618876 - DNA, 25 bp, Mus musculus
ctggccgcgctcagcatcagtgacg

SEQ ID NO: 618877 - DNA, 25 bp, Mus musculus
ctggccgcgctctgcatcagtgacg

SEQ ID NO: 618878 - DNA, 25 bp, Mus musculus
ctggccgcggagacagtcgaagctc

SEQ ID NO: 618879 - DNA, 25 bp, Mus musculus
ctggccgcggagtcagtcgaagctc

SEQ ID NO: 618880 - DNA, 25 bp, Mus musculus
ctggccggcagcatcccaaacgtgt

SEQ ID NO: 618881 - DNA, 25 bp, Mus musculus
ctggccggcagcttcccaaacgtgt

SEQ ID NO: 618882 - DNA, 25 bp, Mus musculus
ctggccggctatcatatcgccctgg

SEQ ID NO: 618883 - DNA, 25 bp, Mus musculus
ctggccggctatgatatcgccctgg

SEQ ID NO: 618884 - DNA, 25 bp, Mus musculus
ctggccgtgctaatgctgttgctgc

SEQ ID NO: 618885 - DNA, 25 bp, Mus musculus
ctggccgtgctattgctgttgctgc

SEQ ID NO: 618886 - DNA, 25 bp, Mus musculus
ctggccgtgtgtcgcatcatcctgg

SEQ ID NO: 618887 - DNA, 25 bp, Mus musculus
ctggccgtgtgtggcatcatcctgg

SEQ ID NO: 618888 - DNA, 25 bp, Mus musculus
ctggcctacagacgacaggaatacg

SEQ ID NO: 618889 - DNA, 25 bp, Mus musculus
ctggcctacagaggacaggaatacg

SEQ ID NO: 618890 - DNA, 25 bp, Mus musculus
ctggcctaccttctgatcggatggg

SEQ ID NO: 618891 - DNA, 25 bp, Mus musculus
ctggcctaccttgtgatcggatggg

SEQ ID NO: 618892 - DNA, 25 bp, Mus musculus
ctggcctcacagacggtctgtccaa

SEQ ID NO: 618893 - DNA, 25 bp, Mus musculus
ctggcctcacagtcggtctgtccaa

SEQ ID NO: 618894 - DNA, 25 bp, Mus musculus
ctggcctcaggaaggagaatggtct

SEQ ID NO: 618895 - DNA, 25 bp, Mus musculus
ctggcctcaggatggagaatggtct

SEQ ID NO: 618896 - DNA, 25 bp, Mus musculus
ctggcctcctatatggagaaggtga

SEQ ID NO: 618897 - DNA, 25 bp, Mus musculus
ctggcctcctatttggagaaggtga

SEQ ID NO: 618898 - DNA, 25 bp, Mus musculus
ctggcctctgagcttctttaataga

SEQ ID NO: 618899 - DNA, 25 bp, Mus musculus
ctggcctctgaggttctttaataga

SEQ ID NO: 618900 - DNA, 25 bp, Mus musculus
ctggcctgctgcacaattctgttgg

SEQ ID NO: 618901 - DNA, 25 bp, Mus musculus
ctggcctgctgctcaattctgttgg

SEQ ID NO: 618902 - DNA, 25 bp, Mus musculus
ctggcctgggaaatgcctcgctttc

SEQ ID NO: 618903 - DNA, 25 bp, Mus musculus
ctggcctgggaattgcctcgctttc

SEQ ID NO: 618904 - DNA, 25 bp, Mus musculus
ctggcctgggtcagccacgacagca

SEQ ID NO: 618905 - DNA, 25 bp, Mus musculus
ctggcctgggtctgccacgacagca

SEQ ID NO: 618906 - DNA, 25 bp, Mus musculus
ctggcctgtggcagataccttctac

SEQ ID NO: 618907 - DNA, 25 bp, Mus musculus
ctggcctgtggctgataccttctac

SEQ ID NO: 618908 - DNA, 25 bp, Mus musculus
ctggcctgtggtctccgcctacagt

SEQ ID NO: 618909 - DNA, 25 bp, Mus musculus
ctggcctgtggtgtccgcctacagt

SEQ ID NO: 618910 - DNA, 25 bp, Mus musculus
ctggccttcgggactcctgcctggg

SEQ ID NO: 618911 - DNA, 25 bp, Mus musculus
ctggccttcgggtctcctgcctggg

SEQ ID NO: 618912 - DNA, 25 bp, Mus musculus
ctggccttctttctcagtctcaggg

SEQ ID NO: 618913 - DNA, 25 bp, Mus musculus
ctggccttctttgtcagtctcaggg

SEQ ID NO: 618914 - DNA, 25 bp, Mus musculus
ctggccttgatcatcccgagatgct

SEQ ID NO: 618915 - DNA, 25 bp, Mus musculus
ctggccttgatcttcccgagatgct

SEQ ID NO: 618916 - DNA, 25 bp, Mus musculus
ctggccttgcctatggcagacggga

SEQ ID NO: 618917 - DNA, 25 bp, Mus musculus
ctggccttgcctttggcagacggga

SEQ ID NO: 618918 - DNA, 25 bp, Mus musculus
ctggcctttggacggcatattgctt

SEQ ID NO: 618919 - DNA, 25 bp, Mus musculus
ctggcctttggagggcatattgctt

SEQ ID NO: 618920 - DNA, 25 bp, Mus musculus
ctggcgactaggagcctgtgaccca

SEQ ID NO: 618921 - DNA, 25 bp, Mus musculus
ctggcgactaggtgcctgtgaccca

SEQ ID NO: 618922 - DNA, 25 bp, Mus musculus
ctggcgaggaccaggagtctatcag

SEQ ID NO: 618923 - DNA, 25 bp, Mus musculus
ctggcgaggacctggagtctatcag

SEQ ID NO: 618924 - DNA, 25 bp, Mus musculus
ctggcgaggactaggcctgccttcc

SEQ ID NO: 618925 - DNA, 25 bp, Mus musculus
ctggcgaggacttggcctgccttcc

SEQ ID NO: 618926 - DNA, 25 bp, Mus musculus
ctggcgagttagaagctgcccctca

SEQ ID NO: 618927 - DNA, 25 bp, Mus musculus
ctggcgagttagtagctgcccctca

SEQ ID NO: 618928 - DNA, 25 bp, Mus musculus
ctggcgattcacaagcagcatcttt

SEQ ID NO: 618929 - DNA, 25 bp, Mus musculus
ctggcgattcactagcagcatcttt

SEQ ID NO: 618930 - DNA, 25 bp, Mus musculus
ctggcgccacggcttcaatgtagcc

SEQ ID NO: 618931 - DNA, 25 bp, Mus musculus
ctggcgccacgggttcaatgtagcc

SEQ ID NO: 618932 - DNA, 25 bp, Mus musculus
ctggcgcctctgcactcaaaggaga

SEQ ID NO: 618933 - DNA, 25 bp, Mus musculus
ctggcgcctctggactcaaaggaga

SEQ ID NO: 618934 - DNA, 25 bp, Mus musculus
ctggcgcctgcgagtgttgcaccca

SEQ ID NO: 618935 - DNA, 25 bp, Mus musculus
ctggcgcctgcgtgtgttgcaccca

SEQ ID NO: 618936 - DNA, 25 bp, Mus musculus
ctggcgcgcctgacttcacggctgg

SEQ ID NO: 618937 - DNA, 25 bp, Mus musculus
ctggcgcgcctgtcttcacggctgg

SEQ ID NO: 618938 - DNA, 25 bp, Mus musculus
ctggcgctcatccttctggtgcagg

SEQ ID NO: 618939 - DNA, 25 bp, Mus musculus
ctggcgctcatcgttctggtgcagg

SEQ ID NO: 618940 - DNA, 25 bp, Mus musculus
ctggcgctggctagccacctgagca

SEQ ID NO: 618941 - DNA, 25 bp, Mus musculus
ctggcgctggcttgccacctgagca

SEQ ID NO: 618942 - DNA, 25 bp, Mus musculus
ctggcgctggtgactgccctggctt

SEQ ID NO: 618943 - DNA, 25 bp, Mus musculus
ctggcgctggtgtctgccctggctt

SEQ ID NO: 618944 - DNA, 25 bp, Mus musculus
ctggcggagttcagctggccttcgc

SEQ ID NO: 618945 - DNA, 25 bp, Mus musculus
ctggcggagttctgctggccttcgc

SEQ ID NO: 618946 - DNA, 25 bp, Mus musculus
ctggcggcaacactctgcttcaggg

SEQ ID NO: 618947 - DNA, 25 bp, Mus musculus
ctggcggcaacagtctgcttcaggg

SEQ ID NO: 618948 - DNA, 25 bp, Mus musculus
ctggcggccacgaggagagcatacc

SEQ ID NO: 618949 - DNA, 25 bp, Mus musculus
ctggcggccacgtggagagcatacc

SEQ ID NO: 618950 - DNA, 25 bp, Mus musculus
ctggcggcggaccacttcaggctca

SEQ ID NO: 618951 - DNA, 25 bp, Mus musculus
ctggcggcggacgacttcaggctca

SEQ ID NO: 618952 - DNA, 25 bp, Mus musculus
ctggcgggcaacaccatcggccttt

SEQ ID NO: 618953 - DNA, 25 bp, Mus musculus
ctggcgggcaactccatcggccttt

SEQ ID NO: 618954 - DNA, 25 bp, Mus musculus
ctggcgggcacgatcgttatcgtat

SEQ ID NO: 618955 - DNA, 25 bp, Mus musculus
ctggcgggcacgttcgttatcgtat

SEQ ID NO: 618956 - DNA, 25 bp, Mus musculus
ctggcggtaaccatgcgggccgagc

SEQ ID NO: 618957 - DNA, 25 bp, Mus musculus
ctggcggtaaccttgcgggccgagc

SEQ ID NO: 618958 - DNA, 25 bp, Mus musculus
ctggcggtctcaacaggtgcggcca

SEQ ID NO: 618959 - DNA, 25 bp, Mus musculus
ctggcggtctcatcaggtgcggcca

SEQ ID NO: 618960 - DNA, 25 bp, Mus musculus
ctggcggtgggaaccacctgcccgt

SEQ ID NO: 618961 - DNA, 25 bp, Mus musculus
ctggcggtgggatccacctgcccgt

SEQ ID NO: 618962 - DNA, 25 bp, Mus musculus
ctggcgtccaaacgtttccgtgctg

SEQ ID NO: 618963 - DNA, 25 bp, Mus musculus
ctggcgtccaaaggtttccgtgctg

SEQ ID NO: 618964 - DNA, 25 bp, Mus musculus
ctggcgtcgtcaccccggaacagtt

SEQ ID NO: 618965 - DNA, 25 bp, Mus musculus
ctggcgtcgtcagcccggaacagtt

SEQ ID NO: 618966 - DNA, 25 bp, Mus musculus
ctggcgtctgtccaccctggacgaa

SEQ ID NO: 618967 - DNA, 25 bp, Mus musculus
ctggcgtctgtcgaccctggacgaa

SEQ ID NO: 618968 - DNA, 25 bp, Mus musculus
ctggcgtgtgagaaactgaataaaa

SEQ ID NO: 618969 - DNA, 25 bp, Mus musculus
ctggcgtgtgagtaactgaataaaa

SEQ ID NO: 618970 - DNA, 25 bp, Mus musculus
ctggctaactacaagctacggttca

SEQ ID NO: 618971 - DNA, 25 bp, Mus musculus
ctggctaactactagctacggttca

SEQ ID NO: 618972 - DNA, 25 bp, Mus musculus
ctggctaatcaacagtgaaaaacct

SEQ ID NO: 618973 - DNA, 25 bp, Mus musculus
ctggctaatcaagagtgaaaaacct

SEQ ID NO: 618974 - DNA, 25 bp, Mus musculus
ctggctaattgcacaggactgcggg

SEQ ID NO: 618975 - DNA, 25 bp, Mus musculus
ctggctaattgctcaggactgcggg

SEQ ID NO: 618976 - DNA, 25 bp, Mus musculus
ctggctacccagcaagtagcactac

SEQ ID NO: 618977 - DNA, 25 bp, Mus musculus
ctggctacccaggaagtagcactac

SEQ ID NO: 618978 - DNA, 25 bp, Mus musculus
ctggctacccgaccccaaagcttgc

SEQ ID NO: 618979 - DNA, 25 bp, Mus musculus
ctggctacccgagcccaaagcttgc

SEQ ID NO: 618980 - DNA, 25 bp, Mus musculus
ctggctacgccgcacagctggagca

SEQ ID NO: 618981 - DNA, 25 bp, Mus musculus
ctggctacgccggacagctggagca

SEQ ID NO: 618982 - DNA, 25 bp, Mus musculus
ctggctacttgaatgtgtatgtaac

SEQ ID NO: 618983 - DNA, 25 bp, Mus musculus
ctggctacttgattgtgtatgtaac

SEQ ID NO: 618984 - DNA, 25 bp, Mus musculus
ctggctagagagcaaggacctcctg

SEQ ID NO: 618985 - DNA, 25 bp, Mus musculus
ctggctagagaggaaggacctcctg

SEQ ID NO: 618986 - DNA, 25 bp, Mus musculus
ctggctaggatgcacactggtttta

SEQ ID NO: 618987 - DNA, 25 bp, Mus musculus
ctggctaggatggacactggtttta

SEQ ID NO: 618988 - DNA, 25 bp, Mus musculus
ctggctagtccacgatactgtggaa

SEQ ID NO: 618989 - DNA, 25 bp, Mus musculus
ctggctagtccaggatactgtggaa

SEQ ID NO: 618990 - DNA, 25 bp, Mus musculus
ctggctatacagacaacttggtgcg

SEQ ID NO: 618991 - DNA, 25 bp, Mus musculus
ctggctatacagtcaacttggtgcg

SEQ ID NO: 618992 - DNA, 25 bp, Mus musculus
ctggctatgggaaagacatggtcaa

SEQ ID NO: 618993 - DNA, 25 bp, Mus musculus
ctggctatgggatagacatggtcaa

SEQ ID NO: 618994 - DNA, 25 bp, Mus musculus
ctggctcaacgccttcgccgagatg

SEQ ID NO: 618995 - DNA, 25 bp, Mus musculus
ctggctcaacgcgttcgccgagatg

SEQ ID NO: 618996 - DNA, 25 bp, Mus musculus
ctggctcaactgagtgagcgcgaga

SEQ ID NO: 618997 - DNA, 25 bp, Mus musculus
ctggctcaactgtgtgagcgcgaga

SEQ ID NO: 618998 - DNA, 25 bp, Mus musculus
ctggctcagaccatgccattgtcac

SEQ ID NO: 618999 - DNA, 25 bp, Mus musculus
ctggctcagaccttgccattgtcac

SEQ ID NO: 619000 - DNA, 25 bp, Mus musculus
ctggctcagcaaccccgataagcat

SEQ ID NO: 619001 - DNA, 25 bp, Mus musculus
ctggctcagcaagcccgataagcat

SEQ ID NO: 619002 - DNA, 25 bp, Mus musculus
ctggctcagcgtatccaatatcatc

SEQ ID NO: 619003 - DNA, 25 bp, Mus musculus
ctggctcagcgtttccaatatcatc

SEQ ID NO: 619004 - DNA, 25 bp, Mus musculus
ctggctccacaacggacacggtgac

SEQ ID NO: 619005 - DNA, 25 bp, Mus musculus
ctggctccacaagggacacggtgac

SEQ ID NO: 619006 - DNA, 25 bp, Mus musculus
ctggctccggagaaagtgcacgccg

SEQ ID NO: 619007 - DNA, 25 bp, Mus musculus
ctggctccggagtaagtgcacgccg

SEQ ID NO: 619008 - DNA, 25 bp, Mus musculus
ctggctcctgggacagttttcttag

SEQ ID NO: 619009 - DNA, 25 bp, Mus musculus
ctggctcctgggtcagttttcttag

SEQ ID NO: 619010 - DNA, 25 bp, Mus musculus
ctggctcgaggtctcatgctcatgg

SEQ ID NO: 619011 - DNA, 25 bp, Mus musculus
ctggctcgaggtgtcatgctcatgg

SEQ ID NO: 619012 - DNA, 25 bp, Mus musculus
ctggctcgcctacaagctaggaatg

SEQ ID NO: 619013 - DNA, 25 bp, Mus musculus
ctggctcgcctagaagctaggaatg

SEQ ID NO: 619014 - DNA, 25 bp, Mus musculus
ctggctcgctgacgccactctggaa

SEQ ID NO: 619015 - DNA, 25 bp, Mus musculus
ctggctcgctgaggccactctggaa

SEQ ID NO: 619016 - DNA, 25 bp, Mus musculus
ctggctcggtgacgttggatgggca

SEQ ID NO: 619017 - DNA, 25 bp, Mus musculus
ctggctcggtgaggttggatgggca

SEQ ID NO: 619018 - DNA, 25 bp, Mus musculus
ctggctcggtgcactgatgacttca

SEQ ID NO: 619019 - DNA, 25 bp, Mus musculus
ctggctcggtgctctgatgacttca

SEQ ID NO: 619020 - DNA, 25 bp, Mus musculus
ctggctcgtgtgaacgaagctgcca

SEQ ID NO: 619021 - DNA, 25 bp, Mus musculus
ctggctcgtgtgtacgaagctgcca

SEQ ID NO: 619022 - DNA, 25 bp, Mus musculus
ctggctctagacaggtggtatgcgc

SEQ ID NO: 619023 - DNA, 25 bp, Mus musculus
ctggctctagactggtggtatgcgc

SEQ ID NO: 619024 - DNA, 25 bp, Mus musculus
ctggctctgaacagggcgtggcccc

SEQ ID NO: 619025 - DNA, 25 bp, Mus musculus
ctggctctgaactgggcgtggcccc

SEQ ID NO: 619026 - DNA, 25 bp, Mus musculus
ctggctctgtgtcctatcagggtca

SEQ ID NO: 619027 - DNA, 25 bp, Mus musculus
ctggctctgtgtgctatcagggtca

SEQ ID NO: 619028 - DNA, 25 bp, Mus musculus
ctggctctgttcaatgtgacggaga

SEQ ID NO: 619029 - DNA, 25 bp, Mus musculus
ctggctctgttctatgtgacggaga

SEQ ID NO: 619030 - DNA, 25 bp, Mus musculus
ctggctcttcatcctttccaaggtc

SEQ ID NO: 619031 - DNA, 25 bp, Mus musculus
ctggctcttcatgctttccaaggtc

SEQ ID NO: 619032 - DNA, 25 bp, Mus musculus
ctggctcttctgagggtgagatcac

SEQ ID NO: 619033 - DNA, 25 bp, Mus musculus
ctggctcttctgtgggtgagatcac

SEQ ID NO: 619034 - DNA, 25 bp, Mus musculus
ctggctgaacagatcaaggagctga

SEQ ID NO: 619035 - DNA, 25 bp, Mus musculus
ctggctgaacagttcaaggagctga

SEQ ID NO: 619036 - DNA, 25 bp, Mus musculus
ctggctgaactcaagcctgggcgcc

SEQ ID NO: 619037 - DNA, 25 bp, Mus musculus
ctggctgaactctagcctgggcgcc

SEQ ID NO: 619038 - DNA, 25 bp, Mus musculus
ctggctgaagggagagttcatcacg

SEQ ID NO: 619039 - DNA, 25 bp, Mus musculus
ctggctgaagggtgagttcatcacg

SEQ ID NO: 619040 - DNA, 25 bp, Mus musculus
ctggctgaattaccactgagacttt

SEQ ID NO: 619041 - DNA, 25 bp, Mus musculus
ctggctgaattagcactgagacttt

SEQ ID NO: 619042 - DNA, 25 bp, Mus musculus
ctggctgacattccttactgggttt

SEQ ID NO: 619043 - DNA, 25 bp, Mus musculus
ctggctgacattgcttactgggttt

SEQ ID NO: 619044 - DNA, 25 bp, Mus musculus
ctggctgaccccactggagcctttg

SEQ ID NO: 619045 - DNA, 25 bp, Mus musculus
ctggctgacccctctggagcctttg

SEQ ID NO: 619046 - DNA, 25 bp, Mus musculus
ctggctgaggaaacctgtcctggca

SEQ ID NO: 619047 - DNA, 25 bp, Mus musculus
ctggctgaggaacctagggctttca

SEQ ID NO: 619048 - DNA, 25 bp, Mus musculus
ctggctgaggaagctagggctttca

SEQ ID NO: 619049 - DNA, 25 bp, Mus musculus
ctggctgaggaatcctgtcctggca

SEQ ID NO: 619050 - DNA, 25 bp, Mus musculus
ctggctgataacagacatgcggcgg

SEQ ID NO: 619051 - DNA, 25 bp, Mus musculus
ctggctgataactgacatgcggcgg

SEQ ID NO: 619052 - DNA, 25 bp, Mus musculus
ctggctgccatcaacattgggaata

SEQ ID NO: 619053 - DNA, 25 bp, Mus musculus
ctggctgccatctacattgggaata

SEQ ID NO: 619054 - DNA, 25 bp, Mus musculus
ctggctgcccagatgaaacccacaa

SEQ ID NO: 619055 - DNA, 25 bp, Mus musculus
ctggctgcccagttgaaacccacaa

SEQ ID NO: 619056 - DNA, 25 bp, Mus musculus
ctggctgccctgcttagcctggtac

SEQ ID NO: 619057 - DNA, 25 bp, Mus musculus
ctggctgccctggttagcctggtac

SEQ ID NO: 619058 - DNA, 25 bp, Mus musculus
ctggctgccgtgaggccgtgacctt

SEQ ID NO: 619059 - DNA, 25 bp, Mus musculus
ctggctgccgtgtggccgtgacctt

SEQ ID NO: 619060 - DNA, 25 bp, Mus musculus
ctggctgctaagactgttgaggaag

SEQ ID NO: 619061 - DNA, 25 bp, Mus musculus
ctggctgctaagtctgttgaggaag

SEQ ID NO: 619062 - DNA, 25 bp, Mus musculus
ctggctgctaggaacgtcctggtga

SEQ ID NO: 619063 - DNA, 25 bp, Mus musculus
ctggctgctaggtacgtcctggtga

SEQ ID NO: 619064 - DNA, 25 bp, Mus musculus
ctggctgctccactgctttagtcat

SEQ ID NO: 619065 - DNA, 25 bp, Mus musculus
ctggctgctccagtgctttagtcat

SEQ ID NO: 619066 - DNA, 25 bp, Mus musculus
ctggctgctgacaggtgaagagtca

SEQ ID NO: 619067 - DNA, 25 bp, Mus musculus
ctggctgctgactggtgaagagtca

SEQ ID NO: 619068 - DNA, 25 bp, Mus musculus
ctggctgctgcacttgagccgagtt

SEQ ID NO: 619069 - DNA, 25 bp, Mus musculus
ctggctgctgcagttgagccgagtt

SEQ ID NO: 619070 - DNA, 25 bp, Mus musculus
ctggctgctggcaccagtgttcgac

SEQ ID NO: 619071 - DNA, 25 bp, Mus musculus
ctggctgctggcaggttaaacaatc

SEQ ID NO: 619072 - DNA, 25 bp, Mus musculus
ctggctgctggctccagtgttcgac

SEQ ID NO: 619073 - DNA, 25 bp, Mus musculus
ctggctgctggctggttaaacaatc

SEQ ID NO: 619074 - DNA, 25 bp, Mus musculus
ctggctggaaacatggcgtcgcgca

SEQ ID NO: 619075 - DNA, 25 bp, Mus musculus
ctggctggaaacttggcgtcgcgca

SEQ ID NO: 619076 - DNA, 25 bp, Mus musculus
ctggctggaaagacgtctactcggg

SEQ ID NO: 619077 - DNA, 25 bp, Mus musculus
ctggctggaaagtcgtctactcggg

SEQ ID NO: 619078 - DNA, 25 bp, Mus musculus
ctggctggaagtatgggacctatct

SEQ ID NO: 619079 - DNA, 25 bp, Mus musculus
ctggctggaagtttgggacctatct

SEQ ID NO: 619080 - DNA, 25 bp, Mus musculus
ctggctggacacacgagaaagacgg

SEQ ID NO: 619081 - DNA, 25 bp, Mus musculus
ctggctggacactcgagaaagacgg

SEQ ID NO: 619082 - DNA, 25 bp, Mus musculus
ctggctggagagatatctgagacat

SEQ ID NO: 619083 - DNA, 25 bp, Mus musculus
ctggctggagagttatctgagacat

SEQ ID NO: 619084 - DNA, 25 bp, Mus musculus
ctggctggccgcagctcatgttctg

SEQ ID NO: 619085 - DNA, 25 bp, Mus musculus
ctggctggccgctgctcatgttctg

SEQ ID NO: 619086 - DNA, 25 bp, Mus musculus
ctggctggccgtctgtggcatcatc

SEQ ID NO: 619087 - DNA, 25 bp, Mus musculus
ctggctggccgtgtgtggcatcatc

SEQ ID NO: 619088 - DNA, 25 bp, Mus musculus
ctggctggcgctcggcacagttttc

SEQ ID NO: 619089 - DNA, 25 bp, Mus musculus
ctggctggcgctgggcacagttttc

SEQ ID NO: 619090 - DNA, 25 bp, Mus musculus
ctggctggcttcatcacctctgtcg

SEQ ID NO: 619091 - DNA, 25 bp, Mus musculus
ctggctggcttcttcacctctgtcg

SEQ ID NO: 619092 - DNA, 25 bp, Mus musculus
ctggctgggtatcaatgcagaatcc

SEQ ID NO: 619093 - DNA, 25 bp, Mus musculus
ctggctgggtatgaatgcagaatcc

SEQ ID NO: 619094 - DNA, 25 bp, Mus musculus
ctggctgtatgcactcactgccctg

SEQ ID NO: 619095 - DNA, 25 bp, Mus musculus
ctggctgtatgctctcactgccctg

SEQ ID NO: 619096 - DNA, 25 bp, Mus musculus
ctggctgtcgcacggttcccagtgc

SEQ ID NO: 619097 - DNA, 25 bp, Mus musculus
ctggctgtcgcagggttcccagtgc

SEQ ID NO: 619098 - DNA, 25 bp, Mus musculus
ctggctgtctttagccttttgctga

SEQ ID NO: 619099 - DNA, 25 bp, Mus musculus
ctggctgtcttttgccttttgctga

SEQ ID NO: 619100 - DNA, 25 bp, Mus musculus
ctggctgtgctgaacggcaaacgcg

SEQ ID NO: 619101 - DNA, 25 bp, Mus musculus
ctggctgtgctgtacggcaaacgcg

SEQ ID NO: 619102 - DNA, 25 bp, Mus musculus
ctggctgtgggcaatggacttgcct

SEQ ID NO: 619103 - DNA, 25 bp, Mus musculus
ctggctgtgggcacaagctaagcgc

SEQ ID NO: 619104 - DNA, 25 bp, Mus musculus
ctggctgtgggctatggacttgcct

SEQ ID NO: 619105 - DNA, 25 bp, Mus musculus
ctggctgtgggctcaagctaagcgc

SEQ ID NO: 619106 - DNA, 25 bp, Mus musculus
ctggctgttccacaagaccttgcag

SEQ ID NO: 619107 - DNA, 25 bp, Mus musculus
ctggctgttccagaagaccttgcag

SEQ ID NO: 619108 - DNA, 25 bp, Mus musculus
ctggctgttgttcaagagtcttgca

SEQ ID NO: 619109 - DNA, 25 bp, Mus musculus
ctggctgttgttgaagagtcttgca

SEQ ID NO: 619110 - DNA, 25 bp, Mus musculus
ctggcttaaagacggactggatctg

SEQ ID NO: 619111 - DNA, 25 bp, Mus musculus
ctggcttaaagagggactggatctg

SEQ ID NO: 619112 - DNA, 25 bp, Mus musculus
ctggcttaattgacctacttttgga

SEQ ID NO: 619113 - DNA, 25 bp, Mus musculus
ctggcttaattgtcctacttttgga

SEQ ID NO: 619114 - DNA, 25 bp, Mus musculus
ctggcttagagactatgaataggaa

SEQ ID NO: 619115 - DNA, 25 bp, Mus musculus
ctggcttagagagtatgaataggaa

SEQ ID NO: 619116 - DNA, 25 bp, Mus musculus
ctggcttagctgcaggaaggcctct

SEQ ID NO: 619117 - DNA, 25 bp, Mus musculus
ctggcttagctggaggaaggcctct

SEQ ID NO: 619118 - DNA, 25 bp, Mus musculus
ctggcttcacatacaccttccgtag

SEQ ID NO: 619119 - DNA, 25 bp, Mus musculus
ctggcttcacattcaccttccgtag

SEQ ID NO: 619120 - DNA, 25 bp, Mus musculus
ctggcttcactgcattggctcttct

SEQ ID NO: 619121 - DNA, 25 bp, Mus musculus
ctggcttcactggattggctcttct

SEQ ID NO: 619122 - DNA, 25 bp, Mus musculus
ctggcttccccgatgcagacagctt

SEQ ID NO: 619123 - DNA, 25 bp, Mus musculus
ctggcttccccgttgcagacagctt

SEQ ID NO: 619124 - DNA, 25 bp, Mus musculus
ctggcttcctggatgtaagcacagg

SEQ ID NO: 619125 - DNA, 25 bp, Mus musculus
ctggcttcctggttgtaagcacagg

SEQ ID NO: 619126 - DNA, 25 bp, Mus musculus
ctggcttctatgatgcctgtgccca

SEQ ID NO: 619127 - DNA, 25 bp, Mus musculus
ctggcttctatgttgcctgtgccca

SEQ ID NO: 619128 - DNA, 25 bp, Mus musculus
ctggctttcggccacagcacctatg

SEQ ID NO: 619129 - DNA, 25 bp, Mus musculus
ctggctttcggcgacagcacctatg

SEQ ID NO: 619130 - DNA, 25 bp, Mus musculus
ctggctttgactcactcttcctgct

SEQ ID NO: 619131 - DNA, 25 bp, Mus musculus
ctggctttgactgactcttcctgct

SEQ ID NO: 619132 - DNA, 25 bp, Mus musculus
ctggctttggccaaagcctgtgcag

SEQ ID NO: 619133 - DNA, 25 bp, Mus musculus
ctggctttggcctaagcctgtgcag

SEQ ID NO: 619134 - DNA, 25 bp, Mus musculus
ctggcttttggacgctcttgttgga

SEQ ID NO: 619135 - DNA, 25 bp, Mus musculus
ctggcttttggaggctcttgttgga

SEQ ID NO: 619136 - DNA, 25 bp, Mus musculus
ctgggaaaacatagatcaatatact

SEQ ID NO: 619137 - DNA, 25 bp, Mus musculus
ctgggaaaacattgatcaatatact

SEQ ID NO: 619138 - DNA, 25 bp, Mus musculus
ctgggaaacagtcaactcaggttat

SEQ ID NO: 619139 - DNA, 25 bp, Mus musculus
ctgggaaacagtgaactcaggttat

SEQ ID NO: 619140 - DNA, 25 bp, Mus musculus
ctgggaaagcttcaatattcactgg

SEQ ID NO: 619141 - DNA, 25 bp, Mus musculus
ctgggaaagcttgaatattcactgg

SEQ ID NO: 619142 - DNA, 25 bp, Mus musculus
ctgggaaaggccacaataccggaga

SEQ ID NO: 619143 - DNA, 25 bp, Mus musculus
ctgggaaaggcctcaataccggaga

SEQ ID NO: 619144 - DNA, 25 bp, Mus musculus
ctgggaaagggtcaaaaaatgatca

SEQ ID NO: 619145 - DNA, 25 bp, Mus musculus
ctgggaaagggtgaaaaaatgatca

SEQ ID NO: 619146 - DNA, 25 bp, Mus musculus
ctgggaaaggtgcaagctctgctcc

SEQ ID NO: 619147 - DNA, 25 bp, Mus musculus
ctgggaaaggtggaagctctgctcc

SEQ ID NO: 619148 - DNA, 25 bp, Mus musculus
ctgggaaagtgtcccaagatggcat

SEQ ID NO: 619149 - DNA, 25 bp, Mus musculus
ctgggaaagtgtgccaagatggcat

SEQ ID NO: 619150 - DNA, 25 bp, Mus musculus
ctgggaaatggtacagagtaccgag

SEQ ID NO: 619151 - DNA, 25 bp, Mus musculus
ctgggaaatggttcagagtaccgag

SEQ ID NO: 619152 - DNA, 25 bp, Mus musculus
ctgggaacatgcagctgcgagccgc

SEQ ID NO: 619153 - DNA, 25 bp, Mus musculus
ctgggaacatgctgctgcgagccgc

SEQ ID NO: 619154 - DNA, 25 bp, Mus musculus
ctgggaaccagcagtcaggaggtca

SEQ ID NO: 619155 - DNA, 25 bp, Mus musculus
ctgggaaccagctgtcaggaggtca

SEQ ID NO: 619156 - DNA, 25 bp, Mus musculus
ctgggaacggctccgactgcaccgt

SEQ ID NO: 619157 - DNA, 25 bp, Mus musculus
ctgggaacggctgcgactgcaccgt

SEQ ID NO: 619158 - DNA, 25 bp, Mus musculus
ctgggaacgtgccaccagacctgca

SEQ ID NO: 619159 - DNA, 25 bp, Mus musculus
ctgggaacgtgcgaccagacctgca

SEQ ID NO: 619160 - DNA, 25 bp, Mus musculus
ctgggaactacgcttgctggagaca

SEQ ID NO: 619161 - DNA, 25 bp, Mus musculus
ctgggaactacggttgctggagaca

SEQ ID NO: 619162 - DNA, 25 bp, Mus musculus
ctgggaactccactctctgaggcac

SEQ ID NO: 619163 - DNA, 25 bp, Mus musculus
ctgggaactccagtctctgaggcac

SEQ ID NO: 619164 - DNA, 25 bp, Mus musculus
ctgggaagaccactattcatgtaaa

SEQ ID NO: 619165 - DNA, 25 bp, Mus musculus
ctgggaagaccagtattcatgtaaa

SEQ ID NO: 619166 - DNA, 25 bp, Mus musculus
ctgggaagatctcgtaagaagatgc

SEQ ID NO: 619167 - DNA, 25 bp, Mus musculus
ctgggaagatctggtaagaagatgc

SEQ ID NO: 619168 - DNA, 25 bp, Mus musculus
ctgggaagccatctaggcacaggct

SEQ ID NO: 619169 - DNA, 25 bp, Mus musculus
ctgggaagccatgtaggcacaggct

SEQ ID NO: 619170 - DNA, 25 bp, Mus musculus
ctgggaagctgaagacccaaccaag

SEQ ID NO: 619171 - DNA, 25 bp, Mus musculus
ctgggaagctgatgacccaaccaag

SEQ ID NO: 619172 - DNA, 25 bp, Mus musculus
ctgggaagctgtacctcattggaat

SEQ ID NO: 619173 - DNA, 25 bp, Mus musculus
ctgggaagctgttcctcattggaat

SEQ ID NO: 619174 - DNA, 25 bp, Mus musculus
ctgggaagggacaacagaggcactt

SEQ ID NO: 619175 - DNA, 25 bp, Mus musculus
ctgggaagggactacagaggcactt

SEQ ID NO: 619176 - DNA, 25 bp, Mus musculus
ctgggaatgacacaatcctggtttt

SEQ ID NO: 619177 - DNA, 25 bp, Mus musculus
ctgggaatgacagaatcctggtttt

SEQ ID NO: 619178 - DNA, 25 bp, Mus musculus
ctgggaatggaaccccagtcatctg

SEQ ID NO: 619179 - DNA, 25 bp, Mus musculus
ctgggaatggaagcccagtcatctg

SEQ ID NO: 619180 - DNA, 25 bp, Mus musculus
ctgggaattgctcgctccgccaagc

SEQ ID NO: 619181 - DNA, 25 bp, Mus musculus
ctgggaattgctggctccgccaagc

SEQ ID NO: 619182 - DNA, 25 bp, Mus musculus
ctgggacaacgcctttgcagagcct

SEQ ID NO: 619183 - DNA, 25 bp, Mus musculus
ctgggacaacgcgtttgcagagcct

SEQ ID NO: 619184 - DNA, 25 bp, Mus musculus
ctgggacaaggtagaaaggagcttt

SEQ ID NO: 619185 - DNA, 25 bp, Mus musculus
ctgggacaaggttgaaaggagcttt

SEQ ID NO: 619186 - DNA, 25 bp, Mus musculus
ctgggacaatgacaatgacattctc

SEQ ID NO: 619187 - DNA, 25 bp, Mus musculus
ctgggacaatgagaatgacattctc

SEQ ID NO: 619188 - DNA, 25 bp, Mus musculus
ctgggacacaaacgaccacagcatc

SEQ ID NO: 619189 - DNA, 25 bp, Mus musculus
ctgggacacaaaggaccacagcatc

SEQ ID NO: 619190 - DNA, 25 bp, Mus musculus
ctgggacacgtcagaaagcgagctg

SEQ ID NO: 619191 - DNA, 25 bp, Mus musculus
ctgggacacgtctgaaagcgagctg

SEQ ID NO: 619192 - DNA, 25 bp, Mus musculus
ctgggacagaggagaccctggaaaa

SEQ ID NO: 619193 - DNA, 25 bp, Mus musculus
ctgggacagaggtgaccctggaaaa

SEQ ID NO: 619194 - DNA, 25 bp, Mus musculus
ctgggacagtgcagactttgtattt

SEQ ID NO: 619195 - DNA, 25 bp, Mus musculus
ctgggacagtgctgactttgtattt

SEQ ID NO: 619196 - DNA, 25 bp, Mus musculus
ctgggacagttaaaccacaaacaag

SEQ ID NO: 619197 - DNA, 25 bp, Mus musculus
ctgggacagttataccacaaacaag

SEQ ID NO: 619198 - DNA, 25 bp, Mus musculus
ctgggacatgtgcaagtgagcttct

SEQ ID NO: 619199 - DNA, 25 bp, Mus musculus
ctgggacatgtggaagtgagcttct

SEQ ID NO: 619200 - DNA, 25 bp, Mus musculus
ctgggaccacagcacttcctggaga

SEQ ID NO: 619201 - DNA, 25 bp, Mus musculus
ctgggaccacaggacttcctggaga

SEQ ID NO: 619202 - DNA, 25 bp, Mus musculus
ctgggacccaagaggtaagattggt

SEQ ID NO: 619203 - DNA, 25 bp, Mus musculus
ctgggacccaagtggtaagattggt

SEQ ID NO: 619204 - DNA, 25 bp, Mus musculus
ctgggacccaggcaatgtcagaagt

SEQ ID NO: 619205 - DNA, 25 bp, Mus musculus
ctgggacccagggaatgtcagaagt

SEQ ID NO: 619206 - DNA, 25 bp, Mus musculus
ctgggaccccgcagaacatgatggc

SEQ ID NO: 619207 - DNA, 25 bp, Mus musculus
ctgggaccccgctgaacatgatggc

SEQ ID NO: 619208 - DNA, 25 bp, Mus musculus
ctgggacctagcaggtggacagcat

SEQ ID NO: 619209 - DNA, 25 bp, Mus musculus
ctgggacctagctggtggacagcat

SEQ ID NO: 619210 - DNA, 25 bp, Mus musculus
ctgggactaagtctccgaagtatgt

SEQ ID NO: 619211 - DNA, 25 bp, Mus musculus
ctgggactaagtgtccgaagtatgt

SEQ ID NO: 619212 - DNA, 25 bp, Mus musculus
ctgggactatccagagaaccggcct

SEQ ID NO: 619213 - DNA, 25 bp, Mus musculus
ctgggactatcctgagaaccggcct

SEQ ID NO: 619214 - DNA, 25 bp, Mus musculus
ctgggactccctaccagatgagctg

SEQ ID NO: 619215 - DNA, 25 bp, Mus musculus
ctgggactcccttccagatgagctg

SEQ ID NO: 619216 - DNA, 25 bp, Mus musculus
ctgggacttaccaactacagatgga

SEQ ID NO: 619217 - DNA, 25 bp, Mus musculus
ctgggacttacctactacagatgga

SEQ ID NO: 619218 - DNA, 25 bp, Mus musculus
ctgggagaacaacccatcagcgggt

SEQ ID NO: 619219 - DNA, 25 bp, Mus musculus
ctgggagaacaagccatcagcgggt

SEQ ID NO: 619220 - DNA, 25 bp, Mus musculus
ctgggagagaaacgccggttcatac

SEQ ID NO: 619221 - DNA, 25 bp, Mus musculus
ctgggagagaaaggccggttcatac

SEQ ID NO: 619222 - DNA, 25 bp, Mus musculus
ctgggagagatgcaggccgaacggc

SEQ ID NO: 619223 - DNA, 25 bp, Mus musculus
ctgggagagatggaggccgaacggc

SEQ ID NO: 619224 - DNA, 25 bp, Mus musculus
ctgggagaggctaagaagcagcttc

SEQ ID NO: 619225 - DNA, 25 bp, Mus musculus
ctgggagaggcttagaagcagcttc

SEQ ID NO: 619226 - DNA, 25 bp, Mus musculus
ctgggagatcccaacgtacggagcc

SEQ ID NO: 619227 - DNA, 25 bp, Mus musculus
ctgggagatccctacgtacggagcc

SEQ ID NO: 619228 - DNA, 25 bp, Mus musculus
ctgggagatggcctcatagcccata

SEQ ID NO: 619229 - DNA, 25 bp, Mus musculus
ctgggagatggcgtcatagcccata

SEQ ID NO: 619230 - DNA, 25 bp, Mus musculus
ctgggagcagcgcaaagcacagaat

SEQ ID NO: 619231 - DNA, 25 bp, Mus musculus
ctgggagcagcggaaagcacagaat

SEQ ID NO: 619232 - DNA, 25 bp, Mus musculus
ctgggagccatccagagagccaagc

SEQ ID NO: 619233 - DNA, 25 bp, Mus musculus
ctgggagccatcgagagagccaagc

SEQ ID NO: 619234 - DNA, 25 bp, Mus musculus
ctgggagcctccatggtgataccgg

SEQ ID NO: 619235 - DNA, 25 bp, Mus musculus
ctgggagcctccttggtgataccgg

SEQ ID NO: 619236 - DNA, 25 bp, Mus musculus
ctgggaggacccagtggaaaaacag

SEQ ID NO: 619237 - DNA, 25 bp, Mus musculus
ctgggaggaccctgtggaaaaacag

SEQ ID NO: 619238 - DNA, 25 bp, Mus musculus
ctgggaggagcacaaagacacattc

SEQ ID NO: 619239 - DNA, 25 bp, Mus musculus
ctgggaggagcagaaagacacattc

SEQ ID NO: 619240 - DNA, 25 bp, Mus musculus
ctgggaggagtcaggagttttctca

SEQ ID NO: 619241 - DNA, 25 bp, Mus musculus
ctgggaggagtctggagttttctca

SEQ ID NO: 619242 - DNA, 25 bp, Mus musculus
ctgggaggcattcctacctgaagcc

SEQ ID NO: 619243 - DNA, 25 bp, Mus musculus
ctgggaggcattgctacctgaagcc

SEQ ID NO: 619244 - DNA, 25 bp, Mus musculus
ctgggaggccgacagtaccaccaaa

SEQ ID NO: 619245 - DNA, 25 bp, Mus musculus
ctgggaggccgagagtaccaccaaa

SEQ ID NO: 619246 - DNA, 25 bp, Mus musculus
ctgggaggctgacaccggagccggt

SEQ ID NO: 619247 - DNA, 25 bp, Mus musculus
ctgggaggctgagaccggagccggt

SEQ ID NO: 619248 - DNA, 25 bp, Mus musculus
ctgggaggtttcacagaggacgcta

SEQ ID NO: 619249 - DNA, 25 bp, Mus musculus
ctgggaggtttctcagaggacgcta

SEQ ID NO: 619250 - DNA, 25 bp, Mus musculus
ctgggagtcccactcccgtgcagag

SEQ ID NO: 619251 - DNA, 25 bp, Mus musculus
ctgggagtcccagtcccgtgcagag

SEQ ID NO: 619252 - DNA, 25 bp, Mus musculus
ctgggagtgacaccatccgagccat

SEQ ID NO: 619253 - DNA, 25 bp, Mus musculus
ctgggagtgacagcatccgagccat

SEQ ID NO: 619254 - DNA, 25 bp, Mus musculus
ctgggagttacacgccctacgacga

SEQ ID NO: 619255 - DNA, 25 bp, Mus musculus
ctgggagttacaggccctacgacga

SEQ ID NO: 619256 - DNA, 25 bp, Mus musculus
ctgggagtttccagcttttgaggca

SEQ ID NO: 619257 - DNA, 25 bp, Mus musculus
ctgggagtttcctgcttttgaggca

SEQ ID NO: 619258 - DNA, 25 bp, Mus musculus
ctgggagtttctaccaggaactgga

SEQ ID NO: 619259 - DNA, 25 bp, Mus musculus
ctgggagtttcttccaggaactgga

SEQ ID NO: 619260 - DNA, 25 bp, Mus musculus
ctgggatacaagcaagaaagatctg

SEQ ID NO: 619261 - DNA, 25 bp, Mus musculus
ctgggatacaaggaagaaagatctg

SEQ ID NO: 619262 - DNA, 25 bp, Mus musculus
ctgggatcttgtcggaaacaacacc

SEQ ID NO: 619263 - DNA, 25 bp, Mus musculus
ctgggatcttgtgggaaacaacacc

SEQ ID NO: 619264 - DNA, 25 bp, Mus musculus
ctgggatgaacgagccaagatcgat

SEQ ID NO: 619265 - DNA, 25 bp, Mus musculus
ctgggatgaacgtgccaagatcgat

SEQ ID NO: 619266 - DNA, 25 bp, Mus musculus
ctgggatgaagcacgtggagaccaa

SEQ ID NO: 619267 - DNA, 25 bp, Mus musculus
ctgggatgaagctcgtggagaccaa

SEQ ID NO: 619268 - DNA, 25 bp, Mus musculus
ctgggatgccacaccagtgcagtgc

SEQ ID NO: 619269 - DNA, 25 bp, Mus musculus
ctgggatgccactccagtgcagtgc

SEQ ID NO: 619270 - DNA, 25 bp, Mus musculus
ctgggatgcctgaacagtggtacca

SEQ ID NO: 619271 - DNA, 25 bp, Mus musculus
ctgggatgcctgtacagtggtacca

SEQ ID NO: 619272 - DNA, 25 bp, Mus musculus
ctgggatgcgtcagcctcggagcct

SEQ ID NO: 619273 - DNA, 25 bp, Mus musculus
ctgggatgcgtctgcctcggagcct

SEQ ID NO: 619274 - DNA, 25 bp, Mus musculus
ctgggattctcaagaggacggtctt

SEQ ID NO: 619275 - DNA, 25 bp, Mus musculus
ctgggattctcatgaggacggtctt

SEQ ID NO: 619276 - DNA, 25 bp, Mus musculus
ctgggattcttgctggtgccaacat

SEQ ID NO: 619277 - DNA, 25 bp, Mus musculus
ctgggattcttggtggtgccaacat

SEQ ID NO: 619278 - DNA, 25 bp, Mus musculus
ctgggatttcctactttgcctgtct

SEQ ID NO: 619279 - DNA, 25 bp, Mus musculus
ctgggatttcctctgtcacagcctc

SEQ ID NO: 619280 - DNA, 25 bp, Mus musculus
ctgggatttcctgtgtcacagcctc

SEQ ID NO: 619281 - DNA, 25 bp, Mus musculus
ctgggatttccttctttgcctgtct

SEQ ID NO: 619282 - DNA, 25 bp, Mus musculus
ctgggattttcaccaaggaaaatgc

SEQ ID NO: 619283 - DNA, 25 bp, Mus musculus
ctgggattttcagcaaggaaaatgc

SEQ ID NO: 619284 - DNA, 25 bp, Mus musculus
ctgggcaagcagagaggcaaccact

SEQ ID NO: 619285 - DNA, 25 bp, Mus musculus
ctgggcaagcagtgaggcaaccact

SEQ ID NO: 619286 - DNA, 25 bp, Mus musculus
ctgggcaagccgactgccagccagg

SEQ ID NO: 619287 - DNA, 25 bp, Mus musculus
ctgggcaagccgtctgccagccagg

SEQ ID NO: 619288 - DNA, 25 bp, Mus musculus
ctgggcaaggacctcttccacagag

SEQ ID NO: 619289 - DNA, 25 bp, Mus musculus
ctgggcaaggacgtcttccacagag

SEQ ID NO: 619290 - DNA, 25 bp, Mus musculus
ctgggcaatatgatcgtgattgtgc

SEQ ID NO: 619291 - DNA, 25 bp, Mus musculus
ctgggcaatatgttcgtgattgtgc

SEQ ID NO: 619292 - DNA, 25 bp, Mus musculus
ctgggcaccgataaggcggctccag

SEQ ID NO: 619293 - DNA, 25 bp, Mus musculus
ctgggcaccgattaggcggctccag

SEQ ID NO: 619294 - DNA, 25 bp, Mus musculus
ctgggcacctatatgtccagcagca

SEQ ID NO: 619295 - DNA, 25 bp, Mus musculus
ctgggcacctatttgtccagcagca

SEQ ID NO: 619296 - DNA, 25 bp, Mus musculus
ctgggcacctttcagcctgatgtgg

SEQ ID NO: 619297 - DNA, 25 bp, Mus musculus
ctgggcacctttgagcctgatgtgg

SEQ ID NO: 619298 - DNA, 25 bp, Mus musculus
ctgggcactgaacatgaaggaactg

SEQ ID NO: 619299 - DNA, 25 bp, Mus musculus
ctgggcactgaagatgaaggaactg

SEQ ID NO: 619300 - DNA, 25 bp, Mus musculus
ctgggcactgatcaaggagatcgaa

SEQ ID NO: 619301 - DNA, 25 bp, Mus musculus
ctgggcactgatcgctcacactact

SEQ ID NO: 619302 - DNA, 25 bp, Mus musculus
ctgggcactgatgaaggagatcgaa

SEQ ID NO: 619303 - DNA, 25 bp, Mus musculus
ctgggcactgatggctcacactact

SEQ ID NO: 619304 - DNA, 25 bp, Mus musculus
ctgggcactgcacgaggcagaattc

SEQ ID NO: 619305 - DNA, 25 bp, Mus musculus
ctgggcactgcaggaggcagaattc

SEQ ID NO: 619306 - DNA, 25 bp, Mus musculus
ctgggcagaatgacacgatggatga

SEQ ID NO: 619307 - DNA, 25 bp, Mus musculus
ctgggcagaatgtcacgatggatga

SEQ ID NO: 619308 - DNA, 25 bp, Mus musculus
ctgggcagacacctcacactattgt

SEQ ID NO: 619309 - DNA, 25 bp, Mus musculus
ctgggcagacacgtcacactattgt

SEQ ID NO: 619310 - DNA, 25 bp, Mus musculus
ctgggcagccctacgacacgatgaa

SEQ ID NO: 619311 - DNA, 25 bp, Mus musculus
ctgggcagcccttcgacacgatgaa

SEQ ID NO: 619312 - DNA, 25 bp, Mus musculus
ctgggcagcgagcacacagaggttc

SEQ ID NO: 619313 - DNA, 25 bp, Mus musculus
ctgggcagcgaggacacagaggttc

SEQ ID NO: 619314 - DNA, 25 bp, Mus musculus
ctgggcaggcagactacgaaaataa

SEQ ID NO: 619315 - DNA, 25 bp, Mus musculus
ctgggcaggcagtctacgaaaataa

SEQ ID NO: 619316 - DNA, 25 bp, Mus musculus
ctgggcataactaaccccgaaggca

SEQ ID NO: 619317 - DNA, 25 bp, Mus musculus
ctgggcataacttaccccgaaggca

SEQ ID NO: 619318 - DNA, 25 bp, Mus musculus
ctgggcatcagcatcgtgggccaga

SEQ ID NO: 619319 - DNA, 25 bp, Mus musculus
ctgggcatcagcttcgtgggccaga

SEQ ID NO: 619320 - DNA, 25 bp, Mus musculus
ctgggcatctacaagcagggcctta

SEQ ID NO: 619321 - DNA, 25 bp, Mus musculus
ctgggcatctactagcagggcctta

SEQ ID NO: 619322 - DNA, 25 bp, Mus musculus
ctgggcatgggcagcaccatggccc

SEQ ID NO: 619323 - DNA, 25 bp, Mus musculus
ctgggcatgggctgcaccatggccc

SEQ ID NO: 619324 - DNA, 25 bp, Mus musculus
ctgggccaaaatcataacagattga

SEQ ID NO: 619325 - DNA, 25 bp, Mus musculus
ctgggccaaaatgataacagattga

SEQ ID NO: 619326 - DNA, 25 bp, Mus musculus
ctgggccacgccctctaccagctca

SEQ ID NO: 619327 - DNA, 25 bp, Mus musculus
ctgggccacgccgtctaccagctca

SEQ ID NO: 619328 - DNA, 25 bp, Mus musculus
ctgggcccagaacaatgaccaaggg

SEQ ID NO: 619329 - DNA, 25 bp, Mus musculus
ctgggcccagaagaatgaccaaggg

SEQ ID NO: 619330 - DNA, 25 bp, Mus musculus
ctgggccccgctcacagcagtttgg

SEQ ID NO: 619331 - DNA, 25 bp, Mus musculus
ctgggccccgctgacagcagtttgg

SEQ ID NO: 619332 - DNA, 25 bp, Mus musculus
ctgggcccgagtccacagctgctga

SEQ ID NO: 619333 - DNA, 25 bp, Mus musculus
ctgggcccgagtgcacagctgctga

SEQ ID NO: 619334 - DNA, 25 bp, Mus musculus
ctgggccctcaacatggaaatctgt

SEQ ID NO: 619335 - DNA, 25 bp, Mus musculus
ctgggccctcaagatggaaatctgt

SEQ ID NO: 619336 - DNA, 25 bp, Mus musculus
ctgggccctgcaagcaaacataaaa

SEQ ID NO: 619337 - DNA, 25 bp, Mus musculus
ctgggccctgcatgcaaacataaaa

SEQ ID NO: 619338 - DNA, 25 bp, Mus musculus
ctgggccctggaagaagtacagctg

SEQ ID NO: 619339 - DNA, 25 bp, Mus musculus
ctgggccctggatgaagtacagctg

SEQ ID NO: 619340 - DNA, 25 bp, Mus musculus
ctgggcccttttcccgcttgcagga

SEQ ID NO: 619341 - DNA, 25 bp, Mus musculus
ctgggcccttttgccgcttgcagga

SEQ ID NO: 619342 - DNA, 25 bp, Mus musculus
ctgggccgcccgatggtactttgtg

SEQ ID NO: 619343 - DNA, 25 bp, Mus musculus
ctgggccgcccgttggtactttgtg

SEQ ID NO: 619344 - DNA, 25 bp, Mus musculus
ctgggccgctgcagtgaacaacgcc

SEQ ID NO: 619345 - DNA, 25 bp, Mus musculus
ctgggccgctgctgtgaacaacgcc

SEQ ID NO: 619346 - DNA, 25 bp, Mus musculus
ctgggcctcacacttgtatgtgagt

SEQ ID NO: 619347 - DNA, 25 bp, Mus musculus
ctgggcctcacagttgtatgtgagt

SEQ ID NO: 619348 - DNA, 25 bp, Mus musculus
ctgggcctcatcaggtgccgctgga

SEQ ID NO: 619349 - DNA, 25 bp, Mus musculus
ctgggcctcatctggtgccgctgga

SEQ ID NO: 619350 - DNA, 25 bp, Mus musculus
ctgggcctctgcaaggactcggagt

SEQ ID NO: 619351 - DNA, 25 bp, Mus musculus
ctgggcctctgctaggactcggagt

SEQ ID NO: 619352 - DNA, 25 bp, Mus musculus
ctgggcctgaagcagcagatcgaaa

SEQ ID NO: 619353 - DNA, 25 bp, Mus musculus
ctgggcctgaaggagcagatcgaaa

SEQ ID NO: 619354 - DNA, 25 bp, Mus musculus
ctgggcctggctaacgaccggaaga

SEQ ID NO: 619355 - DNA, 25 bp, Mus musculus
ctgggcctggcttacgaccggaaga

SEQ ID NO: 619356 - DNA, 25 bp, Mus musculus
ctgggcctttagaggtggtctagca

SEQ ID NO: 619357 - DNA, 25 bp, Mus musculus
ctgggcctttagtggtggtctagca

SEQ ID NO: 619358 - DNA, 25 bp, Mus musculus
ctgggcgagatgatgcttatgcttt

SEQ ID NO: 619359 - DNA, 25 bp, Mus musculus
ctgggcgagatgttgcttatgcttt

SEQ ID NO: 619360 - DNA, 25 bp, Mus musculus
ctgggcgcctgtcccggtttgtcta

SEQ ID NO: 619361 - DNA, 25 bp, Mus musculus
ctgggcgcctgtgccggtttgtcta

SEQ ID NO: 619362 - DNA, 25 bp, Mus musculus
ctgggctaccgtctggcctaaccgt

SEQ ID NO: 619363 - DNA, 25 bp, Mus musculus
ctgggctaccgtgtggcctaaccgt

SEQ ID NO: 619364 - DNA, 25 bp, Mus musculus
ctgggctacctacaacatgtgttgg

SEQ ID NO: 619365 - DNA, 25 bp, Mus musculus
ctgggctacctagaacatgtgttgg

SEQ ID NO: 619366 - DNA, 25 bp, Mus musculus
ctgggctatgacctggagaatgacc

SEQ ID NO: 619367 - DNA, 25 bp, Mus musculus
ctgggctatgacgtggagaatgacc

SEQ ID NO: 619368 - DNA, 25 bp, Mus musculus
ctgggctcagatccaaatgacgtgg

SEQ ID NO: 619369 - DNA, 25 bp, Mus musculus
ctgggctcagatgcaaatgacgtgg

SEQ ID NO: 619370 - DNA, 25 bp, Mus musculus
ctgggctccacgaagagactcaaca

SEQ ID NO: 619371 - DNA, 25 bp, Mus musculus
ctgggctccacgtagagactcaaca

SEQ ID NO: 619372 - DNA, 25 bp, Mus musculus
ctgggctcctaacagcgaccgtatt

SEQ ID NO: 619373 - DNA, 25 bp, Mus musculus
ctgggctcctaagagcgaccgtatt

SEQ ID NO: 619374 - DNA, 25 bp, Mus musculus
ctgggctcctcgctttcagcgcaga

SEQ ID NO: 619375 - DNA, 25 bp, Mus musculus
ctgggctcctcggtttcagcgcaga

SEQ ID NO: 619376 - DNA, 25 bp, Mus musculus
ctgggctcctggagtcccgcttgct

SEQ ID NO: 619377 - DNA, 25 bp, Mus musculus
ctgggctcctggtgtcccgcttgct

SEQ ID NO: 619378 - DNA, 25 bp, Mus musculus
ctgggctccttacgctgcaagaatt

SEQ ID NO: 619379 - DNA, 25 bp, Mus musculus
ctgggctccttaggctgcaagaatt

SEQ ID NO: 619380 - DNA, 25 bp, Mus musculus
ctgggctcgctaaaggagaggcacc

SEQ ID NO: 619381 - DNA, 25 bp, Mus musculus
ctgggctcgctataggagaggcacc

SEQ ID NO: 619382 - DNA, 25 bp, Mus musculus
ctgggctcggccactgcgaggttcc

SEQ ID NO: 619383 - DNA, 25 bp, Mus musculus
ctgggctcggcctctgcgaggttcc

SEQ ID NO: 619384 - DNA, 25 bp, Mus musculus
ctgggctgacccacacagtccattt

SEQ ID NO: 619385 - DNA, 25 bp, Mus musculus
ctgggctgaccctcacagtccattt

SEQ ID NO: 619386 - DNA, 25 bp, Mus musculus
ctgggctgagatcgccaagatgcta

SEQ ID NO: 619387 - DNA, 25 bp, Mus musculus
ctgggctgagatggccaagatgcta

SEQ ID NO: 619388 - DNA, 25 bp, Mus musculus
ctgggctgcacaacagcctgtgtgg

SEQ ID NO: 619389 - DNA, 25 bp, Mus musculus
ctgggctgcacatcagcctgtgtgg

SEQ ID NO: 619390 - DNA, 25 bp, Mus musculus
ctgggctgcatgcactccatgtgca

SEQ ID NO: 619391 - DNA, 25 bp, Mus musculus
ctgggctgcatggactccatgtgca

SEQ ID NO: 619392 - DNA, 25 bp, Mus musculus
ctgggctgctcactaccgcgaggca

SEQ ID NO: 619393 - DNA, 25 bp, Mus musculus
ctgggctgctcagtaccgcgaggca

SEQ ID NO: 619394 - DNA, 25 bp, Mus musculus
ctgggctggaagcaagctccaccct

SEQ ID NO: 619395 - DNA, 25 bp, Mus musculus
ctgggctggaaggaagctccaccct

SEQ ID NO: 619396 - DNA, 25 bp, Mus musculus
ctgggctggctcctagactatggga

SEQ ID NO: 619397 - DNA, 25 bp, Mus musculus
ctgggctggctcgtagactatggga

SEQ ID NO: 619398 - DNA, 25 bp, Mus musculus
ctgggctgggccaggagagtcgtgg

SEQ ID NO: 619399 - DNA, 25 bp, Mus musculus
ctgggctgggcctggagagtcgtgg

SEQ ID NO: 619400 - DNA, 25 bp, Mus musculus
ctgggctggtgcagagattccgtcc

SEQ ID NO: 619401 - DNA, 25 bp, Mus musculus
ctgggctggtgctgagattccgtcc

SEQ ID NO: 619402 - DNA, 25 bp, Mus musculus
ctgggctggtttcttttctataggc

SEQ ID NO: 619403 - DNA, 25 bp, Mus musculus
ctgggctggtttgttttctataggc

SEQ ID NO: 619404 - DNA, 25 bp, Mus musculus
ctgggctgtcctcgatttgttgtga

SEQ ID NO: 619405 - DNA, 25 bp, Mus musculus
ctgggctgtcctggatttgttgtga

SEQ ID NO: 619406 - DNA, 25 bp, Mus musculus
ctgggcttcaacatcgtcggtggga

SEQ ID NO: 619407 - DNA, 25 bp, Mus musculus
ctgggcttcaacttcgtcggtggga

SEQ ID NO: 619408 - DNA, 25 bp, Mus musculus
ctgggcttctacattcgagatggca

SEQ ID NO: 619409 - DNA, 25 bp, Mus musculus
ctgggcttctactttcgagatggca

SEQ ID NO: 619410 - DNA, 25 bp, Mus musculus
ctgggcttctcccataggagtttgt

SEQ ID NO: 619411 - DNA, 25 bp, Mus musculus
ctgggcttctccgataggagtttgt

SEQ ID NO: 619412 - DNA, 25 bp, Mus musculus
ctgggcttctgcagatcattctgat

SEQ ID NO: 619413 - DNA, 25 bp, Mus musculus
ctgggcttctgctgatcattctgat

SEQ ID NO: 619414 - DNA, 25 bp, Mus musculus
ctgggcttgaacagtatgctattaa

SEQ ID NO: 619415 - DNA, 25 bp, Mus musculus
ctgggcttgaactgtatgctattaa

SEQ ID NO: 619416 - DNA, 25 bp, Mus musculus
ctgggcttgagccactggccctcag

SEQ ID NO: 619417 - DNA, 25 bp, Mus musculus
ctgggcttgagcgactggccctcag

SEQ ID NO: 619418 - DNA, 25 bp, Mus musculus
ctgggctttcgaactgcaggagaga

SEQ ID NO: 619419 - DNA, 25 bp, Mus musculus
ctgggctttcgatctgcaggagaga

SEQ ID NO: 619420 - DNA, 25 bp, Mus musculus
ctgggctttcgcattgatgtggcat

SEQ ID NO: 619421 - DNA, 25 bp, Mus musculus
ctgggctttcgctttgatgtggcat

SEQ ID NO: 619422 - DNA, 25 bp, Mus musculus
ctgggctttgagcaggttgcccctt

SEQ ID NO: 619423 - DNA, 25 bp, Mus musculus
ctgggctttgaggaggttgcccctt

SEQ ID NO: 619424 - DNA, 25 bp, Mus musculus
ctgggctttgatccgctctgccaca

SEQ ID NO: 619425 - DNA, 25 bp, Mus musculus
ctgggctttgatgcgctctgccaca

SEQ ID NO: 619426 - DNA, 25 bp, Mus musculus
ctggggcacccaaaggaagaggaca

SEQ ID NO: 619427 - DNA, 25 bp, Mus musculus
ctggggcacccataggaagaggaca

SEQ ID NO: 619428 - DNA, 25 bp, Mus musculus
ctggggcgtggcatctggattttca

SEQ ID NO: 619429 - DNA, 25 bp, Mus musculus
ctggggcgtggcttctggattttca

SEQ ID NO: 619430 - DNA, 25 bp, Mus musculus
ctgggtaagcggacgcactgaagca

SEQ ID NO: 619431 - DNA, 25 bp, Mus musculus
ctgggtaagcggtcgcactgaagca

SEQ ID NO: 619432 - DNA, 25 bp, Mus musculus
ctgggtaatggtcagccctgaagtc

SEQ ID NO: 619433 - DNA, 25 bp, Mus musculus
ctgggtaatggtgagccctgaagtc

SEQ ID NO: 619434 - DNA, 25 bp, Mus musculus
ctgggtacagagagaccactggttg

SEQ ID NO: 619435 - DNA, 25 bp, Mus musculus
ctgggtacagagtgaccactggttg

SEQ ID NO: 619436 - DNA, 25 bp, Mus musculus
ctgggtacccttcgtcatggtcagt

SEQ ID NO: 619437 - DNA, 25 bp, Mus musculus
ctgggtacccttggtcatggtcagt

SEQ ID NO: 619438 - DNA, 25 bp, Mus musculus
ctgggtactaagctcaacgtgaaga

SEQ ID NO: 619439 - DNA, 25 bp, Mus musculus
ctgggtactaaggtcaacgtgaaga

SEQ ID NO: 619440 - DNA, 25 bp, Mus musculus
ctgggtactatcagccaagccggga

SEQ ID NO: 619441 - DNA, 25 bp, Mus musculus
ctgggtactatctgccaagccggga

SEQ ID NO: 619442 - DNA, 25 bp, Mus musculus
ctgggtagatccagcccctgagggc

SEQ ID NO: 619443 - DNA, 25 bp, Mus musculus
ctgggtagatcctgcccctgagggc

SEQ ID NO: 619444 - DNA, 25 bp, Mus musculus
ctgggtaggcagcttaaaggctact

SEQ ID NO: 619445 - DNA, 25 bp, Mus musculus
ctgggtaggcaggttaaaggctact

SEQ ID NO: 619446 - DNA, 25 bp, Mus musculus
ctgggtaggtatacacagatgagaa

SEQ ID NO: 619447 - DNA, 25 bp, Mus musculus
ctgggtaggtattcacagatgagaa

SEQ ID NO: 619448 - DNA, 25 bp, Mus musculus
ctgggtatcggaagcatgcttggaa

SEQ ID NO: 619449 - DNA, 25 bp, Mus musculus
ctgggtatcggatgcatgcttggaa

SEQ ID NO: 619450 - DNA, 25 bp, Mus musculus
ctgggtatttttcgagtctatgtca

SEQ ID NO: 619451 - DNA, 25 bp, Mus musculus
ctgggtatttttggagtctatgtca

SEQ ID NO: 619452 - DNA, 25 bp, Mus musculus
ctgggtcacaaacattgacaacagc

SEQ ID NO: 619453 - DNA, 25 bp, Mus musculus
ctgggtcacaaagattgacaacagc

SEQ ID NO: 619454 - DNA, 25 bp, Mus musculus
ctgggtcagatgcaggactccccac

SEQ ID NO: 619455 - DNA, 25 bp, Mus musculus
ctgggtcagatggaggactccccac

SEQ ID NO: 619456 - DNA, 25 bp, Mus musculus
ctgggtcagcgtagcaaaccgggct

SEQ ID NO: 619457 - DNA, 25 bp, Mus musculus
ctgggtcagcgttgcaaaccgggct

SEQ ID NO: 619458 - DNA, 25 bp, Mus musculus
ctgggtcatctcctcccgtttattt

SEQ ID NO: 619459 - DNA, 25 bp, Mus musculus
ctgggtcatctcgtcccgtttattt

SEQ ID NO: 619460 - DNA, 25 bp, Mus musculus
ctgggtcattgtcattggctccttc

SEQ ID NO: 619461 - DNA, 25 bp, Mus musculus
ctgggtcattgtgattggctccttc

SEQ ID NO: 619462 - DNA, 25 bp, Mus musculus
ctgggtccccgcaaaggttcacaag

SEQ ID NO: 619463 - DNA, 25 bp, Mus musculus
ctgggtccccgctaaggttcacaag

SEQ ID NO: 619464 - DNA, 25 bp, Mus musculus
ctgggtccggaacagccatgtgaac

SEQ ID NO: 619465 - DNA, 25 bp, Mus musculus
ctgggtccggaagagccatgtgaac

SEQ ID NO: 619466 - DNA, 25 bp, Mus musculus
ctgggtctcacacgctacgggatct

SEQ ID NO: 619467 - DNA, 25 bp, Mus musculus
ctgggtctcacaggctacgggatct

SEQ ID NO: 619468 - DNA, 25 bp, Mus musculus
ctgggtctcctcatggtgattctga

SEQ ID NO: 619469 - DNA, 25 bp, Mus musculus
ctgggtctcctcttggtgattctga

SEQ ID NO: 619470 - DNA, 25 bp, Mus musculus
ctgggtctgaccctggaactccagg

SEQ ID NO: 619471 - DNA, 25 bp, Mus musculus
ctgggtctgaccgtggaactccagg

SEQ ID NO: 619472 - DNA, 25 bp, Mus musculus
ctgggtctgtcaccccacaggaaga

SEQ ID NO: 619473 - DNA, 25 bp, Mus musculus
ctgggtctgtcagcccacaggaaga

SEQ ID NO: 619474 - DNA, 25 bp, Mus musculus
ctgggtgactttaatgccgattgca

SEQ ID NO: 619475 - DNA, 25 bp, Mus musculus
ctgggtgacttttatgccgattgca

SEQ ID NO: 619476 - DNA, 25 bp, Mus musculus
ctgggtgagaatcccggcttgcaca

SEQ ID NO: 619477 - DNA, 25 bp, Mus musculus
ctgggtgagaatgccggcttgcaca

SEQ ID NO: 619478 - DNA, 25 bp, Mus musculus
ctgggtggaaacatcagtcatctga

SEQ ID NO: 619479 - DNA, 25 bp, Mus musculus
ctgggtggaaacttcagtcatctga

SEQ ID NO: 619480 - DNA, 25 bp, Mus musculus
ctgggtggcacaaagtacatctctt

SEQ ID NO: 619481 - DNA, 25 bp, Mus musculus
ctgggtggcacatagtacatctctt

SEQ ID NO: 619482 - DNA, 25 bp, Mus musculus
ctgggtggctatactgtcaccgcca

SEQ ID NO: 619483 - DNA, 25 bp, Mus musculus
ctgggtggctattctgtcaccgcca

SEQ ID NO: 619484 - DNA, 25 bp, Mus musculus
ctgggtggctccatcggctttctgg

SEQ ID NO: 619485 - DNA, 25 bp, Mus musculus
ctgggtggctccttcggctttctgg

SEQ ID NO: 619486 - DNA, 25 bp, Mus musculus
ctgggtgtcattctggtaaggttct

SEQ ID NO: 619487 - DNA, 25 bp, Mus musculus
ctgggtgtcattgtggtaaggttct

SEQ ID NO: 619488 - DNA, 25 bp, Mus musculus
ctgggtgtgcagcaagtgcccctct

SEQ ID NO: 619489 - DNA, 25 bp, Mus musculus
ctgggtgtgcaggaagtgcccctct

SEQ ID NO: 619490 - DNA, 25 bp, Mus musculus
ctgggttaaggacctgcgcagttta

SEQ ID NO: 619491 - DNA, 25 bp, Mus musculus
ctgggttaaggagctgcgcagttta

SEQ ID NO: 619492 - DNA, 25 bp, Mus musculus
ctgggttaggcccaccaacgctgta

SEQ ID NO: 619493 - DNA, 25 bp, Mus musculus
ctgggttaggccgaccaacgctgta

SEQ ID NO: 619494 - DNA, 25 bp, Mus musculus
ctgggttccagacagtgcccggatc

SEQ ID NO: 619495 - DNA, 25 bp, Mus musculus
ctgggttccagagagtgcccggatc

SEQ ID NO: 619496 - DNA, 25 bp, Mus musculus
ctgggttctcctctcgggcaggctt

SEQ ID NO: 619497 - DNA, 25 bp, Mus musculus
ctgggttctcctgtcgggcaggctt

SEQ ID NO: 619498 - DNA, 25 bp, Mus musculus
ctgggttctgagactccacggagga

SEQ ID NO: 619499 - DNA, 25 bp, Mus musculus
ctgggttctgagtctccacggagga

SEQ ID NO: 619500 - DNA, 25 bp, Mus musculus
ctggtaaaatacactgccaatgaag

SEQ ID NO: 619501 - DNA, 25 bp, Mus musculus
ctggtaaaatactctgccaatgaag

SEQ ID NO: 619502 - DNA, 25 bp, Mus musculus
ctggtaacagagagatttggtatgc

SEQ ID NO: 619503 - DNA, 25 bp, Mus musculus
ctggtaacagagtgatttggtatgc

SEQ ID NO: 619504 - DNA, 25 bp, Mus musculus
ctggtaacttgtagtgcggagcgaa

SEQ ID NO: 619505 - DNA, 25 bp, Mus musculus
ctggtaacttgttgtgcggagcgaa

SEQ ID NO: 619506 - DNA, 25 bp, Mus musculus
ctggtacaggtgagtttttcttact

SEQ ID NO: 619507 - DNA, 25 bp, Mus musculus
ctggtacaggtgtgtttttcttact

SEQ ID NO: 619508 - DNA, 25 bp, Mus musculus
ctggtacccagccattggaggtgct

SEQ ID NO: 619509 - DNA, 25 bp, Mus musculus
ctggtacccagcgattggaggtgct

SEQ ID NO: 619510 - DNA, 25 bp, Mus musculus
ctggtacgaaggcatatcgggctct

SEQ ID NO: 619511 - DNA, 25 bp, Mus musculus
ctggtacgaagggatatcgggctct

SEQ ID NO: 619512 - DNA, 25 bp, Mus musculus
ctggtacgtcaacgattaaaatgtg

SEQ ID NO: 619513 - DNA, 25 bp, Mus musculus
ctggtacgtcaaggattaaaatgtg

SEQ ID NO: 619514 - DNA, 25 bp, Mus musculus
ctggtagaaggcctcaaagtcgaac

SEQ ID NO: 619515 - DNA, 25 bp, Mus musculus
ctggtagaaggcgtcaaagtcgaac

SEQ ID NO: 619516 - DNA, 25 bp, Mus musculus
ctggtagatgctcacaagaagatgg

SEQ ID NO: 619517 - DNA, 25 bp, Mus musculus
ctggtagatgctgacaagaagatgg

SEQ ID NO: 619518 - DNA, 25 bp, Mus musculus
ctggtagattgccagaggactcccc

SEQ ID NO: 619519 - DNA, 25 bp, Mus musculus
ctggtagattgcgagaggactcccc

SEQ ID NO: 619520 - DNA, 25 bp, Mus musculus
ctggtaggtgagaagctgagcctcc

SEQ ID NO: 619521 - DNA, 25 bp, Mus musculus
ctggtaggtgagtagctgagcctcc

SEQ ID NO: 619522 - DNA, 25 bp, Mus musculus
ctggtatcagctatcgaacaatgag

SEQ ID NO: 619523 - DNA, 25 bp, Mus musculus
ctggtatcagctttcgaacaatgag

SEQ ID NO: 619524 - DNA, 25 bp, Mus musculus
ctggtatcccgtctgccaggatgat

SEQ ID NO: 619525 - DNA, 25 bp, Mus musculus
ctggtatcccgtgtgccaggatgat

SEQ ID NO: 619526 - DNA, 25 bp, Mus musculus
ctggtatgcttgactttgtcaacaa

SEQ ID NO: 619527 - DNA, 25 bp, Mus musculus
ctggtatgcttgtctttgtcaacaa

SEQ ID NO: 619528 - DNA, 25 bp, Mus musculus
ctggtattgaaacccgagtcttccc

SEQ ID NO: 619529 - DNA, 25 bp, Mus musculus
ctggtattgaaagccgagtcttccc

SEQ ID NO: 619530 - DNA, 25 bp, Mus musculus
ctggtattgagaattactttattgg

SEQ ID NO: 619531 - DNA, 25 bp, Mus musculus
ctggtattgagatttactttattgg

SEQ ID NO: 619532 - DNA, 25 bp, Mus musculus
ctggtattggcacctgttatgtgca

SEQ ID NO: 619533 - DNA, 25 bp, Mus musculus
ctggtattggcagctgttatgtgca

SEQ ID NO: 619534 - DNA, 25 bp, Mus musculus
ctggtatttagaccgcagcgcctga

SEQ ID NO: 619535 - DNA, 25 bp, Mus musculus
ctggtatttagagcgcagcgcctga

SEQ ID NO: 619536 - DNA, 25 bp, Mus musculus
ctggtcaacgggagcctcttcccag

SEQ ID NO: 619537 - DNA, 25 bp, Mus musculus
ctggtcaacgggtgcctcttcccag

SEQ ID NO: 619538 - DNA, 25 bp, Mus musculus
ctggtcaatggcaccatgtgtgagg

SEQ ID NO: 619539 - DNA, 25 bp, Mus musculus
ctggtcaatggctccatgtgtgagg

SEQ ID NO: 619540 - DNA, 25 bp, Mus musculus
ctggtcacaggtcgctgcggcttcc

SEQ ID NO: 619541 - DNA, 25 bp, Mus musculus
ctggtcacaggtggctgcggcttcc

SEQ ID NO: 619542 - DNA, 25 bp, Mus musculus
ctggtcactgcccaggatcagttat

SEQ ID NO: 619543 - DNA, 25 bp, Mus musculus
ctggtcactgccgaggatcagttat

SEQ ID NO: 619544 - DNA, 25 bp, Mus musculus
ctggtcagcaagatctggcaatgaa

SEQ ID NO: 619545 - DNA, 25 bp, Mus musculus
ctggtcagcaagttctggcaatgaa

SEQ ID NO: 619546 - DNA, 25 bp, Mus musculus
ctggtcagctgtcagaagtgtcgcc

SEQ ID NO: 619547 - DNA, 25 bp, Mus musculus
ctggtcagctgtgagaagtgtcgcc

SEQ ID NO: 619548 - DNA, 25 bp, Mus musculus
ctggtcatctggaaccccagggcca

SEQ ID NO: 619549 - DNA, 25 bp, Mus musculus
ctggtcatctggtaccccagggcca

SEQ ID NO: 619550 - DNA, 25 bp, Mus musculus
ctggtcatgcagctcttccaggacc

SEQ ID NO: 619551 - DNA, 25 bp, Mus musculus
ctggtcatgcaggtcttccaggacc

SEQ ID NO: 619552 - DNA, 25 bp, Mus musculus
ctggtcattctcctgctggttacct

SEQ ID NO: 619553 - DNA, 25 bp, Mus musculus
ctggtcattctcgtgctggttacct

SEQ ID NO: 619554 - DNA, 25 bp, Mus musculus
ctggtcattgcccagctgttgttct

SEQ ID NO: 619555 - DNA, 25 bp, Mus musculus
ctggtcattgccgagctgttgttct

SEQ ID NO: 619556 - DNA, 25 bp, Mus musculus
ctggtccaggccagtgcatatgtga

SEQ ID NO: 619557 - DNA, 25 bp, Mus musculus
ctggtccaggcctgtgcatatgtga

SEQ ID NO: 619558 - DNA, 25 bp, Mus musculus
ctggtccccgcgctgctactgggtg

SEQ ID NO: 619559 - DNA, 25 bp, Mus musculus
ctggtccccgcggtgctactgggtg

SEQ ID NO: 619560 - DNA, 25 bp, Mus musculus
ctggtcccttatagataacctagtg

SEQ ID NO: 619561 - DNA, 25 bp, Mus musculus
ctggtcccttattgataacctagtg

SEQ ID NO: 619562 - DNA, 25 bp, Mus musculus
ctggtcccttccagatctgcagctg

SEQ ID NO: 619563 - DNA, 25 bp, Mus musculus
ctggtcccttcctgatctgcagctg

SEQ ID NO: 619564 - DNA, 25 bp, Mus musculus
ctggtccgagatcccaagcagaggc

SEQ ID NO: 619565 - DNA, 25 bp, Mus musculus
ctggtccgagatgccaagcagaggc

SEQ ID NO: 619566 - DNA, 25 bp, Mus musculus
ctggtccgcaatcccaagatccttt

SEQ ID NO: 619567 - DNA, 25 bp, Mus musculus
ctggtccgcaatgccaagatccttt

SEQ ID NO: 619568 - DNA, 25 bp, Mus musculus
ctggtcctcatgaagtgtgtgaacc

SEQ ID NO: 619569 - DNA, 25 bp, Mus musculus
ctggtcctcatgtagtgtgtgaacc

SEQ ID NO: 619570 - DNA, 25 bp, Mus musculus
ctggtcctcctgatttgcgcccgga

SEQ ID NO: 619571 - DNA, 25 bp, Mus musculus
ctggtcctcctgttttgcgcccgga

SEQ ID NO: 619572 - DNA, 25 bp, Mus musculus
ctggtcctgtacactatgagtagtg

SEQ ID NO: 619573 - DNA, 25 bp, Mus musculus
ctggtcctgtactctatgagtagtg

SEQ ID NO: 619574 - DNA, 25 bp, Mus musculus
ctggtccttcagctatgcttggatg

SEQ ID NO: 619575 - DNA, 25 bp, Mus musculus
ctggtccttcaggtatgcttggatg

SEQ ID NO: 619576 - DNA, 25 bp, Mus musculus
ctggtccttgttcatcatcaccgtg

SEQ ID NO: 619577 - DNA, 25 bp, Mus musculus
ctggtccttgttgatcatcaccgtg

SEQ ID NO: 619578 - DNA, 25 bp, Mus musculus
ctggtcgcggaaacgctcggctgtc

SEQ ID NO: 619579 - DNA, 25 bp, Mus musculus
ctggtcgcggaatcgctcggctgtc

SEQ ID NO: 619580 - DNA, 25 bp, Mus musculus
ctggtcggatgaccccatcaaggag

SEQ ID NO: 619581 - DNA, 25 bp, Mus musculus
ctggtcggatgagcccatcaaggag

SEQ ID NO: 619582 - DNA, 25 bp, Mus musculus
ctggtctcaattcccgtctcaaggc

SEQ ID NO: 619583 - DNA, 25 bp, Mus musculus
ctggtctcaattgccgtctcaaggc

SEQ ID NO: 619584 - DNA, 25 bp, Mus musculus
ctggtctccagcagtcccaactaag

SEQ ID NO: 619585 - DNA, 25 bp, Mus musculus
ctggtctccagctgtcccaactaag

SEQ ID NO: 619586 - DNA, 25 bp, Mus musculus
ctggtctccatgcaggcatcaagca

SEQ ID NO: 619587 - DNA, 25 bp, Mus musculus
ctggtctccatggaggcatcaagca

SEQ ID NO: 619588 - DNA, 25 bp, Mus musculus
ctggtctgcagtctgtgcacatttt

SEQ ID NO: 619589 - DNA, 25 bp, Mus musculus
ctggtctgcagtgtgtgcacatttt

SEQ ID NO: 619590 - DNA, 25 bp, Mus musculus
ctggtctggacccaaacgctgtcca

SEQ ID NO: 619591 - DNA, 25 bp, Mus musculus
ctggtctggaccgaaacgctgtcca

SEQ ID NO: 619592 - DNA, 25 bp, Mus musculus
ctggtctggcaaagagcagatgacc

SEQ ID NO: 619593 - DNA, 25 bp, Mus musculus
ctggtctggcaatgagcagatgacc

SEQ ID NO: 619594 - DNA, 25 bp, Mus musculus
ctggtctgtggaccgccagctcttg

SEQ ID NO: 619595 - DNA, 25 bp, Mus musculus
ctggtctgtggagcgccagctcttg

SEQ ID NO: 619596 - DNA, 25 bp, Mus musculus
ctggtcttttggcatcctactctgg

SEQ ID NO: 619597 - DNA, 25 bp, Mus musculus
ctggtcttttgggatcctactctgg

SEQ ID NO: 619598 - DNA, 25 bp, Mus musculus
ctggtctttttgatttgaaagcagc

SEQ ID NO: 619599 - DNA, 25 bp, Mus musculus
ctggtctttttgttttgaaagcagc

SEQ ID NO: 619600 - DNA, 25 bp, Mus musculus
ctggtgaaacagaacagtgtcttga

SEQ ID NO: 619601 - DNA, 25 bp, Mus musculus
ctggtgaaacagtacagtgtcttga

SEQ ID NO: 619602 - DNA, 25 bp, Mus musculus
ctggtgaaagagaaggccacaggcc

SEQ ID NO: 619603 - DNA, 25 bp, Mus musculus
ctggtgaaagagtaggccacaggcc

SEQ ID NO: 619604 - DNA, 25 bp, Mus musculus
ctggtgaagaggatctaccggctgt

SEQ ID NO: 619605 - DNA, 25 bp, Mus musculus
ctggtgaagaggttctaccggctgt

SEQ ID NO: 619606 - DNA, 25 bp, Mus musculus
ctggtgaagagtcccaatcagcgcc

SEQ ID NO: 619607 - DNA, 25 bp, Mus musculus
ctggtgaagagtgccaatcagcgcc

SEQ ID NO: 619608 - DNA, 25 bp, Mus musculus
ctggtgaagattcctgattttggac

SEQ ID NO: 619609 - DNA, 25 bp, Mus musculus
ctggtgaagattgctgattttggac

SEQ ID NO: 619610 - DNA, 25 bp, Mus musculus
ctggtgaatgaacgatgacagctac

SEQ ID NO: 619611 - DNA, 25 bp, Mus musculus
ctggtgaatgaaggatgacagctac

SEQ ID NO: 619612 - DNA, 25 bp, Mus musculus
ctggtgaatgcaccatataagcggg

SEQ ID NO: 619613 - DNA, 25 bp, Mus musculus
ctggtgaatgcagcatataagcggg

SEQ ID NO: 619614 - DNA, 25 bp, Mus musculus
ctggtgaatgctatcatcaacagtg

SEQ ID NO: 619615 - DNA, 25 bp, Mus musculus
ctggtgaatgctttcatcaacagtg

SEQ ID NO: 619616 - DNA, 25 bp, Mus musculus
ctggtgaattagaagtagagctgac

SEQ ID NO: 619617 - DNA, 25 bp, Mus musculus
ctggtgaattagtagtagagctgac

SEQ ID NO: 619618 - DNA, 25 bp, Mus musculus
ctggtgacacagaagcctttaggca

SEQ ID NO: 619619 - DNA, 25 bp, Mus musculus
ctggtgacacagtagcctttaggca

SEQ ID NO: 619620 - DNA, 25 bp, Mus musculus
ctggtgaccttcagtgaagaagtgg

SEQ ID NO: 619621 - DNA, 25 bp, Mus musculus
ctggtgaccttctgtgaagaagtgg

SEQ ID NO: 619622 - DNA, 25 bp, Mus musculus
ctggtgactgtgcacggccagctca

SEQ ID NO: 619623 - DNA, 25 bp, Mus musculus
ctggtgactgtggacggccagctca

SEQ ID NO: 619624 - DNA, 25 bp, Mus musculus
ctggtgacttaacatcaggagatga

SEQ ID NO: 619625 - DNA, 25 bp, Mus musculus
ctggtgacttaagatcaggagatga

SEQ ID NO: 619626 - DNA, 25 bp, Mus musculus
ctggtgagcccgctgatgaatttac

SEQ ID NO: 619627 - DNA, 25 bp, Mus musculus
ctggtgagcccggtgatgaatttac

SEQ ID NO: 619628 - DNA, 25 bp, Mus musculus
ctggtgaggcagagcgtcctctcta

SEQ ID NO: 619629 - DNA, 25 bp, Mus musculus
ctggtgaggcagtgcgtcctctcta

SEQ ID NO: 619630 - DNA, 25 bp, Mus musculus
ctggtgagtaggctgtgcaccctca

SEQ ID NO: 619631 - DNA, 25 bp, Mus musculus
ctggtgagtagggtgtgcaccctca

SEQ ID NO: 619632 - DNA, 25 bp, Mus musculus
ctggtgatagttactccacatttga

SEQ ID NO: 619633 - DNA, 25 bp, Mus musculus
ctggtgatagtttctccacatttga

SEQ ID NO: 619634 - DNA, 25 bp, Mus musculus
ctggtgatgcggagaagggaggagc

SEQ ID NO: 619635 - DNA, 25 bp, Mus musculus
ctggtgatgcggtgaagggaggagc

SEQ ID NO: 619636 - DNA, 25 bp, Mus musculus
ctggtgatggccctctgcagtcaaa

SEQ ID NO: 619637 - DNA, 25 bp, Mus musculus
ctggtgatggccgtctgcagtcaaa

SEQ ID NO: 619638 - DNA, 25 bp, Mus musculus
ctggtgattcagacgtacatccggg

SEQ ID NO: 619639 - DNA, 25 bp, Mus musculus
ctggtgattcagtcgtacatccggg

SEQ ID NO: 619640 - DNA, 25 bp, Mus musculus
ctggtgcacggacctgagacacgat

SEQ ID NO: 619641 - DNA, 25 bp, Mus musculus
ctggtgcacggagctgagacacgat

SEQ ID NO: 619642 - DNA, 25 bp, Mus musculus
ctggtgcagaaccacttcgccggca

SEQ ID NO: 619643 - DNA, 25 bp, Mus musculus
ctggtgcagaacgacttcgccggca

SEQ ID NO: 619644 - DNA, 25 bp, Mus musculus
ctggtgcagctcaacgcggtcgtgt

SEQ ID NO: 619645 - DNA, 25 bp, Mus musculus
ctggtgcagctctacgcggtcgtgt

SEQ ID NO: 619646 - DNA, 25 bp, Mus musculus
ctggtgcaggtcaacagccgcttca

SEQ ID NO: 619647 - DNA, 25 bp, Mus musculus
ctggtgcaggtctacagccgcttca

SEQ ID NO: 619648 - DNA, 25 bp, Mus musculus
ctggtgcagtgaacattgtgctttt

SEQ ID NO: 619649 - DNA, 25 bp, Mus musculus
ctggtgcagtgatcattgtgctttt

SEQ ID NO: 619650 - DNA, 25 bp, Mus musculus
ctggtgcatctcacggcagctgtgg

SEQ ID NO: 619651 - DNA, 25 bp, Mus musculus
ctggtgcatctctcggcagctgtgg

SEQ ID NO: 619652 - DNA, 25 bp, Mus musculus
ctggtgccagagaaagacagcccca

SEQ ID NO: 619653 - DNA, 25 bp, Mus musculus
ctggtgccagagtaagacagcccca

SEQ ID NO: 619654 - DNA, 25 bp, Mus musculus
ctggtgccatctaagggtggccgtt

SEQ ID NO: 619655 - DNA, 25 bp, Mus musculus
ctggtgccatcttagggtggccgtt

SEQ ID NO: 619656 - DNA, 25 bp, Mus musculus
ctggtgcccacccaggtagagcctg

SEQ ID NO: 619657 - DNA, 25 bp, Mus musculus
ctggtgcccaccctgtttcagagtc

SEQ ID NO: 619658 - DNA, 25 bp, Mus musculus
ctggtgcccaccgaggtagagcctg

SEQ ID NO: 619659 - DNA, 25 bp, Mus musculus
ctggtgcccaccgtgtttcagagtc

SEQ ID NO: 619660 - DNA, 25 bp, Mus musculus
ctggtgcccgggacacgtgatcgaa

SEQ ID NO: 619661 - DNA, 25 bp, Mus musculus
ctggtgcccgggtcacgtgatcgaa

SEQ ID NO: 619662 - DNA, 25 bp, Mus musculus
ctggtgccctgtatgaatgactgtg

SEQ ID NO: 619663 - DNA, 25 bp, Mus musculus
ctggtgccctgtttgaatgactgtg

SEQ ID NO: 619664 - DNA, 25 bp, Mus musculus
ctggtgcctcgtcttcatgcatggg

SEQ ID NO: 619665 - DNA, 25 bp, Mus musculus
ctggtgcctcgtgttcatgcatggg

SEQ ID NO: 619666 - DNA, 25 bp, Mus musculus
ctggtgctagtgactgctccctgct

SEQ ID NO: 619667 - DNA, 25 bp, Mus musculus
ctggtgctagtgtctgctccctgct

SEQ ID NO: 619668 - DNA, 25 bp, Mus musculus
ctggtgctcactcgtcatcgtagcc

SEQ ID NO: 619669 - DNA, 25 bp, Mus musculus
ctggtgctcactggtcatcgtagcc

SEQ ID NO: 619670 - DNA, 25 bp, Mus musculus
ctggtgctcagcacgggcatgttct

SEQ ID NO: 619671 - DNA, 25 bp, Mus musculus
ctggtgctcagctcgggcatgttct

SEQ ID NO: 619672 - DNA, 25 bp, Mus musculus
ctggtgctcttacgaaggagtatag

SEQ ID NO: 619673 - DNA, 25 bp, Mus musculus
ctggtgctcttaggaaggagtatag

SEQ ID NO: 619674 - DNA, 25 bp, Mus musculus
ctggtgctgaagaggattatctgga

SEQ ID NO: 619675 - DNA, 25 bp, Mus musculus
ctggtgctgaagtggattatctgga

SEQ ID NO: 619676 - DNA, 25 bp, Mus musculus
ctggtgctgctcaacgagatgggcc

SEQ ID NO: 619677 - DNA, 25 bp, Mus musculus
ctggtgctgctctacgagatgggcc

SEQ ID NO: 619678 - DNA, 25 bp, Mus musculus
ctggtgcttcatcgcaaggttgcag

SEQ ID NO: 619679 - DNA, 25 bp, Mus musculus
ctggtgcttcatggcaaggttgcag

SEQ ID NO: 619680 - DNA, 25 bp, Mus musculus
ctggtgcttgaaaatgagggcgccc

SEQ ID NO: 619681 - DNA, 25 bp, Mus musculus
ctggtgcttgaatatgagggcgccc

SEQ ID NO: 619682 - DNA, 25 bp, Mus musculus
ctggtggaaatcagcggattcgctt

SEQ ID NO: 619683 - DNA, 25 bp, Mus musculus
ctggtggaaatctgcggattcgctt

SEQ ID NO: 619684 - DNA, 25 bp, Mus musculus
ctggtggaacggagacaagtacctg

SEQ ID NO: 619685 - DNA, 25 bp, Mus musculus
ctggtggaacggtgacaagtacctg

SEQ ID NO: 619686 - DNA, 25 bp, Mus musculus
ctggtggacaaaagacaatggaaat

SEQ ID NO: 619687 - DNA, 25 bp, Mus musculus
ctggtggacaaatgacaatggaaat

SEQ ID NO: 619688 - DNA, 25 bp, Mus musculus
ctggtggacccgctcatccggaagc

SEQ ID NO: 619689 - DNA, 25 bp, Mus musculus
ctggtggacccggtcatccggaagc

SEQ ID NO: 619690 - DNA, 25 bp, Mus musculus
ctggtggaccgcaggatccgcagcc

SEQ ID NO: 619691 - DNA, 25 bp, Mus musculus
ctggtggaccgctggatccgcagcc

SEQ ID NO: 619692 - DNA, 25 bp, Mus musculus
ctggtggaggtcataaccaagagaa

SEQ ID NO: 619693 - DNA, 25 bp, Mus musculus
ctggtggaggtcttaaccaagagaa

SEQ ID NO: 619694 - DNA, 25 bp, Mus musculus
ctggtggatttcctgggatatatgc

SEQ ID NO: 619695 - DNA, 25 bp, Mus musculus
ctggtggatttcgtgggatatatgc

SEQ ID NO: 619696 - DNA, 25 bp, Mus musculus
ctggtggcagatcccacagtatgtg

SEQ ID NO: 619697 - DNA, 25 bp, Mus musculus
ctggtggcagatgccacagtatgtg

SEQ ID NO: 619698 - DNA, 25 bp, Mus musculus
ctggtggcccttccttaataaagat

SEQ ID NO: 619699 - DNA, 25 bp, Mus musculus
ctggtggcccttctgaggacagaac

SEQ ID NO: 619700 - DNA, 25 bp, Mus musculus
ctggtggcccttgcttaataaagat

SEQ ID NO: 619701 - DNA, 25 bp, Mus musculus
ctggtggcccttgtgaggacagaac

SEQ ID NO: 619702 - DNA, 25 bp, Mus musculus
ctggtggccgagctaccttccggat

SEQ ID NO: 619703 - DNA, 25 bp, Mus musculus
ctggtggccgaggtaccttccggat

SEQ ID NO: 619704 - DNA, 25 bp, Mus musculus
ctggtggcgttgagatctataatgg

SEQ ID NO: 619705 - DNA, 25 bp, Mus musculus
ctggtggcgttgtgatctataatgg

SEQ ID NO: 619706 - DNA, 25 bp, Mus musculus
ctggtggctattatgtgcctgcagt

SEQ ID NO: 619707 - DNA, 25 bp, Mus musculus
ctggtggctattttgtgcctgcagt

SEQ ID NO: 619708 - DNA, 25 bp, Mus musculus
ctggtggctgacatcaggcagaggg

SEQ ID NO: 619709 - DNA, 25 bp, Mus musculus
ctggtggctgacttcaggcagaggg

SEQ ID NO: 619710 - DNA, 25 bp, Mus musculus
ctggtggctgccatcacactgcgct

SEQ ID NO: 619711 - DNA, 25 bp, Mus musculus
ctggtggctgccttcacactgcgct

SEQ ID NO: 619712 - DNA, 25 bp, Mus musculus
ctggtggctgcgctgctgttcatca

SEQ ID NO: 619713 - DNA, 25 bp, Mus musculus
ctggtggctgcggtgctgttcatca

SEQ ID NO: 619714 - DNA, 25 bp, Mus musculus
ctggtgggaataaagtcctcctcct

SEQ ID NO: 619715 - DNA, 25 bp, Mus musculus
ctggtgggaatatagtcctcctcct

SEQ ID NO: 619716 - DNA, 25 bp, Mus musculus
ctggtgggagctacccacgcgcgac

SEQ ID NO: 619717 - DNA, 25 bp, Mus musculus
ctggtgggagcttcccacgcgcgac

SEQ ID NO: 619718 - DNA, 25 bp, Mus musculus
ctggtgggcatgagcccctcatctt

SEQ ID NO: 619719 - DNA, 25 bp, Mus musculus
ctggtgggcatgtgcccctcatctt

SEQ ID NO: 619720 - DNA, 25 bp, Mus musculus
ctggtgggcgctatgacaatctggt

SEQ ID NO: 619721 - DNA, 25 bp, Mus musculus
ctggtgggcgctttgacaatctggt

SEQ ID NO: 619722 - DNA, 25 bp, Mus musculus
ctggtgggtaccaccctggacacac

SEQ ID NO: 619723 - DNA, 25 bp, Mus musculus
ctggtgggtacctccctggacacac

SEQ ID NO: 619724 - DNA, 25 bp, Mus musculus
ctggtgggtcttccctgtgacagca

SEQ ID NO: 619725 - DNA, 25 bp, Mus musculus
ctggtgggtcttgcctgtgacagca

SEQ ID NO: 619726 - DNA, 25 bp, Mus musculus
ctggtggtagcacttctatactgct

SEQ ID NO: 619727 - DNA, 25 bp, Mus musculus
ctggtggtagcagttctatactgct

SEQ ID NO: 619728 - DNA, 25 bp, Mus musculus
ctggtggttcagaatgtgtccgtca

SEQ ID NO: 619729 - DNA, 25 bp, Mus musculus
ctggtggttcagtatgtgtccgtca

SEQ ID NO: 619730 - DNA, 25 bp, Mus musculus
ctggtggttggacaccaagcacctc

SEQ ID NO: 619731 - DNA, 25 bp, Mus musculus
ctggtggttggagaccaagcacctc

SEQ ID NO: 619732 - DNA, 25 bp, Mus musculus
ctggtgtaaaagagcaagtaaggac

SEQ ID NO: 619733 - DNA, 25 bp, Mus musculus
ctggtgtaaaagtgcaagtaaggac

SEQ ID NO: 619734 - DNA, 25 bp, Mus musculus
ctggtgtacgacaagtgtgatcgga

SEQ ID NO: 619735 - DNA, 25 bp, Mus musculus
ctggtgtacgactagtgtgatcgga

SEQ ID NO: 619736 - DNA, 25 bp, Mus musculus
ctggtgtcctttatagcctcctggg

SEQ ID NO: 619737 - DNA, 25 bp, Mus musculus
ctggtgtcctttttagcctcctggg

SEQ ID NO: 619738 - DNA, 25 bp, Mus musculus
ctggtgtcggtaaccatttggtggt

SEQ ID NO: 619739 - DNA, 25 bp, Mus musculus
ctggtgtcggtatccatttggtggt

SEQ ID NO: 619740 - DNA, 25 bp, Mus musculus
ctggtgtctctaccaacctgtgtga

SEQ ID NO: 619741 - DNA, 25 bp, Mus musculus
ctggtgtctctagcaacctgtgtga

SEQ ID NO: 619742 - DNA, 25 bp, Mus musculus
ctggtgtctgaaaatatgtccaaaa

SEQ ID NO: 619743 - DNA, 25 bp, Mus musculus
ctggtgtctgaatatatgtccaaaa

SEQ ID NO: 619744 - DNA, 25 bp, Mus musculus
ctggtgtcttcgacgcggcttggat

SEQ ID NO: 619745 - DNA, 25 bp, Mus musculus
ctggtgtcttcgtcgcggcttggat

SEQ ID NO: 619746 - DNA, 25 bp, Mus musculus
ctggtgtcttggcaatgcccttgga

SEQ ID NO: 619747 - DNA, 25 bp, Mus musculus
ctggtgtcttgggaatgcccttgga

SEQ ID NO: 619748 - DNA, 25 bp, Mus musculus
ctggtgtgcttacctacaaggctct

SEQ ID NO: 619749 - DNA, 25 bp, Mus musculus
ctggtgtgcttagctacaaggctct

SEQ ID NO: 619750 - DNA, 25 bp, Mus musculus
ctggtgtggcacacatggtttttaa

SEQ ID NO: 619751 - DNA, 25 bp, Mus musculus
ctggtgtggcactcatggtttttaa

SEQ ID NO: 619752 - DNA, 25 bp, Mus musculus
ctggtgtggccaaatctcagctcct

SEQ ID NO: 619753 - DNA, 25 bp, Mus musculus
ctggtgtggccatatctcagctcct

SEQ ID NO: 619754 - DNA, 25 bp, Mus musculus
ctggtgtggttccagtaagaattga

SEQ ID NO: 619755 - DNA, 25 bp, Mus musculus
ctggtgtggttcgagtaagaattga

SEQ ID NO: 619756 - DNA, 25 bp, Mus musculus
ctggtgtgtatgagctcagcctttg

SEQ ID NO: 619757 - DNA, 25 bp, Mus musculus
ctggtgtgtatgtgctcagcctttg

SEQ ID NO: 619758 - DNA, 25 bp, Mus musculus
ctggtgtgtgccatgcctagtttca

SEQ ID NO: 619759 - DNA, 25 bp, Mus musculus
ctggtgtgtgccttgcctagtttca

SEQ ID NO: 619760 - DNA, 25 bp, Mus musculus
ctggtgtgtgggcagccacccttcc

SEQ ID NO: 619761 - DNA, 25 bp, Mus musculus
ctggtgtgtggggagccacccttcc

SEQ ID NO: 619762 - DNA, 25 bp, Mus musculus
ctggtgttcagacgaaggctcccca

SEQ ID NO: 619763 - DNA, 25 bp, Mus musculus
ctggtgttcagaggaaggctcccca

SEQ ID NO: 619764 - DNA, 25 bp, Mus musculus
ctggtgtttgctatacagatgggct

SEQ ID NO: 619765 - DNA, 25 bp, Mus musculus
ctggtgtttgctttacagatgggct

SEQ ID NO: 619766 - DNA, 25 bp, Mus musculus
ctggttacatccctggcaaaggcag

SEQ ID NO: 619767 - DNA, 25 bp, Mus musculus
ctggttacatccgtggcaaaggcag

SEQ ID NO: 619768 - DNA, 25 bp, Mus musculus
ctggttaccaaactgttcacaggga

SEQ ID NO: 619769 - DNA, 25 bp, Mus musculus
ctggttaccaaagtgttcacaggga

SEQ ID NO: 619770 - DNA, 25 bp, Mus musculus
ctggttatcttgctaggtctttgcc

SEQ ID NO: 619771 - DNA, 25 bp, Mus musculus
ctggttatcttggtaggtctttgcc

SEQ ID NO: 619772 - DNA, 25 bp, Mus musculus
ctggttatgcccacagtgtactgaa

SEQ ID NO: 619773 - DNA, 25 bp, Mus musculus
ctggttatgccctcagtgtactgaa

SEQ ID NO: 619774 - DNA, 25 bp, Mus musculus
ctggttatgggaacaagcagtctaa

SEQ ID NO: 619775 - DNA, 25 bp, Mus musculus
ctggttatgggatcaagcagtctaa

SEQ ID NO: 619776 - DNA, 25 bp, Mus musculus
ctggttcagctgacagggttgctaa

SEQ ID NO: 619777 - DNA, 25 bp, Mus musculus
ctggttcagctgtcagggttgctaa

SEQ ID NO: 619778 - DNA, 25 bp, Mus musculus
ctggttcaggtgcaaagtgtcaacc

SEQ ID NO: 619779 - DNA, 25 bp, Mus musculus
ctggttcaggtggaaagtgtcaacc

SEQ ID NO: 619780 - DNA, 25 bp, Mus musculus
ctggttccacctcgtcggacttttg

SEQ ID NO: 619781 - DNA, 25 bp, Mus musculus
ctggttccacctggtcggacttttg

SEQ ID NO: 619782 - DNA, 25 bp, Mus musculus
ctggttccctctcagagaagcctgt

SEQ ID NO: 619783 - DNA, 25 bp, Mus musculus
ctggttccctctgagagaagcctgt

SEQ ID NO: 619784 - DNA, 25 bp, Mus musculus
ctggttccctgtaattaagcaggct

SEQ ID NO: 619785 - DNA, 25 bp, Mus musculus
ctggttccctgttattaagcaggct

SEQ ID NO: 619786 - DNA, 25 bp, Mus musculus
ctggttcggaccatctcttccatgg

SEQ ID NO: 619787 - DNA, 25 bp, Mus musculus
ctggttcggaccttctcttccatgg

SEQ ID NO: 619788 - DNA, 25 bp, Mus musculus
ctggttctagtcaggccacaggcct

SEQ ID NO: 619789 - DNA, 25 bp, Mus musculus
ctggttctagtctggccacaggcct

SEQ ID NO: 619790 - DNA, 25 bp, Mus musculus
ctggttctgctgctaacagctcctt

SEQ ID NO: 619791 - DNA, 25 bp, Mus musculus
ctggttctgctggtaacagctcctt

SEQ ID NO: 619792 - DNA, 25 bp, Mus musculus
ctggttgcagaactgcctaaagagc

SEQ ID NO: 619793 - DNA, 25 bp, Mus musculus
ctggttgcagaagtgcctaaagagc

SEQ ID NO: 619794 - DNA, 25 bp, Mus musculus
ctggttggcgtgctggctactctca

SEQ ID NO: 619795 - DNA, 25 bp, Mus musculus
ctggttggcgtggtggctactctca

SEQ ID NO: 619796 - DNA, 25 bp, Mus musculus
ctggttgtacgaagggcccacgctc

SEQ ID NO: 619797 - DNA, 25 bp, Mus musculus
ctggttgtacgatgggcccacgctc

SEQ ID NO: 619798 - DNA, 25 bp, Mus musculus
ctggttgtatggagacaaaattctt

SEQ ID NO: 619799 - DNA, 25 bp, Mus musculus
ctggttgtatggtgacaaaattctt

SEQ ID NO: 619800 - DNA, 25 bp, Mus musculus
ctggttgtcattcgccagtctacag

SEQ ID NO: 619801 - DNA, 25 bp, Mus musculus
ctggttgtcattggccagtctacag

SEQ ID NO: 619802 - DNA, 25 bp, Mus musculus
ctggtttcatacaggcaaatggttc

SEQ ID NO: 619803 - DNA, 25 bp, Mus musculus
ctggtttcatactggcaaatggttc

SEQ ID NO: 619804 - DNA, 25 bp, Mus musculus
ctggtttccagccaagtttgtggag

SEQ ID NO: 619805 - DNA, 25 bp, Mus musculus
ctggtttccagcgaagtttgtggag

SEQ ID NO: 619806 - DNA, 25 bp, Mus musculus
ctggtttccaggagacagacacgat

SEQ ID NO: 619807 - DNA, 25 bp, Mus musculus
ctggtttccaggtgacagacacgat

SEQ ID NO: 619808 - DNA, 25 bp, Mus musculus
ctggtttcgtgaaggagtgttcaca

SEQ ID NO: 619809 - DNA, 25 bp, Mus musculus
ctggtttcgtgatggagtgttcaca

SEQ ID NO: 619810 - DNA, 25 bp, Mus musculus
ctggtttggaagaccaaaagtgagc

SEQ ID NO: 619811 - DNA, 25 bp, Mus musculus
ctggtttggaagtccaaaagtgagc

SEQ ID NO: 619812 - DNA, 25 bp, Mus musculus
ctggttttcatcactaaagggctct

SEQ ID NO: 619813 - DNA, 25 bp, Mus musculus
ctggttttcatctctaaagggctct

SEQ ID NO: 619814 - DNA, 25 bp, Mus musculus
ctgtaaagcagaagaactgggcagg

SEQ ID NO: 619815 - DNA, 25 bp, Mus musculus
ctgtaaagcagatgaactgggcagg

SEQ ID NO: 619816 - DNA, 25 bp, Mus musculus
ctgtaaatcggaagctccaacaggg

SEQ ID NO: 619817 - DNA, 25 bp, Mus musculus
ctgtaaatcggatgctccaacaggg

SEQ ID NO: 619818 - DNA, 25 bp, Mus musculus
ctgtaacaacatccggcaactgctg

SEQ ID NO: 619819 - DNA, 25 bp, Mus musculus
ctgtaacaacatgcggcaactgctg

SEQ ID NO: 619820 - DNA, 25 bp, Mus musculus
ctgtaacatctgcagagtgtgtgca

SEQ ID NO: 619821 - DNA, 25 bp, Mus musculus
ctgtaacatctggagagtgtgtgca

SEQ ID NO: 619822 - DNA, 25 bp, Mus musculus
ctgtaaccattgaccagccatcatc

SEQ ID NO: 619823 - DNA, 25 bp, Mus musculus
ctgtaaccattgtccagccatcatc

SEQ ID NO: 619824 - DNA, 25 bp, Mus musculus
ctgtaacgagaacgctagtggattt

SEQ ID NO: 619825 - DNA, 25 bp, Mus musculus
ctgtaacgagaaggctagtggattt

SEQ ID NO: 619826 - DNA, 25 bp, Mus musculus
ctgtaactgcgcagatcagtttgtc

SEQ ID NO: 619827 - DNA, 25 bp, Mus musculus
ctgtaactgcgctgatcagtttgtc

SEQ ID NO: 619828 - DNA, 25 bp, Mus musculus
ctgtaagaaatgattgttcaaaaag

SEQ ID NO: 619829 - DNA, 25 bp, Mus musculus
ctgtaagaaatgtttgttcaaaaag

SEQ ID NO: 619830 - DNA, 25 bp, Mus musculus
ctgtaagagaagagatcgagagcaa

SEQ ID NO: 619831 - DNA, 25 bp, Mus musculus
ctgtaagagaagtgatcgagagcaa

SEQ ID NO: 619832 - DNA, 25 bp, Mus musculus
ctgtaaggacaaacgcggagctgct

SEQ ID NO: 619833 - DNA, 25 bp, Mus musculus
ctgtaaggacaatcgcggagctgct

SEQ ID NO: 619834 - DNA, 25 bp, Mus musculus
ctgtaattagttaccaatcacctgg

SEQ ID NO: 619835 - DNA, 25 bp, Mus musculus
ctgtaattagtttccaatcacctgg

SEQ ID NO: 619836 - DNA, 25 bp, Mus musculus
ctgtacacagccctgctgtgcggaa

SEQ ID NO: 619837 - DNA, 25 bp, Mus musculus
ctgtacacagccgtgctgtgcggaa

SEQ ID NO: 619838 - DNA, 25 bp, Mus musculus
ctgtacagaaacactctgaaagaat

SEQ ID NO: 619839 - DNA, 25 bp, Mus musculus
ctgtacagaaactctctgaaagaat

SEQ ID NO: 619840 - DNA, 25 bp, Mus musculus
ctgtacatggaaccacaaagtgatc

SEQ ID NO: 619841 - DNA, 25 bp, Mus musculus
ctgtacatggaagcacaaagtgatc

SEQ ID NO: 619842 - DNA, 25 bp, Mus musculus
ctgtaccagcggaaagagcctgtta

SEQ ID NO: 619843 - DNA, 25 bp, Mus musculus
ctgtaccagcggtaagagcctgtta

SEQ ID NO: 619844 - DNA, 25 bp, Mus musculus
ctgtaccatgtgagatgtgacaaag

SEQ ID NO: 619845 - DNA, 25 bp, Mus musculus
ctgtaccatgtgtgatgtgacaaag

SEQ ID NO: 619846 - DNA, 25 bp, Mus musculus
ctgtacccatgaagaggatgccggg

SEQ ID NO: 619847 - DNA, 25 bp, Mus musculus
ctgtacccatgatgaggatgccggg

SEQ ID NO: 619848 - DNA, 25 bp, Mus musculus
ctgtacccttgcagggcggagcgct

SEQ ID NO: 619849 - DNA, 25 bp, Mus musculus
ctgtacccttgctgggcggagcgct

SEQ ID NO: 619850 - DNA, 25 bp, Mus musculus
ctgtacctgctgctgagaaagtcct

SEQ ID NO: 619851 - DNA, 25 bp, Mus musculus
ctgtacctgctggtgagaaagtcct

SEQ ID NO: 619852 - DNA, 25 bp, Mus musculus
ctgtacctggagagccaggaagatg

SEQ ID NO: 619853 - DNA, 25 bp, Mus musculus
ctgtacctggagtgccaggaagatg

SEQ ID NO: 619854 - DNA, 25 bp, Mus musculus
ctgtaccttcctatcctctgctgag

SEQ ID NO: 619855 - DNA, 25 bp, Mus musculus
ctgtaccttcctttcctctgctgag

SEQ ID NO: 619856 - DNA, 25 bp, Mus musculus
ctgtacgccttgagccgcctgggtg

SEQ ID NO: 619857 - DNA, 25 bp, Mus musculus
ctgtacgccttgtgccgcctgggtg

SEQ ID NO: 619858 - DNA, 25 bp, Mus musculus
ctgtacggcaccaatgagaaggagc

SEQ ID NO: 619859 - DNA, 25 bp, Mus musculus
ctgtacggcacctatgagaaggagc

SEQ ID NO: 619860 - DNA, 25 bp, Mus musculus
ctgtacggccgcaggtaggtctcca

SEQ ID NO: 619861 - DNA, 25 bp, Mus musculus
ctgtacggccgctggtaggtctcca

SEQ ID NO: 619862 - DNA, 25 bp, Mus musculus
ctgtactccatgagcagatgaagga

SEQ ID NO: 619863 - DNA, 25 bp, Mus musculus
ctgtactccatgtgcagatgaagga

SEQ ID NO: 619864 - DNA, 25 bp, Mus musculus
ctgtactctactccttcctgaatgg

SEQ ID NO: 619865 - DNA, 25 bp, Mus musculus
ctgtactctactgcttcctgaatgg

SEQ ID NO: 619866 - DNA, 25 bp, Mus musculus
ctgtactggctgacatcttccagcg

SEQ ID NO: 619867 - DNA, 25 bp, Mus musculus
ctgtactggctgtcatcttccagcg

SEQ ID NO: 619868 - DNA, 25 bp, Mus musculus
ctgtacttcgagaccgacgcagcca

SEQ ID NO: 619869 - DNA, 25 bp, Mus musculus
ctgtacttcgagtccgacgcagcca

SEQ ID NO: 619870 - DNA, 25 bp, Mus musculus
ctgtagaaacggaggagcgtgcatt

SEQ ID NO: 619871 - DNA, 25 bp, Mus musculus
ctgtagaaacggtggagcgtgcatt

SEQ ID NO: 619872 - DNA, 25 bp, Mus musculus
ctgtagacctctaccgtaatgcggg

SEQ ID NO: 619873 - DNA, 25 bp, Mus musculus
ctgtagacctcttccgtaatgcggg

SEQ ID NO: 619874 - DNA, 25 bp, Mus musculus
ctgtagcacaggatggccatgggcc

SEQ ID NO: 619875 - DNA, 25 bp, Mus musculus
ctgtagcacaggttggccatgggcc

SEQ ID NO: 619876 - DNA, 25 bp, Mus musculus
ctgtagcaggctacactcggttccc

SEQ ID NO: 619877 - DNA, 25 bp, Mus musculus
ctgtagcaggcttcactcggttccc

SEQ ID NO: 619878 - DNA, 25 bp, Mus musculus
ctgtagcatcctcgctattcccgga

SEQ ID NO: 619879 - DNA, 25 bp, Mus musculus
ctgtagcatcctggctattcccgga

SEQ ID NO: 619880 - DNA, 25 bp, Mus musculus
ctgtagctttatcggacctgcgtaa

SEQ ID NO: 619881 - DNA, 25 bp, Mus musculus
ctgtagctttatgggacctgcgtaa

SEQ ID NO: 619882 - DNA, 25 bp, Mus musculus
ctgtaggagcatcggccatgtattc

SEQ ID NO: 619883 - DNA, 25 bp, Mus musculus
ctgtaggagcatgggccatgtattc

SEQ ID NO: 619884 - DNA, 25 bp, Mus musculus
ctgtaggcctctccttttatcttgg

SEQ ID NO: 619885 - DNA, 25 bp, Mus musculus
ctgtaggcctctgcttttatcttgg

SEQ ID NO: 619886 - DNA, 25 bp, Mus musculus
ctgtaggtcggtctgcttggcctct

SEQ ID NO: 619887 - DNA, 25 bp, Mus musculus
ctgtaggtcggtgtgcttggcctct

SEQ ID NO: 619888 - DNA, 25 bp, Mus musculus
ctgtagtagaagagcgtcgacggaa

SEQ ID NO: 619889 - DNA, 25 bp, Mus musculus
ctgtagtagaagtgcgtcgacggaa

SEQ ID NO: 619890 - DNA, 25 bp, Mus musculus
ctgtagtctttgaatccatccattc

SEQ ID NO: 619891 - DNA, 25 bp, Mus musculus
ctgtagtctttgtatccatccattc

SEQ ID NO: 619892 - DNA, 25 bp, Mus musculus
ctgtagtgacttacatgacgaagac

SEQ ID NO: 619893 - DNA, 25 bp, Mus musculus
ctgtagtgactttcatgacgaagac

SEQ ID NO: 619894 - DNA, 25 bp, Mus musculus
ctgtatacaaatcagtacgtggcta

SEQ ID NO: 619895 - DNA, 25 bp, Mus musculus
ctgtatacaaatgagtacgtggcta

SEQ ID NO: 619896 - DNA, 25 bp, Mus musculus
ctgtatagaaatcgtgacatcacta

SEQ ID NO: 619897 - DNA, 25 bp, Mus musculus
ctgtatagaaatggtgacatcacta

SEQ ID NO: 619898 - DNA, 25 bp, Mus musculus
ctgtatataaggagccgcatccgcc

SEQ ID NO: 619899 - DNA, 25 bp, Mus musculus
ctgtatataaggtgccgcatccgcc

SEQ ID NO: 619900 - DNA, 25 bp, Mus musculus
ctgtatatccgacgactgcagccag

SEQ ID NO: 619901 - DNA, 25 bp, Mus musculus
ctgtatatccgaggactgcagccag

SEQ ID NO: 619902 - DNA, 25 bp, Mus musculus
ctgtatcaagaaactagagaaggag

SEQ ID NO: 619903 - DNA, 25 bp, Mus musculus
ctgtatcaagaatctagagaaggag

SEQ ID NO: 619904 - DNA, 25 bp, Mus musculus
ctgtatcaatacagataaagttaga

SEQ ID NO: 619905 - DNA, 25 bp, Mus musculus
ctgtatcaatactgataaagttaga

SEQ ID NO: 619906 - DNA, 25 bp, Mus musculus
ctgtatcagcatccagtggtttaga

SEQ ID NO: 619907 - DNA, 25 bp, Mus musculus
ctgtatcagcatgcagtggtttaga

SEQ ID NO: 619908 - DNA, 25 bp, Mus musculus
ctgtatcagcgccagcgagagcaag

SEQ ID NO: 619909 - DNA, 25 bp, Mus musculus
ctgtatcagcgcgagcgagagcaag

SEQ ID NO: 619910 - DNA, 25 bp, Mus musculus
ctgtatcagggaaggagagtacctc

SEQ ID NO: 619911 - DNA, 25 bp, Mus musculus
ctgtatcagggatggagagtacctc

SEQ ID NO: 619912 - DNA, 25 bp, Mus musculus
ctgtatccttcacgatgagccggca

SEQ ID NO: 619913 - DNA, 25 bp, Mus musculus
ctgtatccttcaggatgagccggca

SEQ ID NO: 619914 - DNA, 25 bp, Mus musculus
ctgtatctaatgaatctcaagcctt

SEQ ID NO: 619915 - DNA, 25 bp, Mus musculus
ctgtatctaatgtatctcaagcctt

SEQ ID NO: 619916 - DNA, 25 bp, Mus musculus
ctgtatgacactatctctgcctttg

SEQ ID NO: 619917 - DNA, 25 bp, Mus musculus
ctgtatgacactttctctgcctttg

SEQ ID NO: 619918 - DNA, 25 bp, Mus musculus
ctgtatgcgcctctgacagccctga

SEQ ID NO: 619919 - DNA, 25 bp, Mus musculus
ctgtatgcgcctgtgacagccctga

SEQ ID NO: 619920 - DNA, 25 bp, Mus musculus
ctgtatggcacacctgatggctgtg

SEQ ID NO: 619921 - DNA, 25 bp, Mus musculus
ctgtatggcacagctgatggctgtg

SEQ ID NO: 619922 - DNA, 25 bp, Mus musculus
ctgtatgtggaacacggtctgatta

SEQ ID NO: 619923 - DNA, 25 bp, Mus musculus
ctgtatgtggaagacggtctgatta

SEQ ID NO: 619924 - DNA, 25 bp, Mus musculus
ctgtattggcaaatgctggagaaga

SEQ ID NO: 619925 - DNA, 25 bp, Mus musculus
ctgtattggcaattgctggagaaga

SEQ ID NO: 619926 - DNA, 25 bp, Mus musculus
ctgtcaaagctgaacaagctaattg

SEQ ID NO: 619927 - DNA, 25 bp, Mus musculus
ctgtcaaagctgtacaagctaattg

SEQ ID NO: 619928 - DNA, 25 bp, Mus musculus
ctgtcaacggctcttgaatgagggc

SEQ ID NO: 619929 - DNA, 25 bp, Mus musculus
ctgtcaacggctgttgaatgagggc

SEQ ID NO: 619930 - DNA, 25 bp, Mus musculus
ctgtcaactgtcacgactctccgag

SEQ ID NO: 619931 - DNA, 25 bp, Mus musculus
ctgtcaactgtctcgactctccgag

SEQ ID NO: 619932 - DNA, 25 bp, Mus musculus
ctgtcaagtactccagtcatagtat

SEQ ID NO: 619933 - DNA, 25 bp, Mus musculus
ctgtcaagtactgcagtcatagtat

SEQ ID NO: 619934 - DNA, 25 bp, Mus musculus
ctgtcaatattgctgctcagatggg

SEQ ID NO: 619935 - DNA, 25 bp, Mus musculus
ctgtcaatattggtgctcagatggg

SEQ ID NO: 619936 - DNA, 25 bp, Mus musculus
ctgtcacaagtaccctcggaagcac

SEQ ID NO: 619937 - DNA, 25 bp, Mus musculus
ctgtcacaagtagcctcggaagcac

SEQ ID NO: 619938 - DNA, 25 bp, Mus musculus
ctgtcacagtcaagaaagaagtcca

SEQ ID NO: 619939 - DNA, 25 bp, Mus musculus
ctgtcacagtcatgaaagaagtcca

SEQ ID NO: 619940 - DNA, 25 bp, Mus musculus
ctgtcacattcgaggttagttcaac

SEQ ID NO: 619941 - DNA, 25 bp, Mus musculus
ctgtcacattcgtggttagttcaac

SEQ ID NO: 619942 - DNA, 25 bp, Mus musculus
ctgtcaccaggcagttctacgctgc

SEQ ID NO: 619943 - DNA, 25 bp, Mus musculus
ctgtcaccaggctgttctacgctgc

SEQ ID NO: 619944 - DNA, 25 bp, Mus musculus
ctgtcaccatccaggcactatttga

SEQ ID NO: 619945 - DNA, 25 bp, Mus musculus
ctgtcaccatcctggcactatttga

SEQ ID NO: 619946 - DNA, 25 bp, Mus musculus
ctgtcacccaataccaagaggaacc

SEQ ID NO: 619947 - DNA, 25 bp, Mus musculus
ctgtcacccaattccaagaggaacc

SEQ ID NO: 619948 - DNA, 25 bp, Mus musculus
ctgtcaccggtgcaacactgcctgt

SEQ ID NO: 619949 - DNA, 25 bp, Mus musculus
ctgtcaccggtggaacactgcctgt

SEQ ID NO: 619950 - DNA, 25 bp, Mus musculus
ctgtcaccgtagcagatttcccaga

SEQ ID NO: 619951 - DNA, 25 bp, Mus musculus
ctgtcaccgtaggagatttcccaga

SEQ ID NO: 619952 - DNA, 25 bp, Mus musculus
ctgtcacggacaaagatcagcccca

SEQ ID NO: 619953 - DNA, 25 bp, Mus musculus
ctgtcacggacatagatcagcccca

SEQ ID NO: 619954 - DNA, 25 bp, Mus musculus
ctgtcacggtgtcgacgccgagctc

SEQ ID NO: 619955 - DNA, 25 bp, Mus musculus
ctgtcacggtgtggacgccgagctc

SEQ ID NO: 619956 - DNA, 25 bp, Mus musculus
ctgtcacgtggacgctcctggccaa

SEQ ID NO: 619957 - DNA, 25 bp, Mus musculus
ctgtcacgtggaggctcctggccaa

SEQ ID NO: 619958 - DNA, 25 bp, Mus musculus
ctgtcactgacacggctgagtcagc

SEQ ID NO: 619959 - DNA, 25 bp, Mus musculus
ctgtcactgacagggctgagtcagc

SEQ ID NO: 619960 - DNA, 25 bp, Mus musculus
ctgtcactgtcgatcttatcgtggg

SEQ ID NO: 619961 - DNA, 25 bp, Mus musculus
ctgtcactgtcgttcttatcgtggg

SEQ ID NO: 619962 - DNA, 25 bp, Mus musculus
ctgtcactgtctcaggttaaaaaaa

SEQ ID NO: 619963 - DNA, 25 bp, Mus musculus
ctgtcactgtctgaggttaaaaaaa

SEQ ID NO: 619964 - DNA, 25 bp, Mus musculus
ctgtcagaacttatcgatatcagca

SEQ ID NO: 619965 - DNA, 25 bp, Mus musculus
ctgtcagaacttttcgatatcagca

SEQ ID NO: 619966 - DNA, 25 bp, Mus musculus
ctgtcagatataaaatcccactcca

SEQ ID NO: 619967 - DNA, 25 bp, Mus musculus
ctgtcagatatataatcccactcca

SEQ ID NO: 619968 - DNA, 25 bp, Mus musculus
ctgtcagatgagcaggccccactga

SEQ ID NO: 619969 - DNA, 25 bp, Mus musculus
ctgtcagatgaggaggccccactga

SEQ ID NO: 619970 - DNA, 25 bp, Mus musculus
ctgtcagccaatcagaataatattg

SEQ ID NO: 619971 - DNA, 25 bp, Mus musculus
ctgtcagccaatgagaataatattg

SEQ ID NO: 619972 - DNA, 25 bp, Mus musculus
ctgtcagcggtgactcagtggccca

SEQ ID NO: 619973 - DNA, 25 bp, Mus musculus
ctgtcagcggtgtctcagtggccca

SEQ ID NO: 619974 - DNA, 25 bp, Mus musculus
ctgtcagctccaccggcggtggtat

SEQ ID NO: 619975 - DNA, 25 bp, Mus musculus
ctgtcagctccagcggcggtggtat

SEQ ID NO: 619976 - DNA, 25 bp, Mus musculus
ctgtcagctcgaatgcggcagcacc

SEQ ID NO: 619977 - DNA, 25 bp, Mus musculus
ctgtcagctcgattgcggcagcacc

SEQ ID NO: 619978 - DNA, 25 bp, Mus musculus
ctgtcaggagagaggaggtccttcc

SEQ ID NO: 619979 - DNA, 25 bp, Mus musculus
ctgtcaggagagtggaggtccttcc

SEQ ID NO: 619980 - DNA, 25 bp, Mus musculus
ctgtcaggaggcagggccacacgct

SEQ ID NO: 619981 - DNA, 25 bp, Mus musculus
ctgtcaggaggctgggccacacgct

SEQ ID NO: 619982 - DNA, 25 bp, Mus musculus
ctgtcagtcatcagtgtggtcctgg

SEQ ID NO: 619983 - DNA, 25 bp, Mus musculus
ctgtcagtcatctgtgtggtcctgg

SEQ ID NO: 619984 - DNA, 25 bp, Mus musculus
ctgtcataaaccactacaacgtggc

SEQ ID NO: 619985 - DNA, 25 bp, Mus musculus
ctgtcataaacctctacaacgtggc

SEQ ID NO: 619986 - DNA, 25 bp, Mus musculus
ctgtcataaactcattatcagtgga

SEQ ID NO: 619987 - DNA, 25 bp, Mus musculus
ctgtcataaactgattatcagtgga

SEQ ID NO: 619988 - DNA, 25 bp, Mus musculus
ctgtcataacttctccgggaaaagg

SEQ ID NO: 619989 - DNA, 25 bp, Mus musculus
ctgtcataacttgtccgggaaaagg

SEQ ID NO: 619990 - DNA, 25 bp, Mus musculus
ctgtcatcaaggctcggaagctgtc

SEQ ID NO: 619991 - DNA, 25 bp, Mus musculus
ctgtcatcaagggtcggaagctgtc

SEQ ID NO: 619992 - DNA, 25 bp, Mus musculus
ctgtcatccattagagcggtaatca

SEQ ID NO: 619993 - DNA, 25 bp, Mus musculus
ctgtcatccatttgagcggtaatca

SEQ ID NO: 619994 - DNA, 25 bp, Mus musculus
ctgtcatcccatccaacaatgagaa

SEQ ID NO: 619995 - DNA, 25 bp, Mus musculus
ctgtcatcccatgcaacaatgagaa

SEQ ID NO: 619996 - DNA, 25 bp, Mus musculus
ctgtcatggatcaaacatgctgtcc

SEQ ID NO: 619997 - DNA, 25 bp, Mus musculus
ctgtcatggatctaacatgctgtcc

SEQ ID NO: 619998 - DNA, 25 bp, Mus musculus
ctgtcattaaacaagctgtacaaag

SEQ ID NO: 619999 - DNA, 25 bp, Mus musculus
ctgtcattaaactagctgtacaaag

SEQ ID NO: 620000 - DNA, 25 bp, Mus musculus
ctgtccaaggtacccggtgaagaag

SEQ ID NO: 620001 - DNA, 25 bp, Mus musculus
ctgtccaaggtagccggtgaagaag

SEQ ID NO: 620002 - DNA, 25 bp, Mus musculus
ctgtccaccatgattgacgggagtg

SEQ ID NO: 620003 - DNA, 25 bp, Mus musculus
ctgtccaccatgctctccagttatg

SEQ ID NO: 620004 - DNA, 25 bp, Mus musculus
ctgtccaccatggtctccagttatg

SEQ ID NO: 620005 - DNA, 25 bp, Mus musculus
ctgtccaccatgtttgacgggagtg

SEQ ID NO: 620006 - DNA, 25 bp, Mus musculus
ctgtccacggtgctgaacatcatta

SEQ ID NO: 620007 - DNA, 25 bp, Mus musculus
ctgtccacggtggtgaacatcatta

SEQ ID NO: 620008 - DNA, 25 bp, Mus musculus
ctgtccagaggcactgatcgggaca

SEQ ID NO: 620009 - DNA, 25 bp, Mus musculus
ctgtccagaggctctgatcgggaca

SEQ ID NO: 620010 - DNA, 25 bp, Mus musculus
ctgtccagcgaacgagcaagccagc

SEQ ID NO: 620011 - DNA, 25 bp, Mus musculus
ctgtccagcgaaggagcaagccagc

SEQ ID NO: 620012 - DNA, 25 bp, Mus musculus
ctgtccagctgcagggaaccccatg

SEQ ID NO: 620013 - DNA, 25 bp, Mus musculus
ctgtccagctgctgggaaccccatg

SEQ ID NO: 620014 - DNA, 25 bp, Mus musculus
ctgtccagggtcagtatggagcagt

SEQ ID NO: 620015 - DNA, 25 bp, Mus musculus
ctgtccagggtctgtatggagcagt

SEQ ID NO: 620016 - DNA, 25 bp, Mus musculus
ctgtccagtgcaatgtctgctgcga

SEQ ID NO: 620017 - DNA, 25 bp, Mus musculus
ctgtccagtgcattgtctgctgcga

SEQ ID NO: 620018 - DNA, 25 bp, Mus musculus
ctgtcccagccgatctctctggagg

SEQ ID NO: 620019 - DNA, 25 bp, Mus musculus
ctgtcccagccgttctctctggagg

SEQ ID NO: 620020 - DNA, 25 bp, Mus musculus
ctgtcccaggtgcagtgcctgatca

SEQ ID NO: 620021 - DNA, 25 bp, Mus musculus
ctgtcccaggtggagtgcctgatca

SEQ ID NO: 620022 - DNA, 25 bp, Mus musculus
ctgtccccagggacatcggttggtg

SEQ ID NO: 620023 - DNA, 25 bp, Mus musculus
ctgtccccagggtcatcggttggtg

SEQ ID NO: 620024 - DNA, 25 bp, Mus musculus
ctgtccctatttaccaacttgcaaa

SEQ ID NO: 620025 - DNA, 25 bp, Mus musculus
ctgtccctattttccaacttgcaaa

SEQ ID NO: 620026 - DNA, 25 bp, Mus musculus
ctgtccctcaagagagtgactttac

SEQ ID NO: 620027 - DNA, 25 bp, Mus musculus
ctgtccctcaagtgagtgactttac

SEQ ID NO: 620028 - DNA, 25 bp, Mus musculus
ctgtccgaaatgatgcccggtgttg

SEQ ID NO: 620029 - DNA, 25 bp, Mus musculus
ctgtccgaaatgttgcccggtgttg

SEQ ID NO: 620030 - DNA, 25 bp, Mus musculus
ctgtccgagcccagggcgggataca

SEQ ID NO: 620031 - DNA, 25 bp, Mus musculus
ctgtccgagccctgggcgggataca

SEQ ID NO: 620032 - DNA, 25 bp, Mus musculus
ctgtcctactacagcagctgctgga

SEQ ID NO: 620033 - DNA, 25 bp, Mus musculus
ctgtcctactactgcagctgctgga

SEQ ID NO: 620034 - DNA, 25 bp, Mus musculus
ctgtcctcacggcagctgctgtggc

SEQ ID NO: 620035 - DNA, 25 bp, Mus musculus
ctgtcctcacgggagctgctgtggc

SEQ ID NO: 620036 - DNA, 25 bp, Mus musculus
ctgtcctccccgaggagaagcactt

SEQ ID NO: 620037 - DNA, 25 bp, Mus musculus
ctgtcctccccgtggagaagcactt

SEQ ID NO: 620038 - DNA, 25 bp, Mus musculus
ctgtcctcctttagtttggcagctc

SEQ ID NO: 620039 - DNA, 25 bp, Mus musculus
ctgtcctccttttgtttggcagctc

SEQ ID NO: 620040 - DNA, 25 bp, Mus musculus
ctgtcctcgttcatgcgcgtggtgg

SEQ ID NO: 620041 - DNA, 25 bp, Mus musculus
ctgtcctcgttcttgcgcgtggtgg

SEQ ID NO: 620042 - DNA, 25 bp, Mus musculus
ctgtcctctcatcagggacctcaag

SEQ ID NO: 620043 - DNA, 25 bp, Mus musculus
ctgtcctctcatgagggacctcaag

SEQ ID NO: 620044 - DNA, 25 bp, Mus musculus
ctgtcctgactgcaatctgctgtgt

SEQ ID NO: 620045 - DNA, 25 bp, Mus musculus
ctgtcctgactggaatctgctgtgt

SEQ ID NO: 620046 - DNA, 25 bp, Mus musculus
ctgtcctgcacaagccaggtgcttc

SEQ ID NO: 620047 - DNA, 25 bp, Mus musculus
ctgtcctgcacatgccaggtgcttc

SEQ ID NO: 620048 - DNA, 25 bp, Mus musculus
ctgtcctgggcgacccggaacgaag

SEQ ID NO: 620049 - DNA, 25 bp, Mus musculus
ctgtcctgggcgtcccggaacgaag

SEQ ID NO: 620050 - DNA, 25 bp, Mus musculus
ctgtccttcctgcagggctgcaggt

SEQ ID NO: 620051 - DNA, 25 bp, Mus musculus
ctgtccttcctggagggctgcaggt

SEQ ID NO: 620052 - DNA, 25 bp, Mus musculus
ctgtccttgcagcaggccataatca

SEQ ID NO: 620053 - DNA, 25 bp, Mus musculus
ctgtccttgcaggaggccataatca

SEQ ID NO: 620054 - DNA, 25 bp, Mus musculus
ctgtccttggtgattggttccatcc

SEQ ID NO: 620055 - DNA, 25 bp, Mus musculus
ctgtccttggtgtttggttccatcc

SEQ ID NO: 620056 - DNA, 25 bp, Mus musculus
ctgtcgatgcccctgaacgggctga

SEQ ID NO: 620057 - DNA, 25 bp, Mus musculus
ctgtcgatgcccgtgaacgggctga

SEQ ID NO: 620058 - DNA, 25 bp, Mus musculus
ctgtcgcctgtcaagaagggaagtc

SEQ ID NO: 620059 - DNA, 25 bp, Mus musculus
ctgtcgcctgtctagaagggaagtc

SEQ ID NO: 620060 - DNA, 25 bp, Mus musculus
ctgtcgctcatccagggcctggtgt

SEQ ID NO: 620061 - DNA, 25 bp, Mus musculus
ctgtcgctcatcgagggcctggtgt

SEQ ID NO: 620062 - DNA, 25 bp, Mus musculus
ctgtcgctgttcatccaggtggcat

SEQ ID NO: 620063 - DNA, 25 bp, Mus musculus
ctgtcgctgttcttccaggtggcat

SEQ ID NO: 620064 - DNA, 25 bp, Mus musculus
ctgtcggctcaacaagtgcttccgg

SEQ ID NO: 620065 - DNA, 25 bp, Mus musculus
ctgtcggctcaagaagtgcttccgg

SEQ ID NO: 620066 - DNA, 25 bp, Mus musculus
ctgtcggtgcccacgttcacacagg

SEQ ID NO: 620067 - DNA, 25 bp, Mus musculus
ctgtcggtgccctcgttcacacagg

SEQ ID NO: 620068 - DNA, 25 bp, Mus musculus
ctgtcgtgggagaattgccgcctga

SEQ ID NO: 620069 - DNA, 25 bp, Mus musculus
ctgtcgtgggagtattgccgcctga

SEQ ID NO: 620070 - DNA, 25 bp, Mus musculus
ctgtcgtttatgctgcgcgccgcga

SEQ ID NO: 620071 - DNA, 25 bp, Mus musculus
ctgtcgtttatggtgcgcgccgcga

SEQ ID NO: 620072 - DNA, 25 bp, Mus musculus
ctgtctaagaaacctgccacactgc

SEQ ID NO: 620073 - DNA, 25 bp, Mus musculus
ctgtctaagaaagctgccacactgc

SEQ ID NO: 620074 - DNA, 25 bp, Mus musculus
ctgtctacttgcacctggagctgga

SEQ ID NO: 620075 - DNA, 25 bp, Mus musculus
ctgtctacttgctcctggagctgga

SEQ ID NO: 620076 - DNA, 25 bp, Mus musculus
ctgtctcagcagatcaacatgaacc

SEQ ID NO: 620077 - DNA, 25 bp, Mus musculus
ctgtctcagcagttcaacatgaacc

SEQ ID NO: 620078 - DNA, 25 bp, Mus musculus
ctgtctcaggaactgagcagtccag

SEQ ID NO: 620079 - DNA, 25 bp, Mus musculus
ctgtctcaggaagtgagcagtccag

SEQ ID NO: 620080 - DNA, 25 bp, Mus musculus
ctgtctcccttgacccaggtacagt

SEQ ID NO: 620081 - DNA, 25 bp, Mus musculus
ctgtctcccttgtcccaggtacagt

SEQ ID NO: 620082 - DNA, 25 bp, Mus musculus
ctgtctccgagaaagccaagggcct

SEQ ID NO: 620083 - DNA, 25 bp, Mus musculus
ctgtctccgagatagccaagggcct

SEQ ID NO: 620084 - DNA, 25 bp, Mus musculus
ctgtctccgtcaacaagcatactga

SEQ ID NO: 620085 - DNA, 25 bp, Mus musculus
ctgtctccgtcatcaagcatactga

SEQ ID NO: 620086 - DNA, 25 bp, Mus musculus
ctgtctccgtggccgtgggctctct

SEQ ID NO: 620087 - DNA, 25 bp, Mus musculus
ctgtctccgtgggcgtgggctctct

SEQ ID NO: 620088 - DNA, 25 bp, Mus musculus
ctgtctcgagagctgaagacactct

SEQ ID NO: 620089 - DNA, 25 bp, Mus musculus
ctgtctcgagaggtgaagacactct

SEQ ID NO: 620090 - DNA, 25 bp, Mus musculus
ctgtctctaaggcatgggccgagct

SEQ ID NO: 620091 - DNA, 25 bp, Mus musculus
ctgtctctaagggatgggccgagct

SEQ ID NO: 620092 - DNA, 25 bp, Mus musculus
ctgtctctacagaagcacctggagg

SEQ ID NO: 620093 - DNA, 25 bp, Mus musculus
ctgtctctacagtagcacctggagg

SEQ ID NO: 620094 - DNA, 25 bp, Mus musculus
ctgtctgaacttagattttatcggc

SEQ ID NO: 620095 - DNA, 25 bp, Mus musculus
ctgtctgaactttgattttatcggc

SEQ ID NO: 620096 - DNA, 25 bp, Mus musculus
ctgtctgaggatcagttaagctctt

SEQ ID NO: 620097 - DNA, 25 bp, Mus musculus
ctgtctgaggatgagttaagctctt

SEQ ID NO: 620098 - DNA, 25 bp, Mus musculus
ctgtctgatgagagcaattgagatc

SEQ ID NO: 620099 - DNA, 25 bp, Mus musculus
ctgtctgatgagtgcaattgagatc

SEQ ID NO: 620100 - DNA, 25 bp, Mus musculus
ctgtctgcatagaccggcgtcattt

SEQ ID NO: 620101 - DNA, 25 bp, Mus musculus
ctgtctgcatagtccggcgtcattt

SEQ ID NO: 620102 - DNA, 25 bp, Mus musculus
ctgtctgccatcctggtcccgctca

SEQ ID NO: 620103 - DNA, 25 bp, Mus musculus
ctgtctgccatcgtggtcccgctca

SEQ ID NO: 620104 - DNA, 25 bp, Mus musculus
ctgtctggaagcacacaaagaagtt

SEQ ID NO: 620105 - DNA, 25 bp, Mus musculus
ctgtctggaagctcacaaagaagtt

SEQ ID NO: 620106 - DNA, 25 bp, Mus musculus
ctgtctggcctaacttgctgctcag

SEQ ID NO: 620107 - DNA, 25 bp, Mus musculus
ctgtctggcctatcttgctgctcag

SEQ ID NO: 620108 - DNA, 25 bp, Mus musculus
ctgtctggccttaagcgcttcatcc

SEQ ID NO: 620109 - DNA, 25 bp, Mus musculus
ctgtctggcctttagcgcttcatcc

SEQ ID NO: 620110 - DNA, 25 bp, Mus musculus
ctgtctgggaagctctcagcatctc

SEQ ID NO: 620111 - DNA, 25 bp, Mus musculus
ctgtctgggaaggtctcagcatctc

SEQ ID NO: 620112 - DNA, 25 bp, Mus musculus
ctgtctgggcccctggtctgcagct

SEQ ID NO: 620113 - DNA, 25 bp, Mus musculus
ctgtctgggcccgtggtctgcagct

SEQ ID NO: 620114 - DNA, 25 bp, Mus musculus
ctgtctggtattatgatgccaagga

SEQ ID NO: 620115 - DNA, 25 bp, Mus musculus
ctgtctggtattttgatgccaagga

SEQ ID NO: 620116 - DNA, 25 bp, Mus musculus
ctgtctgtagttccggacagcttca

SEQ ID NO: 620117 - DNA, 25 bp, Mus musculus
ctgtctgtagttgcggacagcttca

SEQ ID NO: 620118 - DNA, 25 bp, Mus musculus
ctgtctgtcgggatgtcacacaatg

SEQ ID NO: 620119 - DNA, 25 bp, Mus musculus
ctgtctgtcgggttgtcacacaatg

SEQ ID NO: 620120 - DNA, 25 bp, Mus musculus
ctgtctgtctgcatagtccggcgtc

SEQ ID NO: 620121 - DNA, 25 bp, Mus musculus
ctgtctgtctgcttagtccggcgtc

SEQ ID NO: 620122 - DNA, 25 bp, Mus musculus
ctgtctgtgcccagaacatctaata

SEQ ID NO: 620123 - DNA, 25 bp, Mus musculus
ctgtctgtgccctgaacatctaata

SEQ ID NO: 620124 - DNA, 25 bp, Mus musculus
ctgtctgtgcttaaacgcacttggg

SEQ ID NO: 620125 - DNA, 25 bp, Mus musculus
ctgtctgtgcttcatggaattgcca

SEQ ID NO: 620126 - DNA, 25 bp, Mus musculus
ctgtctgtgcttgatggaattgcca

SEQ ID NO: 620127 - DNA, 25 bp, Mus musculus
ctgtctgtgctttaacgcacttggg

SEQ ID NO: 620128 - DNA, 25 bp, Mus musculus
ctgtctgttccgcagctgggccatt

SEQ ID NO: 620129 - DNA, 25 bp, Mus musculus
ctgtctgttccggagctgggccatt

SEQ ID NO: 620130 - DNA, 25 bp, Mus musculus
ctgtcttagttgagcacttgaggct

SEQ ID NO: 620131 - DNA, 25 bp, Mus musculus
ctgtcttagttgtgcacttgaggct

SEQ ID NO: 620132 - DNA, 25 bp, Mus musculus
ctgtcttcacgacgaggaggccaca

SEQ ID NO: 620133 - DNA, 25 bp, Mus musculus
ctgtcttcacgaggaggaggccaca

SEQ ID NO: 620134 - DNA, 25 bp, Mus musculus
ctgtcttccagaatgaatgcatgct

SEQ ID NO: 620135 - DNA, 25 bp, Mus musculus
ctgtcttccagattgaatgcatgct

SEQ ID NO: 620136 - DNA, 25 bp, Mus musculus
ctgtcttctgacaaataaaaagcat

SEQ ID NO: 620137 - DNA, 25 bp, Mus musculus
ctgtcttctgactaataaaaagcat

SEQ ID NO: 620138 - DNA, 25 bp, Mus musculus
ctgtctttattgctgaatcatcagc

SEQ ID NO: 620139 - DNA, 25 bp, Mus musculus
ctgtctttattggtgaatcatcagc

SEQ ID NO: 620140 - DNA, 25 bp, Mus musculus
ctgtgaaaacccagctagagaagta

SEQ ID NO: 620141 - DNA, 25 bp, Mus musculus
ctgtgaaaaccctgctagagaagta

SEQ ID NO: 620142 - DNA, 25 bp, Mus musculus
ctgtgaaaatcccaagaaggccttg

SEQ ID NO: 620143 - DNA, 25 bp, Mus musculus
ctgtgaaaatccgaagaaggccttg

SEQ ID NO: 620144 - DNA, 25 bp, Mus musculus
ctgtgaaaccctaacaaccatgagg

SEQ ID NO: 620145 - DNA, 25 bp, Mus musculus
ctgtgaaacccttacaaccatgagg

SEQ ID NO: 620146 - DNA, 25 bp, Mus musculus
ctgtgaaagctcaggtgacatcatt

SEQ ID NO: 620147 - DNA, 25 bp, Mus musculus
ctgtgaaagctctggtgacatcatt

SEQ ID NO: 620148 - DNA, 25 bp, Mus musculus
ctgtgaaaggacacagtaatttggg

SEQ ID NO: 620149 - DNA, 25 bp, Mus musculus
ctgtgaaaggactcagtaatttggg

SEQ ID NO: 620150 - DNA, 25 bp, Mus musculus
ctgtgaaagtaactcacacacaggg

SEQ ID NO: 620151 - DNA, 25 bp, Mus musculus
ctgtgaaagtaagtcacacacaggg

SEQ ID NO: 620152 - DNA, 25 bp, Mus musculus
ctgtgaaatgacaaaagaaattgct

SEQ ID NO: 620153 - DNA, 25 bp, Mus musculus
ctgtgaaatgactaaagaaattgct

SEQ ID NO: 620154 - DNA, 25 bp, Mus musculus
ctgtgaacaagcacccgggcaagag

SEQ ID NO: 620155 - DNA, 25 bp, Mus musculus
ctgtgaacaagctcccgggcaagag

SEQ ID NO: 620156 - DNA, 25 bp, Mus musculus
ctgtgaaccagacccgccagctggt

SEQ ID NO: 620157 - DNA, 25 bp, Mus musculus
ctgtgaaccagagccgccagctggt

SEQ ID NO: 620158 - DNA, 25 bp, Mus musculus
ctgtgaacctgtagttaaaggagaa

SEQ ID NO: 620159 - DNA, 25 bp, Mus musculus
ctgtgaacctgttgttaaaggagaa

SEQ ID NO: 620160 - DNA, 25 bp, Mus musculus
ctgtgaacgtgtcctcagagctgat

SEQ ID NO: 620161 - DNA, 25 bp, Mus musculus
ctgtgaacgtgtgctcagagctgat

SEQ ID NO: 620162 - DNA, 25 bp, Mus musculus
ctgtgaactgagaggtccatgtgct

SEQ ID NO: 620163 - DNA, 25 bp, Mus musculus
ctgtgaactgagtggtccatgtgct

SEQ ID NO: 620164 - DNA, 25 bp, Mus musculus
ctgtgaactggcaattggcttggag

SEQ ID NO: 620165 - DNA, 25 bp, Mus musculus
ctgtgaactggctattggcttggag

SEQ ID NO: 620166 - DNA, 25 bp, Mus musculus
ctgtgaagataaagccccagccact

SEQ ID NO: 620167 - DNA, 25 bp, Mus musculus
ctgtgaagataatgccccagccact

SEQ ID NO: 620168 - DNA, 25 bp, Mus musculus
ctgtgaagatcaacgacaagaccca

SEQ ID NO: 620169 - DNA, 25 bp, Mus musculus
ctgtgaagatcatcgacaagaccca

SEQ ID NO: 620170 - DNA, 25 bp, Mus musculus
ctgtgaagccgtactgcacctgcgc

SEQ ID NO: 620171 - DNA, 25 bp, Mus musculus
ctgtgaagccgttctgcacctgcgc

SEQ ID NO: 620172 - DNA, 25 bp, Mus musculus
ctgtgaagcggtcgccatctatggc

SEQ ID NO: 620173 - DNA, 25 bp, Mus musculus
ctgtgaagcggtggccatctatggc

SEQ ID NO: 620174 - DNA, 25 bp, Mus musculus
ctgtgaagcttaagttaacacaact

SEQ ID NO: 620175 - DNA, 25 bp, Mus musculus
ctgtgaagcttatgttaacacaact

SEQ ID NO: 620176 - DNA, 25 bp, Mus musculus
ctgtgaagtcttccccaaaaaccat

SEQ ID NO: 620177 - DNA, 25 bp, Mus musculus
ctgtgaagtcttgcccaaaaaccat

SEQ ID NO: 620178 - DNA, 25 bp, Mus musculus
ctgtgaatattgagctcgggccttc

SEQ ID NO: 620179 - DNA, 25 bp, Mus musculus
ctgtgaatattgtgctcgggccttc

SEQ ID NO: 620180 - DNA, 25 bp, Mus musculus
ctgtgaatggagacaaagtggcctc

SEQ ID NO: 620181 - DNA, 25 bp, Mus musculus
ctgtgaatggagtcaaagtggcctc

SEQ ID NO: 620182 - DNA, 25 bp, Mus musculus
ctgtgaatggatctatgattatacc

SEQ ID NO: 620183 - DNA, 25 bp, Mus musculus
ctgtgaatggatgtatgattatacc

SEQ ID NO: 620184 - DNA, 25 bp, Mus musculus
ctgtgaatgtgacccatgatgcagc

SEQ ID NO: 620185 - DNA, 25 bp, Mus musculus
ctgtgaatgtgagccatgatgcagc

SEQ ID NO: 620186 - DNA, 25 bp, Mus musculus
ctgtgaattctgagagcagcgcttc

SEQ ID NO: 620187 - DNA, 25 bp, Mus musculus
ctgtgaattctgtgagcagcgcttc

SEQ ID NO: 620188 - DNA, 25 bp, Mus musculus
ctgtgacaaattaagtggccatccc

SEQ ID NO: 620189 - DNA, 25 bp, Mus musculus
ctgtgacaaatttagtggccatccc

SEQ ID NO: 620190 - DNA, 25 bp, Mus musculus
ctgtgacacgtaatcctatggtgtg

SEQ ID NO: 620191 - DNA, 25 bp, Mus musculus
ctgtgacacgtattcctatggtgtg

SEQ ID NO: 620192 - DNA, 25 bp, Mus musculus
ctgtgacagcgcaaaggctgcccag

SEQ ID NO: 620193 - DNA, 25 bp, Mus musculus
ctgtgacagcgctaaggctgcccag

SEQ ID NO: 620194 - DNA, 25 bp, Mus musculus
ctgtgacaggggctaccggcccaac

SEQ ID NO: 620195 - DNA, 25 bp, Mus musculus
ctgtgacagggggtaccggcccaac

SEQ ID NO: 620196 - DNA, 25 bp, Mus musculus
ctgtgacccgacagggcagtgtcac

SEQ ID NO: 620197 - DNA, 25 bp, Mus musculus
ctgtgacccgactgggcagtgtcac

SEQ ID NO: 620198 - DNA, 25 bp, Mus musculus
ctgtgaccctttcctgcagtgtggg

SEQ ID NO: 620199 - DNA, 25 bp, Mus musculus
ctgtgaccctttgctgcagtgtggg

SEQ ID NO: 620200 - DNA, 25 bp, Mus musculus
ctgtgaccgacactggcaagatgca

SEQ ID NO: 620201 - DNA, 25 bp, Mus musculus
ctgtgaccgacagtggcaagatgca

SEQ ID NO: 620202 - DNA, 25 bp, Mus musculus
ctgtgaccggacctgtaaggacact

SEQ ID NO: 620203 - DNA, 25 bp, Mus musculus
ctgtgaccggacgtgtaaggacact

SEQ ID NO: 620204 - DNA, 25 bp, Mus musculus
ctgtgaccttgcacggcgctatggc

SEQ ID NO: 620205 - DNA, 25 bp, Mus musculus
ctgtgaccttgctcggcgctatggc

SEQ ID NO: 620206 - DNA, 25 bp, Mus musculus
ctgtgacgagggaaagggacttact

SEQ ID NO: 620207 - DNA, 25 bp, Mus musculus
ctgtgacgagggtaagggacttact

SEQ ID NO: 620208 - DNA, 25 bp, Mus musculus
ctgtgacgctttcggtgagagcact

SEQ ID NO: 620209 - DNA, 25 bp, Mus musculus
ctgtgacgctttgggtgagagcact

SEQ ID NO: 620210 - DNA, 25 bp, Mus musculus
ctgtgactctggcacctgtctggac

SEQ ID NO: 620211 - DNA, 25 bp, Mus musculus
ctgtgactctgggacctgtctggac

SEQ ID NO: 620212 - DNA, 25 bp, Mus musculus
ctgtgacttacactgagacaaaaga

SEQ ID NO: 620213 - DNA, 25 bp, Mus musculus
ctgtgacttacagtgagacaaaaga

SEQ ID NO: 620214 - DNA, 25 bp, Mus musculus
ctgtgagaacaaccgctatggcatg

SEQ ID NO: 620215 - DNA, 25 bp, Mus musculus
ctgtgagaacaagcgctatggcatg

SEQ ID NO: 620216 - DNA, 25 bp, Mus musculus
ctgtgagaacagactagaaactgac

SEQ ID NO: 620217 - DNA, 25 bp, Mus musculus
ctgtgagaacagtctagaaactgac

SEQ ID NO: 620218 - DNA, 25 bp, Mus musculus
ctgtgagaagcacgactcagtgtgc

SEQ ID NO: 620219 - DNA, 25 bp, Mus musculus
ctgtgagaagcaggactcagtgtgc

SEQ ID NO: 620220 - DNA, 25 bp, Mus musculus
ctgtgagaatatagagacgtcggag

SEQ ID NO: 620221 - DNA, 25 bp, Mus musculus
ctgtgagaatattgagacgtcggag

SEQ ID NO: 620222 - DNA, 25 bp, Mus musculus
ctgtgagaccatcggcaatgccaca

SEQ ID NO: 620223 - DNA, 25 bp, Mus musculus
ctgtgagaccatgggcaatgccaca

SEQ ID NO: 620224 - DNA, 25 bp, Mus musculus
ctgtgagcaagtataaagagcagct

SEQ ID NO: 620225 - DNA, 25 bp, Mus musculus
ctgtgagcaagtttaaagagcagct

SEQ ID NO: 620226 - DNA, 25 bp, Mus musculus
ctgtgagcagaactgtaggtctgac

SEQ ID NO: 620227 - DNA, 25 bp, Mus musculus
ctgtgagcagaagtgtaggtctgac

SEQ ID NO: 620228 - DNA, 25 bp, Mus musculus
ctgtgagcaggccatttgtgtgtct

SEQ ID NO: 620229 - DNA, 25 bp, Mus musculus
ctgtgagcaggcgatttgtgtgtct

SEQ ID NO: 620230 - DNA, 25 bp, Mus musculus
ctgtgagcattgcactatagttgtc

SEQ ID NO: 620231 - DNA, 25 bp, Mus musculus
ctgtgagcattggactatagttgtc

SEQ ID NO: 620232 - DNA, 25 bp, Mus musculus
ctgtgagcctctctctagtgtgtgg

SEQ ID NO: 620233 - DNA, 25 bp, Mus musculus
ctgtgagcctctgtctagtgtgtgg

SEQ ID NO: 620234 - DNA, 25 bp, Mus musculus
ctgtgagctgagacccggtcaagcg

SEQ ID NO: 620235 - DNA, 25 bp, Mus musculus
ctgtgagctgagtcccggtcaagcg

SEQ ID NO: 620236 - DNA, 25 bp, Mus musculus
ctgtgagctgcgagagtgccttgaa

SEQ ID NO: 620237 - DNA, 25 bp, Mus musculus
ctgtgagctgcgtgagtgccttgaa

SEQ ID NO: 620238 - DNA, 25 bp, Mus musculus
ctgtgaggagcaatcagtttgtgga

SEQ ID NO: 620239 - DNA, 25 bp, Mus musculus
ctgtgaggagcattcagtttgtgga

SEQ ID NO: 620240 - DNA, 25 bp, Mus musculus
ctgtgaggcggcacgtagacgtccc

SEQ ID NO: 620241 - DNA, 25 bp, Mus musculus
ctgtgaggcggctcgtagacgtccc

SEQ ID NO: 620242 - DNA, 25 bp, Mus musculus
ctgtgagtaccacagtgcctgttgg

SEQ ID NO: 620243 - DNA, 25 bp, Mus musculus
ctgtgagtaccagagtgcctgttgg

SEQ ID NO: 620244 - DNA, 25 bp, Mus musculus
ctgtgagtatacatctttctcaata

SEQ ID NO: 620245 - DNA, 25 bp, Mus musculus
ctgtgagtatacttctttctcaata

SEQ ID NO: 620246 - DNA, 25 bp, Mus musculus
ctgtgagtcgcaccaccgaggtgaa

SEQ ID NO: 620247 - DNA, 25 bp, Mus musculus
ctgtgagtcgcagcaccgaggtgaa

SEQ ID NO: 620248 - DNA, 25 bp, Mus musculus
ctgtgagtgaagacgtccatgtcca

SEQ ID NO: 620249 - DNA, 25 bp, Mus musculus
ctgtgagtgaagtcgtccatgtcca

SEQ ID NO: 620250 - DNA, 25 bp, Mus musculus
ctgtgagtgacgactcaaagaggct

SEQ ID NO: 620251 - DNA, 25 bp, Mus musculus
ctgtgagtgacgtctcaaagaggct

SEQ ID NO: 620252 - DNA, 25 bp, Mus musculus
ctgtgagtgcagagacggctaccat

SEQ ID NO: 620253 - DNA, 25 bp, Mus musculus
ctgtgagtgcagtgacggctaccat

SEQ ID NO: 620254 - DNA, 25 bp, Mus musculus
ctgtgagtgcttaggctaaatttgg

SEQ ID NO: 620255 - DNA, 25 bp, Mus musculus
ctgtgagtgctttggctaaatttgg

SEQ ID NO: 620256 - DNA, 25 bp, Mus musculus
ctgtgatagtgtctaccttggtgct

SEQ ID NO: 620257 - DNA, 25 bp, Mus musculus
ctgtgatagtgtgtaccttggtgct

SEQ ID NO: 620258 - DNA, 25 bp, Mus musculus
ctgtgatcaccaccattgccgtggg

SEQ ID NO: 620259 - DNA, 25 bp, Mus musculus
ctgtgatcaccagcattgccgtggg

SEQ ID NO: 620260 - DNA, 25 bp, Mus musculus
ctgtgatcatgtatggagttcccta

SEQ ID NO: 620261 - DNA, 25 bp, Mus musculus
ctgtgatcatgtttggagttcccta

SEQ ID NO: 620262 - DNA, 25 bp, Mus musculus
ctgtgatccgcccaattatcgccac

SEQ ID NO: 620263 - DNA, 25 bp, Mus musculus
ctgtgatccgccgaattatcgccac

SEQ ID NO: 620264 - DNA, 25 bp, Mus musculus
ctgtgatcctgtagctgacagtgct

SEQ ID NO: 620265 - DNA, 25 bp, Mus musculus
ctgtgatcctgttgctgacagtgct

SEQ ID NO: 620266 - DNA, 25 bp, Mus musculus
ctgtgatctccaatgacaagaaggg

SEQ ID NO: 620267 - DNA, 25 bp, Mus musculus
ctgtgatctccattgacaagaaggg

SEQ ID NO: 620268 - DNA, 25 bp, Mus musculus
ctgtgatgagataccagctctctga

SEQ ID NO: 620269 - DNA, 25 bp, Mus musculus
ctgtgatgagattccagctctctga

SEQ ID NO: 620270 - DNA, 25 bp, Mus musculus
ctgtgatgctggaccgagctgagaa

SEQ ID NO: 620271 - DNA, 25 bp, Mus musculus
ctgtgatgctggtccgagctgagaa

SEQ ID NO: 620272 - DNA, 25 bp, Mus musculus
ctgtgatggactcttgctctcctag

SEQ ID NO: 620273 - DNA, 25 bp, Mus musculus
ctgtgatggactgttgctctcctag

SEQ ID NO: 620274 - DNA, 25 bp, Mus musculus
ctgtgatgttcgcagattttgggca

SEQ ID NO: 620275 - DNA, 25 bp, Mus musculus
ctgtgatgttcggagattttgggca

SEQ ID NO: 620276 - DNA, 25 bp, Mus musculus
ctgtgattggccatgcatcgttgga

SEQ ID NO: 620277 - DNA, 25 bp, Mus musculus
ctgtgattggccttgcatcgttgga

SEQ ID NO: 620278 - DNA, 25 bp, Mus musculus
ctgtgcaacggtcaggattaccgtg

SEQ ID NO: 620279 - DNA, 25 bp, Mus musculus
ctgtgcaacggtgaggattaccgtg

SEQ ID NO: 620280 - DNA, 25 bp, Mus musculus
ctgtgcacagccacaagacagagct

SEQ ID NO: 620281 - DNA, 25 bp, Mus musculus
ctgtgcacagcctcaagacagagct

SEQ ID NO: 620282 - DNA, 25 bp, Mus musculus
ctgtgcacgcccagagggaagagct

SEQ ID NO: 620283 - DNA, 25 bp, Mus musculus
ctgtgcacgccctgagggaagagct

SEQ ID NO: 620284 - DNA, 25 bp, Mus musculus
ctgtgcagatggacttcaacatact

SEQ ID NO: 620285 - DNA, 25 bp, Mus musculus
ctgtgcagatggtcttcaacatact

SEQ ID NO: 620286 - DNA, 25 bp, Mus musculus
ctgtgcagcgcaccctggtgttgca

SEQ ID NO: 620287 - DNA, 25 bp, Mus musculus
ctgtgcagcgcagcctggtgttgca

SEQ ID NO: 620288 - DNA, 25 bp, Mus musculus
ctgtgcagctgacgaatgggaatct

SEQ ID NO: 620289 - DNA, 25 bp, Mus musculus
ctgtgcagctgaggaatgggaatct

SEQ ID NO: 620290 - DNA, 25 bp, Mus musculus
ctgtgcagctgccagaagatggcaa

SEQ ID NO: 620291 - DNA, 25 bp, Mus musculus
ctgtgcagctgcgagaagatggcaa

SEQ ID NO: 620292 - DNA, 25 bp, Mus musculus
ctgtgcaggagacgtgtccatttcg

SEQ ID NO: 620293 - DNA, 25 bp, Mus musculus
ctgtgcaggagaggtgtccatttcg

SEQ ID NO: 620294 - DNA, 25 bp, Mus musculus
ctgtgcagggctatcggttgacaaa

SEQ ID NO: 620295 - DNA, 25 bp, Mus musculus
ctgtgcagggctttcggttgacaaa

SEQ ID NO: 620296 - DNA, 25 bp, Mus musculus
ctgtgcaggtgcacctgggtgccca

SEQ ID NO: 620297 - DNA, 25 bp, Mus musculus
ctgtgcaggtgctcctgggtgccca

SEQ ID NO: 620298 - DNA, 25 bp, Mus musculus
ctgtgcagtccgatgaacgacttca

SEQ ID NO: 620299 - DNA, 25 bp, Mus musculus
ctgtgcagtccgttgaacgacttca

SEQ ID NO: 620300 - DNA, 25 bp, Mus musculus
ctgtgcataggcacggaggtgccaa

SEQ ID NO: 620301 - DNA, 25 bp, Mus musculus
ctgtgcataggctcggaggtgccaa

SEQ ID NO: 620302 - DNA, 25 bp, Mus musculus
ctgtgcattctacccatcgactctt

SEQ ID NO: 620303 - DNA, 25 bp, Mus musculus
ctgtgcattctagccatcgactctt

SEQ ID NO: 620304 - DNA, 25 bp, Mus musculus
ctgtgccaagatccaggttgtcagc

SEQ ID NO: 620305 - DNA, 25 bp, Mus musculus
ctgtgccaagatgcaggttgtcagc

SEQ ID NO: 620306 - DNA, 25 bp, Mus musculus
ctgtgccactctcggtgtgaacctg

SEQ ID NO: 620307 - DNA, 25 bp, Mus musculus
ctgtgccactctgggtgtgaacctg

SEQ ID NO: 620308 - DNA, 25 bp, Mus musculus
ctgtgccactgaaagagctgattga

SEQ ID NO: 620309 - DNA, 25 bp, Mus musculus
ctgtgccactgatagagctgattga

SEQ ID NO: 620310 - DNA, 25 bp, Mus musculus
ctgtgccagcacaaagagagcgggc

SEQ ID NO: 620311 - DNA, 25 bp, Mus musculus
ctgtgccagcactaagagagcgggc

SEQ ID NO: 620312 - DNA, 25 bp, Mus musculus
ctgtgccatgatctcagcttctggt

SEQ ID NO: 620313 - DNA, 25 bp, Mus musculus
ctgtgccatgatgtcagcttctggt

SEQ ID NO: 620314 - DNA, 25 bp, Mus musculus
ctgtgcccagtgaaagtacctgcat

SEQ ID NO: 620315 - DNA, 25 bp, Mus musculus
ctgtgcccagtgtaagtacctgcat

SEQ ID NO: 620316 - DNA, 25 bp, Mus musculus
ctgtgccccaggattccagcagagc

SEQ ID NO: 620317 - DNA, 25 bp, Mus musculus
ctgtgccccaggtttccagcagagc

SEQ ID NO: 620318 - DNA, 25 bp, Mus musculus
ctgtgcccctggagcaccgagtggc

SEQ ID NO: 620319 - DNA, 25 bp, Mus musculus
ctgtgcccctggtgcaccgagtggc

SEQ ID NO: 620320 - DNA, 25 bp, Mus musculus
ctgtgcccggttcgctggagcacca

SEQ ID NO: 620321 - DNA, 25 bp, Mus musculus
ctgtgcccggttggctggagcacca

SEQ ID NO: 620322 - DNA, 25 bp, Mus musculus
ctgtgcccgtgcagatgccaaaggc

SEQ ID NO: 620323 - DNA, 25 bp, Mus musculus
ctgtgcccgtgctgatgccaaaggc

SEQ ID NO: 620324 - DNA, 25 bp, Mus musculus
ctgtgccctggcactcatggcggtg

SEQ ID NO: 620325 - DNA, 25 bp, Mus musculus
ctgtgccctggctctcatggcggtg

SEQ ID NO: 620326 - DNA, 25 bp, Mus musculus
ctgtgccctggtaggaaattaaact

SEQ ID NO: 620327 - DNA, 25 bp, Mus musculus
ctgtgccctggttggaaattaaact

SEQ ID NO: 620328 - DNA, 25 bp, Mus musculus
ctgtgccgagaacccgcaatgaccg

SEQ ID NO: 620329 - DNA, 25 bp, Mus musculus
ctgtgccgagaagccgcaatgaccg

SEQ ID NO: 620330 - DNA, 25 bp, Mus musculus
ctgtgccgctgcacgagcttcgcga

SEQ ID NO: 620331 - DNA, 25 bp, Mus musculus
ctgtgccgctgctcgagcttcgcga

SEQ ID NO: 620332 - DNA, 25 bp, Mus musculus
ctgtgccggtctccccaaagtgttg

SEQ ID NO: 620333 - DNA, 25 bp, Mus musculus
ctgtgccggtctgcccaaagtgttg

SEQ ID NO: 620334 - DNA, 25 bp, Mus musculus
ctgtgccgtcagcaccaaacttgca

SEQ ID NO: 620335 - DNA, 25 bp, Mus musculus
ctgtgccgtcaggaccaaacttgca

SEQ ID NO: 620336 - DNA, 25 bp, Mus musculus
ctgtgcctggatatgttttgagtgc

SEQ ID NO: 620337 - DNA, 25 bp, Mus musculus
ctgtgcctggatttgttttgagtgc

SEQ ID NO: 620338 - DNA, 25 bp, Mus musculus
ctgtgccttcatcggctctttggcc

SEQ ID NO: 620339 - DNA, 25 bp, Mus musculus
ctgtgccttcatgggctctttggcc

SEQ ID NO: 620340 - DNA, 25 bp, Mus musculus
ctgtgccttcttccagtgtttctgc

SEQ ID NO: 620341 - DNA, 25 bp, Mus musculus
ctgtgccttcttgcagtgtttctgc

SEQ ID NO: 620342 - DNA, 25 bp, Mus musculus
ctgtgcctttccaggaataaaattt

SEQ ID NO: 620343 - DNA, 25 bp, Mus musculus
ctgtgcctttcctggaataaaattt

SEQ ID NO: 620344 - DNA, 25 bp, Mus musculus
ctgtgcctttttctgcgtcagttgg

SEQ ID NO: 620345 - DNA, 25 bp, Mus musculus
ctgtgcctttttgtgcgtcagttgg

SEQ ID NO: 620346 - DNA, 25 bp, Mus musculus
ctgtgcgaagagacatggaggtcaa

SEQ ID NO: 620347 - DNA, 25 bp, Mus musculus
ctgtgcgaagagtcatggaggtcaa

SEQ ID NO: 620348 - DNA, 25 bp, Mus musculus
ctgtgcgcaaacagcaggcacagtg

SEQ ID NO: 620349 - DNA, 25 bp, Mus musculus
ctgtgcgcaaactgcaggcacagtg

SEQ ID NO: 620350 - DNA, 25 bp, Mus musculus
ctgtgcgcactgcatctttgccact

SEQ ID NO: 620351 - DNA, 25 bp, Mus musculus
ctgtgcgcactggatctttgccact

SEQ ID NO: 620352 - DNA, 25 bp, Mus musculus
ctgtgcgccccaacctgtctggctc

SEQ ID NO: 620353 - DNA, 25 bp, Mus musculus
ctgtgcgccccatcctgtctggctc

SEQ ID NO: 620354 - DNA, 25 bp, Mus musculus
ctgtgcgcctcgaggttacagagga

SEQ ID NO: 620355 - DNA, 25 bp, Mus musculus
ctgtgcgcctcgtggttacagagga

SEQ ID NO: 620356 - DNA, 25 bp, Mus musculus
ctgtgcgctcccagcgtgctgacta

SEQ ID NO: 620357 - DNA, 25 bp, Mus musculus
ctgtgcgctccctgcgtgctgacta

SEQ ID NO: 620358 - DNA, 25 bp, Mus musculus
ctgtgcgctggaacagccctgagga

SEQ ID NO: 620359 - DNA, 25 bp, Mus musculus
ctgtgcgctggatcagccctgagga

SEQ ID NO: 620360 - DNA, 25 bp, Mus musculus
ctgtgcggacagaaccgtgaggtac

SEQ ID NO: 620361 - DNA, 25 bp, Mus musculus
ctgtgcggacagtaccgtgaggtac

SEQ ID NO: 620362 - DNA, 25 bp, Mus musculus
ctgtgcggagaacggccactcccag

SEQ ID NO: 620363 - DNA, 25 bp, Mus musculus
ctgtgcggagaagggccactcccag

SEQ ID NO: 620364 - DNA, 25 bp, Mus musculus
ctgtgctatggaactgggtgtgaac

SEQ ID NO: 620365 - DNA, 25 bp, Mus musculus
ctgtgctatggatctgggtgtgaac

SEQ ID NO: 620366 - DNA, 25 bp, Mus musculus
ctgtgctcaactaggcttatgccca

SEQ ID NO: 620367 - DNA, 25 bp, Mus musculus
ctgtgctcaacttggcttatgccca

SEQ ID NO: 620368 - DNA, 25 bp, Mus musculus
ctgtgctcccctcaggaaaatatct

SEQ ID NO: 620369 - DNA, 25 bp, Mus musculus
ctgtgctcccctgaggaaaatatct

SEQ ID NO: 620370 - DNA, 25 bp, Mus musculus
ctgtgctccgggactctcatgttga

SEQ ID NO: 620371 - DNA, 25 bp, Mus musculus
ctgtgctccgggtctctcatgttga

SEQ ID NO: 620372 - DNA, 25 bp, Mus musculus
ctgtgctcttgtcccgtagcctcag

SEQ ID NO: 620373 - DNA, 25 bp, Mus musculus
ctgtgctcttgtgccgtagcctcag

SEQ ID NO: 620374 - DNA, 25 bp, Mus musculus
ctgtgctgagcaacatcgaccgtat

SEQ ID NO: 620375 - DNA, 25 bp, Mus musculus
ctgtgctgagcatcatcgaccgtat

SEQ ID NO: 620376 - DNA, 25 bp, Mus musculus
ctgtgctgaggcactactttgatga

SEQ ID NO: 620377 - DNA, 25 bp, Mus musculus
ctgtgctgaggctctactttgatga

SEQ ID NO: 620378 - DNA, 25 bp, Mus musculus
ctgtgctgcagcacacgccagaggt

SEQ ID NO: 620379 - DNA, 25 bp, Mus musculus
ctgtgctgcagctcacgccagaggt

SEQ ID NO: 620380 - DNA, 25 bp, Mus musculus
ctgtgctgctggcttattgacaggc

SEQ ID NO: 620381 - DNA, 25 bp, Mus musculus
ctgtgctgctgggttattgacaggc

SEQ ID NO: 620382 - DNA, 25 bp, Mus musculus
ctgtgctgtgctataattctcgact

SEQ ID NO: 620383 - DNA, 25 bp, Mus musculus
ctgtgctgtgctttaattctcgact

SEQ ID NO: 620384 - DNA, 25 bp, Mus musculus
ctgtgcttaagaccgggaccacgga

SEQ ID NO: 620385 - DNA, 25 bp, Mus musculus
ctgtgcttaagagcgggaccacgga

SEQ ID NO: 620386 - DNA, 25 bp, Mus musculus
ctgtgcttcaagctctaataaattc

SEQ ID NO: 620387 - DNA, 25 bp, Mus musculus
ctgtgcttcaaggtctaataaattc

SEQ ID NO: 620388 - DNA, 25 bp, Mus musculus
ctgtgcttcgataaggacgagttca

SEQ ID NO: 620389 - DNA, 25 bp, Mus musculus
ctgtgcttcgattaggacgagttca

SEQ ID NO: 620390 - DNA, 25 bp, Mus musculus
ctgtgcttgagcctgggaaaactga

SEQ ID NO: 620391 - DNA, 25 bp, Mus musculus
ctgtgcttgagcgtgggaaaactga

SEQ ID NO: 620392 - DNA, 25 bp, Mus musculus
ctgtggaaagaaataacctgatgag

SEQ ID NO: 620393 - DNA, 25 bp, Mus musculus
ctgtggaaagaattaacctgatgag

SEQ ID NO: 620394 - DNA, 25 bp, Mus musculus
ctgtggaagagcactccttcgggag

SEQ ID NO: 620395 - DNA, 25 bp, Mus musculus
ctgtggaagagctctccttcgggag

SEQ ID NO: 620396 - DNA, 25 bp, Mus musculus
ctgtggaagaggataccacctgcta

SEQ ID NO: 620397 - DNA, 25 bp, Mus musculus
ctgtggaagaggttaccacctgcta

SEQ ID NO: 620398 - DNA, 25 bp, Mus musculus
ctgtggaagagtatgtgtatgagat

SEQ ID NO: 620399 - DNA, 25 bp, Mus musculus
ctgtggaagagtttgtgtatgagat

SEQ ID NO: 620400 - DNA, 25 bp, Mus musculus
ctgtggaagctcaatgtgtagagga

SEQ ID NO: 620401 - DNA, 25 bp, Mus musculus
ctgtggaagctctatgtgtagagga

SEQ ID NO: 620402 - DNA, 25 bp, Mus musculus
ctgtggaattcacctggcaggaatg

SEQ ID NO: 620403 - DNA, 25 bp, Mus musculus
ctgtggaattcagctggcaggaatg

SEQ ID NO: 620404 - DNA, 25 bp, Mus musculus
ctgtggaattggcacgacaaagtca

SEQ ID NO: 620405 - DNA, 25 bp, Mus musculus
ctgtggaattgggacgacaaagtca

SEQ ID NO: 620406 - DNA, 25 bp, Mus musculus
ctgtggacaaggaaatgaaggaact

SEQ ID NO: 620407 - DNA, 25 bp, Mus musculus
ctgtggacaaggtaatgaaggaact

SEQ ID NO: 620408 - DNA, 25 bp, Mus musculus
ctgtggacacacaacagtattgctt

SEQ ID NO: 620409 - DNA, 25 bp, Mus musculus
ctgtggacacactacagtattgctt

SEQ ID NO: 620410 - DNA, 25 bp, Mus musculus
ctgtggacagtaccgtcggcaacga

SEQ ID NO: 620411 - DNA, 25 bp, Mus musculus
ctgtggacagtagcgtcggcaacga

SEQ ID NO: 620412 - DNA, 25 bp, Mus musculus
ctgtggacggccagctcatccggaa

SEQ ID NO: 620413 - DNA, 25 bp, Mus musculus
ctgtggacggcctgctcatccggaa

SEQ ID NO: 620414 - DNA, 25 bp, Mus musculus
ctgtggactagtcagcattttttgt

SEQ ID NO: 620415 - DNA, 25 bp, Mus musculus
ctgtggactagtgagcattttttgt

SEQ ID NO: 620416 - DNA, 25 bp, Mus musculus
ctgtggagaaacaggaagaggtaac

SEQ ID NO: 620417 - DNA, 25 bp, Mus musculus
ctgtggagaaactggaagaggtaac

SEQ ID NO: 620418 - DNA, 25 bp, Mus musculus
ctgtggagaaatattgaacctcacc

SEQ ID NO: 620419 - DNA, 25 bp, Mus musculus
ctgtggagaaattttgaacctcacc

SEQ ID NO: 620420 - DNA, 25 bp, Mus musculus
ctgtggagaacgctgcagagattct

SEQ ID NO: 620421 - DNA, 25 bp, Mus musculus
ctgtggagaacggtgcagagattct

SEQ ID NO: 620422 - DNA, 25 bp, Mus musculus
ctgtggagaccgcaaagtaccagga

SEQ ID NO: 620423 - DNA, 25 bp, Mus musculus
ctgtggagaccggaaagtaccagga

SEQ ID NO: 620424 - DNA, 25 bp, Mus musculus
ctgtggagcagaacggctacacgca

SEQ ID NO: 620425 - DNA, 25 bp, Mus musculus
ctgtggagcagatcggctacacgca

SEQ ID NO: 620426 - DNA, 25 bp, Mus musculus
ctgtggagcatgaaggtcatgagat

SEQ ID NO: 620427 - DNA, 25 bp, Mus musculus
ctgtggagcatgtaggtcatgagat

SEQ ID NO: 620428 - DNA, 25 bp, Mus musculus
ctgtggagcccaccaatgacggaca

SEQ ID NO: 620429 - DNA, 25 bp, Mus musculus
ctgtggagcccagcaatgacggaca

SEQ ID NO: 620430 - DNA, 25 bp, Mus musculus
ctgtggaggaccctgtcagacagct

SEQ ID NO: 620431 - DNA, 25 bp, Mus musculus
ctgtggaggaccgtgtcagacagct

SEQ ID NO: 620432 - DNA, 25 bp, Mus musculus
ctgtggaggccgctcaagctgcctt

SEQ ID NO: 620433 - DNA, 25 bp, Mus musculus
ctgtggaggccggtcaagctgcctt

SEQ ID NO: 620434 - DNA, 25 bp, Mus musculus
ctgtggaggcctacacgagagcact

SEQ ID NO: 620435 - DNA, 25 bp, Mus musculus
ctgtggaggccttcacgagagcact

SEQ ID NO: 620436 - DNA, 25 bp, Mus musculus
ctgtggagttcaaagttgtagagac

SEQ ID NO: 620437 - DNA, 25 bp, Mus musculus
ctgtggagttcatagttgtagagac

SEQ ID NO: 620438 - DNA, 25 bp, Mus musculus
ctgtggagttctccattcatggctg

SEQ ID NO: 620439 - DNA, 25 bp, Mus musculus
ctgtggagttctgcattcatggctg

SEQ ID NO: 620440 - DNA, 25 bp, Mus musculus
ctgtggataaatcgctggcagtcct

SEQ ID NO: 620441 - DNA, 25 bp, Mus musculus
ctgtggataaatggctggcagtcct

SEQ ID NO: 620442 - DNA, 25 bp, Mus musculus
ctgtggataaggaccccatgttgct

SEQ ID NO: 620443 - DNA, 25 bp, Mus musculus
ctgtggataaggtccccatgttgct

SEQ ID NO: 620444 - DNA, 25 bp, Mus musculus
ctgtggatcgccagtgcttagggat

SEQ ID NO: 620445 - DNA, 25 bp, Mus musculus
ctgtggatcgcctgtgcttagggat

SEQ ID NO: 620446 - DNA, 25 bp, Mus musculus
ctgtggatgaggcagacctgctcaa

SEQ ID NO: 620447 - DNA, 25 bp, Mus musculus
ctgtggatgagggagacctgctcaa

SEQ ID NO: 620448 - DNA, 25 bp, Mus musculus
ctgtggatgccgcatgcctccttgc

SEQ ID NO: 620449 - DNA, 25 bp, Mus musculus
ctgtggatgccggatgcctccttgc

SEQ ID NO: 620450 - DNA, 25 bp, Mus musculus
ctgtggcacgagcttttgaagttct

SEQ ID NO: 620451 - DNA, 25 bp, Mus musculus
ctgtggcacgaggttttgaagttct

SEQ ID NO: 620452 - DNA, 25 bp, Mus musculus
ctgtggcagatgcactcaagaggca

SEQ ID NO: 620453 - DNA, 25 bp, Mus musculus
ctgtggcagatggactcaagaggca

SEQ ID NO: 620454 - DNA, 25 bp, Mus musculus
ctgtggcagccacatatcgggccgt

SEQ ID NO: 620455 - DNA, 25 bp, Mus musculus
ctgtggcagccagatatcgggccgt

SEQ ID NO: 620456 - DNA, 25 bp, Mus musculus
ctgtggcatcatccatagcagctcc

SEQ ID NO: 620457 - DNA, 25 bp, Mus musculus
ctgtggcatcatgcatagcagctcc

SEQ ID NO: 620458 - DNA, 25 bp, Mus musculus
ctgtggccaggacctcaacaagctc

SEQ ID NO: 620459 - DNA, 25 bp, Mus musculus
ctgtggccaggagctcaacaagctc

SEQ ID NO: 620460 - DNA, 25 bp, Mus musculus
ctgtggccatggacagtgtgtgcct

SEQ ID NO: 620461 - DNA, 25 bp, Mus musculus
ctgtggccatggtcagtgtgtgcct

SEQ ID NO: 620462 - DNA, 25 bp, Mus musculus
ctgtggcccaggagcacgcagaaaa

SEQ ID NO: 620463 - DNA, 25 bp, Mus musculus
ctgtggcccaggtgcacgcagaaaa

SEQ ID NO: 620464 - DNA, 25 bp, Mus musculus
ctgtggccccaaaggaggacaccac

SEQ ID NO: 620465 - DNA, 25 bp, Mus musculus
ctgtggccccaatggaggacaccac

SEQ ID NO: 620466 - DNA, 25 bp, Mus musculus
ctgtggccgcagatggacagctgca

SEQ ID NO: 620467 - DNA, 25 bp, Mus musculus
ctgtggccgcagttggacagctgca

SEQ ID NO: 620468 - DNA, 25 bp, Mus musculus
ctgtggccgtgcacagtgaccagaa

SEQ ID NO: 620469 - DNA, 25 bp, Mus musculus
ctgtggccgtgctcagtgaccagaa

SEQ ID NO: 620470 - DNA, 25 bp, Mus musculus
ctgtggcctttgctgctccgatagg

SEQ ID NO: 620471 - DNA, 25 bp, Mus musculus
ctgtggcctttggtgctccgatagg

SEQ ID NO: 620472 - DNA, 25 bp, Mus musculus
ctgtggcggagcaggaatctcttcc

SEQ ID NO: 620473 - DNA, 25 bp, Mus musculus
ctgtggcggagctggaatctcttcc

SEQ ID NO: 620474 - DNA, 25 bp, Mus musculus
ctgtggctcatgaggatgtcagaga

SEQ ID NO: 620475 - DNA, 25 bp, Mus musculus
ctgtggctcatgtggatgtcagaga

SEQ ID NO: 620476 - DNA, 25 bp, Mus musculus
ctgtggctgaaactggagccgctca

SEQ ID NO: 620477 - DNA, 25 bp, Mus musculus
ctgtggctgaaagtggagccgctca

SEQ ID NO: 620478 - DNA, 25 bp, Mus musculus
ctgtggctgataccttctaccgcat

SEQ ID NO: 620479 - DNA, 25 bp, Mus musculus
ctgtggctgatagcttctaccgcat

SEQ ID NO: 620480 - DNA, 25 bp, Mus musculus
ctgtggctgccgaagagcccggcct

SEQ ID NO: 620481 - DNA, 25 bp, Mus musculus
ctgtggctgccgtagagcccggcct

SEQ ID NO: 620482 - DNA, 25 bp, Mus musculus
ctgtgggaaatcacccgcttcttcc

SEQ ID NO: 620483 - DNA, 25 bp, Mus musculus
ctgtgggaaatctcccgcttcttcc

SEQ ID NO: 620484 - DNA, 25 bp, Mus musculus
ctgtgggaagaaagctggcagtctc

SEQ ID NO: 620485 - DNA, 25 bp, Mus musculus
ctgtgggaagaatgctggcagtctc

SEQ ID NO: 620486 - DNA, 25 bp, Mus musculus
ctgtgggaagacaaacttggccatg

SEQ ID NO: 620487 - DNA, 25 bp, Mus musculus
ctgtgggaagactaacttggccatg

SEQ ID NO: 620488 - DNA, 25 bp, Mus musculus
ctgtgggaatcgctgtcaccatcct

SEQ ID NO: 620489 - DNA, 25 bp, Mus musculus
ctgtgggaatcggtgtcaccatcct

SEQ ID NO: 620490 - DNA, 25 bp, Mus musculus
ctgtgggacctcactcaggaatgca

SEQ ID NO: 620491 - DNA, 25 bp, Mus musculus
ctgtgggacctctctcaggaatgca

SEQ ID NO: 620492 - DNA, 25 bp, Mus musculus
ctgtgggagtgactcaaatgattcc

SEQ ID NO: 620493 - DNA, 25 bp, Mus musculus
ctgtgggagtgagtcaaatgattcc

SEQ ID NO: 620494 - DNA, 25 bp, Mus musculus
ctgtgggcaaatccacctttgtgaa

SEQ ID NO: 620495 - DNA, 25 bp, Mus musculus
ctgtgggcaaatgcacctttgtgaa

SEQ ID NO: 620496 - DNA, 25 bp, Mus musculus
ctgtgggcacccctgaggatgacaa

SEQ ID NO: 620497 - DNA, 25 bp, Mus musculus
ctgtgggcacccgtgaggatgacaa

SEQ ID NO: 620498 - DNA, 25 bp, Mus musculus
ctgtgggccggcaccgtcatagcat

SEQ ID NO: 620499 - DNA, 25 bp, Mus musculus
ctgtgggccggcatagctctgctct

SEQ ID NO: 620500 - DNA, 25 bp, Mus musculus
ctgtgggccggctccgtcatagcat

SEQ ID NO: 620501 - DNA, 25 bp, Mus musculus
ctgtgggccggcttagctctgctct

SEQ ID NO: 620502 - DNA, 25 bp, Mus musculus
ctgtgggcgcccagctcaaggtcta

SEQ ID NO: 620503 - DNA, 25 bp, Mus musculus
ctgtgggcgccctgctcaaggtcta

SEQ ID NO: 620504 - DNA, 25 bp, Mus musculus
ctgtgggctgctcaatgaagtcatg

SEQ ID NO: 620505 - DNA, 25 bp, Mus musculus
ctgtgggctgctgaatgaagtcatg

SEQ ID NO: 620506 - DNA, 25 bp, Mus musculus
ctgtgggtgccaacccagtccaggt

SEQ ID NO: 620507 - DNA, 25 bp, Mus musculus
ctgtgggtgccatcccagtccaggt

SEQ ID NO: 620508 - DNA, 25 bp, Mus musculus
ctgtgggtgtgtaggccttcctcac

SEQ ID NO: 620509 - DNA, 25 bp, Mus musculus
ctgtgggtgtgttggccttcctcac

SEQ ID NO: 620510 - DNA, 25 bp, Mus musculus
ctgtggtataggaaaggctatggac

SEQ ID NO: 620511 - DNA, 25 bp, Mus musculus
ctgtggtataggtaaggctatggac

SEQ ID NO: 620512 - DNA, 25 bp, Mus musculus
ctgtggtatttcaactggctacggg

SEQ ID NO: 620513 - DNA, 25 bp, Mus musculus
ctgtggtatttctactggctacggg

SEQ ID NO: 620514 - DNA, 25 bp, Mus musculus
ctgtggtcaagaacaaggagacgta

SEQ ID NO: 620515 - DNA, 25 bp, Mus musculus
ctgtggtcaagatcaaggagacgta

SEQ ID NO: 620516 - DNA, 25 bp, Mus musculus
ctgtggtccagaagctaatgaaaat

SEQ ID NO: 620517 - DNA, 25 bp, Mus musculus
ctgtggtccagatgctaatgaaaat

SEQ ID NO: 620518 - DNA, 25 bp, Mus musculus
ctgtggtccggaacatcctgcgtcc

SEQ ID NO: 620519 - DNA, 25 bp, Mus musculus
ctgtggtccggatcatcctgcgtcc

SEQ ID NO: 620520 - DNA, 25 bp, Mus musculus
ctgtggtgaccgagggatccgaatc

SEQ ID NO: 620521 - DNA, 25 bp, Mus musculus
ctgtggtgaccgtgggatccgaatc

SEQ ID NO: 620522 - DNA, 25 bp, Mus musculus
ctgtggtgcgcaagggaatctacac

SEQ ID NO: 620523 - DNA, 25 bp, Mus musculus
ctgtggtgcgcatgggaatctacac

SEQ ID NO: 620524 - DNA, 25 bp, Mus musculus
ctgtggtggacaccacacaaggcaa

SEQ ID NO: 620525 - DNA, 25 bp, Mus musculus
ctgtggtggacagcacacaaggcaa

SEQ ID NO: 620526 - DNA, 25 bp, Mus musculus
ctgtggtggtagatcccggcgctac

SEQ ID NO: 620527 - DNA, 25 bp, Mus musculus
ctgtggtggtagttcccggcgctac

SEQ ID NO: 620528 - DNA, 25 bp, Mus musculus
ctgtggtgtcctcggtgttggcatc

SEQ ID NO: 620529 - DNA, 25 bp, Mus musculus
ctgtggtgtcctgggtgttggcatc

SEQ ID NO: 620530 - DNA, 25 bp, Mus musculus
ctgtggttccccagaaatgctccag

SEQ ID NO: 620531 - DNA, 25 bp, Mus musculus
ctgtggttcccctgaaatgctccag

SEQ ID NO: 620532 - DNA, 25 bp, Mus musculus
ctgtggttccgcaccaagcaggaag

SEQ ID NO: 620533 - DNA, 25 bp, Mus musculus
ctgtggttccgctccaagcaggaag

SEQ ID NO: 620534 - DNA, 25 bp, Mus musculus
ctgtggttgcaacaaaggtgacgca

SEQ ID NO: 620535 - DNA, 25 bp, Mus musculus
ctgtggttgcaagaaaggtgacgca

SEQ ID NO: 620536 - DNA, 25 bp, Mus musculus
ctgtggttgccaagactgacactga

SEQ ID NO: 620537 - DNA, 25 bp, Mus musculus
ctgtggttgccatgactgacactga

SEQ ID NO: 620538 - DNA, 25 bp, Mus musculus
ctgtgtaagccaccaaggagcgcct

SEQ ID NO: 620539 - DNA, 25 bp, Mus musculus
ctgtgtaagccagcaaggagcgcct

SEQ ID NO: 620540 - DNA, 25 bp, Mus musculus
ctgtgtacagtgaggccgaccggaa

SEQ ID NO: 620541 - DNA, 25 bp, Mus musculus
ctgtgtacagtgcagatccccacca

SEQ ID NO: 620542 - DNA, 25 bp, Mus musculus
ctgtgtacagtggagatccccacca

SEQ ID NO: 620543 - DNA, 25 bp, Mus musculus
ctgtgtacagtgtggccgaccggaa

SEQ ID NO: 620544 - DNA, 25 bp, Mus musculus
ctgtgtacctacaggtggtaaacca

SEQ ID NO: 620545 - DNA, 25 bp, Mus musculus
ctgtgtacctactggtggtaaacca

SEQ ID NO: 620546 - DNA, 25 bp, Mus musculus
ctgtgtagtttgcagttgcaagaac

SEQ ID NO: 620547 - DNA, 25 bp, Mus musculus
ctgtgtagtttggagttgcaagaac

SEQ ID NO: 620548 - DNA, 25 bp, Mus musculus
ctgtgtatacccaggggacaccggg

SEQ ID NO: 620549 - DNA, 25 bp, Mus musculus
ctgtgtataccctggggacaccggg

SEQ ID NO: 620550 - DNA, 25 bp, Mus musculus
ctgtgtatctcacggagatctcaag

SEQ ID NO: 620551 - DNA, 25 bp, Mus musculus
ctgtgtatctcagggagatctcaag

SEQ ID NO: 620552 - DNA, 25 bp, Mus musculus
ctgtgtatctgcattcaatttgtag

SEQ ID NO: 620553 - DNA, 25 bp, Mus musculus
ctgtgtatctgctttcaatttgtag

SEQ ID NO: 620554 - DNA, 25 bp, Mus musculus
ctgtgtcaaggaaattggtctccta

SEQ ID NO: 620555 - DNA, 25 bp, Mus musculus
ctgtgtcaaggatattggtctccta

SEQ ID NO: 620556 - DNA, 25 bp, Mus musculus
ctgtgtcacgtgacgggtgcgccgg

SEQ ID NO: 620557 - DNA, 25 bp, Mus musculus
ctgtgtcacgtgtcgggtgcgccgg

SEQ ID NO: 620558 - DNA, 25 bp, Mus musculus
ctgtgtcagacacagatgtgtcaga

SEQ ID NO: 620559 - DNA, 25 bp, Mus musculus
ctgtgtcagacagagatgtgtcaga

SEQ ID NO: 620560 - DNA, 25 bp, Mus musculus
ctgtgtcagcgtaggatgggcaact

SEQ ID NO: 620561 - DNA, 25 bp, Mus musculus
ctgtgtcagcgttggatgggcaact

SEQ ID NO: 620562 - DNA, 25 bp, Mus musculus
ctgtgtcatcgaagagcggactgat

SEQ ID NO: 620563 - DNA, 25 bp, Mus musculus
ctgtgtcatcgatgagcggactgat

SEQ ID NO: 620564 - DNA, 25 bp, Mus musculus
ctgtgtcatggacctaagataggat

SEQ ID NO: 620565 - DNA, 25 bp, Mus musculus
ctgtgtcatggagctaagataggat

SEQ ID NO: 620566 - DNA, 25 bp, Mus musculus
ctgtgtccatgactgcatcaacatc

SEQ ID NO: 620567 - DNA, 25 bp, Mus musculus
ctgtgtccatgagtgcatcaacatc

SEQ ID NO: 620568 - DNA, 25 bp, Mus musculus
ctgtgtcctggaccctgatggacca

SEQ ID NO: 620569 - DNA, 25 bp, Mus musculus
ctgtgtcctggagcctgatggacca

SEQ ID NO: 620570 - DNA, 25 bp, Mus musculus
ctgtgtccttgcacaggcctgaatt

SEQ ID NO: 620571 - DNA, 25 bp, Mus musculus
ctgtgtccttgctcaggcctgaatt

SEQ ID NO: 620572 - DNA, 25 bp, Mus musculus
ctgtgtcgaggcagagcgtttgtct

SEQ ID NO: 620573 - DNA, 25 bp, Mus musculus
ctgtgtcgaggctgagcgtttgtct

SEQ ID NO: 620574 - DNA, 25 bp, Mus musculus
ctgtgtctccagcattctgcaagtg

SEQ ID NO: 620575 - DNA, 25 bp, Mus musculus
ctgtgtctccaggattctgcaagtg

SEQ ID NO: 620576 - DNA, 25 bp, Mus musculus
ctgtgtctcgtgactggagtacgat

SEQ ID NO: 620577 - DNA, 25 bp, Mus musculus
ctgtgtctcgtgtctggagtacgat

SEQ ID NO: 620578 - DNA, 25 bp, Mus musculus
ctgtgtctgaagatctggatataga

SEQ ID NO: 620579 - DNA, 25 bp, Mus musculus
ctgtgtctgaagttctggatataga

SEQ ID NO: 620580 - DNA, 25 bp, Mus musculus
ctgtgtctgcagaacaactggcggg

SEQ ID NO: 620581 - DNA, 25 bp, Mus musculus
ctgtgtctgcagtacaactggcggg

SEQ ID NO: 620582 - DNA, 25 bp, Mus musculus
ctgtgtctgcgtctctgtataccta

SEQ ID NO: 620583 - DNA, 25 bp, Mus musculus
ctgtgtctgcgtgtctgtataccta

SEQ ID NO: 620584 - DNA, 25 bp, Mus musculus
ctgtgtctggtgctctcctccagga

SEQ ID NO: 620585 - DNA, 25 bp, Mus musculus
ctgtgtctggtggtctcctccagga

SEQ ID NO: 620586 - DNA, 25 bp, Mus musculus
ctgtgtgaccagagcctaggctgca

SEQ ID NO: 620587 - DNA, 25 bp, Mus musculus
ctgtgtgaccagtgcctaggctgca

SEQ ID NO: 620588 - DNA, 25 bp, Mus musculus
ctgtgtgacgtcagattgggtactg

SEQ ID NO: 620589 - DNA, 25 bp, Mus musculus
ctgtgtgacgtctgattgggtactg

SEQ ID NO: 620590 - DNA, 25 bp, Mus musculus
ctgtgtgagaacattgccggccacc

SEQ ID NO: 620591 - DNA, 25 bp, Mus musculus
ctgtgtgagaactttgccggccacc

SEQ ID NO: 620592 - DNA, 25 bp, Mus musculus
ctgtgtgagactcgcttccagccct

SEQ ID NO: 620593 - DNA, 25 bp, Mus musculus
ctgtgtgagactggcttccagccct

SEQ ID NO: 620594 - DNA, 25 bp, Mus musculus
ctgtgtgagctcatgccaggcggca

SEQ ID NO: 620595 - DNA, 25 bp, Mus musculus
ctgtgtgagctcttgccaggcggca

SEQ ID NO: 620596 - DNA, 25 bp, Mus musculus
ctgtgtgcaagaagtttgggctgca

SEQ ID NO: 620597 - DNA, 25 bp, Mus musculus
ctgtgtgcaagatgtttgggctgca

SEQ ID NO: 620598 - DNA, 25 bp, Mus musculus
ctgtgtgcacggagcaccgaggcat

SEQ ID NO: 620599 - DNA, 25 bp, Mus musculus
ctgtgtgcacggtgcaccgaggcat

SEQ ID NO: 620600 - DNA, 25 bp, Mus musculus
ctgtgtgccgggataagatgttcgt

SEQ ID NO: 620601 - DNA, 25 bp, Mus musculus
ctgtgtgccgggttaagatgttcgt

SEQ ID NO: 620602 - DNA, 25 bp, Mus musculus
ctgtgtgctcatcccgaagtgacct

SEQ ID NO: 620603 - DNA, 25 bp, Mus musculus
ctgtgtgctcatgccgaagtgacct

SEQ ID NO: 620604 - DNA, 25 bp, Mus musculus
ctgtgtggagatcttagcccggaca

SEQ ID NO: 620605 - DNA, 25 bp, Mus musculus
ctgtgtggagatgttagcccggaca

SEQ ID NO: 620606 - DNA, 25 bp, Mus musculus
ctgtgtggatcaatgtggccgttct

SEQ ID NO: 620607 - DNA, 25 bp, Mus musculus
ctgtgtggatcattgtggccgttct

SEQ ID NO: 620608 - DNA, 25 bp, Mus musculus
ctgtgtggcagacatctggtctctg

SEQ ID NO: 620609 - DNA, 25 bp, Mus musculus
ctgtgtggcagagatctggtctctg

SEQ ID NO: 620610 - DNA, 25 bp, Mus musculus
ctgtgtggctcgcagacccatgaag

SEQ ID NO: 620611 - DNA, 25 bp, Mus musculus
ctgtgtggctcggagacccatgaag

SEQ ID NO: 620612 - DNA, 25 bp, Mus musculus
ctgtgtggctgcagcatctcgggca

SEQ ID NO: 620613 - DNA, 25 bp, Mus musculus
ctgtgtggctgctgcatctcgggca

SEQ ID NO: 620614 - DNA, 25 bp, Mus musculus
ctgtgtggtgtcctgagtattagca

SEQ ID NO: 620615 - DNA, 25 bp, Mus musculus
ctgtgtggtgtcgtgagtattagca

SEQ ID NO: 620616 - DNA, 25 bp, Mus musculus
ctgtgtgtagggacacggctagcaa

SEQ ID NO: 620617 - DNA, 25 bp, Mus musculus
ctgtgtgtagggtcacggctagcaa

SEQ ID NO: 620618 - DNA, 25 bp, Mus musculus
ctgtgtgtccagagtgagccccggc

SEQ ID NO: 620619 - DNA, 25 bp, Mus musculus
ctgtgtgtccagtgtgagccccggc

SEQ ID NO: 620620 - DNA, 25 bp, Mus musculus
ctgtgtgtgtctcgtgagcctttct

SEQ ID NO: 620621 - DNA, 25 bp, Mus musculus
ctgtgtgtgtctggtgagcctttct

SEQ ID NO: 620622 - DNA, 25 bp, Mus musculus
ctgtgttcacgcagcctcagtttct

SEQ ID NO: 620623 - DNA, 25 bp, Mus musculus
ctgtgttcacgctgcctcagtttct

SEQ ID NO: 620624 - DNA, 25 bp, Mus musculus
ctgtgttccagtcccttaaagagca

SEQ ID NO: 620625 - DNA, 25 bp, Mus musculus
ctgtgttccagtgccttaaagagca

SEQ ID NO: 620626 - DNA, 25 bp, Mus musculus
ctgtgttcccttctctaggcacttc

SEQ ID NO: 620627 - DNA, 25 bp, Mus musculus
ctgtgttcccttgtctaggcacttc

SEQ ID NO: 620628 - DNA, 25 bp, Mus musculus
ctgtgttcgggaccctaaaggaaga

SEQ ID NO: 620629 - DNA, 25 bp, Mus musculus
ctgtgttcgggagcctaaaggaaga

SEQ ID NO: 620630 - DNA, 25 bp, Mus musculus
ctgtgttctattacgagatcctgaa

SEQ ID NO: 620631 - DNA, 25 bp, Mus musculus
ctgtgttctatttcgagatcctgaa

SEQ ID NO: 620632 - DNA, 25 bp, Mus musculus
ctgtgttgggagaagatggcagtgc

SEQ ID NO: 620633 - DNA, 25 bp, Mus musculus
ctgtgttgggagtagatggcagtgc

SEQ ID NO: 620634 - DNA, 25 bp, Mus musculus
ctgtgtttagccctcgccctgggca

SEQ ID NO: 620635 - DNA, 25 bp, Mus musculus
ctgtgtttagccgtcgccctgggca

SEQ ID NO: 620636 - DNA, 25 bp, Mus musculus
ctgtgtttgatactattcagtctgc

SEQ ID NO: 620637 - DNA, 25 bp, Mus musculus
ctgtgtttgatagtattcagtctgc

SEQ ID NO: 620638 - DNA, 25 bp, Mus musculus
ctgtgtttggtgcaatctattgtct

SEQ ID NO: 620639 - DNA, 25 bp, Mus musculus
ctgtgtttggtggaatctattgtct

SEQ ID NO: 620640 - DNA, 25 bp, Mus musculus
ctgtgttttcccctatgtaggtgaa

SEQ ID NO: 620641 - DNA, 25 bp, Mus musculus
ctgtgttttcccgtatgtaggtgaa

SEQ ID NO: 620642 - DNA, 25 bp, Mus musculus
ctgtgttttggtcctgagcaggaac

SEQ ID NO: 620643 - DNA, 25 bp, Mus musculus
ctgtgttttggtgctgagcaggaac

SEQ ID NO: 620644 - DNA, 25 bp, Mus musculus
ctgttaaagtcaagatgcagacttc

SEQ ID NO: 620645 - DNA, 25 bp, Mus musculus
ctgttaaagtcatgatgcagacttc

SEQ ID NO: 620646 - DNA, 25 bp, Mus musculus
ctgttaattaacaacgttattgctc

SEQ ID NO: 620647 - DNA, 25 bp, Mus musculus
ctgttaattaactacgttattgctc

SEQ ID NO: 620648 - DNA, 25 bp, Mus musculus
ctgttacaacctaggcatagaagca

SEQ ID NO: 620649 - DNA, 25 bp, Mus musculus
ctgttacaaccttggcatagaagca

SEQ ID NO: 620650 - DNA, 25 bp, Mus musculus
ctgttacagatgagaccttcctgga

SEQ ID NO: 620651 - DNA, 25 bp, Mus musculus
ctgttacagatgtgaccttcctgga

SEQ ID NO: 620652 - DNA, 25 bp, Mus musculus
ctgttacctccgctactcacaaggg

SEQ ID NO: 620653 - DNA, 25 bp, Mus musculus
ctgttacctccggtactcacaaggg

SEQ ID NO: 620654 - DNA, 25 bp, Mus musculus
ctgttacctgttcaatgacagagcc

SEQ ID NO: 620655 - DNA, 25 bp, Mus musculus
ctgttacctgttgaatgacagagcc

SEQ ID NO: 620656 - DNA, 25 bp, Mus musculus
ctgttaccttggacacggtggctgg

SEQ ID NO: 620657 - DNA, 25 bp, Mus musculus
ctgttaccttggtcacggtggctgg

SEQ ID NO: 620658 - DNA, 25 bp, Mus musculus
ctgttacgaagacaagcagagcccc

SEQ ID NO: 620659 - DNA, 25 bp, Mus musculus
ctgttacgaagagaagcagagcccc

SEQ ID NO: 620660 - DNA, 25 bp, Mus musculus
ctgttacgaatgagttggtgagcca

SEQ ID NO: 620661 - DNA, 25 bp, Mus musculus
ctgttacgaatgtgttggtgagcca

SEQ ID NO: 620662 - DNA, 25 bp, Mus musculus
ctgttacgtttgagccagcaagcca

SEQ ID NO: 620663 - DNA, 25 bp, Mus musculus
ctgttacgtttgtgccagcaagcca

SEQ ID NO: 620664 - DNA, 25 bp, Mus musculus
ctgttactttgactctgagaatgac

SEQ ID NO: 620665 - DNA, 25 bp, Mus musculus
ctgttactttgagtctgagaatgac

SEQ ID NO: 620666 - DNA, 25 bp, Mus musculus
ctgttagaaaataaaggtagtgcat

SEQ ID NO: 620667 - DNA, 25 bp, Mus musculus
ctgttagaaaattaaggtagtgcat

SEQ ID NO: 620668 - DNA, 25 bp, Mus musculus
ctgttagaacgaatgagtaggactt

SEQ ID NO: 620669 - DNA, 25 bp, Mus musculus
ctgttagaacgattgagtaggactt

SEQ ID NO: 620670 - DNA, 25 bp, Mus musculus
ctgttagcactgaatcccgatgcag

SEQ ID NO: 620671 - DNA, 25 bp, Mus musculus
ctgttagcactgtatcccgatgcag

SEQ ID NO: 620672 - DNA, 25 bp, Mus musculus
ctgttaggaaggcaagccctcctga

SEQ ID NO: 620673 - DNA, 25 bp, Mus musculus
ctgttaggaagggaagccctcctga

SEQ ID NO: 620674 - DNA, 25 bp, Mus musculus
ctgttataagccagacaagtgcttt

SEQ ID NO: 620675 - DNA, 25 bp, Mus musculus
ctgttataagcctgacaagtgcttt

SEQ ID NO: 620676 - DNA, 25 bp, Mus musculus
ctgttattatcacgagatgcccaca

SEQ ID NO: 620677 - DNA, 25 bp, Mus musculus
ctgttattatcaggagatgcccaca

SEQ ID NO: 620678 - DNA, 25 bp, Mus musculus
ctgttcaagggcaagaaaggtgttt

SEQ ID NO: 620679 - DNA, 25 bp, Mus musculus
ctgttcaagggctagaaaggtgttt

SEQ ID NO: 620680 - DNA, 25 bp, Mus musculus
ctgttcacagagatcggcctaggga

SEQ ID NO: 620681 - DNA, 25 bp, Mus musculus
ctgttcacagagttcggcctaggga

SEQ ID NO: 620682 - DNA, 25 bp, Mus musculus
ctgttcagcacgctcgagtgggccc

SEQ ID NO: 620683 - DNA, 25 bp, Mus musculus
ctgttcagcacggtcgagtgggccc

SEQ ID NO: 620684 - DNA, 25 bp, Mus musculus
ctgttccaccgtcaggtgcaggctg

SEQ ID NO: 620685 - DNA, 25 bp, Mus musculus
ctgttccaccgtgaggtgcaggctg

SEQ ID NO: 620686 - DNA, 25 bp, Mus musculus
ctgttccagcatccgggaggtccga

SEQ ID NO: 620687 - DNA, 25 bp, Mus musculus
ctgttccagcatgcgggaggtccga

SEQ ID NO: 620688 - DNA, 25 bp, Mus musculus
ctgttcccctgacttctccggaggt

SEQ ID NO: 620689 - DNA, 25 bp, Mus musculus
ctgttcccctgagttctccggaggt

SEQ ID NO: 620690 - DNA, 25 bp, Mus musculus
ctgttccctcttcaggtagcagcgg

SEQ ID NO: 620691 - DNA, 25 bp, Mus musculus
ctgttccctcttgaggtagcagcgg

SEQ ID NO: 620692 - DNA, 25 bp, Mus musculus
ctgttcctgaccaagaggatcctga

SEQ ID NO: 620693 - DNA, 25 bp, Mus musculus
ctgttcctgacctagaggatcctga

SEQ ID NO: 620694 - DNA, 25 bp, Mus musculus
ctgttcctggaaagttaattgtacc

SEQ ID NO: 620695 - DNA, 25 bp, Mus musculus
ctgttcctggaatgttaattgtacc

SEQ ID NO: 620696 - DNA, 25 bp, Mus musculus
ctgttcgagaagcttctccagccaa

SEQ ID NO: 620697 - DNA, 25 bp, Mus musculus
ctgttcgagaaggttctccagccaa

SEQ ID NO: 620698 - DNA, 25 bp, Mus musculus
ctgttcgagagcaatgggcagaacg

SEQ ID NO: 620699 - DNA, 25 bp, Mus musculus
ctgttcgagagctatgggcagaacg

SEQ ID NO: 620700 - DNA, 25 bp, Mus musculus
ctgttcggcttcctgtttgcctgtt

SEQ ID NO: 620701 - DNA, 25 bp, Mus musculus
ctgttcggcttcgtgtttgcctgtt

SEQ ID NO: 620702 - DNA, 25 bp, Mus musculus
ctgttctcaggacccagtgtctctg

SEQ ID NO: 620703 - DNA, 25 bp, Mus musculus
ctgttctcaggagccagtgtctctg

SEQ ID NO: 620704 - DNA, 25 bp, Mus musculus
ctgttctgatcaacatgagttggag

SEQ ID NO: 620705 - DNA, 25 bp, Mus musculus
ctgttctgatcatcatgagttggag

SEQ ID NO: 620706 - DNA, 25 bp, Mus musculus
ctgttctgcacaccggctactttca

SEQ ID NO: 620707 - DNA, 25 bp, Mus musculus
ctgttctgcacagcggctactttca

SEQ ID NO: 620708 - DNA, 25 bp, Mus musculus
ctgttctgtgcaaaggcacggaggt

SEQ ID NO: 620709 - DNA, 25 bp, Mus musculus
ctgttctgtgcataggcacggaggt

SEQ ID NO: 620710 - DNA, 25 bp, Mus musculus
ctgttctgtggactccgtcaagaat

SEQ ID NO: 620711 - DNA, 25 bp, Mus musculus
ctgttctgtggagtccgtcaagaat

SEQ ID NO: 620712 - DNA, 25 bp, Mus musculus
ctgttcttacgacgaggagaaagga

SEQ ID NO: 620713 - DNA, 25 bp, Mus musculus
ctgttcttacgaggaggagaaagga

SEQ ID NO: 620714 - DNA, 25 bp, Mus musculus
ctgttcttcgtgatggagtttctca

SEQ ID NO: 620715 - DNA, 25 bp, Mus musculus
ctgttcttcgtgttggagtttctca

SEQ ID NO: 620716 - DNA, 25 bp, Mus musculus
ctgttgactatgaggccacccggat

SEQ ID NO: 620717 - DNA, 25 bp, Mus musculus
ctgttgactatgtggccacccggat

SEQ ID NO: 620718 - DNA, 25 bp, Mus musculus
ctgttgagccatctacagacttctt

SEQ ID NO: 620719 - DNA, 25 bp, Mus musculus
ctgttgagccatgtacagacttctt

SEQ ID NO: 620720 - DNA, 25 bp, Mus musculus
ctgttgataatcaggtgtatgtggc

SEQ ID NO: 620721 - DNA, 25 bp, Mus musculus
ctgttgataatctggtgtatgtggc

SEQ ID NO: 620722 - DNA, 25 bp, Mus musculus
ctgttgatgccaattagagtggaaa

SEQ ID NO: 620723 - DNA, 25 bp, Mus musculus
ctgttgatgccatttagagtggaaa

SEQ ID NO: 620724 - DNA, 25 bp, Mus musculus
ctgttgatggaaagtgaccagctgc

SEQ ID NO: 620725 - DNA, 25 bp, Mus musculus
ctgttgatggaatgtgaccagctgc

SEQ ID NO: 620726 - DNA, 25 bp, Mus musculus
ctgttgatgtcaagcagtcagttgc

SEQ ID NO: 620727 - DNA, 25 bp, Mus musculus
ctgttgatgtcatgcagtcagttgc

SEQ ID NO: 620728 - DNA, 25 bp, Mus musculus
ctgttgcaacagatgtcccgggtct

SEQ ID NO: 620729 - DNA, 25 bp, Mus musculus
ctgttgcaacagttgtcccgggtct

SEQ ID NO: 620730 - DNA, 25 bp, Mus musculus
ctgttgcactttctgtttggacctc

SEQ ID NO: 620731 - DNA, 25 bp, Mus musculus
ctgttgcactttgtgtttggacctc

SEQ ID NO: 620732 - DNA, 25 bp, Mus musculus
ctgttgccagccagctggactgcaa

SEQ ID NO: 620733 - DNA, 25 bp, Mus musculus
ctgttgccagcctgctggactgcaa

SEQ ID NO: 620734 - DNA, 25 bp, Mus musculus
ctgttgccaggacaaacacccgaga

SEQ ID NO: 620735 - DNA, 25 bp, Mus musculus
ctgttgccaggagaaacacccgaga

SEQ ID NO: 620736 - DNA, 25 bp, Mus musculus
ctgttgccattaaaacgtgcaagga

SEQ ID NO: 620737 - DNA, 25 bp, Mus musculus
ctgttgccattataacgtgcaagga

SEQ ID NO: 620738 - DNA, 25 bp, Mus musculus
ctgttgcccacgctgcagagcatca

SEQ ID NO: 620739 - DNA, 25 bp, Mus musculus
ctgttgcccacggtgcagagcatca

SEQ ID NO: 620740 - DNA, 25 bp, Mus musculus
ctgttgccgctgctcagtacagaag

SEQ ID NO: 620741 - DNA, 25 bp, Mus musculus
ctgttgccgctggtcagtacagaag

SEQ ID NO: 620742 - DNA, 25 bp, Mus musculus
ctgttgctcttcaacctgattcggt

SEQ ID NO: 620743 - DNA, 25 bp, Mus musculus
ctgttgctcttctacctgattcggt

SEQ ID NO: 620744 - DNA, 25 bp, Mus musculus
ctgttgctgcagcttggcttcctga

SEQ ID NO: 620745 - DNA, 25 bp, Mus musculus
ctgttgctgcaggttggcttcctga

SEQ ID NO: 620746 - DNA, 25 bp, Mus musculus
ctgttgcttcagaatggagctgaca

SEQ ID NO: 620747 - DNA, 25 bp, Mus musculus
ctgttgcttcagtatggagctgaca

SEQ ID NO: 620748 - DNA, 25 bp, Mus musculus
ctgttgcttcgcagcatttccaaaa

SEQ ID NO: 620749 - DNA, 25 bp, Mus musculus
ctgttgcttcgctgcatttccaaaa

SEQ ID NO: 620750 - DNA, 25 bp, Mus musculus
ctgttggaacagatctcttccctgt

SEQ ID NO: 620751 - DNA, 25 bp, Mus musculus
ctgttggaacagttctcttccctgt

SEQ ID NO: 620752 - DNA, 25 bp, Mus musculus
ctgttggacctaaaggagaacctgg

SEQ ID NO: 620753 - DNA, 25 bp, Mus musculus
ctgttggacctataggagaacctgg

SEQ ID NO: 620754 - DNA, 25 bp, Mus musculus
ctgttggagacacactgggagtcca

SEQ ID NO: 620755 - DNA, 25 bp, Mus musculus
ctgttggagacagactgggagtcca

SEQ ID NO: 620756 - DNA, 25 bp, Mus musculus
ctgttggagtttcgagccaaggccc

SEQ ID NO: 620757 - DNA, 25 bp, Mus musculus
ctgttggagtttggagccaaggccc

SEQ ID NO: 620758 - DNA, 25 bp, Mus musculus
ctgttggatcaccagtgtctccaag

SEQ ID NO: 620759 - DNA, 25 bp, Mus musculus
ctgttggatcacgagtgtctccaag

SEQ ID NO: 620760 - DNA, 25 bp, Mus musculus
ctgttggcggctccagaaccagatg

SEQ ID NO: 620761 - DNA, 25 bp, Mus musculus
ctgttggcggctgcagaaccagatg

SEQ ID NO: 620762 - DNA, 25 bp, Mus musculus
ctgttggtctttatgcagatgagac

SEQ ID NO: 620763 - DNA, 25 bp, Mus musculus
ctgttggtctttttgcagatgagac

SEQ ID NO: 620764 - DNA, 25 bp, Mus musculus
ctgttggtgacactggagtcccagc

SEQ ID NO: 620765 - DNA, 25 bp, Mus musculus
ctgttggtgacagtggagtcccagc

SEQ ID NO: 620766 - DNA, 25 bp, Mus musculus
ctgttggtgtgcagcaactacaccc

SEQ ID NO: 620767 - DNA, 25 bp, Mus musculus
ctgttggtgtgctgcaactacaccc

SEQ ID NO: 620768 - DNA, 25 bp, Mus musculus
ctgttgtaacaccagcagcgtcaag

SEQ ID NO: 620769 - DNA, 25 bp, Mus musculus
ctgttgtaacacgagcagcgtcaag

SEQ ID NO: 620770 - DNA, 25 bp, Mus musculus
ctgttgtaaccccatgagcatgggt

SEQ ID NO: 620771 - DNA, 25 bp, Mus musculus
ctgttgtaacccgatgagcatgggt

SEQ ID NO: 620772 - DNA, 25 bp, Mus musculus
ctgttgtaggcgatgttctctacac

SEQ ID NO: 620773 - DNA, 25 bp, Mus musculus
ctgttgtaggcgttgttctctacac

SEQ ID NO: 620774 - DNA, 25 bp, Mus musculus
ctgttgtcacgaccgctggtgcccg

SEQ ID NO: 620775 - DNA, 25 bp, Mus musculus
ctgttgtcacgagcgctggtgcccg

SEQ ID NO: 620776 - DNA, 25 bp, Mus musculus
ctgttgtcgggcatggcctgcgcct

SEQ ID NO: 620777 - DNA, 25 bp, Mus musculus
ctgttgtcgggcttggcctgcgcct

SEQ ID NO: 620778 - DNA, 25 bp, Mus musculus
ctgttgtctcagaaatggtgattac

SEQ ID NO: 620779 - DNA, 25 bp, Mus musculus
ctgttgtctcagtaatggtgattac

SEQ ID NO: 620780 - DNA, 25 bp, Mus musculus
ctgttgtgccggctaatctgttcca

SEQ ID NO: 620781 - DNA, 25 bp, Mus musculus
ctgttgtgccgggtaatctgttcca

SEQ ID NO: 620782 - DNA, 25 bp, Mus musculus
ctgttgtggtgcctggtctgtccac

SEQ ID NO: 620783 - DNA, 25 bp, Mus musculus
ctgttgtggtgcgtggtctgtccac

SEQ ID NO: 620784 - DNA, 25 bp, Mus musculus
ctgttgtgtgtgcacattggcgaaa

SEQ ID NO: 620785 - DNA, 25 bp, Mus musculus
ctgttgtgtgtggacattggcgaaa

SEQ ID NO: 620786 - DNA, 25 bp, Mus musculus
ctgtttacctatcacaatgctgcgg

SEQ ID NO: 620787 - DNA, 25 bp, Mus musculus
ctgtttacctatgacaatgctgcgg

SEQ ID NO: 620788 - DNA, 25 bp, Mus musculus
ctgtttataggcattgcagctcttt

SEQ ID NO: 620789 - DNA, 25 bp, Mus musculus
ctgtttataggctttgcagctcttt

SEQ ID NO: 620790 - DNA, 25 bp, Mus musculus
ctgtttatgtttcgcgattggcacc

SEQ ID NO: 620791 - DNA, 25 bp, Mus musculus
ctgtttatgtttggcgattggcacc

SEQ ID NO: 620792 - DNA, 25 bp, Mus musculus
ctgtttcagagtctgtctgcctgcc

SEQ ID NO: 620793 - DNA, 25 bp, Mus musculus
ctgtttcagagtgtgtctgcctgcc

SEQ ID NO: 620794 - DNA, 25 bp, Mus musculus
ctgtttcaggagacatccgtaaagc

SEQ ID NO: 620795 - DNA, 25 bp, Mus musculus
ctgtttcaggagtcatccgtaaagc

SEQ ID NO: 620796 - DNA, 25 bp, Mus musculus
ctgtttcaggccagggcaaaagagg

SEQ ID NO: 620797 - DNA, 25 bp, Mus musculus
ctgtttcaggcctgggcaaaagagg

SEQ ID NO: 620798 - DNA, 25 bp, Mus musculus
ctgtttccagtgcagtccaagtaca

SEQ ID NO: 620799 - DNA, 25 bp, Mus musculus
ctgtttccagtggagtccaagtaca

SEQ ID NO: 620800 - DNA, 25 bp, Mus musculus
ctgtttccatgtccctctcggcaga

SEQ ID NO: 620801 - DNA, 25 bp, Mus musculus
ctgtttccatgtgcctctcggcaga

SEQ ID NO: 620802 - DNA, 25 bp, Mus musculus
ctgtttgattatcgtctgggcagtg

SEQ ID NO: 620803 - DNA, 25 bp, Mus musculus
ctgtttgattatggtctgggcagtg

SEQ ID NO: 620804 - DNA, 25 bp, Mus musculus
ctgtttgcagacctccatgcatacc

SEQ ID NO: 620805 - DNA, 25 bp, Mus musculus
ctgtttgcagacgtccatgcatacc

SEQ ID NO: 620806 - DNA, 25 bp, Mus musculus
ctgtttgcaggtcacattgaagaga

SEQ ID NO: 620807 - DNA, 25 bp, Mus musculus
ctgtttgcaggtgacattgaagaga

SEQ ID NO: 620808 - DNA, 25 bp, Mus musculus
ctgtttgctgcaagctgcatgacac

SEQ ID NO: 620809 - DNA, 25 bp, Mus musculus
ctgtttgctgcatgctgcatgacac

SEQ ID NO: 620810 - DNA, 25 bp, Mus musculus
ctgtttggagaactgcctgattggc

SEQ ID NO: 620811 - DNA, 25 bp, Mus musculus
ctgtttggagaagtgcctgattggc

SEQ ID NO: 620812 - DNA, 25 bp, Mus musculus
ctgtttggatggagcaacggatttt

SEQ ID NO: 620813 - DNA, 25 bp, Mus musculus
ctgtttggatggtgcaacggatttt

SEQ ID NO: 620814 - DNA, 25 bp, Mus musculus
ctgtttggctatcgaaatgaacaga

SEQ ID NO: 620815 - DNA, 25 bp, Mus musculus
ctgtttggctatggaaatgaacaga

SEQ ID NO: 620816 - DNA, 25 bp, Mus musculus
ctgtttgtcaaacgtctgtctgagg

SEQ ID NO: 620817 - DNA, 25 bp, Mus musculus
ctgtttgtcaaaggtctgtctgagg

SEQ ID NO: 620818 - DNA, 25 bp, Mus musculus
ctgtttgtgaatacagactacgaac

SEQ ID NO: 620819 - DNA, 25 bp, Mus musculus
ctgtttgtgaattcagactacgaac

SEQ ID NO: 620820 - DNA, 25 bp, Mus musculus
ctgtttgttagcctgcgaaggcccc

SEQ ID NO: 620821 - DNA, 25 bp, Mus musculus
ctgtttgttagcgtgcgaaggcccc

SEQ ID NO: 620822 - DNA, 25 bp, Mus musculus
ctgttttatgtgattgagacaagcc

SEQ ID NO: 620823 - DNA, 25 bp, Mus musculus
ctgttttatgtgtttgagacaagcc

SEQ ID NO: 620824 - DNA, 25 bp, Mus musculus
ctgttttcaaagagcatcgagactc

SEQ ID NO: 620825 - DNA, 25 bp, Mus musculus
ctgttttcaaagtgcatcgagactc

SEQ ID NO: 620826 - DNA, 25 bp, Mus musculus
ctgttttccttgctgagcaaatacc

SEQ ID NO: 620827 - DNA, 25 bp, Mus musculus
ctgttttccttggtgagcaaatacc

SEQ ID NO: 620828 - DNA, 25 bp, Mus musculus
ctgttttctgacccgggcggcagca

SEQ ID NO: 620829 - DNA, 25 bp, Mus musculus
ctgttttctgacgcgggcggcagca

SEQ ID NO: 620830 - DNA, 25 bp, Mus musculus
ctgttttcttgaagctagctcggaa

SEQ ID NO: 620831 - DNA, 25 bp, Mus musculus
ctgttttcttgatgctagctcggaa

SEQ ID NO: 620832 - DNA, 25 bp, Mus musculus
ctgttttgggctactctgtgtatga

SEQ ID NO: 620833 - DNA, 25 bp, Mus musculus
ctgttttgggcttctctgtgtatga

SEQ ID NO: 620834 - DNA, 25 bp, Mus musculus
cttaaaactgcaacgtgaggagaat

SEQ ID NO: 620835 - DNA, 25 bp, Mus musculus
cttaaaactgcatcgtgaggagaat

SEQ ID NO: 620836 - DNA, 25 bp, Mus musculus
cttaaaagctgacagttgaggccat

SEQ ID NO: 620837 - DNA, 25 bp, Mus musculus
cttaaaagctgagagttgaggccat

SEQ ID NO: 620838 - DNA, 25 bp, Mus musculus
cttaaaagtcgtcctgaccagggct

SEQ ID NO: 620839 - DNA, 25 bp, Mus musculus
cttaaaagtcgtgctgaccagggct

SEQ ID NO: 620840 - DNA, 25 bp, Mus musculus
cttaaaatgattcgcatcaagaagg

SEQ ID NO: 620841 - DNA, 25 bp, Mus musculus
cttaaaatgattggcatcaagaagg

SEQ ID NO: 620842 - DNA, 25 bp, Mus musculus
cttaaacagaagacagtttgtcaga

SEQ ID NO: 620843 - DNA, 25 bp, Mus musculus
cttaaacagaagtcagtttgtcaga

SEQ ID NO: 620844 - DNA, 25 bp, Mus musculus
cttaaagcatgcctcctggattttt

SEQ ID NO: 620845 - DNA, 25 bp, Mus musculus
cttaaagcatgcgtcctggattttt

SEQ ID NO: 620846 - DNA, 25 bp, Mus musculus
cttaaagcatttcgtaattctactg

SEQ ID NO: 620847 - DNA, 25 bp, Mus musculus
cttaaagcatttggtaattctactg

SEQ ID NO: 620848 - DNA, 25 bp, Mus musculus
cttaaagctgtgaaaatgaccctga

SEQ ID NO: 620849 - DNA, 25 bp, Mus musculus
cttaaagctgtgtaaatgaccctga

SEQ ID NO: 620850 - DNA, 25 bp, Mus musculus
cttaaaggagctcggctcaacagct

SEQ ID NO: 620851 - DNA, 25 bp, Mus musculus
cttaaaggagctgggctcaacagct

SEQ ID NO: 620852 - DNA, 25 bp, Mus musculus
cttaaatgagttcgcctggcgcctg

SEQ ID NO: 620853 - DNA, 25 bp, Mus musculus
cttaaatgagttggcctggcgcctg

SEQ ID NO: 620854 - DNA, 25 bp, Mus musculus
cttaacaagctgatggaggcactgg

SEQ ID NO: 620855 - DNA, 25 bp, Mus musculus
cttaacaagctgttggaggcactgg

SEQ ID NO: 620856 - DNA, 25 bp, Mus musculus
cttaacatgggcagcacggcagggt

SEQ ID NO: 620857 - DNA, 25 bp, Mus musculus
cttaacatgggctgcacggcagggt

SEQ ID NO: 620858 - DNA, 25 bp, Mus musculus
cttaaccgcgctacaggttcctcat

SEQ ID NO: 620859 - DNA, 25 bp, Mus musculus
cttaaccgcgcttcaggttcctcat

SEQ ID NO: 620860 - DNA, 25 bp, Mus musculus
cttaactgcttaatttcccactgta

SEQ ID NO: 620861 - DNA, 25 bp, Mus musculus
cttaactgcttattttcccactgta

SEQ ID NO: 620862 - DNA, 25 bp, Mus musculus
cttaagaagacaattggttccaaag

SEQ ID NO: 620863 - DNA, 25 bp, Mus musculus
cttaagaagacatttggttccaaag

SEQ ID NO: 620864 - DNA, 25 bp, Mus musculus
cttaagaggaagatatggtcaaacc

SEQ ID NO: 620865 - DNA, 25 bp, Mus musculus
cttaagaggaagttatggtcaaacc

SEQ ID NO: 620866 - DNA, 25 bp, Mus musculus
cttaagattcataaaggtgggcctc

SEQ ID NO: 620867 - DNA, 25 bp, Mus musculus
cttaagattcattaaggtgggcctc

SEQ ID NO: 620868 - DNA, 25 bp, Mus musculus
cttaagattgctaccctagctggga

SEQ ID NO: 620869 - DNA, 25 bp, Mus musculus
cttaagattgcttccctagctggga

SEQ ID NO: 620870 - DNA, 25 bp, Mus musculus
cttaagcagctacagggaagtattg

SEQ ID NO: 620871 - DNA, 25 bp, Mus musculus
cttaagcagctagagggaagtattg

SEQ ID NO: 620872 - DNA, 25 bp, Mus musculus
cttaagcgagatctagtaacagaga

SEQ ID NO: 620873 - DNA, 25 bp, Mus musculus
cttaagcgagatgtagtaacagaga

SEQ ID NO: 620874 - DNA, 25 bp, Mus musculus
cttaagctgagccttaagtggcagc

SEQ ID NO: 620875 - DNA, 25 bp, Mus musculus
cttaagctgagcgttaagtggcagc

SEQ ID NO: 620876 - DNA, 25 bp, Mus musculus
cttaagcttactccagactggctct

SEQ ID NO: 620877 - DNA, 25 bp, Mus musculus
cttaagcttactgcagactggctct

SEQ ID NO: 620878 - DNA, 25 bp, Mus musculus
cttaaggcaggcctgaaggaagccc

SEQ ID NO: 620879 - DNA, 25 bp, Mus musculus
cttaaggcaggcgtgaaggaagccc

SEQ ID NO: 620880 - DNA, 25 bp, Mus musculus
cttaagggaagaccagacaagaact

SEQ ID NO: 620881 - DNA, 25 bp, Mus musculus
cttaagggaagagcagacaagaact

SEQ ID NO: 620882 - DNA, 25 bp, Mus musculus
cttaagtataggatcacgtggccac

SEQ ID NO: 620883 - DNA, 25 bp, Mus musculus
cttaagtataggttcacgtggccac

SEQ ID NO: 620884 - DNA, 25 bp, Mus musculus
cttaagtcgattcggagcgagctga

SEQ ID NO: 620885 - DNA, 25 bp, Mus musculus
cttaagtcgattgggagcgagctga

SEQ ID NO: 620886 - DNA, 25 bp, Mus musculus
cttaagtgacagagtcccctcctca

SEQ ID NO: 620887 - DNA, 25 bp, Mus musculus
cttaagtgacagtgtcccctcctca

SEQ ID NO: 620888 - DNA, 25 bp, Mus musculus
cttaagttgctcagttacactagaa

SEQ ID NO: 620889 - DNA, 25 bp, Mus musculus
cttaagttgctctgttacactagaa

SEQ ID NO: 620890 - DNA, 25 bp, Mus musculus
cttaataaggatcaaagagtttctg

SEQ ID NO: 620891 - DNA, 25 bp, Mus musculus
cttaataaggatgaaagagtttctg

SEQ ID NO: 620892 - DNA, 25 bp, Mus musculus
cttaatagtgatccccaaatctgtc

SEQ ID NO: 620893 - DNA, 25 bp, Mus musculus
cttaatagtgatgcccaaatctgtc

SEQ ID NO: 620894 - DNA, 25 bp, Mus musculus
cttaatatgtgacagaaatgctggc

SEQ ID NO: 620895 - DNA, 25 bp, Mus musculus
cttaatatgtgagagaaatgctggc

SEQ ID NO: 620896 - DNA, 25 bp, Mus musculus
cttaatgaagccctgaagaggtacc

SEQ ID NO: 620897 - DNA, 25 bp, Mus musculus
cttaatgaagccgtgaagaggtacc

SEQ ID NO: 620898 - DNA, 25 bp, Mus musculus
cttaatgagtctcgaagaatctact

SEQ ID NO: 620899 - DNA, 25 bp, Mus musculus
cttaatgagtctggaagaatctact

SEQ ID NO: 620900 - DNA, 25 bp, Mus musculus
cttaatgcactcctggctacccgag

SEQ ID NO: 620901 - DNA, 25 bp, Mus musculus
cttaatgcactcgtggctacccgag

SEQ ID NO: 620902 - DNA, 25 bp, Mus musculus
cttaatgcagacctgaactccatgg

SEQ ID NO: 620903 - DNA, 25 bp, Mus musculus
cttaatgcagacgtgaactccatgg

SEQ ID NO: 620904 - DNA, 25 bp, Mus musculus
cttaatgggccaaaatacaaatgca

SEQ ID NO: 620905 - DNA, 25 bp, Mus musculus
cttaatgggccataatacaaatgca

SEQ ID NO: 620906 - DNA, 25 bp, Mus musculus
cttaatggtgacagactcctgggcc

SEQ ID NO: 620907 - DNA, 25 bp, Mus musculus
cttaatggtgactgactcctgggcc

SEQ ID NO: 620908 - DNA, 25 bp, Mus musculus
cttaattaacgaagccatggatgtg

SEQ ID NO: 620909 - DNA, 25 bp, Mus musculus
cttaattaacgatgccatggatgtg

SEQ ID NO: 620910 - DNA, 25 bp, Mus musculus
cttaattgatggctcacacaaggtc

SEQ ID NO: 620911 - DNA, 25 bp, Mus musculus
cttaattgatgggtcacacaaggtc

SEQ ID NO: 620912 - DNA, 25 bp, Mus musculus
cttaattgctgtagggactcattcc

SEQ ID NO: 620913 - DNA, 25 bp, Mus musculus
cttaattgctgttgggactcattcc

SEQ ID NO: 620914 - DNA, 25 bp, Mus musculus
cttaatttgggtcttaatcagcatc

SEQ ID NO: 620915 - DNA, 25 bp, Mus musculus
cttaatttgggtgttaatcagcatc

SEQ ID NO: 620916 - DNA, 25 bp, Mus musculus
cttacaaaaggaaaaagtcacaaga

SEQ ID NO: 620917 - DNA, 25 bp, Mus musculus
cttacaaaaggataaagtcacaaga

SEQ ID NO: 620918 - DNA, 25 bp, Mus musculus
cttacaaatctcagctcagctgtgt

SEQ ID NO: 620919 - DNA, 25 bp, Mus musculus
cttacaaatctctgctcagctgtgt

SEQ ID NO: 620920 - DNA, 25 bp, Mus musculus
cttacaaatgccagaaggcctcctc

SEQ ID NO: 620921 - DNA, 25 bp, Mus musculus
cttacaaatgcctgaaggcctcctc

SEQ ID NO: 620922 - DNA, 25 bp, Mus musculus
cttacaagcactatgaggagaccca

SEQ ID NO: 620923 - DNA, 25 bp, Mus musculus
cttacaagcactttgaggagaccca

SEQ ID NO: 620924 - DNA, 25 bp, Mus musculus
cttacaaggctcagcgggagaagga

SEQ ID NO: 620925 - DNA, 25 bp, Mus musculus
cttacaaggctctgcgggagaagga

SEQ ID NO: 620926 - DNA, 25 bp, Mus musculus
cttacaatctaacgaagaagatgaa

SEQ ID NO: 620927 - DNA, 25 bp, Mus musculus
cttacaatctaaggaagaagatgaa

SEQ ID NO: 620928 - DNA, 25 bp, Mus musculus
cttacaccctatattgcatctcctg

SEQ ID NO: 620929 - DNA, 25 bp, Mus musculus
cttacaccctattttgcatctcctg

SEQ ID NO: 620930 - DNA, 25 bp, Mus musculus
cttacacctggtcactcaagtgcaa

SEQ ID NO: 620931 - DNA, 25 bp, Mus musculus
cttacacctggtgactcaagtgcaa

SEQ ID NO: 620932 - DNA, 25 bp, Mus musculus
cttacagaatgaatgcatacagcca

SEQ ID NO: 620933 - DNA, 25 bp, Mus musculus
cttacagaatgattgcatacagcca

SEQ ID NO: 620934 - DNA, 25 bp, Mus musculus
cttacagcgaccacgctggtggaga

SEQ ID NO: 620935 - DNA, 25 bp, Mus musculus
cttacagcgacctcgctggtggaga

SEQ ID NO: 620936 - DNA, 25 bp, Mus musculus
cttacaggattcagcccaatgagga

SEQ ID NO: 620937 - DNA, 25 bp, Mus musculus
cttacaggattctgcccaatgagga

SEQ ID NO: 620938 - DNA, 25 bp, Mus musculus
cttacaggttgtcagagagatgcag

SEQ ID NO: 620939 - DNA, 25 bp, Mus musculus
cttacaggttgtgagagagatgcag

SEQ ID NO: 620940 - DNA, 25 bp, Mus musculus
cttacatatggcagggatcgtaggt

SEQ ID NO: 620941 - DNA, 25 bp, Mus musculus
cttacatatggctgggatcgtaggt

SEQ ID NO: 620942 - DNA, 25 bp, Mus musculus
cttacatcgttcagtgctttggcac

SEQ ID NO: 620943 - DNA, 25 bp, Mus musculus
cttacatcgttctgtgctttggcac

SEQ ID NO: 620944 - DNA, 25 bp, Mus musculus
cttacatctccaagaagctgactcg

SEQ ID NO: 620945 - DNA, 25 bp, Mus musculus
cttacatctccatgaagctgactcg

SEQ ID NO: 620946 - DNA, 25 bp, Mus musculus
cttacatggcatatagagtaacaac

SEQ ID NO: 620947 - DNA, 25 bp, Mus musculus
cttacatggcatttagagtaacaac

SEQ ID NO: 620948 - DNA, 25 bp, Mus musculus
cttacatgttgcagttaagaagcca

SEQ ID NO: 620949 - DNA, 25 bp, Mus musculus
cttacatgttgctgttaagaagcca

SEQ ID NO: 620950 - DNA, 25 bp, Mus musculus
cttaccaagcagaatgaaaagtctg

SEQ ID NO: 620951 - DNA, 25 bp, Mus musculus
cttaccaagcagcaagattgctgcg

SEQ ID NO: 620952 - DNA, 25 bp, Mus musculus
cttaccaagcaggaagattgctgcg

SEQ ID NO: 620953 - DNA, 25 bp, Mus musculus
cttaccaagcagtatgaaaagtctg

SEQ ID NO: 620954 - DNA, 25 bp, Mus musculus
cttaccaaggagcagtcatcttgga

SEQ ID NO: 620955 - DNA, 25 bp, Mus musculus
cttaccaaggaggagtcatcttgga

SEQ ID NO: 620956 - DNA, 25 bp, Mus musculus
cttaccactatcagagagtagagac

SEQ ID NO: 620957 - DNA, 25 bp, Mus musculus
cttaccactatctgagagtagagac

SEQ ID NO: 620958 - DNA, 25 bp, Mus musculus
cttaccacttgaagatgggtggtgg

SEQ ID NO: 620959 - DNA, 25 bp, Mus musculus
cttaccacttgatgatgggtggtgg

SEQ ID NO: 620960 - DNA, 25 bp, Mus musculus
cttaccagaagtccccttgctagtt

SEQ ID NO: 620961 - DNA, 25 bp, Mus musculus
cttaccagaagtgcccttgctagtt

SEQ ID NO: 620962 - DNA, 25 bp, Mus musculus
cttaccgcacgcagttttactacag

SEQ ID NO: 620963 - DNA, 25 bp, Mus musculus
cttaccgcacgctgttttactacag

SEQ ID NO: 620964 - DNA, 25 bp, Mus musculus
cttacctatcaaaaagaagcatttg

SEQ ID NO: 620965 - DNA, 25 bp, Mus musculus
cttacctatcaataagaagcatttg

SEQ ID NO: 620966 - DNA, 25 bp, Mus musculus
cttaccttagctctgccttcagggt

SEQ ID NO: 620967 - DNA, 25 bp, Mus musculus
cttaccttagctgtgccttcagggt

SEQ ID NO: 620968 - DNA, 25 bp, Mus musculus
cttaccttcatgcacgactcagagg

SEQ ID NO: 620969 - DNA, 25 bp, Mus musculus
cttaccttcatggacgactcagagg

SEQ ID NO: 620970 - DNA, 25 bp, Mus musculus
cttacctttaggagctccgatccgg

SEQ ID NO: 620971 - DNA, 25 bp, Mus musculus
cttacctttaggtgctccgatccgg

SEQ ID NO: 620972 - DNA, 25 bp, Mus musculus
cttacctttatgcaagatcagtacc

SEQ ID NO: 620973 - DNA, 25 bp, Mus musculus
cttacctttatggaagatcagtacc

SEQ ID NO: 620974 - DNA, 25 bp, Mus musculus
cttacgaaattgagagggagctccg

SEQ ID NO: 620975 - DNA, 25 bp, Mus musculus
cttacgaaattgtgagggagctccg

SEQ ID NO: 620976 - DNA, 25 bp, Mus musculus
cttacgacacagaggtgtgggagct

SEQ ID NO: 620977 - DNA, 25 bp, Mus musculus
cttacgacacagtggtgtgggagct

SEQ ID NO: 620978 - DNA, 25 bp, Mus musculus
cttacgagaacgacaagaagcgggc

SEQ ID NO: 620979 - DNA, 25 bp, Mus musculus
cttacgagaacgtcaagaagcgggc

SEQ ID NO: 620980 - DNA, 25 bp, Mus musculus
cttacgatgtgcatgagaggaacca

SEQ ID NO: 620981 - DNA, 25 bp, Mus musculus
cttacgatgtgcttgagaggaacca

SEQ ID NO: 620982 - DNA, 25 bp, Mus musculus
cttacgcatcatctgtcacctggag

SEQ ID NO: 620983 - DNA, 25 bp, Mus musculus
cttacgcatcatgtgtcacctggag

SEQ ID NO: 620984 - DNA, 25 bp, Mus musculus
cttacgtagtcaaggagcaggcttt

SEQ ID NO: 620985 - DNA, 25 bp, Mus musculus
cttacgtagtcatggagcaggcttt

SEQ ID NO: 620986 - DNA, 25 bp, Mus musculus
cttacgtcactgatggtgcttgcag

SEQ ID NO: 620987 - DNA, 25 bp, Mus musculus
cttacgtcactgttggtgcttgcag

SEQ ID NO: 620988 - DNA, 25 bp, Mus musculus
cttacgtcttccattccggacatga

SEQ ID NO: 620989 - DNA, 25 bp, Mus musculus
cttacgtcttcctttccggacatga

SEQ ID NO: 620990 - DNA, 25 bp, Mus musculus
cttactacttctcctgaccttgagg

SEQ ID NO: 620991 - DNA, 25 bp, Mus musculus
cttactacttctgctgaccttgagg

SEQ ID NO: 620992 - DNA, 25 bp, Mus musculus
cttactgaccacacaaatgtgaagt

SEQ ID NO: 620993 - DNA, 25 bp, Mus musculus
cttactgaccactcaaatgtgaagt

SEQ ID NO: 620994 - DNA, 25 bp, Mus musculus
cttactggcggtattggctgtgtgt

SEQ ID NO: 620995 - DNA, 25 bp, Mus musculus
cttactggcggttttggctgtgtgt

SEQ ID NO: 620996 - DNA, 25 bp, Mus musculus
cttactggtgtacacaatagcatcc

SEQ ID NO: 620997 - DNA, 25 bp, Mus musculus
cttactggtgtagacaatagcatcc

SEQ ID NO: 620998 - DNA, 25 bp, Mus musculus
cttactgtcggaccagcggtcctgg

SEQ ID NO: 620999 - DNA, 25 bp, Mus musculus
cttactgtcggagcagcggtcctgg

SEQ ID NO: 621000 - DNA, 25 bp, Mus musculus
cttacttaatatagatccaactggc

SEQ ID NO: 621001 - DNA, 25 bp, Mus musculus
cttacttaatattgatccaactggc

SEQ ID NO: 621002 - DNA, 25 bp, Mus musculus
cttacttactcgaagagcaaactgg

SEQ ID NO: 621003 - DNA, 25 bp, Mus musculus
cttacttactcgtagagcaaactgg

SEQ ID NO: 621004 - DNA, 25 bp, Mus musculus
cttacttgggaaaatactgggctat

SEQ ID NO: 621005 - DNA, 25 bp, Mus musculus
cttacttgggaatatactgggctat

SEQ ID NO: 621006 - DNA, 25 bp, Mus musculus
cttactttccacaggatatgcagta

SEQ ID NO: 621007 - DNA, 25 bp, Mus musculus
cttactttccactggatatgcagta

SEQ ID NO: 621008 - DNA, 25 bp, Mus musculus
cttagaacacatagcagttccttcc

SEQ ID NO: 621009 - DNA, 25 bp, Mus musculus
cttagaacacattgcagttccttcc

SEQ ID NO: 621010 - DNA, 25 bp, Mus musculus
cttagaacatcacattcaagtcaga

SEQ ID NO: 621011 - DNA, 25 bp, Mus musculus
cttagaacatcagattcaagtcaga

SEQ ID NO: 621012 - DNA, 25 bp, Mus musculus
cttagaagcatccttggagtctgcg

SEQ ID NO: 621013 - DNA, 25 bp, Mus musculus
cttagaagcatcgttggagtctgcg

SEQ ID NO: 621014 - DNA, 25 bp, Mus musculus
cttagacaccctacagaagaccgtg

SEQ ID NO: 621015 - DNA, 25 bp, Mus musculus
cttagacacccttcagaagaccgtg

SEQ ID NO: 621016 - DNA, 25 bp, Mus musculus
cttagagaaatcaggtcagcgtgac

SEQ ID NO: 621017 - DNA, 25 bp, Mus musculus
cttagagaaatctggtcagcgtgac

SEQ ID NO: 621018 - DNA, 25 bp, Mus musculus
cttagagaactactaaaagaagtga

SEQ ID NO: 621019 - DNA, 25 bp, Mus musculus
cttagagaactagtaaaagaagtga

SEQ ID NO: 621020 - DNA, 25 bp, Mus musculus
cttagagaaggtctagccggtctac

SEQ ID NO: 621021 - DNA, 25 bp, Mus musculus
cttagagaaggtgtagccggtctac

SEQ ID NO: 621022 - DNA, 25 bp, Mus musculus
cttagagaccacacgaaaggagata

SEQ ID NO: 621023 - DNA, 25 bp, Mus musculus
cttagagaccactcgaaaggagata

SEQ ID NO: 621024 - DNA, 25 bp, Mus musculus
cttagagagcttaacactcagtggg

SEQ ID NO: 621025 - DNA, 25 bp, Mus musculus
cttagagagctttacactcagtggg

SEQ ID NO: 621026 - DNA, 25 bp, Mus musculus
cttagagagtgacatggacagcgtc

SEQ ID NO: 621027 - DNA, 25 bp, Mus musculus
cttagagagtgagatggacagcgtc

SEQ ID NO: 621028 - DNA, 25 bp, Mus musculus
cttagagatggcacccaatgtcccc

SEQ ID NO: 621029 - DNA, 25 bp, Mus musculus
cttagagatggctcccaatgtcccc

SEQ ID NO: 621030 - DNA, 25 bp, Mus musculus
cttagagcgtctacgggatccagca

SEQ ID NO: 621031 - DNA, 25 bp, Mus musculus
cttagagcgtcttcgggatccagca

SEQ ID NO: 621032 - DNA, 25 bp, Mus musculus
cttagagctccaaccggcagtggcg

SEQ ID NO: 621033 - DNA, 25 bp, Mus musculus
cttagagctccatccggcagtggcg

SEQ ID NO: 621034 - DNA, 25 bp, Mus musculus
cttagaggcccgagcctgtgcagct

SEQ ID NO: 621035 - DNA, 25 bp, Mus musculus
cttagaggcccgtgcctgtgcagct

SEQ ID NO: 621036 - DNA, 25 bp, Mus musculus
cttagagttcaccaggaccagacct

SEQ ID NO: 621037 - DNA, 25 bp, Mus musculus
cttagagttcacgaggaccagacct

SEQ ID NO: 621038 - DNA, 25 bp, Mus musculus
cttagatagtaaattccccggagtg

SEQ ID NO: 621039 - DNA, 25 bp, Mus musculus
cttagatagtaatttccccggagtg

SEQ ID NO: 621040 - DNA, 25 bp, Mus musculus
cttagatatgatcccgcacttggag

SEQ ID NO: 621041 - DNA, 25 bp, Mus musculus
cttagatatgatgccgcacttggag

SEQ ID NO: 621042 - DNA, 25 bp, Mus musculus
cttagatgcgccacggcttcggtag

SEQ ID NO: 621043 - DNA, 25 bp, Mus musculus
cttagatgcgcctcggcttcggtag

SEQ ID NO: 621044 - DNA, 25 bp, Mus musculus
cttagatgtggaccaacttggaatc

SEQ ID NO: 621045 - DNA, 25 bp, Mus musculus
cttagatgtggagcaacttggaatc

SEQ ID NO: 621046 - DNA, 25 bp, Mus musculus
cttagcaacgtccagtccaagtgtg

SEQ ID NO: 621047 - DNA, 25 bp, Mus musculus
cttagcaacgtcgagtccaagtgtg

SEQ ID NO: 621048 - DNA, 25 bp, Mus musculus
cttagcaggaccatgagcgaggaca

SEQ ID NO: 621049 - DNA, 25 bp, Mus musculus
cttagcaggaccttgagcgaggaca

SEQ ID NO: 621050 - DNA, 25 bp, Mus musculus
cttagcccctggcatgggtgacctg

SEQ ID NO: 621051 - DNA, 25 bp, Mus musculus
cttagcccctgggatgggtgacctg

SEQ ID NO: 621052 - DNA, 25 bp, Mus musculus
cttagccggcaacgatgcagcagca

SEQ ID NO: 621053 - DNA, 25 bp, Mus musculus
cttagccggcaaggatgcagcagca

SEQ ID NO: 621054 - DNA, 25 bp, Mus musculus
cttagccgggagcttggatctactg

SEQ ID NO: 621055 - DNA, 25 bp, Mus musculus
cttagccgggaggttggatctactg

SEQ ID NO: 621056 - DNA, 25 bp, Mus musculus
cttagcctcgcaaatctctaagtgc

SEQ ID NO: 621057 - DNA, 25 bp, Mus musculus
cttagcctcgcatatctctaagtgc

SEQ ID NO: 621058 - DNA, 25 bp, Mus musculus
cttagcgggtaaagcgcttgcagca

SEQ ID NO: 621059 - DNA, 25 bp, Mus musculus
cttagcgggtaatgcgcttgcagca

SEQ ID NO: 621060 - DNA, 25 bp, Mus musculus
cttagctccgaactagtgtagcagc

SEQ ID NO: 621061 - DNA, 25 bp, Mus musculus
cttagctccgaagtagtgtagcagc

SEQ ID NO: 621062 - DNA, 25 bp, Mus musculus
cttagctgaagacgttggcaataag

SEQ ID NO: 621063 - DNA, 25 bp, Mus musculus
cttagctgaagaggttggcaataag

SEQ ID NO: 621064 - DNA, 25 bp, Mus musculus
cttagctgagggacccggaagcact

SEQ ID NO: 621065 - DNA, 25 bp, Mus musculus
cttagctgagggtcccggaagcact

SEQ ID NO: 621066 - DNA, 25 bp, Mus musculus
cttagctggacacgacaaccgagtc

SEQ ID NO: 621067 - DNA, 25 bp, Mus musculus
cttagctggacaggacaaccgagtc

SEQ ID NO: 621068 - DNA, 25 bp, Mus musculus
cttagctggctgacaccttcccttg

SEQ ID NO: 621069 - DNA, 25 bp, Mus musculus
cttagctggctgtcaccttcccttg

SEQ ID NO: 621070 - DNA, 25 bp, Mus musculus
cttaggactggaccctggataacca

SEQ ID NO: 621071 - DNA, 25 bp, Mus musculus
cttaggactggagcctggataacca

SEQ ID NO: 621072 - DNA, 25 bp, Mus musculus
cttaggagaagtcatgagaagccca

SEQ ID NO: 621073 - DNA, 25 bp, Mus musculus
cttaggagaagtgatgagaagccca

SEQ ID NO: 621074 - DNA, 25 bp, Mus musculus
cttaggagactgcaccgcaagcact

SEQ ID NO: 621075 - DNA, 25 bp, Mus musculus
cttaggagactggaccgcaagcact

SEQ ID NO: 621076 - DNA, 25 bp, Mus musculus
cttaggatcatacaggtgacagtcg

SEQ ID NO: 621077 - DNA, 25 bp, Mus musculus
cttaggatcatagaggtgacagtcg

SEQ ID NO: 621078 - DNA, 25 bp, Mus musculus
cttagggaagaccatgaaggatcag

SEQ ID NO: 621079 - DNA, 25 bp, Mus musculus
cttagggaagacgatgaaggatcag

SEQ ID NO: 621080 - DNA, 25 bp, Mus musculus
cttagggcttcaccagtgcgcgtgc

SEQ ID NO: 621081 - DNA, 25 bp, Mus musculus
cttagggcttcagcagtgcgcgtgc

SEQ ID NO: 621082 - DNA, 25 bp, Mus musculus
cttagggtacctcacaacgggcact

SEQ ID NO: 621083 - DNA, 25 bp, Mus musculus
cttagggtacctgacaacgggcact

SEQ ID NO: 621084 - DNA, 25 bp, Mus musculus
cttagggtcagcctcccaaggagac

SEQ ID NO: 621085 - DNA, 25 bp, Mus musculus
cttagggtcagcgtcccaaggagac

SEQ ID NO: 621086 - DNA, 25 bp, Mus musculus
cttagggtttaacaagatgtgttgc

SEQ ID NO: 621087 - DNA, 25 bp, Mus musculus
cttagggtttaagaagatgtgttgc

SEQ ID NO: 621088 - DNA, 25 bp, Mus musculus
cttagtagaacgagctggacgacgg

SEQ ID NO: 621089 - DNA, 25 bp, Mus musculus
cttagtagaacgtgctggacgacgg

SEQ ID NO: 621090 - DNA, 25 bp, Mus musculus
cttagtagcaagcacaaaacaattc

SEQ ID NO: 621091 - DNA, 25 bp, Mus musculus
cttagtagcaaggacaaaacaattc

SEQ ID NO: 621092 - DNA, 25 bp, Mus musculus
cttagtagtgtcctggagctgcagc

SEQ ID NO: 621093 - DNA, 25 bp, Mus musculus
cttagtagtgtcgtggagctgcagc

SEQ ID NO: 621094 - DNA, 25 bp, Mus musculus
cttagtctgcccctgcagtctgtat

SEQ ID NO: 621095 - DNA, 25 bp, Mus musculus
cttagtctgcccgtgcagtctgtat

SEQ ID NO: 621096 - DNA, 25 bp, Mus musculus
cttagtgagattctagacatggttc

SEQ ID NO: 621097 - DNA, 25 bp, Mus musculus
cttagtgagattgtagacatggttc

SEQ ID NO: 621098 - DNA, 25 bp, Mus musculus
cttagtgatgggatggatgaagtcc

SEQ ID NO: 621099 - DNA, 25 bp, Mus musculus
cttagtgatgggttggatgaagtcc

SEQ ID NO: 621100 - DNA, 25 bp, Mus musculus
cttagtgcatgaatcgttccttgat

SEQ ID NO: 621101 - DNA, 25 bp, Mus musculus
cttagtgcatgattcgttccttgat

SEQ ID NO: 621102 - DNA, 25 bp, Mus musculus
cttagtggaagaacatgggtctgtc

SEQ ID NO: 621103 - DNA, 25 bp, Mus musculus
cttagtggaagatcatgggtctgtc

SEQ ID NO: 621104 - DNA, 25 bp, Mus musculus
cttagtggtagcatttgtctgcaag

SEQ ID NO: 621105 - DNA, 25 bp, Mus musculus
cttagtggtagcttttgtctgcaag

SEQ ID NO: 621106 - DNA, 25 bp, Mus musculus
cttagttaggacaggagtgcttggc

SEQ ID NO: 621107 - DNA, 25 bp, Mus musculus
cttagttaggactggagtgcttggc

SEQ ID NO: 621108 - DNA, 25 bp, Mus musculus
cttagttctccacgaagttggctct

SEQ ID NO: 621109 - DNA, 25 bp, Mus musculus
cttagttctccaggaagttggctct

SEQ ID NO: 621110 - DNA, 25 bp, Mus musculus
cttagtttcttcagcgagtcgccgg

SEQ ID NO: 621111 - DNA, 25 bp, Mus musculus
cttagtttcttctgcgagtcgccgg

SEQ ID NO: 621112 - DNA, 25 bp, Mus musculus
cttataaacttcagcctcagggctc

SEQ ID NO: 621113 - DNA, 25 bp, Mus musculus
cttataaacttctgcctcagggctc

SEQ ID NO: 621114 - DNA, 25 bp, Mus musculus
cttataccacaaagagagcgaggtg

SEQ ID NO: 621115 - DNA, 25 bp, Mus musculus
cttataccacaatgagagcgaggtg

SEQ ID NO: 621116 - DNA, 25 bp, Mus musculus
cttatagataagcagggaccccagc

SEQ ID NO: 621117 - DNA, 25 bp, Mus musculus
cttatagataaggagggaccccagc

SEQ ID NO: 621118 - DNA, 25 bp, Mus musculus
cttatatcttgaaaactgggccgta

SEQ ID NO: 621119 - DNA, 25 bp, Mus musculus
cttatatcttgataactgggccgta

SEQ ID NO: 621120 - DNA, 25 bp, Mus musculus
cttatatggattagcaaaggagtcc

SEQ ID NO: 621121 - DNA, 25 bp, Mus musculus
cttatatggatttgcaaaggagtcc

SEQ ID NO: 621122 - DNA, 25 bp, Mus musculus
cttatccaaaccagtggctggtacc

SEQ ID NO: 621123 - DNA, 25 bp, Mus musculus
cttatccaaacctgtggctggtacc

SEQ ID NO: 621124 - DNA, 25 bp, Mus musculus
cttatccttgtcagtgggactggcc

SEQ ID NO: 621125 - DNA, 25 bp, Mus musculus
cttatccttgtctgtgggactggcc

SEQ ID NO: 621126 - DNA, 25 bp, Mus musculus
cttatcgctcaacatgaagaacgag

SEQ ID NO: 621127 - DNA, 25 bp, Mus musculus
cttatcgctcaagatgaagaacgag

SEQ ID NO: 621128 - DNA, 25 bp, Mus musculus
cttatcgctcagaaagttcgaggtg

SEQ ID NO: 621129 - DNA, 25 bp, Mus musculus
cttatcgctcagtaagttcgaggtg

SEQ ID NO: 621130 - DNA, 25 bp, Mus musculus
cttatcggaggacgtaagcccgcag

SEQ ID NO: 621131 - DNA, 25 bp, Mus musculus
cttatcggaggaggtaagcccgcag

SEQ ID NO: 621132 - DNA, 25 bp, Mus musculus
cttatctaaatcagtgcctgccaca

SEQ ID NO: 621133 - DNA, 25 bp, Mus musculus
cttatctaaatctgtgcctgccaca

SEQ ID NO: 621134 - DNA, 25 bp, Mus musculus
cttatctacagacagacatacccca

SEQ ID NO: 621135 - DNA, 25 bp, Mus musculus
cttatctacagagagacatacccca

SEQ ID NO: 621136 - DNA, 25 bp, Mus musculus
cttatctagtgtattcaaaggatcc

SEQ ID NO: 621137 - DNA, 25 bp, Mus musculus
cttatctagtgttttcaaaggatcc

SEQ ID NO: 621138 - DNA, 25 bp, Mus musculus
cttatcttccgtaacgccttcacgt

SEQ ID NO: 621139 - DNA, 25 bp, Mus musculus
cttatcttccgttacgccttcacgt

SEQ ID NO: 621140 - DNA, 25 bp, Mus musculus
cttatgaaaagccagcttaaagcag

SEQ ID NO: 621141 - DNA, 25 bp, Mus musculus
cttatgaaaagcgagcttaaagcag

SEQ ID NO: 621142 - DNA, 25 bp, Mus musculus
cttatgaaccctacgtctgcatcta

SEQ ID NO: 621143 - DNA, 25 bp, Mus musculus
cttatgaacccttcgtctgcatcta

SEQ ID NO: 621144 - DNA, 25 bp, Mus musculus
cttatgaacgtgagcctgttgctgc

SEQ ID NO: 621145 - DNA, 25 bp, Mus musculus
cttatgaacgtgtgcctgttgctgc

SEQ ID NO: 621146 - DNA, 25 bp, Mus musculus
cttatgaagagaataacgatactgg

SEQ ID NO: 621147 - DNA, 25 bp, Mus musculus
cttatgaagagattaacgatactgg

SEQ ID NO: 621148 - DNA, 25 bp, Mus musculus
cttatgacaactacggactagatcc

SEQ ID NO: 621149 - DNA, 25 bp, Mus musculus
cttatgacaacttcggactagatcc

SEQ ID NO: 621150 - DNA, 25 bp, Mus musculus
cttatgagtgagaacttgggagctc

SEQ ID NO: 621151 - DNA, 25 bp, Mus musculus
cttatgagtgagtacttgggagctc

SEQ ID NO: 621152 - DNA, 25 bp, Mus musculus
cttatgcaccctacgtggagcccag

SEQ ID NO: 621153 - DNA, 25 bp, Mus musculus
cttatgcacccttcgtggagcccag

SEQ ID NO: 621154 - DNA, 25 bp, Mus musculus
cttatgcccaggagaaaccctccag

SEQ ID NO: 621155 - DNA, 25 bp, Mus musculus
cttatgcccaggtgaaaccctccag

SEQ ID NO: 621156 - DNA, 25 bp, Mus musculus
cttatgcgtggcactgctagaggga

SEQ ID NO: 621157 - DNA, 25 bp, Mus musculus
cttatgcgtggctctgctagaggga

SEQ ID NO: 621158 - DNA, 25 bp, Mus musculus
cttatgctgatgctctatatctgcc

SEQ ID NO: 621159 - DNA, 25 bp, Mus musculus
cttatgctgatggtctatatctgcc

SEQ ID NO: 621160 - DNA, 25 bp, Mus musculus
cttatggccaggatagtgtttcact

SEQ ID NO: 621161 - DNA, 25 bp, Mus musculus
cttatggccaggttagtgtttcact

SEQ ID NO: 621162 - DNA, 25 bp, Mus musculus
cttatggcgaccctcgactgtccct

SEQ ID NO: 621163 - DNA, 25 bp, Mus musculus
cttatggcgaccgtcgactgtccct

SEQ ID NO: 621164 - DNA, 25 bp, Mus musculus
cttatgtacgtgaagagcatgaagg

SEQ ID NO: 621165 - DNA, 25 bp, Mus musculus
cttatgtacgtgtagagcatgaagg

SEQ ID NO: 621166 - DNA, 25 bp, Mus musculus
cttatgtagtggaagttatttctcc

SEQ ID NO: 621167 - DNA, 25 bp, Mus musculus
cttatgtagtggtagttatttctcc

SEQ ID NO: 621168 - DNA, 25 bp, Mus musculus
cttatgtcatctcgtacctggtgga

SEQ ID NO: 621169 - DNA, 25 bp, Mus musculus
cttatgtcatctggtacctggtgga

SEQ ID NO: 621170 - DNA, 25 bp, Mus musculus
cttatgtcattgagttattcctcta

SEQ ID NO: 621171 - DNA, 25 bp, Mus musculus
cttatgtcattgtgttattcctcta

SEQ ID NO: 621172 - DNA, 25 bp, Mus musculus
cttatgtctcctatcccctgcaggg

SEQ ID NO: 621173 - DNA, 25 bp, Mus musculus
cttatgtctcctttcccctgcaggg

SEQ ID NO: 621174 - DNA, 25 bp, Mus musculus
cttatgtggaacctctccctgacta

SEQ ID NO: 621175 - DNA, 25 bp, Mus musculus
cttatgtggaacgtctccctgacta

SEQ ID NO: 621176 - DNA, 25 bp, Mus musculus
cttatgtggcctctcccagttgctg

SEQ ID NO: 621177 - DNA, 25 bp, Mus musculus
cttatgtggcctgtcccagttgctg

SEQ ID NO: 621178 - DNA, 25 bp, Mus musculus
cttattatgatcatgtaccttctga

SEQ ID NO: 621179 - DNA, 25 bp, Mus musculus
cttattatgatcttgtaccttctga

SEQ ID NO: 621180 - DNA, 25 bp, Mus musculus
cttattatgcccctgatgccctggc

SEQ ID NO: 621181 - DNA, 25 bp, Mus musculus
cttattatgcccgtgatgccctggc

SEQ ID NO: 621182 - DNA, 25 bp, Mus musculus
cttattgaagctccaaaaggtggcc

SEQ ID NO: 621183 - DNA, 25 bp, Mus musculus
cttattgaagctgcaaaaggtggcc

SEQ ID NO: 621184 - DNA, 25 bp, Mus musculus
cttattgacatcattcgagagaaag

SEQ ID NO: 621185 - DNA, 25 bp, Mus musculus
cttattgacatctttcgagagaaag

SEQ ID NO: 621186 - DNA, 25 bp, Mus musculus
cttattgagtcaaaccatggtactt

SEQ ID NO: 621187 - DNA, 25 bp, Mus musculus
cttattgagtcataccatggtactt

SEQ ID NO: 621188 - DNA, 25 bp, Mus musculus
cttattgcctttccactctggatgg

SEQ ID NO: 621189 - DNA, 25 bp, Mus musculus
cttattgcctttgcactctggatgg

SEQ ID NO: 621190 - DNA, 25 bp, Mus musculus
cttattgttggaaggccaggagaac

SEQ ID NO: 621191 - DNA, 25 bp, Mus musculus
cttattgttggatggccaggagaac

SEQ ID NO: 621192 - DNA, 25 bp, Mus musculus
cttatttcttgcataaagcaaggca

SEQ ID NO: 621193 - DNA, 25 bp, Mus musculus
cttatttcttgcttaaagcaaggca

SEQ ID NO: 621194 - DNA, 25 bp, Mus musculus
cttatttttatccagcacaaacgga

SEQ ID NO: 621195 - DNA, 25 bp, Mus musculus
cttatttttatcgagcacaaacgga

SEQ ID NO: 621196 - DNA, 25 bp, Mus musculus
cttcaaaatggacctgtcccgcctt

SEQ ID NO: 621197 - DNA, 25 bp, Mus musculus
cttcaaaatggagctgtcccgcctt

SEQ ID NO: 621198 - DNA, 25 bp, Mus musculus
cttcaaaatttcctcaaaggagaag

SEQ ID NO: 621199 - DNA, 25 bp, Mus musculus
cttcaaaatttcgtcaaaggagaag

SEQ ID NO: 621200 - DNA, 25 bp, Mus musculus
cttcaaagaactcggagaggccaga

SEQ ID NO: 621201 - DNA, 25 bp, Mus musculus
cttcaaagaactgggagaggccaga

SEQ ID NO: 621202 - DNA, 25 bp, Mus musculus
cttcaaagacctcgatgtggctgtc

SEQ ID NO: 621203 - DNA, 25 bp, Mus musculus
cttcaaagacctggatgtggctgtc

SEQ ID NO: 621204 - DNA, 25 bp, Mus musculus
cttcaaagccttagacaagcacatg

SEQ ID NO: 621205 - DNA, 25 bp, Mus musculus
cttcaaagcctttgacaagcacatg

SEQ ID NO: 621206 - DNA, 25 bp, Mus musculus
cttcaaaggcaacagctggaggcta

SEQ ID NO: 621207 - DNA, 25 bp, Mus musculus
cttcaaaggcaagagctggaggcta

SEQ ID NO: 621208 - DNA, 25 bp, Mus musculus
cttcaaagtggtcgtgatctcagcc

SEQ ID NO: 621209 - DNA, 25 bp, Mus musculus
cttcaaagtggtggtgatctcagcc

SEQ ID NO: 621210 - DNA, 25 bp, Mus musculus
cttcaaatttccaatgtaacgatgt

SEQ ID NO: 621211 - DNA, 25 bp, Mus musculus
cttcaaatttcctatgtaacgatgt

SEQ ID NO: 621212 - DNA, 25 bp, Mus musculus
cttcaacagactagcctctgggcac

SEQ ID NO: 621213 - DNA, 25 bp, Mus musculus
cttcaacagacttgcctctgggcac

SEQ ID NO: 621214 - DNA, 25 bp, Mus musculus
cttcaacagagtaacctctggaggg

SEQ ID NO: 621215 - DNA, 25 bp, Mus musculus
cttcaacagagttacctctggaggg

SEQ ID NO: 621216 - DNA, 25 bp, Mus musculus
cttcaacccgctactgggagagact

SEQ ID NO: 621217 - DNA, 25 bp, Mus musculus
cttcaacccgcttctgggagagact

SEQ ID NO: 621218 - DNA, 25 bp, Mus musculus
cttcaaccggacagacttcctgggc

SEQ ID NO: 621219 - DNA, 25 bp, Mus musculus
cttcaaccggactgacttcctgggc

SEQ ID NO: 621220 - DNA, 25 bp, Mus musculus
cttcaacctgaaacctctggttcac

SEQ ID NO: 621221 - DNA, 25 bp, Mus musculus
cttcaacctgaatcctctggttcac

SEQ ID NO: 621222 - DNA, 25 bp, Mus musculus
cttcaacgagaaagttggcatcgcc

SEQ ID NO: 621223 - DNA, 25 bp, Mus musculus
cttcaacgagaatgttggcatcgcc

SEQ ID NO: 621224 - DNA, 25 bp, Mus musculus
cttcaactctgcacacgacacagac

SEQ ID NO: 621225 - DNA, 25 bp, Mus musculus
cttcaactctgctcacgacacagac

SEQ ID NO: 621226 - DNA, 25 bp, Mus musculus
cttcaagagcttacacagtggactg

SEQ ID NO: 621227 - DNA, 25 bp, Mus musculus
cttcaagagctttcacagtggactg

SEQ ID NO: 621228 - DNA, 25 bp, Mus musculus
cttcaagaggccagagggcatgcat

SEQ ID NO: 621229 - DNA, 25 bp, Mus musculus
cttcaagaggcctgagggcatgcat

SEQ ID NO: 621230 - DNA, 25 bp, Mus musculus
cttcaagagggacatgtcgtccaag

SEQ ID NO: 621231 - DNA, 25 bp, Mus musculus
cttcaagagggagatgtcgtccaag

SEQ ID NO: 621232 - DNA, 25 bp, Mus musculus
cttcaagatcaacgccgtgggtcgt

SEQ ID NO: 621233 - DNA, 25 bp, Mus musculus
cttcaagatcaaggccgtgggtcgt

SEQ ID NO: 621234 - DNA, 25 bp, Mus musculus
cttcaagatgcacaataaatccgtc

SEQ ID NO: 621235 - DNA, 25 bp, Mus musculus
cttcaagatgcagaataaatccgtc

SEQ ID NO: 621236 - DNA, 25 bp, Mus musculus
cttcaagatgggagcccgcacagag

SEQ ID NO: 621237 - DNA, 25 bp, Mus musculus
cttcaagatgggtgcccgcacagag

SEQ ID NO: 621238 - DNA, 25 bp, Mus musculus
cttcaagcttgacgccgtggagaag

SEQ ID NO: 621239 - DNA, 25 bp, Mus musculus
cttcaagcttgaggccgtggagaag

SEQ ID NO: 621240 - DNA, 25 bp, Mus musculus
cttcaaggagcgaagggaggcaaga

SEQ ID NO: 621241 - DNA, 25 bp, Mus musculus
cttcaaggagcgtagggaggcaaga

SEQ ID NO: 621242 - DNA, 25 bp, Mus musculus
cttcaaggagtaagttgtgctggtg

SEQ ID NO: 621243 - DNA, 25 bp, Mus musculus
cttcaaggagtatgttgtgctggtg

SEQ ID NO: 621244 - DNA, 25 bp, Mus musculus
cttcaaggtcttacaagtgatcgga

SEQ ID NO: 621245 - DNA, 25 bp, Mus musculus
cttcaaggtcttacctggaagcact

SEQ ID NO: 621246 - DNA, 25 bp, Mus musculus
cttcaaggtctttcaagtgatcgga

SEQ ID NO: 621247 - DNA, 25 bp, Mus musculus
cttcaaggtctttcctggaagcact

SEQ ID NO: 621248 - DNA, 25 bp, Mus musculus
cttcaaggtggaaggtgagtcttcg

SEQ ID NO: 621249 - DNA, 25 bp, Mus musculus
cttcaaggtggatggtgagtcttcg

SEQ ID NO: 621250 - DNA, 25 bp, Mus musculus
cttcaaggttacatcgcggagtggg

SEQ ID NO: 621251 - DNA, 25 bp, Mus musculus
cttcaaggttacttcgcggagtggg

SEQ ID NO: 621252 - DNA, 25 bp, Mus musculus
cttcaagtcacccaagggaggtgag

SEQ ID NO: 621253 - DNA, 25 bp, Mus musculus
cttcaagtcaccgaagggaggtgag

SEQ ID NO: 621254 - DNA, 25 bp, Mus musculus
cttcaagtctggacttaagtacaag

SEQ ID NO: 621255 - DNA, 25 bp, Mus musculus
cttcaagtctggtcttaagtacaag

SEQ ID NO: 621256 - DNA, 25 bp, Mus musculus
cttcaagtgtaacccgatcagcatg

SEQ ID NO: 621257 - DNA, 25 bp, Mus musculus
cttcaagtgtaagccgatcagcatg

SEQ ID NO: 621258 - DNA, 25 bp, Mus musculus
cttcaataaggaatacgggacctat

SEQ ID NO: 621259 - DNA, 25 bp, Mus musculus
cttcaataaggattacgggacctat

SEQ ID NO: 621260 - DNA, 25 bp, Mus musculus
cttcaatgactgcaagggcaacgag

SEQ ID NO: 621261 - DNA, 25 bp, Mus musculus
cttcaatgactggaagggcaacgag

SEQ ID NO: 621262 - DNA, 25 bp, Mus musculus
cttcaatgagacattcactttcaag

SEQ ID NO: 621263 - DNA, 25 bp, Mus musculus
cttcaatgagactttcactttcaag

SEQ ID NO: 621264 - DNA, 25 bp, Mus musculus
cttcaatgagatcaacaagatcccc

SEQ ID NO: 621265 - DNA, 25 bp, Mus musculus
cttcaatgagatgaacaagatcccc

SEQ ID NO: 621266 - DNA, 25 bp, Mus musculus
cttcaatgagctaccctcccgaagg

SEQ ID NO: 621267 - DNA, 25 bp, Mus musculus
cttcaatgagcttccctcccgaagg

SEQ ID NO: 621268 - DNA, 25 bp, Mus musculus
cttcaatgccaacaccagtttcatg

SEQ ID NO: 621269 - DNA, 25 bp, Mus musculus
cttcaatgccaagaccagtttcatg

SEQ ID NO: 621270 - DNA, 25 bp, Mus musculus
cttcaatgctgtaggcgatggcata

SEQ ID NO: 621271 - DNA, 25 bp, Mus musculus
cttcaatgctgttggcgatggcata

SEQ ID NO: 621272 - DNA, 25 bp, Mus musculus
cttcaatgtcccaggagaaagaccc

SEQ ID NO: 621273 - DNA, 25 bp, Mus musculus
cttcaatgtccctggagaaagaccc

SEQ ID NO: 621274 - DNA, 25 bp, Mus musculus
cttcaatgttgtctgcaaggagtgt

SEQ ID NO: 621275 - DNA, 25 bp, Mus musculus
cttcaatgttgtgtgcaaggagtgt

SEQ ID NO: 621276 - DNA, 25 bp, Mus musculus
cttcaattgctgagaagaaagtgca

SEQ ID NO: 621277 - DNA, 25 bp, Mus musculus
cttcaattgctgtgaagaaagtgca

SEQ ID NO: 621278 - DNA, 25 bp, Mus musculus
cttcacaaaggacctggataaagcc

SEQ ID NO: 621279 - DNA, 25 bp, Mus musculus
cttcacaaaggagctggataaagcc

SEQ ID NO: 621280 - DNA, 25 bp, Mus musculus
cttcacaaagggaggcaaaggattg

SEQ ID NO: 621281 - DNA, 25 bp, Mus musculus
cttcacaaagggtggcaaaggattg

SEQ ID NO: 621282 - DNA, 25 bp, Mus musculus
cttcacaactttcgtgggagggcct

SEQ ID NO: 621283 - DNA, 25 bp, Mus musculus
cttcacaactttggtgggagggcct

SEQ ID NO: 621284 - DNA, 25 bp, Mus musculus
cttcacacaacgaactagaaaagca

SEQ ID NO: 621285 - DNA, 25 bp, Mus musculus
cttcacacaacgtactagaaaagca

SEQ ID NO: 621286 - DNA, 25 bp, Mus musculus
cttcacacaggacgccgctgtgagt

SEQ ID NO: 621287 - DNA, 25 bp, Mus musculus
cttcacacaggaggccgctgtgagt

SEQ ID NO: 621288 - DNA, 25 bp, Mus musculus
cttcacacatctagagcgagaaggc

SEQ ID NO: 621289 - DNA, 25 bp, Mus musculus
cttcacacatcttgagcgagaaggc

SEQ ID NO: 621290 - DNA, 25 bp, Mus musculus
cttcacacgggccttcgaccagatt

SEQ ID NO: 621291 - DNA, 25 bp, Mus musculus
cttcacacgggcgttcgaccagatt

SEQ ID NO: 621292 - DNA, 25 bp, Mus musculus
cttcacactgcactctggaggctac

SEQ ID NO: 621293 - DNA, 25 bp, Mus musculus
cttcacactgcagtctggaggctac

SEQ ID NO: 621294 - DNA, 25 bp, Mus musculus
cttcacatgtctaggccgtgatggg

SEQ ID NO: 621295 - DNA, 25 bp, Mus musculus
cttcacatgtcttggccgtgatggg

SEQ ID NO: 621296 - DNA, 25 bp, Mus musculus
cttcaccaggcaagagcccatcggg

SEQ ID NO: 621297 - DNA, 25 bp, Mus musculus
cttcaccaggcatgagcccatcggg

SEQ ID NO: 621298 - DNA, 25 bp, Mus musculus
cttcaccagggacactgctatttca

SEQ ID NO: 621299 - DNA, 25 bp, Mus musculus
cttcaccagggagactgctatttca

SEQ ID NO: 621300 - DNA, 25 bp, Mus musculus
cttcacccacttactgacaggtgtg

SEQ ID NO: 621301 - DNA, 25 bp, Mus musculus
cttcacccactttctgacaggtgtg

SEQ ID NO: 621302 - DNA, 25 bp, Mus musculus
cttcacccaggccatgatgtatttt

SEQ ID NO: 621303 - DNA, 25 bp, Mus musculus
cttcacccaggcgatgatgtatttt

SEQ ID NO: 621304 - DNA, 25 bp, Mus musculus
cttcaccgaattccgagaagccggg

SEQ ID NO: 621305 - DNA, 25 bp, Mus musculus
cttcaccgaattgcgagaagccggg

SEQ ID NO: 621306 - DNA, 25 bp, Mus musculus
cttcaccttcgaagatgcccagcag

SEQ ID NO: 621307 - DNA, 25 bp, Mus musculus
cttcaccttcgatgatgcccagcag

SEQ ID NO: 621308 - DNA, 25 bp, Mus musculus
cttcacgcgtgcagcggtagcggct

SEQ ID NO: 621309 - DNA, 25 bp, Mus musculus
cttcacgcgtgctgcggtagcggct

SEQ ID NO: 621310 - DNA, 25 bp, Mus musculus
cttcacgggcgcctgcattacacag

SEQ ID NO: 621311 - DNA, 25 bp, Mus musculus
cttcacgggcgcgtgcattacacag

SEQ ID NO: 621312 - DNA, 25 bp, Mus musculus
cttcactactgtcgcagcgactttg

SEQ ID NO: 621313 - DNA, 25 bp, Mus musculus
cttcactactgtggcagcgactttg

SEQ ID NO: 621314 - DNA, 25 bp, Mus musculus
cttcactatgcactctgagtgtggg

SEQ ID NO: 621315 - DNA, 25 bp, Mus musculus
cttcactatgcagtctgagtgtggg

SEQ ID NO: 621316 - DNA, 25 bp, Mus musculus
cttcactccacaaatatttgctgaa

SEQ ID NO: 621317 - DNA, 25 bp, Mus musculus
cttcactccacatatatttgctgaa

SEQ ID NO: 621318 - DNA, 25 bp, Mus musculus
cttcactcggaacctcatggctcag

SEQ ID NO: 621319 - DNA, 25 bp, Mus musculus
cttcactcggaagctcatggctcag

SEQ ID NO: 621320 - DNA, 25 bp, Mus musculus
cttcactgacggcaagacggtggcc

SEQ ID NO: 621321 - DNA, 25 bp, Mus musculus
cttcactgacgggaagacggtggcc

SEQ ID NO: 621322 - DNA, 25 bp, Mus musculus
cttcactgatggcacacttcgggag

SEQ ID NO: 621323 - DNA, 25 bp, Mus musculus
cttcactgatgggacacttcgggag

SEQ ID NO: 621324 - DNA, 25 bp, Mus musculus
cttcactgcagacaaccggaagaaa

SEQ ID NO: 621325 - DNA, 25 bp, Mus musculus
cttcactgcagagaaccggaagaaa

SEQ ID NO: 621326 - DNA, 25 bp, Mus musculus
cttcactggtgacgacagaaggcgt

SEQ ID NO: 621327 - DNA, 25 bp, Mus musculus
cttcactggtgaggacagaaggcgt

SEQ ID NO: 621328 - DNA, 25 bp, Mus musculus
cttcacttgagacgcctgagggaaa

SEQ ID NO: 621329 - DNA, 25 bp, Mus musculus
cttcacttgagaggcctgagggaaa

SEQ ID NO: 621330 - DNA, 25 bp, Mus musculus
cttcacttggttcactggaacacca

SEQ ID NO: 621331 - DNA, 25 bp, Mus musculus
cttcacttggttgactggaacacca

SEQ ID NO: 621332 - DNA, 25 bp, Mus musculus
cttcagaacattcaggtactgggac

SEQ ID NO: 621333 - DNA, 25 bp, Mus musculus
cttcagaacattgaggtactgggac

SEQ ID NO: 621334 - DNA, 25 bp, Mus musculus
cttcagaagaagacgggcagtgctt

SEQ ID NO: 621335 - DNA, 25 bp, Mus musculus
cttcagaagaagtcgggcagtgctt

SEQ ID NO: 621336 - DNA, 25 bp, Mus musculus
cttcagacaggacccggatgtatcc

SEQ ID NO: 621337 - DNA, 25 bp, Mus musculus
cttcagacaggagccggatgtatcc

SEQ ID NO: 621338 - DNA, 25 bp, Mus musculus
cttcagacgaagatgggaattctca

SEQ ID NO: 621339 - DNA, 25 bp, Mus musculus
cttcagacgaagttgggaattctca

SEQ ID NO: 621340 - DNA, 25 bp, Mus musculus
cttcagagatcaccgtgctggagac

SEQ ID NO: 621341 - DNA, 25 bp, Mus musculus
cttcagagatcagcgtgctggagac

SEQ ID NO: 621342 - DNA, 25 bp, Mus musculus
cttcagagccctatgcactggtgag

SEQ ID NO: 621343 - DNA, 25 bp, Mus musculus
cttcagagccctttgcactggtgag

SEQ ID NO: 621344 - DNA, 25 bp, Mus musculus
cttcagaggaagctacagcgaggta

SEQ ID NO: 621345 - DNA, 25 bp, Mus musculus
cttcagaggaaggtacagcgaggta

SEQ ID NO: 621346 - DNA, 25 bp, Mus musculus
cttcagagtgaactaaaagggaaca

SEQ ID NO: 621347 - DNA, 25 bp, Mus musculus
cttcagagtgaagtaaaagggaaca

SEQ ID NO: 621348 - DNA, 25 bp, Mus musculus
cttcagagtttgctacttctcctgg

SEQ ID NO: 621349 - DNA, 25 bp, Mus musculus
cttcagagtttggtacttctcctgg

SEQ ID NO: 621350 - DNA, 25 bp, Mus musculus
cttcagataaaccagtccatcattt

SEQ ID NO: 621351 - DNA, 25 bp, Mus musculus
cttcagataaacgagtccatcattt

SEQ ID NO: 621352 - DNA, 25 bp, Mus musculus
cttcagatgctactgactggaggca

SEQ ID NO: 621353 - DNA, 25 bp, Mus musculus
cttcagatgctagtgactggaggca

SEQ ID NO: 621354 - DNA, 25 bp, Mus musculus
cttcagatgctgaatacaccagcag

SEQ ID NO: 621355 - DNA, 25 bp, Mus musculus
cttcagatgctgtatacaccagcag

SEQ ID NO: 621356 - DNA, 25 bp, Mus musculus
cttcagcacgcgagtattgccagct

SEQ ID NO: 621357 - DNA, 25 bp, Mus musculus
cttcagcacgcgtgtattgccagct

SEQ ID NO: 621358 - DNA, 25 bp, Mus musculus
cttcagcagatcaggtccagggtca

SEQ ID NO: 621359 - DNA, 25 bp, Mus musculus
cttcagcagatctggtccagggtca

SEQ ID NO: 621360 - DNA, 25 bp, Mus musculus
cttcagcagctaaccaaagaagaga

SEQ ID NO: 621361 - DNA, 25 bp, Mus musculus
cttcagcagctatccaaagaagaga

SEQ ID NO: 621362 - DNA, 25 bp, Mus musculus
cttcagcataagcaaggacacagct

SEQ ID NO: 621363 - DNA, 25 bp, Mus musculus
cttcagcataaggaaggacacagct

SEQ ID NO: 621364 - DNA, 25 bp, Mus musculus
cttcagcatcgtcggtgggtacgaa

SEQ ID NO: 621365 - DNA, 25 bp, Mus musculus
cttcagcatcgtgggtgggtacgaa

SEQ ID NO: 621366 - DNA, 25 bp, Mus musculus
cttcagccaagtcgactggtttttg

SEQ ID NO: 621367 - DNA, 25 bp, Mus musculus
cttcagccaagtggactggtttttg

SEQ ID NO: 621368 - DNA, 25 bp, Mus musculus
cttcagccgttacacattcaacggg

SEQ ID NO: 621369 - DNA, 25 bp, Mus musculus
cttcagccgttagacattcaacggg

SEQ ID NO: 621370 - DNA, 25 bp, Mus musculus
cttcagcctaggagtctgcccgtac

SEQ ID NO: 621371 - DNA, 25 bp, Mus musculus
cttcagcctaggtgtctgcccgtac

SEQ ID NO: 621372 - DNA, 25 bp, Mus musculus
cttcagcctgcacaaaacaaaaatg

SEQ ID NO: 621373 - DNA, 25 bp, Mus musculus
cttcagcctgcagaaaacaaaaatg

SEQ ID NO: 621374 - DNA, 25 bp, Mus musculus
cttcagcgcagcaggcctcggactt

SEQ ID NO: 621375 - DNA, 25 bp, Mus musculus
cttcagcgcagctggcctcggactt

SEQ ID NO: 621376 - DNA, 25 bp, Mus musculus
cttcagcgtcatcgccacggtcatt

SEQ ID NO: 621377 - DNA, 25 bp, Mus musculus
cttcagcgtcatggccacggtcatt

SEQ ID NO: 621378 - DNA, 25 bp, Mus musculus
cttcagcgtcttctgtgagatcaaa

SEQ ID NO: 621379 - DNA, 25 bp, Mus musculus
cttcagcgtcttgtgtgagatcaaa

SEQ ID NO: 621380 - DNA, 25 bp, Mus musculus
cttcagctcatgaacaacaagcttc

SEQ ID NO: 621381 - DNA, 25 bp, Mus musculus
cttcagctcatgtacaacaagcttc

SEQ ID NO: 621382 - DNA, 25 bp, Mus musculus
cttcagctccagaaggctaggctgc

SEQ ID NO: 621383 - DNA, 25 bp, Mus musculus
cttcagctccagtaggctaggctgc

SEQ ID NO: 621384 - DNA, 25 bp, Mus musculus
cttcagctcccactctagcttggag

SEQ ID NO: 621385 - DNA, 25 bp, Mus musculus
cttcagctcccagtctagcttggag

SEQ ID NO: 621386 - DNA, 25 bp, Mus musculus
cttcagctgaaaacgatggggactt

SEQ ID NO: 621387 - DNA, 25 bp, Mus musculus
cttcagctgaaatcgatggggactt

SEQ ID NO: 621388 - DNA, 25 bp, Mus musculus
cttcagctgcgtatcagtgatcaca

SEQ ID NO: 621389 - DNA, 25 bp, Mus musculus
cttcagctgcgtttcagtgatcaca

SEQ ID NO: 621390 - DNA, 25 bp, Mus musculus
cttcagcttcctcttgggcatgacc

SEQ ID NO: 621391 - DNA, 25 bp, Mus musculus
cttcagcttcctgttgggcatgacc

SEQ ID NO: 621392 - DNA, 25 bp, Mus musculus
cttcaggacaaaagtagcgaacccc

SEQ ID NO: 621393 - DNA, 25 bp, Mus musculus
cttcaggacaaatgtagcgaacccc

SEQ ID NO: 621394 - DNA, 25 bp, Mus musculus
cttcaggaccatactggataaggag

SEQ ID NO: 621395 - DNA, 25 bp, Mus musculus
cttcaggaccattctggataaggag

SEQ ID NO: 621396 - DNA, 25 bp, Mus musculus
cttcaggactcgctacgttttcatt

SEQ ID NO: 621397 - DNA, 25 bp, Mus musculus
cttcaggactcggtacgttttcatt

SEQ ID NO: 621398 - DNA, 25 bp, Mus musculus
cttcaggcctgcacctgtagtcgca

SEQ ID NO: 621399 - DNA, 25 bp, Mus musculus
cttcaggcctgctcctgtagtcgca

SEQ ID NO: 621400 - DNA, 25 bp, Mus musculus
cttcaggctgatcgcaagagctgtg

SEQ ID NO: 621401 - DNA, 25 bp, Mus musculus
cttcaggctgatggcaagagctgtg

SEQ ID NO: 621402 - DNA, 25 bp, Mus musculus
cttcaggcttcacctcagaaatgaa

SEQ ID NO: 621403 - DNA, 25 bp, Mus musculus
cttcaggcttcagctcagaaatgaa

SEQ ID NO: 621404 - DNA, 25 bp, Mus musculus
cttcagggaaaaagctgggcgactg

SEQ ID NO: 621405 - DNA, 25 bp, Mus musculus
cttcagggaaaatgctgggcgactg

SEQ ID NO: 621406 - DNA, 25 bp, Mus musculus
cttcagggcttccaccgttcgttca

SEQ ID NO: 621407 - DNA, 25 bp, Mus musculus
cttcagggcttcgaccgttcgttca

SEQ ID NO: 621408 - DNA, 25 bp, Mus musculus
cttcaggtagacacggcgctgaggc

SEQ ID NO: 621409 - DNA, 25 bp, Mus musculus
cttcaggtagactcggcgctgaggc

SEQ ID NO: 621410 - DNA, 25 bp, Mus musculus
cttcaggttaaaagtcagctgactt

SEQ ID NO: 621411 - DNA, 25 bp, Mus musculus
cttcaggttaaatgtcagctgactt

SEQ ID NO: 621412 - DNA, 25 bp, Mus musculus
cttcaggttcatcaaggtcaaagag

SEQ ID NO: 621413 - DNA, 25 bp, Mus musculus
cttcaggttcatgaaggtcaaagag

SEQ ID NO: 621414 - DNA, 25 bp, Mus musculus
cttcagtaaaacagaacagcttgga

SEQ ID NO: 621415 - DNA, 25 bp, Mus musculus
cttcagtaaaactgaacagcttgga

SEQ ID NO: 621416 - DNA, 25 bp, Mus musculus
cttcagtaagggagaggagaacctc

SEQ ID NO: 621417 - DNA, 25 bp, Mus musculus
cttcagtaagggtgaggagaacctc

SEQ ID NO: 621418 - DNA, 25 bp, Mus musculus
cttcagtgcatgcaacacctggtac

SEQ ID NO: 621419 - DNA, 25 bp, Mus musculus
cttcagtgcatggaacacctggtac

SEQ ID NO: 621420 - DNA, 25 bp, Mus musculus
cttcagtgccatctttgaacatgaa

SEQ ID NO: 621421 - DNA, 25 bp, Mus musculus
cttcagtgccatgtttgaacatgaa

SEQ ID NO: 621422 - DNA, 25 bp, Mus musculus
cttcagtggacaagggctgtgcgcc

SEQ ID NO: 621423 - DNA, 25 bp, Mus musculus
cttcagtggacatgggctgtgcgcc

SEQ ID NO: 621424 - DNA, 25 bp, Mus musculus
cttcagtggaccagtaagttctgac

SEQ ID NO: 621425 - DNA, 25 bp, Mus musculus
cttcagtggacctgtaagttctgac

SEQ ID NO: 621426 - DNA, 25 bp, Mus musculus
cttcagttactacccagcagaaaac

SEQ ID NO: 621427 - DNA, 25 bp, Mus musculus
cttcagttactagccagcagaaaac

SEQ ID NO: 621428 - DNA, 25 bp, Mus musculus
cttcagttattcagtcagatcggac

SEQ ID NO: 621429 - DNA, 25 bp, Mus musculus
cttcagttattctgtcagatcggac

SEQ ID NO: 621430 - DNA, 25 bp, Mus musculus
cttcagttttacctgcagccgccta

SEQ ID NO: 621431 - DNA, 25 bp, Mus musculus
cttcagttttacgtgcagccgccta

SEQ ID NO: 621432 - DNA, 25 bp, Mus musculus
cttcataaaagaagccatgcaaatc

SEQ ID NO: 621433 - DNA, 25 bp, Mus musculus
cttcataaaagatgccatgcaaatc

SEQ ID NO: 621434 - DNA, 25 bp, Mus musculus
cttcataacagacagggtcccagcc

SEQ ID NO: 621435 - DNA, 25 bp, Mus musculus
cttcataacagagagggtcccagcc

SEQ ID NO: 621436 - DNA, 25 bp, Mus musculus
cttcataggcctcggagagctcgtc

SEQ ID NO: 621437 - DNA, 25 bp, Mus musculus
cttcataggcctgggagagctcgtc

SEQ ID NO: 621438 - DNA, 25 bp, Mus musculus
cttcatagggtcagtacagatgcca

SEQ ID NO: 621439 - DNA, 25 bp, Mus musculus
cttcatagggtctgtacagatgcca

SEQ ID NO: 621440 - DNA, 25 bp, Mus musculus
cttcatagtactcgagcgggcatta

SEQ ID NO: 621441 - DNA, 25 bp, Mus musculus
cttcatagtactggagcgggcatta

SEQ ID NO: 621442 - DNA, 25 bp, Mus musculus
cttcatagtagaaatgcagttagca

SEQ ID NO: 621443 - DNA, 25 bp, Mus musculus
cttcatagtagatatgcagttagca

SEQ ID NO: 621444 - DNA, 25 bp, Mus musculus
cttcatagtgctcgcgcccattttg

SEQ ID NO: 621445 - DNA, 25 bp, Mus musculus
cttcatagtgctggcgcccattttg

SEQ ID NO: 621446 - DNA, 25 bp, Mus musculus
cttcatagtttaagtgccagatact

SEQ ID NO: 621447 - DNA, 25 bp, Mus musculus
cttcatagtttatgtgccagatact

SEQ ID NO: 621448 - DNA, 25 bp, Mus musculus
cttcatatccacactgatgtccttg

SEQ ID NO: 621449 - DNA, 25 bp, Mus musculus
cttcatatccactctgatgtccttg

SEQ ID NO: 621450 - DNA, 25 bp, Mus musculus
cttcatatctggctaagcatcaaag

SEQ ID NO: 621451 - DNA, 25 bp, Mus musculus
cttcatatctgggtaagcatcaaag

SEQ ID NO: 621452 - DNA, 25 bp, Mus musculus
cttcatcaaagacgagcactgcatc

SEQ ID NO: 621453 - DNA, 25 bp, Mus musculus
cttcatcaaagaggagcactgcatc

SEQ ID NO: 621454 - DNA, 25 bp, Mus musculus
cttcatcaaattctgtgaccacata

SEQ ID NO: 621455 - DNA, 25 bp, Mus musculus
cttcatcaaattgtgtgaccacata

SEQ ID NO: 621456 - DNA, 25 bp, Mus musculus
cttcatcaaccgaaagtgcttgttt

SEQ ID NO: 621457 - DNA, 25 bp, Mus musculus
cttcatcaaccgtaagtgcttgttt

SEQ ID NO: 621458 - DNA, 25 bp, Mus musculus
cttcatcagcaaccacaagtcaagg

SEQ ID NO: 621459 - DNA, 25 bp, Mus musculus
cttcatcagcaagcacaagtcaagg

SEQ ID NO: 621460 - DNA, 25 bp, Mus musculus
cttcatcaggatcacattccctggg

SEQ ID NO: 621461 - DNA, 25 bp, Mus musculus
cttcatcaggatgacattccctggg

SEQ ID NO: 621462 - DNA, 25 bp, Mus musculus
cttcatcatcctccctcttgggaga

SEQ ID NO: 621463 - DNA, 25 bp, Mus musculus
cttcatcatcctgcctcttgggaga

SEQ ID NO: 621464 - DNA, 25 bp, Mus musculus
cttcatcatggaaggtggagccatg

SEQ ID NO: 621465 - DNA, 25 bp, Mus musculus
cttcatcatggatggtggagccatg

SEQ ID NO: 621466 - DNA, 25 bp, Mus musculus
cttcatccaagaatcaagcagttgc

SEQ ID NO: 621467 - DNA, 25 bp, Mus musculus
cttcatccaagattcaagcagttgc

SEQ ID NO: 621468 - DNA, 25 bp, Mus musculus
cttcatccagataacagcctcatcg

SEQ ID NO: 621469 - DNA, 25 bp, Mus musculus
cttcatccagattacagcctcatcg

SEQ ID NO: 621470 - DNA, 25 bp, Mus musculus
cttcatcctgccctgtgctatcgga

SEQ ID NO: 621471 - DNA, 25 bp, Mus musculus
cttcatcctgccgtgtgctatcgga

SEQ ID NO: 621472 - DNA, 25 bp, Mus musculus
cttcatcgactgcttcctcacaaag

SEQ ID NO: 621473 - DNA, 25 bp, Mus musculus
cttcatcgactggttcctcacaaag

SEQ ID NO: 621474 - DNA, 25 bp, Mus musculus
cttcatcgatgacgctggccactgc

SEQ ID NO: 621475 - DNA, 25 bp, Mus musculus
cttcatcgatgaggctggccactgc

SEQ ID NO: 621476 - DNA, 25 bp, Mus musculus
cttcatcgccagcaagggagtcaag

SEQ ID NO: 621477 - DNA, 25 bp, Mus musculus
cttcatcgccaggaagggagtcaag

SEQ ID NO: 621478 - DNA, 25 bp, Mus musculus
cttcatcgtctacactgaggccatt

SEQ ID NO: 621479 - DNA, 25 bp, Mus musculus
cttcatcgtctagactgaggccatt

SEQ ID NO: 621480 - DNA, 25 bp, Mus musculus
cttcatctgctgctgcgggatgtaa

SEQ ID NO: 621481 - DNA, 25 bp, Mus musculus
cttcatctgctggtgcgggatgtaa

SEQ ID NO: 621482 - DNA, 25 bp, Mus musculus
cttcatgaagagaatcaattgctat

SEQ ID NO: 621483 - DNA, 25 bp, Mus musculus
cttcatgaagagtatcaattgctat

SEQ ID NO: 621484 - DNA, 25 bp, Mus musculus
cttcatgaataacccctcagatggc

SEQ ID NO: 621485 - DNA, 25 bp, Mus musculus
cttcatgaataagccctcagatggc

SEQ ID NO: 621486 - DNA, 25 bp, Mus musculus
cttcatgaggcgaggcgggagcagg

SEQ ID NO: 621487 - DNA, 25 bp, Mus musculus
cttcatgaggcgtggcgggagcagg

SEQ ID NO: 621488 - DNA, 25 bp, Mus musculus
cttcatgcaaaacgcatcgtgcaca

SEQ ID NO: 621489 - DNA, 25 bp, Mus musculus
cttcatgcaaaaggcatcgtgcaca

SEQ ID NO: 621490 - DNA, 25 bp, Mus musculus
cttcatggaggtaaaagggtcatgg

SEQ ID NO: 621491 - DNA, 25 bp, Mus musculus
cttcatggaggttaaagggtcatgg

SEQ ID NO: 621492 - DNA, 25 bp, Mus musculus
cttcatggcaggaatactggttgga

SEQ ID NO: 621493 - DNA, 25 bp, Mus musculus
cttcatggcaggtatactggttgga

SEQ ID NO: 621494 - DNA, 25 bp, Mus musculus
cttcatggcttcacagatgctcaag

SEQ ID NO: 621495 - DNA, 25 bp, Mus musculus
cttcatggcttctcagatgctcaag

SEQ ID NO: 621496 - DNA, 25 bp, Mus musculus
cttcatgggtgcctcagagccagac

SEQ ID NO: 621497 - DNA, 25 bp, Mus musculus
cttcatgggtgcgtcagagccagac

SEQ ID NO: 621498 - DNA, 25 bp, Mus musculus
cttcatggtggaccccatccagggt

SEQ ID NO: 621499 - DNA, 25 bp, Mus musculus
cttcatggtggagcccatccagggt

SEQ ID NO: 621500 - DNA, 25 bp, Mus musculus
cttcatgtcaccacggttcccaggg

SEQ ID NO: 621501 - DNA, 25 bp, Mus musculus
cttcatgtcacctcggttcccaggg

SEQ ID NO: 621502 - DNA, 25 bp, Mus musculus
cttcatgtggccacgatgaatgtca

SEQ ID NO: 621503 - DNA, 25 bp, Mus musculus
cttcatgtggcctcgatgaatgtca

SEQ ID NO: 621504 - DNA, 25 bp, Mus musculus
cttcatgttcaaaggaacctccttg

SEQ ID NO: 621505 - DNA, 25 bp, Mus musculus
cttcatgttcaatggaacctccttg

SEQ ID NO: 621506 - DNA, 25 bp, Mus musculus
cttcatgttgctaacactgggtatg

SEQ ID NO: 621507 - DNA, 25 bp, Mus musculus
cttcatgttgcttacactgggtatg

SEQ ID NO: 621508 - DNA, 25 bp, Mus musculus
cttcattaagggagaactgagaaac

SEQ ID NO: 621509 - DNA, 25 bp, Mus musculus
cttcattaagggtgaactgagaaac

SEQ ID NO: 621510 - DNA, 25 bp, Mus musculus
cttcattcccgtcgcctgtttcttg

SEQ ID NO: 621511 - DNA, 25 bp, Mus musculus
cttcattcccgtggcctgtttcttg

SEQ ID NO: 621512 - DNA, 25 bp, Mus musculus
cttcattcgaaactaagtacctgcc

SEQ ID NO: 621513 - DNA, 25 bp, Mus musculus
cttcattcgaaagtaagtacctgcc

SEQ ID NO: 621514 - DNA, 25 bp, Mus musculus
cttcattctcccaaggaggcgcttc

SEQ ID NO: 621515 - DNA, 25 bp, Mus musculus
cttcattctccctaggaggcgcttc

SEQ ID NO: 621516 - DNA, 25 bp, Mus musculus
cttcattgaatcacgggccaagccc

SEQ ID NO: 621517 - DNA, 25 bp, Mus musculus
cttcattgaatctcgggccaagccc

SEQ ID NO: 621518 - DNA, 25 bp, Mus musculus
cttcattgaccgcaaacgcacaggg

SEQ ID NO: 621519 - DNA, 25 bp, Mus musculus
cttcattgaccggaaacgcacaggg

SEQ ID NO: 621520 - DNA, 25 bp, Mus musculus
cttcattgagaacggcattagagca

SEQ ID NO: 621521 - DNA, 25 bp, Mus musculus
cttcattgagaagggcattagagca

SEQ ID NO: 621522 - DNA, 25 bp, Mus musculus
cttcattggcaccttcaaggctttt

SEQ ID NO: 621523 - DNA, 25 bp, Mus musculus
cttcattggcacgttcaaggctttt

SEQ ID NO: 621524 - DNA, 25 bp, Mus musculus
cttccaaaggaaccaatgatgtggc

SEQ ID NO: 621525 - DNA, 25 bp, Mus musculus
cttccaaaggaagcaatgatgtggc

SEQ ID NO: 621526 - DNA, 25 bp, Mus musculus
cttccaaatgatagggtgagcagca

SEQ ID NO: 621527 - DNA, 25 bp, Mus musculus
cttccaaatgattgggtgagcagca

SEQ ID NO: 621528 - DNA, 25 bp, Mus musculus
cttccaaattgacaagaagattggc

SEQ ID NO: 621529 - DNA, 25 bp, Mus musculus
cttccaaattgagaagaagattggc

SEQ ID NO: 621530 - DNA, 25 bp, Mus musculus
cttccaaatttcaaccccagtgagg

SEQ ID NO: 621531 - DNA, 25 bp, Mus musculus
cttccaaatttctaccccagtgagg

SEQ ID NO: 621532 - DNA, 25 bp, Mus musculus
cttccaacctacctagcagaaagtg

SEQ ID NO: 621533 - DNA, 25 bp, Mus musculus
cttccaacctacgtagcagaaagtg

SEQ ID NO: 621534 - DNA, 25 bp, Mus musculus
cttccaagagacctggctcgcagaa

SEQ ID NO: 621535 - DNA, 25 bp, Mus musculus
cttccaagagacgtggctcgcagaa

SEQ ID NO: 621536 - DNA, 25 bp, Mus musculus
cttccaagatgaaccatgccttctt

SEQ ID NO: 621537 - DNA, 25 bp, Mus musculus
cttccaagatgatccatgccttctt

SEQ ID NO: 621538 - DNA, 25 bp, Mus musculus
cttccaaggcttcggggagtccagc

SEQ ID NO: 621539 - DNA, 25 bp, Mus musculus
cttccaaggcttgggggagtccagc

SEQ ID NO: 621540 - DNA, 25 bp, Mus musculus
cttccacaagctattcatatgccag

SEQ ID NO: 621541 - DNA, 25 bp, Mus musculus
cttccacaagcttttcatatgccag

SEQ ID NO: 621542 - DNA, 25 bp, Mus musculus
cttccacactaaccctttctatggg

SEQ ID NO: 621543 - DNA, 25 bp, Mus musculus
cttccacactaagcctttctatggg

SEQ ID NO: 621544 - DNA, 25 bp, Mus musculus
cttccactacaacatgagcagccat

SEQ ID NO: 621545 - DNA, 25 bp, Mus musculus
cttccactacaagatgagcagccat

SEQ ID NO: 621546 - DNA, 25 bp, Mus musculus
cttccactccaaatcgggcaaatgg

SEQ ID NO: 621547 - DNA, 25 bp, Mus musculus
cttccactccaattcgggcaaatgg

SEQ ID NO: 621548 - DNA, 25 bp, Mus musculus
cttccactgagacgcgaggcggtct

SEQ ID NO: 621549 - DNA, 25 bp, Mus musculus
cttccactgagaggcgaggcggtct

SEQ ID NO: 621550 - DNA, 25 bp, Mus musculus
cttccactgtatagcctgatgtgtt

SEQ ID NO: 621551 - DNA, 25 bp, Mus musculus
cttccactgtattgcctgatgtgtt

SEQ ID NO: 621552 - DNA, 25 bp, Mus musculus
cttccactttgaaatcctgaagccc

SEQ ID NO: 621553 - DNA, 25 bp, Mus musculus
cttccactttgatatcctgaagccc

SEQ ID NO: 621554 - DNA, 25 bp, Mus musculus
cttccagacggaagccaagctgcac

SEQ ID NO: 621555 - DNA, 25 bp, Mus musculus
cttccagacggatgccaagctgcac

SEQ ID NO: 621556 - DNA, 25 bp, Mus musculus
cttccagagaagctgtccttggtga

SEQ ID NO: 621557 - DNA, 25 bp, Mus musculus
cttccagagaaggtgtccttggtga

SEQ ID NO: 621558 - DNA, 25 bp, Mus musculus
cttccagaggggcattcaggtgtca

SEQ ID NO: 621559 - DNA, 25 bp, Mus musculus
cttccagagggggattcaggtgtca

SEQ ID NO: 621560 - DNA, 25 bp, Mus musculus
cttccagccactctttcggttcggg

SEQ ID NO: 621561 - DNA, 25 bp, Mus musculus
cttccagccactgtttcggttcggg

SEQ ID NO: 621562 - DNA, 25 bp, Mus musculus
cttccagccagaagtgtggtcctca

SEQ ID NO: 621563 - DNA, 25 bp, Mus musculus
cttccagccagatgtgtggtcctca

SEQ ID NO: 621564 - DNA, 25 bp, Mus musculus
cttccagcccttccttgtggtggct

SEQ ID NO: 621565 - DNA, 25 bp, Mus musculus
cttccagcccttgcttgtggtggct

SEQ ID NO: 621566 - DNA, 25 bp, Mus musculus
cttccagctgctctttgcttggagg

SEQ ID NO: 621567 - DNA, 25 bp, Mus musculus
cttccagctgctgtttgcttggagg

SEQ ID NO: 621568 - DNA, 25 bp, Mus musculus
cttccaggaaatcgctattgatatc

SEQ ID NO: 621569 - DNA, 25 bp, Mus musculus
cttccaggaaatggctattgatatc

SEQ ID NO: 621570 - DNA, 25 bp, Mus musculus
cttccaggaggacgatgacacatct

SEQ ID NO: 621571 - DNA, 25 bp, Mus musculus
cttccaggaggaggatgacacatct

SEQ ID NO: 621572 - DNA, 25 bp, Mus musculus
cttccaggagtgataccagctttag

SEQ ID NO: 621573 - DNA, 25 bp, Mus musculus
cttccaggagtgttaccagctttag

SEQ ID NO: 621574 - DNA, 25 bp, Mus musculus
cttccaggatgtcagatttgtcagc

SEQ ID NO: 621575 - DNA, 25 bp, Mus musculus
cttccaggatgtgagatttgtcagc

SEQ ID NO: 621576 - DNA, 25 bp, Mus musculus
cttccaggccttcgaggagaacatg

SEQ ID NO: 621577 - DNA, 25 bp, Mus musculus
cttccaggccttggaggagaacatg

SEQ ID NO: 621578 - DNA, 25 bp, Mus musculus
cttccagggccgaccaagtttgaca

SEQ ID NO: 621579 - DNA, 25 bp, Mus musculus
cttccagggccgtccaagtttgaca

SEQ ID NO: 621580 - DNA, 25 bp, Mus musculus
cttccaggtattcaaagggtgatgg

SEQ ID NO: 621581 - DNA, 25 bp, Mus musculus
cttccaggtattgaaagggtgatgg

SEQ ID NO: 621582 - DNA, 25 bp, Mus musculus
cttccagtgcacacgaaggctgact

SEQ ID NO: 621583 - DNA, 25 bp, Mus musculus
cttccagtgcactcgaaggctgact

SEQ ID NO: 621584 - DNA, 25 bp, Mus musculus
cttccagtgcttcagccgctgtcat

SEQ ID NO: 621585 - DNA, 25 bp, Mus musculus
cttccagtgcttgagccgctgtcat

SEQ ID NO: 621586 - DNA, 25 bp, Mus musculus
cttccagtgtgaccttgcctatttc

SEQ ID NO: 621587 - DNA, 25 bp, Mus musculus
cttccagtgtgagcttgcctatttc

SEQ ID NO: 621588 - DNA, 25 bp, Mus musculus
cttccatcccacattcggattctgg

SEQ ID NO: 621589 - DNA, 25 bp, Mus musculus
cttccatcccactttcggattctgg

SEQ ID NO: 621590 - DNA, 25 bp, Mus musculus
cttccatcgtggagatagcaataaa

SEQ ID NO: 621591 - DNA, 25 bp, Mus musculus
cttccatcgtggtgatagcaataaa

SEQ ID NO: 621592 - DNA, 25 bp, Mus musculus
cttccatgagagatgggcaggtacc

SEQ ID NO: 621593 - DNA, 25 bp, Mus musculus
cttccatgagagttgggcaggtacc

SEQ ID NO: 621594 - DNA, 25 bp, Mus musculus
cttccatgggctagtgcagaaaatc

SEQ ID NO: 621595 - DNA, 25 bp, Mus musculus
cttccatgggcttgtgcagaaaatc

SEQ ID NO: 621596 - DNA, 25 bp, Mus musculus
cttccatggtgaatacccagccaaa

SEQ ID NO: 621597 - DNA, 25 bp, Mus musculus
cttccatggtgattacccagccaaa

SEQ ID NO: 621598 - DNA, 25 bp, Mus musculus
cttccatgtctcaactgaagaatgt

SEQ ID NO: 621599 - DNA, 25 bp, Mus musculus
cttccatgtctctactgaagaatgt

SEQ ID NO: 621600 - DNA, 25 bp, Mus musculus
cttcccaactgaaggttccagggat

SEQ ID NO: 621601 - DNA, 25 bp, Mus musculus
cttcccaactgatggttccagggat

SEQ ID NO: 621602 - DNA, 25 bp, Mus musculus
cttcccacacggaggaattattgcc

SEQ ID NO: 621603 - DNA, 25 bp, Mus musculus
cttcccacacggtggaattattgcc

SEQ ID NO: 621604 - DNA, 25 bp, Mus musculus
cttcccagcctccaatattaaagca

SEQ ID NO: 621605 - DNA, 25 bp, Mus musculus
cttcccagcctcgaatattaaagca

SEQ ID NO: 621606 - DNA, 25 bp, Mus musculus
cttcccatggttcctcgtggcggtg

SEQ ID NO: 621607 - DNA, 25 bp, Mus musculus
cttcccatggttgctcgtggcggtg

SEQ ID NO: 621608 - DNA, 25 bp, Mus musculus
cttccccagggcagtgcttattatg

SEQ ID NO: 621609 - DNA, 25 bp, Mus musculus
cttccccagggctgtgcttattatg

SEQ ID NO: 621610 - DNA, 25 bp, Mus musculus
cttccccgatgcagacagcttcgta

SEQ ID NO: 621611 - DNA, 25 bp, Mus musculus
cttccccgatgctgacagcttcgta

SEQ ID NO: 621612 - DNA, 25 bp, Mus musculus
cttccccgtaggacgtaccatgcgg

SEQ ID NO: 621613 - DNA, 25 bp, Mus musculus
cttccccgtaggtcgtaccatgcgg

SEQ ID NO: 621614 - DNA, 25 bp, Mus musculus
cttcccctggacaacaagtgagttt

SEQ ID NO: 621615 - DNA, 25 bp, Mus musculus
cttcccctggactacaagtgagttt

SEQ ID NO: 621616 - DNA, 25 bp, Mus musculus
cttcccgagtggacgaagagccttg

SEQ ID NO: 621617 - DNA, 25 bp, Mus musculus
cttcccgagtggtcgaagagccttg

SEQ ID NO: 621618 - DNA, 25 bp, Mus musculus
cttcccggatagctgtgcccaagct

SEQ ID NO: 621619 - DNA, 25 bp, Mus musculus
cttcccggataggtgtgcccaagct

SEQ ID NO: 621620 - DNA, 25 bp, Mus musculus
cttcccggtccgcaggtgcagcgaa

SEQ ID NO: 621621 - DNA, 25 bp, Mus musculus
cttcccggtccggaggtgcagcgaa

SEQ ID NO: 621622 - DNA, 25 bp, Mus musculus
cttcccgtacagatacaagcagcag

SEQ ID NO: 621623 - DNA, 25 bp, Mus musculus
cttcccgtacagttacaagcagcag

SEQ ID NO: 621624 - DNA, 25 bp, Mus musculus
cttccctactggacacaagtgtcag

SEQ ID NO: 621625 - DNA, 25 bp, Mus musculus
cttccctactggtcacaagtgtcag

SEQ ID NO: 621626 - DNA, 25 bp, Mus musculus
cttccctattccagagcctgacggt

SEQ ID NO: 621627 - DNA, 25 bp, Mus musculus
cttccctattcctgagcctgacggt

SEQ ID NO: 621628 - DNA, 25 bp, Mus musculus
cttccctcagtgcagttcctcagga

SEQ ID NO: 621629 - DNA, 25 bp, Mus musculus
cttccctcagtggagttcctcagga

SEQ ID NO: 621630 - DNA, 25 bp, Mus musculus
cttccctcctagaggcctgtgacgt

SEQ ID NO: 621631 - DNA, 25 bp, Mus musculus
cttccctcctagtggcctgtgacgt

SEQ ID NO: 621632 - DNA, 25 bp, Mus musculus
cttccctgacgtcgggacctacgag

SEQ ID NO: 621633 - DNA, 25 bp, Mus musculus
cttccctgacgtggggacctacgag

SEQ ID NO: 621634 - DNA, 25 bp, Mus musculus
cttcccttatctcagcgcctttggg

SEQ ID NO: 621635 - DNA, 25 bp, Mus musculus
cttcccttatctgagcgcctttggg

SEQ ID NO: 621636 - DNA, 25 bp, Mus musculus
cttcccttcagtaccgaaggaatgt

SEQ ID NO: 621637 - DNA, 25 bp, Mus musculus
cttcccttcagttccgaaggaatgt

SEQ ID NO: 621638 - DNA, 25 bp, Mus musculus
cttcccttcgcgagcaaggctctga

SEQ ID NO: 621639 - DNA, 25 bp, Mus musculus
cttcccttcgcgtgcaaggctctga

SEQ ID NO: 621640 - DNA, 25 bp, Mus musculus
cttcccttcttgcaggaatacttgg

SEQ ID NO: 621641 - DNA, 25 bp, Mus musculus
cttcccttcttggaggaatacttgg

SEQ ID NO: 621642 - DNA, 25 bp, Mus musculus
cttccctttgctctaaacaatgtca

SEQ ID NO: 621643 - DNA, 25 bp, Mus musculus
cttccctttgctgtaaacaatgtca

SEQ ID NO: 621644 - DNA, 25 bp, Mus musculus
cttccgaagcggactcattgcccag

SEQ ID NO: 621645 - DNA, 25 bp, Mus musculus
cttccgaagcggtctcattgcccag

SEQ ID NO: 621646 - DNA, 25 bp, Mus musculus
cttccgagactaaaggcgtgtgcac

SEQ ID NO: 621647 - DNA, 25 bp, Mus musculus
cttccgagactataggcgtgtgcac

SEQ ID NO: 621648 - DNA, 25 bp, Mus musculus
cttccgcagtttccggtcagagtgt

SEQ ID NO: 621649 - DNA, 25 bp, Mus musculus
cttccgcagtttgcggtcagagtgt

SEQ ID NO: 621650 - DNA, 25 bp, Mus musculus
cttccgctggatactgggcctgcat

SEQ ID NO: 621651 - DNA, 25 bp, Mus musculus
cttccgctggattctgggcctgcat

SEQ ID NO: 621652 - DNA, 25 bp, Mus musculus
cttccgcttctgcaggcttccagag

SEQ ID NO: 621653 - DNA, 25 bp, Mus musculus
cttccgcttctggaggcttccagag

SEQ ID NO: 621654 - DNA, 25 bp, Mus musculus
cttccggaaggcctgccgtctagtg

SEQ ID NO: 621655 - DNA, 25 bp, Mus musculus
cttccggaaggcgtgccgtctagtg

SEQ ID NO: 621656 - DNA, 25 bp, Mus musculus
cttccggaattaagacaacattaca

SEQ ID NO: 621657 - DNA, 25 bp, Mus musculus
cttccggaattatgacaacattaca

SEQ ID NO: 621658 - DNA, 25 bp, Mus musculus
cttccggctgtcaagtggagctgat

SEQ ID NO: 621659 - DNA, 25 bp, Mus musculus
cttccggctgtctagtggagctgat

SEQ ID NO: 621660 - DNA, 25 bp, Mus musculus
cttccgggagcaactagcccaggga

SEQ ID NO: 621661 - DNA, 25 bp, Mus musculus
cttccgggagcatctagcccaggga

SEQ ID NO: 621662 - DNA, 25 bp, Mus musculus
cttccgggctgcagaagaggcgttt

SEQ ID NO: 621663 - DNA, 25 bp, Mus musculus
cttccgggctgctgaagaggcgttt

SEQ ID NO: 621664 - DNA, 25 bp, Mus musculus
cttccgggtactcggctgcttggta

SEQ ID NO: 621665 - DNA, 25 bp, Mus musculus
cttccgggtactgggctgcttggta

SEQ ID NO: 621666 - DNA, 25 bp, Mus musculus
cttccgggtccgcatgcaaggccag

SEQ ID NO: 621667 - DNA, 25 bp, Mus musculus
cttccgggtccggatgcaaggccag

SEQ ID NO: 621668 - DNA, 25 bp, Mus musculus
cttccggtgtccagaagacgaaagc

SEQ ID NO: 621669 - DNA, 25 bp, Mus musculus
cttccggtgtcctgaagacgaaagc

SEQ ID NO: 621670 - DNA, 25 bp, Mus musculus
cttccgtccgacctgcgcgagaagg

SEQ ID NO: 621671 - DNA, 25 bp, Mus musculus
cttccgtccgacgtgcgcgagaagg

SEQ ID NO: 621672 - DNA, 25 bp, Mus musculus
cttccgtgttccaccctgtcttaga

SEQ ID NO: 621673 - DNA, 25 bp, Mus musculus
cttccgtgttcctccctgtcttaga

SEQ ID NO: 621674 - DNA, 25 bp, Mus musculus
cttccgttcttcaggtgtcagactc

SEQ ID NO: 621675 - DNA, 25 bp, Mus musculus
cttccgttcttctggtgtcagactc

SEQ ID NO: 621676 - DNA, 25 bp, Mus musculus
cttcctaagcctctactgacagcaa

SEQ ID NO: 621677 - DNA, 25 bp, Mus musculus
cttcctaagcctgtactgacagcaa

SEQ ID NO: 621678 - DNA, 25 bp, Mus musculus
cttcctatatccctcctgaggacat

SEQ ID NO: 621679 - DNA, 25 bp, Mus musculus
cttcctatatccgtcctgaggacat

SEQ ID NO: 621680 - DNA, 25 bp, Mus musculus
cttcctatttcacgcggtatcttgg

SEQ ID NO: 621681 - DNA, 25 bp, Mus musculus
cttcctatttcaggcggtatcttgg

SEQ ID NO: 621682 - DNA, 25 bp, Mus musculus
cttcctcagttcacttaaatcacag

SEQ ID NO: 621683 - DNA, 25 bp, Mus musculus
cttcctcagttctcttaaatcacag

SEQ ID NO: 621684 - DNA, 25 bp, Mus musculus
cttcctccagctataccaagaggct

SEQ ID NO: 621685 - DNA, 25 bp, Mus musculus
cttcctccagctttaccaagaggct

SEQ ID NO: 621686 - DNA, 25 bp, Mus musculus
cttcctccgcgacagagaagctggg

SEQ ID NO: 621687 - DNA, 25 bp, Mus musculus
cttcctccgcgagagagaagctggg

SEQ ID NO: 621688 - DNA, 25 bp, Mus musculus
cttcctcggcaacctatgggcgctg

SEQ ID NO: 621689 - DNA, 25 bp, Mus musculus
cttcctcggcaagctatgggcgctg

SEQ ID NO: 621690 - DNA, 25 bp, Mus musculus
cttcctctgcctactagactaacaa

SEQ ID NO: 621691 - DNA, 25 bp, Mus musculus
cttcctctgccttctagactaacaa

SEQ ID NO: 621692 - DNA, 25 bp, Mus musculus
cttcctgaaaatcaaatgcctggct

SEQ ID NO: 621693 - DNA, 25 bp, Mus musculus
cttcctgaaaatgaaatgcctggct

SEQ ID NO: 621694 - DNA, 25 bp, Mus musculus
cttcctgaagaaaacggtgatggaa

SEQ ID NO: 621695 - DNA, 25 bp, Mus musculus
cttcctgaagaaccctctacggagg

SEQ ID NO: 621696 - DNA, 25 bp, Mus musculus
cttcctgaagaagcctctacggagg

SEQ ID NO: 621697 - DNA, 25 bp, Mus musculus
cttcctgaagaatacggtgatggaa

SEQ ID NO: 621698 - DNA, 25 bp, Mus musculus
cttcctgagaacaagccattctcca

SEQ ID NO: 621699 - DNA, 25 bp, Mus musculus
cttcctgagaactagccattctcca

SEQ ID NO: 621700 - DNA, 25 bp, Mus musculus
cttcctgagagacactgtgcctggg

SEQ ID NO: 621701 - DNA, 25 bp, Mus musculus
cttcctgagagactgatgcagatga

SEQ ID NO: 621702 - DNA, 25 bp, Mus musculus
cttcctgagagagactgtgcctggg

SEQ ID NO: 621703 - DNA, 25 bp, Mus musculus
cttcctgagagagtgatgcagatga

SEQ ID NO: 621704 - DNA, 25 bp, Mus musculus
cttcctgagcctcgcggcactgtgt

SEQ ID NO: 621705 - DNA, 25 bp, Mus musculus
cttcctgagcctggcggcactgtgt

SEQ ID NO: 621706 - DNA, 25 bp, Mus musculus
cttcctgaggacctcagagaaaaac

SEQ ID NO: 621707 - DNA, 25 bp, Mus musculus
cttcctgaggacgtcagagaaaaac

SEQ ID NO: 621708 - DNA, 25 bp, Mus musculus
cttcctgatcgacggctacccgagg

SEQ ID NO: 621709 - DNA, 25 bp, Mus musculus
cttcctgatcgagggctacccgagg

SEQ ID NO: 621710 - DNA, 25 bp, Mus musculus
cttcctgcagagagtggaaaatgct

SEQ ID NO: 621711 - DNA, 25 bp, Mus musculus
cttcctgcagagtgtggaaaatgct

SEQ ID NO: 621712 - DNA, 25 bp, Mus musculus
cttcctgccagtcattgggttggtg

SEQ ID NO: 621713 - DNA, 25 bp, Mus musculus
cttcctgccagtgattgggttggtg

SEQ ID NO: 621714 - DNA, 25 bp, Mus musculus
cttcctgcggatatagacagcactt

SEQ ID NO: 621715 - DNA, 25 bp, Mus musculus
cttcctgcggatttagacagcactt

SEQ ID NO: 621716 - DNA, 25 bp, Mus musculus
cttcctgctaatcaaaatattgtca

SEQ ID NO: 621717 - DNA, 25 bp, Mus musculus
cttcctgctaatgaaaatattgtca

SEQ ID NO: 621718 - DNA, 25 bp, Mus musculus
cttcctgctggccagaaaggcgact

SEQ ID NO: 621719 - DNA, 25 bp, Mus musculus
cttcctgctggcgagaaaggcgact

SEQ ID NO: 621720 - DNA, 25 bp, Mus musculus
cttcctgctgggatactctgatggg

SEQ ID NO: 621721 - DNA, 25 bp, Mus musculus
cttcctgctgggttactctgatggg

SEQ ID NO: 621722 - DNA, 25 bp, Mus musculus
cttcctggaaaacctgaaccaagtc

SEQ ID NO: 621723 - DNA, 25 bp, Mus musculus
cttcctggaaaagctgaaccaagtc

SEQ ID NO: 621724 - DNA, 25 bp, Mus musculus
cttcctggacagctaccacttgtct

SEQ ID NO: 621725 - DNA, 25 bp, Mus musculus
cttcctggacaggtaccacttgtct

SEQ ID NO: 621726 - DNA, 25 bp, Mus musculus
cttcctggaccgatgctgtatgctg

SEQ ID NO: 621727 - DNA, 25 bp, Mus musculus
cttcctggaccgttgctgtatgctg

SEQ ID NO: 621728 - DNA, 25 bp, Mus musculus
cttcctggacgacctgcatgagaca

SEQ ID NO: 621729 - DNA, 25 bp, Mus musculus
cttcctggacgagctgcatgagaca

SEQ ID NO: 621730 - DNA, 25 bp, Mus musculus
cttcctggaggacctccgaaagggc

SEQ ID NO: 621731 - DNA, 25 bp, Mus musculus
cttcctggaggagctccgaaagggc

SEQ ID NO: 621732 - DNA, 25 bp, Mus musculus
cttcctggatgtaagcacaggattg

SEQ ID NO: 621733 - DNA, 25 bp, Mus musculus
cttcctggatgttagcacaggattg

SEQ ID NO: 621734 - DNA, 25 bp, Mus musculus
cttcctggattaaatcatgggtggc

SEQ ID NO: 621735 - DNA, 25 bp, Mus musculus
cttcctggattatatcatgggtggc

SEQ ID NO: 621736 - DNA, 25 bp, Mus musculus
cttcctgggatgctggcatttggac

SEQ ID NO: 621737 - DNA, 25 bp, Mus musculus
cttcctgggatggtggcatttggac

SEQ ID NO: 621738 - DNA, 25 bp, Mus musculus
cttcctgggcaccgccatgttcatt

SEQ ID NO: 621739 - DNA, 25 bp, Mus musculus
cttcctgggcacggccatgttcatt

SEQ ID NO: 621740 - DNA, 25 bp, Mus musculus
cttcctggggccaaaggccagatgg

SEQ ID NO: 621741 - DNA, 25 bp, Mus musculus
cttcctggggcctaaggccagatgg

SEQ ID NO: 621742 - DNA, 25 bp, Mus musculus
cttcctggtgatcgtagatgccctg

SEQ ID NO: 621743 - DNA, 25 bp, Mus musculus
cttcctggtgatggtagatgccctg

SEQ ID NO: 621744 - DNA, 25 bp, Mus musculus
cttcctggttcaagactactttgtg

SEQ ID NO: 621745 - DNA, 25 bp, Mus musculus
cttcctggttcatgactactttgtg

SEQ ID NO: 621746 - DNA, 25 bp, Mus musculus
cttcctgtaagtctttctgtgtaac

SEQ ID NO: 621747 - DNA, 25 bp, Mus musculus
cttcctgtaagtgtttctgtgtaac

SEQ ID NO: 621748 - DNA, 25 bp, Mus musculus
cttcctgttcatagtgggagtcacc

SEQ ID NO: 621749 - DNA, 25 bp, Mus musculus
cttcctgttcattgtgggagtcacc

SEQ ID NO: 621750 - DNA, 25 bp, Mus musculus
cttcctgtttatcacctatgaggag

SEQ ID NO: 621751 - DNA, 25 bp, Mus musculus
cttcctgtttatgacctatgaggag

SEQ ID NO: 621752 - DNA, 25 bp, Mus musculus
cttcctgtttgtcggacgaggagac

SEQ ID NO: 621753 - DNA, 25 bp, Mus musculus
cttcctgtttgtgggacgaggagac

SEQ ID NO: 621754 - DNA, 25 bp, Mus musculus
cttccttaaggaagcataggacgat

SEQ ID NO: 621755 - DNA, 25 bp, Mus musculus
cttccttaaggatgcataggacgat

SEQ ID NO: 621756 - DNA, 25 bp, Mus musculus
cttccttccaacatgtggctccatg

SEQ ID NO: 621757 - DNA, 25 bp, Mus musculus
cttccttccaacttgtggctccatg

SEQ ID NO: 621758 - DNA, 25 bp, Mus musculus
cttccttcgcgtcggccgtctggtg

SEQ ID NO: 621759 - DNA, 25 bp, Mus musculus
cttccttcgcgtgggccgtctggtg

SEQ ID NO: 621760 - DNA, 25 bp, Mus musculus
cttccttcggagaccggagactgat

SEQ ID NO: 621761 - DNA, 25 bp, Mus musculus
cttccttcggagtccggagactgat

SEQ ID NO: 621762 - DNA, 25 bp, Mus musculus
cttccttctgagagtagcggtgtag

SEQ ID NO: 621763 - DNA, 25 bp, Mus musculus
cttccttctgagtgtagcggtgtag

SEQ ID NO: 621764 - DNA, 25 bp, Mus musculus
cttccttgaagaagacgacaggctg

SEQ ID NO: 621765 - DNA, 25 bp, Mus musculus
cttccttgaagatgacgacaggctg

SEQ ID NO: 621766 - DNA, 25 bp, Mus musculus
cttccttgaagccatggctgttgga

SEQ ID NO: 621767 - DNA, 25 bp, Mus musculus
cttccttgaagcgatggctgttgga

SEQ ID NO: 621768 - DNA, 25 bp, Mus musculus
cttccttgcagcaatggcagcagtg

SEQ ID NO: 621769 - DNA, 25 bp, Mus musculus
cttccttgcagctatggcagcagtg

SEQ ID NO: 621770 - DNA, 25 bp, Mus musculus
cttccttggaacatcacagtacatt

SEQ ID NO: 621771 - DNA, 25 bp, Mus musculus
cttccttggaacttcacagtacatt

SEQ ID NO: 621772 - DNA, 25 bp, Mus musculus
cttccttgggaaatcatggttgacc

SEQ ID NO: 621773 - DNA, 25 bp, Mus musculus
cttccttgggaattcatggttgacc

SEQ ID NO: 621774 - DNA, 25 bp, Mus musculus
cttccttgtgtgattctagaactac

SEQ ID NO: 621775 - DNA, 25 bp, Mus musculus
cttccttgtgtgtttctagaactac

SEQ ID NO: 621776 - DNA, 25 bp, Mus musculus
cttcctttggctccagccagctaga

SEQ ID NO: 621777 - DNA, 25 bp, Mus musculus
cttcctttggctgcagccagctaga

SEQ ID NO: 621778 - DNA, 25 bp, Mus musculus
cttcctttgtggctggacgatgtgc

SEQ ID NO: 621779 - DNA, 25 bp, Mus musculus
cttcctttgtgggtggacgatgtgc

SEQ ID NO: 621780 - DNA, 25 bp, Mus musculus
cttcgaaagctgaagcaccccaaca

SEQ ID NO: 621781 - DNA, 25 bp, Mus musculus
cttcgaaagctgtagcaccccaaca

SEQ ID NO: 621782 - DNA, 25 bp, Mus musculus
cttcgaacagctcatcagccgacgg

SEQ ID NO: 621783 - DNA, 25 bp, Mus musculus
cttcgaacagctgatcagccgacgg

SEQ ID NO: 621784 - DNA, 25 bp, Mus musculus
cttcgaagcgtcatggagcaatcca

SEQ ID NO: 621785 - DNA, 25 bp, Mus musculus
cttcgaagcgtcttggagcaatcca

SEQ ID NO: 621786 - DNA, 25 bp, Mus musculus
cttcgaaggactcctcgaagcgagg

SEQ ID NO: 621787 - DNA, 25 bp, Mus musculus
cttcgaaggactgctcgaagcgagg

SEQ ID NO: 621788 - DNA, 25 bp, Mus musculus
cttcgaataagaaccacaactgcag

SEQ ID NO: 621789 - DNA, 25 bp, Mus musculus
cttcgaataagatccacaactgcag

SEQ ID NO: 621790 - DNA, 25 bp, Mus musculus
cttcgacaagaacatatcactactg

SEQ ID NO: 621791 - DNA, 25 bp, Mus musculus
cttcgacaagaagatatcactactg

SEQ ID NO: 621792 - DNA, 25 bp, Mus musculus
cttcgacatctgacagttgtcactc

SEQ ID NO: 621793 - DNA, 25 bp, Mus musculus
cttcgacatctgtcagttgtcactc

SEQ ID NO: 621794 - DNA, 25 bp, Mus musculus
cttcgactacatcttcaagttgctg

SEQ ID NO: 621795 - DNA, 25 bp, Mus musculus
cttcgactacatgttcaagttgctg

SEQ ID NO: 621796 - DNA, 25 bp, Mus musculus
cttcgactgggtcgcaggaaccagc

SEQ ID NO: 621797 - DNA, 25 bp, Mus musculus
cttcgactgggtggcaggaaccagc

SEQ ID NO: 621798 - DNA, 25 bp, Mus musculus
cttcgagatcccctttgagcagatc

SEQ ID NO: 621799 - DNA, 25 bp, Mus musculus
cttcgagatcccgtttgagcagatc

SEQ ID NO: 621800 - DNA, 25 bp, Mus musculus
cttcgagcaggtaaaatccctgatg

SEQ ID NO: 621801 - DNA, 25 bp, Mus musculus
cttcgagcaggttaaatccctgatg

SEQ ID NO: 621802 - DNA, 25 bp, Mus musculus
cttcgaggagctcggctgggccagg

SEQ ID NO: 621803 - DNA, 25 bp, Mus musculus
cttcgaggagctgggctgggccagg

SEQ ID NO: 621804 - DNA, 25 bp, Mus musculus
cttcgaggctacatttggaacaaat

SEQ ID NO: 621805 - DNA, 25 bp, Mus musculus
cttcgaggctacttttggaacaaat

SEQ ID NO: 621806 - DNA, 25 bp, Mus musculus
cttcgagggtgccacatgtgagaat

SEQ ID NO: 621807 - DNA, 25 bp, Mus musculus
cttcgagggtgcgacatgtgagaat

SEQ ID NO: 621808 - DNA, 25 bp, Mus musculus
cttcgagtacgacacccagagaagg

SEQ ID NO: 621809 - DNA, 25 bp, Mus musculus
cttcgagtacgagacccagagaagg

SEQ ID NO: 621810 - DNA, 25 bp, Mus musculus
cttcgagtacttagccccagatttc

SEQ ID NO: 621811 - DNA, 25 bp, Mus musculus
cttcgagtactttgccccagatttc

SEQ ID NO: 621812 - DNA, 25 bp, Mus musculus
cttcgatcctgacctgtatgaggga

SEQ ID NO: 621813 - DNA, 25 bp, Mus musculus
cttcgatcctgagctgtatgaggga

SEQ ID NO: 621814 - DNA, 25 bp, Mus musculus
cttcgatgacaaagccaagttgccc

SEQ ID NO: 621815 - DNA, 25 bp, Mus musculus
cttcgatgacaatgccaagttgccc

SEQ ID NO: 621816 - DNA, 25 bp, Mus musculus
cttcgatggagtcgattgtgcaatc

SEQ ID NO: 621817 - DNA, 25 bp, Mus musculus
cttcgatggagtggattgtgcaatc

SEQ ID NO: 621818 - DNA, 25 bp, Mus musculus
cttcgcaaaagtcgagtaggcaaca

SEQ ID NO: 621819 - DNA, 25 bp, Mus musculus
cttcgcaaaagtggagtaggcaaca

SEQ ID NO: 621820 - DNA, 25 bp, Mus musculus
cttcgcaagaatcaatgggaggacc

SEQ ID NO: 621821 - DNA, 25 bp, Mus musculus
cttcgcaagaatgaatgggaggacc

SEQ ID NO: 621822 - DNA, 25 bp, Mus musculus
cttcgcacccgtaccaggtggtaca

SEQ ID NO: 621823 - DNA, 25 bp, Mus musculus
cttcgcacccgttccaggtggtaca

SEQ ID NO: 621824 - DNA, 25 bp, Mus musculus
cttcgccaaggacttcgtggacgct

SEQ ID NO: 621825 - DNA, 25 bp, Mus musculus
cttcgccaaggagttcgtggacgct

SEQ ID NO: 621826 - DNA, 25 bp, Mus musculus
cttcgcccgggcatatgcagaggga

SEQ ID NO: 621827 - DNA, 25 bp, Mus musculus
cttcgcccgggcttatgcagaggga

SEQ ID NO: 621828 - DNA, 25 bp, Mus musculus
cttcgcgcttggactgtcaggcggc

SEQ ID NO: 621829 - DNA, 25 bp, Mus musculus
cttcgcgcttggtctgtcaggcggc

SEQ ID NO: 621830 - DNA, 25 bp, Mus musculus
cttcgctaacaactctggcttcatg

SEQ ID NO: 621831 - DNA, 25 bp, Mus musculus
cttcgctaacaagtctggcttcatg

SEQ ID NO: 621832 - DNA, 25 bp, Mus musculus
cttcgctacctactggatgggatga

SEQ ID NO: 621833 - DNA, 25 bp, Mus musculus
cttcgctacctagtggatgggatga

SEQ ID NO: 621834 - DNA, 25 bp, Mus musculus
cttcgctatttgcatggtgtcccca

SEQ ID NO: 621835 - DNA, 25 bp, Mus musculus
cttcgctatttggatggtgtcccca

SEQ ID NO: 621836 - DNA, 25 bp, Mus musculus
cttcgctgtgaaatggacatcatga

SEQ ID NO: 621837 - DNA, 25 bp, Mus musculus
cttcgctgtgaattggacatcatga

SEQ ID NO: 621838 - DNA, 25 bp, Mus musculus
cttcggaaacttcatgccagtgttg

SEQ ID NO: 621839 - DNA, 25 bp, Mus musculus
cttcggaaacttgatgccagtgttg

SEQ ID NO: 621840 - DNA, 25 bp, Mus musculus
cttcggaaaggaaggcaagaggaca

SEQ ID NO: 621841 - DNA, 25 bp, Mus musculus
cttcggaaaggatggcaagaggaca

SEQ ID NO: 621842 - DNA, 25 bp, Mus musculus
cttcggacagcacgaggcaacgtcc

SEQ ID NO: 621843 - DNA, 25 bp, Mus musculus
cttcggacagcaggaggcaacgtcc

SEQ ID NO: 621844 - DNA, 25 bp, Mus musculus
cttcggacagccagggagcaacacc

SEQ ID NO: 621845 - DNA, 25 bp, Mus musculus
cttcggacagcctgggagcaacacc

SEQ ID NO: 621846 - DNA, 25 bp, Mus musculus
cttcggacagtgagcagcctgctca

SEQ ID NO: 621847 - DNA, 25 bp, Mus musculus
cttcggacagtgtgcagcctgctca

SEQ ID NO: 621848 - DNA, 25 bp, Mus musculus
cttcggaggaccaagcactggaggt

SEQ ID NO: 621849 - DNA, 25 bp, Mus musculus
cttcggaggacctagcactggaggt

SEQ ID NO: 621850 - DNA, 25 bp, Mus musculus
cttcggatgcagaaggctctgaacc

SEQ ID NO: 621851 - DNA, 25 bp, Mus musculus
cttcggatgcagtaggctctgaacc

SEQ ID NO: 621852 - DNA, 25 bp, Mus musculus
cttcggcaagatcggtgtcctccgc

SEQ ID NO: 621853 - DNA, 25 bp, Mus musculus
cttcggcaagatgggtgtcctccgc

SEQ ID NO: 621854 - DNA, 25 bp, Mus musculus
cttcggcatcctactgggcgtgtgt

SEQ ID NO: 621855 - DNA, 25 bp, Mus musculus
cttcggcatccttctgggcgtgtgt

SEQ ID NO: 621856 - DNA, 25 bp, Mus musculus
cttcggccgcagagaccaataggaa

SEQ ID NO: 621857 - DNA, 25 bp, Mus musculus
cttcggccgcagtgaccaataggaa

SEQ ID NO: 621858 - DNA, 25 bp, Mus musculus
cttcggcgagtgctgtcagtgttcc

SEQ ID NO: 621859 - DNA, 25 bp, Mus musculus
cttcggcgagtggtgtcagtgttcc

SEQ ID NO: 621860 - DNA, 25 bp, Mus musculus
cttcggctgcagcactacgagcaga

SEQ ID NO: 621861 - DNA, 25 bp, Mus musculus
cttcggctgcaggactacgagcaga

SEQ ID NO: 621862 - DNA, 25 bp, Mus musculus
cttcgggaacagcatatcatggcgt

SEQ ID NO: 621863 - DNA, 25 bp, Mus musculus
cttcgggaacaggatatcatggcgt

SEQ ID NO: 621864 - DNA, 25 bp, Mus musculus
cttcgggaagttcatccaagtcaac

SEQ ID NO: 621865 - DNA, 25 bp, Mus musculus
cttcgggaagttgatccaagtcaac

SEQ ID NO: 621866 - DNA, 25 bp, Mus musculus
cttcgggaatgtcacggcttagttg

SEQ ID NO: 621867 - DNA, 25 bp, Mus musculus
cttcgggaatgtgacggcttagttg

SEQ ID NO: 621868 - DNA, 25 bp, Mus musculus
cttcgggagcaaacatgggaagcca

SEQ ID NO: 621869 - DNA, 25 bp, Mus musculus
cttcgggagcaatcatgggaagcca

SEQ ID NO: 621870 - DNA, 25 bp, Mus musculus
cttcgggatgcccaaacagggaaga

SEQ ID NO: 621871 - DNA, 25 bp, Mus musculus
cttcgggatgccgaaacagggaaga

SEQ ID NO: 621872 - DNA, 25 bp, Mus musculus
cttcgggcaagtagtcatggctgaa

SEQ ID NO: 621873 - DNA, 25 bp, Mus musculus
cttcgggcaagttgtcatggctgaa

SEQ ID NO: 621874 - DNA, 25 bp, Mus musculus
cttcgggcacagaaaaaacagtctt

SEQ ID NO: 621875 - DNA, 25 bp, Mus musculus
cttcgggcacagtaaaaacagtctt

SEQ ID NO: 621876 - DNA, 25 bp, Mus musculus
cttcgggcagcaccctatggagtga

SEQ ID NO: 621877 - DNA, 25 bp, Mus musculus
cttcgggcagcagcctatggagtga

SEQ ID NO: 621878 - DNA, 25 bp, Mus musculus
cttcgggccgctactgctgcgcata

SEQ ID NO: 621879 - DNA, 25 bp, Mus musculus
cttcgggccgcttctgctgcgcata

SEQ ID NO: 621880 - DNA, 25 bp, Mus musculus
cttcgggccttgcactgagctgtgc

SEQ ID NO: 621881 - DNA, 25 bp, Mus musculus
cttcgggccttggactgagctgtgc

SEQ ID NO: 621882 - DNA, 25 bp, Mus musculus
cttcgggcgagtcccttacccaaga

SEQ ID NO: 621883 - DNA, 25 bp, Mus musculus
cttcgggcgagtgccttacccaaga

SEQ ID NO: 621884 - DNA, 25 bp, Mus musculus
cttcggtcatcgctctcttgggcat

SEQ ID NO: 621885 - DNA, 25 bp, Mus musculus
cttcggtcatcggtctcttgggcat

SEQ ID NO: 621886 - DNA, 25 bp, Mus musculus
cttcggtggaccaagtacaggacct

SEQ ID NO: 621887 - DNA, 25 bp, Mus musculus
cttcggtggacctagtacaggacct

SEQ ID NO: 621888 - DNA, 25 bp, Mus musculus
cttcggtgtggcagggcagctcaca

SEQ ID NO: 621889 - DNA, 25 bp, Mus musculus
cttcggtgtggctgggcagctcaca

SEQ ID NO: 621890 - DNA, 25 bp, Mus musculus
cttcggttccctcggtcactggcat

SEQ ID NO: 621891 - DNA, 25 bp, Mus musculus
cttcggttccctgggtcactggcat

SEQ ID NO: 621892 - DNA, 25 bp, Mus musculus
cttcgtaagcggcttcagctcttgc

SEQ ID NO: 621893 - DNA, 25 bp, Mus musculus
cttcgtaagcgggttcagctcttgc

SEQ ID NO: 621894 - DNA, 25 bp, Mus musculus
cttcgtacaaagaccctgcgcaaca

SEQ ID NO: 621895 - DNA, 25 bp, Mus musculus
cttcgtacaaagtccctgcgcaaca

SEQ ID NO: 621896 - DNA, 25 bp, Mus musculus
cttcgtaggcccagggaacagattc

SEQ ID NO: 621897 - DNA, 25 bp, Mus musculus
cttcgtaggccctgggaacagattc

SEQ ID NO: 621898 - DNA, 25 bp, Mus musculus
cttcgtaggcgcagggttcggtgca

SEQ ID NO: 621899 - DNA, 25 bp, Mus musculus
cttcgtaggcgctgggttcggtgca

SEQ ID NO: 621900 - DNA, 25 bp, Mus musculus
cttcgtcgcggcatggatttcaaac

SEQ ID NO: 621901 - DNA, 25 bp, Mus musculus
cttcgtcgcggcttggatttcaaac

SEQ ID NO: 621902 - DNA, 25 bp, Mus musculus
cttcgtctgcaaatagagacatggg

SEQ ID NO: 621903 - DNA, 25 bp, Mus musculus
cttcgtctgcaattagagacatggg

SEQ ID NO: 621904 - DNA, 25 bp, Mus musculus
cttcgtcttcaaattcgtcttctgg

SEQ ID NO: 621905 - DNA, 25 bp, Mus musculus
cttcgtcttcaatttcgtcttctgg

SEQ ID NO: 621906 - DNA, 25 bp, Mus musculus
cttcgtgacgtacccggcgcacata

SEQ ID NO: 621907 - DNA, 25 bp, Mus musculus
cttcgtgacgtagccggcgcacata

SEQ ID NO: 621908 - DNA, 25 bp, Mus musculus
cttcgtgatgaacaatgggactgct

SEQ ID NO: 621909 - DNA, 25 bp, Mus musculus
cttcgtgatgaagaatgggactgct

SEQ ID NO: 621910 - DNA, 25 bp, Mus musculus
cttcgtgatgcgcagcgccagctcg

SEQ ID NO: 621911 - DNA, 25 bp, Mus musculus
cttcgtgatgcggagcgccagctcg

SEQ ID NO: 621912 - DNA, 25 bp, Mus musculus
cttcgtgctcctcttctttgtgggc

SEQ ID NO: 621913 - DNA, 25 bp, Mus musculus
cttcgtgctcctgttctttgtgggc

SEQ ID NO: 621914 - DNA, 25 bp, Mus musculus
cttcgtggccacacaagagcagagg

SEQ ID NO: 621915 - DNA, 25 bp, Mus musculus
cttcgtggccactcaagagcagagg

SEQ ID NO: 621916 - DNA, 25 bp, Mus musculus
cttcgtggctctcgtgatcctggga

SEQ ID NO: 621917 - DNA, 25 bp, Mus musculus
cttcgtggctctggtgatcctggga

SEQ ID NO: 621918 - DNA, 25 bp, Mus musculus
cttcgtgtgccaccgctgtagccag

SEQ ID NO: 621919 - DNA, 25 bp, Mus musculus
cttcgtgtgccagcgctgtagccag

SEQ ID NO: 621920 - DNA, 25 bp, Mus musculus
cttcgtgtttgcctgttatgtgagc

SEQ ID NO: 621921 - DNA, 25 bp, Mus musculus
cttcgtgtttgcgtgttatgtgagc

SEQ ID NO: 621922 - DNA, 25 bp, Mus musculus
cttcgttagtgaagttgttatctcc

SEQ ID NO: 621923 - DNA, 25 bp, Mus musculus
cttcgttagtgatgttgttatctcc

SEQ ID NO: 621924 - DNA, 25 bp, Mus musculus
cttcgttgccttccctatctctaag

SEQ ID NO: 621925 - DNA, 25 bp, Mus musculus
cttcgttgccttgcctatctctaag

SEQ ID NO: 621926 - DNA, 25 bp, Mus musculus
cttcgttggagcagtcggtagctcc

SEQ ID NO: 621927 - DNA, 25 bp, Mus musculus
cttcgttggagctgtcggtagctcc

SEQ ID NO: 621928 - DNA, 25 bp, Mus musculus
cttctaaagacacaaaacctggatg

SEQ ID NO: 621929 - DNA, 25 bp, Mus musculus
cttctaaagacagaaaacctggatg

SEQ ID NO: 621930 - DNA, 25 bp, Mus musculus
cttctaatccttacacgaggactct

SEQ ID NO: 621931 - DNA, 25 bp, Mus musculus
cttctaatcctttcacgaggactct

SEQ ID NO: 621932 - DNA, 25 bp, Mus musculus
cttctaatgtgaaagcaagtcctaa

SEQ ID NO: 621933 - DNA, 25 bp, Mus musculus
cttctaatgtgatagcaagtcctaa

SEQ ID NO: 621934 - DNA, 25 bp, Mus musculus
cttctacaaaataggtaaggtggca

SEQ ID NO: 621935 - DNA, 25 bp, Mus musculus
cttctacaaaattggtaaggtggca

SEQ ID NO: 621936 - DNA, 25 bp, Mus musculus
cttctacaaagtcccaagaaaaaga

SEQ ID NO: 621937 - DNA, 25 bp, Mus musculus
cttctacaaagtgccaagaaaaaga

SEQ ID NO: 621938 - DNA, 25 bp, Mus musculus
cttctacagtcacggcctggagtcc

SEQ ID NO: 621939 - DNA, 25 bp, Mus musculus
cttctacagtcagggcctggagtcc

SEQ ID NO: 621940 - DNA, 25 bp, Mus musculus
cttctacatgtaatcgcaaaactga

SEQ ID NO: 621941 - DNA, 25 bp, Mus musculus
cttctacatgtattcgcaaaactga

SEQ ID NO: 621942 - DNA, 25 bp, Mus musculus
cttctaccacagctttggccgcgtg

SEQ ID NO: 621943 - DNA, 25 bp, Mus musculus
cttctaccacaggtttggccgcgtg

SEQ ID NO: 621944 - DNA, 25 bp, Mus musculus
cttctaccactgagcgtactctcta

SEQ ID NO: 621945 - DNA, 25 bp, Mus musculus
cttctaccactgtgcgtactctcta

SEQ ID NO: 621946 - DNA, 25 bp, Mus musculus
cttctacccggtcatgctgatgcta

SEQ ID NO: 621947 - DNA, 25 bp, Mus musculus
cttctacccggtgatgctgatgcta

SEQ ID NO: 621948 - DNA, 25 bp, Mus musculus
cttctaccgcgacacggtgcaggtg

SEQ ID NO: 621949 - DNA, 25 bp, Mus musculus
cttctaccgcgagacggtgcaggtg

SEQ ID NO: 621950 - DNA, 25 bp, Mus musculus
cttctacctggaagttggacagcta

SEQ ID NO: 621951 - DNA, 25 bp, Mus musculus
cttctacctggatgttggacagcta

SEQ ID NO: 621952 - DNA, 25 bp, Mus musculus
cttctactgccactgtctgcctggg

SEQ ID NO: 621953 - DNA, 25 bp, Mus musculus
cttctactgccagtgtctgcctggg

SEQ ID NO: 621954 - DNA, 25 bp, Mus musculus
cttctagagagacttgtgtggcgtt

SEQ ID NO: 621955 - DNA, 25 bp, Mus musculus
cttctagagagagttgtgtggcgtt

SEQ ID NO: 621956 - DNA, 25 bp, Mus musculus
cttctagagcaactgttaaatcaga

SEQ ID NO: 621957 - DNA, 25 bp, Mus musculus
cttctagagcaagtgttaaatcaga

SEQ ID NO: 621958 - DNA, 25 bp, Mus musculus
cttctaggaaaaatgctagggccga

SEQ ID NO: 621959 - DNA, 25 bp, Mus musculus
cttctaggaaaattgctagggccga

SEQ ID NO: 621960 - DNA, 25 bp, Mus musculus
cttctagggctacattcggaaacca

SEQ ID NO: 621961 - DNA, 25 bp, Mus musculus
cttctagggctagattcggaaacca

SEQ ID NO: 621962 - DNA, 25 bp, Mus musculus
cttctatggcatcgattatgcagcc

SEQ ID NO: 621963 - DNA, 25 bp, Mus musculus
cttctatggcatggattatgcagcc

SEQ ID NO: 621964 - DNA, 25 bp, Mus musculus
cttctatggccaatttgtggctggc

SEQ ID NO: 621965 - DNA, 25 bp, Mus musculus
cttctatggccattttgtggctggc

SEQ ID NO: 621966 - DNA, 25 bp, Mus musculus
cttctatgtagaccacccgttgact

SEQ ID NO: 621967 - DNA, 25 bp, Mus musculus
cttctatgtagagcacccgttgact

SEQ ID NO: 621968 - DNA, 25 bp, Mus musculus
cttctatgtccacggtagaggccat

SEQ ID NO: 621969 - DNA, 25 bp, Mus musculus
cttctatgtccagggtagaggccat

SEQ ID NO: 621970 - DNA, 25 bp, Mus musculus
cttctattccaacgacagtgaagga

SEQ ID NO: 621971 - DNA, 25 bp, Mus musculus
cttctattccaaggacagtgaagga

SEQ ID NO: 621972 - DNA, 25 bp, Mus musculus
cttctcaaccaacggtggactggcc

SEQ ID NO: 621973 - DNA, 25 bp, Mus musculus
cttctcaaccaagggtggactggcc

SEQ ID NO: 621974 - DNA, 25 bp, Mus musculus
cttctcacgaaccatcaatgcaggg

SEQ ID NO: 621975 - DNA, 25 bp, Mus musculus
cttctcacgaacgatcaatgcaggg

SEQ ID NO: 621976 - DNA, 25 bp, Mus musculus
cttctcagaaacagactgagaggcc

SEQ ID NO: 621977 - DNA, 25 bp, Mus musculus
cttctcagaaactgactgagaggcc

SEQ ID NO: 621978 - DNA, 25 bp, Mus musculus
cttctcagaagccagtaaaatgttc

SEQ ID NO: 621979 - DNA, 25 bp, Mus musculus
cttctcagaagcgagtaaaatgttc

SEQ ID NO: 621980 - DNA, 25 bp, Mus musculus
cttctcagagaactatatcccattt

SEQ ID NO: 621981 - DNA, 25 bp, Mus musculus
cttctcagagaagtatatcccattt

SEQ ID NO: 621982 - DNA, 25 bp, Mus musculus
cttctcagagcgcattttcatcgcg

SEQ ID NO: 621983 - DNA, 25 bp, Mus musculus
cttctcagagcggattttcatcgcg

SEQ ID NO: 621984 - DNA, 25 bp, Mus musculus
cttctcagctgccagtaaagccaag

SEQ ID NO: 621985 - DNA, 25 bp, Mus musculus
cttctcagctgcgagtaaagccaag

SEQ ID NO: 621986 - DNA, 25 bp, Mus musculus
cttctcagtgcacgtttgcaccatc

SEQ ID NO: 621987 - DNA, 25 bp, Mus musculus
cttctcagtgcaggtttgcaccatc

SEQ ID NO: 621988 - DNA, 25 bp, Mus musculus
cttctcatggagaaccagcttctcc

SEQ ID NO: 621989 - DNA, 25 bp, Mus musculus
cttctcatggagctccacagtgtca

SEQ ID NO: 621990 - DNA, 25 bp, Mus musculus
cttctcatggaggtccacagtgtca

SEQ ID NO: 621991 - DNA, 25 bp, Mus musculus
cttctcatggagtaccagcttctcc

SEQ ID NO: 621992 - DNA, 25 bp, Mus musculus
cttctcatggctcgctccaggacta

SEQ ID NO: 621993 - DNA, 25 bp, Mus musculus
cttctcatggctggctccaggacta

SEQ ID NO: 621994 - DNA, 25 bp, Mus musculus
cttctcatgttcagccggcatacac

SEQ ID NO: 621995 - DNA, 25 bp, Mus musculus
cttctcatgttctgccggcatacac

SEQ ID NO: 621996 - DNA, 25 bp, Mus musculus
cttctccaatacaacagacgtcgag

SEQ ID NO: 621997 - DNA, 25 bp, Mus musculus
cttctccaatactacagacgtcgag

SEQ ID NO: 621998 - DNA, 25 bp, Mus musculus
cttctccagaaaacgacagtaaatc

SEQ ID NO: 621999 - DNA, 25 bp, Mus musculus
cttctccagaaatcgacagtaaatc

SEQ ID NO: 622000 - DNA, 25 bp, Mus musculus
cttctccagagtatcagtgaccacc

SEQ ID NO: 622001 - DNA, 25 bp, Mus musculus
cttctccagagtttcagtgaccacc

SEQ ID NO: 622002 - DNA, 25 bp, Mus musculus
cttctccagtgacggactggtggtc

SEQ ID NO: 622003 - DNA, 25 bp, Mus musculus
cttctccagtgagggactggtggtc

SEQ ID NO: 622004 - DNA, 25 bp, Mus musculus
cttctccatgcaaagagcagcatag

SEQ ID NO: 622005 - DNA, 25 bp, Mus musculus
cttctccatgcatagagcagcatag

SEQ ID NO: 622006 - DNA, 25 bp, Mus musculus
cttctccctcttcgacaaggatgga

SEQ ID NO: 622007 - DNA, 25 bp, Mus musculus
cttctccctcttggacaaggatgga

SEQ ID NO: 622008 - DNA, 25 bp, Mus musculus
cttctccgtgtccatgctagcaggg

SEQ ID NO: 622009 - DNA, 25 bp, Mus musculus
cttctccgtgtcgatgctagcaggg

SEQ ID NO: 622010 - DNA, 25 bp, Mus musculus
cttctcctacctccggcgtgtagtg

SEQ ID NO: 622011 - DNA, 25 bp, Mus musculus
cttctcctacctgcggcgtgtagtg

SEQ ID NO: 622012 - DNA, 25 bp, Mus musculus
cttctcctgacaatgccacatctgt

SEQ ID NO: 622013 - DNA, 25 bp, Mus musculus
cttctcctgacattgccacatctgt

SEQ ID NO: 622014 - DNA, 25 bp, Mus musculus
cttctcctgtcacgccgggataact

SEQ ID NO: 622015 - DNA, 25 bp, Mus musculus
cttctcctgtcaggccgggataact

SEQ ID NO: 622016 - DNA, 25 bp, Mus musculus
cttctcgctcctagatggcacctgt

SEQ ID NO: 622017 - DNA, 25 bp, Mus musculus
cttctcgctccttgatggcacctgt

SEQ ID NO: 622018 - DNA, 25 bp, Mus musculus
cttctcggacctctattcagagtga

SEQ ID NO: 622019 - DNA, 25 bp, Mus musculus
cttctcggacctgtattcagagtga

SEQ ID NO: 622020 - DNA, 25 bp, Mus musculus
cttctcggagctcttcaaaaaggag

SEQ ID NO: 622021 - DNA, 25 bp, Mus musculus
cttctcggagctgttcaaaaaggag

SEQ ID NO: 622022 - DNA, 25 bp, Mus musculus
cttctcggatgaacagaaagacaag

SEQ ID NO: 622023 - DNA, 25 bp, Mus musculus
cttctcggatgatcagaaagacaag

SEQ ID NO: 622024 - DNA, 25 bp, Mus musculus
cttctcggtggcacgcggaggaccc

SEQ ID NO: 622025 - DNA, 25 bp, Mus musculus
cttctcggtggctcgcggaggaccc

SEQ ID NO: 622026 - DNA, 25 bp, Mus musculus
cttctctaccgacagatgtcatcat

SEQ ID NO: 622027 - DNA, 25 bp, Mus musculus
cttctctaccgagagatgtcatcat

SEQ ID NO: 622028 - DNA, 25 bp, Mus musculus
cttctctcagcactgcctgagaatg

SEQ ID NO: 622029 - DNA, 25 bp, Mus musculus
cttctctcagcagtgcctgagaatg

SEQ ID NO: 622030 - DNA, 25 bp, Mus musculus
cttctctcggtcattgttattggga

SEQ ID NO: 622031 - DNA, 25 bp, Mus musculus
cttctctcggtctttgttattggga

SEQ ID NO: 622032 - DNA, 25 bp, Mus musculus
cttctctggaaaaggccacacaaat

SEQ ID NO: 622033 - DNA, 25 bp, Mus musculus
cttctctggaaatggccacacaaat

SEQ ID NO: 622034 - DNA, 25 bp, Mus musculus
cttctctggttcagggaatagactg

SEQ ID NO: 622035 - DNA, 25 bp, Mus musculus
cttctctggttctgggaatagactg

SEQ ID NO: 622036 - DNA, 25 bp, Mus musculus
cttctctgtccgagttgaaggtgac

SEQ ID NO: 622037 - DNA, 25 bp, Mus musculus
cttctctgtccgtgttgaaggtgac

SEQ ID NO: 622038 - DNA, 25 bp, Mus musculus
cttctctgtcttccaaagccctttg

SEQ ID NO: 622039 - DNA, 25 bp, Mus musculus
cttctctgtcttgcaaagccctttg

SEQ ID NO: 622040 - DNA, 25 bp, Mus musculus
cttctctgtggaaagctcgggccct

SEQ ID NO: 622041 - DNA, 25 bp, Mus musculus
cttctctgtggatagctcgggccct

SEQ ID NO: 622042 - DNA, 25 bp, Mus musculus
cttctctgttggaggcatgattggc

SEQ ID NO: 622043 - DNA, 25 bp, Mus musculus
cttctctgttggtggcatgattggc

SEQ ID NO: 622044 - DNA, 25 bp, Mus musculus
cttctcttgatgatgggctgtaacc

SEQ ID NO: 622045 - DNA, 25 bp, Mus musculus
cttctcttgatgttgggctgtaacc

SEQ ID NO: 622046 - DNA, 25 bp, Mus musculus
cttctcttgggtcgccgtgagccta

SEQ ID NO: 622047 - DNA, 25 bp, Mus musculus
cttctcttgggtggccgtgagccta

SEQ ID NO: 622048 - DNA, 25 bp, Mus musculus
cttctctttcgccacgacatgaact

SEQ ID NO: 622049 - DNA, 25 bp, Mus musculus
cttctctttcgcgacgacatgaact

SEQ ID NO: 622050 - DNA, 25 bp, Mus musculus
cttctctttctacatcctgaggacc

SEQ ID NO: 622051 - DNA, 25 bp, Mus musculus
cttctctttctagatcctgaggacc

SEQ ID NO: 622052 - DNA, 25 bp, Mus musculus
cttctgaagaggatgtgtgtgctgt

SEQ ID NO: 622053 - DNA, 25 bp, Mus musculus
cttctgaagaggcttgacaatgtgt

SEQ ID NO: 622054 - DNA, 25 bp, Mus musculus
cttctgaagagggttgacaatgtgt

SEQ ID NO: 622055 - DNA, 25 bp, Mus musculus
cttctgaagaggttgtgtgtgctgt

SEQ ID NO: 622056 - DNA, 25 bp, Mus musculus
cttctgacagaacagaacgatgaaa

SEQ ID NO: 622057 - DNA, 25 bp, Mus musculus
cttctgacagaagagaacgatgaaa

SEQ ID NO: 622058 - DNA, 25 bp, Mus musculus
cttctgacccttctgttgataaaga

SEQ ID NO: 622059 - DNA, 25 bp, Mus musculus
cttctgacccttgtgttgataaaga

SEQ ID NO: 622060 - DNA, 25 bp, Mus musculus
cttctgactttacctctggctctgg

SEQ ID NO: 622061 - DNA, 25 bp, Mus musculus
cttctgactttagctctggctctgg

SEQ ID NO: 622062 - DNA, 25 bp, Mus musculus
cttctgagagcacagaggtgatctg

SEQ ID NO: 622063 - DNA, 25 bp, Mus musculus
cttctgagagcagagaggtgatctg

SEQ ID NO: 622064 - DNA, 25 bp, Mus musculus
cttctgagcaatactggctctgctg

SEQ ID NO: 622065 - DNA, 25 bp, Mus musculus
cttctgagcaattctggctctgctg

SEQ ID NO: 622066 - DNA, 25 bp, Mus musculus
cttctgagctcacacagagcctgga

SEQ ID NO: 622067 - DNA, 25 bp, Mus musculus
cttctgagctcagacagagcctgga

SEQ ID NO: 622068 - DNA, 25 bp, Mus musculus
cttctgaggctccaaattcagctgt

SEQ ID NO: 622069 - DNA, 25 bp, Mus musculus
cttctgaggctcgaaattcagctgt

SEQ ID NO: 622070 - DNA, 25 bp, Mus musculus
cttctgagttagagatgaacatggg

SEQ ID NO: 622071 - DNA, 25 bp, Mus musculus
cttctgagttagtgatgaacatggg

SEQ ID NO: 622072 - DNA, 25 bp, Mus musculus
cttctgatctccaggtaaccatctt

SEQ ID NO: 622073 - DNA, 25 bp, Mus musculus
cttctgatctcctggtaaccatctt

SEQ ID NO: 622074 - DNA, 25 bp, Mus musculus
cttctgatgaacacagctggatcat

SEQ ID NO: 622075 - DNA, 25 bp, Mus musculus
cttctgatgaactcagctggatcat

SEQ ID NO: 622076 - DNA, 25 bp, Mus musculus
cttctgatgctcacacgtacttggg

SEQ ID NO: 622077 - DNA, 25 bp, Mus musculus
cttctgatgctctcacgtacttggg

SEQ ID NO: 622078 - DNA, 25 bp, Mus musculus
cttctgattccgcaaaccctgtgat

SEQ ID NO: 622079 - DNA, 25 bp, Mus musculus
cttctgattccggaaaccctgtgat

SEQ ID NO: 622080 - DNA, 25 bp, Mus musculus
cttctgcaaaggagatgtgctcacc

SEQ ID NO: 622081 - DNA, 25 bp, Mus musculus
cttctgcaaaggtgatgtgctcacc

SEQ ID NO: 622082 - DNA, 25 bp, Mus musculus
cttctgcaacatcagtactctaggg

SEQ ID NO: 622083 - DNA, 25 bp, Mus musculus
cttctgcaacatgagtactctaggg

SEQ ID NO: 622084 - DNA, 25 bp, Mus musculus
cttctgcagctaagaacagaggtgg

SEQ ID NO: 622085 - DNA, 25 bp, Mus musculus
cttctgcagctatgaacagaggtgg

SEQ ID NO: 622086 - DNA, 25 bp, Mus musculus
cttctgcagctgatggatcctttcc

SEQ ID NO: 622087 - DNA, 25 bp, Mus musculus
cttctgcagctgttggatcctttcc

SEQ ID NO: 622088 - DNA, 25 bp, Mus musculus
cttctgcagggcagatactggccca

SEQ ID NO: 622089 - DNA, 25 bp, Mus musculus
cttctgcagggctgatactggccca

SEQ ID NO: 622090 - DNA, 25 bp, Mus musculus
cttctgcaggtgagactgaactctg

SEQ ID NO: 622091 - DNA, 25 bp, Mus musculus
cttctgcaggtgtgactgaactctg

SEQ ID NO: 622092 - DNA, 25 bp, Mus musculus
cttctgcagtacattcgcggccttc

SEQ ID NO: 622093 - DNA, 25 bp, Mus musculus
cttctgcagtactttcgcggccttc

SEQ ID NO: 622094 - DNA, 25 bp, Mus musculus
cttctgcagttcaaagggtccatgc

SEQ ID NO: 622095 - DNA, 25 bp, Mus musculus
cttctgcagttctaagggtccatgc

SEQ ID NO: 622096 - DNA, 25 bp, Mus musculus
cttctgccgcaacccagactgggat

SEQ ID NO: 622097 - DNA, 25 bp, Mus musculus
cttctgccgcaagccagactgggat

SEQ ID NO: 622098 - DNA, 25 bp, Mus musculus
cttctgccgtggatgtaaagccagc

SEQ ID NO: 622099 - DNA, 25 bp, Mus musculus
cttctgccgtggttgtaaagccagc

SEQ ID NO: 622100 - DNA, 25 bp, Mus musculus
cttctgcctattaaattctgggatt

SEQ ID NO: 622101 - DNA, 25 bp, Mus musculus
cttctgcctatttaattctgggatt

SEQ ID NO: 622102 - DNA, 25 bp, Mus musculus
cttctgcgaactccttctggatgac

SEQ ID NO: 622103 - DNA, 25 bp, Mus musculus
cttctgcgaactgcttctggatgac

SEQ ID NO: 622104 - DNA, 25 bp, Mus musculus
cttctgcgagatcttgatgcgggaa

SEQ ID NO: 622105 - DNA, 25 bp, Mus musculus
cttctgcgagatgttgatgcgggaa

SEQ ID NO: 622106 - DNA, 25 bp, Mus musculus
cttctgcgtcctcctgctaggctgt

SEQ ID NO: 622107 - DNA, 25 bp, Mus musculus
cttctgcgtcctgctgctaggctgt

SEQ ID NO: 622108 - DNA, 25 bp, Mus musculus
cttctgctgatcctcatcgcacagg

SEQ ID NO: 622109 - DNA, 25 bp, Mus musculus
cttctgctgatcgtcatcgcacagg

SEQ ID NO: 622110 - DNA, 25 bp, Mus musculus
cttctgctgtggaaaaattacacct

SEQ ID NO: 622111 - DNA, 25 bp, Mus musculus
cttctgctgtggtaaaattacacct

SEQ ID NO: 622112 - DNA, 25 bp, Mus musculus
cttctggaagaacttgattcttgtc

SEQ ID NO: 622113 - DNA, 25 bp, Mus musculus
cttctggaagaagttgattcttgtc

SEQ ID NO: 622114 - DNA, 25 bp, Mus musculus
cttctggacctgctgggcagtgcca

SEQ ID NO: 622115 - DNA, 25 bp, Mus musculus
cttctggacctggtgggcagtgcca

SEQ ID NO: 622116 - DNA, 25 bp, Mus musculus
cttctggagacgcagcaggcctatg

SEQ ID NO: 622117 - DNA, 25 bp, Mus musculus
cttctggagacggagcaggcctatg

SEQ ID NO: 622118 - DNA, 25 bp, Mus musculus
cttctggagcacagcggcgtgtgtc

SEQ ID NO: 622119 - DNA, 25 bp, Mus musculus
cttctggagcactgcggcgtgtgtc

SEQ ID NO: 622120 - DNA, 25 bp, Mus musculus
cttctggaggatagcctggtgcccc

SEQ ID NO: 622121 - DNA, 25 bp, Mus musculus
cttctggaggattgcctggtgcccc

SEQ ID NO: 622122 - DNA, 25 bp, Mus musculus
cttctgggaaacaacgggcgactct

SEQ ID NO: 622123 - DNA, 25 bp, Mus musculus
cttctgggaaactacgggcgactct

SEQ ID NO: 622124 - DNA, 25 bp, Mus musculus
cttctgggagacattgtagaatggc

SEQ ID NO: 622125 - DNA, 25 bp, Mus musculus
cttctgggagactttgtagaatggc

SEQ ID NO: 622126 - DNA, 25 bp, Mus musculus
cttctgggccaaaaacaggcacttg

SEQ ID NO: 622127 - DNA, 25 bp, Mus musculus
cttctgggccaataacaggcacttg

SEQ ID NO: 622128 - DNA, 25 bp, Mus musculus
cttctgggctatcgtccgggcgatc

SEQ ID NO: 622129 - DNA, 25 bp, Mus musculus
cttctgggctatggtccgggcgatc

SEQ ID NO: 622130 - DNA, 25 bp, Mus musculus
cttctggtacagagttcaagggctc

SEQ ID NO: 622131 - DNA, 25 bp, Mus musculus
cttctggtacagtgttcaagggctc

SEQ ID NO: 622132 - DNA, 25 bp, Mus musculus
cttctggtctctccacatgctgctg

SEQ ID NO: 622133 - DNA, 25 bp, Mus musculus
cttctggtctctgcacatgctgctg

SEQ ID NO: 622134 - DNA, 25 bp, Mus musculus
cttctgtatggacctccaggctgtg

SEQ ID NO: 622135 - DNA, 25 bp, Mus musculus
cttctgtatggagctccaggctgtg

SEQ ID NO: 622136 - DNA, 25 bp, Mus musculus
cttctgtcggccctgttgaccgcgg

SEQ ID NO: 622137 - DNA, 25 bp, Mus musculus
cttctgtcggccgtgttgaccgcgg

SEQ ID NO: 622138 - DNA, 25 bp, Mus musculus
cttctgtcgtcaatgccaacgggac

SEQ ID NO: 622139 - DNA, 25 bp, Mus musculus
cttctgtcgtcattgccaacgggac

SEQ ID NO: 622140 - DNA, 25 bp, Mus musculus
cttctgtctgctccttatccacaat

SEQ ID NO: 622141 - DNA, 25 bp, Mus musculus
cttctgtctgctgcttatccacaat

SEQ ID NO: 622142 - DNA, 25 bp, Mus musculus
cttctgtctggacgacacgtcctgt

SEQ ID NO: 622143 - DNA, 25 bp, Mus musculus
cttctgtctggaggacacgtcctgt

SEQ ID NO: 622144 - DNA, 25 bp, Mus musculus
cttctgtgagcaaatggctctggtc

SEQ ID NO: 622145 - DNA, 25 bp, Mus musculus
cttctgtgagcaaggatgtgcccga

SEQ ID NO: 622146 - DNA, 25 bp, Mus musculus
cttctgtgagcatatggctctggtc

SEQ ID NO: 622147 - DNA, 25 bp, Mus musculus
cttctgtgagcatggatgtgcccga

SEQ ID NO: 622148 - DNA, 25 bp, Mus musculus
cttctgtgcaaacgaatggcaggca

SEQ ID NO: 622149 - DNA, 25 bp, Mus musculus
cttctgtgcaaaggaatggcaggca

SEQ ID NO: 622150 - DNA, 25 bp, Mus musculus
cttctgtgctgtcctataattctcg

SEQ ID NO: 622151 - DNA, 25 bp, Mus musculus
cttctgtgctgtgctataattctcg

SEQ ID NO: 622152 - DNA, 25 bp, Mus musculus
cttctgtggcctactcaaagagtgg

SEQ ID NO: 622153 - DNA, 25 bp, Mus musculus
cttctgtggccttctcaaagagtgg

SEQ ID NO: 622154 - DNA, 25 bp, Mus musculus
cttctgtggctgacaggtggcctgg

SEQ ID NO: 622155 - DNA, 25 bp, Mus musculus
cttctgtggctgtcaggtggcctgg

SEQ ID NO: 622156 - DNA, 25 bp, Mus musculus
cttctgtgggcacacgctgacattc

SEQ ID NO: 622157 - DNA, 25 bp, Mus musculus
cttctgtgggcagacgctgacattc

SEQ ID NO: 622158 - DNA, 25 bp, Mus musculus
cttctgttattaacaggagatgccc

SEQ ID NO: 622159 - DNA, 25 bp, Mus musculus
cttctgttattatcaggagatgccc

SEQ ID NO: 622160 - DNA, 25 bp, Mus musculus
cttctgttctacaaagcatccacaa

SEQ ID NO: 622161 - DNA, 25 bp, Mus musculus
cttctgttctactaagcatccacaa

SEQ ID NO: 622162 - DNA, 25 bp, Mus musculus
cttctgttgaagatggcatgggctg

SEQ ID NO: 622163 - DNA, 25 bp, Mus musculus
cttctgttgaagttggcatgggctg

SEQ ID NO: 622164 - DNA, 25 bp, Mus musculus
cttctgtttaggagtcttgccttcc

SEQ ID NO: 622165 - DNA, 25 bp, Mus musculus
cttctgtttaggtgtcttgccttcc

SEQ ID NO: 622166 - DNA, 25 bp, Mus musculus
cttctgtttcccagtctatgttcag

SEQ ID NO: 622167 - DNA, 25 bp, Mus musculus
cttctgtttccctgtctatgttcag

SEQ ID NO: 622168 - DNA, 25 bp, Mus musculus
cttcttaaaggcaccgaggcgtcca

SEQ ID NO: 622169 - DNA, 25 bp, Mus musculus
cttcttaaaggctccgaggcgtcca

SEQ ID NO: 622170 - DNA, 25 bp, Mus musculus
cttcttacccttcacaacaacgtgg

SEQ ID NO: 622171 - DNA, 25 bp, Mus musculus
cttcttacccttgacaacaacgtgg

SEQ ID NO: 622172 - DNA, 25 bp, Mus musculus
cttcttcaacacagacgtggcccag

SEQ ID NO: 622173 - DNA, 25 bp, Mus musculus
cttcttcaacactgacgtggcccag

SEQ ID NO: 622174 - DNA, 25 bp, Mus musculus
cttcttcacatgacttggccgtgat

SEQ ID NO: 622175 - DNA, 25 bp, Mus musculus
cttcttcacatgtcttggccgtgat

SEQ ID NO: 622176 - DNA, 25 bp, Mus musculus
cttcttcaccttcatggctcagctg

SEQ ID NO: 622177 - DNA, 25 bp, Mus musculus
cttcttcaccttgatggctcagctg

SEQ ID NO: 622178 - DNA, 25 bp, Mus musculus
cttcttcactacagtggcagcgact

SEQ ID NO: 622179 - DNA, 25 bp, Mus musculus
cttcttcactactgtggcagcgact

SEQ ID NO: 622180 - DNA, 25 bp, Mus musculus
cttcttcaggagatgccaaagtggg

SEQ ID NO: 622181 - DNA, 25 bp, Mus musculus
cttcttcaggagttgccaaagtggg

SEQ ID NO: 622182 - DNA, 25 bp, Mus musculus
cttcttcatcaaccgtaagtgcttg

SEQ ID NO: 622183 - DNA, 25 bp, Mus musculus
cttcttcatcaagcgtaagtgcttg

SEQ ID NO: 622184 - DNA, 25 bp, Mus musculus
cttcttcatcctagtggctgtccgt

SEQ ID NO: 622185 - DNA, 25 bp, Mus musculus
cttcttcatccttgtggctgtccgt

SEQ ID NO: 622186 - DNA, 25 bp, Mus musculus
cttcttcccaaacgatgtgctgacc

SEQ ID NO: 622187 - DNA, 25 bp, Mus musculus
cttcttcccaaaggatgtgctgacc

SEQ ID NO: 622188 - DNA, 25 bp, Mus musculus
cttcttcctcgtagaaatgttccag

SEQ ID NO: 622189 - DNA, 25 bp, Mus musculus
cttcttcctcgttgaaatgttccag

SEQ ID NO: 622190 - DNA, 25 bp, Mus musculus
cttcttccttaaccgcgcttcaggt

SEQ ID NO: 622191 - DNA, 25 bp, Mus musculus
cttcttccttaagcgcgcttcaggt

SEQ ID NO: 622192 - DNA, 25 bp, Mus musculus
cttcttcgtgatcagtgattacaga

SEQ ID NO: 622193 - DNA, 25 bp, Mus musculus
cttcttcgtgatgagtgattacaga

SEQ ID NO: 622194 - DNA, 25 bp, Mus musculus
cttcttctgggtcgcccggatggtc

SEQ ID NO: 622195 - DNA, 25 bp, Mus musculus
cttcttctgggtggcccggatggtc

SEQ ID NO: 622196 - DNA, 25 bp, Mus musculus
cttcttctggttcgtgggtttctgc

SEQ ID NO: 622197 - DNA, 25 bp, Mus musculus
cttcttctggttggtgggtttctgc

SEQ ID NO: 622198 - DNA, 25 bp, Mus musculus
cttcttcttatgcaagacggccgtg

SEQ ID NO: 622199 - DNA, 25 bp, Mus musculus
cttcttcttatggaagacggccgtg

SEQ ID NO: 622200 - DNA, 25 bp, Mus musculus
cttcttcttcgtcaatgacttcagc

SEQ ID NO: 622201 - DNA, 25 bp, Mus musculus
cttcttcttcgtgaatgacttcagc

SEQ ID NO: 622202 - DNA, 25 bp, Mus musculus
cttcttgaaaagactcgcctggttt

SEQ ID NO: 622203 - DNA, 25 bp, Mus musculus
cttcttgaaaagtctcgcctggttt

SEQ ID NO: 622204 - DNA, 25 bp, Mus musculus
cttcttgacatcactgctgtagtag

SEQ ID NO: 622205 - DNA, 25 bp, Mus musculus
cttcttgacatctctgctgtagtag

SEQ ID NO: 622206 - DNA, 25 bp, Mus musculus
cttcttgagcttcaggctggaaaga

SEQ ID NO: 622207 - DNA, 25 bp, Mus musculus
cttcttgagcttgaggctggaaaga

SEQ ID NO: 622208 - DNA, 25 bp, Mus musculus
cttcttgcaggaatacttggatctc

SEQ ID NO: 622209 - DNA, 25 bp, Mus musculus
cttcttgcaggattacttggatctc

SEQ ID NO: 622210 - DNA, 25 bp, Mus musculus
cttcttggacagctgagaaatccat

SEQ ID NO: 622211 - DNA, 25 bp, Mus musculus
cttcttggacaggtgagaaatccat

SEQ ID NO: 622212 - DNA, 25 bp, Mus musculus
cttcttggattcactcctggccacg

SEQ ID NO: 622213 - DNA, 25 bp, Mus musculus
cttcttggattctctcctggccacg

SEQ ID NO: 622214 - DNA, 25 bp, Mus musculus
cttcttggcacgcatactgatggac

SEQ ID NO: 622215 - DNA, 25 bp, Mus musculus
cttcttggcacggatactgatggac

SEQ ID NO: 622216 - DNA, 25 bp, Mus musculus
cttcttgggaagcccctttctggcg

SEQ ID NO: 622217 - DNA, 25 bp, Mus musculus
cttcttgggaaggccctttctggcg

SEQ ID NO: 622218 - DNA, 25 bp, Mus musculus
cttcttgggtttagcgattagtgcc

SEQ ID NO: 622219 - DNA, 25 bp, Mus musculus
cttcttgggttttgcgattagtgcc

SEQ ID NO: 622220 - DNA, 25 bp, Mus musculus
cttcttgtctcacagagcagtagag

SEQ ID NO: 622221 - DNA, 25 bp, Mus musculus
cttcttgtctcagagagcagtagag

SEQ ID NO: 622222 - DNA, 25 bp, Mus musculus
cttcttgtgaatcgacagcctctgc

SEQ ID NO: 622223 - DNA, 25 bp, Mus musculus
cttcttgtgaatggacagcctctgc

SEQ ID NO: 622224 - DNA, 25 bp, Mus musculus
cttctttaagtgcacagtggatgtt

SEQ ID NO: 622225 - DNA, 25 bp, Mus musculus
cttctttaagtggacagtggatgtt

SEQ ID NO: 622226 - DNA, 25 bp, Mus musculus
cttctttctgagatggcctcaacag

SEQ ID NO: 622227 - DNA, 25 bp, Mus musculus
cttctttctgagttggcctcaacag

SEQ ID NO: 622228 - DNA, 25 bp, Mus musculus
cttctttgaatccagaagctggcaa

SEQ ID NO: 622229 - DNA, 25 bp, Mus musculus
cttctttgaatcgagaagctggcaa

SEQ ID NO: 622230 - DNA, 25 bp, Mus musculus
cttctttgctgtcgataatggccca

SEQ ID NO: 622231 - DNA, 25 bp, Mus musculus
cttctttgctgtggataatggccca

SEQ ID NO: 622232 - DNA, 25 bp, Mus musculus
cttctttggcttccgaaccttcagc

SEQ ID NO: 622233 - DNA, 25 bp, Mus musculus
cttctttggcttgcgaaccttcagc

SEQ ID NO: 622234 - DNA, 25 bp, Mus musculus
cttctttgtatcctggccttagtga

SEQ ID NO: 622235 - DNA, 25 bp, Mus musculus
cttctttgtatcgtggccttagtga

SEQ ID NO: 622236 - DNA, 25 bp, Mus musculus
cttctttgtcttctacatgctgctg

SEQ ID NO: 622237 - DNA, 25 bp, Mus musculus
cttctttgtcttgtacatgctgctg

SEQ ID NO: 622238 - DNA, 25 bp, Mus musculus
cttcttttagatcttccggaagctg

SEQ ID NO: 622239 - DNA, 25 bp, Mus musculus
cttcttttagatgttccggaagctg

SEQ ID NO: 622240 - DNA, 25 bp, Mus musculus
cttgaaaagaagctcaaacagacaa

SEQ ID NO: 622241 - DNA, 25 bp, Mus musculus
cttgaaaagaaggtcaaacagacaa

SEQ ID NO: 622242 - DNA, 25 bp, Mus musculus
cttgaaaatcttcgatactctgtgg

SEQ ID NO: 622243 - DNA, 25 bp, Mus musculus
cttgaaaatcttggatactctgtgg

SEQ ID NO: 622244 - DNA, 25 bp, Mus musculus
cttgaaagagaacagctgtgtggct

SEQ ID NO: 622245 - DNA, 25 bp, Mus musculus
cttgaaagagaagagctgtgtggct

SEQ ID NO: 622246 - DNA, 25 bp, Mus musculus
cttgaaagatgccaatgatgtaccg

SEQ ID NO: 622247 - DNA, 25 bp, Mus musculus
cttgaaagatgcgaatgatgtaccg

SEQ ID NO: 622248 - DNA, 25 bp, Mus musculus
cttgaaagcacgaggattggaagag

SEQ ID NO: 622249 - DNA, 25 bp, Mus musculus
cttgaaagcacgtggattggaagag

SEQ ID NO: 622250 - DNA, 25 bp, Mus musculus
cttgaaagtgacatcctggctgtgc

SEQ ID NO: 622251 - DNA, 25 bp, Mus musculus
cttgaaagtgacttcctggctgtgc

SEQ ID NO: 622252 - DNA, 25 bp, Mus musculus
cttgaaatggtgatcatctggtggt

SEQ ID NO: 622253 - DNA, 25 bp, Mus musculus
cttgaaatggtgttcatctggtggt

SEQ ID NO: 622254 - DNA, 25 bp, Mus musculus
cttgaacaggctcctggtcagttat

SEQ ID NO: 622255 - DNA, 25 bp, Mus musculus
cttgaacaggctgctggtcagttat

SEQ ID NO: 622256 - DNA, 25 bp, Mus musculus
cttgaaccaaaaatggtgagtgcca

SEQ ID NO: 622257 - DNA, 25 bp, Mus musculus
cttgaaccaaaattggtgagtgcca

SEQ ID NO: 622258 - DNA, 25 bp, Mus musculus
cttgaaccccttcgaggactggctg

SEQ ID NO: 622259 - DNA, 25 bp, Mus musculus
cttgaaccccttggaggactggctg

SEQ ID NO: 622260 - DNA, 25 bp, Mus musculus
cttgaacccttcagggaggtcctgg

SEQ ID NO: 622261 - DNA, 25 bp, Mus musculus
cttgaacccttctgggaggtcctgg

SEQ ID NO: 622262 - DNA, 25 bp, Mus musculus
cttgaaccgagaccggaaggcagcc

SEQ ID NO: 622263 - DNA, 25 bp, Mus musculus
cttgaaccgagagcggaaggcagcc

SEQ ID NO: 622264 - DNA, 25 bp, Mus musculus
cttgaacgtcacaagccatggagag

SEQ ID NO: 622265 - DNA, 25 bp, Mus musculus
cttgaacgtcactagccatggagag

SEQ ID NO: 622266 - DNA, 25 bp, Mus musculus
cttgaacttgatatgaagaccaggc

SEQ ID NO: 622267 - DNA, 25 bp, Mus musculus
cttgaacttgatttgaagaccaggc

SEQ ID NO: 622268 - DNA, 25 bp, Mus musculus
cttgaacttggccatctccgcagga

SEQ ID NO: 622269 - DNA, 25 bp, Mus musculus
cttgaacttggcgatctccgcagga

SEQ ID NO: 622270 - DNA, 25 bp, Mus musculus
cttgaagaaatgaactagttgagtg

SEQ ID NO: 622271 - DNA, 25 bp, Mus musculus
cttgaagaaatgtactagttgagtg

SEQ ID NO: 622272 - DNA, 25 bp, Mus musculus
cttgaagaggcccagaaagccattc

SEQ ID NO: 622273 - DNA, 25 bp, Mus musculus
cttgaagaggccgagaaagccattc

SEQ ID NO: 622274 - DNA, 25 bp, Mus musculus
cttgaagagttgaaacagtcagtcc

SEQ ID NO: 622275 - DNA, 25 bp, Mus musculus
cttgaagagttgtaacagtcagtcc

SEQ ID NO: 622276 - DNA, 25 bp, Mus musculus
cttgaagccattcagctcctggaaa

SEQ ID NO: 622277 - DNA, 25 bp, Mus musculus
cttgaagccattgagctcctggaaa

SEQ ID NO: 622278 - DNA, 25 bp, Mus musculus
cttgaagcccctcctgattggtgag

SEQ ID NO: 622279 - DNA, 25 bp, Mus musculus
cttgaagcccctgctgattggtgag

SEQ ID NO: 622280 - DNA, 25 bp, Mus musculus
cttgaagcgcgtcggaccgaacact

SEQ ID NO: 622281 - DNA, 25 bp, Mus musculus
cttgaagcgcgtgggaccgaacact

SEQ ID NO: 622282 - DNA, 25 bp, Mus musculus
cttgaagctgaacgtgactgtcaat

SEQ ID NO: 622283 - DNA, 25 bp, Mus musculus
cttgaagctgaaggtgactgtcaat

SEQ ID NO: 622284 - DNA, 25 bp, Mus musculus
cttgaaggaggtcctccgttctgag

SEQ ID NO: 622285 - DNA, 25 bp, Mus musculus
cttgaaggaggtgctccgttctgag

SEQ ID NO: 622286 - DNA, 25 bp, Mus musculus
cttgaagtcactcgaggctcaggct

SEQ ID NO: 622287 - DNA, 25 bp, Mus musculus
cttgaagtcactggaggctcaggct

SEQ ID NO: 622288 - DNA, 25 bp, Mus musculus
cttgaagtcaggcagtttgaatcct

SEQ ID NO: 622289 - DNA, 25 bp, Mus musculus
cttgaagtcagggagtttgaatcct

SEQ ID NO: 622290 - DNA, 25 bp, Mus musculus
cttgaatgatgaaagtcagcatggc

SEQ ID NO: 622291 - DNA, 25 bp, Mus musculus
cttgaatgatgatagtcagcatggc

SEQ ID NO: 622292 - DNA, 25 bp, Mus musculus
cttgaatgtcagctgcagacagaaa

SEQ ID NO: 622293 - DNA, 25 bp, Mus musculus
cttgaatgtcaggtgcagacagaaa

SEQ ID NO: 622294 - DNA, 25 bp, Mus musculus
cttgaattaaggatgattgtgagcc

SEQ ID NO: 622295 - DNA, 25 bp, Mus musculus
cttgaattaaggttgattgtgagcc

SEQ ID NO: 622296 - DNA, 25 bp, Mus musculus
cttgacaaaagtaagctgaagccag

SEQ ID NO: 622297 - DNA, 25 bp, Mus musculus
cttgacaaaagttagctgaagccag

SEQ ID NO: 622298 - DNA, 25 bp, Mus musculus
cttgacaagaacaaactacaggcga

SEQ ID NO: 622299 - DNA, 25 bp, Mus musculus
cttgacaagaactaactacaggcga

SEQ ID NO: 622300 - DNA, 25 bp, Mus musculus
cttgacactcagaatcttttgcgca

SEQ ID NO: 622301 - DNA, 25 bp, Mus musculus
cttgacactcagtatcttttgcgca

SEQ ID NO: 622302 - DNA, 25 bp, Mus musculus
cttgacagcaagatccacaaggaac

SEQ ID NO: 622303 - DNA, 25 bp, Mus musculus
cttgacagcaagttccacaaggaac

SEQ ID NO: 622304 - DNA, 25 bp, Mus musculus
cttgacatacagcttgagaaactgc

SEQ ID NO: 622305 - DNA, 25 bp, Mus musculus
cttgacatacaggttgagaaactgc

SEQ ID NO: 622306 - DNA, 25 bp, Mus musculus
cttgacatctctcctgtagtagaca

SEQ ID NO: 622307 - DNA, 25 bp, Mus musculus
cttgacatctctgctgtagtagaca

SEQ ID NO: 622308 - DNA, 25 bp, Mus musculus
cttgacatgcttcccttggcatgcg

SEQ ID NO: 622309 - DNA, 25 bp, Mus musculus
cttgacatgcttgccttggcatgcg

SEQ ID NO: 622310 - DNA, 25 bp, Mus musculus
cttgacattatgcttggcaacaaaa

SEQ ID NO: 622311 - DNA, 25 bp, Mus musculus
cttgacattatggttggcaacaaaa

SEQ ID NO: 622312 - DNA, 25 bp, Mus musculus
cttgaccaaggaacacagatcttct

SEQ ID NO: 622313 - DNA, 25 bp, Mus musculus
cttgaccaaggatcacagatcttct

SEQ ID NO: 622314 - DNA, 25 bp, Mus musculus
cttgaccagcaacttcggaaacttc

SEQ ID NO: 622315 - DNA, 25 bp, Mus musculus
cttgaccagcaagttcggaaacttc

SEQ ID NO: 622316 - DNA, 25 bp, Mus musculus
cttgaccatgatcgccagaaagatg

SEQ ID NO: 622317 - DNA, 25 bp, Mus musculus
cttgaccatgatggccagaaagatg

SEQ ID NO: 622318 - DNA, 25 bp, Mus musculus
cttgacccaggtacagtcatgtcgg

SEQ ID NO: 622319 - DNA, 25 bp, Mus musculus
cttgacccaggttcagtcatgtcgg

SEQ ID NO: 622320 - DNA, 25 bp, Mus musculus
cttgacccatcaagtagatgccttg

SEQ ID NO: 622321 - DNA, 25 bp, Mus musculus
cttgacccatcatgtagatgccttg

SEQ ID NO: 622322 - DNA, 25 bp, Mus musculus
cttgaccgttgaaccagccacggga

SEQ ID NO: 622323 - DNA, 25 bp, Mus musculus
cttgaccgttgatccagccacggga

SEQ ID NO: 622324 - DNA, 25 bp, Mus musculus
cttgacgcaagaagctcgcagcggc

SEQ ID NO: 622325 - DNA, 25 bp, Mus musculus
cttgacgcaagatgctcgcagcggc

SEQ ID NO: 622326 - DNA, 25 bp, Mus musculus
cttgactataatcagtacttcaggg

SEQ ID NO: 622327 - DNA, 25 bp, Mus musculus
cttgactataatgagtacttcaggg

SEQ ID NO: 622328 - DNA, 25 bp, Mus musculus
cttgactatgatcgctagaaaaatg

SEQ ID NO: 622329 - DNA, 25 bp, Mus musculus
cttgactatgatggctagaaaaatg

SEQ ID NO: 622330 - DNA, 25 bp, Mus musculus
cttgactcatggaaagaaggtcctc

SEQ ID NO: 622331 - DNA, 25 bp, Mus musculus
cttgactcatggtaagaaggtcctc

SEQ ID NO: 622332 - DNA, 25 bp, Mus musculus
cttgactcccaacttgccatagcaa

SEQ ID NO: 622333 - DNA, 25 bp, Mus musculus
cttgactcccaagttgccatagcaa

SEQ ID NO: 622334 - DNA, 25 bp, Mus musculus
cttgactggacactggctccaaaga

SEQ ID NO: 622335 - DNA, 25 bp, Mus musculus
cttgactggacagtggctccaaaga

SEQ ID NO: 622336 - DNA, 25 bp, Mus musculus
cttgactggcctcgagatgaccact

SEQ ID NO: 622337 - DNA, 25 bp, Mus musculus
cttgactggcctggagatgaccact

SEQ ID NO: 622338 - DNA, 25 bp, Mus musculus
cttgactggcttaacgtggcgaggt

SEQ ID NO: 622339 - DNA, 25 bp, Mus musculus
cttgactggctttacgtggcgaggt

SEQ ID NO: 622340 - DNA, 25 bp, Mus musculus
cttgacttcaatacccggactcagg

SEQ ID NO: 622341 - DNA, 25 bp, Mus musculus
cttgacttcaattcccggactcagg

SEQ ID NO: 622342 - DNA, 25 bp, Mus musculus
cttgacttcagcctgcagaaaacaa

SEQ ID NO: 622343 - DNA, 25 bp, Mus musculus
cttgacttcagcgtgcagaaaacaa

SEQ ID NO: 622344 - DNA, 25 bp, Mus musculus
cttgagaaaaatcgaaactcatggg

SEQ ID NO: 622345 - DNA, 25 bp, Mus musculus
cttgagaaaaatggaaactcatggg

SEQ ID NO: 622346 - DNA, 25 bp, Mus musculus
cttgagaaaatgaaatgctctgtgt

SEQ ID NO: 622347 - DNA, 25 bp, Mus musculus
cttgagaaaatgtaatgctctgtgt

SEQ ID NO: 622348 - DNA, 25 bp, Mus musculus
cttgagaactagcttgggaccatgg

SEQ ID NO: 622349 - DNA, 25 bp, Mus musculus
cttgagaactaggttgggaccatgg

SEQ ID NO: 622350 - DNA, 25 bp, Mus musculus
cttgagaagctcaaatactatttgc

SEQ ID NO: 622351 - DNA, 25 bp, Mus musculus
cttgagaagctctaatactatttgc

SEQ ID NO: 622352 - DNA, 25 bp, Mus musculus
cttgagacagaaatggaatgacccc

SEQ ID NO: 622353 - DNA, 25 bp, Mus musculus
cttgagacagaattggaatgacccc

SEQ ID NO: 622354 - DNA, 25 bp, Mus musculus
cttgagacggccaccactgatggaa

SEQ ID NO: 622355 - DNA, 25 bp, Mus musculus
cttgagacggcctccactgatggaa

SEQ ID NO: 622356 - DNA, 25 bp, Mus musculus
cttgagatcagaagaacctagtgct

SEQ ID NO: 622357 - DNA, 25 bp, Mus musculus
cttgagatcagatgaacctagtgct

SEQ ID NO: 622358 - DNA, 25 bp, Mus musculus
cttgagatcctcacagctctgatgc

SEQ ID NO: 622359 - DNA, 25 bp, Mus musculus
cttgagatcctctcagctctgatgc

SEQ ID NO: 622360 - DNA, 25 bp, Mus musculus
cttgagatggccatcgacaccctga

SEQ ID NO: 622361 - DNA, 25 bp, Mus musculus
cttgagatggccttcgacaccctga

SEQ ID NO: 622362 - DNA, 25 bp, Mus musculus
cttgagcaccctcaaggtgaagggc

SEQ ID NO: 622363 - DNA, 25 bp, Mus musculus
cttgagcaccctgaaggtgaagggc

SEQ ID NO: 622364 - DNA, 25 bp, Mus musculus
cttgagcagaagagtacgcggtgct

SEQ ID NO: 622365 - DNA, 25 bp, Mus musculus
cttgagcagaagtgtacgcggtgct

SEQ ID NO: 622366 - DNA, 25 bp, Mus musculus
cttgagcagcggcaaaatttggtat

SEQ ID NO: 622367 - DNA, 25 bp, Mus musculus
cttgagcagcgggaaaatttggtat

SEQ ID NO: 622368 - DNA, 25 bp, Mus musculus
cttgagcatcgaagccatggacgtg

SEQ ID NO: 622369 - DNA, 25 bp, Mus musculus
cttgagcatcgatgccatggacgtg

SEQ ID NO: 622370 - DNA, 25 bp, Mus musculus
cttgagcctcccagagttgtcagga

SEQ ID NO: 622371 - DNA, 25 bp, Mus musculus
cttgagcctccctgagttgtcagga

SEQ ID NO: 622372 - DNA, 25 bp, Mus musculus
cttgagcgcttaagacttggtgctg

SEQ ID NO: 622373 - DNA, 25 bp, Mus musculus
cttgagcgcttatgacttggtgctg

SEQ ID NO: 622374 - DNA, 25 bp, Mus musculus
cttgagctcccaagtaccttggcac

SEQ ID NO: 622375 - DNA, 25 bp, Mus musculus
cttgagctcccatgtaccttggcac

SEQ ID NO: 622376 - DNA, 25 bp, Mus musculus
cttgagctgctcaggtgtactgggt

SEQ ID NO: 622377 - DNA, 25 bp, Mus musculus
cttgagctgctcattcggaccctgc

SEQ ID NO: 622378 - DNA, 25 bp, Mus musculus
cttgagctgctctggtgtactgggt

SEQ ID NO: 622379 - DNA, 25 bp, Mus musculus
cttgagctgctctttcggaccctgc

SEQ ID NO: 622380 - DNA, 25 bp, Mus musculus
cttgagctggaaatgggagatgatt

SEQ ID NO: 622381 - DNA, 25 bp, Mus musculus
cttgagctggaattgggagatgatt

SEQ ID NO: 622382 - DNA, 25 bp, Mus musculus
cttgaggaaaggaaacttcttggtg

SEQ ID NO: 622383 - DNA, 25 bp, Mus musculus
cttgaggaaaggtaacttcttggtg

SEQ ID NO: 622384 - DNA, 25 bp, Mus musculus
cttgaggaacccctgaaagagggca

SEQ ID NO: 622385 - DNA, 25 bp, Mus musculus
cttgaggaacccgtgaaagagggca

SEQ ID NO: 622386 - DNA, 25 bp, Mus musculus
cttgaggaggaaatggaccgcaaca

SEQ ID NO: 622387 - DNA, 25 bp, Mus musculus
cttgaggaggaattggaccgcaaca

SEQ ID NO: 622388 - DNA, 25 bp, Mus musculus
cttgaggaggcaccgctgactgtga

SEQ ID NO: 622389 - DNA, 25 bp, Mus musculus
cttgaggaggcagcgctgactgtga

SEQ ID NO: 622390 - DNA, 25 bp, Mus musculus
cttgaggagtaccacgcagaagaag

SEQ ID NO: 622391 - DNA, 25 bp, Mus musculus
cttgaggagtacgacgcagaagaag

SEQ ID NO: 622392 - DNA, 25 bp, Mus musculus
cttgaggagttaaatttagagaaca

SEQ ID NO: 622393 - DNA, 25 bp, Mus musculus
cttgaggagttatatttagagaaca

SEQ ID NO: 622394 - DNA, 25 bp, Mus musculus
cttgaggatcctcgctgctgaacgg

SEQ ID NO: 622395 - DNA, 25 bp, Mus musculus
cttgaggatcctggctgctgaacgg

SEQ ID NO: 622396 - DNA, 25 bp, Mus musculus
cttgaggcagatcaagaagacccgg

SEQ ID NO: 622397 - DNA, 25 bp, Mus musculus
cttgaggcagatgaagaagacccgg

SEQ ID NO: 622398 - DNA, 25 bp, Mus musculus
cttgaggcaggccaagcaaggacca

SEQ ID NO: 622399 - DNA, 25 bp, Mus musculus
cttgaggcaggcgaagcaaggacca

SEQ ID NO: 622400 - DNA, 25 bp, Mus musculus
cttgaggccggcagctgccagtgat

SEQ ID NO: 622401 - DNA, 25 bp, Mus musculus
cttgaggccggctgctgccagtgat

SEQ ID NO: 622402 - DNA, 25 bp, Mus musculus
cttgaggcctcgcaaggtcagcacc

SEQ ID NO: 622403 - DNA, 25 bp, Mus musculus
cttgaggcctcggaaggtcagcacc

SEQ ID NO: 622404 - DNA, 25 bp, Mus musculus
cttgaggttggccaatccccattca

SEQ ID NO: 622405 - DNA, 25 bp, Mus musculus
cttgaggttggcgaatccccattca

SEQ ID NO: 622406 - DNA, 25 bp, Mus musculus
cttgagtgaagtacggtgctctggc

SEQ ID NO: 622407 - DNA, 25 bp, Mus musculus
cttgagtgaagttcggtgctctggc

SEQ ID NO: 622408 - DNA, 25 bp, Mus musculus
cttgagtgctgacgcttcggtctga

SEQ ID NO: 622409 - DNA, 25 bp, Mus musculus
cttgagtgctgaggcttcggtctga

SEQ ID NO: 622410 - DNA, 25 bp, Mus musculus
cttgagtggcaacatcacggcattt

SEQ ID NO: 622411 - DNA, 25 bp, Mus musculus
cttgagtggcaagatcacggcattt

SEQ ID NO: 622412 - DNA, 25 bp, Mus musculus
cttgagtggccaatacgagagggct

SEQ ID NO: 622413 - DNA, 25 bp, Mus musculus
cttgagtggccattacgagagggct

SEQ ID NO: 622414 - DNA, 25 bp, Mus musculus
cttgagtttactaggtgaggcgccc

SEQ ID NO: 622415 - DNA, 25 bp, Mus musculus
cttgagtttacttggtgaggcgccc

SEQ ID NO: 622416 - DNA, 25 bp, Mus musculus
cttgataaatgacacgatggagctt

SEQ ID NO: 622417 - DNA, 25 bp, Mus musculus
cttgataaatgagacgatggagctt

SEQ ID NO: 622418 - DNA, 25 bp, Mus musculus
cttgataatccacgcagaccaccgt

SEQ ID NO: 622419 - DNA, 25 bp, Mus musculus
cttgataatccaggcagaccaccgt

SEQ ID NO: 622420 - DNA, 25 bp, Mus musculus
cttgatacaggcatggacagcggag

SEQ ID NO: 622421 - DNA, 25 bp, Mus musculus
cttgatacaggcttggacagcggag

SEQ ID NO: 622422 - DNA, 25 bp, Mus musculus
cttgatatgtggagctagggcccaa

SEQ ID NO: 622423 - DNA, 25 bp, Mus musculus
cttgatatgtggtgctagggcccaa

SEQ ID NO: 622424 - DNA, 25 bp, Mus musculus
cttgatctgctcaacctcttccaga

SEQ ID NO: 622425 - DNA, 25 bp, Mus musculus
cttgatctgctctacctcttccaga

SEQ ID NO: 622426 - DNA, 25 bp, Mus musculus
cttgatctggcacattggaagtggg

SEQ ID NO: 622427 - DNA, 25 bp, Mus musculus
cttgatctggcagattggaagtggg

SEQ ID NO: 622428 - DNA, 25 bp, Mus musculus
cttgatgaacgactaacagctttga

SEQ ID NO: 622429 - DNA, 25 bp, Mus musculus
cttgatgaacgagtaacagctttga

SEQ ID NO: 622430 - DNA, 25 bp, Mus musculus
cttgatgaagtcagtaagagtgacc

SEQ ID NO: 622431 - DNA, 25 bp, Mus musculus
cttgatgaagtctgtaagagtgacc

SEQ ID NO: 622432 - DNA, 25 bp, Mus musculus
cttgatgaataacggaggctgcgac

SEQ ID NO: 622433 - DNA, 25 bp, Mus musculus
cttgatgaataagggaggctgcgac

SEQ ID NO: 622434 - DNA, 25 bp, Mus musculus
cttgatgacattcggcaggactgga

SEQ ID NO: 622435 - DNA, 25 bp, Mus musculus
cttgatgacattgggcaggactgga

SEQ ID NO: 622436 - DNA, 25 bp, Mus musculus
cttgatgaccgtcgctctgctgctg

SEQ ID NO: 622437 - DNA, 25 bp, Mus musculus
cttgatgaccgtggctctgctgctg

SEQ ID NO: 622438 - DNA, 25 bp, Mus musculus
cttgatgacgcactgtgtgtttgga

SEQ ID NO: 622439 - DNA, 25 bp, Mus musculus
cttgatgacgcagtgtgtgtttgga

SEQ ID NO: 622440 - DNA, 25 bp, Mus musculus
cttgatgcacttcggtgagaacggc

SEQ ID NO: 622441 - DNA, 25 bp, Mus musculus
cttgatgcacttgggtgagaacggc

SEQ ID NO: 622442 - DNA, 25 bp, Mus musculus
cttgatgcatgtaatctgggcagcg

SEQ ID NO: 622443 - DNA, 25 bp, Mus musculus
cttgatgcatgttatctgggcagcg

SEQ ID NO: 622444 - DNA, 25 bp, Mus musculus
cttgatgctgacacaaggatttggg

SEQ ID NO: 622445 - DNA, 25 bp, Mus musculus
cttgatgctgactcaaggatttggg

SEQ ID NO: 622446 - DNA, 25 bp, Mus musculus
cttgatgggaccatgcgtctttgct

SEQ ID NO: 622447 - DNA, 25 bp, Mus musculus
cttgatgggaccttgcgtctttgct

SEQ ID NO: 622448 - DNA, 25 bp, Mus musculus
cttgatgggtctcgccggtctcctg

SEQ ID NO: 622449 - DNA, 25 bp, Mus musculus
cttgatgggtctggccggtctcctg

SEQ ID NO: 622450 - DNA, 25 bp, Mus musculus
cttgatgtgactagatgtgggcact

SEQ ID NO: 622451 - DNA, 25 bp, Mus musculus
cttgatgtgacttgatgtgggcact

SEQ ID NO: 622452 - DNA, 25 bp, Mus musculus
cttgatgtgctacaaaagctgtgca

SEQ ID NO: 622453 - DNA, 25 bp, Mus musculus
cttgatgtgctagaaaagctgtgca

SEQ ID NO: 622454 - DNA, 25 bp, Mus musculus
cttgattccggacagcttaccttga

SEQ ID NO: 622455 - DNA, 25 bp, Mus musculus
cttgattccggagagcttaccttga

SEQ ID NO: 622456 - DNA, 25 bp, Mus musculus
cttgattcttctacggcccaaagag

SEQ ID NO: 622457 - DNA, 25 bp, Mus musculus
cttgattcttcttcggcccaaagag

SEQ ID NO: 622458 - DNA, 25 bp, Mus musculus
cttgattgcttcagcgtgccatcgg

SEQ ID NO: 622459 - DNA, 25 bp, Mus musculus
cttgattgcttctgcgtgccatcgg

SEQ ID NO: 622460 - DNA, 25 bp, Mus musculus
cttgattgtggacgactggctagaa

SEQ ID NO: 622461 - DNA, 25 bp, Mus musculus
cttgattgtggaggactggctagaa

SEQ ID NO: 622462 - DNA, 25 bp, Mus musculus
cttgatttcctgcatctggtaacat

SEQ ID NO: 622463 - DNA, 25 bp, Mus musculus
cttgatttcctggatctggtaacat

SEQ ID NO: 622464 - DNA, 25 bp, Mus musculus
cttgatttctggatgcgtcatcggc

SEQ ID NO: 622465 - DNA, 25 bp, Mus musculus
cttgatttctggttgcgtcatcggc

SEQ ID NO: 622466 - DNA, 25 bp, Mus musculus
cttgatttctttcagatccttcggt

SEQ ID NO: 622467 - DNA, 25 bp, Mus musculus
cttgatttctttgagatccttcggt

SEQ ID NO: 622468 - DNA, 25 bp, Mus musculus
cttgcaaacaacaatctccagacac

SEQ ID NO: 622469 - DNA, 25 bp, Mus musculus
cttgcaaacaactatctccagacac

SEQ ID NO: 622470 - DNA, 25 bp, Mus musculus
cttgcaaacaagagcgttaaggatg

SEQ ID NO: 622471 - DNA, 25 bp, Mus musculus
cttgcaaacaagtgcgttaaggatg

SEQ ID NO: 622472 - DNA, 25 bp, Mus musculus
cttgcaactttcatcaggagctgaa

SEQ ID NO: 622473 - DNA, 25 bp, Mus musculus
cttgcaactttcttcaggagctgaa

SEQ ID NO: 622474 - DNA, 25 bp, Mus musculus
cttgcaagatacctcaaccggaact

SEQ ID NO: 622475 - DNA, 25 bp, Mus musculus
cttgcaagatacgtcaaccggaact

SEQ ID NO: 622476 - DNA, 25 bp, Mus musculus
cttgcaagggaacctggtcattggc

SEQ ID NO: 622477 - DNA, 25 bp, Mus musculus
cttgcaagggaagctggtcattggc

SEQ ID NO: 622478 - DNA, 25 bp, Mus musculus
cttgcaatgccaattagttgtggat

SEQ ID NO: 622479 - DNA, 25 bp, Mus musculus
cttgcaatgccatttagttgtggat

SEQ ID NO: 622480 - DNA, 25 bp, Mus musculus
cttgcaatggctccgtctttggtcg

SEQ ID NO: 622481 - DNA, 25 bp, Mus musculus
cttgcaatggctgcgtctttggtcg

SEQ ID NO: 622482 - DNA, 25 bp, Mus musculus
cttgcacaaatcaatgcacaaagag

SEQ ID NO: 622483 - DNA, 25 bp, Mus musculus
cttgcacaaatctatgcacaaagag

SEQ ID NO: 622484 - DNA, 25 bp, Mus musculus
cttgcacagaatcaaaacttggtgc

SEQ ID NO: 622485 - DNA, 25 bp, Mus musculus
cttgcacagaatgaaaacttggtgc

SEQ ID NO: 622486 - DNA, 25 bp, Mus musculus
cttgcacagctgctgtgggatctta

SEQ ID NO: 622487 - DNA, 25 bp, Mus musculus
cttgcacagctggtgtgggatctta

SEQ ID NO: 622488 - DNA, 25 bp, Mus musculus
cttgcacaggcacactcgagatgga

SEQ ID NO: 622489 - DNA, 25 bp, Mus musculus
cttgcacaggcagactcgagatgga

SEQ ID NO: 622490 - DNA, 25 bp, Mus musculus
cttgcacagtggctagacagctact

SEQ ID NO: 622491 - DNA, 25 bp, Mus musculus
cttgcacagtgggtagacagctact

SEQ ID NO: 622492 - DNA, 25 bp, Mus musculus
cttgcaccaagaagactgagtaggc

SEQ ID NO: 622493 - DNA, 25 bp, Mus musculus
cttgcaccaagatgactgagtaggc

SEQ ID NO: 622494 - DNA, 25 bp, Mus musculus
cttgcaccagagcatagataggttc

SEQ ID NO: 622495 - DNA, 25 bp, Mus musculus
cttgcaccagaggatagataggttc

SEQ ID NO: 622496 - DNA, 25 bp, Mus musculus
cttgcactcaagcaatggaagactg

SEQ ID NO: 622497 - DNA, 25 bp, Mus musculus
cttgcactcaaggaatggaagactg

SEQ ID NO: 622498 - DNA, 25 bp, Mus musculus
cttgcagaaggacctaatgctgcgt

SEQ ID NO: 622499 - DNA, 25 bp, Mus musculus
cttgcagaaggagctaatgctgcgt

SEQ ID NO: 622500 - DNA, 25 bp, Mus musculus
cttgcagacaagaacagcttcattt

SEQ ID NO: 622501 - DNA, 25 bp, Mus musculus
cttgcagacaagtacagcttcattt

SEQ ID NO: 622502 - DNA, 25 bp, Mus musculus
cttgcagacaggagacacgaggcct

SEQ ID NO: 622503 - DNA, 25 bp, Mus musculus
cttgcagacaggtgacacgaggcct

SEQ ID NO: 622504 - DNA, 25 bp, Mus musculus
cttgcagagagtacttttataaacc

SEQ ID NO: 622505 - DNA, 25 bp, Mus musculus
cttgcagagagttcttttataaacc

SEQ ID NO: 622506 - DNA, 25 bp, Mus musculus
cttgcagagctgatagaagagtaca

SEQ ID NO: 622507 - DNA, 25 bp, Mus musculus
cttgcagagctgttagaagagtaca

SEQ ID NO: 622508 - DNA, 25 bp, Mus musculus
cttgcagagcttaggccttgacaat

SEQ ID NO: 622509 - DNA, 25 bp, Mus musculus
cttgcagagctttggccttgacaat

SEQ ID NO: 622510 - DNA, 25 bp, Mus musculus
cttgcagatacaccgctaggaaaag

SEQ ID NO: 622511 - DNA, 25 bp, Mus musculus
cttgcagatacagcgctaggaaaag

SEQ ID NO: 622512 - DNA, 25 bp, Mus musculus
cttgcagcaccaagaagaactatga

SEQ ID NO: 622513 - DNA, 25 bp, Mus musculus
cttgcagcaccatgaagaactatga

SEQ ID NO: 622514 - DNA, 25 bp, Mus musculus
cttgcagcagaactcgccagctggt

SEQ ID NO: 622515 - DNA, 25 bp, Mus musculus
cttgcagcagaagtcgccagctggt

SEQ ID NO: 622516 - DNA, 25 bp, Mus musculus
cttgcagcatggaaactttctactc

SEQ ID NO: 622517 - DNA, 25 bp, Mus musculus
cttgcagcatggtaactttctactc

SEQ ID NO: 622518 - DNA, 25 bp, Mus musculus
cttgcagctgtgacaccgctccaga

SEQ ID NO: 622519 - DNA, 25 bp, Mus musculus
cttgcagctgtgtcaccgctccaga

SEQ ID NO: 622520 - DNA, 25 bp, Mus musculus
cttgcagctttaaacacggaaaaag

SEQ ID NO: 622521 - DNA, 25 bp, Mus musculus
cttgcagctttatacacggaaaaag

SEQ ID NO: 622522 - DNA, 25 bp, Mus musculus
cttgcaggaaaactcccagtgtgct

SEQ ID NO: 622523 - DNA, 25 bp, Mus musculus
cttgcaggaaaagtcccagtgtgct

SEQ ID NO: 622524 - DNA, 25 bp, Mus musculus
cttgcaggctccaaatcatctggct

SEQ ID NO: 622525 - DNA, 25 bp, Mus musculus
cttgcaggctcctaatcatctggct

SEQ ID NO: 622526 - DNA, 25 bp, Mus musculus
cttgcagggaccaggacccgggtca

SEQ ID NO: 622527 - DNA, 25 bp, Mus musculus
cttgcagggacctggacccgggtca

SEQ ID NO: 622528 - DNA, 25 bp, Mus musculus
cttgcagggcttcaatgaaatcctg

SEQ ID NO: 622529 - DNA, 25 bp, Mus musculus
cttgcagggcttgaatgaaatcctg

SEQ ID NO: 622530 - DNA, 25 bp, Mus musculus
cttgcagtgttcagtaccaatgcca

SEQ ID NO: 622531 - DNA, 25 bp, Mus musculus
cttgcagtgttctgtaccaatgcca

SEQ ID NO: 622532 - DNA, 25 bp, Mus musculus
cttgcagtttcacacgacagtggga

SEQ ID NO: 622533 - DNA, 25 bp, Mus musculus
cttgcagtttcagacgacagtggga

SEQ ID NO: 622534 - DNA, 25 bp, Mus musculus
cttgcatcgaggagggcgcaaacca

SEQ ID NO: 622535 - DNA, 25 bp, Mus musculus
cttgcatcgaggtgggcgcaaacca

SEQ ID NO: 622536 - DNA, 25 bp, Mus musculus
cttgcatgttctaggtgaagtcggc

SEQ ID NO: 622537 - DNA, 25 bp, Mus musculus
cttgcatgttcttggtgaagtcggc

SEQ ID NO: 622538 - DNA, 25 bp, Mus musculus
cttgcattgtttaacgccgccagtg

SEQ ID NO: 622539 - DNA, 25 bp, Mus musculus
cttgcattgttttacgccgccagtg

SEQ ID NO: 622540 - DNA, 25 bp, Mus musculus
cttgccaaaatgcagctgaagtgga

SEQ ID NO: 622541 - DNA, 25 bp, Mus musculus
cttgccaaaatggagctgaagtgga

SEQ ID NO: 622542 - DNA, 25 bp, Mus musculus
cttgccaaggaaccagaagacggga

SEQ ID NO: 622543 - DNA, 25 bp, Mus musculus
cttgccaaggaagcagaagacggga

SEQ ID NO: 622544 - DNA, 25 bp, Mus musculus
cttgccaccctgaagtggatcctgg

SEQ ID NO: 622545 - DNA, 25 bp, Mus musculus
cttgccaccctgtagtggatcctgg

SEQ ID NO: 622546 - DNA, 25 bp, Mus musculus
cttgccacctgtacagctgaccaga

SEQ ID NO: 622547 - DNA, 25 bp, Mus musculus
cttgccacctgttcagctgaccaga

SEQ ID NO: 622548 - DNA, 25 bp, Mus musculus
cttgccactaagcttcgggagacca

SEQ ID NO: 622549 - DNA, 25 bp, Mus musculus
cttgccactaaggttcgggagacca

SEQ ID NO: 622550 - DNA, 25 bp, Mus musculus
cttgccacttccatgcttcggaaag

SEQ ID NO: 622551 - DNA, 25 bp, Mus musculus
cttgccacttccttgcttcggaaag

SEQ ID NO: 622552 - DNA, 25 bp, Mus musculus
cttgccagaaaactgaagaacgttg

SEQ ID NO: 622553 - DNA, 25 bp, Mus musculus
cttgccagaaaagtgaagaacgttg

SEQ ID NO: 622554 - DNA, 25 bp, Mus musculus
cttgccagagatcatcaggatggta

SEQ ID NO: 622555 - DNA, 25 bp, Mus musculus
cttgccagagatgatcaggatggta

SEQ ID NO: 622556 - DNA, 25 bp, Mus musculus
cttgccagtagtcaccctggttgga

SEQ ID NO: 622557 - DNA, 25 bp, Mus musculus
cttgccagtagtgaccctggttgga

SEQ ID NO: 622558 - DNA, 25 bp, Mus musculus
cttgccataggcaaacactggagct

SEQ ID NO: 622559 - DNA, 25 bp, Mus musculus
cttgccataggctaacactggagct

SEQ ID NO: 622560 - DNA, 25 bp, Mus musculus
cttgccatcaggacagggtcagggc

SEQ ID NO: 622561 - DNA, 25 bp, Mus musculus
cttgccatcaggtcagggtcagggc

SEQ ID NO: 622562 - DNA, 25 bp, Mus musculus
cttgcccaaaaccagaaggactgca

SEQ ID NO: 622563 - DNA, 25 bp, Mus musculus
cttgcccaaaacgagaaggactgca

SEQ ID NO: 622564 - DNA, 25 bp, Mus musculus
cttgcccaaggaacgagactcatct

SEQ ID NO: 622565 - DNA, 25 bp, Mus musculus
cttgcccaaggatcgagactcatct

SEQ ID NO: 622566 - DNA, 25 bp, Mus musculus
cttgcccagaaacacttgagcagtg

SEQ ID NO: 622567 - DNA, 25 bp, Mus musculus
cttgcccagaaagacttgagcagtg

SEQ ID NO: 622568 - DNA, 25 bp, Mus musculus
cttgcccagcccctgctgtgatgga

SEQ ID NO: 622569 - DNA, 25 bp, Mus musculus
cttgcccagcccgtgctgtgatgga

SEQ ID NO: 622570 - DNA, 25 bp, Mus musculus
cttgcccaggaacagaccggaaggc

SEQ ID NO: 622571 - DNA, 25 bp, Mus musculus
cttgcccaggaagagaccggaaggc

SEQ ID NO: 622572 - DNA, 25 bp, Mus musculus
cttgcccctcttcgaagtggagact

SEQ ID NO: 622573 - DNA, 25 bp, Mus musculus
cttgcccctcttggaagtggagact

SEQ ID NO: 622574 - DNA, 25 bp, Mus musculus
cttgcccgagataaaggcgttaact

SEQ ID NO: 622575 - DNA, 25 bp, Mus musculus
cttgcccgagattaaggcgttaact

SEQ ID NO: 622576 - DNA, 25 bp, Mus musculus
cttgcccgagccagtgctgctcaga

SEQ ID NO: 622577 - DNA, 25 bp, Mus musculus
cttgcccgagcctgtgctgctcaga

SEQ ID NO: 622578 - DNA, 25 bp, Mus musculus
cttgcccgctgtagtggtcccttct

SEQ ID NO: 622579 - DNA, 25 bp, Mus musculus
cttgcccgctgttgtggtcccttct

SEQ ID NO: 622580 - DNA, 25 bp, Mus musculus
cttgccctaagcatagtcccgttag

SEQ ID NO: 622581 - DNA, 25 bp, Mus musculus
cttgccctaagcttagtcccgttag

SEQ ID NO: 622582 - DNA, 25 bp, Mus musculus
cttgccctgtgtcgtacatgctgct

SEQ ID NO: 622583 - DNA, 25 bp, Mus musculus
cttgccctgtgtggtacatgctgct

SEQ ID NO: 622584 - DNA, 25 bp, Mus musculus
cttgccgaataaccaaaggactgtg

SEQ ID NO: 622585 - DNA, 25 bp, Mus musculus
cttgccgaataagcaaaggactgtg

SEQ ID NO: 622586 - DNA, 25 bp, Mus musculus
cttgccgacttgcaggaaagcctgg

SEQ ID NO: 622587 - DNA, 25 bp, Mus musculus
cttgccgacttggaggaaagcctgg

SEQ ID NO: 622588 - DNA, 25 bp, Mus musculus
cttgccggcggaacagtgagacatc

SEQ ID NO: 622589 - DNA, 25 bp, Mus musculus
cttgccggcggatcagtgagacatc

SEQ ID NO: 622590 - DNA, 25 bp, Mus musculus
cttgccgggcttctttgaagaggca

SEQ ID NO: 622591 - DNA, 25 bp, Mus musculus
cttgccgggcttgtttgaagaggca

SEQ ID NO: 622592 - DNA, 25 bp, Mus musculus
cttgccgtcgagagacagcggcctg

SEQ ID NO: 622593 - DNA, 25 bp, Mus musculus
cttgccgtcgagtgacagcggcctg

SEQ ID NO: 622594 - DNA, 25 bp, Mus musculus
cttgccgtttctctccttggaatag

SEQ ID NO: 622595 - DNA, 25 bp, Mus musculus
cttgccgtttctgtccttggaatag

SEQ ID NO: 622596 - DNA, 25 bp, Mus musculus
cttgcctaagtaccggcgccagagt

SEQ ID NO: 622597 - DNA, 25 bp, Mus musculus
cttgcctaagtagcggcgccagagt

SEQ ID NO: 622598 - DNA, 25 bp, Mus musculus
cttgcctactatcaccacgactggt

SEQ ID NO: 622599 - DNA, 25 bp, Mus musculus
cttgcctactatgaccacgactggt

SEQ ID NO: 622600 - DNA, 25 bp, Mus musculus
cttgcctatgccagacacagggctg

SEQ ID NO: 622601 - DNA, 25 bp, Mus musculus
cttgcctatgcctgacacagggctg

SEQ ID NO: 622602 - DNA, 25 bp, Mus musculus
cttgcctgaggaagaacttgatttc

SEQ ID NO: 622603 - DNA, 25 bp, Mus musculus
cttgcctgaggatgaacttgatttc

SEQ ID NO: 622604 - DNA, 25 bp, Mus musculus
cttgcctgatgaatgtagatgtcat

SEQ ID NO: 622605 - DNA, 25 bp, Mus musculus
cttgcctgatgattgtagatgtcat

SEQ ID NO: 622606 - DNA, 25 bp, Mus musculus
cttgcctgctggaagtctgttttgg

SEQ ID NO: 622607 - DNA, 25 bp, Mus musculus
cttgcctgctggtagtctgttttgg

SEQ ID NO: 622608 - DNA, 25 bp, Mus musculus
cttgcctgggatatgctggatttag

SEQ ID NO: 622609 - DNA, 25 bp, Mus musculus
cttgcctgggatttgctggatttag

SEQ ID NO: 622610 - DNA, 25 bp, Mus musculus
cttgccttcagaaaaccacaaagag

SEQ ID NO: 622611 - DNA, 25 bp, Mus musculus
cttgccttcagataaccacaaagag

SEQ ID NO: 622612 - DNA, 25 bp, Mus musculus
cttgccttccttccttgcattgtgt

SEQ ID NO: 622613 - DNA, 25 bp, Mus musculus
cttgccttccttgcttgcattgtgt

SEQ ID NO: 622614 - DNA, 25 bp, Mus musculus
cttgccttcgttccaaattgccaga

SEQ ID NO: 622615 - DNA, 25 bp, Mus musculus
cttgccttcgttgcaaattgccaga

SEQ ID NO: 622616 - DNA, 25 bp, Mus musculus
cttgcgaatggaccggcaggctgct

SEQ ID NO: 622617 - DNA, 25 bp, Mus musculus
cttgcgaatggagcggcaggctgct

SEQ ID NO: 622618 - DNA, 25 bp, Mus musculus
cttgcgcacggaacagctggatgga

SEQ ID NO: 622619 - DNA, 25 bp, Mus musculus
cttgcgcacggatcagctggatgga

SEQ ID NO: 622620 - DNA, 25 bp, Mus musculus
cttgcgcagggacggacgctttcaa

SEQ ID NO: 622621 - DNA, 25 bp, Mus musculus
cttgcgcagggagggacgctttcaa

SEQ ID NO: 622622 - DNA, 25 bp, Mus musculus
cttgcgccagagaaacacaaattaa

SEQ ID NO: 622623 - DNA, 25 bp, Mus musculus
cttgcgccagagtaacacaaattaa

SEQ ID NO: 622624 - DNA, 25 bp, Mus musculus
cttgcgctcaagacgggaatcacca

SEQ ID NO: 622625 - DNA, 25 bp, Mus musculus
cttgcgctcaagtcgggaatcacca

SEQ ID NO: 622626 - DNA, 25 bp, Mus musculus
cttgcgctccaaactcattctggtg

SEQ ID NO: 622627 - DNA, 25 bp, Mus musculus
cttgcgctccaatctcattctggtg

SEQ ID NO: 622628 - DNA, 25 bp, Mus musculus
cttgcgctgtacaccgggctaggct

SEQ ID NO: 622629 - DNA, 25 bp, Mus musculus
cttgcgctgtactccgggctaggct

SEQ ID NO: 622630 - DNA, 25 bp, Mus musculus
cttgcggcgcgactgtctcagaagc

SEQ ID NO: 622631 - DNA, 25 bp, Mus musculus
cttgcggcgcgagtgtctcagaagc

SEQ ID NO: 622632 - DNA, 25 bp, Mus musculus
cttgcggctcacacaaagcaggagg

SEQ ID NO: 622633 - DNA, 25 bp, Mus musculus
cttgcggctcactcaaagcaggagg

SEQ ID NO: 622634 - DNA, 25 bp, Mus musculus
cttgcggtgccgactgggtgttcct

SEQ ID NO: 622635 - DNA, 25 bp, Mus musculus
cttgcggtgccgtctgggtgttcct

SEQ ID NO: 622636 - DNA, 25 bp, Mus musculus
cttgcgtgggcaccataccacctat

SEQ ID NO: 622637 - DNA, 25 bp, Mus musculus
cttgcgtgggcagcataccacctat

SEQ ID NO: 622638 - DNA, 25 bp, Mus musculus
cttgctaataacatccatccttctg

SEQ ID NO: 622639 - DNA, 25 bp, Mus musculus
cttgctaataacttccatccttctg

SEQ ID NO: 622640 - DNA, 25 bp, Mus musculus
cttgctatgcttcttgaaggatctc

SEQ ID NO: 622641 - DNA, 25 bp, Mus musculus
cttgctatgcttgttgaaggatctc

SEQ ID NO: 622642 - DNA, 25 bp, Mus musculus
cttgctcaatgacccagggacccag

SEQ ID NO: 622643 - DNA, 25 bp, Mus musculus
cttgctcaatgagccagggacccag

SEQ ID NO: 622644 - DNA, 25 bp, Mus musculus
cttgctcagaatactggttatgacc

SEQ ID NO: 622645 - DNA, 25 bp, Mus musculus
cttgctcagaattctggttatgacc

SEQ ID NO: 622646 - DNA, 25 bp, Mus musculus
cttgctcagtggcttaccaagcctg

SEQ ID NO: 622647 - DNA, 25 bp, Mus musculus
cttgctcagtgggttaccaagcctg

SEQ ID NO: 622648 - DNA, 25 bp, Mus musculus
cttgctccaaggactgagcaaactc

SEQ ID NO: 622649 - DNA, 25 bp, Mus musculus
cttgctccaaggtctgagcaaactc

SEQ ID NO: 622650 - DNA, 25 bp, Mus musculus
cttgctcggcgcaatggccttaagg

SEQ ID NO: 622651 - DNA, 25 bp, Mus musculus
cttgctcggcgctatggccttaagg

SEQ ID NO: 622652 - DNA, 25 bp, Mus musculus
cttgctcgggaccttcacaaccgga

SEQ ID NO: 622653 - DNA, 25 bp, Mus musculus
cttgctcgggacgttcacaaccgga

SEQ ID NO: 622654 - DNA, 25 bp, Mus musculus
cttgctctacctcgcacacaagtat

SEQ ID NO: 622655 - DNA, 25 bp, Mus musculus
cttgctctacctggcacacaagtat

SEQ ID NO: 622656 - DNA, 25 bp, Mus musculus
cttgctctcgacagttaatggcggg

SEQ ID NO: 622657 - DNA, 25 bp, Mus musculus
cttgctctcgactgttaatggcggg

SEQ ID NO: 622658 - DNA, 25 bp, Mus musculus
cttgctctgcatcggcccagagctg

SEQ ID NO: 622659 - DNA, 25 bp, Mus musculus
cttgctctgcatgggcccagagctg

SEQ ID NO: 622660 - DNA, 25 bp, Mus musculus
cttgctctggacctgggatggctcc

SEQ ID NO: 622661 - DNA, 25 bp, Mus musculus
cttgctctggacgtgggatggctcc

SEQ ID NO: 622662 - DNA, 25 bp, Mus musculus
cttgctgaatatcttgctgcagaga

SEQ ID NO: 622663 - DNA, 25 bp, Mus musculus
cttgctgaatatgttgctgcagaga

SEQ ID NO: 622664 - DNA, 25 bp, Mus musculus
cttgctgagaaactaacaggcccaa

SEQ ID NO: 622665 - DNA, 25 bp, Mus musculus
cttgctgagaaagtaacaggcccaa

SEQ ID NO: 622666 - DNA, 25 bp, Mus musculus
cttgctgagtgcagcccacgtcctg

SEQ ID NO: 622667 - DNA, 25 bp, Mus musculus
cttgctgagtgctgcccacgtcctg

SEQ ID NO: 622668 - DNA, 25 bp, Mus musculus
cttgctgatgacagaagtggcctgg

SEQ ID NO: 622669 - DNA, 25 bp, Mus musculus
cttgctgatgactgaagtggcctgg

SEQ ID NO: 622670 - DNA, 25 bp, Mus musculus
cttgctgatggtccacggctggcct

SEQ ID NO: 622671 - DNA, 25 bp, Mus musculus
cttgctgatggtgcacggctggcct

SEQ ID NO: 622672 - DNA, 25 bp, Mus musculus
cttgctgcccttctgtaagaataca

SEQ ID NO: 622673 - DNA, 25 bp, Mus musculus
cttgctgcccttgtgtaagaataca

SEQ ID NO: 622674 - DNA, 25 bp, Mus musculus
cttgctgctcagacctctaataaaa

SEQ ID NO: 622675 - DNA, 25 bp, Mus musculus
cttgctgctcagtcctctaataaaa

SEQ ID NO: 622676 - DNA, 25 bp, Mus musculus
cttgctgctgttcgccgacaaagtg

SEQ ID NO: 622677 - DNA, 25 bp, Mus musculus
cttgctgctgttggccgacaaagtg

SEQ ID NO: 622678 - DNA, 25 bp, Mus musculus
cttgctggaacgcttctatgaccct

SEQ ID NO: 622679 - DNA, 25 bp, Mus musculus
cttgctggaacggttctatgaccct

SEQ ID NO: 622680 - DNA, 25 bp, Mus musculus
cttgctggcatccacacactttttt

SEQ ID NO: 622681 - DNA, 25 bp, Mus musculus
cttgctggcatcgacacactttttt

SEQ ID NO: 622682 - DNA, 25 bp, Mus musculus
cttgctgggagcctgtctggcctta

SEQ ID NO: 622683 - DNA, 25 bp, Mus musculus
cttgctgggagcgtgtctggcctta

SEQ ID NO: 622684 - DNA, 25 bp, Mus musculus
cttgctgtaccacatgctgtgtggc

SEQ ID NO: 622685 - DNA, 25 bp, Mus musculus
cttgctgtaccagatgctgtgtggc

SEQ ID NO: 622686 - DNA, 25 bp, Mus musculus
cttgctgtatccaatgtaaataacc

SEQ ID NO: 622687 - DNA, 25 bp, Mus musculus
cttgctgtatcctatgtaaataacc

SEQ ID NO: 622688 - DNA, 25 bp, Mus musculus
cttgctgtctgtcccggttcatcac

SEQ ID NO: 622689 - DNA, 25 bp, Mus musculus
cttgctgtctgtgccggttcatcac

SEQ ID NO: 622690 - DNA, 25 bp, Mus musculus
cttgctgtggagagtacagtcatcc

SEQ ID NO: 622691 - DNA, 25 bp, Mus musculus
cttgctgtggagtgtacagtcatcc

SEQ ID NO: 622692 - DNA, 25 bp, Mus musculus
cttgctgtgtggatgacttcactgc

SEQ ID NO: 622693 - DNA, 25 bp, Mus musculus
cttgctgtgtggttgacttcactgc

SEQ ID NO: 622694 - DNA, 25 bp, Mus musculus
cttgcttcaagaagcctggtcctgg

SEQ ID NO: 622695 - DNA, 25 bp, Mus musculus
cttgcttcaagatgcctggtcctgg

SEQ ID NO: 622696 - DNA, 25 bp, Mus musculus
cttgcttcagggaatccaaaactat

SEQ ID NO: 622697 - DNA, 25 bp, Mus musculus
cttgcttcagggtatccaaaactat

SEQ ID NO: 622698 - DNA, 25 bp, Mus musculus
cttgcttctacgacacctgctggag

SEQ ID NO: 622699 - DNA, 25 bp, Mus musculus
cttgcttctacgtcacctgctggag

SEQ ID NO: 622700 - DNA, 25 bp, Mus musculus
cttgcttgtggtcgctcctacccag

SEQ ID NO: 622701 - DNA, 25 bp, Mus musculus
cttgcttgtggtggctcctacccag

SEQ ID NO: 622702 - DNA, 25 bp, Mus musculus
cttgcttttcagagtccctccaatg

SEQ ID NO: 622703 - DNA, 25 bp, Mus musculus
cttgcttttcagtgtccctccaatg

SEQ ID NO: 622704 - DNA, 25 bp, Mus musculus
cttggaaaaatcagtctcctgagga

SEQ ID NO: 622705 - DNA, 25 bp, Mus musculus
cttggaaaaatctgtctcctgagga

SEQ ID NO: 622706 - DNA, 25 bp, Mus musculus
cttggaaagacaccatggattattg

SEQ ID NO: 622707 - DNA, 25 bp, Mus musculus
cttggaaagacagcatggattattg

SEQ ID NO: 622708 - DNA, 25 bp, Mus musculus
cttggaaagatgagttctgacgggc

SEQ ID NO: 622709 - DNA, 25 bp, Mus musculus
cttggaaagatgtgttctgacgggc

SEQ ID NO: 622710 - DNA, 25 bp, Mus musculus
cttggaacatgaagccaggaattgc

SEQ ID NO: 622711 - DNA, 25 bp, Mus musculus
cttggaacatgatgccaggaattgc

SEQ ID NO: 622712 - DNA, 25 bp, Mus musculus
cttggaaccgggacgacatagcgcg

SEQ ID NO: 622713 - DNA, 25 bp, Mus musculus
cttggaaccgggtcgacatagcgcg

SEQ ID NO: 622714 - DNA, 25 bp, Mus musculus
cttggaacgcgcagcagaacgaggt

SEQ ID NO: 622715 - DNA, 25 bp, Mus musculus
cttggaacgcgctgcagaacgaggt

SEQ ID NO: 622716 - DNA, 25 bp, Mus musculus
cttggaacttagctgtgcaatctga

SEQ ID NO: 622717 - DNA, 25 bp, Mus musculus
cttggaacttaggtgtgcaatctga

SEQ ID NO: 622718 - DNA, 25 bp, Mus musculus
cttggaagaaacctgaccatcccca

SEQ ID NO: 622719 - DNA, 25 bp, Mus musculus
cttggaagaaacgtgaccatcccca

SEQ ID NO: 622720 - DNA, 25 bp, Mus musculus
cttggaagagggaggtacagatccc

SEQ ID NO: 622721 - DNA, 25 bp, Mus musculus
cttggaagagggtggtacagatccc

SEQ ID NO: 622722 - DNA, 25 bp, Mus musculus
cttggaagccgcactgagggcagct

SEQ ID NO: 622723 - DNA, 25 bp, Mus musculus
cttggaagccgctctgagggcagct

SEQ ID NO: 622724 - DNA, 25 bp, Mus musculus
cttggaagggatactccgtggcgct

SEQ ID NO: 622725 - DNA, 25 bp, Mus musculus
cttggaagggattctccgtggcgct

SEQ ID NO: 622726 - DNA, 25 bp, Mus musculus
cttggaagtgttatgcacagatgac

SEQ ID NO: 622727 - DNA, 25 bp, Mus musculus
cttggaagtgttttgcacagatgac

SEQ ID NO: 622728 - DNA, 25 bp, Mus musculus
cttggaatctatccctgcaggacag

SEQ ID NO: 622729 - DNA, 25 bp, Mus musculus
cttggaatctatgcctgcaggacag

SEQ ID NO: 622730 - DNA, 25 bp, Mus musculus
cttggaatctccctgtgcactgcgc

SEQ ID NO: 622731 - DNA, 25 bp, Mus musculus
cttggaatctccgtgtgcactgcgc

SEQ ID NO: 622732 - DNA, 25 bp, Mus musculus
cttggaatggttcctctgcccatgt

SEQ ID NO: 622733 - DNA, 25 bp, Mus musculus
cttggaatggttgctctgcccatgt

SEQ ID NO: 622734 - DNA, 25 bp, Mus musculus
cttggacaagctcccagaagtctga

SEQ ID NO: 622735 - DNA, 25 bp, Mus musculus
cttggacaagctccctctgtggcct

SEQ ID NO: 622736 - DNA, 25 bp, Mus musculus
cttggacaagctgccagaagtctga

SEQ ID NO: 622737 - DNA, 25 bp, Mus musculus
cttggacaagctgcctctgtggcct

SEQ ID NO: 622738 - DNA, 25 bp, Mus musculus
cttggacaaggtctgcgactccgcc

SEQ ID NO: 622739 - DNA, 25 bp, Mus musculus
cttggacaaggtgtgcgactccgcc

SEQ ID NO: 622740 - DNA, 25 bp, Mus musculus
cttggacaagtgagtaccgagctat

SEQ ID NO: 622741 - DNA, 25 bp, Mus musculus
cttggacaagtgtgtaccgagctat

SEQ ID NO: 622742 - DNA, 25 bp, Mus musculus
cttggacagagcagttattgagcat

SEQ ID NO: 622743 - DNA, 25 bp, Mus musculus
cttggacagagctgttattgagcat

SEQ ID NO: 622744 - DNA, 25 bp, Mus musculus
cttggaccacaaccgagcaaaatct

SEQ ID NO: 622745 - DNA, 25 bp, Mus musculus
cttggaccacaagcgagcaaaatct

SEQ ID NO: 622746 - DNA, 25 bp, Mus musculus
cttggaccagtaaggtagaattgaa

SEQ ID NO: 622747 - DNA, 25 bp, Mus musculus
cttggaccagtatggtagaattgaa

SEQ ID NO: 622748 - DNA, 25 bp, Mus musculus
cttggacccggaaatcctgtttgac

SEQ ID NO: 622749 - DNA, 25 bp, Mus musculus
cttggacccggatatcctgtttgac

SEQ ID NO: 622750 - DNA, 25 bp, Mus musculus
cttggaccttgtctgggacccctga

SEQ ID NO: 622751 - DNA, 25 bp, Mus musculus
cttggaccttgtgtgggacccctga

SEQ ID NO: 622752 - DNA, 25 bp, Mus musculus
cttggacgaaaccatcatcatcttt

SEQ ID NO: 622753 - DNA, 25 bp, Mus musculus
cttggacgaaacgatcatcatcttt

SEQ ID NO: 622754 - DNA, 25 bp, Mus musculus
cttggacgccaactcactgtgtgct

SEQ ID NO: 622755 - DNA, 25 bp, Mus musculus
cttggacgccaagtcactgtgtgct

SEQ ID NO: 622756 - DNA, 25 bp, Mus musculus
cttggacggcaacccttgcggctca

SEQ ID NO: 622757 - DNA, 25 bp, Mus musculus
cttggacggcaagccttgcggctca

SEQ ID NO: 622758 - DNA, 25 bp, Mus musculus
cttggacgtattcccttgggctctc

SEQ ID NO: 622759 - DNA, 25 bp, Mus musculus
cttggacgtattgccttgggctctc

SEQ ID NO: 622760 - DNA, 25 bp, Mus musculus
cttggactataccacactgcaggac

SEQ ID NO: 622761 - DNA, 25 bp, Mus musculus
cttggactatacgacactgcaggac

SEQ ID NO: 622762 - DNA, 25 bp, Mus musculus
cttggactccatcagaggcttctcc

SEQ ID NO: 622763 - DNA, 25 bp, Mus musculus
cttggactccatgagaggcttctcc

SEQ ID NO: 622764 - DNA, 25 bp, Mus musculus
cttggactctatcggctctggaggt

SEQ ID NO: 622765 - DNA, 25 bp, Mus musculus
cttggactctatgggctctggaggt

SEQ ID NO: 622766 - DNA, 25 bp, Mus musculus
cttggactgactcttaagatgcaga

SEQ ID NO: 622767 - DNA, 25 bp, Mus musculus
cttggactgactgttaagatgcaga

SEQ ID NO: 622768 - DNA, 25 bp, Mus musculus
cttggactgatgagagactgaaatt

SEQ ID NO: 622769 - DNA, 25 bp, Mus musculus
cttggactgatgtgagactgaaatt

SEQ ID NO: 622770 - DNA, 25 bp, Mus musculus
cttggactggacagctggatctggc

SEQ ID NO: 622771 - DNA, 25 bp, Mus musculus
cttggactggacattggtgcccagg

SEQ ID NO: 622772 - DNA, 25 bp, Mus musculus
cttggactggactgctggatctggc

SEQ ID NO: 622773 - DNA, 25 bp, Mus musculus
cttggactggactttggtgcccagg

SEQ ID NO: 622774 - DNA, 25 bp, Mus musculus
cttggacttcaaaagcgagggctca

SEQ ID NO: 622775 - DNA, 25 bp, Mus musculus
cttggacttcaatagcgagggctca

SEQ ID NO: 622776 - DNA, 25 bp, Mus musculus
cttggacttcccatgcctggactct

SEQ ID NO: 622777 - DNA, 25 bp, Mus musculus
cttggacttcccttgcctggactct

SEQ ID NO: 622778 - DNA, 25 bp, Mus musculus
cttggagaattaacagggacagtga

SEQ ID NO: 622779 - DNA, 25 bp, Mus musculus
cttggagaattatcagggacagtga

SEQ ID NO: 622780 - DNA, 25 bp, Mus musculus
cttggagaattcacaccgagtcttc

SEQ ID NO: 622781 - DNA, 25 bp, Mus musculus
cttggagaattctcaccgagtcttc

SEQ ID NO: 622782 - DNA, 25 bp, Mus musculus
cttggagaggacagtcttggatcaa

SEQ ID NO: 622783 - DNA, 25 bp, Mus musculus
cttggagaggactgtcttggatcaa

SEQ ID NO: 622784 - DNA, 25 bp, Mus musculus
cttggagatgagcagcagctaaaag

SEQ ID NO: 622785 - DNA, 25 bp, Mus musculus
cttggagatgaggagcagctaaaag

SEQ ID NO: 622786 - DNA, 25 bp, Mus musculus
cttggagcaaaactcagtgagcgga

SEQ ID NO: 622787 - DNA, 25 bp, Mus musculus
cttggagcaaaagtcagtgagcgga

SEQ ID NO: 622788 - DNA, 25 bp, Mus musculus
cttggagcagaacgcataataagtg

SEQ ID NO: 622789 - DNA, 25 bp, Mus musculus
cttggagcagaaggcataataagtg

SEQ ID NO: 622790 - DNA, 25 bp, Mus musculus
cttggagcagttcattttattagcc

SEQ ID NO: 622791 - DNA, 25 bp, Mus musculus
cttggagcagttgattttattagcc

SEQ ID NO: 622792 - DNA, 25 bp, Mus musculus
cttggagccctcaggtcctacagga

SEQ ID NO: 622793 - DNA, 25 bp, Mus musculus
cttggagccctctggtcctacagga

SEQ ID NO: 622794 - DNA, 25 bp, Mus musculus
cttggagctcacaaagaccagactg

SEQ ID NO: 622795 - DNA, 25 bp, Mus musculus
cttggagctcactaagaccagactg

SEQ ID NO: 622796 - DNA, 25 bp, Mus musculus
cttggagcttctattccagagcaga

SEQ ID NO: 622797 - DNA, 25 bp, Mus musculus
cttggagcttcttttccagagcaga

SEQ ID NO: 622798 - DNA, 25 bp, Mus musculus
cttggaggaagcacatgagtggaac

SEQ ID NO: 622799 - DNA, 25 bp, Mus musculus
cttggaggaagctcatgagtggaac

SEQ ID NO: 622800 - DNA, 25 bp, Mus musculus
cttggaggatccataacaggatggg

SEQ ID NO: 622801 - DNA, 25 bp, Mus musculus
cttggaggatccttaacaggatggg

SEQ ID NO: 622802 - DNA, 25 bp, Mus musculus
cttggaggatgtagcaagaatgaaa

SEQ ID NO: 622803 - DNA, 25 bp, Mus musculus
cttggaggatgttgcaagaatgaaa

SEQ ID NO: 622804 - DNA, 25 bp, Mus musculus
cttggaggctgccacgccgagtttc

SEQ ID NO: 622805 - DNA, 25 bp, Mus musculus
cttggaggctgcgacgccgagtttc

SEQ ID NO: 622806 - DNA, 25 bp, Mus musculus
cttggagggaccagttcctctgggc

SEQ ID NO: 622807 - DNA, 25 bp, Mus musculus
cttggagggacctgttcctctgggc

SEQ ID NO: 622808 - DNA, 25 bp, Mus musculus
cttggagggcgccaaggctcgggtt

SEQ ID NO: 622809 - DNA, 25 bp, Mus musculus
cttggagggcgcgaaggctcgggtt

SEQ ID NO: 622810 - DNA, 25 bp, Mus musculus
cttggaggttccacttaccttagct

SEQ ID NO: 622811 - DNA, 25 bp, Mus musculus
cttggaggttcctcttaccttagct

SEQ ID NO: 622812 - DNA, 25 bp, Mus musculus
cttggagtctagaaatctcttgaga

SEQ ID NO: 622813 - DNA, 25 bp, Mus musculus
cttggagtctagtaatctcttgaga

SEQ ID NO: 622814 - DNA, 25 bp, Mus musculus
cttggagtctttcagcaatcttcta

SEQ ID NO: 622815 - DNA, 25 bp, Mus musculus
cttggagtctttgagcaatcttcta

SEQ ID NO: 622816 - DNA, 25 bp, Mus musculus
cttggagtgaagaattacattgacc

SEQ ID NO: 622817 - DNA, 25 bp, Mus musculus
cttggagtgaagtattacattgacc

SEQ ID NO: 622818 - DNA, 25 bp, Mus musculus
cttggagtgcaaccatgtatactgc

SEQ ID NO: 622819 - DNA, 25 bp, Mus musculus
cttggagtgcaagcatgtatactgc

SEQ ID NO: 622820 - DNA, 25 bp, Mus musculus
cttggataagcaagggacaagagga

SEQ ID NO: 622821 - DNA, 25 bp, Mus musculus
cttggataagcatgggacaagagga

SEQ ID NO: 622822 - DNA, 25 bp, Mus musculus
cttggataagcgaggcgttcgctcg

SEQ ID NO: 622823 - DNA, 25 bp, Mus musculus
cttggataagcgtggcgttcgctcg

SEQ ID NO: 622824 - DNA, 25 bp, Mus musculus
cttggatatgagagacaggatgttc

SEQ ID NO: 622825 - DNA, 25 bp, Mus musculus
cttggatatgagtgacaggatgttc

SEQ ID NO: 622826 - DNA, 25 bp, Mus musculus
cttggatcaaaaccaggaagagatc

SEQ ID NO: 622827 - DNA, 25 bp, Mus musculus
cttggatcaaaagcaggaagagatc

SEQ ID NO: 622828 - DNA, 25 bp, Mus musculus
cttggatggactatgctagtgaaca

SEQ ID NO: 622829 - DNA, 25 bp, Mus musculus
cttggatggactttgctagtgaaca

SEQ ID NO: 622830 - DNA, 25 bp, Mus musculus
cttggatgggataagaggagttcct

SEQ ID NO: 622831 - DNA, 25 bp, Mus musculus
cttggatgggattagaggagttcct

SEQ ID NO: 622832 - DNA, 25 bp, Mus musculus
cttggattctctagggccccgtcat

SEQ ID NO: 622833 - DNA, 25 bp, Mus musculus
cttggattctcttgggccccgtcat

SEQ ID NO: 622834 - DNA, 25 bp, Mus musculus
cttggattctttagagcagttggca

SEQ ID NO: 622835 - DNA, 25 bp, Mus musculus
cttggattcttttgagcagttggca

SEQ ID NO: 622836 - DNA, 25 bp, Mus musculus
cttggcaattaaagaaaggattggc

SEQ ID NO: 622837 - DNA, 25 bp, Mus musculus
cttggcaattaatgaaaggattggc

SEQ ID NO: 622838 - DNA, 25 bp, Mus musculus
cttggcacaggacgatactcccatc

SEQ ID NO: 622839 - DNA, 25 bp, Mus musculus
cttggcacaggaggatactcccatc

SEQ ID NO: 622840 - DNA, 25 bp, Mus musculus
cttggcacctgccaggacatggaga

SEQ ID NO: 622841 - DNA, 25 bp, Mus musculus
cttggcacctgcgaggacatggaga

SEQ ID NO: 622842 - DNA, 25 bp, Mus musculus
cttggcacttaactgacagtgtccc

SEQ ID NO: 622843 - DNA, 25 bp, Mus musculus
cttggcacttaagtgacagtgtccc

SEQ ID NO: 622844 - DNA, 25 bp, Mus musculus
cttggcagacataaatcaagagagg

SEQ ID NO: 622845 - DNA, 25 bp, Mus musculus
cttggcagacattaatcaagagagg

SEQ ID NO: 622846 - DNA, 25 bp, Mus musculus
cttggcagccttagactcaggtgct

SEQ ID NO: 622847 - DNA, 25 bp, Mus musculus
cttggcagcctttgactcaggtgct

SEQ ID NO: 622848 - DNA, 25 bp, Mus musculus
cttggccactggcatcagggtgtac

SEQ ID NO: 622849 - DNA, 25 bp, Mus musculus
cttggccactgggatcagggtgtac

SEQ ID NO: 622850 - DNA, 25 bp, Mus musculus
cttggcccacaactaatgtgattat

SEQ ID NO: 622851 - DNA, 25 bp, Mus musculus
cttggcccacaagtaatgtgattat

SEQ ID NO: 622852 - DNA, 25 bp, Mus musculus
cttggcccaggcctcattgaacact

SEQ ID NO: 622853 - DNA, 25 bp, Mus musculus
cttggcccaggcgtcattgaacact

SEQ ID NO: 622854 - DNA, 25 bp, Mus musculus
cttggccccgacagaaaacttcaca

SEQ ID NO: 622855 - DNA, 25 bp, Mus musculus
cttggccccgactgaaaacttcaca

SEQ ID NO: 622856 - DNA, 25 bp, Mus musculus
cttggccctgaacataggaagtcag

SEQ ID NO: 622857 - DNA, 25 bp, Mus musculus
cttggccctgaagataggaagtcag

SEQ ID NO: 622858 - DNA, 25 bp, Mus musculus
cttggccgctgcagagagaaggaaa

SEQ ID NO: 622859 - DNA, 25 bp, Mus musculus
cttggccgctgctgagagaaggaaa

SEQ ID NO: 622860 - DNA, 25 bp, Mus musculus
cttggcctgaaaatgcgaccttgta

SEQ ID NO: 622861 - DNA, 25 bp, Mus musculus
cttggcctgaaattgcgaccttgta

SEQ ID NO: 622862 - DNA, 25 bp, Mus musculus
cttggcctgcccattggaactgtgc

SEQ ID NO: 622863 - DNA, 25 bp, Mus musculus
cttggcctgccctttggaactgtgc

SEQ ID NO: 622864 - DNA, 25 bp, Mus musculus
cttggcctgcctctttggaaatgaa

SEQ ID NO: 622865 - DNA, 25 bp, Mus musculus
cttggcctgcctgtttggaaatgaa

SEQ ID NO: 622866 - DNA, 25 bp, Mus musculus
cttggcctgcgcaccatgtcgcagg

SEQ ID NO: 622867 - DNA, 25 bp, Mus musculus
cttggcctgcgctccatgtcgcagg

SEQ ID NO: 622868 - DNA, 25 bp, Mus musculus
cttggcgaacccagggagagatgga

SEQ ID NO: 622869 - DNA, 25 bp, Mus musculus
cttggcgaaccctgggagagatgga

SEQ ID NO: 622870 - DNA, 25 bp, Mus musculus
cttggcgaagttactttcaatggag

SEQ ID NO: 622871 - DNA, 25 bp, Mus musculus
cttggcgaagtttctttcaatggag

SEQ ID NO: 622872 - DNA, 25 bp, Mus musculus
cttggcgaattaagggctgctggcc

SEQ ID NO: 622873 - DNA, 25 bp, Mus musculus
cttggcgaattatgggctgctggcc

SEQ ID NO: 622874 - DNA, 25 bp, Mus musculus
cttggcgagccgatccagcactgtt

SEQ ID NO: 622875 - DNA, 25 bp, Mus musculus
cttggcgagccgttccagcactgtt

SEQ ID NO: 622876 - DNA, 25 bp, Mus musculus
cttggcgcagcaagagagtgagatt

SEQ ID NO: 622877 - DNA, 25 bp, Mus musculus
cttggcgcagcatgagagtgagatt

SEQ ID NO: 622878 - DNA, 25 bp, Mus musculus
cttggcgccctgaacacctactggg

SEQ ID NO: 622879 - DNA, 25 bp, Mus musculus
cttggcgccctgtacacctactggg

SEQ ID NO: 622880 - DNA, 25 bp, Mus musculus
cttggcgcggacacctactatgggc

SEQ ID NO: 622881 - DNA, 25 bp, Mus musculus
cttggcgcggactcctactatgggc

SEQ ID NO: 622882 - DNA, 25 bp, Mus musculus
cttggctaatggcatgagcctccag

SEQ ID NO: 622883 - DNA, 25 bp, Mus musculus
cttggctaatgggatgagcctccag

SEQ ID NO: 622884 - DNA, 25 bp, Mus musculus
cttggctcactccttcctgaatggg

SEQ ID NO: 622885 - DNA, 25 bp, Mus musculus
cttggctcactcgttcctgaatggg

SEQ ID NO: 622886 - DNA, 25 bp, Mus musculus
cttggctcagggaacagggtgactt

SEQ ID NO: 622887 - DNA, 25 bp, Mus musculus
cttggctcagggtacagggtgactt

SEQ ID NO: 622888 - DNA, 25 bp, Mus musculus
cttggctcatcacaagttattaact

SEQ ID NO: 622889 - DNA, 25 bp, Mus musculus
cttggctcatcagaagttattaact

SEQ ID NO: 622890 - DNA, 25 bp, Mus musculus
cttggctccaggatttgtgcaggaa

SEQ ID NO: 622891 - DNA, 25 bp, Mus musculus
cttggctccaggttttgtgcaggaa

SEQ ID NO: 622892 - DNA, 25 bp, Mus musculus
cttggctcctaccaaggccttggaa

SEQ ID NO: 622893 - DNA, 25 bp, Mus musculus
cttggctcctacgaaggccttggaa

SEQ ID NO: 622894 - DNA, 25 bp, Mus musculus
cttggctcgtgtcaatgagcagaga

SEQ ID NO: 622895 - DNA, 25 bp, Mus musculus
cttggctcgtgtgaatgagcagaga

SEQ ID NO: 622896 - DNA, 25 bp, Mus musculus
cttggctgaaacaggacgactggac

SEQ ID NO: 622897 - DNA, 25 bp, Mus musculus
cttggctgaaactggacgactggac

SEQ ID NO: 622898 - DNA, 25 bp, Mus musculus
cttggctgaccccacagtggccttg

SEQ ID NO: 622899 - DNA, 25 bp, Mus musculus
cttggctgacccgacagtggccttg

SEQ ID NO: 622900 - DNA, 25 bp, Mus musculus
cttggctgcataagtcagacacaag

SEQ ID NO: 622901 - DNA, 25 bp, Mus musculus
cttggctgcatacagggtgttcatg

SEQ ID NO: 622902 - DNA, 25 bp, Mus musculus
cttggctgcatagagggtgttcatg

SEQ ID NO: 622903 - DNA, 25 bp, Mus musculus
cttggctgcatatgtcagacacaag

SEQ ID NO: 622904 - DNA, 25 bp, Mus musculus
cttggctgcgcgagccaagctgaga

SEQ ID NO: 622905 - DNA, 25 bp, Mus musculus
cttggctgcgcgtgccaagctgaga

SEQ ID NO: 622906 - DNA, 25 bp, Mus musculus
cttggctggccacgagaagtacctt

SEQ ID NO: 622907 - DNA, 25 bp, Mus musculus
cttggctggccaggagaagtacctt

SEQ ID NO: 622908 - DNA, 25 bp, Mus musculus
cttggctggctacgcggacatcttc

SEQ ID NO: 622909 - DNA, 25 bp, Mus musculus
cttggctggctaggcggacatcttc

SEQ ID NO: 622910 - DNA, 25 bp, Mus musculus
cttggctgggagacagagagatgac

SEQ ID NO: 622911 - DNA, 25 bp, Mus musculus
cttggctgggagtcagagagatgac

SEQ ID NO: 622912 - DNA, 25 bp, Mus musculus
cttggctgtagtaccacagggtgct

SEQ ID NO: 622913 - DNA, 25 bp, Mus musculus
cttggctgtagttccacagggtgct

SEQ ID NO: 622914 - DNA, 25 bp, Mus musculus
cttggcttcaatctcccaggagaaa

SEQ ID NO: 622915 - DNA, 25 bp, Mus musculus
cttggcttcaatgtcccaggagaaa

SEQ ID NO: 622916 - DNA, 25 bp, Mus musculus
cttggcttcaccactgtggcctttg

SEQ ID NO: 622917 - DNA, 25 bp, Mus musculus
cttggcttcacctctgtggcctttg

SEQ ID NO: 622918 - DNA, 25 bp, Mus musculus
cttggcttgggacaccttggctgta

SEQ ID NO: 622919 - DNA, 25 bp, Mus musculus
cttggcttgggagaccttggctgta

SEQ ID NO: 622920 - DNA, 25 bp, Mus musculus
cttggctttgttctgcttaggaaat

SEQ ID NO: 622921 - DNA, 25 bp, Mus musculus
cttggctttgttgtgcttaggaaat

SEQ ID NO: 622922 - DNA, 25 bp, Mus musculus
cttgggaaaatactggatgacctcg

SEQ ID NO: 622923 - DNA, 25 bp, Mus musculus
cttgggaaaatagtggatgacctcg

SEQ ID NO: 622924 - DNA, 25 bp, Mus musculus
cttgggaaataacagatgtaaatac

SEQ ID NO: 622925 - DNA, 25 bp, Mus musculus
cttgggaaataagagatgtaaatac

SEQ ID NO: 622926 - DNA, 25 bp, Mus musculus
cttgggaacagcatgcgaagtggta

SEQ ID NO: 622927 - DNA, 25 bp, Mus musculus
cttgggaacagcttgcgaagtggta

SEQ ID NO: 622928 - DNA, 25 bp, Mus musculus
cttgggaacagtattgctcacttgc

SEQ ID NO: 622929 - DNA, 25 bp, Mus musculus
cttgggaacagttttgctcacttgc

SEQ ID NO: 622930 - DNA, 25 bp, Mus musculus
cttgggaacctcagaaagctacgag

SEQ ID NO: 622931 - DNA, 25 bp, Mus musculus
cttgggaacctctgaaagctacgag

SEQ ID NO: 622932 - DNA, 25 bp, Mus musculus
cttgggaactgaccgcaatggtagc

SEQ ID NO: 622933 - DNA, 25 bp, Mus musculus
cttgggaactgagcgcaatggtagc

SEQ ID NO: 622934 - DNA, 25 bp, Mus musculus
cttgggaagaaaacggaccgcagag

SEQ ID NO: 622935 - DNA, 25 bp, Mus musculus
cttgggaagaaatcggaccgcagag

SEQ ID NO: 622936 - DNA, 25 bp, Mus musculus
cttgggaatgatctcagctgctcca

SEQ ID NO: 622937 - DNA, 25 bp, Mus musculus
cttgggaatgatgtcagctgctcca

SEQ ID NO: 622938 - DNA, 25 bp, Mus musculus
cttgggaatgtgactactgcagaga

SEQ ID NO: 622939 - DNA, 25 bp, Mus musculus
cttgggaatgtgtctactgcagaga

SEQ ID NO: 622940 - DNA, 25 bp, Mus musculus
cttgggagaattaatggagcaatga

SEQ ID NO: 622941 - DNA, 25 bp, Mus musculus
cttgggagaatttatggagcaatga

SEQ ID NO: 622942 - DNA, 25 bp, Mus musculus
cttgggagctagatgcctgtgtagc

SEQ ID NO: 622943 - DNA, 25 bp, Mus musculus
cttgggagctagttgcctgtgtagc

SEQ ID NO: 622944 - DNA, 25 bp, Mus musculus
cttgggagtcatccctcagtgggct

SEQ ID NO: 622945 - DNA, 25 bp, Mus musculus
cttgggagtcatgcctcagtgggct

SEQ ID NO: 622946 - DNA, 25 bp, Mus musculus
cttgggatatttaattcacagccca

SEQ ID NO: 622947 - DNA, 25 bp, Mus musculus
cttgggatattttattcacagccca

SEQ ID NO: 622948 - DNA, 25 bp, Mus musculus
cttgggcagaccaacaatgagagcc

SEQ ID NO: 622949 - DNA, 25 bp, Mus musculus
cttgggcagacctacaatgagagcc

SEQ ID NO: 622950 - DNA, 25 bp, Mus musculus
cttgggcagcccagtagaagttagg

SEQ ID NO: 622951 - DNA, 25 bp, Mus musculus
cttgggcagccctgtagaagttagg

SEQ ID NO: 622952 - DNA, 25 bp, Mus musculus
cttgggcagcgtctgtccagctcct

SEQ ID NO: 622953 - DNA, 25 bp, Mus musculus
cttgggcagcgtgtgtccagctcct

SEQ ID NO: 622954 - DNA, 25 bp, Mus musculus
cttgggcatgatatataatgtaatc

SEQ ID NO: 622955 - DNA, 25 bp, Mus musculus
cttgggcatgatttataatgtaatc

SEQ ID NO: 622956 - DNA, 25 bp, Mus musculus
cttgggccaaagcttctgctgtgga

SEQ ID NO: 622957 - DNA, 25 bp, Mus musculus
cttgggccaaaggttctgctgtgga

SEQ ID NO: 622958 - DNA, 25 bp, Mus musculus
cttgggcccaagaggacctgagctg

SEQ ID NO: 622959 - DNA, 25 bp, Mus musculus
cttgggcccaagtggacctgagctg

SEQ ID NO: 622960 - DNA, 25 bp, Mus musculus
cttgggcccaggaacaggtaccttg

SEQ ID NO: 622961 - DNA, 25 bp, Mus musculus
cttgggcccaggtacaggtaccttg

SEQ ID NO: 622962 - DNA, 25 bp, Mus musculus
cttgggccttctcgctcggttgcac

SEQ ID NO: 622963 - DNA, 25 bp, Mus musculus
cttgggccttctggctcggttgcac

SEQ ID NO: 622964 - DNA, 25 bp, Mus musculus
cttgggcgctggagtctatgtccta

SEQ ID NO: 622965 - DNA, 25 bp, Mus musculus
cttgggcgctggtgtctatgtccta

SEQ ID NO: 622966 - DNA, 25 bp, Mus musculus
cttgggctacggatttgtgaactat

SEQ ID NO: 622967 - DNA, 25 bp, Mus musculus
cttgggctacggttttgtgaactat

SEQ ID NO: 622968 - DNA, 25 bp, Mus musculus
cttgggctctgtatgggactctatc

SEQ ID NO: 622969 - DNA, 25 bp, Mus musculus
cttgggctctgtttgggactctatc

SEQ ID NO: 622970 - DNA, 25 bp, Mus musculus
cttgggctgtgtacagattttgctc

SEQ ID NO: 622971 - DNA, 25 bp, Mus musculus
cttgggctgtgttcagattttgctc

SEQ ID NO: 622972 - DNA, 25 bp, Mus musculus
cttgggcttacgagatcatgtggca

SEQ ID NO: 622973 - DNA, 25 bp, Mus musculus
cttgggcttacgtgatcatgtggca

SEQ ID NO: 622974 - DNA, 25 bp, Mus musculus
cttgggcttttgctagaactgttgg

SEQ ID NO: 622975 - DNA, 25 bp, Mus musculus
cttgggcttttggtagaactgttgg

SEQ ID NO: 622976 - DNA, 25 bp, Mus musculus
cttgggtcacccagaatgtctcggg

SEQ ID NO: 622977 - DNA, 25 bp, Mus musculus
cttgggtcaccctgaatgtctcggg

SEQ ID NO: 622978 - DNA, 25 bp, Mus musculus
cttgggtctattaaatcatcaccag

SEQ ID NO: 622979 - DNA, 25 bp, Mus musculus
cttgggtctatttaatcatcaccag

SEQ ID NO: 622980 - DNA, 25 bp, Mus musculus
cttgggtgcattcagcctttggtga

SEQ ID NO: 622981 - DNA, 25 bp, Mus musculus
cttgggtgcattgagcctttggtga

SEQ ID NO: 622982 - DNA, 25 bp, Mus musculus
cttgggtgccctccgcaagctactt

SEQ ID NO: 622983 - DNA, 25 bp, Mus musculus
cttgggtgccctgcgcaagctactt

SEQ ID NO: 622984 - DNA, 25 bp, Mus musculus
cttgggtgctgtctgtcggctgaga

SEQ ID NO: 622985 - DNA, 25 bp, Mus musculus
cttgggtgctgtgtgtcggctgaga

SEQ ID NO: 622986 - DNA, 25 bp, Mus musculus
cttgggtgtagaaattgctaagaac

SEQ ID NO: 622987 - DNA, 25 bp, Mus musculus
cttgggtgtagatattgctaagaac

SEQ ID NO: 622988 - DNA, 25 bp, Mus musculus
cttgggttttggcagcctgatcgct

SEQ ID NO: 622989 - DNA, 25 bp, Mus musculus
cttgggttttgggagcctgatcgct

SEQ ID NO: 622990 - DNA, 25 bp, Mus musculus
cttggtagaagacagcaacgtgcag

SEQ ID NO: 622991 - DNA, 25 bp, Mus musculus
cttggtagaagagagcaacgtgcag

SEQ ID NO: 622992 - DNA, 25 bp, Mus musculus
cttggtcaacaaaattttacagaat

SEQ ID NO: 622993 - DNA, 25 bp, Mus musculus
cttggtcaacaatattttacagaat

SEQ ID NO: 622994 - DNA, 25 bp, Mus musculus
cttggtcacaggaggccccgtcggc

SEQ ID NO: 622995 - DNA, 25 bp, Mus musculus
cttggtcacaggtggccccgtcggc

SEQ ID NO: 622996 - DNA, 25 bp, Mus musculus
cttggtccagacatgtgcagataca

SEQ ID NO: 622997 - DNA, 25 bp, Mus musculus
cttggtccagacttgtgcagataca

SEQ ID NO: 622998 - DNA, 25 bp, Mus musculus
cttggtcggcctcgcggtaaccttg

SEQ ID NO: 622999 - DNA, 25 bp, Mus musculus
cttggtcggcctggcggtaaccttg

SEQ ID NO: 623000 - DNA, 25 bp, Mus musculus
cttggtctgttgcactgtcagtggc

SEQ ID NO: 623001 - DNA, 25 bp, Mus musculus
cttggtctgttggactgtcagtggc

SEQ ID NO: 623002 - DNA, 25 bp, Mus musculus
cttggtgaacagaggatcagaagcc

SEQ ID NO: 623003 - DNA, 25 bp, Mus musculus
cttggtgaacagtggatcagaagcc

SEQ ID NO: 623004 - DNA, 25 bp, Mus musculus
cttggtgaattcagtgtggccagaa

SEQ ID NO: 623005 - DNA, 25 bp, Mus musculus
cttggtgaattctgtgtggccagaa

SEQ ID NO: 623006 - DNA, 25 bp, Mus musculus
cttggtgcacacctagcagacacca

SEQ ID NO: 623007 - DNA, 25 bp, Mus musculus
cttggtgcacacgtagcagacacca

SEQ ID NO: 623008 - DNA, 25 bp, Mus musculus
cttggtgcaggacgcgtaagaccac

SEQ ID NO: 623009 - DNA, 25 bp, Mus musculus
cttggtgcaggaggcgtaagaccac

SEQ ID NO: 623010 - DNA, 25 bp, Mus musculus
cttggtgctaacagtggcttgcaca

SEQ ID NO: 623011 - DNA, 25 bp, Mus musculus
cttggtgctaactgtggcttgcaca

SEQ ID NO: 623012 - DNA, 25 bp, Mus musculus
cttggtgctatgaggtgaaggacaa

SEQ ID NO: 623013 - DNA, 25 bp, Mus musculus
cttggtgctatgtggtgaaggacaa

SEQ ID NO: 623014 - DNA, 25 bp, Mus musculus
cttggtgcttaaagcaaaggagctg

SEQ ID NO: 623015 - DNA, 25 bp, Mus musculus
cttggtgcttaatgcaaaggagctg

SEQ ID NO: 623016 - DNA, 25 bp, Mus musculus
cttggtggccgcaggatttgatgcc

SEQ ID NO: 623017 - DNA, 25 bp, Mus musculus
cttggtggccgctggatttgatgcc

SEQ ID NO: 623018 - DNA, 25 bp, Mus musculus
cttggtggccttagcaatctatgtg

SEQ ID NO: 623019 - DNA, 25 bp, Mus musculus
cttggtggcctttgcaatctatgtg

SEQ ID NO: 623020 - DNA, 25 bp, Mus musculus
cttggtgggcagatctgaaggcact

SEQ ID NO: 623021 - DNA, 25 bp, Mus musculus
cttggtgggcagttctgaaggcact

SEQ ID NO: 623022 - DNA, 25 bp, Mus musculus
cttggtgtgctgctaggaacgactt

SEQ ID NO: 623023 - DNA, 25 bp, Mus musculus
cttggtgtgctggtaggaacgactt

SEQ ID NO: 623024 - DNA, 25 bp, Mus musculus
cttggtgtggaacgcgcagaacacc

SEQ ID NO: 623025 - DNA, 25 bp, Mus musculus
cttggtgtggaaggcgcagaacacc

SEQ ID NO: 623026 - DNA, 25 bp, Mus musculus
cttggttaccttaggcctgctgccg

SEQ ID NO: 623027 - DNA, 25 bp, Mus musculus
cttggttacctttggcctgctgccg

SEQ ID NO: 623028 - DNA, 25 bp, Mus musculus
cttggttggaatactgttcctaatc

SEQ ID NO: 623029 - DNA, 25 bp, Mus musculus
cttggttggaattctgttcctaatc

SEQ ID NO: 623030 - DNA, 25 bp, Mus musculus
cttggttggtccctggcattggatt

SEQ ID NO: 623031 - DNA, 25 bp, Mus musculus
cttggttggtccgtggcattggatt

SEQ ID NO: 623032 - DNA, 25 bp, Mus musculus
cttggttgttatcgccatggagaaa

SEQ ID NO: 623033 - DNA, 25 bp, Mus musculus
cttggttgttatggccatggagaaa

SEQ ID NO: 623034 - DNA, 25 bp, Mus musculus
cttggttgttttagctcgaaggctc

SEQ ID NO: 623035 - DNA, 25 bp, Mus musculus
cttggttgtttttgctcgaaggctc

SEQ ID NO: 623036 - DNA, 25 bp, Mus musculus
cttgtaaaggagacatctggatggt

SEQ ID NO: 623037 - DNA, 25 bp, Mus musculus
cttgtaaaggagtcatctggatggt

SEQ ID NO: 623038 - DNA, 25 bp, Mus musculus
cttgtaagataaagaaggctgctgc

SEQ ID NO: 623039 - DNA, 25 bp, Mus musculus
cttgtaagataatgaaggctgctgc

SEQ ID NO: 623040 - DNA, 25 bp, Mus musculus
cttgtaagcaataaggacacgtggc

SEQ ID NO: 623041 - DNA, 25 bp, Mus musculus
cttgtaagcaattaggacacgtggc

SEQ ID NO: 623042 - DNA, 25 bp, Mus musculus
cttgtaatcaaacgaagattccaac

SEQ ID NO: 623043 - DNA, 25 bp, Mus musculus
cttgtaatcaaaggaagattccaac

SEQ ID NO: 623044 - DNA, 25 bp, Mus musculus
cttgtacaatgcatcacggctgaat

SEQ ID NO: 623045 - DNA, 25 bp, Mus musculus
cttgtacaatgcttcacggctgaat

SEQ ID NO: 623046 - DNA, 25 bp, Mus musculus
cttgtacatgctcacatcaagttga

SEQ ID NO: 623047 - DNA, 25 bp, Mus musculus
cttgtacatgctgacatcaagttga

SEQ ID NO: 623048 - DNA, 25 bp, Mus musculus
cttgtacgtgatctctttgagctca

SEQ ID NO: 623049 - DNA, 25 bp, Mus musculus
cttgtacgtgatgtctttgagctca

SEQ ID NO: 623050 - DNA, 25 bp, Mus musculus
cttgtactctgtacaggaggctgcc

SEQ ID NO: 623051 - DNA, 25 bp, Mus musculus
cttgtactctgttcaggaggctgcc

SEQ ID NO: 623052 - DNA, 25 bp, Mus musculus
cttgtactgggcagggaacctgtag

SEQ ID NO: 623053 - DNA, 25 bp, Mus musculus
cttgtactgggctgggaacctgtag

SEQ ID NO: 623054 - DNA, 25 bp, Mus musculus
cttgtagaactgcaagaagtagaaa

SEQ ID NO: 623055 - DNA, 25 bp, Mus musculus
cttgtagaactggaagaagtagaaa

SEQ ID NO: 623056 - DNA, 25 bp, Mus musculus
cttgtagaccctcatgcttgtgctg

SEQ ID NO: 623057 - DNA, 25 bp, Mus musculus
cttgtagaccctgatgcttgtgctg

SEQ ID NO: 623058 - DNA, 25 bp, Mus musculus
cttgtaggcctcaagcctagtggtc

SEQ ID NO: 623059 - DNA, 25 bp, Mus musculus
cttgtaggcctctagcctagtggtc

SEQ ID NO: 623060 - DNA, 25 bp, Mus musculus
cttgtagggcccagcgccgctgaga

SEQ ID NO: 623061 - DNA, 25 bp, Mus musculus
cttgtagggccctgcgccgctgaga

SEQ ID NO: 623062 - DNA, 25 bp, Mus musculus
cttgtagtagacatccactgtggag

SEQ ID NO: 623063 - DNA, 25 bp, Mus musculus
cttgtagtagacttccactgtggag

SEQ ID NO: 623064 - DNA, 25 bp, Mus musculus
cttgtagtgggcactgcttctggag

SEQ ID NO: 623065 - DNA, 25 bp, Mus musculus
cttgtagtgggctctgcttctggag

SEQ ID NO: 623066 - DNA, 25 bp, Mus musculus
cttgtataaaggagatgtaacggtc

SEQ ID NO: 623067 - DNA, 25 bp, Mus musculus
cttgtataaaggtgatgtaacggtc

SEQ ID NO: 623068 - DNA, 25 bp, Mus musculus
cttgtatactttcctccacctgtga

SEQ ID NO: 623069 - DNA, 25 bp, Mus musculus
cttgtatactttgctccacctgtga

SEQ ID NO: 623070 - DNA, 25 bp, Mus musculus
cttgtatgatgacagcttcaatgtt

SEQ ID NO: 623071 - DNA, 25 bp, Mus musculus
cttgtatgatgagagcttcaatgtt

SEQ ID NO: 623072 - DNA, 25 bp, Mus musculus
cttgtatgccttccaggtaactcac

SEQ ID NO: 623073 - DNA, 25 bp, Mus musculus
cttgtatgccttgcaggtaactcac

SEQ ID NO: 623074 - DNA, 25 bp, Mus musculus
cttgtatgctccaaaagatgactac

SEQ ID NO: 623075 - DNA, 25 bp, Mus musculus
cttgtatgctcctaaagatgactac

SEQ ID NO: 623076 - DNA, 25 bp, Mus musculus
cttgtcaagaacaggtaagagactc

SEQ ID NO: 623077 - DNA, 25 bp, Mus musculus
cttgtcaagaactggtaagagactc

SEQ ID NO: 623078 - DNA, 25 bp, Mus musculus
cttgtcaatgtcaccacggcaacgg

SEQ ID NO: 623079 - DNA, 25 bp, Mus musculus
cttgtcaatgtctccacggcaacgg

SEQ ID NO: 623080 - DNA, 25 bp, Mus musculus
cttgtcacagctcaaggatgcacac

SEQ ID NO: 623081 - DNA, 25 bp, Mus musculus
cttgtcacagctgaaggatgcacac

SEQ ID NO: 623082 - DNA, 25 bp, Mus musculus
cttgtcaccgtcatgctctcaggga

SEQ ID NO: 623083 - DNA, 25 bp, Mus musculus
cttgtcaccgtcttgctctcaggga

SEQ ID NO: 623084 - DNA, 25 bp, Mus musculus
cttgtcacggctacagatgatggct

SEQ ID NO: 623085 - DNA, 25 bp, Mus musculus
cttgtcacggcttcagatgatggct

SEQ ID NO: 623086 - DNA, 25 bp, Mus musculus
cttgtcactgccatcatcctctggg

SEQ ID NO: 623087 - DNA, 25 bp, Mus musculus
cttgtcactgccttcatcctctggg

SEQ ID NO: 623088 - DNA, 25 bp, Mus musculus
cttgtcagaataccttacacgaaag

SEQ ID NO: 623089 - DNA, 25 bp, Mus musculus
cttgtcagaatagcttacacgaaag

SEQ ID NO: 623090 - DNA, 25 bp, Mus musculus
cttgtcaggatgaccaagagccaca

SEQ ID NO: 623091 - DNA, 25 bp, Mus musculus
cttgtcaggatgtccaagagccaca

SEQ ID NO: 623092 - DNA, 25 bp, Mus musculus
cttgtcatccttaggagaattacag

SEQ ID NO: 623093 - DNA, 25 bp, Mus musculus
cttgtcatcctttggagaattacag

SEQ ID NO: 623094 - DNA, 25 bp, Mus musculus
cttgtcatctgccagtgcccctgtg

SEQ ID NO: 623095 - DNA, 25 bp, Mus musculus
cttgtcatctgcgagtgcccctgtg

SEQ ID NO: 623096 - DNA, 25 bp, Mus musculus
cttgtcatggatacgagcctgtgtc

SEQ ID NO: 623097 - DNA, 25 bp, Mus musculus
cttgtcatggattcgagcctgtgtc

SEQ ID NO: 623098 - DNA, 25 bp, Mus musculus
cttgtccagagcaccagcacatctt

SEQ ID NO: 623099 - DNA, 25 bp, Mus musculus
cttgtccagagctccagcacatctt

SEQ ID NO: 623100 - DNA, 25 bp, Mus musculus
cttgtcccctccctgagttagctgg

SEQ ID NO: 623101 - DNA, 25 bp, Mus musculus
cttgtcccctccgtgagttagctgg

SEQ ID NO: 623102 - DNA, 25 bp, Mus musculus
cttgtccgcatcatcagtatccttg

SEQ ID NO: 623103 - DNA, 25 bp, Mus musculus
cttgtccgcatcttcagtatccttg

SEQ ID NO: 623104 - DNA, 25 bp, Mus musculus
cttgtcctgggaacaagacttcaga

SEQ ID NO: 623105 - DNA, 25 bp, Mus musculus
cttgtcctgggatcaagacttcaga

SEQ ID NO: 623106 - DNA, 25 bp, Mus musculus
cttgtcgtgaccctgattgggatga

SEQ ID NO: 623107 - DNA, 25 bp, Mus musculus
cttgtcgtgaccgtgattgggatga

SEQ ID NO: 623108 - DNA, 25 bp, Mus musculus
cttgtctatgaacccctcagctggc

SEQ ID NO: 623109 - DNA, 25 bp, Mus musculus
cttgtctatgaagccctcagctggc

SEQ ID NO: 623110 - DNA, 25 bp, Mus musculus
cttgtctcagagagcagtagagatg

SEQ ID NO: 623111 - DNA, 25 bp, Mus musculus
cttgtctcagagtgcagtagagatg

SEQ ID NO: 623112 - DNA, 25 bp, Mus musculus
cttgtctcgggccagatggcttcaa

SEQ ID NO: 623113 - DNA, 25 bp, Mus musculus
cttgtctcgggcgagatggcttcaa

SEQ ID NO: 623114 - DNA, 25 bp, Mus musculus
cttgtctctaacacaccagtgggtc

SEQ ID NO: 623115 - DNA, 25 bp, Mus musculus
cttgtctctaactcaccagtgggtc

SEQ ID NO: 623116 - DNA, 25 bp, Mus musculus
cttgtctgaaaaccagtctttgctg

SEQ ID NO: 623117 - DNA, 25 bp, Mus musculus
cttgtctgaaaagcagtctttgctg

SEQ ID NO: 623118 - DNA, 25 bp, Mus musculus
cttgtctgagcaccccatgtctgaa

SEQ ID NO: 623119 - DNA, 25 bp, Mus musculus
cttgtctgagcagcccatgtctgaa

SEQ ID NO: 623120 - DNA, 25 bp, Mus musculus
cttgtctgcaacaatcaagtagcag

SEQ ID NO: 623121 - DNA, 25 bp, Mus musculus
cttgtctgcaactatcaagtagcag

SEQ ID NO: 623122 - DNA, 25 bp, Mus musculus
cttgtctgccctagccttctgcata

SEQ ID NO: 623123 - DNA, 25 bp, Mus musculus
cttgtctgcccttgccttctgcata

SEQ ID NO: 623124 - DNA, 25 bp, Mus musculus
cttgtcttcagcctcccaattgtct

SEQ ID NO: 623125 - DNA, 25 bp, Mus musculus
cttgtcttcagcgtcccaattgtct

SEQ ID NO: 623126 - DNA, 25 bp, Mus musculus
cttgtcttcagtcccatagtcaaca

SEQ ID NO: 623127 - DNA, 25 bp, Mus musculus
cttgtcttcagtgccatagtcaaca

SEQ ID NO: 623128 - DNA, 25 bp, Mus musculus
cttgtgaaccatccccaagaccaga

SEQ ID NO: 623129 - DNA, 25 bp, Mus musculus
cttgtgaaccatgcccaagaccaga

SEQ ID NO: 623130 - DNA, 25 bp, Mus musculus
cttgtgaacctcctgtagcgctgcc

SEQ ID NO: 623131 - DNA, 25 bp, Mus musculus
cttgtgaacctcgtgtagcgctgcc

SEQ ID NO: 623132 - DNA, 25 bp, Mus musculus
cttgtgaagaacaccaaagggaaca

SEQ ID NO: 623133 - DNA, 25 bp, Mus musculus
cttgtgaagaactccaaagggaaca

SEQ ID NO: 623134 - DNA, 25 bp, Mus musculus
cttgtgaggaatcgcactgactctg

SEQ ID NO: 623135 - DNA, 25 bp, Mus musculus
cttgtgaggaatggcactgactctg

SEQ ID NO: 623136 - DNA, 25 bp, Mus musculus
cttgtgaggtgtccctgagaccgat

SEQ ID NO: 623137 - DNA, 25 bp, Mus musculus
cttgtgaggtgtgcctgagaccgat

SEQ ID NO: 623138 - DNA, 25 bp, Mus musculus
cttgtgagtcttccagatgagaccc

SEQ ID NO: 623139 - DNA, 25 bp, Mus musculus
cttgtgagtcttgcagatgagaccc

SEQ ID NO: 623140 - DNA, 25 bp, Mus musculus
cttgtgatcgtacctccctgggttc

SEQ ID NO: 623141 - DNA, 25 bp, Mus musculus
cttgtgatcgtagctccctgggttc

SEQ ID NO: 623142 - DNA, 25 bp, Mus musculus
cttgtgcaaacgcaaagactgaaga

SEQ ID NO: 623143 - DNA, 25 bp, Mus musculus
cttgtgcaaacggaaagactgaaga

SEQ ID NO: 623144 - DNA, 25 bp, Mus musculus
cttgtgcagaagctgcagtccccag

SEQ ID NO: 623145 - DNA, 25 bp, Mus musculus
cttgtgcagaaggtgcagtccccag

SEQ ID NO: 623146 - DNA, 25 bp, Mus musculus
cttgtgccacgacttcaggaggaac

SEQ ID NO: 623147 - DNA, 25 bp, Mus musculus
cttgtgccacgagttcaggaggaac

SEQ ID NO: 623148 - DNA, 25 bp, Mus musculus
cttgtgcctagtcgtcggagacact

SEQ ID NO: 623149 - DNA, 25 bp, Mus musculus
cttgtgcctagtggtcggagacact

SEQ ID NO: 623150 - DNA, 25 bp, Mus musculus
cttgtgctcacacaggtcagagtga

SEQ ID NO: 623151 - DNA, 25 bp, Mus musculus
cttgtgctcacagaggtcagagtga

SEQ ID NO: 623152 - DNA, 25 bp, Mus musculus
cttgtgctgtatagctgcctgggcc

SEQ ID NO: 623153 - DNA, 25 bp, Mus musculus
cttgtgctgtattgctgcctgggcc

SEQ ID NO: 623154 - DNA, 25 bp, Mus musculus
cttgtggaaggacgcgagaacatca

SEQ ID NO: 623155 - DNA, 25 bp, Mus musculus
cttgtggaaggaggcgagaacatca

SEQ ID NO: 623156 - DNA, 25 bp, Mus musculus
cttgtggaatgtcaccgtgaagaac

SEQ ID NO: 623157 - DNA, 25 bp, Mus musculus
cttgtggaatgtgaccgtgaagaac

SEQ ID NO: 623158 - DNA, 25 bp, Mus musculus
cttgtggacagcaggtcaatcattt

SEQ ID NO: 623159 - DNA, 25 bp, Mus musculus
cttgtggacagctggtcaatcattt

SEQ ID NO: 623160 - DNA, 25 bp, Mus musculus
cttgtggagatccataacgggaagc

SEQ ID NO: 623161 - DNA, 25 bp, Mus musculus
cttgtggagatcgataacgggaagc

SEQ ID NO: 623162 - DNA, 25 bp, Mus musculus
cttgtgggacccataatgtgggagc

SEQ ID NO: 623163 - DNA, 25 bp, Mus musculus
cttgtgggacccttaatgtgggagc

SEQ ID NO: 623164 - DNA, 25 bp, Mus musculus
cttgtgggccaactctccattgtgc

SEQ ID NO: 623165 - DNA, 25 bp, Mus musculus
cttgtgggccaagtctccattgtgc

SEQ ID NO: 623166 - DNA, 25 bp, Mus musculus
cttgtgggctttatgctcattggcg

SEQ ID NO: 623167 - DNA, 25 bp, Mus musculus
cttgtgggctttttgctcattggcg

SEQ ID NO: 623168 - DNA, 25 bp, Mus musculus
cttgtgggtttgatgactatgagcc

SEQ ID NO: 623169 - DNA, 25 bp, Mus musculus
cttgtgggtttgttgactatgagcc

SEQ ID NO: 623170 - DNA, 25 bp, Mus musculus
cttgtggtcctgaaaaattccgcta

SEQ ID NO: 623171 - DNA, 25 bp, Mus musculus
cttgtggtcctgtaaaattccgcta

SEQ ID NO: 623172 - DNA, 25 bp, Mus musculus
cttgtgtcagatcccaaccaacatg

SEQ ID NO: 623173 - DNA, 25 bp, Mus musculus
cttgtgtcagatgccaaccaacatg

SEQ ID NO: 623174 - DNA, 25 bp, Mus musculus
cttgtgtcatacagcctctattcag

SEQ ID NO: 623175 - DNA, 25 bp, Mus musculus
cttgtgtcatactgcctctattcag

SEQ ID NO: 623176 - DNA, 25 bp, Mus musculus
cttgtgtcggcacttgttgaatatg

SEQ ID NO: 623177 - DNA, 25 bp, Mus musculus
cttgtgtcggcagttgttgaatatg

SEQ ID NO: 623178 - DNA, 25 bp, Mus musculus
cttgtgtcgggaaaggagccagacc

SEQ ID NO: 623179 - DNA, 25 bp, Mus musculus
cttgtgtcgggataggagccagacc

SEQ ID NO: 623180 - DNA, 25 bp, Mus musculus
cttgtgtcttttctgagggtggaat

SEQ ID NO: 623181 - DNA, 25 bp, Mus musculus
cttgtgtcttttgtgagggtggaat

SEQ ID NO: 623182 - DNA, 25 bp, Mus musculus
cttgtgtgaacccaaaacttcctgg

SEQ ID NO: 623183 - DNA, 25 bp, Mus musculus
cttgtgtgaaccgaaaacttcctgg

SEQ ID NO: 623184 - DNA, 25 bp, Mus musculus
cttgtgtgaatgctgcctccccttt

SEQ ID NO: 623185 - DNA, 25 bp, Mus musculus
cttgtgtgaatggtgcctccccttt

SEQ ID NO: 623186 - DNA, 25 bp, Mus musculus
cttgtgtgagatcaaagagaaaaca

SEQ ID NO: 623187 - DNA, 25 bp, Mus musculus
cttgtgtgagatgaaagagaaaaca

SEQ ID NO: 623188 - DNA, 25 bp, Mus musculus
cttgtgtgcaggagatgtcctctga

SEQ ID NO: 623189 - DNA, 25 bp, Mus musculus
cttgtgtgcaggtgatgtcctctga

SEQ ID NO: 623190 - DNA, 25 bp, Mus musculus
cttgtgtgccgtctgcagcttgggc

SEQ ID NO: 623191 - DNA, 25 bp, Mus musculus
cttgtgtgccgtgtgcagcttgggc

SEQ ID NO: 623192 - DNA, 25 bp, Mus musculus
cttgtgtggaggacatcttcaccct

SEQ ID NO: 623193 - DNA, 25 bp, Mus musculus
cttgtgtggaggtcatcttcaccct

SEQ ID NO: 623194 - DNA, 25 bp, Mus musculus
cttgtgtggcaacattagctttgag

SEQ ID NO: 623195 - DNA, 25 bp, Mus musculus
cttgtgtggcaagattagctttgag

SEQ ID NO: 623196 - DNA, 25 bp, Mus musculus
cttgtgtggcgtagaatgactgtct

SEQ ID NO: 623197 - DNA, 25 bp, Mus musculus
cttgtgtggcgttgaatgactgtct

SEQ ID NO: 623198 - DNA, 25 bp, Mus musculus
cttgtgttgtggagagccccaaaca

SEQ ID NO: 623199 - DNA, 25 bp, Mus musculus
cttgtgttgtggtgagccccaaaca

SEQ ID NO: 623200 - DNA, 25 bp, Mus musculus
cttgttaagggaccatggaccaaag

SEQ ID NO: 623201 - DNA, 25 bp, Mus musculus
cttgttaagggagcatggaccaaag

SEQ ID NO: 623202 - DNA, 25 bp, Mus musculus
cttgttaagggcacttgtgtgaccc

SEQ ID NO: 623203 - DNA, 25 bp, Mus musculus
cttgttaagggctcttgtgtgaccc

SEQ ID NO: 623204 - DNA, 25 bp, Mus musculus
cttgttacacaacctttcgatgaag

SEQ ID NO: 623205 - DNA, 25 bp, Mus musculus
cttgttacacaagctttcgatgaag

SEQ ID NO: 623206 - DNA, 25 bp, Mus musculus
cttgttacagatcaatgtcgaagaa

SEQ ID NO: 623207 - DNA, 25 bp, Mus musculus
cttgttacagatgaatgtcgaagaa

SEQ ID NO: 623208 - DNA, 25 bp, Mus musculus
cttgttacaggtccaatgaagacat

SEQ ID NO: 623209 - DNA, 25 bp, Mus musculus
cttgttacaggtgcaatgaagacat

SEQ ID NO: 623210 - DNA, 25 bp, Mus musculus
cttgttatatgaacgcggcgctgca

SEQ ID NO: 623211 - DNA, 25 bp, Mus musculus
cttgttatatgatcgcggcgctgca

SEQ ID NO: 623212 - DNA, 25 bp, Mus musculus
cttgttatgctacgtgtaactgggc

SEQ ID NO: 623213 - DNA, 25 bp, Mus musculus
cttgttatgctaggtgtaactgggc

SEQ ID NO: 623214 - DNA, 25 bp, Mus musculus
cttgttcaccaacgatgagggaaga

SEQ ID NO: 623215 - DNA, 25 bp, Mus musculus
cttgttcaccaactaaaactgccaa

SEQ ID NO: 623216 - DNA, 25 bp, Mus musculus
cttgttcaccaaggatgagggaaga

SEQ ID NO: 623217 - DNA, 25 bp, Mus musculus
cttgttcaccaagtaaaactgccaa

SEQ ID NO: 623218 - DNA, 25 bp, Mus musculus
cttgttcagtggctggcacacctca

SEQ ID NO: 623219 - DNA, 25 bp, Mus musculus
cttgttcagtgggtggcacacctca

SEQ ID NO: 623220 - DNA, 25 bp, Mus musculus
cttgttcatccacttccagtgcaga

SEQ ID NO: 623221 - DNA, 25 bp, Mus musculus
cttgttcatccagttccagtgcaga

SEQ ID NO: 623222 - DNA, 25 bp, Mus musculus
cttgttccagacataaggacattag

SEQ ID NO: 623223 - DNA, 25 bp, Mus musculus
cttgttccagacttaaggacattag

SEQ ID NO: 623224 - DNA, 25 bp, Mus musculus
cttgttctgcacagcaacctcctga

SEQ ID NO: 623225 - DNA, 25 bp, Mus musculus
cttgttctgcactgcaacctcctga

SEQ ID NO: 623226 - DNA, 25 bp, Mus musculus
cttgttcttcaacgctgcagtcgcc

SEQ ID NO: 623227 - DNA, 25 bp, Mus musculus
cttgttcttcaaggctgcagtcgcc

SEQ ID NO: 623228 - DNA, 25 bp, Mus musculus
cttgttcttcttcatcacagttgat

SEQ ID NO: 623229 - DNA, 25 bp, Mus musculus
cttgttcttcttgatcacagttgat

SEQ ID NO: 623230 - DNA, 25 bp, Mus musculus
cttgttcttggtcccacaaacatcc

SEQ ID NO: 623231 - DNA, 25 bp, Mus musculus
cttgttcttggtgccacaaacatcc

SEQ ID NO: 623232 - DNA, 25 bp, Mus musculus
cttgttggtccacttgttcgatgcc

SEQ ID NO: 623233 - DNA, 25 bp, Mus musculus
cttgttggtccagttgttcgatgcc

SEQ ID NO: 623234 - DNA, 25 bp, Mus musculus
cttgttgtcatgcattgcaagaggg

SEQ ID NO: 623235 - DNA, 25 bp, Mus musculus
cttgttgtcatggattgcaagaggg

SEQ ID NO: 623236 - DNA, 25 bp, Mus musculus
cttgttgtccgtcccgggagtccga

SEQ ID NO: 623237 - DNA, 25 bp, Mus musculus
cttgttgtccgtgccgggagtccga

SEQ ID NO: 623238 - DNA, 25 bp, Mus musculus
cttgttgtttctcgtcccggtctca

SEQ ID NO: 623239 - DNA, 25 bp, Mus musculus
cttgttgtttctggtcccggtctca

SEQ ID NO: 623240 - DNA, 25 bp, Mus musculus
cttgtttaaattcttggtcatcgga

SEQ ID NO: 623241 - DNA, 25 bp, Mus musculus
cttgtttaaattgttggtcatcgga

SEQ ID NO: 623242 - DNA, 25 bp, Mus musculus
cttgtttcactcaggtcatgcccgg

SEQ ID NO: 623243 - DNA, 25 bp, Mus musculus
cttgtttcactctggtcatgcccgg

SEQ ID NO: 623244 - DNA, 25 bp, Mus musculus
cttgtttcccggcatacctgcaact

SEQ ID NO: 623245 - DNA, 25 bp, Mus musculus
cttgtttcccgggatacctgcaact

SEQ ID NO: 623246 - DNA, 25 bp, Mus musculus
cttgtttttagccagtcgctcatat

SEQ ID NO: 623247 - DNA, 25 bp, Mus musculus
cttgtttttagcgagtcgctcatat

SEQ ID NO: 623248 - DNA, 25 bp, Mus musculus
ctttaaaaggcaactcagagatggt

SEQ ID NO: 623249 - DNA, 25 bp, Mus musculus
ctttaaaaggcatctcagagatggt

SEQ ID NO: 623250 - DNA, 25 bp, Mus musculus
ctttaaaagtcaaaggccgaggagc

SEQ ID NO: 623251 - DNA, 25 bp, Mus musculus
ctttaaaagtcataggccgaggagc

SEQ ID NO: 623252 - DNA, 25 bp, Mus musculus
ctttaaaagtgtaggaataatacag

SEQ ID NO: 623253 - DNA, 25 bp, Mus musculus
ctttaaaagtgttggaataatacag

SEQ ID NO: 623254 - DNA, 25 bp, Mus musculus
ctttaaagaataagcaagagttgtg

SEQ ID NO: 623255 - DNA, 25 bp, Mus musculus
ctttaaagaatatgcaagagttgtg

SEQ ID NO: 623256 - DNA, 25 bp, Mus musculus
ctttaaagatccagtgtaccgggcg

SEQ ID NO: 623257 - DNA, 25 bp, Mus musculus
ctttaaagatcctgtgtaccgggcg

SEQ ID NO: 623258 - DNA, 25 bp, Mus musculus
ctttaaagtagtaggagactggaca

SEQ ID NO: 623259 - DNA, 25 bp, Mus musculus
ctttaaagtagttggagactggaca

SEQ ID NO: 623260 - DNA, 25 bp, Mus musculus
ctttaaatcctgacctcacaagttc

SEQ ID NO: 623261 - DNA, 25 bp, Mus musculus
ctttaaatcctgtcctcacaagttc

SEQ ID NO: 623262 - DNA, 25 bp, Mus musculus
ctttaaatgggaataaaggatagcg

SEQ ID NO: 623263 - DNA, 25 bp, Mus musculus
ctttaaatgggattaaaggatagcg

SEQ ID NO: 623264 - DNA, 25 bp, Mus musculus
ctttaacactgtaggaggacacaac

SEQ ID NO: 623265 - DNA, 25 bp, Mus musculus
ctttaacactgttggaggacacaac

SEQ ID NO: 623266 - DNA, 25 bp, Mus musculus
ctttaaccagatatattcttgcaga

SEQ ID NO: 623267 - DNA, 25 bp, Mus musculus
ctttaaccagatttattcttgcaga

SEQ ID NO: 623268 - DNA, 25 bp, Mus musculus
ctttaacgagctcgaggccagcgtg

SEQ ID NO: 623269 - DNA, 25 bp, Mus musculus
ctttaacgagctggaggccagcgtg

SEQ ID NO: 623270 - DNA, 25 bp, Mus musculus
ctttaactacaacggcaagaatgtg

SEQ ID NO: 623271 - DNA, 25 bp, Mus musculus
ctttaactacaagggcaagaatgtg

SEQ ID NO: 623272 - DNA, 25 bp, Mus musculus
ctttaactctccaaaaatgtgtgtg

SEQ ID NO: 623273 - DNA, 25 bp, Mus musculus
ctttaactctcctaaaatgtgtgtg

SEQ ID NO: 623274 - DNA, 25 bp, Mus musculus
ctttaagaagacagttgcgatgcat

SEQ ID NO: 623275 - DNA, 25 bp, Mus musculus
ctttaagaagactgttgcgatgcat

SEQ ID NO: 623276 - DNA, 25 bp, Mus musculus
ctttaagacggtatgctggaatggc

SEQ ID NO: 623277 - DNA, 25 bp, Mus musculus
ctttaagacggtttgctggaatggc

SEQ ID NO: 623278 - DNA, 25 bp, Mus musculus
ctttaagatgttatagagctgggcg

SEQ ID NO: 623279 - DNA, 25 bp, Mus musculus
ctttaagatgttttagagctgggcg

SEQ ID NO: 623280 - DNA, 25 bp, Mus musculus
ctttaagatttccatgtgagggctg

SEQ ID NO: 623281 - DNA, 25 bp, Mus musculus
ctttaagatttcgatgtgagggctg

SEQ ID NO: 623282 - DNA, 25 bp, Mus musculus
ctttaagcgcgtatggctggcccgc

SEQ ID NO: 623283 - DNA, 25 bp, Mus musculus
ctttaagcgcgtttggctggcccgc

SEQ ID NO: 623284 - DNA, 25 bp, Mus musculus
ctttaagggcgcagtctcaatgact

SEQ ID NO: 623285 - DNA, 25 bp, Mus musculus
ctttaagggcgctgtctcaatgact

SEQ ID NO: 623286 - DNA, 25 bp, Mus musculus
ctttaagggtatatttgttcatcga

SEQ ID NO: 623287 - DNA, 25 bp, Mus musculus
ctttaagggtatttttgttcatcga

SEQ ID NO: 623288 - DNA, 25 bp, Mus musculus
ctttaatagagcagatgattctcaa

SEQ ID NO: 623289 - DNA, 25 bp, Mus musculus
ctttaatagagctgatgattctcaa

SEQ ID NO: 623290 - DNA, 25 bp, Mus musculus
ctttaatagtgacgaagatgccaaa

SEQ ID NO: 623291 - DNA, 25 bp, Mus musculus
ctttaatagtgaggaagatgccaaa

SEQ ID NO: 623292 - DNA, 25 bp, Mus musculus
ctttaatcgcctacggcaggaacag

SEQ ID NO: 623293 - DNA, 25 bp, Mus musculus
ctttaatcgccttcggcaggaacag

SEQ ID NO: 623294 - DNA, 25 bp, Mus musculus
ctttaattgcgcaagtaagtaaact

SEQ ID NO: 623295 - DNA, 25 bp, Mus musculus
ctttaattgcgctagtaagtaaact

SEQ ID NO: 623296 - DNA, 25 bp, Mus musculus
ctttaatttatgctgagatggcagg

SEQ ID NO: 623297 - DNA, 25 bp, Mus musculus
ctttaatttatggtgagatggcagg

SEQ ID NO: 623298 - DNA, 25 bp, Mus musculus
ctttacaaagctacaacagttgact

SEQ ID NO: 623299 - DNA, 25 bp, Mus musculus
ctttacaaagcttcaacagttgact

SEQ ID NO: 623300 - DNA, 25 bp, Mus musculus
ctttacaagagactgcgaccatggc

SEQ ID NO: 623301 - DNA, 25 bp, Mus musculus
ctttacaagagagtgcgaccatggc

SEQ ID NO: 623302 - DNA, 25 bp, Mus musculus
ctttacaagccaagagctttggatc

SEQ ID NO: 623303 - DNA, 25 bp, Mus musculus
ctttacaagccatgagctttggatc

SEQ ID NO: 623304 - DNA, 25 bp, Mus musculus
ctttacacgctaatggaatagaggg

SEQ ID NO: 623305 - DNA, 25 bp, Mus musculus
ctttacacgctattggaatagaggg

SEQ ID NO: 623306 - DNA, 25 bp, Mus musculus
ctttacagacttaagaagcatcctg

SEQ ID NO: 623307 - DNA, 25 bp, Mus musculus
ctttacagactttagaagcatcctg

SEQ ID NO: 623308 - DNA, 25 bp, Mus musculus
ctttaccacgtaatatgcaccagtg

SEQ ID NO: 623309 - DNA, 25 bp, Mus musculus
ctttaccacgtattatgcaccagtg

SEQ ID NO: 623310 - DNA, 25 bp, Mus musculus
ctttacgagatcaactgaaccagaa

SEQ ID NO: 623311 - DNA, 25 bp, Mus musculus
ctttacgagatctactgaaccagaa

SEQ ID NO: 623312 - DNA, 25 bp, Mus musculus
ctttacgtggcacctgggagatgct

SEQ ID NO: 623313 - DNA, 25 bp, Mus musculus
ctttacgtggcagctgggagatgct

SEQ ID NO: 623314 - DNA, 25 bp, Mus musculus
ctttacgttaacagcgctcgggact

SEQ ID NO: 623315 - DNA, 25 bp, Mus musculus
ctttacgttaactgcgctcgggact

SEQ ID NO: 623316 - DNA, 25 bp, Mus musculus
ctttactgacagagggcagggctct

SEQ ID NO: 623317 - DNA, 25 bp, Mus musculus
ctttactgacagtgggcagggctct

SEQ ID NO: 623318 - DNA, 25 bp, Mus musculus
ctttagaaggataagaaggcgagga

SEQ ID NO: 623319 - DNA, 25 bp, Mus musculus
ctttagaaggattagaaggcgagga

SEQ ID NO: 623320 - DNA, 25 bp, Mus musculus
ctttagaccaaaccgttctatcagg

SEQ ID NO: 623321 - DNA, 25 bp, Mus musculus
ctttagaccaaagcgttctatcagg

SEQ ID NO: 623322 - DNA, 25 bp, Mus musculus
ctttagaccttcaaaacaatgacct

SEQ ID NO: 623323 - DNA, 25 bp, Mus musculus
ctttagaccttctaaacaatgacct

SEQ ID NO: 623324 - DNA, 25 bp, Mus musculus
ctttagaggagcactatttagatgc

SEQ ID NO: 623325 - DNA, 25 bp, Mus musculus
ctttagaggagctctatttagatgc

SEQ ID NO: 623326 - DNA, 25 bp, Mus musculus
ctttagatcctaagtgcgagtaggt

SEQ ID NO: 623327 - DNA, 25 bp, Mus musculus
ctttagatcctatgtgcgagtaggt

SEQ ID NO: 623328 - DNA, 25 bp, Mus musculus
ctttagcaatctctctttgctcagg

SEQ ID NO: 623329 - DNA, 25 bp, Mus musculus
ctttagcaatctgtctttgctcagg

SEQ ID NO: 623330 - DNA, 25 bp, Mus musculus
ctttagccattaatgaaagtggagg

SEQ ID NO: 623331 - DNA, 25 bp, Mus musculus
ctttagccattattgaaagtggagg

SEQ ID NO: 623332 - DNA, 25 bp, Mus musculus
ctttagcgcttcatccttggttaag

SEQ ID NO: 623333 - DNA, 25 bp, Mus musculus
ctttagcgcttcttccttggttaag

SEQ ID NO: 623334 - DNA, 25 bp, Mus musculus
ctttaggaagcacggctttctctgg

SEQ ID NO: 623335 - DNA, 25 bp, Mus musculus
ctttaggaagcagggctttctctgg

SEQ ID NO: 623336 - DNA, 25 bp, Mus musculus
ctttaggagctgctataggctcagc

SEQ ID NO: 623337 - DNA, 25 bp, Mus musculus
ctttaggagctggtataggctcagc

SEQ ID NO: 623338 - DNA, 25 bp, Mus musculus
ctttagtagcagcatgaagcgcgtc

SEQ ID NO: 623339 - DNA, 25 bp, Mus musculus
ctttagtagcaggatgaagcgcgtc

SEQ ID NO: 623340 - DNA, 25 bp, Mus musculus
ctttagttgatgaggcttcgggtga

SEQ ID NO: 623341 - DNA, 25 bp, Mus musculus
ctttagttgatgtggcttcgggtga

SEQ ID NO: 623342 - DNA, 25 bp, Mus musculus
ctttataatacgagtcatggcttcc

SEQ ID NO: 623343 - DNA, 25 bp, Mus musculus
ctttataatacgtgtcatggcttcc

SEQ ID NO: 623344 - DNA, 25 bp, Mus musculus
ctttatagaccacaatcttagtcct

SEQ ID NO: 623345 - DNA, 25 bp, Mus musculus
ctttatagaccagaatcttagtcct

SEQ ID NO: 623346 - DNA, 25 bp, Mus musculus
ctttatccagcccaccgtgttcggg

SEQ ID NO: 623347 - DNA, 25 bp, Mus musculus
ctttatccagccgaccgtgttcggg

SEQ ID NO: 623348 - DNA, 25 bp, Mus musculus
ctttatcgtgagagattcgagacac

SEQ ID NO: 623349 - DNA, 25 bp, Mus musculus
ctttatcgtgagtgattcgagacac

SEQ ID NO: 623350 - DNA, 25 bp, Mus musculus
ctttatctatcaccagctccatcag

SEQ ID NO: 623351 - DNA, 25 bp, Mus musculus
ctttatctatcagcagctccatcag

SEQ ID NO: 623352 - DNA, 25 bp, Mus musculus
ctttatctctttagcattcggaggg

SEQ ID NO: 623353 - DNA, 25 bp, Mus musculus
ctttatctcttttgcattcggaggg

SEQ ID NO: 623354 - DNA, 25 bp, Mus musculus
ctttatctgcaccataaagacagac

SEQ ID NO: 623355 - DNA, 25 bp, Mus musculus
ctttatctgcacgataaagacagac

SEQ ID NO: 623356 - DNA, 25 bp, Mus musculus
ctttatgactatcaagcacggacgg

SEQ ID NO: 623357 - DNA, 25 bp, Mus musculus
ctttatgactatgaagcacggacgg

SEQ ID NO: 623358 - DNA, 25 bp, Mus musculus
ctttatgaggaacttgtaagcaata

SEQ ID NO: 623359 - DNA, 25 bp, Mus musculus
ctttatgaggaagttgtaagcaata

SEQ ID NO: 623360 - DNA, 25 bp, Mus musculus
ctttatgaggatctatgatgcctat

SEQ ID NO: 623361 - DNA, 25 bp, Mus musculus
ctttatgaggatgtatgatgcctat

SEQ ID NO: 623362 - DNA, 25 bp, Mus musculus
ctttatgccccgctggcaaatgatg

SEQ ID NO: 623363 - DNA, 25 bp, Mus musculus
ctttatgccccggtggcaaatgatg

SEQ ID NO: 623364 - DNA, 25 bp, Mus musculus
ctttatgcgactattggtgtctctg

SEQ ID NO: 623365 - DNA, 25 bp, Mus musculus
ctttatgcgacttttggtgtctctg

SEQ ID NO: 623366 - DNA, 25 bp, Mus musculus
ctttatgtctagacaaaggagcaga

SEQ ID NO: 623367 - DNA, 25 bp, Mus musculus
ctttatgtctagtcaaaggagcaga

SEQ ID NO: 623368 - DNA, 25 bp, Mus musculus
ctttattccagtcgccgaggactcc

SEQ ID NO: 623369 - DNA, 25 bp, Mus musculus
ctttattccagtggccgaggactcc

SEQ ID NO: 623370 - DNA, 25 bp, Mus musculus
ctttattctagcctttggaaggatg

SEQ ID NO: 623371 - DNA, 25 bp, Mus musculus
ctttattctagcgtttggaaggatg

SEQ ID NO: 623372 - DNA, 25 bp, Mus musculus
ctttattctctcatggacctggcca

SEQ ID NO: 623373 - DNA, 25 bp, Mus musculus
ctttattctctcttggacctggcca

SEQ ID NO: 623374 - DNA, 25 bp, Mus musculus
ctttattgagcacatgggcggactg

SEQ ID NO: 623375 - DNA, 25 bp, Mus musculus
ctttattgagcagatgggcggactg

SEQ ID NO: 623376 - DNA, 25 bp, Mus musculus
ctttattggctacaaggaacggcct

SEQ ID NO: 623377 - DNA, 25 bp, Mus musculus
ctttattggctagaaggaacggcct

SEQ ID NO: 623378 - DNA, 25 bp, Mus musculus
ctttatttgttgacgagtgggatgg

SEQ ID NO: 623379 - DNA, 25 bp, Mus musculus
ctttatttgttgtcgagtgggatgg

SEQ ID NO: 623380 - DNA, 25 bp, Mus musculus
ctttcaaaaatgactgccatagcct

SEQ ID NO: 623381 - DNA, 25 bp, Mus musculus
ctttcaaaaatgtctgccatagcct

SEQ ID NO: 623382 - DNA, 25 bp, Mus musculus
ctttcaaatccaaacatagcagcaa

SEQ ID NO: 623383 - DNA, 25 bp, Mus musculus
ctttcaaatccatacatagcagcaa

SEQ ID NO: 623384 - DNA, 25 bp, Mus musculus
ctttcaactgaaagacacgagtttg

SEQ ID NO: 623385 - DNA, 25 bp, Mus musculus
ctttcaactgaatgacacgagtttg

SEQ ID NO: 623386 - DNA, 25 bp, Mus musculus
ctttcaagtgagctgttgcgtactg

SEQ ID NO: 623387 - DNA, 25 bp, Mus musculus
ctttcaagtgaggtgttgcgtactg

SEQ ID NO: 623388 - DNA, 25 bp, Mus musculus
ctttcacaagcacagactgacccag

SEQ ID NO: 623389 - DNA, 25 bp, Mus musculus
ctttcacaagcagagactgacccag

SEQ ID NO: 623390 - DNA, 25 bp, Mus musculus
ctttcacagccacagccgagttcag

SEQ ID NO: 623391 - DNA, 25 bp, Mus musculus
ctttcacagccagagccgagttcag

SEQ ID NO: 623392 - DNA, 25 bp, Mus musculus
ctttcaccagtgacgatgccgttga

SEQ ID NO: 623393 - DNA, 25 bp, Mus musculus
ctttcaccagtgtcgatgccgttga

SEQ ID NO: 623394 - DNA, 25 bp, Mus musculus
ctttcaccctgtatgagttctggca

SEQ ID NO: 623395 - DNA, 25 bp, Mus musculus
ctttcaccctgtttgagttctggca

SEQ ID NO: 623396 - DNA, 25 bp, Mus musculus
ctttcaccgtgaagggtgtcatcag

SEQ ID NO: 623397 - DNA, 25 bp, Mus musculus
ctttcaccgtgatgggtgtcatcag

SEQ ID NO: 623398 - DNA, 25 bp, Mus musculus
ctttcacctcagaatagtgctgcct

SEQ ID NO: 623399 - DNA, 25 bp, Mus musculus
ctttcacctcagtatagtgctgcct

SEQ ID NO: 623400 - DNA, 25 bp, Mus musculus
ctttcacctgtgctgtatttccctg

SEQ ID NO: 623401 - DNA, 25 bp, Mus musculus
ctttcacctgtggtgtatttccctg

SEQ ID NO: 623402 - DNA, 25 bp, Mus musculus
ctttcactgaacacagaacttgctg

SEQ ID NO: 623403 - DNA, 25 bp, Mus musculus
ctttcactgaactcagaacttgctg

SEQ ID NO: 623404 - DNA, 25 bp, Mus musculus
ctttcacttgctaaggtgcggccaa

SEQ ID NO: 623405 - DNA, 25 bp, Mus musculus
ctttcacttgcttaggtgcggccaa

SEQ ID NO: 623406 - DNA, 25 bp, Mus musculus
ctttcaggaacgacaagcccatcag

SEQ ID NO: 623407 - DNA, 25 bp, Mus musculus
ctttcaggaacgtcaagcccatcag

SEQ ID NO: 623408 - DNA, 25 bp, Mus musculus
ctttcaggagtcaaataagatgcac

SEQ ID NO: 623409 - DNA, 25 bp, Mus musculus
ctttcaggagtctaataagatgcac

SEQ ID NO: 623410 - DNA, 25 bp, Mus musculus
ctttcaggttctagccgggagctct

SEQ ID NO: 623411 - DNA, 25 bp, Mus musculus
ctttcaggttcttgccgggagctct

SEQ ID NO: 623412 - DNA, 25 bp, Mus musculus
ctttcagtgctacggagcccaaggc

SEQ ID NO: 623413 - DNA, 25 bp, Mus musculus
ctttcagtgctagggagcccaaggc

SEQ ID NO: 623414 - DNA, 25 bp, Mus musculus
ctttcagttctcaagccattccaga

SEQ ID NO: 623415 - DNA, 25 bp, Mus musculus
ctttcagttctctagccattccaga

SEQ ID NO: 623416 - DNA, 25 bp, Mus musculus
ctttcagtttcactagctctgcggt

SEQ ID NO: 623417 - DNA, 25 bp, Mus musculus
ctttcagtttcagtagctctgcggt

SEQ ID NO: 623418 - DNA, 25 bp, Mus musculus
ctttcatcaataatgtggaggtgga

SEQ ID NO: 623419 - DNA, 25 bp, Mus musculus
ctttcatcaatattgtggaggtgga

SEQ ID NO: 623420 - DNA, 25 bp, Mus musculus
ctttcatccatgagtccctcaatca

SEQ ID NO: 623421 - DNA, 25 bp, Mus musculus
ctttcatccatgtgtccctcaatca

SEQ ID NO: 623422 - DNA, 25 bp, Mus musculus
ctttcatcctagacgcaaatccaga

SEQ ID NO: 623423 - DNA, 25 bp, Mus musculus
ctttcatcctagtcgcaaatccaga

SEQ ID NO: 623424 - DNA, 25 bp, Mus musculus
ctttcatctcttcaaagaagggatt

SEQ ID NO: 623425 - DNA, 25 bp, Mus musculus
ctttcatctcttgaaagaagggatt

SEQ ID NO: 623426 - DNA, 25 bp, Mus musculus
ctttcatggcagctagagcagctta

SEQ ID NO: 623427 - DNA, 25 bp, Mus musculus
ctttcatggcaggtagagcagctta

SEQ ID NO: 623428 - DNA, 25 bp, Mus musculus
ctttcattgaaaactctgctatggg

SEQ ID NO: 623429 - DNA, 25 bp, Mus musculus
ctttcattgaaatctctgctatggg

SEQ ID NO: 623430 - DNA, 25 bp, Mus musculus
ctttcattgtggaccccttgccctt

SEQ ID NO: 623431 - DNA, 25 bp, Mus musculus
ctttcattgtggtccccttgccctt

SEQ ID NO: 623432 - DNA, 25 bp, Mus musculus
ctttccaacgaacactgtgaaaatg

SEQ ID NO: 623433 - DNA, 25 bp, Mus musculus
ctttccaacgaagactgtgaaaatg

SEQ ID NO: 623434 - DNA, 25 bp, Mus musculus
ctttccaactgtaggagcaggttca

SEQ ID NO: 623435 - DNA, 25 bp, Mus musculus
ctttccaactgttggagcaggttca

SEQ ID NO: 623436 - DNA, 25 bp, Mus musculus
ctttccacaggtcagcagagcactt

SEQ ID NO: 623437 - DNA, 25 bp, Mus musculus
ctttccacaggtgagcagagcactt

SEQ ID NO: 623438 - DNA, 25 bp, Mus musculus
ctttccacccaaaaagtaactgtga

SEQ ID NO: 623439 - DNA, 25 bp, Mus musculus
ctttccacccaataagtaactgtga

SEQ ID NO: 623440 - DNA, 25 bp, Mus musculus
ctttccactggacagattattagca

SEQ ID NO: 623441 - DNA, 25 bp, Mus musculus
ctttccactggagagattattagca

SEQ ID NO: 623442 - DNA, 25 bp, Mus musculus
ctttccactgtgagtacgtcagcag

SEQ ID NO: 623443 - DNA, 25 bp, Mus musculus
ctttccactgtgtgtacgtcagcag

SEQ ID NO: 623444 - DNA, 25 bp, Mus musculus
ctttccaggaagcacataattgaag

SEQ ID NO: 623445 - DNA, 25 bp, Mus musculus
ctttccaggaaggacataattgaag

SEQ ID NO: 623446 - DNA, 25 bp, Mus musculus
ctttccagggacacctgtgaagtgc

SEQ ID NO: 623447 - DNA, 25 bp, Mus musculus
ctttccagggactcctgtgaagtgc

SEQ ID NO: 623448 - DNA, 25 bp, Mus musculus
ctttccaggtagcaaagacagttgg

SEQ ID NO: 623449 - DNA, 25 bp, Mus musculus
ctttccaggtaggaaagacagttgg

SEQ ID NO: 623450 - DNA, 25 bp, Mus musculus
ctttccagtcttagcacgttgcctc

SEQ ID NO: 623451 - DNA, 25 bp, Mus musculus
ctttccagtctttgcacgttgcctc

SEQ ID NO: 623452 - DNA, 25 bp, Mus musculus
ctttccatgaagagggcgggtactc

SEQ ID NO: 623453 - DNA, 25 bp, Mus musculus
ctttccatgaagtgggcgggtactc

SEQ ID NO: 623454 - DNA, 25 bp, Mus musculus
ctttccatgttcagtaagagtgaat

SEQ ID NO: 623455 - DNA, 25 bp, Mus musculus
ctttccatgttctgtaagagtgaat

SEQ ID NO: 623456 - DNA, 25 bp, Mus musculus
ctttcccaaggtatgagaatgagct

SEQ ID NO: 623457 - DNA, 25 bp, Mus musculus
ctttcccaaggtttgagaatgagct

SEQ ID NO: 623458 - DNA, 25 bp, Mus musculus
ctttccccaagtcaaaagcagagct

SEQ ID NO: 623459 - DNA, 25 bp, Mus musculus
ctttccccaagtgaaaagcagagct

SEQ ID NO: 623460 - DNA, 25 bp, Mus musculus
ctttccctacagagatgatataatg

SEQ ID NO: 623461 - DNA, 25 bp, Mus musculus
ctttccctacagtgatgatataatg

SEQ ID NO: 623462 - DNA, 25 bp, Mus musculus
ctttccctctgtccagtgggaccaa

SEQ ID NO: 623463 - DNA, 25 bp, Mus musculus
ctttccctctgtgcagtgggaccaa

SEQ ID NO: 623464 - DNA, 25 bp, Mus musculus
ctttccctgcaacgctgcagagctt

SEQ ID NO: 623465 - DNA, 25 bp, Mus musculus
ctttccctgcaaggctgcagagctt

SEQ ID NO: 623466 - DNA, 25 bp, Mus musculus
ctttccctgcccagatggccaagca

SEQ ID NO: 623467 - DNA, 25 bp, Mus musculus
ctttccctgccctgatggccaagca

SEQ ID NO: 623468 - DNA, 25 bp, Mus musculus
ctttcccttgacaccgctggacaaa

SEQ ID NO: 623469 - DNA, 25 bp, Mus musculus
ctttcccttgactccgctggacaaa

SEQ ID NO: 623470 - DNA, 25 bp, Mus musculus
ctttccgagttccagcatgtcatct

SEQ ID NO: 623471 - DNA, 25 bp, Mus musculus
ctttccgagttcgagcatgtcatct

SEQ ID NO: 623472 - DNA, 25 bp, Mus musculus
ctttccggaacaacaagaccatcgc

SEQ ID NO: 623473 - DNA, 25 bp, Mus musculus
ctttccggaacatcaagaccatcgc

SEQ ID NO: 623474 - DNA, 25 bp, Mus musculus
ctttccggtggtaggccgcctgctc

SEQ ID NO: 623475 - DNA, 25 bp, Mus musculus
ctttccggtggttggccgcctgctc

SEQ ID NO: 623476 - DNA, 25 bp, Mus musculus
ctttccgtcagaatacacacggaat

SEQ ID NO: 623477 - DNA, 25 bp, Mus musculus
ctttccgtcagattacacacggaat

SEQ ID NO: 623478 - DNA, 25 bp, Mus musculus
ctttccgtgaagaaacgccagtaga

SEQ ID NO: 623479 - DNA, 25 bp, Mus musculus
ctttccgtgaagtaacgccagtaga

SEQ ID NO: 623480 - DNA, 25 bp, Mus musculus
ctttcctgagggagtgaagttgctg

SEQ ID NO: 623481 - DNA, 25 bp, Mus musculus
ctttcctgagggtgtgaagttgctg

SEQ ID NO: 623482 - DNA, 25 bp, Mus musculus
ctttcctgctctagcctgtgaacaa

SEQ ID NO: 623483 - DNA, 25 bp, Mus musculus
ctttcctgctcttgcctgtgaacaa

SEQ ID NO: 623484 - DNA, 25 bp, Mus musculus
ctttcctggaatactaatctgagtg

SEQ ID NO: 623485 - DNA, 25 bp, Mus musculus
ctttcctggaattctaatctgagtg

SEQ ID NO: 623486 - DNA, 25 bp, Mus musculus
ctttcctgggatcccggccgggatg

SEQ ID NO: 623487 - DNA, 25 bp, Mus musculus
ctttcctgggatgccggccgggatg

SEQ ID NO: 623488 - DNA, 25 bp, Mus musculus
ctttcctggttgcagggacagattt

SEQ ID NO: 623489 - DNA, 25 bp, Mus musculus
ctttcctggttggagggacagattt

SEQ ID NO: 623490 - DNA, 25 bp, Mus musculus
ctttcctgtgcgaggccgggctacg

SEQ ID NO: 623491 - DNA, 25 bp, Mus musculus
ctttcctgtgcgtggccgggctacg

SEQ ID NO: 623492 - DNA, 25 bp, Mus musculus
ctttccttcaagaggagtaacgcag

SEQ ID NO: 623493 - DNA, 25 bp, Mus musculus
ctttccttcaagtggagtaacgcag

SEQ ID NO: 623494 - DNA, 25 bp, Mus musculus
ctttccttcgagagaagacaggacc

SEQ ID NO: 623495 - DNA, 25 bp, Mus musculus
ctttccttcgagtgaagacaggacc

SEQ ID NO: 623496 - DNA, 25 bp, Mus musculus
ctttcctttcccaaggtatgagaat

SEQ ID NO: 623497 - DNA, 25 bp, Mus musculus
ctttcctttccctaggtatgagaat

SEQ ID NO: 623498 - DNA, 25 bp, Mus musculus
ctttcctttgcaattcagtgtagta

SEQ ID NO: 623499 - DNA, 25 bp, Mus musculus
ctttcctttgcatttcagtgtagta

SEQ ID NO: 623500 - DNA, 25 bp, Mus musculus
ctttccttttgtcgcttgagagaat

SEQ ID NO: 623501 - DNA, 25 bp, Mus musculus
ctttccttttgtggcttgagagaat

SEQ ID NO: 623502 - DNA, 25 bp, Mus musculus
ctttcgaaagttagatgagagatac

SEQ ID NO: 623503 - DNA, 25 bp, Mus musculus
ctttcgaaagtttgatgagagatac

SEQ ID NO: 623504 - DNA, 25 bp, Mus musculus
ctttcgacctgacatctctgactac

SEQ ID NO: 623505 - DNA, 25 bp, Mus musculus
ctttcgacctgagatctctgactac

SEQ ID NO: 623506 - DNA, 25 bp, Mus musculus
ctttcgagggacagttcgttatgca

SEQ ID NO: 623507 - DNA, 25 bp, Mus musculus
ctttcgagggactgttcgttatgca

SEQ ID NO: 623508 - DNA, 25 bp, Mus musculus
ctttcgattctacccactgaggctt

SEQ ID NO: 623509 - DNA, 25 bp, Mus musculus
ctttcgattctagccactgaggctt

SEQ ID NO: 623510 - DNA, 25 bp, Mus musculus
ctttcgcagcagaagaggctcctgg

SEQ ID NO: 623511 - DNA, 25 bp, Mus musculus
ctttcgcagcagtagaggctcctgg

SEQ ID NO: 623512 - DNA, 25 bp, Mus musculus
ctttcgcagggccagaggcgtctat

SEQ ID NO: 623513 - DNA, 25 bp, Mus musculus
ctttcgcagggcgagaggcgtctat

SEQ ID NO: 623514 - DNA, 25 bp, Mus musculus
ctttcgcctgcaaaagaccttcatc

SEQ ID NO: 623515 - DNA, 25 bp, Mus musculus
ctttcgcctgcataagaccttcatc

SEQ ID NO: 623516 - DNA, 25 bp, Mus musculus
ctttcggactgcacagatccaaatg

SEQ ID NO: 623517 - DNA, 25 bp, Mus musculus
ctttcggactgctcagatccaaatg

SEQ ID NO: 623518 - DNA, 25 bp, Mus musculus
ctttcggagacgaggaacagctgac

SEQ ID NO: 623519 - DNA, 25 bp, Mus musculus
ctttcggagacgtggaacagctgac

SEQ ID NO: 623520 - DNA, 25 bp, Mus musculus
ctttcggagcagctggtgaaacagt

SEQ ID NO: 623521 - DNA, 25 bp, Mus musculus
ctttcggagcaggtggtgaaacagt

SEQ ID NO: 623522 - DNA, 25 bp, Mus musculus
ctttcggcagctacaagtgctactg

SEQ ID NO: 623523 - DNA, 25 bp, Mus musculus
ctttcggcagcttcaagtgctactg

SEQ ID NO: 623524 - DNA, 25 bp, Mus musculus
ctttcggccgctcttgtattgtact

SEQ ID NO: 623525 - DNA, 25 bp, Mus musculus
ctttcggccgctgttgtattgtact

SEQ ID NO: 623526 - DNA, 25 bp, Mus musculus
ctttcggctaagctacatctatcag

SEQ ID NO: 623527 - DNA, 25 bp, Mus musculus
ctttcggctaaggtacatctatcag

SEQ ID NO: 623528 - DNA, 25 bp, Mus musculus
ctttcgtgaggcagttgctctctga

SEQ ID NO: 623529 - DNA, 25 bp, Mus musculus
ctttcgtgaggctgttgctctctga

SEQ ID NO: 623530 - DNA, 25 bp, Mus musculus
ctttcgtggccaaggtgatgtgcgt

SEQ ID NO: 623531 - DNA, 25 bp, Mus musculus
ctttcgtggccatggtgatgtgcgt

SEQ ID NO: 623532 - DNA, 25 bp, Mus musculus
ctttctacagagcaggtggaccacc

SEQ ID NO: 623533 - DNA, 25 bp, Mus musculus
ctttctacagaggaggtggaccacc

SEQ ID NO: 623534 - DNA, 25 bp, Mus musculus
ctttctacctctagtcatctgccag

SEQ ID NO: 623535 - DNA, 25 bp, Mus musculus
ctttctacctcttgtcatctgccag

SEQ ID NO: 623536 - DNA, 25 bp, Mus musculus
ctttctacgtctaaaggcagagact

SEQ ID NO: 623537 - DNA, 25 bp, Mus musculus
ctttctacgtcttaaggcagagact

SEQ ID NO: 623538 - DNA, 25 bp, Mus musculus
ctttctactcggcacactcttcatt

SEQ ID NO: 623539 - DNA, 25 bp, Mus musculus
ctttctactcgggacactcttcatt

SEQ ID NO: 623540 - DNA, 25 bp, Mus musculus
ctttctagattcagaagctggtgga

SEQ ID NO: 623541 - DNA, 25 bp, Mus musculus
ctttctagattctgaagctggtgga

SEQ ID NO: 623542 - DNA, 25 bp, Mus musculus
ctttctatggccctggtgccggaag

SEQ ID NO: 623543 - DNA, 25 bp, Mus musculus
ctttctatggccgtggtgccggaag

SEQ ID NO: 623544 - DNA, 25 bp, Mus musculus
ctttctattggacaggacatagaag

SEQ ID NO: 623545 - DNA, 25 bp, Mus musculus
ctttctattggagaggacatagaag

SEQ ID NO: 623546 - DNA, 25 bp, Mus musculus
ctttctcactgaacttattgaccga

SEQ ID NO: 623547 - DNA, 25 bp, Mus musculus
ctttctcactgatcttattgaccga

SEQ ID NO: 623548 - DNA, 25 bp, Mus musculus
ctttctcaggccaatatttgctccg

SEQ ID NO: 623549 - DNA, 25 bp, Mus musculus
ctttctcaggcctatatttgctccg

SEQ ID NO: 623550 - DNA, 25 bp, Mus musculus
ctttctcagtcccagctgggtacgc

SEQ ID NO: 623551 - DNA, 25 bp, Mus musculus
ctttctcagtccgagctgggtacgc

SEQ ID NO: 623552 - DNA, 25 bp, Mus musculus
ctttctcagtgacagcgtgtggatc

SEQ ID NO: 623553 - DNA, 25 bp, Mus musculus
ctttctcagtgagagcgtgtggatc

SEQ ID NO: 623554 - DNA, 25 bp, Mus musculus
ctttctccctagagatgtgcctcct

SEQ ID NO: 623555 - DNA, 25 bp, Mus musculus
ctttctccctagtgatgtgcctcct

SEQ ID NO: 623556 - DNA, 25 bp, Mus musculus
ctttctccggtgagggcactctcct

SEQ ID NO: 623557 - DNA, 25 bp, Mus musculus
ctttctccggtgtgggcactctcct

SEQ ID NO: 623558 - DNA, 25 bp, Mus musculus
ctttctcggagccactgtggtggtt

SEQ ID NO: 623559 - DNA, 25 bp, Mus musculus
ctttctcggagcgactgtggtggtt

SEQ ID NO: 623560 - DNA, 25 bp, Mus musculus
ctttctcggtgtctgagtcctgccc

SEQ ID NO: 623561 - DNA, 25 bp, Mus musculus
ctttctcggtgtgtgagtcctgccc

SEQ ID NO: 623562 - DNA, 25 bp, Mus musculus
ctttctctggaaatacacctatggc

SEQ ID NO: 623563 - DNA, 25 bp, Mus musculus
ctttctctggaattacacctatggc

SEQ ID NO: 623564 - DNA, 25 bp, Mus musculus
ctttctcttctgctctagcgcatag

SEQ ID NO: 623565 - DNA, 25 bp, Mus musculus
ctttctcttctggtctagcgcatag

SEQ ID NO: 623566 - DNA, 25 bp, Mus musculus
ctttctgaactacacgaggaccctc

SEQ ID NO: 623567 - DNA, 25 bp, Mus musculus
ctttctgaactagacgaggaccctc

SEQ ID NO: 623568 - DNA, 25 bp, Mus musculus
ctttctgacaggagtgtgcgccatc

SEQ ID NO: 623569 - DNA, 25 bp, Mus musculus
ctttctgacaggtgtgtgcgccatc

SEQ ID NO: 623570 - DNA, 25 bp, Mus musculus
ctttctgacagtcctgcttaatccg

SEQ ID NO: 623571 - DNA, 25 bp, Mus musculus
ctttctgacagtgctgcttaatccg

SEQ ID NO: 623572 - DNA, 25 bp, Mus musculus
ctttctgactcgcatgcattggtca

SEQ ID NO: 623573 - DNA, 25 bp, Mus musculus
ctttctgactcggatgcattggtca

SEQ ID NO: 623574 - DNA, 25 bp, Mus musculus
ctttctgagagtcggatggagcacc

SEQ ID NO: 623575 - DNA, 25 bp, Mus musculus
ctttctgagagtgggatggagcacc

SEQ ID NO: 623576 - DNA, 25 bp, Mus musculus
ctttctgataagagacagcgagtct

SEQ ID NO: 623577 - DNA, 25 bp, Mus musculus
ctttctgataagtgacagcgagtct

SEQ ID NO: 623578 - DNA, 25 bp, Mus musculus
ctttctgcagcgctactatgggaaa

SEQ ID NO: 623579 - DNA, 25 bp, Mus musculus
ctttctgcagcggtactatgggaaa

SEQ ID NO: 623580 - DNA, 25 bp, Mus musculus
ctttctgcaggtaccgacccttgac

SEQ ID NO: 623581 - DNA, 25 bp, Mus musculus
ctttctgcaggttccgacccttgac

SEQ ID NO: 623582 - DNA, 25 bp, Mus musculus
ctttctgcatccagtttgaagaaga

SEQ ID NO: 623583 - DNA, 25 bp, Mus musculus
ctttctgcatcctgtttgaagaaga

SEQ ID NO: 623584 - DNA, 25 bp, Mus musculus
ctttctgccatgatgcgactctggg

SEQ ID NO: 623585 - DNA, 25 bp, Mus musculus
ctttctgccatgttgcgactctggg

SEQ ID NO: 623586 - DNA, 25 bp, Mus musculus
ctttctgcgcaacgccgagtgcatc

SEQ ID NO: 623587 - DNA, 25 bp, Mus musculus
ctttctgcgcaaggccgagtgcatc

SEQ ID NO: 623588 - DNA, 25 bp, Mus musculus
ctttctgctcttaacagccacaagg

SEQ ID NO: 623589 - DNA, 25 bp, Mus musculus
ctttctgctctttacagccacaagg

SEQ ID NO: 623590 - DNA, 25 bp, Mus musculus
ctttctgcttttacatgactctggg

SEQ ID NO: 623591 - DNA, 25 bp, Mus musculus
ctttctgctttttcatgactctggg

SEQ ID NO: 623592 - DNA, 25 bp, Mus musculus
ctttctggcatcagctgggtaggca

SEQ ID NO: 623593 - DNA, 25 bp, Mus musculus
ctttctggcatctgctgggtaggca

SEQ ID NO: 623594 - DNA, 25 bp, Mus musculus
ctttctggccaccaagacgtcgtga

SEQ ID NO: 623595 - DNA, 25 bp, Mus musculus
ctttctggccacgaagacgtcgtga

SEQ ID NO: 623596 - DNA, 25 bp, Mus musculus
ctttctgggatgagctgacccacag

SEQ ID NO: 623597 - DNA, 25 bp, Mus musculus
ctttctgggatgtgctgacccacag

SEQ ID NO: 623598 - DNA, 25 bp, Mus musculus
ctttctggtcgcctgtcgggtgtcc

SEQ ID NO: 623599 - DNA, 25 bp, Mus musculus
ctttctggtcgcgtgtcgggtgtcc

SEQ ID NO: 623600 - DNA, 25 bp, Mus musculus
ctttctggtctgcacccaaacgctg

SEQ ID NO: 623601 - DNA, 25 bp, Mus musculus
ctttctggtctggacccaaacgctg

SEQ ID NO: 623602 - DNA, 25 bp, Mus musculus
ctttctggtgatcggctccaagttc

SEQ ID NO: 623603 - DNA, 25 bp, Mus musculus
ctttctggtgatgggctccaagttc

SEQ ID NO: 623604 - DNA, 25 bp, Mus musculus
ctttctgtagctccgattggagcat

SEQ ID NO: 623605 - DNA, 25 bp, Mus musculus
ctttctgtagctgcgattggagcat

SEQ ID NO: 623606 - DNA, 25 bp, Mus musculus
ctttctgtgtgtattgagccagcac

SEQ ID NO: 623607 - DNA, 25 bp, Mus musculus
ctttctgtgtgttttgagccagcac

SEQ ID NO: 623608 - DNA, 25 bp, Mus musculus
ctttctgttggtccgacttgacttt

SEQ ID NO: 623609 - DNA, 25 bp, Mus musculus
ctttctgttggtgcgacttgacttt

SEQ ID NO: 623610 - DNA, 25 bp, Mus musculus
ctttctgttgtgagcatgctggcag

SEQ ID NO: 623611 - DNA, 25 bp, Mus musculus
ctttctgttgtgtgcatgctggcag

SEQ ID NO: 623612 - DNA, 25 bp, Mus musculus
ctttctgtttgtaagcttggtctgc

SEQ ID NO: 623613 - DNA, 25 bp, Mus musculus
ctttctgtttgttagcttggtctgc

SEQ ID NO: 623614 - DNA, 25 bp, Mus musculus
ctttctgttttgcacagccgtgttg

SEQ ID NO: 623615 - DNA, 25 bp, Mus musculus
ctttctgttttggacagccgtgttg

SEQ ID NO: 623616 - DNA, 25 bp, Mus musculus
ctttcttcatagattatgtgccaga

SEQ ID NO: 623617 - DNA, 25 bp, Mus musculus
ctttcttcatagtttatgtgccaga

SEQ ID NO: 623618 - DNA, 25 bp, Mus musculus
ctttcttctctaccgacagatgtca

SEQ ID NO: 623619 - DNA, 25 bp, Mus musculus
ctttcttctctagcgacagatgtca

SEQ ID NO: 623620 - DNA, 25 bp, Mus musculus
ctttcttgcttgatgggacccaaat

SEQ ID NO: 623621 - DNA, 25 bp, Mus musculus
ctttcttgcttgttgggacccaaat

SEQ ID NO: 623622 - DNA, 25 bp, Mus musculus
ctttcttggacaacatgtttggacc

SEQ ID NO: 623623 - DNA, 25 bp, Mus musculus
ctttcttggacatcatgtttggacc

SEQ ID NO: 623624 - DNA, 25 bp, Mus musculus
ctttgaaaataacaggtgtgtgcac

SEQ ID NO: 623625 - DNA, 25 bp, Mus musculus
ctttgaaaataagaggtgtgtgcac

SEQ ID NO: 623626 - DNA, 25 bp, Mus musculus
ctttgaaagtatcggacctacaggg

SEQ ID NO: 623627 - DNA, 25 bp, Mus musculus
ctttgaaagtatgggacctacaggg

SEQ ID NO: 623628 - DNA, 25 bp, Mus musculus
ctttgaaatcaaaacaccagttgga

SEQ ID NO: 623629 - DNA, 25 bp, Mus musculus
ctttgaaatcaatacaccagttgga

SEQ ID NO: 623630 - DNA, 25 bp, Mus musculus
ctttgaacaagtcagggaaataagg

SEQ ID NO: 623631 - DNA, 25 bp, Mus musculus
ctttgaacaagtgagggaaataagg

SEQ ID NO: 623632 - DNA, 25 bp, Mus musculus
ctttgaacggacacctgcgtctggg

SEQ ID NO: 623633 - DNA, 25 bp, Mus musculus
ctttgaacggactcctgcgtctggg

SEQ ID NO: 623634 - DNA, 25 bp, Mus musculus
ctttgaacggctcagagtgagtact

SEQ ID NO: 623635 - DNA, 25 bp, Mus musculus
ctttgaacggctgagagtgagtact

SEQ ID NO: 623636 - DNA, 25 bp, Mus musculus
ctttgaactggaagtttctgggaag

SEQ ID NO: 623637 - DNA, 25 bp, Mus musculus
ctttgaactggatgtttctgggaag

SEQ ID NO: 623638 - DNA, 25 bp, Mus musculus
ctttgaagacaaatcggcctatgca

SEQ ID NO: 623639 - DNA, 25 bp, Mus musculus
ctttgaagacaattcggcctatgca

SEQ ID NO: 623640 - DNA, 25 bp, Mus musculus
ctttgaagatgacgccatgctgacc

SEQ ID NO: 623641 - DNA, 25 bp, Mus musculus
ctttgaagatgaggccatgctgacc

SEQ ID NO: 623642 - DNA, 25 bp, Mus musculus
ctttgaagcagaagaggccttggat

SEQ ID NO: 623643 - DNA, 25 bp, Mus musculus
ctttgaagcagatgaggccttggat

SEQ ID NO: 623644 - DNA, 25 bp, Mus musculus
ctttgaaggacaccaggtttcagct

SEQ ID NO: 623645 - DNA, 25 bp, Mus musculus
ctttgaaggacagcaggtttcagct

SEQ ID NO: 623646 - DNA, 25 bp, Mus musculus
ctttgaaggattcgccaatggccaa

SEQ ID NO: 623647 - DNA, 25 bp, Mus musculus
ctttgaaggattggccaatggccaa

SEQ ID NO: 623648 - DNA, 25 bp, Mus musculus
ctttgaagtacaagggctgcagcct

SEQ ID NO: 623649 - DNA, 25 bp, Mus musculus
ctttgaagtacatgggctgcagcct

SEQ ID NO: 623650 - DNA, 25 bp, Mus musculus
ctttgaagtttcaacattagtggga

SEQ ID NO: 623651 - DNA, 25 bp, Mus musculus
ctttgaagtttctacattagtggga

SEQ ID NO: 623652 - DNA, 25 bp, Mus musculus
ctttgaatccagaagctggcaaaca

SEQ ID NO: 623653 - DNA, 25 bp, Mus musculus
ctttgaatccagtagctggcaaaca

SEQ ID NO: 623654 - DNA, 25 bp, Mus musculus
ctttgaatccttatcttagagcttg

SEQ ID NO: 623655 - DNA, 25 bp, Mus musculus
ctttgaatccttttcttagagcttg

SEQ ID NO: 623656 - DNA, 25 bp, Mus musculus
ctttgaatctaaaacagaggagtca

SEQ ID NO: 623657 - DNA, 25 bp, Mus musculus
ctttgaatctaatacagaggagtca

SEQ ID NO: 623658 - DNA, 25 bp, Mus musculus
ctttgacaaaatacagcagctgaag

SEQ ID NO: 623659 - DNA, 25 bp, Mus musculus
ctttgacaaaattcagcagctgaag

SEQ ID NO: 623660 - DNA, 25 bp, Mus musculus
ctttgacaacagagggaaagtcacc

SEQ ID NO: 623661 - DNA, 25 bp, Mus musculus
ctttgacaacagtgggaaagtcacc

SEQ ID NO: 623662 - DNA, 25 bp, Mus musculus
ctttgacaaggacactgtgatcaac

SEQ ID NO: 623663 - DNA, 25 bp, Mus musculus
ctttgacaaggagactgtgatcaac

SEQ ID NO: 623664 - DNA, 25 bp, Mus musculus
ctttgacaagtactgactgaaaaag

SEQ ID NO: 623665 - DNA, 25 bp, Mus musculus
ctttgacaagtagtgactgaaaaag

SEQ ID NO: 623666 - DNA, 25 bp, Mus musculus
ctttgacagaagctaggagtccagg

SEQ ID NO: 623667 - DNA, 25 bp, Mus musculus
ctttgacagaaggtaggagtccagg

SEQ ID NO: 623668 - DNA, 25 bp, Mus musculus
ctttgacagctgctgaagcccagaa

SEQ ID NO: 623669 - DNA, 25 bp, Mus musculus
ctttgacagctggtgaagcccagaa

SEQ ID NO: 623670 - DNA, 25 bp, Mus musculus
ctttgacaggaacacaggtggattc

SEQ ID NO: 623671 - DNA, 25 bp, Mus musculus
ctttgacaggaagacaggtggattc

SEQ ID NO: 623672 - DNA, 25 bp, Mus musculus
ctttgacatcttctgtgacgtgggc

SEQ ID NO: 623673 - DNA, 25 bp, Mus musculus
ctttgacatcttgtgtgacgtgggc

SEQ ID NO: 623674 - DNA, 25 bp, Mus musculus
ctttgacatgcaagaggttgttctg

SEQ ID NO: 623675 - DNA, 25 bp, Mus musculus
ctttgacatgcatgaggttgttctg

SEQ ID NO: 623676 - DNA, 25 bp, Mus musculus
ctttgaccaagacggagtgtgtata

SEQ ID NO: 623677 - DNA, 25 bp, Mus musculus
ctttgaccaagagggagtgtgtata

SEQ ID NO: 623678 - DNA, 25 bp, Mus musculus
ctttgaccacccagggaaaggtcat

SEQ ID NO: 623679 - DNA, 25 bp, Mus musculus
ctttgaccaccctgggaaaggtcat

SEQ ID NO: 623680 - DNA, 25 bp, Mus musculus
ctttgacccgcacggagactgacgc

SEQ ID NO: 623681 - DNA, 25 bp, Mus musculus
ctttgacccgcagggagactgacgc

SEQ ID NO: 623682 - DNA, 25 bp, Mus musculus
ctttgaccgcttctctaagcatgac

SEQ ID NO: 623683 - DNA, 25 bp, Mus musculus
ctttgaccgcttgtctaagcatgac

SEQ ID NO: 623684 - DNA, 25 bp, Mus musculus
ctttgaccgtgtacgaaatgctgag

SEQ ID NO: 623685 - DNA, 25 bp, Mus musculus
ctttgaccgtgttcgaaatgctgag

SEQ ID NO: 623686 - DNA, 25 bp, Mus musculus
ctttgacctcaacattgacaatgaa

SEQ ID NO: 623687 - DNA, 25 bp, Mus musculus
ctttgacctcaagattgacaatgaa

SEQ ID NO: 623688 - DNA, 25 bp, Mus musculus
ctttgacctgacagaagctatcgca

SEQ ID NO: 623689 - DNA, 25 bp, Mus musculus
ctttgacctgactgaagctatcgca

SEQ ID NO: 623690 - DNA, 25 bp, Mus musculus
ctttgacctggaagtcaaaggtgtc

SEQ ID NO: 623691 - DNA, 25 bp, Mus musculus
ctttgacctggaccgccagtcagga

SEQ ID NO: 623692 - DNA, 25 bp, Mus musculus
ctttgacctggagcgccagtcagga

SEQ ID NO: 623693 - DNA, 25 bp, Mus musculus
ctttgacctggatgtcaaaggtgtc

SEQ ID NO: 623694 - DNA, 25 bp, Mus musculus
ctttgacctggtcgaccggagtctg

SEQ ID NO: 623695 - DNA, 25 bp, Mus musculus
ctttgacctggtggaccggagtctg

SEQ ID NO: 623696 - DNA, 25 bp, Mus musculus
ctttgacgatgacaccctgaggctt

SEQ ID NO: 623697 - DNA, 25 bp, Mus musculus
ctttgacgatgagaccctgaggctt

SEQ ID NO: 623698 - DNA, 25 bp, Mus musculus
ctttgactaacacctcccagagcag

SEQ ID NO: 623699 - DNA, 25 bp, Mus musculus
ctttgactaacagctcccagagcag

SEQ ID NO: 623700 - DNA, 25 bp, Mus musculus
ctttgactcgggagcagaagtttga

SEQ ID NO: 623701 - DNA, 25 bp, Mus musculus
ctttgactcgggtgcagaagtttga

SEQ ID NO: 623702 - DNA, 25 bp, Mus musculus
ctttgagaagtgagggaaccagcgc

SEQ ID NO: 623703 - DNA, 25 bp, Mus musculus
ctttgagaagtgtgggaaccagcgc

SEQ ID NO: 623704 - DNA, 25 bp, Mus musculus
ctttgagaatacagcaatcttaccc

SEQ ID NO: 623705 - DNA, 25 bp, Mus musculus
ctttgagaatactgcaatcttaccc

SEQ ID NO: 623706 - DNA, 25 bp, Mus musculus
ctttgagagagccaagttctgggtt

SEQ ID NO: 623707 - DNA, 25 bp, Mus musculus
ctttgagagagcgaagttctgggtt

SEQ ID NO: 623708 - DNA, 25 bp, Mus musculus
ctttgagagctacctggcagttgcc

SEQ ID NO: 623709 - DNA, 25 bp, Mus musculus
ctttgagagctagctggcagttgcc

SEQ ID NO: 623710 - DNA, 25 bp, Mus musculus
ctttgagagtggagtatacaacaac

SEQ ID NO: 623711 - DNA, 25 bp, Mus musculus
ctttgagagtggtgtatacaacaac

SEQ ID NO: 623712 - DNA, 25 bp, Mus musculus
ctttgagatcaaagaggcctttgca

SEQ ID NO: 623713 - DNA, 25 bp, Mus musculus
ctttgagatcaatgaggcctttgca

SEQ ID NO: 623714 - DNA, 25 bp, Mus musculus
ctttgagatggaagagaaggacttt

SEQ ID NO: 623715 - DNA, 25 bp, Mus musculus
ctttgagatggatgagaaggacttt

SEQ ID NO: 623716 - DNA, 25 bp, Mus musculus
ctttgagattggagcgtggactgaa

SEQ ID NO: 623717 - DNA, 25 bp, Mus musculus
ctttgagattggtgcgtggactgaa

SEQ ID NO: 623718 - DNA, 25 bp, Mus musculus
ctttgagcgcatcctttggcgagtg

SEQ ID NO: 623719 - DNA, 25 bp, Mus musculus
ctttgagcgcatgctttggcgagtg

SEQ ID NO: 623720 - DNA, 25 bp, Mus musculus
ctttgagctgatccgggaaccctgc

SEQ ID NO: 623721 - DNA, 25 bp, Mus musculus
ctttgagctgatgcgggaaccctgc

SEQ ID NO: 623722 - DNA, 25 bp, Mus musculus
ctttgagcttccagctttcgacccg

SEQ ID NO: 623723 - DNA, 25 bp, Mus musculus
ctttgagcttcctgctttcgacccg

SEQ ID NO: 623724 - DNA, 25 bp, Mus musculus
ctttgaggacatattgtcagagaac

SEQ ID NO: 623725 - DNA, 25 bp, Mus musculus
ctttgaggacattttgtcagagaac

SEQ ID NO: 623726 - DNA, 25 bp, Mus musculus
ctttgaggagcaaatccgggctttg

SEQ ID NO: 623727 - DNA, 25 bp, Mus musculus
ctttgaggagcatatccgggctttg

SEQ ID NO: 623728 - DNA, 25 bp, Mus musculus
ctttgaggaggtagccccttgcacc

SEQ ID NO: 623729 - DNA, 25 bp, Mus musculus
ctttgaggaggttgccccttgcacc

SEQ ID NO: 623730 - DNA, 25 bp, Mus musculus
ctttgaggagttccgggactctgat

SEQ ID NO: 623731 - DNA, 25 bp, Mus musculus
ctttgaggagttgcgggactctgat

SEQ ID NO: 623732 - DNA, 25 bp, Mus musculus
ctttgaggccatctttcggtcgttc

SEQ ID NO: 623733 - DNA, 25 bp, Mus musculus
ctttgaggccatgtttcggtcgttc

SEQ ID NO: 623734 - DNA, 25 bp, Mus musculus
ctttgaggcccgcatctgtgcttgc

SEQ ID NO: 623735 - DNA, 25 bp, Mus musculus
ctttgaggcccggatctgtgcttgc

SEQ ID NO: 623736 - DNA, 25 bp, Mus musculus
ctttgaggtgagcttcttggaaact

SEQ ID NO: 623737 - DNA, 25 bp, Mus musculus
ctttgaggtgaggttcttggaaact

SEQ ID NO: 623738 - DNA, 25 bp, Mus musculus
ctttgagtagcactgtgtgggcaca

SEQ ID NO: 623739 - DNA, 25 bp, Mus musculus
ctttgagtagcagtgtgtgggcaca

SEQ ID NO: 623740 - DNA, 25 bp, Mus musculus
ctttgagtcaaaccaacccatcagc

SEQ ID NO: 623741 - DNA, 25 bp, Mus musculus
ctttgagtcaaagcaacccatcagc

SEQ ID NO: 623742 - DNA, 25 bp, Mus musculus
ctttgagtccctacgggacactgag

SEQ ID NO: 623743 - DNA, 25 bp, Mus musculus
ctttgagtcccttcgggacactgag

SEQ ID NO: 623744 - DNA, 25 bp, Mus musculus
ctttgatacagacagcaggcatgcc

SEQ ID NO: 623745 - DNA, 25 bp, Mus musculus
ctttgatacagagagcaggcatgcc

SEQ ID NO: 623746 - DNA, 25 bp, Mus musculus
ctttgatatggacgccttcactgaa

SEQ ID NO: 623747 - DNA, 25 bp, Mus musculus
ctttgatatggaggccttcactgaa

SEQ ID NO: 623748 - DNA, 25 bp, Mus musculus
ctttgatatggtcgagaaggcctgc

SEQ ID NO: 623749 - DNA, 25 bp, Mus musculus
ctttgatatggtggagaaggcctgc

SEQ ID NO: 623750 - DNA, 25 bp, Mus musculus
ctttgatcaggaaggactcgtggag

SEQ ID NO: 623751 - DNA, 25 bp, Mus musculus
ctttgatcaggatggactcgtggag

SEQ ID NO: 623752 - DNA, 25 bp, Mus musculus
ctttgatgaactatacaggcagtgc

SEQ ID NO: 623753 - DNA, 25 bp, Mus musculus
ctttgatgaactttacaggcagtgc

SEQ ID NO: 623754 - DNA, 25 bp, Mus musculus
ctttgatggctcagcttgggatgag

SEQ ID NO: 623755 - DNA, 25 bp, Mus musculus
ctttgatggctctgcttgggatgag

SEQ ID NO: 623756 - DNA, 25 bp, Mus musculus
ctttgatgggcactcaggacccaag

SEQ ID NO: 623757 - DNA, 25 bp, Mus musculus
ctttgatgggcagtcaggacccaag

SEQ ID NO: 623758 - DNA, 25 bp, Mus musculus
ctttgatgtgcccatcttcacggaa

SEQ ID NO: 623759 - DNA, 25 bp, Mus musculus
ctttgatgtgccgatcttcacggaa

SEQ ID NO: 623760 - DNA, 25 bp, Mus musculus
ctttgattccggacacggtggcgcg

SEQ ID NO: 623761 - DNA, 25 bp, Mus musculus
ctttgattccggtcacggtggcgcg

SEQ ID NO: 623762 - DNA, 25 bp, Mus musculus
ctttgcaaatggacgctccacaggc

SEQ ID NO: 623763 - DNA, 25 bp, Mus musculus
ctttgcaaatggtcgctccacaggc

SEQ ID NO: 623764 - DNA, 25 bp, Mus musculus
ctttgcaagagaaggcaatgtgccc

SEQ ID NO: 623765 - DNA, 25 bp, Mus musculus
ctttgcaagagatggcaatgtgccc

SEQ ID NO: 623766 - DNA, 25 bp, Mus musculus
ctttgcaaggttatgtgcctatgaa

SEQ ID NO: 623767 - DNA, 25 bp, Mus musculus
ctttgcaaggttttgtgcctatgaa

SEQ ID NO: 623768 - DNA, 25 bp, Mus musculus
ctttgcacagaacaacgttactgag

SEQ ID NO: 623769 - DNA, 25 bp, Mus musculus
ctttgcacagaagaacgttactgag

SEQ ID NO: 623770 - DNA, 25 bp, Mus musculus
ctttgcacggccatgatggaggtcg

SEQ ID NO: 623771 - DNA, 25 bp, Mus musculus
ctttgcacggccttgatggaggtcg

SEQ ID NO: 623772 - DNA, 25 bp, Mus musculus
ctttgcagacctcatagtcttgaag

SEQ ID NO: 623773 - DNA, 25 bp, Mus musculus
ctttgcagacctgatagtcttgaag

SEQ ID NO: 623774 - DNA, 25 bp, Mus musculus
ctttgcagactcagttcaaggagaa

SEQ ID NO: 623775 - DNA, 25 bp, Mus musculus
ctttgcagactctgttcaaggagaa

SEQ ID NO: 623776 - DNA, 25 bp, Mus musculus
ctttgcagctgcagtgactacacct

SEQ ID NO: 623777 - DNA, 25 bp, Mus musculus
ctttgcagctgctgtgactacacct

SEQ ID NO: 623778 - DNA, 25 bp, Mus musculus
ctttgcagtccgctgacgtgattgt

SEQ ID NO: 623779 - DNA, 25 bp, Mus musculus
ctttgcagtccggtgacgtgattgt

SEQ ID NO: 623780 - DNA, 25 bp, Mus musculus
ctttgcatcacccagtgtggtgcca

SEQ ID NO: 623781 - DNA, 25 bp, Mus musculus
ctttgcatcaccgagtgtggtgcca

SEQ ID NO: 623782 - DNA, 25 bp, Mus musculus
ctttgcatcgagagctgggcctggt

SEQ ID NO: 623783 - DNA, 25 bp, Mus musculus
ctttgcatcgagtgctgggcctggt

SEQ ID NO: 623784 - DNA, 25 bp, Mus musculus
ctttgccaacatcgtgtggcaggat

SEQ ID NO: 623785 - DNA, 25 bp, Mus musculus
ctttgccaacatggtgtggcaggat

SEQ ID NO: 623786 - DNA, 25 bp, Mus musculus
ctttgcccagcgctactgtcagtgc

SEQ ID NO: 623787 - DNA, 25 bp, Mus musculus
ctttgcccagcggtactgtcagtgc

SEQ ID NO: 623788 - DNA, 25 bp, Mus musculus
ctttgcccagctcgaccgcattgtg

SEQ ID NO: 623789 - DNA, 25 bp, Mus musculus
ctttgcccagctggaccgcattgtg

SEQ ID NO: 623790 - DNA, 25 bp, Mus musculus
ctttgcccatttcgatgctaccact

SEQ ID NO: 623791 - DNA, 25 bp, Mus musculus
ctttgcccatttggatgctaccact

SEQ ID NO: 623792 - DNA, 25 bp, Mus musculus
ctttgcccctggcaagagcttccaa

SEQ ID NO: 623793 - DNA, 25 bp, Mus musculus
ctttgcccctgggaagagcttccaa

SEQ ID NO: 623794 - DNA, 25 bp, Mus musculus
ctttgccctcttcatcagcattgta

SEQ ID NO: 623795 - DNA, 25 bp, Mus musculus
ctttgccctcttgatcagcattgta

SEQ ID NO: 623796 - DNA, 25 bp, Mus musculus
ctttgcccttcacttaaacaggatg

SEQ ID NO: 623797 - DNA, 25 bp, Mus musculus
ctttgcccttcagttaaacaggatg

SEQ ID NO: 623798 - DNA, 25 bp, Mus musculus
ctttgccgaagtatctaaggatccc

SEQ ID NO: 623799 - DNA, 25 bp, Mus musculus
ctttgccgaagtttctaaggatccc

SEQ ID NO: 623800 - DNA, 25 bp, Mus musculus
ctttgccggactacggaggacagag

SEQ ID NO: 623801 - DNA, 25 bp, Mus musculus
ctttgccggacttcggaggacagag

SEQ ID NO: 623802 - DNA, 25 bp, Mus musculus
ctttgccggcttctgttccagatcc

SEQ ID NO: 623803 - DNA, 25 bp, Mus musculus
ctttgccggcttgtgttccagatcc

SEQ ID NO: 623804 - DNA, 25 bp, Mus musculus
ctttgccgttgtcatctatttccag

SEQ ID NO: 623805 - DNA, 25 bp, Mus musculus
ctttgccgttgtgatctatttccag

SEQ ID NO: 623806 - DNA, 25 bp, Mus musculus
ctttgcctcaacagggctatggaac

SEQ ID NO: 623807 - DNA, 25 bp, Mus musculus
ctttgcctcaactgggctatggaac

SEQ ID NO: 623808 - DNA, 25 bp, Mus musculus
ctttgcctgcacaattgtggatatc

SEQ ID NO: 623809 - DNA, 25 bp, Mus musculus
ctttgcctgcactattgtggatatc

SEQ ID NO: 623810 - DNA, 25 bp, Mus musculus
ctttgcctgctccaacaggatcgga

SEQ ID NO: 623811 - DNA, 25 bp, Mus musculus
ctttgcctgctcgaacaggatcgga

SEQ ID NO: 623812 - DNA, 25 bp, Mus musculus
ctttgcctggccataccaagcagga

SEQ ID NO: 623813 - DNA, 25 bp, Mus musculus
ctttgcctggcccaagattctcaag

SEQ ID NO: 623814 - DNA, 25 bp, Mus musculus
ctttgcctggccgaagattctcaag

SEQ ID NO: 623815 - DNA, 25 bp, Mus musculus
ctttgcctggccttaccaagcagga

SEQ ID NO: 623816 - DNA, 25 bp, Mus musculus
ctttgcgaggagctggtaagaacct

SEQ ID NO: 623817 - DNA, 25 bp, Mus musculus
ctttgcgaggaggtggtaagaacct

SEQ ID NO: 623818 - DNA, 25 bp, Mus musculus
ctttgcggacgacgtgcttggttct

SEQ ID NO: 623819 - DNA, 25 bp, Mus musculus
ctttgcggacgaggtgcttggttct

SEQ ID NO: 623820 - DNA, 25 bp, Mus musculus
ctttgcggcagacccacagtcagca

SEQ ID NO: 623821 - DNA, 25 bp, Mus musculus
ctttgcggcagagccacagtcagca

SEQ ID NO: 623822 - DNA, 25 bp, Mus musculus
ctttgcggctgtcactcacagtcag

SEQ ID NO: 623823 - DNA, 25 bp, Mus musculus
ctttgcggctgtgactcacagtcag

SEQ ID NO: 623824 - DNA, 25 bp, Mus musculus
ctttgcggtgctcgtatttagagcg

SEQ ID NO: 623825 - DNA, 25 bp, Mus musculus
ctttgcggtgctggtatttagagcg

SEQ ID NO: 623826 - DNA, 25 bp, Mus musculus
ctttgcgtgtggctggagacacttc

SEQ ID NO: 623827 - DNA, 25 bp, Mus musculus
ctttgcgtgtgggtggagacacttc

SEQ ID NO: 623828 - DNA, 25 bp, Mus musculus
ctttgcgttgcgcatcgccagccgt

SEQ ID NO: 623829 - DNA, 25 bp, Mus musculus
ctttgcgttgcggatcgccagccgt

SEQ ID NO: 623830 - DNA, 25 bp, Mus musculus
ctttgctcagacctgaacgagtgca

SEQ ID NO: 623831 - DNA, 25 bp, Mus musculus
ctttgctcagacgtgaacgagtgca

SEQ ID NO: 623832 - DNA, 25 bp, Mus musculus
ctttgctcagagacaagtgctccca

SEQ ID NO: 623833 - DNA, 25 bp, Mus musculus
ctttgctcagagtcaagtgctccca

SEQ ID NO: 623834 - DNA, 25 bp, Mus musculus
ctttgctccgctccttggattacag

SEQ ID NO: 623835 - DNA, 25 bp, Mus musculus
ctttgctccgctgcttggattacag

SEQ ID NO: 623836 - DNA, 25 bp, Mus musculus
ctttgctctgctctgcctcatggat

SEQ ID NO: 623837 - DNA, 25 bp, Mus musculus
ctttgctctgctgtgcctcatggat

SEQ ID NO: 623838 - DNA, 25 bp, Mus musculus
ctttgctgatcaacattcttcatag

SEQ ID NO: 623839 - DNA, 25 bp, Mus musculus
ctttgctgatcatcattcttcatag

SEQ ID NO: 623840 - DNA, 25 bp, Mus musculus
ctttgctgcctactggttgcctggc

SEQ ID NO: 623841 - DNA, 25 bp, Mus musculus
ctttgctgcctagtggttgcctggc

SEQ ID NO: 623842 - DNA, 25 bp, Mus musculus
ctttgctggaatagctgttggtgca

SEQ ID NO: 623843 - DNA, 25 bp, Mus musculus
ctttgctggaattgctgttggtgca

SEQ ID NO: 623844 - DNA, 25 bp, Mus musculus
ctttgctggagtaagtttctgctag

SEQ ID NO: 623845 - DNA, 25 bp, Mus musculus
ctttgctggagttagtttctgctag

SEQ ID NO: 623846 - DNA, 25 bp, Mus musculus
ctttgctggttaagatggcaatgcc

SEQ ID NO: 623847 - DNA, 25 bp, Mus musculus
ctttgctggttatgatggcaatgcc

SEQ ID NO: 623848 - DNA, 25 bp, Mus musculus
ctttgctgtaggacaggactttttc

SEQ ID NO: 623849 - DNA, 25 bp, Mus musculus
ctttgctgtaggtcaggactttttc

SEQ ID NO: 623850 - DNA, 25 bp, Mus musculus
ctttgctgtgaaccagagccgccag

SEQ ID NO: 623851 - DNA, 25 bp, Mus musculus
ctttgctgtgaagcagagccgccag

SEQ ID NO: 623852 - DNA, 25 bp, Mus musculus
ctttgcttgataactccttggagtc

SEQ ID NO: 623853 - DNA, 25 bp, Mus musculus
ctttgcttgatatctccttggagtc

SEQ ID NO: 623854 - DNA, 25 bp, Mus musculus
ctttgctttggtcagcgataagctg

SEQ ID NO: 623855 - DNA, 25 bp, Mus musculus
ctttgctttggtgagcgataagctg

SEQ ID NO: 623856 - DNA, 25 bp, Mus musculus
ctttggaaaagcaggacggaactga

SEQ ID NO: 623857 - DNA, 25 bp, Mus musculus
ctttggaaaagctggacggaactga

SEQ ID NO: 623858 - DNA, 25 bp, Mus musculus
ctttggaagatgatggtcccagggc

SEQ ID NO: 623859 - DNA, 25 bp, Mus musculus
ctttggaagatgttggtcccagggc

SEQ ID NO: 623860 - DNA, 25 bp, Mus musculus
ctttggaccattcgttctgccttcc

SEQ ID NO: 623861 - DNA, 25 bp, Mus musculus
ctttggaccattggttctgccttcc

SEQ ID NO: 623862 - DNA, 25 bp, Mus musculus
ctttggacgctaaggcagacctcaa

SEQ ID NO: 623863 - DNA, 25 bp, Mus musculus
ctttggacgctatggcagacctcaa

SEQ ID NO: 623864 - DNA, 25 bp, Mus musculus
ctttggagaagaatggcctgatgtc

SEQ ID NO: 623865 - DNA, 25 bp, Mus musculus
ctttggagaagattggcctgatgtc

SEQ ID NO: 623866 - DNA, 25 bp, Mus musculus
ctttggagcagaagctcagggcgcc

SEQ ID NO: 623867 - DNA, 25 bp, Mus musculus
ctttggagcagatgctcagggcgcc

SEQ ID NO: 623868 - DNA, 25 bp, Mus musculus
ctttggaggaccaagcactggaggt

SEQ ID NO: 623869 - DNA, 25 bp, Mus musculus
ctttggaggacctagcactggaggt

SEQ ID NO: 623870 - DNA, 25 bp, Mus musculus
ctttggaggagactacaatgagctg

SEQ ID NO: 623871 - DNA, 25 bp, Mus musculus
ctttggaggagagtacaatgagctg

SEQ ID NO: 623872 - DNA, 25 bp, Mus musculus
ctttggagggacatttgacctcgtc

SEQ ID NO: 623873 - DNA, 25 bp, Mus musculus
ctttggagggacttttgacctcgtc

SEQ ID NO: 623874 - DNA, 25 bp, Mus musculus
ctttggagtacaccttcaagtgaag

SEQ ID NO: 623875 - DNA, 25 bp, Mus musculus
ctttggagtacagcttcaagtgaag

SEQ ID NO: 623876 - DNA, 25 bp, Mus musculus
ctttggagtcagattacatcgtgga

SEQ ID NO: 623877 - DNA, 25 bp, Mus musculus
ctttggagtcagtttacatcgtgga

SEQ ID NO: 623878 - DNA, 25 bp, Mus musculus
ctttggagtcgcaggtcaacttaca

SEQ ID NO: 623879 - DNA, 25 bp, Mus musculus
ctttggagtcgctggtcaacttaca

SEQ ID NO: 623880 - DNA, 25 bp, Mus musculus
ctttggatacctagtgctgctgtcc

SEQ ID NO: 623881 - DNA, 25 bp, Mus musculus
ctttggataccttgtgctgctgtcc

SEQ ID NO: 623882 - DNA, 25 bp, Mus musculus
ctttggatcgcaatggcaaggtcat

SEQ ID NO: 623883 - DNA, 25 bp, Mus musculus
ctttggatcgcattggcaaggtcat

SEQ ID NO: 623884 - DNA, 25 bp, Mus musculus
ctttggatgaccatacttggatgga

SEQ ID NO: 623885 - DNA, 25 bp, Mus musculus
ctttggatgaccttacttggatgga

SEQ ID NO: 623886 - DNA, 25 bp, Mus musculus
ctttggatgccaatgagaaagccca

SEQ ID NO: 623887 - DNA, 25 bp, Mus musculus
ctttggatgccactgtgagttgtca

SEQ ID NO: 623888 - DNA, 25 bp, Mus musculus
ctttggatgccagtgtgagttgtca

SEQ ID NO: 623889 - DNA, 25 bp, Mus musculus
ctttggatgccattgagaaagccca

SEQ ID NO: 623890 - DNA, 25 bp, Mus musculus
ctttggattcaacgcagtcgcggag

SEQ ID NO: 623891 - DNA, 25 bp, Mus musculus
ctttggattcaaggcagtcgcggag

SEQ ID NO: 623892 - DNA, 25 bp, Mus musculus
ctttggattctgcagagcacttttg

SEQ ID NO: 623893 - DNA, 25 bp, Mus musculus
ctttggattctggagagcacttttg

SEQ ID NO: 623894 - DNA, 25 bp, Mus musculus
ctttggcaatacaaccatcgtggtg

SEQ ID NO: 623895 - DNA, 25 bp, Mus musculus
ctttggcaatactaccatcgtggtg

SEQ ID NO: 623896 - DNA, 25 bp, Mus musculus
ctttggcaccacactgatcatgctg

SEQ ID NO: 623897 - DNA, 25 bp, Mus musculus
ctttggcaccactctgatcatgctg

SEQ ID NO: 623898 - DNA, 25 bp, Mus musculus
ctttggcagcctccccattggagca

SEQ ID NO: 623899 - DNA, 25 bp, Mus musculus
ctttggcagcctgcccattggagca

SEQ ID NO: 623900 - DNA, 25 bp, Mus musculus
ctttggcatttaatggtacagatgg

SEQ ID NO: 623901 - DNA, 25 bp, Mus musculus
ctttggcatttattggtacagatgg

SEQ ID NO: 623902 - DNA, 25 bp, Mus musculus
ctttggccaaggcattagctgcttg

SEQ ID NO: 623903 - DNA, 25 bp, Mus musculus
ctttggccaagggattagctgcttg

SEQ ID NO: 623904 - DNA, 25 bp, Mus musculus
ctttggcccttgcttcctcacctgc

SEQ ID NO: 623905 - DNA, 25 bp, Mus musculus
ctttggcccttggttcctcacctgc

SEQ ID NO: 623906 - DNA, 25 bp, Mus musculus
ctttggccgggtcatctctacttgg

SEQ ID NO: 623907 - DNA, 25 bp, Mus musculus
ctttggccgggtgatctctacttgg

SEQ ID NO: 623908 - DNA, 25 bp, Mus musculus
ctttggcctggcacgagatgtgcac

SEQ ID NO: 623909 - DNA, 25 bp, Mus musculus
ctttggcctggctcgagatgtgcac

SEQ ID NO: 623910 - DNA, 25 bp, Mus musculus
ctttggcctggtcgactcagagaag

SEQ ID NO: 623911 - DNA, 25 bp, Mus musculus
ctttggcctggtggactcagagaag

SEQ ID NO: 623912 - DNA, 25 bp, Mus musculus
ctttggccttgccaggcaggcagac

SEQ ID NO: 623913 - DNA, 25 bp, Mus musculus
ctttggccttgcgaggcaggcagac

SEQ ID NO: 623914 - DNA, 25 bp, Mus musculus
ctttggcggtatatcagcttattga

SEQ ID NO: 623915 - DNA, 25 bp, Mus musculus
ctttggcggtatttcagcttattga

SEQ ID NO: 623916 - DNA, 25 bp, Mus musculus
ctttggctccaacgtcctgtctcgg

SEQ ID NO: 623917 - DNA, 25 bp, Mus musculus
ctttggctccaaggtcctgtctcgg

SEQ ID NO: 623918 - DNA, 25 bp, Mus musculus
ctttggctgattcgactctgaggga

SEQ ID NO: 623919 - DNA, 25 bp, Mus musculus
ctttggctgattggactctgaggga

SEQ ID NO: 623920 - DNA, 25 bp, Mus musculus
ctttggctgcatcccttgtggtctt

SEQ ID NO: 623921 - DNA, 25 bp, Mus musculus
ctttggctgcatgccttgtggtctt

SEQ ID NO: 623922 - DNA, 25 bp, Mus musculus
ctttggctggcaaccaatggtggtc

SEQ ID NO: 623923 - DNA, 25 bp, Mus musculus
ctttggctggcatccaatggtggtc

SEQ ID NO: 623924 - DNA, 25 bp, Mus musculus
ctttggctgtttaatcatcacgggt

SEQ ID NO: 623925 - DNA, 25 bp, Mus musculus
ctttggctgttttatcatcacgggt

SEQ ID NO: 623926 - DNA, 25 bp, Mus musculus
ctttggcttctcatgatgatgggct

SEQ ID NO: 623927 - DNA, 25 bp, Mus musculus
ctttggcttctcttgatgatgggct

SEQ ID NO: 623928 - DNA, 25 bp, Mus musculus
ctttggcttgcgaaccttcagcaga

SEQ ID NO: 623929 - DNA, 25 bp, Mus musculus
ctttggcttgcgtaccttcagcaga

SEQ ID NO: 623930 - DNA, 25 bp, Mus musculus
ctttggctttatacctgagatcatc

SEQ ID NO: 623931 - DNA, 25 bp, Mus musculus
ctttggctttattcctgagatcatc

SEQ ID NO: 623932 - DNA, 25 bp, Mus musculus
ctttgggaaatgcagcactgatgac

SEQ ID NO: 623933 - DNA, 25 bp, Mus musculus
ctttgggaaatggagcactgatgac

SEQ ID NO: 623934 - DNA, 25 bp, Mus musculus
ctttgggaacaaccatagctgttgg

SEQ ID NO: 623935 - DNA, 25 bp, Mus musculus
ctttgggaacaagcatagctgttgg

SEQ ID NO: 623936 - DNA, 25 bp, Mus musculus
ctttgggagaagcaatcataactga

SEQ ID NO: 623937 - DNA, 25 bp, Mus musculus
ctttgggagaaggaatcataactga

SEQ ID NO: 623938 - DNA, 25 bp, Mus musculus
ctttgggatatacagatgagtccca

SEQ ID NO: 623939 - DNA, 25 bp, Mus musculus
ctttgggatatagagatgagtccca

SEQ ID NO: 623940 - DNA, 25 bp, Mus musculus
ctttgggcagtacaaagccttctaa

SEQ ID NO: 623941 - DNA, 25 bp, Mus musculus
ctttgggcagtagaaagccttctaa

SEQ ID NO: 623942 - DNA, 25 bp, Mus musculus
ctttgggcccacagtgggagcagca

SEQ ID NO: 623943 - DNA, 25 bp, Mus musculus
ctttgggcccactgtgggagcagca

SEQ ID NO: 623944 - DNA, 25 bp, Mus musculus
ctttgggcgaccagctatgaaggca

SEQ ID NO: 623945 - DNA, 25 bp, Mus musculus
ctttgggcgacctgctatgaaggca

SEQ ID NO: 623946 - DNA, 25 bp, Mus musculus
ctttgggctggcacgtggtgtccac

SEQ ID NO: 623947 - DNA, 25 bp, Mus musculus
ctttgggctggctcgtggtgtccac

SEQ ID NO: 623948 - DNA, 25 bp, Mus musculus
ctttgggtcaggaaagtagttgtgc

SEQ ID NO: 623949 - DNA, 25 bp, Mus musculus
ctttgggtcaggtaagtagttgtgc

SEQ ID NO: 623950 - DNA, 25 bp, Mus musculus
ctttggtacccacaagagagcttga

SEQ ID NO: 623951 - DNA, 25 bp, Mus musculus
ctttggtacccagaagagagcttga

SEQ ID NO: 623952 - DNA, 25 bp, Mus musculus
ctttggtccattctacaggccaaga

SEQ ID NO: 623953 - DNA, 25 bp, Mus musculus
ctttggtccattgtacaggccaaga

SEQ ID NO: 623954 - DNA, 25 bp, Mus musculus
ctttggtcgggcagtgtctctgcat

SEQ ID NO: 623955 - DNA, 25 bp, Mus musculus
ctttggtcgggctgtgtctctgcat

SEQ ID NO: 623956 - DNA, 25 bp, Mus musculus
ctttggtctgtaaagattccattgg

SEQ ID NO: 623957 - DNA, 25 bp, Mus musculus
ctttggtctgtatagattccattgg

SEQ ID NO: 623958 - DNA, 25 bp, Mus musculus
ctttggtgagtacctgcctgtttcc

SEQ ID NO: 623959 - DNA, 25 bp, Mus musculus
ctttggtgagtagctgcctgtttcc

SEQ ID NO: 623960 - DNA, 25 bp, Mus musculus
ctttggtgatccaccaggacctaag

SEQ ID NO: 623961 - DNA, 25 bp, Mus musculus
ctttggtgatcctccaggacctaag

SEQ ID NO: 623962 - DNA, 25 bp, Mus musculus
ctttggtgccttcgtggcctcttta

SEQ ID NO: 623963 - DNA, 25 bp, Mus musculus
ctttggtgccttggtggcctcttta

SEQ ID NO: 623964 - DNA, 25 bp, Mus musculus
ctttggtgctgtagcctactagggc

SEQ ID NO: 623965 - DNA, 25 bp, Mus musculus
ctttggtgctgttgcctactagggc

SEQ ID NO: 623966 - DNA, 25 bp, Mus musculus
ctttggtggccccaaaggacatgac

SEQ ID NO: 623967 - DNA, 25 bp, Mus musculus
ctttggtggcccgaaaggacatgac

SEQ ID NO: 623968 - DNA, 25 bp, Mus musculus
ctttggtgtgcaactttctgtacct

SEQ ID NO: 623969 - DNA, 25 bp, Mus musculus
ctttggtgtgcatctttctgtacct

SEQ ID NO: 623970 - DNA, 25 bp, Mus musculus
ctttggttgtgaaggccagtggcct

SEQ ID NO: 623971 - DNA, 25 bp, Mus musculus
ctttggttgtgatggccagtggcct

SEQ ID NO: 623972 - DNA, 25 bp, Mus musculus
ctttggtttgttagtgagcttagtt

SEQ ID NO: 623973 - DNA, 25 bp, Mus musculus
ctttggtttgtttgtgagcttagtt

SEQ ID NO: 623974 - DNA, 25 bp, Mus musculus
ctttgtaaaaatactcatcgtggag

SEQ ID NO: 623975 - DNA, 25 bp, Mus musculus
ctttgtaaaaattctcatcgtggag

SEQ ID NO: 623976 - DNA, 25 bp, Mus musculus
ctttgtaaccttatctggaatccgg

SEQ ID NO: 623977 - DNA, 25 bp, Mus musculus
ctttgtaaccttttctggaatccgg

SEQ ID NO: 623978 - DNA, 25 bp, Mus musculus
ctttgtaagcaacagggaatcattt

SEQ ID NO: 623979 - DNA, 25 bp, Mus musculus
ctttgtaagcaagagggaatcattt

SEQ ID NO: 623980 - DNA, 25 bp, Mus musculus
ctttgtacagctcgatctagacttt

SEQ ID NO: 623981 - DNA, 25 bp, Mus musculus
ctttgtacagctggatctagacttt

SEQ ID NO: 623982 - DNA, 25 bp, Mus musculus
ctttgtactgtcctgctttgagaac

SEQ ID NO: 623983 - DNA, 25 bp, Mus musculus
ctttgtactgtcgtgctttgagaac

SEQ ID NO: 623984 - DNA, 25 bp, Mus musculus
ctttgtacttgcaccagaacgacat

SEQ ID NO: 623985 - DNA, 25 bp, Mus musculus
ctttgtacttgctccagaacgacat

SEQ ID NO: 623986 - DNA, 25 bp, Mus musculus
ctttgtatgtaactcggtggtcggc

SEQ ID NO: 623987 - DNA, 25 bp, Mus musculus
ctttgtatgtaagtcggtggtcggc

SEQ ID NO: 623988 - DNA, 25 bp, Mus musculus
ctttgtatttccaggacatgtttgg

SEQ ID NO: 623989 - DNA, 25 bp, Mus musculus
ctttgtatttcctggacatgtttgg

SEQ ID NO: 623990 - DNA, 25 bp, Mus musculus
ctttgtcaacctctcaacaaacctg

SEQ ID NO: 623991 - DNA, 25 bp, Mus musculus
ctttgtcaacctgtcaacaaacctg

SEQ ID NO: 623992 - DNA, 25 bp, Mus musculus
ctttgtccctgaatacacccaggag

SEQ ID NO: 623993 - DNA, 25 bp, Mus musculus
ctttgtccctgattacacccaggag

SEQ ID NO: 623994 - DNA, 25 bp, Mus musculus
ctttgtcctggactgtcctttttgg

SEQ ID NO: 623995 - DNA, 25 bp, Mus musculus
ctttgtcctggagtgtcctttttgg

SEQ ID NO: 623996 - DNA, 25 bp, Mus musculus
ctttgtcgaagcaagaggaccggca

SEQ ID NO: 623997 - DNA, 25 bp, Mus musculus
ctttgtcgaagctagaggaccggca

SEQ ID NO: 623998 - DNA, 25 bp, Mus musculus
ctttgtcggatgaagcatacagatc

SEQ ID NO: 623999 - DNA, 25 bp, Mus musculus
ctttgtcggatgtagcatacagatc

SEQ ID NO: 624000 - DNA, 25 bp, Mus musculus
ctttgtctagaaagaatcgcaccgc

SEQ ID NO: 624001 - DNA, 25 bp, Mus musculus
ctttgtctagaatgaatcgcaccgc

SEQ ID NO: 624002 - DNA, 25 bp, Mus musculus
ctttgtctcttgctcatttctccct

SEQ ID NO: 624003 - DNA, 25 bp, Mus musculus
ctttgtctcttggtcatttctccct

SEQ ID NO: 624004 - DNA, 25 bp, Mus musculus
ctttgtgacagtcgcttacacctca

SEQ ID NO: 624005 - DNA, 25 bp, Mus musculus
ctttgtgacagtggcttacacctca

SEQ ID NO: 624006 - DNA, 25 bp, Mus musculus
ctttgtgatcagcatccaggatgga

SEQ ID NO: 624007 - DNA, 25 bp, Mus musculus
ctttgtgatcaggatccaggatgga

SEQ ID NO: 624008 - DNA, 25 bp, Mus musculus
ctttgtgcagctcataaaactccaa

SEQ ID NO: 624009 - DNA, 25 bp, Mus musculus
ctttgtgcagctgataaaactccaa

SEQ ID NO: 624010 - DNA, 25 bp, Mus musculus
ctttgtgccagacaaatatgcttgc

SEQ ID NO: 624011 - DNA, 25 bp, Mus musculus
ctttgtgccagagaaatatgcttgc

SEQ ID NO: 624012 - DNA, 25 bp, Mus musculus
ctttgtgcccacctgggatttgtcg

SEQ ID NO: 624013 - DNA, 25 bp, Mus musculus
ctttgtgcccacgtgggatttgtcg

SEQ ID NO: 624014 - DNA, 25 bp, Mus musculus
ctttgtgccccgagttaatgagaag

SEQ ID NO: 624015 - DNA, 25 bp, Mus musculus
ctttgtgccccgtgttaatgagaag

SEQ ID NO: 624016 - DNA, 25 bp, Mus musculus
ctttgtgccctcagcaacctccaag

SEQ ID NO: 624017 - DNA, 25 bp, Mus musculus
ctttgtgccctctgcaacctccaag

SEQ ID NO: 624018 - DNA, 25 bp, Mus musculus
ctttgtgctaaacgagaatgaaact

SEQ ID NO: 624019 - DNA, 25 bp, Mus musculus
ctttgtgctaaaggagaatgaaact

SEQ ID NO: 624020 - DNA, 25 bp, Mus musculus
ctttgtgcttgactatgtcaacggg

SEQ ID NO: 624021 - DNA, 25 bp, Mus musculus
ctttgtgcttgagtatgtcaacggg

SEQ ID NO: 624022 - DNA, 25 bp, Mus musculus
ctttgtggacgactatgatcccact

SEQ ID NO: 624023 - DNA, 25 bp, Mus musculus
ctttgtggacgagtatgatcccact

SEQ ID NO: 624024 - DNA, 25 bp, Mus musculus
ctttgtggcaaaaatatatgtaggc

SEQ ID NO: 624025 - DNA, 25 bp, Mus musculus
ctttgtggcaaatatatatgtaggc

SEQ ID NO: 624026 - DNA, 25 bp, Mus musculus
ctttgtggcctcaagctagaagtca

SEQ ID NO: 624027 - DNA, 25 bp, Mus musculus
ctttgtggcctctagctagaagtca

SEQ ID NO: 624028 - DNA, 25 bp, Mus musculus
ctttgtggctctccctgcggtcata

SEQ ID NO: 624029 - DNA, 25 bp, Mus musculus
ctttgtggctctgcctgcggtcata

SEQ ID NO: 624030 - DNA, 25 bp, Mus musculus
ctttgtgggataaacccaactgttg

SEQ ID NO: 624031 - DNA, 25 bp, Mus musculus
ctttgtgggatatacccaactgttg

SEQ ID NO: 624032 - DNA, 25 bp, Mus musculus
ctttgtgggccaacgatgccaggac

SEQ ID NO: 624033 - DNA, 25 bp, Mus musculus
ctttgtgggccatcgatgccaggac

SEQ ID NO: 624034 - DNA, 25 bp, Mus musculus
ctttgtgggctacaacagcaccggc

SEQ ID NO: 624035 - DNA, 25 bp, Mus musculus
ctttgtgggctagaacagcaccggc

SEQ ID NO: 624036 - DNA, 25 bp, Mus musculus
ctttgtgggctcaggactgttggcc

SEQ ID NO: 624037 - DNA, 25 bp, Mus musculus
ctttgtgggctctggactgttggcc

SEQ ID NO: 624038 - DNA, 25 bp, Mus musculus
ctttgtggtgccaaacccaaagcag

SEQ ID NO: 624039 - DNA, 25 bp, Mus musculus
ctttgtggtgcctaacccaaagcag

SEQ ID NO: 624040 - DNA, 25 bp, Mus musculus
ctttgtggtggtcaggcgtccctac

SEQ ID NO: 624041 - DNA, 25 bp, Mus musculus
ctttgtggtggtgaggcgtccctac

SEQ ID NO: 624042 - DNA, 25 bp, Mus musculus
ctttgtggtgttagtgcatcagaca

SEQ ID NO: 624043 - DNA, 25 bp, Mus musculus
ctttgtggtgtttgtgcatcagaca

SEQ ID NO: 624044 - DNA, 25 bp, Mus musculus
ctttgtgtcagcctgcagtccataa

SEQ ID NO: 624045 - DNA, 25 bp, Mus musculus
ctttgtgtcagcgtgcagtccataa

SEQ ID NO: 624046 - DNA, 25 bp, Mus musculus
ctttgttacagactctccgtgaatc

SEQ ID NO: 624047 - DNA, 25 bp, Mus musculus
ctttgttacagagtctccgtgaatc

SEQ ID NO: 624048 - DNA, 25 bp, Mus musculus
ctttgttcaattatacaccagggca

SEQ ID NO: 624049 - DNA, 25 bp, Mus musculus
ctttgttcaattttacaccagggca

SEQ ID NO: 624050 - DNA, 25 bp, Mus musculus
ctttgttcagtgctgtgcgctcagg

SEQ ID NO: 624051 - DNA, 25 bp, Mus musculus
ctttgttcagtggtgtgcgctcagg

SEQ ID NO: 624052 - DNA, 25 bp, Mus musculus
ctttgttctacacgcagatccagca

SEQ ID NO: 624053 - DNA, 25 bp, Mus musculus
ctttgttctacaggcagatccagca

SEQ ID NO: 624054 - DNA, 25 bp, Mus musculus
ctttgttctgacctgctcgggctca

SEQ ID NO: 624055 - DNA, 25 bp, Mus musculus
ctttgttctgacgtgctcgggctca

SEQ ID NO: 624056 - DNA, 25 bp, Mus musculus
ctttgttctggtagccttctctcag

SEQ ID NO: 624057 - DNA, 25 bp, Mus musculus
ctttgttctggttgccttctctcag

SEQ ID NO: 624058 - DNA, 25 bp, Mus musculus
ctttgttgctggcttaattgtccta

SEQ ID NO: 624059 - DNA, 25 bp, Mus musculus
ctttgttgctgggttaattgtccta

SEQ ID NO: 624060 - DNA, 25 bp, Mus musculus
ctttgttgtcccaggaaagatctat

SEQ ID NO: 624061 - DNA, 25 bp, Mus musculus
ctttgttgtccctggaaagatctat

SEQ ID NO: 624062 - DNA, 25 bp, Mus musculus
ctttgttgtggtaggagttaatgac

SEQ ID NO: 624063 - DNA, 25 bp, Mus musculus
ctttgttgtggttggagttaatgac

SEQ ID NO: 624064 - DNA, 25 bp, Mus musculus
cttttaacacaacggagcccgtgat

SEQ ID NO: 624065 - DNA, 25 bp, Mus musculus
cttttaacacaagggagcccgtgat

SEQ ID NO: 624066 - DNA, 25 bp, Mus musculus
cttttaaccatgaggaggcccaggt

SEQ ID NO: 624067 - DNA, 25 bp, Mus musculus
cttttaaccatgtggaggcccaggt

SEQ ID NO: 624068 - DNA, 25 bp, Mus musculus
cttttaagacgcctagggaaggctg

SEQ ID NO: 624069 - DNA, 25 bp, Mus musculus
cttttaagacgcgtagggaaggctg

SEQ ID NO: 624070 - DNA, 25 bp, Mus musculus
cttttaatagcaagggcaaggtctg

SEQ ID NO: 624071 - DNA, 25 bp, Mus musculus
cttttaatagcatgggcaaggtctg

SEQ ID NO: 624072 - DNA, 25 bp, Mus musculus
cttttaatgcttctctagtacagag

SEQ ID NO: 624073 - DNA, 25 bp, Mus musculus
cttttaatgcttgtctagtacagag

SEQ ID NO: 624074 - DNA, 25 bp, Mus musculus
cttttaatgggcaggaccgagacca

SEQ ID NO: 624075 - DNA, 25 bp, Mus musculus
cttttaatgggctggaccgagacca

SEQ ID NO: 624076 - DNA, 25 bp, Mus musculus
cttttacaaaacacgttaatgcaga

SEQ ID NO: 624077 - DNA, 25 bp, Mus musculus
cttttacaaaactcgttaatgcaga

SEQ ID NO: 624078 - DNA, 25 bp, Mus musculus
cttttacccaagagcagattgaggc

SEQ ID NO: 624079 - DNA, 25 bp, Mus musculus
cttttacccaagtgcagattgaggc

SEQ ID NO: 624080 - DNA, 25 bp, Mus musculus
cttttaccccaaaggtcttcagctt

SEQ ID NO: 624081 - DNA, 25 bp, Mus musculus
cttttaccccaatggtcttcagctt

SEQ ID NO: 624082 - DNA, 25 bp, Mus musculus
cttttactgagaagagtgtgggcaa

SEQ ID NO: 624083 - DNA, 25 bp, Mus musculus
cttttactgagatgagtgtgggcaa

SEQ ID NO: 624084 - DNA, 25 bp, Mus musculus
cttttagatctgagcattctagcca

SEQ ID NO: 624085 - DNA, 25 bp, Mus musculus
cttttagatctgtgcattctagcca

SEQ ID NO: 624086 - DNA, 25 bp, Mus musculus
cttttaggaaagacatacttgaagc

SEQ ID NO: 624087 - DNA, 25 bp, Mus musculus
cttttaggaaagtcatacttgaagc

SEQ ID NO: 624088 - DNA, 25 bp, Mus musculus
cttttaggaccaacagacgtatgca

SEQ ID NO: 624089 - DNA, 25 bp, Mus musculus
cttttaggaccatcagacgtatgca

SEQ ID NO: 624090 - DNA, 25 bp, Mus musculus
cttttagggaaacacagcagtgacc

SEQ ID NO: 624091 - DNA, 25 bp, Mus musculus
cttttagggaaagacagcagtgacc

SEQ ID NO: 624092 - DNA, 25 bp, Mus musculus
cttttataccaacctgcacagagca

SEQ ID NO: 624093 - DNA, 25 bp, Mus musculus
cttttataccaagctgcacagagca

SEQ ID NO: 624094 - DNA, 25 bp, Mus musculus
cttttcaagctgatgaaagagggcc

SEQ ID NO: 624095 - DNA, 25 bp, Mus musculus
cttttcaagctgttgaaagagggcc

SEQ ID NO: 624096 - DNA, 25 bp, Mus musculus
cttttcaagtatagtggtctgctac

SEQ ID NO: 624097 - DNA, 25 bp, Mus musculus
cttttcaagtattgtggtctgctac

SEQ ID NO: 624098 - DNA, 25 bp, Mus musculus
cttttcaccaagcaactagtgctgc

SEQ ID NO: 624099 - DNA, 25 bp, Mus musculus
cttttcaccaaggaactagtgctgc

SEQ ID NO: 624100 - DNA, 25 bp, Mus musculus
cttttcaggctcagaactaggaggg

SEQ ID NO: 624101 - DNA, 25 bp, Mus musculus
cttttcaggctctgaactaggaggg

SEQ ID NO: 624102 - DNA, 25 bp, Mus musculus
cttttccaagacaataaaatcgccg

SEQ ID NO: 624103 - DNA, 25 bp, Mus musculus
cttttccaagactataaaatcgccg

SEQ ID NO: 624104 - DNA, 25 bp, Mus musculus
cttttccaccataagaacagaactc

SEQ ID NO: 624105 - DNA, 25 bp, Mus musculus
cttttccaccattagaacagaactc

SEQ ID NO: 624106 - DNA, 25 bp, Mus musculus
cttttccagacaaggattccaagtt

SEQ ID NO: 624107 - DNA, 25 bp, Mus musculus
cttttccagacatggattccaagtt

SEQ ID NO: 624108 - DNA, 25 bp, Mus musculus
cttttccagggcagaacagcagcag

SEQ ID NO: 624109 - DNA, 25 bp, Mus musculus
cttttccagggctgaacagcagcag

SEQ ID NO: 624110 - DNA, 25 bp, Mus musculus
cttttcctgaacatcgagcaggtta

SEQ ID NO: 624111 - DNA, 25 bp, Mus musculus
cttttcctgaacttcgagcaggtta

SEQ ID NO: 624112 - DNA, 25 bp, Mus musculus
cttttcctgggacctagcaggtgga

SEQ ID NO: 624113 - DNA, 25 bp, Mus musculus
cttttcctgggagctagcaggtgga

SEQ ID NO: 624114 - DNA, 25 bp, Mus musculus
cttttcgcaggtaattgtcatatct

SEQ ID NO: 624115 - DNA, 25 bp, Mus musculus
cttttcgcaggttattgtcatatct

SEQ ID NO: 624116 - DNA, 25 bp, Mus musculus
cttttcggctgccatccatgactat

SEQ ID NO: 624117 - DNA, 25 bp, Mus musculus
cttttcggctgcgatccatgactat

SEQ ID NO: 624118 - DNA, 25 bp, Mus musculus
cttttcggtggcagcggtcccggca

SEQ ID NO: 624119 - DNA, 25 bp, Mus musculus
cttttcggtggctgcggtcccggca

SEQ ID NO: 624120 - DNA, 25 bp, Mus musculus
cttttcggttctccagacccggcgg

SEQ ID NO: 624121 - DNA, 25 bp, Mus musculus
cttttcggttctgcagacccggcgg

SEQ ID NO: 624122 - DNA, 25 bp, Mus musculus
cttttcgtgaacactagggtgttgg

SEQ ID NO: 624123 - DNA, 25 bp, Mus musculus
cttttcgtgaactctagggtgttgg

SEQ ID NO: 624124 - DNA, 25 bp, Mus musculus
cttttctatggacctcctggctgtg

SEQ ID NO: 624125 - DNA, 25 bp, Mus musculus
cttttctatggagctcctggctgtg

SEQ ID NO: 624126 - DNA, 25 bp, Mus musculus
cttttctcaatgcagagtggtctgt

SEQ ID NO: 624127 - DNA, 25 bp, Mus musculus
cttttctcaatggagagtggtctgt

SEQ ID NO: 624128 - DNA, 25 bp, Mus musculus
cttttctccagccaatgtggatgct

SEQ ID NO: 624129 - DNA, 25 bp, Mus musculus
cttttctccagcgaatgtggatgct

SEQ ID NO: 624130 - DNA, 25 bp, Mus musculus
cttttctcctggatgttactaacag

SEQ ID NO: 624131 - DNA, 25 bp, Mus musculus
cttttctcctggttgttactaacag

SEQ ID NO: 624132 - DNA, 25 bp, Mus musculus
cttttcttaaagatgaggatcctca

SEQ ID NO: 624133 - DNA, 25 bp, Mus musculus
cttttcttaaagttgaggatcctca

SEQ ID NO: 624134 - DNA, 25 bp, Mus musculus
cttttgaacagccacttatgcgtgg

SEQ ID NO: 624135 - DNA, 25 bp, Mus musculus
cttttgaacagcgacttatgcgtgg

SEQ ID NO: 624136 - DNA, 25 bp, Mus musculus
cttttgaatgcacatgccatctcat

SEQ ID NO: 624137 - DNA, 25 bp, Mus musculus
cttttgaatgcagatgccatctcat

SEQ ID NO: 624138 - DNA, 25 bp, Mus musculus
cttttgacaaggaacagagccttcc

SEQ ID NO: 624139 - DNA, 25 bp, Mus musculus
cttttgacaaggtacagagccttcc

SEQ ID NO: 624140 - DNA, 25 bp, Mus musculus
cttttgacagtgattaccgagagca

SEQ ID NO: 624141 - DNA, 25 bp, Mus musculus
cttttgacagtgtttaccgagagca

SEQ ID NO: 624142 - DNA, 25 bp, Mus musculus
cttttgacttccaagagcactgggc

SEQ ID NO: 624143 - DNA, 25 bp, Mus musculus
cttttgacttcctagagcactgggc

SEQ ID NO: 624144 - DNA, 25 bp, Mus musculus
cttttgagcataagaagaagtctgg

SEQ ID NO: 624145 - DNA, 25 bp, Mus musculus
cttttgagcatatgaagaagtctgg

SEQ ID NO: 624146 - DNA, 25 bp, Mus musculus
cttttgagctcgcacaccaaggttc

SEQ ID NO: 624147 - DNA, 25 bp, Mus musculus
cttttgagctcggacaccaaggttc

SEQ ID NO: 624148 - DNA, 25 bp, Mus musculus
cttttgagtgccagtgtctacaggg

SEQ ID NO: 624149 - DNA, 25 bp, Mus musculus
cttttgagtgcctgtgtctacaggg

SEQ ID NO: 624150 - DNA, 25 bp, Mus musculus
cttttgataaatatggatgtagcca

SEQ ID NO: 624151 - DNA, 25 bp, Mus musculus
cttttgataaatttggatgtagcca

SEQ ID NO: 624152 - DNA, 25 bp, Mus musculus
cttttgccaccacagggagcacttc

SEQ ID NO: 624153 - DNA, 25 bp, Mus musculus
cttttgccaccagagggagcacttc

SEQ ID NO: 624154 - DNA, 25 bp, Mus musculus
cttttgcctgtacactggcttcctc

SEQ ID NO: 624155 - DNA, 25 bp, Mus musculus
cttttgcctgtagactggcttcctc

SEQ ID NO: 624156 - DNA, 25 bp, Mus musculus
cttttgctagagagcaaggctttga

SEQ ID NO: 624157 - DNA, 25 bp, Mus musculus
cttttgctagagtgcaaggctttga

SEQ ID NO: 624158 - DNA, 25 bp, Mus musculus
cttttgctcacaaggagggccccaa

SEQ ID NO: 624159 - DNA, 25 bp, Mus musculus
cttttgctcacatggagggccccaa

SEQ ID NO: 624160 - DNA, 25 bp, Mus musculus
cttttgctgggaagacggccaacaa

SEQ ID NO: 624161 - DNA, 25 bp, Mus musculus
cttttgctgggatgacggccaacaa

SEQ ID NO: 624162 - DNA, 25 bp, Mus musculus
cttttggaaatgcaggaaactccca

SEQ ID NO: 624163 - DNA, 25 bp, Mus musculus
cttttggaaatggaggaaactccca

SEQ ID NO: 624164 - DNA, 25 bp, Mus musculus
cttttggaacaaaatgtgagtcctg

SEQ ID NO: 624165 - DNA, 25 bp, Mus musculus
cttttggaacaatatgtgagtcctg

SEQ ID NO: 624166 - DNA, 25 bp, Mus musculus
cttttggaacagatacgagcttact

SEQ ID NO: 624167 - DNA, 25 bp, Mus musculus
cttttggaacagttacgagcttact

SEQ ID NO: 624168 - DNA, 25 bp, Mus musculus
cttttggactgcagaaggcccagca

SEQ ID NO: 624169 - DNA, 25 bp, Mus musculus
cttttggactgctgaaggcccagca

SEQ ID NO: 624170 - DNA, 25 bp, Mus musculus
cttttggacttgaatcagatggagg

SEQ ID NO: 624171 - DNA, 25 bp, Mus musculus
cttttggacttgtatcagatggagg

SEQ ID NO: 624172 - DNA, 25 bp, Mus musculus
cttttggagaaccttcgagtgagac

SEQ ID NO: 624173 - DNA, 25 bp, Mus musculus
cttttggagaacgttcgagtgagac

SEQ ID NO: 624174 - DNA, 25 bp, Mus musculus
cttttggaggcacctctacccgagg

SEQ ID NO: 624175 - DNA, 25 bp, Mus musculus
cttttggaggcagctctacccgagg

SEQ ID NO: 624176 - DNA, 25 bp, Mus musculus
cttttggcggatcctaaatctaaat

SEQ ID NO: 624177 - DNA, 25 bp, Mus musculus
cttttggcggatgctaaatctaaat

SEQ ID NO: 624178 - DNA, 25 bp, Mus musculus
cttttggcttggaagggattctccg

SEQ ID NO: 624179 - DNA, 25 bp, Mus musculus
cttttggcttggtagggattctccg

SEQ ID NO: 624180 - DNA, 25 bp, Mus musculus
cttttgggaccaccaatattaagga

SEQ ID NO: 624181 - DNA, 25 bp, Mus musculus
cttttgggaccagcaatattaagga

SEQ ID NO: 624182 - DNA, 25 bp, Mus musculus
cttttgggcttcaggtgagcactgg

SEQ ID NO: 624183 - DNA, 25 bp, Mus musculus
cttttgggcttctggtgagcactgg

SEQ ID NO: 624184 - DNA, 25 bp, Mus musculus
cttttgtcgaaacggcagcatttgt

SEQ ID NO: 624185 - DNA, 25 bp, Mus musculus
cttttgtcgaaagggcagcatttgt

SEQ ID NO: 624186 - DNA, 25 bp, Mus musculus
cttttgtctcctccagtcaagggtg

SEQ ID NO: 624187 - DNA, 25 bp, Mus musculus
cttttgtctcctgcagtcaagggtg

SEQ ID NO: 624188 - DNA, 25 bp, Mus musculus
cttttgtctctgaagaagtgcccca

SEQ ID NO: 624189 - DNA, 25 bp, Mus musculus
cttttgtctctgtagaagtgcccca

SEQ ID NO: 624190 - DNA, 25 bp, Mus musculus
cttttgtgaccaccgtaggctgggt

SEQ ID NO: 624191 - DNA, 25 bp, Mus musculus
cttttgtgaccagcgtaggctgggt

SEQ ID NO: 624192 - DNA, 25 bp, Mus musculus
cttttgtgagggaggaattcagctc

SEQ ID NO: 624193 - DNA, 25 bp, Mus musculus
cttttgtgagggtggaattcagctc

SEQ ID NO: 624194 - DNA, 25 bp, Mus musculus
cttttgtggatgcatagagacctcg

SEQ ID NO: 624195 - DNA, 25 bp, Mus musculus
cttttgtggatggatagagacctcg

SEQ ID NO: 624196 - DNA, 25 bp, Mus musculus
cttttgtggcccatactatgcacgg

SEQ ID NO: 624197 - DNA, 25 bp, Mus musculus
cttttgtggcccttactatgcacgg

SEQ ID NO: 624198 - DNA, 25 bp, Mus musculus
cttttgttcagtccaaagagacgga

SEQ ID NO: 624199 - DNA, 25 bp, Mus musculus
cttttgttcagtgcaaagagacgga

SEQ ID NO: 624200 - DNA, 25 bp, Mus musculus
cttttgttcatcagctgggacggag

SEQ ID NO: 624201 - DNA, 25 bp, Mus musculus
cttttgttcatctgctgggacggag

SEQ ID NO: 624202 - DNA, 25 bp, Mus musculus
ctttttaaatagcaggtgtctcggg

SEQ ID NO: 624203 - DNA, 25 bp, Mus musculus
ctttttaaataggaggtgtctcggg

SEQ ID NO: 624204 - DNA, 25 bp, Mus musculus
ctttttaagttacagacagtgcaca

SEQ ID NO: 624205 - DNA, 25 bp, Mus musculus
ctttttaagttagagacagtgcaca

SEQ ID NO: 624206 - DNA, 25 bp, Mus musculus
ctttttatgtccaggagtcctgcac

SEQ ID NO: 624207 - DNA, 25 bp, Mus musculus
ctttttatgtcctggagtcctgcac

SEQ ID NO: 624208 - DNA, 25 bp, Mus musculus
ctttttattctgcaagtctgatcga

SEQ ID NO: 624209 - DNA, 25 bp, Mus musculus
ctttttattctggaagtctgatcga

SEQ ID NO: 624210 - DNA, 25 bp, Mus musculus
ctttttcagctaacaagaattccat

SEQ ID NO: 624211 - DNA, 25 bp, Mus musculus
ctttttcagctatcaagaattccat

SEQ ID NO: 624212 - DNA, 25 bp, Mus musculus
ctttttccagaactggctaatagca

SEQ ID NO: 624213 - DNA, 25 bp, Mus musculus
ctttttccagaagtggctaatagca

SEQ ID NO: 624214 - DNA, 25 bp, Mus musculus
ctttttcgagagctggaggtacgcc

SEQ ID NO: 624215 - DNA, 25 bp, Mus musculus
ctttttcgagaggtggaggtacgcc

SEQ ID NO: 624216 - DNA, 25 bp, Mus musculus
ctttttctctcaatagaaaggtggg

SEQ ID NO: 624217 - DNA, 25 bp, Mus musculus
ctttttctctcattagaaaggtggg

SEQ ID NO: 624218 - DNA, 25 bp, Mus musculus
ctttttctggagacaaagggatatc

SEQ ID NO: 624219 - DNA, 25 bp, Mus musculus
ctttttctggagtcaaagggatatc

SEQ ID NO: 624220 - DNA, 25 bp, Mus musculus
ctttttcttccgcaggagctgaaga

SEQ ID NO: 624221 - DNA, 25 bp, Mus musculus
ctttttcttccggaggagctgaaga

SEQ ID NO: 624222 - DNA, 25 bp, Mus musculus
ctttttcttcttccgcacagcgggt

SEQ ID NO: 624223 - DNA, 25 bp, Mus musculus
ctttttcttcttgcgcacagcgggt

SEQ ID NO: 624224 - DNA, 25 bp, Mus musculus
ctttttgaaaccaagatcaagatcc

SEQ ID NO: 624225 - DNA, 25 bp, Mus musculus
ctttttgaaacctagatcaagatcc

SEQ ID NO: 624226 - DNA, 25 bp, Mus musculus
ctttttgcagaacccagattccaaa

SEQ ID NO: 624227 - DNA, 25 bp, Mus musculus
ctttttgcagaagccagattccaaa

SEQ ID NO: 624228 - DNA, 25 bp, Mus musculus
ctttttggatgacgatcgtctggaa

SEQ ID NO: 624229 - DNA, 25 bp, Mus musculus
ctttttggatgaggatcgtctggaa

SEQ ID NO: 624230 - DNA, 25 bp, Mus musculus
ctttttggccgcaggtgagccgcgc

SEQ ID NO: 624231 - DNA, 25 bp, Mus musculus
ctttttggccgctggtgagccgcgc

SEQ ID NO: 624232 - DNA, 25 bp, Mus musculus
ctttttgtgaaaagagatggtgtca

SEQ ID NO: 624233 - DNA, 25 bp, Mus musculus
ctttttgtgaaatgagatggtgtca

SEQ ID NO: 624234 - DNA, 25 bp, Mus musculus
gaaaaaacaaagctccccagtgatg

SEQ ID NO: 624235 - DNA, 25 bp, Mus musculus
gaaaaaacaaaggtccccagtgatg

SEQ ID NO: 624236 - DNA, 25 bp, Mus musculus
gaaaaaacacttcgtcacaacccag

SEQ ID NO: 624237 - DNA, 25 bp, Mus musculus
gaaaaaacacttggtcacaacccag

SEQ ID NO: 624238 - DNA, 25 bp, Mus musculus
gaaaaaacagctcaaacaatgcaga

SEQ ID NO: 624239 - DNA, 25 bp, Mus musculus
gaaaaaacagctgaaacaatgcaga

SEQ ID NO: 624240 - DNA, 25 bp, Mus musculus
gaaaaaacatctcaagcctcactgg

SEQ ID NO: 624241 - DNA, 25 bp, Mus musculus
gaaaaaacatctgaagcctcactgg

SEQ ID NO: 624242 - DNA, 25 bp, Mus musculus
gaaaaaaccgcacagttctactcct

SEQ ID NO: 624243 - DNA, 25 bp, Mus musculus
gaaaaaaccgcagagttctactcct

SEQ ID NO: 624244 - DNA, 25 bp, Mus musculus
gaaaaaacgcaccagcatagagacc

SEQ ID NO: 624245 - DNA, 25 bp, Mus musculus
gaaaaaacgcacgagcatagagacc

SEQ ID NO: 624246 - DNA, 25 bp, Mus musculus
gaaaaaactcaaacacgccaatgtg

SEQ ID NO: 624247 - DNA, 25 bp, Mus musculus
gaaaaaactcaatcacgccaatgtg

SEQ ID NO: 624248 - DNA, 25 bp, Mus musculus
gaaaaaactctcaacttaatcatgg

SEQ ID NO: 624249 - DNA, 25 bp, Mus musculus
gaaaaaactctctacttaatcatgg

SEQ ID NO: 624250 - DNA, 25 bp, Mus musculus
gaaaaaagagccagcaatttcatca

SEQ ID NO: 624251 - DNA, 25 bp, Mus musculus
gaaaaaagagcctgcaatttcatca

SEQ ID NO: 624252 - DNA, 25 bp, Mus musculus
gaaaaaagcaaaatagaatctggct

SEQ ID NO: 624253 - DNA, 25 bp, Mus musculus
gaaaaaagcaaattagaatctggct

SEQ ID NO: 624254 - DNA, 25 bp, Mus musculus
gaaaaaagccaacatgcaggaacca

SEQ ID NO: 624255 - DNA, 25 bp, Mus musculus
gaaaaaagccaagatgcaggaacca

SEQ ID NO: 624256 - DNA, 25 bp, Mus musculus
gaaaaaagctttagtaaatgtggag

SEQ ID NO: 624257 - DNA, 25 bp, Mus musculus
gaaaaaagcttttgtaaatgtggag

SEQ ID NO: 624258 - DNA, 25 bp, Mus musculus
gaaaaaaggtttatctatgcttcag

SEQ ID NO: 624259 - DNA, 25 bp, Mus musculus
gaaaaaaggtttttctatgcttcag

SEQ ID NO: 624260 - DNA, 25 bp, Mus musculus
gaaaaaagttgcctcaagactcaag

SEQ ID NO: 624261 - DNA, 25 bp, Mus musculus
gaaaaaagttgcgtcaagactcaag

SEQ ID NO: 624262 - DNA, 25 bp, Mus musculus
gaaaaaataacactatgcaagtgtc

SEQ ID NO: 624263 - DNA, 25 bp, Mus musculus
gaaaaaataacagtatgcaagtgtc

SEQ ID NO: 624264 - DNA, 25 bp, Mus musculus
gaaaaaatagtgaaccttgaacttg

SEQ ID NO: 624265 - DNA, 25 bp, Mus musculus
gaaaaaatagtgtaccttgaacttg

SEQ ID NO: 624266 - DNA, 25 bp, Mus musculus
gaaaaaatccaaacatccgggagca

SEQ ID NO: 624267 - DNA, 25 bp, Mus musculus
gaaaaaatccaatcatccgggagca

SEQ ID NO: 624268 - DNA, 25 bp, Mus musculus
gaaaaaatccccaatgctccttatg

SEQ ID NO: 624269 - DNA, 25 bp, Mus musculus
gaaaaaatcccctatgctccttatg

SEQ ID NO: 624270 - DNA, 25 bp, Mus musculus
gaaaaaatccgtaactgcatcacaa

SEQ ID NO: 624271 - DNA, 25 bp, Mus musculus
gaaaaaatccgttactgcatcacaa

SEQ ID NO: 624272 - DNA, 25 bp, Mus musculus
gaaaaaatgaatcggatgcttctaa

SEQ ID NO: 624273 - DNA, 25 bp, Mus musculus
gaaaaaatgaatgggatgcttctaa

SEQ ID NO: 624274 - DNA, 25 bp, Mus musculus
gaaaaaatgccacaacatccataag

SEQ ID NO: 624275 - DNA, 25 bp, Mus musculus
gaaaaaatgccagaacatccataag

SEQ ID NO: 624276 - DNA, 25 bp, Mus musculus
gaaaaaatgcctatgggattccaag

SEQ ID NO: 624277 - DNA, 25 bp, Mus musculus
gaaaaaatgcctttgggattccaag

SEQ ID NO: 624278 - DNA, 25 bp, Mus musculus
gaaaaaatgctgaagtgtgggaccc

SEQ ID NO: 624279 - DNA, 25 bp, Mus musculus
gaaaaaatgctgtagtgtgggaccc

SEQ ID NO: 624280 - DNA, 25 bp, Mus musculus
gaaaaaatggctatgacctaccaga

SEQ ID NO: 624281 - DNA, 25 bp, Mus musculus
gaaaaaatggctttgacctaccaga

SEQ ID NO: 624282 - DNA, 25 bp, Mus musculus
gaaaaaattgaacccattgatgtag

SEQ ID NO: 624283 - DNA, 25 bp, Mus musculus
gaaaaaattgaagccattgatgtag

SEQ ID NO: 624284 - DNA, 25 bp, Mus musculus
gaaaaaattgctatacctcaatttg

SEQ ID NO: 624285 - DNA, 25 bp, Mus musculus
gaaaaaattgctatcatcctagacg

SEQ ID NO: 624286 - DNA, 25 bp, Mus musculus
gaaaaaattgctttacctcaatttg

SEQ ID NO: 624287 - DNA, 25 bp, Mus musculus
gaaaaaattgctttcatcctagacg

SEQ ID NO: 624288 - DNA, 25 bp, Mus musculus
gaaaaaatttgtaagcgatgattcc

SEQ ID NO: 624289 - DNA, 25 bp, Mus musculus
gaaaaaatttgttagcgatgattcc

SEQ ID NO: 624290 - DNA, 25 bp, Mus musculus
gaaaaacaccagagagtacagcgta

SEQ ID NO: 624291 - DNA, 25 bp, Mus musculus
gaaaaacaccagtgagtacagcgta

SEQ ID NO: 624292 - DNA, 25 bp, Mus musculus
gaaaaacacctaagaatgtccagac

SEQ ID NO: 624293 - DNA, 25 bp, Mus musculus
gaaaaacacctatgaatgtccagac

SEQ ID NO: 624294 - DNA, 25 bp, Mus musculus
gaaaaacagatgcaagtgtcccctt

SEQ ID NO: 624295 - DNA, 25 bp, Mus musculus
gaaaaacagatggaagtgtcccctt

SEQ ID NO: 624296 - DNA, 25 bp, Mus musculus
gaaaaacagccacaaaagcccagtg

SEQ ID NO: 624297 - DNA, 25 bp, Mus musculus
gaaaaacagccagaaaagcccagtg

SEQ ID NO: 624298 - DNA, 25 bp, Mus musculus
gaaaaacaggaactattctgtgctg

SEQ ID NO: 624299 - DNA, 25 bp, Mus musculus
gaaaaacaggaagtattctgtgctg

SEQ ID NO: 624300 - DNA, 25 bp, Mus musculus
gaaaaacagtcgacctgcggagaaa

SEQ ID NO: 624301 - DNA, 25 bp, Mus musculus
gaaaaacagtcgtcctgcggagaaa

SEQ ID NO: 624302 - DNA, 25 bp, Mus musculus
gaaaaacagtggaatccagcaagcc

SEQ ID NO: 624303 - DNA, 25 bp, Mus musculus
gaaaaacagtggtatccagcaagcc

SEQ ID NO: 624304 - DNA, 25 bp, Mus musculus
gaaaaacagttacagtcaatgacaa

SEQ ID NO: 624305 - DNA, 25 bp, Mus musculus
gaaaaacagttagagtcaatgacaa

SEQ ID NO: 624306 - DNA, 25 bp, Mus musculus
gaaaaacatcgcaccgtttcagagg

SEQ ID NO: 624307 - DNA, 25 bp, Mus musculus
gaaaaacatcgctccgtttcagagg

SEQ ID NO: 624308 - DNA, 25 bp, Mus musculus
gaaaaacattagcagggtatatcat

SEQ ID NO: 624309 - DNA, 25 bp, Mus musculus
gaaaaacattaggagggtatatcat

SEQ ID NO: 624310 - DNA, 25 bp, Mus musculus
gaaaaacattctatatcacacagag

SEQ ID NO: 624311 - DNA, 25 bp, Mus musculus
gaaaaacattctttatcacacagag

SEQ ID NO: 624312 - DNA, 25 bp, Mus musculus
gaaaaaccacataagtgtaaccagt

SEQ ID NO: 624313 - DNA, 25 bp, Mus musculus
gaaaaaccacattagtgtaaccagt

SEQ ID NO: 624314 - DNA, 25 bp, Mus musculus
gaaaaaccaccgaccatggccagct

SEQ ID NO: 624315 - DNA, 25 bp, Mus musculus
gaaaaaccaccgtccatggccagct

SEQ ID NO: 624316 - DNA, 25 bp, Mus musculus
gaaaaacccctgctctgactctgag

SEQ ID NO: 624317 - DNA, 25 bp, Mus musculus
gaaaaacccctggtctgactctgag

SEQ ID NO: 624318 - DNA, 25 bp, Mus musculus
gaaaaaccttgcaggaacttgtgat

SEQ ID NO: 624319 - DNA, 25 bp, Mus musculus
gaaaaaccttgctggaacttgtgat

SEQ ID NO: 624320 - DNA, 25 bp, Mus musculus
gaaaaacctttgcacagctgttctg

SEQ ID NO: 624321 - DNA, 25 bp, Mus musculus
gaaaaacctttggacagctgttctg

SEQ ID NO: 624322 - DNA, 25 bp, Mus musculus
gaaaaacgaagaccggcactggaga

SEQ ID NO: 624323 - DNA, 25 bp, Mus musculus
gaaaaacgaagagcggcactggaga

SEQ ID NO: 624324 - DNA, 25 bp, Mus musculus
gaaaaacgaagtcaagcacgtttct

SEQ ID NO: 624325 - DNA, 25 bp, Mus musculus
gaaaaacgaagtgaagcacgtttct

SEQ ID NO: 624326 - DNA, 25 bp, Mus musculus
gaaaaacgacttctcccaacaggag

SEQ ID NO: 624327 - DNA, 25 bp, Mus musculus
gaaaaacgacttgtcccaacaggag

SEQ ID NO: 624328 - DNA, 25 bp, Mus musculus
gaaaaacgcaagataaacagcccca

SEQ ID NO: 624329 - DNA, 25 bp, Mus musculus
gaaaaacgcaagttaaacagcccca

SEQ ID NO: 624330 - DNA, 25 bp, Mus musculus
gaaaaacggaggcatatatgaagga

SEQ ID NO: 624331 - DNA, 25 bp, Mus musculus
gaaaaacggagggatatatgaagga

SEQ ID NO: 624332 - DNA, 25 bp, Mus musculus
gaaaaacggtatcgcttgggagtca

SEQ ID NO: 624333 - DNA, 25 bp, Mus musculus
gaaaaacggtatggcttgggagtca

SEQ ID NO: 624334 - DNA, 25 bp, Mus musculus
gaaaaacggttcaatctgaaggaag

SEQ ID NO: 624335 - DNA, 25 bp, Mus musculus
gaaaaacggttctatctgaaggaag

SEQ ID NO: 624336 - DNA, 25 bp, Mus musculus
gaaaaacgtgctcggccatatgcag

SEQ ID NO: 624337 - DNA, 25 bp, Mus musculus
gaaaaacgtgctgggccatatgcag

SEQ ID NO: 624338 - DNA, 25 bp, Mus musculus
gaaaaacgtggtaccttgcgttctg

SEQ ID NO: 624339 - DNA, 25 bp, Mus musculus
gaaaaacgtggttccttgcgttctg

SEQ ID NO: 624340 - DNA, 25 bp, Mus musculus
gaaaaactaagtacactcaatcaag

SEQ ID NO: 624341 - DNA, 25 bp, Mus musculus
gaaaaactaagttcactcaatcaag

SEQ ID NO: 624342 - DNA, 25 bp, Mus musculus
gaaaaactctgtcatcggcttgaac

SEQ ID NO: 624343 - DNA, 25 bp, Mus musculus
gaaaaactctgtgatcggcttgaac

SEQ ID NO: 624344 - DNA, 25 bp, Mus musculus
gaaaaactgatgaagcaaattggtg

SEQ ID NO: 624345 - DNA, 25 bp, Mus musculus
gaaaaactgatgtagcaaattggtg

SEQ ID NO: 624346 - DNA, 25 bp, Mus musculus
gaaaaactgccaatgtagtagtgta

SEQ ID NO: 624347 - DNA, 25 bp, Mus musculus
gaaaaactgccacaggaattgcttc

SEQ ID NO: 624348 - DNA, 25 bp, Mus musculus
gaaaaactgccagaggaattgcttc

SEQ ID NO: 624349 - DNA, 25 bp, Mus musculus
gaaaaactgccattgtagtagtgta

SEQ ID NO: 624350 - DNA, 25 bp, Mus musculus
gaaaaactgctgacagatcgaaaag

SEQ ID NO: 624351 - DNA, 25 bp, Mus musculus
gaaaaactgctgtcagatcgaaaag

SEQ ID NO: 624352 - DNA, 25 bp, Mus musculus
gaaaaacttacacctagaggaagag

SEQ ID NO: 624353 - DNA, 25 bp, Mus musculus
gaaaaacttacagctagaggaagag

SEQ ID NO: 624354 - DNA, 25 bp, Mus musculus
gaaaaacttcatagaatgtacaagg

SEQ ID NO: 624355 - DNA, 25 bp, Mus musculus
gaaaaacttcattgaatgtacaagg

SEQ ID NO: 624356 - DNA, 25 bp, Mus musculus
gaaaaacttccacatcgtccacggg

SEQ ID NO: 624357 - DNA, 25 bp, Mus musculus
gaaaaacttccagatcgtccacggg

SEQ ID NO: 624358 - DNA, 25 bp, Mus musculus
gaaaaacttgctactctccatggtg

SEQ ID NO: 624359 - DNA, 25 bp, Mus musculus
gaaaaacttgcttctctccatggtg

SEQ ID NO: 624360 - DNA, 25 bp, Mus musculus
gaaaaactttcccaatgccatcgaa

SEQ ID NO: 624361 - DNA, 25 bp, Mus musculus
gaaaaactttccgaatgccatcgaa

SEQ ID NO: 624362 - DNA, 25 bp, Mus musculus
gaaaaactttctaagtgcctgggag

SEQ ID NO: 624363 - DNA, 25 bp, Mus musculus
gaaaaactttcttagtgcctgggag

SEQ ID NO: 624364 - DNA, 25 bp, Mus musculus
gaaaaagaacaacgatcagctcagc

SEQ ID NO: 624365 - DNA, 25 bp, Mus musculus
gaaaaagaacaaggatcagctcagc

SEQ ID NO: 624366 - DNA, 25 bp, Mus musculus
gaaaaagaagcaacgaggagcggat

SEQ ID NO: 624367 - DNA, 25 bp, Mus musculus
gaaaaagaagcatcgaggagcggat

SEQ ID NO: 624368 - DNA, 25 bp, Mus musculus
gaaaaagaagcgagagaaggcgtac

SEQ ID NO: 624369 - DNA, 25 bp, Mus musculus
gaaaaagaagcgctgtcgggctact

SEQ ID NO: 624370 - DNA, 25 bp, Mus musculus
gaaaaagaagcggtgtcgggctact

SEQ ID NO: 624371 - DNA, 25 bp, Mus musculus
gaaaaagaagcgtgagaaggcgtac

SEQ ID NO: 624372 - DNA, 25 bp, Mus musculus
gaaaaagaagctatctaataccctg

SEQ ID NO: 624373 - DNA, 25 bp, Mus musculus
gaaaaagaagctcgagccaaatttc

SEQ ID NO: 624374 - DNA, 25 bp, Mus musculus
gaaaaagaagctggagccaaatttc

SEQ ID NO: 624375 - DNA, 25 bp, Mus musculus
gaaaaagaagctttctaataccctg

SEQ ID NO: 624376 - DNA, 25 bp, Mus musculus
gaaaaagacattcctgtggaggctt

SEQ ID NO: 624377 - DNA, 25 bp, Mus musculus
gaaaaagacattgctgtggaggctt

SEQ ID NO: 624378 - DNA, 25 bp, Mus musculus
gaaaaagaccaacgattctgcttca

SEQ ID NO: 624379 - DNA, 25 bp, Mus musculus
gaaaaagaccaaggattctgcttca

SEQ ID NO: 624380 - DNA, 25 bp, Mus musculus
gaaaaagacggtcgaagatgctgat

SEQ ID NO: 624381 - DNA, 25 bp, Mus musculus
gaaaaagacggtggaagatgctgat

SEQ ID NO: 624382 - DNA, 25 bp, Mus musculus
gaaaaagactagatttggacttaag

SEQ ID NO: 624383 - DNA, 25 bp, Mus musculus
gaaaaagactagttttggacttaag

SEQ ID NO: 624384 - DNA, 25 bp, Mus musculus
gaaaaagactgcagtcgtgacagcg

SEQ ID NO: 624385 - DNA, 25 bp, Mus musculus
gaaaaagactgctgtcgtgacagcg

SEQ ID NO: 624386 - DNA, 25 bp, Mus musculus
gaaaaagagaagaggttaacaagtg

SEQ ID NO: 624387 - DNA, 25 bp, Mus musculus
gaaaaagagaagtggttaacaagtg

SEQ ID NO: 624388 - DNA, 25 bp, Mus musculus
gaaaaagaggacagcattcaggtca

SEQ ID NO: 624389 - DNA, 25 bp, Mus musculus
gaaaaagaggactgcattcaggtca

SEQ ID NO: 624390 - DNA, 25 bp, Mus musculus
gaaaaagaggttctagcggcgccca

SEQ ID NO: 624391 - DNA, 25 bp, Mus musculus
gaaaaagaggttgtagcggcgccca

SEQ ID NO: 624392 - DNA, 25 bp, Mus musculus
gaaaaagagtgtactgaccaccaag

SEQ ID NO: 624393 - DNA, 25 bp, Mus musculus
gaaaaagagtgttctgaccaccaag

SEQ ID NO: 624394 - DNA, 25 bp, Mus musculus
gaaaaagatgcaacaccataccctg

SEQ ID NO: 624395 - DNA, 25 bp, Mus musculus
gaaaaagatgcatcaccataccctg

SEQ ID NO: 624396 - DNA, 25 bp, Mus musculus
gaaaaagatggaaactatcatacga

SEQ ID NO: 624397 - DNA, 25 bp, Mus musculus
gaaaaagatggatactatcatacga

SEQ ID NO: 624398 - DNA, 25 bp, Mus musculus
gaaaaagcaataaggagaaggttgc

SEQ ID NO: 624399 - DNA, 25 bp, Mus musculus
gaaaaagcaatatggagaaggttgc

SEQ ID NO: 624400 - DNA, 25 bp, Mus musculus
gaaaaagcagctatacaacatctac

SEQ ID NO: 624401 - DNA, 25 bp, Mus musculus
gaaaaagcagctttacaacatctac

SEQ ID NO: 624402 - DNA, 25 bp, Mus musculus
gaaaaagcagttaggacaggctgaa

SEQ ID NO: 624403 - DNA, 25 bp, Mus musculus
gaaaaagcagtttggacaggctgaa

SEQ ID NO: 624404 - DNA, 25 bp, Mus musculus
gaaaaagccaagctcatcggtcaga

SEQ ID NO: 624405 - DNA, 25 bp, Mus musculus
gaaaaagccaaggtcatcggtcaga

SEQ ID NO: 624406 - DNA, 25 bp, Mus musculus
gaaaaagcccaactcatccgggccg

SEQ ID NO: 624407 - DNA, 25 bp, Mus musculus
gaaaaagcccaagtcatccgggccg

SEQ ID NO: 624408 - DNA, 25 bp, Mus musculus
gaaaaagccccgcatgttgaactga

SEQ ID NO: 624409 - DNA, 25 bp, Mus musculus
gaaaaagccccggatgttgaactga

SEQ ID NO: 624410 - DNA, 25 bp, Mus musculus
gaaaaagcctatcaaatcatgaggg

SEQ ID NO: 624411 - DNA, 25 bp, Mus musculus
gaaaaagcctatgaaatcatgaggg

SEQ ID NO: 624412 - DNA, 25 bp, Mus musculus
gaaaaagcctcgcaatgccattacc

SEQ ID NO: 624413 - DNA, 25 bp, Mus musculus
gaaaaagcctcggaatgccattacc

SEQ ID NO: 624414 - DNA, 25 bp, Mus musculus
gaaaaagcgagcaccgagcttctgt

SEQ ID NO: 624415 - DNA, 25 bp, Mus musculus
gaaaaagcgagctccgagcttctgt

SEQ ID NO: 624416 - DNA, 25 bp, Mus musculus
gaaaaagcgcaacatgtccttgttg

SEQ ID NO: 624417 - DNA, 25 bp, Mus musculus
gaaaaagcgcaagatgtccttgttg

SEQ ID NO: 624418 - DNA, 25 bp, Mus musculus
gaaaaagcggcaccgagaccgtatg

SEQ ID NO: 624419 - DNA, 25 bp, Mus musculus
gaaaaagcggcagcgagaccgtatg

SEQ ID NO: 624420 - DNA, 25 bp, Mus musculus
gaaaaagctgccacagccagagagc

SEQ ID NO: 624421 - DNA, 25 bp, Mus musculus
gaaaaagctgcctcagccagagagc

SEQ ID NO: 624422 - DNA, 25 bp, Mus musculus
gaaaaagctgggacctgggcctgtt

SEQ ID NO: 624423 - DNA, 25 bp, Mus musculus
gaaaaagctgggtcctgggcctgtt

SEQ ID NO: 624424 - DNA, 25 bp, Mus musculus
gaaaaaggaattacgagcagatgct

SEQ ID NO: 624425 - DNA, 25 bp, Mus musculus
gaaaaaggaatttcgagcagatgct

SEQ ID NO: 624426 - DNA, 25 bp, Mus musculus
gaaaaaggacagcagctcaagcgga

SEQ ID NO: 624427 - DNA, 25 bp, Mus musculus
gaaaaaggacaggagctcaagcgga

SEQ ID NO: 624428 - DNA, 25 bp, Mus musculus
gaaaaaggagctcgtaacctgcatg

SEQ ID NO: 624429 - DNA, 25 bp, Mus musculus
gaaaaaggagctggtaacctgcatg

SEQ ID NO: 624430 - DNA, 25 bp, Mus musculus
gaaaaaggagtcaagctctgctgct

SEQ ID NO: 624431 - DNA, 25 bp, Mus musculus
gaaaaaggagtctagctctgctgct

SEQ ID NO: 624432 - DNA, 25 bp, Mus musculus
gaaaaaggatggctccatgttgcac

SEQ ID NO: 624433 - DNA, 25 bp, Mus musculus
gaaaaaggatgggtccatgttgcac

SEQ ID NO: 624434 - DNA, 25 bp, Mus musculus
gaaaaaggcaatcccgagttttgtg

SEQ ID NO: 624435 - DNA, 25 bp, Mus musculus
gaaaaaggcaatgccgagttttgtg

SEQ ID NO: 624436 - DNA, 25 bp, Mus musculus
gaaaaaggtgtgcataagccgcctt

SEQ ID NO: 624437 - DNA, 25 bp, Mus musculus
gaaaaaggtgtggataagccgcctt

SEQ ID NO: 624438 - DNA, 25 bp, Mus musculus
gaaaaagtacgactccactggaatg

SEQ ID NO: 624439 - DNA, 25 bp, Mus musculus
gaaaaagtacgagtccactggaatg

SEQ ID NO: 624440 - DNA, 25 bp, Mus musculus
gaaaaagtatcacagctggaggccg

SEQ ID NO: 624441 - DNA, 25 bp, Mus musculus
gaaaaagtatcagagctggaggccg

SEQ ID NO: 624442 - DNA, 25 bp, Mus musculus
gaaaaagtatggatcccgcctaccg

SEQ ID NO: 624443 - DNA, 25 bp, Mus musculus
gaaaaagtatggttcccgcctaccg

SEQ ID NO: 624444 - DNA, 25 bp, Mus musculus
gaaaaagtcaatagctcacaacatg

SEQ ID NO: 624445 - DNA, 25 bp, Mus musculus
gaaaaagtcaattgctcacaacatg

SEQ ID NO: 624446 - DNA, 25 bp, Mus musculus
gaaaaagtctataatctcgtaaaag

SEQ ID NO: 624447 - DNA, 25 bp, Mus musculus
gaaaaagtctattatctcgtaaaag

SEQ ID NO: 624448 - DNA, 25 bp, Mus musculus
gaaaaagtctctatagaaaggtgac

SEQ ID NO: 624449 - DNA, 25 bp, Mus musculus
gaaaaagtctctttagaaaggtgac

SEQ ID NO: 624450 - DNA, 25 bp, Mus musculus
gaaaaagtgcatccctctgtacgtc

SEQ ID NO: 624451 - DNA, 25 bp, Mus musculus
gaaaaagtgcatgcctctgtacgtc

SEQ ID NO: 624452 - DNA, 25 bp, Mus musculus
gaaaaagtggcgctggatcaacaac

SEQ ID NO: 624453 - DNA, 25 bp, Mus musculus
gaaaaagtggcggtggatcaacaac

SEQ ID NO: 624454 - DNA, 25 bp, Mus musculus
gaaaaagtggtcctgaaatccacct

SEQ ID NO: 624455 - DNA, 25 bp, Mus musculus
gaaaaagtggtcgtgaaatccacct

SEQ ID NO: 624456 - DNA, 25 bp, Mus musculus
gaaaaagtgtttattcctcatggac

SEQ ID NO: 624457 - DNA, 25 bp, Mus musculus
gaaaaagtgttttttcctcatggac

SEQ ID NO: 624458 - DNA, 25 bp, Mus musculus
gaaaaagttcccacctctacagatt

SEQ ID NO: 624459 - DNA, 25 bp, Mus musculus
gaaaaagttccctcctctacagatt

SEQ ID NO: 624460 - DNA, 25 bp, Mus musculus
gaaaaagttcgaatctatagaatgg

SEQ ID NO: 624461 - DNA, 25 bp, Mus musculus
gaaaaagttcgattctatagaatgg

SEQ ID NO: 624462 - DNA, 25 bp, Mus musculus
gaaaaagttctaccagcctgacaag

SEQ ID NO: 624463 - DNA, 25 bp, Mus musculus
gaaaaagttctagcagcctgacaag

SEQ ID NO: 624464 - DNA, 25 bp, Mus musculus
gaaaaagttgtacaagccacgaaca

SEQ ID NO: 624465 - DNA, 25 bp, Mus musculus
gaaaaagttgtagaagccacgaaca

SEQ ID NO: 624466 - DNA, 25 bp, Mus musculus
gaaaaataaggacagccgcctcacc

SEQ ID NO: 624467 - DNA, 25 bp, Mus musculus
gaaaaataaggagagccgcctcacc

SEQ ID NO: 624468 - DNA, 25 bp, Mus musculus
gaaaaatacattctcagggcctgct

SEQ ID NO: 624469 - DNA, 25 bp, Mus musculus
gaaaaatacattgtcagggcctgct

SEQ ID NO: 624470 - DNA, 25 bp, Mus musculus
gaaaaataccagaaaatcaaactgc

SEQ ID NO: 624471 - DNA, 25 bp, Mus musculus
gaaaaataccagtaaatcaaactgc

SEQ ID NO: 624472 - DNA, 25 bp, Mus musculus
gaaaaatactccactcctggtctga

SEQ ID NO: 624473 - DNA, 25 bp, Mus musculus
gaaaaatactcctctcctggtctga

SEQ ID NO: 624474 - DNA, 25 bp, Mus musculus
gaaaaatagcctcttctttccgaga

SEQ ID NO: 624475 - DNA, 25 bp, Mus musculus
gaaaaatagcctgttctttccgaga

SEQ ID NO: 624476 - DNA, 25 bp, Mus musculus
gaaaaatcccttcgaccattcccag

SEQ ID NO: 624477 - DNA, 25 bp, Mus musculus
gaaaaatcccttggaccattcccag

SEQ ID NO: 624478 - DNA, 25 bp, Mus musculus
gaaaaatccgtgaggtatcatcact

SEQ ID NO: 624479 - DNA, 25 bp, Mus musculus
gaaaaatccgtgtggtatcatcact

SEQ ID NO: 624480 - DNA, 25 bp, Mus musculus
gaaaaatctgtcacctgaggaaaag

SEQ ID NO: 624481 - DNA, 25 bp, Mus musculus
gaaaaatctgtctcctgaggaaaag

SEQ ID NO: 624482 - DNA, 25 bp, Mus musculus
gaaaaatgacttctccagaaaacga

SEQ ID NO: 624483 - DNA, 25 bp, Mus musculus
gaaaaatgacttgtccagaaaacga

SEQ ID NO: 624484 - DNA, 25 bp, Mus musculus
gaaaaatgaggtatactgggactta

SEQ ID NO: 624485 - DNA, 25 bp, Mus musculus
gaaaaatgaggtttactgggactta

SEQ ID NO: 624486 - DNA, 25 bp, Mus musculus
gaaaaatgatggattcgataaggaa

SEQ ID NO: 624487 - DNA, 25 bp, Mus musculus
gaaaaatgatggtttcgataaggaa

SEQ ID NO: 624488 - DNA, 25 bp, Mus musculus
gaaaaatgccaactgaaaggtgtca

SEQ ID NO: 624489 - DNA, 25 bp, Mus musculus
gaaaaatgccaagtgaaaggtgtca

SEQ ID NO: 624490 - DNA, 25 bp, Mus musculus
gaaaaatgccaccttggcatgggac

SEQ ID NO: 624491 - DNA, 25 bp, Mus musculus
gaaaaatgccacgttggcatgggac

SEQ ID NO: 624492 - DNA, 25 bp, Mus musculus
gaaaaatgcctcaaggagacgacag

SEQ ID NO: 624493 - DNA, 25 bp, Mus musculus
gaaaaatgcctcattccaagtgact

SEQ ID NO: 624494 - DNA, 25 bp, Mus musculus
gaaaaatgcctctaggagacgacag

SEQ ID NO: 624495 - DNA, 25 bp, Mus musculus
gaaaaatgcctctttccaagtgact

SEQ ID NO: 624496 - DNA, 25 bp, Mus musculus
gaaaaatgcgaacctgtaattggtc

SEQ ID NO: 624497 - DNA, 25 bp, Mus musculus
gaaaaatgcgaagctgtaattggtc

SEQ ID NO: 624498 - DNA, 25 bp, Mus musculus
gaaaaatggcatctggacaaggacc

SEQ ID NO: 624499 - DNA, 25 bp, Mus musculus
gaaaaatggcatgtggacaaggacc

SEQ ID NO: 624500 - DNA, 25 bp, Mus musculus
gaaaaatggcgacactttcattatg

SEQ ID NO: 624501 - DNA, 25 bp, Mus musculus
gaaaaatggcgagactttcattatg

SEQ ID NO: 624502 - DNA, 25 bp, Mus musculus
gaaaaatgggaacttgcggtatgaa

SEQ ID NO: 624503 - DNA, 25 bp, Mus musculus
gaaaaatgggaagttgcggtatgaa

SEQ ID NO: 624504 - DNA, 25 bp, Mus musculus
gaaaaatgggacaaggtacaacagc

SEQ ID NO: 624505 - DNA, 25 bp, Mus musculus
gaaaaatgggactaggtacaacagc

SEQ ID NO: 624506 - DNA, 25 bp, Mus musculus
gaaaaatggtcaaaagaggtcataa

SEQ ID NO: 624507 - DNA, 25 bp, Mus musculus
gaaaaatggtcataagaggtcataa

SEQ ID NO: 624508 - DNA, 25 bp, Mus musculus
gaaaaatgtgtcaccaaaggctatg

SEQ ID NO: 624509 - DNA, 25 bp, Mus musculus
gaaaaatgtgtctccaaaggctatg

SEQ ID NO: 624510 - DNA, 25 bp, Mus musculus
gaaaaattacacctatcgacggaga

SEQ ID NO: 624511 - DNA, 25 bp, Mus musculus
gaaaaattacacgtatcgacggaga

SEQ ID NO: 624512 - DNA, 25 bp, Mus musculus
gaaaaattccgcaatgctcaagatg

SEQ ID NO: 624513 - DNA, 25 bp, Mus musculus
gaaaaattccgctatgctcaagatg

SEQ ID NO: 624514 - DNA, 25 bp, Mus musculus
gaaaaattcctcaccgagcagatga

SEQ ID NO: 624515 - DNA, 25 bp, Mus musculus
gaaaaattcctctccgagcagatga

SEQ ID NO: 624516 - DNA, 25 bp, Mus musculus
gaaaaatttcgacacagctctgcag

SEQ ID NO: 624517 - DNA, 25 bp, Mus musculus
gaaaaatttcgagacagctctgcag

SEQ ID NO: 624518 - DNA, 25 bp, Mus musculus
gaaaacaaagcacgagccagaagca

SEQ ID NO: 624519 - DNA, 25 bp, Mus musculus
gaaaacaaagcaggagccagaagca

SEQ ID NO: 624520 - DNA, 25 bp, Mus musculus
gaaaacaacataaacagcacatcca

SEQ ID NO: 624521 - DNA, 25 bp, Mus musculus
gaaaacaacatatacagcacatcca

SEQ ID NO: 624522 - DNA, 25 bp, Mus musculus
gaaaacaacgccctggactcctatt

SEQ ID NO: 624523 - DNA, 25 bp, Mus musculus
gaaaacaacgccgtggactcctatt

SEQ ID NO: 624524 - DNA, 25 bp, Mus musculus
gaaaacaagaataaaggatctgccc

SEQ ID NO: 624525 - DNA, 25 bp, Mus musculus
gaaaacaagaattaaggatctgccc

SEQ ID NO: 624526 - DNA, 25 bp, Mus musculus
gaaaacaagtctccatgtggctaag

SEQ ID NO: 624527 - DNA, 25 bp, Mus musculus
gaaaacaagtctgcatgtggctaag

SEQ ID NO: 624528 - DNA, 25 bp, Mus musculus
gaaaacaatcagatgaatgtctacc

SEQ ID NO: 624529 - DNA, 25 bp, Mus musculus
gaaaacaatcagttgaatgtctacc

SEQ ID NO: 624530 - DNA, 25 bp, Mus musculus
gaaaacaattttcacaacataacag

SEQ ID NO: 624531 - DNA, 25 bp, Mus musculus
gaaaacaattttgacaacataacag

SEQ ID NO: 624532 - DNA, 25 bp, Mus musculus
gaaaacacaatacgctacttcaaat

SEQ ID NO: 624533 - DNA, 25 bp, Mus musculus
gaaaacacaataggctacttcaaat

SEQ ID NO: 624534 - DNA, 25 bp, Mus musculus
gaaaacacagatacaagcagctcac

SEQ ID NO: 624535 - DNA, 25 bp, Mus musculus
gaaaacacagattcaagcagctcac

SEQ ID NO: 624536 - DNA, 25 bp, Mus musculus
gaaaacacccatccttagactactg

SEQ ID NO: 624537 - DNA, 25 bp, Mus musculus
gaaaacacccatgcttagactactg

SEQ ID NO: 624538 - DNA, 25 bp, Mus musculus
gaaaacaccccaaagagtgccgagg

SEQ ID NO: 624539 - DNA, 25 bp, Mus musculus
gaaaacaccccatagagtgccgagg

SEQ ID NO: 624540 - DNA, 25 bp, Mus musculus
gaaaacacctgtccacggtgggcct

SEQ ID NO: 624541 - DNA, 25 bp, Mus musculus
gaaaacacctgtgcacggtgggcct

SEQ ID NO: 624542 - DNA, 25 bp, Mus musculus
gaaaacactgaacttaacaacctgg

SEQ ID NO: 624543 - DNA, 25 bp, Mus musculus
gaaaacactgaagttaacaacctgg

SEQ ID NO: 624544 - DNA, 25 bp, Mus musculus
gaaaacactgagaatcgggagatca

SEQ ID NO: 624545 - DNA, 25 bp, Mus musculus
gaaaacactgagtatcgggagatca

SEQ ID NO: 624546 - DNA, 25 bp, Mus musculus
gaaaacactggactggaactggatg

SEQ ID NO: 624547 - DNA, 25 bp, Mus musculus
gaaaacactggagtggaactggatg

SEQ ID NO: 624548 - DNA, 25 bp, Mus musculus
gaaaacactgtcattgtagacacca

SEQ ID NO: 624549 - DNA, 25 bp, Mus musculus
gaaaacactgtctttgtagacacca

SEQ ID NO: 624550 - DNA, 25 bp, Mus musculus
gaaaacacttgaacccaaagattgg

SEQ ID NO: 624551 - DNA, 25 bp, Mus musculus
gaaaacacttgatcccaaagattgg

SEQ ID NO: 624552 - DNA, 25 bp, Mus musculus
gaaaacactttcatccaaggatgag

SEQ ID NO: 624553 - DNA, 25 bp, Mus musculus
gaaaacactttcttccaaggatgag

SEQ ID NO: 624554 - DNA, 25 bp, Mus musculus
gaaaacagacctcactttgtgaaca

SEQ ID NO: 624555 - DNA, 25 bp, Mus musculus
gaaaacagacctgactttgtgaaca

SEQ ID NO: 624556 - DNA, 25 bp, Mus musculus
gaaaacagatggcactgtacagctt

SEQ ID NO: 624557 - DNA, 25 bp, Mus musculus
gaaaacagatgggactgtacagctt

SEQ ID NO: 624558 - DNA, 25 bp, Mus musculus
gaaaacagattgatgacttaaagaa

SEQ ID NO: 624559 - DNA, 25 bp, Mus musculus
gaaaacagattgttgacttaaagaa

SEQ ID NO: 624560 - DNA, 25 bp, Mus musculus
gaaaacagcaatcgatcttatctaa

SEQ ID NO: 624561 - DNA, 25 bp, Mus musculus
gaaaacagcaatggatcttatctaa

SEQ ID NO: 624562 - DNA, 25 bp, Mus musculus
gaaaacagccaacaacaatgtggtg

SEQ ID NO: 624563 - DNA, 25 bp, Mus musculus
gaaaacagccaagaacaatgtggtg

SEQ ID NO: 624564 - DNA, 25 bp, Mus musculus
gaaaacagccctatcatcaataatg

SEQ ID NO: 624565 - DNA, 25 bp, Mus musculus
gaaaacagccctttcatcaataatg

SEQ ID NO: 624566 - DNA, 25 bp, Mus musculus
gaaaacagcggacttcttcctccag

SEQ ID NO: 624567 - DNA, 25 bp, Mus musculus
gaaaacagcggagttcttcctccag

SEQ ID NO: 624568 - DNA, 25 bp, Mus musculus
gaaaacagctgaaaccgaagaggga

SEQ ID NO: 624569 - DNA, 25 bp, Mus musculus
gaaaacagctgaactcttgggaagg

SEQ ID NO: 624570 - DNA, 25 bp, Mus musculus
gaaaacagctgataccgaagaggga

SEQ ID NO: 624571 - DNA, 25 bp, Mus musculus
gaaaacagctgatctcttgggaagg

SEQ ID NO: 624572 - DNA, 25 bp, Mus musculus
gaaaacaggaatagtgtccacgggc

SEQ ID NO: 624573 - DNA, 25 bp, Mus musculus
gaaaacaggaattgtgtccacgggc

SEQ ID NO: 624574 - DNA, 25 bp, Mus musculus
gaaaacaggccacgagatgattgag

SEQ ID NO: 624575 - DNA, 25 bp, Mus musculus
gaaaacaggccaggagatgattgag

SEQ ID NO: 624576 - DNA, 25 bp, Mus musculus
gaaaacaggtctaggctttacctga

SEQ ID NO: 624577 - DNA, 25 bp, Mus musculus
gaaaacaggtcttggctttacctga

SEQ ID NO: 624578 - DNA, 25 bp, Mus musculus
gaaaacatacccagtaaatactcct

SEQ ID NO: 624579 - DNA, 25 bp, Mus musculus
gaaaacataccctgtaaatactcct

SEQ ID NO: 624580 - DNA, 25 bp, Mus musculus
gaaaacatactgcagaaacaatcgt

SEQ ID NO: 624581 - DNA, 25 bp, Mus musculus
gaaaacatactggagaaacaatcgt

SEQ ID NO: 624582 - DNA, 25 bp, Mus musculus
gaaaacatccctacagtgggcttgg

SEQ ID NO: 624583 - DNA, 25 bp, Mus musculus
gaaaacatcccttcagtgggcttgg

SEQ ID NO: 624584 - DNA, 25 bp, Mus musculus
gaaaacatccgccaagacttctaat

SEQ ID NO: 624585 - DNA, 25 bp, Mus musculus
gaaaacatccgcgaagacttctaat

SEQ ID NO: 624586 - DNA, 25 bp, Mus musculus
gaaaacatctggaaccgcagtgacc

SEQ ID NO: 624587 - DNA, 25 bp, Mus musculus
gaaaacatctggtaccgcagtgacc

SEQ ID NO: 624588 - DNA, 25 bp, Mus musculus
gaaaacatgaatctctctgaggccc

SEQ ID NO: 624589 - DNA, 25 bp, Mus musculus
gaaaacatgaatgtctctgaggccc

SEQ ID NO: 624590 - DNA, 25 bp, Mus musculus
gaaaacatgccgacagctgaagcca

SEQ ID NO: 624591 - DNA, 25 bp, Mus musculus
gaaaacatgccgtcagctgaagcca

SEQ ID NO: 624592 - DNA, 25 bp, Mus musculus
gaaaacatggagaaaatggagccaa

SEQ ID NO: 624593 - DNA, 25 bp, Mus musculus
gaaaacatggagattgctgaacttt

SEQ ID NO: 624594 - DNA, 25 bp, Mus musculus
gaaaacatggagtaaatggagccaa

SEQ ID NO: 624595 - DNA, 25 bp, Mus musculus
gaaaacatggagtttgctgaacttt

SEQ ID NO: 624596 - DNA, 25 bp, Mus musculus
gaaaacatggccatctagagtcaga

SEQ ID NO: 624597 - DNA, 25 bp, Mus musculus
gaaaacatggccttctagagtcaga

SEQ ID NO: 624598 - DNA, 25 bp, Mus musculus
gaaaacattgcacagtcgctagttg

SEQ ID NO: 624599 - DNA, 25 bp, Mus musculus
gaaaacattgcagagtcgctagttg

SEQ ID NO: 624600 - DNA, 25 bp, Mus musculus
gaaaacattttgcagctgattacct

SEQ ID NO: 624601 - DNA, 25 bp, Mus musculus
gaaaacattttggagctgattacct

SEQ ID NO: 624602 - DNA, 25 bp, Mus musculus
gaaaaccaattaatgtatctaccag

SEQ ID NO: 624603 - DNA, 25 bp, Mus musculus
gaaaaccaattattgtatctaccag

SEQ ID NO: 624604 - DNA, 25 bp, Mus musculus
gaaaaccaccggagcaagatcagtt

SEQ ID NO: 624605 - DNA, 25 bp, Mus musculus
gaaaaccaccggtgcaagatcagtt

SEQ ID NO: 624606 - DNA, 25 bp, Mus musculus
gaaaaccagaagcaacagtgtgtct

SEQ ID NO: 624607 - DNA, 25 bp, Mus musculus
gaaaaccagaaggaacagtgtgtct

SEQ ID NO: 624608 - DNA, 25 bp, Mus musculus
gaaaaccagatcctcacccgagatg

SEQ ID NO: 624609 - DNA, 25 bp, Mus musculus
gaaaaccagatcgtcacccgagatg

SEQ ID NO: 624610 - DNA, 25 bp, Mus musculus
gaaaaccagcaactattgcctgttc

SEQ ID NO: 624611 - DNA, 25 bp, Mus musculus
gaaaaccagcaagtattgcctgttc

SEQ ID NO: 624612 - DNA, 25 bp, Mus musculus
gaaaaccagctaatgcccatagaga

SEQ ID NO: 624613 - DNA, 25 bp, Mus musculus
gaaaaccagctattgcccatagaga

SEQ ID NO: 624614 - DNA, 25 bp, Mus musculus
gaaaaccagggcacttactcgggtg

SEQ ID NO: 624615 - DNA, 25 bp, Mus musculus
gaaaaccagggctcttactcgggtg

SEQ ID NO: 624616 - DNA, 25 bp, Mus musculus
gaaaaccaggtgataccatatatac

SEQ ID NO: 624617 - DNA, 25 bp, Mus musculus
gaaaaccaggtgttaccatatatac

SEQ ID NO: 624618 - DNA, 25 bp, Mus musculus
gaaaaccagtctatgctgaggatgc

SEQ ID NO: 624619 - DNA, 25 bp, Mus musculus
gaaaaccagtctttgctgaggatgc

SEQ ID NO: 624620 - DNA, 25 bp, Mus musculus
gaaaaccagtgtccctacattaatg

SEQ ID NO: 624621 - DNA, 25 bp, Mus musculus
gaaaaccagtgtgcctacattaatg

SEQ ID NO: 624622 - DNA, 25 bp, Mus musculus
gaaaaccagttgaacagcatgtagc

SEQ ID NO: 624623 - DNA, 25 bp, Mus musculus
gaaaaccagttgtacagcatgtagc

SEQ ID NO: 624624 - DNA, 25 bp, Mus musculus
gaaaaccatcacacatgaacttctg

SEQ ID NO: 624625 - DNA, 25 bp, Mus musculus
gaaaaccatcactcatgaacttctg

SEQ ID NO: 624626 - DNA, 25 bp, Mus musculus
gaaaaccattaaagttacgacagca

SEQ ID NO: 624627 - DNA, 25 bp, Mus musculus
gaaaaccattaatgttacgacagca

SEQ ID NO: 624628 - DNA, 25 bp, Mus musculus
gaaaaccattctctgcaaagaaagg

SEQ ID NO: 624629 - DNA, 25 bp, Mus musculus
gaaaaccattctgtgcaaagaaagg

SEQ ID NO: 624630 - DNA, 25 bp, Mus musculus
gaaaacccaagtacctgtacagtgg

SEQ ID NO: 624631 - DNA, 25 bp, Mus musculus
gaaaacccaagttcctgtacagtgg

SEQ ID NO: 624632 - DNA, 25 bp, Mus musculus
gaaaacccatagataaagctcttgg

SEQ ID NO: 624633 - DNA, 25 bp, Mus musculus
gaaaacccatagttaaagctcttgg

SEQ ID NO: 624634 - DNA, 25 bp, Mus musculus
gaaaaccctcagaagagtttaatgg

SEQ ID NO: 624635 - DNA, 25 bp, Mus musculus
gaaaaccctcagtagagtttaatgg

SEQ ID NO: 624636 - DNA, 25 bp, Mus musculus
gaaaaccctgctagagaagtacaca

SEQ ID NO: 624637 - DNA, 25 bp, Mus musculus
gaaaaccctgcttgagaagtacaca

SEQ ID NO: 624638 - DNA, 25 bp, Mus musculus
gaaaaccctgtcactataaactaca

SEQ ID NO: 624639 - DNA, 25 bp, Mus musculus
gaaaaccctgtctctataaactaca

SEQ ID NO: 624640 - DNA, 25 bp, Mus musculus
gaaaaccgaaatctgagcaacctgg

SEQ ID NO: 624641 - DNA, 25 bp, Mus musculus
gaaaaccgaaatgtgagcaacctgg

SEQ ID NO: 624642 - DNA, 25 bp, Mus musculus
gaaaacctagaaatacagctacaat

SEQ ID NO: 624643 - DNA, 25 bp, Mus musculus
gaaaacctagaattacagctacaat

SEQ ID NO: 624644 - DNA, 25 bp, Mus musculus
gaaaacctcattaggctcactgaag

SEQ ID NO: 624645 - DNA, 25 bp, Mus musculus
gaaaacctcatttggctcactgaag

SEQ ID NO: 624646 - DNA, 25 bp, Mus musculus
gaaaacctccagctcttcctgggtt

SEQ ID NO: 624647 - DNA, 25 bp, Mus musculus
gaaaacctccaggtcttcctgggtt

SEQ ID NO: 624648 - DNA, 25 bp, Mus musculus
gaaaacctctatcagctaatgaaag

SEQ ID NO: 624649 - DNA, 25 bp, Mus musculus
gaaaacctctatgagctaatgaaag

SEQ ID NO: 624650 - DNA, 25 bp, Mus musculus
gaaaacctgaaaaccacaaatgtcg

SEQ ID NO: 624651 - DNA, 25 bp, Mus musculus
gaaaacctgaaatccacaaatgtcg

SEQ ID NO: 624652 - DNA, 25 bp, Mus musculus
gaaaacctgaatctagccatgccca

SEQ ID NO: 624653 - DNA, 25 bp, Mus musculus
gaaaacctgaatgtagccatgccca

SEQ ID NO: 624654 - DNA, 25 bp, Mus musculus
gaaaacctgagtcatgacagagaaa

SEQ ID NO: 624655 - DNA, 25 bp, Mus musculus
gaaaacctgagtgatgacagagaaa

SEQ ID NO: 624656 - DNA, 25 bp, Mus musculus
gaaaacctgttaatacctgtgtgct

SEQ ID NO: 624657 - DNA, 25 bp, Mus musculus
gaaaacctgttattacctgtgtgct

SEQ ID NO: 624658 - DNA, 25 bp, Mus musculus
gaaaaccttagtatgcaccagatgc

SEQ ID NO: 624659 - DNA, 25 bp, Mus musculus
gaaaaccttagtttgcaccagatgc

SEQ ID NO: 624660 - DNA, 25 bp, Mus musculus
gaaaaccttattcctgatgcccagg

SEQ ID NO: 624661 - DNA, 25 bp, Mus musculus
gaaaaccttattgctgatgcccagg

SEQ ID NO: 624662 - DNA, 25 bp, Mus musculus
gaaaaccttcccacatataaactag

SEQ ID NO: 624663 - DNA, 25 bp, Mus musculus
gaaaaccttccctcatataaactag

SEQ ID NO: 624664 - DNA, 25 bp, Mus musculus
gaaaaccttcctctggagaacacag

SEQ ID NO: 624665 - DNA, 25 bp, Mus musculus
gaaaaccttcctgtggagaacacag

SEQ ID NO: 624666 - DNA, 25 bp, Mus musculus
gaaaaccttgagcagcccatggccc

SEQ ID NO: 624667 - DNA, 25 bp, Mus musculus
gaaaaccttgaggagcccatggccc

SEQ ID NO: 624668 - DNA, 25 bp, Mus musculus
gaaaaccttgtacgagaagatcaag

SEQ ID NO: 624669 - DNA, 25 bp, Mus musculus
gaaaaccttgtaggagaagatcaag

SEQ ID NO: 624670 - DNA, 25 bp, Mus musculus
gaaaacgaacctctacaagtggctg

SEQ ID NO: 624671 - DNA, 25 bp, Mus musculus
gaaaacgaacctgtacaagtggctg

SEQ ID NO: 624672 - DNA, 25 bp, Mus musculus
gaaaacgaactgaacatcgtatatg

SEQ ID NO: 624673 - DNA, 25 bp, Mus musculus
gaaaacgaactgtacatcgtatatg

SEQ ID NO: 624674 - DNA, 25 bp, Mus musculus
gaaaacgaacttcacctgaaactcg

SEQ ID NO: 624675 - DNA, 25 bp, Mus musculus
gaaaacgaacttgacctgaaactcg

SEQ ID NO: 624676 - DNA, 25 bp, Mus musculus
gaaaacgacagtaaatcaatccaga

SEQ ID NO: 624677 - DNA, 25 bp, Mus musculus
gaaaacgacagttaatcaatccaga

SEQ ID NO: 624678 - DNA, 25 bp, Mus musculus
gaaaacgagccacaaacatgcatgg

SEQ ID NO: 624679 - DNA, 25 bp, Mus musculus
gaaaacgagccagaaacatgcatgg

SEQ ID NO: 624680 - DNA, 25 bp, Mus musculus
gaaaacgagggccaattggaccaag

SEQ ID NO: 624681 - DNA, 25 bp, Mus musculus
gaaaacgagggcgaattggaccaag

SEQ ID NO: 624682 - DNA, 25 bp, Mus musculus
gaaaacgatacactgttgacaaatc

SEQ ID NO: 624683 - DNA, 25 bp, Mus musculus
gaaaacgatacagtgttgacaaatc

SEQ ID NO: 624684 - DNA, 25 bp, Mus musculus
gaaaacgatagccaggagaagctca

SEQ ID NO: 624685 - DNA, 25 bp, Mus musculus
gaaaacgatagcgaggagaagctca

SEQ ID NO: 624686 - DNA, 25 bp, Mus musculus
gaaaacgcaaggaatgtcccgacca

SEQ ID NO: 624687 - DNA, 25 bp, Mus musculus
gaaaacgcaaggtatgtcccgacca

SEQ ID NO: 624688 - DNA, 25 bp, Mus musculus
gaaaacgcaggcagcaccaaaatca

SEQ ID NO: 624689 - DNA, 25 bp, Mus musculus
gaaaacgcaggctgcaccaaaatca

SEQ ID NO: 624690 - DNA, 25 bp, Mus musculus
gaaaacgctgtcatctagacaggta

SEQ ID NO: 624691 - DNA, 25 bp, Mus musculus
gaaaacgctgtcttctagacaggta

SEQ ID NO: 624692 - DNA, 25 bp, Mus musculus
gaaaacgcttcaccatctggagaca

SEQ ID NO: 624693 - DNA, 25 bp, Mus musculus
gaaaacgcttcagcatctggagaca

SEQ ID NO: 624694 - DNA, 25 bp, Mus musculus
gaaaacgctttgagctttaacactg

SEQ ID NO: 624695 - DNA, 25 bp, Mus musculus
gaaaacgctttgtgctttaacactg

SEQ ID NO: 624696 - DNA, 25 bp, Mus musculus
gaaaacggcaacaatccattgaaaa

SEQ ID NO: 624697 - DNA, 25 bp, Mus musculus
gaaaacggcaactatccattgaaaa

SEQ ID NO: 624698 - DNA, 25 bp, Mus musculus
gaaaacggtgaccaacaacttgaag

SEQ ID NO: 624699 - DNA, 25 bp, Mus musculus
gaaaacggtgacgaacaacttgaag

SEQ ID NO: 624700 - DNA, 25 bp, Mus musculus
gaaaacgtacgtccaggagcattct

SEQ ID NO: 624701 - DNA, 25 bp, Mus musculus
gaaaacgtacgtgcaggagcattct

SEQ ID NO: 624702 - DNA, 25 bp, Mus musculus
gaaaacgtcaatcctggtgctggtc

SEQ ID NO: 624703 - DNA, 25 bp, Mus musculus
gaaaacgtcaatgctggtgctggtc

SEQ ID NO: 624704 - DNA, 25 bp, Mus musculus
gaaaactaaagaacctgtaatcatg

SEQ ID NO: 624705 - DNA, 25 bp, Mus musculus
gaaaactaaagatcctgtaatcatg

SEQ ID NO: 624706 - DNA, 25 bp, Mus musculus
gaaaactaagggcatgcaggacctc

SEQ ID NO: 624707 - DNA, 25 bp, Mus musculus
gaaaactaaggggatgcaggacctc

SEQ ID NO: 624708 - DNA, 25 bp, Mus musculus
gaaaactaagtgcaataaatacgct

SEQ ID NO: 624709 - DNA, 25 bp, Mus musculus
gaaaactaagtggaataaatacgct

SEQ ID NO: 624710 - DNA, 25 bp, Mus musculus
gaaaactacaacagatcacaatacg

SEQ ID NO: 624711 - DNA, 25 bp, Mus musculus
gaaaactacaactgatcacaatacg

SEQ ID NO: 624712 - DNA, 25 bp, Mus musculus
gaaaactacaggattctcagtcggc

SEQ ID NO: 624713 - DNA, 25 bp, Mus musculus
gaaaactacaggtttctcagtcggc

SEQ ID NO: 624714 - DNA, 25 bp, Mus musculus
gaaaactacgcgacagtggttggct

SEQ ID NO: 624715 - DNA, 25 bp, Mus musculus
gaaaactacgcgtcagtggttggct

SEQ ID NO: 624716 - DNA, 25 bp, Mus musculus
gaaaactatcatcgctggattgcag

SEQ ID NO: 624717 - DNA, 25 bp, Mus musculus
gaaaactatcatggctggattgcag

SEQ ID NO: 624718 - DNA, 25 bp, Mus musculus
gaaaactatctcaatgatcccagct

SEQ ID NO: 624719 - DNA, 25 bp, Mus musculus
gaaaactatctctatgatcccagct

SEQ ID NO: 624720 - DNA, 25 bp, Mus musculus
gaaaactatgaacatatccgaggat

SEQ ID NO: 624721 - DNA, 25 bp, Mus musculus
gaaaactatgaagatatccgaggat

SEQ ID NO: 624722 - DNA, 25 bp, Mus musculus
gaaaactatgatctgtgcgcgcgtg

SEQ ID NO: 624723 - DNA, 25 bp, Mus musculus
gaaaactatgatgtgtgcgcgcgtg

SEQ ID NO: 624724 - DNA, 25 bp, Mus musculus
gaaaactatgccctcgtgtactcct

SEQ ID NO: 624725 - DNA, 25 bp, Mus musculus
gaaaactatgccgtcgtgtactcct

SEQ ID NO: 624726 - DNA, 25 bp, Mus musculus
gaaaactcaaatagatgataggaac

SEQ ID NO: 624727 - DNA, 25 bp, Mus musculus
gaaaactcaaattgatgataggaac

SEQ ID NO: 624728 - DNA, 25 bp, Mus musculus
gaaaactcagtgaggcgtgttttta

SEQ ID NO: 624729 - DNA, 25 bp, Mus musculus
gaaaactcagtgtggcgtgttttta

SEQ ID NO: 624730 - DNA, 25 bp, Mus musculus
gaaaactcatcaactgggacagtta

SEQ ID NO: 624731 - DNA, 25 bp, Mus musculus
gaaaactcatcatctgggacagtta

SEQ ID NO: 624732 - DNA, 25 bp, Mus musculus
gaaaactccatcacctcggataata

SEQ ID NO: 624733 - DNA, 25 bp, Mus musculus
gaaaactccatctcctcggataata

SEQ ID NO: 624734 - DNA, 25 bp, Mus musculus
gaaaactcgagaatgccttcggaag

SEQ ID NO: 624735 - DNA, 25 bp, Mus musculus
gaaaactcgagattgccttcggaag

SEQ ID NO: 624736 - DNA, 25 bp, Mus musculus
gaaaactcgagtacaggcaggcaat

SEQ ID NO: 624737 - DNA, 25 bp, Mus musculus
gaaaactcgagttcaggcaggcaat

SEQ ID NO: 624738 - DNA, 25 bp, Mus musculus
gaaaactcggccatccagaaagtgg

SEQ ID NO: 624739 - DNA, 25 bp, Mus musculus
gaaaactcggccttccagaaagtgg

SEQ ID NO: 624740 - DNA, 25 bp, Mus musculus
gaaaactcgggaagacctggcaagg

SEQ ID NO: 624741 - DNA, 25 bp, Mus musculus
gaaaactcgggatgacctggcaagg

SEQ ID NO: 624742 - DNA, 25 bp, Mus musculus
gaaaactctcacaagtcaagcgata

SEQ ID NO: 624743 - DNA, 25 bp, Mus musculus
gaaaactctcactagtcaagcgata

SEQ ID NO: 624744 - DNA, 25 bp, Mus musculus
gaaaactctgttatggatcacaaca

SEQ ID NO: 624745 - DNA, 25 bp, Mus musculus
gaaaactctgttttggatcacaaca

SEQ ID NO: 624746 - DNA, 25 bp, Mus musculus
gaaaactgaacacgcgaacaagctt

SEQ ID NO: 624747 - DNA, 25 bp, Mus musculus
gaaaactgaacaggcgaacaagctt

SEQ ID NO: 624748 - DNA, 25 bp, Mus musculus
gaaaactgaccgcacagagcagtgg

SEQ ID NO: 624749 - DNA, 25 bp, Mus musculus
gaaaactgaccggacagagcagtgg

SEQ ID NO: 624750 - DNA, 25 bp, Mus musculus
gaaaactgagatcgtatgtgcctcc

SEQ ID NO: 624751 - DNA, 25 bp, Mus musculus
gaaaactgagatggtatgtgcctcc

SEQ ID NO: 624752 - DNA, 25 bp, Mus musculus
gaaaactgcaagatgccagcagatc

SEQ ID NO: 624753 - DNA, 25 bp, Mus musculus
gaaaactgcaagttgccagcagatc

SEQ ID NO: 624754 - DNA, 25 bp, Mus musculus
gaaaactgcagtcggctctaaggaa

SEQ ID NO: 624755 - DNA, 25 bp, Mus musculus
gaaaactgcagtgggctctaaggaa

SEQ ID NO: 624756 - DNA, 25 bp, Mus musculus
gaaaactggaccaacagtgaccgag

SEQ ID NO: 624757 - DNA, 25 bp, Mus musculus
gaaaactggacctacagtgaccgag

SEQ ID NO: 624758 - DNA, 25 bp, Mus musculus
gaaaactggcagagtttcacaagct

SEQ ID NO: 624759 - DNA, 25 bp, Mus musculus
gaaaactggcagtgtttcacaagct

SEQ ID NO: 624760 - DNA, 25 bp, Mus musculus
gaaaactgtggacggctactgagaa

SEQ ID NO: 624761 - DNA, 25 bp, Mus musculus
gaaaactgtggagggctactgagaa

SEQ ID NO: 624762 - DNA, 25 bp, Mus musculus
gaaaacttaataatcaacccagcct

SEQ ID NO: 624763 - DNA, 25 bp, Mus musculus
gaaaacttaatattcaacccagcct

SEQ ID NO: 624764 - DNA, 25 bp, Mus musculus
gaaaacttaatcacagactcaaaca

SEQ ID NO: 624765 - DNA, 25 bp, Mus musculus
gaaaacttaatccaatacaaatggc

SEQ ID NO: 624766 - DNA, 25 bp, Mus musculus
gaaaacttaatcgaatacaaatggc

SEQ ID NO: 624767 - DNA, 25 bp, Mus musculus
gaaaacttaatctcagactcaaaca

SEQ ID NO: 624768 - DNA, 25 bp, Mus musculus
gaaaacttagaaaatcaggttgctg

SEQ ID NO: 624769 - DNA, 25 bp, Mus musculus
gaaaacttagaatatcaggttgctg

SEQ ID NO: 624770 - DNA, 25 bp, Mus musculus
gaaaacttatccatgaaggctgcct

SEQ ID NO: 624771 - DNA, 25 bp, Mus musculus
gaaaacttatccttgaaggctgcct

SEQ ID NO: 624772 - DNA, 25 bp, Mus musculus
gaaaacttattaagcctgtgctccc

SEQ ID NO: 624773 - DNA, 25 bp, Mus musculus
gaaaacttattatgcctgtgctccc

SEQ ID NO: 624774 - DNA, 25 bp, Mus musculus
gaaaacttcaccctactcatcaaga

SEQ ID NO: 624775 - DNA, 25 bp, Mus musculus
gaaaacttcaccgtactcatcaaga

SEQ ID NO: 624776 - DNA, 25 bp, Mus musculus
gaaaacttgactcacccatctgtaa

SEQ ID NO: 624777 - DNA, 25 bp, Mus musculus
gaaaacttgactgacccatctgtaa

SEQ ID NO: 624778 - DNA, 25 bp, Mus musculus
gaaaacttgcatctgccaatgagtc

SEQ ID NO: 624779 - DNA, 25 bp, Mus musculus
gaaaacttgcatgtgccaatgagtc

SEQ ID NO: 624780 - DNA, 25 bp, Mus musculus
gaaaactttgcacaacgttgggaca

SEQ ID NO: 624781 - DNA, 25 bp, Mus musculus
gaaaactttgcagaacgttgggaca

SEQ ID NO: 624782 - DNA, 25 bp, Mus musculus
gaaaagaaacatccaagccacggag

SEQ ID NO: 624783 - DNA, 25 bp, Mus musculus
gaaaagaaacatgcaagccacggag

SEQ ID NO: 624784 - DNA, 25 bp, Mus musculus
gaaaagaaacctcctgttggcgtat

SEQ ID NO: 624785 - DNA, 25 bp, Mus musculus
gaaaagaaacctgctgttggcgtat

SEQ ID NO: 624786 - DNA, 25 bp, Mus musculus
gaaaagaaagggacccgatcctctg

SEQ ID NO: 624787 - DNA, 25 bp, Mus musculus
gaaaagaaagggtcccgatcctctg

SEQ ID NO: 624788 - DNA, 25 bp, Mus musculus
gaaaagaaagtaatcctggagaagc

SEQ ID NO: 624789 - DNA, 25 bp, Mus musculus
gaaaagaaagtattcctggagaagc

SEQ ID NO: 624790 - DNA, 25 bp, Mus musculus
gaaaagaaatctattagccttgaag

SEQ ID NO: 624791 - DNA, 25 bp, Mus musculus
gaaaagaaatcttttagccttgaag

SEQ ID NO: 624792 - DNA, 25 bp, Mus musculus
gaaaagaaatgaccaatcagttgcc

SEQ ID NO: 624793 - DNA, 25 bp, Mus musculus
gaaaagaaatgagcaatcagttgcc

SEQ ID NO: 624794 - DNA, 25 bp, Mus musculus
gaaaagaacacaaggagaaattggt

SEQ ID NO: 624795 - DNA, 25 bp, Mus musculus
gaaaagaacacatggagaaattggt

SEQ ID NO: 624796 - DNA, 25 bp, Mus musculus
gaaaagaacatcctacacatcatga

SEQ ID NO: 624797 - DNA, 25 bp, Mus musculus
gaaaagaacatcgtacacatcatga

SEQ ID NO: 624798 - DNA, 25 bp, Mus musculus
gaaaagaactgtcgactaatagaga

SEQ ID NO: 624799 - DNA, 25 bp, Mus musculus
gaaaagaactgtggactaatagaga

SEQ ID NO: 624800 - DNA, 25 bp, Mus musculus
gaaaagaagcggcatcaccaaacgc

SEQ ID NO: 624801 - DNA, 25 bp, Mus musculus
gaaaagaagcgggatcaccaaacgc

SEQ ID NO: 624802 - DNA, 25 bp, Mus musculus
gaaaagaaggagagaagctgcctgc

SEQ ID NO: 624803 - DNA, 25 bp, Mus musculus
gaaaagaaggagtgaagctgcctgc

SEQ ID NO: 624804 - DNA, 25 bp, Mus musculus
gaaaagaaggcgatcattattagcc

SEQ ID NO: 624805 - DNA, 25 bp, Mus musculus
gaaaagaaggcgttcattattagcc

SEQ ID NO: 624806 - DNA, 25 bp, Mus musculus
gaaaagaagtacacgaacaagactg

SEQ ID NO: 624807 - DNA, 25 bp, Mus musculus
gaaaagaagtactcgaacaagactg

SEQ ID NO: 624808 - DNA, 25 bp, Mus musculus
gaaaagaatccacatatggttgctg

SEQ ID NO: 624809 - DNA, 25 bp, Mus musculus
gaaaagaatccagatatggttgctg

SEQ ID NO: 624810 - DNA, 25 bp, Mus musculus
gaaaagaatgccattgagtccctct

SEQ ID NO: 624811 - DNA, 25 bp, Mus musculus
gaaaagaatgcctttgagtccctct

SEQ ID NO: 624812 - DNA, 25 bp, Mus musculus
gaaaagaatgctaaagccttcccat

SEQ ID NO: 624813 - DNA, 25 bp, Mus musculus
gaaaagaatgctcctgctatcatct

SEQ ID NO: 624814 - DNA, 25 bp, Mus musculus
gaaaagaatgctgctgctatcatct

SEQ ID NO: 624815 - DNA, 25 bp, Mus musculus
gaaaagaatgcttaagccttcccat

SEQ ID NO: 624816 - DNA, 25 bp, Mus musculus
gaaaagaatttcaaccagacttgag

SEQ ID NO: 624817 - DNA, 25 bp, Mus musculus
gaaaagaatttctaccagacttgag

SEQ ID NO: 624818 - DNA, 25 bp, Mus musculus
gaaaagaccaggcactacctgctcc

SEQ ID NO: 624819 - DNA, 25 bp, Mus musculus
gaaaagaccagggactacctgctcc

SEQ ID NO: 624820 - DNA, 25 bp, Mus musculus
gaaaagacccgcaggcttaacactc

SEQ ID NO: 624821 - DNA, 25 bp, Mus musculus
gaaaagacccgctggcttaacactc

SEQ ID NO: 624822 - DNA, 25 bp, Mus musculus
gaaaagacggaacccttgacttctg

SEQ ID NO: 624823 - DNA, 25 bp, Mus musculus
gaaaagacggaagccttgacttctg

SEQ ID NO: 624824 - DNA, 25 bp, Mus musculus
gaaaagacggctccaaacgttctgt

SEQ ID NO: 624825 - DNA, 25 bp, Mus musculus
gaaaagacggctgcaaacgttctgt

SEQ ID NO: 624826 - DNA, 25 bp, Mus musculus
gaaaagacgggaagctgtatgcatt

SEQ ID NO: 624827 - DNA, 25 bp, Mus musculus
gaaaagacgggatgctgtatgcatt

SEQ ID NO: 624828 - DNA, 25 bp, Mus musculus
gaaaagacggtcaaccatgcagaag

SEQ ID NO: 624829 - DNA, 25 bp, Mus musculus
gaaaagacggtctaccatgcagaag

SEQ ID NO: 624830 - DNA, 25 bp, Mus musculus
gaaaagacggtgatacatcgctgac

SEQ ID NO: 624831 - DNA, 25 bp, Mus musculus
gaaaagacggtgttacatcgctgac

SEQ ID NO: 624832 - DNA, 25 bp, Mus musculus
gaaaagactcgaatccgttctggaa

SEQ ID NO: 624833 - DNA, 25 bp, Mus musculus
gaaaagactcgattccgttctggaa

SEQ ID NO: 624834 - DNA, 25 bp, Mus musculus
gaaaagactgataccctggaacatg

SEQ ID NO: 624835 - DNA, 25 bp, Mus musculus
gaaaagactgattccctggaacatg

SEQ ID NO: 624836 - DNA, 25 bp, Mus musculus
gaaaagactgctctgatcaatgctg

SEQ ID NO: 624837 - DNA, 25 bp, Mus musculus
gaaaagactgctgtgatcaatgctg

SEQ ID NO: 624838 - DNA, 25 bp, Mus musculus
gaaaagacttccatccgccaacatg

SEQ ID NO: 624839 - DNA, 25 bp, Mus musculus
gaaaagacttccttccgccaacatg

SEQ ID NO: 624840 - DNA, 25 bp, Mus musculus
gaaaagagcagaattgaagctggaa

SEQ ID NO: 624841 - DNA, 25 bp, Mus musculus
gaaaagagcagatttgaagctggaa

SEQ ID NO: 624842 - DNA, 25 bp, Mus musculus
gaaaagagccaaagaactgccgtgt

SEQ ID NO: 624843 - DNA, 25 bp, Mus musculus
gaaaagagccaatgaactgccgtgt

SEQ ID NO: 624844 - DNA, 25 bp, Mus musculus
gaaaagagccctacctacggcgtgc

SEQ ID NO: 624845 - DNA, 25 bp, Mus musculus
gaaaagagccctctgaataactcag

SEQ ID NO: 624846 - DNA, 25 bp, Mus musculus
gaaaagagccctgtgaataactcag

SEQ ID NO: 624847 - DNA, 25 bp, Mus musculus
gaaaagagcccttcctacggcgtgc

SEQ ID NO: 624848 - DNA, 25 bp, Mus musculus
gaaaagagcttcctatgcagccggg

SEQ ID NO: 624849 - DNA, 25 bp, Mus musculus
gaaaagagcttcctggttgccttgg

SEQ ID NO: 624850 - DNA, 25 bp, Mus musculus
gaaaagagcttcgtatgcagccggg

SEQ ID NO: 624851 - DNA, 25 bp, Mus musculus
gaaaagagcttcgtggttgccttgg

SEQ ID NO: 624852 - DNA, 25 bp, Mus musculus
gaaaagagggccagttgcatcagcc

SEQ ID NO: 624853 - DNA, 25 bp, Mus musculus
gaaaagagggcctgttgcatcagcc

SEQ ID NO: 624854 - DNA, 25 bp, Mus musculus
gaaaagaggtacaacagtgtcctgt

SEQ ID NO: 624855 - DNA, 25 bp, Mus musculus
gaaaagaggtactacagtgtcctgt

SEQ ID NO: 624856 - DNA, 25 bp, Mus musculus
gaaaagagtaaacataagttcatgg

SEQ ID NO: 624857 - DNA, 25 bp, Mus musculus
gaaaagagtaaagataagttcatgg

SEQ ID NO: 624858 - DNA, 25 bp, Mus musculus
gaaaagagtatgcaatagccctgcc

SEQ ID NO: 624859 - DNA, 25 bp, Mus musculus
gaaaagagtatggaatagccctgcc

SEQ ID NO: 624860 - DNA, 25 bp, Mus musculus
gaaaagagtcatcaatccaagagcc

SEQ ID NO: 624861 - DNA, 25 bp, Mus musculus
gaaaagagtcatgaatccaagagcc

SEQ ID NO: 624862 - DNA, 25 bp, Mus musculus
gaaaagagtctgctcctccgtggaa

SEQ ID NO: 624863 - DNA, 25 bp, Mus musculus
gaaaagagtctggtcctccgtggaa

SEQ ID NO: 624864 - DNA, 25 bp, Mus musculus
gaaaagagtcttaggatgtctatga

SEQ ID NO: 624865 - DNA, 25 bp, Mus musculus
gaaaagagtctttggatgtctatga

SEQ ID NO: 624866 - DNA, 25 bp, Mus musculus
gaaaagagtggtagtatactggaaa

SEQ ID NO: 624867 - DNA, 25 bp, Mus musculus
gaaaagagtggtatcgatttcccag

SEQ ID NO: 624868 - DNA, 25 bp, Mus musculus
gaaaagagtggttgtatactggaaa

SEQ ID NO: 624869 - DNA, 25 bp, Mus musculus
gaaaagagtggtttcgatttcccag

SEQ ID NO: 624870 - DNA, 25 bp, Mus musculus
gaaaagagtttaaccagcccaactg

SEQ ID NO: 624871 - DNA, 25 bp, Mus musculus
gaaaagagtttatccagcccaactg

SEQ ID NO: 624872 - DNA, 25 bp, Mus musculus
gaaaagataactcagacagaccacg

SEQ ID NO: 624873 - DNA, 25 bp, Mus musculus
gaaaagataactgagacagaccacg

SEQ ID NO: 624874 - DNA, 25 bp, Mus musculus
gaaaagatcacacagagctccctga

SEQ ID NO: 624875 - DNA, 25 bp, Mus musculus
gaaaagatcacagagagctccctga

SEQ ID NO: 624876 - DNA, 25 bp, Mus musculus
gaaaagatgacaaaagtccgcggtt

SEQ ID NO: 624877 - DNA, 25 bp, Mus musculus
gaaaagatgacataagtccgcggtt

SEQ ID NO: 624878 - DNA, 25 bp, Mus musculus
gaaaagatgcataattaccacgggt

SEQ ID NO: 624879 - DNA, 25 bp, Mus musculus
gaaaagatgcattattaccacgggt

SEQ ID NO: 624880 - DNA, 25 bp, Mus musculus
gaaaagatgcgtagccacatggccc

SEQ ID NO: 624881 - DNA, 25 bp, Mus musculus
gaaaagatgcgttgccacatggccc

SEQ ID NO: 624882 - DNA, 25 bp, Mus musculus
gaaaagatggtaacaatagaattgc

SEQ ID NO: 624883 - DNA, 25 bp, Mus musculus
gaaaagatggtaatgtgcagggtca

SEQ ID NO: 624884 - DNA, 25 bp, Mus musculus
gaaaagatggtatcaatagaattgc

SEQ ID NO: 624885 - DNA, 25 bp, Mus musculus
gaaaagatggtattgtgcagggtca

SEQ ID NO: 624886 - DNA, 25 bp, Mus musculus
gaaaagatgtttcgttttcacaagc

SEQ ID NO: 624887 - DNA, 25 bp, Mus musculus
gaaaagatgtttggttttcacaagc

SEQ ID NO: 624888 - DNA, 25 bp, Mus musculus
gaaaagattggaacggaagaatgag

SEQ ID NO: 624889 - DNA, 25 bp, Mus musculus
gaaaagattggatcggaagaatgag

SEQ ID NO: 624890 - DNA, 25 bp, Mus musculus
gaaaagcaactactagcggaatgga

SEQ ID NO: 624891 - DNA, 25 bp, Mus musculus
gaaaagcaactagtagcggaatgga

SEQ ID NO: 624892 - DNA, 25 bp, Mus musculus
gaaaagcaagtaagaggacctcaac

SEQ ID NO: 624893 - DNA, 25 bp, Mus musculus
gaaaagcaagtatgaggacctcaac

SEQ ID NO: 624894 - DNA, 25 bp, Mus musculus
gaaaagcaatacattatccacatga

SEQ ID NO: 624895 - DNA, 25 bp, Mus musculus
gaaaagcaatactttatccacatga

SEQ ID NO: 624896 - DNA, 25 bp, Mus musculus
gaaaagcaccaaactgacttgagaa

SEQ ID NO: 624897 - DNA, 25 bp, Mus musculus
gaaaagcaccaatctgacttgagaa

SEQ ID NO: 624898 - DNA, 25 bp, Mus musculus
gaaaagcaccatctccacggagttg

SEQ ID NO: 624899 - DNA, 25 bp, Mus musculus
gaaaagcaccatgtccacggagttg

SEQ ID NO: 624900 - DNA, 25 bp, Mus musculus
gaaaagcagacaaccaacaacacta

SEQ ID NO: 624901 - DNA, 25 bp, Mus musculus
gaaaagcagacatccaacaacacta

SEQ ID NO: 624902 - DNA, 25 bp, Mus musculus
gaaaagcagctcctggaaagcacgg

SEQ ID NO: 624903 - DNA, 25 bp, Mus musculus
gaaaagcagctcgtggaaagcacgg

SEQ ID NO: 624904 - DNA, 25 bp, Mus musculus
gaaaagcaggacacctctcagagag

SEQ ID NO: 624905 - DNA, 25 bp, Mus musculus
gaaaagcaggactcctctcagagag

SEQ ID NO: 624906 - DNA, 25 bp, Mus musculus
gaaaagcaggatcaacaagtgggcc

SEQ ID NO: 624907 - DNA, 25 bp, Mus musculus
gaaaagcaggatgaacaagtgggcc

SEQ ID NO: 624908 - DNA, 25 bp, Mus musculus
gaaaagcaggcaaacgaagagccca

SEQ ID NO: 624909 - DNA, 25 bp, Mus musculus
gaaaagcaggcatacgaagagccca

SEQ ID NO: 624910 - DNA, 25 bp, Mus musculus
gaaaagcaggtgaacgtggcctccg

SEQ ID NO: 624911 - DNA, 25 bp, Mus musculus
gaaaagcaggtgtacgtggcctccg

SEQ ID NO: 624912 - DNA, 25 bp, Mus musculus
gaaaagcatggaacaattcatcgtg

SEQ ID NO: 624913 - DNA, 25 bp, Mus musculus
gaaaagcatggatcaattcatcgtg

SEQ ID NO: 624914 - DNA, 25 bp, Mus musculus
gaaaagccacaaatgaataccaggt

SEQ ID NO: 624915 - DNA, 25 bp, Mus musculus
gaaaagccacaattgaataccaggt

SEQ ID NO: 624916 - DNA, 25 bp, Mus musculus
gaaaagccagttcaagcgttgggaa

SEQ ID NO: 624917 - DNA, 25 bp, Mus musculus
gaaaagccagttcggaatactcaca

SEQ ID NO: 624918 - DNA, 25 bp, Mus musculus
gaaaagccagttgaagcgttgggaa

SEQ ID NO: 624919 - DNA, 25 bp, Mus musculus
gaaaagccagttgggaatactcaca

SEQ ID NO: 624920 - DNA, 25 bp, Mus musculus
gaaaagcccagaaagtgagcatggc

SEQ ID NO: 624921 - DNA, 25 bp, Mus musculus
gaaaagcccagatagtgagcatggc

SEQ ID NO: 624922 - DNA, 25 bp, Mus musculus
gaaaagcccaggctgataataaatg

SEQ ID NO: 624923 - DNA, 25 bp, Mus musculus
gaaaagcccagggtgataataaatg

SEQ ID NO: 624924 - DNA, 25 bp, Mus musculus
gaaaagcccgtgaagaatgcttctg

SEQ ID NO: 624925 - DNA, 25 bp, Mus musculus
gaaaagcccgtgtagaatgcttctg

SEQ ID NO: 624926 - DNA, 25 bp, Mus musculus
gaaaagccggctatgtcgtcgaagc

SEQ ID NO: 624927 - DNA, 25 bp, Mus musculus
gaaaagccggctttgtcgtcgaagc

SEQ ID NO: 624928 - DNA, 25 bp, Mus musculus
gaaaagccgtccagcctcttgtcca

SEQ ID NO: 624929 - DNA, 25 bp, Mus musculus
gaaaagccgtcctgcctcttgtcca

SEQ ID NO: 624930 - DNA, 25 bp, Mus musculus
gaaaagcctgtcatacagaggccct

SEQ ID NO: 624931 - DNA, 25 bp, Mus musculus
gaaaagcctgtcttacagaggccct

SEQ ID NO: 624932 - DNA, 25 bp, Mus musculus
gaaaagcctgtgatcccgtcagtag

SEQ ID NO: 624933 - DNA, 25 bp, Mus musculus
gaaaagcctgtgttcccgtcagtag

SEQ ID NO: 624934 - DNA, 25 bp, Mus musculus
gaaaagcctttgatccgtgggatgg

SEQ ID NO: 624935 - DNA, 25 bp, Mus musculus
gaaaagcctttgttccgtgggatgg

SEQ ID NO: 624936 - DNA, 25 bp, Mus musculus
gaaaagcgacatcttttgcaccttg

SEQ ID NO: 624937 - DNA, 25 bp, Mus musculus
gaaaagcgacatgttttgcaccttg

SEQ ID NO: 624938 - DNA, 25 bp, Mus musculus
gaaaagcggacgatgatcaaagcct

SEQ ID NO: 624939 - DNA, 25 bp, Mus musculus
gaaaagcggacgttgatcaaagcct

SEQ ID NO: 624940 - DNA, 25 bp, Mus musculus
gaaaagcggcccacactaagaaagg

SEQ ID NO: 624941 - DNA, 25 bp, Mus musculus
gaaaagcggccctcactaagaaagg

SEQ ID NO: 624942 - DNA, 25 bp, Mus musculus
gaaaagcggctgactgatcctgggt

SEQ ID NO: 624943 - DNA, 25 bp, Mus musculus
gaaaagcggctgtctgatcctgggt

SEQ ID NO: 624944 - DNA, 25 bp, Mus musculus
gaaaagcgtcacaattacaacatta

SEQ ID NO: 624945 - DNA, 25 bp, Mus musculus
gaaaagcgtcactattacaacatta

SEQ ID NO: 624946 - DNA, 25 bp, Mus musculus
gaaaagctaacacatgaagaagtag

SEQ ID NO: 624947 - DNA, 25 bp, Mus musculus
gaaaagctaacagatgaagaagtag

SEQ ID NO: 624948 - DNA, 25 bp, Mus musculus
gaaaagctaaccagtaactccggtg

SEQ ID NO: 624949 - DNA, 25 bp, Mus musculus
gaaaagctaacctgtaactccggtg

SEQ ID NO: 624950 - DNA, 25 bp, Mus musculus
gaaaagctactccttcctgagagag

SEQ ID NO: 624951 - DNA, 25 bp, Mus musculus
gaaaagctactcgttcctgagagag

SEQ ID NO: 624952 - DNA, 25 bp, Mus musculus
gaaaagctcacaagtaaatcgattg

SEQ ID NO: 624953 - DNA, 25 bp, Mus musculus
gaaaagctcacatgtaaatcgattg

SEQ ID NO: 624954 - DNA, 25 bp, Mus musculus
gaaaagctcgccacgaatgtcacgt

SEQ ID NO: 624955 - DNA, 25 bp, Mus musculus
gaaaagctcgcctcgaatgtcacgt

SEQ ID NO: 624956 - DNA, 25 bp, Mus musculus
gaaaagctcttgattgccgagctaa

SEQ ID NO: 624957 - DNA, 25 bp, Mus musculus
gaaaagctcttgtttgccgagctaa

SEQ ID NO: 624958 - DNA, 25 bp, Mus musculus
gaaaagctgacgcaggctgccatcg

SEQ ID NO: 624959 - DNA, 25 bp, Mus musculus
gaaaagctgacggaggctgccatcg

SEQ ID NO: 624960 - DNA, 25 bp, Mus musculus
gaaaagctgcggaaggagatttaca

SEQ ID NO: 624961 - DNA, 25 bp, Mus musculus
gaaaagctgcggtaggagatttaca

SEQ ID NO: 624962 - DNA, 25 bp, Mus musculus
gaaaagctgctgacagccactggca

SEQ ID NO: 624963 - DNA, 25 bp, Mus musculus
gaaaagctgctgtcagccactggca

SEQ ID NO: 624964 - DNA, 25 bp, Mus musculus
gaaaagctggaacctcaaggccctc

SEQ ID NO: 624965 - DNA, 25 bp, Mus musculus
gaaaagctggaagctcaaggccctc

SEQ ID NO: 624966 - DNA, 25 bp, Mus musculus
gaaaagctgggtcgagtagtacata

SEQ ID NO: 624967 - DNA, 25 bp, Mus musculus
gaaaagctgggtggagtagtacata

SEQ ID NO: 624968 - DNA, 25 bp, Mus musculus
gaaaagcttcaacaaatcttcatcg

SEQ ID NO: 624969 - DNA, 25 bp, Mus musculus
gaaaagcttcaagaaatcttcatcg

SEQ ID NO: 624970 - DNA, 25 bp, Mus musculus
gaaaagcttcctagagatgatgcag

SEQ ID NO: 624971 - DNA, 25 bp, Mus musculus
gaaaagcttccttgagatgatgcag

SEQ ID NO: 624972 - DNA, 25 bp, Mus musculus
gaaaagctttgcataagggttgcat

SEQ ID NO: 624973 - DNA, 25 bp, Mus musculus
gaaaagctttgcttaagggttgcat

SEQ ID NO: 624974 - DNA, 25 bp, Mus musculus
gaaaagcttttgcactgctgaaggc

SEQ ID NO: 624975 - DNA, 25 bp, Mus musculus
gaaaagcttttggactgctgaaggc

SEQ ID NO: 624976 - DNA, 25 bp, Mus musculus
gaaaaggaaaagactcgaccaagat

SEQ ID NO: 624977 - DNA, 25 bp, Mus musculus
gaaaaggaaaagtctcgaccaagat

SEQ ID NO: 624978 - DNA, 25 bp, Mus musculus
gaaaaggaacgtcagagaattacag

SEQ ID NO: 624979 - DNA, 25 bp, Mus musculus
gaaaaggaacgtgagagaattacag

SEQ ID NO: 624980 - DNA, 25 bp, Mus musculus
gaaaaggaagtacgactagccatcc

SEQ ID NO: 624981 - DNA, 25 bp, Mus musculus
gaaaaggaagtaggactagccatcc

SEQ ID NO: 624982 - DNA, 25 bp, Mus musculus
gaaaaggaatccagcccaactggct

SEQ ID NO: 624983 - DNA, 25 bp, Mus musculus
gaaaaggaatcctgcccaactggct

SEQ ID NO: 624984 - DNA, 25 bp, Mus musculus
gaaaaggacccacagaatgacccag

SEQ ID NO: 624985 - DNA, 25 bp, Mus musculus
gaaaaggacccagagaatgacccag

SEQ ID NO: 624986 - DNA, 25 bp, Mus musculus
gaaaaggacctcacgaagtgttgga

SEQ ID NO: 624987 - DNA, 25 bp, Mus musculus
gaaaaggacctctcgaagtgttgga

SEQ ID NO: 624988 - DNA, 25 bp, Mus musculus
gaaaaggacctgctccgtaccatgc

SEQ ID NO: 624989 - DNA, 25 bp, Mus musculus
gaaaaggacctggtccgtaccatgc

SEQ ID NO: 624990 - DNA, 25 bp, Mus musculus
gaaaaggactggaattatgctcaac

SEQ ID NO: 624991 - DNA, 25 bp, Mus musculus
gaaaaggactggtattatgctcaac

SEQ ID NO: 624992 - DNA, 25 bp, Mus musculus
gaaaaggagcagaagtcaatcaggt

SEQ ID NO: 624993 - DNA, 25 bp, Mus musculus
gaaaaggagcagtagtcaatcaggt

SEQ ID NO: 624994 - DNA, 25 bp, Mus musculus
gaaaaggaggcaccgttcctaacca

SEQ ID NO: 624995 - DNA, 25 bp, Mus musculus
gaaaaggaggcagcgttcctaacca

SEQ ID NO: 624996 - DNA, 25 bp, Mus musculus
gaaaaggatcctaagttgcagcagg

SEQ ID NO: 624997 - DNA, 25 bp, Mus musculus
gaaaaggatccttagttgcagcagg

SEQ ID NO: 624998 - DNA, 25 bp, Mus musculus
gaaaaggcaaatctccctatgaccc

SEQ ID NO: 624999 - DNA, 25 bp, Mus musculus
gaaaaggcaaatgtccctatgaccc

SEQ ID NO: 625000 - DNA, 25 bp, Mus musculus
gaaaaggcacgcagatctgtctgga

SEQ ID NO: 625001 - DNA, 25 bp, Mus musculus
gaaaaggcacgctgatctgtctgga

SEQ ID NO: 625002 - DNA, 25 bp, Mus musculus
gaaaaggcagatctcggagagctca

SEQ ID NO: 625003 - DNA, 25 bp, Mus musculus
gaaaaggcagatgtcggagagctca

SEQ ID NO: 625004 - DNA, 25 bp, Mus musculus
gaaaaggcagtcaatgtgggcgtct

SEQ ID NO: 625005 - DNA, 25 bp, Mus musculus
gaaaaggcagtctatgtgggcgtct

SEQ ID NO: 625006 - DNA, 25 bp, Mus musculus
gaaaaggcagttccaaccaggtgtg

SEQ ID NO: 625007 - DNA, 25 bp, Mus musculus
gaaaaggcagttgcaaccaggtgtg

SEQ ID NO: 625008 - DNA, 25 bp, Mus musculus
gaaaaggcatagaggcagcaacagc

SEQ ID NO: 625009 - DNA, 25 bp, Mus musculus
gaaaaggcatagtggcagcaacagc

SEQ ID NO: 625010 - DNA, 25 bp, Mus musculus
gaaaaggccaagcagcgctatgaca

SEQ ID NO: 625011 - DNA, 25 bp, Mus musculus
gaaaaggccaaggagcgctatgaca

SEQ ID NO: 625012 - DNA, 25 bp, Mus musculus
gaaaaggcctacaggttctggaagg

SEQ ID NO: 625013 - DNA, 25 bp, Mus musculus
gaaaaggcctactggttctggaagg

SEQ ID NO: 625014 - DNA, 25 bp, Mus musculus
gaaaaggcctccagtagagaaggcc

SEQ ID NO: 625015 - DNA, 25 bp, Mus musculus
gaaaaggcctcctgtagagaaggcc

SEQ ID NO: 625016 - DNA, 25 bp, Mus musculus
gaaaaggcggagcagctatgctccc

SEQ ID NO: 625017 - DNA, 25 bp, Mus musculus
gaaaaggcggaggagctatgctccc

SEQ ID NO: 625018 - DNA, 25 bp, Mus musculus
gaaaaggcgggcatttaacagtgta

SEQ ID NO: 625019 - DNA, 25 bp, Mus musculus
gaaaaggcgggcttttaacagtgta

SEQ ID NO: 625020 - DNA, 25 bp, Mus musculus
gaaaaggcgtaacttcagtaaacag

SEQ ID NO: 625021 - DNA, 25 bp, Mus musculus
gaaaaggcgtaagttcagtaaacag

SEQ ID NO: 625022 - DNA, 25 bp, Mus musculus
gaaaaggctaagcaagcacttgaga

SEQ ID NO: 625023 - DNA, 25 bp, Mus musculus
gaaaaggctaaggaagcacttgaga

SEQ ID NO: 625024 - DNA, 25 bp, Mus musculus
gaaaaggctagaaatcatcaatgaa

SEQ ID NO: 625025 - DNA, 25 bp, Mus musculus
gaaaaggctagatatcatcaatgaa

SEQ ID NO: 625026 - DNA, 25 bp, Mus musculus
gaaaaggctctacggctgcagataa

SEQ ID NO: 625027 - DNA, 25 bp, Mus musculus
gaaaaggctctagggctgcagataa

SEQ ID NO: 625028 - DNA, 25 bp, Mus musculus
gaaaagggacgtctaatcattgagt

SEQ ID NO: 625029 - DNA, 25 bp, Mus musculus
gaaaagggacgtgtaatcattgagt

SEQ ID NO: 625030 - DNA, 25 bp, Mus musculus
gaaaagggcattaacttcaaacttg

SEQ ID NO: 625031 - DNA, 25 bp, Mus musculus
gaaaagggcattcagctggcctatc

SEQ ID NO: 625032 - DNA, 25 bp, Mus musculus
gaaaagggcattcttagcacctcag

SEQ ID NO: 625033 - DNA, 25 bp, Mus musculus
gaaaagggcattgagctggcctatc

SEQ ID NO: 625034 - DNA, 25 bp, Mus musculus
gaaaagggcattgttagcacctcag

SEQ ID NO: 625035 - DNA, 25 bp, Mus musculus
gaaaagggcatttacttcaaacttg

SEQ ID NO: 625036 - DNA, 25 bp, Mus musculus
gaaaagggcctgatgctctggccag

SEQ ID NO: 625037 - DNA, 25 bp, Mus musculus
gaaaagggcctgttgctctggccag

SEQ ID NO: 625038 - DNA, 25 bp, Mus musculus
gaaaagggctatcctggccaacaat

SEQ ID NO: 625039 - DNA, 25 bp, Mus musculus
gaaaagggctatgctggccaacaat

SEQ ID NO: 625040 - DNA, 25 bp, Mus musculus
gaaaaggtaatcagaagaccttggc

SEQ ID NO: 625041 - DNA, 25 bp, Mus musculus
gaaaaggtaatctgaagaccttggc

SEQ ID NO: 625042 - DNA, 25 bp, Mus musculus
gaaaaggtcaaaccgagtgtcatcc

SEQ ID NO: 625043 - DNA, 25 bp, Mus musculus
gaaaaggtcaaagcgagtgtcatcc

SEQ ID NO: 625044 - DNA, 25 bp, Mus musculus
gaaaaggtcgaacgagatcgcaaga

SEQ ID NO: 625045 - DNA, 25 bp, Mus musculus
gaaaaggtcgaaggagatcgcaaga

SEQ ID NO: 625046 - DNA, 25 bp, Mus musculus
gaaaaggtctttaacactgcaggct

SEQ ID NO: 625047 - DNA, 25 bp, Mus musculus
gaaaaggtcttttacactgcaggct

SEQ ID NO: 625048 - DNA, 25 bp, Mus musculus
gaaaaggtgccaaacacagatgacg

SEQ ID NO: 625049 - DNA, 25 bp, Mus musculus
gaaaaggtgccaattctgtcctgag

SEQ ID NO: 625050 - DNA, 25 bp, Mus musculus
gaaaaggtgccatacacagatgacg

SEQ ID NO: 625051 - DNA, 25 bp, Mus musculus
gaaaaggtgccatttctgtcctgag

SEQ ID NO: 625052 - DNA, 25 bp, Mus musculus
gaaaaggtggagacccctgccaaag

SEQ ID NO: 625053 - DNA, 25 bp, Mus musculus
gaaaaggtggagtcccctgccaaag

SEQ ID NO: 625054 - DNA, 25 bp, Mus musculus
gaaaaggttccacgcattctcaggg

SEQ ID NO: 625055 - DNA, 25 bp, Mus musculus
gaaaaggttccaggcattctcaggg

SEQ ID NO: 625056 - DNA, 25 bp, Mus musculus
gaaaaggttgttctccagctctttc

SEQ ID NO: 625057 - DNA, 25 bp, Mus musculus
gaaaaggttgttgtccagctctttc

SEQ ID NO: 625058 - DNA, 25 bp, Mus musculus
gaaaaggttttcaacaacatcatga

SEQ ID NO: 625059 - DNA, 25 bp, Mus musculus
gaaaaggttttctacaacatcatga

SEQ ID NO: 625060 - DNA, 25 bp, Mus musculus
gaaaagtaatttccctgtgcaacaa

SEQ ID NO: 625061 - DNA, 25 bp, Mus musculus
gaaaagtaatttgcctgtgcaacaa

SEQ ID NO: 625062 - DNA, 25 bp, Mus musculus
gaaaagtacacaagataacagagaa

SEQ ID NO: 625063 - DNA, 25 bp, Mus musculus
gaaaagtacacatgataacagagaa

SEQ ID NO: 625064 - DNA, 25 bp, Mus musculus
gaaaagtacatcatgcctccaaatt

SEQ ID NO: 625065 - DNA, 25 bp, Mus musculus
gaaaagtacatccatgagaattaca

SEQ ID NO: 625066 - DNA, 25 bp, Mus musculus
gaaaagtacatcgatgagaattaca

SEQ ID NO: 625067 - DNA, 25 bp, Mus musculus
gaaaagtacatcttgcctccaaatt

SEQ ID NO: 625068 - DNA, 25 bp, Mus musculus
gaaaagtaccatacagaccgcggag

SEQ ID NO: 625069 - DNA, 25 bp, Mus musculus
gaaaagtaccattcagaccgcggag

SEQ ID NO: 625070 - DNA, 25 bp, Mus musculus
gaaaagtatatgaattctgtacaga

SEQ ID NO: 625071 - DNA, 25 bp, Mus musculus
gaaaagtatatgtattctgtacaga

SEQ ID NO: 625072 - DNA, 25 bp, Mus musculus
gaaaagtatgccattgtcaactgga

SEQ ID NO: 625073 - DNA, 25 bp, Mus musculus
gaaaagtatgcctttgtcaactgga

SEQ ID NO: 625074 - DNA, 25 bp, Mus musculus
gaaaagtcagttcgagaaaattgcc

SEQ ID NO: 625075 - DNA, 25 bp, Mus musculus
gaaaagtcagttggagaaaattgcc

SEQ ID NO: 625076 - DNA, 25 bp, Mus musculus
gaaaagtcattccagtttggaggcc

SEQ ID NO: 625077 - DNA, 25 bp, Mus musculus
gaaaagtcattcgagtttggaggcc

SEQ ID NO: 625078 - DNA, 25 bp, Mus musculus
gaaaagtccacccttggtagagtga

SEQ ID NO: 625079 - DNA, 25 bp, Mus musculus
gaaaagtccaccgttggtagagtga

SEQ ID NO: 625080 - DNA, 25 bp, Mus musculus
gaaaagtcccatacctggttgagca

SEQ ID NO: 625081 - DNA, 25 bp, Mus musculus
gaaaagtcccattcctggttgagca

SEQ ID NO: 625082 - DNA, 25 bp, Mus musculus
gaaaagtccgggacacgattgccct

SEQ ID NO: 625083 - DNA, 25 bp, Mus musculus
gaaaagtccgggtcacgattgccct

SEQ ID NO: 625084 - DNA, 25 bp, Mus musculus
gaaaagtcgcggagagctactttgt

SEQ ID NO: 625085 - DNA, 25 bp, Mus musculus
gaaaagtcgcggtgagctactttgt

SEQ ID NO: 625086 - DNA, 25 bp, Mus musculus
gaaaagtctcagcatagcatgtatc

SEQ ID NO: 625087 - DNA, 25 bp, Mus musculus
gaaaagtctcaggatagcatgtatc

SEQ ID NO: 625088 - DNA, 25 bp, Mus musculus
gaaaagtctcgcctggtttcccagg

SEQ ID NO: 625089 - DNA, 25 bp, Mus musculus
gaaaagtctcgcgtggtttcccagg

SEQ ID NO: 625090 - DNA, 25 bp, Mus musculus
gaaaagtctcgtaccaagtttggcg

SEQ ID NO: 625091 - DNA, 25 bp, Mus musculus
gaaaagtctcgttccaagtttggcg

SEQ ID NO: 625092 - DNA, 25 bp, Mus musculus
gaaaagtctgcaagttgtcaaaggc

SEQ ID NO: 625093 - DNA, 25 bp, Mus musculus
gaaaagtctgcacaagggctacact

SEQ ID NO: 625094 - DNA, 25 bp, Mus musculus
gaaaagtctgcagaagggctacact

SEQ ID NO: 625095 - DNA, 25 bp, Mus musculus
gaaaagtctgcatgttgtcaaaggc

SEQ ID NO: 625096 - DNA, 25 bp, Mus musculus
gaaaagtctgtcatctgccgaatca

SEQ ID NO: 625097 - DNA, 25 bp, Mus musculus
gaaaagtctgtcttctgccgaatca

SEQ ID NO: 625098 - DNA, 25 bp, Mus musculus
gaaaagtctttaattcactcaagta

SEQ ID NO: 625099 - DNA, 25 bp, Mus musculus
gaaaagtctttatttcactcaagta

SEQ ID NO: 625100 - DNA, 25 bp, Mus musculus
gaaaagtgcaagaaacttcaatctg

SEQ ID NO: 625101 - DNA, 25 bp, Mus musculus
gaaaagtgcaagtaacttcaatctg

SEQ ID NO: 625102 - DNA, 25 bp, Mus musculus
gaaaagtgctttatctgctgcaaaa

SEQ ID NO: 625103 - DNA, 25 bp, Mus musculus
gaaaagtgctttttctgctgcaaaa

SEQ ID NO: 625104 - DNA, 25 bp, Mus musculus
gaaaagtgggcaaaggtctctaagg

SEQ ID NO: 625105 - DNA, 25 bp, Mus musculus
gaaaagtgggcataggtctctaagg

SEQ ID NO: 625106 - DNA, 25 bp, Mus musculus
gaaaagtgtgttattggcatgtacc

SEQ ID NO: 625107 - DNA, 25 bp, Mus musculus
gaaaagtgtgtttttggcatgtacc

SEQ ID NO: 625108 - DNA, 25 bp, Mus musculus
gaaaagttatgtctggagcgctcag

SEQ ID NO: 625109 - DNA, 25 bp, Mus musculus
gaaaagttatgtgtggagcgctcag

SEQ ID NO: 625110 - DNA, 25 bp, Mus musculus
gaaaagttcaaactccagtgtttga

SEQ ID NO: 625111 - DNA, 25 bp, Mus musculus
gaaaagttcaaagtccagtgtttga

SEQ ID NO: 625112 - DNA, 25 bp, Mus musculus
gaaaagttccttatattcatgtggg

SEQ ID NO: 625113 - DNA, 25 bp, Mus musculus
gaaaagttccttttattcatgtggg

SEQ ID NO: 625114 - DNA, 25 bp, Mus musculus
gaaaagttgaggatatcaatgcccg

SEQ ID NO: 625115 - DNA, 25 bp, Mus musculus
gaaaagttgaggttatcaatgcccg

SEQ ID NO: 625116 - DNA, 25 bp, Mus musculus
gaaaagttgccaatgcccggcgcat

SEQ ID NO: 625117 - DNA, 25 bp, Mus musculus
gaaaagttgccattgcccggcgcat

SEQ ID NO: 625118 - DNA, 25 bp, Mus musculus
gaaaagttgtcacactcctgtgctt

SEQ ID NO: 625119 - DNA, 25 bp, Mus musculus
gaaaagttgtcagactcctgtgctt

SEQ ID NO: 625120 - DNA, 25 bp, Mus musculus
gaaaagtttaagcagtgccagaggc

SEQ ID NO: 625121 - DNA, 25 bp, Mus musculus
gaaaagtttaaggagtgccagaggc

SEQ ID NO: 625122 - DNA, 25 bp, Mus musculus
gaaaataaacggagttgagccagga

SEQ ID NO: 625123 - DNA, 25 bp, Mus musculus
gaaaataaacggtgttgagccagga

SEQ ID NO: 625124 - DNA, 25 bp, Mus musculus
gaaaataacgtcaagtcctcccgtg

SEQ ID NO: 625125 - DNA, 25 bp, Mus musculus
gaaaataacgtctagtcctcccgtg

SEQ ID NO: 625126 - DNA, 25 bp, Mus musculus
gaaaataatatacgccccagtcact

SEQ ID NO: 625127 - DNA, 25 bp, Mus musculus
gaaaataatataggccccagtcact

SEQ ID NO: 625128 - DNA, 25 bp, Mus musculus
gaaaataatgacagaagcaattagt

SEQ ID NO: 625129 - DNA, 25 bp, Mus musculus
gaaaataatgactgaagcaattagt

SEQ ID NO: 625130 - DNA, 25 bp, Mus musculus
gaaaatacccagattgtcaaagact

SEQ ID NO: 625131 - DNA, 25 bp, Mus musculus
gaaaatacccagtttgtcaaagact

SEQ ID NO: 625132 - DNA, 25 bp, Mus musculus
gaaaatacgaagcttgtgtcagaga

SEQ ID NO: 625133 - DNA, 25 bp, Mus musculus
gaaaatacgaaggttgtgtcagaga

SEQ ID NO: 625134 - DNA, 25 bp, Mus musculus
gaaaatagaggaccctcagtatgga

SEQ ID NO: 625135 - DNA, 25 bp, Mus musculus
gaaaatagaggagcctcagtatgga

SEQ ID NO: 625136 - DNA, 25 bp, Mus musculus
gaaaataggagcaaggtcagtccca

SEQ ID NO: 625137 - DNA, 25 bp, Mus musculus
gaaaataggagctaggtcagtccca

SEQ ID NO: 625138 - DNA, 25 bp, Mus musculus
gaaaatagggaacaagtgagcctca

SEQ ID NO: 625139 - DNA, 25 bp, Mus musculus
gaaaatagggaagaagtgagcctca

SEQ ID NO: 625140 - DNA, 25 bp, Mus musculus
gaaaatagggcaccttcaagaggac

SEQ ID NO: 625141 - DNA, 25 bp, Mus musculus
gaaaatagggcagcttcaagaggac

SEQ ID NO: 625142 - DNA, 25 bp, Mus musculus
gaaaatatcacaactagcatccctg

SEQ ID NO: 625143 - DNA, 25 bp, Mus musculus
gaaaatatcacatctagcatccctg

SEQ ID NO: 625144 - DNA, 25 bp, Mus musculus
gaaaatatccaactaccgcacacat

SEQ ID NO: 625145 - DNA, 25 bp, Mus musculus
gaaaatatccaagtaccgcacacat

SEQ ID NO: 625146 - DNA, 25 bp, Mus musculus
gaaaatatctacctgcggagtgaag

SEQ ID NO: 625147 - DNA, 25 bp, Mus musculus
gaaaatatctacgtgcggagtgaag

SEQ ID NO: 625148 - DNA, 25 bp, Mus musculus
gaaaatatgaagacggagatggccc

SEQ ID NO: 625149 - DNA, 25 bp, Mus musculus
gaaaatatgaagtcggagatggccc

SEQ ID NO: 625150 - DNA, 25 bp, Mus musculus
gaaaatatgaccctgctgttcgaag

SEQ ID NO: 625151 - DNA, 25 bp, Mus musculus
gaaaatatgaccgtgctgttcgaag

SEQ ID NO: 625152 - DNA, 25 bp, Mus musculus
gaaaatattctacggcatccagtgc

SEQ ID NO: 625153 - DNA, 25 bp, Mus musculus
gaaaatattctagggcatccagtgc

SEQ ID NO: 625154 - DNA, 25 bp, Mus musculus
gaaaatattgagcttcccatggata

SEQ ID NO: 625155 - DNA, 25 bp, Mus musculus
gaaaatattgaggttcccatggata

SEQ ID NO: 625156 - DNA, 25 bp, Mus musculus
gaaaatcaaagtcaacaaaaccctg

SEQ ID NO: 625157 - DNA, 25 bp, Mus musculus
gaaaatcaaagtgaacaaaaccctg

SEQ ID NO: 625158 - DNA, 25 bp, Mus musculus
gaaaatcaaatacgccttcagtctg

SEQ ID NO: 625159 - DNA, 25 bp, Mus musculus
gaaaatcaaataggccttcagtctg

SEQ ID NO: 625160 - DNA, 25 bp, Mus musculus
gaaaatcaacgtatcctccttctgg

SEQ ID NO: 625161 - DNA, 25 bp, Mus musculus
gaaaatcaacgtttcctccttctgg

SEQ ID NO: 625162 - DNA, 25 bp, Mus musculus
gaaaatcaagaaaatcaaagtcgtc

SEQ ID NO: 625163 - DNA, 25 bp, Mus musculus
gaaaatcaagaatatcaaagtcgtc

SEQ ID NO: 625164 - DNA, 25 bp, Mus musculus
gaaaatcaaggactacaatggccag

SEQ ID NO: 625165 - DNA, 25 bp, Mus musculus
gaaaatcaaggagtacaatggccag

SEQ ID NO: 625166 - DNA, 25 bp, Mus musculus
gaaaatcaagtgcacagccttccag

SEQ ID NO: 625167 - DNA, 25 bp, Mus musculus
gaaaatcaagtggacagccttccag

SEQ ID NO: 625168 - DNA, 25 bp, Mus musculus
gaaaatcaagttagcaacaagcagg

SEQ ID NO: 625169 - DNA, 25 bp, Mus musculus
gaaaatcaagtttgcaacaagcagg

SEQ ID NO: 625170 - DNA, 25 bp, Mus musculus
gaaaatcacaagactgtgaagccct

SEQ ID NO: 625171 - DNA, 25 bp, Mus musculus
gaaaatcacaagtctgtgaagccct

SEQ ID NO: 625172 - DNA, 25 bp, Mus musculus
gaaaatcagaggctccttaaagata

SEQ ID NO: 625173 - DNA, 25 bp, Mus musculus
gaaaatcagagggtccttaaagata

SEQ ID NO: 625174 - DNA, 25 bp, Mus musculus
gaaaatcagcggagttataaacaga

SEQ ID NO: 625175 - DNA, 25 bp, Mus musculus
gaaaatcagcggtgttataaacaga

SEQ ID NO: 625176 - DNA, 25 bp, Mus musculus
gaaaatcaggacaaatcttggccag

SEQ ID NO: 625177 - DNA, 25 bp, Mus musculus
gaaaatcaggacattgccatccagg

SEQ ID NO: 625178 - DNA, 25 bp, Mus musculus
gaaaatcaggactaatcttggccag

SEQ ID NO: 625179 - DNA, 25 bp, Mus musculus
gaaaatcaggactttgccatccagg

SEQ ID NO: 625180 - DNA, 25 bp, Mus musculus
gaaaatcataggacatctcactggg

SEQ ID NO: 625181 - DNA, 25 bp, Mus musculus
gaaaatcataggtcatctcactggg

SEQ ID NO: 625182 - DNA, 25 bp, Mus musculus
gaaaatcatccaccagacttggaac

SEQ ID NO: 625183 - DNA, 25 bp, Mus musculus
gaaaatcatccagcagacttggaac

SEQ ID NO: 625184 - DNA, 25 bp, Mus musculus
gaaaatcatctcattcagttaaagt

SEQ ID NO: 625185 - DNA, 25 bp, Mus musculus
gaaaatcatctctttcagttaaagt

SEQ ID NO: 625186 - DNA, 25 bp, Mus musculus
gaaaatcatgaaacagtagcatatg

SEQ ID NO: 625187 - DNA, 25 bp, Mus musculus
gaaaatcatgaatcagtagcatatg

SEQ ID NO: 625188 - DNA, 25 bp, Mus musculus
gaaaatcatggcagactcgggaccc

SEQ ID NO: 625189 - DNA, 25 bp, Mus musculus
gaaaatcatggctgactcgggaccc

SEQ ID NO: 625190 - DNA, 25 bp, Mus musculus
gaaaatcatgtcagcaggctgaccc

SEQ ID NO: 625191 - DNA, 25 bp, Mus musculus
gaaaatcatgtctgcaggctgaccc

SEQ ID NO: 625192 - DNA, 25 bp, Mus musculus
gaaaatcattcaagtggccaagagc

SEQ ID NO: 625193 - DNA, 25 bp, Mus musculus
gaaaatcattcatgtggccaagagc

SEQ ID NO: 625194 - DNA, 25 bp, Mus musculus
gaaaatccaaatccagtgacagcca

SEQ ID NO: 625195 - DNA, 25 bp, Mus musculus
gaaaatccaaatgcagtgacagcca

SEQ ID NO: 625196 - DNA, 25 bp, Mus musculus
gaaaatccacgcaggacctattaca

SEQ ID NO: 625197 - DNA, 25 bp, Mus musculus
gaaaatccacgctggacctattaca

SEQ ID NO: 625198 - DNA, 25 bp, Mus musculus
gaaaatccattaccatcagatgcag

SEQ ID NO: 625199 - DNA, 25 bp, Mus musculus
gaaaatccattagcatcagatgcag

SEQ ID NO: 625200 - DNA, 25 bp, Mus musculus
gaaaatccattcacttgaagaactc

SEQ ID NO: 625201 - DNA, 25 bp, Mus musculus
gaaaatccattctcttgaagaactc

SEQ ID NO: 625202 - DNA, 25 bp, Mus musculus
gaaaatcccaagaaggccttgaaag

SEQ ID NO: 625203 - DNA, 25 bp, Mus musculus
gaaaatcccaagtaggccttgaaag

SEQ ID NO: 625204 - DNA, 25 bp, Mus musculus
gaaaatcctaacatactcagcccag

SEQ ID NO: 625205 - DNA, 25 bp, Mus musculus
gaaaatcctaacttactcagcccag

SEQ ID NO: 625206 - DNA, 25 bp, Mus musculus
gaaaatcctcaactgcaaggcagtg

SEQ ID NO: 625207 - DNA, 25 bp, Mus musculus
gaaaatcctcaagtgcaaggcagtg

SEQ ID NO: 625208 - DNA, 25 bp, Mus musculus
gaaaatcctccaaaggaatggcctg

SEQ ID NO: 625209 - DNA, 25 bp, Mus musculus
gaaaatcctccataggaatggcctg

SEQ ID NO: 625210 - DNA, 25 bp, Mus musculus
gaaaatcctcgaaaagattatcagc

SEQ ID NO: 625211 - DNA, 25 bp, Mus musculus
gaaaatcctcgataagattatcagc

SEQ ID NO: 625212 - DNA, 25 bp, Mus musculus
gaaaatcctgatccagagtacccag

SEQ ID NO: 625213 - DNA, 25 bp, Mus musculus
gaaaatcctgatgcagagtacccag

SEQ ID NO: 625214 - DNA, 25 bp, Mus musculus
gaaaatcctgcgcaaagcagacatg

SEQ ID NO: 625215 - DNA, 25 bp, Mus musculus
gaaaatcctgcggaaagcagacatg

SEQ ID NO: 625216 - DNA, 25 bp, Mus musculus
gaaaatcgccaactgaggcgctcgc

SEQ ID NO: 625217 - DNA, 25 bp, Mus musculus
gaaaatcgccaagtgaggcgctcgc

SEQ ID NO: 625218 - DNA, 25 bp, Mus musculus
gaaaatcgccagaccatcatcaatc

SEQ ID NO: 625219 - DNA, 25 bp, Mus musculus
gaaaatcgccagtccatcatcaatc

SEQ ID NO: 625220 - DNA, 25 bp, Mus musculus
gaaaatcgggctctaaaagatgaag

SEQ ID NO: 625221 - DNA, 25 bp, Mus musculus
gaaaatcgggctgtaaaagatgaag

SEQ ID NO: 625222 - DNA, 25 bp, Mus musculus
gaaaatcgtgtgatccaggcggaaa

SEQ ID NO: 625223 - DNA, 25 bp, Mus musculus
gaaaatcgtgtgttccaggcggaaa

SEQ ID NO: 625224 - DNA, 25 bp, Mus musculus
gaaaatctacatcacgctctctgcc

SEQ ID NO: 625225 - DNA, 25 bp, Mus musculus
gaaaatctacatgacgctctctgcc

SEQ ID NO: 625226 - DNA, 25 bp, Mus musculus
gaaaatctcagcaggtatctggaag

SEQ ID NO: 625227 - DNA, 25 bp, Mus musculus
gaaaatctcagctggtatctggaag

SEQ ID NO: 625228 - DNA, 25 bp, Mus musculus
gaaaatctcagtattcttctgtgtg

SEQ ID NO: 625229 - DNA, 25 bp, Mus musculus
gaaaatctcagttttcttctgtgtg

SEQ ID NO: 625230 - DNA, 25 bp, Mus musculus
gaaaatctcatgacagcccttgctg

SEQ ID NO: 625231 - DNA, 25 bp, Mus musculus
gaaaatctcatgtcagcccttgctg

SEQ ID NO: 625232 - DNA, 25 bp, Mus musculus
gaaaatctccggcaaaccactgcta

SEQ ID NO: 625233 - DNA, 25 bp, Mus musculus
gaaaatctccgggaaaccactgcta

SEQ ID NO: 625234 - DNA, 25 bp, Mus musculus
gaaaatctccttccctgtgatcctc

SEQ ID NO: 625235 - DNA, 25 bp, Mus musculus
gaaaatctccttgcctgtgatcctc

SEQ ID NO: 625236 - DNA, 25 bp, Mus musculus
gaaaatctctcacctgactgccggg

SEQ ID NO: 625237 - DNA, 25 bp, Mus musculus
gaaaatctctcagctgactgccggg

SEQ ID NO: 625238 - DNA, 25 bp, Mus musculus
gaaaatctgacaaaaagcctttgcg

SEQ ID NO: 625239 - DNA, 25 bp, Mus musculus
gaaaatctgacataaagcctttgcg

SEQ ID NO: 625240 - DNA, 25 bp, Mus musculus
gaaaatctgcaaacttgtaactggg

SEQ ID NO: 625241 - DNA, 25 bp, Mus musculus
gaaaatctgcaatcttgtaactggg

SEQ ID NO: 625242 - DNA, 25 bp, Mus musculus
gaaaatctgctactattcaacaggg

SEQ ID NO: 625243 - DNA, 25 bp, Mus musculus
gaaaatctgctagtattcaacaggg

SEQ ID NO: 625244 - DNA, 25 bp, Mus musculus
gaaaatcttcaaatcccagggcaca

SEQ ID NO: 625245 - DNA, 25 bp, Mus musculus
gaaaatcttcaattcccagggcaca

SEQ ID NO: 625246 - DNA, 25 bp, Mus musculus
gaaaatcttcccagtcatttcaagt

SEQ ID NO: 625247 - DNA, 25 bp, Mus musculus
gaaaatcttccctgtcatttcaagt

SEQ ID NO: 625248 - DNA, 25 bp, Mus musculus
gaaaatcttcgactacgagacccag

SEQ ID NO: 625249 - DNA, 25 bp, Mus musculus
gaaaatcttcgagtacgagacccag

SEQ ID NO: 625250 - DNA, 25 bp, Mus musculus
gaaaatgaaacgataccaagttgga

SEQ ID NO: 625251 - DNA, 25 bp, Mus musculus
gaaaatgaaacgttaccaagttgga

SEQ ID NO: 625252 - DNA, 25 bp, Mus musculus
gaaaatgaaatacagctaagagcgc

SEQ ID NO: 625253 - DNA, 25 bp, Mus musculus
gaaaatgaaatagagctaagagcgc

SEQ ID NO: 625254 - DNA, 25 bp, Mus musculus
gaaaatgaacacagcctcttgaggg

SEQ ID NO: 625255 - DNA, 25 bp, Mus musculus
gaaaatgaacactgcctcttgaggg

SEQ ID NO: 625256 - DNA, 25 bp, Mus musculus
gaaaatgaacttctagaactgcaag

SEQ ID NO: 625257 - DNA, 25 bp, Mus musculus
gaaaatgaacttgtagaactgcaag

SEQ ID NO: 625258 - DNA, 25 bp, Mus musculus
gaaaatgaagccagactgaaagcgt

SEQ ID NO: 625259 - DNA, 25 bp, Mus musculus
gaaaatgaagcctgactgaaagcgt

SEQ ID NO: 625260 - DNA, 25 bp, Mus musculus
gaaaatgaaggcagtgacgaagaca

SEQ ID NO: 625261 - DNA, 25 bp, Mus musculus
gaaaatgaaggctgtgacgaagaca

SEQ ID NO: 625262 - DNA, 25 bp, Mus musculus
gaaaatgaagtcaacggtcgtgctg

SEQ ID NO: 625263 - DNA, 25 bp, Mus musculus
gaaaatgaagtctacggtcgtgctg

SEQ ID NO: 625264 - DNA, 25 bp, Mus musculus
gaaaatgaatggagtcaatgagcgc

SEQ ID NO: 625265 - DNA, 25 bp, Mus musculus
gaaaatgaatggtgtcaatgagcgc

SEQ ID NO: 625266 - DNA, 25 bp, Mus musculus
gaaaatgacagtcggaatgattact

SEQ ID NO: 625267 - DNA, 25 bp, Mus musculus
gaaaatgacagtgggaatgattact

SEQ ID NO: 625268 - DNA, 25 bp, Mus musculus
gaaaatgactcacacgaacaaggct

SEQ ID NO: 625269 - DNA, 25 bp, Mus musculus
gaaaatgactcagacgaacaaggct

SEQ ID NO: 625270 - DNA, 25 bp, Mus musculus
gaaaatgactgtcatccttccagga

SEQ ID NO: 625271 - DNA, 25 bp, Mus musculus
gaaaatgactgtgatccttccagga

SEQ ID NO: 625272 - DNA, 25 bp, Mus musculus
gaaaatgagagtcgctccaaaggct

SEQ ID NO: 625273 - DNA, 25 bp, Mus musculus
gaaaatgagagtggctccaaaggct

SEQ ID NO: 625274 - DNA, 25 bp, Mus musculus
gaaaatgagggaacatactatggcc

SEQ ID NO: 625275 - DNA, 25 bp, Mus musculus
gaaaatgagggatcatactatggcc

SEQ ID NO: 625276 - DNA, 25 bp, Mus musculus
gaaaatgatgataccaagtcacctg

SEQ ID NO: 625277 - DNA, 25 bp, Mus musculus
gaaaatgatgattccaagtcacctg

SEQ ID NO: 625278 - DNA, 25 bp, Mus musculus
gaaaatgcaattatcacagattcag

SEQ ID NO: 625279 - DNA, 25 bp, Mus musculus
gaaaatgcaattttcacagattcag

SEQ ID NO: 625280 - DNA, 25 bp, Mus musculus
gaaaatgcatctcaaagtggacgtt

SEQ ID NO: 625281 - DNA, 25 bp, Mus musculus
gaaaatgcatctgaaagtggacgtt

SEQ ID NO: 625282 - DNA, 25 bp, Mus musculus
gaaaatgcattgaaccaggtgaaac

SEQ ID NO: 625283 - DNA, 25 bp, Mus musculus
gaaaatgcattgtaccaggtgaaac

SEQ ID NO: 625284 - DNA, 25 bp, Mus musculus
gaaaatgccaatcaaactgactgtg

SEQ ID NO: 625285 - DNA, 25 bp, Mus musculus
gaaaatgccaatgaaactgactgtg

SEQ ID NO: 625286 - DNA, 25 bp, Mus musculus
gaaaatgccaggatgatgcctccct

SEQ ID NO: 625287 - DNA, 25 bp, Mus musculus
gaaaatgccaggttgatgcctccct

SEQ ID NO: 625288 - DNA, 25 bp, Mus musculus
gaaaatgccattcagcagatgggtg

SEQ ID NO: 625289 - DNA, 25 bp, Mus musculus
gaaaatgccattgagcagatgggtg

SEQ ID NO: 625290 - DNA, 25 bp, Mus musculus
gaaaatgcgaccatgtatcagcaac

SEQ ID NO: 625291 - DNA, 25 bp, Mus musculus
gaaaatgcgaccttgtatcagcaac

SEQ ID NO: 625292 - DNA, 25 bp, Mus musculus
gaaaatgcggacactcaagacttga

SEQ ID NO: 625293 - DNA, 25 bp, Mus musculus
gaaaatgcggactctcaagacttga

SEQ ID NO: 625294 - DNA, 25 bp, Mus musculus
gaaaatgcgtatcacatggaagccg

SEQ ID NO: 625295 - DNA, 25 bp, Mus musculus
gaaaatgcgtatgacatggaagccg

SEQ ID NO: 625296 - DNA, 25 bp, Mus musculus
gaaaatgctactaagaagagagaac

SEQ ID NO: 625297 - DNA, 25 bp, Mus musculus
gaaaatgctacttagaagagagaac

SEQ ID NO: 625298 - DNA, 25 bp, Mus musculus
gaaaatgctccacgcgccctgggtt

SEQ ID NO: 625299 - DNA, 25 bp, Mus musculus
gaaaatgctccaggcgccctgggtt

SEQ ID NO: 625300 - DNA, 25 bp, Mus musculus
gaaaatgctttcctcagtgagttta

SEQ ID NO: 625301 - DNA, 25 bp, Mus musculus
gaaaatgctttcgtcagtgagttta

SEQ ID NO: 625302 - DNA, 25 bp, Mus musculus
gaaaatgctttgaaagtatgggacc

SEQ ID NO: 625303 - DNA, 25 bp, Mus musculus
gaaaatgctttgtaagtatgggacc

SEQ ID NO: 625304 - DNA, 25 bp, Mus musculus
gaaaatggaagaagagcaaaacatc

SEQ ID NO: 625305 - DNA, 25 bp, Mus musculus
gaaaatggaagacactgctcctgac

SEQ ID NO: 625306 - DNA, 25 bp, Mus musculus
gaaaatggaagagactgctcctgac

SEQ ID NO: 625307 - DNA, 25 bp, Mus musculus
gaaaatggaagatgagcaaaacatc

SEQ ID NO: 625308 - DNA, 25 bp, Mus musculus
gaaaatggagccaataaacactttg

SEQ ID NO: 625309 - DNA, 25 bp, Mus musculus
gaaaatggagcctataaacactttg

SEQ ID NO: 625310 - DNA, 25 bp, Mus musculus
gaaaatggatttcgttatatcccct

SEQ ID NO: 625311 - DNA, 25 bp, Mus musculus
gaaaatggatttggttatatcccct

SEQ ID NO: 625312 - DNA, 25 bp, Mus musculus
gaaaatggcagtacaaccaacgtcg

SEQ ID NO: 625313 - DNA, 25 bp, Mus musculus
gaaaatggcagttcaaccaacgtcg

SEQ ID NO: 625314 - DNA, 25 bp, Mus musculus
gaaaatggccaaatcgttacgagga

SEQ ID NO: 625315 - DNA, 25 bp, Mus musculus
gaaaatggccaattcgttacgagga

SEQ ID NO: 625316 - DNA, 25 bp, Mus musculus
gaaaatggcttaagaatatgcagat

SEQ ID NO: 625317 - DNA, 25 bp, Mus musculus
gaaaatggcttatgaatatgcagat

SEQ ID NO: 625318 - DNA, 25 bp, Mus musculus
gaaaatgggtttctcgtcattaaga

SEQ ID NO: 625319 - DNA, 25 bp, Mus musculus
gaaaatgggtttgtcgtcattaaga

SEQ ID NO: 625320 - DNA, 25 bp, Mus musculus
gaaaatggtagaccactgagcctgg

SEQ ID NO: 625321 - DNA, 25 bp, Mus musculus
gaaaatggtagagcactgagcctgg

SEQ ID NO: 625322 - DNA, 25 bp, Mus musculus
gaaaatggtagccatcccaaccttg

SEQ ID NO: 625323 - DNA, 25 bp, Mus musculus
gaaaatggtagcgatcccaaccttg

SEQ ID NO: 625324 - DNA, 25 bp, Mus musculus
gaaaatggttttacagcggcagaga

SEQ ID NO: 625325 - DNA, 25 bp, Mus musculus
gaaaatggtttttcagcggcagaga

SEQ ID NO: 625326 - DNA, 25 bp, Mus musculus
gaaaatgtatcaatcttccatggga

SEQ ID NO: 625327 - DNA, 25 bp, Mus musculus
gaaaatgtatcattcttccatggga

SEQ ID NO: 625328 - DNA, 25 bp, Mus musculus
gaaaatgtcagccacccataagccc

SEQ ID NO: 625329 - DNA, 25 bp, Mus musculus
gaaaatgtcagcgacccataagccc

SEQ ID NO: 625330 - DNA, 25 bp, Mus musculus
gaaaatgtcatcaagagagagggct

SEQ ID NO: 625331 - DNA, 25 bp, Mus musculus
gaaaatgtcatctagagagagggct

SEQ ID NO: 625332 - DNA, 25 bp, Mus musculus
gaaaatgtccagagcttggcagctg

SEQ ID NO: 625333 - DNA, 25 bp, Mus musculus
gaaaatgtccagtgcttggcagctg

SEQ ID NO: 625334 - DNA, 25 bp, Mus musculus
gaaaatgtctttatggtctccatgc

SEQ ID NO: 625335 - DNA, 25 bp, Mus musculus
gaaaatgtctttttggtctccatgc

SEQ ID NO: 625336 - DNA, 25 bp, Mus musculus
gaaaatgtgcccattcctcctgatc

SEQ ID NO: 625337 - DNA, 25 bp, Mus musculus
gaaaatgtgccctttcctcctgatc

SEQ ID NO: 625338 - DNA, 25 bp, Mus musculus
gaaaatgtgctgcttgcatccgcag

SEQ ID NO: 625339 - DNA, 25 bp, Mus musculus
gaaaatgtgctggttgcatccgcag

SEQ ID NO: 625340 - DNA, 25 bp, Mus musculus
gaaaatgtggccacctactttactt

SEQ ID NO: 625341 - DNA, 25 bp, Mus musculus
gaaaatgtggcctcctactttactt

SEQ ID NO: 625342 - DNA, 25 bp, Mus musculus
gaaaatgttcctccaggacctgagg

SEQ ID NO: 625343 - DNA, 25 bp, Mus musculus
gaaaatgttcctgcaggacctgagg

SEQ ID NO: 625344 - DNA, 25 bp, Mus musculus
gaaaatgttctcaagtgtcccactc

SEQ ID NO: 625345 - DNA, 25 bp, Mus musculus
gaaaatgttctcactcctcagcgaa

SEQ ID NO: 625346 - DNA, 25 bp, Mus musculus
gaaaatgttctctagtgtcccactc

SEQ ID NO: 625347 - DNA, 25 bp, Mus musculus
gaaaatgttctctctcctcagcgaa

SEQ ID NO: 625348 - DNA, 25 bp, Mus musculus
gaaaatgttgaaagagcagctacag

SEQ ID NO: 625349 - DNA, 25 bp, Mus musculus
gaaaatgttgaacaggactaccaaa

SEQ ID NO: 625350 - DNA, 25 bp, Mus musculus
gaaaatgttgaagaggactaccaaa

SEQ ID NO: 625351 - DNA, 25 bp, Mus musculus
gaaaatgttgaatgagcagctacag

SEQ ID NO: 625352 - DNA, 25 bp, Mus musculus
gaaaatgttggcatagatattactc

SEQ ID NO: 625353 - DNA, 25 bp, Mus musculus
gaaaatgttggcttagatattactc

SEQ ID NO: 625354 - DNA, 25 bp, Mus musculus
gaaaattaaccacaaggagagcgct

SEQ ID NO: 625355 - DNA, 25 bp, Mus musculus
gaaaattaaccagaaggagagcgct

SEQ ID NO: 625356 - DNA, 25 bp, Mus musculus
gaaaattactgacggatctccttcc

SEQ ID NO: 625357 - DNA, 25 bp, Mus musculus
gaaaattactgagggatctccttcc

SEQ ID NO: 625358 - DNA, 25 bp, Mus musculus
gaaaattagccacctggccgcggtg

SEQ ID NO: 625359 - DNA, 25 bp, Mus musculus
gaaaattagccagctggccgcggtg

SEQ ID NO: 625360 - DNA, 25 bp, Mus musculus
gaaaattcaactaggatgcaactga

SEQ ID NO: 625361 - DNA, 25 bp, Mus musculus
gaaaattcaacttggatgcaactga

SEQ ID NO: 625362 - DNA, 25 bp, Mus musculus
gaaaattcaatgaggcaagaacaga

SEQ ID NO: 625363 - DNA, 25 bp, Mus musculus
gaaaattcaatgtggcaagaacaga

SEQ ID NO: 625364 - DNA, 25 bp, Mus musculus
gaaaattcagccattagcaaaagcc

SEQ ID NO: 625365 - DNA, 25 bp, Mus musculus
gaaaattcagcctttagcaaaagcc

SEQ ID NO: 625366 - DNA, 25 bp, Mus musculus
gaaaattcatccatagtattgcata

SEQ ID NO: 625367 - DNA, 25 bp, Mus musculus
gaaaattcatccttagtattgcata

SEQ ID NO: 625368 - DNA, 25 bp, Mus musculus
gaaaattccaccacctgaactacag

SEQ ID NO: 625369 - DNA, 25 bp, Mus musculus
gaaaattccacctcctgaactacag

SEQ ID NO: 625370 - DNA, 25 bp, Mus musculus
gaaaattccagaatcgcagttcttg

SEQ ID NO: 625371 - DNA, 25 bp, Mus musculus
gaaaattccagattcgcagttcttg

SEQ ID NO: 625372 - DNA, 25 bp, Mus musculus
gaaaattcgtcgctcaatcttatcg

SEQ ID NO: 625373 - DNA, 25 bp, Mus musculus
gaaaattcgtcggtcaatcttatcg

SEQ ID NO: 625374 - DNA, 25 bp, Mus musculus
gaaaattctacactccaaagaaaag

SEQ ID NO: 625375 - DNA, 25 bp, Mus musculus
gaaaattctacagtccaaagaaaag

SEQ ID NO: 625376 - DNA, 25 bp, Mus musculus
gaaaattctgttcactacctggcca

SEQ ID NO: 625377 - DNA, 25 bp, Mus musculus
gaaaattctgttgactacctggcca

SEQ ID NO: 625378 - DNA, 25 bp, Mus musculus
gaaaattcttccagatgacttagct

SEQ ID NO: 625379 - DNA, 25 bp, Mus musculus
gaaaattcttcctgatgacttagct

SEQ ID NO: 625380 - DNA, 25 bp, Mus musculus
gaaaattgacataccgtctgtcttt

SEQ ID NO: 625381 - DNA, 25 bp, Mus musculus
gaaaattgacattccgtctgtcttt

SEQ ID NO: 625382 - DNA, 25 bp, Mus musculus
gaaaattgagaaacggcgtcaggag

SEQ ID NO: 625383 - DNA, 25 bp, Mus musculus
gaaaattgagaatcggcgtcaggag

SEQ ID NO: 625384 - DNA, 25 bp, Mus musculus
gaaaattgagcgacaaacgctgtca

SEQ ID NO: 625385 - DNA, 25 bp, Mus musculus
gaaaattgagcgtcaaacgctgtca

SEQ ID NO: 625386 - DNA, 25 bp, Mus musculus
gaaaattgaggcacacaatgcagac

SEQ ID NO: 625387 - DNA, 25 bp, Mus musculus
gaaaattgaggctcacaatgcagac

SEQ ID NO: 625388 - DNA, 25 bp, Mus musculus
gaaaattgggcaatatctcaggatg

SEQ ID NO: 625389 - DNA, 25 bp, Mus musculus
gaaaattgggcattatctcaggatg

SEQ ID NO: 625390 - DNA, 25 bp, Mus musculus
gaaaattgtcaacgtggaccagtgg

SEQ ID NO: 625391 - DNA, 25 bp, Mus musculus
gaaaattgtcaaggtggaccagtgg

SEQ ID NO: 625392 - DNA, 25 bp, Mus musculus
gaaaattgtgatcctatttaatact

SEQ ID NO: 625393 - DNA, 25 bp, Mus musculus
gaaaattgtgatgctatttaatact

SEQ ID NO: 625394 - DNA, 25 bp, Mus musculus
gaaaattgtgccaaagcctacatac

SEQ ID NO: 625395 - DNA, 25 bp, Mus musculus
gaaaattgtgcctaagcctacatac

SEQ ID NO: 625396 - DNA, 25 bp, Mus musculus
gaaaattgtgttctttgcgggtgtc

SEQ ID NO: 625397 - DNA, 25 bp, Mus musculus
gaaaattgtgttgtttgcgggtgtc

SEQ ID NO: 625398 - DNA, 25 bp, Mus musculus
gaaaatttacaacctccttgcccac

SEQ ID NO: 625399 - DNA, 25 bp, Mus musculus
gaaaatttacaagctccttgcccac

SEQ ID NO: 625400 - DNA, 25 bp, Mus musculus
gaaaatttgttaacgctgtcttagg

SEQ ID NO: 625401 - DNA, 25 bp, Mus musculus
gaaaatttgttatcgctgtcttagg

SEQ ID NO: 625402 - DNA, 25 bp, Mus musculus
gaaacaaacagtctgggcgtgcact

SEQ ID NO: 625403 - DNA, 25 bp, Mus musculus
gaaacaaacagtgtgggcgtgcact

SEQ ID NO: 625404 - DNA, 25 bp, Mus musculus
gaaacaaaccgcaccctgagagttg

SEQ ID NO: 625405 - DNA, 25 bp, Mus musculus
gaaacaaaccgctccctgagagttg

SEQ ID NO: 625406 - DNA, 25 bp, Mus musculus
gaaacaaactataggagagacctgg

SEQ ID NO: 625407 - DNA, 25 bp, Mus musculus
gaaacaaactattggagagacctgg

SEQ ID NO: 625408 - DNA, 25 bp, Mus musculus
gaaacaaagaaaccatgattaccca

SEQ ID NO: 625409 - DNA, 25 bp, Mus musculus
gaaacaaagaaagcatgattaccca

SEQ ID NO: 625410 - DNA, 25 bp, Mus musculus
gaaacaaagcgaagagcttgccctg

SEQ ID NO: 625411 - DNA, 25 bp, Mus musculus
gaaacaaagcgatgagcttgccctg

SEQ ID NO: 625412 - DNA, 25 bp, Mus musculus
gaaacaaatatactctagagactcg

SEQ ID NO: 625413 - DNA, 25 bp, Mus musculus
gaaacaaatatagtctagagactcg

SEQ ID NO: 625414 - DNA, 25 bp, Mus musculus
gaaacaaatgtcctcggtttcaaag

SEQ ID NO: 625415 - DNA, 25 bp, Mus musculus
gaaacaaatgtcgtcggtttcaaag

SEQ ID NO: 625416 - DNA, 25 bp, Mus musculus
gaaacaacaaatactggtaacagag

SEQ ID NO: 625417 - DNA, 25 bp, Mus musculus
gaaacaacaaattctggtaacagag

SEQ ID NO: 625418 - DNA, 25 bp, Mus musculus
gaaacaacaatgctaaacactagat

SEQ ID NO: 625419 - DNA, 25 bp, Mus musculus
gaaacaacaatggtaaacactagat

SEQ ID NO: 625420 - DNA, 25 bp, Mus musculus
gaaacaacacgtatgctgaacccca

SEQ ID NO: 625421 - DNA, 25 bp, Mus musculus
gaaacaacacgtttgctgaacccca

SEQ ID NO: 625422 - DNA, 25 bp, Mus musculus
gaaacaacactaagctcatagaatg

SEQ ID NO: 625423 - DNA, 25 bp, Mus musculus
gaaacaacactatgctcatagaatg

SEQ ID NO: 625424 - DNA, 25 bp, Mus musculus
gaaacaacaggcatacaagtttgga

SEQ ID NO: 625425 - DNA, 25 bp, Mus musculus
gaaacaacaggcttacaagtttgga

SEQ ID NO: 625426 - DNA, 25 bp, Mus musculus
gaaacaacccgacgacgaaagccat

SEQ ID NO: 625427 - DNA, 25 bp, Mus musculus
gaaacaacccgaggacgaaagccat

SEQ ID NO: 625428 - DNA, 25 bp, Mus musculus
gaaacaaccgcacctgatcgtgaag

SEQ ID NO: 625429 - DNA, 25 bp, Mus musculus
gaaacaaccgcagctgatcgtgaag

SEQ ID NO: 625430 - DNA, 25 bp, Mus musculus
gaaacaacctgaacaacaaaccgga

SEQ ID NO: 625431 - DNA, 25 bp, Mus musculus
gaaacaacctgatcaacaaaccgga

SEQ ID NO: 625432 - DNA, 25 bp, Mus musculus
gaaacaactcgaacggaacctgtgg

SEQ ID NO: 625433 - DNA, 25 bp, Mus musculus
gaaacaactcgatcggaacctgtgg

SEQ ID NO: 625434 - DNA, 25 bp, Mus musculus
gaaacaactgcaatgacggagacat

SEQ ID NO: 625435 - DNA, 25 bp, Mus musculus
gaaacaactgcattgacggagacat

SEQ ID NO: 625436 - DNA, 25 bp, Mus musculus
gaaacaactgccaatgtcctacagg

SEQ ID NO: 625437 - DNA, 25 bp, Mus musculus
gaaacaactgcctatgtcctacagg

SEQ ID NO: 625438 - DNA, 25 bp, Mus musculus
gaaacaacttctccggcatgcaaag

SEQ ID NO: 625439 - DNA, 25 bp, Mus musculus
gaaacaacttctgcggcatgcaaag

SEQ ID NO: 625440 - DNA, 25 bp, Mus musculus
gaaacaacttgcagctaaaatacag

SEQ ID NO: 625441 - DNA, 25 bp, Mus musculus
gaaacaacttgctgctaaaatacag

SEQ ID NO: 625442 - DNA, 25 bp, Mus musculus
gaaacaagcggaacgactattcact

SEQ ID NO: 625443 - DNA, 25 bp, Mus musculus
gaaacaagcggatcgactattcact

SEQ ID NO: 625444 - DNA, 25 bp, Mus musculus
gaaacaagcttgaccgcctcatgac

SEQ ID NO: 625445 - DNA, 25 bp, Mus musculus
gaaacaagcttgtccgcctcatgac

SEQ ID NO: 625446 - DNA, 25 bp, Mus musculus
gaaacaaggaccattgctgtcgact

SEQ ID NO: 625447 - DNA, 25 bp, Mus musculus
gaaacaaggacctttgctgtcgact

SEQ ID NO: 625448 - DNA, 25 bp, Mus musculus
gaaacaaggagacgaaatccataat

SEQ ID NO: 625449 - DNA, 25 bp, Mus musculus
gaaacaaggagaggaaatccataat

SEQ ID NO: 625450 - DNA, 25 bp, Mus musculus
gaaacaagtcttccatcctcaagat

SEQ ID NO: 625451 - DNA, 25 bp, Mus musculus
gaaacaagtcttgcatcctcaagat

SEQ ID NO: 625452 - DNA, 25 bp, Mus musculus
gaaacaagttacatcgaagacaact

SEQ ID NO: 625453 - DNA, 25 bp, Mus musculus
gaaacaagttacttcgaagacaact

SEQ ID NO: 625454 - DNA, 25 bp, Mus musculus
gaaacaagttttctgaagtcaggta

SEQ ID NO: 625455 - DNA, 25 bp, Mus musculus
gaaacaagttttgtgaagtcaggta

SEQ ID NO: 625456 - DNA, 25 bp, Mus musculus
gaaacaatcctgaactcagacatag

SEQ ID NO: 625457 - DNA, 25 bp, Mus musculus
gaaacaatcctgtactcagacatag

SEQ ID NO: 625458 - DNA, 25 bp, Mus musculus
gaaacaatcgtgatttctgtaagtc

SEQ ID NO: 625459 - DNA, 25 bp, Mus musculus
gaaacaatcgtgttttctgtaagtc

SEQ ID NO: 625460 - DNA, 25 bp, Mus musculus
gaaacaatctatcgttctccggtct

SEQ ID NO: 625461 - DNA, 25 bp, Mus musculus
gaaacaatctatggttctccggtct

SEQ ID NO: 625462 - DNA, 25 bp, Mus musculus
gaaacaatgaatcagaaaagcccag

SEQ ID NO: 625463 - DNA, 25 bp, Mus musculus
gaaacaatgaatgagaaaagcccag

SEQ ID NO: 625464 - DNA, 25 bp, Mus musculus
gaaacaatgaggacatcttcatggc

SEQ ID NO: 625465 - DNA, 25 bp, Mus musculus
gaaacaatgaggtcatcttcatggc

SEQ ID NO: 625466 - DNA, 25 bp, Mus musculus
gaaacacaaactcttcatctctggc

SEQ ID NO: 625467 - DNA, 25 bp, Mus musculus
gaaacacaaactgttcatctctggc

SEQ ID NO: 625468 - DNA, 25 bp, Mus musculus
gaaacacaaatcatcctcctccttt

SEQ ID NO: 625469 - DNA, 25 bp, Mus musculus
gaaacacaaatcttcctcctccttt

SEQ ID NO: 625470 - DNA, 25 bp, Mus musculus
gaaacacacacgagcacccagagca

SEQ ID NO: 625471 - DNA, 25 bp, Mus musculus
gaaacacacacgtgcacccagagca

SEQ ID NO: 625472 - DNA, 25 bp, Mus musculus
gaaacacacttgaagcccgggaaga

SEQ ID NO: 625473 - DNA, 25 bp, Mus musculus
gaaacacacttgtagcccgggaaga

SEQ ID NO: 625474 - DNA, 25 bp, Mus musculus
gaaacacagaatccccttaaagaag

SEQ ID NO: 625475 - DNA, 25 bp, Mus musculus
gaaacacagaatgcccttaaagaag

SEQ ID NO: 625476 - DNA, 25 bp, Mus musculus
gaaacacagtgtcgagcatctggaa

SEQ ID NO: 625477 - DNA, 25 bp, Mus musculus
gaaacacagtgtggagcatctggaa

SEQ ID NO: 625478 - DNA, 25 bp, Mus musculus
gaaacacagttgacagagtccatga

SEQ ID NO: 625479 - DNA, 25 bp, Mus musculus
gaaacacagttgtcagagtccatga

SEQ ID NO: 625480 - DNA, 25 bp, Mus musculus
gaaacacatcatcagggtcccaacc

SEQ ID NO: 625481 - DNA, 25 bp, Mus musculus
gaaacacatcatgagggtcccaacc

SEQ ID NO: 625482 - DNA, 25 bp, Mus musculus
gaaacacatcctacatcgagatctg

SEQ ID NO: 625483 - DNA, 25 bp, Mus musculus
gaaacacatccttcatcgagatctg

SEQ ID NO: 625484 - DNA, 25 bp, Mus musculus
gaaacacatctcacctttctggctc

SEQ ID NO: 625485 - DNA, 25 bp, Mus musculus
gaaacacatctctcctttctggctc

SEQ ID NO: 625486 - DNA, 25 bp, Mus musculus
gaaacaccagagctgtgatgtgtcc

SEQ ID NO: 625487 - DNA, 25 bp, Mus musculus
gaaacaccagaggtgtgatgtgtcc

SEQ ID NO: 625488 - DNA, 25 bp, Mus musculus
gaaacaccaggaccttagatgcagg

SEQ ID NO: 625489 - DNA, 25 bp, Mus musculus
gaaacaccaggagcttagatgcagg

SEQ ID NO: 625490 - DNA, 25 bp, Mus musculus
gaaacaccatcgcaagcgttcacac

SEQ ID NO: 625491 - DNA, 25 bp, Mus musculus
gaaacaccatcggaagcgttcacac

SEQ ID NO: 625492 - DNA, 25 bp, Mus musculus
gaaacaccccagaaactgacgaagc

SEQ ID NO: 625493 - DNA, 25 bp, Mus musculus
gaaacaccccagtaactgacgaagc

SEQ ID NO: 625494 - DNA, 25 bp, Mus musculus
gaaacacccggaactgaagtatatc

SEQ ID NO: 625495 - DNA, 25 bp, Mus musculus
gaaacacccggatctgaagtatatc

SEQ ID NO: 625496 - DNA, 25 bp, Mus musculus
gaaacaccctggaggccgtaaagat

SEQ ID NO: 625497 - DNA, 25 bp, Mus musculus
gaaacaccctggtggccgtaaagat

SEQ ID NO: 625498 - DNA, 25 bp, Mus musculus
gaaacaccgcatcgtatggtccacg

SEQ ID NO: 625499 - DNA, 25 bp, Mus musculus
gaaacaccgcatggtatggtccacg

SEQ ID NO: 625500 - DNA, 25 bp, Mus musculus
gaaacaccgcgtcgagtaacgatga

SEQ ID NO: 625501 - DNA, 25 bp, Mus musculus
gaaacaccgcgtggagtaacgatga

SEQ ID NO: 625502 - DNA, 25 bp, Mus musculus
gaaacaccgtggcaactctgctctc

SEQ ID NO: 625503 - DNA, 25 bp, Mus musculus
gaaacaccgtgggaactctgctctc

SEQ ID NO: 625504 - DNA, 25 bp, Mus musculus
gaaacacctcacagaagaacttata

SEQ ID NO: 625505 - DNA, 25 bp, Mus musculus
gaaacacctcactgaagaacttata

SEQ ID NO: 625506 - DNA, 25 bp, Mus musculus
gaaacacctcggcagccaaactact

SEQ ID NO: 625507 - DNA, 25 bp, Mus musculus
gaaacacctcgggagccaaactact

SEQ ID NO: 625508 - DNA, 25 bp, Mus musculus
gaaacacctgcaatctcgttctagg

SEQ ID NO: 625509 - DNA, 25 bp, Mus musculus
gaaacacctgcattctcgttctagg

SEQ ID NO: 625510 - DNA, 25 bp, Mus musculus
gaaacacctgtaagaaggccttcga

SEQ ID NO: 625511 - DNA, 25 bp, Mus musculus
gaaacacctgtatgaaggccttcga

SEQ ID NO: 625512 - DNA, 25 bp, Mus musculus
gaaacaccttccatcgaaatgacct

SEQ ID NO: 625513 - DNA, 25 bp, Mus musculus
gaaacaccttccttcgaaatgacct

SEQ ID NO: 625514 - DNA, 25 bp, Mus musculus
gaaacacgagaaagattggaaccca

SEQ ID NO: 625515 - DNA, 25 bp, Mus musculus
gaaacacgagaatgattggaaccca

SEQ ID NO: 625516 - DNA, 25 bp, Mus musculus
gaaacacgctatcagtattttgagg

SEQ ID NO: 625517 - DNA, 25 bp, Mus musculus
gaaacacgctatgagtattttgagg

SEQ ID NO: 625518 - DNA, 25 bp, Mus musculus
gaaacacgtcgtcatcaacggcagc

SEQ ID NO: 625519 - DNA, 25 bp, Mus musculus
gaaacacgtcgtgatcaacggcagc

SEQ ID NO: 625520 - DNA, 25 bp, Mus musculus
gaaacacgtgcactccctggttgcc

SEQ ID NO: 625521 - DNA, 25 bp, Mus musculus
gaaacacgtgcagtccctggttgcc

SEQ ID NO: 625522 - DNA, 25 bp, Mus musculus
gaaacactaaagaccagccgggaga

SEQ ID NO: 625523 - DNA, 25 bp, Mus musculus
gaaacactaaagtccagccgggaga

SEQ ID NO: 625524 - DNA, 25 bp, Mus musculus
gaaacactattcacacaggttcagc

SEQ ID NO: 625525 - DNA, 25 bp, Mus musculus
gaaacactattctcacaggttcagc

SEQ ID NO: 625526 - DNA, 25 bp, Mus musculus
gaaacactgagtaagaccaggcaga

SEQ ID NO: 625527 - DNA, 25 bp, Mus musculus
gaaacactgagttagaccaggcaga

SEQ ID NO: 625528 - DNA, 25 bp, Mus musculus
gaaacactgcacaacttcccgaaag

SEQ ID NO: 625529 - DNA, 25 bp, Mus musculus
gaaacactgcactacttcccgaaag

SEQ ID NO: 625530 - DNA, 25 bp, Mus musculus
gaaacactgcagcaacctcattcag

SEQ ID NO: 625531 - DNA, 25 bp, Mus musculus
gaaacactgcaggaacctcattcag

SEQ ID NO: 625532 - DNA, 25 bp, Mus musculus
gaaacactggaacgacatgatcgct

SEQ ID NO: 625533 - DNA, 25 bp, Mus musculus
gaaacactggaaggacatgatcgct

SEQ ID NO: 625534 - DNA, 25 bp, Mus musculus
gaaacacttcagcaactggtacagc

SEQ ID NO: 625535 - DNA, 25 bp, Mus musculus
gaaacacttcaggaactggtacagc

SEQ ID NO: 625536 - DNA, 25 bp, Mus musculus
gaaacacttgagcagtgtctcccga

SEQ ID NO: 625537 - DNA, 25 bp, Mus musculus
gaaacacttgaggagtgtctcccga

SEQ ID NO: 625538 - DNA, 25 bp, Mus musculus
gaaacagacatcataatgtggtccc

SEQ ID NO: 625539 - DNA, 25 bp, Mus musculus
gaaacagacatcttaatgtggtccc

SEQ ID NO: 625540 - DNA, 25 bp, Mus musculus
gaaacagaccatcgcgcaccagcag

SEQ ID NO: 625541 - DNA, 25 bp, Mus musculus
gaaacagaccatggcgcaccagcag

SEQ ID NO: 625542 - DNA, 25 bp, Mus musculus
gaaacagacgccaggacagaggctt

SEQ ID NO: 625543 - DNA, 25 bp, Mus musculus
gaaacagacgcctggacagaggctt

SEQ ID NO: 625544 - DNA, 25 bp, Mus musculus
gaaacagagcatcattaccagaacc

SEQ ID NO: 625545 - DNA, 25 bp, Mus musculus
gaaacagagcatgattaccagaacc

SEQ ID NO: 625546 - DNA, 25 bp, Mus musculus
gaaacagagctcaccgggaaatgct

SEQ ID NO: 625547 - DNA, 25 bp, Mus musculus
gaaacagagctctccgggaaatgct

SEQ ID NO: 625548 - DNA, 25 bp, Mus musculus
gaaacagatatgaggctggagcaca

SEQ ID NO: 625549 - DNA, 25 bp, Mus musculus
gaaacagatatgtggctggagcaca

SEQ ID NO: 625550 - DNA, 25 bp, Mus musculus
gaaacagatcaacagctcgctagtg

SEQ ID NO: 625551 - DNA, 25 bp, Mus musculus
gaaacagatcaagagctcgctagtg

SEQ ID NO: 625552 - DNA, 25 bp, Mus musculus
gaaacagatgaaaccagcaaagatg

SEQ ID NO: 625553 - DNA, 25 bp, Mus musculus
gaaacagatgaatccagcaaagatg

SEQ ID NO: 625554 - DNA, 25 bp, Mus musculus
gaaacagattaaacccactttgggc

SEQ ID NO: 625555 - DNA, 25 bp, Mus musculus
gaaacagattaatcccactttgggc

SEQ ID NO: 625556 - DNA, 25 bp, Mus musculus
gaaacagattctcgagtctattgaa

SEQ ID NO: 625557 - DNA, 25 bp, Mus musculus
gaaacagattctggagtctattgaa

SEQ ID NO: 625558 - DNA, 25 bp, Mus musculus
gaaacagcaacgattgtcagccaat

SEQ ID NO: 625559 - DNA, 25 bp, Mus musculus
gaaacagcaacgtttgtcagccaat

SEQ ID NO: 625560 - DNA, 25 bp, Mus musculus
gaaacagcaggccatgcatctgtgt

SEQ ID NO: 625561 - DNA, 25 bp, Mus musculus
gaaacagcaggcgatgcatctgtgt

SEQ ID NO: 625562 - DNA, 25 bp, Mus musculus
gaaacagcagtgacggcggctccca

SEQ ID NO: 625563 - DNA, 25 bp, Mus musculus
gaaacagcagtgagcttctaagtca

SEQ ID NO: 625564 - DNA, 25 bp, Mus musculus
gaaacagcagtgtcggcggctccca

SEQ ID NO: 625565 - DNA, 25 bp, Mus musculus
gaaacagcagtgtgcttctaagtca

SEQ ID NO: 625566 - DNA, 25 bp, Mus musculus
gaaacagcatcgacaatagccaacc

SEQ ID NO: 625567 - DNA, 25 bp, Mus musculus
gaaacagcatcgtcaatagccaacc

SEQ ID NO: 625568 - DNA, 25 bp, Mus musculus
gaaacagccagaagaggaacccatg

SEQ ID NO: 625569 - DNA, 25 bp, Mus musculus
gaaacagccagatgaggaacccatg

SEQ ID NO: 625570 - DNA, 25 bp, Mus musculus
gaaacagccagtagagagtacaaga

SEQ ID NO: 625571 - DNA, 25 bp, Mus musculus
gaaacagccagttgagagtacaaga

SEQ ID NO: 625572 - DNA, 25 bp, Mus musculus
gaaacagccctgaaccttaaacttg

SEQ ID NO: 625573 - DNA, 25 bp, Mus musculus
gaaacagccctgtaccttaaacttg

SEQ ID NO: 625574 - DNA, 25 bp, Mus musculus
gaaacagcctctagccagatattgt

SEQ ID NO: 625575 - DNA, 25 bp, Mus musculus
gaaacagcctcttgccagatattgt

SEQ ID NO: 625576 - DNA, 25 bp, Mus musculus
gaaacagcctggaatttatgcatgc

SEQ ID NO: 625577 - DNA, 25 bp, Mus musculus
gaaacagcctggtatttatgcatgc

SEQ ID NO: 625578 - DNA, 25 bp, Mus musculus
gaaacagctacgagaatgggatgaa

SEQ ID NO: 625579 - DNA, 25 bp, Mus musculus
gaaacagctacgtgaatgggatgaa

SEQ ID NO: 625580 - DNA, 25 bp, Mus musculus
gaaacagctgctctctgcgacggag

SEQ ID NO: 625581 - DNA, 25 bp, Mus musculus
gaaacagctgctgtctgcgacggag

SEQ ID NO: 625582 - DNA, 25 bp, Mus musculus
gaaacaggaactctggaatcccaac

SEQ ID NO: 625583 - DNA, 25 bp, Mus musculus
gaaacaggaactgtggaatcccaac

SEQ ID NO: 625584 - DNA, 25 bp, Mus musculus
gaaacaggacgactggacctttcac

SEQ ID NO: 625585 - DNA, 25 bp, Mus musculus
gaaacaggacgagtggacctttcac

SEQ ID NO: 625586 - DNA, 25 bp, Mus musculus
gaaacaggaggtatactacctaatt

SEQ ID NO: 625587 - DNA, 25 bp, Mus musculus
gaaacaggaggtttactacctaatt

SEQ ID NO: 625588 - DNA, 25 bp, Mus musculus
gaaacaggagtaactgctgttcagt

SEQ ID NO: 625589 - DNA, 25 bp, Mus musculus
gaaacaggagtatctgctgttcagt

SEQ ID NO: 625590 - DNA, 25 bp, Mus musculus
gaaacaggatcaatgtccagactct

SEQ ID NO: 625591 - DNA, 25 bp, Mus musculus
gaaacaggatcattgtccagactct

SEQ ID NO: 625592 - DNA, 25 bp, Mus musculus
gaaacaggatctccaacagaagcct

SEQ ID NO: 625593 - DNA, 25 bp, Mus musculus
gaaacaggatctgcaacagaagcct

SEQ ID NO: 625594 - DNA, 25 bp, Mus musculus
gaaacaggtaatagcaaccacagtt

SEQ ID NO: 625595 - DNA, 25 bp, Mus musculus
gaaacaggtaattgcaaccacagtt

SEQ ID NO: 625596 - DNA, 25 bp, Mus musculus
gaaacagtcagtccagcagttgcga

SEQ ID NO: 625597 - DNA, 25 bp, Mus musculus
gaaacagtcagtgcagcagttgcga

SEQ ID NO: 625598 - DNA, 25 bp, Mus musculus
gaaacagtcccaagtcagagacagg

SEQ ID NO: 625599 - DNA, 25 bp, Mus musculus
gaaacagtcccatgtcagagacagg

SEQ ID NO: 625600 - DNA, 25 bp, Mus musculus
gaaacagtcgtgagccagagtcaga

SEQ ID NO: 625601 - DNA, 25 bp, Mus musculus
gaaacagtcgtgtgccagagtcaga

SEQ ID NO: 625602 - DNA, 25 bp, Mus musculus
gaaacagtgactctacccatgatga

SEQ ID NO: 625603 - DNA, 25 bp, Mus musculus
gaaacagtgactgtacccatgatga

SEQ ID NO: 625604 - DNA, 25 bp, Mus musculus
gaaacagtgagaaggagattcctgt

SEQ ID NO: 625605 - DNA, 25 bp, Mus musculus
gaaacagtgagatggagattcctgt

SEQ ID NO: 625606 - DNA, 25 bp, Mus musculus
gaaacagtgagtagaatgaacctta

SEQ ID NO: 625607 - DNA, 25 bp, Mus musculus
gaaacagtgagttgaatgaacctta

SEQ ID NO: 625608 - DNA, 25 bp, Mus musculus
gaaacagtgccactcaggatcgaaa

SEQ ID NO: 625609 - DNA, 25 bp, Mus musculus
gaaacagtgccagtcaggatcgaaa

SEQ ID NO: 625610 - DNA, 25 bp, Mus musculus
gaaacagtgtggatataagttattt

SEQ ID NO: 625611 - DNA, 25 bp, Mus musculus
gaaacagtgtggttataagttattt

SEQ ID NO: 625612 - DNA, 25 bp, Mus musculus
gaaacagtgttaccatctgggaagc

SEQ ID NO: 625613 - DNA, 25 bp, Mus musculus
gaaacagtgttagcatctgggaagc

SEQ ID NO: 625614 - DNA, 25 bp, Mus musculus
gaaacagttactcttctcccaggag

SEQ ID NO: 625615 - DNA, 25 bp, Mus musculus
gaaacagttactgttctcccaggag

SEQ ID NO: 625616 - DNA, 25 bp, Mus musculus
gaaacagttggcacgacaggcacta

SEQ ID NO: 625617 - DNA, 25 bp, Mus musculus
gaaacagttggctcgacaggcacta

SEQ ID NO: 625618 - DNA, 25 bp, Mus musculus
gaaacagtttggcatcgatggagaa

SEQ ID NO: 625619 - DNA, 25 bp, Mus musculus
gaaacagtttgggatcgatggagaa

SEQ ID NO: 625620 - DNA, 25 bp, Mus musculus
gaaacatacagtcagatctcaggaa

SEQ ID NO: 625621 - DNA, 25 bp, Mus musculus
gaaacatacagtgagatctcaggaa

SEQ ID NO: 625622 - DNA, 25 bp, Mus musculus
gaaacataccaactgtcttcccatc

SEQ ID NO: 625623 - DNA, 25 bp, Mus musculus
gaaacataccaagtgtcttcccatc

SEQ ID NO: 625624 - DNA, 25 bp, Mus musculus
gaaacatagcaccttccatggtgag

SEQ ID NO: 625625 - DNA, 25 bp, Mus musculus
gaaacatagcacgttccatggtgag

SEQ ID NO: 625626 - DNA, 25 bp, Mus musculus
gaaacatagctgctctttcagaacg

SEQ ID NO: 625627 - DNA, 25 bp, Mus musculus
gaaacatagctggtctttcagaacg

SEQ ID NO: 625628 - DNA, 25 bp, Mus musculus
gaaacatatgacagccattcagctg

SEQ ID NO: 625629 - DNA, 25 bp, Mus musculus
gaaacatatgactgccattcagctg

SEQ ID NO: 625630 - DNA, 25 bp, Mus musculus
gaaacatattcaagatttgaactgg

SEQ ID NO: 625631 - DNA, 25 bp, Mus musculus
gaaacatattcatgatttgaactgg

SEQ ID NO: 625632 - DNA, 25 bp, Mus musculus
gaaacatcaattcgctatgtgaccc

SEQ ID NO: 625633 - DNA, 25 bp, Mus musculus
gaaacatcaattggctatgtgaccc

SEQ ID NO: 625634 - DNA, 25 bp, Mus musculus
gaaacatcagataaggcctcagtcc

SEQ ID NO: 625635 - DNA, 25 bp, Mus musculus
gaaacatcagattaggcctcagtcc

SEQ ID NO: 625636 - DNA, 25 bp, Mus musculus
gaaacatcagggagataaattcaac

SEQ ID NO: 625637 - DNA, 25 bp, Mus musculus
gaaacatcagggtgataaattcaac

SEQ ID NO: 625638 - DNA, 25 bp, Mus musculus
gaaacatcagtgctagccatgcatg

SEQ ID NO: 625639 - DNA, 25 bp, Mus musculus
gaaacatcagtggtagccatgcatg

SEQ ID NO: 625640 - DNA, 25 bp, Mus musculus
gaaacatccaaactgctccgtggag

SEQ ID NO: 625641 - DNA, 25 bp, Mus musculus
gaaacatccaaagtgctccgtggag

SEQ ID NO: 625642 - DNA, 25 bp, Mus musculus
gaaacatccacaactgccttatggg

SEQ ID NO: 625643 - DNA, 25 bp, Mus musculus
gaaacatccacatctgccttatggg

SEQ ID NO: 625644 - DNA, 25 bp, Mus musculus
gaaacatccagcaagacaggcaaaa

SEQ ID NO: 625645 - DNA, 25 bp, Mus musculus
gaaacatccagctagacaggcaaaa

SEQ ID NO: 625646 - DNA, 25 bp, Mus musculus
gaaacatcctgtcgagtgcggagaa

SEQ ID NO: 625647 - DNA, 25 bp, Mus musculus
gaaacatcctgtggagtgcggagaa

SEQ ID NO: 625648 - DNA, 25 bp, Mus musculus
gaaacatcgaagagctaaacaagga

SEQ ID NO: 625649 - DNA, 25 bp, Mus musculus
gaaacatcgaagtgctaaacaagga

SEQ ID NO: 625650 - DNA, 25 bp, Mus musculus
gaaacatcgctgagtgactgatcct

SEQ ID NO: 625651 - DNA, 25 bp, Mus musculus
gaaacatcgctgtgtgactgatcct

SEQ ID NO: 625652 - DNA, 25 bp, Mus musculus
gaaacatctcccaatttaaggcaag

SEQ ID NO: 625653 - DNA, 25 bp, Mus musculus
gaaacatctccctatttaaggcaag

SEQ ID NO: 625654 - DNA, 25 bp, Mus musculus
gaaacatcttcaagaggaaccagga

SEQ ID NO: 625655 - DNA, 25 bp, Mus musculus
gaaacatcttcactgcagaggtcca

SEQ ID NO: 625656 - DNA, 25 bp, Mus musculus
gaaacatcttcagtgcagaggtcca

SEQ ID NO: 625657 - DNA, 25 bp, Mus musculus
gaaacatcttcatgaggaaccagga

SEQ ID NO: 625658 - DNA, 25 bp, Mus musculus
gaaacatcttgccaactatgaacgg

SEQ ID NO: 625659 - DNA, 25 bp, Mus musculus
gaaacatcttgcgaactatgaacgg

SEQ ID NO: 625660 - DNA, 25 bp, Mus musculus
gaaacatctttcaacctaatatcag

SEQ ID NO: 625661 - DNA, 25 bp, Mus musculus
gaaacatctttctacctaatatcag

SEQ ID NO: 625662 - DNA, 25 bp, Mus musculus
gaaacatgacatagaagcccagtgg

SEQ ID NO: 625663 - DNA, 25 bp, Mus musculus
gaaacatgacattgaagcccagtgg

SEQ ID NO: 625664 - DNA, 25 bp, Mus musculus
gaaacatgacctctttccaaactgg

SEQ ID NO: 625665 - DNA, 25 bp, Mus musculus
gaaacatgacctgtttccaaactgg

SEQ ID NO: 625666 - DNA, 25 bp, Mus musculus
gaaacatgacttctcgaatccaccc

SEQ ID NO: 625667 - DNA, 25 bp, Mus musculus
gaaacatgacttgtcgaatccaccc

SEQ ID NO: 625668 - DNA, 25 bp, Mus musculus
gaaacatgaggccttctgtgtcccc

SEQ ID NO: 625669 - DNA, 25 bp, Mus musculus
gaaacatgaggcgttctgtgtcccc

SEQ ID NO: 625670 - DNA, 25 bp, Mus musculus
gaaacatgcggcaaatttcacaccg

SEQ ID NO: 625671 - DNA, 25 bp, Mus musculus
gaaacatgcggctaatttcacaccg

SEQ ID NO: 625672 - DNA, 25 bp, Mus musculus
gaaacatgctctcaactgtcacaga

SEQ ID NO: 625673 - DNA, 25 bp, Mus musculus
gaaacatgctctgaactgtcacaga

SEQ ID NO: 625674 - DNA, 25 bp, Mus musculus
gaaacatgcttaatggcccactgta

SEQ ID NO: 625675 - DNA, 25 bp, Mus musculus
gaaacatgcttattggcccactgta

SEQ ID NO: 625676 - DNA, 25 bp, Mus musculus
gaaacatgctttctaatgggccctg

SEQ ID NO: 625677 - DNA, 25 bp, Mus musculus
gaaacatgctttgtaatgggccctg

SEQ ID NO: 625678 - DNA, 25 bp, Mus musculus
gaaacatggcgtctgctctggagca

SEQ ID NO: 625679 - DNA, 25 bp, Mus musculus
gaaacatggcgtgtgctctggagca

SEQ ID NO: 625680 - DNA, 25 bp, Mus musculus
gaaacatggctcacttcgtggctac

SEQ ID NO: 625681 - DNA, 25 bp, Mus musculus
gaaacatggctctcttcgtggctac

SEQ ID NO: 625682 - DNA, 25 bp, Mus musculus
gaaacatgggttatcttaagcctcg

SEQ ID NO: 625683 - DNA, 25 bp, Mus musculus
gaaacatgggttttcttaagcctcg

SEQ ID NO: 625684 - DNA, 25 bp, Mus musculus
gaaacatggtggatccatcccagca

SEQ ID NO: 625685 - DNA, 25 bp, Mus musculus
gaaacatggtggttccatcccagca

SEQ ID NO: 625686 - DNA, 25 bp, Mus musculus
gaaacattaagtcccatccccaggg

SEQ ID NO: 625687 - DNA, 25 bp, Mus musculus
gaaacattaagtgccatccccaggg

SEQ ID NO: 625688 - DNA, 25 bp, Mus musculus
gaaacattcaaaacaagcccatgag

SEQ ID NO: 625689 - DNA, 25 bp, Mus musculus
gaaacattcaaatcaagcccatgag

SEQ ID NO: 625690 - DNA, 25 bp, Mus musculus
gaaacattcaagatccactttaaga

SEQ ID NO: 625691 - DNA, 25 bp, Mus musculus
gaaacattcaagttccactttaaga

SEQ ID NO: 625692 - DNA, 25 bp, Mus musculus
gaaacattcctaagtctgccgggcc

SEQ ID NO: 625693 - DNA, 25 bp, Mus musculus
gaaacattcctatgtctgccgggcc

SEQ ID NO: 625694 - DNA, 25 bp, Mus musculus
gaaacattggccctcaactggcaat

SEQ ID NO: 625695 - DNA, 25 bp, Mus musculus
gaaacattggccgtcaactggcaat

SEQ ID NO: 625696 - DNA, 25 bp, Mus musculus
gaaacattggtcagcttcacttcac

SEQ ID NO: 625697 - DNA, 25 bp, Mus musculus
gaaacattggtctgcttcacttcac

SEQ ID NO: 625698 - DNA, 25 bp, Mus musculus
gaaacatttattccctgacccctct

SEQ ID NO: 625699 - DNA, 25 bp, Mus musculus
gaaacatttattgcctgacccctct

SEQ ID NO: 625700 - DNA, 25 bp, Mus musculus
gaaacatttcaacgtctcctcactc

SEQ ID NO: 625701 - DNA, 25 bp, Mus musculus
gaaacatttcaaggtctcctcactc

SEQ ID NO: 625702 - DNA, 25 bp, Mus musculus
gaaacattttacaccgtagctgtgg

SEQ ID NO: 625703 - DNA, 25 bp, Mus musculus
gaaacattttactccgtagctgtgg

SEQ ID NO: 625704 - DNA, 25 bp, Mus musculus
gaaacattttcgaggctgtccgcag

SEQ ID NO: 625705 - DNA, 25 bp, Mus musculus
gaaacattttcgtggctgtccgcag

SEQ ID NO: 625706 - DNA, 25 bp, Mus musculus
gaaacattttctatggaattcctag

SEQ ID NO: 625707 - DNA, 25 bp, Mus musculus
gaaacattttctttggaattcctag

SEQ ID NO: 625708 - DNA, 25 bp, Mus musculus
gaaaccaaagccatctgaccaagct

SEQ ID NO: 625709 - DNA, 25 bp, Mus musculus
gaaaccaaagccttctgaccaagct

SEQ ID NO: 625710 - DNA, 25 bp, Mus musculus
gaaaccaaatcgcaggccattgcaa

SEQ ID NO: 625711 - DNA, 25 bp, Mus musculus
gaaaccaaatcggaggccattgcaa

SEQ ID NO: 625712 - DNA, 25 bp, Mus musculus
gaaaccaacacgcttctggccaggc

SEQ ID NO: 625713 - DNA, 25 bp, Mus musculus
gaaaccaacacggttctggccaggc

SEQ ID NO: 625714 - DNA, 25 bp, Mus musculus
gaaaccaacaggaacaaccacatta

SEQ ID NO: 625715 - DNA, 25 bp, Mus musculus
gaaaccaacaggtacaaccacatta

SEQ ID NO: 625716 - DNA, 25 bp, Mus musculus
gaaaccaagataaccatgttttccg

SEQ ID NO: 625717 - DNA, 25 bp, Mus musculus
gaaaccaagatatccatgttttccg

SEQ ID NO: 625718 - DNA, 25 bp, Mus musculus
gaaaccaagcagagcgcctgccact

SEQ ID NO: 625719 - DNA, 25 bp, Mus musculus
gaaaccaagcagtgcgcctgccact

SEQ ID NO: 625720 - DNA, 25 bp, Mus musculus
gaaaccaagttgcatggctgcccac

SEQ ID NO: 625721 - DNA, 25 bp, Mus musculus
gaaaccaagttggatggctgcccac

SEQ ID NO: 625722 - DNA, 25 bp, Mus musculus
gaaaccaataaaacatctatggaga

SEQ ID NO: 625723 - DNA, 25 bp, Mus musculus
gaaaccaataaatcatctatggaga

SEQ ID NO: 625724 - DNA, 25 bp, Mus musculus
gaaaccaatcaaattacttttgtgg

SEQ ID NO: 625725 - DNA, 25 bp, Mus musculus
gaaaccaatcaatttacttttgtgg

SEQ ID NO: 625726 - DNA, 25 bp, Mus musculus
gaaaccaatcacatcaaaccatccg

SEQ ID NO: 625727 - DNA, 25 bp, Mus musculus
gaaaccaatcacttcaaaccatccg

SEQ ID NO: 625728 - DNA, 25 bp, Mus musculus
gaaaccacaacaaaaggaagacatt

SEQ ID NO: 625729 - DNA, 25 bp, Mus musculus
gaaaccacaacataaggaagacatt

SEQ ID NO: 625730 - DNA, 25 bp, Mus musculus
gaaaccacgccacgacacaagcagg

SEQ ID NO: 625731 - DNA, 25 bp, Mus musculus
gaaaccacgccaggacacaagcagg

SEQ ID NO: 625732 - DNA, 25 bp, Mus musculus
gaaaccacggatcccagtggcaaaa

SEQ ID NO: 625733 - DNA, 25 bp, Mus musculus
gaaaccacggatgccagtggcaaaa

SEQ ID NO: 625734 - DNA, 25 bp, Mus musculus
gaaaccacgtcaaattgacaaccca

SEQ ID NO: 625735 - DNA, 25 bp, Mus musculus
gaaaccacgtcatattgacaaccca

SEQ ID NO: 625736 - DNA, 25 bp, Mus musculus
gaaaccactattagtagtgtcctgc

SEQ ID NO: 625737 - DNA, 25 bp, Mus musculus
gaaaccactatttgtagtgtcctgc

SEQ ID NO: 625738 - DNA, 25 bp, Mus musculus
gaaaccactcggcatgaagacgccc

SEQ ID NO: 625739 - DNA, 25 bp, Mus musculus
gaaaccactcgggatgaagacgccc

SEQ ID NO: 625740 - DNA, 25 bp, Mus musculus
gaaaccactctgaatgtccaactcc

SEQ ID NO: 625741 - DNA, 25 bp, Mus musculus
gaaaccactctgtatgtccaactcc

SEQ ID NO: 625742 - DNA, 25 bp, Mus musculus
gaaaccacttatcctgggcagactc

SEQ ID NO: 625743 - DNA, 25 bp, Mus musculus
gaaaccacttatgctgggcagactc

SEQ ID NO: 625744 - DNA, 25 bp, Mus musculus
gaaaccactttgcagtctacgtact

SEQ ID NO: 625745 - DNA, 25 bp, Mus musculus
gaaaccactttggagtctacgtact

SEQ ID NO: 625746 - DNA, 25 bp, Mus musculus
gaaaccagaccgaacgcctattgag

SEQ ID NO: 625747 - DNA, 25 bp, Mus musculus
gaaaccagaccgtacgcctattgag

SEQ ID NO: 625748 - DNA, 25 bp, Mus musculus
gaaaccagaggaacagcctatgtgg

SEQ ID NO: 625749 - DNA, 25 bp, Mus musculus
gaaaccagaggatcagcctatgtgg

SEQ ID NO: 625750 - DNA, 25 bp, Mus musculus
gaaaccagatcaagttatcaaagag

SEQ ID NO: 625751 - DNA, 25 bp, Mus musculus
gaaaccagatcatgttatcaaagag

SEQ ID NO: 625752 - DNA, 25 bp, Mus musculus
gaaaccagatttctcatcagccgaa

SEQ ID NO: 625753 - DNA, 25 bp, Mus musculus
gaaaccagatttgtcatcagccgaa

SEQ ID NO: 625754 - DNA, 25 bp, Mus musculus
gaaaccagcccacgaaatatagagc

SEQ ID NO: 625755 - DNA, 25 bp, Mus musculus
gaaaccagcccaggaaatatagagc

SEQ ID NO: 625756 - DNA, 25 bp, Mus musculus
gaaaccagctagatatcggagaggc

SEQ ID NO: 625757 - DNA, 25 bp, Mus musculus
gaaaccagctagttatcggagaggc

SEQ ID NO: 625758 - DNA, 25 bp, Mus musculus
gaaaccaggatcaatttggatctgc

SEQ ID NO: 625759 - DNA, 25 bp, Mus musculus
gaaaccaggatctatttggatctgc

SEQ ID NO: 625760 - DNA, 25 bp, Mus musculus
gaaaccagggctccccaggacttct

SEQ ID NO: 625761 - DNA, 25 bp, Mus musculus
gaaaccagggctgcccaggacttct

SEQ ID NO: 625762 - DNA, 25 bp, Mus musculus
gaaaccagggtcaggcgaggaccaa

SEQ ID NO: 625763 - DNA, 25 bp, Mus musculus
gaaaccagggtctggcgaggaccaa

SEQ ID NO: 625764 - DNA, 25 bp, Mus musculus
gaaaccaggtcaacatccctctggt

SEQ ID NO: 625765 - DNA, 25 bp, Mus musculus
gaaaccaggtcatcatccctctggt

SEQ ID NO: 625766 - DNA, 25 bp, Mus musculus
gaaaccagtctaacaaagccatact

SEQ ID NO: 625767 - DNA, 25 bp, Mus musculus
gaaaccagtctatcaaagccatact

SEQ ID NO: 625768 - DNA, 25 bp, Mus musculus
gaaaccagtgaccaccagatgaacc

SEQ ID NO: 625769 - DNA, 25 bp, Mus musculus
gaaaccagtgacgaccagatgaacc

SEQ ID NO: 625770 - DNA, 25 bp, Mus musculus
gaaaccagtgtgagggatttcctca

SEQ ID NO: 625771 - DNA, 25 bp, Mus musculus
gaaaccagtgtgtgggatttcctca

SEQ ID NO: 625772 - DNA, 25 bp, Mus musculus
gaaaccagttgcatctggagttcag

SEQ ID NO: 625773 - DNA, 25 bp, Mus musculus
gaaaccagttgcttctggagttcag

SEQ ID NO: 625774 - DNA, 25 bp, Mus musculus
gaaaccatacaacttaagaagactg

SEQ ID NO: 625775 - DNA, 25 bp, Mus musculus
gaaaccatacaagttaagaagactg

SEQ ID NO: 625776 - DNA, 25 bp, Mus musculus
gaaaccatatttcagatcgatccgc

SEQ ID NO: 625777 - DNA, 25 bp, Mus musculus
gaaaccatatttgagatcgatccgc

SEQ ID NO: 625778 - DNA, 25 bp, Mus musculus
gaaaccatcatcaccaacaggaagc

SEQ ID NO: 625779 - DNA, 25 bp, Mus musculus
gaaaccatcatctccaacaggaagc

SEQ ID NO: 625780 - DNA, 25 bp, Mus musculus
gaaaccatccaaagcatcaacagtt

SEQ ID NO: 625781 - DNA, 25 bp, Mus musculus
gaaaccatccaatgcatcaacagtt

SEQ ID NO: 625782 - DNA, 25 bp, Mus musculus
gaaaccatccttcgcttcacaggag

SEQ ID NO: 625783 - DNA, 25 bp, Mus musculus
gaaaccatccttggcttcacaggag

SEQ ID NO: 625784 - DNA, 25 bp, Mus musculus
gaaaccatctgacctttcagaagaa

SEQ ID NO: 625785 - DNA, 25 bp, Mus musculus
gaaaccatctgagctttcagaagaa

SEQ ID NO: 625786 - DNA, 25 bp, Mus musculus
gaaaccatcttacaggacgacattg

SEQ ID NO: 625787 - DNA, 25 bp, Mus musculus
gaaaccatcttagaggacgacattg

SEQ ID NO: 625788 - DNA, 25 bp, Mus musculus
gaaaccatgaccctcagcagtctgg

SEQ ID NO: 625789 - DNA, 25 bp, Mus musculus
gaaaccatgaccgtcagcagtctgg

SEQ ID NO: 625790 - DNA, 25 bp, Mus musculus
gaaaccatgatcaccttggcaacgt

SEQ ID NO: 625791 - DNA, 25 bp, Mus musculus
gaaaccatgatctccttggcaacgt

SEQ ID NO: 625792 - DNA, 25 bp, Mus musculus
gaaaccatgccaaagaagccggatg

SEQ ID NO: 625793 - DNA, 25 bp, Mus musculus
gaaaccatgccatagaagccggatg

SEQ ID NO: 625794 - DNA, 25 bp, Mus musculus
gaaaccatgcgcctgattatcttga

SEQ ID NO: 625795 - DNA, 25 bp, Mus musculus
gaaaccatgcgcgtgattatcttga

SEQ ID NO: 625796 - DNA, 25 bp, Mus musculus
gaaaccatggacagattcatggaga

SEQ ID NO: 625797 - DNA, 25 bp, Mus musculus
gaaaccatggactgattcatggaga

SEQ ID NO: 625798 - DNA, 25 bp, Mus musculus
gaaaccatggcaaggtcgccctggg

SEQ ID NO: 625799 - DNA, 25 bp, Mus musculus
gaaaccatggcatggtcgccctggg

SEQ ID NO: 625800 - DNA, 25 bp, Mus musculus
gaaaccattcccctccaggagagca

SEQ ID NO: 625801 - DNA, 25 bp, Mus musculus
gaaaccattcccgtccaggagagca

SEQ ID NO: 625802 - DNA, 25 bp, Mus musculus
gaaaccatttcgagactgtgcagat

SEQ ID NO: 625803 - DNA, 25 bp, Mus musculus
gaaaccatttcgtgactgtgcagat

SEQ ID NO: 625804 - DNA, 25 bp, Mus musculus
gaaaccatttgacattccaaaagcg

SEQ ID NO: 625805 - DNA, 25 bp, Mus musculus
gaaaccatttgagattccaaaagcg

SEQ ID NO: 625806 - DNA, 25 bp, Mus musculus
gaaacccaagcaccagccctataaa

SEQ ID NO: 625807 - DNA, 25 bp, Mus musculus
gaaacccaagcagcagccctataaa

SEQ ID NO: 625808 - DNA, 25 bp, Mus musculus
gaaacccaagctaggagcttatgtt

SEQ ID NO: 625809 - DNA, 25 bp, Mus musculus
gaaacccaagcttggagcttatgtt

SEQ ID NO: 625810 - DNA, 25 bp, Mus musculus
gaaacccaaggtccggaaaagtctg

SEQ ID NO: 625811 - DNA, 25 bp, Mus musculus
gaaacccaaggtgcggaaaagtctg

SEQ ID NO: 625812 - DNA, 25 bp, Mus musculus
gaaacccaagtcctagcacgaagct

SEQ ID NO: 625813 - DNA, 25 bp, Mus musculus
gaaacccaagtcgtagcacgaagct

SEQ ID NO: 625814 - DNA, 25 bp, Mus musculus
gaaacccacagcatgtgccttgctg

SEQ ID NO: 625815 - DNA, 25 bp, Mus musculus
gaaacccacagcttgtgccttgctg

SEQ ID NO: 625816 - DNA, 25 bp, Mus musculus
gaaacccagataattcaggccaaga

SEQ ID NO: 625817 - DNA, 25 bp, Mus musculus
gaaacccagatatttcaggccaaga

SEQ ID NO: 625818 - DNA, 25 bp, Mus musculus
gaaacccagccaatacgaactgcct

SEQ ID NO: 625819 - DNA, 25 bp, Mus musculus
gaaacccagccattacgaactgcct

SEQ ID NO: 625820 - DNA, 25 bp, Mus musculus
gaaacccagcgtacttcaggagatg

SEQ ID NO: 625821 - DNA, 25 bp, Mus musculus
gaaacccagcgttcttcaggagatg

SEQ ID NO: 625822 - DNA, 25 bp, Mus musculus
gaaacccagtcacgtcattgtggag

SEQ ID NO: 625823 - DNA, 25 bp, Mus musculus
gaaacccagtcaggtcattgtggag

SEQ ID NO: 625824 - DNA, 25 bp, Mus musculus
gaaacccagtgaaaacagactacag

SEQ ID NO: 625825 - DNA, 25 bp, Mus musculus
gaaacccagtgataacagactacag

SEQ ID NO: 625826 - DNA, 25 bp, Mus musculus
gaaacccatctcaatcgattgtgac

SEQ ID NO: 625827 - DNA, 25 bp, Mus musculus
gaaacccatctctatcgattgtgac

SEQ ID NO: 625828 - DNA, 25 bp, Mus musculus
gaaaccccgcgtagcagtcaacaat

SEQ ID NO: 625829 - DNA, 25 bp, Mus musculus
gaaaccccgcgttgcagtcaacaat

SEQ ID NO: 625830 - DNA, 25 bp, Mus musculus
gaaacccctcaaagcgttcatgctt

SEQ ID NO: 625831 - DNA, 25 bp, Mus musculus
gaaacccctcaatgcgttcatgctt

SEQ ID NO: 625832 - DNA, 25 bp, Mus musculus
gaaaccccttcaccaaagtgtcttg

SEQ ID NO: 625833 - DNA, 25 bp, Mus musculus
gaaaccccttcagcaaagtgtcttg

SEQ ID NO: 625834 - DNA, 25 bp, Mus musculus
gaaaccccttttaggtgctcatccg

SEQ ID NO: 625835 - DNA, 25 bp, Mus musculus
gaaacccctttttggtgctcatccg

SEQ ID NO: 625836 - DNA, 25 bp, Mus musculus
gaaaccctacaccatgtcatagatg

SEQ ID NO: 625837 - DNA, 25 bp, Mus musculus
gaaaccctacacgatgtcatagatg

SEQ ID NO: 625838 - DNA, 25 bp, Mus musculus
gaaaccctcacaatgatcgatttgt

SEQ ID NO: 625839 - DNA, 25 bp, Mus musculus
gaaaccctcacattgatcgatttgt

SEQ ID NO: 625840 - DNA, 25 bp, Mus musculus
gaaaccctcgtacaaatggcatgtg

SEQ ID NO: 625841 - DNA, 25 bp, Mus musculus
gaaaccctcgtagaaatggcatgtg

SEQ ID NO: 625842 - DNA, 25 bp, Mus musculus
gaaaccctgacccttgtctttgaat

SEQ ID NO: 625843 - DNA, 25 bp, Mus musculus
gaaaccctgaccgttgtctttgaat

SEQ ID NO: 625844 - DNA, 25 bp, Mus musculus
gaaaccctgaggaaagtggactctg

SEQ ID NO: 625845 - DNA, 25 bp, Mus musculus
gaaaccctgaggtaagtggactctg

SEQ ID NO: 625846 - DNA, 25 bp, Mus musculus
gaaaccctgatcacagggaaatggg

SEQ ID NO: 625847 - DNA, 25 bp, Mus musculus
gaaaccctgatctcagggaaatggg

SEQ ID NO: 625848 - DNA, 25 bp, Mus musculus
gaaaccctggacctgggattcaagg

SEQ ID NO: 625849 - DNA, 25 bp, Mus musculus
gaaaccctggacgtgggattcaagg

SEQ ID NO: 625850 - DNA, 25 bp, Mus musculus
gaaaccctttcacctttcacatcta

SEQ ID NO: 625851 - DNA, 25 bp, Mus musculus
gaaaccctttcagctttcacatcta

SEQ ID NO: 625852 - DNA, 25 bp, Mus musculus
gaaaccgacctgcactgcatttttg

SEQ ID NO: 625853 - DNA, 25 bp, Mus musculus
gaaaccgacctggactgcatttttg

SEQ ID NO: 625854 - DNA, 25 bp, Mus musculus
gaaaccgcatcaacatgggaaaaag

SEQ ID NO: 625855 - DNA, 25 bp, Mus musculus
gaaaccgcatcatcatgggaaaaag

SEQ ID NO: 625856 - DNA, 25 bp, Mus musculus
gaaaccgcttagcttttcacaacaa

SEQ ID NO: 625857 - DNA, 25 bp, Mus musculus
gaaaccgcttaggttttcacaacaa

SEQ ID NO: 625858 - DNA, 25 bp, Mus musculus
gaaaccggaagtccacgttgcgcgc

SEQ ID NO: 625859 - DNA, 25 bp, Mus musculus
gaaaccggaagtgcacgttgcgcgc

SEQ ID NO: 625860 - DNA, 25 bp, Mus musculus
gaaaccggcgcgaagaatgcgaagc

SEQ ID NO: 625861 - DNA, 25 bp, Mus musculus
gaaaccggcgcgtagaatgcgaagc

SEQ ID NO: 625862 - DNA, 25 bp, Mus musculus
gaaaccggcgctcttcagcgtcttg

SEQ ID NO: 625863 - DNA, 25 bp, Mus musculus
gaaaccggcgctgttcagcgtcttg

SEQ ID NO: 625864 - DNA, 25 bp, Mus musculus
gaaaccgtacggacgcaacaagccg

SEQ ID NO: 625865 - DNA, 25 bp, Mus musculus
gaaaccgtacggtcgcaacaagccg

SEQ ID NO: 625866 - DNA, 25 bp, Mus musculus
gaaaccgtccatcagtatcaccact

SEQ ID NO: 625867 - DNA, 25 bp, Mus musculus
gaaaccgtccatgagtatcaccact

SEQ ID NO: 625868 - DNA, 25 bp, Mus musculus
gaaaccgtggtaattcgtctgtgaa

SEQ ID NO: 625869 - DNA, 25 bp, Mus musculus
gaaaccgtggtatttcgtctgtgaa

SEQ ID NO: 625870 - DNA, 25 bp, Mus musculus
gaaaccgtgtacaacagcggcgaca

SEQ ID NO: 625871 - DNA, 25 bp, Mus musculus
gaaaccgtgtactacagcggcgaca

SEQ ID NO: 625872 - DNA, 25 bp, Mus musculus
gaaacctaaagtctctgaatcagac

SEQ ID NO: 625873 - DNA, 25 bp, Mus musculus
gaaacctaaagtgtctgaatcagac

SEQ ID NO: 625874 - DNA, 25 bp, Mus musculus
gaaacctaggagctcaggctgccct

SEQ ID NO: 625875 - DNA, 25 bp, Mus musculus
gaaacctaggaggtcaggctgccct

SEQ ID NO: 625876 - DNA, 25 bp, Mus musculus
gaaacctatcaaatcatttctcagg

SEQ ID NO: 625877 - DNA, 25 bp, Mus musculus
gaaacctatcaattcatttctcagg

SEQ ID NO: 625878 - DNA, 25 bp, Mus musculus
gaaacctatgatctacctcctgcct

SEQ ID NO: 625879 - DNA, 25 bp, Mus musculus
gaaacctatgatgtacctcctgcct

SEQ ID NO: 625880 - DNA, 25 bp, Mus musculus
gaaacctatgcactaaatatgtcct

SEQ ID NO: 625881 - DNA, 25 bp, Mus musculus
gaaacctatgcagtaaatatgtcct

SEQ ID NO: 625882 - DNA, 25 bp, Mus musculus
gaaacctatttcatatagacttcgg

SEQ ID NO: 625883 - DNA, 25 bp, Mus musculus
gaaacctatttcttatagacttcgg

SEQ ID NO: 625884 - DNA, 25 bp, Mus musculus
gaaacctccaatactgtggccactg

SEQ ID NO: 625885 - DNA, 25 bp, Mus musculus
gaaacctccaattctgtggccactg

SEQ ID NO: 625886 - DNA, 25 bp, Mus musculus
gaaacctccattctgatccgcatca

SEQ ID NO: 625887 - DNA, 25 bp, Mus musculus
gaaacctccattgtgatccgcatca

SEQ ID NO: 625888 - DNA, 25 bp, Mus musculus
gaaacctctaagagtttaagctcag

SEQ ID NO: 625889 - DNA, 25 bp, Mus musculus
gaaacctctaagtgtttaagctcag

SEQ ID NO: 625890 - DNA, 25 bp, Mus musculus
gaaacctctgacatggaaaccccag

SEQ ID NO: 625891 - DNA, 25 bp, Mus musculus
gaaacctctgacttggaaaccccag

SEQ ID NO: 625892 - DNA, 25 bp, Mus musculus
gaaacctctggcagttcctaccagc

SEQ ID NO: 625893 - DNA, 25 bp, Mus musculus
gaaacctctggctgttcctaccagc

SEQ ID NO: 625894 - DNA, 25 bp, Mus musculus
gaaacctgaacacctataagcgtct

SEQ ID NO: 625895 - DNA, 25 bp, Mus musculus
gaaacctgaacagctataagcgtct

SEQ ID NO: 625896 - DNA, 25 bp, Mus musculus
gaaacctgaagcatattgttaacca

SEQ ID NO: 625897 - DNA, 25 bp, Mus musculus
gaaacctgaagcttattgttaacca

SEQ ID NO: 625898 - DNA, 25 bp, Mus musculus
gaaacctgactcagttatttgcata

SEQ ID NO: 625899 - DNA, 25 bp, Mus musculus
gaaacctgactctgttatttgcata

SEQ ID NO: 625900 - DNA, 25 bp, Mus musculus
gaaacctgagcaacattaaggcttt

SEQ ID NO: 625901 - DNA, 25 bp, Mus musculus
gaaacctgagcatcattaaggcttt

SEQ ID NO: 625902 - DNA, 25 bp, Mus musculus
gaaacctgaggacgctttctggcca

SEQ ID NO: 625903 - DNA, 25 bp, Mus musculus
gaaacctgaggaggctttctggcca

SEQ ID NO: 625904 - DNA, 25 bp, Mus musculus
gaaacctgatacctaaaattttgca

SEQ ID NO: 625905 - DNA, 25 bp, Mus musculus
gaaacctgatacgtaaaattttgca

SEQ ID NO: 625906 - DNA, 25 bp, Mus musculus
gaaacctgcctgagaactgactgct

SEQ ID NO: 625907 - DNA, 25 bp, Mus musculus
gaaacctgcctgtgaactgactgct

SEQ ID NO: 625908 - DNA, 25 bp, Mus musculus
gaaacctgctgtaggcgtatttggg

SEQ ID NO: 625909 - DNA, 25 bp, Mus musculus
gaaacctgctgttggcgtatttggg

SEQ ID NO: 625910 - DNA, 25 bp, Mus musculus
gaaacctggaccagaagtaagggtg

SEQ ID NO: 625911 - DNA, 25 bp, Mus musculus
gaaacctggacctgaagtaagggtg

SEQ ID NO: 625912 - DNA, 25 bp, Mus musculus
gaaacctggaggcatcatagtgcga

SEQ ID NO: 625913 - DNA, 25 bp, Mus musculus
gaaacctggagggatcatagtgcga

SEQ ID NO: 625914 - DNA, 25 bp, Mus musculus
gaaacctggccgacatggatagtcc

SEQ ID NO: 625915 - DNA, 25 bp, Mus musculus
gaaacctggccgtcatggatagtcc

SEQ ID NO: 625916 - DNA, 25 bp, Mus musculus
gaaacctgggtcatccgcaggattg

SEQ ID NO: 625917 - DNA, 25 bp, Mus musculus
gaaacctgggtcttccgcaggattg

SEQ ID NO: 625918 - DNA, 25 bp, Mus musculus
gaaacctggtcaagacaaattcacg

SEQ ID NO: 625919 - DNA, 25 bp, Mus musculus
gaaacctggtcatgacaaattcacg

SEQ ID NO: 625920 - DNA, 25 bp, Mus musculus
gaaacctgtcatacttaggcccttg

SEQ ID NO: 625921 - DNA, 25 bp, Mus musculus
gaaacctgtcatcagctgccaatca

SEQ ID NO: 625922 - DNA, 25 bp, Mus musculus
gaaacctgtcatgagctgccaatca

SEQ ID NO: 625923 - DNA, 25 bp, Mus musculus
gaaacctgtcattcttaggcccttg

SEQ ID NO: 625924 - DNA, 25 bp, Mus musculus
gaaaccttaatccaaacaagtctgt

SEQ ID NO: 625925 - DNA, 25 bp, Mus musculus
gaaaccttaatcgaaacaagtctgt

SEQ ID NO: 625926 - DNA, 25 bp, Mus musculus
gaaaccttatttatccctgcggagt

SEQ ID NO: 625927 - DNA, 25 bp, Mus musculus
gaaaccttatttttccctgcggagt

SEQ ID NO: 625928 - DNA, 25 bp, Mus musculus
gaaaccttcaatagtgacaaaatat

SEQ ID NO: 625929 - DNA, 25 bp, Mus musculus
gaaaccttcaattgtgacaaaatat

SEQ ID NO: 625930 - DNA, 25 bp, Mus musculus
gaaaccttccggaagttgcagctta

SEQ ID NO: 625931 - DNA, 25 bp, Mus musculus
gaaaccttccggtagttgcagctta

SEQ ID NO: 625932 - DNA, 25 bp, Mus musculus
gaaaccttctggagaattccagcca

SEQ ID NO: 625933 - DNA, 25 bp, Mus musculus
gaaaccttctggtgaattccagcca

SEQ ID NO: 625934 - DNA, 25 bp, Mus musculus
gaaaccttgagcagaggcctactgg

SEQ ID NO: 625935 - DNA, 25 bp, Mus musculus
gaaaccttgagctgaggcctactgg

SEQ ID NO: 625936 - DNA, 25 bp, Mus musculus
gaaaccttgctaagctggaaatgct

SEQ ID NO: 625937 - DNA, 25 bp, Mus musculus
gaaaccttgctatgctggaaatgct

SEQ ID NO: 625938 - DNA, 25 bp, Mus musculus
gaaacctttaacctgctgttgcgag

SEQ ID NO: 625939 - DNA, 25 bp, Mus musculus
gaaacctttaacgtgctgttgcgag

SEQ ID NO: 625940 - DNA, 25 bp, Mus musculus
gaaacctttacaaacgaatggactg

SEQ ID NO: 625941 - DNA, 25 bp, Mus musculus
gaaacctttacatacgaatggactg

SEQ ID NO: 625942 - DNA, 25 bp, Mus musculus
gaaacctttcagatgcagcgactaa

SEQ ID NO: 625943 - DNA, 25 bp, Mus musculus
gaaacctttcagttgcagcgactaa

SEQ ID NO: 625944 - DNA, 25 bp, Mus musculus
gaaacctttgatactggctgactgc

SEQ ID NO: 625945 - DNA, 25 bp, Mus musculus
gaaacctttgattctggctgactgc

SEQ ID NO: 625946 - DNA, 25 bp, Mus musculus
gaaacctttgcccaccttatagtgc

SEQ ID NO: 625947 - DNA, 25 bp, Mus musculus
gaaacctttgccgaccttatagtgc

SEQ ID NO: 625948 - DNA, 25 bp, Mus musculus
gaaaccttttcacttgtatgctata

SEQ ID NO: 625949 - DNA, 25 bp, Mus musculus
gaaaccttttcagttgtatgctata

SEQ ID NO: 625950 - DNA, 25 bp, Mus musculus
gaaacgaaaggtcaaattaacagct

SEQ ID NO: 625951 - DNA, 25 bp, Mus musculus
gaaacgaaaggtgaaattaacagct

SEQ ID NO: 625952 - DNA, 25 bp, Mus musculus
gaaacgaaatccagccaacgttcac

SEQ ID NO: 625953 - DNA, 25 bp, Mus musculus
gaaacgaaatcctgccaacgttcac

SEQ ID NO: 625954 - DNA, 25 bp, Mus musculus
gaaacgaaatgtatccaatgtggcc

SEQ ID NO: 625955 - DNA, 25 bp, Mus musculus
gaaacgaaatgtttccaatgtggcc

SEQ ID NO: 625956 - DNA, 25 bp, Mus musculus
gaaacgaatgcacggccccattcca

SEQ ID NO: 625957 - DNA, 25 bp, Mus musculus
gaaacgaatgcagggccccattcca

SEQ ID NO: 625958 - DNA, 25 bp, Mus musculus
gaaacgacagaacctcactaccagt

SEQ ID NO: 625959 - DNA, 25 bp, Mus musculus
gaaacgacagaagctcactaccagt

SEQ ID NO: 625960 - DNA, 25 bp, Mus musculus
gaaacgacgatacttgagacctact

SEQ ID NO: 625961 - DNA, 25 bp, Mus musculus
gaaacgacgatagttgagacctact

SEQ ID NO: 625962 - DNA, 25 bp, Mus musculus
gaaacgactagacaaggatggcgtc

SEQ ID NO: 625963 - DNA, 25 bp, Mus musculus
gaaacgactagagaaggatggcgtc

SEQ ID NO: 625964 - DNA, 25 bp, Mus musculus
gaaacgagattaaagaagcacccat

SEQ ID NO: 625965 - DNA, 25 bp, Mus musculus
gaaacgagattatagaagcacccat

SEQ ID NO: 625966 - DNA, 25 bp, Mus musculus
gaaacgatgcccaaaccatgagctg

SEQ ID NO: 625967 - DNA, 25 bp, Mus musculus
gaaacgatgccctaaccatgagctg

SEQ ID NO: 625968 - DNA, 25 bp, Mus musculus
gaaacgatggcacccctggcacagc

SEQ ID NO: 625969 - DNA, 25 bp, Mus musculus
gaaacgatggcagccctggcacagc

SEQ ID NO: 625970 - DNA, 25 bp, Mus musculus
gaaacgattacaccctttgtagagc

SEQ ID NO: 625971 - DNA, 25 bp, Mus musculus
gaaacgattacagcctttgtagagc

SEQ ID NO: 625972 - DNA, 25 bp, Mus musculus
gaaacgattcagcttgcctgcaaag

SEQ ID NO: 625973 - DNA, 25 bp, Mus musculus
gaaacgattcaggttgcctgcaaag

SEQ ID NO: 625974 - DNA, 25 bp, Mus musculus
gaaacgcaacgtcattcccgagacc

SEQ ID NO: 625975 - DNA, 25 bp, Mus musculus
gaaacgcaacgtgattcccgagacc

SEQ ID NO: 625976 - DNA, 25 bp, Mus musculus
gaaacgcaaggaactgcttcaacgc

SEQ ID NO: 625977 - DNA, 25 bp, Mus musculus
gaaacgcaaggatctgcttcaacgc

SEQ ID NO: 625978 - DNA, 25 bp, Mus musculus
gaaacgcagagtagtagacacagag

SEQ ID NO: 625979 - DNA, 25 bp, Mus musculus
gaaacgcagagttgtagacacagag

SEQ ID NO: 625980 - DNA, 25 bp, Mus musculus
gaaacgccaaaaaccacgtagagag

SEQ ID NO: 625981 - DNA, 25 bp, Mus musculus
gaaacgccaaaatccacgtagagag

SEQ ID NO: 625982 - DNA, 25 bp, Mus musculus
gaaacgccacctaactgctaaatgg

SEQ ID NO: 625983 - DNA, 25 bp, Mus musculus
gaaacgccaccttactgctaaatgg

SEQ ID NO: 625984 - DNA, 25 bp, Mus musculus
gaaacgccagctagtggactatgaa

SEQ ID NO: 625985 - DNA, 25 bp, Mus musculus
gaaacgccagcttgtggactatgaa

SEQ ID NO: 625986 - DNA, 25 bp, Mus musculus
gaaacgccagggagccaagatggca

SEQ ID NO: 625987 - DNA, 25 bp, Mus musculus
gaaacgccagggtgccaagatggca

SEQ ID NO: 625988 - DNA, 25 bp, Mus musculus
gaaacgcccaaacaaggatcctgtg

SEQ ID NO: 625989 - DNA, 25 bp, Mus musculus
gaaacgcccaaactgtacagagaga

SEQ ID NO: 625990 - DNA, 25 bp, Mus musculus
gaaacgcccaaagaaggatcctgtg

SEQ ID NO: 625991 - DNA, 25 bp, Mus musculus
gaaacgcccaaagtgtacagagaga

SEQ ID NO: 625992 - DNA, 25 bp, Mus musculus
gaaacgcccatcaatccaagaagat

SEQ ID NO: 625993 - DNA, 25 bp, Mus musculus
gaaacgcccatctatccaagaagat

SEQ ID NO: 625994 - DNA, 25 bp, Mus musculus
gaaacgcctcaaacaagccaggaga

SEQ ID NO: 625995 - DNA, 25 bp, Mus musculus
gaaacgcctcaatcaagccaggaga

SEQ ID NO: 625996 - DNA, 25 bp, Mus musculus
gaaacgctacgaaggccctctctgg

SEQ ID NO: 625997 - DNA, 25 bp, Mus musculus
gaaacgctacgatggccctctctgg

SEQ ID NO: 625998 - DNA, 25 bp, Mus musculus
gaaacgctgcagaaatgtcaatgtg

SEQ ID NO: 625999 - DNA, 25 bp, Mus musculus
gaaacgctgcagtaatgtcaatgtg

SEQ ID NO: 626000 - DNA, 25 bp, Mus musculus
gaaacggaaaataccagcagtatta

SEQ ID NO: 626001 - DNA, 25 bp, Mus musculus
gaaacggaaaattccagcagtatta

SEQ ID NO: 626002 - DNA, 25 bp, Mus musculus
gaaacggaagtgcagaaagcagccc

SEQ ID NO: 626003 - DNA, 25 bp, Mus musculus
gaaacggaagtggagaaagcagccc

SEQ ID NO: 626004 - DNA, 25 bp, Mus musculus
gaaacggaatcacagacacacattt

SEQ ID NO: 626005 - DNA, 25 bp, Mus musculus
gaaacggaatcagagacacacattt

SEQ ID NO: 626006 - DNA, 25 bp, Mus musculus
gaaacggacctgatggctaccacaa

SEQ ID NO: 626007 - DNA, 25 bp, Mus musculus
gaaacggacctgttggctaccacaa

SEQ ID NO: 626008 - DNA, 25 bp, Mus musculus
gaaacggagaaacaagctggcgcct

SEQ ID NO: 626009 - DNA, 25 bp, Mus musculus
gaaacggagaaagaagctggcgcct

SEQ ID NO: 626010 - DNA, 25 bp, Mus musculus
gaaacggagctgagagacctgccag

SEQ ID NO: 626011 - DNA, 25 bp, Mus musculus
gaaacggagctgtgagacctgccag

SEQ ID NO: 626012 - DNA, 25 bp, Mus musculus
gaaacggagttgcataagctcaccg

SEQ ID NO: 626013 - DNA, 25 bp, Mus musculus
gaaacggagttggataagctcaccg

SEQ ID NO: 626014 - DNA, 25 bp, Mus musculus
gaaacggcaactaggacctgaggag

SEQ ID NO: 626015 - DNA, 25 bp, Mus musculus
gaaacggcaacttggacctgaggag

SEQ ID NO: 626016 - DNA, 25 bp, Mus musculus
gaaacggccagtcttctcttgagga

SEQ ID NO: 626017 - DNA, 25 bp, Mus musculus
gaaacggccagtgttctcttgagga

SEQ ID NO: 626018 - DNA, 25 bp, Mus musculus
gaaacggcttgacgaaaagcaaaga

SEQ ID NO: 626019 - DNA, 25 bp, Mus musculus
gaaacggcttgaggaaaagcaaaga

SEQ ID NO: 626020 - DNA, 25 bp, Mus musculus
gaaacggcttggacaggagttcacc

SEQ ID NO: 626021 - DNA, 25 bp, Mus musculus
gaaacggcttggtcaggagttcacc

SEQ ID NO: 626022 - DNA, 25 bp, Mus musculus
gaaacgggatgaattggacaaagca

SEQ ID NO: 626023 - DNA, 25 bp, Mus musculus
gaaacgggatgatttggacaaagca

SEQ ID NO: 626024 - DNA, 25 bp, Mus musculus
gaaacgggtcatctaacgtaagcaa

SEQ ID NO: 626025 - DNA, 25 bp, Mus musculus
gaaacgggtcatgtaacgtaagcaa

SEQ ID NO: 626026 - DNA, 25 bp, Mus musculus
gaaacggtaactatggtgaccacaa

SEQ ID NO: 626027 - DNA, 25 bp, Mus musculus
gaaacggtaactttggtgaccacaa

SEQ ID NO: 626028 - DNA, 25 bp, Mus musculus
gaaacggtcaaactgtttttgcagc

SEQ ID NO: 626029 - DNA, 25 bp, Mus musculus
gaaacggtcaaagtgtttttgcagc

SEQ ID NO: 626030 - DNA, 25 bp, Mus musculus
gaaacggtcacgagaaccagaggaa

SEQ ID NO: 626031 - DNA, 25 bp, Mus musculus
gaaacggtcacgtgaaccagaggaa

SEQ ID NO: 626032 - DNA, 25 bp, Mus musculus
gaaacggttacgattatggccagtg

SEQ ID NO: 626033 - DNA, 25 bp, Mus musculus
gaaacggttacgtttatggccagtg

SEQ ID NO: 626034 - DNA, 25 bp, Mus musculus
gaaacggttcatagctttacagtca

SEQ ID NO: 626035 - DNA, 25 bp, Mus musculus
gaaacggttcattgctttacagtca

SEQ ID NO: 626036 - DNA, 25 bp, Mus musculus
gaaacgtactccctcaaggcaagga

SEQ ID NO: 626037 - DNA, 25 bp, Mus musculus
gaaacgtactccgtcaaggcaagga

SEQ ID NO: 626038 - DNA, 25 bp, Mus musculus
gaaacgtatcccattttgtgaatca

SEQ ID NO: 626039 - DNA, 25 bp, Mus musculus
gaaacgtatccctttttgtgaatca

SEQ ID NO: 626040 - DNA, 25 bp, Mus musculus
gaaacgtatttaaatccagtgcgct

SEQ ID NO: 626041 - DNA, 25 bp, Mus musculus
gaaacgtatttatatccagtgcgct

SEQ ID NO: 626042 - DNA, 25 bp, Mus musculus
gaaacgtctgagagctgaaaaccca

SEQ ID NO: 626043 - DNA, 25 bp, Mus musculus
gaaacgtctgagtgctgaaaaccca

SEQ ID NO: 626044 - DNA, 25 bp, Mus musculus
gaaacgtctgtcagttaacctgccc

SEQ ID NO: 626045 - DNA, 25 bp, Mus musculus
gaaacgtctgtctgttaacctgccc

SEQ ID NO: 626046 - DNA, 25 bp, Mus musculus
gaaacgtcttagacagtgaggatga

SEQ ID NO: 626047 - DNA, 25 bp, Mus musculus
gaaacgtcttagtcagtgaggatga

SEQ ID NO: 626048 - DNA, 25 bp, Mus musculus
gaaacgtgacaacagtaatccaggt

SEQ ID NO: 626049 - DNA, 25 bp, Mus musculus
gaaacgtgacaagagtaatccaggt

SEQ ID NO: 626050 - DNA, 25 bp, Mus musculus
gaaacgtgacacattttccaccaga

SEQ ID NO: 626051 - DNA, 25 bp, Mus musculus
gaaacgtgacactttttccaccaga

SEQ ID NO: 626052 - DNA, 25 bp, Mus musculus
gaaacgtgactgcactttaagtaac

SEQ ID NO: 626053 - DNA, 25 bp, Mus musculus
gaaacgtgactggactttaagtaac

SEQ ID NO: 626054 - DNA, 25 bp, Mus musculus
gaaacgtgagtactggcagaagcaa

SEQ ID NO: 626055 - DNA, 25 bp, Mus musculus
gaaacgtgagtagtggcagaagcaa

SEQ ID NO: 626056 - DNA, 25 bp, Mus musculus
gaaacgtgctgacgaacagtgtccc

SEQ ID NO: 626057 - DNA, 25 bp, Mus musculus
gaaacgtgctgaggaacagtgtccc

SEQ ID NO: 626058 - DNA, 25 bp, Mus musculus
gaaacgtggaacataagaatggaca

SEQ ID NO: 626059 - DNA, 25 bp, Mus musculus
gaaacgtggaacttaagaatggaca

SEQ ID NO: 626060 - DNA, 25 bp, Mus musculus
gaaacgtggaccatgcagccactca

SEQ ID NO: 626061 - DNA, 25 bp, Mus musculus
gaaacgtggaccttgcagccactca

SEQ ID NO: 626062 - DNA, 25 bp, Mus musculus
gaaacgtgtagcatctgcttcccgg

SEQ ID NO: 626063 - DNA, 25 bp, Mus musculus
gaaacgtgtagcttctgcttcccgg

SEQ ID NO: 626064 - DNA, 25 bp, Mus musculus
gaaacgtgtgaaccttgaagggaaa

SEQ ID NO: 626065 - DNA, 25 bp, Mus musculus
gaaacgtgtgaagcttgaagggaaa

SEQ ID NO: 626066 - DNA, 25 bp, Mus musculus
gaaacgttttagctatgaaagtgag

SEQ ID NO: 626067 - DNA, 25 bp, Mus musculus
gaaacgttttaggtatgaaagtgag

SEQ ID NO: 626068 - DNA, 25 bp, Mus musculus
gaaactacagcaacttcttggcaga

SEQ ID NO: 626069 - DNA, 25 bp, Mus musculus
gaaactacagcatcttcttggcaga

SEQ ID NO: 626070 - DNA, 25 bp, Mus musculus
gaaactacattcagtctctggccca

SEQ ID NO: 626071 - DNA, 25 bp, Mus musculus
gaaactacattctgtctctggccca

SEQ ID NO: 626072 - DNA, 25 bp, Mus musculus
gaaactaccaaaccaatttctcctg

SEQ ID NO: 626073 - DNA, 25 bp, Mus musculus
gaaactaccaaagcaatttctcctg

SEQ ID NO: 626074 - DNA, 25 bp, Mus musculus
gaaactacggctctagaacaggcac

SEQ ID NO: 626075 - DNA, 25 bp, Mus musculus
gaaactacggctgtagaacaggcac

SEQ ID NO: 626076 - DNA, 25 bp, Mus musculus
gaaactacgtatccagatttcattg

SEQ ID NO: 626077 - DNA, 25 bp, Mus musculus
gaaactacgtatgcagatttcattg

SEQ ID NO: 626078 - DNA, 25 bp, Mus musculus
gaaactactagaaccaagactgcag

SEQ ID NO: 626079 - DNA, 25 bp, Mus musculus
gaaactactagatccaagactgcag

SEQ ID NO: 626080 - DNA, 25 bp, Mus musculus
gaaactagagcgagatctcagcttt

SEQ ID NO: 626081 - DNA, 25 bp, Mus musculus
gaaactagagcgtgatctcagcttt

SEQ ID NO: 626082 - DNA, 25 bp, Mus musculus
gaaactagatccattactcctgaag

SEQ ID NO: 626083 - DNA, 25 bp, Mus musculus
gaaactagatcctttactcctgaag

SEQ ID NO: 626084 - DNA, 25 bp, Mus musculus
gaaactagatcgcatgctgggcact

SEQ ID NO: 626085 - DNA, 25 bp, Mus musculus
gaaactagatcggatgctgggcact

SEQ ID NO: 626086 - DNA, 25 bp, Mus musculus
gaaactagtacactagagatccaag

SEQ ID NO: 626087 - DNA, 25 bp, Mus musculus
gaaactagtacagtagagatccaag

SEQ ID NO: 626088 - DNA, 25 bp, Mus musculus
gaaactagtcccaggaccaaaatca

SEQ ID NO: 626089 - DNA, 25 bp, Mus musculus
gaaactagtccctggaccaaaatca

SEQ ID NO: 626090 - DNA, 25 bp, Mus musculus
gaaactataggaagaagctgaatct

SEQ ID NO: 626091 - DNA, 25 bp, Mus musculus
gaaactataggatgaagctgaatct

SEQ ID NO: 626092 - DNA, 25 bp, Mus musculus
gaaactatcaaaccgcagagtaggc

SEQ ID NO: 626093 - DNA, 25 bp, Mus musculus
gaaactatcaaagcgcagagtaggc

SEQ ID NO: 626094 - DNA, 25 bp, Mus musculus
gaaactatcatcatgtggctcataa

SEQ ID NO: 626095 - DNA, 25 bp, Mus musculus
gaaactatcatcttgtggctcataa

SEQ ID NO: 626096 - DNA, 25 bp, Mus musculus
gaaactatcgagcacatacaagact

SEQ ID NO: 626097 - DNA, 25 bp, Mus musculus
gaaactatcgaggacatacaagact

SEQ ID NO: 626098 - DNA, 25 bp, Mus musculus
gaaactatggcaacctcctgctgga

SEQ ID NO: 626099 - DNA, 25 bp, Mus musculus
gaaactatggcatcctcctgctgga

SEQ ID NO: 626100 - DNA, 25 bp, Mus musculus
gaaactcaaagtaacagacattctg

SEQ ID NO: 626101 - DNA, 25 bp, Mus musculus
gaaactcaaagttacagacattctg

SEQ ID NO: 626102 - DNA, 25 bp, Mus musculus
gaaactcaacccaaaaggaagtgct

SEQ ID NO: 626103 - DNA, 25 bp, Mus musculus
gaaactcaaccctaaaggaagtgct

SEQ ID NO: 626104 - DNA, 25 bp, Mus musculus
gaaactcaatgcaacgcttgaccag

SEQ ID NO: 626105 - DNA, 25 bp, Mus musculus
gaaactcaatgctacgcttgaccag

SEQ ID NO: 626106 - DNA, 25 bp, Mus musculus
gaaactcaccaacccatcgtggaga

SEQ ID NO: 626107 - DNA, 25 bp, Mus musculus
gaaactcaccaagccatcgtggaga

SEQ ID NO: 626108 - DNA, 25 bp, Mus musculus
gaaactcacttgcacgaggacgagg

SEQ ID NO: 626109 - DNA, 25 bp, Mus musculus
gaaactcacttggacgaggacgagg

SEQ ID NO: 626110 - DNA, 25 bp, Mus musculus
gaaactcagcaaagtccctgatgac

SEQ ID NO: 626111 - DNA, 25 bp, Mus musculus
gaaactcagcaatgtccctgatgac

SEQ ID NO: 626112 - DNA, 25 bp, Mus musculus
gaaactcagcagagtcagcccaaag

SEQ ID NO: 626113 - DNA, 25 bp, Mus musculus
gaaactcagcagtgtcagcccaaag

SEQ ID NO: 626114 - DNA, 25 bp, Mus musculus
gaaactcaggatcaatggtccactg

SEQ ID NO: 626115 - DNA, 25 bp, Mus musculus
gaaactcaggatgaatggtccactg

SEQ ID NO: 626116 - DNA, 25 bp, Mus musculus
gaaactcagggactacgctgcgaaa

SEQ ID NO: 626117 - DNA, 25 bp, Mus musculus
gaaactcagggagtacgctgcgaaa

SEQ ID NO: 626118 - DNA, 25 bp, Mus musculus
gaaactcagtttaagaagatcctcg

SEQ ID NO: 626119 - DNA, 25 bp, Mus musculus
gaaactcagttttagaagatcctcg

SEQ ID NO: 626120 - DNA, 25 bp, Mus musculus
gaaactcatcacctttcccagaatc

SEQ ID NO: 626121 - DNA, 25 bp, Mus musculus
gaaactcatcacgtttcccagaatc

SEQ ID NO: 626122 - DNA, 25 bp, Mus musculus
gaaactcatgggaaaaactcatgtg

SEQ ID NO: 626123 - DNA, 25 bp, Mus musculus
gaaactcatgggtaaaactcatgtg

SEQ ID NO: 626124 - DNA, 25 bp, Mus musculus
gaaactcattagacactggaggtga

SEQ ID NO: 626125 - DNA, 25 bp, Mus musculus
gaaactcattagtcactggaggtga

SEQ ID NO: 626126 - DNA, 25 bp, Mus musculus
gaaactcattgcagagaaacacagg

SEQ ID NO: 626127 - DNA, 25 bp, Mus musculus
gaaactcattgctgagaaacacagg

SEQ ID NO: 626128 - DNA, 25 bp, Mus musculus
gaaactcatttcagggcccgtaagg

SEQ ID NO: 626129 - DNA, 25 bp, Mus musculus
gaaactcatttctgggcccgtaagg

SEQ ID NO: 626130 - DNA, 25 bp, Mus musculus
gaaactcccatcatgactatcccaa

SEQ ID NO: 626131 - DNA, 25 bp, Mus musculus
gaaactcccatcttgactatcccaa

SEQ ID NO: 626132 - DNA, 25 bp, Mus musculus
gaaactcctacgcagatatctttag

SEQ ID NO: 626133 - DNA, 25 bp, Mus musculus
gaaactcctacggagatatctttag

SEQ ID NO: 626134 - DNA, 25 bp, Mus musculus
gaaactcctcctccatcattgcttt

SEQ ID NO: 626135 - DNA, 25 bp, Mus musculus
gaaactcctcctgcatcattgcttt

SEQ ID NO: 626136 - DNA, 25 bp, Mus musculus
gaaactccttctcttactattcaaa

SEQ ID NO: 626137 - DNA, 25 bp, Mus musculus
gaaactccttctgttactattcaaa

SEQ ID NO: 626138 - DNA, 25 bp, Mus musculus
gaaactcgagtgacacccactggga

SEQ ID NO: 626139 - DNA, 25 bp, Mus musculus
gaaactcgagtgtcacccactggga

SEQ ID NO: 626140 - DNA, 25 bp, Mus musculus
gaaactcggaatcagttcattgatg

SEQ ID NO: 626141 - DNA, 25 bp, Mus musculus
gaaactcggaatgagttcattgatg

SEQ ID NO: 626142 - DNA, 25 bp, Mus musculus
gaaactcggcagagccgtggtgacc

SEQ ID NO: 626143 - DNA, 25 bp, Mus musculus
gaaactcggcagtgccgtggtgacc

SEQ ID NO: 626144 - DNA, 25 bp, Mus musculus
gaaactcggcatcaatctgatgaat

SEQ ID NO: 626145 - DNA, 25 bp, Mus musculus
gaaactcggcatgaatctgatgaat

SEQ ID NO: 626146 - DNA, 25 bp, Mus musculus
gaaactcgtgctagcataaaatggc

SEQ ID NO: 626147 - DNA, 25 bp, Mus musculus
gaaactcgtgcttgcataaaatggc

SEQ ID NO: 626148 - DNA, 25 bp, Mus musculus
gaaactctacatctcagtggcagga

SEQ ID NO: 626149 - DNA, 25 bp, Mus musculus
gaaactctacatgtcagtggcagga

SEQ ID NO: 626150 - DNA, 25 bp, Mus musculus
gaaactctaccacgccacttctggg

SEQ ID NO: 626151 - DNA, 25 bp, Mus musculus
gaaactctaccaggccacttctggg

SEQ ID NO: 626152 - DNA, 25 bp, Mus musculus
gaaactctacttcggcttctggtgg

SEQ ID NO: 626153 - DNA, 25 bp, Mus musculus
gaaactctacttgggcttctggtgg

SEQ ID NO: 626154 - DNA, 25 bp, Mus musculus
gaaactctcaagagacatccaaggt

SEQ ID NO: 626155 - DNA, 25 bp, Mus musculus
gaaactctcaagtgacatccaaggt

SEQ ID NO: 626156 - DNA, 25 bp, Mus musculus
gaaactctccatagctgactatcct

SEQ ID NO: 626157 - DNA, 25 bp, Mus musculus
gaaactctccattgctgactatcct

SEQ ID NO: 626158 - DNA, 25 bp, Mus musculus
gaaactctcttgatactcaagatga

SEQ ID NO: 626159 - DNA, 25 bp, Mus musculus
gaaactctcttgttactcaagatga

SEQ ID NO: 626160 - DNA, 25 bp, Mus musculus
gaaactctgaaaaccatcgtaccta

SEQ ID NO: 626161 - DNA, 25 bp, Mus musculus
gaaactctgaaatccatcgtaccta

SEQ ID NO: 626162 - DNA, 25 bp, Mus musculus
gaaactctggctactcaacgggaca

SEQ ID NO: 626163 - DNA, 25 bp, Mus musculus
gaaactctggcttctcaacgggaca

SEQ ID NO: 626164 - DNA, 25 bp, Mus musculus
gaaactcttcgtcgacaagataaga

SEQ ID NO: 626165 - DNA, 25 bp, Mus musculus
gaaactcttcgtggacaagataaga

SEQ ID NO: 626166 - DNA, 25 bp, Mus musculus
gaaactcttgcaaatggtaaaagct

SEQ ID NO: 626167 - DNA, 25 bp, Mus musculus
gaaactcttgcatatggtaaaagct

SEQ ID NO: 626168 - DNA, 25 bp, Mus musculus
gaaactgaaacgctgcattcgcaca

SEQ ID NO: 626169 - DNA, 25 bp, Mus musculus
gaaactgaaacggtgcattcgcaca

SEQ ID NO: 626170 - DNA, 25 bp, Mus musculus
gaaactgaacagacaaagccatcca

SEQ ID NO: 626171 - DNA, 25 bp, Mus musculus
gaaactgaacagtcaaagccatcca

SEQ ID NO: 626172 - DNA, 25 bp, Mus musculus
gaaactgaaccactttccgagcaga

SEQ ID NO: 626173 - DNA, 25 bp, Mus musculus
gaaactgaaccagtttccgagcaga

SEQ ID NO: 626174 - DNA, 25 bp, Mus musculus
gaaactgaacccacccgatgagagt

SEQ ID NO: 626175 - DNA, 25 bp, Mus musculus
gaaactgaaccctcccgatgagagt

SEQ ID NO: 626176 - DNA, 25 bp, Mus musculus
gaaactgaagctaaccttataacag

SEQ ID NO: 626177 - DNA, 25 bp, Mus musculus
gaaactgaagcttaccttataacag

SEQ ID NO: 626178 - DNA, 25 bp, Mus musculus
gaaactgacagccacaaggtgacca

SEQ ID NO: 626179 - DNA, 25 bp, Mus musculus
gaaactgacagcgacaaggtgacca

SEQ ID NO: 626180 - DNA, 25 bp, Mus musculus
gaaactgactgcaatcccctggatc

SEQ ID NO: 626181 - DNA, 25 bp, Mus musculus
gaaactgactgctatcccctggatc

SEQ ID NO: 626182 - DNA, 25 bp, Mus musculus
gaaactgactggcaggattccctgg

SEQ ID NO: 626183 - DNA, 25 bp, Mus musculus
gaaactgactgggaggattccctgg

SEQ ID NO: 626184 - DNA, 25 bp, Mus musculus
gaaactgagatgagcttcatgcttg

SEQ ID NO: 626185 - DNA, 25 bp, Mus musculus
gaaactgagatgtgcttcatgcttg

SEQ ID NO: 626186 - DNA, 25 bp, Mus musculus
gaaactgagattaccaaagaatcac

SEQ ID NO: 626187 - DNA, 25 bp, Mus musculus
gaaactgagatttccaaagaatcac

SEQ ID NO: 626188 - DNA, 25 bp, Mus musculus
gaaactgagcgtactagcgcaggct

SEQ ID NO: 626189 - DNA, 25 bp, Mus musculus
gaaactgagcgttctagcgcaggct

SEQ ID NO: 626190 - DNA, 25 bp, Mus musculus
gaaactgaggccctatggagcccca

SEQ ID NO: 626191 - DNA, 25 bp, Mus musculus
gaaactgaggccgtatggagcccca

SEQ ID NO: 626192 - DNA, 25 bp, Mus musculus
gaaactgatgatacatatttggtgt

SEQ ID NO: 626193 - DNA, 25 bp, Mus musculus
gaaactgatgattcatatttggtgt

SEQ ID NO: 626194 - DNA, 25 bp, Mus musculus
gaaactgattgcaaacaacacgacg

SEQ ID NO: 626195 - DNA, 25 bp, Mus musculus
gaaactgattgctaacaacacgacg

SEQ ID NO: 626196 - DNA, 25 bp, Mus musculus
gaaactgcaaatccttaatgcttcc

SEQ ID NO: 626197 - DNA, 25 bp, Mus musculus
gaaactgcaaatgcttaatgcttcc

SEQ ID NO: 626198 - DNA, 25 bp, Mus musculus
gaaactgcagcacaaaaaccaggcg

SEQ ID NO: 626199 - DNA, 25 bp, Mus musculus
gaaactgcagcagaaaaaccaggcg

SEQ ID NO: 626200 - DNA, 25 bp, Mus musculus
gaaactgctgcacattagctctttt

SEQ ID NO: 626201 - DNA, 25 bp, Mus musculus
gaaactgctgcagattagctctttt

SEQ ID NO: 626202 - DNA, 25 bp, Mus musculus
gaaactgctggtaccttctgaagct

SEQ ID NO: 626203 - DNA, 25 bp, Mus musculus
gaaactgctggttccttctgaagct

SEQ ID NO: 626204 - DNA, 25 bp, Mus musculus
gaaactgcttatattgaagaccggc

SEQ ID NO: 626205 - DNA, 25 bp, Mus musculus
gaaactgcttattttgaagaccggc

SEQ ID NO: 626206 - DNA, 25 bp, Mus musculus
gaaactgcttctacagggccttagg

SEQ ID NO: 626207 - DNA, 25 bp, Mus musculus
gaaactgcttcttcagggccttagg

SEQ ID NO: 626208 - DNA, 25 bp, Mus musculus
gaaactgctttcagtaccctcgcga

SEQ ID NO: 626209 - DNA, 25 bp, Mus musculus
gaaactgctttctgtaccctcgcga

SEQ ID NO: 626210 - DNA, 25 bp, Mus musculus
gaaactggacaaaaaacaagtgctg

SEQ ID NO: 626211 - DNA, 25 bp, Mus musculus
gaaactggacaataaacaagtgctg

SEQ ID NO: 626212 - DNA, 25 bp, Mus musculus
gaaactggacataagccagcagctc

SEQ ID NO: 626213 - DNA, 25 bp, Mus musculus
gaaactggacattagccagcagctc

SEQ ID NO: 626214 - DNA, 25 bp, Mus musculus
gaaactggaccaacaaccggcttaa

SEQ ID NO: 626215 - DNA, 25 bp, Mus musculus
gaaactggaccatcaaccggcttaa

SEQ ID NO: 626216 - DNA, 25 bp, Mus musculus
gaaactggagacaccttcagataac

SEQ ID NO: 626217 - DNA, 25 bp, Mus musculus
gaaactggagactccttcagataac

SEQ ID NO: 626218 - DNA, 25 bp, Mus musculus
gaaactggagatcatgagacagaag

SEQ ID NO: 626219 - DNA, 25 bp, Mus musculus
gaaactggagatgatgagacagaag

SEQ ID NO: 626220 - DNA, 25 bp, Mus musculus
gaaactggatccagtgtctgcatag

SEQ ID NO: 626221 - DNA, 25 bp, Mus musculus
gaaactggatcctgtgtctgcatag

SEQ ID NO: 626222 - DNA, 25 bp, Mus musculus
gaaactggcagacttgtatggctcc

SEQ ID NO: 626223 - DNA, 25 bp, Mus musculus
gaaactggcagagttgtatggctcc

SEQ ID NO: 626224 - DNA, 25 bp, Mus musculus
gaaactggcgtgagagtaactgaat

SEQ ID NO: 626225 - DNA, 25 bp, Mus musculus
gaaactggcgtgtgagtaactgaat

SEQ ID NO: 626226 - DNA, 25 bp, Mus musculus
gaaactggcttcaatatgtgagtcc

SEQ ID NO: 626227 - DNA, 25 bp, Mus musculus
gaaactggcttctatatgtgagtcc

SEQ ID NO: 626228 - DNA, 25 bp, Mus musculus
gaaactgggaaaccttcaatattca

SEQ ID NO: 626229 - DNA, 25 bp, Mus musculus
gaaactgggaaagcttcaatattca

SEQ ID NO: 626230 - DNA, 25 bp, Mus musculus
gaaactgggctcacctggaccaact

SEQ ID NO: 626231 - DNA, 25 bp, Mus musculus
gaaactgggctctcctggaccaact

SEQ ID NO: 626232 - DNA, 25 bp, Mus musculus
gaaactggggagactgccccaccaa

SEQ ID NO: 626233 - DNA, 25 bp, Mus musculus
gaaactggggagtctgccccaccaa

SEQ ID NO: 626234 - DNA, 25 bp, Mus musculus
gaaactgggtctactctgggattcc

SEQ ID NO: 626235 - DNA, 25 bp, Mus musculus
gaaactgggtcttctctgggattcc

SEQ ID NO: 626236 - DNA, 25 bp, Mus musculus
gaaactgggtggcattttcatgccc

SEQ ID NO: 626237 - DNA, 25 bp, Mus musculus
gaaactgggtgggattttcatgccc

SEQ ID NO: 626238 - DNA, 25 bp, Mus musculus
gaaactggtgtcattccccttgctg

SEQ ID NO: 626239 - DNA, 25 bp, Mus musculus
gaaactggtgtctttccccttgctg

SEQ ID NO: 626240 - DNA, 25 bp, Mus musculus
gaaactggttgtagtatcccctggt

SEQ ID NO: 626241 - DNA, 25 bp, Mus musculus
gaaactggttgttgtatcccctggt

SEQ ID NO: 626242 - DNA, 25 bp, Mus musculus
gaaactgtaaccattgaattgaaga

SEQ ID NO: 626243 - DNA, 25 bp, Mus musculus
gaaactgtaacctttgaattgaaga

SEQ ID NO: 626244 - DNA, 25 bp, Mus musculus
gaaactgtaataaggtcctcgtgac

SEQ ID NO: 626245 - DNA, 25 bp, Mus musculus
gaaactgtaatatggtcctcgtgac

SEQ ID NO: 626246 - DNA, 25 bp, Mus musculus
gaaactgtagatcctgccactgctg

SEQ ID NO: 626247 - DNA, 25 bp, Mus musculus
gaaactgtagatgctgccactgctg

SEQ ID NO: 626248 - DNA, 25 bp, Mus musculus
gaaactgtagccacagtacctggga

SEQ ID NO: 626249 - DNA, 25 bp, Mus musculus
gaaactgtagcctcagtacctggga

SEQ ID NO: 626250 - DNA, 25 bp, Mus musculus
gaaactgtataaaacctgctctgtg

SEQ ID NO: 626251 - DNA, 25 bp, Mus musculus
gaaactgtataatacctgctctgtg

SEQ ID NO: 626252 - DNA, 25 bp, Mus musculus
gaaactgtcacaagactggctgtgc

SEQ ID NO: 626253 - DNA, 25 bp, Mus musculus
gaaactgtcacatgactggctgtgc

SEQ ID NO: 626254 - DNA, 25 bp, Mus musculus
gaaactgtccagagtactagagcgg

SEQ ID NO: 626255 - DNA, 25 bp, Mus musculus
gaaactgtccagtgtactagagcgg

SEQ ID NO: 626256 - DNA, 25 bp, Mus musculus
gaaactgtccatacctcattagagc

SEQ ID NO: 626257 - DNA, 25 bp, Mus musculus
gaaactgtccattcctcattagagc

SEQ ID NO: 626258 - DNA, 25 bp, Mus musculus
gaaactgtcggaccgatcgccctgc

SEQ ID NO: 626259 - DNA, 25 bp, Mus musculus
gaaactgtcggagcgatcgccctgc

SEQ ID NO: 626260 - DNA, 25 bp, Mus musculus
gaaactgtgaagcagatccgccaga

SEQ ID NO: 626261 - DNA, 25 bp, Mus musculus
gaaactgtgaaggagatccgccaga

SEQ ID NO: 626262 - DNA, 25 bp, Mus musculus
gaaactgtgcgtaccagtgaagcaa

SEQ ID NO: 626263 - DNA, 25 bp, Mus musculus
gaaactgtgcgttccagtgaagcaa

SEQ ID NO: 626264 - DNA, 25 bp, Mus musculus
gaaactgtgctcaacttggcttatg

SEQ ID NO: 626265 - DNA, 25 bp, Mus musculus
gaaactgtgctctacttggcttatg

SEQ ID NO: 626266 - DNA, 25 bp, Mus musculus
gaaactgtgggacgagtcatgacaa

SEQ ID NO: 626267 - DNA, 25 bp, Mus musculus
gaaactgtgggaggagtcatgacaa

SEQ ID NO: 626268 - DNA, 25 bp, Mus musculus
gaaactgtgtctcctcgttcactgc

SEQ ID NO: 626269 - DNA, 25 bp, Mus musculus
gaaactgtgtctgctcgttcactgc

SEQ ID NO: 626270 - DNA, 25 bp, Mus musculus
gaaactgttagaaagcagataccat

SEQ ID NO: 626271 - DNA, 25 bp, Mus musculus
gaaactgttagatagcagataccat

SEQ ID NO: 626272 - DNA, 25 bp, Mus musculus
gaaactgttcccctgcggaaagact

SEQ ID NO: 626273 - DNA, 25 bp, Mus musculus
gaaactgttcccgtgcggaaagact

SEQ ID NO: 626274 - DNA, 25 bp, Mus musculus
gaaactgttgtgacataaatggtgg

SEQ ID NO: 626275 - DNA, 25 bp, Mus musculus
gaaactgttgtgtcataaatggtgg

SEQ ID NO: 626276 - DNA, 25 bp, Mus musculus
gaaacttaaagacatatccaacacc

SEQ ID NO: 626277 - DNA, 25 bp, Mus musculus
gaaacttaaagagatatccaacacc

SEQ ID NO: 626278 - DNA, 25 bp, Mus musculus
gaaacttaaccaacttgagtctccc

SEQ ID NO: 626279 - DNA, 25 bp, Mus musculus
gaaacttaaccatcttgagtctccc

SEQ ID NO: 626280 - DNA, 25 bp, Mus musculus
gaaacttaatgacgaataagcaggc

SEQ ID NO: 626281 - DNA, 25 bp, Mus musculus
gaaacttaatgaggaataagcaggc

SEQ ID NO: 626282 - DNA, 25 bp, Mus musculus
gaaacttaccgacgctgacgcgtac

SEQ ID NO: 626283 - DNA, 25 bp, Mus musculus
gaaacttaccgaggctgacgcgtac

SEQ ID NO: 626284 - DNA, 25 bp, Mus musculus
gaaacttacctgcaagcccactgga

SEQ ID NO: 626285 - DNA, 25 bp, Mus musculus
gaaacttacctggaagcccactgga

SEQ ID NO: 626286 - DNA, 25 bp, Mus musculus
gaaacttacgaaaaggaggtgacag

SEQ ID NO: 626287 - DNA, 25 bp, Mus musculus
gaaacttacgaataggaggtgacag

SEQ ID NO: 626288 - DNA, 25 bp, Mus musculus
gaaacttatcctagtctgtgggact

SEQ ID NO: 626289 - DNA, 25 bp, Mus musculus
gaaacttatccttgtctgtgggact

SEQ ID NO: 626290 - DNA, 25 bp, Mus musculus
gaaacttcaaagagccagggcggtg

SEQ ID NO: 626291 - DNA, 25 bp, Mus musculus
gaaacttcaaagtgccagggcggtg

SEQ ID NO: 626292 - DNA, 25 bp, Mus musculus
gaaacttcaacgagctctccaggat

SEQ ID NO: 626293 - DNA, 25 bp, Mus musculus
gaaacttcaacgtgctctccaggat

SEQ ID NO: 626294 - DNA, 25 bp, Mus musculus
gaaacttcaatcagccaatgtgcaa

SEQ ID NO: 626295 - DNA, 25 bp, Mus musculus
gaaacttcaatctgccaatgtgcaa

SEQ ID NO: 626296 - DNA, 25 bp, Mus musculus
gaaacttcacctagttccgtggcta

SEQ ID NO: 626297 - DNA, 25 bp, Mus musculus
gaaacttcaccttgttccgtggcta

SEQ ID NO: 626298 - DNA, 25 bp, Mus musculus
gaaacttcagtcatctgatctgaga

SEQ ID NO: 626299 - DNA, 25 bp, Mus musculus
gaaacttcagtcttctgatctgaga

SEQ ID NO: 626300 - DNA, 25 bp, Mus musculus
gaaacttcatgccagtgttgaagcc

SEQ ID NO: 626301 - DNA, 25 bp, Mus musculus
gaaacttcatgcgagtgttgaagcc

SEQ ID NO: 626302 - DNA, 25 bp, Mus musculus
gaaacttcatggctcctttgacctg

SEQ ID NO: 626303 - DNA, 25 bp, Mus musculus
gaaacttcatgggtcctttgacctg

SEQ ID NO: 626304 - DNA, 25 bp, Mus musculus
gaaacttcattcaccctaggaggcg

SEQ ID NO: 626305 - DNA, 25 bp, Mus musculus
gaaacttcattctccctaggaggcg

SEQ ID NO: 626306 - DNA, 25 bp, Mus musculus
gaaacttccagcaggccggagtaag

SEQ ID NO: 626307 - DNA, 25 bp, Mus musculus
gaaacttccagctggccggagtaag

SEQ ID NO: 626308 - DNA, 25 bp, Mus musculus
gaaacttccatgctgaatacccagc

SEQ ID NO: 626309 - DNA, 25 bp, Mus musculus
gaaacttccatggtgaatacccagc

SEQ ID NO: 626310 - DNA, 25 bp, Mus musculus
gaaacttccgagacctctctgcaaa

SEQ ID NO: 626311 - DNA, 25 bp, Mus musculus
gaaacttccgagtcctctctgcaaa

SEQ ID NO: 626312 - DNA, 25 bp, Mus musculus
gaaacttcgcctctctgacgactgg

SEQ ID NO: 626313 - DNA, 25 bp, Mus musculus
gaaacttcgcctgtctgacgactgg

SEQ ID NO: 626314 - DNA, 25 bp, Mus musculus
gaaacttcggctcgtgtggagcaaa

SEQ ID NO: 626315 - DNA, 25 bp, Mus musculus
gaaacttcggctggtgtggagcaaa

SEQ ID NO: 626316 - DNA, 25 bp, Mus musculus
gaaacttcgggaatgtgacggctta

SEQ ID NO: 626317 - DNA, 25 bp, Mus musculus
gaaacttcgggattgtgacggctta

SEQ ID NO: 626318 - DNA, 25 bp, Mus musculus
gaaacttctagcaagactgtcactt

SEQ ID NO: 626319 - DNA, 25 bp, Mus musculus
gaaacttctagctagactgtcactt

SEQ ID NO: 626320 - DNA, 25 bp, Mus musculus
gaaacttctcggaacccaggtgccg

SEQ ID NO: 626321 - DNA, 25 bp, Mus musculus
gaaacttctcggtacccaggtgccg

SEQ ID NO: 626322 - DNA, 25 bp, Mus musculus
gaaacttctcttagccgtagatgga

SEQ ID NO: 626323 - DNA, 25 bp, Mus musculus
gaaacttctctttgccgtagatgga

SEQ ID NO: 626324 - DNA, 25 bp, Mus musculus
gaaacttctgcacaacattcagctc

SEQ ID NO: 626325 - DNA, 25 bp, Mus musculus
gaaacttctgcagaacattcagctc

SEQ ID NO: 626326 - DNA, 25 bp, Mus musculus
gaaacttctgcgctactacagcaag

SEQ ID NO: 626327 - DNA, 25 bp, Mus musculus
gaaacttctgcggtactacagcaag

SEQ ID NO: 626328 - DNA, 25 bp, Mus musculus
gaaacttgagatacttggccagcct

SEQ ID NO: 626329 - DNA, 25 bp, Mus musculus
gaaacttgagattcttggccagcct

SEQ ID NO: 626330 - DNA, 25 bp, Mus musculus
gaaacttgagtcagaagtaatggag

SEQ ID NO: 626331 - DNA, 25 bp, Mus musculus
gaaacttgagtctgaagtaatggag

SEQ ID NO: 626332 - DNA, 25 bp, Mus musculus
gaaacttgatcgacctctacagcaa

SEQ ID NO: 626333 - DNA, 25 bp, Mus musculus
gaaacttgatcgtcctctacagcaa

SEQ ID NO: 626334 - DNA, 25 bp, Mus musculus
gaaacttgattgaaggtcaaatgcc

SEQ ID NO: 626335 - DNA, 25 bp, Mus musculus
gaaacttgattgtaggtcaaatgcc

SEQ ID NO: 626336 - DNA, 25 bp, Mus musculus
gaaacttgccaacatcggccaaggc

SEQ ID NO: 626337 - DNA, 25 bp, Mus musculus
gaaacttgccaagatcggccaaggc

SEQ ID NO: 626338 - DNA, 25 bp, Mus musculus
gaaacttggacgaattgccttgggc

SEQ ID NO: 626339 - DNA, 25 bp, Mus musculus
gaaacttggacgtattgccttgggc

SEQ ID NO: 626340 - DNA, 25 bp, Mus musculus
gaaacttggagactggaatgagaaa

SEQ ID NO: 626341 - DNA, 25 bp, Mus musculus
gaaacttggagagtggaatgagaaa

SEQ ID NO: 626342 - DNA, 25 bp, Mus musculus
gaaacttggcagctccttggactgg

SEQ ID NO: 626343 - DNA, 25 bp, Mus musculus
gaaacttggcaggtccttggactgg

SEQ ID NO: 626344 - DNA, 25 bp, Mus musculus
gaaacttgggacatcctttcgtgag

SEQ ID NO: 626345 - DNA, 25 bp, Mus musculus
gaaacttgggacttcctttcgtgag

SEQ ID NO: 626346 - DNA, 25 bp, Mus musculus
gaaacttgggctacaaacaacagaa

SEQ ID NO: 626347 - DNA, 25 bp, Mus musculus
gaaacttgggcttcaaacaacagaa

SEQ ID NO: 626348 - DNA, 25 bp, Mus musculus
gaaacttggtacatcatggtgaatg

SEQ ID NO: 626349 - DNA, 25 bp, Mus musculus
gaaacttggtacttcatggtgaatg

SEQ ID NO: 626350 - DNA, 25 bp, Mus musculus
gaaacttggtccactgagttacaaa

SEQ ID NO: 626351 - DNA, 25 bp, Mus musculus
gaaacttggtcctctgagttacaaa

SEQ ID NO: 626352 - DNA, 25 bp, Mus musculus
gaaacttgtcatactcgatgctctg

SEQ ID NO: 626353 - DNA, 25 bp, Mus musculus
gaaacttgtcattctcgatgctctg

SEQ ID NO: 626354 - DNA, 25 bp, Mus musculus
gaaactttataaacagaacatgcag

SEQ ID NO: 626355 - DNA, 25 bp, Mus musculus
gaaactttataatcagaacatgcag

SEQ ID NO: 626356 - DNA, 25 bp, Mus musculus
gaaactttcaagcagatttactcac

SEQ ID NO: 626357 - DNA, 25 bp, Mus musculus
gaaactttcaaggagatttactcac

SEQ ID NO: 626358 - DNA, 25 bp, Mus musculus
gaaactttgccaccttatcatcctc

SEQ ID NO: 626359 - DNA, 25 bp, Mus musculus
gaaactttgccagcttatcatcctc

SEQ ID NO: 626360 - DNA, 25 bp, Mus musculus
gaaactttggtcaagcttacattgt

SEQ ID NO: 626361 - DNA, 25 bp, Mus musculus
gaaactttggtctagcttacattgt

SEQ ID NO: 626362 - DNA, 25 bp, Mus musculus
gaaactttgtgtccaatggccagga

SEQ ID NO: 626363 - DNA, 25 bp, Mus musculus
gaaactttgtgtgcaatggccagga

SEQ ID NO: 626364 - DNA, 25 bp, Mus musculus
gaaacttttctccaactatgatagc

SEQ ID NO: 626365 - DNA, 25 bp, Mus musculus
gaaacttttctcgaactatgatagc

SEQ ID NO: 626366 - DNA, 25 bp, Mus musculus
gaaagaaaagaaacctgctgttggc

SEQ ID NO: 626367 - DNA, 25 bp, Mus musculus
gaaagaaaagaatcctgctgttggc

SEQ ID NO: 626368 - DNA, 25 bp, Mus musculus
gaaagaaaagcaatcgagagaaacc

SEQ ID NO: 626369 - DNA, 25 bp, Mus musculus
gaaagaaaagcattcgagagaaacc

SEQ ID NO: 626370 - DNA, 25 bp, Mus musculus
gaaagaaaaggccataaaggagctg

SEQ ID NO: 626371 - DNA, 25 bp, Mus musculus
gaaagaaaaggcgataaaggagctg

SEQ ID NO: 626372 - DNA, 25 bp, Mus musculus
gaaagaaaatcaaggctgactcggg

SEQ ID NO: 626373 - DNA, 25 bp, Mus musculus
gaaagaaaatcatggctgactcggg

SEQ ID NO: 626374 - DNA, 25 bp, Mus musculus
gaaagaaaatgtaccaccccagagc

SEQ ID NO: 626375 - DNA, 25 bp, Mus musculus
gaaagaaaatgttccaccccagagc

SEQ ID NO: 626376 - DNA, 25 bp, Mus musculus
gaaagaaacccacaggctgcgtctg

SEQ ID NO: 626377 - DNA, 25 bp, Mus musculus
gaaagaaacccagaggctgcgtctg

SEQ ID NO: 626378 - DNA, 25 bp, Mus musculus
gaaagaaacctcaggctgttcctac

SEQ ID NO: 626379 - DNA, 25 bp, Mus musculus
gaaagaaacctctggctgttcctac

SEQ ID NO: 626380 - DNA, 25 bp, Mus musculus
gaaagaaactcaccacgagctgcgg

SEQ ID NO: 626381 - DNA, 25 bp, Mus musculus
gaaagaaactcagcacgagctgcgg

SEQ ID NO: 626382 - DNA, 25 bp, Mus musculus
gaaagaaaggagaggctatccaaat

SEQ ID NO: 626383 - DNA, 25 bp, Mus musculus
gaaagaaaggagtggctatccaaat

SEQ ID NO: 626384 - DNA, 25 bp, Mus musculus
gaaagaaaggccaagttgatgaccg

SEQ ID NO: 626385 - DNA, 25 bp, Mus musculus
gaaagaaaggcctagttgatgaccg

SEQ ID NO: 626386 - DNA, 25 bp, Mus musculus
gaaagaaatgcacggattaacctta

SEQ ID NO: 626387 - DNA, 25 bp, Mus musculus
gaaagaaatgcagggattaacctta

SEQ ID NO: 626388 - DNA, 25 bp, Mus musculus
gaaagaacaagtcaaaattgctgaa

SEQ ID NO: 626389 - DNA, 25 bp, Mus musculus
gaaagaacaagtgaaaattgctgaa

SEQ ID NO: 626390 - DNA, 25 bp, Mus musculus
gaaagaacacctcgtttagagccaa

SEQ ID NO: 626391 - DNA, 25 bp, Mus musculus
gaaagaacacctggtttagagccaa

SEQ ID NO: 626392 - DNA, 25 bp, Mus musculus
gaaagaacagcgagtaagtgcaagt

SEQ ID NO: 626393 - DNA, 25 bp, Mus musculus
gaaagaacagcgtgtaagtgcaagt

SEQ ID NO: 626394 - DNA, 25 bp, Mus musculus
gaaagaacagctatctgacacctgg

SEQ ID NO: 626395 - DNA, 25 bp, Mus musculus
gaaagaacagctttctgacacctgg

SEQ ID NO: 626396 - DNA, 25 bp, Mus musculus
gaaagaacagtaactcaccaccttg

SEQ ID NO: 626397 - DNA, 25 bp, Mus musculus
gaaagaacagtatctcaccaccttg

SEQ ID NO: 626398 - DNA, 25 bp, Mus musculus
gaaagaacatgcagcttacagctgg

SEQ ID NO: 626399 - DNA, 25 bp, Mus musculus
gaaagaacatgctgcttacagctgg

SEQ ID NO: 626400 - DNA, 25 bp, Mus musculus
gaaagaaccagcaggctcctggaaa

SEQ ID NO: 626401 - DNA, 25 bp, Mus musculus
gaaagaaccagctggctcctggaaa

SEQ ID NO: 626402 - DNA, 25 bp, Mus musculus
gaaagaaccctcagcattgtgccat

SEQ ID NO: 626403 - DNA, 25 bp, Mus musculus
gaaagaaccctctgcattgtgccat

SEQ ID NO: 626404 - DNA, 25 bp, Mus musculus
gaaagaacgcttcaacatcgacatg

SEQ ID NO: 626405 - DNA, 25 bp, Mus musculus
gaaagaacgcttgaacatcgacatg

SEQ ID NO: 626406 - DNA, 25 bp, Mus musculus
gaaagaacggtgaccatcagaagac

SEQ ID NO: 626407 - DNA, 25 bp, Mus musculus
gaaagaacggtgtccatcagaagac

SEQ ID NO: 626408 - DNA, 25 bp, Mus musculus
gaaagaacgtgaagagccagtcctc

SEQ ID NO: 626409 - DNA, 25 bp, Mus musculus
gaaagaacgtgatgagccagtcctc

SEQ ID NO: 626410 - DNA, 25 bp, Mus musculus
gaaagaactgaaagacctgctacaa

SEQ ID NO: 626411 - DNA, 25 bp, Mus musculus
gaaagaactgaatgacctgctacaa

SEQ ID NO: 626412 - DNA, 25 bp, Mus musculus
gaaagaactggaaataattacaggc

SEQ ID NO: 626413 - DNA, 25 bp, Mus musculus
gaaagaactggatataattacaggc

SEQ ID NO: 626414 - DNA, 25 bp, Mus musculus
gaaagaactggtccagatcctcctg

SEQ ID NO: 626415 - DNA, 25 bp, Mus musculus
gaaagaactggtcgttgaactatga

SEQ ID NO: 626416 - DNA, 25 bp, Mus musculus
gaaagaactggtgcagatcctcctg

SEQ ID NO: 626417 - DNA, 25 bp, Mus musculus
gaaagaactggtggttgaactatga

SEQ ID NO: 626418 - DNA, 25 bp, Mus musculus
gaaagaacttgacgaatatgtggaa

SEQ ID NO: 626419 - DNA, 25 bp, Mus musculus
gaaagaacttgaggaatatgtggaa

SEQ ID NO: 626420 - DNA, 25 bp, Mus musculus
gaaagaactttccaatgtccgatgt

SEQ ID NO: 626421 - DNA, 25 bp, Mus musculus
gaaagaactttcgaatgtccgatgt

SEQ ID NO: 626422 - DNA, 25 bp, Mus musculus
gaaagaagacctaccagtgccacca

SEQ ID NO: 626423 - DNA, 25 bp, Mus musculus
gaaagaagaccttccagtgccacca

SEQ ID NO: 626424 - DNA, 25 bp, Mus musculus
gaaagaagaggcaaggcagatcaag

SEQ ID NO: 626425 - DNA, 25 bp, Mus musculus
gaaagaagaggctaggcagatcaag

SEQ ID NO: 626426 - DNA, 25 bp, Mus musculus
gaaagaagagtactggaaacttact

SEQ ID NO: 626427 - DNA, 25 bp, Mus musculus
gaaagaagagtagtggaaacttact

SEQ ID NO: 626428 - DNA, 25 bp, Mus musculus
gaaagaagattcacccaaatgggcc

SEQ ID NO: 626429 - DNA, 25 bp, Mus musculus
gaaagaagattctcccaaatgggcc

SEQ ID NO: 626430 - DNA, 25 bp, Mus musculus
gaaagaagattgcaaagcgtagcac

SEQ ID NO: 626431 - DNA, 25 bp, Mus musculus
gaaagaagattggaaagcgtagcac

SEQ ID NO: 626432 - DNA, 25 bp, Mus musculus
gaaagaagatttaaggaagccgtga

SEQ ID NO: 626433 - DNA, 25 bp, Mus musculus
gaaagaagattttaggaagccgtga

SEQ ID NO: 626434 - DNA, 25 bp, Mus musculus
gaaagaagcagcacttccatctaca

SEQ ID NO: 626435 - DNA, 25 bp, Mus musculus
gaaagaagcagctcttccatctaca

SEQ ID NO: 626436 - DNA, 25 bp, Mus musculus
gaaagaagcccacttcccagtggat

SEQ ID NO: 626437 - DNA, 25 bp, Mus musculus
gaaagaagcccagttcccagtggat

SEQ ID NO: 626438 - DNA, 25 bp, Mus musculus
gaaagaagctgaagctttaaagcat

SEQ ID NO: 626439 - DNA, 25 bp, Mus musculus
gaaagaagctgatgctttaaagcat

SEQ ID NO: 626440 - DNA, 25 bp, Mus musculus
gaaagaaggaatcaataaagccatt

SEQ ID NO: 626441 - DNA, 25 bp, Mus musculus
gaaagaaggaatgaataaagccatt

SEQ ID NO: 626442 - DNA, 25 bp, Mus musculus
gaaagaagggataatccataccctc

SEQ ID NO: 626443 - DNA, 25 bp, Mus musculus
gaaagaagggattatccataccctc

SEQ ID NO: 626444 - DNA, 25 bp, Mus musculus
gaaagaaggtttatcaaaggagaat

SEQ ID NO: 626445 - DNA, 25 bp, Mus musculus
gaaagaaggtttttcaaaggagaat

SEQ ID NO: 626446 - DNA, 25 bp, Mus musculus
gaaagaagtattccggcctctcaag

SEQ ID NO: 626447 - DNA, 25 bp, Mus musculus
gaaagaagtattgcggcctctcaag

SEQ ID NO: 626448 - DNA, 25 bp, Mus musculus
gaaagaagtcatccccaacgttgag

SEQ ID NO: 626449 - DNA, 25 bp, Mus musculus
gaaagaagtcatgcccaacgttgag

SEQ ID NO: 626450 - DNA, 25 bp, Mus musculus
gaaagaagtctgattcacgatagaa

SEQ ID NO: 626451 - DNA, 25 bp, Mus musculus
gaaagaagtctgtttcacgatagaa

SEQ ID NO: 626452 - DNA, 25 bp, Mus musculus
gaaagaagtgtgagtccatcatgga

SEQ ID NO: 626453 - DNA, 25 bp, Mus musculus
gaaagaagtgtgtgtccatcatgga

SEQ ID NO: 626454 - DNA, 25 bp, Mus musculus
gaaagaagttccactcagtgcacag

SEQ ID NO: 626455 - DNA, 25 bp, Mus musculus
gaaagaagttcctctcagtgcacag

SEQ ID NO: 626456 - DNA, 25 bp, Mus musculus
gaaagaagtttgattccagtcatga

SEQ ID NO: 626457 - DNA, 25 bp, Mus musculus
gaaagaagtttgtttccagtcatga

SEQ ID NO: 626458 - DNA, 25 bp, Mus musculus
gaaagaataccaatttgccaaagga

SEQ ID NO: 626459 - DNA, 25 bp, Mus musculus
gaaagaataccattttgccaaagga

SEQ ID NO: 626460 - DNA, 25 bp, Mus musculus
gaaagaatatgcctggtcttgtgac

SEQ ID NO: 626461 - DNA, 25 bp, Mus musculus
gaaagaatatgcgtggtcttgtgac

SEQ ID NO: 626462 - DNA, 25 bp, Mus musculus
gaaagaatctgtatacaaatgagta

SEQ ID NO: 626463 - DNA, 25 bp, Mus musculus
gaaagaatctgtttacaaatgagta

SEQ ID NO: 626464 - DNA, 25 bp, Mus musculus
gaaagaatggaacaggacttaagag

SEQ ID NO: 626465 - DNA, 25 bp, Mus musculus
gaaagaatggaagaggacttaagag

SEQ ID NO: 626466 - DNA, 25 bp, Mus musculus
gaaagaatggccacttacaaagccg

SEQ ID NO: 626467 - DNA, 25 bp, Mus musculus
gaaagaatggcctcttacaaagccg

SEQ ID NO: 626468 - DNA, 25 bp, Mus musculus
gaaagaatgtacatgtgcctttctc

SEQ ID NO: 626469 - DNA, 25 bp, Mus musculus
gaaagaatgtacttgtgcctttctc

SEQ ID NO: 626470 - DNA, 25 bp, Mus musculus
gaaagaatttcccagccgtcttccg

SEQ ID NO: 626471 - DNA, 25 bp, Mus musculus
gaaagaatttccgagccgtcttccg

SEQ ID NO: 626472 - DNA, 25 bp, Mus musculus
gaaagacaaaacagaagtgtccggc

SEQ ID NO: 626473 - DNA, 25 bp, Mus musculus
gaaagacaaaactgaagtgtccggc

SEQ ID NO: 626474 - DNA, 25 bp, Mus musculus
gaaagacaaagaccagaagcccgag

SEQ ID NO: 626475 - DNA, 25 bp, Mus musculus
gaaagacaaagagcagaagcccgag

SEQ ID NO: 626476 - DNA, 25 bp, Mus musculus
gaaagacaacacaatctcctgccca

SEQ ID NO: 626477 - DNA, 25 bp, Mus musculus
gaaagacaacactatctcctgccca

SEQ ID NO: 626478 - DNA, 25 bp, Mus musculus
gaaagacaaggtctacagctacctg

SEQ ID NO: 626479 - DNA, 25 bp, Mus musculus
gaaagacaaggtgtacagctacctg

SEQ ID NO: 626480 - DNA, 25 bp, Mus musculus
gaaagacaatctccctgagtggctt

SEQ ID NO: 626481 - DNA, 25 bp, Mus musculus
gaaagacaatctgcctgagtggctt

SEQ ID NO: 626482 - DNA, 25 bp, Mus musculus
gaaagacacgaccattaggaacttg

SEQ ID NO: 626483 - DNA, 25 bp, Mus musculus
gaaagacacgacgattaggaacttg

SEQ ID NO: 626484 - DNA, 25 bp, Mus musculus
gaaagacagcccattgcggccaatg

SEQ ID NO: 626485 - DNA, 25 bp, Mus musculus
gaaagacagccctttgcggccaatg

SEQ ID NO: 626486 - DNA, 25 bp, Mus musculus
gaaagacagtacagatcatggagct

SEQ ID NO: 626487 - DNA, 25 bp, Mus musculus
gaaagacagtactgatcatggagct

SEQ ID NO: 626488 - DNA, 25 bp, Mus musculus
gaaagacagtgtattgccaggctgg

SEQ ID NO: 626489 - DNA, 25 bp, Mus musculus
gaaagacagtgttttgccaggctgg

SEQ ID NO: 626490 - DNA, 25 bp, Mus musculus
gaaagacagttccacaaggccttct

SEQ ID NO: 626491 - DNA, 25 bp, Mus musculus
gaaagacagttcgacaaggccttct

SEQ ID NO: 626492 - DNA, 25 bp, Mus musculus
gaaagacatgttcttcagaatttag

SEQ ID NO: 626493 - DNA, 25 bp, Mus musculus
gaaagacatgttgttcagaatttag

SEQ ID NO: 626494 - DNA, 25 bp, Mus musculus
gaaagaccaactcttccctcatcag

SEQ ID NO: 626495 - DNA, 25 bp, Mus musculus
gaaagaccaactgttccctcatcag

SEQ ID NO: 626496 - DNA, 25 bp, Mus musculus
gaaagaccacagatgcctccttgct

SEQ ID NO: 626497 - DNA, 25 bp, Mus musculus
gaaagaccacagttgcctccttgct

SEQ ID NO: 626498 - DNA, 25 bp, Mus musculus
gaaagaccagaacggcaaccatgtg

SEQ ID NO: 626499 - DNA, 25 bp, Mus musculus
gaaagaccagaagggcaaccatgtg

SEQ ID NO: 626500 - DNA, 25 bp, Mus musculus
gaaagaccaggtatgatcgcctctc

SEQ ID NO: 626501 - DNA, 25 bp, Mus musculus
gaaagaccaggtttgatcgcctctc

SEQ ID NO: 626502 - DNA, 25 bp, Mus musculus
gaaagacccaatagctcatccagcc

SEQ ID NO: 626503 - DNA, 25 bp, Mus musculus
gaaagacccaattgctcatccagcc

SEQ ID NO: 626504 - DNA, 25 bp, Mus musculus
gaaagaccctcgaagccactggtat

SEQ ID NO: 626505 - DNA, 25 bp, Mus musculus
gaaagaccctcgtagccactggtat

SEQ ID NO: 626506 - DNA, 25 bp, Mus musculus
gaaagaccctttcctgttccaagaa

SEQ ID NO: 626507 - DNA, 25 bp, Mus musculus
gaaagaccctttgctgttccaagaa

SEQ ID NO: 626508 - DNA, 25 bp, Mus musculus
gaaagaccgagcactcttcaatgga

SEQ ID NO: 626509 - DNA, 25 bp, Mus musculus
gaaagaccgagctctcttcaatgga

SEQ ID NO: 626510 - DNA, 25 bp, Mus musculus
gaaagaccgctaccttccagacaca

SEQ ID NO: 626511 - DNA, 25 bp, Mus musculus
gaaagaccgctagcttccagacaca

SEQ ID NO: 626512 - DNA, 25 bp, Mus musculus
gaaagaccggcaagggcatgtctag

SEQ ID NO: 626513 - DNA, 25 bp, Mus musculus
gaaagaccggcatgggcatgtctag

SEQ ID NO: 626514 - DNA, 25 bp, Mus musculus
gaaagacctgctacaggtagacacg

SEQ ID NO: 626515 - DNA, 25 bp, Mus musculus
gaaagacctgctcttgggcccatgt

SEQ ID NO: 626516 - DNA, 25 bp, Mus musculus
gaaagacctgctgttgggcccatgt

SEQ ID NO: 626517 - DNA, 25 bp, Mus musculus
gaaagacctgcttcaggtagacacg

SEQ ID NO: 626518 - DNA, 25 bp, Mus musculus
gaaagaccttgtacccatccggaca

SEQ ID NO: 626519 - DNA, 25 bp, Mus musculus
gaaagaccttgttcccatccggaca

SEQ ID NO: 626520 - DNA, 25 bp, Mus musculus
gaaagacgaaacagtgagtgactgt

SEQ ID NO: 626521 - DNA, 25 bp, Mus musculus
gaaagacgaaactgtgagtgactgt

SEQ ID NO: 626522 - DNA, 25 bp, Mus musculus
gaaagacgaagcagatgcggatctc

SEQ ID NO: 626523 - DNA, 25 bp, Mus musculus
gaaagacgaagctgatgcggatctc

SEQ ID NO: 626524 - DNA, 25 bp, Mus musculus
gaaagacgagatctgctccagggtc

SEQ ID NO: 626525 - DNA, 25 bp, Mus musculus
gaaagacgagatgtgctccagggtc

SEQ ID NO: 626526 - DNA, 25 bp, Mus musculus
gaaagacgcagaattggcaaactct

SEQ ID NO: 626527 - DNA, 25 bp, Mus musculus
gaaagacgcagatttggcaaactct

SEQ ID NO: 626528 - DNA, 25 bp, Mus musculus
gaaagacgctatctacaaatgtgta

SEQ ID NO: 626529 - DNA, 25 bp, Mus musculus
gaaagacgctatgtacaaatgtgta

SEQ ID NO: 626530 - DNA, 25 bp, Mus musculus
gaaagacggactaagacggaacaag

SEQ ID NO: 626531 - DNA, 25 bp, Mus musculus
gaaagacggacttagacggaacaag

SEQ ID NO: 626532 - DNA, 25 bp, Mus musculus
gaaagactaccacagtggtcctggg

SEQ ID NO: 626533 - DNA, 25 bp, Mus musculus
gaaagactaccagagtggtcctggg

SEQ ID NO: 626534 - DNA, 25 bp, Mus musculus
gaaagactagcacccaaaatagatc

SEQ ID NO: 626535 - DNA, 25 bp, Mus musculus
gaaagactagcagccaaaatagatc

SEQ ID NO: 626536 - DNA, 25 bp, Mus musculus
gaaagactcagtcacatgtccatgg

SEQ ID NO: 626537 - DNA, 25 bp, Mus musculus
gaaagactcagtgacatgtccatgg

SEQ ID NO: 626538 - DNA, 25 bp, Mus musculus
gaaagactcatacaacgtgccctga

SEQ ID NO: 626539 - DNA, 25 bp, Mus musculus
gaaagactcatagaacgtgccctga

SEQ ID NO: 626540 - DNA, 25 bp, Mus musculus
gaaagactcgacatctgctgctagc

SEQ ID NO: 626541 - DNA, 25 bp, Mus musculus
gaaagactcgacttctgctgctagc

SEQ ID NO: 626542 - DNA, 25 bp, Mus musculus
gaaagactgcctattctgaaccagc

SEQ ID NO: 626543 - DNA, 25 bp, Mus musculus
gaaagactgccttttctgaaccagc

SEQ ID NO: 626544 - DNA, 25 bp, Mus musculus
gaaagactggagatactacttcaga

SEQ ID NO: 626545 - DNA, 25 bp, Mus musculus
gaaagactggagttactacttcaga

SEQ ID NO: 626546 - DNA, 25 bp, Mus musculus
gaaagacttaatcttcatgggaaaa

SEQ ID NO: 626547 - DNA, 25 bp, Mus musculus
gaaagacttaatgttcatgggaaaa

SEQ ID NO: 626548 - DNA, 25 bp, Mus musculus
gaaagacttgcacagccacatgatc

SEQ ID NO: 626549 - DNA, 25 bp, Mus musculus
gaaagacttgcagagccacatgatc

SEQ ID NO: 626550 - DNA, 25 bp, Mus musculus
gaaagacttggtccgagctgtgtcc

SEQ ID NO: 626551 - DNA, 25 bp, Mus musculus
gaaagacttggtgcgagctgtgtcc

SEQ ID NO: 626552 - DNA, 25 bp, Mus musculus
gaaagacttgtgattgagcttgggc

SEQ ID NO: 626553 - DNA, 25 bp, Mus musculus
gaaagacttgtgtttgagcttgggc

SEQ ID NO: 626554 - DNA, 25 bp, Mus musculus
gaaagactttgaacagtgggaccct

SEQ ID NO: 626555 - DNA, 25 bp, Mus musculus
gaaagactttgatcagtgggaccct

SEQ ID NO: 626556 - DNA, 25 bp, Mus musculus
gaaagagaagaaatcccctgctggg

SEQ ID NO: 626557 - DNA, 25 bp, Mus musculus
gaaagagaagaattcccctgctggg

SEQ ID NO: 626558 - DNA, 25 bp, Mus musculus
gaaagagaagctccagaatacattg

SEQ ID NO: 626559 - DNA, 25 bp, Mus musculus
gaaagagaagctgcagaatacattg

SEQ ID NO: 626560 - DNA, 25 bp, Mus musculus
gaaagagaaggacaaactcagcacc

SEQ ID NO: 626561 - DNA, 25 bp, Mus musculus
gaaagagaaggagaaactcagcacc

SEQ ID NO: 626562 - DNA, 25 bp, Mus musculus
gaaagagaccatcccaatgccactg

SEQ ID NO: 626563 - DNA, 25 bp, Mus musculus
gaaagagaccatgccaatgccactg

SEQ ID NO: 626564 - DNA, 25 bp, Mus musculus
gaaagagacggacaacaccaaacca

SEQ ID NO: 626565 - DNA, 25 bp, Mus musculus
gaaagagacggagaacaccaaacca

SEQ ID NO: 626566 - DNA, 25 bp, Mus musculus
gaaagagacgtaagccttgttccag

SEQ ID NO: 626567 - DNA, 25 bp, Mus musculus
gaaagagacgtatgccttgttccag

SEQ ID NO: 626568 - DNA, 25 bp, Mus musculus
gaaagagataagcaaagctaacatc

SEQ ID NO: 626569 - DNA, 25 bp, Mus musculus
gaaagagataaggaaagctaacatc

SEQ ID NO: 626570 - DNA, 25 bp, Mus musculus
gaaagagatcgaagttctggagttt

SEQ ID NO: 626571 - DNA, 25 bp, Mus musculus
gaaagagatcgatgttctggagttt

SEQ ID NO: 626572 - DNA, 25 bp, Mus musculus
gaaagagatgtcatttctgacagcc

SEQ ID NO: 626573 - DNA, 25 bp, Mus musculus
gaaagagatgtcttttctgacagcc

SEQ ID NO: 626574 - DNA, 25 bp, Mus musculus
gaaagagatgttcgtgctctagctc

SEQ ID NO: 626575 - DNA, 25 bp, Mus musculus
gaaagagatgttggtgctctagctc

SEQ ID NO: 626576 - DNA, 25 bp, Mus musculus
gaaagagattgaaaagttcaaagac

SEQ ID NO: 626577 - DNA, 25 bp, Mus musculus
gaaagagattgataagttcaaagac

SEQ ID NO: 626578 - DNA, 25 bp, Mus musculus
gaaagagccacaattctcaccaggg

SEQ ID NO: 626579 - DNA, 25 bp, Mus musculus
gaaagagccacatttctcaccaggg

SEQ ID NO: 626580 - DNA, 25 bp, Mus musculus
gaaagagccaggaaggtgctgaatc

SEQ ID NO: 626581 - DNA, 25 bp, Mus musculus
gaaagagccaggtaggtgctgaatc

SEQ ID NO: 626582 - DNA, 25 bp, Mus musculus
gaaagagccatgagtaagagttgtt

SEQ ID NO: 626583 - DNA, 25 bp, Mus musculus
gaaagagccatgtgtaagagttgtt

SEQ ID NO: 626584 - DNA, 25 bp, Mus musculus
gaaagagccgttcagccggcgccca

SEQ ID NO: 626585 - DNA, 25 bp, Mus musculus
gaaagagccgttgagccggcgccca

SEQ ID NO: 626586 - DNA, 25 bp, Mus musculus
gaaagagcgccaaacggaaaatgga

SEQ ID NO: 626587 - DNA, 25 bp, Mus musculus
gaaagagcgccatacggaaaatgga

SEQ ID NO: 626588 - DNA, 25 bp, Mus musculus
gaaagagctcagaatgtcactcggc

SEQ ID NO: 626589 - DNA, 25 bp, Mus musculus
gaaagagctcagtatgtcactcggc

SEQ ID NO: 626590 - DNA, 25 bp, Mus musculus
gaaagagcttcactctagcccaggg

SEQ ID NO: 626591 - DNA, 25 bp, Mus musculus
gaaagagcttcagtctagcccaggg

SEQ ID NO: 626592 - DNA, 25 bp, Mus musculus
gaaagaggacccctattgccgttcg

SEQ ID NO: 626593 - DNA, 25 bp, Mus musculus
gaaagaggacccgtattgccgttcg

SEQ ID NO: 626594 - DNA, 25 bp, Mus musculus
gaaagaggacctagcttgtatctga

SEQ ID NO: 626595 - DNA, 25 bp, Mus musculus
gaaagaggaccttgcttgtatctga

SEQ ID NO: 626596 - DNA, 25 bp, Mus musculus
gaaagaggacgaacaagagggaggg

SEQ ID NO: 626597 - DNA, 25 bp, Mus musculus
gaaagaggacgatcaagagggaggg

SEQ ID NO: 626598 - DNA, 25 bp, Mus musculus
gaaagaggactcatgcaatggcctg

SEQ ID NO: 626599 - DNA, 25 bp, Mus musculus
gaaagaggactcttgcaatggcctg

SEQ ID NO: 626600 - DNA, 25 bp, Mus musculus
gaaagagggcctcaagttcgagaac

SEQ ID NO: 626601 - DNA, 25 bp, Mus musculus
gaaagagggcctgaagttcgagaac

SEQ ID NO: 626602 - DNA, 25 bp, Mus musculus
gaaagagtaagtcttttgagagcct

SEQ ID NO: 626603 - DNA, 25 bp, Mus musculus
gaaagagtaagtgttttgagagcct

SEQ ID NO: 626604 - DNA, 25 bp, Mus musculus
gaaagagtcataaagccctacgcgt

SEQ ID NO: 626605 - DNA, 25 bp, Mus musculus
gaaagagtcatatagccctacgcgt

SEQ ID NO: 626606 - DNA, 25 bp, Mus musculus
gaaagagtggtcacctggaattttg

SEQ ID NO: 626607 - DNA, 25 bp, Mus musculus
gaaagagtggtctcctggaattttg

SEQ ID NO: 626608 - DNA, 25 bp, Mus musculus
gaaagagtgtgtcctcctcgctaga

SEQ ID NO: 626609 - DNA, 25 bp, Mus musculus
gaaagagtgtgtgctcctcgctaga

SEQ ID NO: 626610 - DNA, 25 bp, Mus musculus
gaaagagttaccagcctggctccat

SEQ ID NO: 626611 - DNA, 25 bp, Mus musculus
gaaagagttacctgcctggctccat

SEQ ID NO: 626612 - DNA, 25 bp, Mus musculus
gaaagagttcctcgatgaccttttc

SEQ ID NO: 626613 - DNA, 25 bp, Mus musculus
gaaagagttcctggatgaccttttc

SEQ ID NO: 626614 - DNA, 25 bp, Mus musculus
gaaagagttctcacttcctggagca

SEQ ID NO: 626615 - DNA, 25 bp, Mus musculus
gaaagagttctctcttcctggagca

SEQ ID NO: 626616 - DNA, 25 bp, Mus musculus
gaaagagttgtcagaggaatcagaa

SEQ ID NO: 626617 - DNA, 25 bp, Mus musculus
gaaagagttgtctgaggaatcagaa

SEQ ID NO: 626618 - DNA, 25 bp, Mus musculus
gaaagagtttcccagagtcaggcgc

SEQ ID NO: 626619 - DNA, 25 bp, Mus musculus
gaaagagtttccgagagtcaggcgc

SEQ ID NO: 626620 - DNA, 25 bp, Mus musculus
gaaagagtttttaccactggtccat

SEQ ID NO: 626621 - DNA, 25 bp, Mus musculus
gaaagagttttttccactggtccat

SEQ ID NO: 626622 - DNA, 25 bp, Mus musculus
gaaagataaaaacgctatccaggca

SEQ ID NO: 626623 - DNA, 25 bp, Mus musculus
gaaagataaaaaggctatccaggca

SEQ ID NO: 626624 - DNA, 25 bp, Mus musculus
gaaagataacacagacccaggacaa

SEQ ID NO: 626625 - DNA, 25 bp, Mus musculus
gaaagataacactgacccaggacaa

SEQ ID NO: 626626 - DNA, 25 bp, Mus musculus
gaaagataacagagaccaggcctgg

SEQ ID NO: 626627 - DNA, 25 bp, Mus musculus
gaaagataacagtgaccaggcctgg

SEQ ID NO: 626628 - DNA, 25 bp, Mus musculus
gaaagatacaggaccatcaccacag

SEQ ID NO: 626629 - DNA, 25 bp, Mus musculus
gaaagatacaggtccatcaccacag

SEQ ID NO: 626630 - DNA, 25 bp, Mus musculus
gaaagatacttcaacaacctggagg

SEQ ID NO: 626631 - DNA, 25 bp, Mus musculus
gaaagatacttctacaacctggagg

SEQ ID NO: 626632 - DNA, 25 bp, Mus musculus
gaaagatcacaacttggagaagctc

SEQ ID NO: 626633 - DNA, 25 bp, Mus musculus
gaaagatcacaagttggagaagctc

SEQ ID NO: 626634 - DNA, 25 bp, Mus musculus
gaaagatcacatccgagaagctggg

SEQ ID NO: 626635 - DNA, 25 bp, Mus musculus
gaaagatcacatgcgagaagctggg

SEQ ID NO: 626636 - DNA, 25 bp, Mus musculus
gaaagatcacttctcggtaacctgc

SEQ ID NO: 626637 - DNA, 25 bp, Mus musculus
gaaagatcacttgtcggtaacctgc

SEQ ID NO: 626638 - DNA, 25 bp, Mus musculus
gaaagatccgtgacatcccctacgt

SEQ ID NO: 626639 - DNA, 25 bp, Mus musculus
gaaagatccgtgtcatcccctacgt

SEQ ID NO: 626640 - DNA, 25 bp, Mus musculus
gaaagatcgaaactcaatgctacgc

SEQ ID NO: 626641 - DNA, 25 bp, Mus musculus
gaaagatcgaaagtcaatgctacgc

SEQ ID NO: 626642 - DNA, 25 bp, Mus musculus
gaaagatcgtgcctcattgtcaagc

SEQ ID NO: 626643 - DNA, 25 bp, Mus musculus
gaaagatcgtgcgtcattgtcaagc

SEQ ID NO: 626644 - DNA, 25 bp, Mus musculus
gaaagatcgttcagtacgagtgtga

SEQ ID NO: 626645 - DNA, 25 bp, Mus musculus
gaaagatcgttctgtacgagtgtga

SEQ ID NO: 626646 - DNA, 25 bp, Mus musculus
gaaagatctataccccaatggagta

SEQ ID NO: 626647 - DNA, 25 bp, Mus musculus
gaaagatctatagcccaatggagta

SEQ ID NO: 626648 - DNA, 25 bp, Mus musculus
gaaagatctcatagcccgcagcgtc

SEQ ID NO: 626649 - DNA, 25 bp, Mus musculus
gaaagatctcattgcccgcagcgtc

SEQ ID NO: 626650 - DNA, 25 bp, Mus musculus
gaaagatgaaccaccacaagtaccg

SEQ ID NO: 626651 - DNA, 25 bp, Mus musculus
gaaagatgaacctccacaagtaccg

SEQ ID NO: 626652 - DNA, 25 bp, Mus musculus
gaaagatgaacgaggccttcgagga

SEQ ID NO: 626653 - DNA, 25 bp, Mus musculus
gaaagatgaacgtggccttcgagga

SEQ ID NO: 626654 - DNA, 25 bp, Mus musculus
gaaagatgaattctgtgatgatgga

SEQ ID NO: 626655 - DNA, 25 bp, Mus musculus
gaaagatgaattgtgtgatgatgga

SEQ ID NO: 626656 - DNA, 25 bp, Mus musculus
gaaagatgacagctacatgaaatca

SEQ ID NO: 626657 - DNA, 25 bp, Mus musculus
gaaagatgacaggtacatgaaatca

SEQ ID NO: 626658 - DNA, 25 bp, Mus musculus
gaaagatgacatctatcatcaagtt

SEQ ID NO: 626659 - DNA, 25 bp, Mus musculus
gaaagatgacatgtatcatcaagtt

SEQ ID NO: 626660 - DNA, 25 bp, Mus musculus
gaaagatgcagcagctactcaacag

SEQ ID NO: 626661 - DNA, 25 bp, Mus musculus
gaaagatgcagctgctactcaacag

SEQ ID NO: 626662 - DNA, 25 bp, Mus musculus
gaaagatgccaaagatgtaccgatc

SEQ ID NO: 626663 - DNA, 25 bp, Mus musculus
gaaagatgccaatgatgtaccgatc

SEQ ID NO: 626664 - DNA, 25 bp, Mus musculus
gaaagatgctctagtcttcttcaac

SEQ ID NO: 626665 - DNA, 25 bp, Mus musculus
gaaagatgctcttgtcttcttcaac

SEQ ID NO: 626666 - DNA, 25 bp, Mus musculus
gaaagatgcttaaagcctggccaac

SEQ ID NO: 626667 - DNA, 25 bp, Mus musculus
gaaagatgcttatagcctggccaac

SEQ ID NO: 626668 - DNA, 25 bp, Mus musculus
gaaagatggatcaagtcgcaactag

SEQ ID NO: 626669 - DNA, 25 bp, Mus musculus
gaaagatggatctagtcgcaactag

SEQ ID NO: 626670 - DNA, 25 bp, Mus musculus
gaaagatggcgtaccagagcctccg

SEQ ID NO: 626671 - DNA, 25 bp, Mus musculus
gaaagatggcgttccagagcctccg

SEQ ID NO: 626672 - DNA, 25 bp, Mus musculus
gaaagatgggtaccttaatggctcc

SEQ ID NO: 626673 - DNA, 25 bp, Mus musculus
gaaagatgggtagcttaatggctcc

SEQ ID NO: 626674 - DNA, 25 bp, Mus musculus
gaaagatggtgacaaggaaaaaaca

SEQ ID NO: 626675 - DNA, 25 bp, Mus musculus
gaaagatggtgagaaggaaaaaaca

SEQ ID NO: 626676 - DNA, 25 bp, Mus musculus
gaaagatgtagacacctaagaccat

SEQ ID NO: 626677 - DNA, 25 bp, Mus musculus
gaaagatgtagagacctaagaccat

SEQ ID NO: 626678 - DNA, 25 bp, Mus musculus
gaaagatgtcctcaccagcacgtac

SEQ ID NO: 626679 - DNA, 25 bp, Mus musculus
gaaagatgtcctgaccagcacgtac

SEQ ID NO: 626680 - DNA, 25 bp, Mus musculus
gaaagatgtgtcacagggagtctcc

SEQ ID NO: 626681 - DNA, 25 bp, Mus musculus
gaaagatgtgtctcagggagtctcc

SEQ ID NO: 626682 - DNA, 25 bp, Mus musculus
gaaagatgttagcacctcagacctg

SEQ ID NO: 626683 - DNA, 25 bp, Mus musculus
gaaagatgttaggacctcagacctg

SEQ ID NO: 626684 - DNA, 25 bp, Mus musculus
gaaagattatcaacaaacatccagg

SEQ ID NO: 626685 - DNA, 25 bp, Mus musculus
gaaagattatcatcaaacatccagg

SEQ ID NO: 626686 - DNA, 25 bp, Mus musculus
gaaagattcggaaactgcagacctc

SEQ ID NO: 626687 - DNA, 25 bp, Mus musculus
gaaagattcggatactgcagacctc

SEQ ID NO: 626688 - DNA, 25 bp, Mus musculus
gaaagattgctgatatacgacctgg

SEQ ID NO: 626689 - DNA, 25 bp, Mus musculus
gaaagattgctgttatacgacctgg

SEQ ID NO: 626690 - DNA, 25 bp, Mus musculus
gaaagattggaacccagatgagcca

SEQ ID NO: 626691 - DNA, 25 bp, Mus musculus
gaaagattggaagccagatgagcca

SEQ ID NO: 626692 - DNA, 25 bp, Mus musculus
gaaagattgggtagctactccccga

SEQ ID NO: 626693 - DNA, 25 bp, Mus musculus
gaaagattgggttgctactccccga

SEQ ID NO: 626694 - DNA, 25 bp, Mus musculus
gaaagatttcgaacaatcacttcca

SEQ ID NO: 626695 - DNA, 25 bp, Mus musculus
gaaagatttcgatcaatcacttcca

SEQ ID NO: 626696 - DNA, 25 bp, Mus musculus
gaaagatttggaccgccatctaaga

SEQ ID NO: 626697 - DNA, 25 bp, Mus musculus
gaaagatttggacgtatctgcagag

SEQ ID NO: 626698 - DNA, 25 bp, Mus musculus
gaaagatttggagcgccatctaaga

SEQ ID NO: 626699 - DNA, 25 bp, Mus musculus
gaaagatttggaggtatctgcagag

SEQ ID NO: 626700 - DNA, 25 bp, Mus musculus
gaaagcaaagcacttcctgcccttt

SEQ ID NO: 626701 - DNA, 25 bp, Mus musculus
gaaagcaaagcagttcctgcccttt

SEQ ID NO: 626702 - DNA, 25 bp, Mus musculus
gaaagcaaaggaagcctagagtgga

SEQ ID NO: 626703 - DNA, 25 bp, Mus musculus
gaaagcaaaggatgcctagagtgga

SEQ ID NO: 626704 - DNA, 25 bp, Mus musculus
gaaagcaacgctaaaggaagctcag

SEQ ID NO: 626705 - DNA, 25 bp, Mus musculus
gaaagcaacgcttaaggaagctcag

SEQ ID NO: 626706 - DNA, 25 bp, Mus musculus
gaaagcaagaggaaccccatgatgg

SEQ ID NO: 626707 - DNA, 25 bp, Mus musculus
gaaagcaagaggtaccccatgatgg

SEQ ID NO: 626708 - DNA, 25 bp, Mus musculus
gaaagcaagcctcaacagtgcctga

SEQ ID NO: 626709 - DNA, 25 bp, Mus musculus
gaaagcaagcctgaacagtgcctga

SEQ ID NO: 626710 - DNA, 25 bp, Mus musculus
gaaagcaagctcatgctgctaaaag

SEQ ID NO: 626711 - DNA, 25 bp, Mus musculus
gaaagcaagctcttgctgctaaaag

SEQ ID NO: 626712 - DNA, 25 bp, Mus musculus
gaaagcaaggtgctagatttctgga

SEQ ID NO: 626713 - DNA, 25 bp, Mus musculus
gaaagcaaggtggtagatttctgga

SEQ ID NO: 626714 - DNA, 25 bp, Mus musculus
gaaagcaagtagaaaaggccatggg

SEQ ID NO: 626715 - DNA, 25 bp, Mus musculus
gaaagcaagtagtaaaggccatggg

SEQ ID NO: 626716 - DNA, 25 bp, Mus musculus
gaaagcaatccacctaaaaatgaag

SEQ ID NO: 626717 - DNA, 25 bp, Mus musculus
gaaagcaatccagctaaaaatgaag

SEQ ID NO: 626718 - DNA, 25 bp, Mus musculus
gaaagcaatgagcaatggcatatcc

SEQ ID NO: 626719 - DNA, 25 bp, Mus musculus
gaaagcaatgaggaatggcatatcc

SEQ ID NO: 626720 - DNA, 25 bp, Mus musculus
gaaagcaatggaagttcaactgcca

SEQ ID NO: 626721 - DNA, 25 bp, Mus musculus
gaaagcaatggatgttcaactgcca

SEQ ID NO: 626722 - DNA, 25 bp, Mus musculus
gaaagcacacgtctttgggatcacg

SEQ ID NO: 626723 - DNA, 25 bp, Mus musculus
gaaagcacacgtgtttgggatcacg

SEQ ID NO: 626724 - DNA, 25 bp, Mus musculus
gaaagcacagacaacatactctcca

SEQ ID NO: 626725 - DNA, 25 bp, Mus musculus
gaaagcacagactacatactctcca

SEQ ID NO: 626726 - DNA, 25 bp, Mus musculus
gaaagcacagagatctcccatggag

SEQ ID NO: 626727 - DNA, 25 bp, Mus musculus
gaaagcacagagttctcccatggag

SEQ ID NO: 626728 - DNA, 25 bp, Mus musculus
gaaagcacagatctgtgctgacgtc

SEQ ID NO: 626729 - DNA, 25 bp, Mus musculus
gaaagcacagatgtgtgctgacgtc

SEQ ID NO: 626730 - DNA, 25 bp, Mus musculus
gaaagcacatcgactgtatccttac

SEQ ID NO: 626731 - DNA, 25 bp, Mus musculus
gaaagcacatcgtctgtatccttac

SEQ ID NO: 626732 - DNA, 25 bp, Mus musculus
gaaagcaccgcacgtctgagcagcc

SEQ ID NO: 626733 - DNA, 25 bp, Mus musculus
gaaagcaccgcaggtctgagcagcc

SEQ ID NO: 626734 - DNA, 25 bp, Mus musculus
gaaagcacctccatccaggatgtag

SEQ ID NO: 626735 - DNA, 25 bp, Mus musculus
gaaagcacctccttccaggatgtag

SEQ ID NO: 626736 - DNA, 25 bp, Mus musculus
gaaagcaccttcagaaatatgccag

SEQ ID NO: 626737 - DNA, 25 bp, Mus musculus
gaaagcaccttctgaaatatgccag

SEQ ID NO: 626738 - DNA, 25 bp, Mus musculus
gaaagcaccttgctatcgggctgtg

SEQ ID NO: 626739 - DNA, 25 bp, Mus musculus
gaaagcaccttggtatcgggctgtg

SEQ ID NO: 626740 - DNA, 25 bp, Mus musculus
gaaagcacgagcacgctcaaggcct

SEQ ID NO: 626741 - DNA, 25 bp, Mus musculus
gaaagcacgagctcgctcaaggcct

SEQ ID NO: 626742 - DNA, 25 bp, Mus musculus
gaaagcacgcttagattggaacacc

SEQ ID NO: 626743 - DNA, 25 bp, Mus musculus
gaaagcacgctttgattggaacacc

SEQ ID NO: 626744 - DNA, 25 bp, Mus musculus
gaaagcactgaccaccggagatatt

SEQ ID NO: 626745 - DNA, 25 bp, Mus musculus
gaaagcactgacgaccggagatatt

SEQ ID NO: 626746 - DNA, 25 bp, Mus musculus
gaaagcactgagacgtgaagatgag

SEQ ID NO: 626747 - DNA, 25 bp, Mus musculus
gaaagcactgagtcgtgaagatgag

SEQ ID NO: 626748 - DNA, 25 bp, Mus musculus
gaaagcactgctctcccagcagaca

SEQ ID NO: 626749 - DNA, 25 bp, Mus musculus
gaaagcactgctgtcccagcagaca

SEQ ID NO: 626750 - DNA, 25 bp, Mus musculus
gaaagcactgtactatctgaaggag

SEQ ID NO: 626751 - DNA, 25 bp, Mus musculus
gaaagcactgtagtatctgaaggag

SEQ ID NO: 626752 - DNA, 25 bp, Mus musculus
gaaagcactgttcgcaagctgcaga

SEQ ID NO: 626753 - DNA, 25 bp, Mus musculus
gaaagcactgttggcaagctgcaga

SEQ ID NO: 626754 - DNA, 25 bp, Mus musculus
gaaagcagaaaccatgaccgtcagc

SEQ ID NO: 626755 - DNA, 25 bp, Mus musculus
gaaagcagaaacgatgaccgtcagc

SEQ ID NO: 626756 - DNA, 25 bp, Mus musculus
gaaagcagaaatagaacgcatgaga

SEQ ID NO: 626757 - DNA, 25 bp, Mus musculus
gaaagcagaaattgaacgcatgaga

SEQ ID NO: 626758 - DNA, 25 bp, Mus musculus
gaaagcagacatacctctgatggtc

SEQ ID NO: 626759 - DNA, 25 bp, Mus musculus
gaaagcagacattcctctgatggtc

SEQ ID NO: 626760 - DNA, 25 bp, Mus musculus
gaaagcagagcaaagtggaagctaa

SEQ ID NO: 626761 - DNA, 25 bp, Mus musculus
gaaagcagagcaccctttgcctgaa

SEQ ID NO: 626762 - DNA, 25 bp, Mus musculus
gaaagcagagcagcctttgcctgaa

SEQ ID NO: 626763 - DNA, 25 bp, Mus musculus
gaaagcagagcatagtggaagctaa

SEQ ID NO: 626764 - DNA, 25 bp, Mus musculus
gaaagcagagccagtggcaaagcca

SEQ ID NO: 626765 - DNA, 25 bp, Mus musculus
gaaagcagagcctgtggcaaagcca

SEQ ID NO: 626766 - DNA, 25 bp, Mus musculus
gaaagcagcaagaatcggacagcgc

SEQ ID NO: 626767 - DNA, 25 bp, Mus musculus
gaaagcagcaagtatcggacagcgc

SEQ ID NO: 626768 - DNA, 25 bp, Mus musculus
gaaagcagcagtcttgaagacctct

SEQ ID NO: 626769 - DNA, 25 bp, Mus musculus
gaaagcagcagtgttgaagacctct

SEQ ID NO: 626770 - DNA, 25 bp, Mus musculus
gaaagcagctagacattcggccaac

SEQ ID NO: 626771 - DNA, 25 bp, Mus musculus
gaaagcagctagtcattcggccaac

SEQ ID NO: 626772 - DNA, 25 bp, Mus musculus
gaaagcagctggattcaaagatcct

SEQ ID NO: 626773 - DNA, 25 bp, Mus musculus
gaaagcagctggtttcaaagatcct

SEQ ID NO: 626774 - DNA, 25 bp, Mus musculus
gaaagcaggctgaagaggtcaacgc

SEQ ID NO: 626775 - DNA, 25 bp, Mus musculus
gaaagcaggctgtagaggtcaacgc

SEQ ID NO: 626776 - DNA, 25 bp, Mus musculus
gaaagcagggtaagccgtcagaaga

SEQ ID NO: 626777 - DNA, 25 bp, Mus musculus
gaaagcagggtacccactggagaaa

SEQ ID NO: 626778 - DNA, 25 bp, Mus musculus
gaaagcagggtagccactggagaaa

SEQ ID NO: 626779 - DNA, 25 bp, Mus musculus
gaaagcagggtatgccgtcagaaga

SEQ ID NO: 626780 - DNA, 25 bp, Mus musculus
gaaagcaggtcgatccattctccag

SEQ ID NO: 626781 - DNA, 25 bp, Mus musculus
gaaagcaggtcgttccattctccag

SEQ ID NO: 626782 - DNA, 25 bp, Mus musculus
gaaagcagtaggagcatgcagaatc

SEQ ID NO: 626783 - DNA, 25 bp, Mus musculus
gaaagcagtaggtgcatgcagaatc

SEQ ID NO: 626784 - DNA, 25 bp, Mus musculus
gaaagcagtcaacactgcccaagga

SEQ ID NO: 626785 - DNA, 25 bp, Mus musculus
gaaagcagtcaagactgcccaagga

SEQ ID NO: 626786 - DNA, 25 bp, Mus musculus
gaaagcagtcctctggagccacagg

SEQ ID NO: 626787 - DNA, 25 bp, Mus musculus
gaaagcagtcctgtggagccacagg

SEQ ID NO: 626788 - DNA, 25 bp, Mus musculus
gaaagcagttggcatctgcccactg

SEQ ID NO: 626789 - DNA, 25 bp, Mus musculus
gaaagcagttgggatctgcccactg

SEQ ID NO: 626790 - DNA, 25 bp, Mus musculus
gaaagcatacaaagaagctgtgagc

SEQ ID NO: 626791 - DNA, 25 bp, Mus musculus
gaaagcatacaatgaagctgtgagc

SEQ ID NO: 626792 - DNA, 25 bp, Mus musculus
gaaagcatacatactgtgggattcc

SEQ ID NO: 626793 - DNA, 25 bp, Mus musculus
gaaagcatacattctgtgggattcc

SEQ ID NO: 626794 - DNA, 25 bp, Mus musculus
gaaagcatatctacctgagagcctg

SEQ ID NO: 626795 - DNA, 25 bp, Mus musculus
gaaagcatatcttcctgagagcctg

SEQ ID NO: 626796 - DNA, 25 bp, Mus musculus
gaaagcatccagaccaatctcaggc

SEQ ID NO: 626797 - DNA, 25 bp, Mus musculus
gaaagcatccagtccaatctcaggc

SEQ ID NO: 626798 - DNA, 25 bp, Mus musculus
gaaagcatccgaacattgcaagaaa

SEQ ID NO: 626799 - DNA, 25 bp, Mus musculus
gaaagcatccgatcattgcaagaaa

SEQ ID NO: 626800 - DNA, 25 bp, Mus musculus
gaaagcatcctgatggcctgcaaag

SEQ ID NO: 626801 - DNA, 25 bp, Mus musculus
gaaagcatcctgttggcctgcaaag

SEQ ID NO: 626802 - DNA, 25 bp, Mus musculus
gaaagcatctatctgcgtcttacgt

SEQ ID NO: 626803 - DNA, 25 bp, Mus musculus
gaaagcatctatgtgcgtcttacgt

SEQ ID NO: 626804 - DNA, 25 bp, Mus musculus
gaaagcatctttccaactgaatcag

SEQ ID NO: 626805 - DNA, 25 bp, Mus musculus
gaaagcatctttgcaactgaatcag

SEQ ID NO: 626806 - DNA, 25 bp, Mus musculus
gaaagcatgctgatcaatggctatg

SEQ ID NO: 626807 - DNA, 25 bp, Mus musculus
gaaagcatgctgttcaatggctatg

SEQ ID NO: 626808 - DNA, 25 bp, Mus musculus
gaaagcatgtgtaaattttacagta

SEQ ID NO: 626809 - DNA, 25 bp, Mus musculus
gaaagcatgtgttaattttacagta

SEQ ID NO: 626810 - DNA, 25 bp, Mus musculus
gaaagcattaatcgctgcagaggat

SEQ ID NO: 626811 - DNA, 25 bp, Mus musculus
gaaagcattaatggctgcagaggat

SEQ ID NO: 626812 - DNA, 25 bp, Mus musculus
gaaagcattcaacgccaggttccca

SEQ ID NO: 626813 - DNA, 25 bp, Mus musculus
gaaagcattcaaggccaggttccca

SEQ ID NO: 626814 - DNA, 25 bp, Mus musculus
gaaagcattggcacgggactgcagt

SEQ ID NO: 626815 - DNA, 25 bp, Mus musculus
gaaagcattggctcgggactgcagt

SEQ ID NO: 626816 - DNA, 25 bp, Mus musculus
gaaagcattgggaatgtgcaagttc

SEQ ID NO: 626817 - DNA, 25 bp, Mus musculus
gaaagcattgggtatgtgcaagttc

SEQ ID NO: 626818 - DNA, 25 bp, Mus musculus
gaaagccaacctacaatactatgcc

SEQ ID NO: 626819 - DNA, 25 bp, Mus musculus
gaaagccaaccttcaatactatgcc

SEQ ID NO: 626820 - DNA, 25 bp, Mus musculus
gaaagccaacttagttcgcagtccc

SEQ ID NO: 626821 - DNA, 25 bp, Mus musculus
gaaagccaactttgttcgcagtccc

SEQ ID NO: 626822 - DNA, 25 bp, Mus musculus
gaaagccaagtacagctccgggaac

SEQ ID NO: 626823 - DNA, 25 bp, Mus musculus
gaaagccaagtagagctccgggaac

SEQ ID NO: 626824 - DNA, 25 bp, Mus musculus
gaaagccaatacctgcctgttgagg

SEQ ID NO: 626825 - DNA, 25 bp, Mus musculus
gaaagccaatacgtgcctgttgagg

SEQ ID NO: 626826 - DNA, 25 bp, Mus musculus
gaaagccacagcagccctggttgta

SEQ ID NO: 626827 - DNA, 25 bp, Mus musculus
gaaagccacagctgccctggttgta

SEQ ID NO: 626828 - DNA, 25 bp, Mus musculus
gaaagccacagtcagtgggaactac

SEQ ID NO: 626829 - DNA, 25 bp, Mus musculus
gaaagccacagtgagtgggaactac

SEQ ID NO: 626830 - DNA, 25 bp, Mus musculus
gaaagccacatacttctcttgtggg

SEQ ID NO: 626831 - DNA, 25 bp, Mus musculus
gaaagccacatagttctcttgtggg

SEQ ID NO: 626832 - DNA, 25 bp, Mus musculus
gaaagccacccaaccttccatggaa

SEQ ID NO: 626833 - DNA, 25 bp, Mus musculus
gaaagccacccatccttccatggaa

SEQ ID NO: 626834 - DNA, 25 bp, Mus musculus
gaaagccacgctcgtcttctgagat

SEQ ID NO: 626835 - DNA, 25 bp, Mus musculus
gaaagccacgctggtcttctgagat

SEQ ID NO: 626836 - DNA, 25 bp, Mus musculus
gaaagccagaaaatgggttctgtgt

SEQ ID NO: 626837 - DNA, 25 bp, Mus musculus
gaaagccagaaattgggttctgtgt

SEQ ID NO: 626838 - DNA, 25 bp, Mus musculus
gaaagccaggtgacagattccattc

SEQ ID NO: 626839 - DNA, 25 bp, Mus musculus
gaaagccaggtgtcagattccattc

SEQ ID NO: 626840 - DNA, 25 bp, Mus musculus
gaaagccagtaacgtatcaacagca

SEQ ID NO: 626841 - DNA, 25 bp, Mus musculus
gaaagccagtaaggtatcaacagca

SEQ ID NO: 626842 - DNA, 25 bp, Mus musculus
gaaagccagtacacacagtcatggg

SEQ ID NO: 626843 - DNA, 25 bp, Mus musculus
gaaagccagtactcacagtcatggg

SEQ ID NO: 626844 - DNA, 25 bp, Mus musculus
gaaagccatagacgaattgctaaag

SEQ ID NO: 626845 - DNA, 25 bp, Mus musculus
gaaagccatagaggaattgctaaag

SEQ ID NO: 626846 - DNA, 25 bp, Mus musculus
gaaagccatcaaagcctgagtgggc

SEQ ID NO: 626847 - DNA, 25 bp, Mus musculus
gaaagccatcaatgcctgagtgggc

SEQ ID NO: 626848 - DNA, 25 bp, Mus musculus
gaaagccatcataagtttctggagt

SEQ ID NO: 626849 - DNA, 25 bp, Mus musculus
gaaagccatcattagtttctggagt

SEQ ID NO: 626850 - DNA, 25 bp, Mus musculus
gaaagccatcgacgtcctgcagtcc

SEQ ID NO: 626851 - DNA, 25 bp, Mus musculus
gaaagccatcgaggtcctgcagtcc

SEQ ID NO: 626852 - DNA, 25 bp, Mus musculus
gaaagccatcgcacgtctcattgag

SEQ ID NO: 626853 - DNA, 25 bp, Mus musculus
gaaagccatcgcagaccacatcaga

SEQ ID NO: 626854 - DNA, 25 bp, Mus musculus
gaaagccatcgctcgtctcattgag

SEQ ID NO: 626855 - DNA, 25 bp, Mus musculus
gaaagccatcgctgaccacatcaga

SEQ ID NO: 626856 - DNA, 25 bp, Mus musculus
gaaagccatgaaaacctccagcaga

SEQ ID NO: 626857 - DNA, 25 bp, Mus musculus
gaaagccatgaatacctccagcaga

SEQ ID NO: 626858 - DNA, 25 bp, Mus musculus
gaaagcccaggaagtactggcggat

SEQ ID NO: 626859 - DNA, 25 bp, Mus musculus
gaaagcccaggatgtactggcggat

SEQ ID NO: 626860 - DNA, 25 bp, Mus musculus
gaaagccccaggacatcatcttcac

SEQ ID NO: 626861 - DNA, 25 bp, Mus musculus
gaaagccccaggtcatcatcttcac

SEQ ID NO: 626862 - DNA, 25 bp, Mus musculus
gaaagccccattcacttcgtggtca

SEQ ID NO: 626863 - DNA, 25 bp, Mus musculus
gaaagccccattgacttcgtggtca

SEQ ID NO: 626864 - DNA, 25 bp, Mus musculus
gaaagcccccatatgctgatatcca

SEQ ID NO: 626865 - DNA, 25 bp, Mus musculus
gaaagcccccatttgctgatatcca

SEQ ID NO: 626866 - DNA, 25 bp, Mus musculus
gaaagccccccacttccagttgttg

SEQ ID NO: 626867 - DNA, 25 bp, Mus musculus
gaaagccccccagttccagttgttg

SEQ ID NO: 626868 - DNA, 25 bp, Mus musculus
gaaagcccgtatactccgagagagg

SEQ ID NO: 626869 - DNA, 25 bp, Mus musculus
gaaagcccgtattctccgagagagg

SEQ ID NO: 626870 - DNA, 25 bp, Mus musculus
gaaagcccgtgcctacttcctttcg

SEQ ID NO: 626871 - DNA, 25 bp, Mus musculus
gaaagcccgtgcgtacttcctttcg

SEQ ID NO: 626872 - DNA, 25 bp, Mus musculus
gaaagccctactctcctcctgaggg

SEQ ID NO: 626873 - DNA, 25 bp, Mus musculus
gaaagccctactgtcctcctgaggg

SEQ ID NO: 626874 - DNA, 25 bp, Mus musculus
gaaagccctccgagaaacaaagtgc

SEQ ID NO: 626875 - DNA, 25 bp, Mus musculus
gaaagccctccgtgaaacaaagtgc

SEQ ID NO: 626876 - DNA, 25 bp, Mus musculus
gaaagccctgatccttgagctgaaa

SEQ ID NO: 626877 - DNA, 25 bp, Mus musculus
gaaagccctgatgcttgagctgaaa

SEQ ID NO: 626878 - DNA, 25 bp, Mus musculus
gaaagcccttcaacccgcttctggg

SEQ ID NO: 626879 - DNA, 25 bp, Mus musculus
gaaagcccttcatcccgcttctggg

SEQ ID NO: 626880 - DNA, 25 bp, Mus musculus
gaaagcccttcgatgatcaagatga

SEQ ID NO: 626881 - DNA, 25 bp, Mus musculus
gaaagcccttcgttgatcaagatga

SEQ ID NO: 626882 - DNA, 25 bp, Mus musculus
gaaagccgagcccaaaaagatgaag

SEQ ID NO: 626883 - DNA, 25 bp, Mus musculus
gaaagccgagccgaaaaagatgaag

SEQ ID NO: 626884 - DNA, 25 bp, Mus musculus
gaaagccgagtcatcccttcctctt

SEQ ID NO: 626885 - DNA, 25 bp, Mus musculus
gaaagccgagtcttcccttcctctt

SEQ ID NO: 626886 - DNA, 25 bp, Mus musculus
gaaagccgcactaacctagcggcga

SEQ ID NO: 626887 - DNA, 25 bp, Mus musculus
gaaagccgcacttacctagcggcga

SEQ ID NO: 626888 - DNA, 25 bp, Mus musculus
gaaagccggacactggcagtgaaac

SEQ ID NO: 626889 - DNA, 25 bp, Mus musculus
gaaagccggacagtggcagtgaaac

SEQ ID NO: 626890 - DNA, 25 bp, Mus musculus
gaaagccggaccatcgtagctgacg

SEQ ID NO: 626891 - DNA, 25 bp, Mus musculus
gaaagccggaccttcgtagctgacg

SEQ ID NO: 626892 - DNA, 25 bp, Mus musculus
gaaagccgtgatctcagatgttcac

SEQ ID NO: 626893 - DNA, 25 bp, Mus musculus
gaaagccgtgatgtcagatgttcac

SEQ ID NO: 626894 - DNA, 25 bp, Mus musculus
gaaagcctacaaccccatgtgctct

SEQ ID NO: 626895 - DNA, 25 bp, Mus musculus
gaaagcctacaagcccatgtgctct

SEQ ID NO: 626896 - DNA, 25 bp, Mus musculus
gaaagcctacatcgaattagtcaac

SEQ ID NO: 626897 - DNA, 25 bp, Mus musculus
gaaagcctacatggaattagtcaac

SEQ ID NO: 626898 - DNA, 25 bp, Mus musculus
gaaagcctacttctgccagtggtga

SEQ ID NO: 626899 - DNA, 25 bp, Mus musculus
gaaagcctacttgtgccagtggtga

SEQ ID NO: 626900 - DNA, 25 bp, Mus musculus
gaaagcctagttctcttatagaaga

SEQ ID NO: 626901 - DNA, 25 bp, Mus musculus
gaaagcctagttgtcttatagaaga

SEQ ID NO: 626902 - DNA, 25 bp, Mus musculus
gaaagcctatgaagcctacggacca

SEQ ID NO: 626903 - DNA, 25 bp, Mus musculus
gaaagcctatgatgcctacggacca

SEQ ID NO: 626904 - DNA, 25 bp, Mus musculus
gaaagcctccgaaagcagctaggcc

SEQ ID NO: 626905 - DNA, 25 bp, Mus musculus
gaaagcctccgatagcagctaggcc

SEQ ID NO: 626906 - DNA, 25 bp, Mus musculus
gaaagcctcggaagagctcaggagc

SEQ ID NO: 626907 - DNA, 25 bp, Mus musculus
gaaagcctcggatgagctcaggagc

SEQ ID NO: 626908 - DNA, 25 bp, Mus musculus
gaaagcctctgacagcaaacagtct

SEQ ID NO: 626909 - DNA, 25 bp, Mus musculus
gaaagcctctgagagcaaacagtct

SEQ ID NO: 626910 - DNA, 25 bp, Mus musculus
gaaagcctctgcctcttcttactca

SEQ ID NO: 626911 - DNA, 25 bp, Mus musculus
gaaagcctctgcgtcttcttactca

SEQ ID NO: 626912 - DNA, 25 bp, Mus musculus
gaaagcctgaaacgcctcaaacaag

SEQ ID NO: 626913 - DNA, 25 bp, Mus musculus
gaaagcctgaaaggcctcaaacaag

SEQ ID NO: 626914 - DNA, 25 bp, Mus musculus
gaaagcctggcaatcctggactccc

SEQ ID NO: 626915 - DNA, 25 bp, Mus musculus
gaaagcctggcattcctggactccc

SEQ ID NO: 626916 - DNA, 25 bp, Mus musculus
gaaagccttccgcacttccagtggc

SEQ ID NO: 626917 - DNA, 25 bp, Mus musculus
gaaagccttccggacttccagtggc

SEQ ID NO: 626918 - DNA, 25 bp, Mus musculus
gaaagccttctaaccattccaaagt

SEQ ID NO: 626919 - DNA, 25 bp, Mus musculus
gaaagccttctatccattccaaagt

SEQ ID NO: 626920 - DNA, 25 bp, Mus musculus
gaaagcctttctcagtcacaccgag

SEQ ID NO: 626921 - DNA, 25 bp, Mus musculus
gaaagcctttctgagtcacaccgag

SEQ ID NO: 626922 - DNA, 25 bp, Mus musculus
gaaagcgagcagatcgtctcggcga

SEQ ID NO: 626923 - DNA, 25 bp, Mus musculus
gaaagcgagcagttcgtctcggcga

SEQ ID NO: 626924 - DNA, 25 bp, Mus musculus
gaaagcgatggacctgggtaccctt

SEQ ID NO: 626925 - DNA, 25 bp, Mus musculus
gaaagcgatggagctgggtaccctt

SEQ ID NO: 626926 - DNA, 25 bp, Mus musculus
gaaagcgatggcagtcaccagtgac

SEQ ID NO: 626927 - DNA, 25 bp, Mus musculus
gaaagcgatggctgtcaccagtgac

SEQ ID NO: 626928 - DNA, 25 bp, Mus musculus
gaaagcgcaagactctcaatgccag

SEQ ID NO: 626929 - DNA, 25 bp, Mus musculus
gaaagcgcaagagtctcaatgccag

SEQ ID NO: 626930 - DNA, 25 bp, Mus musculus
gaaagcgccccacgatggcattgtt

SEQ ID NO: 626931 - DNA, 25 bp, Mus musculus
gaaagcgccccaggatggcattgtt

SEQ ID NO: 626932 - DNA, 25 bp, Mus musculus
gaaagcgctatccttcacgccgagg

SEQ ID NO: 626933 - DNA, 25 bp, Mus musculus
gaaagcgctatcgttcacgccgagg

SEQ ID NO: 626934 - DNA, 25 bp, Mus musculus
gaaagcggagcaatgttagaaagtg

SEQ ID NO: 626935 - DNA, 25 bp, Mus musculus
gaaagcggagcattgttagaaagtg

SEQ ID NO: 626936 - DNA, 25 bp, Mus musculus
gaaagcggctcaagttccgggccca

SEQ ID NO: 626937 - DNA, 25 bp, Mus musculus
gaaagcggctcatgttccgggccca

SEQ ID NO: 626938 - DNA, 25 bp, Mus musculus
gaaagcggtgccagtcacaggaatg

SEQ ID NO: 626939 - DNA, 25 bp, Mus musculus
gaaagcggtgcctgtcacaggaatg

SEQ ID NO: 626940 - DNA, 25 bp, Mus musculus
gaaagcggttacctgtctgagcacc

SEQ ID NO: 626941 - DNA, 25 bp, Mus musculus
gaaagcggttacgtgtctgagcacc

SEQ ID NO: 626942 - DNA, 25 bp, Mus musculus
gaaagcgtcatcatccaagatctga

SEQ ID NO: 626943 - DNA, 25 bp, Mus musculus
gaaagcgtcatcttccaagatctga

SEQ ID NO: 626944 - DNA, 25 bp, Mus musculus
gaaagcgtcgctcctccgctctagt

SEQ ID NO: 626945 - DNA, 25 bp, Mus musculus
gaaagcgtcgctgctccgctctagt

SEQ ID NO: 626946 - DNA, 25 bp, Mus musculus
gaaagcgtctgtcgagacactgaca

SEQ ID NO: 626947 - DNA, 25 bp, Mus musculus
gaaagcgtctgtggagacactgaca

SEQ ID NO: 626948 - DNA, 25 bp, Mus musculus
gaaagctaacacaccattctgacgg

SEQ ID NO: 626949 - DNA, 25 bp, Mus musculus
gaaagctaacactccattctgacgg

SEQ ID NO: 626950 - DNA, 25 bp, Mus musculus
gaaagctaactacagaatgtactct

SEQ ID NO: 626951 - DNA, 25 bp, Mus musculus
gaaagctaactagagaatgtactct

SEQ ID NO: 626952 - DNA, 25 bp, Mus musculus
gaaagctacattatgcacacctacc

SEQ ID NO: 626953 - DNA, 25 bp, Mus musculus
gaaagctacattttgcacacctacc

SEQ ID NO: 626954 - DNA, 25 bp, Mus musculus
gaaagctactggatcttgggtttct

SEQ ID NO: 626955 - DNA, 25 bp, Mus musculus
gaaagctactggttcttgggtttct

SEQ ID NO: 626956 - DNA, 25 bp, Mus musculus
gaaagctaggagactatgctgacct

SEQ ID NO: 626957 - DNA, 25 bp, Mus musculus
gaaagctaggagtctatgctgacct

SEQ ID NO: 626958 - DNA, 25 bp, Mus musculus
gaaagctatgctccggcaaactaga

SEQ ID NO: 626959 - DNA, 25 bp, Mus musculus
gaaagctatgctgcggcaaactaga

SEQ ID NO: 626960 - DNA, 25 bp, Mus musculus
gaaagctcacaacagtggcgaagac

SEQ ID NO: 626961 - DNA, 25 bp, Mus musculus
gaaagctcacaagagtggcgaagac

SEQ ID NO: 626962 - DNA, 25 bp, Mus musculus
gaaagctcacagaaacaactaaccc

SEQ ID NO: 626963 - DNA, 25 bp, Mus musculus
gaaagctcacagacggttcaccctg

SEQ ID NO: 626964 - DNA, 25 bp, Mus musculus
gaaagctcacagtaacaactaaccc

SEQ ID NO: 626965 - DNA, 25 bp, Mus musculus
gaaagctcacagtcggttcaccctg

SEQ ID NO: 626966 - DNA, 25 bp, Mus musculus
gaaagctcggctacctgccctaatc

SEQ ID NO: 626967 - DNA, 25 bp, Mus musculus
gaaagctcggcttcctgccctaatc

SEQ ID NO: 626968 - DNA, 25 bp, Mus musculus
gaaagctctacaaagcctgtatacc

SEQ ID NO: 626969 - DNA, 25 bp, Mus musculus
gaaagctctacatagcctgtatacc

SEQ ID NO: 626970 - DNA, 25 bp, Mus musculus
gaaagctctccgcacactcaagaga

SEQ ID NO: 626971 - DNA, 25 bp, Mus musculus
gaaagctctccggacactcaagaga

SEQ ID NO: 626972 - DNA, 25 bp, Mus musculus
gaaagctctgcaacatgtaccagtg

SEQ ID NO: 626973 - DNA, 25 bp, Mus musculus
gaaagctctgcacgttttcttcgtg

SEQ ID NO: 626974 - DNA, 25 bp, Mus musculus
gaaagctctgcaggttttcttcgtg

SEQ ID NO: 626975 - DNA, 25 bp, Mus musculus
gaaagctctgcatcatgtaccagtg

SEQ ID NO: 626976 - DNA, 25 bp, Mus musculus
gaaagctcttctcttgtcttcaaaa

SEQ ID NO: 626977 - DNA, 25 bp, Mus musculus
gaaagctcttctgttgtcttcaaaa

SEQ ID NO: 626978 - DNA, 25 bp, Mus musculus
gaaagctgacagatgttgagaccca

SEQ ID NO: 626979 - DNA, 25 bp, Mus musculus
gaaagctgacagttgttgagaccca

SEQ ID NO: 626980 - DNA, 25 bp, Mus musculus
gaaagctgagcaaggaatactggga

SEQ ID NO: 626981 - DNA, 25 bp, Mus musculus
gaaagctgagcatggaatactggga

SEQ ID NO: 626982 - DNA, 25 bp, Mus musculus
gaaagctgatgccagctcttcccag

SEQ ID NO: 626983 - DNA, 25 bp, Mus musculus
gaaagctgatgcgagctcttcccag

SEQ ID NO: 626984 - DNA, 25 bp, Mus musculus
gaaagctgcaacataacgtcttacg

SEQ ID NO: 626985 - DNA, 25 bp, Mus musculus
gaaagctgcaacttaacgtcttacg

SEQ ID NO: 626986 - DNA, 25 bp, Mus musculus
gaaagctgcgagaatgactccgggt

SEQ ID NO: 626987 - DNA, 25 bp, Mus musculus
gaaagctgcgagtatgactccgggt

SEQ ID NO: 626988 - DNA, 25 bp, Mus musculus
gaaagctgcggtcgcgtgcttcggg

SEQ ID NO: 626989 - DNA, 25 bp, Mus musculus
gaaagctgcggtggcgtgcttcggg

SEQ ID NO: 626990 - DNA, 25 bp, Mus musculus
gaaagctgctcaacacgggagaaaa

SEQ ID NO: 626991 - DNA, 25 bp, Mus musculus
gaaagctgctcatcacgggagaaaa

SEQ ID NO: 626992 - DNA, 25 bp, Mus musculus
gaaagctgcttcaggattcaacgca

SEQ ID NO: 626993 - DNA, 25 bp, Mus musculus
gaaagctgcttctggattcaacgca

SEQ ID NO: 626994 - DNA, 25 bp, Mus musculus
gaaagctggcagacatggacagcca

SEQ ID NO: 626995 - DNA, 25 bp, Mus musculus
gaaagctggcagtcatggacagcca

SEQ ID NO: 626996 - DNA, 25 bp, Mus musculus
gaaagctggcttatcggccacccaa

SEQ ID NO: 626997 - DNA, 25 bp, Mus musculus
gaaagctggcttttcggccacccaa

SEQ ID NO: 626998 - DNA, 25 bp, Mus musculus
gaaagctggtctacatcaaaaagaa

SEQ ID NO: 626999 - DNA, 25 bp, Mus musculus
gaaagctggtcttcatcaaaaagaa

SEQ ID NO: 627000 - DNA, 25 bp, Mus musculus
gaaagctgtgcacaattcctgcggc

SEQ ID NO: 627001 - DNA, 25 bp, Mus musculus
gaaagctgtgcagaattcctgcggc

SEQ ID NO: 627002 - DNA, 25 bp, Mus musculus
gaaagctgtgctcttgtacattatg

SEQ ID NO: 627003 - DNA, 25 bp, Mus musculus
gaaagctgtgctgttgtacattatg

SEQ ID NO: 627004 - DNA, 25 bp, Mus musculus
gaaagctgtgtccttgccagagcca

SEQ ID NO: 627005 - DNA, 25 bp, Mus musculus
gaaagctgtgtcgttgccagagcca

SEQ ID NO: 627006 - DNA, 25 bp, Mus musculus
gaaagctgtttccttatacctgacc

SEQ ID NO: 627007 - DNA, 25 bp, Mus musculus
gaaagctgtttcgttatacctgacc

SEQ ID NO: 627008 - DNA, 25 bp, Mus musculus
gaaagcttcaatattcactggacta

SEQ ID NO: 627009 - DNA, 25 bp, Mus musculus
gaaagcttcaattttcactggacta

SEQ ID NO: 627010 - DNA, 25 bp, Mus musculus
gaaagcttcagtctgcaatctacag

SEQ ID NO: 627011 - DNA, 25 bp, Mus musculus
gaaagcttcagtgtgcaatctacag

SEQ ID NO: 627012 - DNA, 25 bp, Mus musculus
gaaagcttccctcagggcacaaagg

SEQ ID NO: 627013 - DNA, 25 bp, Mus musculus
gaaagcttccctgagggcacaaagg

SEQ ID NO: 627014 - DNA, 25 bp, Mus musculus
gaaagcttcggaaaactcaggacgc

SEQ ID NO: 627015 - DNA, 25 bp, Mus musculus
gaaagcttcggataactcaggacgc

SEQ ID NO: 627016 - DNA, 25 bp, Mus musculus
gaaagcttctgaccaactaagggcg

SEQ ID NO: 627017 - DNA, 25 bp, Mus musculus
gaaagcttctgacccctcaagctct

SEQ ID NO: 627018 - DNA, 25 bp, Mus musculus
gaaagcttctgagcaactaagggcg

SEQ ID NO: 627019 - DNA, 25 bp, Mus musculus
gaaagcttctgagccctcaagctct

SEQ ID NO: 627020 - DNA, 25 bp, Mus musculus
gaaagctttctcaagtcccagtgac

SEQ ID NO: 627021 - DNA, 25 bp, Mus musculus
gaaagctttctctagtcccagtgac

SEQ ID NO: 627022 - DNA, 25 bp, Mus musculus
gaaagctttggaaatcattcagtgt

SEQ ID NO: 627023 - DNA, 25 bp, Mus musculus
gaaagctttggatatcattcagtgt

SEQ ID NO: 627024 - DNA, 25 bp, Mus musculus
gaaaggaaactgcattcaagccaac

SEQ ID NO: 627025 - DNA, 25 bp, Mus musculus
gaaaggaaactggattcaagccaac

SEQ ID NO: 627026 - DNA, 25 bp, Mus musculus
gaaaggaacacgctatactcatctt

SEQ ID NO: 627027 - DNA, 25 bp, Mus musculus
gaaaggaacacggtatactcatctt

SEQ ID NO: 627028 - DNA, 25 bp, Mus musculus
gaaaggaaccgaacaataccagagt

SEQ ID NO: 627029 - DNA, 25 bp, Mus musculus
gaaaggaaccgatcaataccagagt

SEQ ID NO: 627030 - DNA, 25 bp, Mus musculus
gaaaggaaccttacactcttgaggc

SEQ ID NO: 627031 - DNA, 25 bp, Mus musculus
gaaaggaacctttcactcttgaggc

SEQ ID NO: 627032 - DNA, 25 bp, Mus musculus
gaaaggaagaggatccacacacgac

SEQ ID NO: 627033 - DNA, 25 bp, Mus musculus
gaaaggaagaggttccacacacgac

SEQ ID NO: 627034 - DNA, 25 bp, Mus musculus
gaaaggaagatgaataccgaggccc

SEQ ID NO: 627035 - DNA, 25 bp, Mus musculus
gaaaggaagatgtataccgaggccc

SEQ ID NO: 627036 - DNA, 25 bp, Mus musculus
gaaaggaagcaaagatacaaacaga

SEQ ID NO: 627037 - DNA, 25 bp, Mus musculus
gaaaggaagcaatgatacaaacaga

SEQ ID NO: 627038 - DNA, 25 bp, Mus musculus
gaaaggaaggccatgcccgctaatc

SEQ ID NO: 627039 - DNA, 25 bp, Mus musculus
gaaaggaaggccttgcccgctaatc

SEQ ID NO: 627040 - DNA, 25 bp, Mus musculus
gaaaggaaggttaaggcaccagctc

SEQ ID NO: 627041 - DNA, 25 bp, Mus musculus
gaaaggaaggtttaggcaccagctc

SEQ ID NO: 627042 - DNA, 25 bp, Mus musculus
gaaaggacagagctcctgacatact

SEQ ID NO: 627043 - DNA, 25 bp, Mus musculus
gaaaggacagaggtcctgacatact

SEQ ID NO: 627044 - DNA, 25 bp, Mus musculus
gaaaggacagatagagaagcagccg

SEQ ID NO: 627045 - DNA, 25 bp, Mus musculus
gaaaggacagattgagaagcagccg

SEQ ID NO: 627046 - DNA, 25 bp, Mus musculus
gaaaggacatcaacccatcaaatct

SEQ ID NO: 627047 - DNA, 25 bp, Mus musculus
gaaaggacatcatcccatcaaatct

SEQ ID NO: 627048 - DNA, 25 bp, Mus musculus
gaaaggacatccatgcccagctgca

SEQ ID NO: 627049 - DNA, 25 bp, Mus musculus
gaaaggacatccttgcccagctgca

SEQ ID NO: 627050 - DNA, 25 bp, Mus musculus
gaaaggacctacaatgtggcagccg

SEQ ID NO: 627051 - DNA, 25 bp, Mus musculus
gaaaggacctactatgtggcagccg

SEQ ID NO: 627052 - DNA, 25 bp, Mus musculus
gaaaggacctccagtcaggttgtga

SEQ ID NO: 627053 - DNA, 25 bp, Mus musculus
gaaaggacctcctgtcaggttgtga

SEQ ID NO: 627054 - DNA, 25 bp, Mus musculus
gaaaggacctgtcaccacagttgca

SEQ ID NO: 627055 - DNA, 25 bp, Mus musculus
gaaaggacctgtgaccacagttgca

SEQ ID NO: 627056 - DNA, 25 bp, Mus musculus
gaaaggactactcgaatttgccacg

SEQ ID NO: 627057 - DNA, 25 bp, Mus musculus
gaaaggactactggaatttgccacg

SEQ ID NO: 627058 - DNA, 25 bp, Mus musculus
gaaaggactcccactaaggaccagg

SEQ ID NO: 627059 - DNA, 25 bp, Mus musculus
gaaaggactccctctaaggaccagg

SEQ ID NO: 627060 - DNA, 25 bp, Mus musculus
gaaaggactctgctgtgaacagcca

SEQ ID NO: 627061 - DNA, 25 bp, Mus musculus
gaaaggactctggtgtgaacagcca

SEQ ID NO: 627062 - DNA, 25 bp, Mus musculus
gaaaggactgtccttgccccaaggt

SEQ ID NO: 627063 - DNA, 25 bp, Mus musculus
gaaaggactgtcgttgccccaaggt

SEQ ID NO: 627064 - DNA, 25 bp, Mus musculus
gaaaggagatcacttcaagagtgac

SEQ ID NO: 627065 - DNA, 25 bp, Mus musculus
gaaaggagatcagttcaagagtgac

SEQ ID NO: 627066 - DNA, 25 bp, Mus musculus
gaaaggagatcccaccagagaggtt

SEQ ID NO: 627067 - DNA, 25 bp, Mus musculus
gaaaggagatccgaccagagaggtt

SEQ ID NO: 627068 - DNA, 25 bp, Mus musculus
gaaaggagcatgagccaaccacgtc

SEQ ID NO: 627069 - DNA, 25 bp, Mus musculus
gaaaggagcatgtgccaaccacgtc

SEQ ID NO: 627070 - DNA, 25 bp, Mus musculus
gaaaggagccccattatataggccc

SEQ ID NO: 627071 - DNA, 25 bp, Mus musculus
gaaaggagcccctttatataggccc

SEQ ID NO: 627072 - DNA, 25 bp, Mus musculus
gaaaggagctcgctattggtgtccc

SEQ ID NO: 627073 - DNA, 25 bp, Mus musculus
gaaaggagctcggtattggtgtccc

SEQ ID NO: 627074 - DNA, 25 bp, Mus musculus
gaaaggaggcaacacatctcagtct

SEQ ID NO: 627075 - DNA, 25 bp, Mus musculus
gaaaggaggcaagacatctcagtct

SEQ ID NO: 627076 - DNA, 25 bp, Mus musculus
gaaaggataactcacaagagtcttg

SEQ ID NO: 627077 - DNA, 25 bp, Mus musculus
gaaaggataactgacaagagtcttg

SEQ ID NO: 627078 - DNA, 25 bp, Mus musculus
gaaaggatcatcaatcttcgtcact

SEQ ID NO: 627079 - DNA, 25 bp, Mus musculus
gaaaggatcatctatcttcgtcact

SEQ ID NO: 627080 - DNA, 25 bp, Mus musculus
gaaaggatcatgcaacctccagtgg

SEQ ID NO: 627081 - DNA, 25 bp, Mus musculus
gaaaggatcatggaacctccagtgg

SEQ ID NO: 627082 - DNA, 25 bp, Mus musculus
gaaaggatccccagtgcagttgggc

SEQ ID NO: 627083 - DNA, 25 bp, Mus musculus
gaaaggatcccctgtgcagttgggc

SEQ ID NO: 627084 - DNA, 25 bp, Mus musculus
gaaaggatgctacctggctgctatc

SEQ ID NO: 627085 - DNA, 25 bp, Mus musculus
gaaaggatgctagctggctgctatc

SEQ ID NO: 627086 - DNA, 25 bp, Mus musculus
gaaaggatgtgcctaccttttgata

SEQ ID NO: 627087 - DNA, 25 bp, Mus musculus
gaaaggatgtgcgtaccttttgata

SEQ ID NO: 627088 - DNA, 25 bp, Mus musculus
gaaaggattactacagtccgttgga

SEQ ID NO: 627089 - DNA, 25 bp, Mus musculus
gaaaggattacttcagtccgttgga

SEQ ID NO: 627090 - DNA, 25 bp, Mus musculus
gaaaggattatgagtgacaagagga

SEQ ID NO: 627091 - DNA, 25 bp, Mus musculus
gaaaggattatgtgtgacaagagga

SEQ ID NO: 627092 - DNA, 25 bp, Mus musculus
gaaaggattccgcagttacgtggat

SEQ ID NO: 627093 - DNA, 25 bp, Mus musculus
gaaaggattccggagttacgtggat

SEQ ID NO: 627094 - DNA, 25 bp, Mus musculus
gaaaggattcgcatcaaattcggtg

SEQ ID NO: 627095 - DNA, 25 bp, Mus musculus
gaaaggattcgcttcaaattcggtg

SEQ ID NO: 627096 - DNA, 25 bp, Mus musculus
gaaaggattctgacagtctaggacc

SEQ ID NO: 627097 - DNA, 25 bp, Mus musculus
gaaaggattctgtcagtctaggacc

SEQ ID NO: 627098 - DNA, 25 bp, Mus musculus
gaaaggattgaacagttccagagca

SEQ ID NO: 627099 - DNA, 25 bp, Mus musculus
gaaaggattgaagagttccagagca

SEQ ID NO: 627100 - DNA, 25 bp, Mus musculus
gaaaggattggactcaccagggcat

SEQ ID NO: 627101 - DNA, 25 bp, Mus musculus
gaaaggattggagtcaccagggcat

SEQ ID NO: 627102 - DNA, 25 bp, Mus musculus
gaaaggattggcaatcctgatgaca

SEQ ID NO: 627103 - DNA, 25 bp, Mus musculus
gaaaggattggctatcctgatgaca

SEQ ID NO: 627104 - DNA, 25 bp, Mus musculus
gaaaggatttcacaagacccaatgg

SEQ ID NO: 627105 - DNA, 25 bp, Mus musculus
gaaaggatttcagaagacccaatgg

SEQ ID NO: 627106 - DNA, 25 bp, Mus musculus
gaaaggatttctacagccaaggcaa

SEQ ID NO: 627107 - DNA, 25 bp, Mus musculus
gaaaggatttcttcagccaaggcaa

SEQ ID NO: 627108 - DNA, 25 bp, Mus musculus
gaaaggatttggaggcgccatgaca

SEQ ID NO: 627109 - DNA, 25 bp, Mus musculus
gaaaggatttggtggcgccatgaca

SEQ ID NO: 627110 - DNA, 25 bp, Mus musculus
gaaaggcaaagaataaaacggatgc

SEQ ID NO: 627111 - DNA, 25 bp, Mus musculus
gaaaggcaaagattaaaacggatgc

SEQ ID NO: 627112 - DNA, 25 bp, Mus musculus
gaaaggcaactcatgtaatgaagaa

SEQ ID NO: 627113 - DNA, 25 bp, Mus musculus
gaaaggcaactcttgtaatgaagaa

SEQ ID NO: 627114 - DNA, 25 bp, Mus musculus
gaaaggcacatacaaatgactcttc

SEQ ID NO: 627115 - DNA, 25 bp, Mus musculus
gaaaggcacatagaaatgactcttc

SEQ ID NO: 627116 - DNA, 25 bp, Mus musculus
gaaaggcaccacctggaatttggga

SEQ ID NO: 627117 - DNA, 25 bp, Mus musculus
gaaaggcaccacgtggaatttggga

SEQ ID NO: 627118 - DNA, 25 bp, Mus musculus
gaaaggcactatcgttcctggctat

SEQ ID NO: 627119 - DNA, 25 bp, Mus musculus
gaaaggcactatggttcctggctat

SEQ ID NO: 627120 - DNA, 25 bp, Mus musculus
gaaaggcactgcaaatccatgtctg

SEQ ID NO: 627121 - DNA, 25 bp, Mus musculus
gaaaggcactgctaatccatgtctg

SEQ ID NO: 627122 - DNA, 25 bp, Mus musculus
gaaaggcagcctcaagaagtgctct

SEQ ID NO: 627123 - DNA, 25 bp, Mus musculus
gaaaggcagcctgaagaagtgctct

SEQ ID NO: 627124 - DNA, 25 bp, Mus musculus
gaaaggcagcttacttgctgatggg

SEQ ID NO: 627125 - DNA, 25 bp, Mus musculus
gaaaggcagctttcttgctgatggg

SEQ ID NO: 627126 - DNA, 25 bp, Mus musculus
gaaaggcaggaacaggtctctcact

SEQ ID NO: 627127 - DNA, 25 bp, Mus musculus
gaaaggcaggaagaggtctctcact

SEQ ID NO: 627128 - DNA, 25 bp, Mus musculus
gaaaggcaggcgatgatggcaaacc

SEQ ID NO: 627129 - DNA, 25 bp, Mus musculus
gaaaggcaggcgttgatggcaaacc

SEQ ID NO: 627130 - DNA, 25 bp, Mus musculus
gaaaggcatctgacccaagcaggag

SEQ ID NO: 627131 - DNA, 25 bp, Mus musculus
gaaaggcatctgtcccaagcaggag

SEQ ID NO: 627132 - DNA, 25 bp, Mus musculus
gaaaggccacaaaaccggagagcag

SEQ ID NO: 627133 - DNA, 25 bp, Mus musculus
gaaaggccacaataccggagagcag

SEQ ID NO: 627134 - DNA, 25 bp, Mus musculus
gaaaggccataaaatttctgaagga

SEQ ID NO: 627135 - DNA, 25 bp, Mus musculus
gaaaggccataatatttctgaagga

SEQ ID NO: 627136 - DNA, 25 bp, Mus musculus
gaaaggcccgctaaccatttctgca

SEQ ID NO: 627137 - DNA, 25 bp, Mus musculus
gaaaggcccgcttaccatttctgca

SEQ ID NO: 627138 - DNA, 25 bp, Mus musculus
gaaaggccgccgaggccagttcatc

SEQ ID NO: 627139 - DNA, 25 bp, Mus musculus
gaaaggccgccgtggccagttcatc

SEQ ID NO: 627140 - DNA, 25 bp, Mus musculus
gaaaggccggttcatacttgcctgg

SEQ ID NO: 627141 - DNA, 25 bp, Mus musculus
gaaaggccggttgatacttgcctgg

SEQ ID NO: 627142 - DNA, 25 bp, Mus musculus
gaaaggcctactcgcaggtgcacat

SEQ ID NO: 627143 - DNA, 25 bp, Mus musculus
gaaaggcctactggcaggtgcacat

SEQ ID NO: 627144 - DNA, 25 bp, Mus musculus
gaaaggcctatactgggccaaaatg

SEQ ID NO: 627145 - DNA, 25 bp, Mus musculus
gaaaggcctatagtgggccaaaatg

SEQ ID NO: 627146 - DNA, 25 bp, Mus musculus
gaaaggcctcataatccatggagca

SEQ ID NO: 627147 - DNA, 25 bp, Mus musculus
gaaaggcctcattatccatggagca

SEQ ID NO: 627148 - DNA, 25 bp, Mus musculus
gaaaggcctcttccgccaagggatg

SEQ ID NO: 627149 - DNA, 25 bp, Mus musculus
gaaaggcctcttgcgccaagggatg

SEQ ID NO: 627150 - DNA, 25 bp, Mus musculus
gaaaggccttatctctgtgagttct

SEQ ID NO: 627151 - DNA, 25 bp, Mus musculus
gaaaggccttatgtctgtgagttct

SEQ ID NO: 627152 - DNA, 25 bp, Mus musculus
gaaaggcctttacccaatgttcaag

SEQ ID NO: 627153 - DNA, 25 bp, Mus musculus
gaaaggcctttagccaatgttcaag

SEQ ID NO: 627154 - DNA, 25 bp, Mus musculus
gaaaggcgactaatcagacgctcct

SEQ ID NO: 627155 - DNA, 25 bp, Mus musculus
gaaaggcgactattcagacgctcct

SEQ ID NO: 627156 - DNA, 25 bp, Mus musculus
gaaaggcgagatctgccatttatta

SEQ ID NO: 627157 - DNA, 25 bp, Mus musculus
gaaaggcgagatgtgccatttatta

SEQ ID NO: 627158 - DNA, 25 bp, Mus musculus
gaaaggcgagggatactcaaaccca

SEQ ID NO: 627159 - DNA, 25 bp, Mus musculus
gaaaggcgagggttactcaaaccca

SEQ ID NO: 627160 - DNA, 25 bp, Mus musculus
gaaaggcgatgcattactagtgcgc

SEQ ID NO: 627161 - DNA, 25 bp, Mus musculus
gaaaggcgatgctttactagtgcgc

SEQ ID NO: 627162 - DNA, 25 bp, Mus musculus
gaaaggcgggaacaacaagttgatc

SEQ ID NO: 627163 - DNA, 25 bp, Mus musculus
gaaaggcgggaagaacaagttgatc

SEQ ID NO: 627164 - DNA, 25 bp, Mus musculus
gaaaggcgggtcaatgcacatgtac

SEQ ID NO: 627165 - DNA, 25 bp, Mus musculus
gaaaggcgggtctatgcacatgtac

SEQ ID NO: 627166 - DNA, 25 bp, Mus musculus
gaaaggcggtggagacctgtctgaa

SEQ ID NO: 627167 - DNA, 25 bp, Mus musculus
gaaaggcggtggtgacctgtctgaa

SEQ ID NO: 627168 - DNA, 25 bp, Mus musculus
gaaaggcggtgtcctggtctactaa

SEQ ID NO: 627169 - DNA, 25 bp, Mus musculus
gaaaggcggtgtgctggtctactaa

SEQ ID NO: 627170 - DNA, 25 bp, Mus musculus
gaaaggcgtggcaaaggttgaccat

SEQ ID NO: 627171 - DNA, 25 bp, Mus musculus
gaaaggcgtggctaaggttgaccat

SEQ ID NO: 627172 - DNA, 25 bp, Mus musculus
gaaaggctactcaggcttcatcacc

SEQ ID NO: 627173 - DNA, 25 bp, Mus musculus
gaaaggctactctggcttcatcacc

SEQ ID NO: 627174 - DNA, 25 bp, Mus musculus
gaaaggctatgcactactcattgac

SEQ ID NO: 627175 - DNA, 25 bp, Mus musculus
gaaaggctatgctctactcattgac

SEQ ID NO: 627176 - DNA, 25 bp, Mus musculus
gaaaggctatggactgcacagcccg

SEQ ID NO: 627177 - DNA, 25 bp, Mus musculus
gaaaggctatggtctgcacagcccg

SEQ ID NO: 627178 - DNA, 25 bp, Mus musculus
gaaaggctcattcggactatatgct

SEQ ID NO: 627179 - DNA, 25 bp, Mus musculus
gaaaggctcattgggactatatgct

SEQ ID NO: 627180 - DNA, 25 bp, Mus musculus
gaaaggctccgtccatgcatgcaaa

SEQ ID NO: 627181 - DNA, 25 bp, Mus musculus
gaaaggctccgtgcatgcatgcaaa

SEQ ID NO: 627182 - DNA, 25 bp, Mus musculus
gaaaggctgccaataagaatcgggc

SEQ ID NO: 627183 - DNA, 25 bp, Mus musculus
gaaaggctgccattaagaatcgggc

SEQ ID NO: 627184 - DNA, 25 bp, Mus musculus
gaaaggcttcacatccatctcaaga

SEQ ID NO: 627185 - DNA, 25 bp, Mus musculus
gaaaggcttcacttccatctcaaga

SEQ ID NO: 627186 - DNA, 25 bp, Mus musculus
gaaaggcttcctactcggctgtgag

SEQ ID NO: 627187 - DNA, 25 bp, Mus musculus
gaaaggcttccttctcggctgtgag

SEQ ID NO: 627188 - DNA, 25 bp, Mus musculus
gaaaggctttcccagatggctcata

SEQ ID NO: 627189 - DNA, 25 bp, Mus musculus
gaaaggctttccgagatggctcata

SEQ ID NO: 627190 - DNA, 25 bp, Mus musculus
gaaaggcttttgacgaaagggcagc

SEQ ID NO: 627191 - DNA, 25 bp, Mus musculus
gaaaggcttttgtcgaaagggcagc

SEQ ID NO: 627192 - DNA, 25 bp, Mus musculus
gaaagggaaccacaaatgcgcctag

SEQ ID NO: 627193 - DNA, 25 bp, Mus musculus
gaaagggaaccagaaatgcgcctag

SEQ ID NO: 627194 - DNA, 25 bp, Mus musculus
gaaagggaacgaatccacgctaagg

SEQ ID NO: 627195 - DNA, 25 bp, Mus musculus
gaaagggaacgattccacgctaagg

SEQ ID NO: 627196 - DNA, 25 bp, Mus musculus
gaaagggaagatattccacatcgac

SEQ ID NO: 627197 - DNA, 25 bp, Mus musculus
gaaagggaagattttccacatcgac

SEQ ID NO: 627198 - DNA, 25 bp, Mus musculus
gaaagggacccgatcctctgtccga

SEQ ID NO: 627199 - DNA, 25 bp, Mus musculus
gaaagggacccgttcctctgtccga

SEQ ID NO: 627200 - DNA, 25 bp, Mus musculus
gaaagggacctgactctagagcaaa

SEQ ID NO: 627201 - DNA, 25 bp, Mus musculus
gaaagggacctgtctctagagcaaa

SEQ ID NO: 627202 - DNA, 25 bp, Mus musculus
gaaagggactccagaaccagggcct

SEQ ID NO: 627203 - DNA, 25 bp, Mus musculus
gaaagggactcctgaaccagggcct

SEQ ID NO: 627204 - DNA, 25 bp, Mus musculus
gaaagggactcgcttttctgaaagc

SEQ ID NO: 627205 - DNA, 25 bp, Mus musculus
gaaagggactcggttttctgaaagc

SEQ ID NO: 627206 - DNA, 25 bp, Mus musculus
gaaagggagaccctgcagactcatc

SEQ ID NO: 627207 - DNA, 25 bp, Mus musculus
gaaagggagaccgtgcagactcatc

SEQ ID NO: 627208 - DNA, 25 bp, Mus musculus
gaaagggagactctcaaagaactac

SEQ ID NO: 627209 - DNA, 25 bp, Mus musculus
gaaagggagactgtcaaagaactac

SEQ ID NO: 627210 - DNA, 25 bp, Mus musculus
gaaagggagattatatgacctgtac

SEQ ID NO: 627211 - DNA, 25 bp, Mus musculus
gaaagggagattttatgacctgtac

SEQ ID NO: 627212 - DNA, 25 bp, Mus musculus
gaaagggagtgacccacatcagagt

SEQ ID NO: 627213 - DNA, 25 bp, Mus musculus
gaaagggagtgagccacatcagagt

SEQ ID NO: 627214 - DNA, 25 bp, Mus musculus
gaaagggcaaaacagtggaagagac

SEQ ID NO: 627215 - DNA, 25 bp, Mus musculus
gaaagggcaaaagagtggaagagac

SEQ ID NO: 627216 - DNA, 25 bp, Mus musculus
gaaagggcaagaacgcgcagactta

SEQ ID NO: 627217 - DNA, 25 bp, Mus musculus
gaaagggcaagatcgcgcagactta

SEQ ID NO: 627218 - DNA, 25 bp, Mus musculus
gaaagggcacccagtgcgagaagat

SEQ ID NO: 627219 - DNA, 25 bp, Mus musculus
gaaagggcaccctgtgcgagaagat

SEQ ID NO: 627220 - DNA, 25 bp, Mus musculus
gaaagggcagctcgacaccgatcct

SEQ ID NO: 627221 - DNA, 25 bp, Mus musculus
gaaagggcagctggacaccgatcct

SEQ ID NO: 627222 - DNA, 25 bp, Mus musculus
gaaagggcagtgacttcaagacgga

SEQ ID NO: 627223 - DNA, 25 bp, Mus musculus
gaaagggcagtgtcttcaagacgga

SEQ ID NO: 627224 - DNA, 25 bp, Mus musculus
gaaagggccaacaggagttgcagca

SEQ ID NO: 627225 - DNA, 25 bp, Mus musculus
gaaagggccaactggagttgcagca

SEQ ID NO: 627226 - DNA, 25 bp, Mus musculus
gaaagggcgataccgcctacctctc

SEQ ID NO: 627227 - DNA, 25 bp, Mus musculus
gaaagggcgatagcgcctacctctc

SEQ ID NO: 627228 - DNA, 25 bp, Mus musculus
gaaagggctcaacgtcagaagcgcc

SEQ ID NO: 627229 - DNA, 25 bp, Mus musculus
gaaagggctcaaggtcagaagcgcc

SEQ ID NO: 627230 - DNA, 25 bp, Mus musculus
gaaagggcttagaccagtgcctgac

SEQ ID NO: 627231 - DNA, 25 bp, Mus musculus
gaaagggcttagtccagtgcctgac

SEQ ID NO: 627232 - DNA, 25 bp, Mus musculus
gaaaggggaccacgtcaaacattat

SEQ ID NO: 627233 - DNA, 25 bp, Mus musculus
gaaaggggaccaggtcaaacattat

SEQ ID NO: 627234 - DNA, 25 bp, Mus musculus
gaaagggtattcactaaccacctca

SEQ ID NO: 627235 - DNA, 25 bp, Mus musculus
gaaagggtattctctaaccacctca

SEQ ID NO: 627236 - DNA, 25 bp, Mus musculus
gaaagggtccttctcggaagtgaca

SEQ ID NO: 627237 - DNA, 25 bp, Mus musculus
gaaagggtccttgtcggaagtgaca

SEQ ID NO: 627238 - DNA, 25 bp, Mus musculus
gaaagggtgacgaaacgctgctgac

SEQ ID NO: 627239 - DNA, 25 bp, Mus musculus
gaaagggtgacgtaacgctgctgac

SEQ ID NO: 627240 - DNA, 25 bp, Mus musculus
gaaagggtgtcaaacagtcagtgcc

SEQ ID NO: 627241 - DNA, 25 bp, Mus musculus
gaaagggtgtcatacagtcagtgcc

SEQ ID NO: 627242 - DNA, 25 bp, Mus musculus
gaaagggttctgctatgtcttcaaa

SEQ ID NO: 627243 - DNA, 25 bp, Mus musculus
gaaagggttctggtatgtcttcaaa

SEQ ID NO: 627244 - DNA, 25 bp, Mus musculus
gaaagggttggcagtcccctgaaga

SEQ ID NO: 627245 - DNA, 25 bp, Mus musculus
gaaagggttggctgtcccctgaaga

SEQ ID NO: 627246 - DNA, 25 bp, Mus musculus
gaaaggtcaattaacagcgcaagat

SEQ ID NO: 627247 - DNA, 25 bp, Mus musculus
gaaaggtcaatttacagcgcaagat

SEQ ID NO: 627248 - DNA, 25 bp, Mus musculus
gaaaggtcacagctggagtaccaaa

SEQ ID NO: 627249 - DNA, 25 bp, Mus musculus
gaaaggtcacaggtggagtaccaaa

SEQ ID NO: 627250 - DNA, 25 bp, Mus musculus
gaaaggtcacctctcaggctctcct

SEQ ID NO: 627251 - DNA, 25 bp, Mus musculus
gaaaggtcacctgtcaggctctcct

SEQ ID NO: 627252 - DNA, 25 bp, Mus musculus
gaaaggtcccctctatctttgagcc

SEQ ID NO: 627253 - DNA, 25 bp, Mus musculus
gaaaggtcccctgtatctttgagcc

SEQ ID NO: 627254 - DNA, 25 bp, Mus musculus
gaaaggtcgcctagtgcaaacgcaa

SEQ ID NO: 627255 - DNA, 25 bp, Mus musculus
gaaaggtcgccttgtgcaaacgcaa

SEQ ID NO: 627256 - DNA, 25 bp, Mus musculus
gaaaggtctagcacccgaggtggcc

SEQ ID NO: 627257 - DNA, 25 bp, Mus musculus
gaaaggtctagctcccgaggtggcc

SEQ ID NO: 627258 - DNA, 25 bp, Mus musculus
gaaaggtgaccccaaacttcgaatg

SEQ ID NO: 627259 - DNA, 25 bp, Mus musculus
gaaaggtgacccgaaacttcgaatg

SEQ ID NO: 627260 - DNA, 25 bp, Mus musculus
gaaaggtgcagacttacacgtgcca

SEQ ID NO: 627261 - DNA, 25 bp, Mus musculus
gaaaggtgcagagttacacgtgcca

SEQ ID NO: 627262 - DNA, 25 bp, Mus musculus
gaaaggtgcccgacagaggaagatc

SEQ ID NO: 627263 - DNA, 25 bp, Mus musculus
gaaaggtgcccgtcagaggaagatc

SEQ ID NO: 627264 - DNA, 25 bp, Mus musculus
gaaaggtgcgctatcccttttgatt

SEQ ID NO: 627265 - DNA, 25 bp, Mus musculus
gaaaggtgcgctttcccttttgatt

SEQ ID NO: 627266 - DNA, 25 bp, Mus musculus
gaaaggtgctctagccaatcttcaa

SEQ ID NO: 627267 - DNA, 25 bp, Mus musculus
gaaaggtgctcttgccaatcttcaa

SEQ ID NO: 627268 - DNA, 25 bp, Mus musculus
gaaaggtggcccacaccatcaaggg

SEQ ID NO: 627269 - DNA, 25 bp, Mus musculus
gaaaggtggccctcaccatcaaggg

SEQ ID NO: 627270 - DNA, 25 bp, Mus musculus
gaaaggtgtactaccacactgatgc

SEQ ID NO: 627271 - DNA, 25 bp, Mus musculus
gaaaggtgtacttccacactgatgc

SEQ ID NO: 627272 - DNA, 25 bp, Mus musculus
gaaaggtgtcaaataatgagttcct

SEQ ID NO: 627273 - DNA, 25 bp, Mus musculus
gaaaggtgtcaattaatgagttcct

SEQ ID NO: 627274 - DNA, 25 bp, Mus musculus
gaaaggttatccacattggccagct

SEQ ID NO: 627275 - DNA, 25 bp, Mus musculus
gaaaggttatcctcattggccagct

SEQ ID NO: 627276 - DNA, 25 bp, Mus musculus
gaaaggttgactctggctcccaaag

SEQ ID NO: 627277 - DNA, 25 bp, Mus musculus
gaaaggttgactgtggctcccaaag

SEQ ID NO: 627278 - DNA, 25 bp, Mus musculus
gaaaggttgctacggtatcatacag

SEQ ID NO: 627279 - DNA, 25 bp, Mus musculus
gaaaggttgctagggtatcatacag

SEQ ID NO: 627280 - DNA, 25 bp, Mus musculus
gaaaggttgctgctctccctggacc

SEQ ID NO: 627281 - DNA, 25 bp, Mus musculus
gaaaggttgctggtctccctggacc

SEQ ID NO: 627282 - DNA, 25 bp, Mus musculus
gaaagtaaaacaacagcagctaaag

SEQ ID NO: 627283 - DNA, 25 bp, Mus musculus
gaaagtaaaacatcagcagctaaag

SEQ ID NO: 627284 - DNA, 25 bp, Mus musculus
gaaagtaacccgcttgtctcatgcc

SEQ ID NO: 627285 - DNA, 25 bp, Mus musculus
gaaagtaacccggttgtctcatgcc

SEQ ID NO: 627286 - DNA, 25 bp, Mus musculus
gaaagtaagaggcatccagatgctc

SEQ ID NO: 627287 - DNA, 25 bp, Mus musculus
gaaagtaagagggatccagatgctc

SEQ ID NO: 627288 - DNA, 25 bp, Mus musculus
gaaagtacaaagagttgccgacaga

SEQ ID NO: 627289 - DNA, 25 bp, Mus musculus
gaaagtacaaagtgttgccgacaga

SEQ ID NO: 627290 - DNA, 25 bp, Mus musculus
gaaagtacactcagctgtttgacac

SEQ ID NO: 627291 - DNA, 25 bp, Mus musculus
gaaagtacactctgctgtttgacac

SEQ ID NO: 627292 - DNA, 25 bp, Mus musculus
gaaagtaccgctaccactgagacag

SEQ ID NO: 627293 - DNA, 25 bp, Mus musculus
gaaagtaccgcttccactgagacag

SEQ ID NO: 627294 - DNA, 25 bp, Mus musculus
gaaagtacctcaagtgcgggggcat

SEQ ID NO: 627295 - DNA, 25 bp, Mus musculus
gaaagtacctcatgtgcgggggcat

SEQ ID NO: 627296 - DNA, 25 bp, Mus musculus
gaaagtacttcgagggcttcggaga

SEQ ID NO: 627297 - DNA, 25 bp, Mus musculus
gaaagtacttcgtgggcttcggaga

SEQ ID NO: 627298 - DNA, 25 bp, Mus musculus
gaaagtactttcacagccgagacta

SEQ ID NO: 627299 - DNA, 25 bp, Mus musculus
gaaagtactttctcagccgagacta

SEQ ID NO: 627300 - DNA, 25 bp, Mus musculus
gaaagtagatgtaagttcttcaaca

SEQ ID NO: 627301 - DNA, 25 bp, Mus musculus
gaaagtagatgttagttcttcaaca

SEQ ID NO: 627302 - DNA, 25 bp, Mus musculus
gaaagtagcagtcagagttcctctg

SEQ ID NO: 627303 - DNA, 25 bp, Mus musculus
gaaagtagcagtgagagttcctctg

SEQ ID NO: 627304 - DNA, 25 bp, Mus musculus
gaaagtagcatccatgccacaagag

SEQ ID NO: 627305 - DNA, 25 bp, Mus musculus
gaaagtagcatcgatgccacaagag

SEQ ID NO: 627306 - DNA, 25 bp, Mus musculus
gaaagtaggtgcatctaagccccgg

SEQ ID NO: 627307 - DNA, 25 bp, Mus musculus
gaaagtaggtgcttctaagccccgg

SEQ ID NO: 627308 - DNA, 25 bp, Mus musculus
gaaagtagtagactacacaacagca

SEQ ID NO: 627309 - DNA, 25 bp, Mus musculus
gaaagtagtagagtacacaacagca

SEQ ID NO: 627310 - DNA, 25 bp, Mus musculus
gaaagtatgatccagcgctcagcct

SEQ ID NO: 627311 - DNA, 25 bp, Mus musculus
gaaagtatgatcgagcgctcagcct

SEQ ID NO: 627312 - DNA, 25 bp, Mus musculus
gaaagtatggttaccccaggtctga

SEQ ID NO: 627313 - DNA, 25 bp, Mus musculus
gaaagtatggtttccccaggtctga

SEQ ID NO: 627314 - DNA, 25 bp, Mus musculus
gaaagtcaaaccagctgaggcggag

SEQ ID NO: 627315 - DNA, 25 bp, Mus musculus
gaaagtcaaacctgctgaggcggag

SEQ ID NO: 627316 - DNA, 25 bp, Mus musculus
gaaagtcaaccaaggttgctcagtc

SEQ ID NO: 627317 - DNA, 25 bp, Mus musculus
gaaagtcaaccatggttgctcagtc

SEQ ID NO: 627318 - DNA, 25 bp, Mus musculus
gaaagtcaacgaaagccaaatactg

SEQ ID NO: 627319 - DNA, 25 bp, Mus musculus
gaaagtcaacgatagccaaatactg

SEQ ID NO: 627320 - DNA, 25 bp, Mus musculus
gaaagtcacaatcgtgaatgctgac

SEQ ID NO: 627321 - DNA, 25 bp, Mus musculus
gaaagtcacaatggtgaatgctgac

SEQ ID NO: 627322 - DNA, 25 bp, Mus musculus
gaaagtcacaccaccctgaaatacg

SEQ ID NO: 627323 - DNA, 25 bp, Mus musculus
gaaagtcacacctccctgaaatacg

SEQ ID NO: 627324 - DNA, 25 bp, Mus musculus
gaaagtcactccacagtctgatggc

SEQ ID NO: 627325 - DNA, 25 bp, Mus musculus
gaaagtcactcctcagtctgatggc

SEQ ID NO: 627326 - DNA, 25 bp, Mus musculus
gaaagtcactgaccccagcatccta

SEQ ID NO: 627327 - DNA, 25 bp, Mus musculus
gaaagtcactgagcccagcatccta

SEQ ID NO: 627328 - DNA, 25 bp, Mus musculus
gaaagtcactggatttacacaaggc

SEQ ID NO: 627329 - DNA, 25 bp, Mus musculus
gaaagtcactggttttacacaaggc

SEQ ID NO: 627330 - DNA, 25 bp, Mus musculus
gaaagtcataaaccaagtactagca

SEQ ID NO: 627331 - DNA, 25 bp, Mus musculus
gaaagtcataaagcaagtactagca

SEQ ID NO: 627332 - DNA, 25 bp, Mus musculus
gaaagtcatctcagccaagagccat

SEQ ID NO: 627333 - DNA, 25 bp, Mus musculus
gaaagtcatctctgccaagagccat

SEQ ID NO: 627334 - DNA, 25 bp, Mus musculus
gaaagtcatgcccttcgctaatctc

SEQ ID NO: 627335 - DNA, 25 bp, Mus musculus
gaaagtcatgccgttcgctaatctc

SEQ ID NO: 627336 - DNA, 25 bp, Mus musculus
gaaagtcatggaagctcccctcttg

SEQ ID NO: 627337 - DNA, 25 bp, Mus musculus
gaaagtcatggatgctcccctcttg

SEQ ID NO: 627338 - DNA, 25 bp, Mus musculus
gaaagtcattacagtgccacacaag

SEQ ID NO: 627339 - DNA, 25 bp, Mus musculus
gaaagtcattactgtgccacacaag

SEQ ID NO: 627340 - DNA, 25 bp, Mus musculus
gaaagtcattgaaagccgagcccaa

SEQ ID NO: 627341 - DNA, 25 bp, Mus musculus
gaaagtcattgatagccgagcccaa

SEQ ID NO: 627342 - DNA, 25 bp, Mus musculus
gaaagtcctcgaagacctgaataaa

SEQ ID NO: 627343 - DNA, 25 bp, Mus musculus
gaaagtcctcgatgacctgaataaa

SEQ ID NO: 627344 - DNA, 25 bp, Mus musculus
gaaagtcctgccatctccttaggtt

SEQ ID NO: 627345 - DNA, 25 bp, Mus musculus
gaaagtcctgccttctccttaggtt

SEQ ID NO: 627346 - DNA, 25 bp, Mus musculus
gaaagtcctgctagtctaaagagag

SEQ ID NO: 627347 - DNA, 25 bp, Mus musculus
gaaagtcctgcttgtctaaagagag

SEQ ID NO: 627348 - DNA, 25 bp, Mus musculus
gaaagtccttgaagcactgcattcc

SEQ ID NO: 627349 - DNA, 25 bp, Mus musculus
gaaagtccttgatgcactgcattcc

SEQ ID NO: 627350 - DNA, 25 bp, Mus musculus
gaaagtcgaagccagcaaagtacct

SEQ ID NO: 627351 - DNA, 25 bp, Mus musculus
gaaagtcgaagcgagcaaagtacct

SEQ ID NO: 627352 - DNA, 25 bp, Mus musculus
gaaagtcgctcgcttggacaacatc

SEQ ID NO: 627353 - DNA, 25 bp, Mus musculus
gaaagtcgctcggttggacaacatc

SEQ ID NO: 627354 - DNA, 25 bp, Mus musculus
gaaagtcggcttcatctacataatg

SEQ ID NO: 627355 - DNA, 25 bp, Mus musculus
gaaagtcggcttgatctacataatg

SEQ ID NO: 627356 - DNA, 25 bp, Mus musculus
gaaagtcgttccacgaacacgcaag

SEQ ID NO: 627357 - DNA, 25 bp, Mus musculus
gaaagtcgttcctcgaacacgcaag

SEQ ID NO: 627358 - DNA, 25 bp, Mus musculus
gaaagtctaactccaagtcaaaagc

SEQ ID NO: 627359 - DNA, 25 bp, Mus musculus
gaaagtctaactgcaagtcaaaagc

SEQ ID NO: 627360 - DNA, 25 bp, Mus musculus
gaaagtctcgtcagagggatctcac

SEQ ID NO: 627361 - DNA, 25 bp, Mus musculus
gaaagtctcgtctgagggatctcac

SEQ ID NO: 627362 - DNA, 25 bp, Mus musculus
gaaagtctggataggaatcaagaag

SEQ ID NO: 627363 - DNA, 25 bp, Mus musculus
gaaagtctggattggaatcaagaag

SEQ ID NO: 627364 - DNA, 25 bp, Mus musculus
gaaagtctggccattaccttggcca

SEQ ID NO: 627365 - DNA, 25 bp, Mus musculus
gaaagtctggcctttaccttggcca

SEQ ID NO: 627366 - DNA, 25 bp, Mus musculus
gaaagtctgtgtatttacaggcaag

SEQ ID NO: 627367 - DNA, 25 bp, Mus musculus
gaaagtctgtgtttttacaggcaag

SEQ ID NO: 627368 - DNA, 25 bp, Mus musculus
gaaagtgaacaacttcccaccattg

SEQ ID NO: 627369 - DNA, 25 bp, Mus musculus
gaaagtgaacaagttcccaccattg

SEQ ID NO: 627370 - DNA, 25 bp, Mus musculus
gaaagtgaactgaaactattttggt

SEQ ID NO: 627371 - DNA, 25 bp, Mus musculus
gaaagtgaactgtaactattttggt

SEQ ID NO: 627372 - DNA, 25 bp, Mus musculus
gaaagtgaagcactatgaactgacc

SEQ ID NO: 627373 - DNA, 25 bp, Mus musculus
gaaagtgaagcagtatgaactgacc

SEQ ID NO: 627374 - DNA, 25 bp, Mus musculus
gaaagtgaaggtcttccgggccgcg

SEQ ID NO: 627375 - DNA, 25 bp, Mus musculus
gaaagtgaaggtgttccgggccgcg

SEQ ID NO: 627376 - DNA, 25 bp, Mus musculus
gaaagtgacgttccagaggagttcc

SEQ ID NO: 627377 - DNA, 25 bp, Mus musculus
gaaagtgacgttgcagaggagttcc

SEQ ID NO: 627378 - DNA, 25 bp, Mus musculus
gaaagtgagaccaacgtcctgcaag

SEQ ID NO: 627379 - DNA, 25 bp, Mus musculus
gaaagtgagacctacgtcctgcaag

SEQ ID NO: 627380 - DNA, 25 bp, Mus musculus
gaaagtgagagactagaggccttaa

SEQ ID NO: 627381 - DNA, 25 bp, Mus musculus
gaaagtgagagagtagaggccttaa

SEQ ID NO: 627382 - DNA, 25 bp, Mus musculus
gaaagtgagctcaacccaaccttca

SEQ ID NO: 627383 - DNA, 25 bp, Mus musculus
gaaagtgagctctacccaaccttca

SEQ ID NO: 627384 - DNA, 25 bp, Mus musculus
gaaagtgagtcaacaagtgaagatg

SEQ ID NO: 627385 - DNA, 25 bp, Mus musculus
gaaagtgagtcatcaagtgaagatg

SEQ ID NO: 627386 - DNA, 25 bp, Mus musculus
gaaagtgagtgcctcccttgcagcc

SEQ ID NO: 627387 - DNA, 25 bp, Mus musculus
gaaagtgagtgcgtcccttgcagcc

SEQ ID NO: 627388 - DNA, 25 bp, Mus musculus
gaaagtgagttcaccctttccatct

SEQ ID NO: 627389 - DNA, 25 bp, Mus musculus
gaaagtgagttctccctttccatct

SEQ ID NO: 627390 - DNA, 25 bp, Mus musculus
gaaagtgatccgcaataccttcgag

SEQ ID NO: 627391 - DNA, 25 bp, Mus musculus
gaaagtgatccggaataccttcgag

SEQ ID NO: 627392 - DNA, 25 bp, Mus musculus
gaaagtgatctcagtccccaaaggc

SEQ ID NO: 627393 - DNA, 25 bp, Mus musculus
gaaagtgatctctgtccccaaaggc

SEQ ID NO: 627394 - DNA, 25 bp, Mus musculus
gaaagtgatcttcttaaggcaatta

SEQ ID NO: 627395 - DNA, 25 bp, Mus musculus
gaaagtgatcttgttaaggcaatta

SEQ ID NO: 627396 - DNA, 25 bp, Mus musculus
gaaagtgatgaactggaaggaaact

SEQ ID NO: 627397 - DNA, 25 bp, Mus musculus
gaaagtgatgaagtggaaggaaact

SEQ ID NO: 627398 - DNA, 25 bp, Mus musculus
gaaagtgatgccatgttcgctgctg

SEQ ID NO: 627399 - DNA, 25 bp, Mus musculus
gaaagtgatgccttgttcgctgctg

SEQ ID NO: 627400 - DNA, 25 bp, Mus musculus
gaaagtgatttcatcaataaagcaa

SEQ ID NO: 627401 - DNA, 25 bp, Mus musculus
gaaagtgatttcttcaataaagcaa

SEQ ID NO: 627402 - DNA, 25 bp, Mus musculus
gaaagtgatttgaccatgaattgag

SEQ ID NO: 627403 - DNA, 25 bp, Mus musculus
gaaagtgatttgtccatgaattgag

SEQ ID NO: 627404 - DNA, 25 bp, Mus musculus
gaaagtgcacagactcttccggcga

SEQ ID NO: 627405 - DNA, 25 bp, Mus musculus
gaaagtgcacagtctcttccggcga

SEQ ID NO: 627406 - DNA, 25 bp, Mus musculus
gaaagtgcagcacatgcgattgttt

SEQ ID NO: 627407 - DNA, 25 bp, Mus musculus
gaaagtgcagcagatgcgattgttt

SEQ ID NO: 627408 - DNA, 25 bp, Mus musculus
gaaagtgcagccaaaaagcctgacg

SEQ ID NO: 627409 - DNA, 25 bp, Mus musculus
gaaagtgcagcctaaaagcctgacg

SEQ ID NO: 627410 - DNA, 25 bp, Mus musculus
gaaagtgccctacagatacaccgtg

SEQ ID NO: 627411 - DNA, 25 bp, Mus musculus
gaaagtgccctagagatacaccgtg

SEQ ID NO: 627412 - DNA, 25 bp, Mus musculus
gaaagtgccgcccatgactacactt

SEQ ID NO: 627413 - DNA, 25 bp, Mus musculus
gaaagtgccgccgatgactacactt

SEQ ID NO: 627414 - DNA, 25 bp, Mus musculus
gaaagtgcctctactaactatgcca

SEQ ID NO: 627415 - DNA, 25 bp, Mus musculus
gaaagtgcctcttctaactatgcca

SEQ ID NO: 627416 - DNA, 25 bp, Mus musculus
gaaagtgcgggccaagtgtatataa

SEQ ID NO: 627417 - DNA, 25 bp, Mus musculus
gaaagtgcgggcgaagtgtatataa

SEQ ID NO: 627418 - DNA, 25 bp, Mus musculus
gaaagtgctaatagcttcactctga

SEQ ID NO: 627419 - DNA, 25 bp, Mus musculus
gaaagtgctaattgcttcactctga

SEQ ID NO: 627420 - DNA, 25 bp, Mus musculus
gaaagtgctcgtatgattagagaaa

SEQ ID NO: 627421 - DNA, 25 bp, Mus musculus
gaaagtgctcgtttgattagagaaa

SEQ ID NO: 627422 - DNA, 25 bp, Mus musculus
gaaagtgctcttccggctctatggg

SEQ ID NO: 627423 - DNA, 25 bp, Mus musculus
gaaagtgctcttgcggctctatggg

SEQ ID NO: 627424 - DNA, 25 bp, Mus musculus
gaaagtgctgggaccaagctgtaag

SEQ ID NO: 627425 - DNA, 25 bp, Mus musculus
gaaagtgctgggtccaagctgtaag

SEQ ID NO: 627426 - DNA, 25 bp, Mus musculus
gaaagtgctttgaaagcaaacaggc

SEQ ID NO: 627427 - DNA, 25 bp, Mus musculus
gaaagtgctttgtaagcaaacaggc

SEQ ID NO: 627428 - DNA, 25 bp, Mus musculus
gaaagtggaaacaatgaggtcatct

SEQ ID NO: 627429 - DNA, 25 bp, Mus musculus
gaaagtggaaactatgaggtcatct

SEQ ID NO: 627430 - DNA, 25 bp, Mus musculus
gaaagtggatcccaaatattgacta

SEQ ID NO: 627431 - DNA, 25 bp, Mus musculus
gaaagtggatccgaaatattgacta

SEQ ID NO: 627432 - DNA, 25 bp, Mus musculus
gaaagtggcatcacttgtctctgac

SEQ ID NO: 627433 - DNA, 25 bp, Mus musculus
gaaagtggcatctcttgtctctgac

SEQ ID NO: 627434 - DNA, 25 bp, Mus musculus
gaaagtggccacaagaggtctgtgt

SEQ ID NO: 627435 - DNA, 25 bp, Mus musculus
gaaagtggccactagaggtctgtgt

SEQ ID NO: 627436 - DNA, 25 bp, Mus musculus
gaaagtggccagactgatcggcgtg

SEQ ID NO: 627437 - DNA, 25 bp, Mus musculus
gaaagtggccagtctgatcggcgtg

SEQ ID NO: 627438 - DNA, 25 bp, Mus musculus
gaaagtggctgacgattacgtcagt

SEQ ID NO: 627439 - DNA, 25 bp, Mus musculus
gaaagtggctgactccaagaagctg

SEQ ID NO: 627440 - DNA, 25 bp, Mus musculus
gaaagtggctgaggattacgtcagt

SEQ ID NO: 627441 - DNA, 25 bp, Mus musculus
gaaagtggctgagtccaagaagctg

SEQ ID NO: 627442 - DNA, 25 bp, Mus musculus
gaaagtgtataacacctacaacggg

SEQ ID NO: 627443 - DNA, 25 bp, Mus musculus
gaaagtgtataagacctacaacggg

SEQ ID NO: 627444 - DNA, 25 bp, Mus musculus
gaaagtgtcaacctccaagtggcga

SEQ ID NO: 627445 - DNA, 25 bp, Mus musculus
gaaagtgtcaacgtccaagtggcga

SEQ ID NO: 627446 - DNA, 25 bp, Mus musculus
gaaagtgtcagactcaacgggcaca

SEQ ID NO: 627447 - DNA, 25 bp, Mus musculus
gaaagtgtcagagtcaacgggcaca

SEQ ID NO: 627448 - DNA, 25 bp, Mus musculus
gaaagtgtgaacatccggtggtcca

SEQ ID NO: 627449 - DNA, 25 bp, Mus musculus
gaaagtgtgaacttccggtggtcca

SEQ ID NO: 627450 - DNA, 25 bp, Mus musculus
gaaagtgtgagaaccaaaggccatg

SEQ ID NO: 627451 - DNA, 25 bp, Mus musculus
gaaagtgtgagatccaaaggccatg

SEQ ID NO: 627452 - DNA, 25 bp, Mus musculus
gaaagtgtttgcagaacataaagaa

SEQ ID NO: 627453 - DNA, 25 bp, Mus musculus
gaaagtgtttgctgaacataaagaa

SEQ ID NO: 627454 - DNA, 25 bp, Mus musculus
gaaagttacaggactttgaagcaac

SEQ ID NO: 627455 - DNA, 25 bp, Mus musculus
gaaagttacaggtctttgaagcaac

SEQ ID NO: 627456 - DNA, 25 bp, Mus musculus
gaaagttagccacgagtaacgtctg

SEQ ID NO: 627457 - DNA, 25 bp, Mus musculus
gaaagttagccaggagtaacgtctg

SEQ ID NO: 627458 - DNA, 25 bp, Mus musculus
gaaagttcgctacagcttctacaga

SEQ ID NO: 627459 - DNA, 25 bp, Mus musculus
gaaagttcgctagagcttctacaga

SEQ ID NO: 627460 - DNA, 25 bp, Mus musculus
gaaagttctattcttgggatgagtg

SEQ ID NO: 627461 - DNA, 25 bp, Mus musculus
gaaagttctattgttgggatgagtg

SEQ ID NO: 627462 - DNA, 25 bp, Mus musculus
gaaagttctcatatttgtcctcctg

SEQ ID NO: 627463 - DNA, 25 bp, Mus musculus
gaaagttctcatttttgtcctcctg

SEQ ID NO: 627464 - DNA, 25 bp, Mus musculus
gaaagttctgccatctgcctgtccc

SEQ ID NO: 627465 - DNA, 25 bp, Mus musculus
gaaagttctgccttctgcctgtccc

SEQ ID NO: 627466 - DNA, 25 bp, Mus musculus
gaaagttgaagactcttgggcccct

SEQ ID NO: 627467 - DNA, 25 bp, Mus musculus
gaaagttgaagagtcttgggcccct

SEQ ID NO: 627468 - DNA, 25 bp, Mus musculus
gaaagttgcttcagggcgaacatca

SEQ ID NO: 627469 - DNA, 25 bp, Mus musculus
gaaagttgcttctgggcgaacatca

SEQ ID NO: 627470 - DNA, 25 bp, Mus musculus
gaaagttggtgtcttccctgtcctg

SEQ ID NO: 627471 - DNA, 25 bp, Mus musculus
gaaagttggtgtgttccctgtcctg

SEQ ID NO: 627472 - DNA, 25 bp, Mus musculus
gaaagttgtcccctatgtatgtacc

SEQ ID NO: 627473 - DNA, 25 bp, Mus musculus
gaaagttgtcccgtatgtatgtacc

SEQ ID NO: 627474 - DNA, 25 bp, Mus musculus
gaaagtttcaacctcatcatgcacc

SEQ ID NO: 627475 - DNA, 25 bp, Mus musculus
gaaagtttcaacgtcatcatgcacc

SEQ ID NO: 627476 - DNA, 25 bp, Mus musculus
gaaagtttgccacatataacccttc

SEQ ID NO: 627477 - DNA, 25 bp, Mus musculus
gaaagtttgccagatataacccttc

SEQ ID NO: 627478 - DNA, 25 bp, Mus musculus
gaaagttttcatcacccgcaagtca

SEQ ID NO: 627479 - DNA, 25 bp, Mus musculus
gaaagttttcatgacccgcaagtca

SEQ ID NO: 627480 - DNA, 25 bp, Mus musculus
gaaagttttggtctatgaagctcta

SEQ ID NO: 627481 - DNA, 25 bp, Mus musculus
gaaagttttggtgtatgaagctcta

SEQ ID NO: 627482 - DNA, 25 bp, Mus musculus
gaaataaaaagccagttgtgtgact

SEQ ID NO: 627483 - DNA, 25 bp, Mus musculus
gaaataaaaagcgagttgtgtgact

SEQ ID NO: 627484 - DNA, 25 bp, Mus musculus
gaaataaagataaaacagcagctgt

SEQ ID NO: 627485 - DNA, 25 bp, Mus musculus
gaaataaagatataacagcagctgt

SEQ ID NO: 627486 - DNA, 25 bp, Mus musculus
gaaataaatactaggccaagcccgg

SEQ ID NO: 627487 - DNA, 25 bp, Mus musculus
gaaataaatacttggccaagcccgg

SEQ ID NO: 627488 - DNA, 25 bp, Mus musculus
gaaataaatgccctcttcctctcaa

SEQ ID NO: 627489 - DNA, 25 bp, Mus musculus
gaaataaatgccgtcttcctctcaa

SEQ ID NO: 627490 - DNA, 25 bp, Mus musculus
gaaataacaaagattctgagcagcc

SEQ ID NO: 627491 - DNA, 25 bp, Mus musculus
gaaataacaaagtttctgagcagcc

SEQ ID NO: 627492 - DNA, 25 bp, Mus musculus
gaaataacagatacgggcagctggg

SEQ ID NO: 627493 - DNA, 25 bp, Mus musculus
gaaataacagattcgggcagctggg

SEQ ID NO: 627494 - DNA, 25 bp, Mus musculus
gaaataacagcaaaagctcagaaag

SEQ ID NO: 627495 - DNA, 25 bp, Mus musculus
gaaataacagcataagctcagaaag

SEQ ID NO: 627496 - DNA, 25 bp, Mus musculus
gaaataaccaagataatgagcaccc

SEQ ID NO: 627497 - DNA, 25 bp, Mus musculus
gaaataaccaagttaatgagcaccc

SEQ ID NO: 627498 - DNA, 25 bp, Mus musculus
gaaataaccagcctgcaagaactgg

SEQ ID NO: 627499 - DNA, 25 bp, Mus musculus
gaaataaccagcgtgcaagaactgg

SEQ ID NO: 627500 - DNA, 25 bp, Mus musculus
gaaataaccgttagtgctgctccaa

SEQ ID NO: 627501 - DNA, 25 bp, Mus musculus
gaaataaccgtttgtgctgctccaa

SEQ ID NO: 627502 - DNA, 25 bp, Mus musculus
gaaataacctgaagaggttgtcaca

SEQ ID NO: 627503 - DNA, 25 bp, Mus musculus
gaaataacctgatgaggttgtcaca

SEQ ID NO: 627504 - DNA, 25 bp, Mus musculus
gaaataactcatctccttttgcccc

SEQ ID NO: 627505 - DNA, 25 bp, Mus musculus
gaaataactcatgtccttttgcccc

SEQ ID NO: 627506 - DNA, 25 bp, Mus musculus
gaaataacttccatttgaacaagca

SEQ ID NO: 627507 - DNA, 25 bp, Mus musculus
gaaataacttccttttgaacaagca

SEQ ID NO: 627508 - DNA, 25 bp, Mus musculus
gaaataagagccagtatcaccagcg

SEQ ID NO: 627509 - DNA, 25 bp, Mus musculus
gaaataagagcctgtatcaccagcg

SEQ ID NO: 627510 - DNA, 25 bp, Mus musculus
gaaataagcctcaccatgcacactg

SEQ ID NO: 627511 - DNA, 25 bp, Mus musculus
gaaataagcctctccatgcacactg

SEQ ID NO: 627512 - DNA, 25 bp, Mus musculus
gaaataatgaggacgtttctatcat

SEQ ID NO: 627513 - DNA, 25 bp, Mus musculus
gaaataatgaggtcgtttctatcat

SEQ ID NO: 627514 - DNA, 25 bp, Mus musculus
gaaataattacacgcggatcccatg

SEQ ID NO: 627515 - DNA, 25 bp, Mus musculus
gaaataattacaggcggatcccatg

SEQ ID NO: 627516 - DNA, 25 bp, Mus musculus
gaaataattgagagccgggtggaat

SEQ ID NO: 627517 - DNA, 25 bp, Mus musculus
gaaataattgagtgccgggtggaat

SEQ ID NO: 627518 - DNA, 25 bp, Mus musculus
gaaatacaaaaacagagtacgaagt

SEQ ID NO: 627519 - DNA, 25 bp, Mus musculus
gaaatacaaaaagagagtacgaagt

SEQ ID NO: 627520 - DNA, 25 bp, Mus musculus
gaaatacaacaacagagagcagcac

SEQ ID NO: 627521 - DNA, 25 bp, Mus musculus
gaaatacaacaagagagagcagcac

SEQ ID NO: 627522 - DNA, 25 bp, Mus musculus
gaaatacaacccagataaacactat

SEQ ID NO: 627523 - DNA, 25 bp, Mus musculus
gaaatacaaccctgataaacactat

SEQ ID NO: 627524 - DNA, 25 bp, Mus musculus
gaaatacaagacctttcaagagagg

SEQ ID NO: 627525 - DNA, 25 bp, Mus musculus
gaaatacaagacgtttcaagagagg

SEQ ID NO: 627526 - DNA, 25 bp, Mus musculus
gaaatacagaagagtcatctccgac

SEQ ID NO: 627527 - DNA, 25 bp, Mus musculus
gaaatacagaagtgtcatctccgac

SEQ ID NO: 627528 - DNA, 25 bp, Mus musculus
gaaatacagaataaccattgagagg

SEQ ID NO: 627529 - DNA, 25 bp, Mus musculus
gaaatacagaattaccattgagagg

SEQ ID NO: 627530 - DNA, 25 bp, Mus musculus
gaaatacagaccaggtctgctagcc

SEQ ID NO: 627531 - DNA, 25 bp, Mus musculus
gaaatacagacctggtctgctagcc

SEQ ID NO: 627532 - DNA, 25 bp, Mus musculus
gaaatacaggcacttattcaacagc

SEQ ID NO: 627533 - DNA, 25 bp, Mus musculus
gaaatacaggcagttattcaacagc

SEQ ID NO: 627534 - DNA, 25 bp, Mus musculus
gaaatacatctcagaaagtaaatgc

SEQ ID NO: 627535 - DNA, 25 bp, Mus musculus
gaaatacatctctgaaagtaaatgc

SEQ ID NO: 627536 - DNA, 25 bp, Mus musculus
gaaataccacgacctggccttccag

SEQ ID NO: 627537 - DNA, 25 bp, Mus musculus
gaaataccacgagctggccttccag

SEQ ID NO: 627538 - DNA, 25 bp, Mus musculus
gaaataccacttccaagaacgagtt

SEQ ID NO: 627539 - DNA, 25 bp, Mus musculus
gaaataccacttgcaagaacgagtt

SEQ ID NO: 627540 - DNA, 25 bp, Mus musculus
gaaatacccagaagtttcttgtgac

SEQ ID NO: 627541 - DNA, 25 bp, Mus musculus
gaaatacccagatgtttcttgtgac

SEQ ID NO: 627542 - DNA, 25 bp, Mus musculus
gaaatacccgtcatatacgcacaga

SEQ ID NO: 627543 - DNA, 25 bp, Mus musculus
gaaatacccgtcttatacgcacaga

SEQ ID NO: 627544 - DNA, 25 bp, Mus musculus
gaaataccggcccaaatactgcggc

SEQ ID NO: 627545 - DNA, 25 bp, Mus musculus
gaaataccggccgaaatactgcggc

SEQ ID NO: 627546 - DNA, 25 bp, Mus musculus
gaaataccgtataccgttctacatg

SEQ ID NO: 627547 - DNA, 25 bp, Mus musculus
gaaataccgtattccgttctacatg

SEQ ID NO: 627548 - DNA, 25 bp, Mus musculus
gaaatacctcgaaatccccaagatg

SEQ ID NO: 627549 - DNA, 25 bp, Mus musculus
gaaatacctcgatatccccaagatg

SEQ ID NO: 627550 - DNA, 25 bp, Mus musculus
gaaatacctggccagcggagccata

SEQ ID NO: 627551 - DNA, 25 bp, Mus musculus
gaaatacctggcgagcggagccata

SEQ ID NO: 627552 - DNA, 25 bp, Mus musculus
gaaatacctgggatttacgtcctgt

SEQ ID NO: 627553 - DNA, 25 bp, Mus musculus
gaaatacctgggttttacgtcctgt

SEQ ID NO: 627554 - DNA, 25 bp, Mus musculus
gaaatacgagatctcaccagaagct

SEQ ID NO: 627555 - DNA, 25 bp, Mus musculus
gaaatacgagatgtcaccagaagct

SEQ ID NO: 627556 - DNA, 25 bp, Mus musculus
gaaatacgagttattccagagaagg

SEQ ID NO: 627557 - DNA, 25 bp, Mus musculus
gaaatacgagtttttccagagaagg

SEQ ID NO: 627558 - DNA, 25 bp, Mus musculus
gaaatacgccaacaaatcagttaag

SEQ ID NO: 627559 - DNA, 25 bp, Mus musculus
gaaatacgccaagaaatcagttaag

SEQ ID NO: 627560 - DNA, 25 bp, Mus musculus
gaaatacggcttctacacgcatgtg

SEQ ID NO: 627561 - DNA, 25 bp, Mus musculus
gaaatacggcttgtacacgcatgtg

SEQ ID NO: 627562 - DNA, 25 bp, Mus musculus
gaaatacggtgacaagaggatcatc

SEQ ID NO: 627563 - DNA, 25 bp, Mus musculus
gaaatacggtgagaagaggatcatc

SEQ ID NO: 627564 - DNA, 25 bp, Mus musculus
gaaatactacagctcgtcccaaact

SEQ ID NO: 627565 - DNA, 25 bp, Mus musculus
gaaatactacaggtcgtcccaaact

SEQ ID NO: 627566 - DNA, 25 bp, Mus musculus
gaaatactacctaagatcaggacgg

SEQ ID NO: 627567 - DNA, 25 bp, Mus musculus
gaaatactaccttagatcaggacgg

SEQ ID NO: 627568 - DNA, 25 bp, Mus musculus
gaaatactacttcgaaggagtctcc

SEQ ID NO: 627569 - DNA, 25 bp, Mus musculus
gaaatactacttggaaggagtctcc

SEQ ID NO: 627570 - DNA, 25 bp, Mus musculus
gaaatactccaacacttcgtttgag

SEQ ID NO: 627571 - DNA, 25 bp, Mus musculus
gaaatactccaagacttcgtttgag

SEQ ID NO: 627572 - DNA, 25 bp, Mus musculus
gaaatactgtctagtagtcccgtgg

SEQ ID NO: 627573 - DNA, 25 bp, Mus musculus
gaaatactgtcttgtagtcccgtgg

SEQ ID NO: 627574 - DNA, 25 bp, Mus musculus
gaaatacttgcgcaagcagactacc

SEQ ID NO: 627575 - DNA, 25 bp, Mus musculus
gaaatacttgcggaagcagactacc

SEQ ID NO: 627576 - DNA, 25 bp, Mus musculus
gaaatacttgtgactggcttcaaaa

SEQ ID NO: 627577 - DNA, 25 bp, Mus musculus
gaaatacttgtgtctggcttcaaaa

SEQ ID NO: 627578 - DNA, 25 bp, Mus musculus
gaaatacttgttatatgaacgcggc

SEQ ID NO: 627579 - DNA, 25 bp, Mus musculus
gaaatacttgttttatgaacgcggc

SEQ ID NO: 627580 - DNA, 25 bp, Mus musculus
gaaatagaagccagtgaggtgatgc

SEQ ID NO: 627581 - DNA, 25 bp, Mus musculus
gaaatagaagcctgtgaggtgatgc

SEQ ID NO: 627582 - DNA, 25 bp, Mus musculus
gaaatagacctgcacactgtacact

SEQ ID NO: 627583 - DNA, 25 bp, Mus musculus
gaaatagacctggacactgtacact

SEQ ID NO: 627584 - DNA, 25 bp, Mus musculus
gaaatagacttcctaaagatcaact

SEQ ID NO: 627585 - DNA, 25 bp, Mus musculus
gaaatagacttcgtaaagatcaact

SEQ ID NO: 627586 - DNA, 25 bp, Mus musculus
gaaatagagcatctcctgaacggca

SEQ ID NO: 627587 - DNA, 25 bp, Mus musculus
gaaatagagcatgtcctgaacggca

SEQ ID NO: 627588 - DNA, 25 bp, Mus musculus
gaaatagatacgctgtgcttggcct

SEQ ID NO: 627589 - DNA, 25 bp, Mus musculus
gaaatagatacggtgtgcttggcct

SEQ ID NO: 627590 - DNA, 25 bp, Mus musculus
gaaatagcccacacttacaaggccg

SEQ ID NO: 627591 - DNA, 25 bp, Mus musculus
gaaatagcccactcttacaaggccg

SEQ ID NO: 627592 - DNA, 25 bp, Mus musculus
gaaatagctgagaaaatggccacat

SEQ ID NO: 627593 - DNA, 25 bp, Mus musculus
gaaatagctgagtaaatggccacat

SEQ ID NO: 627594 - DNA, 25 bp, Mus musculus
gaaatagcttcaccaaacacagatg

SEQ ID NO: 627595 - DNA, 25 bp, Mus musculus
gaaatagcttcagcaaacacagatg

SEQ ID NO: 627596 - DNA, 25 bp, Mus musculus
gaaataggaacaagtgacttctcta

SEQ ID NO: 627597 - DNA, 25 bp, Mus musculus
gaaataggaacatgtgacttctcta

SEQ ID NO: 627598 - DNA, 25 bp, Mus musculus
gaaataggcggtatgtatcccttct

SEQ ID NO: 627599 - DNA, 25 bp, Mus musculus
gaaataggcggtttgtatcccttct

SEQ ID NO: 627600 - DNA, 25 bp, Mus musculus
gaaatagggccacgcttgtcttctc

SEQ ID NO: 627601 - DNA, 25 bp, Mus musculus
gaaatagggccaggcttgtcttctc

SEQ ID NO: 627602 - DNA, 25 bp, Mus musculus
gaaatagtatctcctagcgacctag

SEQ ID NO: 627603 - DNA, 25 bp, Mus musculus
gaaatagtatctgctagcgacctag

SEQ ID NO: 627604 - DNA, 25 bp, Mus musculus
gaaatagtgaatctccataaagaga

SEQ ID NO: 627605 - DNA, 25 bp, Mus musculus
gaaatagtgaatgtccataaagaga

SEQ ID NO: 627606 - DNA, 25 bp, Mus musculus
gaaatagtggataaatctggtgtgg

SEQ ID NO: 627607 - DNA, 25 bp, Mus musculus
gaaatagtggattaatctggtgtgg

SEQ ID NO: 627608 - DNA, 25 bp, Mus musculus
gaaatataaaaaccagtgcactgag

SEQ ID NO: 627609 - DNA, 25 bp, Mus musculus
gaaatataaaaagcagtgcactgag

SEQ ID NO: 627610 - DNA, 25 bp, Mus musculus
gaaatataaagacggaggaagtcgt

SEQ ID NO: 627611 - DNA, 25 bp, Mus musculus
gaaatataaagagggaggaagtcgt

SEQ ID NO: 627612 - DNA, 25 bp, Mus musculus
gaaatataaccactccatgcaggcc

SEQ ID NO: 627613 - DNA, 25 bp, Mus musculus
gaaatataaccagtccatgcaggcc

SEQ ID NO: 627614 - DNA, 25 bp, Mus musculus
gaaatataagctcttctacggaatg

SEQ ID NO: 627615 - DNA, 25 bp, Mus musculus
gaaatataagctgttctacggaatg

SEQ ID NO: 627616 - DNA, 25 bp, Mus musculus
gaaatatagtaaatctgctcttggt

SEQ ID NO: 627617 - DNA, 25 bp, Mus musculus
gaaatatagtaattctgctcttggt

SEQ ID NO: 627618 - DNA, 25 bp, Mus musculus
gaaatatcatgcaacatgtcaacag

SEQ ID NO: 627619 - DNA, 25 bp, Mus musculus
gaaatatcatgctacatgtcaacag

SEQ ID NO: 627620 - DNA, 25 bp, Mus musculus
gaaatatccttcagatcaatgtgaa

SEQ ID NO: 627621 - DNA, 25 bp, Mus musculus
gaaatatccttctgatcaatgtgaa

SEQ ID NO: 627622 - DNA, 25 bp, Mus musculus
gaaatatctggaacaattcctcatg

SEQ ID NO: 627623 - DNA, 25 bp, Mus musculus
gaaatatctggatcaattcctcatg

SEQ ID NO: 627624 - DNA, 25 bp, Mus musculus
gaaatatctgtcacccaattccaag

SEQ ID NO: 627625 - DNA, 25 bp, Mus musculus
gaaatatctgtctcccaattccaag

SEQ ID NO: 627626 - DNA, 25 bp, Mus musculus
gaaatatcttcaagcaaaactgact

SEQ ID NO: 627627 - DNA, 25 bp, Mus musculus
gaaatatcttcatgcaaaactgact

SEQ ID NO: 627628 - DNA, 25 bp, Mus musculus
gaaatatgcaatcgagcagagcatc

SEQ ID NO: 627629 - DNA, 25 bp, Mus musculus
gaaatatgcaatggagcagagcatc

SEQ ID NO: 627630 - DNA, 25 bp, Mus musculus
gaaatatggaccagtggtttctctg

SEQ ID NO: 627631 - DNA, 25 bp, Mus musculus
gaaatatggacctgtggtttctctg

SEQ ID NO: 627632 - DNA, 25 bp, Mus musculus
gaaatatggcctccttcaccaagca

SEQ ID NO: 627633 - DNA, 25 bp, Mus musculus
gaaatatggcctgcttcaccaagca

SEQ ID NO: 627634 - DNA, 25 bp, Mus musculus
gaaatatgggataccggagcacgaa

SEQ ID NO: 627635 - DNA, 25 bp, Mus musculus
gaaatatgggattccggagcacgaa

SEQ ID NO: 627636 - DNA, 25 bp, Mus musculus
gaaatatggtgaatctctgtaccga

SEQ ID NO: 627637 - DNA, 25 bp, Mus musculus
gaaatatggtgattctctgtaccga

SEQ ID NO: 627638 - DNA, 25 bp, Mus musculus
gaaatatgtcctcaacacctgcggg

SEQ ID NO: 627639 - DNA, 25 bp, Mus musculus
gaaatatgtcctgaacacctgcggg

SEQ ID NO: 627640 - DNA, 25 bp, Mus musculus
gaaatatgttatatcccacaagaaa

SEQ ID NO: 627641 - DNA, 25 bp, Mus musculus
gaaatatgttatttcccacaagaaa

SEQ ID NO: 627642 - DNA, 25 bp, Mus musculus
gaaatattcactctccattaggaag

SEQ ID NO: 627643 - DNA, 25 bp, Mus musculus
gaaatattcactgtccattaggaag

SEQ ID NO: 627644 - DNA, 25 bp, Mus musculus
gaaatattctccatgtcccggccaa

SEQ ID NO: 627645 - DNA, 25 bp, Mus musculus
gaaatattctccttgtcccggccaa

SEQ ID NO: 627646 - DNA, 25 bp, Mus musculus
gaaatattgaacctcacctgaagaa

SEQ ID NO: 627647 - DNA, 25 bp, Mus musculus
gaaatattgaacgtcacctgaagaa

SEQ ID NO: 627648 - DNA, 25 bp, Mus musculus
gaaatattgactattaccgcttgga

SEQ ID NO: 627649 - DNA, 25 bp, Mus musculus
gaaatattgacttttaccgcttgga

SEQ ID NO: 627650 - DNA, 25 bp, Mus musculus
gaaatattgccacgtactatggtgc

SEQ ID NO: 627651 - DNA, 25 bp, Mus musculus
gaaatattgccaggtactatggtgc

SEQ ID NO: 627652 - DNA, 25 bp, Mus musculus
gaaatatttttacatggccttggac

SEQ ID NO: 627653 - DNA, 25 bp, Mus musculus
gaaatatttttagatggccttggac

SEQ ID NO: 627654 - DNA, 25 bp, Mus musculus
gaaatcaaaccccaatcctctggaa

SEQ ID NO: 627655 - DNA, 25 bp, Mus musculus
gaaatcaaacccgaatcctctggaa

SEQ ID NO: 627656 - DNA, 25 bp, Mus musculus
gaaatcaaagaaaatcttggtgaag

SEQ ID NO: 627657 - DNA, 25 bp, Mus musculus
gaaatcaaagaatatcttggtgaag

SEQ ID NO: 627658 - DNA, 25 bp, Mus musculus
gaaatcaaagcaatctcccgggata

SEQ ID NO: 627659 - DNA, 25 bp, Mus musculus
gaaatcaaagcattctcccgggata

SEQ ID NO: 627660 - DNA, 25 bp, Mus musculus
gaaatcaacaaaaacgtcatgtcag

SEQ ID NO: 627661 - DNA, 25 bp, Mus musculus
gaaatcaacaaatacgtcatgtcag

SEQ ID NO: 627662 - DNA, 25 bp, Mus musculus
gaaatcaacacgcatgagtgcgcca

SEQ ID NO: 627663 - DNA, 25 bp, Mus musculus
gaaatcaacacggatgagtgcgcca

SEQ ID NO: 627664 - DNA, 25 bp, Mus musculus
gaaatcaaccaactccaggtcaatg

SEQ ID NO: 627665 - DNA, 25 bp, Mus musculus
gaaatcaaccaagtccaggtcaatg

SEQ ID NO: 627666 - DNA, 25 bp, Mus musculus
gaaatcaacgtgctggagaaaatca

SEQ ID NO: 627667 - DNA, 25 bp, Mus musculus
gaaatcaacgtggtggagaaaatca

SEQ ID NO: 627668 - DNA, 25 bp, Mus musculus
gaaatcaacgttactactccatcta

SEQ ID NO: 627669 - DNA, 25 bp, Mus musculus
gaaatcaacgtttctactccatcta

SEQ ID NO: 627670 - DNA, 25 bp, Mus musculus
gaaatcaagaagatagccagctttc

SEQ ID NO: 627671 - DNA, 25 bp, Mus musculus
gaaatcaagaagatgatggcgacct

SEQ ID NO: 627672 - DNA, 25 bp, Mus musculus
gaaatcaagaagctatgggagcctt

SEQ ID NO: 627673 - DNA, 25 bp, Mus musculus
gaaatcaagaaggtatgggagcctt

SEQ ID NO: 627674 - DNA, 25 bp, Mus musculus
gaaatcaagaagttagccagctttc

SEQ ID NO: 627675 - DNA, 25 bp, Mus musculus
gaaatcaagaagttgatggcgacct

SEQ ID NO: 627676 - DNA, 25 bp, Mus musculus
gaaatcaagattctacagctcctaa

SEQ ID NO: 627677 - DNA, 25 bp, Mus musculus
gaaatcaagattgtacagctcctaa

SEQ ID NO: 627678 - DNA, 25 bp, Mus musculus
gaaatcaagcagatagatgaagaga

SEQ ID NO: 627679 - DNA, 25 bp, Mus musculus
gaaatcaagcagttagatgaagaga

SEQ ID NO: 627680 - DNA, 25 bp, Mus musculus
gaaatcaatattcagatcgtattcc

SEQ ID NO: 627681 - DNA, 25 bp, Mus musculus
gaaatcaatattgagatcgtattcc

SEQ ID NO: 627682 - DNA, 25 bp, Mus musculus
gaaatcaatgacatggagaacttgg

SEQ ID NO: 627683 - DNA, 25 bp, Mus musculus
gaaatcaatgacttggagaacttgg

SEQ ID NO: 627684 - DNA, 25 bp, Mus musculus
gaaatcacacatcgatttgatgaca

SEQ ID NO: 627685 - DNA, 25 bp, Mus musculus
gaaatcacacatggatttgatgaca

SEQ ID NO: 627686 - DNA, 25 bp, Mus musculus
gaaatcacagctctggccgtggagt

SEQ ID NO: 627687 - DNA, 25 bp, Mus musculus
gaaatcacagctgtggccgtggagt

SEQ ID NO: 627688 - DNA, 25 bp, Mus musculus
gaaatcaccaagacctccacagaga

SEQ ID NO: 627689 - DNA, 25 bp, Mus musculus
gaaatcaccaagtcctccacagaga

SEQ ID NO: 627690 - DNA, 25 bp, Mus musculus
gaaatcaccctgcagcactactgtg

SEQ ID NO: 627691 - DNA, 25 bp, Mus musculus
gaaatcaccctggagcactactgtg

SEQ ID NO: 627692 - DNA, 25 bp, Mus musculus
gaaatcactattcgagctcatcagg

SEQ ID NO: 627693 - DNA, 25 bp, Mus musculus
gaaatcactattggagctcatcagg

SEQ ID NO: 627694 - DNA, 25 bp, Mus musculus
gaaatcactgctagttcagcaccag

SEQ ID NO: 627695 - DNA, 25 bp, Mus musculus
gaaatcactgcttgttcagcaccag

SEQ ID NO: 627696 - DNA, 25 bp, Mus musculus
gaaatcagaaagaagctgctacagc

SEQ ID NO: 627697 - DNA, 25 bp, Mus musculus
gaaatcagaaagtagctgctacagc

SEQ ID NO: 627698 - DNA, 25 bp, Mus musculus
gaaatcagaattcttgttgagcaac

SEQ ID NO: 627699 - DNA, 25 bp, Mus musculus
gaaatcagaattgttgttgagcaac

SEQ ID NO: 627700 - DNA, 25 bp, Mus musculus
gaaatcagagctctttggccttaaa

SEQ ID NO: 627701 - DNA, 25 bp, Mus musculus
gaaatcagagctgtttggccttaaa

SEQ ID NO: 627702 - DNA, 25 bp, Mus musculus
gaaatcagatcaagtcccaagagac

SEQ ID NO: 627703 - DNA, 25 bp, Mus musculus
gaaatcagatcatgtcccaagagac

SEQ ID NO: 627704 - DNA, 25 bp, Mus musculus
gaaatcagccgacagaagactcagg

SEQ ID NO: 627705 - DNA, 25 bp, Mus musculus
gaaatcagccgagagaagactcagg

SEQ ID NO: 627706 - DNA, 25 bp, Mus musculus
gaaatcagcctcagggaacggctgg

SEQ ID NO: 627707 - DNA, 25 bp, Mus musculus
gaaatcagcctctgggaacggctgg

SEQ ID NO: 627708 - DNA, 25 bp, Mus musculus
gaaatcagccttccgaacattcact

SEQ ID NO: 627709 - DNA, 25 bp, Mus musculus
gaaatcagccttgcgaacattcact

SEQ ID NO: 627710 - DNA, 25 bp, Mus musculus
gaaatcagctctaactcgccagtga

SEQ ID NO: 627711 - DNA, 25 bp, Mus musculus
gaaatcagctcttactcgccagtga

SEQ ID NO: 627712 - DNA, 25 bp, Mus musculus
gaaatcaggaaaaggcgtgacgtga

SEQ ID NO: 627713 - DNA, 25 bp, Mus musculus
gaaatcaggaaatggcgtgacgtga

SEQ ID NO: 627714 - DNA, 25 bp, Mus musculus
gaaatcaggacacctaaccctcttt

SEQ ID NO: 627715 - DNA, 25 bp, Mus musculus
gaaatcaggacagctaaccctcttt

SEQ ID NO: 627716 - DNA, 25 bp, Mus musculus
gaaatcagggagatctatggcgaga

SEQ ID NO: 627717 - DNA, 25 bp, Mus musculus
gaaatcagggagttctatggcgaga

SEQ ID NO: 627718 - DNA, 25 bp, Mus musculus
gaaatcagttgacatcaccacagga

SEQ ID NO: 627719 - DNA, 25 bp, Mus musculus
gaaatcagttgagatcaccacagga

SEQ ID NO: 627720 - DNA, 25 bp, Mus musculus
gaaatcatcaatcaagatgacgttg

SEQ ID NO: 627721 - DNA, 25 bp, Mus musculus
gaaatcatcaatgaagatgacgttg

SEQ ID NO: 627722 - DNA, 25 bp, Mus musculus
gaaatcatccgaagcaaggctggac

SEQ ID NO: 627723 - DNA, 25 bp, Mus musculus
gaaatcatccgatgcaaggctggac

SEQ ID NO: 627724 - DNA, 25 bp, Mus musculus
gaaatcatctaaaagcctctttgca

SEQ ID NO: 627725 - DNA, 25 bp, Mus musculus
gaaatcatctaatagcctctttgca

SEQ ID NO: 627726 - DNA, 25 bp, Mus musculus
gaaatcatctatacggacttcagct

SEQ ID NO: 627727 - DNA, 25 bp, Mus musculus
gaaatcatctattcggacttcagct

SEQ ID NO: 627728 - DNA, 25 bp, Mus musculus
gaaatcatgagaagtcagatcgtag

SEQ ID NO: 627729 - DNA, 25 bp, Mus musculus
gaaatcatgagatgtcagatcgtag

SEQ ID NO: 627730 - DNA, 25 bp, Mus musculus
gaaatcatgaggaaccagttctccg

SEQ ID NO: 627731 - DNA, 25 bp, Mus musculus
gaaatcatgaggtaccagttctccg

SEQ ID NO: 627732 - DNA, 25 bp, Mus musculus
gaaatcatgatcacttcctcggata

SEQ ID NO: 627733 - DNA, 25 bp, Mus musculus
gaaatcatgatctcttcctcggata

SEQ ID NO: 627734 - DNA, 25 bp, Mus musculus
gaaatcatgcacaacccaaacttca

SEQ ID NO: 627735 - DNA, 25 bp, Mus musculus
gaaatcatgcactacccaaacttca

SEQ ID NO: 627736 - DNA, 25 bp, Mus musculus
gaaatcattcacagctgtctgtcag

SEQ ID NO: 627737 - DNA, 25 bp, Mus musculus
gaaatcattcactgctgtctgtcag

SEQ ID NO: 627738 - DNA, 25 bp, Mus musculus
gaaatcattcctacaaatactctag

SEQ ID NO: 627739 - DNA, 25 bp, Mus musculus
gaaatcattcctatctggagtctct

SEQ ID NO: 627740 - DNA, 25 bp, Mus musculus
gaaatcattccttcaaatactctag

SEQ ID NO: 627741 - DNA, 25 bp, Mus musculus
gaaatcattcctttctggagtctct

SEQ ID NO: 627742 - DNA, 25 bp, Mus musculus
gaaatccaacgtcctcatgcccatt

SEQ ID NO: 627743 - DNA, 25 bp, Mus musculus
gaaatccaacgtgctcatgcccatt

SEQ ID NO: 627744 - DNA, 25 bp, Mus musculus
gaaatccaagcccaaaaagtgtgtg

SEQ ID NO: 627745 - DNA, 25 bp, Mus musculus
gaaatccaagccgaaaaagtgtgtg

SEQ ID NO: 627746 - DNA, 25 bp, Mus musculus
gaaatccaagctcgtgatctatgga

SEQ ID NO: 627747 - DNA, 25 bp, Mus musculus
gaaatccaagctggtgatctatgga

SEQ ID NO: 627748 - DNA, 25 bp, Mus musculus
gaaatccaatccagccatccaagct

SEQ ID NO: 627749 - DNA, 25 bp, Mus musculus
gaaatccaatcctgccatccaagct

SEQ ID NO: 627750 - DNA, 25 bp, Mus musculus
gaaatccacaaaagtcgttcccctg

SEQ ID NO: 627751 - DNA, 25 bp, Mus musculus
gaaatccacaaatgtcgttcccctg

SEQ ID NO: 627752 - DNA, 25 bp, Mus musculus
gaaatccagaaaacatcgaagatgc

SEQ ID NO: 627753 - DNA, 25 bp, Mus musculus
gaaatccagaaaatggcagagcagt

SEQ ID NO: 627754 - DNA, 25 bp, Mus musculus
gaaatccagaaatcatcgaagatgc

SEQ ID NO: 627755 - DNA, 25 bp, Mus musculus
gaaatccagaaattggcagagcagt

SEQ ID NO: 627756 - DNA, 25 bp, Mus musculus
gaaatccagaccctgcactctgagt

SEQ ID NO: 627757 - DNA, 25 bp, Mus musculus
gaaatccagaccgtgcactctgagt

SEQ ID NO: 627758 - DNA, 25 bp, Mus musculus
gaaatccagaggctgtttctgagct

SEQ ID NO: 627759 - DNA, 25 bp, Mus musculus
gaaatccagaggcttctttaactac

SEQ ID NO: 627760 - DNA, 25 bp, Mus musculus
gaaatccagagggtgtttctgagct

SEQ ID NO: 627761 - DNA, 25 bp, Mus musculus
gaaatccagagggttctttaactac

SEQ ID NO: 627762 - DNA, 25 bp, Mus musculus
gaaatccagatacgaacaggttgac

SEQ ID NO: 627763 - DNA, 25 bp, Mus musculus
gaaatccagataggaacaggttgac

SEQ ID NO: 627764 - DNA, 25 bp, Mus musculus
gaaatccagcacagaggcccgacct

SEQ ID NO: 627765 - DNA, 25 bp, Mus musculus
gaaatccagcactgaggcccgacct

SEQ ID NO: 627766 - DNA, 25 bp, Mus musculus
gaaatccagcgaagatgcaggaaat

SEQ ID NO: 627767 - DNA, 25 bp, Mus musculus
gaaatccagcgatgatgcaggaaat

SEQ ID NO: 627768 - DNA, 25 bp, Mus musculus
gaaatccaggaactaagaagtaaga

SEQ ID NO: 627769 - DNA, 25 bp, Mus musculus
gaaatccaggaagtaagaagtaaga

SEQ ID NO: 627770 - DNA, 25 bp, Mus musculus
gaaatccagttgacattcccaccca

SEQ ID NO: 627771 - DNA, 25 bp, Mus musculus
gaaatccagttgtcattcccaccca

SEQ ID NO: 627772 - DNA, 25 bp, Mus musculus
gaaatccatccccatttgtaccctg

SEQ ID NO: 627773 - DNA, 25 bp, Mus musculus
gaaatccatcccgatttgtaccctg

SEQ ID NO: 627774 - DNA, 25 bp, Mus musculus
gaaatccattgcacaactgaattct

SEQ ID NO: 627775 - DNA, 25 bp, Mus musculus
gaaatccattgctcaactgaattct

SEQ ID NO: 627776 - DNA, 25 bp, Mus musculus
gaaatcccaaccaaggcaagaaggg

SEQ ID NO: 627777 - DNA, 25 bp, Mus musculus
gaaatcccaacctaggcaagaaggg

SEQ ID NO: 627778 - DNA, 25 bp, Mus musculus
gaaatcccaatgctgtagaccagtg

SEQ ID NO: 627779 - DNA, 25 bp, Mus musculus
gaaatcccaatggtgtagaccagtg

SEQ ID NO: 627780 - DNA, 25 bp, Mus musculus
gaaatcccaggaagcagtaggcctt

SEQ ID NO: 627781 - DNA, 25 bp, Mus musculus
gaaatcccaggatgcagtaggcctt

SEQ ID NO: 627782 - DNA, 25 bp, Mus musculus
gaaatcccatcaagagaagccgaat

SEQ ID NO: 627783 - DNA, 25 bp, Mus musculus
gaaatcccatcatgagaagccgaat

SEQ ID NO: 627784 - DNA, 25 bp, Mus musculus
gaaatcccattcatctcaacagcag

SEQ ID NO: 627785 - DNA, 25 bp, Mus musculus
gaaatcccattcttctcaacagcag

SEQ ID NO: 627786 - DNA, 25 bp, Mus musculus
gaaatcccctggagctctataggga

SEQ ID NO: 627787 - DNA, 25 bp, Mus musculus
gaaatcccctggtgctctataggga

SEQ ID NO: 627788 - DNA, 25 bp, Mus musculus
gaaatccctcttcaccacctgtggt

SEQ ID NO: 627789 - DNA, 25 bp, Mus musculus
gaaatccctcttgaccacctgtggt

SEQ ID NO: 627790 - DNA, 25 bp, Mus musculus
gaaatccctgctcaatagatgtgcg

SEQ ID NO: 627791 - DNA, 25 bp, Mus musculus
gaaatccctgctgaatagatgtgcg

SEQ ID NO: 627792 - DNA, 25 bp, Mus musculus
gaaatccgacctcgaaatagaacta

SEQ ID NO: 627793 - DNA, 25 bp, Mus musculus
gaaatccgacctggaaatagaacta

SEQ ID NO: 627794 - DNA, 25 bp, Mus musculus
gaaatccgagtccttcatcttttgg

SEQ ID NO: 627795 - DNA, 25 bp, Mus musculus
gaaatccgagtcgttcatcttttgg

SEQ ID NO: 627796 - DNA, 25 bp, Mus musculus
gaaatccggcaacgcgctcagcgat

SEQ ID NO: 627797 - DNA, 25 bp, Mus musculus
gaaatccggcaaggcgctcagcgat

SEQ ID NO: 627798 - DNA, 25 bp, Mus musculus
gaaatccggcccagagttcctggac

SEQ ID NO: 627799 - DNA, 25 bp, Mus musculus
gaaatccggccctgagttcctggac

SEQ ID NO: 627800 - DNA, 25 bp, Mus musculus
gaaatccggcgaaggcttccaaaac

SEQ ID NO: 627801 - DNA, 25 bp, Mus musculus
gaaatccggcgatggcttccaaaac

SEQ ID NO: 627802 - DNA, 25 bp, Mus musculus
gaaatccgtagccttgtaggctccc

SEQ ID NO: 627803 - DNA, 25 bp, Mus musculus
gaaatccgtagcgttgtaggctccc

SEQ ID NO: 627804 - DNA, 25 bp, Mus musculus
gaaatccgttcacctctccggtggg

SEQ ID NO: 627805 - DNA, 25 bp, Mus musculus
gaaatccgttcagctctccggtggg

SEQ ID NO: 627806 - DNA, 25 bp, Mus musculus
gaaatcctacagacagagctcaaac

SEQ ID NO: 627807 - DNA, 25 bp, Mus musculus
gaaatcctacagtcagagctcaaac

SEQ ID NO: 627808 - DNA, 25 bp, Mus musculus
gaaatcctcactaaggcagtgggaa

SEQ ID NO: 627809 - DNA, 25 bp, Mus musculus
gaaatcctcacttaggcagtgggaa

SEQ ID NO: 627810 - DNA, 25 bp, Mus musculus
gaaatcctctaacaaccattcgaag

SEQ ID NO: 627811 - DNA, 25 bp, Mus musculus
gaaatcctctaagaaccattcgaag

SEQ ID NO: 627812 - DNA, 25 bp, Mus musculus
gaaatcctcttgcatgtggctagaa

SEQ ID NO: 627813 - DNA, 25 bp, Mus musculus
gaaatcctcttggatgtggctagaa

SEQ ID NO: 627814 - DNA, 25 bp, Mus musculus
gaaatcctgaggcagctgtcttcac

SEQ ID NO: 627815 - DNA, 25 bp, Mus musculus
gaaatcctgagggagctgtcttcac

SEQ ID NO: 627816 - DNA, 25 bp, Mus musculus
gaaatcctggccagtgacgctgttg

SEQ ID NO: 627817 - DNA, 25 bp, Mus musculus
gaaatcctggcctgtgacgctgttg

SEQ ID NO: 627818 - DNA, 25 bp, Mus musculus
gaaatcctggctacatctacgagag

SEQ ID NO: 627819 - DNA, 25 bp, Mus musculus
gaaatcctggcttcatctacgagag

SEQ ID NO: 627820 - DNA, 25 bp, Mus musculus
gaaatcctgttcagaagacccgtca

SEQ ID NO: 627821 - DNA, 25 bp, Mus musculus
gaaatcctgttctgaagacccgtca

SEQ ID NO: 627822 - DNA, 25 bp, Mus musculus
gaaatccttctgctcaattgaaggg

SEQ ID NO: 627823 - DNA, 25 bp, Mus musculus
gaaatccttctggtcaattgaaggg

SEQ ID NO: 627824 - DNA, 25 bp, Mus musculus
gaaatcctttgacggtggtgctgct

SEQ ID NO: 627825 - DNA, 25 bp, Mus musculus
gaaatcctttgagggtggtgctgct

SEQ ID NO: 627826 - DNA, 25 bp, Mus musculus
gaaatcgaaggcctgaatgacacct

SEQ ID NO: 627827 - DNA, 25 bp, Mus musculus
gaaatcgaaggcgtgaatgacacct

SEQ ID NO: 627828 - DNA, 25 bp, Mus musculus
gaaatcgaatctatccagccttgca

SEQ ID NO: 627829 - DNA, 25 bp, Mus musculus
gaaatcgaatctttccagccttgca

SEQ ID NO: 627830 - DNA, 25 bp, Mus musculus
gaaatcgataatcccagagaactcc

SEQ ID NO: 627831 - DNA, 25 bp, Mus musculus
gaaatcgataatgccagagaactcc

SEQ ID NO: 627832 - DNA, 25 bp, Mus musculus
gaaatcgcccatcattccgacagat

SEQ ID NO: 627833 - DNA, 25 bp, Mus musculus
gaaatcgcccatgattccgacagat

SEQ ID NO: 627834 - DNA, 25 bp, Mus musculus
gaaatcgccgagagagagctgagct

SEQ ID NO: 627835 - DNA, 25 bp, Mus musculus
gaaatcgccgagtgagagctgagct

SEQ ID NO: 627836 - DNA, 25 bp, Mus musculus
gaaatcgctgtgattagccctcgcc

SEQ ID NO: 627837 - DNA, 25 bp, Mus musculus
gaaatcgctgtgtttagccctcgcc

SEQ ID NO: 627838 - DNA, 25 bp, Mus musculus
gaaatcgcttcccttcggtgtccag

SEQ ID NO: 627839 - DNA, 25 bp, Mus musculus
gaaatcgcttccgttcggtgtccag

SEQ ID NO: 627840 - DNA, 25 bp, Mus musculus
gaaatcggatctatgtctcaagaga

SEQ ID NO: 627841 - DNA, 25 bp, Mus musculus
gaaatcggatctttgtctcaagaga

SEQ ID NO: 627842 - DNA, 25 bp, Mus musculus
gaaatcgggagaagtgctaagtcat

SEQ ID NO: 627843 - DNA, 25 bp, Mus musculus
gaaatcgggagatgtgctaagtcat

SEQ ID NO: 627844 - DNA, 25 bp, Mus musculus
gaaatcgtaaagattagcctgcaga

SEQ ID NO: 627845 - DNA, 25 bp, Mus musculus
gaaatcgtaaagtttagcctgcaga

SEQ ID NO: 627846 - DNA, 25 bp, Mus musculus
gaaatcgtgaagcaaggcaaagtcc

SEQ ID NO: 627847 - DNA, 25 bp, Mus musculus
gaaatcgtgaaggaaggcaaagtcc

SEQ ID NO: 627848 - DNA, 25 bp, Mus musculus
gaaatcgtgacgacatctcggactt

SEQ ID NO: 627849 - DNA, 25 bp, Mus musculus
gaaatcgtgacgtcatctcggactt

SEQ ID NO: 627850 - DNA, 25 bp, Mus musculus
gaaatcgtgtccacattatgcttct

SEQ ID NO: 627851 - DNA, 25 bp, Mus musculus
gaaatcgtgtcctcattatgcttct

SEQ ID NO: 627852 - DNA, 25 bp, Mus musculus
gaaatcgtgtctatcatgatttccg

SEQ ID NO: 627853 - DNA, 25 bp, Mus musculus
gaaatcgtgtctttcatgatttccg

SEQ ID NO: 627854 - DNA, 25 bp, Mus musculus
gaaatctacagcacaggtcggatgg

SEQ ID NO: 627855 - DNA, 25 bp, Mus musculus
gaaatctacagctcaggtcggatgg

SEQ ID NO: 627856 - DNA, 25 bp, Mus musculus
gaaatctacattactgaaggaactc

SEQ ID NO: 627857 - DNA, 25 bp, Mus musculus
gaaatctacatttctgaaggaactc

SEQ ID NO: 627858 - DNA, 25 bp, Mus musculus
gaaatctacgctcctaaactccaag

SEQ ID NO: 627859 - DNA, 25 bp, Mus musculus
gaaatctacgctgctaaactccaag

SEQ ID NO: 627860 - DNA, 25 bp, Mus musculus
gaaatctatcccagcatcactgcag

SEQ ID NO: 627861 - DNA, 25 bp, Mus musculus
gaaatctatccctgcatcactgcag

SEQ ID NO: 627862 - DNA, 25 bp, Mus musculus
gaaatctatgaccacatcgctgatg

SEQ ID NO: 627863 - DNA, 25 bp, Mus musculus
gaaatctatgacgacatcgctgatg

SEQ ID NO: 627864 - DNA, 25 bp, Mus musculus
gaaatctatgctctctctcacagca

SEQ ID NO: 627865 - DNA, 25 bp, Mus musculus
gaaatctatgctgtctctcacagca

SEQ ID NO: 627866 - DNA, 25 bp, Mus musculus
gaaatctatggtcccgtgggctccc

SEQ ID NO: 627867 - DNA, 25 bp, Mus musculus
gaaatctatggtgccgtgggctccc

SEQ ID NO: 627868 - DNA, 25 bp, Mus musculus
gaaatctattccatcgggcgagtgc

SEQ ID NO: 627869 - DNA, 25 bp, Mus musculus
gaaatctattccttcgggcgagtgc

SEQ ID NO: 627870 - DNA, 25 bp, Mus musculus
gaaatctcagagcttcccatccgaa

SEQ ID NO: 627871 - DNA, 25 bp, Mus musculus
gaaatctcagaggttcccatccgaa

SEQ ID NO: 627872 - DNA, 25 bp, Mus musculus
gaaatctccacccagctcattcgct

SEQ ID NO: 627873 - DNA, 25 bp, Mus musculus
gaaatctccaccgagctcattcgct

SEQ ID NO: 627874 - DNA, 25 bp, Mus musculus
gaaatctccccgagcagacaactac

SEQ ID NO: 627875 - DNA, 25 bp, Mus musculus
gaaatctccccgtgcagacaactac

SEQ ID NO: 627876 - DNA, 25 bp, Mus musculus
gaaatctcctttagggcttctggtg

SEQ ID NO: 627877 - DNA, 25 bp, Mus musculus
gaaatctccttttgggcttctggtg

SEQ ID NO: 627878 - DNA, 25 bp, Mus musculus
gaaatctcgtgtagttaagcagcca

SEQ ID NO: 627879 - DNA, 25 bp, Mus musculus
gaaatctcgtgttgttaagcagcca

SEQ ID NO: 627880 - DNA, 25 bp, Mus musculus
gaaatctctcccctcatctcttatg

SEQ ID NO: 627881 - DNA, 25 bp, Mus musculus
gaaatctctcccgtcatctcttatg

SEQ ID NO: 627882 - DNA, 25 bp, Mus musculus
gaaatctctgggataattaacgccc

SEQ ID NO: 627883 - DNA, 25 bp, Mus musculus
gaaatctctgggttaattaacgccc

SEQ ID NO: 627884 - DNA, 25 bp, Mus musculus
gaaatctcttgtatgcctcgctagg

SEQ ID NO: 627885 - DNA, 25 bp, Mus musculus
gaaatctcttgtttgcctcgctagg

SEQ ID NO: 627886 - DNA, 25 bp, Mus musculus
gaaatctgccgcaacctgctgaggc

SEQ ID NO: 627887 - DNA, 25 bp, Mus musculus
gaaatctgccgctacctgctgaggc

SEQ ID NO: 627888 - DNA, 25 bp, Mus musculus
gaaatctgcctaaggatgtttgagt

SEQ ID NO: 627889 - DNA, 25 bp, Mus musculus
gaaatctgcctatggatgtttgagt

SEQ ID NO: 627890 - DNA, 25 bp, Mus musculus
gaaatctggatgcaaaactttgcac

SEQ ID NO: 627891 - DNA, 25 bp, Mus musculus
gaaatctggatggaaaactttgcac

SEQ ID NO: 627892 - DNA, 25 bp, Mus musculus
gaaatctggcatagttgtccctgac

SEQ ID NO: 627893 - DNA, 25 bp, Mus musculus
gaaatctggcattgttgtccctgac

SEQ ID NO: 627894 - DNA, 25 bp, Mus musculus
gaaatctggttccattgctgcttgc

SEQ ID NO: 627895 - DNA, 25 bp, Mus musculus
gaaatctggttcgattgctgcttgc

SEQ ID NO: 627896 - DNA, 25 bp, Mus musculus
gaaatctgtatgacatgttccacac

SEQ ID NO: 627897 - DNA, 25 bp, Mus musculus
gaaatctgtatgtcatgttccacac

SEQ ID NO: 627898 - DNA, 25 bp, Mus musculus
gaaatctgtcagatttagcttttaa

SEQ ID NO: 627899 - DNA, 25 bp, Mus musculus
gaaatctgtcagttttagcttttaa

SEQ ID NO: 627900 - DNA, 25 bp, Mus musculus
gaaatctgtcatccagcttgacctt

SEQ ID NO: 627901 - DNA, 25 bp, Mus musculus
gaaatctgtcatgcagcttgacctt

SEQ ID NO: 627902 - DNA, 25 bp, Mus musculus
gaaatctgtctgaagcttagcctga

SEQ ID NO: 627903 - DNA, 25 bp, Mus musculus
gaaatctgtctgtagcttagcctga

SEQ ID NO: 627904 - DNA, 25 bp, Mus musculus
gaaatctgtcttcccctctgaaacg

SEQ ID NO: 627905 - DNA, 25 bp, Mus musculus
gaaatctgtcttgccctctgaaacg

SEQ ID NO: 627906 - DNA, 25 bp, Mus musculus
gaaatctgtgttccctgcaactgtt

SEQ ID NO: 627907 - DNA, 25 bp, Mus musculus
gaaatctgtgttgcctgcaactgtt

SEQ ID NO: 627908 - DNA, 25 bp, Mus musculus
gaaatcttactaacttgccttctga

SEQ ID NO: 627909 - DNA, 25 bp, Mus musculus
gaaatcttactatcttgccttctga

SEQ ID NO: 627910 - DNA, 25 bp, Mus musculus
gaaatcttagaacatcaggacttac

SEQ ID NO: 627911 - DNA, 25 bp, Mus musculus
gaaatcttagaagatcaggacttac

SEQ ID NO: 627912 - DNA, 25 bp, Mus musculus
gaaatcttcaggaccaccttcttac

SEQ ID NO: 627913 - DNA, 25 bp, Mus musculus
gaaatcttcaggtccaccttcttac

SEQ ID NO: 627914 - DNA, 25 bp, Mus musculus
gaaatcttctagacttaagtccaga

SEQ ID NO: 627915 - DNA, 25 bp, Mus musculus
gaaatcttctagtcttaagtccaga

SEQ ID NO: 627916 - DNA, 25 bp, Mus musculus
gaaatcttgcgacttactgttcagg

SEQ ID NO: 627917 - DNA, 25 bp, Mus musculus
gaaatcttgcgagttactgttcagg

SEQ ID NO: 627918 - DNA, 25 bp, Mus musculus
gaaatcttggtacaagagagcaacg

SEQ ID NO: 627919 - DNA, 25 bp, Mus musculus
gaaatcttggtagaagagagcaacg

SEQ ID NO: 627920 - DNA, 25 bp, Mus musculus
gaaatcttgtggatcaaggaaatgg

SEQ ID NO: 627921 - DNA, 25 bp, Mus musculus
gaaatcttgtggttcaaggaaatgg

SEQ ID NO: 627922 - DNA, 25 bp, Mus musculus
gaaatgaaaaccattaggcttcgag

SEQ ID NO: 627923 - DNA, 25 bp, Mus musculus
gaaatgaaaacctttaggcttcgag

SEQ ID NO: 627924 - DNA, 25 bp, Mus musculus
gaaatgaaaccccagctactgagtg

SEQ ID NO: 627925 - DNA, 25 bp, Mus musculus
gaaatgaaacccgagctactgagtg

SEQ ID NO: 627926 - DNA, 25 bp, Mus musculus
gaaatgaaagacaaccacagtggtc

SEQ ID NO: 627927 - DNA, 25 bp, Mus musculus
gaaatgaaagactaccacagtggtc

SEQ ID NO: 627928 - DNA, 25 bp, Mus musculus
gaaatgaacagactctggcttcagg

SEQ ID NO: 627929 - DNA, 25 bp, Mus musculus
gaaatgaacagagtctggcttcagg

SEQ ID NO: 627930 - DNA, 25 bp, Mus musculus
gaaatgaacctgagtctgagaaggt

SEQ ID NO: 627931 - DNA, 25 bp, Mus musculus
gaaatgaacctgtgtctgagaaggt

SEQ ID NO: 627932 - DNA, 25 bp, Mus musculus
gaaatgaagcacctagccagcagag

SEQ ID NO: 627933 - DNA, 25 bp, Mus musculus
gaaatgaagcacgtagccagcagag

SEQ ID NO: 627934 - DNA, 25 bp, Mus musculus
gaaatgaagcgtcctaaagtgtccc

SEQ ID NO: 627935 - DNA, 25 bp, Mus musculus
gaaatgaagcgtgctaaagtgtccc

SEQ ID NO: 627936 - DNA, 25 bp, Mus musculus
gaaatgaattacctggcatccaagg

SEQ ID NO: 627937 - DNA, 25 bp, Mus musculus
gaaatgaattacgtggcatccaagg

SEQ ID NO: 627938 - DNA, 25 bp, Mus musculus
gaaatgaattctcccaaagagaaat

SEQ ID NO: 627939 - DNA, 25 bp, Mus musculus
gaaatgaattctgccaaagagaaat

SEQ ID NO: 627940 - DNA, 25 bp, Mus musculus
gaaatgacacccagacaactgcagt

SEQ ID NO: 627941 - DNA, 25 bp, Mus musculus
gaaatgacaccctgacaactgcagt

SEQ ID NO: 627942 - DNA, 25 bp, Mus musculus
gaaatgaccatgctcatcgggtgcc

SEQ ID NO: 627943 - DNA, 25 bp, Mus musculus
gaaatgaccatggtcatcgggtgcc

SEQ ID NO: 627944 - DNA, 25 bp, Mus musculus
gaaatgaccggcagggcctgtacac

SEQ ID NO: 627945 - DNA, 25 bp, Mus musculus
gaaatgaccggctgggcctgtacac

SEQ ID NO: 627946 - DNA, 25 bp, Mus musculus
gaaatgacgaaactaccatgcctac

SEQ ID NO: 627947 - DNA, 25 bp, Mus musculus
gaaatgacgaaagtaccatgcctac

SEQ ID NO: 627948 - DNA, 25 bp, Mus musculus
gaaatgactatacttggtattgtct

SEQ ID NO: 627949 - DNA, 25 bp, Mus musculus
gaaatgactatagttggtattgtct

SEQ ID NO: 627950 - DNA, 25 bp, Mus musculus
gaaatgacttcacccaaaccaccat

SEQ ID NO: 627951 - DNA, 25 bp, Mus musculus
gaaatgacttcagccaaaccaccat

SEQ ID NO: 627952 - DNA, 25 bp, Mus musculus
gaaatgagaaaactagtttgcgaac

SEQ ID NO: 627953 - DNA, 25 bp, Mus musculus
gaaatgagaaaagtagtttgcgaac

SEQ ID NO: 627954 - DNA, 25 bp, Mus musculus
gaaatgagacaaacccacaccatgg

SEQ ID NO: 627955 - DNA, 25 bp, Mus musculus
gaaatgagacaatcccacaccatgg

SEQ ID NO: 627956 - DNA, 25 bp, Mus musculus
gaaatgagacgaaggagcgccaagt

SEQ ID NO: 627957 - DNA, 25 bp, Mus musculus
gaaatgagacgatggagcgccaagt

SEQ ID NO: 627958 - DNA, 25 bp, Mus musculus
gaaatgagatatataaacggactgt

SEQ ID NO: 627959 - DNA, 25 bp, Mus musculus
gaaatgagatatttaaacggactgt

SEQ ID NO: 627960 - DNA, 25 bp, Mus musculus
gaaatgagatcacctttactagcag

SEQ ID NO: 627961 - DNA, 25 bp, Mus musculus
gaaatgagatcagctttactagcag

SEQ ID NO: 627962 - DNA, 25 bp, Mus musculus
gaaatgagcatcactgctaaaggag

SEQ ID NO: 627963 - DNA, 25 bp, Mus musculus
gaaatgagcatctctgctaaaggag

SEQ ID NO: 627964 - DNA, 25 bp, Mus musculus
gaaatgagccagcacataatcaaat

SEQ ID NO: 627965 - DNA, 25 bp, Mus musculus
gaaatgagccaggacataatcaaat

SEQ ID NO: 627966 - DNA, 25 bp, Mus musculus
gaaatgagccgacactccaagtgca

SEQ ID NO: 627967 - DNA, 25 bp, Mus musculus
gaaatgagccgagactccaagtgca

SEQ ID NO: 627968 - DNA, 25 bp, Mus musculus
gaaatgagcgagatttcgtatcctg

SEQ ID NO: 627969 - DNA, 25 bp, Mus musculus
gaaatgagcgagttttcgtatcctg

SEQ ID NO: 627970 - DNA, 25 bp, Mus musculus
gaaatgagctataccaagttcaaga

SEQ ID NO: 627971 - DNA, 25 bp, Mus musculus
gaaatgagctattccaagttcaaga

SEQ ID NO: 627972 - DNA, 25 bp, Mus musculus
gaaatgagtaccacaggctgggtcg

SEQ ID NO: 627973 - DNA, 25 bp, Mus musculus
gaaatgagtacctcaggctgggtcg

SEQ ID NO: 627974 - DNA, 25 bp, Mus musculus
gaaatgagtattcctgctcatctag

SEQ ID NO: 627975 - DNA, 25 bp, Mus musculus
gaaatgagtattgctgctcatctag

SEQ ID NO: 627976 - DNA, 25 bp, Mus musculus
gaaatgagttgtatgtcagttctag

SEQ ID NO: 627977 - DNA, 25 bp, Mus musculus
gaaatgagttgtttgtcagttctag

SEQ ID NO: 627978 - DNA, 25 bp, Mus musculus
gaaatgatcgttacaactacgtggt

SEQ ID NO: 627979 - DNA, 25 bp, Mus musculus
gaaatgatcgtttcaactacgtggt

SEQ ID NO: 627980 - DNA, 25 bp, Mus musculus
gaaatgatgaagctctcagaagaaa

SEQ ID NO: 627981 - DNA, 25 bp, Mus musculus
gaaatgatgaaggtctcagaagaaa

SEQ ID NO: 627982 - DNA, 25 bp, Mus musculus
gaaatgatgcttcagtttactgtca

SEQ ID NO: 627983 - DNA, 25 bp, Mus musculus
gaaatgatgcttgagtttactgtca

SEQ ID NO: 627984 - DNA, 25 bp, Mus musculus
gaaatgatggatctcaagcacttca

SEQ ID NO: 627985 - DNA, 25 bp, Mus musculus
gaaatgatggatgtcaagcacttca

SEQ ID NO: 627986 - DNA, 25 bp, Mus musculus
gaaatgatgtcaagtcttcacaaaa

SEQ ID NO: 627987 - DNA, 25 bp, Mus musculus
gaaatgatgtcatgtcttcacaaaa

SEQ ID NO: 627988 - DNA, 25 bp, Mus musculus
gaaatgattcacatatgcttcccgt

SEQ ID NO: 627989 - DNA, 25 bp, Mus musculus
gaaatgattcacttatgcttcccgt

SEQ ID NO: 627990 - DNA, 25 bp, Mus musculus
gaaatgattgacagattcttcacaa

SEQ ID NO: 627991 - DNA, 25 bp, Mus musculus
gaaatgattgactgattcttcacaa

SEQ ID NO: 627992 - DNA, 25 bp, Mus musculus
gaaatgattgttcgagcaagacaga

SEQ ID NO: 627993 - DNA, 25 bp, Mus musculus
gaaatgattgttggagcaagacaga

SEQ ID NO: 627994 - DNA, 25 bp, Mus musculus
gaaatgcaaataatggtaacctact

SEQ ID NO: 627995 - DNA, 25 bp, Mus musculus
gaaatgcaaatattggtaacctact

SEQ ID NO: 627996 - DNA, 25 bp, Mus musculus
gaaatgcaaccgacagcgatcttag

SEQ ID NO: 627997 - DNA, 25 bp, Mus musculus
gaaatgcaaccgtcagcgatcttag

SEQ ID NO: 627998 - DNA, 25 bp, Mus musculus
gaaatgcaagacaagcagagtcggc

SEQ ID NO: 627999 - DNA, 25 bp, Mus musculus
gaaatgcaagactagcagagtcggc

SEQ ID NO: 628000 - DNA, 25 bp, Mus musculus
gaaatgcaagagaaacttcagaatt

SEQ ID NO: 628001 - DNA, 25 bp, Mus musculus
gaaatgcaagagtaacttcagaatt

SEQ ID NO: 628002 - DNA, 25 bp, Mus musculus
gaaatgcaagtgattatcaccagga

SEQ ID NO: 628003 - DNA, 25 bp, Mus musculus
gaaatgcaagtgtttatcaccagga

SEQ ID NO: 628004 - DNA, 25 bp, Mus musculus
gaaatgcaatacatgatatcctggt

SEQ ID NO: 628005 - DNA, 25 bp, Mus musculus
gaaatgcaatacttgatatcctggt

SEQ ID NO: 628006 - DNA, 25 bp, Mus musculus
gaaatgcacatacccggtcctcaag

SEQ ID NO: 628007 - DNA, 25 bp, Mus musculus
gaaatgcacatagccggtcctcaag

SEQ ID NO: 628008 - DNA, 25 bp, Mus musculus
gaaatgcacttacaagtggtggcca

SEQ ID NO: 628009 - DNA, 25 bp, Mus musculus
gaaatgcacttagaagtggtggcca

SEQ ID NO: 628010 - DNA, 25 bp, Mus musculus
gaaatgcagcatcacagtatcacag

SEQ ID NO: 628011 - DNA, 25 bp, Mus musculus
gaaatgcagcatgacagtatcacag

SEQ ID NO: 628012 - DNA, 25 bp, Mus musculus
gaaatgcagcgtagagcaccatacg

SEQ ID NO: 628013 - DNA, 25 bp, Mus musculus
gaaatgcagcgttgagcaccatacg

SEQ ID NO: 628014 - DNA, 25 bp, Mus musculus
gaaatgcaggaaccctcaggtcagt

SEQ ID NO: 628015 - DNA, 25 bp, Mus musculus
gaaatgcaggaagcctcaggtcagt

SEQ ID NO: 628016 - DNA, 25 bp, Mus musculus
gaaatgcatcctccgcaaccttggt

SEQ ID NO: 628017 - DNA, 25 bp, Mus musculus
gaaatgcatcctgcgcaaccttggt

SEQ ID NO: 628018 - DNA, 25 bp, Mus musculus
gaaatgcattcgctacttacccgga

SEQ ID NO: 628019 - DNA, 25 bp, Mus musculus
gaaatgcattcggtacttacccgga

SEQ ID NO: 628020 - DNA, 25 bp, Mus musculus
gaaatgcattgaatgtgttcagcca

SEQ ID NO: 628021 - DNA, 25 bp, Mus musculus
gaaatgcattgattgtgttcagcca

SEQ ID NO: 628022 - DNA, 25 bp, Mus musculus
gaaatgccaagtccccaagaaaacc

SEQ ID NO: 628023 - DNA, 25 bp, Mus musculus
gaaatgccaagtgcccaagaaaacc

SEQ ID NO: 628024 - DNA, 25 bp, Mus musculus
gaaatgccagcacgtaaacagaccc

SEQ ID NO: 628025 - DNA, 25 bp, Mus musculus
gaaatgccagcaggtaaacagaccc

SEQ ID NO: 628026 - DNA, 25 bp, Mus musculus
gaaatgccaggaacaaaaagacacc

SEQ ID NO: 628027 - DNA, 25 bp, Mus musculus
gaaatgccaggatcaaaaagacacc

SEQ ID NO: 628028 - DNA, 25 bp, Mus musculus
gaaatgccatccaccctggggaccg

SEQ ID NO: 628029 - DNA, 25 bp, Mus musculus
gaaatgccatcctccctggggaccg

SEQ ID NO: 628030 - DNA, 25 bp, Mus musculus
gaaatgccatctactttgctgttgg

SEQ ID NO: 628031 - DNA, 25 bp, Mus musculus
gaaatgccatcttctttgctgttgg

SEQ ID NO: 628032 - DNA, 25 bp, Mus musculus
gaaatgccattgatccgagggaact

SEQ ID NO: 628033 - DNA, 25 bp, Mus musculus
gaaatgccattgttccgagggaact

SEQ ID NO: 628034 - DNA, 25 bp, Mus musculus
gaaatgcccaatcgctacaacacag

SEQ ID NO: 628035 - DNA, 25 bp, Mus musculus
gaaatgcccaatggctacaacacag

SEQ ID NO: 628036 - DNA, 25 bp, Mus musculus
gaaatgcccaggctattgctgacct

SEQ ID NO: 628037 - DNA, 25 bp, Mus musculus
gaaatgcccagggtattgctgacct

SEQ ID NO: 628038 - DNA, 25 bp, Mus musculus
gaaatgccctcgcatcagacctacg

SEQ ID NO: 628039 - DNA, 25 bp, Mus musculus
gaaatgccctcggatcagacctacg

SEQ ID NO: 628040 - DNA, 25 bp, Mus musculus
gaaatgccctttcctgacagcacaa

SEQ ID NO: 628041 - DNA, 25 bp, Mus musculus
gaaatgccctttgctgacagcacaa

SEQ ID NO: 628042 - DNA, 25 bp, Mus musculus
gaaatgccgaatcaaaatgataagc

SEQ ID NO: 628043 - DNA, 25 bp, Mus musculus
gaaatgccgaatgaaaatgataagc

SEQ ID NO: 628044 - DNA, 25 bp, Mus musculus
gaaatgccgcagatatccggtacgc

SEQ ID NO: 628045 - DNA, 25 bp, Mus musculus
gaaatgccgcagttatccggtacgc

SEQ ID NO: 628046 - DNA, 25 bp, Mus musculus
gaaatgccgggcactcaatgctgcc

SEQ ID NO: 628047 - DNA, 25 bp, Mus musculus
gaaatgccgggctctcaatgctgcc

SEQ ID NO: 628048 - DNA, 25 bp, Mus musculus
gaaatgcctatgctttccctaaaga

SEQ ID NO: 628049 - DNA, 25 bp, Mus musculus
gaaatgcctatggtttccctaaaga

SEQ ID NO: 628050 - DNA, 25 bp, Mus musculus
gaaatgcctctgaagaatgttttta

SEQ ID NO: 628051 - DNA, 25 bp, Mus musculus
gaaatgcctctgtagaatgttttta

SEQ ID NO: 628052 - DNA, 25 bp, Mus musculus
gaaatgcctgcaatcccctgaaaag

SEQ ID NO: 628053 - DNA, 25 bp, Mus musculus
gaaatgcctgcattcccctgaaaag

SEQ ID NO: 628054 - DNA, 25 bp, Mus musculus
gaaatgccttcaacagacttgcctc

SEQ ID NO: 628055 - DNA, 25 bp, Mus musculus
gaaatgccttcatcagacttgcctc

SEQ ID NO: 628056 - DNA, 25 bp, Mus musculus
gaaatgcggacccaaatactgcttg

SEQ ID NO: 628057 - DNA, 25 bp, Mus musculus
gaaatgcggaccgaaatactgcttg

SEQ ID NO: 628058 - DNA, 25 bp, Mus musculus
gaaatgcgtgcacaagattcagagc

SEQ ID NO: 628059 - DNA, 25 bp, Mus musculus
gaaatgcgtgcagaagattcagagc

SEQ ID NO: 628060 - DNA, 25 bp, Mus musculus
gaaatgctaagcagaccctctctac

SEQ ID NO: 628061 - DNA, 25 bp, Mus musculus
gaaatgctaagctgaccctctctac

SEQ ID NO: 628062 - DNA, 25 bp, Mus musculus
gaaatgctactgcaagccacagcgg

SEQ ID NO: 628063 - DNA, 25 bp, Mus musculus
gaaatgctactggaagccacagcgg

SEQ ID NO: 628064 - DNA, 25 bp, Mus musculus
gaaatgctcacccagaagtatgaag

SEQ ID NO: 628065 - DNA, 25 bp, Mus musculus
gaaatgctcaccgagaagtatgaag

SEQ ID NO: 628066 - DNA, 25 bp, Mus musculus
gaaatgctcagtcctctacaacagt

SEQ ID NO: 628067 - DNA, 25 bp, Mus musculus
gaaatgctcagtgctctacaacagt

SEQ ID NO: 628068 - DNA, 25 bp, Mus musculus
gaaatgctgaaacttcttcttctaa

SEQ ID NO: 628069 - DNA, 25 bp, Mus musculus
gaaatgctgaaagttcttcttctaa

SEQ ID NO: 628070 - DNA, 25 bp, Mus musculus
gaaatgctgacccaacccttagaca

SEQ ID NO: 628071 - DNA, 25 bp, Mus musculus
gaaatgctgaccgaacccttagaca

SEQ ID NO: 628072 - DNA, 25 bp, Mus musculus
gaaatgctgaggaacttcatccaaa

SEQ ID NO: 628073 - DNA, 25 bp, Mus musculus
gaaatgctgaggtacttcatccaaa

SEQ ID NO: 628074 - DNA, 25 bp, Mus musculus
gaaatgctgccaatgttaagccctc

SEQ ID NO: 628075 - DNA, 25 bp, Mus musculus
gaaatgctgccattgttaagccctc

SEQ ID NO: 628076 - DNA, 25 bp, Mus musculus
gaaatgctgctcctggtccagtcct

SEQ ID NO: 628077 - DNA, 25 bp, Mus musculus
gaaatgctgctcgtggtccagtcct

SEQ ID NO: 628078 - DNA, 25 bp, Mus musculus
gaaatgctgggaagaaaagtttgag

SEQ ID NO: 628079 - DNA, 25 bp, Mus musculus
gaaatgctgggatgaaaagtttgag

SEQ ID NO: 628080 - DNA, 25 bp, Mus musculus
gaaatgctgtccatgctgggagacc

SEQ ID NO: 628081 - DNA, 25 bp, Mus musculus
gaaatgctgtccttgctgggagacc

SEQ ID NO: 628082 - DNA, 25 bp, Mus musculus
gaaatgcttgcaaaacataacatcg

SEQ ID NO: 628083 - DNA, 25 bp, Mus musculus
gaaatgcttgcataacataacatcg

SEQ ID NO: 628084 - DNA, 25 bp, Mus musculus
gaaatgctttgccttgcggatcgcc

SEQ ID NO: 628085 - DNA, 25 bp, Mus musculus
gaaatgctttgcgttgcggatcgcc

SEQ ID NO: 628086 - DNA, 25 bp, Mus musculus
gaaatggaaaacagcaatggatctt

SEQ ID NO: 628087 - DNA, 25 bp, Mus musculus
gaaatggaaaactgcaatggatctt

SEQ ID NO: 628088 - DNA, 25 bp, Mus musculus
gaaatggaaacaccgttgtcagcac

SEQ ID NO: 628089 - DNA, 25 bp, Mus musculus
gaaatggaaacagcgttgtcagcac

SEQ ID NO: 628090 - DNA, 25 bp, Mus musculus
gaaatggacacacaacaaaagaacc

SEQ ID NO: 628091 - DNA, 25 bp, Mus musculus
gaaatggacacaccaagtatctacc

SEQ ID NO: 628092 - DNA, 25 bp, Mus musculus
gaaatggacacagaacaaaagaacc

SEQ ID NO: 628093 - DNA, 25 bp, Mus musculus
gaaatggacacagcaagtatctacc

SEQ ID NO: 628094 - DNA, 25 bp, Mus musculus
gaaatggacagtacacttgctgttc

SEQ ID NO: 628095 - DNA, 25 bp, Mus musculus
gaaatggacagttcacttgctgttc

SEQ ID NO: 628096 - DNA, 25 bp, Mus musculus
gaaatggacatgaaatctagtgcaa

SEQ ID NO: 628097 - DNA, 25 bp, Mus musculus
gaaatggacatgtaatctagtgcaa

SEQ ID NO: 628098 - DNA, 25 bp, Mus musculus
gaaatggagcacagatgacgtgcag

SEQ ID NO: 628099 - DNA, 25 bp, Mus musculus
gaaatggagcactgatgacgtgcag

SEQ ID NO: 628100 - DNA, 25 bp, Mus musculus
gaaatggagcctactgatgcacaaa

SEQ ID NO: 628101 - DNA, 25 bp, Mus musculus
gaaatggagcctcgacttaagcctg

SEQ ID NO: 628102 - DNA, 25 bp, Mus musculus
gaaatggagcctggacttaagcctg

SEQ ID NO: 628103 - DNA, 25 bp, Mus musculus
gaaatggagccttctgatgcacaaa

SEQ ID NO: 628104 - DNA, 25 bp, Mus musculus
gaaatggaggccctgaacagatcta

SEQ ID NO: 628105 - DNA, 25 bp, Mus musculus
gaaatggaggccgtgaacagatcta

SEQ ID NO: 628106 - DNA, 25 bp, Mus musculus
gaaatggaggctcaactaaactcca

SEQ ID NO: 628107 - DNA, 25 bp, Mus musculus
gaaatggaggctgaactaaactcca

SEQ ID NO: 628108 - DNA, 25 bp, Mus musculus
gaaatggaggtgagagtttcacagc

SEQ ID NO: 628109 - DNA, 25 bp, Mus musculus
gaaatggaggtgcttcatctacgga

SEQ ID NO: 628110 - DNA, 25 bp, Mus musculus
gaaatggaggtggttcatctacgga

SEQ ID NO: 628111 - DNA, 25 bp, Mus musculus
gaaatggaggtgtgagtttcacagc

SEQ ID NO: 628112 - DNA, 25 bp, Mus musculus
gaaatggagttcctatcctcccaag

SEQ ID NO: 628113 - DNA, 25 bp, Mus musculus
gaaatggagttcgtatcctcccaag

SEQ ID NO: 628114 - DNA, 25 bp, Mus musculus
gaaatggatcgtaccccgtcggttg

SEQ ID NO: 628115 - DNA, 25 bp, Mus musculus
gaaatggatcgttccccgtcggttg

SEQ ID NO: 628116 - DNA, 25 bp, Mus musculus
gaaatggatgccatttactaaccca

SEQ ID NO: 628117 - DNA, 25 bp, Mus musculus
gaaatggatgccttttactaaccca

SEQ ID NO: 628118 - DNA, 25 bp, Mus musculus
gaaatggatttcaatactgtggaca

SEQ ID NO: 628119 - DNA, 25 bp, Mus musculus
gaaatggatttctatactgtggaca

SEQ ID NO: 628120 - DNA, 25 bp, Mus musculus
gaaatggcaaccagtcatgtacaga

SEQ ID NO: 628121 - DNA, 25 bp, Mus musculus
gaaatggcaacctgtcatgtacaga

SEQ ID NO: 628122 - DNA, 25 bp, Mus musculus
gaaatggcacctatggacaagtcta

SEQ ID NO: 628123 - DNA, 25 bp, Mus musculus
gaaatggcacctttggacaagtcta

SEQ ID NO: 628124 - DNA, 25 bp, Mus musculus
gaaatggcagacacaaatagatccc

SEQ ID NO: 628125 - DNA, 25 bp, Mus musculus
gaaatggcagaccatatgatggcca

SEQ ID NO: 628126 - DNA, 25 bp, Mus musculus
gaaatggcagacgatatgatggcca

SEQ ID NO: 628127 - DNA, 25 bp, Mus musculus
gaaatggcagactcaaatagatccc

SEQ ID NO: 628128 - DNA, 25 bp, Mus musculus
gaaatggcagcaccattcctcaatg

SEQ ID NO: 628129 - DNA, 25 bp, Mus musculus
gaaatggcagcagcattcctcaatg

SEQ ID NO: 628130 - DNA, 25 bp, Mus musculus
gaaatggccaggacattcaactgtg

SEQ ID NO: 628131 - DNA, 25 bp, Mus musculus
gaaatggccaggtcattcaactgtg

SEQ ID NO: 628132 - DNA, 25 bp, Mus musculus
gaaatggccattcccttcttcacgg

SEQ ID NO: 628133 - DNA, 25 bp, Mus musculus
gaaatggccattgccttcttcacgg

SEQ ID NO: 628134 - DNA, 25 bp, Mus musculus
gaaatggcccataccgtcagctctt

SEQ ID NO: 628135 - DNA, 25 bp, Mus musculus
gaaatggcccattccgtcagctctt

SEQ ID NO: 628136 - DNA, 25 bp, Mus musculus
gaaatggcccggaggaactggatat

SEQ ID NO: 628137 - DNA, 25 bp, Mus musculus
gaaatggcccggtggaactggatat

SEQ ID NO: 628138 - DNA, 25 bp, Mus musculus
gaaatggccgagcacggctgtggcc

SEQ ID NO: 628139 - DNA, 25 bp, Mus musculus
gaaatggccgaggacggctgtggcc

SEQ ID NO: 628140 - DNA, 25 bp, Mus musculus
gaaatggcggttagaagcacttcac

SEQ ID NO: 628141 - DNA, 25 bp, Mus musculus
gaaatggcggtttgaagcacttcac

SEQ ID NO: 628142 - DNA, 25 bp, Mus musculus
gaaatggctattcatatcattcctc

SEQ ID NO: 628143 - DNA, 25 bp, Mus musculus
gaaatggctattgatatcattcctc

SEQ ID NO: 628144 - DNA, 25 bp, Mus musculus
gaaatggctgcactcccgagctgtg

SEQ ID NO: 628145 - DNA, 25 bp, Mus musculus
gaaatggctgcagtcccgagctgtg

SEQ ID NO: 628146 - DNA, 25 bp, Mus musculus
gaaatggcttcaatgcagagacagg

SEQ ID NO: 628147 - DNA, 25 bp, Mus musculus
gaaatggcttcattgcagagacagg

SEQ ID NO: 628148 - DNA, 25 bp, Mus musculus
gaaatgggaagaagctcaaattacc

SEQ ID NO: 628149 - DNA, 25 bp, Mus musculus
gaaatgggaagactccgcccacccg

SEQ ID NO: 628150 - DNA, 25 bp, Mus musculus
gaaatgggaagagtccgcccacccg

SEQ ID NO: 628151 - DNA, 25 bp, Mus musculus
gaaatgggaagatgctcaaattacc

SEQ ID NO: 628152 - DNA, 25 bp, Mus musculus
gaaatgggaatgaggcacagaaaga

SEQ ID NO: 628153 - DNA, 25 bp, Mus musculus
gaaatgggaatgtggcacagaaaga

SEQ ID NO: 628154 - DNA, 25 bp, Mus musculus
gaaatgggaattaaacacatacttg

SEQ ID NO: 628155 - DNA, 25 bp, Mus musculus
gaaatgggaatttaacacatacttg

SEQ ID NO: 628156 - DNA, 25 bp, Mus musculus
gaaatgggacccacttatgcagatc

SEQ ID NO: 628157 - DNA, 25 bp, Mus musculus
gaaatgggaccctcttatgcagatc

SEQ ID NO: 628158 - DNA, 25 bp, Mus musculus
gaaatgggcggcactatcccgtcat

SEQ ID NO: 628159 - DNA, 25 bp, Mus musculus
gaaatgggcggctctatcccgtcat

SEQ ID NO: 628160 - DNA, 25 bp, Mus musculus
gaaatgggtagactttggaactact

SEQ ID NO: 628161 - DNA, 25 bp, Mus musculus
gaaatgggtagagtttggaactact

SEQ ID NO: 628162 - DNA, 25 bp, Mus musculus
gaaatgggtcttatgacattggcat

SEQ ID NO: 628163 - DNA, 25 bp, Mus musculus
gaaatgggtcttttgacattggcat

SEQ ID NO: 628164 - DNA, 25 bp, Mus musculus
gaaatgggtgccatctcaacactaa

SEQ ID NO: 628165 - DNA, 25 bp, Mus musculus
gaaatgggtgccttctcaacactaa

SEQ ID NO: 628166 - DNA, 25 bp, Mus musculus
gaaatggtacaaactcaaagggtga

SEQ ID NO: 628167 - DNA, 25 bp, Mus musculus
gaaatggtacaatctcaaagggtga

SEQ ID NO: 628168 - DNA, 25 bp, Mus musculus
gaaatggtaggcagcttcacacctc

SEQ ID NO: 628169 - DNA, 25 bp, Mus musculus
gaaatggtaggctgcttcacacctc

SEQ ID NO: 628170 - DNA, 25 bp, Mus musculus
gaaatggtcatcaggtaagcagtct

SEQ ID NO: 628171 - DNA, 25 bp, Mus musculus
gaaatggtcatctggtaagcagtct

SEQ ID NO: 628172 - DNA, 25 bp, Mus musculus
gaaatggtgcccaggatcagcctac

SEQ ID NO: 628173 - DNA, 25 bp, Mus musculus
gaaatggtgccctggatcagcctac

SEQ ID NO: 628174 - DNA, 25 bp, Mus musculus
gaaatggtgcctcttactgtgtaaa

SEQ ID NO: 628175 - DNA, 25 bp, Mus musculus
gaaatggtgcctgttactgtgtaaa

SEQ ID NO: 628176 - DNA, 25 bp, Mus musculus
gaaatggtggagctcttttctacca

SEQ ID NO: 628177 - DNA, 25 bp, Mus musculus
gaaatggtggaggtcttttctacca

SEQ ID NO: 628178 - DNA, 25 bp, Mus musculus
gaaatggtggcaagtcctacatcta

SEQ ID NO: 628179 - DNA, 25 bp, Mus musculus
gaaatggtggcatgtcctacatcta

SEQ ID NO: 628180 - DNA, 25 bp, Mus musculus
gaaatggtgggtctcagcactcctg

SEQ ID NO: 628181 - DNA, 25 bp, Mus musculus
gaaatggtgggtgtcagcactcctg

SEQ ID NO: 628182 - DNA, 25 bp, Mus musculus
gaaatggtgttaaacctgcctagaa

SEQ ID NO: 628183 - DNA, 25 bp, Mus musculus
gaaatggtgttatacctgcctagaa

SEQ ID NO: 628184 - DNA, 25 bp, Mus musculus
gaaatggtgttcatctcagacatga

SEQ ID NO: 628185 - DNA, 25 bp, Mus musculus
gaaatggtgttcttctcagacatga

SEQ ID NO: 628186 - DNA, 25 bp, Mus musculus
gaaatggtgttgcatatcaacctca

SEQ ID NO: 628187 - DNA, 25 bp, Mus musculus
gaaatggtgttggatatcaacctca

SEQ ID NO: 628188 - DNA, 25 bp, Mus musculus
gaaatggttaagcaactagatggcc

SEQ ID NO: 628189 - DNA, 25 bp, Mus musculus
gaaatggttaaggaactagatggcc

SEQ ID NO: 628190 - DNA, 25 bp, Mus musculus
gaaatggttcaaagcagggttagag

SEQ ID NO: 628191 - DNA, 25 bp, Mus musculus
gaaatggttcaatgcagggttagag

SEQ ID NO: 628192 - DNA, 25 bp, Mus musculus
gaaatgtaacgcaaaaggaaataga

SEQ ID NO: 628193 - DNA, 25 bp, Mus musculus
gaaatgtaacgctaaaggaaataga

SEQ ID NO: 628194 - DNA, 25 bp, Mus musculus
gaaatgtacactaccactgacgggc

SEQ ID NO: 628195 - DNA, 25 bp, Mus musculus
gaaatgtacacttccactgacgggc

SEQ ID NO: 628196 - DNA, 25 bp, Mus musculus
gaaatgtaccaaagtcggaggctca

SEQ ID NO: 628197 - DNA, 25 bp, Mus musculus
gaaatgtaccaatgtcggaggctca

SEQ ID NO: 628198 - DNA, 25 bp, Mus musculus
gaaatgtactagagtggccagcctg

SEQ ID NO: 628199 - DNA, 25 bp, Mus musculus
gaaatgtactagtgtggccagcctg

SEQ ID NO: 628200 - DNA, 25 bp, Mus musculus
gaaatgtagctgacaactgtccccg

SEQ ID NO: 628201 - DNA, 25 bp, Mus musculus
gaaatgtagctgtcaactgtccccg

SEQ ID NO: 628202 - DNA, 25 bp, Mus musculus
gaaatgtatcctcccacctagctgg

SEQ ID NO: 628203 - DNA, 25 bp, Mus musculus
gaaatgtatcctgccacctagctgg

SEQ ID NO: 628204 - DNA, 25 bp, Mus musculus
gaaatgtatgcacactttttcgcac

SEQ ID NO: 628205 - DNA, 25 bp, Mus musculus
gaaatgtatgcagactttttcgcac

SEQ ID NO: 628206 - DNA, 25 bp, Mus musculus
gaaatgtcacctagggctagatgcc

SEQ ID NO: 628207 - DNA, 25 bp, Mus musculus
gaaatgtcaccttgggctagatgcc

SEQ ID NO: 628208 - DNA, 25 bp, Mus musculus
gaaatgtcagagctgctaacggaga

SEQ ID NO: 628209 - DNA, 25 bp, Mus musculus
gaaatgtcagaggtgctaacggaga

SEQ ID NO: 628210 - DNA, 25 bp, Mus musculus
gaaatgtcagttccacactcgtcaa

SEQ ID NO: 628211 - DNA, 25 bp, Mus musculus
gaaatgtcagttcctgcgtccccag

SEQ ID NO: 628212 - DNA, 25 bp, Mus musculus
gaaatgtcagttgcacactcgtcaa

SEQ ID NO: 628213 - DNA, 25 bp, Mus musculus
gaaatgtcagttgctgcgtccccag

SEQ ID NO: 628214 - DNA, 25 bp, Mus musculus
gaaatgtcatggcaacacgcttctg

SEQ ID NO: 628215 - DNA, 25 bp, Mus musculus
gaaatgtcatgggaacacgcttctg

SEQ ID NO: 628216 - DNA, 25 bp, Mus musculus
gaaatgtccaaaacttacctacctc

SEQ ID NO: 628217 - DNA, 25 bp, Mus musculus
gaaatgtccaaatcttacctacctc

SEQ ID NO: 628218 - DNA, 25 bp, Mus musculus
gaaatgtcttcacctgttgctgcac

SEQ ID NO: 628219 - DNA, 25 bp, Mus musculus
gaaatgtcttcagctgttgctgcac

SEQ ID NO: 628220 - DNA, 25 bp, Mus musculus
gaaatgtcttggagaacttacagag

SEQ ID NO: 628221 - DNA, 25 bp, Mus musculus
gaaatgtcttggtgaacttacagag

SEQ ID NO: 628222 - DNA, 25 bp, Mus musculus
gaaatgtgaacgcaagaagcaggct

SEQ ID NO: 628223 - DNA, 25 bp, Mus musculus
gaaatgtgaacggaagaagcaggct

SEQ ID NO: 628224 - DNA, 25 bp, Mus musculus
gaaatgtgactgatatctttctcag

SEQ ID NO: 628225 - DNA, 25 bp, Mus musculus
gaaatgtgactgttatctttctcag

SEQ ID NO: 628226 - DNA, 25 bp, Mus musculus
gaaatgtgatttctccctctcgcgt

SEQ ID NO: 628227 - DNA, 25 bp, Mus musculus
gaaatgtgatttgtccctctcgcgt

SEQ ID NO: 628228 - DNA, 25 bp, Mus musculus
gaaatgtgcagaataaaagcacccc

SEQ ID NO: 628229 - DNA, 25 bp, Mus musculus
gaaatgtgcagattaaaagcacccc

SEQ ID NO: 628230 - DNA, 25 bp, Mus musculus
gaaatgtgccccaatattaccagga

SEQ ID NO: 628231 - DNA, 25 bp, Mus musculus
gaaatgtgcccctatattaccagga

SEQ ID NO: 628232 - DNA, 25 bp, Mus musculus
gaaatgtgggacagcatgcaagaag

SEQ ID NO: 628233 - DNA, 25 bp, Mus musculus
gaaatgtgggactgcatgcaagaag

SEQ ID NO: 628234 - DNA, 25 bp, Mus musculus
gaaatgtgggctatctccccgaatg

SEQ ID NO: 628235 - DNA, 25 bp, Mus musculus
gaaatgtgggctttctccccgaatg

SEQ ID NO: 628236 - DNA, 25 bp, Mus musculus
gaaatgtgggtcctgtccaatgctg

SEQ ID NO: 628237 - DNA, 25 bp, Mus musculus
gaaatgtgggtcgtgtccaatgctg

SEQ ID NO: 628238 - DNA, 25 bp, Mus musculus
gaaatgtggtctatggagaaccaat

SEQ ID NO: 628239 - DNA, 25 bp, Mus musculus
gaaatgtggtctttggagaaccaat

SEQ ID NO: 628240 - DNA, 25 bp, Mus musculus
gaaatgtgtcacaagaagagggctt

SEQ ID NO: 628241 - DNA, 25 bp, Mus musculus
gaaatgtgtcactagaagagggctt

SEQ ID NO: 628242 - DNA, 25 bp, Mus musculus
gaaatgtgtcatccctatggcccag

SEQ ID NO: 628243 - DNA, 25 bp, Mus musculus
gaaatgtgtcatgcctatggcccag

SEQ ID NO: 628244 - DNA, 25 bp, Mus musculus
gaaatgtgttctcctcagatgcggc

SEQ ID NO: 628245 - DNA, 25 bp, Mus musculus
gaaatgtgttctgctcagatgcggc

SEQ ID NO: 628246 - DNA, 25 bp, Mus musculus
gaaatgtgttttccattatgtggag

SEQ ID NO: 628247 - DNA, 25 bp, Mus musculus
gaaatgtgttttgcattatgtggag

SEQ ID NO: 628248 - DNA, 25 bp, Mus musculus
gaaatgttacccagatcgtgtggac

SEQ ID NO: 628249 - DNA, 25 bp, Mus musculus
gaaatgttaccctgatcgtgtggac

SEQ ID NO: 628250 - DNA, 25 bp, Mus musculus
gaaatgttactgatgaaaggcccta

SEQ ID NO: 628251 - DNA, 25 bp, Mus musculus
gaaatgttactgttgaaaggcccta

SEQ ID NO: 628252 - DNA, 25 bp, Mus musculus
gaaatgttcaagcagacagctcgac

SEQ ID NO: 628253 - DNA, 25 bp, Mus musculus
gaaatgttcaaggagacagctcgac

SEQ ID NO: 628254 - DNA, 25 bp, Mus musculus
gaaatgttctcacgaatgaagctga

SEQ ID NO: 628255 - DNA, 25 bp, Mus musculus
gaaatgttctcaggaatgaagctga

SEQ ID NO: 628256 - DNA, 25 bp, Mus musculus
gaaatgttggctctcgacgcaccga

SEQ ID NO: 628257 - DNA, 25 bp, Mus musculus
gaaatgttggctgtcgacgcaccga

SEQ ID NO: 628258 - DNA, 25 bp, Mus musculus
gaaatgttgtctcatccagtgaaaa

SEQ ID NO: 628259 - DNA, 25 bp, Mus musculus
gaaatgttgtctgatccagtgaaaa

SEQ ID NO: 628260 - DNA, 25 bp, Mus musculus
gaaatgttgtttacatggttctcct

SEQ ID NO: 628261 - DNA, 25 bp, Mus musculus
gaaatgttgttttcatggttctcct

SEQ ID NO: 628262 - DNA, 25 bp, Mus musculus
gaaatgtttactctggtgtgcaccg

SEQ ID NO: 628263 - DNA, 25 bp, Mus musculus
gaaatgtttactgtggtgtgcaccg

SEQ ID NO: 628264 - DNA, 25 bp, Mus musculus
gaaatgtttggaacctttagcacag

SEQ ID NO: 628265 - DNA, 25 bp, Mus musculus
gaaatgtttggatcctttagcacag

SEQ ID NO: 628266 - DNA, 25 bp, Mus musculus
gaaatgttttagctgcatcaagcca

SEQ ID NO: 628267 - DNA, 25 bp, Mus musculus
gaaatgttttaggtgcatcaagcca

SEQ ID NO: 628268 - DNA, 25 bp, Mus musculus
gaaatgttttggaaccacgtgtcca

SEQ ID NO: 628269 - DNA, 25 bp, Mus musculus
gaaatgttttggtaccacgtgtcca

SEQ ID NO: 628270 - DNA, 25 bp, Mus musculus
gaaattaaaagaactagatgactgg

SEQ ID NO: 628271 - DNA, 25 bp, Mus musculus
gaaattaaaagatctagatgactgg

SEQ ID NO: 628272 - DNA, 25 bp, Mus musculus
gaaattaaaaggacaggtgctgtcc

SEQ ID NO: 628273 - DNA, 25 bp, Mus musculus
gaaattaaaaggtcaggtgctgtcc

SEQ ID NO: 628274 - DNA, 25 bp, Mus musculus
gaaattaaaatccagctatcgacaa

SEQ ID NO: 628275 - DNA, 25 bp, Mus musculus
gaaattaaaatcgagctatcgacaa

SEQ ID NO: 628276 - DNA, 25 bp, Mus musculus
gaaattaaagccaatctttcctctg

SEQ ID NO: 628277 - DNA, 25 bp, Mus musculus
gaaattaaagcctatctttcctctg

SEQ ID NO: 628278 - DNA, 25 bp, Mus musculus
gaaattaaagtacttcagtccacat

SEQ ID NO: 628279 - DNA, 25 bp, Mus musculus
gaaattaaagtagttcagtccacat

SEQ ID NO: 628280 - DNA, 25 bp, Mus musculus
gaaattaaatgacctctgggcctca

SEQ ID NO: 628281 - DNA, 25 bp, Mus musculus
gaaattaaatgagctctgggcctca

SEQ ID NO: 628282 - DNA, 25 bp, Mus musculus
gaaattaacagtccagaaacttact

SEQ ID NO: 628283 - DNA, 25 bp, Mus musculus
gaaattaacagtgcagaaacttact

SEQ ID NO: 628284 - DNA, 25 bp, Mus musculus
gaaattaagattctgagtgtaggcg

SEQ ID NO: 628285 - DNA, 25 bp, Mus musculus
gaaattaagattgtgagtgtaggcg

SEQ ID NO: 628286 - DNA, 25 bp, Mus musculus
gaaattaagcaacgtcctggatccc

SEQ ID NO: 628287 - DNA, 25 bp, Mus musculus
gaaattaagcaaggtcctggatccc

SEQ ID NO: 628288 - DNA, 25 bp, Mus musculus
gaaattaagcggctcactctcccgg

SEQ ID NO: 628289 - DNA, 25 bp, Mus musculus
gaaattaagcgggtcactctcccgg

SEQ ID NO: 628290 - DNA, 25 bp, Mus musculus
gaaattaagtgacttggccacagtc

SEQ ID NO: 628291 - DNA, 25 bp, Mus musculus
gaaattaagtgagttggccacagtc

SEQ ID NO: 628292 - DNA, 25 bp, Mus musculus
gaaattaccttgaaaggcttcagag

SEQ ID NO: 628293 - DNA, 25 bp, Mus musculus
gaaattaccttgatgatgctcttat

SEQ ID NO: 628294 - DNA, 25 bp, Mus musculus
gaaattaccttgtaaggcttcagag

SEQ ID NO: 628295 - DNA, 25 bp, Mus musculus
gaaattaccttgttgatgctcttat

SEQ ID NO: 628296 - DNA, 25 bp, Mus musculus
gaaattacgacgcagcacttggagg

SEQ ID NO: 628297 - DNA, 25 bp, Mus musculus
gaaattacgacggagcacttggagg

SEQ ID NO: 628298 - DNA, 25 bp, Mus musculus
gaaattagagataggcacttctgag

SEQ ID NO: 628299 - DNA, 25 bp, Mus musculus
gaaattagagattggcacttctgag

SEQ ID NO: 628300 - DNA, 25 bp, Mus musculus
gaaattatacatagaggctgcctct

SEQ ID NO: 628301 - DNA, 25 bp, Mus musculus
gaaattatacattgaggctgcctct

SEQ ID NO: 628302 - DNA, 25 bp, Mus musculus
gaaattatatttccttcagagcaga

SEQ ID NO: 628303 - DNA, 25 bp, Mus musculus
gaaattatatttgcttcagagcaga

SEQ ID NO: 628304 - DNA, 25 bp, Mus musculus
gaaattatcaatcatctggctgacc

SEQ ID NO: 628305 - DNA, 25 bp, Mus musculus
gaaattatcaatgatctggctgacc

SEQ ID NO: 628306 - DNA, 25 bp, Mus musculus
gaaattatccgacacgtggacctca

SEQ ID NO: 628307 - DNA, 25 bp, Mus musculus
gaaattatccgagacgtggacctca

SEQ ID NO: 628308 - DNA, 25 bp, Mus musculus
gaaattatctgtaccagcctcagtg

SEQ ID NO: 628309 - DNA, 25 bp, Mus musculus
gaaattatctgttccagcctcagtg

SEQ ID NO: 628310 - DNA, 25 bp, Mus musculus
gaaattatggaccatgggcctccag

SEQ ID NO: 628311 - DNA, 25 bp, Mus musculus
gaaattatggacgatgggcctccag

SEQ ID NO: 628312 - DNA, 25 bp, Mus musculus
gaaattattgacagttttgcacagg

SEQ ID NO: 628313 - DNA, 25 bp, Mus musculus
gaaattattgactgttttgcacagg

SEQ ID NO: 628314 - DNA, 25 bp, Mus musculus
gaaattattttgatcagcctgtgac

SEQ ID NO: 628315 - DNA, 25 bp, Mus musculus
gaaattattttgttcagcctgtgac

SEQ ID NO: 628316 - DNA, 25 bp, Mus musculus
gaaattcaagctcgtgttcctggga

SEQ ID NO: 628317 - DNA, 25 bp, Mus musculus
gaaattcaagctggtgttcctggga

SEQ ID NO: 628318 - DNA, 25 bp, Mus musculus
gaaattcacactagtttttcaagag

SEQ ID NO: 628319 - DNA, 25 bp, Mus musculus
gaaattcacacttgtttttcaagag

SEQ ID NO: 628320 - DNA, 25 bp, Mus musculus
gaaattcaccatcttcgataatggg

SEQ ID NO: 628321 - DNA, 25 bp, Mus musculus
gaaattcaccatgttcgataatggg

SEQ ID NO: 628322 - DNA, 25 bp, Mus musculus
gaaattcagaaaccattcgccaccg

SEQ ID NO: 628323 - DNA, 25 bp, Mus musculus
gaaattcagaaagcattcgccaccg

SEQ ID NO: 628324 - DNA, 25 bp, Mus musculus
gaaattcagatacacctgctaactg

SEQ ID NO: 628325 - DNA, 25 bp, Mus musculus
gaaattcagatagacctgctaactg

SEQ ID NO: 628326 - DNA, 25 bp, Mus musculus
gaaattcaggatcaagcagaaagga

SEQ ID NO: 628327 - DNA, 25 bp, Mus musculus
gaaattcaggatgaagcagaaagga

SEQ ID NO: 628328 - DNA, 25 bp, Mus musculus
gaaattcaggctcgtactggatcct

SEQ ID NO: 628329 - DNA, 25 bp, Mus musculus
gaaattcaggctggtactggatcct

SEQ ID NO: 628330 - DNA, 25 bp, Mus musculus
gaaattcagggcagcagctcggtga

SEQ ID NO: 628331 - DNA, 25 bp, Mus musculus
gaaattcagggctgcagctcggtga

SEQ ID NO: 628332 - DNA, 25 bp, Mus musculus
gaaattcagtctacagggtctcaag

SEQ ID NO: 628333 - DNA, 25 bp, Mus musculus
gaaattcagtcttcagggtctcaag

SEQ ID NO: 628334 - DNA, 25 bp, Mus musculus
gaaattcatggaagacatgatgccc

SEQ ID NO: 628335 - DNA, 25 bp, Mus musculus
gaaattcatggatgacatgatgccc

SEQ ID NO: 628336 - DNA, 25 bp, Mus musculus
gaaattcatgtcaatgactgcccaa

SEQ ID NO: 628337 - DNA, 25 bp, Mus musculus
gaaattcatgtctatgactgcccaa

SEQ ID NO: 628338 - DNA, 25 bp, Mus musculus
gaaattcattgcacagaaaatggcc

SEQ ID NO: 628339 - DNA, 25 bp, Mus musculus
gaaattcattgctcagaaaatggcc

SEQ ID NO: 628340 - DNA, 25 bp, Mus musculus
gaaattccacttcctgcgagtctac

SEQ ID NO: 628341 - DNA, 25 bp, Mus musculus
gaaattccacttgctgcgagtctac

SEQ ID NO: 628342 - DNA, 25 bp, Mus musculus
gaaattccgaggacaagaccttggc

SEQ ID NO: 628343 - DNA, 25 bp, Mus musculus
gaaattccgaggtcaagaccttggc

SEQ ID NO: 628344 - DNA, 25 bp, Mus musculus
gaaattcctaagcattctctgttcc

SEQ ID NO: 628345 - DNA, 25 bp, Mus musculus
gaaattcctaaggattctctgttcc

SEQ ID NO: 628346 - DNA, 25 bp, Mus musculus
gaaattcctctaccctatcagttgc

SEQ ID NO: 628347 - DNA, 25 bp, Mus musculus
gaaattcctctagcctatcagttgc

SEQ ID NO: 628348 - DNA, 25 bp, Mus musculus
gaaattcctggcactttaccaaact

SEQ ID NO: 628349 - DNA, 25 bp, Mus musculus
gaaattcctggctctttaccaaact

SEQ ID NO: 628350 - DNA, 25 bp, Mus musculus
gaaattcctggtacccagggcctca

SEQ ID NO: 628351 - DNA, 25 bp, Mus musculus
gaaattcctggttcccagggcctca

SEQ ID NO: 628352 - DNA, 25 bp, Mus musculus
gaaattcctgtgagatatgccatga

SEQ ID NO: 628353 - DNA, 25 bp, Mus musculus
gaaattcctgtgtgatatgccatga

SEQ ID NO: 628354 - DNA, 25 bp, Mus musculus
gaaattcgagccatctgtattgaag

SEQ ID NO: 628355 - DNA, 25 bp, Mus musculus
gaaattcgagccttctgtattgaag

SEQ ID NO: 628356 - DNA, 25 bp, Mus musculus
gaaattcgagtcatcccagataaag

SEQ ID NO: 628357 - DNA, 25 bp, Mus musculus
gaaattcgagtcttcccagataaag

SEQ ID NO: 628358 - DNA, 25 bp, Mus musculus
gaaattcgagttctatattcaacta

SEQ ID NO: 628359 - DNA, 25 bp, Mus musculus
gaaattcgagttgtatattcaacta

SEQ ID NO: 628360 - DNA, 25 bp, Mus musculus
gaaattcgcaggaaggaatccatgc

SEQ ID NO: 628361 - DNA, 25 bp, Mus musculus
gaaattcgcaggtaggaatccatgc

SEQ ID NO: 628362 - DNA, 25 bp, Mus musculus
gaaattcgtgccctgccactggtac

SEQ ID NO: 628363 - DNA, 25 bp, Mus musculus
gaaattcgtgccgtgccactggtac

SEQ ID NO: 628364 - DNA, 25 bp, Mus musculus
gaaattctagggaatcggccaggtc

SEQ ID NO: 628365 - DNA, 25 bp, Mus musculus
gaaattctagggtatcggccaggtc

SEQ ID NO: 628366 - DNA, 25 bp, Mus musculus
gaaattctcccacatgctttgtgtc

SEQ ID NO: 628367 - DNA, 25 bp, Mus musculus
gaaattctcccagatgctttgtgtc

SEQ ID NO: 628368 - DNA, 25 bp, Mus musculus
gaaattctctgacgactttggacag

SEQ ID NO: 628369 - DNA, 25 bp, Mus musculus
gaaattctctgaggactttggacag

SEQ ID NO: 628370 - DNA, 25 bp, Mus musculus
gaaattctgaagattcacgaaaaaa

SEQ ID NO: 628371 - DNA, 25 bp, Mus musculus
gaaattctgaagtttcacgaaaaaa

SEQ ID NO: 628372 - DNA, 25 bp, Mus musculus
gaaattctgtctaatctggaagtcg

SEQ ID NO: 628373 - DNA, 25 bp, Mus musculus
gaaattctgtcttatctggaagtcg

SEQ ID NO: 628374 - DNA, 25 bp, Mus musculus
gaaattcttagaaaacttcactcac

SEQ ID NO: 628375 - DNA, 25 bp, Mus musculus
gaaattcttagataacttcactcac

SEQ ID NO: 628376 - DNA, 25 bp, Mus musculus
gaaattcttatgaggcctaccatct

SEQ ID NO: 628377 - DNA, 25 bp, Mus musculus
gaaattcttatgtggcctaccatct

SEQ ID NO: 628378 - DNA, 25 bp, Mus musculus
gaaattctttgcaacctatggatct

SEQ ID NO: 628379 - DNA, 25 bp, Mus musculus
gaaattctttgctacctatggatct

SEQ ID NO: 628380 - DNA, 25 bp, Mus musculus
gaaattgaaactcacacagatatct

SEQ ID NO: 628381 - DNA, 25 bp, Mus musculus
gaaattgaaactcctacgcagatat

SEQ ID NO: 628382 - DNA, 25 bp, Mus musculus
gaaattgaaactgacacagatatct

SEQ ID NO: 628383 - DNA, 25 bp, Mus musculus
gaaattgaaactgctacgcagatat

SEQ ID NO: 628384 - DNA, 25 bp, Mus musculus
gaaattgaaagcatggagaagacca

SEQ ID NO: 628385 - DNA, 25 bp, Mus musculus
gaaattgaaagcctgggatccacag

SEQ ID NO: 628386 - DNA, 25 bp, Mus musculus
gaaattgaaagcgtgggatccacag

SEQ ID NO: 628387 - DNA, 25 bp, Mus musculus
gaaattgaaagcttggagaagacca

SEQ ID NO: 628388 - DNA, 25 bp, Mus musculus
gaaattgaagaaatagtattcccta

SEQ ID NO: 628389 - DNA, 25 bp, Mus musculus
gaaattgaagaaatcgagagcaact

SEQ ID NO: 628390 - DNA, 25 bp, Mus musculus
gaaattgaagaattagtattcccta

SEQ ID NO: 628391 - DNA, 25 bp, Mus musculus
gaaattgaagaattcgagagcaact

SEQ ID NO: 628392 - DNA, 25 bp, Mus musculus
gaaattgagaagatcccagcgagct

SEQ ID NO: 628393 - DNA, 25 bp, Mus musculus
gaaattgagaagttcccagcgagct

SEQ ID NO: 628394 - DNA, 25 bp, Mus musculus
gaaattgagatccacgggactgaga

SEQ ID NO: 628395 - DNA, 25 bp, Mus musculus
gaaattgagatcgacgggactgaga

SEQ ID NO: 628396 - DNA, 25 bp, Mus musculus
gaaattgaggacatccaacaggaga

SEQ ID NO: 628397 - DNA, 25 bp, Mus musculus
gaaattgaggacttccaacaggaga

SEQ ID NO: 628398 - DNA, 25 bp, Mus musculus
gaaattgaggatccttcacctacta

SEQ ID NO: 628399 - DNA, 25 bp, Mus musculus
gaaattgaggatgcttcacctacta

SEQ ID NO: 628400 - DNA, 25 bp, Mus musculus
gaaattgatcgtcaattgcagaaga

SEQ ID NO: 628401 - DNA, 25 bp, Mus musculus
gaaattgatcgtgaattgcagaaga

SEQ ID NO: 628402 - DNA, 25 bp, Mus musculus
gaaattgatgagctgacccggatct

SEQ ID NO: 628403 - DNA, 25 bp, Mus musculus
gaaattgatgaggtgacccggatct

SEQ ID NO: 628404 - DNA, 25 bp, Mus musculus
gaaattgattcacaaattgcagccc

SEQ ID NO: 628405 - DNA, 25 bp, Mus musculus
gaaattgattcagaaattgcagccc

SEQ ID NO: 628406 - DNA, 25 bp, Mus musculus
gaaattgcaaaaaggcccgagtcgc

SEQ ID NO: 628407 - DNA, 25 bp, Mus musculus
gaaattgcaaaatggcccgagtcgc

SEQ ID NO: 628408 - DNA, 25 bp, Mus musculus
gaaattgcagccctacgatcagagc

SEQ ID NO: 628409 - DNA, 25 bp, Mus musculus
gaaattgcagccgtacgatcagagc

SEQ ID NO: 628410 - DNA, 25 bp, Mus musculus
gaaattgcagtgaacctgtggaact

SEQ ID NO: 628411 - DNA, 25 bp, Mus musculus
gaaattgcagtgtacctgtggaact

SEQ ID NO: 628412 - DNA, 25 bp, Mus musculus
gaaattgctcgacgctgttctattg

SEQ ID NO: 628413 - DNA, 25 bp, Mus musculus
gaaattgctcgaggctgttctattg

SEQ ID NO: 628414 - DNA, 25 bp, Mus musculus
gaaattgctgctagatatgggttca

SEQ ID NO: 628415 - DNA, 25 bp, Mus musculus
gaaattgctgcttgatatgggttca

SEQ ID NO: 628416 - DNA, 25 bp, Mus musculus
gaaattgcttaacgaactttccagg

SEQ ID NO: 628417 - DNA, 25 bp, Mus musculus
gaaattgcttaaggaactttccagg

SEQ ID NO: 628418 - DNA, 25 bp, Mus musculus
gaaattgcttccagttatatccagt

SEQ ID NO: 628419 - DNA, 25 bp, Mus musculus
gaaattgcttcctgttatatccagt

SEQ ID NO: 628420 - DNA, 25 bp, Mus musculus
gaaattgcttttactagacaactgc

SEQ ID NO: 628421 - DNA, 25 bp, Mus musculus
gaaattgctttttctagacaactgc

SEQ ID NO: 628422 - DNA, 25 bp, Mus musculus
gaaattggagatctgctgcagaacc

SEQ ID NO: 628423 - DNA, 25 bp, Mus musculus
gaaattggagatgtgctgcagaacc

SEQ ID NO: 628424 - DNA, 25 bp, Mus musculus
gaaattggatctagtctccaactgg

SEQ ID NO: 628425 - DNA, 25 bp, Mus musculus
gaaattggatcttgtctccaactgg

SEQ ID NO: 628426 - DNA, 25 bp, Mus musculus
gaaattggcacaactccaccactgc

SEQ ID NO: 628427 - DNA, 25 bp, Mus musculus
gaaattggcacatctccaccactgc

SEQ ID NO: 628428 - DNA, 25 bp, Mus musculus
gaaattggcaccaagaaaaaggtga

SEQ ID NO: 628429 - DNA, 25 bp, Mus musculus
gaaattggcaccattactgggagaa

SEQ ID NO: 628430 - DNA, 25 bp, Mus musculus
gaaattggcacctagaaaaaggtga

SEQ ID NO: 628431 - DNA, 25 bp, Mus musculus
gaaattggcacctttactgggagaa

SEQ ID NO: 628432 - DNA, 25 bp, Mus musculus
gaaattgggcaacaaaccatgactg

SEQ ID NO: 628433 - DNA, 25 bp, Mus musculus
gaaattgggcaagaaaccatgactg

SEQ ID NO: 628434 - DNA, 25 bp, Mus musculus
gaaattgggcctatgtcttgcttca

SEQ ID NO: 628435 - DNA, 25 bp, Mus musculus
gaaattgggcctttgtcttgcttca

SEQ ID NO: 628436 - DNA, 25 bp, Mus musculus
gaaattgggtacaactgtgtggcag

SEQ ID NO: 628437 - DNA, 25 bp, Mus musculus
gaaattgggtactactgtgtggcag

SEQ ID NO: 628438 - DNA, 25 bp, Mus musculus
gaaattggtggacagagcaaaatcc

SEQ ID NO: 628439 - DNA, 25 bp, Mus musculus
gaaattggtggagagagcaaaatcc

SEQ ID NO: 628440 - DNA, 25 bp, Mus musculus
gaaattggtgtgacagatccggaaa

SEQ ID NO: 628441 - DNA, 25 bp, Mus musculus
gaaattggtgtgtcagatccggaaa

SEQ ID NO: 628442 - DNA, 25 bp, Mus musculus
gaaattgtaagcaccttaggagaag

SEQ ID NO: 628443 - DNA, 25 bp, Mus musculus
gaaattgtaagctccttaggagaag

SEQ ID NO: 628444 - DNA, 25 bp, Mus musculus
gaaattgtacacctcccattggctg

SEQ ID NO: 628445 - DNA, 25 bp, Mus musculus
gaaattgtacacgtcccattggctg

SEQ ID NO: 628446 - DNA, 25 bp, Mus musculus
gaaattgtaggacaaggcccagcgc

SEQ ID NO: 628447 - DNA, 25 bp, Mus musculus
gaaattgtaggagaaggcccagcgc

SEQ ID NO: 628448 - DNA, 25 bp, Mus musculus
gaaattgtcttcaacaaagtcatcg

SEQ ID NO: 628449 - DNA, 25 bp, Mus musculus
gaaattgtcttctacaaagtcatcg

SEQ ID NO: 628450 - DNA, 25 bp, Mus musculus
gaaattgtgtatcccgtggacttca

SEQ ID NO: 628451 - DNA, 25 bp, Mus musculus
gaaattgtgtatgccgtggacttca

SEQ ID NO: 628452 - DNA, 25 bp, Mus musculus
gaaattgttaccagacagcaccttg

SEQ ID NO: 628453 - DNA, 25 bp, Mus musculus
gaaattgttacctgacagcaccttg

SEQ ID NO: 628454 - DNA, 25 bp, Mus musculus
gaaattgttcgaatattccaaaccg

SEQ ID NO: 628455 - DNA, 25 bp, Mus musculus
gaaattgttcgattattccaaaccg

SEQ ID NO: 628456 - DNA, 25 bp, Mus musculus
gaaattgttgaaatcttgctgcaac

SEQ ID NO: 628457 - DNA, 25 bp, Mus musculus
gaaattgttgaattcttgctgcaac

SEQ ID NO: 628458 - DNA, 25 bp, Mus musculus
gaaattgttgcacttgatctcgatg

SEQ ID NO: 628459 - DNA, 25 bp, Mus musculus
gaaattgttgcagttgatctcgatg

SEQ ID NO: 628460 - DNA, 25 bp, Mus musculus
gaaatttaacatcgatcctaaaaag

SEQ ID NO: 628461 - DNA, 25 bp, Mus musculus
gaaatttaacatggatcctaaaaag

SEQ ID NO: 628462 - DNA, 25 bp, Mus musculus
gaaatttaaggacgcacctgatggg

SEQ ID NO: 628463 - DNA, 25 bp, Mus musculus
gaaatttaaggaggcacctgatggg

SEQ ID NO: 628464 - DNA, 25 bp, Mus musculus
gaaatttacgatcccttggacatgc

SEQ ID NO: 628465 - DNA, 25 bp, Mus musculus
gaaatttacgatgccttggacatgc

SEQ ID NO: 628466 - DNA, 25 bp, Mus musculus
gaaatttactgtaggccactgccag

SEQ ID NO: 628467 - DNA, 25 bp, Mus musculus
gaaatttactgttggccactgccag

SEQ ID NO: 628468 - DNA, 25 bp, Mus musculus
gaaatttagttccattcagatgcag

SEQ ID NO: 628469 - DNA, 25 bp, Mus musculus
gaaatttagttcgattcagatgcag

SEQ ID NO: 628470 - DNA, 25 bp, Mus musculus
gaaatttcactcaacgtattattcg

SEQ ID NO: 628471 - DNA, 25 bp, Mus musculus
gaaatttcactctacgtattattcg

SEQ ID NO: 628472 - DNA, 25 bp, Mus musculus
gaaatttcgacgatgccctggacat

SEQ ID NO: 628473 - DNA, 25 bp, Mus musculus
gaaatttcgacgttgccctggacat

SEQ ID NO: 628474 - DNA, 25 bp, Mus musculus
gaaatttctcaccagtggtatcagt

SEQ ID NO: 628475 - DNA, 25 bp, Mus musculus
gaaatttctcacgagtggtatcagt

SEQ ID NO: 628476 - DNA, 25 bp, Mus musculus
gaaatttctgccatggttctcacta

SEQ ID NO: 628477 - DNA, 25 bp, Mus musculus
gaaatttctgccttggttctcacta

SEQ ID NO: 628478 - DNA, 25 bp, Mus musculus
gaaatttctggcaaaaggagagatc

SEQ ID NO: 628479 - DNA, 25 bp, Mus musculus
gaaatttctggctaaaggagagatc

SEQ ID NO: 628480 - DNA, 25 bp, Mus musculus
gaaatttcttttaatgtcatacagg

SEQ ID NO: 628481 - DNA, 25 bp, Mus musculus
gaaatttctttttatgtcatacagg

SEQ ID NO: 628482 - DNA, 25 bp, Mus musculus
gaaatttgaaccctaccacgacagt

SEQ ID NO: 628483 - DNA, 25 bp, Mus musculus
gaaatttgaaccgtaccacgacagt

SEQ ID NO: 628484 - DNA, 25 bp, Mus musculus
gaaatttgaactagctgcctgctga

SEQ ID NO: 628485 - DNA, 25 bp, Mus musculus
gaaatttgaacttgctgcctgctga

SEQ ID NO: 628486 - DNA, 25 bp, Mus musculus
gaaatttgaagaaggatcaagtctt

SEQ ID NO: 628487 - DNA, 25 bp, Mus musculus
gaaatttgaagatggatcaagtctt

SEQ ID NO: 628488 - DNA, 25 bp, Mus musculus
gaaatttgacccacttctgaaagac

SEQ ID NO: 628489 - DNA, 25 bp, Mus musculus
gaaatttgaccctcttctgaaagac

SEQ ID NO: 628490 - DNA, 25 bp, Mus musculus
gaaatttgagtcaaaagcatgcccc

SEQ ID NO: 628491 - DNA, 25 bp, Mus musculus
gaaatttgagtctaaagcatgcccc

SEQ ID NO: 628492 - DNA, 25 bp, Mus musculus
gaaatttgcattccaaaacaccatg

SEQ ID NO: 628493 - DNA, 25 bp, Mus musculus
gaaatttgcattgcaaaacaccatg

SEQ ID NO: 628494 - DNA, 25 bp, Mus musculus
gaaatttggagtagcatgaattcgt

SEQ ID NO: 628495 - DNA, 25 bp, Mus musculus
gaaatttggagtctacgtgcgctcg

SEQ ID NO: 628496 - DNA, 25 bp, Mus musculus
gaaatttggagtgtacgtgcgctcg

SEQ ID NO: 628497 - DNA, 25 bp, Mus musculus
gaaatttggagttgcatgaattcgt

SEQ ID NO: 628498 - DNA, 25 bp, Mus musculus
gaaatttggattcaccttgctacct

SEQ ID NO: 628499 - DNA, 25 bp, Mus musculus
gaaatttggattgaccttgctacct

SEQ ID NO: 628500 - DNA, 25 bp, Mus musculus
gaaatttgtcatcgtcgtggattcc

SEQ ID NO: 628501 - DNA, 25 bp, Mus musculus
gaaatttgtcatggtcgtggattcc

SEQ ID NO: 628502 - DNA, 25 bp, Mus musculus
gaaattttacacagaagatggtaac

SEQ ID NO: 628503 - DNA, 25 bp, Mus musculus
gaaattttacactgaagatggtaac

SEQ ID NO: 628504 - DNA, 25 bp, Mus musculus
gaaattttagtgatgacaacggcta

SEQ ID NO: 628505 - DNA, 25 bp, Mus musculus
gaaattttagtgttgacaacggcta

SEQ ID NO: 628506 - DNA, 25 bp, Mus musculus
gaaattttatcacccaactgagtcg

SEQ ID NO: 628507 - DNA, 25 bp, Mus musculus
gaaattttatcagccaactgagtcg

SEQ ID NO: 628508 - DNA, 25 bp, Mus musculus
gaaattttatgaagatcccaagagc

SEQ ID NO: 628509 - DNA, 25 bp, Mus musculus
gaaattttatgatgatcccaagagc

SEQ ID NO: 628510 - DNA, 25 bp, Mus musculus
gaaattttcaggagactcacaaaaa

SEQ ID NO: 628511 - DNA, 25 bp, Mus musculus
gaaattttcaggtgactcacaaaaa

SEQ ID NO: 628512 - DNA, 25 bp, Mus musculus
gaaattttgcacaagaacagtgccc

SEQ ID NO: 628513 - DNA, 25 bp, Mus musculus
gaaattttgcactagaacagtgccc

SEQ ID NO: 628514 - DNA, 25 bp, Mus musculus
gaaattttgcggagacaaggcccct

SEQ ID NO: 628515 - DNA, 25 bp, Mus musculus
gaaattttgcggtgacaaggcccct

SEQ ID NO: 628516 - DNA, 25 bp, Mus musculus
gaaattttgggcatgatggatccgg

SEQ ID NO: 628517 - DNA, 25 bp, Mus musculus
gaaattttgggcttgatggatccgg

SEQ ID NO: 628518 - DNA, 25 bp, Mus musculus
gaaatttttaagatgggccaggcat

SEQ ID NO: 628519 - DNA, 25 bp, Mus musculus
gaaatttttaagttgggccaggcat

SEQ ID NO: 628520 - DNA, 25 bp, Mus musculus
gaaatttttgcaagtattaaccaga

SEQ ID NO: 628521 - DNA, 25 bp, Mus musculus
gaaatttttgcatgtattaaccaga

SEQ ID NO: 628522 - DNA, 25 bp, Mus musculus
gaacaaaaagcgagttgtgacacct

SEQ ID NO: 628523 - DNA, 25 bp, Mus musculus
gaacaaaaagcgtgttgtgacacct

SEQ ID NO: 628524 - DNA, 25 bp, Mus musculus
gaacaaaactgtagaggactcccca

SEQ ID NO: 628525 - DNA, 25 bp, Mus musculus
gaacaaaactgttgaggactcccca

SEQ ID NO: 628526 - DNA, 25 bp, Mus musculus
gaacaaaagtgacttcagccaggcc

SEQ ID NO: 628527 - DNA, 25 bp, Mus musculus
gaacaaaagtgagttcagccaggcc

SEQ ID NO: 628528 - DNA, 25 bp, Mus musculus
gaacaaaatgccagtgccttccttc

SEQ ID NO: 628529 - DNA, 25 bp, Mus musculus
gaacaaaatgcctgtgccttccttc

SEQ ID NO: 628530 - DNA, 25 bp, Mus musculus
gaacaaaattaaacgggctaatggg

SEQ ID NO: 628531 - DNA, 25 bp, Mus musculus
gaacaaaattaatcgggctaatggg

SEQ ID NO: 628532 - DNA, 25 bp, Mus musculus
gaacaaacaggtagccatgggcaga

SEQ ID NO: 628533 - DNA, 25 bp, Mus musculus
gaacaaacaggttgccatgggcaga

SEQ ID NO: 628534 - DNA, 25 bp, Mus musculus
gaacaaacatgtcgaattcttccgc

SEQ ID NO: 628535 - DNA, 25 bp, Mus musculus
gaacaaacatgtggaattcttccgc

SEQ ID NO: 628536 - DNA, 25 bp, Mus musculus
gaacaaaccgtcagataaggccacc

SEQ ID NO: 628537 - DNA, 25 bp, Mus musculus
gaacaaaccgtctgataaggccacc

SEQ ID NO: 628538 - DNA, 25 bp, Mus musculus
gaacaaacctaacgagaattcagaa

SEQ ID NO: 628539 - DNA, 25 bp, Mus musculus
gaacaaacctaaggagaattcagaa

SEQ ID NO: 628540 - DNA, 25 bp, Mus musculus
gaacaaacgcttccgagctgctcag

SEQ ID NO: 628541 - DNA, 25 bp, Mus musculus
gaacaaacgcttgcgagctgctcag

SEQ ID NO: 628542 - DNA, 25 bp, Mus musculus
gaacaaactacacgcgattgccaac

SEQ ID NO: 628543 - DNA, 25 bp, Mus musculus
gaacaaactacaggcgattgccaac

SEQ ID NO: 628544 - DNA, 25 bp, Mus musculus
gaacaaactactcaacaggatctcg

SEQ ID NO: 628545 - DNA, 25 bp, Mus musculus
gaacaaactactgaacaggatctcg

SEQ ID NO: 628546 - DNA, 25 bp, Mus musculus
gaacaaactgctcttcattgagacc

SEQ ID NO: 628547 - DNA, 25 bp, Mus musculus
gaacaaactgctgttcattgagacc

SEQ ID NO: 628548 - DNA, 25 bp, Mus musculus
gaacaaacttctacatctcctaagc

SEQ ID NO: 628549 - DNA, 25 bp, Mus musculus
gaacaaacttcttcatctcctaagc

SEQ ID NO: 628550 - DNA, 25 bp, Mus musculus
gaacaaactttcaccaagcactgaa

SEQ ID NO: 628551 - DNA, 25 bp, Mus musculus
gaacaaactttctccaagcactgaa

SEQ ID NO: 628552 - DNA, 25 bp, Mus musculus
gaacaaagaccaaggctgtgcccac

SEQ ID NO: 628553 - DNA, 25 bp, Mus musculus
gaacaaagaccatggctgtgcccac

SEQ ID NO: 628554 - DNA, 25 bp, Mus musculus
gaacaaagacggcatgctgatcgcg

SEQ ID NO: 628555 - DNA, 25 bp, Mus musculus
gaacaaagacgggatgctgatcgcg

SEQ ID NO: 628556 - DNA, 25 bp, Mus musculus
gaacaaagactcctatctgatcctg

SEQ ID NO: 628557 - DNA, 25 bp, Mus musculus
gaacaaagactcgtatctgatcctg

SEQ ID NO: 628558 - DNA, 25 bp, Mus musculus
gaacaaagccttcggaccttggctc

SEQ ID NO: 628559 - DNA, 25 bp, Mus musculus
gaacaaagccttgggaccttggctc

SEQ ID NO: 628560 - DNA, 25 bp, Mus musculus
gaacaaaggcctcatgatcatcgac

SEQ ID NO: 628561 - DNA, 25 bp, Mus musculus
gaacaaaggcctgatgatcatcgac

SEQ ID NO: 628562 - DNA, 25 bp, Mus musculus
gaacaaagtcatcgagcagctagga

SEQ ID NO: 628563 - DNA, 25 bp, Mus musculus
gaacaaagtcatggagcagctagga

SEQ ID NO: 628564 - DNA, 25 bp, Mus musculus
gaacaaagtgtcaacaatggtccca

SEQ ID NO: 628565 - DNA, 25 bp, Mus musculus
gaacaaagtgtctacaatggtccca

SEQ ID NO: 628566 - DNA, 25 bp, Mus musculus
gaacaaataatcagggttcctgtcc

SEQ ID NO: 628567 - DNA, 25 bp, Mus musculus
gaacaaataatctgggttcctgtcc

SEQ ID NO: 628568 - DNA, 25 bp, Mus musculus
gaacaaatcatgctaaaacatgccc

SEQ ID NO: 628569 - DNA, 25 bp, Mus musculus
gaacaaatcatggtaaaacatgccc

SEQ ID NO: 628570 - DNA, 25 bp, Mus musculus
gaacaaatcccacaatgacagcggt

SEQ ID NO: 628571 - DNA, 25 bp, Mus musculus
gaacaaatcccagaatgacagcggt

SEQ ID NO: 628572 - DNA, 25 bp, Mus musculus
gaacaaatcgtcagtgcctggagca

SEQ ID NO: 628573 - DNA, 25 bp, Mus musculus
gaacaaatcgtctgtgcctggagca

SEQ ID NO: 628574 - DNA, 25 bp, Mus musculus
gaacaaatgggcatgcctatgggca

SEQ ID NO: 628575 - DNA, 25 bp, Mus musculus
gaacaaatgggcttgcctatgggca

SEQ ID NO: 628576 - DNA, 25 bp, Mus musculus
gaacaaatgtgtccaaagcagcagc

SEQ ID NO: 628577 - DNA, 25 bp, Mus musculus
gaacaaatgtgtgcaaagcagcagc

SEQ ID NO: 628578 - DNA, 25 bp, Mus musculus
gaacaaattgacaacctagctacag

SEQ ID NO: 628579 - DNA, 25 bp, Mus musculus
gaacaaattgactacctagctacag

SEQ ID NO: 628580 - DNA, 25 bp, Mus musculus
gaacaacaaagccagaaaccgagct

SEQ ID NO: 628581 - DNA, 25 bp, Mus musculus
gaacaacaaagcgagaaaccgagct

SEQ ID NO: 628582 - DNA, 25 bp, Mus musculus
gaacaacaaccaccagaacgctgct

SEQ ID NO: 628583 - DNA, 25 bp, Mus musculus
gaacaacaaccagcagaacgctgct

SEQ ID NO: 628584 - DNA, 25 bp, Mus musculus
gaacaacaagaaatcggacaatgat

SEQ ID NO: 628585 - DNA, 25 bp, Mus musculus
gaacaacaagaattcggacaatgat

SEQ ID NO: 628586 - DNA, 25 bp, Mus musculus
gaacaacaatacacaacacaaaaag

SEQ ID NO: 628587 - DNA, 25 bp, Mus musculus
gaacaacaatactcaacacaaaaag

SEQ ID NO: 628588 - DNA, 25 bp, Mus musculus
gaacaacaatcaaactcctacccgg

SEQ ID NO: 628589 - DNA, 25 bp, Mus musculus
gaacaacaatcatactcctacccgg

SEQ ID NO: 628590 - DNA, 25 bp, Mus musculus
gaacaacaccaaccgcagcattaaa

SEQ ID NO: 628591 - DNA, 25 bp, Mus musculus
gaacaacaccaagcgcagcattaaa

SEQ ID NO: 628592 - DNA, 25 bp, Mus musculus
gaacaacagactccttgaagtcgct

SEQ ID NO: 628593 - DNA, 25 bp, Mus musculus
gaacaacagactgcttgaagtcgct

SEQ ID NO: 628594 - DNA, 25 bp, Mus musculus
gaacaacagcctaccaccttatgct

SEQ ID NO: 628595 - DNA, 25 bp, Mus musculus
gaacaacagccttccaccttatgct

SEQ ID NO: 628596 - DNA, 25 bp, Mus musculus
gaacaacagcgacgacgccgaggac

SEQ ID NO: 628597 - DNA, 25 bp, Mus musculus
gaacaacagcgaggacgccgaggac

SEQ ID NO: 628598 - DNA, 25 bp, Mus musculus
gaacaacatcggcatagttgatgtg

SEQ ID NO: 628599 - DNA, 25 bp, Mus musculus
gaacaacatcgggatagttgatgtg

SEQ ID NO: 628600 - DNA, 25 bp, Mus musculus
gaacaaccaagtattctcaaggtca

SEQ ID NO: 628601 - DNA, 25 bp, Mus musculus
gaacaaccaagttttctcaaggtca

SEQ ID NO: 628602 - DNA, 25 bp, Mus musculus
gaacaaccagaaattaggctacaga

SEQ ID NO: 628603 - DNA, 25 bp, Mus musculus
gaacaaccagaatttaggctacaga

SEQ ID NO: 628604 - DNA, 25 bp, Mus musculus
gaacaaccagacacctgtagacgtg

SEQ ID NO: 628605 - DNA, 25 bp, Mus musculus
gaacaaccagactcctgtagacgtg

SEQ ID NO: 628606 - DNA, 25 bp, Mus musculus
gaacaacccctacaggagatgtgga

SEQ ID NO: 628607 - DNA, 25 bp, Mus musculus
gaacaacccctagaggagatgtgga

SEQ ID NO: 628608 - DNA, 25 bp, Mus musculus
gaacaaccgtctacggctacagctg

SEQ ID NO: 628609 - DNA, 25 bp, Mus musculus
gaacaaccgtcttcggctacagctg

SEQ ID NO: 628610 - DNA, 25 bp, Mus musculus
gaacaacctcgtcaaaagcaggcca

SEQ ID NO: 628611 - DNA, 25 bp, Mus musculus
gaacaacctcgtgaaaagcaggcca

SEQ ID NO: 628612 - DNA, 25 bp, Mus musculus
gaacaacgaggactggactgtagac

SEQ ID NO: 628613 - DNA, 25 bp, Mus musculus
gaacaacgaggagtggactgtagac

SEQ ID NO: 628614 - DNA, 25 bp, Mus musculus
gaacaacgctctacatatcagcacg

SEQ ID NO: 628615 - DNA, 25 bp, Mus musculus
gaacaacgctcttcatatcagcacg

SEQ ID NO: 628616 - DNA, 25 bp, Mus musculus
gaacaacgctgtaaggaaccttcag

SEQ ID NO: 628617 - DNA, 25 bp, Mus musculus
gaacaacgctgttaggaaccttcag

SEQ ID NO: 628618 - DNA, 25 bp, Mus musculus
gaacaacggttcaacgggtccatgg

SEQ ID NO: 628619 - DNA, 25 bp, Mus musculus
gaacaacggttctacgggtccatgg

SEQ ID NO: 628620 - DNA, 25 bp, Mus musculus
gaacaactagaaccattgaaagctt

SEQ ID NO: 628621 - DNA, 25 bp, Mus musculus
gaacaactagaagcattgaaagctt

SEQ ID NO: 628622 - DNA, 25 bp, Mus musculus
gaacaactcctgaagaacaactggg

SEQ ID NO: 628623 - DNA, 25 bp, Mus musculus
gaacaactcctgtagaacaactggg

SEQ ID NO: 628624 - DNA, 25 bp, Mus musculus
gaacaactgccgacgtatcgcttta

SEQ ID NO: 628625 - DNA, 25 bp, Mus musculus
gaacaactgccgtcgtatcgcttta

SEQ ID NO: 628626 - DNA, 25 bp, Mus musculus
gaacaactggaaaatttacaagctc

SEQ ID NO: 628627 - DNA, 25 bp, Mus musculus
gaacaactggaatatttacaagctc

SEQ ID NO: 628628 - DNA, 25 bp, Mus musculus
gaacaactggacagtagaggaggaa

SEQ ID NO: 628629 - DNA, 25 bp, Mus musculus
gaacaactggactgtagaggaggaa

SEQ ID NO: 628630 - DNA, 25 bp, Mus musculus
gaacaactggccactaagcccaggg

SEQ ID NO: 628631 - DNA, 25 bp, Mus musculus
gaacaactggcctctaagcccaggg

SEQ ID NO: 628632 - DNA, 25 bp, Mus musculus
gaacaactgggaacgccaccattga

SEQ ID NO: 628633 - DNA, 25 bp, Mus musculus
gaacaactgggatcgccaccattga

SEQ ID NO: 628634 - DNA, 25 bp, Mus musculus
gaacaagaaaccacaatggctccat

SEQ ID NO: 628635 - DNA, 25 bp, Mus musculus
gaacaagaaaccagagggaagcacc

SEQ ID NO: 628636 - DNA, 25 bp, Mus musculus
gaacaagaaacctcaatggctccat

SEQ ID NO: 628637 - DNA, 25 bp, Mus musculus
gaacaagaaacctgagggaagcacc

SEQ ID NO: 628638 - DNA, 25 bp, Mus musculus
gaacaagaaataaaggacctgctgg

SEQ ID NO: 628639 - DNA, 25 bp, Mus musculus
gaacaagaaatataggacctgctgg

SEQ ID NO: 628640 - DNA, 25 bp, Mus musculus
gaacaagaacgtacctctgcctgag

SEQ ID NO: 628641 - DNA, 25 bp, Mus musculus
gaacaagaacgttcctctgcctgag

SEQ ID NO: 628642 - DNA, 25 bp, Mus musculus
gaacaagaactacaattgtggaatg

SEQ ID NO: 628643 - DNA, 25 bp, Mus musculus
gaacaagaactagaattgtggaatg

SEQ ID NO: 628644 - DNA, 25 bp, Mus musculus
gaacaagaagccaccctgggttcct

SEQ ID NO: 628645 - DNA, 25 bp, Mus musculus
gaacaagaagcctccctgggttcct

SEQ ID NO: 628646 - DNA, 25 bp, Mus musculus
gaacaagaagctccggcccctgtat

SEQ ID NO: 628647 - DNA, 25 bp, Mus musculus
gaacaagaagctgcggcccctgtat

SEQ ID NO: 628648 - DNA, 25 bp, Mus musculus
gaacaagacagacttcgccaacacc

SEQ ID NO: 628649 - DNA, 25 bp, Mus musculus
gaacaagacagagttcgccaacacc

SEQ ID NO: 628650 - DNA, 25 bp, Mus musculus
gaacaagactcacgtttgggtgttt

SEQ ID NO: 628651 - DNA, 25 bp, Mus musculus
gaacaagactcaggtttgggtgttt

SEQ ID NO: 628652 - DNA, 25 bp, Mus musculus
gaacaagactctacgctatggagtt

SEQ ID NO: 628653 - DNA, 25 bp, Mus musculus
gaacaagactcttcgctatggagtt

SEQ ID NO: 628654 - DNA, 25 bp, Mus musculus
gaacaagagcttcatcgtgtgatcg

SEQ ID NO: 628655 - DNA, 25 bp, Mus musculus
gaacaagagcttgatcgtgtgatcg

SEQ ID NO: 628656 - DNA, 25 bp, Mus musculus
gaacaagaggctatccgcagtaacc

SEQ ID NO: 628657 - DNA, 25 bp, Mus musculus
gaacaagaggctttccgcagtaacc

SEQ ID NO: 628658 - DNA, 25 bp, Mus musculus
gaacaagatcagcatcctccttagc

SEQ ID NO: 628659 - DNA, 25 bp, Mus musculus
gaacaagatcaggatcctccttagc

SEQ ID NO: 628660 - DNA, 25 bp, Mus musculus
gaacaagatgccatgctggtggaca

SEQ ID NO: 628661 - DNA, 25 bp, Mus musculus
gaacaagatgccttgctggtggaca

SEQ ID NO: 628662 - DNA, 25 bp, Mus musculus
gaacaagatggcctacagggcttct

SEQ ID NO: 628663 - DNA, 25 bp, Mus musculus
gaacaagatggcgtacagggcttct

SEQ ID NO: 628664 - DNA, 25 bp, Mus musculus
gaacaagatgtcctccaagctattg

SEQ ID NO: 628665 - DNA, 25 bp, Mus musculus
gaacaagatgtcgtccaagctattg

SEQ ID NO: 628666 - DNA, 25 bp, Mus musculus
gaacaagcagccaataacttagccg

SEQ ID NO: 628667 - DNA, 25 bp, Mus musculus
gaacaagcagcctataacttagccg

SEQ ID NO: 628668 - DNA, 25 bp, Mus musculus
gaacaagcatgtccactttgagcag

SEQ ID NO: 628669 - DNA, 25 bp, Mus musculus
gaacaagcatgtgcactttgagcag

SEQ ID NO: 628670 - DNA, 25 bp, Mus musculus
gaacaagccaagcagctccggcgtc

SEQ ID NO: 628671 - DNA, 25 bp, Mus musculus
gaacaagccaaggagctccggcgtc

SEQ ID NO: 628672 - DNA, 25 bp, Mus musculus
gaacaagccagcacgaaaaacctct

SEQ ID NO: 628673 - DNA, 25 bp, Mus musculus
gaacaagccagctcgaaaaacctct

SEQ ID NO: 628674 - DNA, 25 bp, Mus musculus
gaacaagcctaccatgaactatgag

SEQ ID NO: 628675 - DNA, 25 bp, Mus musculus
gaacaagcctacgatgaactatgag

SEQ ID NO: 628676 - DNA, 25 bp, Mus musculus
gaacaagcctggcactttcttctgc

SEQ ID NO: 628677 - DNA, 25 bp, Mus musculus
gaacaagcctgggactttcttctgc

SEQ ID NO: 628678 - DNA, 25 bp, Mus musculus
gaacaagctctcagatcagacagtg

SEQ ID NO: 628679 - DNA, 25 bp, Mus musculus
gaacaagctctctgatcagacagtg

SEQ ID NO: 628680 - DNA, 25 bp, Mus musculus
gaacaagctgctcatagagcagttg

SEQ ID NO: 628681 - DNA, 25 bp, Mus musculus
gaacaagctgctgatagagcagttg

SEQ ID NO: 628682 - DNA, 25 bp, Mus musculus
gaacaagcttcaccttccagaagga

SEQ ID NO: 628683 - DNA, 25 bp, Mus musculus
gaacaagcttcagcttccagaagga

SEQ ID NO: 628684 - DNA, 25 bp, Mus musculus
gaacaaggacatagccccaagatgg

SEQ ID NO: 628685 - DNA, 25 bp, Mus musculus
gaacaaggacattgccccaagatgg

SEQ ID NO: 628686 - DNA, 25 bp, Mus musculus
gaacaaggacttagtgcgccccaaa

SEQ ID NO: 628687 - DNA, 25 bp, Mus musculus
gaacaaggactttgtgcgccccaaa

SEQ ID NO: 628688 - DNA, 25 bp, Mus musculus
gaacaaggaggcctccctcctcagg

SEQ ID NO: 628689 - DNA, 25 bp, Mus musculus
gaacaaggaggcgtccctcctcagg

SEQ ID NO: 628690 - DNA, 25 bp, Mus musculus
gaacaaggcaacctgccaagacaca

SEQ ID NO: 628691 - DNA, 25 bp, Mus musculus
gaacaaggcaacgtgccaagacaca

SEQ ID NO: 628692 - DNA, 25 bp, Mus musculus
gaacaaggcggacttccaaggcatc

SEQ ID NO: 628693 - DNA, 25 bp, Mus musculus
gaacaaggcggagttccaaggcatc

SEQ ID NO: 628694 - DNA, 25 bp, Mus musculus
gaacaaggcgtccaacgacgtccct

SEQ ID NO: 628695 - DNA, 25 bp, Mus musculus
gaacaaggcgtcgaacgacgtccct

SEQ ID NO: 628696 - DNA, 25 bp, Mus musculus
gaacaagggaaccattctcaaggcc

SEQ ID NO: 628697 - DNA, 25 bp, Mus musculus
gaacaagggaacgattctcaaggcc

SEQ ID NO: 628698 - DNA, 25 bp, Mus musculus
gaacaagggatgcttcctgaagacc

SEQ ID NO: 628699 - DNA, 25 bp, Mus musculus
gaacaagggatggttcctgaagacc

SEQ ID NO: 628700 - DNA, 25 bp, Mus musculus
gaacaaggggttcttaggacagaca

SEQ ID NO: 628701 - DNA, 25 bp, Mus musculus
gaacaaggggttgttaggacagaca

SEQ ID NO: 628702 - DNA, 25 bp, Mus musculus
gaacaagggtttcctttggcacagt

SEQ ID NO: 628703 - DNA, 25 bp, Mus musculus
gaacaagggtttgctttggcacagt

SEQ ID NO: 628704 - DNA, 25 bp, Mus musculus
gaacaagtacttcctgctcaacaac

SEQ ID NO: 628705 - DNA, 25 bp, Mus musculus
gaacaagtacttgctgctcaacaac

SEQ ID NO: 628706 - DNA, 25 bp, Mus musculus
gaacaagtatatatctgcagaaagg

SEQ ID NO: 628707 - DNA, 25 bp, Mus musculus
gaacaagtatatttctgcagaaagg

SEQ ID NO: 628708 - DNA, 25 bp, Mus musculus
gaacaagtatgactatctccctacc

SEQ ID NO: 628709 - DNA, 25 bp, Mus musculus
gaacaagtatgagtatctccctacc

SEQ ID NO: 628710 - DNA, 25 bp, Mus musculus
gaacaagtcgaacatattattcatg

SEQ ID NO: 628711 - DNA, 25 bp, Mus musculus
gaacaagtcgaagatattattcatg

SEQ ID NO: 628712 - DNA, 25 bp, Mus musculus
gaacaagtctaaattcagagatgcg

SEQ ID NO: 628713 - DNA, 25 bp, Mus musculus
gaacaagtctaatttcagagatgcg

SEQ ID NO: 628714 - DNA, 25 bp, Mus musculus
gaacaagtctttatatatacctggc

SEQ ID NO: 628715 - DNA, 25 bp, Mus musculus
gaacaagtctttttatatacctggc

SEQ ID NO: 628716 - DNA, 25 bp, Mus musculus
gaacaagtgactctcccaataggtg

SEQ ID NO: 628717 - DNA, 25 bp, Mus musculus
gaacaagtgactgtcccaataggtg

SEQ ID NO: 628718 - DNA, 25 bp, Mus musculus
gaacaagtgataaaagaaatcaacc

SEQ ID NO: 628719 - DNA, 25 bp, Mus musculus
gaacaagtgatataagaaatcaacc

SEQ ID NO: 628720 - DNA, 25 bp, Mus musculus
gaacaagtggaactatgagtctgaa

SEQ ID NO: 628721 - DNA, 25 bp, Mus musculus
gaacaagtggaagtatgagtctgaa

SEQ ID NO: 628722 - DNA, 25 bp, Mus musculus
gaacaagtggagcacaatctggctt

SEQ ID NO: 628723 - DNA, 25 bp, Mus musculus
gaacaagtggaggacaatctggctt

SEQ ID NO: 628724 - DNA, 25 bp, Mus musculus
gaacaagttcctcgcccgttatgta

SEQ ID NO: 628725 - DNA, 25 bp, Mus musculus
gaacaagttcctggcccgttatgta

SEQ ID NO: 628726 - DNA, 25 bp, Mus musculus
gaacaagttgggacagcccagtttg

SEQ ID NO: 628727 - DNA, 25 bp, Mus musculus
gaacaagttgggtcagcccagtttg

SEQ ID NO: 628728 - DNA, 25 bp, Mus musculus
gaacaagtttggcagcatccggcag

SEQ ID NO: 628729 - DNA, 25 bp, Mus musculus
gaacaagtttgggagcatccggcag

SEQ ID NO: 628730 - DNA, 25 bp, Mus musculus
gaacaatacaggaacgactcgcacc

SEQ ID NO: 628731 - DNA, 25 bp, Mus musculus
gaacaatacaggtacgactcgcacc

SEQ ID NO: 628732 - DNA, 25 bp, Mus musculus
gaacaatcaggcaggagttgcaagg

SEQ ID NO: 628733 - DNA, 25 bp, Mus musculus
gaacaatcaggctggagttgcaagg

SEQ ID NO: 628734 - DNA, 25 bp, Mus musculus
gaacaatccacccaccattgtgcat

SEQ ID NO: 628735 - DNA, 25 bp, Mus musculus
gaacaatccaccgaccattgtgcat

SEQ ID NO: 628736 - DNA, 25 bp, Mus musculus
gaacaatctctgcaggaaaagtgaa

SEQ ID NO: 628737 - DNA, 25 bp, Mus musculus
gaacaatctctggaggaaaagtgaa

SEQ ID NO: 628738 - DNA, 25 bp, Mus musculus
gaacaatctttgcttacccatctgc

SEQ ID NO: 628739 - DNA, 25 bp, Mus musculus
gaacaatctttggttacccatctgc

SEQ ID NO: 628740 - DNA, 25 bp, Mus musculus
gaacaatcttttctggtttcttggg

SEQ ID NO: 628741 - DNA, 25 bp, Mus musculus
gaacaatcttttgtggtttcttggg

SEQ ID NO: 628742 - DNA, 25 bp, Mus musculus
gaacaatgacatatctgagcttcgc

SEQ ID NO: 628743 - DNA, 25 bp, Mus musculus
gaacaatgacatttctgagcttcgc

SEQ ID NO: 628744 - DNA, 25 bp, Mus musculus
gaacaatgacctactgtaccgggac

SEQ ID NO: 628745 - DNA, 25 bp, Mus musculus
gaacaatgaccttctgtaccgggac

SEQ ID NO: 628746 - DNA, 25 bp, Mus musculus
gaacaatggcccaagtagcagtgac

SEQ ID NO: 628747 - DNA, 25 bp, Mus musculus
gaacaatggccctagtagcagtgac

SEQ ID NO: 628748 - DNA, 25 bp, Mus musculus
gaacaatggcttcgtgatggcacac

SEQ ID NO: 628749 - DNA, 25 bp, Mus musculus
gaacaatggcttggtgatggcacac

SEQ ID NO: 628750 - DNA, 25 bp, Mus musculus
gaacaatggtcgcacaccacagtaa

SEQ ID NO: 628751 - DNA, 25 bp, Mus musculus
gaacaatggtcggacaccacagtaa

SEQ ID NO: 628752 - DNA, 25 bp, Mus musculus
gaacaatgtgtcacccaatgaaagc

SEQ ID NO: 628753 - DNA, 25 bp, Mus musculus
gaacaatgtgtctcccaatgaaagc

SEQ ID NO: 628754 - DNA, 25 bp, Mus musculus
gaacaattaccacccctactaaagg

SEQ ID NO: 628755 - DNA, 25 bp, Mus musculus
gaacaattaccagccctactaaagg

SEQ ID NO: 628756 - DNA, 25 bp, Mus musculus
gaacaattatgaagcccttaaagac

SEQ ID NO: 628757 - DNA, 25 bp, Mus musculus
gaacaattatgatgcccttaaagac

SEQ ID NO: 628758 - DNA, 25 bp, Mus musculus
gaacaattcatgcttcctctaacag

SEQ ID NO: 628759 - DNA, 25 bp, Mus musculus
gaacaattcatggttcctctaacag

SEQ ID NO: 628760 - DNA, 25 bp, Mus musculus
gaacaattgctgcagcgcctaaaga

SEQ ID NO: 628761 - DNA, 25 bp, Mus musculus
gaacaattgctggagcgcctaaaga

SEQ ID NO: 628762 - DNA, 25 bp, Mus musculus
gaacaattggatatcatgatggaga

SEQ ID NO: 628763 - DNA, 25 bp, Mus musculus
gaacaattggatttcatgatggaga

SEQ ID NO: 628764 - DNA, 25 bp, Mus musculus
gaacaattgtgacaaggacgccgtg

SEQ ID NO: 628765 - DNA, 25 bp, Mus musculus
gaacaattgtgagaaggacgccgtg

SEQ ID NO: 628766 - DNA, 25 bp, Mus musculus
gaacaatttaaacacagcaggctaa

SEQ ID NO: 628767 - DNA, 25 bp, Mus musculus
gaacaatttaaagacagcaggctaa

SEQ ID NO: 628768 - DNA, 25 bp, Mus musculus
gaacaatttttaatctagccaaggg

SEQ ID NO: 628769 - DNA, 25 bp, Mus musculus
gaacaatttttattctagccaaggg

SEQ ID NO: 628770 - DNA, 25 bp, Mus musculus
gaacacaaactgcatggcaaattga

SEQ ID NO: 628771 - DNA, 25 bp, Mus musculus
gaacacaaactggatggcaaattga

SEQ ID NO: 628772 - DNA, 25 bp, Mus musculus
gaacacaaatgaatgggaggctctg

SEQ ID NO: 628773 - DNA, 25 bp, Mus musculus
gaacacaaatgattgggaggctctg

SEQ ID NO: 628774 - DNA, 25 bp, Mus musculus
gaacacaagacacaagggcgtgctt

SEQ ID NO: 628775 - DNA, 25 bp, Mus musculus
gaacacaagacagaagggcgtgctt

SEQ ID NO: 628776 - DNA, 25 bp, Mus musculus
gaacacaataacctgaggcccgtgg

SEQ ID NO: 628777 - DNA, 25 bp, Mus musculus
gaacacaataacgtgaggcccgtgg

SEQ ID NO: 628778 - DNA, 25 bp, Mus musculus
gaacacaatgttacctttcacagtg

SEQ ID NO: 628779 - DNA, 25 bp, Mus musculus
gaacacaatgtttcctttcacagtg

SEQ ID NO: 628780 - DNA, 25 bp, Mus musculus
gaacacacagctcaaagtatctgtg

SEQ ID NO: 628781 - DNA, 25 bp, Mus musculus
gaacacacagctgaaagtatctgtg

SEQ ID NO: 628782 - DNA, 25 bp, Mus musculus
gaacacacataaaagatgttgcagc

SEQ ID NO: 628783 - DNA, 25 bp, Mus musculus
gaacacacataatagatgttgcagc

SEQ ID NO: 628784 - DNA, 25 bp, Mus musculus
gaacacaccattcatgggatcagga

SEQ ID NO: 628785 - DNA, 25 bp, Mus musculus
gaacacaccattgatgggatcagga

SEQ ID NO: 628786 - DNA, 25 bp, Mus musculus
gaacacactgcactcaagggcaagt

SEQ ID NO: 628787 - DNA, 25 bp, Mus musculus
gaacacactgcagtcaagggcaagt

SEQ ID NO: 628788 - DNA, 25 bp, Mus musculus
gaacacactgcgcagagctacatgc

SEQ ID NO: 628789 - DNA, 25 bp, Mus musculus
gaacacactgcggagagctacatgc

SEQ ID NO: 628790 - DNA, 25 bp, Mus musculus
gaacacacttaacccctactacaat

SEQ ID NO: 628791 - DNA, 25 bp, Mus musculus
gaacacacttaagccctactacaat

SEQ ID NO: 628792 - DNA, 25 bp, Mus musculus
gaacacactttcctctaggacctaa

SEQ ID NO: 628793 - DNA, 25 bp, Mus musculus
gaacacactttcgtctaggacctaa

SEQ ID NO: 628794 - DNA, 25 bp, Mus musculus
gaacacagaaggctccttccattgc

SEQ ID NO: 628795 - DNA, 25 bp, Mus musculus
gaacacagaagggtccttccattgc

SEQ ID NO: 628796 - DNA, 25 bp, Mus musculus
gaacacagatgtcccgacttcggaa

SEQ ID NO: 628797 - DNA, 25 bp, Mus musculus
gaacacagatgtgccgacttcggaa

SEQ ID NO: 628798 - DNA, 25 bp, Mus musculus
gaacacagccctccatgtggcggtg

SEQ ID NO: 628799 - DNA, 25 bp, Mus musculus
gaacacagccctgcatgtggcggtg

SEQ ID NO: 628800 - DNA, 25 bp, Mus musculus
gaacacagcgctacttaaccacggt

SEQ ID NO: 628801 - DNA, 25 bp, Mus musculus
gaacacagcgcttcttaaccacggt

SEQ ID NO: 628802 - DNA, 25 bp, Mus musculus
gaacacagcttcatcaagcactatg

SEQ ID NO: 628803 - DNA, 25 bp, Mus musculus
gaacacagcttcttcaagcactatg

SEQ ID NO: 628804 - DNA, 25 bp, Mus musculus
gaacacaggcagagtctccgtgaca

SEQ ID NO: 628805 - DNA, 25 bp, Mus musculus
gaacacaggcagtgtctccgtgaca

SEQ ID NO: 628806 - DNA, 25 bp, Mus musculus
gaacacaggcttacagcaagagaca

SEQ ID NO: 628807 - DNA, 25 bp, Mus musculus
gaacacaggcttcgaactcagggag

SEQ ID NO: 628808 - DNA, 25 bp, Mus musculus
gaacacaggcttggaactcagggag

SEQ ID NO: 628809 - DNA, 25 bp, Mus musculus
gaacacaggctttcagcaagagaca

SEQ ID NO: 628810 - DNA, 25 bp, Mus musculus
gaacacaggtacagaacgagtggat

SEQ ID NO: 628811 - DNA, 25 bp, Mus musculus
gaacacaggtactgaacgagtggat

SEQ ID NO: 628812 - DNA, 25 bp, Mus musculus
gaacacagtggccatcagcagaaga

SEQ ID NO: 628813 - DNA, 25 bp, Mus musculus
gaacacagtggcgatcagcagaaga

SEQ ID NO: 628814 - DNA, 25 bp, Mus musculus
gaacacagtgggagctctgacagcc

SEQ ID NO: 628815 - DNA, 25 bp, Mus musculus
gaacacagtgggtgctctgacagcc

SEQ ID NO: 628816 - DNA, 25 bp, Mus musculus
gaacacatataaccagacggcgctg

SEQ ID NO: 628817 - DNA, 25 bp, Mus musculus
gaacacatataagcagacggcgctg

SEQ ID NO: 628818 - DNA, 25 bp, Mus musculus
gaacacatgggcaccaatgtcattg

SEQ ID NO: 628819 - DNA, 25 bp, Mus musculus
gaacacatgggctccaatgtcattg

SEQ ID NO: 628820 - DNA, 25 bp, Mus musculus
gaacacatttgtcggtacacccttc

SEQ ID NO: 628821 - DNA, 25 bp, Mus musculus
gaacacatttgtgggtacacccttc

SEQ ID NO: 628822 - DNA, 25 bp, Mus musculus
gaacaccaaaacacactaagcacgt

SEQ ID NO: 628823 - DNA, 25 bp, Mus musculus
gaacaccaaaactcactaagcacgt

SEQ ID NO: 628824 - DNA, 25 bp, Mus musculus
gaacaccaaaggcaacactctcaaa

SEQ ID NO: 628825 - DNA, 25 bp, Mus musculus
gaacaccaaagggaacactctcaaa

SEQ ID NO: 628826 - DNA, 25 bp, Mus musculus
gaacaccaagcgagattgcaaaaag

SEQ ID NO: 628827 - DNA, 25 bp, Mus musculus
gaacaccaagcgtgattgcaaaaag

SEQ ID NO: 628828 - DNA, 25 bp, Mus musculus
gaacaccaagttcttagtgcgggct

SEQ ID NO: 628829 - DNA, 25 bp, Mus musculus
gaacaccaagttgttagtgcgggct

SEQ ID NO: 628830 - DNA, 25 bp, Mus musculus
gaacaccaatggcagctaccgctgc

SEQ ID NO: 628831 - DNA, 25 bp, Mus musculus
gaacaccaatgggagctaccgctgc

SEQ ID NO: 628832 - DNA, 25 bp, Mus musculus
gaacaccaccaacaagtctttctgg

SEQ ID NO: 628833 - DNA, 25 bp, Mus musculus
gaacaccaccaagaagtctttctgg

SEQ ID NO: 628834 - DNA, 25 bp, Mus musculus
gaacaccactgcactacgctgtgcg

SEQ ID NO: 628835 - DNA, 25 bp, Mus musculus
gaacaccactgctctacgctgtgcg

SEQ ID NO: 628836 - DNA, 25 bp, Mus musculus
gaacaccacttcaaaataacctaat

SEQ ID NO: 628837 - DNA, 25 bp, Mus musculus
gaacaccacttctaaataacctaat

SEQ ID NO: 628838 - DNA, 25 bp, Mus musculus
gaacaccagtgcatgcaggaattca

SEQ ID NO: 628839 - DNA, 25 bp, Mus musculus
gaacaccagtgcttgcaggaattca

SEQ ID NO: 628840 - DNA, 25 bp, Mus musculus
gaacaccagtggacactgctcacca

SEQ ID NO: 628841 - DNA, 25 bp, Mus musculus
gaacaccagtggtcactgctcacca

SEQ ID NO: 628842 - DNA, 25 bp, Mus musculus
gaacaccagtgtccctgcaggaaca

SEQ ID NO: 628843 - DNA, 25 bp, Mus musculus
gaacaccagtgtgcctgcaggaaca

SEQ ID NO: 628844 - DNA, 25 bp, Mus musculus
gaacaccatagcaccattgtctcca

SEQ ID NO: 628845 - DNA, 25 bp, Mus musculus
gaacaccatagctccattgtctcca

SEQ ID NO: 628846 - DNA, 25 bp, Mus musculus
gaacaccatgtgagtgaatacacct

SEQ ID NO: 628847 - DNA, 25 bp, Mus musculus
gaacaccatgtgtgtgaatacacct

SEQ ID NO: 628848 - DNA, 25 bp, Mus musculus
gaacacccactgattgagcgtgtgc

SEQ ID NO: 628849 - DNA, 25 bp, Mus musculus
gaacacccactgtttgagcgtgtgc

SEQ ID NO: 628850 - DNA, 25 bp, Mus musculus
gaacacccgctgcaattccctgaag

SEQ ID NO: 628851 - DNA, 25 bp, Mus musculus
gaacacccgctggaattccctgaag

SEQ ID NO: 628852 - DNA, 25 bp, Mus musculus
gaacacccggtgcagtctttctgaa

SEQ ID NO: 628853 - DNA, 25 bp, Mus musculus
gaacacccggtggagtctttctgaa

SEQ ID NO: 628854 - DNA, 25 bp, Mus musculus
gaacaccctcctcaatgggcacaag

SEQ ID NO: 628855 - DNA, 25 bp, Mus musculus
gaacaccctcctgaatgggcacaag

SEQ ID NO: 628856 - DNA, 25 bp, Mus musculus
gaacacccttatatgaccagatcat

SEQ ID NO: 628857 - DNA, 25 bp, Mus musculus
gaacacccttatttgaccagatcat

SEQ ID NO: 628858 - DNA, 25 bp, Mus musculus
gaacaccgaatgaggacacgtggcc

SEQ ID NO: 628859 - DNA, 25 bp, Mus musculus
gaacaccgaatgtggacacgtggcc

SEQ ID NO: 628860 - DNA, 25 bp, Mus musculus
gaacaccgagttaacgtctgcgagc

SEQ ID NO: 628861 - DNA, 25 bp, Mus musculus
gaacaccgagtttacgtctgcgagc

SEQ ID NO: 628862 - DNA, 25 bp, Mus musculus
gaacaccgcttcagtgtgctgcgta

SEQ ID NO: 628863 - DNA, 25 bp, Mus musculus
gaacaccgcttctgtgtgctgcgta

SEQ ID NO: 628864 - DNA, 25 bp, Mus musculus
gaacaccggcaacatttccttagat

SEQ ID NO: 628865 - DNA, 25 bp, Mus musculus
gaacaccggcaagatttccttagat

SEQ ID NO: 628866 - DNA, 25 bp, Mus musculus
gaacaccggccaagaagtgtctaaa

SEQ ID NO: 628867 - DNA, 25 bp, Mus musculus
gaacaccggccatgaagtgtctaaa

SEQ ID NO: 628868 - DNA, 25 bp, Mus musculus
gaacaccgtgtgaaactgccatgca

SEQ ID NO: 628869 - DNA, 25 bp, Mus musculus
gaacaccgtgtgtaactgccatgca

SEQ ID NO: 628870 - DNA, 25 bp, Mus musculus
gaacacctataaccgtcttgccatt

SEQ ID NO: 628871 - DNA, 25 bp, Mus musculus
gaacacctataagcgtcttgccatt

SEQ ID NO: 628872 - DNA, 25 bp, Mus musculus
gaacacctcactcggaaacattgcc

SEQ ID NO: 628873 - DNA, 25 bp, Mus musculus
gaacacctcactgggaaacattgcc

SEQ ID NO: 628874 - DNA, 25 bp, Mus musculus
gaacacctggttaagagccaaatgg

SEQ ID NO: 628875 - DNA, 25 bp, Mus musculus
gaacacctggtttagagccaaatgg

SEQ ID NO: 628876 - DNA, 25 bp, Mus musculus
gaacacctgtctcttgcctactcgg

SEQ ID NO: 628877 - DNA, 25 bp, Mus musculus
gaacacctgtctgttgcctactcgg

SEQ ID NO: 628878 - DNA, 25 bp, Mus musculus
gaacaccttaaacgaagaaagatgg

SEQ ID NO: 628879 - DNA, 25 bp, Mus musculus
gaacaccttaaaggaagaaagatgg

SEQ ID NO: 628880 - DNA, 25 bp, Mus musculus
gaacaccttggacagtgccctgagt

SEQ ID NO: 628881 - DNA, 25 bp, Mus musculus
gaacaccttggagagtgccctgagt

SEQ ID NO: 628882 - DNA, 25 bp, Mus musculus
gaacacgaccctatgtgatctcccg

SEQ ID NO: 628883 - DNA, 25 bp, Mus musculus
gaacacgaccctttgtgatctcccg

SEQ ID NO: 628884 - DNA, 25 bp, Mus musculus
gaacacgagagtacaaccactgtca

SEQ ID NO: 628885 - DNA, 25 bp, Mus musculus
gaacacgagagttcaaccactgtca

SEQ ID NO: 628886 - DNA, 25 bp, Mus musculus
gaacacgatggtcgatgtttgccaa

SEQ ID NO: 628887 - DNA, 25 bp, Mus musculus
gaacacgatggtggatgtttgccaa

SEQ ID NO: 628888 - DNA, 25 bp, Mus musculus
gaacacgatttaaggaatatcccca

SEQ ID NO: 628889 - DNA, 25 bp, Mus musculus
gaacacgatttatggaatatcccca

SEQ ID NO: 628890 - DNA, 25 bp, Mus musculus
gaacacgcaagcaggtcatccacca

SEQ ID NO: 628891 - DNA, 25 bp, Mus musculus
gaacacgcaagctggtcatccacca

SEQ ID NO: 628892 - DNA, 25 bp, Mus musculus
gaacacgcaaggctgataaccctcg

SEQ ID NO: 628893 - DNA, 25 bp, Mus musculus
gaacacgcaagggtgataaccctcg

SEQ ID NO: 628894 - DNA, 25 bp, Mus musculus
gaacacgcccatcattgctggcctt

SEQ ID NO: 628895 - DNA, 25 bp, Mus musculus
gaacacgcccatgattgctggcctt

SEQ ID NO: 628896 - DNA, 25 bp, Mus musculus
gaacacgctagcaaaggattattca

SEQ ID NO: 628897 - DNA, 25 bp, Mus musculus
gaacacgctagctaaggattattca

SEQ ID NO: 628898 - DNA, 25 bp, Mus musculus
gaacacgggttacctatcctgccat

SEQ ID NO: 628899 - DNA, 25 bp, Mus musculus
gaacacgggttagctatcctgccat

SEQ ID NO: 628900 - DNA, 25 bp, Mus musculus
gaacacgggttcattggctgccgca

SEQ ID NO: 628901 - DNA, 25 bp, Mus musculus
gaacacgggttctttggctgccgca

SEQ ID NO: 628902 - DNA, 25 bp, Mus musculus
gaacacgtctgaatccagggcacac

SEQ ID NO: 628903 - DNA, 25 bp, Mus musculus
gaacacgtctgattccagggcacac

SEQ ID NO: 628904 - DNA, 25 bp, Mus musculus
gaacacgtgaggctccaaaattgag

SEQ ID NO: 628905 - DNA, 25 bp, Mus musculus
gaacacgtgagggtccaaaattgag

SEQ ID NO: 628906 - DNA, 25 bp, Mus musculus
gaacacgtgcgcactggacaggcct

SEQ ID NO: 628907 - DNA, 25 bp, Mus musculus
gaacacgtgcgctctggacaggcct

SEQ ID NO: 628908 - DNA, 25 bp, Mus musculus
gaacactaaagacgcgacggagcct

SEQ ID NO: 628909 - DNA, 25 bp, Mus musculus
gaacactaaagaggcgacggagcct

SEQ ID NO: 628910 - DNA, 25 bp, Mus musculus
gaacactaaagcaggcctgtgatct

SEQ ID NO: 628911 - DNA, 25 bp, Mus musculus
gaacactaaagctggcctgtgatct

SEQ ID NO: 628912 - DNA, 25 bp, Mus musculus
gaacactaacttccctgctggcatt

SEQ ID NO: 628913 - DNA, 25 bp, Mus musculus
gaacactaacttgcctgctggcatt

SEQ ID NO: 628914 - DNA, 25 bp, Mus musculus
gaacactacaccacagagttcctat

SEQ ID NO: 628915 - DNA, 25 bp, Mus musculus
gaacactacacctcagagttcctat

SEQ ID NO: 628916 - DNA, 25 bp, Mus musculus
gaacactactctcaaaaacctaggg

SEQ ID NO: 628917 - DNA, 25 bp, Mus musculus
gaacactactctgaaaaacctaggg

SEQ ID NO: 628918 - DNA, 25 bp, Mus musculus
gaacactaggccacagagtgatacc

SEQ ID NO: 628919 - DNA, 25 bp, Mus musculus
gaacactaggcctcagagtgatacc

SEQ ID NO: 628920 - DNA, 25 bp, Mus musculus
gaacactatggcactctcaaaggtc

SEQ ID NO: 628921 - DNA, 25 bp, Mus musculus
gaacactatggctctctcaaaggtc

SEQ ID NO: 628922 - DNA, 25 bp, Mus musculus
gaacactatttgcttaaggagaagc

SEQ ID NO: 628923 - DNA, 25 bp, Mus musculus
gaacactatttggttaaggagaagc

SEQ ID NO: 628924 - DNA, 25 bp, Mus musculus
gaacactcatcactgggttggcaag

SEQ ID NO: 628925 - DNA, 25 bp, Mus musculus
gaacactcatcagtgggttggcaag

SEQ ID NO: 628926 - DNA, 25 bp, Mus musculus
gaacactcgctcagctttagggata

SEQ ID NO: 628927 - DNA, 25 bp, Mus musculus
gaacactcgctctgctttagggata

SEQ ID NO: 628928 - DNA, 25 bp, Mus musculus
gaacactctcttctaagttaccgga

SEQ ID NO: 628929 - DNA, 25 bp, Mus musculus
gaacactctcttgtaagttaccgga

SEQ ID NO: 628930 - DNA, 25 bp, Mus musculus
gaacactctgaacaaggtcttaaag

SEQ ID NO: 628931 - DNA, 25 bp, Mus musculus
gaacactctgaagaaggtcttaaag

SEQ ID NO: 628932 - DNA, 25 bp, Mus musculus
gaacactctgatccagtatcacagc

SEQ ID NO: 628933 - DNA, 25 bp, Mus musculus
gaacactctgatgcagtatcacagc

SEQ ID NO: 628934 - DNA, 25 bp, Mus musculus
gaacactgacaaataggcatggaat

SEQ ID NO: 628935 - DNA, 25 bp, Mus musculus
gaacactgacaattaggcatggaat

SEQ ID NO: 628936 - DNA, 25 bp, Mus musculus
gaacactgaggccatggtacgcaac

SEQ ID NO: 628937 - DNA, 25 bp, Mus musculus
gaacactgaggcgatggtacgcaac

SEQ ID NO: 628938 - DNA, 25 bp, Mus musculus
gaacactgcagtaggaaaaattgtc

SEQ ID NO: 628939 - DNA, 25 bp, Mus musculus
gaacactgcagttggaaaaattgtc

SEQ ID NO: 628940 - DNA, 25 bp, Mus musculus
gaacactgcctgaaggaccttgagg

SEQ ID NO: 628941 - DNA, 25 bp, Mus musculus
gaacactgcctgtaggaccttgagg

SEQ ID NO: 628942 - DNA, 25 bp, Mus musculus
gaacactgccttatggccaggatag

SEQ ID NO: 628943 - DNA, 25 bp, Mus musculus
gaacactgccttttggccaggatag

SEQ ID NO: 628944 - DNA, 25 bp, Mus musculus
gaacactgctcaccttggtcaacct

SEQ ID NO: 628945 - DNA, 25 bp, Mus musculus
gaacactgctcagcttggtcaacct

SEQ ID NO: 628946 - DNA, 25 bp, Mus musculus
gaacactggaacctcctcacaggga

SEQ ID NO: 628947 - DNA, 25 bp, Mus musculus
gaacactggaacgtcctcacaggga

SEQ ID NO: 628948 - DNA, 25 bp, Mus musculus
gaacactggaagatgaagatcaaat

SEQ ID NO: 628949 - DNA, 25 bp, Mus musculus
gaacactggaagttgaagatcaaat

SEQ ID NO: 628950 - DNA, 25 bp, Mus musculus
gaacactggagccatgacaaccagt

SEQ ID NO: 628951 - DNA, 25 bp, Mus musculus
gaacactggagcgatgacaaccagt

SEQ ID NO: 628952 - DNA, 25 bp, Mus musculus
gaacactggatacaactcagaacag

SEQ ID NO: 628953 - DNA, 25 bp, Mus musculus
gaacactggatagaactcagaacag

SEQ ID NO: 628954 - DNA, 25 bp, Mus musculus
gaacactggattcttattcaggcat

SEQ ID NO: 628955 - DNA, 25 bp, Mus musculus
gaacactggattgttattcaggcat

SEQ ID NO: 628956 - DNA, 25 bp, Mus musculus
gaacactgggatcacacctgtgccc

SEQ ID NO: 628957 - DNA, 25 bp, Mus musculus
gaacactgggatgacacctgtgccc

SEQ ID NO: 628958 - DNA, 25 bp, Mus musculus
gaacactggtagaaagccagccctg

SEQ ID NO: 628959 - DNA, 25 bp, Mus musculus
gaacactggtagtaagccagccctg

SEQ ID NO: 628960 - DNA, 25 bp, Mus musculus
gaacactgtaggcatcccattctga

SEQ ID NO: 628961 - DNA, 25 bp, Mus musculus
gaacactgtagggatcccattctga

SEQ ID NO: 628962 - DNA, 25 bp, Mus musculus
gaacactgtctacttttcctccatc

SEQ ID NO: 628963 - DNA, 25 bp, Mus musculus
gaacactgtctagttttcctccatc

SEQ ID NO: 628964 - DNA, 25 bp, Mus musculus
gaacactgtggaaggaattagtcta

SEQ ID NO: 628965 - DNA, 25 bp, Mus musculus
gaacactgtggatggaattagtcta

SEQ ID NO: 628966 - DNA, 25 bp, Mus musculus
gaacactgtggtacccaccaagaag

SEQ ID NO: 628967 - DNA, 25 bp, Mus musculus
gaacactgtggttcccaccaagaag

SEQ ID NO: 628968 - DNA, 25 bp, Mus musculus
gaacacttacgtatgcagcgagaga

SEQ ID NO: 628969 - DNA, 25 bp, Mus musculus
gaacacttacgtttgcagcgagaga

SEQ ID NO: 628970 - DNA, 25 bp, Mus musculus
gaacacttactacaacagacaggag

SEQ ID NO: 628971 - DNA, 25 bp, Mus musculus
gaacacttactagaacagacaggag

SEQ ID NO: 628972 - DNA, 25 bp, Mus musculus
gaacacttccctaagccatgctcag

SEQ ID NO: 628973 - DNA, 25 bp, Mus musculus
gaacacttcccttagccatgctcag

SEQ ID NO: 628974 - DNA, 25 bp, Mus musculus
gaacacttcggaactatggaagcta

SEQ ID NO: 628975 - DNA, 25 bp, Mus musculus
gaacacttcggatctatggaagcta

SEQ ID NO: 628976 - DNA, 25 bp, Mus musculus
gaacacttgaacacacagaacggag

SEQ ID NO: 628977 - DNA, 25 bp, Mus musculus
gaacacttgaactcacagaacggag

SEQ ID NO: 628978 - DNA, 25 bp, Mus musculus
gaacacttgaccctgtagacggagt

SEQ ID NO: 628979 - DNA, 25 bp, Mus musculus
gaacacttgaccgtgtagacggagt

SEQ ID NO: 628980 - DNA, 25 bp, Mus musculus
gaacactttaaccaggcaatagaag

SEQ ID NO: 628981 - DNA, 25 bp, Mus musculus
gaacactttaacgaggcaatagaag

SEQ ID NO: 628982 - DNA, 25 bp, Mus musculus
gaacagaaacccacaagtaacctct

SEQ ID NO: 628983 - DNA, 25 bp, Mus musculus
gaacagaaaccctcaagtaacctct

SEQ ID NO: 628984 - DNA, 25 bp, Mus musculus
gaacagaaagacagatacagttgct

SEQ ID NO: 628985 - DNA, 25 bp, Mus musculus
gaacagaaagactgatacagttgct

SEQ ID NO: 628986 - DNA, 25 bp, Mus musculus
gaacagaaatcgatcaagaagtggg

SEQ ID NO: 628987 - DNA, 25 bp, Mus musculus
gaacagaaatcgttcaagaagtggg

SEQ ID NO: 628988 - DNA, 25 bp, Mus musculus
gaacagaacctgagtgtgatatcca

SEQ ID NO: 628989 - DNA, 25 bp, Mus musculus
gaacagaacctgtgtgtgatatcca

SEQ ID NO: 628990 - DNA, 25 bp, Mus musculus
gaacagaactccaagcaacacttac

SEQ ID NO: 628991 - DNA, 25 bp, Mus musculus
gaacagaactcctagcaacacttac

SEQ ID NO: 628992 - DNA, 25 bp, Mus musculus
gaacagaactctacataaccaaggt

SEQ ID NO: 628993 - DNA, 25 bp, Mus musculus
gaacagaactcttcataaccaaggt

SEQ ID NO: 628994 - DNA, 25 bp, Mus musculus
gaacagaagcacagattggcgaacg

SEQ ID NO: 628995 - DNA, 25 bp, Mus musculus
gaacagaagcactgattggcgaacg

SEQ ID NO: 628996 - DNA, 25 bp, Mus musculus
gaacagaagttgactggatctggag

SEQ ID NO: 628997 - DNA, 25 bp, Mus musculus
gaacagaagttgtctggatctggag

SEQ ID NO: 628998 - DNA, 25 bp, Mus musculus
gaacagacctttcgcttggagtcga

SEQ ID NO: 628999 - DNA, 25 bp, Mus musculus
gaacagacctttctctacaggagat

SEQ ID NO: 629000 - DNA, 25 bp, Mus musculus
gaacagacctttggcttggagtcga

SEQ ID NO: 629001 - DNA, 25 bp, Mus musculus
gaacagacctttgtctacaggagat

SEQ ID NO: 629002 - DNA, 25 bp, Mus musculus
gaacagactacgagctcagcttaga

SEQ ID NO: 629003 - DNA, 25 bp, Mus musculus
gaacagactacgtgctcagcttaga

SEQ ID NO: 629004 - DNA, 25 bp, Mus musculus
gaacagactagaaactgactctgct

SEQ ID NO: 629005 - DNA, 25 bp, Mus musculus
gaacagactagatactgactctgct

SEQ ID NO: 629006 - DNA, 25 bp, Mus musculus
gaacagactcccctcagaagtacag

SEQ ID NO: 629007 - DNA, 25 bp, Mus musculus
gaacagactcccgtcagaagtacag

SEQ ID NO: 629008 - DNA, 25 bp, Mus musculus
gaacagactcttctcctgggccatc

SEQ ID NO: 629009 - DNA, 25 bp, Mus musculus
gaacagactcttgtcctgggccatc

SEQ ID NO: 629010 - DNA, 25 bp, Mus musculus
gaacagactgctatgtgtgtctcca

SEQ ID NO: 629011 - DNA, 25 bp, Mus musculus
gaacagactgctttgtgtgtctcca

SEQ ID NO: 629012 - DNA, 25 bp, Mus musculus
gaacagactgttcgagcggacacag

SEQ ID NO: 629013 - DNA, 25 bp, Mus musculus
gaacagactgttggagcggacacag

SEQ ID NO: 629014 - DNA, 25 bp, Mus musculus
gaacagacttgcatagcttccttga

SEQ ID NO: 629015 - DNA, 25 bp, Mus musculus
gaacagacttgcttagcttccttga

SEQ ID NO: 629016 - DNA, 25 bp, Mus musculus
gaacagagaaaacagcgggctcaag

SEQ ID NO: 629017 - DNA, 25 bp, Mus musculus
gaacagagaaaacgtctgccacggg

SEQ ID NO: 629018 - DNA, 25 bp, Mus musculus
gaacagagaaaagagcgggctcaag

SEQ ID NO: 629019 - DNA, 25 bp, Mus musculus
gaacagagaaaaggtctgccacggg

SEQ ID NO: 629020 - DNA, 25 bp, Mus musculus
gaacagagaaccagtacagttggaa

SEQ ID NO: 629021 - DNA, 25 bp, Mus musculus
gaacagagaaccctgttatcatggg

SEQ ID NO: 629022 - DNA, 25 bp, Mus musculus
gaacagagaaccgtgttatcatggg

SEQ ID NO: 629023 - DNA, 25 bp, Mus musculus
gaacagagaacctgtacagttggaa

SEQ ID NO: 629024 - DNA, 25 bp, Mus musculus
gaacagagagagcaagtgatgtcat

SEQ ID NO: 629025 - DNA, 25 bp, Mus musculus
gaacagagagaggaagtgatgtcat

SEQ ID NO: 629026 - DNA, 25 bp, Mus musculus
gaacagagattgagctcacagatga

SEQ ID NO: 629027 - DNA, 25 bp, Mus musculus
gaacagagattgtgctcacagatga

SEQ ID NO: 629028 - DNA, 25 bp, Mus musculus
gaacagagcatccagacgctagagc

SEQ ID NO: 629029 - DNA, 25 bp, Mus musculus
gaacagagcatcgagacgctagagc

SEQ ID NO: 629030 - DNA, 25 bp, Mus musculus
gaacagagcattaagtctgagacat

SEQ ID NO: 629031 - DNA, 25 bp, Mus musculus
gaacagagcatttagtctgagacat

SEQ ID NO: 629032 - DNA, 25 bp, Mus musculus
gaacagagccttcttggccgattta

SEQ ID NO: 629033 - DNA, 25 bp, Mus musculus
gaacagagccttgttggccgattta

SEQ ID NO: 629034 - DNA, 25 bp, Mus musculus
gaacagagcgtcctgtcaactcggc

SEQ ID NO: 629035 - DNA, 25 bp, Mus musculus
gaacagagcgtcgtgtcaactcggc

SEQ ID NO: 629036 - DNA, 25 bp, Mus musculus
gaacagaggattcttcagcccacat

SEQ ID NO: 629037 - DNA, 25 bp, Mus musculus
gaacagaggattgttcagcccacat

SEQ ID NO: 629038 - DNA, 25 bp, Mus musculus
gaacagaggcccattgcatctaagc

SEQ ID NO: 629039 - DNA, 25 bp, Mus musculus
gaacagaggccctttgcatctaagc

SEQ ID NO: 629040 - DNA, 25 bp, Mus musculus
gaacagaggctgcttcgcgaagcca

SEQ ID NO: 629041 - DNA, 25 bp, Mus musculus
gaacagaggctggttcgcgaagcca

SEQ ID NO: 629042 - DNA, 25 bp, Mus musculus
gaacagagtccacgagatgccaaac

SEQ ID NO: 629043 - DNA, 25 bp, Mus musculus
gaacagagtccaggagatgccaaac

SEQ ID NO: 629044 - DNA, 25 bp, Mus musculus
gaacagagtcgacgcgctttctccc

SEQ ID NO: 629045 - DNA, 25 bp, Mus musculus
gaacagagtcgaggcgctttctccc

SEQ ID NO: 629046 - DNA, 25 bp, Mus musculus
gaacagagtggtatgatctgcctcg

SEQ ID NO: 629047 - DNA, 25 bp, Mus musculus
gaacagagtggtttgatctgcctcg

SEQ ID NO: 629048 - DNA, 25 bp, Mus musculus
gaacagagtgtcaaatgtgtttgca

SEQ ID NO: 629049 - DNA, 25 bp, Mus musculus
gaacagagtgtctaatgtgtttgca

SEQ ID NO: 629050 - DNA, 25 bp, Mus musculus
gaacagagtgttagcccatctctgc

SEQ ID NO: 629051 - DNA, 25 bp, Mus musculus
gaacagagtgtttgcccatctctgc

SEQ ID NO: 629052 - DNA, 25 bp, Mus musculus
gaacagatactgaataaaatggata

SEQ ID NO: 629053 - DNA, 25 bp, Mus musculus
gaacagatactgtataaaatggata

SEQ ID NO: 629054 - DNA, 25 bp, Mus musculus
gaacagatcagtcgaggacaggaat

SEQ ID NO: 629055 - DNA, 25 bp, Mus musculus
gaacagatcagtggaggacaggaat

SEQ ID NO: 629056 - DNA, 25 bp, Mus musculus
gaacagatccagcttctgtgtaaga

SEQ ID NO: 629057 - DNA, 25 bp, Mus musculus
gaacagatccaggttctgtgtaaga

SEQ ID NO: 629058 - DNA, 25 bp, Mus musculus
gaacagatccttcagaacactgctg

SEQ ID NO: 629059 - DNA, 25 bp, Mus musculus
gaacagatccttgagaacactgctg

SEQ ID NO: 629060 - DNA, 25 bp, Mus musculus
gaacagatgaggaagtacaagatga

SEQ ID NO: 629061 - DNA, 25 bp, Mus musculus
gaacagatgaggtagtacaagatga

SEQ ID NO: 629062 - DNA, 25 bp, Mus musculus
gaacagatggctattgacccaagca

SEQ ID NO: 629063 - DNA, 25 bp, Mus musculus
gaacagatggcttttgacccaagca

SEQ ID NO: 629064 - DNA, 25 bp, Mus musculus
gaacagatgttgactatcaagcagc

SEQ ID NO: 629065 - DNA, 25 bp, Mus musculus
gaacagatgttgtctatcaagcagc

SEQ ID NO: 629066 - DNA, 25 bp, Mus musculus
gaacagattcagcacacagagatgg

SEQ ID NO: 629067 - DNA, 25 bp, Mus musculus
gaacagattcaggacacagagatgg

SEQ ID NO: 629068 - DNA, 25 bp, Mus musculus
gaacagattgctatagctctggtag

SEQ ID NO: 629069 - DNA, 25 bp, Mus musculus
gaacagattgctttagctctggtag

SEQ ID NO: 629070 - DNA, 25 bp, Mus musculus
gaacagatttgccacagctagcgct

SEQ ID NO: 629071 - DNA, 25 bp, Mus musculus
gaacagatttgcgacagctagcgct

SEQ ID NO: 629072 - DNA, 25 bp, Mus musculus
gaacagcaaacaaggttgaccccga

SEQ ID NO: 629073 - DNA, 25 bp, Mus musculus
gaacagcaaacactgacaagcccgg

SEQ ID NO: 629074 - DNA, 25 bp, Mus musculus
gaacagcaaacagtgacaagcccgg

SEQ ID NO: 629075 - DNA, 25 bp, Mus musculus
gaacagcaaacatggttgaccccga

SEQ ID NO: 629076 - DNA, 25 bp, Mus musculus
gaacagcaaaccacgaaatcgccca

SEQ ID NO: 629077 - DNA, 25 bp, Mus musculus
gaacagcaaacctcgaaatcgccca

SEQ ID NO: 629078 - DNA, 25 bp, Mus musculus
gaacagcaaccacacaggctacgat

SEQ ID NO: 629079 - DNA, 25 bp, Mus musculus
gaacagcaaccagacaggctacgat

SEQ ID NO: 629080 - DNA, 25 bp, Mus musculus
gaacagcaatctagcaagtgttgaa

SEQ ID NO: 629081 - DNA, 25 bp, Mus musculus
gaacagcaatcttgcaagtgttgaa

SEQ ID NO: 629082 - DNA, 25 bp, Mus musculus
gaacagcaccagaaaatcttaatat

SEQ ID NO: 629083 - DNA, 25 bp, Mus musculus
gaacagcaccagtaaatcttaatat

SEQ ID NO: 629084 - DNA, 25 bp, Mus musculus
gaacagcacttgagcagataaagaa

SEQ ID NO: 629085 - DNA, 25 bp, Mus musculus
gaacagcacttgtgcagataaagaa

SEQ ID NO: 629086 - DNA, 25 bp, Mus musculus
gaacagcagacacaagtactcgagc

SEQ ID NO: 629087 - DNA, 25 bp, Mus musculus
gaacagcagacagaagtactcgagc

SEQ ID NO: 629088 - DNA, 25 bp, Mus musculus
gaacagcagactctgtccattgcaa

SEQ ID NO: 629089 - DNA, 25 bp, Mus musculus
gaacagcagactgtgtccattgcaa

SEQ ID NO: 629090 - DNA, 25 bp, Mus musculus
gaacagcagcaaccctatcatcgtc

SEQ ID NO: 629091 - DNA, 25 bp, Mus musculus
gaacagcagcaagcctatcatcgtc

SEQ ID NO: 629092 - DNA, 25 bp, Mus musculus
gaacagcagccacatcaagagaccc

SEQ ID NO: 629093 - DNA, 25 bp, Mus musculus
gaacagcagccagatcaagagaccc

SEQ ID NO: 629094 - DNA, 25 bp, Mus musculus
gaacagcagctgaactcatggctgg

SEQ ID NO: 629095 - DNA, 25 bp, Mus musculus
gaacagcagctgtactcatggctgg

SEQ ID NO: 629096 - DNA, 25 bp, Mus musculus
gaacagcatccgattcagtatccag

SEQ ID NO: 629097 - DNA, 25 bp, Mus musculus
gaacagcatccgtttcagtatccag

SEQ ID NO: 629098 - DNA, 25 bp, Mus musculus
gaacagcatcggagttccccgcctg

SEQ ID NO: 629099 - DNA, 25 bp, Mus musculus
gaacagcatcggtgttccccgcctg

SEQ ID NO: 629100 - DNA, 25 bp, Mus musculus
gaacagcatgaacgcatgacctcca

SEQ ID NO: 629101 - DNA, 25 bp, Mus musculus
gaacagcatgaaggcatgacctcca

SEQ ID NO: 629102 - DNA, 25 bp, Mus musculus
gaacagccacttatgcgtggcactg

SEQ ID NO: 629103 - DNA, 25 bp, Mus musculus
gaacagccacttttgcgtggcactg

SEQ ID NO: 629104 - DNA, 25 bp, Mus musculus
gaacagccccgtcgtgctttggctt

SEQ ID NO: 629105 - DNA, 25 bp, Mus musculus
gaacagccccgtggtgctttggctt

SEQ ID NO: 629106 - DNA, 25 bp, Mus musculus
gaacagccctgaaacttttgactag

SEQ ID NO: 629107 - DNA, 25 bp, Mus musculus
gaacagccctgatacttttgactag

SEQ ID NO: 629108 - DNA, 25 bp, Mus musculus
gaacagcctcaaacctgacctcatg

SEQ ID NO: 629109 - DNA, 25 bp, Mus musculus
gaacagcctcaatcctgacctcatg

SEQ ID NO: 629110 - DNA, 25 bp, Mus musculus
gaacagcctctgcttagagttgaag

SEQ ID NO: 629111 - DNA, 25 bp, Mus musculus
gaacagcctctggttagagttgaag

SEQ ID NO: 629112 - DNA, 25 bp, Mus musculus
gaacagcctggaagtctcgaagatg

SEQ ID NO: 629113 - DNA, 25 bp, Mus musculus
gaacagcctggatgtctcgaagatg

SEQ ID NO: 629114 - DNA, 25 bp, Mus musculus
gaacagcgacggcaccttagtggct

SEQ ID NO: 629115 - DNA, 25 bp, Mus musculus
gaacagcgacgggaccttagtggct

SEQ ID NO: 629116 - DNA, 25 bp, Mus musculus
gaacagcgatctcggttcctggctg

SEQ ID NO: 629117 - DNA, 25 bp, Mus musculus
gaacagcgatctgggttcctggctg

SEQ ID NO: 629118 - DNA, 25 bp, Mus musculus
gaacagcgctgaagtggccaagcat

SEQ ID NO: 629119 - DNA, 25 bp, Mus musculus
gaacagcgctgatgtggccaagcat

SEQ ID NO: 629120 - DNA, 25 bp, Mus musculus
gaacagcggcatcgctaaaaaacag

SEQ ID NO: 629121 - DNA, 25 bp, Mus musculus
gaacagcggcatggctaaaaaacag

SEQ ID NO: 629122 - DNA, 25 bp, Mus musculus
gaacagcgtacaccaatcaagagag

SEQ ID NO: 629123 - DNA, 25 bp, Mus musculus
gaacagcgtacagcaatcaagagag

SEQ ID NO: 629124 - DNA, 25 bp, Mus musculus
gaacagcgtcgaagaagggcaagta

SEQ ID NO: 629125 - DNA, 25 bp, Mus musculus
gaacagcgtcgatgaagggcaagta

SEQ ID NO: 629126 - DNA, 25 bp, Mus musculus
gaacagctaaagatgggagaggccc

SEQ ID NO: 629127 - DNA, 25 bp, Mus musculus
gaacagctaaagttgggagaggccc

SEQ ID NO: 629128 - DNA, 25 bp, Mus musculus
gaacagctacccaaatttaaagcta

SEQ ID NO: 629129 - DNA, 25 bp, Mus musculus
gaacagctaccctaatttaaagcta

SEQ ID NO: 629130 - DNA, 25 bp, Mus musculus
gaacagctcaccagcaaggatctag

SEQ ID NO: 629131 - DNA, 25 bp, Mus musculus
gaacagctcacccactgggcagttg

SEQ ID NO: 629132 - DNA, 25 bp, Mus musculus
gaacagctcaccgactgggcagttg

SEQ ID NO: 629133 - DNA, 25 bp, Mus musculus
gaacagctcacctgcaaggatctag

SEQ ID NO: 629134 - DNA, 25 bp, Mus musculus
gaacagctccaacgatgagaccatc

SEQ ID NO: 629135 - DNA, 25 bp, Mus musculus
gaacagctccaaggatgagaccatc

SEQ ID NO: 629136 - DNA, 25 bp, Mus musculus
gaacagctcccaagcctgtgtctgt

SEQ ID NO: 629137 - DNA, 25 bp, Mus musculus
gaacagctcccatgcctgtgtctgt

SEQ ID NO: 629138 - DNA, 25 bp, Mus musculus
gaacagctccgacgaagaattcttt

SEQ ID NO: 629139 - DNA, 25 bp, Mus musculus
gaacagctccgaggaagaattcttt

SEQ ID NO: 629140 - DNA, 25 bp, Mus musculus
gaacagctctttatcaggtcttcag

SEQ ID NO: 629141 - DNA, 25 bp, Mus musculus
gaacagctctttttcaggtcttcag

SEQ ID NO: 629142 - DNA, 25 bp, Mus musculus
gaacagctgatgcactaccatcgga

SEQ ID NO: 629143 - DNA, 25 bp, Mus musculus
gaacagctgatggactaccatcgga

SEQ ID NO: 629144 - DNA, 25 bp, Mus musculus
gaacagctgcaacagggaaagccta

SEQ ID NO: 629145 - DNA, 25 bp, Mus musculus
gaacagctgcaagagggaaagccta

SEQ ID NO: 629146 - DNA, 25 bp, Mus musculus
gaacagctgccactacccagggctt

SEQ ID NO: 629147 - DNA, 25 bp, Mus musculus
gaacagctgccagtacccagggctt

SEQ ID NO: 629148 - DNA, 25 bp, Mus musculus
gaacagctgcttactgaactgggaa

SEQ ID NO: 629149 - DNA, 25 bp, Mus musculus
gaacagctgctttctgaactgggaa

SEQ ID NO: 629150 - DNA, 25 bp, Mus musculus
gaacagctggaaaccttcaggcctt

SEQ ID NO: 629151 - DNA, 25 bp, Mus musculus
gaacagctggaatccttcaggcctt

SEQ ID NO: 629152 - DNA, 25 bp, Mus musculus
gaacagctggagaatggccctaaca

SEQ ID NO: 629153 - DNA, 25 bp, Mus musculus
gaacagctggagtatggccctaaca

SEQ ID NO: 629154 - DNA, 25 bp, Mus musculus
gaacagctgtgccaaagacctcacg

SEQ ID NO: 629155 - DNA, 25 bp, Mus musculus
gaacagctgtgcgaaagacctcacg

SEQ ID NO: 629156 - DNA, 25 bp, Mus musculus
gaacagcttaatcaggcaaaccagt

SEQ ID NO: 629157 - DNA, 25 bp, Mus musculus
gaacagcttaatgaggcaaaccagt

SEQ ID NO: 629158 - DNA, 25 bp, Mus musculus
gaacagcttgatcctgacacaagga

SEQ ID NO: 629159 - DNA, 25 bp, Mus musculus
gaacagcttgatgctgacacaagga

SEQ ID NO: 629160 - DNA, 25 bp, Mus musculus
gaacagcttgttaaggccaaagaac

SEQ ID NO: 629161 - DNA, 25 bp, Mus musculus
gaacagcttgttctgggcacttctc

SEQ ID NO: 629162 - DNA, 25 bp, Mus musculus
gaacagcttgttgtgggcacttctc

SEQ ID NO: 629163 - DNA, 25 bp, Mus musculus
gaacagcttgtttaggccaaagaac

SEQ ID NO: 629164 - DNA, 25 bp, Mus musculus
gaacagctttggagtatcgtacaga

SEQ ID NO: 629165 - DNA, 25 bp, Mus musculus
gaacagctttggtgtatcgtacaga

SEQ ID NO: 629166 - DNA, 25 bp, Mus musculus
gaacaggaaacacggcatcgccgga

SEQ ID NO: 629167 - DNA, 25 bp, Mus musculus
gaacaggaaacagggcatcgccgga

SEQ ID NO: 629168 - DNA, 25 bp, Mus musculus
gaacaggaagagcacgagaaaaata

SEQ ID NO: 629169 - DNA, 25 bp, Mus musculus
gaacaggaagaggacgagaaaaata

SEQ ID NO: 629170 - DNA, 25 bp, Mus musculus
gaacaggaagtaattcagtcacaac

SEQ ID NO: 629171 - DNA, 25 bp, Mus musculus
gaacaggaagtatttcagtcacaac

SEQ ID NO: 629172 - DNA, 25 bp, Mus musculus
gaacaggacagacatcagcggtacc

SEQ ID NO: 629173 - DNA, 25 bp, Mus musculus
gaacaggacagagatcagcggtacc

SEQ ID NO: 629174 - DNA, 25 bp, Mus musculus
gaacaggactggaggttgagccaat

SEQ ID NO: 629175 - DNA, 25 bp, Mus musculus
gaacaggactggtggttgagccaat

SEQ ID NO: 629176 - DNA, 25 bp, Mus musculus
gaacaggagagccttattcatcgct

SEQ ID NO: 629177 - DNA, 25 bp, Mus musculus
gaacaggagagcgttattcatcgct

SEQ ID NO: 629178 - DNA, 25 bp, Mus musculus
gaacaggagtacatatcggccacca

SEQ ID NO: 629179 - DNA, 25 bp, Mus musculus
gaacaggagtacttatcggccacca

SEQ ID NO: 629180 - DNA, 25 bp, Mus musculus
gaacaggagtcacacgagcggaaat

SEQ ID NO: 629181 - DNA, 25 bp, Mus musculus
gaacaggagtcagacgagcggaaat

SEQ ID NO: 629182 - DNA, 25 bp, Mus musculus
gaacaggagtgcaatgctgtgaaac

SEQ ID NO: 629183 - DNA, 25 bp, Mus musculus
gaacaggagtgctatgctgtgaaac

SEQ ID NO: 629184 - DNA, 25 bp, Mus musculus
gaacaggataggatcatgggctgct

SEQ ID NO: 629185 - DNA, 25 bp, Mus musculus
gaacaggataggttcatgggctgct

SEQ ID NO: 629186 - DNA, 25 bp, Mus musculus
gaacaggatcctatggtgatcgccc

SEQ ID NO: 629187 - DNA, 25 bp, Mus musculus
gaacaggatcctttggtgatcgccc

SEQ ID NO: 629188 - DNA, 25 bp, Mus musculus
gaacaggatgctcatctaatcgtgg

SEQ ID NO: 629189 - DNA, 25 bp, Mus musculus
gaacaggatgctgatctaatcgtgg

SEQ ID NO: 629190 - DNA, 25 bp, Mus musculus
gaacaggatggtctacctgtgtcct

SEQ ID NO: 629191 - DNA, 25 bp, Mus musculus
gaacaggatggtgtacctgtgtcct

SEQ ID NO: 629192 - DNA, 25 bp, Mus musculus
gaacaggcaaaaccggtgcctacct

SEQ ID NO: 629193 - DNA, 25 bp, Mus musculus
gaacaggcaaaagcggtgcctacct

SEQ ID NO: 629194 - DNA, 25 bp, Mus musculus
gaacaggctatgcttgatgctcttg

SEQ ID NO: 629195 - DNA, 25 bp, Mus musculus
gaacaggctatggttgatgctcttg

SEQ ID NO: 629196 - DNA, 25 bp, Mus musculus
gaacaggctccaacaggtgcaaagg

SEQ ID NO: 629197 - DNA, 25 bp, Mus musculus
gaacaggctccatcaggtgcaaagg

SEQ ID NO: 629198 - DNA, 25 bp, Mus musculus
gaacaggctttgaaaacatacccag

SEQ ID NO: 629199 - DNA, 25 bp, Mus musculus
gaacaggctttgctcagacctcaga

SEQ ID NO: 629200 - DNA, 25 bp, Mus musculus
gaacaggctttggtcagacctcaga

SEQ ID NO: 629201 - DNA, 25 bp, Mus musculus
gaacaggctttgtaaacatacccag

SEQ ID NO: 629202 - DNA, 25 bp, Mus musculus
gaacagggaggaaccgtgtcctgtc

SEQ ID NO: 629203 - DNA, 25 bp, Mus musculus
gaacagggaggatccgtgtcctgtc

SEQ ID NO: 629204 - DNA, 25 bp, Mus musculus
gaacagggatgaactacatgaaagt

SEQ ID NO: 629205 - DNA, 25 bp, Mus musculus
gaacagggatgatctacatgaaagt

SEQ ID NO: 629206 - DNA, 25 bp, Mus musculus
gaacagggcagtacaggcattgaga

SEQ ID NO: 629207 - DNA, 25 bp, Mus musculus
gaacagggcagttcaggcattgaga

SEQ ID NO: 629208 - DNA, 25 bp, Mus musculus
gaacagggcataaaaacaaagtcac

SEQ ID NO: 629209 - DNA, 25 bp, Mus musculus
gaacagggcatataaacaaagtcac

SEQ ID NO: 629210 - DNA, 25 bp, Mus musculus
gaacagggggcaccaagctctttgc

SEQ ID NO: 629211 - DNA, 25 bp, Mus musculus
gaacagggggcagcaagctctttgc

SEQ ID NO: 629212 - DNA, 25 bp, Mus musculus
gaacagggtgacattgagccaagaa

SEQ ID NO: 629213 - DNA, 25 bp, Mus musculus
gaacagggtgactttgagccaagaa

SEQ ID NO: 629214 - DNA, 25 bp, Mus musculus
gaacagggtgctattccacgactag

SEQ ID NO: 629215 - DNA, 25 bp, Mus musculus
gaacagggtgcttttccacgactag

SEQ ID NO: 629216 - DNA, 25 bp, Mus musculus
gaacaggtatatatacgtggcagca

SEQ ID NO: 629217 - DNA, 25 bp, Mus musculus
gaacaggtatatttacgtggcagca

SEQ ID NO: 629218 - DNA, 25 bp, Mus musculus
gaacaggtgtcccttcacatgagct

SEQ ID NO: 629219 - DNA, 25 bp, Mus musculus
gaacaggtgtccgttcacatgagct

SEQ ID NO: 629220 - DNA, 25 bp, Mus musculus
gaacaggttgttctcccaacacatc

SEQ ID NO: 629221 - DNA, 25 bp, Mus musculus
gaacaggttgttgtcccaacacatc

SEQ ID NO: 629222 - DNA, 25 bp, Mus musculus
gaacagtaaagcatccgacattgct

SEQ ID NO: 629223 - DNA, 25 bp, Mus musculus
gaacagtaaagcttccgacattgct

SEQ ID NO: 629224 - DNA, 25 bp, Mus musculus
gaacagtaacctagccagctggaga

SEQ ID NO: 629225 - DNA, 25 bp, Mus musculus
gaacagtaaccttgccagctggaga

SEQ ID NO: 629226 - DNA, 25 bp, Mus musculus
gaacagtacaccagtagagctatct

SEQ ID NO: 629227 - DNA, 25 bp, Mus musculus
gaacagtacacctgtagagctatct

SEQ ID NO: 629228 - DNA, 25 bp, Mus musculus
gaacagtactgcatagtggccagcc

SEQ ID NO: 629229 - DNA, 25 bp, Mus musculus
gaacagtactgcttagtggccagcc

SEQ ID NO: 629230 - DNA, 25 bp, Mus musculus
gaacagtagagtaccctcctctgga

SEQ ID NO: 629231 - DNA, 25 bp, Mus musculus
gaacagtagagttccctcctctgga

SEQ ID NO: 629232 - DNA, 25 bp, Mus musculus
gaacagtagtctcgaagactcacag

SEQ ID NO: 629233 - DNA, 25 bp, Mus musculus
gaacagtagtctggaagactcacag

SEQ ID NO: 629234 - DNA, 25 bp, Mus musculus
gaacagtatcgacgaacggcgcatc

SEQ ID NO: 629235 - DNA, 25 bp, Mus musculus
gaacagtatcgaggaacggcgcatc

SEQ ID NO: 629236 - DNA, 25 bp, Mus musculus
gaacagtatcgtcgctcagtcagca

SEQ ID NO: 629237 - DNA, 25 bp, Mus musculus
gaacagtatcgtggctcagtcagca

SEQ ID NO: 629238 - DNA, 25 bp, Mus musculus
gaacagtattctcctagttaccccg

SEQ ID NO: 629239 - DNA, 25 bp, Mus musculus
gaacagtattctgctagttaccccg

SEQ ID NO: 629240 - DNA, 25 bp, Mus musculus
gaacagtcacgcctccaccaggaga

SEQ ID NO: 629241 - DNA, 25 bp, Mus musculus
gaacagtcacgcgtccaccaggaga

SEQ ID NO: 629242 - DNA, 25 bp, Mus musculus
gaacagtcagcaaaaccattggtcc

SEQ ID NO: 629243 - DNA, 25 bp, Mus musculus
gaacagtcagcataaccattggtcc

SEQ ID NO: 629244 - DNA, 25 bp, Mus musculus
gaacagtcatgcaaccagtttgctt

SEQ ID NO: 629245 - DNA, 25 bp, Mus musculus
gaacagtcatgctaccagtttgctt

SEQ ID NO: 629246 - DNA, 25 bp, Mus musculus
gaacagtcattacctcggtacagtg

SEQ ID NO: 629247 - DNA, 25 bp, Mus musculus
gaacagtcattagctcggtacagtg

SEQ ID NO: 629248 - DNA, 25 bp, Mus musculus
gaacagtcgtccagatgccttcgct

SEQ ID NO: 629249 - DNA, 25 bp, Mus musculus
gaacagtcgtcctgatgccttcgct

SEQ ID NO: 629250 - DNA, 25 bp, Mus musculus
gaacagtcgtctcggcccggaccaa

SEQ ID NO: 629251 - DNA, 25 bp, Mus musculus
gaacagtcgtctgggcccggaccaa

SEQ ID NO: 629252 - DNA, 25 bp, Mus musculus
gaacagtctattaactccaaaggat

SEQ ID NO: 629253 - DNA, 25 bp, Mus musculus
gaacagtctatttactccaaaggat

SEQ ID NO: 629254 - DNA, 25 bp, Mus musculus
gaacagtctgcccttgcaagaggag

SEQ ID NO: 629255 - DNA, 25 bp, Mus musculus
gaacagtctgccgttgcaagaggag

SEQ ID NO: 629256 - DNA, 25 bp, Mus musculus
gaacagtctttcatgacgatggcag

SEQ ID NO: 629257 - DNA, 25 bp, Mus musculus
gaacagtctttcttgacgatggcag

SEQ ID NO: 629258 - DNA, 25 bp, Mus musculus
gaacagtgatgccagcagctggcta

SEQ ID NO: 629259 - DNA, 25 bp, Mus musculus
gaacagtgatgcgagcagctggcta

SEQ ID NO: 629260 - DNA, 25 bp, Mus musculus
gaacagtgcaaccatttgcaagcca

SEQ ID NO: 629261 - DNA, 25 bp, Mus musculus
gaacagtgcaacgatttgcaagcca

SEQ ID NO: 629262 - DNA, 25 bp, Mus musculus
gaacagtgccctctctatcgagacc

SEQ ID NO: 629263 - DNA, 25 bp, Mus musculus
gaacagtgccctgtctatcgagacc

SEQ ID NO: 629264 - DNA, 25 bp, Mus musculus
gaacagtgccggatcggtgcgtaac

SEQ ID NO: 629265 - DNA, 25 bp, Mus musculus
gaacagtgccggttcggtgcgtaac

SEQ ID NO: 629266 - DNA, 25 bp, Mus musculus
gaacagtgctctattcaagttggga

SEQ ID NO: 629267 - DNA, 25 bp, Mus musculus
gaacagtgctcttttcaagttggga

SEQ ID NO: 629268 - DNA, 25 bp, Mus musculus
gaacagtgcttgcactcactgtgca

SEQ ID NO: 629269 - DNA, 25 bp, Mus musculus
gaacagtgcttggactcactgtgca

SEQ ID NO: 629270 - DNA, 25 bp, Mus musculus
gaacagtggatcagaagccaacgac

SEQ ID NO: 629271 - DNA, 25 bp, Mus musculus
gaacagtggatctgaagccaacgac

SEQ ID NO: 629272 - DNA, 25 bp, Mus musculus
gaacagtgggaaatttcttcgacgg

SEQ ID NO: 629273 - DNA, 25 bp, Mus musculus
gaacagtgggaattttcttcgacgg

SEQ ID NO: 629274 - DNA, 25 bp, Mus musculus
gaacagtggtaccagttttgtgtct

SEQ ID NO: 629275 - DNA, 25 bp, Mus musculus
gaacagtggtacgagttttgtgtct

SEQ ID NO: 629276 - DNA, 25 bp, Mus musculus
gaacagtgtcttcatggaggagaat

SEQ ID NO: 629277 - DNA, 25 bp, Mus musculus
gaacagtgtcttgatggaggagaat

SEQ ID NO: 629278 - DNA, 25 bp, Mus musculus
gaacagttaagaagctggatctcat

SEQ ID NO: 629279 - DNA, 25 bp, Mus musculus
gaacagttaagatgctggatctcat

SEQ ID NO: 629280 - DNA, 25 bp, Mus musculus
gaacagttacgactgcacgtcaggc

SEQ ID NO: 629281 - DNA, 25 bp, Mus musculus
gaacagttacgagtgcacgtcaggc

SEQ ID NO: 629282 - DNA, 25 bp, Mus musculus
gaacagttagtgagctgcttcccca

SEQ ID NO: 629283 - DNA, 25 bp, Mus musculus
gaacagttagtgtgctgcttcccca

SEQ ID NO: 629284 - DNA, 25 bp, Mus musculus
gaacagttcccacgaaccgagatgg

SEQ ID NO: 629285 - DNA, 25 bp, Mus musculus
gaacagttcccaggaaccgagatgg

SEQ ID NO: 629286 - DNA, 25 bp, Mus musculus
gaacagttggtaaacctctggatct

SEQ ID NO: 629287 - DNA, 25 bp, Mus musculus
gaacagttggtatacctctggatct

SEQ ID NO: 629288 - DNA, 25 bp, Mus musculus
gaacagttgtggcatccttggcaca

SEQ ID NO: 629289 - DNA, 25 bp, Mus musculus
gaacagttgtgggatccttggcaca

SEQ ID NO: 629290 - DNA, 25 bp, Mus musculus
gaacagtttaataatgccacgccca

SEQ ID NO: 629291 - DNA, 25 bp, Mus musculus
gaacagtttaattatgccacgccca

SEQ ID NO: 629292 - DNA, 25 bp, Mus musculus
gaacagtttcagcatctgctacgca

SEQ ID NO: 629293 - DNA, 25 bp, Mus musculus
gaacagtttcaggatctgctacgca

SEQ ID NO: 629294 - DNA, 25 bp, Mus musculus
gaacagtttctcaaggtgaatggat

SEQ ID NO: 629295 - DNA, 25 bp, Mus musculus
gaacagtttctctaggtgaatggat

SEQ ID NO: 629296 - DNA, 25 bp, Mus musculus
gaacagtttgagaggaacccggcct

SEQ ID NO: 629297 - DNA, 25 bp, Mus musculus
gaacagtttgagtggaacccggcct

SEQ ID NO: 629298 - DNA, 25 bp, Mus musculus
gaacagtttgataaaactccgtggc

SEQ ID NO: 629299 - DNA, 25 bp, Mus musculus
gaacagtttgattaaactccgtggc

SEQ ID NO: 629300 - DNA, 25 bp, Mus musculus
gaacagttttgcacacttgccagac

SEQ ID NO: 629301 - DNA, 25 bp, Mus musculus
gaacagttttgctcacttgccagac

SEQ ID NO: 629302 - DNA, 25 bp, Mus musculus
gaacataagatcattcctgccgctc

SEQ ID NO: 629303 - DNA, 25 bp, Mus musculus
gaacataagatctttcctgccgctc

SEQ ID NO: 629304 - DNA, 25 bp, Mus musculus
gaacataagctgcatactccgggca

SEQ ID NO: 629305 - DNA, 25 bp, Mus musculus
gaacataagctggatactccgggca

SEQ ID NO: 629306 - DNA, 25 bp, Mus musculus
gaacataagggcagactgctccaat

SEQ ID NO: 629307 - DNA, 25 bp, Mus musculus
gaacataagggctgactgctccaat

SEQ ID NO: 629308 - DNA, 25 bp, Mus musculus
gaacataccatgacactacaacctg

SEQ ID NO: 629309 - DNA, 25 bp, Mus musculus
gaacataccatgtcactacaacctg

SEQ ID NO: 629310 - DNA, 25 bp, Mus musculus
gaacataccgttctcactctgcaat

SEQ ID NO: 629311 - DNA, 25 bp, Mus musculus
gaacataccgttgtcactctgcaat

SEQ ID NO: 629312 - DNA, 25 bp, Mus musculus
gaacatactggaacacttggcgcga

SEQ ID NO: 629313 - DNA, 25 bp, Mus musculus
gaacatactggatcacttggcgcga

SEQ ID NO: 629314 - DNA, 25 bp, Mus musculus
gaacatagaacaaatcacaaagtgg

SEQ ID NO: 629315 - DNA, 25 bp, Mus musculus
gaacatagaacatatcacaaagtgg

SEQ ID NO: 629316 - DNA, 25 bp, Mus musculus
gaacatagaactccaacgtaaccgt

SEQ ID NO: 629317 - DNA, 25 bp, Mus musculus
gaacatagaactgcaacgtaaccgt

SEQ ID NO: 629318 - DNA, 25 bp, Mus musculus
gaacatagagacaattcagagccag

SEQ ID NO: 629319 - DNA, 25 bp, Mus musculus
gaacatagagactattcagagccag

SEQ ID NO: 629320 - DNA, 25 bp, Mus musculus
gaacatagcatgagggcagatgtgc

SEQ ID NO: 629321 - DNA, 25 bp, Mus musculus
gaacatagcatgtgggcagatgtgc

SEQ ID NO: 629322 - DNA, 25 bp, Mus musculus
gaacatagggtgcagagaccagcct

SEQ ID NO: 629323 - DNA, 25 bp, Mus musculus
gaacatagggtggagagaccagcct

SEQ ID NO: 629324 - DNA, 25 bp, Mus musculus
gaacatagtgtcctcgtttctttct

SEQ ID NO: 629325 - DNA, 25 bp, Mus musculus
gaacatagtgtcgtcgtttctttct

SEQ ID NO: 629326 - DNA, 25 bp, Mus musculus
gaacatatgctgattttgggaacca

SEQ ID NO: 629327 - DNA, 25 bp, Mus musculus
gaacatatgctgtttttgggaacca

SEQ ID NO: 629328 - DNA, 25 bp, Mus musculus
gaacatattgttcacctaatgacta

SEQ ID NO: 629329 - DNA, 25 bp, Mus musculus
gaacatattgttcggatgctgctgg

SEQ ID NO: 629330 - DNA, 25 bp, Mus musculus
gaacatattgttgacctaatgacta

SEQ ID NO: 629331 - DNA, 25 bp, Mus musculus
gaacatattgttgggatgctgctgg

SEQ ID NO: 629332 - DNA, 25 bp, Mus musculus
gaacatcaaatcatgccagcagaag

SEQ ID NO: 629333 - DNA, 25 bp, Mus musculus
gaacatcaaatcttgccagcagaag

SEQ ID NO: 629334 - DNA, 25 bp, Mus musculus
gaacatcaaggacttcactgcccaa

SEQ ID NO: 629335 - DNA, 25 bp, Mus musculus
gaacatcaaggagttcactgcccaa

SEQ ID NO: 629336 - DNA, 25 bp, Mus musculus
gaacatcaataaatgctgagtccag

SEQ ID NO: 629337 - DNA, 25 bp, Mus musculus
gaacatcaataattgctgagtccag

SEQ ID NO: 629338 - DNA, 25 bp, Mus musculus
gaacatcaatctcacctgccaggga

SEQ ID NO: 629339 - DNA, 25 bp, Mus musculus
gaacatcaatctgacctgccaggga

SEQ ID NO: 629340 - DNA, 25 bp, Mus musculus
gaacatcacattcggtgagcctcct

SEQ ID NO: 629341 - DNA, 25 bp, Mus musculus
gaacatcacattgggtgagcctcct

SEQ ID NO: 629342 - DNA, 25 bp, Mus musculus
gaacatcacggacaggactcagcag

SEQ ID NO: 629343 - DNA, 25 bp, Mus musculus
gaacatcacggacctcagggtgcag

SEQ ID NO: 629344 - DNA, 25 bp, Mus musculus
gaacatcacggagaggactcagcag

SEQ ID NO: 629345 - DNA, 25 bp, Mus musculus
gaacatcacggagctcagggtgcag

SEQ ID NO: 629346 - DNA, 25 bp, Mus musculus
gaacatcagaaccagggtgggcctc

SEQ ID NO: 629347 - DNA, 25 bp, Mus musculus
gaacatcagaacgagggtgggcctc

SEQ ID NO: 629348 - DNA, 25 bp, Mus musculus
gaacatcagactcagggtttctcca

SEQ ID NO: 629349 - DNA, 25 bp, Mus musculus
gaacatcagactgagggtttctcca

SEQ ID NO: 629350 - DNA, 25 bp, Mus musculus
gaacatcagagtacaagcatctcaa

SEQ ID NO: 629351 - DNA, 25 bp, Mus musculus
gaacatcagagttcaagcatctcaa

SEQ ID NO: 629352 - DNA, 25 bp, Mus musculus
gaacatcagattcaagtcagacctt

SEQ ID NO: 629353 - DNA, 25 bp, Mus musculus
gaacatcagattgaagtcagacctt

SEQ ID NO: 629354 - DNA, 25 bp, Mus musculus
gaacatcagcacagctagagccaag

SEQ ID NO: 629355 - DNA, 25 bp, Mus musculus
gaacatcagcactgctagagccaag

SEQ ID NO: 629356 - DNA, 25 bp, Mus musculus
gaacatcagtctcccggtggcatta

SEQ ID NO: 629357 - DNA, 25 bp, Mus musculus
gaacatcagtctgccggtggcatta

SEQ ID NO: 629358 - DNA, 25 bp, Mus musculus
gaacatcagtgtctcgatggcaacc

SEQ ID NO: 629359 - DNA, 25 bp, Mus musculus
gaacatcagtgtgtcgatggcaacc

SEQ ID NO: 629360 - DNA, 25 bp, Mus musculus
gaacatcatcaaagctcgaaacctc

SEQ ID NO: 629361 - DNA, 25 bp, Mus musculus
gaacatcatcaatgctcgaaacctc

SEQ ID NO: 629362 - DNA, 25 bp, Mus musculus
gaacatcatcccattgagaacccca

SEQ ID NO: 629363 - DNA, 25 bp, Mus musculus
gaacatcatccctttgagaacccca

SEQ ID NO: 629364 - DNA, 25 bp, Mus musculus
gaacatcattaacaagaagggatgg

SEQ ID NO: 629365 - DNA, 25 bp, Mus musculus
gaacatcattaagaagaagggatgg

SEQ ID NO: 629366 - DNA, 25 bp, Mus musculus
gaacatccatcaatgcaacacaaag

SEQ ID NO: 629367 - DNA, 25 bp, Mus musculus
gaacatccatcattgcaacacaaag

SEQ ID NO: 629368 - DNA, 25 bp, Mus musculus
gaacatccatttacccgttcttgga

SEQ ID NO: 629369 - DNA, 25 bp, Mus musculus
gaacatccattttcccgttcttgga

SEQ ID NO: 629370 - DNA, 25 bp, Mus musculus
gaacatcccacacaggcagattgaa

SEQ ID NO: 629371 - DNA, 25 bp, Mus musculus
gaacatcccacagaggcagattgaa

SEQ ID NO: 629372 - DNA, 25 bp, Mus musculus
gaacatccgaatcggcatcctcaaa

SEQ ID NO: 629373 - DNA, 25 bp, Mus musculus
gaacatccgaatgggcatcctcaaa

SEQ ID NO: 629374 - DNA, 25 bp, Mus musculus
gaacatcctctgaggagaagcgcag

SEQ ID NO: 629375 - DNA, 25 bp, Mus musculus
gaacatcctctgtggagaagcgcag

SEQ ID NO: 629376 - DNA, 25 bp, Mus musculus
gaacatcctgatctggacctttctc

SEQ ID NO: 629377 - DNA, 25 bp, Mus musculus
gaacatcctgatgtggacctttctc

SEQ ID NO: 629378 - DNA, 25 bp, Mus musculus
gaacatccttcgcagtgtggctgtc

SEQ ID NO: 629379 - DNA, 25 bp, Mus musculus
gaacatccttcggagtgtggctgtc

SEQ ID NO: 629380 - DNA, 25 bp, Mus musculus
gaacatcgaaatcgtgtctttcatg

SEQ ID NO: 629381 - DNA, 25 bp, Mus musculus
gaacatcgaaatggtgtctttcatg

SEQ ID NO: 629382 - DNA, 25 bp, Mus musculus
gaacatcgagtgacgaatatgtggg

SEQ ID NO: 629383 - DNA, 25 bp, Mus musculus
gaacatcgagtgtcgaatatgtggg

SEQ ID NO: 629384 - DNA, 25 bp, Mus musculus
gaacatcggcaaatttcaagaggag

SEQ ID NO: 629385 - DNA, 25 bp, Mus musculus
gaacatcggcaattttcaagaggag

SEQ ID NO: 629386 - DNA, 25 bp, Mus musculus
gaacatcgtaggctgcaggatccag

SEQ ID NO: 629387 - DNA, 25 bp, Mus musculus
gaacatcgtagggtgcaggatccag

SEQ ID NO: 629388 - DNA, 25 bp, Mus musculus
gaacatctaataaaggccccttgct

SEQ ID NO: 629389 - DNA, 25 bp, Mus musculus
gaacatctaatataggccccttgct

SEQ ID NO: 629390 - DNA, 25 bp, Mus musculus
gaacatctaggcagttcaactgagg

SEQ ID NO: 629391 - DNA, 25 bp, Mus musculus
gaacatctaggctgttcaactgagg

SEQ ID NO: 629392 - DNA, 25 bp, Mus musculus
gaacatctatcacaacctgaaccgg

SEQ ID NO: 629393 - DNA, 25 bp, Mus musculus
gaacatctatcagaacctgaaccgg

SEQ ID NO: 629394 - DNA, 25 bp, Mus musculus
gaacatctcagcagtgaactatgac

SEQ ID NO: 629395 - DNA, 25 bp, Mus musculus
gaacatctcagctgtgaactatgac

SEQ ID NO: 629396 - DNA, 25 bp, Mus musculus
gaacatctgcctagcatctccaagt

SEQ ID NO: 629397 - DNA, 25 bp, Mus musculus
gaacatctgccttgcatctccaagt

SEQ ID NO: 629398 - DNA, 25 bp, Mus musculus
gaacatctggatcgtgaagcccgga

SEQ ID NO: 629399 - DNA, 25 bp, Mus musculus
gaacatctggatggtgaagcccgga

SEQ ID NO: 629400 - DNA, 25 bp, Mus musculus
gaacatcttattaaacagactgact

SEQ ID NO: 629401 - DNA, 25 bp, Mus musculus
gaacatcttatttaacagactgact

SEQ ID NO: 629402 - DNA, 25 bp, Mus musculus
gaacatcttcttccagagggagctg

SEQ ID NO: 629403 - DNA, 25 bp, Mus musculus
gaacatcttcttgcagagggagctg

SEQ ID NO: 629404 - DNA, 25 bp, Mus musculus
gaacatcttgttcctataatagaaa

SEQ ID NO: 629405 - DNA, 25 bp, Mus musculus
gaacatcttgttgctataatagaaa

SEQ ID NO: 629406 - DNA, 25 bp, Mus musculus
gaacatgaaacacgcgctcagccct

SEQ ID NO: 629407 - DNA, 25 bp, Mus musculus
gaacatgaaacaggcgctcagccct

SEQ ID NO: 629408 - DNA, 25 bp, Mus musculus
gaacatgaaagacgcatcccttcgg

SEQ ID NO: 629409 - DNA, 25 bp, Mus musculus
gaacatgaaagaggcatcccttcgg

SEQ ID NO: 629410 - DNA, 25 bp, Mus musculus
gaacatgaaccaagagcgcatccct

SEQ ID NO: 629411 - DNA, 25 bp, Mus musculus
gaacatgaaccatgagcgcatccct

SEQ ID NO: 629412 - DNA, 25 bp, Mus musculus
gaacatgaagccacttgaacatctg

SEQ ID NO: 629413 - DNA, 25 bp, Mus musculus
gaacatgaagcctcttgaacatctg

SEQ ID NO: 629414 - DNA, 25 bp, Mus musculus
gaacatgaagtacccctctcttgga

SEQ ID NO: 629415 - DNA, 25 bp, Mus musculus
gaacatgaagtagccctctcttgga

SEQ ID NO: 629416 - DNA, 25 bp, Mus musculus
gaacatgacattcaaacaccgcatg

SEQ ID NO: 629417 - DNA, 25 bp, Mus musculus
gaacatgacattctctagtagctga

SEQ ID NO: 629418 - DNA, 25 bp, Mus musculus
gaacatgacattgaaacaccgcatg

SEQ ID NO: 629419 - DNA, 25 bp, Mus musculus
gaacatgacattgtctagtagctga

SEQ ID NO: 629420 - DNA, 25 bp, Mus musculus
gaacatgacctgcatcccaacgtga

SEQ ID NO: 629421 - DNA, 25 bp, Mus musculus
gaacatgacctggatcccaacgtga

SEQ ID NO: 629422 - DNA, 25 bp, Mus musculus
gaacatgactctcagaagtggtaaa

SEQ ID NO: 629423 - DNA, 25 bp, Mus musculus
gaacatgactctgagaagtggtaaa

SEQ ID NO: 629424 - DNA, 25 bp, Mus musculus
gaacatgagcggcttcacctgccca

SEQ ID NO: 629425 - DNA, 25 bp, Mus musculus
gaacatgagcgggttcacctgccca

SEQ ID NO: 629426 - DNA, 25 bp, Mus musculus
gaacatgcaagccatccttgatgca

SEQ ID NO: 629427 - DNA, 25 bp, Mus musculus
gaacatgcaagcgatccttgatgca

SEQ ID NO: 629428 - DNA, 25 bp, Mus musculus
gaacatgcagccaacttggtggaca

SEQ ID NO: 629429 - DNA, 25 bp, Mus musculus
gaacatgcagcctacttggtggaca

SEQ ID NO: 629430 - DNA, 25 bp, Mus musculus
gaacatgcatgacgacgcactgcct

SEQ ID NO: 629431 - DNA, 25 bp, Mus musculus
gaacatgcatgaggacgcactgcct

SEQ ID NO: 629432 - DNA, 25 bp, Mus musculus
gaacatgccattcctaaaggtggac

SEQ ID NO: 629433 - DNA, 25 bp, Mus musculus
gaacatgccattgctaaaggtggac

SEQ ID NO: 629434 - DNA, 25 bp, Mus musculus
gaacatgcccatcaagtggtagtag

SEQ ID NO: 629435 - DNA, 25 bp, Mus musculus
gaacatgcccatgaagtggtagtag

SEQ ID NO: 629436 - DNA, 25 bp, Mus musculus
gaacatgccgcaaaaatgaaatcag

SEQ ID NO: 629437 - DNA, 25 bp, Mus musculus
gaacatgccgcataaatgaaatcag

SEQ ID NO: 629438 - DNA, 25 bp, Mus musculus
gaacatgcgcaaagacatctccagt

SEQ ID NO: 629439 - DNA, 25 bp, Mus musculus
gaacatgcgcaatgacatctccagt

SEQ ID NO: 629440 - DNA, 25 bp, Mus musculus
gaacatgcggcaagtgattcaacag

SEQ ID NO: 629441 - DNA, 25 bp, Mus musculus
gaacatgcggcatgtgattcaacag

SEQ ID NO: 629442 - DNA, 25 bp, Mus musculus
gaacatgctaaaaggccaacatgag

SEQ ID NO: 629443 - DNA, 25 bp, Mus musculus
gaacatgctaaatggccaacatgag

SEQ ID NO: 629444 - DNA, 25 bp, Mus musculus
gaacatgctcaacgtgatagctcgg

SEQ ID NO: 629445 - DNA, 25 bp, Mus musculus
gaacatgctcaaggtgatagctcgg

SEQ ID NO: 629446 - DNA, 25 bp, Mus musculus
gaacatgctggaagttcaaatgcat

SEQ ID NO: 629447 - DNA, 25 bp, Mus musculus
gaacatgctggatgttcaaatgcat

SEQ ID NO: 629448 - DNA, 25 bp, Mus musculus
gaacatggacatcaagtcaccctgg

SEQ ID NO: 629449 - DNA, 25 bp, Mus musculus
gaacatggacatgaagtcaccctgg

SEQ ID NO: 629450 - DNA, 25 bp, Mus musculus
gaacatggagggagtcattacacca

SEQ ID NO: 629451 - DNA, 25 bp, Mus musculus
gaacatggagggtgtcattacacca

SEQ ID NO: 629452 - DNA, 25 bp, Mus musculus
gaacatggagtcctttcctggtata

SEQ ID NO: 629453 - DNA, 25 bp, Mus musculus
gaacatggagtcgtttcctggtata

SEQ ID NO: 629454 - DNA, 25 bp, Mus musculus
gaacatggcaacatccttattacag

SEQ ID NO: 629455 - DNA, 25 bp, Mus musculus
gaacatggcaacttccttattacag

SEQ ID NO: 629456 - DNA, 25 bp, Mus musculus
gaacatgggtctctccacaacctta

SEQ ID NO: 629457 - DNA, 25 bp, Mus musculus
gaacatgggtctgtccacaacctta

SEQ ID NO: 629458 - DNA, 25 bp, Mus musculus
gaacatggtggactttgctgtagcc

SEQ ID NO: 629459 - DNA, 25 bp, Mus musculus
gaacatggtggagtttgctgtagcc

SEQ ID NO: 629460 - DNA, 25 bp, Mus musculus
gaacatgtaccaacaccttgtagag

SEQ ID NO: 629461 - DNA, 25 bp, Mus musculus
gaacatgtaccatcaccttgtagag

SEQ ID NO: 629462 - DNA, 25 bp, Mus musculus
gaacatgtgatccacctcatggaca

SEQ ID NO: 629463 - DNA, 25 bp, Mus musculus
gaacatgtgatcgacctcatggaca

SEQ ID NO: 629464 - DNA, 25 bp, Mus musculus
gaacattaactcaaccctgaagtga

SEQ ID NO: 629465 - DNA, 25 bp, Mus musculus
gaacattaactctaccctgaagtga

SEQ ID NO: 629466 - DNA, 25 bp, Mus musculus
gaacattaagacagagcctccggga

SEQ ID NO: 629467 - DNA, 25 bp, Mus musculus
gaacattaagactgagcctccggga

SEQ ID NO: 629468 - DNA, 25 bp, Mus musculus
gaacattacgagaaaccagaccgaa

SEQ ID NO: 629469 - DNA, 25 bp, Mus musculus
gaacattacgagtaaccagaccgaa

SEQ ID NO: 629470 - DNA, 25 bp, Mus musculus
gaacattagaagagtagaaaatgcg

SEQ ID NO: 629471 - DNA, 25 bp, Mus musculus
gaacattagaagtgtagaaaatgcg

SEQ ID NO: 629472 - DNA, 25 bp, Mus musculus
gaacattatgtgcaaggatcaacag

SEQ ID NO: 629473 - DNA, 25 bp, Mus musculus
gaacattatgtggaaggatcaacag

SEQ ID NO: 629474 - DNA, 25 bp, Mus musculus
gaacattcaagaacaggccaaacac

SEQ ID NO: 629475 - DNA, 25 bp, Mus musculus
gaacattcaagaagcgatgacgtca

SEQ ID NO: 629476 - DNA, 25 bp, Mus musculus
gaacattcaagatcaggccaaacac

SEQ ID NO: 629477 - DNA, 25 bp, Mus musculus
gaacattcaagatgcgatgacgtca

SEQ ID NO: 629478 - DNA, 25 bp, Mus musculus
gaacattcactactttaacatcgac

SEQ ID NO: 629479 - DNA, 25 bp, Mus musculus
gaacattcactagtttaacatcgac

SEQ ID NO: 629480 - DNA, 25 bp, Mus musculus
gaacattcagaactatccttcccga

SEQ ID NO: 629481 - DNA, 25 bp, Mus musculus
gaacattcagaagtatccttcccga

SEQ ID NO: 629482 - DNA, 25 bp, Mus musculus
gaacattcagacaagtggctttaaa

SEQ ID NO: 629483 - DNA, 25 bp, Mus musculus
gaacattcagactagtggctttaaa

SEQ ID NO: 629484 - DNA, 25 bp, Mus musculus
gaacattcaggaaggcctaaagatc

SEQ ID NO: 629485 - DNA, 25 bp, Mus musculus
gaacattcaggatggcctaaagatc

SEQ ID NO: 629486 - DNA, 25 bp, Mus musculus
gaacattcgagtcaactgcttagca

SEQ ID NO: 629487 - DNA, 25 bp, Mus musculus
gaacattcgagtgaactgcttagca

SEQ ID NO: 629488 - DNA, 25 bp, Mus musculus
gaacattcgcatagtggtgcttgcc

SEQ ID NO: 629489 - DNA, 25 bp, Mus musculus
gaacattcgcattgtggtgcttgcc

SEQ ID NO: 629490 - DNA, 25 bp, Mus musculus
gaacattcgccacgcctttatcaga

SEQ ID NO: 629491 - DNA, 25 bp, Mus musculus
gaacattcgccaggcctttatcaga

SEQ ID NO: 629492 - DNA, 25 bp, Mus musculus
gaacattcgttgcactaactgctgg

SEQ ID NO: 629493 - DNA, 25 bp, Mus musculus
gaacattcgttggactaactgctgg

SEQ ID NO: 629494 - DNA, 25 bp, Mus musculus
gaacattctacactgggaggtacct

SEQ ID NO: 629495 - DNA, 25 bp, Mus musculus
gaacattctacagtgggaggtacct

SEQ ID NO: 629496 - DNA, 25 bp, Mus musculus
gaacattctgctcgcttcaagctct

SEQ ID NO: 629497 - DNA, 25 bp, Mus musculus
gaacattctgctggcttcaagctct

SEQ ID NO: 629498 - DNA, 25 bp, Mus musculus
gaacattctgtcatacttggacgcc

SEQ ID NO: 629499 - DNA, 25 bp, Mus musculus
gaacattctgtcttacttggacgcc

SEQ ID NO: 629500 - DNA, 25 bp, Mus musculus
gaacattgacttattcccacaaaac

SEQ ID NO: 629501 - DNA, 25 bp, Mus musculus
gaacattgactttttcccacaaaac

SEQ ID NO: 629502 - DNA, 25 bp, Mus musculus
gaacattgcaagcatggtgcggccc

SEQ ID NO: 629503 - DNA, 25 bp, Mus musculus
gaacattgcaaggatggtgcggccc

SEQ ID NO: 629504 - DNA, 25 bp, Mus musculus
gaacattgcacaatatgttgatgag

SEQ ID NO: 629505 - DNA, 25 bp, Mus musculus
gaacattgcacattatgttgatgag

SEQ ID NO: 629506 - DNA, 25 bp, Mus musculus
gaacattgcaccacacgtttctttg

SEQ ID NO: 629507 - DNA, 25 bp, Mus musculus
gaacattgcacctcacgtttctttg

SEQ ID NO: 629508 - DNA, 25 bp, Mus musculus
gaacattgcaggcttggcccgccgc

SEQ ID NO: 629509 - DNA, 25 bp, Mus musculus
gaacattgcagggttggcccgccgc

SEQ ID NO: 629510 - DNA, 25 bp, Mus musculus
gaacattgcccgagactctgagaac

SEQ ID NO: 629511 - DNA, 25 bp, Mus musculus
gaacattgcccgtgactctgagaac

SEQ ID NO: 629512 - DNA, 25 bp, Mus musculus
gaacattgctggatggtcctgtcca

SEQ ID NO: 629513 - DNA, 25 bp, Mus musculus
gaacattgctggttggtcctgtcca

SEQ ID NO: 629514 - DNA, 25 bp, Mus musculus
gaacattgctttcaactatgacatg

SEQ ID NO: 629515 - DNA, 25 bp, Mus musculus
gaacattgctttgaactatgacatg

SEQ ID NO: 629516 - DNA, 25 bp, Mus musculus
gaacattggaaactggtctcctgcc

SEQ ID NO: 629517 - DNA, 25 bp, Mus musculus
gaacattggaaagtggtctcctgcc

SEQ ID NO: 629518 - DNA, 25 bp, Mus musculus
gaacattggaagcaacgtcacactc

SEQ ID NO: 629519 - DNA, 25 bp, Mus musculus
gaacattggaaggaacgtcacactc

SEQ ID NO: 629520 - DNA, 25 bp, Mus musculus
gaacattggtgtaacagctgtggcc

SEQ ID NO: 629521 - DNA, 25 bp, Mus musculus
gaacattggtgtacgcagctgtttt

SEQ ID NO: 629522 - DNA, 25 bp, Mus musculus
gaacattggtgttacagctgtggcc

SEQ ID NO: 629523 - DNA, 25 bp, Mus musculus
gaacattggtgttcgcagctgtttt

SEQ ID NO: 629524 - DNA, 25 bp, Mus musculus
gaacattgtaccaggctttgggccc

SEQ ID NO: 629525 - DNA, 25 bp, Mus musculus
gaacattgtacctggctttgggccc

SEQ ID NO: 629526 - DNA, 25 bp, Mus musculus
gaacatttacatccagctgggcttt

SEQ ID NO: 629527 - DNA, 25 bp, Mus musculus
gaacatttacatgcagctgggcttt

SEQ ID NO: 629528 - DNA, 25 bp, Mus musculus
gaacatttacgcatcggtcatcgct

SEQ ID NO: 629529 - DNA, 25 bp, Mus musculus
gaacatttacgcttcggtcatcgct

SEQ ID NO: 629530 - DNA, 25 bp, Mus musculus
gaacatttcaagaaagcattatagc

SEQ ID NO: 629531 - DNA, 25 bp, Mus musculus
gaacatttcaagtaagcattatagc

SEQ ID NO: 629532 - DNA, 25 bp, Mus musculus
gaacatttcattccgtcagctggcc

SEQ ID NO: 629533 - DNA, 25 bp, Mus musculus
gaacatttcattgcgtcagctggcc

SEQ ID NO: 629534 - DNA, 25 bp, Mus musculus
gaacatttcttccacagaagtataa

SEQ ID NO: 629535 - DNA, 25 bp, Mus musculus
gaacatttcttcgacagaagtataa

SEQ ID NO: 629536 - DNA, 25 bp, Mus musculus
gaacatttgcgaactggccgcacgg

SEQ ID NO: 629537 - DNA, 25 bp, Mus musculus
gaacatttgcgatctggccgcacgg

SEQ ID NO: 629538 - DNA, 25 bp, Mus musculus
gaacatttgcttactccgagggcaa

SEQ ID NO: 629539 - DNA, 25 bp, Mus musculus
gaacatttgctttctccgagggcaa

SEQ ID NO: 629540 - DNA, 25 bp, Mus musculus
gaacatttgggcataggaagcgaca

SEQ ID NO: 629541 - DNA, 25 bp, Mus musculus
gaacatttgggcttaggaagcgaca

SEQ ID NO: 629542 - DNA, 25 bp, Mus musculus
gaacattttagaccatctcgagcaa

SEQ ID NO: 629543 - DNA, 25 bp, Mus musculus
gaacattttagagcatctcgagcaa

SEQ ID NO: 629544 - DNA, 25 bp, Mus musculus
gaacattttcagcttctcgcacgca

SEQ ID NO: 629545 - DNA, 25 bp, Mus musculus
gaacattttcaggttctcgcacgca

SEQ ID NO: 629546 - DNA, 25 bp, Mus musculus
gaacattttcgtacttcattagaag

SEQ ID NO: 629547 - DNA, 25 bp, Mus musculus
gaacattttcgttcttcattagaag

SEQ ID NO: 629548 - DNA, 25 bp, Mus musculus
gaacattttgacattgtaaggcctg

SEQ ID NO: 629549 - DNA, 25 bp, Mus musculus
gaacattttgactttgtaaggcctg

SEQ ID NO: 629550 - DNA, 25 bp, Mus musculus
gaacatttttggagtggaaagtgga

SEQ ID NO: 629551 - DNA, 25 bp, Mus musculus
gaacatttttggtgtggaaagtgga

SEQ ID NO: 629552 - DNA, 25 bp, Mus musculus
gaaccaaaaatgatcccaactgctg

SEQ ID NO: 629553 - DNA, 25 bp, Mus musculus
gaaccaaaaatgttcccaactgctg

SEQ ID NO: 629554 - DNA, 25 bp, Mus musculus
gaaccaaacctgaggcctctgtgga

SEQ ID NO: 629555 - DNA, 25 bp, Mus musculus
gaaccaaacctgtggcctctgtgga

SEQ ID NO: 629556 - DNA, 25 bp, Mus musculus
gaaccaaactcacgccaagagggct

SEQ ID NO: 629557 - DNA, 25 bp, Mus musculus
gaaccaaactcaggccaagagggct

SEQ ID NO: 629558 - DNA, 25 bp, Mus musculus
gaaccaaaggttagatcatgaaatg

SEQ ID NO: 629559 - DNA, 25 bp, Mus musculus
gaaccaaaggtttgatcatgaaatg

SEQ ID NO: 629560 - DNA, 25 bp, Mus musculus
gaaccaaagtcaaaggagtggacct

SEQ ID NO: 629561 - DNA, 25 bp, Mus musculus
gaaccaaagtcataggagtggacct

SEQ ID NO: 629562 - DNA, 25 bp, Mus musculus
gaaccaaatcaacaccaacccggag

SEQ ID NO: 629563 - DNA, 25 bp, Mus musculus
gaaccaaatcaagaccaacccggag

SEQ ID NO: 629564 - DNA, 25 bp, Mus musculus
gaaccaaatgacagaggcacacaag

SEQ ID NO: 629565 - DNA, 25 bp, Mus musculus
gaaccaaatgactgaggcacacaag

SEQ ID NO: 629566 - DNA, 25 bp, Mus musculus
gaaccaacccagagtatcgagggcc

SEQ ID NO: 629567 - DNA, 25 bp, Mus musculus
gaaccaacccagtgtatcgagggcc

SEQ ID NO: 629568 - DNA, 25 bp, Mus musculus
gaaccaacccatcgccctgagtttg

SEQ ID NO: 629569 - DNA, 25 bp, Mus musculus
gaaccaacccatggccctgagtttg

SEQ ID NO: 629570 - DNA, 25 bp, Mus musculus
gaaccaaccctaccgttatgattga

SEQ ID NO: 629571 - DNA, 25 bp, Mus musculus
gaaccaaccctagcgttatgattga

SEQ ID NO: 629572 - DNA, 25 bp, Mus musculus
gaaccaaccttgcatgtgaaaattg

SEQ ID NO: 629573 - DNA, 25 bp, Mus musculus
gaaccaaccttggatgtgaaaattg

SEQ ID NO: 629574 - DNA, 25 bp, Mus musculus
gaaccaactaaacgaactgcctgaa

SEQ ID NO: 629575 - DNA, 25 bp, Mus musculus
gaaccaactaaaggaactgcctgaa

SEQ ID NO: 629576 - DNA, 25 bp, Mus musculus
gaaccaactattcaagccaatgtcg

SEQ ID NO: 629577 - DNA, 25 bp, Mus musculus
gaaccaactattgaagccaatgtcg

SEQ ID NO: 629578 - DNA, 25 bp, Mus musculus
gaaccaagctgcctgccatgacctg

SEQ ID NO: 629579 - DNA, 25 bp, Mus musculus
gaaccaagctgcgtgccatgacctg

SEQ ID NO: 629580 - DNA, 25 bp, Mus musculus
gaaccaaggagaatcagactcctga

SEQ ID NO: 629581 - DNA, 25 bp, Mus musculus
gaaccaaggagattcagactcctga

SEQ ID NO: 629582 - DNA, 25 bp, Mus musculus
gaaccaagggacatcggacttctta

SEQ ID NO: 629583 - DNA, 25 bp, Mus musculus
gaaccaagggacttcggacttctta

SEQ ID NO: 629584 - DNA, 25 bp, Mus musculus
gaaccaagtgttagaggccaagtgc

SEQ ID NO: 629585 - DNA, 25 bp, Mus musculus
gaaccaagtgtttgaggccaagtgc

SEQ ID NO: 629586 - DNA, 25 bp, Mus musculus
gaaccaatctctaccggagtcccag

SEQ ID NO: 629587 - DNA, 25 bp, Mus musculus
gaaccaatctcttccggagtcccag

SEQ ID NO: 629588 - DNA, 25 bp, Mus musculus
gaaccaatgctgcataggccaggct

SEQ ID NO: 629589 - DNA, 25 bp, Mus musculus
gaaccaatgctggataggccaggct

SEQ ID NO: 629590 - DNA, 25 bp, Mus musculus
gaaccaattactatgtggaattctc

SEQ ID NO: 629591 - DNA, 25 bp, Mus musculus
gaaccaattactttgtggaattctc

SEQ ID NO: 629592 - DNA, 25 bp, Mus musculus
gaaccaatttggcttcacttcctga

SEQ ID NO: 629593 - DNA, 25 bp, Mus musculus
gaaccaatttgggttcacttcctga

SEQ ID NO: 629594 - DNA, 25 bp, Mus musculus
gaaccacaaaacagccacctgattg

SEQ ID NO: 629595 - DNA, 25 bp, Mus musculus
gaaccacaaaactgccacctgattg

SEQ ID NO: 629596 - DNA, 25 bp, Mus musculus
gaaccacaagacctacttggatctt

SEQ ID NO: 629597 - DNA, 25 bp, Mus musculus
gaaccacaagacgtacttggatctt

SEQ ID NO: 629598 - DNA, 25 bp, Mus musculus
gaaccacaatgacctgaatagcgtg

SEQ ID NO: 629599 - DNA, 25 bp, Mus musculus
gaaccacaatgagctgaatagcgtg

SEQ ID NO: 629600 - DNA, 25 bp, Mus musculus
gaaccacacacaatcccctggatgt

SEQ ID NO: 629601 - DNA, 25 bp, Mus musculus
gaaccacacacattcccctggatgt

SEQ ID NO: 629602 - DNA, 25 bp, Mus musculus
gaaccacaccaactgccggttaggg

SEQ ID NO: 629603 - DNA, 25 bp, Mus musculus
gaaccacaccaagtgccggttaggg

SEQ ID NO: 629604 - DNA, 25 bp, Mus musculus
gaaccacacttacctagtcatagga

SEQ ID NO: 629605 - DNA, 25 bp, Mus musculus
gaaccacacttagctagtcatagga

SEQ ID NO: 629606 - DNA, 25 bp, Mus musculus
gaaccacagcttcaagtgaactcag

SEQ ID NO: 629607 - DNA, 25 bp, Mus musculus
gaaccacagcttgaagtgaactcag

SEQ ID NO: 629608 - DNA, 25 bp, Mus musculus
gaaccacagggtaacatccaggcag

SEQ ID NO: 629609 - DNA, 25 bp, Mus musculus
gaaccacagggttacatccaggcag

SEQ ID NO: 629610 - DNA, 25 bp, Mus musculus
gaaccacaggttcgcatggctcttc

SEQ ID NO: 629611 - DNA, 25 bp, Mus musculus
gaaccacaggttggcatggctcttc

SEQ ID NO: 629612 - DNA, 25 bp, Mus musculus
gaaccacatctgacagcaagatgga

SEQ ID NO: 629613 - DNA, 25 bp, Mus musculus
gaaccacatctgtcagcaagatgga

SEQ ID NO: 629614 - DNA, 25 bp, Mus musculus
gaaccacatgttcttcagtcccata

SEQ ID NO: 629615 - DNA, 25 bp, Mus musculus
gaaccacatgttgttcagtcccata

SEQ ID NO: 629616 - DNA, 25 bp, Mus musculus
gaaccacatttactctcccttggca

SEQ ID NO: 629617 - DNA, 25 bp, Mus musculus
gaaccacatttagtctcccttggca

SEQ ID NO: 629618 - DNA, 25 bp, Mus musculus
gaaccacatttccttgagagggctt

SEQ ID NO: 629619 - DNA, 25 bp, Mus musculus
gaaccacatttcgttgagagggctt

SEQ ID NO: 629620 - DNA, 25 bp, Mus musculus
gaaccaccaaagctgttccaggcct

SEQ ID NO: 629621 - DNA, 25 bp, Mus musculus
gaaccaccaaaggtgttccaggcct

SEQ ID NO: 629622 - DNA, 25 bp, Mus musculus
gaaccaccacaactaccgtaaactg

SEQ ID NO: 629623 - DNA, 25 bp, Mus musculus
gaaccaccacaagtaccgtaaactg

SEQ ID NO: 629624 - DNA, 25 bp, Mus musculus
gaaccaccagtgattcaaaatcctg

SEQ ID NO: 629625 - DNA, 25 bp, Mus musculus
gaaccaccagtgtttcaaaatcctg

SEQ ID NO: 629626 - DNA, 25 bp, Mus musculus
gaaccacccatcaggtgcacttagt

SEQ ID NO: 629627 - DNA, 25 bp, Mus musculus
gaaccacccatctggtgcacttagt

SEQ ID NO: 629628 - DNA, 25 bp, Mus musculus
gaaccaccccagaagacattctcag

SEQ ID NO: 629629 - DNA, 25 bp, Mus musculus
gaaccaccccagtagacattctcag

SEQ ID NO: 629630 - DNA, 25 bp, Mus musculus
gaaccacctgccagacatcatcaag

SEQ ID NO: 629631 - DNA, 25 bp, Mus musculus
gaaccacctgcctgacatcatcaag

SEQ ID NO: 629632 - DNA, 25 bp, Mus musculus
gaaccaccttaacatccaagaaggt

SEQ ID NO: 629633 - DNA, 25 bp, Mus musculus
gaaccaccttaagatccaagaaggt

SEQ ID NO: 629634 - DNA, 25 bp, Mus musculus
gaaccaccttgactcaggacaacga

SEQ ID NO: 629635 - DNA, 25 bp, Mus musculus
gaaccaccttgagtcaggacaacga

SEQ ID NO: 629636 - DNA, 25 bp, Mus musculus
gaaccaccttgtcatggagattgat

SEQ ID NO: 629637 - DNA, 25 bp, Mus musculus
gaaccaccttgtgatggagattgat

SEQ ID NO: 629638 - DNA, 25 bp, Mus musculus
gaaccacggattcaagtaataacag

SEQ ID NO: 629639 - DNA, 25 bp, Mus musculus
gaaccacggattgaagtaataacag

SEQ ID NO: 629640 - DNA, 25 bp, Mus musculus
gaaccacgggtaacagtctgagcac

SEQ ID NO: 629641 - DNA, 25 bp, Mus musculus
gaaccacgggtatcagtctgagcac

SEQ ID NO: 629642 - DNA, 25 bp, Mus musculus
gaaccacgtgtcagcaatagattat

SEQ ID NO: 629643 - DNA, 25 bp, Mus musculus
gaaccacgtgtccatgtgcattgta

SEQ ID NO: 629644 - DNA, 25 bp, Mus musculus
gaaccacgtgtcgatgtgcattgta

SEQ ID NO: 629645 - DNA, 25 bp, Mus musculus
gaaccacgtgtctgcaatagattat

SEQ ID NO: 629646 - DNA, 25 bp, Mus musculus
gaaccactcatcagctgttgggcca

SEQ ID NO: 629647 - DNA, 25 bp, Mus musculus
gaaccactcatctgctgttgggcca

SEQ ID NO: 629648 - DNA, 25 bp, Mus musculus
gaaccactgaggcaaggctgtagca

SEQ ID NO: 629649 - DNA, 25 bp, Mus musculus
gaaccactgagggaaggctgtagca

SEQ ID NO: 629650 - DNA, 25 bp, Mus musculus
gaaccactgatcagcgggtggctct

SEQ ID NO: 629651 - DNA, 25 bp, Mus musculus
gaaccactgatctgcgggtggctct

SEQ ID NO: 629652 - DNA, 25 bp, Mus musculus
gaaccactgcggaactatgacatcg

SEQ ID NO: 629653 - DNA, 25 bp, Mus musculus
gaaccactgcggtactatgacatcg

SEQ ID NO: 629654 - DNA, 25 bp, Mus musculus
gaaccactggctaaggacactaaaa

SEQ ID NO: 629655 - DNA, 25 bp, Mus musculus
gaaccactggcttaggacactaaaa

SEQ ID NO: 629656 - DNA, 25 bp, Mus musculus
gaaccacttgagaatctagtttgcg

SEQ ID NO: 629657 - DNA, 25 bp, Mus musculus
gaaccacttgagtatctagtttgcg

SEQ ID NO: 629658 - DNA, 25 bp, Mus musculus
gaaccagaactacacatctcagacc

SEQ ID NO: 629659 - DNA, 25 bp, Mus musculus
gaaccagaactagacatctcagacc

SEQ ID NO: 629660 - DNA, 25 bp, Mus musculus
gaaccagacaggcaggtcactcaga

SEQ ID NO: 629661 - DNA, 25 bp, Mus musculus
gaaccagacagggaggtcactcaga

SEQ ID NO: 629662 - DNA, 25 bp, Mus musculus
gaaccagacatcaggaggctcgctg

SEQ ID NO: 629663 - DNA, 25 bp, Mus musculus
gaaccagacatctggaggctcgctg

SEQ ID NO: 629664 - DNA, 25 bp, Mus musculus
gaaccagacgcacctcggtggttga

SEQ ID NO: 629665 - DNA, 25 bp, Mus musculus
gaaccagacgcagctcggtggttga

SEQ ID NO: 629666 - DNA, 25 bp, Mus musculus
gaaccagacggtagcgaactttcta

SEQ ID NO: 629667 - DNA, 25 bp, Mus musculus
gaaccagacggttgcgaactttcta

SEQ ID NO: 629668 - DNA, 25 bp, Mus musculus
gaaccagactagcatctctcagtgg

SEQ ID NO: 629669 - DNA, 25 bp, Mus musculus
gaaccagactaggatctctcagtgg

SEQ ID NO: 629670 - DNA, 25 bp, Mus musculus
gaaccagagattcacagccctcgag

SEQ ID NO: 629671 - DNA, 25 bp, Mus musculus
gaaccagagattgacagccctcgag

SEQ ID NO: 629672 - DNA, 25 bp, Mus musculus
gaaccagagcccctagagtcagagg

SEQ ID NO: 629673 - DNA, 25 bp, Mus musculus
gaaccagagcccgtagagtcagagg

SEQ ID NO: 629674 - DNA, 25 bp, Mus musculus
gaaccagagggaatgacgaagccca

SEQ ID NO: 629675 - DNA, 25 bp, Mus musculus
gaaccagagggattgacgaagccca

SEQ ID NO: 629676 - DNA, 25 bp, Mus musculus
gaaccagagtacaatccctgtggaa

SEQ ID NO: 629677 - DNA, 25 bp, Mus musculus
gaaccagagtactatccctgtggaa

SEQ ID NO: 629678 - DNA, 25 bp, Mus musculus
gaaccagagtccagcgattgtccaa

SEQ ID NO: 629679 - DNA, 25 bp, Mus musculus
gaaccagagtcctgcgattgtccaa

SEQ ID NO: 629680 - DNA, 25 bp, Mus musculus
gaaccagagtgactggtatcttgga

SEQ ID NO: 629681 - DNA, 25 bp, Mus musculus
gaaccagagtgagtggtatcttgga

SEQ ID NO: 629682 - DNA, 25 bp, Mus musculus
gaaccagagtttcccatgccagcat

SEQ ID NO: 629683 - DNA, 25 bp, Mus musculus
gaaccagagtttgccatgccagcat

SEQ ID NO: 629684 - DNA, 25 bp, Mus musculus
gaaccagatgcaatatctcagccca

SEQ ID NO: 629685 - DNA, 25 bp, Mus musculus
gaaccagatgcattatctcagccca

SEQ ID NO: 629686 - DNA, 25 bp, Mus musculus
gaaccagcaaccagtaactgccctt

SEQ ID NO: 629687 - DNA, 25 bp, Mus musculus
gaaccagcaacctgtaactgccctt

SEQ ID NO: 629688 - DNA, 25 bp, Mus musculus
gaaccagcacctcttaagaccatga

SEQ ID NO: 629689 - DNA, 25 bp, Mus musculus
gaaccagcacctgttaagaccatga

SEQ ID NO: 629690 - DNA, 25 bp, Mus musculus
gaaccagcagggacaacaaacagat

SEQ ID NO: 629691 - DNA, 25 bp, Mus musculus
gaaccagcagggtcaacaaacagat

SEQ ID NO: 629692 - DNA, 25 bp, Mus musculus
gaaccagccaaaaccagctatatct

SEQ ID NO: 629693 - DNA, 25 bp, Mus musculus
gaaccagccaaatccagctatatct

SEQ ID NO: 629694 - DNA, 25 bp, Mus musculus
gaaccagctaatcccaacatgcctg

SEQ ID NO: 629695 - DNA, 25 bp, Mus musculus
gaaccagctaatgccaacatgcctg

SEQ ID NO: 629696 - DNA, 25 bp, Mus musculus
gaaccagctggacggctttcagccc

SEQ ID NO: 629697 - DNA, 25 bp, Mus musculus
gaaccagctggagggctttcagccc

SEQ ID NO: 629698 - DNA, 25 bp, Mus musculus
gaaccagctggcaagccgaaagtga

SEQ ID NO: 629699 - DNA, 25 bp, Mus musculus
gaaccagctggctagccgaaagtga

SEQ ID NO: 629700 - DNA, 25 bp, Mus musculus
gaaccaggactgatgctcagggact

SEQ ID NO: 629701 - DNA, 25 bp, Mus musculus
gaaccaggactgttgctcagggact

SEQ ID NO: 629702 - DNA, 25 bp, Mus musculus
gaaccaggatcacacaacggagaat

SEQ ID NO: 629703 - DNA, 25 bp, Mus musculus
gaaccaggatcagacaacggagaat

SEQ ID NO: 629704 - DNA, 25 bp, Mus musculus
gaaccaggcacaagcccttttctac

SEQ ID NO: 629705 - DNA, 25 bp, Mus musculus
gaaccaggcacatgcccttttctac

SEQ ID NO: 629706 - DNA, 25 bp, Mus musculus
gaaccagggtcgcagacctccgatg

SEQ ID NO: 629707 - DNA, 25 bp, Mus musculus
gaaccagggtcggagacctccgatg

SEQ ID NO: 629708 - DNA, 25 bp, Mus musculus
gaaccagggtgtctgtgtccgcttt

SEQ ID NO: 629709 - DNA, 25 bp, Mus musculus
gaaccagggtgtgtgtgtccgcttt

SEQ ID NO: 629710 - DNA, 25 bp, Mus musculus
gaaccaggttatcacctagatttgt

SEQ ID NO: 629711 - DNA, 25 bp, Mus musculus
gaaccaggttatgacctagatttgt

SEQ ID NO: 629712 - DNA, 25 bp, Mus musculus
gaaccaggttcactcgcttcctgca

SEQ ID NO: 629713 - DNA, 25 bp, Mus musculus
gaaccaggttcagtcgcttcctgca

SEQ ID NO: 629714 - DNA, 25 bp, Mus musculus
gaaccagtgtcactactgtcggctc

SEQ ID NO: 629715 - DNA, 25 bp, Mus musculus
gaaccagtgtcagtactgtcggctc

SEQ ID NO: 629716 - DNA, 25 bp, Mus musculus
gaaccagtttcgaacatgtttgagc

SEQ ID NO: 629717 - DNA, 25 bp, Mus musculus
gaaccagtttcgtacatgtttgagc

SEQ ID NO: 629718 - DNA, 25 bp, Mus musculus
gaaccatcatttctattccggacat

SEQ ID NO: 629719 - DNA, 25 bp, Mus musculus
gaaccatcatttgtattccggacat

SEQ ID NO: 629720 - DNA, 25 bp, Mus musculus
gaaccatccttgcatgatgttggtg

SEQ ID NO: 629721 - DNA, 25 bp, Mus musculus
gaaccatccttggatgatgttggtg

SEQ ID NO: 629722 - DNA, 25 bp, Mus musculus
gaaccatcggagatgcacgtgtcct

SEQ ID NO: 629723 - DNA, 25 bp, Mus musculus
gaaccatcggagttgcacgtgtcct

SEQ ID NO: 629724 - DNA, 25 bp, Mus musculus
gaaccatctgctcctcaatggacaa

SEQ ID NO: 629725 - DNA, 25 bp, Mus musculus
gaaccatctgctgctcaatggacaa

SEQ ID NO: 629726 - DNA, 25 bp, Mus musculus
gaaccatctgtgcatcagggccccg

SEQ ID NO: 629727 - DNA, 25 bp, Mus musculus
gaaccatctgtggatcagggccccg

SEQ ID NO: 629728 - DNA, 25 bp, Mus musculus
gaaccatcttggactcttgctaaag

SEQ ID NO: 629729 - DNA, 25 bp, Mus musculus
gaaccatcttggtctcttgctaaag

SEQ ID NO: 629730 - DNA, 25 bp, Mus musculus
gaaccatgaagtatggaacaacccc

SEQ ID NO: 629731 - DNA, 25 bp, Mus musculus
gaaccatgaagtttggaacaacccc

SEQ ID NO: 629732 - DNA, 25 bp, Mus musculus
gaaccatgacttctgctgaggtgaa

SEQ ID NO: 629733 - DNA, 25 bp, Mus musculus
gaaccatgacttgtgctgaggtgaa

SEQ ID NO: 629734 - DNA, 25 bp, Mus musculus
gaaccatgagcgcatccctttcagg

SEQ ID NO: 629735 - DNA, 25 bp, Mus musculus
gaaccatgagcggatccctttcagg

SEQ ID NO: 629736 - DNA, 25 bp, Mus musculus
gaaccatgatccagaccaatttgac

SEQ ID NO: 629737 - DNA, 25 bp, Mus musculus
gaaccatgatcctgaccaatttgac

SEQ ID NO: 629738 - DNA, 25 bp, Mus musculus
gaaccatgcccgagagctggtgcag

SEQ ID NO: 629739 - DNA, 25 bp, Mus musculus
gaaccatgcccgtgagctggtgcag

SEQ ID NO: 629740 - DNA, 25 bp, Mus musculus
gaaccatggaaaacatccctacagt

SEQ ID NO: 629741 - DNA, 25 bp, Mus musculus
gaaccatggaaatcatccctacagt

SEQ ID NO: 629742 - DNA, 25 bp, Mus musculus
gaaccatggagcactctcacacgga

SEQ ID NO: 629743 - DNA, 25 bp, Mus musculus
gaaccatggagctctctcacacgga

SEQ ID NO: 629744 - DNA, 25 bp, Mus musculus
gaaccatggctaagaggctgctgcg

SEQ ID NO: 629745 - DNA, 25 bp, Mus musculus
gaaccatggctatgaggctgctgcg

SEQ ID NO: 629746 - DNA, 25 bp, Mus musculus
gaaccatgggcaccagcaagtgtca

SEQ ID NO: 629747 - DNA, 25 bp, Mus musculus
gaaccatgggcagcagcaagtgtca

SEQ ID NO: 629748 - DNA, 25 bp, Mus musculus
gaaccatgtcctaaggagtgccact

SEQ ID NO: 629749 - DNA, 25 bp, Mus musculus
gaaccatgtccttaggagtgccact

SEQ ID NO: 629750 - DNA, 25 bp, Mus musculus
gaaccatgttaccagttttctgcgt

SEQ ID NO: 629751 - DNA, 25 bp, Mus musculus
gaaccatgttacgagttttctgcgt

SEQ ID NO: 629752 - DNA, 25 bp, Mus musculus
gaaccattgaagaaaatttgtaaca

SEQ ID NO: 629753 - DNA, 25 bp, Mus musculus
gaaccattgaagtaaatttgtaaca

SEQ ID NO: 629754 - DNA, 25 bp, Mus musculus
gaaccattgaggatgtccctgggaa

SEQ ID NO: 629755 - DNA, 25 bp, Mus musculus
gaaccattgaggttgtccctgggaa

SEQ ID NO: 629756 - DNA, 25 bp, Mus musculus
gaaccattttacacaggccaagggc

SEQ ID NO: 629757 - DNA, 25 bp, Mus musculus
gaaccattttactcaggccaagggc

SEQ ID NO: 629758 - DNA, 25 bp, Mus musculus
gaacccaaaactcaagacatagtag

SEQ ID NO: 629759 - DNA, 25 bp, Mus musculus
gaacccaaaactgaagacatagtag

SEQ ID NO: 629760 - DNA, 25 bp, Mus musculus
gaacccaaatagagctgtcttcctg

SEQ ID NO: 629761 - DNA, 25 bp, Mus musculus
gaacccaaatagtgctgtcttcctg

SEQ ID NO: 629762 - DNA, 25 bp, Mus musculus
gaacccaactcaattaacatcacag

SEQ ID NO: 629763 - DNA, 25 bp, Mus musculus
gaacccaactcatttaacatcacag

SEQ ID NO: 629764 - DNA, 25 bp, Mus musculus
gaacccaactgtagcagcaagaacc

SEQ ID NO: 629765 - DNA, 25 bp, Mus musculus
gaacccaactgttgcagcaagaacc

SEQ ID NO: 629766 - DNA, 25 bp, Mus musculus
gaacccaagtttcacttcgctatga

SEQ ID NO: 629767 - DNA, 25 bp, Mus musculus
gaacccaagtttgacttcgctatga

SEQ ID NO: 629768 - DNA, 25 bp, Mus musculus
gaacccacacatcaggaggacctca

SEQ ID NO: 629769 - DNA, 25 bp, Mus musculus
gaacccacacatcttttcggaagga

SEQ ID NO: 629770 - DNA, 25 bp, Mus musculus
gaacccacacatgaggaggacctca

SEQ ID NO: 629771 - DNA, 25 bp, Mus musculus
gaacccacacatgttttcggaagga

SEQ ID NO: 629772 - DNA, 25 bp, Mus musculus
gaacccacacgtcgctttgtatgct

SEQ ID NO: 629773 - DNA, 25 bp, Mus musculus
gaacccacacgtggctttgtatgct

SEQ ID NO: 629774 - DNA, 25 bp, Mus musculus
gaacccacatgacgtgaagccagcc

SEQ ID NO: 629775 - DNA, 25 bp, Mus musculus
gaacccacatgaggtgaagccagcc

SEQ ID NO: 629776 - DNA, 25 bp, Mus musculus
gaacccacgttgactctgaagccga

SEQ ID NO: 629777 - DNA, 25 bp, Mus musculus
gaacccacgttgtctctgaagccga

SEQ ID NO: 629778 - DNA, 25 bp, Mus musculus
gaacccactcctctattccatgaga

SEQ ID NO: 629779 - DNA, 25 bp, Mus musculus
gaacccactcctgtattccatgaga

SEQ ID NO: 629780 - DNA, 25 bp, Mus musculus
gaacccactgggaaaatgaagaact

SEQ ID NO: 629781 - DNA, 25 bp, Mus musculus
gaacccactgggtaaatgaagaact

SEQ ID NO: 629782 - DNA, 25 bp, Mus musculus
gaacccactgtgcttagagcctcat

SEQ ID NO: 629783 - DNA, 25 bp, Mus musculus
gaacccactgtggttagagcctcat

SEQ ID NO: 629784 - DNA, 25 bp, Mus musculus
gaacccactttcagtgccagtcttg

SEQ ID NO: 629785 - DNA, 25 bp, Mus musculus
gaacccactttctgtgccagtcttg

SEQ ID NO: 629786 - DNA, 25 bp, Mus musculus
gaacccagacctaggccatggtcct

SEQ ID NO: 629787 - DNA, 25 bp, Mus musculus
gaacccagaccttggccatggtcct

SEQ ID NO: 629788 - DNA, 25 bp, Mus musculus
gaacccagagatcaaagaaaattaa

SEQ ID NO: 629789 - DNA, 25 bp, Mus musculus
gaacccagagatgaaagaaaattaa

SEQ ID NO: 629790 - DNA, 25 bp, Mus musculus
gaacccagataaagacacacgtcca

SEQ ID NO: 629791 - DNA, 25 bp, Mus musculus
gaacccagataatgacacacgtcca

SEQ ID NO: 629792 - DNA, 25 bp, Mus musculus
gaacccagcggtcttgactgttttg

SEQ ID NO: 629793 - DNA, 25 bp, Mus musculus
gaacccagcggtgttgactgttttg

SEQ ID NO: 629794 - DNA, 25 bp, Mus musculus
gaacccagctcaagctgatgggcct

SEQ ID NO: 629795 - DNA, 25 bp, Mus musculus
gaacccagctcatgctgatgggcct

SEQ ID NO: 629796 - DNA, 25 bp, Mus musculus
gaacccagctggctccggaagagcc

SEQ ID NO: 629797 - DNA, 25 bp, Mus musculus
gaacccagctgggtccggaagagcc

SEQ ID NO: 629798 - DNA, 25 bp, Mus musculus
gaacccagcttgaggacaggactct

SEQ ID NO: 629799 - DNA, 25 bp, Mus musculus
gaacccagcttgtggacaggactct

SEQ ID NO: 629800 - DNA, 25 bp, Mus musculus
gaacccaggaagacaaccaactcaa

SEQ ID NO: 629801 - DNA, 25 bp, Mus musculus
gaacccaggaagtcaaccaactcaa

SEQ ID NO: 629802 - DNA, 25 bp, Mus musculus
gaacccaggactcgtgcgtgtcaga

SEQ ID NO: 629803 - DNA, 25 bp, Mus musculus
gaacccaggactggtgcgtgtcaga

SEQ ID NO: 629804 - DNA, 25 bp, Mus musculus
gaacccaggcatcatgctagaccta

SEQ ID NO: 629805 - DNA, 25 bp, Mus musculus
gaacccaggcatgatgctagaccta

SEQ ID NO: 629806 - DNA, 25 bp, Mus musculus
gaacccagggagagttcactgccag

SEQ ID NO: 629807 - DNA, 25 bp, Mus musculus
gaacccagggagtgttcactgccag

SEQ ID NO: 629808 - DNA, 25 bp, Mus musculus
gaacccaggtctattgtccctgaca

SEQ ID NO: 629809 - DNA, 25 bp, Mus musculus
gaacccaggtcttttgtccctgaca

SEQ ID NO: 629810 - DNA, 25 bp, Mus musculus
gaacccaggtgcatggacatagtaa

SEQ ID NO: 629811 - DNA, 25 bp, Mus musculus
gaacccaggtgcttggacatagtaa

SEQ ID NO: 629812 - DNA, 25 bp, Mus musculus
gaacccagtatgcaggacaaagatg

SEQ ID NO: 629813 - DNA, 25 bp, Mus musculus
gaacccagtatggaggacaaagatg

SEQ ID NO: 629814 - DNA, 25 bp, Mus musculus
gaacccagtgtccagcaagaattgc

SEQ ID NO: 629815 - DNA, 25 bp, Mus musculus
gaacccagtgtcgagcaagaattgc

SEQ ID NO: 629816 - DNA, 25 bp, Mus musculus
gaacccataatcctcgagaacgtga

SEQ ID NO: 629817 - DNA, 25 bp, Mus musculus
gaacccataatcgtcgagaacgtga

SEQ ID NO: 629818 - DNA, 25 bp, Mus musculus
gaacccataccgaggcaccgtggta

SEQ ID NO: 629819 - DNA, 25 bp, Mus musculus
gaacccataccgtggcaccgtggta

SEQ ID NO: 629820 - DNA, 25 bp, Mus musculus
gaacccataggtagtaaggaccagg

SEQ ID NO: 629821 - DNA, 25 bp, Mus musculus
gaacccataggttgtaaggaccagg

SEQ ID NO: 629822 - DNA, 25 bp, Mus musculus
gaacccatggaccaggacctgtctg

SEQ ID NO: 629823 - DNA, 25 bp, Mus musculus
gaacccatggacgaggacctgtctg

SEQ ID NO: 629824 - DNA, 25 bp, Mus musculus
gaacccattgatcactcttccgagg

SEQ ID NO: 629825 - DNA, 25 bp, Mus musculus
gaacccattgatgactcttccgagg

SEQ ID NO: 629826 - DNA, 25 bp, Mus musculus
gaaccccaaaatcttgccttgacct

SEQ ID NO: 629827 - DNA, 25 bp, Mus musculus
gaaccccaaaatgttgccttgacct

SEQ ID NO: 629828 - DNA, 25 bp, Mus musculus
gaaccccactgacgcggagctgcag

SEQ ID NO: 629829 - DNA, 25 bp, Mus musculus
gaaccccactgaggcggagctgcag

SEQ ID NO: 629830 - DNA, 25 bp, Mus musculus
gaaccccagaacatggacaattcca

SEQ ID NO: 629831 - DNA, 25 bp, Mus musculus
gaaccccagaacttggacaattcca

SEQ ID NO: 629832 - DNA, 25 bp, Mus musculus
gaaccccagcatactgacacgtgaa

SEQ ID NO: 629833 - DNA, 25 bp, Mus musculus
gaaccccagcattctgacacgtgaa

SEQ ID NO: 629834 - DNA, 25 bp, Mus musculus
gaaccccagttcaatgcactgctgc

SEQ ID NO: 629835 - DNA, 25 bp, Mus musculus
gaaccccagttctatgcactgctgc

SEQ ID NO: 629836 - DNA, 25 bp, Mus musculus
gaaccccatatccttctcatcttga

SEQ ID NO: 629837 - DNA, 25 bp, Mus musculus
gaaccccatatcgttctcatcttga

SEQ ID NO: 629838 - DNA, 25 bp, Mus musculus
gaaccccatcttcaacgagacgttt

SEQ ID NO: 629839 - DNA, 25 bp, Mus musculus
gaaccccatcttgaacgagacgttt

SEQ ID NO: 629840 - DNA, 25 bp, Mus musculus
gaaccccgattccaagacccatggg

SEQ ID NO: 629841 - DNA, 25 bp, Mus musculus
gaaccccgattcgaagacccatggg

SEQ ID NO: 629842 - DNA, 25 bp, Mus musculus
gaaccccgccgcagtgtttcacagt

SEQ ID NO: 629843 - DNA, 25 bp, Mus musculus
gaaccccgccgctgtgtttcacagt

SEQ ID NO: 629844 - DNA, 25 bp, Mus musculus
gaaccccgtcgacagtaatgatgcc

SEQ ID NO: 629845 - DNA, 25 bp, Mus musculus
gaaccccgtcgagagtaatgatgcc

SEQ ID NO: 629846 - DNA, 25 bp, Mus musculus
gaaccccgtcttctaaaggtgacag

SEQ ID NO: 629847 - DNA, 25 bp, Mus musculus
gaaccccgtcttgtaaaggtgacag

SEQ ID NO: 629848 - DNA, 25 bp, Mus musculus
gaacccctgaaaacagcaaagccag

SEQ ID NO: 629849 - DNA, 25 bp, Mus musculus
gaacccctgaaatcagcaaagccag

SEQ ID NO: 629850 - DNA, 25 bp, Mus musculus
gaaccccttcgacagccggacggag

SEQ ID NO: 629851 - DNA, 25 bp, Mus musculus
gaaccccttcgagagccggacggag

SEQ ID NO: 629852 - DNA, 25 bp, Mus musculus
gaacccgaagatcttgcgataattt

SEQ ID NO: 629853 - DNA, 25 bp, Mus musculus
gaacccgaagatgttgcgataattt

SEQ ID NO: 629854 - DNA, 25 bp, Mus musculus
gaacccgacactcgctggaaattca

SEQ ID NO: 629855 - DNA, 25 bp, Mus musculus
gaacccgacactggctggaaattca

SEQ ID NO: 629856 - DNA, 25 bp, Mus musculus
gaacccgacctcagagcagattgaa

SEQ ID NO: 629857 - DNA, 25 bp, Mus musculus
gaacccgacctctgagcagattgaa

SEQ ID NO: 629858 - DNA, 25 bp, Mus musculus
gaacccgctttgaacgtgtcctcat

SEQ ID NO: 629859 - DNA, 25 bp, Mus musculus
gaacccgctttgtacgtgtcctcat

SEQ ID NO: 629860 - DNA, 25 bp, Mus musculus
gaacccggatcccaggttcaggcct

SEQ ID NO: 629861 - DNA, 25 bp, Mus musculus
gaacccggatccgaggttcaggcct

SEQ ID NO: 629862 - DNA, 25 bp, Mus musculus
gaacccggcgagaggactctgtgaa

SEQ ID NO: 629863 - DNA, 25 bp, Mus musculus
gaacccggcgagtggactctgtgaa

SEQ ID NO: 629864 - DNA, 25 bp, Mus musculus
gaacccggtggcacccgtcatgttt

SEQ ID NO: 629865 - DNA, 25 bp, Mus musculus
gaacccggtggctcccgtcatgttt

SEQ ID NO: 629866 - DNA, 25 bp, Mus musculus
gaacccgtcatgctaagggctctgg

SEQ ID NO: 629867 - DNA, 25 bp, Mus musculus
gaacccgtcatggtaagggctctgg

SEQ ID NO: 629868 - DNA, 25 bp, Mus musculus
gaacccgtgccaatagatgagcctg

SEQ ID NO: 629869 - DNA, 25 bp, Mus musculus
gaacccgtgccattagatgagcctg

SEQ ID NO: 629870 - DNA, 25 bp, Mus musculus
gaacccgtgggtagagctgtaagaa

SEQ ID NO: 629871 - DNA, 25 bp, Mus musculus
gaacccgtgggttgagctgtaagaa

SEQ ID NO: 629872 - DNA, 25 bp, Mus musculus
gaacccgtttccactatagtcctag

SEQ ID NO: 629873 - DNA, 25 bp, Mus musculus
gaacccgtttcctctatagtcctag

SEQ ID NO: 629874 - DNA, 25 bp, Mus musculus
gaaccctaaagaagctacttcaatt

SEQ ID NO: 629875 - DNA, 25 bp, Mus musculus
gaaccctaaagatgctacttcaatt

SEQ ID NO: 629876 - DNA, 25 bp, Mus musculus
gaaccctaccaacgcatccaagtgt

SEQ ID NO: 629877 - DNA, 25 bp, Mus musculus
gaaccctaccaaggcatccaagtgt

SEQ ID NO: 629878 - DNA, 25 bp, Mus musculus
gaaccctacctcagggaataatcta

SEQ ID NO: 629879 - DNA, 25 bp, Mus musculus
gaaccctacctctgggaataatcta

SEQ ID NO: 629880 - DNA, 25 bp, Mus musculus
gaaccctatcagacagtgccgtggt

SEQ ID NO: 629881 - DNA, 25 bp, Mus musculus
gaaccctatcagtcagtgccgtggt

SEQ ID NO: 629882 - DNA, 25 bp, Mus musculus
gaaccctccgaacactatgaacaca

SEQ ID NO: 629883 - DNA, 25 bp, Mus musculus
gaaccctccgaagactatgaacaca

SEQ ID NO: 629884 - DNA, 25 bp, Mus musculus
gaaccctcggaaactggagctctta

SEQ ID NO: 629885 - DNA, 25 bp, Mus musculus
gaaccctcggaatctggagctctta

SEQ ID NO: 629886 - DNA, 25 bp, Mus musculus
gaaccctcggtacgataagtgtgag

SEQ ID NO: 629887 - DNA, 25 bp, Mus musculus
gaaccctcggtaggataagtgtgag

SEQ ID NO: 629888 - DNA, 25 bp, Mus musculus
gaaccctcgtcacggcctattgcta

SEQ ID NO: 629889 - DNA, 25 bp, Mus musculus
gaaccctcgtcagggcctattgcta

SEQ ID NO: 629890 - DNA, 25 bp, Mus musculus
gaaccctctgaacctcctaggagac

SEQ ID NO: 629891 - DNA, 25 bp, Mus musculus
gaaccctctgaagctcctaggagac

SEQ ID NO: 629892 - DNA, 25 bp, Mus musculus
gaaccctgacccagaatgagatggt

SEQ ID NO: 629893 - DNA, 25 bp, Mus musculus
gaaccctgaccctgaatgagatggt

SEQ ID NO: 629894 - DNA, 25 bp, Mus musculus
gaaccctgatgacgataaaatctat

SEQ ID NO: 629895 - DNA, 25 bp, Mus musculus
gaaccctgatgaggataaaatctat

SEQ ID NO: 629896 - DNA, 25 bp, Mus musculus
gaaccctgcataagataggcctggg

SEQ ID NO: 629897 - DNA, 25 bp, Mus musculus
gaaccctgcatatgataggcctggg

SEQ ID NO: 629898 - DNA, 25 bp, Mus musculus
gaaccctggacacagaagacctgag

SEQ ID NO: 629899 - DNA, 25 bp, Mus musculus
gaaccctggacagagaagacctgag

SEQ ID NO: 629900 - DNA, 25 bp, Mus musculus
gaaccctggagcctcatccaaacag

SEQ ID NO: 629901 - DNA, 25 bp, Mus musculus
gaaccctggagcgtcatccaaacag

SEQ ID NO: 629902 - DNA, 25 bp, Mus musculus
gaaccctggatgactccttgaacag

SEQ ID NO: 629903 - DNA, 25 bp, Mus musculus
gaaccctggatgtctccttgaacag

SEQ ID NO: 629904 - DNA, 25 bp, Mus musculus
gaaccctggcgaatatgtggtcaca

SEQ ID NO: 629905 - DNA, 25 bp, Mus musculus
gaaccctggcgattatgtggtcaca

SEQ ID NO: 629906 - DNA, 25 bp, Mus musculus
gaaccctgggtccttaccagagtgg

SEQ ID NO: 629907 - DNA, 25 bp, Mus musculus
gaaccctgggtcgttaccagagtgg

SEQ ID NO: 629908 - DNA, 25 bp, Mus musculus
gaaccctgtaccaagctcaagacga

SEQ ID NO: 629909 - DNA, 25 bp, Mus musculus
gaaccctgtacctagctcaagacga

SEQ ID NO: 629910 - DNA, 25 bp, Mus musculus
gaaccctgtagactgtagagagcct

SEQ ID NO: 629911 - DNA, 25 bp, Mus musculus
gaaccctgtagagtgtagagagcct

SEQ ID NO: 629912 - DNA, 25 bp, Mus musculus
gaaccctgtatccatctggtgggat

SEQ ID NO: 629913 - DNA, 25 bp, Mus musculus
gaaccctgtatcgatctggtgggat

SEQ ID NO: 629914 - DNA, 25 bp, Mus musculus
gaaccctgtccgaggaatcccttat

SEQ ID NO: 629915 - DNA, 25 bp, Mus musculus
gaaccctgtccgtggaatcccttat

SEQ ID NO: 629916 - DNA, 25 bp, Mus musculus
gaaccctgtggaaatgacaccttca

SEQ ID NO: 629917 - DNA, 25 bp, Mus musculus
gaaccctgtggaatctctcatccca

SEQ ID NO: 629918 - DNA, 25 bp, Mus musculus
gaaccctgtggatatgacaccttca

SEQ ID NO: 629919 - DNA, 25 bp, Mus musculus
gaaccctgtggattctctcatccca

SEQ ID NO: 629920 - DNA, 25 bp, Mus musculus
gaaccctgtggccttggacttccct

SEQ ID NO: 629921 - DNA, 25 bp, Mus musculus
gaaccctgtggcgttggacttccct

SEQ ID NO: 629922 - DNA, 25 bp, Mus musculus
gaacccttcagcaataagggccaga

SEQ ID NO: 629923 - DNA, 25 bp, Mus musculus
gaacccttcagctataagggccaga

SEQ ID NO: 629924 - DNA, 25 bp, Mus musculus
gaacccttctatcctgcttttggga

SEQ ID NO: 629925 - DNA, 25 bp, Mus musculus
gaacccttctatgctgcttttggga

SEQ ID NO: 629926 - DNA, 25 bp, Mus musculus
gaacccttctgtcaacaccaagatc

SEQ ID NO: 629927 - DNA, 25 bp, Mus musculus
gaacccttctgtgaacaccaagatc

SEQ ID NO: 629928 - DNA, 25 bp, Mus musculus
gaacccttggagcaacatggcaact

SEQ ID NO: 629929 - DNA, 25 bp, Mus musculus
gaacccttggaggaacatggcaact

SEQ ID NO: 629930 - DNA, 25 bp, Mus musculus
gaaccctttgacctttactcctgca

SEQ ID NO: 629931 - DNA, 25 bp, Mus musculus
gaaccctttgacgtttactcctgca

SEQ ID NO: 629932 - DNA, 25 bp, Mus musculus
gaaccgaaatcgcaaagttggccag

SEQ ID NO: 629933 - DNA, 25 bp, Mus musculus
gaaccgaaatcggaaagttggccag

SEQ ID NO: 629934 - DNA, 25 bp, Mus musculus
gaaccgacttcaaagcagttaactg

SEQ ID NO: 629935 - DNA, 25 bp, Mus musculus
gaaccgacttcatagcagttaactg

SEQ ID NO: 629936 - DNA, 25 bp, Mus musculus
gaaccgagaggacccttccagatac

SEQ ID NO: 629937 - DNA, 25 bp, Mus musculus
gaaccgagaggagccttccagatac

SEQ ID NO: 629938 - DNA, 25 bp, Mus musculus
gaaccgagccggacatctgcgtgtt

SEQ ID NO: 629939 - DNA, 25 bp, Mus musculus
gaaccgagccggtcatctgcgtgtt

SEQ ID NO: 629940 - DNA, 25 bp, Mus musculus
gaaccgagctgacttcttccgacat

SEQ ID NO: 629941 - DNA, 25 bp, Mus musculus
gaaccgagctgagttcttccgacat

SEQ ID NO: 629942 - DNA, 25 bp, Mus musculus
gaaccgagtgtgagcttgcgaagct

SEQ ID NO: 629943 - DNA, 25 bp, Mus musculus
gaaccgagtgtgtgcttgcgaagct

SEQ ID NO: 629944 - DNA, 25 bp, Mus musculus
gaaccgatacacaaccatgaagcag

SEQ ID NO: 629945 - DNA, 25 bp, Mus musculus
gaaccgatacactaccatgaagcag

SEQ ID NO: 629946 - DNA, 25 bp, Mus musculus
gaaccgatcgctcgcgattgcctta

SEQ ID NO: 629947 - DNA, 25 bp, Mus musculus
gaaccgatcgctggcgattgcctta

SEQ ID NO: 629948 - DNA, 25 bp, Mus musculus
gaaccgatctatcccacgattggag

SEQ ID NO: 629949 - DNA, 25 bp, Mus musculus
gaaccgatctatgccacgattggag

SEQ ID NO: 629950 - DNA, 25 bp, Mus musculus
gaaccgcaacatataatggcccacc

SEQ ID NO: 629951 - DNA, 25 bp, Mus musculus
gaaccgcaacatttaatggcccacc

SEQ ID NO: 629952 - DNA, 25 bp, Mus musculus
gaaccgcactgaactgctggccctt

SEQ ID NO: 629953 - DNA, 25 bp, Mus musculus
gaaccgcactgatctgctggccctt

SEQ ID NO: 629954 - DNA, 25 bp, Mus musculus
gaaccgcagaacaggcacgggcttt

SEQ ID NO: 629955 - DNA, 25 bp, Mus musculus
gaaccgcagaactggcacgggcttt

SEQ ID NO: 629956 - DNA, 25 bp, Mus musculus
gaaccgcatgtcaccgggagctcta

SEQ ID NO: 629957 - DNA, 25 bp, Mus musculus
gaaccgcatgtctccgggagctcta

SEQ ID NO: 629958 - DNA, 25 bp, Mus musculus
gaaccgccaagtcccttgtcactgt

SEQ ID NO: 629959 - DNA, 25 bp, Mus musculus
gaaccgccaagtgccttgtcactgt

SEQ ID NO: 629960 - DNA, 25 bp, Mus musculus
gaaccgcccggaagttttgacagtg

SEQ ID NO: 629961 - DNA, 25 bp, Mus musculus
gaaccgcccggatgttttgacagtg

SEQ ID NO: 629962 - DNA, 25 bp, Mus musculus
gaaccgccgttgactgaagcatcac

SEQ ID NO: 629963 - DNA, 25 bp, Mus musculus
gaaccgccgttgtctgaagcatcac

SEQ ID NO: 629964 - DNA, 25 bp, Mus musculus
gaaccgcctgccctaagaagtccag

SEQ ID NO: 629965 - DNA, 25 bp, Mus musculus
gaaccgcctgccgtaagaagtccag

SEQ ID NO: 629966 - DNA, 25 bp, Mus musculus
gaaccgcctgctctactggctcagt

SEQ ID NO: 629967 - DNA, 25 bp, Mus musculus
gaaccgcctgctgtactggctcagt

SEQ ID NO: 629968 - DNA, 25 bp, Mus musculus
gaaccgcgtgttcgacaagctctcc

SEQ ID NO: 629969 - DNA, 25 bp, Mus musculus
gaaccgcgtgttggacaagctctcc

SEQ ID NO: 629970 - DNA, 25 bp, Mus musculus
gaaccgctctatccagaggctgcag

SEQ ID NO: 629971 - DNA, 25 bp, Mus musculus
gaaccgctctatgcagaggctgcag

SEQ ID NO: 629972 - DNA, 25 bp, Mus musculus
gaaccgctgatgcttaagatcccca

SEQ ID NO: 629973 - DNA, 25 bp, Mus musculus
gaaccgctgatggttaagatcccca

SEQ ID NO: 629974 - DNA, 25 bp, Mus musculus
gaaccgctgtctccagtagcctcta

SEQ ID NO: 629975 - DNA, 25 bp, Mus musculus
gaaccgctgtctgcagtagcctcta

SEQ ID NO: 629976 - DNA, 25 bp, Mus musculus
gaaccgctttcacagggccaactgc

SEQ ID NO: 629977 - DNA, 25 bp, Mus musculus
gaaccgctttcagagggccaactgc

SEQ ID NO: 629978 - DNA, 25 bp, Mus musculus
gaaccggaagtgaaggcagcttccc

SEQ ID NO: 629979 - DNA, 25 bp, Mus musculus
gaaccggaagtgtaggcagcttccc

SEQ ID NO: 629980 - DNA, 25 bp, Mus musculus
gaaccggacttgagtttaactgaga

SEQ ID NO: 629981 - DNA, 25 bp, Mus musculus
gaaccggacttgtgtttaactgaga

SEQ ID NO: 629982 - DNA, 25 bp, Mus musculus
gaaccggagacacgaactcctgaat

SEQ ID NO: 629983 - DNA, 25 bp, Mus musculus
gaaccggagacaggaactcctgaat

SEQ ID NO: 629984 - DNA, 25 bp, Mus musculus
gaaccggaggtgcacgagaccacaa

SEQ ID NO: 629985 - DNA, 25 bp, Mus musculus
gaaccggaggtggacgagaccacaa

SEQ ID NO: 629986 - DNA, 25 bp, Mus musculus
gaaccggagtttacataagtctcag

SEQ ID NO: 629987 - DNA, 25 bp, Mus musculus
gaaccggagttttcataagtctcag

SEQ ID NO: 629988 - DNA, 25 bp, Mus musculus
gaaccggatccccatcatggcgaag

SEQ ID NO: 629989 - DNA, 25 bp, Mus musculus
gaaccggatcccgatcatggcgaag

SEQ ID NO: 629990 - DNA, 25 bp, Mus musculus
gaaccggatgagatttccatacaga

SEQ ID NO: 629991 - DNA, 25 bp, Mus musculus
gaaccggatgagttttccatacaga

SEQ ID NO: 629992 - DNA, 25 bp, Mus musculus
gaaccggatgtaatttgttgctccg

SEQ ID NO: 629993 - DNA, 25 bp, Mus musculus
gaaccggatgtattttgttgctccg

SEQ ID NO: 629994 - DNA, 25 bp, Mus musculus
gaaccggcagtgaaaatgtccaggg

SEQ ID NO: 629995 - DNA, 25 bp, Mus musculus
gaaccggcagtgtaaatgtccaggg

SEQ ID NO: 629996 - DNA, 25 bp, Mus musculus
gaaccgggacttccggcataggcca

SEQ ID NO: 629997 - DNA, 25 bp, Mus musculus
gaaccgggacttgcggcataggcca

SEQ ID NO: 629998 - DNA, 25 bp, Mus musculus
gaaccgggtaccaggcagattgaag

SEQ ID NO: 629999 - DNA, 25 bp, Mus musculus
gaaccgggtacctggcagattgaag

SEQ ID NO: 630000 - DNA, 25 bp, Mus musculus
gaaccgggtcataatctatcaagaa

SEQ ID NO: 630001 - DNA, 25 bp, Mus musculus
gaaccgggtcattatctatcaagaa

SEQ ID NO: 630002 - DNA, 25 bp, Mus musculus
gaaccggtctgtctatgcattgccc

SEQ ID NO: 630003 - DNA, 25 bp, Mus musculus
gaaccggtctgtgtatgcattgccc

SEQ ID NO: 630004 - DNA, 25 bp, Mus musculus
gaaccgtaccaccacagtgcgctgg

SEQ ID NO: 630005 - DNA, 25 bp, Mus musculus
gaaccgtaccacgacagtgcgctgg

SEQ ID NO: 630006 - DNA, 25 bp, Mus musculus
gaaccgtagcctcacactccgagat

SEQ ID NO: 630007 - DNA, 25 bp, Mus musculus
gaaccgtagcctgacactccgagat

SEQ ID NO: 630008 - DNA, 25 bp, Mus musculus
gaaccgtattcaccttgttatcctg

SEQ ID NO: 630009 - DNA, 25 bp, Mus musculus
gaaccgtattcagcttgttatcctg

SEQ ID NO: 630010 - DNA, 25 bp, Mus musculus
gaaccgtccaacatcgttagaggct

SEQ ID NO: 630011 - DNA, 25 bp, Mus musculus
gaaccgtccaacttcgttagaggct

SEQ ID NO: 630012 - DNA, 25 bp, Mus musculus
gaaccgtgaggtactttaatgctga

SEQ ID NO: 630013 - DNA, 25 bp, Mus musculus
gaaccgtgaggttctttaatgctga

SEQ ID NO: 630014 - DNA, 25 bp, Mus musculus
gaaccgtgtataaaagtcgctgaag

SEQ ID NO: 630015 - DNA, 25 bp, Mus musculus
gaaccgtgtatataagtcgctgaag

SEQ ID NO: 630016 - DNA, 25 bp, Mus musculus
gaaccgtgtcctccagaactctagg

SEQ ID NO: 630017 - DNA, 25 bp, Mus musculus
gaaccgtgtcctgcagaactctagg

SEQ ID NO: 630018 - DNA, 25 bp, Mus musculus
gaaccgttagtgcaggttcatagaa

SEQ ID NO: 630019 - DNA, 25 bp, Mus musculus
gaaccgttagtggaggttcatagaa

SEQ ID NO: 630020 - DNA, 25 bp, Mus musculus
gaaccgttggtgctatttgttgaca

SEQ ID NO: 630021 - DNA, 25 bp, Mus musculus
gaaccgttggtggtatttgttgaca

SEQ ID NO: 630022 - DNA, 25 bp, Mus musculus
gaacctaacactcaggaaggtggaa

SEQ ID NO: 630023 - DNA, 25 bp, Mus musculus
gaacctaacactgaggaaggtggaa

SEQ ID NO: 630024 - DNA, 25 bp, Mus musculus
gaacctaattgtaagagctagcagc

SEQ ID NO: 630025 - DNA, 25 bp, Mus musculus
gaacctaattgtatcaaacaccgag

SEQ ID NO: 630026 - DNA, 25 bp, Mus musculus
gaacctaattgttagagctagcagc

SEQ ID NO: 630027 - DNA, 25 bp, Mus musculus
gaacctaattgtttcaaacaccgag

SEQ ID NO: 630028 - DNA, 25 bp, Mus musculus
gaacctaatttactcctctgtgaaa

SEQ ID NO: 630029 - DNA, 25 bp, Mus musculus
gaacctaatttagtcctctgtgaaa

SEQ ID NO: 630030 - DNA, 25 bp, Mus musculus
gaacctacagatccacatacacacg

SEQ ID NO: 630031 - DNA, 25 bp, Mus musculus
gaacctacagatgcacatacacacg

SEQ ID NO: 630032 - DNA, 25 bp, Mus musculus
gaacctactatcattcgaagagcct

SEQ ID NO: 630033 - DNA, 25 bp, Mus musculus
gaacctactatctttcgaagagcct

SEQ ID NO: 630034 - DNA, 25 bp, Mus musculus
gaacctactcggaaccacggctctg

SEQ ID NO: 630035 - DNA, 25 bp, Mus musculus
gaacctactcggtaccacggctctg

SEQ ID NO: 630036 - DNA, 25 bp, Mus musculus
gaacctacttccagtgcttatccta

SEQ ID NO: 630037 - DNA, 25 bp, Mus musculus
gaacctacttcctgtgcttatccta

SEQ ID NO: 630038 - DNA, 25 bp, Mus musculus
gaacctagagtcctaatcttaccct

SEQ ID NO: 630039 - DNA, 25 bp, Mus musculus
gaacctagagtcgtaatcttaccct

SEQ ID NO: 630040 - DNA, 25 bp, Mus musculus
gaacctagcaaacctgttccactga

SEQ ID NO: 630041 - DNA, 25 bp, Mus musculus
gaacctagcaaagctgttccactga

SEQ ID NO: 630042 - DNA, 25 bp, Mus musculus
gaacctagcctcacagtggtggtcc

SEQ ID NO: 630043 - DNA, 25 bp, Mus musculus
gaacctagcctccttcagttctaca

SEQ ID NO: 630044 - DNA, 25 bp, Mus musculus
gaacctagcctcgttcagttctaca

SEQ ID NO: 630045 - DNA, 25 bp, Mus musculus
gaacctagcctctcagtggtggtcc

SEQ ID NO: 630046 - DNA, 25 bp, Mus musculus
gaacctaggaaacaacactaagctc

SEQ ID NO: 630047 - DNA, 25 bp, Mus musculus
gaacctaggaaagaacactaagctc

SEQ ID NO: 630048 - DNA, 25 bp, Mus musculus
gaacctagggacatcctctctctgc

SEQ ID NO: 630049 - DNA, 25 bp, Mus musculus
gaacctagggacttcctctctctgc

SEQ ID NO: 630050 - DNA, 25 bp, Mus musculus
gaacctagtgctattggctaaacat

SEQ ID NO: 630051 - DNA, 25 bp, Mus musculus
gaacctagtgcttttggctaaacat

SEQ ID NO: 630052 - DNA, 25 bp, Mus musculus
gaacctagttgaacaactcaaaggg

SEQ ID NO: 630053 - DNA, 25 bp, Mus musculus
gaacctagttgatcaactcaaaggg

SEQ ID NO: 630054 - DNA, 25 bp, Mus musculus
gaacctatatctccctgattgctga

SEQ ID NO: 630055 - DNA, 25 bp, Mus musculus
gaacctatatctgcctgattgctga

SEQ ID NO: 630056 - DNA, 25 bp, Mus musculus
gaacctatgttaaatccgagagtgg

SEQ ID NO: 630057 - DNA, 25 bp, Mus musculus
gaacctatgttatatccgagagtgg

SEQ ID NO: 630058 - DNA, 25 bp, Mus musculus
gaacctcaaagactgcgggctcttc

SEQ ID NO: 630059 - DNA, 25 bp, Mus musculus
gaacctcaaagagtgcgggctcttc

SEQ ID NO: 630060 - DNA, 25 bp, Mus musculus
gaacctcaatgacgtgcttctcctc

SEQ ID NO: 630061 - DNA, 25 bp, Mus musculus
gaacctcaatgaggtgcttctcctc

SEQ ID NO: 630062 - DNA, 25 bp, Mus musculus
gaacctcaccaaaatctatgcgcca

SEQ ID NO: 630063 - DNA, 25 bp, Mus musculus
gaacctcaccaatatctatgcgcca

SEQ ID NO: 630064 - DNA, 25 bp, Mus musculus
gaacctcaccacacttcgagtatgg

SEQ ID NO: 630065 - DNA, 25 bp, Mus musculus
gaacctcaccactcttcgagtatgg

SEQ ID NO: 630066 - DNA, 25 bp, Mus musculus
gaacctcaccgacaaaatcaagaaa

SEQ ID NO: 630067 - DNA, 25 bp, Mus musculus
gaacctcaccgagaaaatcaagaaa

SEQ ID NO: 630068 - DNA, 25 bp, Mus musculus
gaacctcagaaacctacgagagctg

SEQ ID NO: 630069 - DNA, 25 bp, Mus musculus
gaacctcagaaagctacgagagctg

SEQ ID NO: 630070 - DNA, 25 bp, Mus musculus
gaacctcagacaagagcaaccaggc

SEQ ID NO: 630071 - DNA, 25 bp, Mus musculus
gaacctcagacatgagcaaccaggc

SEQ ID NO: 630072 - DNA, 25 bp, Mus musculus
gaacctcagcgaactgatcgacctg

SEQ ID NO: 630073 - DNA, 25 bp, Mus musculus
gaacctcagcgatctgatcgacctg

SEQ ID NO: 630074 - DNA, 25 bp, Mus musculus
gaacctcagcggctaccgaaagaac

SEQ ID NO: 630075 - DNA, 25 bp, Mus musculus
gaacctcagcgggtaccgaaagaac

SEQ ID NO: 630076 - DNA, 25 bp, Mus musculus
gaacctcaggctagacctgcagagg

SEQ ID NO: 630077 - DNA, 25 bp, Mus musculus
gaacctcaggcttgacctgcagagg

SEQ ID NO: 630078 - DNA, 25 bp, Mus musculus
gaacctcagttgcagcaccatgtgg

SEQ ID NO: 630079 - DNA, 25 bp, Mus musculus
gaacctcagttggagcaccatgtgg

SEQ ID NO: 630080 - DNA, 25 bp, Mus musculus
gaacctcatcagactctgatccagt

SEQ ID NO: 630081 - DNA, 25 bp, Mus musculus
gaacctcatcagtctctgatccagt

SEQ ID NO: 630082 - DNA, 25 bp, Mus musculus
gaacctcatcctaggaacgcatcgg

SEQ ID NO: 630083 - DNA, 25 bp, Mus musculus
gaacctcatccttggaacgcatcgg

SEQ ID NO: 630084 - DNA, 25 bp, Mus musculus
gaacctcattcacatccacggcagg

SEQ ID NO: 630085 - DNA, 25 bp, Mus musculus
gaacctcattcagatccacggcagg

SEQ ID NO: 630086 - DNA, 25 bp, Mus musculus
gaacctccaactcgtctggaagcta

SEQ ID NO: 630087 - DNA, 25 bp, Mus musculus
gaacctccaactggtctggaagcta

SEQ ID NO: 630088 - DNA, 25 bp, Mus musculus
gaacctccagatatgctttgtcaat

SEQ ID NO: 630089 - DNA, 25 bp, Mus musculus
gaacctccagatttgctttgtcaat

SEQ ID NO: 630090 - DNA, 25 bp, Mus musculus
gaacctcccaaaatgaccctaactg

SEQ ID NO: 630091 - DNA, 25 bp, Mus musculus
gaacctcccaaattgaccctaactg

SEQ ID NO: 630092 - DNA, 25 bp, Mus musculus
gaacctcccaacaatggcatcgtca

SEQ ID NO: 630093 - DNA, 25 bp, Mus musculus
gaacctcccaactatggcatcgtca

SEQ ID NO: 630094 - DNA, 25 bp, Mus musculus
gaacctccggctccaatggagctgt

SEQ ID NO: 630095 - DNA, 25 bp, Mus musculus
gaacctccggctgcaatggagctgt

SEQ ID NO: 630096 - DNA, 25 bp, Mus musculus
gaacctccggttagtgacagttcac

SEQ ID NO: 630097 - DNA, 25 bp, Mus musculus
gaacctccggtttgtgacagttcac

SEQ ID NO: 630098 - DNA, 25 bp, Mus musculus
gaacctccttatatccagagccagg

SEQ ID NO: 630099 - DNA, 25 bp, Mus musculus
gaacctccttatttccagagccagg

SEQ ID NO: 630100 - DNA, 25 bp, Mus musculus
gaacctcgacaacatggctgacgac

SEQ ID NO: 630101 - DNA, 25 bp, Mus musculus
gaacctcgacaagatggctgacgac

SEQ ID NO: 630102 - DNA, 25 bp, Mus musculus
gaacctcgacgtctatgaacagcaa

SEQ ID NO: 630103 - DNA, 25 bp, Mus musculus
gaacctcgacgtgtatgaacagcaa

SEQ ID NO: 630104 - DNA, 25 bp, Mus musculus
gaacctcgggagcagctcaaggtct

SEQ ID NO: 630105 - DNA, 25 bp, Mus musculus
gaacctcgggaggagctcaaggtct

SEQ ID NO: 630106 - DNA, 25 bp, Mus musculus
gaacctcgggatactatccaaagcc

SEQ ID NO: 630107 - DNA, 25 bp, Mus musculus
gaacctcgggattctatccaaagcc

SEQ ID NO: 630108 - DNA, 25 bp, Mus musculus
gaacctcggtctacggaatctagga

SEQ ID NO: 630109 - DNA, 25 bp, Mus musculus
gaacctcggtcttcggaatctagga

SEQ ID NO: 630110 - DNA, 25 bp, Mus musculus
gaacctcgtcttattgaggctcagg

SEQ ID NO: 630111 - DNA, 25 bp, Mus musculus
gaacctcgtctttttgaggctcagg

SEQ ID NO: 630112 - DNA, 25 bp, Mus musculus
gaacctcgtgaaaattaagcatgcc

SEQ ID NO: 630113 - DNA, 25 bp, Mus musculus
gaacctcgtgaatattaagcatgcc

SEQ ID NO: 630114 - DNA, 25 bp, Mus musculus
gaacctcgttctctggctgtgttcc

SEQ ID NO: 630115 - DNA, 25 bp, Mus musculus
gaacctcgttctgtggctgtgttcc

SEQ ID NO: 630116 - DNA, 25 bp, Mus musculus
gaacctctaaacatattttatgtgg

SEQ ID NO: 630117 - DNA, 25 bp, Mus musculus
gaacctctaaacttattttatgtgg

SEQ ID NO: 630118 - DNA, 25 bp, Mus musculus
gaacctctcatcagattctacagca

SEQ ID NO: 630119 - DNA, 25 bp, Mus musculus
gaacctctcatctgattctacagca

SEQ ID NO: 630120 - DNA, 25 bp, Mus musculus
gaacctctcatgctattgtgggact

SEQ ID NO: 630121 - DNA, 25 bp, Mus musculus
gaacctctcatggtattgtgggact

SEQ ID NO: 630122 - DNA, 25 bp, Mus musculus
gaacctctctcactcctctgaggta

SEQ ID NO: 630123 - DNA, 25 bp, Mus musculus
gaacctctctcagtcctctgaggta

SEQ ID NO: 630124 - DNA, 25 bp, Mus musculus
gaacctctgccccaaacactagaga

SEQ ID NO: 630125 - DNA, 25 bp, Mus musculus
gaacctctgcccgaaacactagaga

SEQ ID NO: 630126 - DNA, 25 bp, Mus musculus
gaacctctgcggctgataccactta

SEQ ID NO: 630127 - DNA, 25 bp, Mus musculus
gaacctctgcgggtgataccactta

SEQ ID NO: 630128 - DNA, 25 bp, Mus musculus
gaacctctggagatggaagtacccc

SEQ ID NO: 630129 - DNA, 25 bp, Mus musculus
gaacctctggagttggaagtacccc

SEQ ID NO: 630130 - DNA, 25 bp, Mus musculus
gaacctcttcctacgggagctgacc

SEQ ID NO: 630131 - DNA, 25 bp, Mus musculus
gaacctcttccttcgggagctgacc

SEQ ID NO: 630132 - DNA, 25 bp, Mus musculus
gaacctctttgaactgggtggccag

SEQ ID NO: 630133 - DNA, 25 bp, Mus musculus
gaacctctttgatctgggtggccag

SEQ ID NO: 630134 - DNA, 25 bp, Mus musculus
gaacctcttttaaaatggcgtagat

SEQ ID NO: 630135 - DNA, 25 bp, Mus musculus
gaacctcttttaaaccacacctggg

SEQ ID NO: 630136 - DNA, 25 bp, Mus musculus
gaacctcttttataatggcgtagat

SEQ ID NO: 630137 - DNA, 25 bp, Mus musculus
gaacctcttttataccacacctggg

SEQ ID NO: 630138 - DNA, 25 bp, Mus musculus
gaacctgaaagcaaagaccgagtgg

SEQ ID NO: 630139 - DNA, 25 bp, Mus musculus
gaacctgaaagctaagaccgagtgg

SEQ ID NO: 630140 - DNA, 25 bp, Mus musculus
gaacctgaacaactcacaaagcaac

SEQ ID NO: 630141 - DNA, 25 bp, Mus musculus
gaacctgaacaagtcacaaagcaac

SEQ ID NO: 630142 - DNA, 25 bp, Mus musculus
gaacctgaagccaattggctctggg

SEQ ID NO: 630143 - DNA, 25 bp, Mus musculus
gaacctgaagcctattggctctggg

SEQ ID NO: 630144 - DNA, 25 bp, Mus musculus
gaacctgaagttaaaggctgaggga

SEQ ID NO: 630145 - DNA, 25 bp, Mus musculus
gaacctgaagtttaaggctgaggga

SEQ ID NO: 630146 - DNA, 25 bp, Mus musculus
gaacctgaataaatctaagacgcca

SEQ ID NO: 630147 - DNA, 25 bp, Mus musculus
gaacctgaataattctaagacgcca

SEQ ID NO: 630148 - DNA, 25 bp, Mus musculus
gaacctgaatgaacctgaaagcaaa

SEQ ID NO: 630149 - DNA, 25 bp, Mus musculus
gaacctgaatgatcctgaaagcaaa

SEQ ID NO: 630150 - DNA, 25 bp, Mus musculus
gaacctgacagaactcgatctaatg

SEQ ID NO: 630151 - DNA, 25 bp, Mus musculus
gaacctgacagatctcgatctaatg

SEQ ID NO: 630152 - DNA, 25 bp, Mus musculus
gaacctgactccctgtgtgctaatg

SEQ ID NO: 630153 - DNA, 25 bp, Mus musculus
gaacctgactccgtgtgtgctaatg

SEQ ID NO: 630154 - DNA, 25 bp, Mus musculus
gaacctgagcctattaggaattgct

SEQ ID NO: 630155 - DNA, 25 bp, Mus musculus
gaacctgagccttttaggaattgct

SEQ ID NO: 630156 - DNA, 25 bp, Mus musculus
gaacctgataggagaccaagccagc

SEQ ID NO: 630157 - DNA, 25 bp, Mus musculus
gaacctgataggtgaccaagccagc

SEQ ID NO: 630158 - DNA, 25 bp, Mus musculus
gaacctgatcgacctgcacaacaag

SEQ ID NO: 630159 - DNA, 25 bp, Mus musculus
gaacctgatcgagctgcacaacaag

SEQ ID NO: 630160 - DNA, 25 bp, Mus musculus
gaacctgatcgcaaaaaaggaaaag

SEQ ID NO: 630161 - DNA, 25 bp, Mus musculus
gaacctgatcgctaaaaaggaaaag

SEQ ID NO: 630162 - DNA, 25 bp, Mus musculus
gaacctgatgccaaactggcccgtg

SEQ ID NO: 630163 - DNA, 25 bp, Mus musculus
gaacctgatgcctaactggcccgtg

SEQ ID NO: 630164 - DNA, 25 bp, Mus musculus
gaacctgccagaagtgtctgctaag

SEQ ID NO: 630165 - DNA, 25 bp, Mus musculus
gaacctgccagatgtgtctgctaag

SEQ ID NO: 630166 - DNA, 25 bp, Mus musculus
gaacctgccgacctgaccagtttga

SEQ ID NO: 630167 - DNA, 25 bp, Mus musculus
gaacctgccgacgtgaccagtttga

SEQ ID NO: 630168 - DNA, 25 bp, Mus musculus
gaacctgcctctacttggtggcgtg

SEQ ID NO: 630169 - DNA, 25 bp, Mus musculus
gaacctgcctcttcttggtggcgtg

SEQ ID NO: 630170 - DNA, 25 bp, Mus musculus
gaacctgcgagaagaccttcttcag

SEQ ID NO: 630171 - DNA, 25 bp, Mus musculus
gaacctgcgagatgaccttcttcag

SEQ ID NO: 630172 - DNA, 25 bp, Mus musculus
gaacctgcgcatagtggtgattgac

SEQ ID NO: 630173 - DNA, 25 bp, Mus musculus
gaacctgcgcattgtggtgattgac

SEQ ID NO: 630174 - DNA, 25 bp, Mus musculus
gaacctgcgtgtacagaggcgctga

SEQ ID NO: 630175 - DNA, 25 bp, Mus musculus
gaacctgcgtgttcagaggcgctga

SEQ ID NO: 630176 - DNA, 25 bp, Mus musculus
gaacctgctacaacgcgccatgcag

SEQ ID NO: 630177 - DNA, 25 bp, Mus musculus
gaacctgctacatcgcgccatgcag

SEQ ID NO: 630178 - DNA, 25 bp, Mus musculus
gaacctgctagcagtgggcatcttt

SEQ ID NO: 630179 - DNA, 25 bp, Mus musculus
gaacctgctagctgtgggcatcttt

SEQ ID NO: 630180 - DNA, 25 bp, Mus musculus
gaacctgctcgacggccaggatgct

SEQ ID NO: 630181 - DNA, 25 bp, Mus musculus
gaacctgctcgagggccaggatgct

SEQ ID NO: 630182 - DNA, 25 bp, Mus musculus
gaacctgctgatcttggactccgaa

SEQ ID NO: 630183 - DNA, 25 bp, Mus musculus
gaacctgctgatgttggactccgaa

SEQ ID NO: 630184 - DNA, 25 bp, Mus musculus
gaacctgctggcaactgagtgcccg

SEQ ID NO: 630185 - DNA, 25 bp, Mus musculus
gaacctgctggctactgagtgcccg

SEQ ID NO: 630186 - DNA, 25 bp, Mus musculus
gaacctggaacactccactgaacgg

SEQ ID NO: 630187 - DNA, 25 bp, Mus musculus
gaacctggaacagtccactgaacgg

SEQ ID NO: 630188 - DNA, 25 bp, Mus musculus
gaacctggaacccaatgaaaccttg

SEQ ID NO: 630189 - DNA, 25 bp, Mus musculus
gaacctggaaccgaatgaaaccttg

SEQ ID NO: 630190 - DNA, 25 bp, Mus musculus
gaacctggaaggcagctacaagtgt

SEQ ID NO: 630191 - DNA, 25 bp, Mus musculus
gaacctggaagggagctacaagtgt

SEQ ID NO: 630192 - DNA, 25 bp, Mus musculus
gaacctggagtcatgtttacttgtt

SEQ ID NO: 630193 - DNA, 25 bp, Mus musculus
gaacctggagtcttgtttacttgtt

SEQ ID NO: 630194 - DNA, 25 bp, Mus musculus
gaacctggatgactgtgcagctgcc

SEQ ID NO: 630195 - DNA, 25 bp, Mus musculus
gaacctggatgagtgtgcagctgcc

SEQ ID NO: 630196 - DNA, 25 bp, Mus musculus
gaacctggcccacaagacgaactct

SEQ ID NO: 630197 - DNA, 25 bp, Mus musculus
gaacctggcccagaagacgaactct

SEQ ID NO: 630198 - DNA, 25 bp, Mus musculus
gaacctggccctatttcaaataatg

SEQ ID NO: 630199 - DNA, 25 bp, Mus musculus
gaacctggccctttttcaaataatg

SEQ ID NO: 630200 - DNA, 25 bp, Mus musculus
gaacctgggatcagaaccaaagccc

SEQ ID NO: 630201 - DNA, 25 bp, Mus musculus
gaacctgggatctgaaccaaagccc

SEQ ID NO: 630202 - DNA, 25 bp, Mus musculus
gaacctgggcaaattgcagttttct

SEQ ID NO: 630203 - DNA, 25 bp, Mus musculus
gaacctgggcaatttgcagttttct

SEQ ID NO: 630204 - DNA, 25 bp, Mus musculus
gaacctgggcataggcaagatcact

SEQ ID NO: 630205 - DNA, 25 bp, Mus musculus
gaacctgggcattggcaagatcact

SEQ ID NO: 630206 - DNA, 25 bp, Mus musculus
gaacctggtattacctatgttttct

SEQ ID NO: 630207 - DNA, 25 bp, Mus musculus
gaacctggtatttcctatgttttct

SEQ ID NO: 630208 - DNA, 25 bp, Mus musculus
gaacctggtgaaaatgagcaccgcc

SEQ ID NO: 630209 - DNA, 25 bp, Mus musculus
gaacctggtgaatatgagcaccgcc

SEQ ID NO: 630210 - DNA, 25 bp, Mus musculus
gaacctggtgctcactggcttctcc

SEQ ID NO: 630211 - DNA, 25 bp, Mus musculus
gaacctggtgctgactggcttctcc

SEQ ID NO: 630212 - DNA, 25 bp, Mus musculus
gaacctgtacagatggaaacattga

SEQ ID NO: 630213 - DNA, 25 bp, Mus musculus
gaacctgtacagttggaaacattga

SEQ ID NO: 630214 - DNA, 25 bp, Mus musculus
gaacctgtaccacttgctatcttag

SEQ ID NO: 630215 - DNA, 25 bp, Mus musculus
gaacctgtaccagttgctatcttag

SEQ ID NO: 630216 - DNA, 25 bp, Mus musculus
gaacctgtcagcattccgtcgagag

SEQ ID NO: 630217 - DNA, 25 bp, Mus musculus
gaacctgtcagctttccgtcgagag

SEQ ID NO: 630218 - DNA, 25 bp, Mus musculus
gaacctgtccataaatgagattatg

SEQ ID NO: 630219 - DNA, 25 bp, Mus musculus
gaacctgtccattaatgagattatg

SEQ ID NO: 630220 - DNA, 25 bp, Mus musculus
gaacctgtctagcagctggcatgat

SEQ ID NO: 630221 - DNA, 25 bp, Mus musculus
gaacctgtctaggagctggcatgat

SEQ ID NO: 630222 - DNA, 25 bp, Mus musculus
gaacctgtctccagcgctctgagag

SEQ ID NO: 630223 - DNA, 25 bp, Mus musculus
gaacctgtctcctgcgctctgagag

SEQ ID NO: 630224 - DNA, 25 bp, Mus musculus
gaacctgtgccgagaagaagccaaa

SEQ ID NO: 630225 - DNA, 25 bp, Mus musculus
gaacctgtgccgtgaagaagccaaa

SEQ ID NO: 630226 - DNA, 25 bp, Mus musculus
gaacctgtgctgattgccaccacga

SEQ ID NO: 630227 - DNA, 25 bp, Mus musculus
gaacctgtgctgtttgccaccacga

SEQ ID NO: 630228 - DNA, 25 bp, Mus musculus
gaacctgtgtgacgcaattctgcag

SEQ ID NO: 630229 - DNA, 25 bp, Mus musculus
gaacctgtgtgaggcaattctgcag

SEQ ID NO: 630230 - DNA, 25 bp, Mus musculus
gaacctgtgtgtcatatccatgcag

SEQ ID NO: 630231 - DNA, 25 bp, Mus musculus
gaacctgtgtgtgatatccatgcag

SEQ ID NO: 630232 - DNA, 25 bp, Mus musculus
gaacctgttacacacagcggtgccg

SEQ ID NO: 630233 - DNA, 25 bp, Mus musculus
gaacctgttacagacagcggtgccg

SEQ ID NO: 630234 - DNA, 25 bp, Mus musculus
gaacctgttccacgcattccttaac

SEQ ID NO: 630235 - DNA, 25 bp, Mus musculus
gaacctgttccaggcattccttaac

SEQ ID NO: 630236 - DNA, 25 bp, Mus musculus
gaacctgttcgaactcctgtccact

SEQ ID NO: 630237 - DNA, 25 bp, Mus musculus
gaacctgttcgatctcctgtccact

SEQ ID NO: 630238 - DNA, 25 bp, Mus musculus
gaacctgttctgcttcgaacaccga

SEQ ID NO: 630239 - DNA, 25 bp, Mus musculus
gaacctgttctggttcgaacaccga

SEQ ID NO: 630240 - DNA, 25 bp, Mus musculus
gaacctgtttgcctatggtacatac

SEQ ID NO: 630241 - DNA, 25 bp, Mus musculus
gaacctgtttgcgtatggtacatac

SEQ ID NO: 630242 - DNA, 25 bp, Mus musculus
gaaccttaaagtcattgccctggca

SEQ ID NO: 630243 - DNA, 25 bp, Mus musculus
gaaccttaaagtgattgccctggca

SEQ ID NO: 630244 - DNA, 25 bp, Mus musculus
gaaccttacactccagagctctcgt

SEQ ID NO: 630245 - DNA, 25 bp, Mus musculus
gaaccttacactgcagagctctcgt

SEQ ID NO: 630246 - DNA, 25 bp, Mus musculus
gaaccttagcttctgggatgcccct

SEQ ID NO: 630247 - DNA, 25 bp, Mus musculus
gaaccttagcttgtgggatgcccct

SEQ ID NO: 630248 - DNA, 25 bp, Mus musculus
gaaccttatcggcttcatgaaagcc

SEQ ID NO: 630249 - DNA, 25 bp, Mus musculus
gaaccttatcgggttcatgaaagcc

SEQ ID NO: 630250 - DNA, 25 bp, Mus musculus
gaaccttattccaagaagcccaaag

SEQ ID NO: 630251 - DNA, 25 bp, Mus musculus
gaaccttattcctagaagcccaaag

SEQ ID NO: 630252 - DNA, 25 bp, Mus musculus
gaaccttattctacaagcctaatgg

SEQ ID NO: 630253 - DNA, 25 bp, Mus musculus
gaaccttattcttcaagcctaatgg

SEQ ID NO: 630254 - DNA, 25 bp, Mus musculus
gaaccttcacaactttggtgggagg

SEQ ID NO: 630255 - DNA, 25 bp, Mus musculus
gaaccttcacaagtttggtgggagg

SEQ ID NO: 630256 - DNA, 25 bp, Mus musculus
gaaccttcagcgcaaacatgcggca

SEQ ID NO: 630257 - DNA, 25 bp, Mus musculus
gaaccttcagcggaaacatgcggca

SEQ ID NO: 630258 - DNA, 25 bp, Mus musculus
gaaccttcaggacctcttagaatta

SEQ ID NO: 630259 - DNA, 25 bp, Mus musculus
gaaccttcaggagctcttagaatta

SEQ ID NO: 630260 - DNA, 25 bp, Mus musculus
gaaccttcaggcaggagcggacctg

SEQ ID NO: 630261 - DNA, 25 bp, Mus musculus
gaaccttcaggctggagcggacctg

SEQ ID NO: 630262 - DNA, 25 bp, Mus musculus
gaaccttcattgagattgacatcct

SEQ ID NO: 630263 - DNA, 25 bp, Mus musculus
gaaccttcattgtgattgacatcct

SEQ ID NO: 630264 - DNA, 25 bp, Mus musculus
gaaccttccggacggtacagagcgc

SEQ ID NO: 630265 - DNA, 25 bp, Mus musculus
gaaccttccggagggtacagagcgc

SEQ ID NO: 630266 - DNA, 25 bp, Mus musculus
gaaccttcctgaccagtgtaactca

SEQ ID NO: 630267 - DNA, 25 bp, Mus musculus
gaaccttcctgagcagtgtaactca

SEQ ID NO: 630268 - DNA, 25 bp, Mus musculus
gaaccttcgggaagccgaaacaggg

SEQ ID NO: 630269 - DNA, 25 bp, Mus musculus
gaaccttcgggatgccgaaacaggg

SEQ ID NO: 630270 - DNA, 25 bp, Mus musculus
gaaccttctgaacagcctaatcggc

SEQ ID NO: 630271 - DNA, 25 bp, Mus musculus
gaaccttctgaagagcctaatcggc

SEQ ID NO: 630272 - DNA, 25 bp, Mus musculus
gaaccttctgcacgtggatctcacc

SEQ ID NO: 630273 - DNA, 25 bp, Mus musculus
gaaccttctgcaggtggatctcacc

SEQ ID NO: 630274 - DNA, 25 bp, Mus musculus
gaaccttctgggatttccttctttg

SEQ ID NO: 630275 - DNA, 25 bp, Mus musculus
gaaccttctgggttttccttctttg

SEQ ID NO: 630276 - DNA, 25 bp, Mus musculus
gaaccttgaagaatatgacccgcct

SEQ ID NO: 630277 - DNA, 25 bp, Mus musculus
gaaccttgaagattatgacccgcct

SEQ ID NO: 630278 - DNA, 25 bp, Mus musculus
gaaccttgactcagagacatcggcc

SEQ ID NO: 630279 - DNA, 25 bp, Mus musculus
gaaccttgactctgagacatcggcc

SEQ ID NO: 630280 - DNA, 25 bp, Mus musculus
gaaccttgaggcagtgaagggccat

SEQ ID NO: 630281 - DNA, 25 bp, Mus musculus
gaaccttgaggctgtgaagggccat

SEQ ID NO: 630282 - DNA, 25 bp, Mus musculus
gaaccttgcctacataggtgccgta

SEQ ID NO: 630283 - DNA, 25 bp, Mus musculus
gaaccttgcctagataggtgccgta

SEQ ID NO: 630284 - DNA, 25 bp, Mus musculus
gaaccttggaaactcatatagctgg

SEQ ID NO: 630285 - DNA, 25 bp, Mus musculus
gaaccttggaaagtcatatagctgg

SEQ ID NO: 630286 - DNA, 25 bp, Mus musculus
gaaccttggaatctctgaggcacat

SEQ ID NO: 630287 - DNA, 25 bp, Mus musculus
gaaccttggaatgtctgaggcacat

SEQ ID NO: 630288 - DNA, 25 bp, Mus musculus
gaaccttggcctcaaaatgcgacct

SEQ ID NO: 630289 - DNA, 25 bp, Mus musculus
gaaccttggcctgaaaatgcgacct

SEQ ID NO: 630290 - DNA, 25 bp, Mus musculus
gaaccttgtgctatagtgactccca

SEQ ID NO: 630291 - DNA, 25 bp, Mus musculus
gaaccttgtgctttagtgactccca

SEQ ID NO: 630292 - DNA, 25 bp, Mus musculus
gaaccttgtggaaccatctgatcca

SEQ ID NO: 630293 - DNA, 25 bp, Mus musculus
gaaccttgtggatccatctgatcca

SEQ ID NO: 630294 - DNA, 25 bp, Mus musculus
gaaccttgtgtgctctcatcgggcc

SEQ ID NO: 630295 - DNA, 25 bp, Mus musculus
gaaccttgtgtggtctcatcgggcc

SEQ ID NO: 630296 - DNA, 25 bp, Mus musculus
gaaccttgttatcttgtgaacgcct

SEQ ID NO: 630297 - DNA, 25 bp, Mus musculus
gaaccttgttatgttgtgaacgcct

SEQ ID NO: 630298 - DNA, 25 bp, Mus musculus
gaacctttaatcagagaagtaacct

SEQ ID NO: 630299 - DNA, 25 bp, Mus musculus
gaacctttaatctgagaagtaacct

SEQ ID NO: 630300 - DNA, 25 bp, Mus musculus
gaacctttactgagcaagtttgcgg

SEQ ID NO: 630301 - DNA, 25 bp, Mus musculus
gaacctttactgtgcaagtttgcgg

SEQ ID NO: 630302 - DNA, 25 bp, Mus musculus
gaacctttcactcgtctggcaatga

SEQ ID NO: 630303 - DNA, 25 bp, Mus musculus
gaacctttcactggtctggcaatga

SEQ ID NO: 630304 - DNA, 25 bp, Mus musculus
gaacctttgctgcaggaggctacat

SEQ ID NO: 630305 - DNA, 25 bp, Mus musculus
gaacctttgctggaggaggctacat

SEQ ID NO: 630306 - DNA, 25 bp, Mus musculus
gaaccttttacaccccattggtcag

SEQ ID NO: 630307 - DNA, 25 bp, Mus musculus
gaaccttttacagcccattggtcag

SEQ ID NO: 630308 - DNA, 25 bp, Mus musculus
gaaccttttgcaccagggcctatgg

SEQ ID NO: 630309 - DNA, 25 bp, Mus musculus
gaaccttttgcagcagggcctatgg

SEQ ID NO: 630310 - DNA, 25 bp, Mus musculus
gaacgaaaacgtacgtgcaggagca

SEQ ID NO: 630311 - DNA, 25 bp, Mus musculus
gaacgaaaacgttcgtgcaggagca

SEQ ID NO: 630312 - DNA, 25 bp, Mus musculus
gaacgaaactgactgcaatcccctg

SEQ ID NO: 630313 - DNA, 25 bp, Mus musculus
gaacgaaactgagtgcaatcccctg

SEQ ID NO: 630314 - DNA, 25 bp, Mus musculus
gaacgaaatgttacgggagtcgcag

SEQ ID NO: 630315 - DNA, 25 bp, Mus musculus
gaacgaaatgtttcgggagtcgcag

SEQ ID NO: 630316 - DNA, 25 bp, Mus musculus
gaacgaacattcagctcgcttcaag

SEQ ID NO: 630317 - DNA, 25 bp, Mus musculus
gaacgaacattctgctcgcttcaag

SEQ ID NO: 630318 - DNA, 25 bp, Mus musculus
gaacgaagagctctactccagaacc

SEQ ID NO: 630319 - DNA, 25 bp, Mus musculus
gaacgaagagctgtactccagaacc

SEQ ID NO: 630320 - DNA, 25 bp, Mus musculus
gaacgaagatgacctctctttcaag

SEQ ID NO: 630321 - DNA, 25 bp, Mus musculus
gaacgaagatgagctctctttcaag

SEQ ID NO: 630322 - DNA, 25 bp, Mus musculus
gaacgaagcctccagacacagacca

SEQ ID NO: 630323 - DNA, 25 bp, Mus musculus
gaacgaagcctcgagacacagacca

SEQ ID NO: 630324 - DNA, 25 bp, Mus musculus
gaacgaattgatactcaaaatcgag

SEQ ID NO: 630325 - DNA, 25 bp, Mus musculus
gaacgaattgattctcaaaatcgag

SEQ ID NO: 630326 - DNA, 25 bp, Mus musculus
gaacgacagctcaggaagctcatct

SEQ ID NO: 630327 - DNA, 25 bp, Mus musculus
gaacgacagctctggaagctcatct

SEQ ID NO: 630328 - DNA, 25 bp, Mus musculus
gaacgacaggatacgattccaggcc

SEQ ID NO: 630329 - DNA, 25 bp, Mus musculus
gaacgacaggattcgattccaggcc

SEQ ID NO: 630330 - DNA, 25 bp, Mus musculus
gaacgacaggtgaaaacaacaaagg

SEQ ID NO: 630331 - DNA, 25 bp, Mus musculus
gaacgacaggtgtaaacaacaaagg

SEQ ID NO: 630332 - DNA, 25 bp, Mus musculus
gaacgacagtatcacctgcggctct

SEQ ID NO: 630333 - DNA, 25 bp, Mus musculus
gaacgacagtatgacctgcggctct

SEQ ID NO: 630334 - DNA, 25 bp, Mus musculus
gaacgaccaagtcaccttgctaaag

SEQ ID NO: 630335 - DNA, 25 bp, Mus musculus
gaacgaccaagtgaccttgctaaag

SEQ ID NO: 630336 - DNA, 25 bp, Mus musculus
gaacgacccttcatttggatcctat

SEQ ID NO: 630337 - DNA, 25 bp, Mus musculus
gaacgacccttcttttggatcctat

SEQ ID NO: 630338 - DNA, 25 bp, Mus musculus
gaacgacgactgacataccgtgcac

SEQ ID NO: 630339 - DNA, 25 bp, Mus musculus
gaacgacgactgtcataccgtgcac

SEQ ID NO: 630340 - DNA, 25 bp, Mus musculus
gaacgactacgtccacgcgctggtg

SEQ ID NO: 630341 - DNA, 25 bp, Mus musculus
gaacgactacgtgcacgcgctggtg

SEQ ID NO: 630342 - DNA, 25 bp, Mus musculus
gaacgactccgcaaagagagacaaa

SEQ ID NO: 630343 - DNA, 25 bp, Mus musculus
gaacgactccgctaagagagacaaa

SEQ ID NO: 630344 - DNA, 25 bp, Mus musculus
gaacgactggaaactaataactaca

SEQ ID NO: 630345 - DNA, 25 bp, Mus musculus
gaacgactggaatctaataactaca

SEQ ID NO: 630346 - DNA, 25 bp, Mus musculus
gaacgactggctcccctttgagctg

SEQ ID NO: 630347 - DNA, 25 bp, Mus musculus
gaacgactggctgccctttgagctg

SEQ ID NO: 630348 - DNA, 25 bp, Mus musculus
gaacgacttgcaacagtggatcgaa

SEQ ID NO: 630349 - DNA, 25 bp, Mus musculus
gaacgacttgcatcagtggatcgaa

SEQ ID NO: 630350 - DNA, 25 bp, Mus musculus
gaacgagaaggactataaccctggc

SEQ ID NO: 630351 - DNA, 25 bp, Mus musculus
gaacgagaaggagtataaccctggc

SEQ ID NO: 630352 - DNA, 25 bp, Mus musculus
gaacgagaagtgacacgaacactac

SEQ ID NO: 630353 - DNA, 25 bp, Mus musculus
gaacgagaagtgtcacgaacactac

SEQ ID NO: 630354 - DNA, 25 bp, Mus musculus
gaacgagacagaacacctcaacatg

SEQ ID NO: 630355 - DNA, 25 bp, Mus musculus
gaacgagacagatcacctcaacatg

SEQ ID NO: 630356 - DNA, 25 bp, Mus musculus
gaacgagacattaaagaaagcactg

SEQ ID NO: 630357 - DNA, 25 bp, Mus musculus
gaacgagacatttaagaaagcactg

SEQ ID NO: 630358 - DNA, 25 bp, Mus musculus
gaacgagactcaacttctgaaaagg

SEQ ID NO: 630359 - DNA, 25 bp, Mus musculus
gaacgagactcatcttctgaaaagg

SEQ ID NO: 630360 - DNA, 25 bp, Mus musculus
gaacgagagagacaagaactgagaa

SEQ ID NO: 630361 - DNA, 25 bp, Mus musculus
gaacgagagagagaagaactgagaa

SEQ ID NO: 630362 - DNA, 25 bp, Mus musculus
gaacgagagcatctataaagtttgc

SEQ ID NO: 630363 - DNA, 25 bp, Mus musculus
gaacgagagcatgtataaagtttgc

SEQ ID NO: 630364 - DNA, 25 bp, Mus musculus
gaacgagagtcactgggtctccctt

SEQ ID NO: 630365 - DNA, 25 bp, Mus musculus
gaacgagagtcagtgggtctccctt

SEQ ID NO: 630366 - DNA, 25 bp, Mus musculus
gaacgagcactgaaaggtccagacc

SEQ ID NO: 630367 - DNA, 25 bp, Mus musculus
gaacgagcactgtaaggtccagacc

SEQ ID NO: 630368 - DNA, 25 bp, Mus musculus
gaacgagccaaacctgctgatcgac

SEQ ID NO: 630369 - DNA, 25 bp, Mus musculus
gaacgagccaaagctgctgatcgac

SEQ ID NO: 630370 - DNA, 25 bp, Mus musculus
gaacgagcccggatgttgcagaaac

SEQ ID NO: 630371 - DNA, 25 bp, Mus musculus
gaacgagcccggttgttgcagaaac

SEQ ID NO: 630372 - DNA, 25 bp, Mus musculus
gaacgagcctctcaggtaagcccca

SEQ ID NO: 630373 - DNA, 25 bp, Mus musculus
gaacgagcctctgaggtaagcccca

SEQ ID NO: 630374 - DNA, 25 bp, Mus musculus
gaacgagctgggagatgcaactgcc

SEQ ID NO: 630375 - DNA, 25 bp, Mus musculus
gaacgagctgggtgatgcaactgcc

SEQ ID NO: 630376 - DNA, 25 bp, Mus musculus
gaacgaggtgctaagcatgaagcct

SEQ ID NO: 630377 - DNA, 25 bp, Mus musculus
gaacgaggtgcttagcatgaagcct

SEQ ID NO: 630378 - DNA, 25 bp, Mus musculus
gaacgaggttgaacgcagcattcag

SEQ ID NO: 630379 - DNA, 25 bp, Mus musculus
gaacgaggttgatcgcagcattcag

SEQ ID NO: 630380 - DNA, 25 bp, Mus musculus
gaacgagtgtgacctcatgatggca

SEQ ID NO: 630381 - DNA, 25 bp, Mus musculus
gaacgagtgtgagctcatgatggca

SEQ ID NO: 630382 - DNA, 25 bp, Mus musculus
gaacgagttagtacaactcgagaaa

SEQ ID NO: 630383 - DNA, 25 bp, Mus musculus
gaacgagttagttcaactcgagaaa

SEQ ID NO: 630384 - DNA, 25 bp, Mus musculus
gaacgagttcaactacttccaaaga

SEQ ID NO: 630385 - DNA, 25 bp, Mus musculus
gaacgagttcaagtacttccaaaga

SEQ ID NO: 630386 - DNA, 25 bp, Mus musculus
gaacgagttccactgtagagacgga

SEQ ID NO: 630387 - DNA, 25 bp, Mus musculus
gaacgagttccagtgtagagacgga

SEQ ID NO: 630388 - DNA, 25 bp, Mus musculus
gaacgagttgataaagtaaagaaga

SEQ ID NO: 630389 - DNA, 25 bp, Mus musculus
gaacgagttgattaagtaaagaaga

SEQ ID NO: 630390 - DNA, 25 bp, Mus musculus
gaacgatactgaaagaacgggctcg

SEQ ID NO: 630391 - DNA, 25 bp, Mus musculus
gaacgatactgatagaacgggctcg

SEQ ID NO: 630392 - DNA, 25 bp, Mus musculus
gaacgatccgttctctcggaagtga

SEQ ID NO: 630393 - DNA, 25 bp, Mus musculus
gaacgatccgttgtctcggaagtga

SEQ ID NO: 630394 - DNA, 25 bp, Mus musculus
gaacgatcgtctacctggatggctc

SEQ ID NO: 630395 - DNA, 25 bp, Mus musculus
gaacgatcgtcttcctggatggctc

SEQ ID NO: 630396 - DNA, 25 bp, Mus musculus
gaacgatgacatcttggcacgagcc

SEQ ID NO: 630397 - DNA, 25 bp, Mus musculus
gaacgatgacatgttggcacgagcc

SEQ ID NO: 630398 - DNA, 25 bp, Mus musculus
gaacgatgacgaactagccttcagc

SEQ ID NO: 630399 - DNA, 25 bp, Mus musculus
gaacgatgacgatctagccttcagc

SEQ ID NO: 630400 - DNA, 25 bp, Mus musculus
gaacgatgccccacaaggtggtgga

SEQ ID NO: 630401 - DNA, 25 bp, Mus musculus
gaacgatgcccctcaaggtggtgga

SEQ ID NO: 630402 - DNA, 25 bp, Mus musculus
gaacgatgctctcagcatccgggag

SEQ ID NO: 630403 - DNA, 25 bp, Mus musculus
gaacgatgctctgagcatccgggag

SEQ ID NO: 630404 - DNA, 25 bp, Mus musculus
gaacgatggagacacacttcagggt

SEQ ID NO: 630405 - DNA, 25 bp, Mus musculus
gaacgatggagagacacttcagggt

SEQ ID NO: 630406 - DNA, 25 bp, Mus musculus
gaacgatggcacctttattggctac

SEQ ID NO: 630407 - DNA, 25 bp, Mus musculus
gaacgatggcacgtttattggctac

SEQ ID NO: 630408 - DNA, 25 bp, Mus musculus
gaacgatggtggcatcagacagatc

SEQ ID NO: 630409 - DNA, 25 bp, Mus musculus
gaacgatggtgggatcagacagatc

SEQ ID NO: 630410 - DNA, 25 bp, Mus musculus
gaacgatggtttctttgcagtgcac

SEQ ID NO: 630411 - DNA, 25 bp, Mus musculus
gaacgatggtttgtttgcagtgcac

SEQ ID NO: 630412 - DNA, 25 bp, Mus musculus
gaacgatgtcaactttgagaacatg

SEQ ID NO: 630413 - DNA, 25 bp, Mus musculus
gaacgatgtcaagtttgagaacatg

SEQ ID NO: 630414 - DNA, 25 bp, Mus musculus
gaacgatgtggacaatgagctcttg

SEQ ID NO: 630415 - DNA, 25 bp, Mus musculus
gaacgatgtggagaatgagctcttg

SEQ ID NO: 630416 - DNA, 25 bp, Mus musculus
gaacgattgtaaaaatagagccacc

SEQ ID NO: 630417 - DNA, 25 bp, Mus musculus
gaacgattgtaataatagagccacc

SEQ ID NO: 630418 - DNA, 25 bp, Mus musculus
gaacgcaacactatacctgaatcct

SEQ ID NO: 630419 - DNA, 25 bp, Mus musculus
gaacgcaacactttacctgaatcct

SEQ ID NO: 630420 - DNA, 25 bp, Mus musculus
gaacgcaagcggctagatgacctat

SEQ ID NO: 630421 - DNA, 25 bp, Mus musculus
gaacgcaagcgggtagatgacctat

SEQ ID NO: 630422 - DNA, 25 bp, Mus musculus
gaacgcaaggacacacggaacccca

SEQ ID NO: 630423 - DNA, 25 bp, Mus musculus
gaacgcaaggactcacggaacccca

SEQ ID NO: 630424 - DNA, 25 bp, Mus musculus
gaacgcaagttcagcccctggattg

SEQ ID NO: 630425 - DNA, 25 bp, Mus musculus
gaacgcaagttctgcccctggattg

SEQ ID NO: 630426 - DNA, 25 bp, Mus musculus
gaacgcacgtgcaaacagcagcata

SEQ ID NO: 630427 - DNA, 25 bp, Mus musculus
gaacgcacgtgctaacagcagcata

SEQ ID NO: 630428 - DNA, 25 bp, Mus musculus
gaacgcagacatctctgaggacatg

SEQ ID NO: 630429 - DNA, 25 bp, Mus musculus
gaacgcagacatgtctgaggacatg

SEQ ID NO: 630430 - DNA, 25 bp, Mus musculus
gaacgcagcactcctcagcaactat

SEQ ID NO: 630431 - DNA, 25 bp, Mus musculus
gaacgcagcactgctcagcaactat

SEQ ID NO: 630432 - DNA, 25 bp, Mus musculus
gaacgcagcttcctttaataccgag

SEQ ID NO: 630433 - DNA, 25 bp, Mus musculus
gaacgcagcttcgtttaataccgag

SEQ ID NO: 630434 - DNA, 25 bp, Mus musculus
gaacgcatcgtgagcgtcatgggcc

SEQ ID NO: 630435 - DNA, 25 bp, Mus musculus
gaacgcatcgtgtgcgtcatgggcc

SEQ ID NO: 630436 - DNA, 25 bp, Mus musculus
gaacgccaagaacctctccatgtat

SEQ ID NO: 630437 - DNA, 25 bp, Mus musculus
gaacgccaagaagctctccatgtat

SEQ ID NO: 630438 - DNA, 25 bp, Mus musculus
gaacgccaatatagccgccagagcc

SEQ ID NO: 630439 - DNA, 25 bp, Mus musculus
gaacgccaatattgccgccagagcc

SEQ ID NO: 630440 - DNA, 25 bp, Mus musculus
gaacgccagctgctactttgacatc

SEQ ID NO: 630441 - DNA, 25 bp, Mus musculus
gaacgccagctggtactttgacatc

SEQ ID NO: 630442 - DNA, 25 bp, Mus musculus
gaacgccaggttccgtttaatgaag

SEQ ID NO: 630443 - DNA, 25 bp, Mus musculus
gaacgccaggttgcgtttaatgaag

SEQ ID NO: 630444 - DNA, 25 bp, Mus musculus
gaacgccattcacatggaggaggaa

SEQ ID NO: 630445 - DNA, 25 bp, Mus musculus
gaacgccattcagatggaggaggaa

SEQ ID NO: 630446 - DNA, 25 bp, Mus musculus
gaacgcccaggtacctttggctctc

SEQ ID NO: 630447 - DNA, 25 bp, Mus musculus
gaacgcccaggttcctttggctctc

SEQ ID NO: 630448 - DNA, 25 bp, Mus musculus
gaacgccttggaacgagctgagcaa

SEQ ID NO: 630449 - DNA, 25 bp, Mus musculus
gaacgccttggaccttttcagacac

SEQ ID NO: 630450 - DNA, 25 bp, Mus musculus
gaacgccttggagcttttcagacac

SEQ ID NO: 630451 - DNA, 25 bp, Mus musculus
gaacgccttggatcgagctgagcaa

SEQ ID NO: 630452 - DNA, 25 bp, Mus musculus
gaacgcgcagacatatcgaacagcc

SEQ ID NO: 630453 - DNA, 25 bp, Mus musculus
gaacgcgcagacttatcgaacagcc

SEQ ID NO: 630454 - DNA, 25 bp, Mus musculus
gaacgcggacttcatcgtggtgatt

SEQ ID NO: 630455 - DNA, 25 bp, Mus musculus
gaacgcggacttgatcgtggtgatt

SEQ ID NO: 630456 - DNA, 25 bp, Mus musculus
gaacgcggcgctccaggctctttct

SEQ ID NO: 630457 - DNA, 25 bp, Mus musculus
gaacgcggcgctgcaggctctttct

SEQ ID NO: 630458 - DNA, 25 bp, Mus musculus
gaacgcgtcaccaatgcagaactga

SEQ ID NO: 630459 - DNA, 25 bp, Mus musculus
gaacgcgtcacctatgcagaactga

SEQ ID NO: 630460 - DNA, 25 bp, Mus musculus
gaacgcgttaggattctttgcctgt

SEQ ID NO: 630461 - DNA, 25 bp, Mus musculus
gaacgcgttaggtttctttgcctgt

SEQ ID NO: 630462 - DNA, 25 bp, Mus musculus
gaacgctaagtgcaactacctgggt

SEQ ID NO: 630463 - DNA, 25 bp, Mus musculus
gaacgctaagtggaactacctgggt

SEQ ID NO: 630464 - DNA, 25 bp, Mus musculus
gaacgctacgttctcatctgtaaac

SEQ ID NO: 630465 - DNA, 25 bp, Mus musculus
gaacgctacgttgtcatctgtaaac

SEQ ID NO: 630466 - DNA, 25 bp, Mus musculus
gaacgctattatcagcgggcactag

SEQ ID NO: 630467 - DNA, 25 bp, Mus musculus
gaacgctattatgagcgggcactag

SEQ ID NO: 630468 - DNA, 25 bp, Mus musculus
gaacgctcacacaaagaccgtggag

SEQ ID NO: 630469 - DNA, 25 bp, Mus musculus
gaacgctcacactaagaccgtggag

SEQ ID NO: 630470 - DNA, 25 bp, Mus musculus
gaacgctcagacagtgggggctcaa

SEQ ID NO: 630471 - DNA, 25 bp, Mus musculus
gaacgctcagactgtgggggctcaa

SEQ ID NO: 630472 - DNA, 25 bp, Mus musculus
gaacgctcccatctactgcatctgt

SEQ ID NO: 630473 - DNA, 25 bp, Mus musculus
gaacgctcccatgtactgcatctgt

SEQ ID NO: 630474 - DNA, 25 bp, Mus musculus
gaacgctgaagaagatccagccttc

SEQ ID NO: 630475 - DNA, 25 bp, Mus musculus
gaacgctgaagatgatccagccttc

SEQ ID NO: 630476 - DNA, 25 bp, Mus musculus
gaacgctgggaactctacgacatca

SEQ ID NO: 630477 - DNA, 25 bp, Mus musculus
gaacgctgggaagtctacgacatca

SEQ ID NO: 630478 - DNA, 25 bp, Mus musculus
gaacgctggtgaatccaaagctgct

SEQ ID NO: 630479 - DNA, 25 bp, Mus musculus
gaacgctggtgaatctttactgcaa

SEQ ID NO: 630480 - DNA, 25 bp, Mus musculus
gaacgctggtgattccaaagctgct

SEQ ID NO: 630481 - DNA, 25 bp, Mus musculus
gaacgctggtgattctttactgcaa

SEQ ID NO: 630482 - DNA, 25 bp, Mus musculus
gaacgctgtcgaatcagaacatgag

SEQ ID NO: 630483 - DNA, 25 bp, Mus musculus
gaacgctgtcgattcagaacatgag

SEQ ID NO: 630484 - DNA, 25 bp, Mus musculus
gaacgctgtctgatgagaaagatca

SEQ ID NO: 630485 - DNA, 25 bp, Mus musculus
gaacgctgtctgttgagaaagatca

SEQ ID NO: 630486 - DNA, 25 bp, Mus musculus
gaacgctgtcttccctaattctcgg

SEQ ID NO: 630487 - DNA, 25 bp, Mus musculus
gaacgctgtcttgcctaattctcgg

SEQ ID NO: 630488 - DNA, 25 bp, Mus musculus
gaacgctgtttccaagaaatgctgg

SEQ ID NO: 630489 - DNA, 25 bp, Mus musculus
gaacgctgtttcgaagaaatgctgg

SEQ ID NO: 630490 - DNA, 25 bp, Mus musculus
gaacgcttacccatatacccggaca

SEQ ID NO: 630491 - DNA, 25 bp, Mus musculus
gaacgcttacccttatacccggaca

SEQ ID NO: 630492 - DNA, 25 bp, Mus musculus
gaacgcttcaacatcgacatgcctc

SEQ ID NO: 630493 - DNA, 25 bp, Mus musculus
gaacgcttcaacttcgacatgcctc

SEQ ID NO: 630494 - DNA, 25 bp, Mus musculus
gaacgcttccgaacaggccagactg

SEQ ID NO: 630495 - DNA, 25 bp, Mus musculus
gaacgcttccgatcaggccagactg

SEQ ID NO: 630496 - DNA, 25 bp, Mus musculus
gaacgcttctgccacctggaaactg

SEQ ID NO: 630497 - DNA, 25 bp, Mus musculus
gaacgcttctgcgacctggaaactg

SEQ ID NO: 630498 - DNA, 25 bp, Mus musculus
gaacgctttgctaatccaatgcctt

SEQ ID NO: 630499 - DNA, 25 bp, Mus musculus
gaacgctttgcttatccaatgcctt

SEQ ID NO: 630500 - DNA, 25 bp, Mus musculus
gaacggaaatttccacatcagtgcc

SEQ ID NO: 630501 - DNA, 25 bp, Mus musculus
gaacggaaatttgcacatcagtgcc

SEQ ID NO: 630502 - DNA, 25 bp, Mus musculus
gaacggaacacaaacctggatcact

SEQ ID NO: 630503 - DNA, 25 bp, Mus musculus
gaacggaacacatacctggatcact

SEQ ID NO: 630504 - DNA, 25 bp, Mus musculus
gaacggaacagacatagaatggtcc

SEQ ID NO: 630505 - DNA, 25 bp, Mus musculus
gaacggaacagagatagaatggtcc

SEQ ID NO: 630506 - DNA, 25 bp, Mus musculus
gaacggaatcttctgacgaaaaaca

SEQ ID NO: 630507 - DNA, 25 bp, Mus musculus
gaacggaatcttgtgacgaaaaaca

SEQ ID NO: 630508 - DNA, 25 bp, Mus musculus
gaacggacatttcagtaccaggact

SEQ ID NO: 630509 - DNA, 25 bp, Mus musculus
gaacggacatttgagtaccaggact

SEQ ID NO: 630510 - DNA, 25 bp, Mus musculus
gaacggaccagaagtgaagaccagg

SEQ ID NO: 630511 - DNA, 25 bp, Mus musculus
gaacggaccagaagtgagctcctgc

SEQ ID NO: 630512 - DNA, 25 bp, Mus musculus
gaacggaccagatgtgaagaccagg

SEQ ID NO: 630513 - DNA, 25 bp, Mus musculus
gaacggaccagatgtgagctcctgc

SEQ ID NO: 630514 - DNA, 25 bp, Mus musculus
gaacggactataatgctgaggaagc

SEQ ID NO: 630515 - DNA, 25 bp, Mus musculus
gaacggactatattgctgaggaagc

SEQ ID NO: 630516 - DNA, 25 bp, Mus musculus
gaacggagaagccagacatctgctc

SEQ ID NO: 630517 - DNA, 25 bp, Mus musculus
gaacggagaagcgagacatctgctc

SEQ ID NO: 630518 - DNA, 25 bp, Mus musculus
gaacggataaatccctttcatcata

SEQ ID NO: 630519 - DNA, 25 bp, Mus musculus
gaacggataaatgcctttcatcata

SEQ ID NO: 630520 - DNA, 25 bp, Mus musculus
gaacggatccgcagtgtcttggatg

SEQ ID NO: 630521 - DNA, 25 bp, Mus musculus
gaacggatccgctgtgtcttggatg

SEQ ID NO: 630522 - DNA, 25 bp, Mus musculus
gaacggattcgacgccatgtcctat

SEQ ID NO: 630523 - DNA, 25 bp, Mus musculus
gaacggattcgaggccatgtcctat

SEQ ID NO: 630524 - DNA, 25 bp, Mus musculus
gaacggcaccacaaacttcaggtag

SEQ ID NO: 630525 - DNA, 25 bp, Mus musculus
gaacggcaccactaacttcaggtag

SEQ ID NO: 630526 - DNA, 25 bp, Mus musculus
gaacggcaccatcctaaactgtgaa

SEQ ID NO: 630527 - DNA, 25 bp, Mus musculus
gaacggcaccatgctaaactgtgaa

SEQ ID NO: 630528 - DNA, 25 bp, Mus musculus
gaacggcagtgaagcagacatagac

SEQ ID NO: 630529 - DNA, 25 bp, Mus musculus
gaacggcagtgatgcagacatagac

SEQ ID NO: 630530 - DNA, 25 bp, Mus musculus
gaacggcattggcattctgacgcta

SEQ ID NO: 630531 - DNA, 25 bp, Mus musculus
gaacggcattgggattctgacgcta

SEQ ID NO: 630532 - DNA, 25 bp, Mus musculus
gaacggccatatagtgtgcctcaat

SEQ ID NO: 630533 - DNA, 25 bp, Mus musculus
gaacggccatattgtgtgcctcaat

SEQ ID NO: 630534 - DNA, 25 bp, Mus musculus
gaacggccggatcctctctagttgt

SEQ ID NO: 630535 - DNA, 25 bp, Mus musculus
gaacggccggatgctctctagttgt

SEQ ID NO: 630536 - DNA, 25 bp, Mus musculus
gaacggctgtttcctcttatccaag

SEQ ID NO: 630537 - DNA, 25 bp, Mus musculus
gaacggctgtttgctcttatccaag

SEQ ID NO: 630538 - DNA, 25 bp, Mus musculus
gaacggcttccccaacgagtactgg

SEQ ID NO: 630539 - DNA, 25 bp, Mus musculus
gaacggcttccccaagaagttgcta

SEQ ID NO: 630540 - DNA, 25 bp, Mus musculus
gaacggcttcccgaacgagtactgg

SEQ ID NO: 630541 - DNA, 25 bp, Mus musculus
gaacggcttcccgaagaagttgcta

SEQ ID NO: 630542 - DNA, 25 bp, Mus musculus
gaacggctttacaggctcagtcccc

SEQ ID NO: 630543 - DNA, 25 bp, Mus musculus
gaacggctttactggctcagtcccc

SEQ ID NO: 630544 - DNA, 25 bp, Mus musculus
gaacgggaatctaaatatggtgcac

SEQ ID NO: 630545 - DNA, 25 bp, Mus musculus
gaacgggaatcttaatatggtgcac

SEQ ID NO: 630546 - DNA, 25 bp, Mus musculus
gaacgggacagcacgctttgaatgc

SEQ ID NO: 630547 - DNA, 25 bp, Mus musculus
gaacgggacagctcgctttgaatgc

SEQ ID NO: 630548 - DNA, 25 bp, Mus musculus
gaacgggactctcgaagaccagctg

SEQ ID NO: 630549 - DNA, 25 bp, Mus musculus
gaacgggactctggaagaccagctg

SEQ ID NO: 630550 - DNA, 25 bp, Mus musculus
gaacgggcatgtataaggaactctg

SEQ ID NO: 630551 - DNA, 25 bp, Mus musculus
gaacgggcatgtttaaggaactctg

SEQ ID NO: 630552 - DNA, 25 bp, Mus musculus
gaacgggcctccatcatcactgatg

SEQ ID NO: 630553 - DNA, 25 bp, Mus musculus
gaacgggcctccttcatcactgatg

SEQ ID NO: 630554 - DNA, 25 bp, Mus musculus
gaacgggctttcctttcagtcaagt

SEQ ID NO: 630555 - DNA, 25 bp, Mus musculus
gaacgggctttcgtttcagtcaagt

SEQ ID NO: 630556 - DNA, 25 bp, Mus musculus
gaacggtaagaaagccaagaaggaa

SEQ ID NO: 630557 - DNA, 25 bp, Mus musculus
gaacggtaagaatgccaagaaggaa

SEQ ID NO: 630558 - DNA, 25 bp, Mus musculus
gaacggtaagagactcaagaagaag

SEQ ID NO: 630559 - DNA, 25 bp, Mus musculus
gaacggtaagagtctcaagaagaag

SEQ ID NO: 630560 - DNA, 25 bp, Mus musculus
gaacggtagagcaaggtgacagcac

SEQ ID NO: 630561 - DNA, 25 bp, Mus musculus
gaacggtagagctaggtgacagcac

SEQ ID NO: 630562 - DNA, 25 bp, Mus musculus
gaacggtccttgaaagagatggaag

SEQ ID NO: 630563 - DNA, 25 bp, Mus musculus
gaacggtccttgtaagagatggaag

SEQ ID NO: 630564 - DNA, 25 bp, Mus musculus
gaacggtctttcactacccatggta

SEQ ID NO: 630565 - DNA, 25 bp, Mus musculus
gaacggtctttctctacccatggta

SEQ ID NO: 630566 - DNA, 25 bp, Mus musculus
gaacggtgcagactaaatgaagaga

SEQ ID NO: 630567 - DNA, 25 bp, Mus musculus
gaacggtgcagagtaaatgaagaga

SEQ ID NO: 630568 - DNA, 25 bp, Mus musculus
gaacggtggacaccacagctgtgtt

SEQ ID NO: 630569 - DNA, 25 bp, Mus musculus
gaacggtggacagcacagctgtgtt

SEQ ID NO: 630570 - DNA, 25 bp, Mus musculus
gaacggtgtggacctcctaatgaag

SEQ ID NO: 630571 - DNA, 25 bp, Mus musculus
gaacggtgtggagctcctaatgaag

SEQ ID NO: 630572 - DNA, 25 bp, Mus musculus
gaacggttcacaccagtgccttctc

SEQ ID NO: 630573 - DNA, 25 bp, Mus musculus
gaacggttcacagcagtgccttctc

SEQ ID NO: 630574 - DNA, 25 bp, Mus musculus
gaacgtaaacttcctttatgtcctg

SEQ ID NO: 630575 - DNA, 25 bp, Mus musculus
gaacgtaaacttgctttatgtcctg

SEQ ID NO: 630576 - DNA, 25 bp, Mus musculus
gaacgtaaaggacgtatacatcacc

SEQ ID NO: 630577 - DNA, 25 bp, Mus musculus
gaacgtaaaggaggtatacatcacc

SEQ ID NO: 630578 - DNA, 25 bp, Mus musculus
gaacgtaatagaaccatggctcagt

SEQ ID NO: 630579 - DNA, 25 bp, Mus musculus
gaacgtaatagatccatggctcagt

SEQ ID NO: 630580 - DNA, 25 bp, Mus musculus
gaacgtacttctctctgccatgtca

SEQ ID NO: 630581 - DNA, 25 bp, Mus musculus
gaacgtacttctgtctgccatgtca

SEQ ID NO: 630582 - DNA, 25 bp, Mus musculus
gaacgtagaactcagtcgctaccaa

SEQ ID NO: 630583 - DNA, 25 bp, Mus musculus
gaacgtagaactgagtcgctaccaa

SEQ ID NO: 630584 - DNA, 25 bp, Mus musculus
gaacgtagggtaaccctgctcagaa

SEQ ID NO: 630585 - DNA, 25 bp, Mus musculus
gaacgtagggtatccctgctcagaa

SEQ ID NO: 630586 - DNA, 25 bp, Mus musculus
gaacgtcaattaacgtcaattaaca

SEQ ID NO: 630587 - DNA, 25 bp, Mus musculus
gaacgtcaattatcgtcaattaaca

SEQ ID NO: 630588 - DNA, 25 bp, Mus musculus
gaacgtcagcaacagggaaagactt

SEQ ID NO: 630589 - DNA, 25 bp, Mus musculus
gaacgtcagcaagagggaaagactt

SEQ ID NO: 630590 - DNA, 25 bp, Mus musculus
gaacgtccagtgaaggaaaaagccg

SEQ ID NO: 630591 - DNA, 25 bp, Mus musculus
gaacgtccagtgtaggaaaaagccg

SEQ ID NO: 630592 - DNA, 25 bp, Mus musculus
gaacgtcctttgcttttctgcggca

SEQ ID NO: 630593 - DNA, 25 bp, Mus musculus
gaacgtcctttggttttctgcggca

SEQ ID NO: 630594 - DNA, 25 bp, Mus musculus
gaacgtcgaagacgctttcatgcag

SEQ ID NO: 630595 - DNA, 25 bp, Mus musculus
gaacgtcgaagaggctttcatgcag

SEQ ID NO: 630596 - DNA, 25 bp, Mus musculus
gaacgtcggataatggagaaagccg

SEQ ID NO: 630597 - DNA, 25 bp, Mus musculus
gaacgtcggatattggagaaagccg

SEQ ID NO: 630598 - DNA, 25 bp, Mus musculus
gaacgtctcggaacttctcctacac

SEQ ID NO: 630599 - DNA, 25 bp, Mus musculus
gaacgtctcggatcttctcctacac

SEQ ID NO: 630600 - DNA, 25 bp, Mus musculus
gaacgtctctgacgccagtattcac

SEQ ID NO: 630601 - DNA, 25 bp, Mus musculus
gaacgtctctgaggccagtattcac

SEQ ID NO: 630602 - DNA, 25 bp, Mus musculus
gaacgtctgcagattgatgagcagc

SEQ ID NO: 630603 - DNA, 25 bp, Mus musculus
gaacgtctgcagtttgatgagcagc

SEQ ID NO: 630604 - DNA, 25 bp, Mus musculus
gaacgtctgtccatgaaggactgat

SEQ ID NO: 630605 - DNA, 25 bp, Mus musculus
gaacgtctgtccttgaaggactgat

SEQ ID NO: 630606 - DNA, 25 bp, Mus musculus
gaacgtcttcaacttcacaactgga

SEQ ID NO: 630607 - DNA, 25 bp, Mus musculus
gaacgtcttcaagttcacaactgga

SEQ ID NO: 630608 - DNA, 25 bp, Mus musculus
gaacgtcttcatcagtcacacacag

SEQ ID NO: 630609 - DNA, 25 bp, Mus musculus
gaacgtcttcatgagtcacacacag

SEQ ID NO: 630610 - DNA, 25 bp, Mus musculus
gaacgtgaacagctacggtcgagta

SEQ ID NO: 630611 - DNA, 25 bp, Mus musculus
gaacgtgaacaggtacggtcgagta

SEQ ID NO: 630612 - DNA, 25 bp, Mus musculus
gaacgtgacggtatttacagattgg

SEQ ID NO: 630613 - DNA, 25 bp, Mus musculus
gaacgtgacggtttttacagattgg

SEQ ID NO: 630614 - DNA, 25 bp, Mus musculus
gaacgtgagctcatactcggcaaag

SEQ ID NO: 630615 - DNA, 25 bp, Mus musculus
gaacgtgagctcttactcggcaaag

SEQ ID NO: 630616 - DNA, 25 bp, Mus musculus
gaacgtgaggagaccaccagccccg

SEQ ID NO: 630617 - DNA, 25 bp, Mus musculus
gaacgtgaggagtccaccagccccg

SEQ ID NO: 630618 - DNA, 25 bp, Mus musculus
gaacgtgagtccctagtccttctta

SEQ ID NO: 630619 - DNA, 25 bp, Mus musculus
gaacgtgagtccgtagtccttctta

SEQ ID NO: 630620 - DNA, 25 bp, Mus musculus
gaacgtgatactcgcaaactgtgga

SEQ ID NO: 630621 - DNA, 25 bp, Mus musculus
gaacgtgatactggcaaactgtgga

SEQ ID NO: 630622 - DNA, 25 bp, Mus musculus
gaacgtgcattgagattggcctgta

SEQ ID NO: 630623 - DNA, 25 bp, Mus musculus
gaacgtgcattgtgattggcctgta

SEQ ID NO: 630624 - DNA, 25 bp, Mus musculus
gaacgtgcccgtaacgggcaactct

SEQ ID NO: 630625 - DNA, 25 bp, Mus musculus
gaacgtgcccgttacgggcaactct

SEQ ID NO: 630626 - DNA, 25 bp, Mus musculus
gaacgtgcgaccagacctgcagaca

SEQ ID NO: 630627 - DNA, 25 bp, Mus musculus
gaacgtgcgacctgacctgcagaca

SEQ ID NO: 630628 - DNA, 25 bp, Mus musculus
gaacgtgcggcaacctttcctcgtg

SEQ ID NO: 630629 - DNA, 25 bp, Mus musculus
gaacgtgcggcatcctttcctcgtg

SEQ ID NO: 630630 - DNA, 25 bp, Mus musculus
gaacgtgctctcagccatgcacggg

SEQ ID NO: 630631 - DNA, 25 bp, Mus musculus
gaacgtgctctctgccatgcacggg

SEQ ID NO: 630632 - DNA, 25 bp, Mus musculus
gaacgtgctgatagctgtggacaca

SEQ ID NO: 630633 - DNA, 25 bp, Mus musculus
gaacgtgctgattgctgtggacaca

SEQ ID NO: 630634 - DNA, 25 bp, Mus musculus
gaacgtggacatctcggtgaccttg

SEQ ID NO: 630635 - DNA, 25 bp, Mus musculus
gaacgtggacatgtcggtgaccttg

SEQ ID NO: 630636 - DNA, 25 bp, Mus musculus
gaacgtggagttcgcctttctggca

SEQ ID NO: 630637 - DNA, 25 bp, Mus musculus
gaacgtggagttggcctttctggca

SEQ ID NO: 630638 - DNA, 25 bp, Mus musculus
gaacgtgggacacagggaacaaaca

SEQ ID NO: 630639 - DNA, 25 bp, Mus musculus
gaacgtgggacagagggaacaaaca

SEQ ID NO: 630640 - DNA, 25 bp, Mus musculus
gaacgtgggcgtcccaacccctgtg

SEQ ID NO: 630641 - DNA, 25 bp, Mus musculus
gaacgtgggcgtgccaacccctgtg

SEQ ID NO: 630642 - DNA, 25 bp, Mus musculus
gaacgtggtggtagtaaccattcaa

SEQ ID NO: 630643 - DNA, 25 bp, Mus musculus
gaacgtggtggttgtaaccattcaa

SEQ ID NO: 630644 - DNA, 25 bp, Mus musculus
gaacgtggttcgcttcaccgggtct

SEQ ID NO: 630645 - DNA, 25 bp, Mus musculus
gaacgtggttcggttcaccgggtct

SEQ ID NO: 630646 - DNA, 25 bp, Mus musculus
gaacgtgtctctactgcaggtcccg

SEQ ID NO: 630647 - DNA, 25 bp, Mus musculus
gaacgtgtctcttctgcaggtcccg

SEQ ID NO: 630648 - DNA, 25 bp, Mus musculus
gaacgtgtgatccatgccgtgcgct

SEQ ID NO: 630649 - DNA, 25 bp, Mus musculus
gaacgtgtgatcgatgccgtgcgct

SEQ ID NO: 630650 - DNA, 25 bp, Mus musculus
gaacgtgtggtgatctgaatcggac

SEQ ID NO: 630651 - DNA, 25 bp, Mus musculus
gaacgtgtggtgttctgaatcggac

SEQ ID NO: 630652 - DNA, 25 bp, Mus musculus
gaacgtgtgttcacgattcgtgaag

SEQ ID NO: 630653 - DNA, 25 bp, Mus musculus
gaacgtgtgttctcgattcgtgaag

SEQ ID NO: 630654 - DNA, 25 bp, Mus musculus
gaacgttacaagaccagtgtcgcta

SEQ ID NO: 630655 - DNA, 25 bp, Mus musculus
gaacgttacaagtccagtgtcgcta

SEQ ID NO: 630656 - DNA, 25 bp, Mus musculus
gaacgttattcgaggtttgctgagg

SEQ ID NO: 630657 - DNA, 25 bp, Mus musculus
gaacgttattcgtggtttgctgagg

SEQ ID NO: 630658 - DNA, 25 bp, Mus musculus
gaacgttcaagtagagtcagcctgg

SEQ ID NO: 630659 - DNA, 25 bp, Mus musculus
gaacgttcaagttgagtcagcctgg

SEQ ID NO: 630660 - DNA, 25 bp, Mus musculus
gaacgttcctcacgccttcatatgc

SEQ ID NO: 630661 - DNA, 25 bp, Mus musculus
gaacgttcctcaggccttcatatgc

SEQ ID NO: 630662 - DNA, 25 bp, Mus musculus
gaacgttctcctcggtggcgcagaa

SEQ ID NO: 630663 - DNA, 25 bp, Mus musculus
gaacgttctcctgggtggcgcagaa

SEQ ID NO: 630664 - DNA, 25 bp, Mus musculus
gaacgttctgcgagatcctcgggct

SEQ ID NO: 630665 - DNA, 25 bp, Mus musculus
gaacgttctgcgtgatcctcgggct

SEQ ID NO: 630666 - DNA, 25 bp, Mus musculus
gaacgttcttccagcaaacgctata

SEQ ID NO: 630667 - DNA, 25 bp, Mus musculus
gaacgttcttcctgcaaacgctata

SEQ ID NO: 630668 - DNA, 25 bp, Mus musculus
gaacgttgagcaatatagagcagga

SEQ ID NO: 630669 - DNA, 25 bp, Mus musculus
gaacgttgagcattatagagcagga

SEQ ID NO: 630670 - DNA, 25 bp, Mus musculus
gaacgttgccacaaggctcatagac

SEQ ID NO: 630671 - DNA, 25 bp, Mus musculus
gaacgttgccactaggctcatagac

SEQ ID NO: 630672 - DNA, 25 bp, Mus musculus
gaacgttgctagatcgcgggtccaa

SEQ ID NO: 630673 - DNA, 25 bp, Mus musculus
gaacgttgctagttcgcgggtccaa

SEQ ID NO: 630674 - DNA, 25 bp, Mus musculus
gaacgtttcagtataaatggtggtt

SEQ ID NO: 630675 - DNA, 25 bp, Mus musculus
gaacgtttcagtttaaatggtggtt

SEQ ID NO: 630676 - DNA, 25 bp, Mus musculus
gaacgtttccgtagcctcattccca

SEQ ID NO: 630677 - DNA, 25 bp, Mus musculus
gaacgtttccgttgcctcattccca

SEQ ID NO: 630678 - DNA, 25 bp, Mus musculus
gaacgtttgaagataattgcagagc

SEQ ID NO: 630679 - DNA, 25 bp, Mus musculus
gaacgtttgaagttaattgcagagc

SEQ ID NO: 630680 - DNA, 25 bp, Mus musculus
gaactaaaccgtagagggcaacagg

SEQ ID NO: 630681 - DNA, 25 bp, Mus musculus
gaactaaaccgttgagggcaacagg

SEQ ID NO: 630682 - DNA, 25 bp, Mus musculus
gaactaaagacacagtctgagccct

SEQ ID NO: 630683 - DNA, 25 bp, Mus musculus
gaactaaagacagagtctgagccct

SEQ ID NO: 630684 - DNA, 25 bp, Mus musculus
gaactaaatggacttgctgtcaaac

SEQ ID NO: 630685 - DNA, 25 bp, Mus musculus
gaactaaatggagttgctgtcaaac

SEQ ID NO: 630686 - DNA, 25 bp, Mus musculus
gaactaatgaccattttccaactac

SEQ ID NO: 630687 - DNA, 25 bp, Mus musculus
gaactaatgacctttttccaactac

SEQ ID NO: 630688 - DNA, 25 bp, Mus musculus
gaactacaataactaagttctcagg

SEQ ID NO: 630689 - DNA, 25 bp, Mus musculus
gaactacaataagtaagttctcagg

SEQ ID NO: 630690 - DNA, 25 bp, Mus musculus
gaactacagctcagatctgggaaag

SEQ ID NO: 630691 - DNA, 25 bp, Mus musculus
gaactacagctctgatctgggaaag

SEQ ID NO: 630692 - DNA, 25 bp, Mus musculus
gaactacagttgaatatttggcccc

SEQ ID NO: 630693 - DNA, 25 bp, Mus musculus
gaactacagttgtatatttggcccc

SEQ ID NO: 630694 - DNA, 25 bp, Mus musculus
gaactacataatatcggctagagcc

SEQ ID NO: 630695 - DNA, 25 bp, Mus musculus
gaactacataatttcggctagagcc

SEQ ID NO: 630696 - DNA, 25 bp, Mus musculus
gaactacatcaacaggacatatccc

SEQ ID NO: 630697 - DNA, 25 bp, Mus musculus
gaactacatcaagaggacatatccc

SEQ ID NO: 630698 - DNA, 25 bp, Mus musculus
gaactacatgaaagacagccttcgc

SEQ ID NO: 630699 - DNA, 25 bp, Mus musculus
gaactacatgaatgacagccttcgc

SEQ ID NO: 630700 - DNA, 25 bp, Mus musculus
gaactacatggaaggcctccctgag

SEQ ID NO: 630701 - DNA, 25 bp, Mus musculus
gaactacatggatggcctccctgag

SEQ ID NO: 630702 - DNA, 25 bp, Mus musculus
gaactacatgggaggccgtggtctc

SEQ ID NO: 630703 - DNA, 25 bp, Mus musculus
gaactacatgggtggccgtggtctc

SEQ ID NO: 630704 - DNA, 25 bp, Mus musculus
gaactaccaagtcactgctgcacct

SEQ ID NO: 630705 - DNA, 25 bp, Mus musculus
gaactaccaagtgactgctgcacct

SEQ ID NO: 630706 - DNA, 25 bp, Mus musculus
gaactaccagagagaaggaaaccag

SEQ ID NO: 630707 - DNA, 25 bp, Mus musculus
gaactaccagagtgaaggaaaccag

SEQ ID NO: 630708 - DNA, 25 bp, Mus musculus
gaactaccaggtctctgagatcttc

SEQ ID NO: 630709 - DNA, 25 bp, Mus musculus
gaactaccaggtgtctgagatcttc

SEQ ID NO: 630710 - DNA, 25 bp, Mus musculus
gaactaccatggcagagcaaaccct

SEQ ID NO: 630711 - DNA, 25 bp, Mus musculus
gaactaccatgggagagcaaaccct

SEQ ID NO: 630712 - DNA, 25 bp, Mus musculus
gaactacccagccaactcagagtgc

SEQ ID NO: 630713 - DNA, 25 bp, Mus musculus
gaactacccagcgaactcagagtgc

SEQ ID NO: 630714 - DNA, 25 bp, Mus musculus
gaactaccttatacagatggcgcgg

SEQ ID NO: 630715 - DNA, 25 bp, Mus musculus
gaactaccttattcagatggcgcgg

SEQ ID NO: 630716 - DNA, 25 bp, Mus musculus
gaactacgcgtgctggatacctcta

SEQ ID NO: 630717 - DNA, 25 bp, Mus musculus
gaactacgcgtggtggatacctcta

SEQ ID NO: 630718 - DNA, 25 bp, Mus musculus
gaactactcactacattaatttcag

SEQ ID NO: 630719 - DNA, 25 bp, Mus musculus
gaactactcacttcattaatttcag

SEQ ID NO: 630720 - DNA, 25 bp, Mus musculus
gaactactccttaaacttttgcctg

SEQ ID NO: 630721 - DNA, 25 bp, Mus musculus
gaactactcctttaacttttgcctg

SEQ ID NO: 630722 - DNA, 25 bp, Mus musculus
gaactactggccctggcgagtattt

SEQ ID NO: 630723 - DNA, 25 bp, Mus musculus
gaactactggccgtggcgagtattt

SEQ ID NO: 630724 - DNA, 25 bp, Mus musculus
gaactacttaaaccaacccaatgca

SEQ ID NO: 630725 - DNA, 25 bp, Mus musculus
gaactacttaaagcaacccaatgca

SEQ ID NO: 630726 - DNA, 25 bp, Mus musculus
gaactactttgcacaagtcgactgc

SEQ ID NO: 630727 - DNA, 25 bp, Mus musculus
gaactactttgctcaagtcgactgc

SEQ ID NO: 630728 - DNA, 25 bp, Mus musculus
gaactagaacgaaaggagcagaagg

SEQ ID NO: 630729 - DNA, 25 bp, Mus musculus
gaactagaacgataggagcagaagg

SEQ ID NO: 630730 - DNA, 25 bp, Mus musculus
gaactagacatcacagaccagaaga

SEQ ID NO: 630731 - DNA, 25 bp, Mus musculus
gaactagacatctcagaccagaaga

SEQ ID NO: 630732 - DNA, 25 bp, Mus musculus
gaactagagagacccaggaggaact

SEQ ID NO: 630733 - DNA, 25 bp, Mus musculus
gaactagagagagccaggaggaact

SEQ ID NO: 630734 - DNA, 25 bp, Mus musculus
gaactagagtacagtgccacagcac

SEQ ID NO: 630735 - DNA, 25 bp, Mus musculus
gaactagagtactgtgccacagcac

SEQ ID NO: 630736 - DNA, 25 bp, Mus musculus
gaactagatggccatgtacttaaat

SEQ ID NO: 630737 - DNA, 25 bp, Mus musculus
gaactagatggcgatgtacttaaat

SEQ ID NO: 630738 - DNA, 25 bp, Mus musculus
gaactagcatataactttactctta

SEQ ID NO: 630739 - DNA, 25 bp, Mus musculus
gaactagcatattactttactctta

SEQ ID NO: 630740 - DNA, 25 bp, Mus musculus
gaactagcccagcttcagtcctagg

SEQ ID NO: 630741 - DNA, 25 bp, Mus musculus
gaactagcccaggttcagtcctagg

SEQ ID NO: 630742 - DNA, 25 bp, Mus musculus
gaactagcctccaatgatatgcagc

SEQ ID NO: 630743 - DNA, 25 bp, Mus musculus
gaactagcctcctatgatatgcagc

SEQ ID NO: 630744 - DNA, 25 bp, Mus musculus
gaactagctctgagcatcactcgag

SEQ ID NO: 630745 - DNA, 25 bp, Mus musculus
gaactagctctgtgcatcactcgag

SEQ ID NO: 630746 - DNA, 25 bp, Mus musculus
gaactagggtagatctggaagcgaa

SEQ ID NO: 630747 - DNA, 25 bp, Mus musculus
gaactagggtagttctggaagcgaa

SEQ ID NO: 630748 - DNA, 25 bp, Mus musculus
gaactagtatccagagagtgccaga

SEQ ID NO: 630749 - DNA, 25 bp, Mus musculus
gaactagtatcctgagagtgccaga

SEQ ID NO: 630750 - DNA, 25 bp, Mus musculus
gaactagtgacacctactggcaact

SEQ ID NO: 630751 - DNA, 25 bp, Mus musculus
gaactagtgacagctactggcaact

SEQ ID NO: 630752 - DNA, 25 bp, Mus musculus
gaactagttgctcagatgggtcctt

SEQ ID NO: 630753 - DNA, 25 bp, Mus musculus
gaactagttgctgagatgggtcctt

SEQ ID NO: 630754 - DNA, 25 bp, Mus musculus
gaactagtttgtctgccttgccata

SEQ ID NO: 630755 - DNA, 25 bp, Mus musculus
gaactagtttgtgtgccttgccata

SEQ ID NO: 630756 - DNA, 25 bp, Mus musculus
gaactatatccacgtgacaccgcag

SEQ ID NO: 630757 - DNA, 25 bp, Mus musculus
gaactatatccaggtgacaccgcag

SEQ ID NO: 630758 - DNA, 25 bp, Mus musculus
gaactatcactcagtcccgtctagg

SEQ ID NO: 630759 - DNA, 25 bp, Mus musculus
gaactatcactctgtcccgtctagg

SEQ ID NO: 630760 - DNA, 25 bp, Mus musculus
gaactatgacgacgagcctgacaag

SEQ ID NO: 630761 - DNA, 25 bp, Mus musculus
gaactatgacgaggagcctgacaag

SEQ ID NO: 630762 - DNA, 25 bp, Mus musculus
gaactatgagaaacttagccgtgca

SEQ ID NO: 630763 - DNA, 25 bp, Mus musculus
gaactatgagaatcttagccgtgca

SEQ ID NO: 630764 - DNA, 25 bp, Mus musculus
gaactatgagcaaatcgtgaaggca

SEQ ID NO: 630765 - DNA, 25 bp, Mus musculus
gaactatgagcatatcgtgaaggca

SEQ ID NO: 630766 - DNA, 25 bp, Mus musculus
gaactatgagccacttggcttggag

SEQ ID NO: 630767 - DNA, 25 bp, Mus musculus
gaactatgagcctcttggcttggag

SEQ ID NO: 630768 - DNA, 25 bp, Mus musculus
gaactatgatgtcgacgagtccatc

SEQ ID NO: 630769 - DNA, 25 bp, Mus musculus
gaactatgatgtggacgagtccatc

SEQ ID NO: 630770 - DNA, 25 bp, Mus musculus
gaactatgcagaaagcgggacggct

SEQ ID NO: 630771 - DNA, 25 bp, Mus musculus
gaactatgcagatagcgggacggct

SEQ ID NO: 630772 - DNA, 25 bp, Mus musculus
gaactatggaccacgctgggagact

SEQ ID NO: 630773 - DNA, 25 bp, Mus musculus
gaactatggacctcgctgggagact

SEQ ID NO: 630774 - DNA, 25 bp, Mus musculus
gaactatggcagattcatcaatgac

SEQ ID NO: 630775 - DNA, 25 bp, Mus musculus
gaactatggcagtttcatcaatgac

SEQ ID NO: 630776 - DNA, 25 bp, Mus musculus
gaactatggcttctacggctgctac

SEQ ID NO: 630777 - DNA, 25 bp, Mus musculus
gaactatggcttgtacggctgctac

SEQ ID NO: 630778 - DNA, 25 bp, Mus musculus
gaactatgtcatcgatcaaagaagg

SEQ ID NO: 630779 - DNA, 25 bp, Mus musculus
gaactatgtcatggatcaaagaagg

SEQ ID NO: 630780 - DNA, 25 bp, Mus musculus
gaactatgtgacagcaaaagatgca

SEQ ID NO: 630781 - DNA, 25 bp, Mus musculus
gaactatgtgactgcaaaagatgca

SEQ ID NO: 630782 - DNA, 25 bp, Mus musculus
gaactatgtgatcccggaagttccg

SEQ ID NO: 630783 - DNA, 25 bp, Mus musculus
gaactatgtgatgccggaagttccg

SEQ ID NO: 630784 - DNA, 25 bp, Mus musculus
gaactatgtggccaagaactttgcc

SEQ ID NO: 630785 - DNA, 25 bp, Mus musculus
gaactatgtggcgaagaactttgcc

SEQ ID NO: 630786 - DNA, 25 bp, Mus musculus
gaactattatccacagaccagagtc

SEQ ID NO: 630787 - DNA, 25 bp, Mus musculus
gaactattatcctcagaccagagtc

SEQ ID NO: 630788 - DNA, 25 bp, Mus musculus
gaactattccgtcatggctatctgt

SEQ ID NO: 630789 - DNA, 25 bp, Mus musculus
gaactattccgtgatggctatctgt

SEQ ID NO: 630790 - DNA, 25 bp, Mus musculus
gaactattctcaacacgtagaatcg

SEQ ID NO: 630791 - DNA, 25 bp, Mus musculus
gaactattctcatcacgtagaatcg

SEQ ID NO: 630792 - DNA, 25 bp, Mus musculus
gaactatttgttccccgttgaggag

SEQ ID NO: 630793 - DNA, 25 bp, Mus musculus
gaactatttgttgcccgttgaggag

SEQ ID NO: 630794 - DNA, 25 bp, Mus musculus
gaactatttttcactcttagctaca

SEQ ID NO: 630795 - DNA, 25 bp, Mus musculus
gaactatttttctctcttagctaca

SEQ ID NO: 630796 - DNA, 25 bp, Mus musculus
gaactcaaatctacgacaagagcta

SEQ ID NO: 630797 - DNA, 25 bp, Mus musculus
gaactcaaatcttcgacaagagcta

SEQ ID NO: 630798 - DNA, 25 bp, Mus musculus
gaactcaacagcaatgtacctgtca

SEQ ID NO: 630799 - DNA, 25 bp, Mus musculus
gaactcaacagctatgtacctgtca

SEQ ID NO: 630800 - DNA, 25 bp, Mus musculus
gaactcaaccgacgagactttttca

SEQ ID NO: 630801 - DNA, 25 bp, Mus musculus
gaactcaaccgaggagactttttca

SEQ ID NO: 630802 - DNA, 25 bp, Mus musculus
gaactcaactgaagctctctgggat

SEQ ID NO: 630803 - DNA, 25 bp, Mus musculus
gaactcaactgatgctctctgggat

SEQ ID NO: 630804 - DNA, 25 bp, Mus musculus
gaactcaacttgaggatctgggatg

SEQ ID NO: 630805 - DNA, 25 bp, Mus musculus
gaactcaacttgtggatctgggatg

SEQ ID NO: 630806 - DNA, 25 bp, Mus musculus
gaactcaagaccagaggctaatgaa

SEQ ID NO: 630807 - DNA, 25 bp, Mus musculus
gaactcaagacctgaggctaatgaa

SEQ ID NO: 630808 - DNA, 25 bp, Mus musculus
gaactcaagcggcattacaacctgg

SEQ ID NO: 630809 - DNA, 25 bp, Mus musculus
gaactcaagcgggattacaacctgg

SEQ ID NO: 630810 - DNA, 25 bp, Mus musculus
gaactcaaggccaactaagctgtct

SEQ ID NO: 630811 - DNA, 25 bp, Mus musculus
gaactcaaggcctactaagctgtct

SEQ ID NO: 630812 - DNA, 25 bp, Mus musculus
gaactcacaagtattcaggatctga

SEQ ID NO: 630813 - DNA, 25 bp, Mus musculus
gaactcacaagttttcaggatctga

SEQ ID NO: 630814 - DNA, 25 bp, Mus musculus
gaactcacacgacatcttccagtac

SEQ ID NO: 630815 - DNA, 25 bp, Mus musculus
gaactcacacgagatcttccagtac

SEQ ID NO: 630816 - DNA, 25 bp, Mus musculus
gaactcacaggcagagcagtcagct

SEQ ID NO: 630817 - DNA, 25 bp, Mus musculus
gaactcacaggctgagcagtcagct

SEQ ID NO: 630818 - DNA, 25 bp, Mus musculus
gaactcaccaccaagcagcagtctg

SEQ ID NO: 630819 - DNA, 25 bp, Mus musculus
gaactcaccacctagcagcagtctg

SEQ ID NO: 630820 - DNA, 25 bp, Mus musculus
gaactcaccccacttaaaatgggat

SEQ ID NO: 630821 - DNA, 25 bp, Mus musculus
gaactcaccccagttaaaatgggat

SEQ ID NO: 630822 - DNA, 25 bp, Mus musculus
gaactcactgacctcgtggacctca

SEQ ID NO: 630823 - DNA, 25 bp, Mus musculus
gaactcactgacgtcgtggacctca

SEQ ID NO: 630824 - DNA, 25 bp, Mus musculus
gaactcactgccacccgtaagaatg

SEQ ID NO: 630825 - DNA, 25 bp, Mus musculus
gaactcactgcctcccgtaagaatg

SEQ ID NO: 630826 - DNA, 25 bp, Mus musculus
gaactcactgtcactttgcagcatc

SEQ ID NO: 630827 - DNA, 25 bp, Mus musculus
gaactcactgtctctttgcagcatc

SEQ ID NO: 630828 - DNA, 25 bp, Mus musculus
gaactcagaattacctgaccttgtg

SEQ ID NO: 630829 - DNA, 25 bp, Mus musculus
gaactcagaatttcctgaccttgtg

SEQ ID NO: 630830 - DNA, 25 bp, Mus musculus
gaactcagatatacttttcctacgc

SEQ ID NO: 630831 - DNA, 25 bp, Mus musculus
gaactcagatattcttttcctacgc

SEQ ID NO: 630832 - DNA, 25 bp, Mus musculus
gaactcagcaaaagattcacctcga

SEQ ID NO: 630833 - DNA, 25 bp, Mus musculus
gaactcagcaaatgattcacctcga

SEQ ID NO: 630834 - DNA, 25 bp, Mus musculus
gaactcagccaccttcaagtcattt

SEQ ID NO: 630835 - DNA, 25 bp, Mus musculus
gaactcagccacgttcaagtcattt

SEQ ID NO: 630836 - DNA, 25 bp, Mus musculus
gaactcagcgcaatgacctctacca

SEQ ID NO: 630837 - DNA, 25 bp, Mus musculus
gaactcagcgcattgacctctacca

SEQ ID NO: 630838 - DNA, 25 bp, Mus musculus
gaactcaggcttatccgagcgagga

SEQ ID NO: 630839 - DNA, 25 bp, Mus musculus
gaactcaggcttttccgagcgagga

SEQ ID NO: 630840 - DNA, 25 bp, Mus musculus
gaactcagtcgcaaccaaacaaaat

SEQ ID NO: 630841 - DNA, 25 bp, Mus musculus
gaactcagtcgctaccaaacaaaat

SEQ ID NO: 630842 - DNA, 25 bp, Mus musculus
gaactcagtgaaaacacggccaaga

SEQ ID NO: 630843 - DNA, 25 bp, Mus musculus
gaactcagtgaatacacggccaaga

SEQ ID NO: 630844 - DNA, 25 bp, Mus musculus
gaactcagtgtaacagatcgccatg

SEQ ID NO: 630845 - DNA, 25 bp, Mus musculus
gaactcagtgtatcagatcgccatg

SEQ ID NO: 630846 - DNA, 25 bp, Mus musculus
gaactcagtgtcagccttttctgtt

SEQ ID NO: 630847 - DNA, 25 bp, Mus musculus
gaactcagtgtctgccttttctgtt

SEQ ID NO: 630848 - DNA, 25 bp, Mus musculus
gaactcagttccctcataataaaaa

SEQ ID NO: 630849 - DNA, 25 bp, Mus musculus
gaactcagttccgtcataataaaaa

SEQ ID NO: 630850 - DNA, 25 bp, Mus musculus
gaactcatagccatgctgctggagg

SEQ ID NO: 630851 - DNA, 25 bp, Mus musculus
gaactcatagccttgctgctggagg

SEQ ID NO: 630852 - DNA, 25 bp, Mus musculus
gaactcatccagctcgcactgcatt

SEQ ID NO: 630853 - DNA, 25 bp, Mus musculus
gaactcatccaggtcgcactgcatt

SEQ ID NO: 630854 - DNA, 25 bp, Mus musculus
gaactcatcggtcaagctgcaggga

SEQ ID NO: 630855 - DNA, 25 bp, Mus musculus
gaactcatcggtgaagctgcaggga

SEQ ID NO: 630856 - DNA, 25 bp, Mus musculus
gaactcatctgaaaaactgccacag

SEQ ID NO: 630857 - DNA, 25 bp, Mus musculus
gaactcatctgataaactgccacag

SEQ ID NO: 630858 - DNA, 25 bp, Mus musculus
gaactcatctggaggcctgacatcg

SEQ ID NO: 630859 - DNA, 25 bp, Mus musculus
gaactcatctggtggcctgacatcg

SEQ ID NO: 630860 - DNA, 25 bp, Mus musculus
gaactcattgaactacgcgagctgg

SEQ ID NO: 630861 - DNA, 25 bp, Mus musculus
gaactcattgaagtacgcgagctgg

SEQ ID NO: 630862 - DNA, 25 bp, Mus musculus
gaactcattgccatgtcccagggtg

SEQ ID NO: 630863 - DNA, 25 bp, Mus musculus
gaactcattgccttgtcccagggtg

SEQ ID NO: 630864 - DNA, 25 bp, Mus musculus
gaactccaaagacatgcagatgaaa

SEQ ID NO: 630865 - DNA, 25 bp, Mus musculus
gaactccaaagagatgcagatgaaa

SEQ ID NO: 630866 - DNA, 25 bp, Mus musculus
gaactccaaagtcgactgcaacggg

SEQ ID NO: 630867 - DNA, 25 bp, Mus musculus
gaactccaaagtggactgcaacggg

SEQ ID NO: 630868 - DNA, 25 bp, Mus musculus
gaactccaagagctgcccctgctgt

SEQ ID NO: 630869 - DNA, 25 bp, Mus musculus
gaactccaagaggtgcccctgctgt

SEQ ID NO: 630870 - DNA, 25 bp, Mus musculus
gaactccactcaagctagatgtcca

SEQ ID NO: 630871 - DNA, 25 bp, Mus musculus
gaactccactcatgctagatgtcca

SEQ ID NO: 630872 - DNA, 25 bp, Mus musculus
gaactccactctctgaggcactgtg

SEQ ID NO: 630873 - DNA, 25 bp, Mus musculus
gaactccactctgtgaggcactgtg

SEQ ID NO: 630874 - DNA, 25 bp, Mus musculus
gaactccaggatcgcattgggcagc

SEQ ID NO: 630875 - DNA, 25 bp, Mus musculus
gaactccaggatggcattgggcagc

SEQ ID NO: 630876 - DNA, 25 bp, Mus musculus
gaactccaggctctgcgcatgtttg

SEQ ID NO: 630877 - DNA, 25 bp, Mus musculus
gaactccaggctgtgcgcatgtttg

SEQ ID NO: 630878 - DNA, 25 bp, Mus musculus
gaactccagggcaatctttgactgg

SEQ ID NO: 630879 - DNA, 25 bp, Mus musculus
gaactccagggctatctttgactgg

SEQ ID NO: 630880 - DNA, 25 bp, Mus musculus
gaactccatcatatttatgcctgac

SEQ ID NO: 630881 - DNA, 25 bp, Mus musculus
gaactccatcatttttatgcctgac

SEQ ID NO: 630882 - DNA, 25 bp, Mus musculus
gaactccctggaaaagatcatagaa

SEQ ID NO: 630883 - DNA, 25 bp, Mus musculus
gaactccctggataagatcatagaa

SEQ ID NO: 630884 - DNA, 25 bp, Mus musculus
gaactccgtgtccagagttcatgaa

SEQ ID NO: 630885 - DNA, 25 bp, Mus musculus
gaactccgtgtcgagagttcatgaa

SEQ ID NO: 630886 - DNA, 25 bp, Mus musculus
gaactcctcctgaaggaaggttttg

SEQ ID NO: 630887 - DNA, 25 bp, Mus musculus
gaactcctcctgtaggaaggttttg

SEQ ID NO: 630888 - DNA, 25 bp, Mus musculus
gaactcctggtccactgaagggaaa

SEQ ID NO: 630889 - DNA, 25 bp, Mus musculus
gaactcctggtcgactgaagggaaa

SEQ ID NO: 630890 - DNA, 25 bp, Mus musculus
gaactcgactagaccttgaagagtg

SEQ ID NO: 630891 - DNA, 25 bp, Mus musculus
gaactcgactagtccttgaagagtg

SEQ ID NO: 630892 - DNA, 25 bp, Mus musculus
gaactcgagaatcgaagaattgtga

SEQ ID NO: 630893 - DNA, 25 bp, Mus musculus
gaactcgagaatggaagaattgtga

SEQ ID NO: 630894 - DNA, 25 bp, Mus musculus
gaactcgagattctctacctgggag

SEQ ID NO: 630895 - DNA, 25 bp, Mus musculus
gaactcgagattgtctacctgggag

SEQ ID NO: 630896 - DNA, 25 bp, Mus musculus
gaactcggcatgaaccagcctcact

SEQ ID NO: 630897 - DNA, 25 bp, Mus musculus
gaactcggcatgtaccagcctcact

SEQ ID NO: 630898 - DNA, 25 bp, Mus musculus
gaactcgggtctctcttaaggacct

SEQ ID NO: 630899 - DNA, 25 bp, Mus musculus
gaactcgggtctgtcttaaggacct

SEQ ID NO: 630900 - DNA, 25 bp, Mus musculus
gaactcgtacggctctgcttggaac

SEQ ID NO: 630901 - DNA, 25 bp, Mus musculus
gaactcgtacgggtctgcttggaac

SEQ ID NO: 630902 - DNA, 25 bp, Mus musculus
gaactcgtgcttagaatggctgctc

SEQ ID NO: 630903 - DNA, 25 bp, Mus musculus
gaactcgtgctttgaatggctgctc

SEQ ID NO: 630904 - DNA, 25 bp, Mus musculus
gaactcgtttggacaataagtcatt

SEQ ID NO: 630905 - DNA, 25 bp, Mus musculus
gaactcgtttggtcaataagtcatt

SEQ ID NO: 630906 - DNA, 25 bp, Mus musculus
gaactctaaacacgaggcaacagaa

SEQ ID NO: 630907 - DNA, 25 bp, Mus musculus
gaactctaaacaggaggcaacagaa

SEQ ID NO: 630908 - DNA, 25 bp, Mus musculus
gaactctacctacggctccgctttg

SEQ ID NO: 630909 - DNA, 25 bp, Mus musculus
gaactctacctagggctccgctttg

SEQ ID NO: 630910 - DNA, 25 bp, Mus musculus
gaactctaggcaacccttccttacg

SEQ ID NO: 630911 - DNA, 25 bp, Mus musculus
gaactctaggcatcccttccttacg

SEQ ID NO: 630912 - DNA, 25 bp, Mus musculus
gaactctatggcaccagaaaaggaa

SEQ ID NO: 630913 - DNA, 25 bp, Mus musculus
gaactctatggctccagaaaaggaa

SEQ ID NO: 630914 - DNA, 25 bp, Mus musculus
gaactctcagagaacttccgcaggt

SEQ ID NO: 630915 - DNA, 25 bp, Mus musculus
gaactctcagagtacttccgcaggt

SEQ ID NO: 630916 - DNA, 25 bp, Mus musculus
gaactctccaggcatcttgtaaata

SEQ ID NO: 630917 - DNA, 25 bp, Mus musculus
gaactctccagggatcttgtaaata

SEQ ID NO: 630918 - DNA, 25 bp, Mus musculus
gaactctcccgccactgggagagag

SEQ ID NO: 630919 - DNA, 25 bp, Mus musculus
gaactctcccgcgactgggagagag

SEQ ID NO: 630920 - DNA, 25 bp, Mus musculus
gaactctcgagtcactacagcctga

SEQ ID NO: 630921 - DNA, 25 bp, Mus musculus
gaactctcgagtgactacagcctga

SEQ ID NO: 630922 - DNA, 25 bp, Mus musculus
gaactctctcgaccccagaatgact

SEQ ID NO: 630923 - DNA, 25 bp, Mus musculus
gaactctctcgagcccagaatgact

SEQ ID NO: 630924 - DNA, 25 bp, Mus musculus
gaactctctgcaacaaacacacgta

SEQ ID NO: 630925 - DNA, 25 bp, Mus musculus
gaactctctgcatcaaacacacgta

SEQ ID NO: 630926 - DNA, 25 bp, Mus musculus
gaactctctgggaagcattcgctac

SEQ ID NO: 630927 - DNA, 25 bp, Mus musculus
gaactctctgggtagcattcgctac

SEQ ID NO: 630928 - DNA, 25 bp, Mus musculus
gaactctgacgtccatccttgacaa

SEQ ID NO: 630929 - DNA, 25 bp, Mus musculus
gaactctgacgtgcatccttgacaa

SEQ ID NO: 630930 - DNA, 25 bp, Mus musculus
gaactctgatatcaccaaagtggta

SEQ ID NO: 630931 - DNA, 25 bp, Mus musculus
gaactctgatatgaccaaagtggta

SEQ ID NO: 630932 - DNA, 25 bp, Mus musculus
gaactctgcctgctcttcgaaccag

SEQ ID NO: 630933 - DNA, 25 bp, Mus musculus
gaactctgcctggtcttcgaaccag

SEQ ID NO: 630934 - DNA, 25 bp, Mus musculus
gaactctgccttagatcgatacgca

SEQ ID NO: 630935 - DNA, 25 bp, Mus musculus
gaactctgcctttgatcgatacgca

SEQ ID NO: 630936 - DNA, 25 bp, Mus musculus
gaactctgggacagctgttgcctat

SEQ ID NO: 630937 - DNA, 25 bp, Mus musculus
gaactctgggactgctgttgcctat

SEQ ID NO: 630938 - DNA, 25 bp, Mus musculus
gaactcttccagcaaatgaacatag

SEQ ID NO: 630939 - DNA, 25 bp, Mus musculus
gaactcttccaggaaatgaacatag

SEQ ID NO: 630940 - DNA, 25 bp, Mus musculus
gaactcttggccatgcatagaggga

SEQ ID NO: 630941 - DNA, 25 bp, Mus musculus
gaactcttggccttgcatagaggga

SEQ ID NO: 630942 - DNA, 25 bp, Mus musculus
gaactctttagaaaaacattaggag

SEQ ID NO: 630943 - DNA, 25 bp, Mus musculus
gaactctttagataaacattaggag

SEQ ID NO: 630944 - DNA, 25 bp, Mus musculus
gaactctttgaaatccggcggacag

SEQ ID NO: 630945 - DNA, 25 bp, Mus musculus
gaactctttgaattccggcggacag

SEQ ID NO: 630946 - DNA, 25 bp, Mus musculus
gaactcttttggatcacttatgaca

SEQ ID NO: 630947 - DNA, 25 bp, Mus musculus
gaactcttttggttcacttatgaca

SEQ ID NO: 630948 - DNA, 25 bp, Mus musculus
gaactctttttcataagcagataac

SEQ ID NO: 630949 - DNA, 25 bp, Mus musculus
gaactctttttcttaagcagataac

SEQ ID NO: 630950 - DNA, 25 bp, Mus musculus
gaactgaaaatgatgggcagccagg

SEQ ID NO: 630951 - DNA, 25 bp, Mus musculus
gaactgaaaatgttgggcagccagg

SEQ ID NO: 630952 - DNA, 25 bp, Mus musculus
gaactgaacaggagggagatgccca

SEQ ID NO: 630953 - DNA, 25 bp, Mus musculus
gaactgaacaggtgggagatgccca

SEQ ID NO: 630954 - DNA, 25 bp, Mus musculus
gaactgaacatcctatatgaaatga

SEQ ID NO: 630955 - DNA, 25 bp, Mus musculus
gaactgaacatcgtatatgaaatga

SEQ ID NO: 630956 - DNA, 25 bp, Mus musculus
gaactgaacctcaccaatatctatg

SEQ ID NO: 630957 - DNA, 25 bp, Mus musculus
gaactgaacctctccaatatctatg

SEQ ID NO: 630958 - DNA, 25 bp, Mus musculus
gaactgaacgtcacggtggtcacct

SEQ ID NO: 630959 - DNA, 25 bp, Mus musculus
gaactgaacgtctcggtggtcacct

SEQ ID NO: 630960 - DNA, 25 bp, Mus musculus
gaactgaagacccatttgcacctgg

SEQ ID NO: 630961 - DNA, 25 bp, Mus musculus
gaactgaagaccgatttgcacctgg

SEQ ID NO: 630962 - DNA, 25 bp, Mus musculus
gaactgaagaggacctgtcgcctga

SEQ ID NO: 630963 - DNA, 25 bp, Mus musculus
gaactgaagaggtcctgtcgcctga

SEQ ID NO: 630964 - DNA, 25 bp, Mus musculus
gaactgaagccaatgtcgtgaaccc

SEQ ID NO: 630965 - DNA, 25 bp, Mus musculus
gaactgaagccattgtcgtgaaccc

SEQ ID NO: 630966 - DNA, 25 bp, Mus musculus
gaactgaaggcccaagatttcatag

SEQ ID NO: 630967 - DNA, 25 bp, Mus musculus
gaactgaaggccgaagatttcatag

SEQ ID NO: 630968 - DNA, 25 bp, Mus musculus
gaactgaaggctccggttgcctttg

SEQ ID NO: 630969 - DNA, 25 bp, Mus musculus
gaactgaaggctgcggttgcctttg

SEQ ID NO: 630970 - DNA, 25 bp, Mus musculus
gaactgaagtccacacttgcttcag

SEQ ID NO: 630971 - DNA, 25 bp, Mus musculus
gaactgaagtcctcacttgcttcag

SEQ ID NO: 630972 - DNA, 25 bp, Mus musculus
gaactgaatctgcagtgttgcctga

SEQ ID NO: 630973 - DNA, 25 bp, Mus musculus
gaactgaatctggagtgttgcctga

SEQ ID NO: 630974 - DNA, 25 bp, Mus musculus
gaactgaatgccctcatgctgcaac

SEQ ID NO: 630975 - DNA, 25 bp, Mus musculus
gaactgaatgccgtcatgctgcaac

SEQ ID NO: 630976 - DNA, 25 bp, Mus musculus
gaactgacagacacgccctatgtgg

SEQ ID NO: 630977 - DNA, 25 bp, Mus musculus
gaactgacagactcgccctatgtgg

SEQ ID NO: 630978 - DNA, 25 bp, Mus musculus
gaactgacatgacgacccctttttg

SEQ ID NO: 630979 - DNA, 25 bp, Mus musculus
gaactgacatgaggacccctttttg

SEQ ID NO: 630980 - DNA, 25 bp, Mus musculus
gaactgacccagatgaaggctggcg

SEQ ID NO: 630981 - DNA, 25 bp, Mus musculus
gaactgacccagttgaaggctggcg

SEQ ID NO: 630982 - DNA, 25 bp, Mus musculus
gaactgacccatcgctatgacgact

SEQ ID NO: 630983 - DNA, 25 bp, Mus musculus
gaactgacccatggctatgacgact

SEQ ID NO: 630984 - DNA, 25 bp, Mus musculus
gaactgacctgtagtccactcccag

SEQ ID NO: 630985 - DNA, 25 bp, Mus musculus
gaactgacctgttgtccactcccag

SEQ ID NO: 630986 - DNA, 25 bp, Mus musculus
gaactgacgtttctggctggtcaag

SEQ ID NO: 630987 - DNA, 25 bp, Mus musculus
gaactgacgtttgtggctggtcaag

SEQ ID NO: 630988 - DNA, 25 bp, Mus musculus
gaactgactccgagtaggaggaccc

SEQ ID NO: 630989 - DNA, 25 bp, Mus musculus
gaactgactccgtgtaggaggaccc

SEQ ID NO: 630990 - DNA, 25 bp, Mus musculus
gaactgactctaaacaaaggccagg

SEQ ID NO: 630991 - DNA, 25 bp, Mus musculus
gaactgactctatacaaaggccagg

SEQ ID NO: 630992 - DNA, 25 bp, Mus musculus
gaactgactgataacagagggatcc

SEQ ID NO: 630993 - DNA, 25 bp, Mus musculus
gaactgactgattacagagggatcc

SEQ ID NO: 630994 - DNA, 25 bp, Mus musculus
gaactgagagagatacatagcaaac

SEQ ID NO: 630995 - DNA, 25 bp, Mus musculus
gaactgagagagttacatagcaaac

SEQ ID NO: 630996 - DNA, 25 bp, Mus musculus
gaactgagcgctctgagacaggcaa

SEQ ID NO: 630997 - DNA, 25 bp, Mus musculus
gaactgagcgctgtgagacaggcaa

SEQ ID NO: 630998 - DNA, 25 bp, Mus musculus
gaactgaggctcaagcacagccgct

SEQ ID NO: 630999 - DNA, 25 bp, Mus musculus
gaactgaggctctagcacagccgct

SEQ ID NO: 631000 - DNA, 25 bp, Mus musculus
gaactgagtggcaccgtggcccaga

SEQ ID NO: 631001 - DNA, 25 bp, Mus musculus
gaactgagtggctccgtggcccaga

SEQ ID NO: 631002 - DNA, 25 bp, Mus musculus
gaactgagttctcggcactattccc

SEQ ID NO: 631003 - DNA, 25 bp, Mus musculus
gaactgagttctgggcactattccc

SEQ ID NO: 631004 - DNA, 25 bp, Mus musculus
gaactgataagacgttcttccttaa

SEQ ID NO: 631005 - DNA, 25 bp, Mus musculus
gaactgataagaggttcttccttaa

SEQ ID NO: 631006 - DNA, 25 bp, Mus musculus
gaactgataggcctacaagagccca

SEQ ID NO: 631007 - DNA, 25 bp, Mus musculus
gaactgataggcgtacaagagccca

SEQ ID NO: 631008 - DNA, 25 bp, Mus musculus
gaactgatccaacatgattgccact

SEQ ID NO: 631009 - DNA, 25 bp, Mus musculus
gaactgatccaagatgattgccact

SEQ ID NO: 631010 - DNA, 25 bp, Mus musculus
gaactgatgtatcgagttgcatttg

SEQ ID NO: 631011 - DNA, 25 bp, Mus musculus
gaactgatgtatggagttgcatttg

SEQ ID NO: 631012 - DNA, 25 bp, Mus musculus
gaactgattccccacgtctatggca

SEQ ID NO: 631013 - DNA, 25 bp, Mus musculus
gaactgattcccgacgtctatggca

SEQ ID NO: 631014 - DNA, 25 bp, Mus musculus
gaactgcaagaactagaaaaacgac

SEQ ID NO: 631015 - DNA, 25 bp, Mus musculus
gaactgcaagaagtagaaaaacgac

SEQ ID NO: 631016 - DNA, 25 bp, Mus musculus
gaactgcaagagcagattggcgcct

SEQ ID NO: 631017 - DNA, 25 bp, Mus musculus
gaactgcaagaggagattggcgcct

SEQ ID NO: 631018 - DNA, 25 bp, Mus musculus
gaactgcaagtgcattttttggatc

SEQ ID NO: 631019 - DNA, 25 bp, Mus musculus
gaactgcaagtggattttttggatc

SEQ ID NO: 631020 - DNA, 25 bp, Mus musculus
gaactgcacaaaaagtgtttcaccc

SEQ ID NO: 631021 - DNA, 25 bp, Mus musculus
gaactgcacaaatagtgtttcaccc

SEQ ID NO: 631022 - DNA, 25 bp, Mus musculus
gaactgcacgagatcaccgacctga

SEQ ID NO: 631023 - DNA, 25 bp, Mus musculus
gaactgcacgagttcaccgacctga

SEQ ID NO: 631024 - DNA, 25 bp, Mus musculus
gaactgcactacatggaggtctacc

SEQ ID NO: 631025 - DNA, 25 bp, Mus musculus
gaactgcactacttggaggtctacc

SEQ ID NO: 631026 - DNA, 25 bp, Mus musculus
gaactgcactccagctgtcactaag

SEQ ID NO: 631027 - DNA, 25 bp, Mus musculus
gaactgcactcctgctgtcactaag

SEQ ID NO: 631028 - DNA, 25 bp, Mus musculus
gaactgcagaacctagaccttttcc

SEQ ID NO: 631029 - DNA, 25 bp, Mus musculus
gaactgcagaacgtagaccttttcc

SEQ ID NO: 631030 - DNA, 25 bp, Mus musculus
gaactgcagcagactcgaatccgca

SEQ ID NO: 631031 - DNA, 25 bp, Mus musculus
gaactgcagcagtctcgaatccgca

SEQ ID NO: 631032 - DNA, 25 bp, Mus musculus
gaactgcagcatcatgtaatctggg

SEQ ID NO: 631033 - DNA, 25 bp, Mus musculus
gaactgcagcatgatgtaatctggg

SEQ ID NO: 631034 - DNA, 25 bp, Mus musculus
gaactgcagcccatcatccctaatg

SEQ ID NO: 631035 - DNA, 25 bp, Mus musculus
gaactgcagcccttcatccctaatg

SEQ ID NO: 631036 - DNA, 25 bp, Mus musculus
gaactgcatgaacaaagaccatggc

SEQ ID NO: 631037 - DNA, 25 bp, Mus musculus
gaactgcatgaagaaagaccatggc

SEQ ID NO: 631038 - DNA, 25 bp, Mus musculus
gaactgcatgcgcaccatgggctac

SEQ ID NO: 631039 - DNA, 25 bp, Mus musculus
gaactgcatgcggaccatgggctac

SEQ ID NO: 631040 - DNA, 25 bp, Mus musculus
gaactgcattcacatagtgcacaga

SEQ ID NO: 631041 - DNA, 25 bp, Mus musculus
gaactgcattcagatagtgcacaga

SEQ ID NO: 631042 - DNA, 25 bp, Mus musculus
gaactgccaacactaaaggatatgg

SEQ ID NO: 631043 - DNA, 25 bp, Mus musculus
gaactgccaacagtaaaggatatgg

SEQ ID NO: 631044 - DNA, 25 bp, Mus musculus
gaactgccagttagccgacgtgaaa

SEQ ID NO: 631045 - DNA, 25 bp, Mus musculus
gaactgccagtttgccgacgtgaaa

SEQ ID NO: 631046 - DNA, 25 bp, Mus musculus
gaactgccatcaccaagaagtttgg

SEQ ID NO: 631047 - DNA, 25 bp, Mus musculus
gaactgccatcagcaagaagtttgg

SEQ ID NO: 631048 - DNA, 25 bp, Mus musculus
gaactgcccaggaagggtgctctta

SEQ ID NO: 631049 - DNA, 25 bp, Mus musculus
gaactgcccaggtagggtgctctta

SEQ ID NO: 631050 - DNA, 25 bp, Mus musculus
gaactgcctcgtcatgtatgtcatc

SEQ ID NO: 631051 - DNA, 25 bp, Mus musculus
gaactgcctcgtgatgtatgtcatc

SEQ ID NO: 631052 - DNA, 25 bp, Mus musculus
gaactgcctgacagcctccaagtca

SEQ ID NO: 631053 - DNA, 25 bp, Mus musculus
gaactgcctgactgcctccaagtca

SEQ ID NO: 631054 - DNA, 25 bp, Mus musculus
gaactgcctggtcggtgaaaataat

SEQ ID NO: 631055 - DNA, 25 bp, Mus musculus
gaactgcctggtgggtgaaaataat

SEQ ID NO: 631056 - DNA, 25 bp, Mus musculus
gaactgcgaacacataaaatcattt

SEQ ID NO: 631057 - DNA, 25 bp, Mus musculus
gaactgcgaacagataaaatcattt

SEQ ID NO: 631058 - DNA, 25 bp, Mus musculus
gaactgcgagcacatagaactcagg

SEQ ID NO: 631059 - DNA, 25 bp, Mus musculus
gaactgcgagcagatagaactcagg

SEQ ID NO: 631060 - DNA, 25 bp, Mus musculus
gaactgcgagccatggcccgaaaga

SEQ ID NO: 631061 - DNA, 25 bp, Mus musculus
gaactgcgagccttggcccgaaaga

SEQ ID NO: 631062 - DNA, 25 bp, Mus musculus
gaactgcgccacctcatgacaaact

SEQ ID NO: 631063 - DNA, 25 bp, Mus musculus
gaactgcgccacgtcatgacaaact

SEQ ID NO: 631064 - DNA, 25 bp, Mus musculus
gaactgcgcttcagccgagcggtcc

SEQ ID NO: 631065 - DNA, 25 bp, Mus musculus
gaactgcgcttctgccgagcggtcc

SEQ ID NO: 631066 - DNA, 25 bp, Mus musculus
gaactgcggagtctcatgaatactt

SEQ ID NO: 631067 - DNA, 25 bp, Mus musculus
gaactgcggagtgtcatgaatactt

SEQ ID NO: 631068 - DNA, 25 bp, Mus musculus
gaactgcggatcagctgaggctttg

SEQ ID NO: 631069 - DNA, 25 bp, Mus musculus
gaactgcggatctgctgaggctttg

SEQ ID NO: 631070 - DNA, 25 bp, Mus musculus
gaactgcgtgagaccaagcgccggc

SEQ ID NO: 631071 - DNA, 25 bp, Mus musculus
gaactgcgtgagtccaagcgccggc

SEQ ID NO: 631072 - DNA, 25 bp, Mus musculus
gaactgctacataagccattactgg

SEQ ID NO: 631073 - DNA, 25 bp, Mus musculus
gaactgctacattagccattactgg

SEQ ID NO: 631074 - DNA, 25 bp, Mus musculus
gaactgctagcaagtatagcgcgaa

SEQ ID NO: 631075 - DNA, 25 bp, Mus musculus
gaactgctagcatgtatagcgcgaa

SEQ ID NO: 631076 - DNA, 25 bp, Mus musculus
gaactgctctgccttaaagcctgcg

SEQ ID NO: 631077 - DNA, 25 bp, Mus musculus
gaactgctctgcgttaaagcctgcg

SEQ ID NO: 631078 - DNA, 25 bp, Mus musculus
gaactgctcttaactcgcttttctc

SEQ ID NO: 631079 - DNA, 25 bp, Mus musculus
gaactgctcttatctcgcttttctc

SEQ ID NO: 631080 - DNA, 25 bp, Mus musculus
gaactgctgcagagtgccagtgcca

SEQ ID NO: 631081 - DNA, 25 bp, Mus musculus
gaactgctgcagtgtgccagtgcca

SEQ ID NO: 631082 - DNA, 25 bp, Mus musculus
gaactgctgcctccatcctaaagtg

SEQ ID NO: 631083 - DNA, 25 bp, Mus musculus
gaactgctgcctgcatcctaaagtg

SEQ ID NO: 631084 - DNA, 25 bp, Mus musculus
gaactgctgctcaaggaatatgtgc

SEQ ID NO: 631085 - DNA, 25 bp, Mus musculus
gaactgctgctctaggaatatgtgc

SEQ ID NO: 631086 - DNA, 25 bp, Mus musculus
gaactgctggagacaatctttctgg

SEQ ID NO: 631087 - DNA, 25 bp, Mus musculus
gaactgctggagtcaatctttctgg

SEQ ID NO: 631088 - DNA, 25 bp, Mus musculus
gaactgcttctgagtaactgaggca

SEQ ID NO: 631089 - DNA, 25 bp, Mus musculus
gaactgcttctgcatcaaagtaaat

SEQ ID NO: 631090 - DNA, 25 bp, Mus musculus
gaactgcttctggatcaaagtaaat

SEQ ID NO: 631091 - DNA, 25 bp, Mus musculus
gaactgcttctgtgtaactgaggca

SEQ ID NO: 631092 - DNA, 25 bp, Mus musculus
gaactggaaaggcagcgacaacttg

SEQ ID NO: 631093 - DNA, 25 bp, Mus musculus
gaactggaaagggagcgacaacttg

SEQ ID NO: 631094 - DNA, 25 bp, Mus musculus
gaactggaaatcagtcctctttgta

SEQ ID NO: 631095 - DNA, 25 bp, Mus musculus
gaactggaaatctgtcctctttgta

SEQ ID NO: 631096 - DNA, 25 bp, Mus musculus
gaactggaacgtagttgctcgcgcc

SEQ ID NO: 631097 - DNA, 25 bp, Mus musculus
gaactggaacgttgttgctcgcgcc

SEQ ID NO: 631098 - DNA, 25 bp, Mus musculus
gaactggaactcaaattcccaaagt

SEQ ID NO: 631099 - DNA, 25 bp, Mus musculus
gaactggaactctaattcccaaagt

SEQ ID NO: 631100 - DNA, 25 bp, Mus musculus
gaactggaagagaccctgaaagtaa

SEQ ID NO: 631101 - DNA, 25 bp, Mus musculus
gaactggaagagtccctgaaagtaa

SEQ ID NO: 631102 - DNA, 25 bp, Mus musculus
gaactggacaaaaactccgaggctc

SEQ ID NO: 631103 - DNA, 25 bp, Mus musculus
gaactggacaaatactccgaggctc

SEQ ID NO: 631104 - DNA, 25 bp, Mus musculus
gaactggaccctagcctggtgttta

SEQ ID NO: 631105 - DNA, 25 bp, Mus musculus
gaactggacccttgcctggtgttta

SEQ ID NO: 631106 - DNA, 25 bp, Mus musculus
gaactggaccggagactactctcga

SEQ ID NO: 631107 - DNA, 25 bp, Mus musculus
gaactggaccggtgactactctcga

SEQ ID NO: 631108 - DNA, 25 bp, Mus musculus
gaactggaccgtctcaagctgagct

SEQ ID NO: 631109 - DNA, 25 bp, Mus musculus
gaactggaccgtgtcaagctgagct

SEQ ID NO: 631110 - DNA, 25 bp, Mus musculus
gaactggactctaaatgggccctga

SEQ ID NO: 631111 - DNA, 25 bp, Mus musculus
gaactggactcttaatgggccctga

SEQ ID NO: 631112 - DNA, 25 bp, Mus musculus
gaactggagatcatcgaacaaaacg

SEQ ID NO: 631113 - DNA, 25 bp, Mus musculus
gaactggagatcttcgaacaaaacg

SEQ ID NO: 631114 - DNA, 25 bp, Mus musculus
gaactggagctgaccgaggccagca

SEQ ID NO: 631115 - DNA, 25 bp, Mus musculus
gaactggagctgtccgaggccagca

SEQ ID NO: 631116 - DNA, 25 bp, Mus musculus
gaactggagtaaatctactctcaac

SEQ ID NO: 631117 - DNA, 25 bp, Mus musculus
gaactggagtaattctactctcaac

SEQ ID NO: 631118 - DNA, 25 bp, Mus musculus
gaactggagtcaagctgctgtaaag

SEQ ID NO: 631119 - DNA, 25 bp, Mus musculus
gaactggagtcatgctgctgtaaag

SEQ ID NO: 631120 - DNA, 25 bp, Mus musculus
gaactggagtgcacggtatctgtca

SEQ ID NO: 631121 - DNA, 25 bp, Mus musculus
gaactggagtgctcggtatctgtca

SEQ ID NO: 631122 - DNA, 25 bp, Mus musculus
gaactggatatgctaccaggaagag

SEQ ID NO: 631123 - DNA, 25 bp, Mus musculus
gaactggatatggtaccaggaagag

SEQ ID NO: 631124 - DNA, 25 bp, Mus musculus
gaactggatgctcttttggaacagc

SEQ ID NO: 631125 - DNA, 25 bp, Mus musculus
gaactggatgctgttttggaacagc

SEQ ID NO: 631126 - DNA, 25 bp, Mus musculus
gaactggattgcagtttcaatgaaa

SEQ ID NO: 631127 - DNA, 25 bp, Mus musculus
gaactggattgctgtttcaatgaaa

SEQ ID NO: 631128 - DNA, 25 bp, Mus musculus
gaactggcaagacaaccagcatcct

SEQ ID NO: 631129 - DNA, 25 bp, Mus musculus
gaactggcaagagaaccagcatcct

SEQ ID NO: 631130 - DNA, 25 bp, Mus musculus
gaactggcagttagcatccatctag

SEQ ID NO: 631131 - DNA, 25 bp, Mus musculus
gaactggcagtttgcatccatctag

SEQ ID NO: 631132 - DNA, 25 bp, Mus musculus
gaactggcattgcttaagcaggaac

SEQ ID NO: 631133 - DNA, 25 bp, Mus musculus
gaactggcattggttaagcaggaac

SEQ ID NO: 631134 - DNA, 25 bp, Mus musculus
gaactggccattaaggtgtgtggtc

SEQ ID NO: 631135 - DNA, 25 bp, Mus musculus
gaactggccatttaggtgtgtggtc

SEQ ID NO: 631136 - DNA, 25 bp, Mus musculus
gaactggcccaaatccggaaggaag

SEQ ID NO: 631137 - DNA, 25 bp, Mus musculus
gaactggcccaattccggaaggaag

SEQ ID NO: 631138 - DNA, 25 bp, Mus musculus
gaactggcgccaatagggactggca

SEQ ID NO: 631139 - DNA, 25 bp, Mus musculus
gaactggcgccattagggactggca

SEQ ID NO: 631140 - DNA, 25 bp, Mus musculus
gaactggcggtgacaaccccggtgt

SEQ ID NO: 631141 - DNA, 25 bp, Mus musculus
gaactggcggtgtcaaccccggtgt

SEQ ID NO: 631142 - DNA, 25 bp, Mus musculus
gaactggctataaaaaccaggctgg

SEQ ID NO: 631143 - DNA, 25 bp, Mus musculus
gaactggctatataaaccaggctgg

SEQ ID NO: 631144 - DNA, 25 bp, Mus musculus
gaactggctattcgcttggagtgcc

SEQ ID NO: 631145 - DNA, 25 bp, Mus musculus
gaactggctattggcttggagtgcc

SEQ ID NO: 631146 - DNA, 25 bp, Mus musculus
gaactggctcaacatggttcgggct

SEQ ID NO: 631147 - DNA, 25 bp, Mus musculus
gaactggctcaagatggttcgggct

SEQ ID NO: 631148 - DNA, 25 bp, Mus musculus
gaactggctcttagatggtttgggt

SEQ ID NO: 631149 - DNA, 25 bp, Mus musculus
gaactggctctttgatggtttgggt

SEQ ID NO: 631150 - DNA, 25 bp, Mus musculus
gaactggctgaccacttgcataaac

SEQ ID NO: 631151 - DNA, 25 bp, Mus musculus
gaactggctgacgacttgcataaac

SEQ ID NO: 631152 - DNA, 25 bp, Mus musculus
gaactggctgtacctttcccgagaa

SEQ ID NO: 631153 - DNA, 25 bp, Mus musculus
gaactggctgtagctttcccgagaa

SEQ ID NO: 631154 - DNA, 25 bp, Mus musculus
gaactggcttcaaatcagtatgtga

SEQ ID NO: 631155 - DNA, 25 bp, Mus musculus
gaactggcttcatatcagtatgtga

SEQ ID NO: 631156 - DNA, 25 bp, Mus musculus
gaactgggagtacttctacagcctg

SEQ ID NO: 631157 - DNA, 25 bp, Mus musculus
gaactgggagtagttctacagcctg

SEQ ID NO: 631158 - DNA, 25 bp, Mus musculus
gaactgggattaactcctagagaga

SEQ ID NO: 631159 - DNA, 25 bp, Mus musculus
gaactgggattatctcctagagaga

SEQ ID NO: 631160 - DNA, 25 bp, Mus musculus
gaactgggcaagatggtcgtggact

SEQ ID NO: 631161 - DNA, 25 bp, Mus musculus
gaactgggcaagcataagtggctat

SEQ ID NO: 631162 - DNA, 25 bp, Mus musculus
gaactgggcaaggataagtggctat

SEQ ID NO: 631163 - DNA, 25 bp, Mus musculus
gaactgggcaagttggtcgtggact

SEQ ID NO: 631164 - DNA, 25 bp, Mus musculus
gaactgggcatcaagtacattggga

SEQ ID NO: 631165 - DNA, 25 bp, Mus musculus
gaactgggcatctagtacattggga

SEQ ID NO: 631166 - DNA, 25 bp, Mus musculus
gaactgggctttcgcactgcccgag

SEQ ID NO: 631167 - DNA, 25 bp, Mus musculus
gaactgggctttggcactgcccgag

SEQ ID NO: 631168 - DNA, 25 bp, Mus musculus
gaactgggtacccaccagcaagcat

SEQ ID NO: 631169 - DNA, 25 bp, Mus musculus
gaactgggtaccgaccagcaagcat

SEQ ID NO: 631170 - DNA, 25 bp, Mus musculus
gaactgggtcacctttcagctgaag

SEQ ID NO: 631171 - DNA, 25 bp, Mus musculus
gaactgggtcacgtttcagctgaag

SEQ ID NO: 631172 - DNA, 25 bp, Mus musculus
gaactgggtccaaagctggcctgtg

SEQ ID NO: 631173 - DNA, 25 bp, Mus musculus
gaactgggtccatagctggcctgtg

SEQ ID NO: 631174 - DNA, 25 bp, Mus musculus
gaactgggtggaaactcacatgaac

SEQ ID NO: 631175 - DNA, 25 bp, Mus musculus
gaactgggtggatactcacatgaac

SEQ ID NO: 631176 - DNA, 25 bp, Mus musculus
gaactgggtgtgactgacttgctat

SEQ ID NO: 631177 - DNA, 25 bp, Mus musculus
gaactgggtgtgtctgacttgctat

SEQ ID NO: 631178 - DNA, 25 bp, Mus musculus
gaactggtccgtcattgaaaaccca

SEQ ID NO: 631179 - DNA, 25 bp, Mus musculus
gaactggtccgtgattgaaaaccca

SEQ ID NO: 631180 - DNA, 25 bp, Mus musculus
gaactggtgagcagactactccatt

SEQ ID NO: 631181 - DNA, 25 bp, Mus musculus
gaactggtgagctgactactccatt

SEQ ID NO: 631182 - DNA, 25 bp, Mus musculus
gaactggtgcctaggcatagcttaa

SEQ ID NO: 631183 - DNA, 25 bp, Mus musculus
gaactggtgccttggcatagcttaa

SEQ ID NO: 631184 - DNA, 25 bp, Mus musculus
gaactggtgctgcagcaactgcgct

SEQ ID NO: 631185 - DNA, 25 bp, Mus musculus
gaactggtgctggagcaactgcgct

SEQ ID NO: 631186 - DNA, 25 bp, Mus musculus
gaactggtggccatatacactagcc

SEQ ID NO: 631187 - DNA, 25 bp, Mus musculus
gaactggtggccttatacactagcc

SEQ ID NO: 631188 - DNA, 25 bp, Mus musculus
gaactggtggttcaactatgatctg

SEQ ID NO: 631189 - DNA, 25 bp, Mus musculus
gaactggtggttgaactatgatctg

SEQ ID NO: 631190 - DNA, 25 bp, Mus musculus
gaactggtgttgcagattccttcat

SEQ ID NO: 631191 - DNA, 25 bp, Mus musculus
gaactggtgttggagattccttcat

SEQ ID NO: 631192 - DNA, 25 bp, Mus musculus
gaactggttcggcatgacactctca

SEQ ID NO: 631193 - DNA, 25 bp, Mus musculus
gaactggttcgggatgacactctca

SEQ ID NO: 631194 - DNA, 25 bp, Mus musculus
gaactgtaaagcagcttatggctac

SEQ ID NO: 631195 - DNA, 25 bp, Mus musculus
gaactgtaaagctgcttatggctac

SEQ ID NO: 631196 - DNA, 25 bp, Mus musculus
gaactgtaatccctgccaataagct

SEQ ID NO: 631197 - DNA, 25 bp, Mus musculus
gaactgtaatccgtgccaataagct

SEQ ID NO: 631198 - DNA, 25 bp, Mus musculus
gaactgtacacacataggctagacc

SEQ ID NO: 631199 - DNA, 25 bp, Mus musculus
gaactgtacacagataggctagacc

SEQ ID NO: 631200 - DNA, 25 bp, Mus musculus
gaactgtaccctaaaatcaagtttg

SEQ ID NO: 631201 - DNA, 25 bp, Mus musculus
gaactgtacccttaaatcaagtttg

SEQ ID NO: 631202 - DNA, 25 bp, Mus musculus
gaactgtattctcgggtgacagcag

SEQ ID NO: 631203 - DNA, 25 bp, Mus musculus
gaactgtattctggggtgacagcag

SEQ ID NO: 631204 - DNA, 25 bp, Mus musculus
gaactgtatttgaacgacaacccca

SEQ ID NO: 631205 - DNA, 25 bp, Mus musculus
gaactgtatttgtacgacaacccca

SEQ ID NO: 631206 - DNA, 25 bp, Mus musculus
gaactgtcacagaatgaaaccggcg

SEQ ID NO: 631207 - DNA, 25 bp, Mus musculus
gaactgtcacagtatgaaaccggcg

SEQ ID NO: 631208 - DNA, 25 bp, Mus musculus
gaactgtcagatatgactcaactca

SEQ ID NO: 631209 - DNA, 25 bp, Mus musculus
gaactgtcagatttgactcaactca

SEQ ID NO: 631210 - DNA, 25 bp, Mus musculus
gaactgtcatcccatccaacaatga

SEQ ID NO: 631211 - DNA, 25 bp, Mus musculus
gaactgtcatccgatccaacaatga

SEQ ID NO: 631212 - DNA, 25 bp, Mus musculus
gaactgtccctaccgcgctcgagtg

SEQ ID NO: 631213 - DNA, 25 bp, Mus musculus
gaactgtccctagcgcgctcgagtg

SEQ ID NO: 631214 - DNA, 25 bp, Mus musculus
gaactgtctcggatggtcagtgagc

SEQ ID NO: 631215 - DNA, 25 bp, Mus musculus
gaactgtctcggttggtcagtgagc

SEQ ID NO: 631216 - DNA, 25 bp, Mus musculus
gaactgtctgagctctctagaggaa

SEQ ID NO: 631217 - DNA, 25 bp, Mus musculus
gaactgtctgaggtctctagaggaa

SEQ ID NO: 631218 - DNA, 25 bp, Mus musculus
gaactgtgaatgctggctcagatct

SEQ ID NO: 631219 - DNA, 25 bp, Mus musculus
gaactgtgaatggtggctcagatct

SEQ ID NO: 631220 - DNA, 25 bp, Mus musculus
gaactgtgactaagctgcagagaag

SEQ ID NO: 631221 - DNA, 25 bp, Mus musculus
gaactgtgactatgctgcagagaag

SEQ ID NO: 631222 - DNA, 25 bp, Mus musculus
gaactgtgatgtctccatgcggctg

SEQ ID NO: 631223 - DNA, 25 bp, Mus musculus
gaactgtgatgtgtccatgcggctg

SEQ ID NO: 631224 - DNA, 25 bp, Mus musculus
gaactgtgcagaccctacctctgaa

SEQ ID NO: 631225 - DNA, 25 bp, Mus musculus
gaactgtgcagagcctacctctgaa

SEQ ID NO: 631226 - DNA, 25 bp, Mus musculus
gaactgtgccctagtagaagaagta

SEQ ID NO: 631227 - DNA, 25 bp, Mus musculus
gaactgtgcccttgtagaagaagta

SEQ ID NO: 631228 - DNA, 25 bp, Mus musculus
gaactgtgcgaaagttctgatcact

SEQ ID NO: 631229 - DNA, 25 bp, Mus musculus
gaactgtgcgaatgttctgatcact

SEQ ID NO: 631230 - DNA, 25 bp, Mus musculus
gaactgtggaatacattatggactc

SEQ ID NO: 631231 - DNA, 25 bp, Mus musculus
gaactgtggaattcattatggactc

SEQ ID NO: 631232 - DNA, 25 bp, Mus musculus
gaactgtgggaaagtatgatttgcc

SEQ ID NO: 631233 - DNA, 25 bp, Mus musculus
gaactgtgggaatgtatgatttgcc

SEQ ID NO: 631234 - DNA, 25 bp, Mus musculus
gaactgtgtacgctttggttttgca

SEQ ID NO: 631235 - DNA, 25 bp, Mus musculus
gaactgtgtacggtttggttttgca

SEQ ID NO: 631236 - DNA, 25 bp, Mus musculus
gaactgttagacagtgggttcttga

SEQ ID NO: 631237 - DNA, 25 bp, Mus musculus
gaactgttagactgtgggttcttga

SEQ ID NO: 631238 - DNA, 25 bp, Mus musculus
gaactgttaggaagcactatgggca

SEQ ID NO: 631239 - DNA, 25 bp, Mus musculus
gaactgttaggatgcactatgggca

SEQ ID NO: 631240 - DNA, 25 bp, Mus musculus
gaactgttcacacgcatttccttca

SEQ ID NO: 631241 - DNA, 25 bp, Mus musculus
gaactgttcacaggcatttccttca

SEQ ID NO: 631242 - DNA, 25 bp, Mus musculus
gaactgttcttgctcaccctcgcta

SEQ ID NO: 631243 - DNA, 25 bp, Mus musculus
gaactgttcttggtcaccctcgcta

SEQ ID NO: 631244 - DNA, 25 bp, Mus musculus
gaactgtttaccacagcagctagca

SEQ ID NO: 631245 - DNA, 25 bp, Mus musculus
gaactgtttacctcagcagctagca

SEQ ID NO: 631246 - DNA, 25 bp, Mus musculus
gaactgtttcgcctggtgcctggca

SEQ ID NO: 631247 - DNA, 25 bp, Mus musculus
gaactgtttcgcgtggtgcctggca

SEQ ID NO: 631248 - DNA, 25 bp, Mus musculus
gaactgtttctgaaagagcatgacc

SEQ ID NO: 631249 - DNA, 25 bp, Mus musculus
gaactgtttctgtaagagcatgacc

SEQ ID NO: 631250 - DNA, 25 bp, Mus musculus
gaactgtttgaaaggattacaagga

SEQ ID NO: 631251 - DNA, 25 bp, Mus musculus
gaactgtttgaatggattacaagga

SEQ ID NO: 631252 - DNA, 25 bp, Mus musculus
gaacttaacatcatcagtgaacgag

SEQ ID NO: 631253 - DNA, 25 bp, Mus musculus
gaacttaacatcttcagtgaacgag

SEQ ID NO: 631254 - DNA, 25 bp, Mus musculus
gaacttaccactagacatcactttg

SEQ ID NO: 631255 - DNA, 25 bp, Mus musculus
gaacttaccactcggcaagcttcaa

SEQ ID NO: 631256 - DNA, 25 bp, Mus musculus
gaacttaccactgggcaagcttcaa

SEQ ID NO: 631257 - DNA, 25 bp, Mus musculus
gaacttaccacttgacatcactttg

SEQ ID NO: 631258 - DNA, 25 bp, Mus musculus
gaacttaccagtcatggataatcaa

SEQ ID NO: 631259 - DNA, 25 bp, Mus musculus
gaacttaccagtgatggataatcaa

SEQ ID NO: 631260 - DNA, 25 bp, Mus musculus
gaacttaccggcagatcatctgttc

SEQ ID NO: 631261 - DNA, 25 bp, Mus musculus
gaacttaccggctgatcatctgttc

SEQ ID NO: 631262 - DNA, 25 bp, Mus musculus
gaacttactgaacgtctctgaggcc

SEQ ID NO: 631263 - DNA, 25 bp, Mus musculus
gaacttactgaaggtctctgaggcc

SEQ ID NO: 631264 - DNA, 25 bp, Mus musculus
gaacttagagccagccttcccagag

SEQ ID NO: 631265 - DNA, 25 bp, Mus musculus
gaacttagagcctgccttcccagag

SEQ ID NO: 631266 - DNA, 25 bp, Mus musculus
gaacttagcaggacttgatgccgtt

SEQ ID NO: 631267 - DNA, 25 bp, Mus musculus
gaacttagcaggtcttgatgccgtt

SEQ ID NO: 631268 - DNA, 25 bp, Mus musculus
gaacttagccttaaatcctgaccag

SEQ ID NO: 631269 - DNA, 25 bp, Mus musculus
gaacttagcctttaatcctgaccag

SEQ ID NO: 631270 - DNA, 25 bp, Mus musculus
gaacttagctgtccaatctgagaag

SEQ ID NO: 631271 - DNA, 25 bp, Mus musculus
gaacttagctgtgcaatctgagaag

SEQ ID NO: 631272 - DNA, 25 bp, Mus musculus
gaacttaggcagacactatgtcggc

SEQ ID NO: 631273 - DNA, 25 bp, Mus musculus
gaacttaggcagtcactatgtcggc

SEQ ID NO: 631274 - DNA, 25 bp, Mus musculus
gaacttatacatcgcaaattccaga

SEQ ID NO: 631275 - DNA, 25 bp, Mus musculus
gaacttatacatggcaaattccaga

SEQ ID NO: 631276 - DNA, 25 bp, Mus musculus
gaacttattgcgaactttgctgcca

SEQ ID NO: 631277 - DNA, 25 bp, Mus musculus
gaacttattgcgtactttgctgcca

SEQ ID NO: 631278 - DNA, 25 bp, Mus musculus
gaacttcaacctcaaacctctggtt

SEQ ID NO: 631279 - DNA, 25 bp, Mus musculus
gaacttcaacctgaaacctctggtt

SEQ ID NO: 631280 - DNA, 25 bp, Mus musculus
gaacttcaatgtagcctttgctttg

SEQ ID NO: 631281 - DNA, 25 bp, Mus musculus
gaacttcaatgttgcctttgctttg

SEQ ID NO: 631282 - DNA, 25 bp, Mus musculus
gaacttcagaggcaacaagaaccca

SEQ ID NO: 631283 - DNA, 25 bp, Mus musculus
gaacttcagagggaacaagaaccca

SEQ ID NO: 631284 - DNA, 25 bp, Mus musculus
gaacttcagcctcactatctagcca

SEQ ID NO: 631285 - DNA, 25 bp, Mus musculus
gaacttcagcctgactatctagcca

SEQ ID NO: 631286 - DNA, 25 bp, Mus musculus
gaacttcagcgtaccttcccctgga

SEQ ID NO: 631287 - DNA, 25 bp, Mus musculus
gaacttcagcgttccttcccctgga

SEQ ID NO: 631288 - DNA, 25 bp, Mus musculus
gaacttcaggagactaatgcggcgc

SEQ ID NO: 631289 - DNA, 25 bp, Mus musculus
gaacttcaggagctgcagatcaccg

SEQ ID NO: 631290 - DNA, 25 bp, Mus musculus
gaacttcaggaggtgcagatcaccg

SEQ ID NO: 631291 - DNA, 25 bp, Mus musculus
gaacttcaggagtctaatgcggcgc

SEQ ID NO: 631292 - DNA, 25 bp, Mus musculus
gaacttcaggatcttcaactcacag

SEQ ID NO: 631293 - DNA, 25 bp, Mus musculus
gaacttcaggatgttcaactcacag

SEQ ID NO: 631294 - DNA, 25 bp, Mus musculus
gaacttcatggcctcactggatcac

SEQ ID NO: 631295 - DNA, 25 bp, Mus musculus
gaacttcatggcgtcactggatcac

SEQ ID NO: 631296 - DNA, 25 bp, Mus musculus
gaacttcatggtcatcaatgcggta

SEQ ID NO: 631297 - DNA, 25 bp, Mus musculus
gaacttcatggtgatcaatgcggta

SEQ ID NO: 631298 - DNA, 25 bp, Mus musculus
gaacttcatgtaagatcagtcccca

SEQ ID NO: 631299 - DNA, 25 bp, Mus musculus
gaacttcatgtatgatcagtcccca

SEQ ID NO: 631300 - DNA, 25 bp, Mus musculus
gaacttccacgtctggaacgactgc

SEQ ID NO: 631301 - DNA, 25 bp, Mus musculus
gaacttccacgtgtggaacgactgc

SEQ ID NO: 631302 - DNA, 25 bp, Mus musculus
gaacttccaggcatgtctgcacaac

SEQ ID NO: 631303 - DNA, 25 bp, Mus musculus
gaacttccaggcttgtctgcacaac

SEQ ID NO: 631304 - DNA, 25 bp, Mus musculus
gaacttccatccatgttaccctgtg

SEQ ID NO: 631305 - DNA, 25 bp, Mus musculus
gaacttccatccttgttaccctgtg

SEQ ID NO: 631306 - DNA, 25 bp, Mus musculus
gaacttccatgaaccccaaccagga

SEQ ID NO: 631307 - DNA, 25 bp, Mus musculus
gaacttccatgatccccaaccagga

SEQ ID NO: 631308 - DNA, 25 bp, Mus musculus
gaacttccatggcactaatacgcgg

SEQ ID NO: 631309 - DNA, 25 bp, Mus musculus
gaacttccatgggactaatacgcgg

SEQ ID NO: 631310 - DNA, 25 bp, Mus musculus
gaacttcccaagaggagctgcgcat

SEQ ID NO: 631311 - DNA, 25 bp, Mus musculus
gaacttcccaagtggagctgcgcat

SEQ ID NO: 631312 - DNA, 25 bp, Mus musculus
gaacttcccagtccagacttctgtg

SEQ ID NO: 631313 - DNA, 25 bp, Mus musculus
gaacttcccagtgcagacttctgtg

SEQ ID NO: 631314 - DNA, 25 bp, Mus musculus
gaacttccgcaaaggccagtacggc

SEQ ID NO: 631315 - DNA, 25 bp, Mus musculus
gaacttccgcaatggccagtacggc

SEQ ID NO: 631316 - DNA, 25 bp, Mus musculus
gaacttccggaccttcttagaactg

SEQ ID NO: 631317 - DNA, 25 bp, Mus musculus
gaacttccggacgttcttagaactg

SEQ ID NO: 631318 - DNA, 25 bp, Mus musculus
gaacttcctctcacagcagcaaaat

SEQ ID NO: 631319 - DNA, 25 bp, Mus musculus
gaacttcctctctcagcagcaaaat

SEQ ID NO: 631320 - DNA, 25 bp, Mus musculus
gaacttcctgttaatcacctatgag

SEQ ID NO: 631321 - DNA, 25 bp, Mus musculus
gaacttcctgtttatcacctatgag

SEQ ID NO: 631322 - DNA, 25 bp, Mus musculus
gaacttcgaaataaagtgaatcgct

SEQ ID NO: 631323 - DNA, 25 bp, Mus musculus
gaacttcgaaattaagtgaatcgct

SEQ ID NO: 631324 - DNA, 25 bp, Mus musculus
gaacttcgaaccagttactatgaga

SEQ ID NO: 631325 - DNA, 25 bp, Mus musculus
gaacttcgaacctgttactatgaga

SEQ ID NO: 631326 - DNA, 25 bp, Mus musculus
gaacttcgagcacgttaaatccctg

SEQ ID NO: 631327 - DNA, 25 bp, Mus musculus
gaacttcgagcaggttaaatccctg

SEQ ID NO: 631328 - DNA, 25 bp, Mus musculus
gaacttcgcgcccaaaggagagcca

SEQ ID NO: 631329 - DNA, 25 bp, Mus musculus
gaacttcgcgccgaaaggagagcca

SEQ ID NO: 631330 - DNA, 25 bp, Mus musculus
gaacttcgcgctcctcaaggtgctg

SEQ ID NO: 631331 - DNA, 25 bp, Mus musculus
gaacttcgcgctgctcaaggtgctg

SEQ ID NO: 631332 - DNA, 25 bp, Mus musculus
gaacttcggagacccagctgctgga

SEQ ID NO: 631333 - DNA, 25 bp, Mus musculus
gaacttcggagagccagctgctgga

SEQ ID NO: 631334 - DNA, 25 bp, Mus musculus
gaacttcggcatccttctgggcgtg

SEQ ID NO: 631335 - DNA, 25 bp, Mus musculus
gaacttcggcatgcttctgggcgtg

SEQ ID NO: 631336 - DNA, 25 bp, Mus musculus
gaacttcggcgtacaagagctatgc

SEQ ID NO: 631337 - DNA, 25 bp, Mus musculus
gaacttcggcgttcaagagctatgc

SEQ ID NO: 631338 - DNA, 25 bp, Mus musculus
gaacttcgtgtccatgagaatgaga

SEQ ID NO: 631339 - DNA, 25 bp, Mus musculus
gaacttcgtgtcgatgagaatgaga

SEQ ID NO: 631340 - DNA, 25 bp, Mus musculus
gaacttctccggcttggttgtgaca

SEQ ID NO: 631341 - DNA, 25 bp, Mus musculus
gaacttctccgggttggttgtgaca

SEQ ID NO: 631342 - DNA, 25 bp, Mus musculus
gaacttctgcagctaagaacagagg

SEQ ID NO: 631343 - DNA, 25 bp, Mus musculus
gaacttctgcagctgtgactgaact

SEQ ID NO: 631344 - DNA, 25 bp, Mus musculus
gaacttctgcaggtaagaacagagg

SEQ ID NO: 631345 - DNA, 25 bp, Mus musculus
gaacttctgcaggtgtgactgaact

SEQ ID NO: 631346 - DNA, 25 bp, Mus musculus
gaacttctggaaaataaggccatcc

SEQ ID NO: 631347 - DNA, 25 bp, Mus musculus
gaacttctggaacaaacaggatacc

SEQ ID NO: 631348 - DNA, 25 bp, Mus musculus
gaacttctggaagaaacaggatacc

SEQ ID NO: 631349 - DNA, 25 bp, Mus musculus
gaacttctggaatataaggccatcc

SEQ ID NO: 631350 - DNA, 25 bp, Mus musculus
gaacttctggagactagcttattga

SEQ ID NO: 631351 - DNA, 25 bp, Mus musculus
gaacttctggagtctagcttattga

SEQ ID NO: 631352 - DNA, 25 bp, Mus musculus
gaacttctgtagcaaccctgatggg

SEQ ID NO: 631353 - DNA, 25 bp, Mus musculus
gaacttctgtaggaaccctgatggg

SEQ ID NO: 631354 - DNA, 25 bp, Mus musculus
gaacttcttactcacaaggatgctc

SEQ ID NO: 631355 - DNA, 25 bp, Mus musculus
gaacttcttactgacaaggatgctc

SEQ ID NO: 631356 - DNA, 25 bp, Mus musculus
gaacttcttagtcactacattcgtc

SEQ ID NO: 631357 - DNA, 25 bp, Mus musculus
gaacttcttagtgactacattcgtc

SEQ ID NO: 631358 - DNA, 25 bp, Mus musculus
gaacttcttgagatgagaggataaa

SEQ ID NO: 631359 - DNA, 25 bp, Mus musculus
gaacttcttgagttgagaggataaa

SEQ ID NO: 631360 - DNA, 25 bp, Mus musculus
gaacttgaacgccatcacctatgag

SEQ ID NO: 631361 - DNA, 25 bp, Mus musculus
gaacttgaacgcgatcacctatgag

SEQ ID NO: 631362 - DNA, 25 bp, Mus musculus
gaacttgacaagcagataagtgacc

SEQ ID NO: 631363 - DNA, 25 bp, Mus musculus
gaacttgacaagcttaacctgtcca

SEQ ID NO: 631364 - DNA, 25 bp, Mus musculus
gaacttgacaaggagataagtgacc

SEQ ID NO: 631365 - DNA, 25 bp, Mus musculus
gaacttgacaaggttaacctgtcca

SEQ ID NO: 631366 - DNA, 25 bp, Mus musculus
gaacttgacacacctgtgcctgtca

SEQ ID NO: 631367 - DNA, 25 bp, Mus musculus
gaacttgacacagctgtgcctgtca

SEQ ID NO: 631368 - DNA, 25 bp, Mus musculus
gaacttgacctgaaactcgtttcct

SEQ ID NO: 631369 - DNA, 25 bp, Mus musculus
gaacttgacctgtaactcgtttcct

SEQ ID NO: 631370 - DNA, 25 bp, Mus musculus
gaacttgacgctctggtttttggcc

SEQ ID NO: 631371 - DNA, 25 bp, Mus musculus
gaacttgacgctgtggtttttggcc

SEQ ID NO: 631372 - DNA, 25 bp, Mus musculus
gaacttgactctaagaagactccct

SEQ ID NO: 631373 - DNA, 25 bp, Mus musculus
gaacttgactcttagaagactccct

SEQ ID NO: 631374 - DNA, 25 bp, Mus musculus
gaacttgaggaacatggcattcact

SEQ ID NO: 631375 - DNA, 25 bp, Mus musculus
gaacttgaggaagatggcattcact

SEQ ID NO: 631376 - DNA, 25 bp, Mus musculus
gaacttgaggggaccaaagctggaa

SEQ ID NO: 631377 - DNA, 25 bp, Mus musculus
gaacttgaggggtccaaagctggaa

SEQ ID NO: 631378 - DNA, 25 bp, Mus musculus
gaacttgaggttcgcgaatccccat

SEQ ID NO: 631379 - DNA, 25 bp, Mus musculus
gaacttgaggttggcgaatccccat

SEQ ID NO: 631380 - DNA, 25 bp, Mus musculus
gaacttgagtttccatccagactgg

SEQ ID NO: 631381 - DNA, 25 bp, Mus musculus
gaacttgagtttgcatccagactgg

SEQ ID NO: 631382 - DNA, 25 bp, Mus musculus
gaacttgatcgcaggaattgggccc

SEQ ID NO: 631383 - DNA, 25 bp, Mus musculus
gaacttgatcgctggaattgggccc

SEQ ID NO: 631384 - DNA, 25 bp, Mus musculus
gaacttgattgtcctcctggctgtg

SEQ ID NO: 631385 - DNA, 25 bp, Mus musculus
gaacttgattgtgctcctggctgtg

SEQ ID NO: 631386 - DNA, 25 bp, Mus musculus
gaacttgatttcatacgtggtgacc

SEQ ID NO: 631387 - DNA, 25 bp, Mus musculus
gaacttgatttcttacgtggtgacc

SEQ ID NO: 631388 - DNA, 25 bp, Mus musculus
gaacttgcagtgacctggacgagga

SEQ ID NO: 631389 - DNA, 25 bp, Mus musculus
gaacttgcagtgtcctggacgagga

SEQ ID NO: 631390 - DNA, 25 bp, Mus musculus
gaacttgccaggaggtccaaggagc

SEQ ID NO: 631391 - DNA, 25 bp, Mus musculus
gaacttgccaggtggtccaaggagc

SEQ ID NO: 631392 - DNA, 25 bp, Mus musculus
gaacttgcccctcagaagaagggag

SEQ ID NO: 631393 - DNA, 25 bp, Mus musculus
gaacttgcccctctccattggcatt

SEQ ID NO: 631394 - DNA, 25 bp, Mus musculus
gaacttgcccctgagaagaagggag

SEQ ID NO: 631395 - DNA, 25 bp, Mus musculus
gaacttgcccctgtccattggcatt

SEQ ID NO: 631396 - DNA, 25 bp, Mus musculus
gaacttgcgaccattgttagccaca

SEQ ID NO: 631397 - DNA, 25 bp, Mus musculus
gaacttgcgacctttgttagccaca

SEQ ID NO: 631398 - DNA, 25 bp, Mus musculus
gaacttgcgagaaatccagcgatga

SEQ ID NO: 631399 - DNA, 25 bp, Mus musculus
gaacttgcgagatatccagcgatga

SEQ ID NO: 631400 - DNA, 25 bp, Mus musculus
gaacttgcggcaattagtgaaagaa

SEQ ID NO: 631401 - DNA, 25 bp, Mus musculus
gaacttgcggcatttagtgaaagaa

SEQ ID NO: 631402 - DNA, 25 bp, Mus musculus
gaacttgctaccaaaggaggccttg

SEQ ID NO: 631403 - DNA, 25 bp, Mus musculus
gaacttgctacctaaggaggccttg

SEQ ID NO: 631404 - DNA, 25 bp, Mus musculus
gaacttgctctacaggtcagtcaga

SEQ ID NO: 631405 - DNA, 25 bp, Mus musculus
gaacttgctctagaggtcagtcaga

SEQ ID NO: 631406 - DNA, 25 bp, Mus musculus
gaacttggaactctgggacaaatag

SEQ ID NO: 631407 - DNA, 25 bp, Mus musculus
gaacttggaactgtgggacaaatag

SEQ ID NO: 631408 - DNA, 25 bp, Mus musculus
gaacttggaccaatgcgaatcccag

SEQ ID NO: 631409 - DNA, 25 bp, Mus musculus
gaacttggaccattgcgaatcccag

SEQ ID NO: 631410 - DNA, 25 bp, Mus musculus
gaacttggatttagcatatcaggag

SEQ ID NO: 631411 - DNA, 25 bp, Mus musculus
gaacttggattttgcatatcaggag

SEQ ID NO: 631412 - DNA, 25 bp, Mus musculus
gaacttggccatctccgcaggatga

SEQ ID NO: 631413 - DNA, 25 bp, Mus musculus
gaacttggccatgtccgcaggatga

SEQ ID NO: 631414 - DNA, 25 bp, Mus musculus
gaacttggcccaatagtccaatttg

SEQ ID NO: 631415 - DNA, 25 bp, Mus musculus
gaacttggcccattagtccaatttg

SEQ ID NO: 631416 - DNA, 25 bp, Mus musculus
gaacttggcgaacctagcgctgcag

SEQ ID NO: 631417 - DNA, 25 bp, Mus musculus
gaacttggcgaagctagcgctgcag

SEQ ID NO: 631418 - DNA, 25 bp, Mus musculus
gaacttggcttgagccttgcaaaca

SEQ ID NO: 631419 - DNA, 25 bp, Mus musculus
gaacttggcttgtgccttgcaaaca

SEQ ID NO: 631420 - DNA, 25 bp, Mus musculus
gaacttgggtttaccatttgatgca

SEQ ID NO: 631421 - DNA, 25 bp, Mus musculus
gaacttgggttttccatttgatgca

SEQ ID NO: 631422 - DNA, 25 bp, Mus musculus
gaacttggtcacacagtccctagag

SEQ ID NO: 631423 - DNA, 25 bp, Mus musculus
gaacttggtcactcagtccctagag

SEQ ID NO: 631424 - DNA, 25 bp, Mus musculus
gaacttggtgccaaagcctgcacca

SEQ ID NO: 631425 - DNA, 25 bp, Mus musculus
gaacttggtgcctaagcctgcacca

SEQ ID NO: 631426 - DNA, 25 bp, Mus musculus
gaacttgtacacatgactgagtcag

SEQ ID NO: 631427 - DNA, 25 bp, Mus musculus
gaacttgtacacttgactgagtcag

SEQ ID NO: 631428 - DNA, 25 bp, Mus musculus
gaacttgtaccacgagctgatgaag

SEQ ID NO: 631429 - DNA, 25 bp, Mus musculus
gaacttgtaccaggagctgatgaag

SEQ ID NO: 631430 - DNA, 25 bp, Mus musculus
gaacttgtagaactgcaagaagtag

SEQ ID NO: 631431 - DNA, 25 bp, Mus musculus
gaacttgtagaagtgcaagaagtag

SEQ ID NO: 631432 - DNA, 25 bp, Mus musculus
gaacttgtcccaactggacactgtg

SEQ ID NO: 631433 - DNA, 25 bp, Mus musculus
gaacttgtcccatctggacactgtg

SEQ ID NO: 631434 - DNA, 25 bp, Mus musculus
gaacttgtccggcagaacaagcgcc

SEQ ID NO: 631435 - DNA, 25 bp, Mus musculus
gaacttgtccgggagaacaagcgcc

SEQ ID NO: 631436 - DNA, 25 bp, Mus musculus
gaacttgtctatcctccaggttata

SEQ ID NO: 631437 - DNA, 25 bp, Mus musculus
gaacttgtctatgctccaggttata

SEQ ID NO: 631438 - DNA, 25 bp, Mus musculus
gaacttgtgcgtcagagtggcttgt

SEQ ID NO: 631439 - DNA, 25 bp, Mus musculus
gaacttgtgcgtgagagtggcttgt

SEQ ID NO: 631440 - DNA, 25 bp, Mus musculus
gaacttgtgtgcagggcgttggaca

SEQ ID NO: 631441 - DNA, 25 bp, Mus musculus
gaacttgtgtgctgggcgttggaca

SEQ ID NO: 631442 - DNA, 25 bp, Mus musculus
gaacttgttgccaaaggacgtccac

SEQ ID NO: 631443 - DNA, 25 bp, Mus musculus
gaacttgttgcctaaggacgtccac

SEQ ID NO: 631444 - DNA, 25 bp, Mus musculus
gaactttacagacgtggcagttcag

SEQ ID NO: 631445 - DNA, 25 bp, Mus musculus
gaactttacagaggtggcagttcag

SEQ ID NO: 631446 - DNA, 25 bp, Mus musculus
gaactttacctccaggccttggaga

SEQ ID NO: 631447 - DNA, 25 bp, Mus musculus
gaactttacctcgaggccttggaga

SEQ ID NO: 631448 - DNA, 25 bp, Mus musculus
gaactttacggtcgtgccggtggag

SEQ ID NO: 631449 - DNA, 25 bp, Mus musculus
gaactttacggtggtgccggtggag

SEQ ID NO: 631450 - DNA, 25 bp, Mus musculus
gaactttatacaaacgaatcgtagg

SEQ ID NO: 631451 - DNA, 25 bp, Mus musculus
gaactttatacatacgaatcgtagg

SEQ ID NO: 631452 - DNA, 25 bp, Mus musculus
gaactttcagaacagcttcaatgga

SEQ ID NO: 631453 - DNA, 25 bp, Mus musculus
gaactttcagaagagcttcaatgga

SEQ ID NO: 631454 - DNA, 25 bp, Mus musculus
gaactttccaaaatcatgcgtgcca

SEQ ID NO: 631455 - DNA, 25 bp, Mus musculus
gaactttccaaattcatgcgtgcca

SEQ ID NO: 631456 - DNA, 25 bp, Mus musculus
gaactttccaatctccgatgtctgt

SEQ ID NO: 631457 - DNA, 25 bp, Mus musculus
gaactttccaatgtccgatgtctgt

SEQ ID NO: 631458 - DNA, 25 bp, Mus musculus
gaactttccagaacgctcggtgggt

SEQ ID NO: 631459 - DNA, 25 bp, Mus musculus
gaactttccagatcgctcggtgggt

SEQ ID NO: 631460 - DNA, 25 bp, Mus musculus
gaactttcctgcattggttgtgaag

SEQ ID NO: 631461 - DNA, 25 bp, Mus musculus
gaactttcctgctttggttgtgaag

SEQ ID NO: 631462 - DNA, 25 bp, Mus musculus
gaactttcggctaaggtacatctat

SEQ ID NO: 631463 - DNA, 25 bp, Mus musculus
gaactttcggcttaggtacatctat

SEQ ID NO: 631464 - DNA, 25 bp, Mus musculus
gaactttctagaactgcgcgcgtag

SEQ ID NO: 631465 - DNA, 25 bp, Mus musculus
gaactttctagatctgcgcgcgtag

SEQ ID NO: 631466 - DNA, 25 bp, Mus musculus
gaactttctccaagaacgtttgaag

SEQ ID NO: 631467 - DNA, 25 bp, Mus musculus
gaactttctccatgaacgtttgaag

SEQ ID NO: 631468 - DNA, 25 bp, Mus musculus
gaactttgaaagagcgctgtacttt

SEQ ID NO: 631469 - DNA, 25 bp, Mus musculus
gaactttgaaagtgcgctgtacttt

SEQ ID NO: 631470 - DNA, 25 bp, Mus musculus
gaactttgaagtatagaaggatgaa

SEQ ID NO: 631471 - DNA, 25 bp, Mus musculus
gaactttgaagtttagaaggatgaa

SEQ ID NO: 631472 - DNA, 25 bp, Mus musculus
gaactttgacaaacctgtgtacttg

SEQ ID NO: 631473 - DNA, 25 bp, Mus musculus
gaactttgacaatcctgtgtacttg

SEQ ID NO: 631474 - DNA, 25 bp, Mus musculus
gaactttgagacatggaatgaacca

SEQ ID NO: 631475 - DNA, 25 bp, Mus musculus
gaactttgagacttggaatgaacca

SEQ ID NO: 631476 - DNA, 25 bp, Mus musculus
gaactttgccatcattgggctgggt

SEQ ID NO: 631477 - DNA, 25 bp, Mus musculus
gaactttgccatgattgggctgggt

SEQ ID NO: 631478 - DNA, 25 bp, Mus musculus
gaactttgccctctttttccagctg

SEQ ID NO: 631479 - DNA, 25 bp, Mus musculus
gaactttgccctgtttttccagctg

SEQ ID NO: 631480 - DNA, 25 bp, Mus musculus
gaactttgccgacattggtagcaat

SEQ ID NO: 631481 - DNA, 25 bp, Mus musculus
gaactttgccgagattggtagcaat

SEQ ID NO: 631482 - DNA, 25 bp, Mus musculus
gaactttgccgcctgtggctcagac

SEQ ID NO: 631483 - DNA, 25 bp, Mus musculus
gaactttgccgcgtgtggctcagac

SEQ ID NO: 631484 - DNA, 25 bp, Mus musculus
gaactttgccttcaatatgtaatga

SEQ ID NO: 631485 - DNA, 25 bp, Mus musculus
gaactttgccttgaatatgtaatga

SEQ ID NO: 631486 - DNA, 25 bp, Mus musculus
gaactttggaaccaagatttctgcc

SEQ ID NO: 631487 - DNA, 25 bp, Mus musculus
gaactttggaacgaagatttctgcc

SEQ ID NO: 631488 - DNA, 25 bp, Mus musculus
gaactttggaggcatgaaagatctc

SEQ ID NO: 631489 - DNA, 25 bp, Mus musculus
gaactttggagggatgaaagatctc

SEQ ID NO: 631490 - DNA, 25 bp, Mus musculus
gaactttggcatcggaaaaagaagc

SEQ ID NO: 631491 - DNA, 25 bp, Mus musculus
gaactttggcatgggaaaaagaagc

SEQ ID NO: 631492 - DNA, 25 bp, Mus musculus
gaactttggcctctgtggactcttt

SEQ ID NO: 631493 - DNA, 25 bp, Mus musculus
gaactttggcctgtgtggactcttt

SEQ ID NO: 631494 - DNA, 25 bp, Mus musculus
gaactttgtccgagagtttcagccg

SEQ ID NO: 631495 - DNA, 25 bp, Mus musculus
gaactttgtccgtgagtttcagccg

SEQ ID NO: 631496 - DNA, 25 bp, Mus musculus
gaactttgtggaagaaccttccgaa

SEQ ID NO: 631497 - DNA, 25 bp, Mus musculus
gaactttgtggaagacagcttcccc

SEQ ID NO: 631498 - DNA, 25 bp, Mus musculus
gaactttgtggatgaaccttccgaa

SEQ ID NO: 631499 - DNA, 25 bp, Mus musculus
gaactttgtggatgacagcttcccc

SEQ ID NO: 631500 - DNA, 25 bp, Mus musculus
gaacttttgaacctcttcaaccatg

SEQ ID NO: 631501 - DNA, 25 bp, Mus musculus
gaacttttgaacgtcttcaaccatg

SEQ ID NO: 631502 - DNA, 25 bp, Mus musculus
gaactttttagaatcttctggctta

SEQ ID NO: 631503 - DNA, 25 bp, Mus musculus
gaactttttagattcttctggctta

SEQ ID NO: 631504 - DNA, 25 bp, Mus musculus
gaagaaaaagaaccggcctggatcc

SEQ ID NO: 631505 - DNA, 25 bp, Mus musculus
gaagaaaaagaagcggcctggatcc

SEQ ID NO: 631506 - DNA, 25 bp, Mus musculus
gaagaaaacaaacacggccggcctg

SEQ ID NO: 631507 - DNA, 25 bp, Mus musculus
gaagaaaacaaagacggccggcctg

SEQ ID NO: 631508 - DNA, 25 bp, Mus musculus
gaagaaaaccaaagcctgcagacac

SEQ ID NO: 631509 - DNA, 25 bp, Mus musculus
gaagaaaaccaatgcctgcagacac

SEQ ID NO: 631510 - DNA, 25 bp, Mus musculus
gaagaaaaccataaggacgcggact

SEQ ID NO: 631511 - DNA, 25 bp, Mus musculus
gaagaaaaccattaggacgcggact

SEQ ID NO: 631512 - DNA, 25 bp, Mus musculus
gaagaaaactatctctatgatccca

SEQ ID NO: 631513 - DNA, 25 bp, Mus musculus
gaagaaaactatgtctatgatccca

SEQ ID NO: 631514 - DNA, 25 bp, Mus musculus
gaagaaaactgaaggcgcctatgat

SEQ ID NO: 631515 - DNA, 25 bp, Mus musculus
gaagaaaactgatggcgcctatgat

SEQ ID NO: 631516 - DNA, 25 bp, Mus musculus
gaagaaaagaaactattcctggaga

SEQ ID NO: 631517 - DNA, 25 bp, Mus musculus
gaagaaaagaaagtattcctggaga

SEQ ID NO: 631518 - DNA, 25 bp, Mus musculus
gaagaaaagaatcggttcgcctggt

SEQ ID NO: 631519 - DNA, 25 bp, Mus musculus
gaagaaaagaatgggttcgcctggt

SEQ ID NO: 631520 - DNA, 25 bp, Mus musculus
gaagaaaagacacccctgcaagtgg

SEQ ID NO: 631521 - DNA, 25 bp, Mus musculus
gaagaaaagacagccctgcaagtgg

SEQ ID NO: 631522 - DNA, 25 bp, Mus musculus
gaagaaaagaccagccaaatggaga

SEQ ID NO: 631523 - DNA, 25 bp, Mus musculus
gaagaaaagacctgccaaatggaga

SEQ ID NO: 631524 - DNA, 25 bp, Mus musculus
gaagaaaagaggctgcacatgtagc

SEQ ID NO: 631525 - DNA, 25 bp, Mus musculus
gaagaaaagagggtgcacatgtagc

SEQ ID NO: 631526 - DNA, 25 bp, Mus musculus
gaagaaaagatcacacagagctccc

SEQ ID NO: 631527 - DNA, 25 bp, Mus musculus
gaagaaaagatctcacagagctccc

SEQ ID NO: 631528 - DNA, 25 bp, Mus musculus
gaagaaaagatgcagattcaggaga

SEQ ID NO: 631529 - DNA, 25 bp, Mus musculus
gaagaaaagatggagattcaggaga

SEQ ID NO: 631530 - DNA, 25 bp, Mus musculus
gaagaaaagctccaacaatttgtga

SEQ ID NO: 631531 - DNA, 25 bp, Mus musculus
gaagaaaagctcgaacaatttgtga

SEQ ID NO: 631532 - DNA, 25 bp, Mus musculus
gaagaaaagcttaagcccgtgtgac

SEQ ID NO: 631533 - DNA, 25 bp, Mus musculus
gaagaaaagctttagcccgtgtgac

SEQ ID NO: 631534 - DNA, 25 bp, Mus musculus
gaagaaaagggaaacccccatgctg

SEQ ID NO: 631535 - DNA, 25 bp, Mus musculus
gaagaaaagggatacccccatgctg

SEQ ID NO: 631536 - DNA, 25 bp, Mus musculus
gaagaaaagggccagcgagacaacc

SEQ ID NO: 631537 - DNA, 25 bp, Mus musculus
gaagaaaagggcgagcgagacaacc

SEQ ID NO: 631538 - DNA, 25 bp, Mus musculus
gaagaaaaggtacgtgcattaagga

SEQ ID NO: 631539 - DNA, 25 bp, Mus musculus
gaagaaaaggtaggtgcattaagga

SEQ ID NO: 631540 - DNA, 25 bp, Mus musculus
gaagaaaaggtgataacctcaagtg

SEQ ID NO: 631541 - DNA, 25 bp, Mus musculus
gaagaaaaggtgttaacctcaagtg

SEQ ID NO: 631542 - DNA, 25 bp, Mus musculus
gaagaaaagtatccctttgtcaact

SEQ ID NO: 631543 - DNA, 25 bp, Mus musculus
gaagaaaagtatgcctttgtcaact

SEQ ID NO: 631544 - DNA, 25 bp, Mus musculus
gaagaaaatattctgaaaggtgtgc

SEQ ID NO: 631545 - DNA, 25 bp, Mus musculus
gaagaaaatattgtgaaaggtgtgc

SEQ ID NO: 631546 - DNA, 25 bp, Mus musculus
gaagaaaatccgacaagttatccga

SEQ ID NO: 631547 - DNA, 25 bp, Mus musculus
gaagaaaatccgtcaagttatccga

SEQ ID NO: 631548 - DNA, 25 bp, Mus musculus
gaagaaaatcttagtgggaggtcta

SEQ ID NO: 631549 - DNA, 25 bp, Mus musculus
gaagaaaatctttgtgggaggtcta

SEQ ID NO: 631550 - DNA, 25 bp, Mus musculus
gaagaaaattgacctagggaagaca

SEQ ID NO: 631551 - DNA, 25 bp, Mus musculus
gaagaaaattgagctagggaagaca

SEQ ID NO: 631552 - DNA, 25 bp, Mus musculus
gaagaaacaacacaggattccaaca

SEQ ID NO: 631553 - DNA, 25 bp, Mus musculus
gaagaaacaacacgtcagcagagca

SEQ ID NO: 631554 - DNA, 25 bp, Mus musculus
gaagaaacaacagaggattccaaca

SEQ ID NO: 631555 - DNA, 25 bp, Mus musculus
gaagaaacaacaggtcagcagagca

SEQ ID NO: 631556 - DNA, 25 bp, Mus musculus
gaagaaacaggacaattcctcccaa

SEQ ID NO: 631557 - DNA, 25 bp, Mus musculus
gaagaaacaggagaattcctcccaa

SEQ ID NO: 631558 - DNA, 25 bp, Mus musculus
gaagaaacagttaccagatgttcag

SEQ ID NO: 631559 - DNA, 25 bp, Mus musculus
gaagaaacagtttccagatgttcag

SEQ ID NO: 631560 - DNA, 25 bp, Mus musculus
gaagaaaccagccaagccaaaatgc

SEQ ID NO: 631561 - DNA, 25 bp, Mus musculus
gaagaaaccagcgaagccaaaatgc

SEQ ID NO: 631562 - DNA, 25 bp, Mus musculus
gaagaaacccagctgtaagctccca

SEQ ID NO: 631563 - DNA, 25 bp, Mus musculus
gaagaaacccaggtgtaagctccca

SEQ ID NO: 631564 - DNA, 25 bp, Mus musculus
gaagaaacgaatccagggccccatt

SEQ ID NO: 631565 - DNA, 25 bp, Mus musculus
gaagaaacgaatgcagggccccatt

SEQ ID NO: 631566 - DNA, 25 bp, Mus musculus
gaagaaacgctcacaagcctgccat

SEQ ID NO: 631567 - DNA, 25 bp, Mus musculus
gaagaaacgctctcaagcctgccat

SEQ ID NO: 631568 - DNA, 25 bp, Mus musculus
gaagaaactattcttcgccatactc

SEQ ID NO: 631569 - DNA, 25 bp, Mus musculus
gaagaaactattgttcgccatactc

SEQ ID NO: 631570 - DNA, 25 bp, Mus musculus
gaagaaactcagaacaaggataaga

SEQ ID NO: 631571 - DNA, 25 bp, Mus musculus
gaagaaactcagtacaaggataaga

SEQ ID NO: 631572 - DNA, 25 bp, Mus musculus
gaagaaactcatagattactgcagc

SEQ ID NO: 631573 - DNA, 25 bp, Mus musculus
gaagaaactcattgattactgcagc

SEQ ID NO: 631574 - DNA, 25 bp, Mus musculus
gaagaaactcctcaagcagctgaaa

SEQ ID NO: 631575 - DNA, 25 bp, Mus musculus
gaagaaactcctgaagcagctgaaa

SEQ ID NO: 631576 - DNA, 25 bp, Mus musculus
gaagaaactggaaggtcacggaaca

SEQ ID NO: 631577 - DNA, 25 bp, Mus musculus
gaagaaactggatggtcacggaaca

SEQ ID NO: 631578 - DNA, 25 bp, Mus musculus
gaagaaactgtgcatctgtactctg

SEQ ID NO: 631579 - DNA, 25 bp, Mus musculus
gaagaaactgtggatctgtactctg

SEQ ID NO: 631580 - DNA, 25 bp, Mus musculus
gaagaaacttggaccactgagttac

SEQ ID NO: 631581 - DNA, 25 bp, Mus musculus
gaagaaacttggtccactgagttac

SEQ ID NO: 631582 - DNA, 25 bp, Mus musculus
gaagaaagacttccagagccacatg

SEQ ID NO: 631583 - DNA, 25 bp, Mus musculus
gaagaaagacttgcagagccacatg

SEQ ID NO: 631584 - DNA, 25 bp, Mus musculus
gaagaaagaggacaccacctttgat

SEQ ID NO: 631585 - DNA, 25 bp, Mus musculus
gaagaaagaggagaccacctttgat

SEQ ID NO: 631586 - DNA, 25 bp, Mus musculus
gaagaaagagtaattttagcgcatt

SEQ ID NO: 631587 - DNA, 25 bp, Mus musculus
gaagaaagagtatttttagcgcatt

SEQ ID NO: 631588 - DNA, 25 bp, Mus musculus
gaagaaagatggaggcgcttagatt

SEQ ID NO: 631589 - DNA, 25 bp, Mus musculus
gaagaaagatggtggcgcttagatt

SEQ ID NO: 631590 - DNA, 25 bp, Mus musculus
gaagaaagatgtagacacctaagac

SEQ ID NO: 631591 - DNA, 25 bp, Mus musculus
gaagaaagatgttgacacctaagac

SEQ ID NO: 631592 - DNA, 25 bp, Mus musculus
gaagaaagcgatccccagcaggccc

SEQ ID NO: 631593 - DNA, 25 bp, Mus musculus
gaagaaagcgatgcccagcaggccc

SEQ ID NO: 631594 - DNA, 25 bp, Mus musculus
gaagaaagcgcgcactaatttagag

SEQ ID NO: 631595 - DNA, 25 bp, Mus musculus
gaagaaagcgcggactaatttagag

SEQ ID NO: 631596 - DNA, 25 bp, Mus musculus
gaagaaagctggcagtctctacctt

SEQ ID NO: 631597 - DNA, 25 bp, Mus musculus
gaagaaagctgggagtctctacctt

SEQ ID NO: 631598 - DNA, 25 bp, Mus musculus
gaagaaaggaagacttgggcttctg

SEQ ID NO: 631599 - DNA, 25 bp, Mus musculus
gaagaaaggaagtcttgggcttctg

SEQ ID NO: 631600 - DNA, 25 bp, Mus musculus
gaagaaaggctgcaaaccagcccga

SEQ ID NO: 631601 - DNA, 25 bp, Mus musculus
gaagaaaggctggaaaccagcccga

SEQ ID NO: 631602 - DNA, 25 bp, Mus musculus
gaagaaagggaccttgatagcctct

SEQ ID NO: 631603 - DNA, 25 bp, Mus musculus
gaagaaagggacgttgatagcctct

SEQ ID NO: 631604 - DNA, 25 bp, Mus musculus
gaagaaagggagaatcatggaccag

SEQ ID NO: 631605 - DNA, 25 bp, Mus musculus
gaagaaagggagtatcatggaccag

SEQ ID NO: 631606 - DNA, 25 bp, Mus musculus
gaagaaaggtggcagatctctatga

SEQ ID NO: 631607 - DNA, 25 bp, Mus musculus
gaagaaaggtgggagatctctatga

SEQ ID NO: 631608 - DNA, 25 bp, Mus musculus
gaagaaagtcatctctaccagcaga

SEQ ID NO: 631609 - DNA, 25 bp, Mus musculus
gaagaaagtcatgtctaccagcaga

SEQ ID NO: 631610 - DNA, 25 bp, Mus musculus
gaagaaagtcttagggtttgattct

SEQ ID NO: 631611 - DNA, 25 bp, Mus musculus
gaagaaagtctttgggtttgattct

SEQ ID NO: 631612 - DNA, 25 bp, Mus musculus
gaagaaagtgatcaaagctggcaag

SEQ ID NO: 631613 - DNA, 25 bp, Mus musculus
gaagaaagtgatgaaagctggcaag

SEQ ID NO: 631614 - DNA, 25 bp, Mus musculus
gaagaaagtgttctgtactccaacc

SEQ ID NO: 631615 - DNA, 25 bp, Mus musculus
gaagaaagtgttgtgtactccaacc

SEQ ID NO: 631616 - DNA, 25 bp, Mus musculus
gaagaaatacctcgccgcagccttc

SEQ ID NO: 631617 - DNA, 25 bp, Mus musculus
gaagaaatacctggccgcagccttc

SEQ ID NO: 631618 - DNA, 25 bp, Mus musculus
gaagaaatacgcattttatgtccag

SEQ ID NO: 631619 - DNA, 25 bp, Mus musculus
gaagaaatacgctttttatgtccag

SEQ ID NO: 631620 - DNA, 25 bp, Mus musculus
gaagaaatacggagacaagaggatc

SEQ ID NO: 631621 - DNA, 25 bp, Mus musculus
gaagaaatacggtgacaagaggatc

SEQ ID NO: 631622 - DNA, 25 bp, Mus musculus
gaagaaatagtaactcctagcgacc

SEQ ID NO: 631623 - DNA, 25 bp, Mus musculus
gaagaaatagtatctcctagcgacc

SEQ ID NO: 631624 - DNA, 25 bp, Mus musculus
gaagaaatcaagcagttagatgaag

SEQ ID NO: 631625 - DNA, 25 bp, Mus musculus
gaagaaatcaaggagttagatgaag

SEQ ID NO: 631626 - DNA, 25 bp, Mus musculus
gaagaaatcaggaaaaggcgtgacg

SEQ ID NO: 631627 - DNA, 25 bp, Mus musculus
gaagaaatcaggtaaaggcgtgacg

SEQ ID NO: 631628 - DNA, 25 bp, Mus musculus
gaagaaatccaacaccgaagagcgg

SEQ ID NO: 631629 - DNA, 25 bp, Mus musculus
gaagaaatccaagaccgaagagcgg

SEQ ID NO: 631630 - DNA, 25 bp, Mus musculus
gaagaaatccagcaagtaagaagta

SEQ ID NO: 631631 - DNA, 25 bp, Mus musculus
gaagaaatccaggaagtaagaagta

SEQ ID NO: 631632 - DNA, 25 bp, Mus musculus
gaagaaatccgacctggaaatagaa

SEQ ID NO: 631633 - DNA, 25 bp, Mus musculus
gaagaaatccgagctggaaatagaa

SEQ ID NO: 631634 - DNA, 25 bp, Mus musculus
gaagaaatccttatctccctccaga

SEQ ID NO: 631635 - DNA, 25 bp, Mus musculus
gaagaaatccttttctccctccaga

SEQ ID NO: 631636 - DNA, 25 bp, Mus musculus
gaagaaatcgacaggtccaccaacg

SEQ ID NO: 631637 - DNA, 25 bp, Mus musculus
gaagaaatcgactggtccaccaacg

SEQ ID NO: 631638 - DNA, 25 bp, Mus musculus
gaagaaatctgaaatcgggattgcc

SEQ ID NO: 631639 - DNA, 25 bp, Mus musculus
gaagaaatctgatatcgggattgcc

SEQ ID NO: 631640 - DNA, 25 bp, Mus musculus
gaagaaatgaaaacccttgcccgag

SEQ ID NO: 631641 - DNA, 25 bp, Mus musculus
gaagaaatgaaatcccttgcccgag

SEQ ID NO: 631642 - DNA, 25 bp, Mus musculus
gaagaaatgaacacattgctagttt

SEQ ID NO: 631643 - DNA, 25 bp, Mus musculus
gaagaaatgaactcattgctagttt

SEQ ID NO: 631644 - DNA, 25 bp, Mus musculus
gaagaaatgaataacctggcatcca

SEQ ID NO: 631645 - DNA, 25 bp, Mus musculus
gaagaaatgaattacctggcatcca

SEQ ID NO: 631646 - DNA, 25 bp, Mus musculus
gaagaaatggacaccagaccaaagg

SEQ ID NO: 631647 - DNA, 25 bp, Mus musculus
gaagaaatggactccagaccaaagg

SEQ ID NO: 631648 - DNA, 25 bp, Mus musculus
gaagaaatggagacctgagcacctg

SEQ ID NO: 631649 - DNA, 25 bp, Mus musculus
gaagaaatggagtcctgagcacctg

SEQ ID NO: 631650 - DNA, 25 bp, Mus musculus
gaagaaattacaacatcttgagttg

SEQ ID NO: 631651 - DNA, 25 bp, Mus musculus
gaagaaattacatcatcttgagttg

SEQ ID NO: 631652 - DNA, 25 bp, Mus musculus
gaagaaattatcagtggtctcatta

SEQ ID NO: 631653 - DNA, 25 bp, Mus musculus
gaagaaattatctgtggtctcatta

SEQ ID NO: 631654 - DNA, 25 bp, Mus musculus
gaagaaattgaaaccagtgctcagt

SEQ ID NO: 631655 - DNA, 25 bp, Mus musculus
gaagaaattgaacccgtgaaaagct

SEQ ID NO: 631656 - DNA, 25 bp, Mus musculus
gaagaaattgaagccgtgaaaagct

SEQ ID NO: 631657 - DNA, 25 bp, Mus musculus
gaagaaattgaatccagtgctcagt

SEQ ID NO: 631658 - DNA, 25 bp, Mus musculus
gaagaaattgcaccccacagtcaga

SEQ ID NO: 631659 - DNA, 25 bp, Mus musculus
gaagaaattgcactgaacctgtgga

SEQ ID NO: 631660 - DNA, 25 bp, Mus musculus
gaagaaattgcagcccacagtcaga

SEQ ID NO: 631661 - DNA, 25 bp, Mus musculus
gaagaaattgcagtgaacctgtgga

SEQ ID NO: 631662 - DNA, 25 bp, Mus musculus
gaagaaattggactgtggatgaaaa

SEQ ID NO: 631663 - DNA, 25 bp, Mus musculus
gaagaaattggagtgtggatgaaaa

SEQ ID NO: 631664 - DNA, 25 bp, Mus musculus
gaagaaatttggagtctacgtgcgc

SEQ ID NO: 631665 - DNA, 25 bp, Mus musculus
gaagaaatttggtgtctacgtgcgc

SEQ ID NO: 631666 - DNA, 25 bp, Mus musculus
gaagaacaacaacagacaagtgtgc

SEQ ID NO: 631667 - DNA, 25 bp, Mus musculus
gaagaacaacaacgctctctcatcc

SEQ ID NO: 631668 - DNA, 25 bp, Mus musculus
gaagaacaacaagagacaagtgtgc

SEQ ID NO: 631669 - DNA, 25 bp, Mus musculus
gaagaacaacaaggctctctcatcc

SEQ ID NO: 631670 - DNA, 25 bp, Mus musculus
gaagaacaacatcatcttgtgccag

SEQ ID NO: 631671 - DNA, 25 bp, Mus musculus
gaagaacaacatgatcttgtgccag

SEQ ID NO: 631672 - DNA, 25 bp, Mus musculus
gaagaacaagcaaagcgctgggcag

SEQ ID NO: 631673 - DNA, 25 bp, Mus musculus
gaagaacaagcaatcggagcagcca

SEQ ID NO: 631674 - DNA, 25 bp, Mus musculus
gaagaacaagcatagcgctgggcag

SEQ ID NO: 631675 - DNA, 25 bp, Mus musculus
gaagaacaagcattcggagcagcca

SEQ ID NO: 631676 - DNA, 25 bp, Mus musculus
gaagaacaagggaacgtttgatgga

SEQ ID NO: 631677 - DNA, 25 bp, Mus musculus
gaagaacaagggtacgtttgatgga

SEQ ID NO: 631678 - DNA, 25 bp, Mus musculus
gaagaacaagtaagacgccagctcc

SEQ ID NO: 631679 - DNA, 25 bp, Mus musculus
gaagaacaagtatgacgccagctcc

SEQ ID NO: 631680 - DNA, 25 bp, Mus musculus
gaagaacaatggagcaggctacttt

SEQ ID NO: 631681 - DNA, 25 bp, Mus musculus
gaagaacaatggtgcaggctacttt

SEQ ID NO: 631682 - DNA, 25 bp, Mus musculus
gaagaacacggtctcgtcggcccgc

SEQ ID NO: 631683 - DNA, 25 bp, Mus musculus
gaagaacacggtgtcgtcggcccgc

SEQ ID NO: 631684 - DNA, 25 bp, Mus musculus
gaagaacagagactaccctctggcc

SEQ ID NO: 631685 - DNA, 25 bp, Mus musculus
gaagaacagagagtaccctctggcc

SEQ ID NO: 631686 - DNA, 25 bp, Mus musculus
gaagaacagcaacatgacctatgag

SEQ ID NO: 631687 - DNA, 25 bp, Mus musculus
gaagaacagcaagatgacctatgag

SEQ ID NO: 631688 - DNA, 25 bp, Mus musculus
gaagaacagttaagaataatggatc

SEQ ID NO: 631689 - DNA, 25 bp, Mus musculus
gaagaacagttatgaataatggatc

SEQ ID NO: 631690 - DNA, 25 bp, Mus musculus
gaagaacatagtctcgtcgtttctt

SEQ ID NO: 631691 - DNA, 25 bp, Mus musculus
gaagaacatagtgtcgtcgtttctt

SEQ ID NO: 631692 - DNA, 25 bp, Mus musculus
gaagaacatcagactcccggtggca

SEQ ID NO: 631693 - DNA, 25 bp, Mus musculus
gaagaacatcagtctcccggtggca

SEQ ID NO: 631694 - DNA, 25 bp, Mus musculus
gaagaacatctccacggagacagcg

SEQ ID NO: 631695 - DNA, 25 bp, Mus musculus
gaagaacatctcctacaagtaccgt

SEQ ID NO: 631696 - DNA, 25 bp, Mus musculus
gaagaacatctcgacggagacagcg

SEQ ID NO: 631697 - DNA, 25 bp, Mus musculus
gaagaacatctcgtacaagtaccgt

SEQ ID NO: 631698 - DNA, 25 bp, Mus musculus
gaagaacatcttacatgtgggcagc

SEQ ID NO: 631699 - DNA, 25 bp, Mus musculus
gaagaacatctttcatgtgggcagc

SEQ ID NO: 631700 - DNA, 25 bp, Mus musculus
gaagaacatggactacatgcggcct

SEQ ID NO: 631701 - DNA, 25 bp, Mus musculus
gaagaacatggagtacatgcggcct

SEQ ID NO: 631702 - DNA, 25 bp, Mus musculus
gaagaacatgggactgtccacaacc

SEQ ID NO: 631703 - DNA, 25 bp, Mus musculus
gaagaacatgggtctgtccacaacc

SEQ ID NO: 631704 - DNA, 25 bp, Mus musculus
gaagaaccaggcaaagtacccaagg

SEQ ID NO: 631705 - DNA, 25 bp, Mus musculus
gaagaaccaggctaagtacccaagg

SEQ ID NO: 631706 - DNA, 25 bp, Mus musculus
gaagaaccagtactcttggcactag

SEQ ID NO: 631707 - DNA, 25 bp, Mus musculus
gaagaaccagtagtcttggcactag

SEQ ID NO: 631708 - DNA, 25 bp, Mus musculus
gaagaaccagtgaatgcgccagaga

SEQ ID NO: 631709 - DNA, 25 bp, Mus musculus
gaagaaccagtgtatgcgccagaga

SEQ ID NO: 631710 - DNA, 25 bp, Mus musculus
gaagaaccatatctcctgtttaaga

SEQ ID NO: 631711 - DNA, 25 bp, Mus musculus
gaagaaccatatgtcctgtttaaga

SEQ ID NO: 631712 - DNA, 25 bp, Mus musculus
gaagaaccatgtcgctcctgcacag

SEQ ID NO: 631713 - DNA, 25 bp, Mus musculus
gaagaaccatgtggctcctgcacag

SEQ ID NO: 631714 - DNA, 25 bp, Mus musculus
gaagaacccaatcctctggaacgtg

SEQ ID NO: 631715 - DNA, 25 bp, Mus musculus
gaagaacccaatgctctggaacgtg

SEQ ID NO: 631716 - DNA, 25 bp, Mus musculus
gaagaacccgcaacaaagcataaga

SEQ ID NO: 631717 - DNA, 25 bp, Mus musculus
gaagaacccgcatcaaagcataaga

SEQ ID NO: 631718 - DNA, 25 bp, Mus musculus
gaagaaccctggaaatcagagaaag

SEQ ID NO: 631719 - DNA, 25 bp, Mus musculus
gaagaaccctggtaatcagagaaag

SEQ ID NO: 631720 - DNA, 25 bp, Mus musculus
gaagaacctacaaatgaagtacccc

SEQ ID NO: 631721 - DNA, 25 bp, Mus musculus
gaagaacctacatatgaagtacccc

SEQ ID NO: 631722 - DNA, 25 bp, Mus musculus
gaagaacctcgtccagaggctggcc

SEQ ID NO: 631723 - DNA, 25 bp, Mus musculus
gaagaacctcgtgcagaggctggcc

SEQ ID NO: 631724 - DNA, 25 bp, Mus musculus
gaagaacctgagatttcgtctgcca

SEQ ID NO: 631725 - DNA, 25 bp, Mus musculus
gaagaacctgagttttcgtctgcca

SEQ ID NO: 631726 - DNA, 25 bp, Mus musculus
gaagaacctgatcgccctcaagaag

SEQ ID NO: 631727 - DNA, 25 bp, Mus musculus
gaagaacctgatggccctcaagaag

SEQ ID NO: 631728 - DNA, 25 bp, Mus musculus
gaagaacctgctaaccatgatggat

SEQ ID NO: 631729 - DNA, 25 bp, Mus musculus
gaagaacctgcttaccatgatggat

SEQ ID NO: 631730 - DNA, 25 bp, Mus musculus
gaagaacctgtgacgggctcaacta

SEQ ID NO: 631731 - DNA, 25 bp, Mus musculus
gaagaacctgtgtcgggctcaacta

SEQ ID NO: 631732 - DNA, 25 bp, Mus musculus
gaagaacctgttcggcgtgccctct

SEQ ID NO: 631733 - DNA, 25 bp, Mus musculus
gaagaacctgttgggcgtgccctct

SEQ ID NO: 631734 - DNA, 25 bp, Mus musculus
gaagaaccttctcgcagtgagcagc

SEQ ID NO: 631735 - DNA, 25 bp, Mus musculus
gaagaaccttctggcagtgagcagc

SEQ ID NO: 631736 - DNA, 25 bp, Mus musculus
gaagaacgagtgagacgtgtgcaca

SEQ ID NO: 631737 - DNA, 25 bp, Mus musculus
gaagaacgagtgtgacgtgtgcaca

SEQ ID NO: 631738 - DNA, 25 bp, Mus musculus
gaagaacgccgccaatcagaaagga

SEQ ID NO: 631739 - DNA, 25 bp, Mus musculus
gaagaacgccgcgaatcagaaagga

SEQ ID NO: 631740 - DNA, 25 bp, Mus musculus
gaagaacggacaattcagtaccagg

SEQ ID NO: 631741 - DNA, 25 bp, Mus musculus
gaagaacggacatttcagtaccagg

SEQ ID NO: 631742 - DNA, 25 bp, Mus musculus
gaagaacggcacctcctttgacatc

SEQ ID NO: 631743 - DNA, 25 bp, Mus musculus
gaagaacggcacgtcctttgacatc

SEQ ID NO: 631744 - DNA, 25 bp, Mus musculus
gaagaacggtctcgtgaagatcaag

SEQ ID NO: 631745 - DNA, 25 bp, Mus musculus
gaagaacggtctggtgaagatcaag

SEQ ID NO: 631746 - DNA, 25 bp, Mus musculus
gaagaacgtgtcctccacatgtgct

SEQ ID NO: 631747 - DNA, 25 bp, Mus musculus
gaagaacgtgtcgtccacatgtgct

SEQ ID NO: 631748 - DNA, 25 bp, Mus musculus
gaagaacgttgtatcctggtacaga

SEQ ID NO: 631749 - DNA, 25 bp, Mus musculus
gaagaacgttgtttcctggtacaga

SEQ ID NO: 631750 - DNA, 25 bp, Mus musculus
gaagaacgttttcccactcgagcag

SEQ ID NO: 631751 - DNA, 25 bp, Mus musculus
gaagaacgttttgccactcgagcag

SEQ ID NO: 631752 - DNA, 25 bp, Mus musculus
gaagaactagacacacactttaaac

SEQ ID NO: 631753 - DNA, 25 bp, Mus musculus
gaagaactagactcacactttaaac

SEQ ID NO: 631754 - DNA, 25 bp, Mus musculus
gaagaactagagacatatcctctcg

SEQ ID NO: 631755 - DNA, 25 bp, Mus musculus
gaagaactagagtcatatcctctcg

SEQ ID NO: 631756 - DNA, 25 bp, Mus musculus
gaagaactagggaagcaaatccaac

SEQ ID NO: 631757 - DNA, 25 bp, Mus musculus
gaagaactagggtagcaaatccaac

SEQ ID NO: 631758 - DNA, 25 bp, Mus musculus
gaagaactagtccatctatcagccg

SEQ ID NO: 631759 - DNA, 25 bp, Mus musculus
gaagaactagtcgatctatcagccg

SEQ ID NO: 631760 - DNA, 25 bp, Mus musculus
gaagaactatcaattcccgagggcg

SEQ ID NO: 631761 - DNA, 25 bp, Mus musculus
gaagaactatcatttcccgagggcg

SEQ ID NO: 631762 - DNA, 25 bp, Mus musculus
gaagaactatggactcgtccctgaa

SEQ ID NO: 631763 - DNA, 25 bp, Mus musculus
gaagaactatggtctcgtccctgaa

SEQ ID NO: 631764 - DNA, 25 bp, Mus musculus
gaagaactccataagctttgcgggc

SEQ ID NO: 631765 - DNA, 25 bp, Mus musculus
gaagaactccattagctttgcgggc

SEQ ID NO: 631766 - DNA, 25 bp, Mus musculus
gaagaactcgagaagcttggtagag

SEQ ID NO: 631767 - DNA, 25 bp, Mus musculus
gaagaactcgagtagcttggtagag

SEQ ID NO: 631768 - DNA, 25 bp, Mus musculus
gaagaactcgtaactgttctcattg

SEQ ID NO: 631769 - DNA, 25 bp, Mus musculus
gaagaactcgtatctgttctcattg

SEQ ID NO: 631770 - DNA, 25 bp, Mus musculus
gaagaactcgtgcagcggcatcgaa

SEQ ID NO: 631771 - DNA, 25 bp, Mus musculus
gaagaactcgtggagcggcatcgaa

SEQ ID NO: 631772 - DNA, 25 bp, Mus musculus
gaagaactctcacaaaaacattccc

SEQ ID NO: 631773 - DNA, 25 bp, Mus musculus
gaagaactctcagaaaaacattccc

SEQ ID NO: 631774 - DNA, 25 bp, Mus musculus
gaagaactgaagatcctctatgctg

SEQ ID NO: 631775 - DNA, 25 bp, Mus musculus
gaagaactgaagttcctctatgctg

SEQ ID NO: 631776 - DNA, 25 bp, Mus musculus
gaagaactggaactggtcacagaga

SEQ ID NO: 631777 - DNA, 25 bp, Mus musculus
gaagaactggaagtggtcacagaga

SEQ ID NO: 631778 - DNA, 25 bp, Mus musculus
gaagaactggcaaagcaggccatag

SEQ ID NO: 631779 - DNA, 25 bp, Mus musculus
gaagaactggcatagcaggccatag

SEQ ID NO: 631780 - DNA, 25 bp, Mus musculus
gaagaactgggaactcagattgagg

SEQ ID NO: 631781 - DNA, 25 bp, Mus musculus
gaagaactgggatctcagattgagg

SEQ ID NO: 631782 - DNA, 25 bp, Mus musculus
gaagaactggttagtgggcctcaag

SEQ ID NO: 631783 - DNA, 25 bp, Mus musculus
gaagaactggtttgtgggcctcaag

SEQ ID NO: 631784 - DNA, 25 bp, Mus musculus
gaagaacttagacttcctatagagg

SEQ ID NO: 631785 - DNA, 25 bp, Mus musculus
gaagaacttagagttcctatagagg

SEQ ID NO: 631786 - DNA, 25 bp, Mus musculus
gaagaacttagcctatatgtactgc

SEQ ID NO: 631787 - DNA, 25 bp, Mus musculus
gaagaacttagcgtatatgtactgc

SEQ ID NO: 631788 - DNA, 25 bp, Mus musculus
gaagaacttcctacgcgtgggccgt

SEQ ID NO: 631789 - DNA, 25 bp, Mus musculus
gaagaacttccttcgcgtgggccgt

SEQ ID NO: 631790 - DNA, 25 bp, Mus musculus
gaagaacttgcaatcagatttgctg

SEQ ID NO: 631791 - DNA, 25 bp, Mus musculus
gaagaacttgcacgatatcaacact

SEQ ID NO: 631792 - DNA, 25 bp, Mus musculus
gaagaacttgcaggatatcaacact

SEQ ID NO: 631793 - DNA, 25 bp, Mus musculus
gaagaacttgcattcagatttgctg

SEQ ID NO: 631794 - DNA, 25 bp, Mus musculus
gaagaacttgccaaaatggagctga

SEQ ID NO: 631795 - DNA, 25 bp, Mus musculus
gaagaacttgcctaaatggagctga

SEQ ID NO: 631796 - DNA, 25 bp, Mus musculus
gaagaacttggacctcttttagaga

SEQ ID NO: 631797 - DNA, 25 bp, Mus musculus
gaagaacttggagctcttttagaga

SEQ ID NO: 631798 - DNA, 25 bp, Mus musculus
gaagaactttctccaagaacgtttg

SEQ ID NO: 631799 - DNA, 25 bp, Mus musculus
gaagaactttctgcaagaacgtttg

SEQ ID NO: 631800 - DNA, 25 bp, Mus musculus
gaagaactttgaaaccagtcagtgg

SEQ ID NO: 631801 - DNA, 25 bp, Mus musculus
gaagaactttgataccagtcagtgg

SEQ ID NO: 631802 - DNA, 25 bp, Mus musculus
gaagaagaaataagagactaaggtg

SEQ ID NO: 631803 - DNA, 25 bp, Mus musculus
gaagaagaaatatgagactaaggtg

SEQ ID NO: 631804 - DNA, 25 bp, Mus musculus
gaagaagaacatcctacagtgtctg

SEQ ID NO: 631805 - DNA, 25 bp, Mus musculus
gaagaagaacatgctacagtgtctg

SEQ ID NO: 631806 - DNA, 25 bp, Mus musculus
gaagaagaaccgcaacaaatgccag

SEQ ID NO: 631807 - DNA, 25 bp, Mus musculus
gaagaagaaccggaacaaatgccag

SEQ ID NO: 631808 - DNA, 25 bp, Mus musculus
gaagaagaagctaaatttggtgcca

SEQ ID NO: 631809 - DNA, 25 bp, Mus musculus
gaagaagaagctcattgacctactc

SEQ ID NO: 631810 - DNA, 25 bp, Mus musculus
gaagaagaagctgattgacctactc

SEQ ID NO: 631811 - DNA, 25 bp, Mus musculus
gaagaagaagcttaatttggtgcca

SEQ ID NO: 631812 - DNA, 25 bp, Mus musculus
gaagaagaagtacgatgtggacaca

SEQ ID NO: 631813 - DNA, 25 bp, Mus musculus
gaagaagaagtaggatgtggacaca

SEQ ID NO: 631814 - DNA, 25 bp, Mus musculus
gaagaagaatatcggccgaggaact

SEQ ID NO: 631815 - DNA, 25 bp, Mus musculus
gaagaagaatatgggccgaggaact

SEQ ID NO: 631816 - DNA, 25 bp, Mus musculus
gaagaagaattacaagagctcaggg

SEQ ID NO: 631817 - DNA, 25 bp, Mus musculus
gaagaagaattagaagagctcaggg

SEQ ID NO: 631818 - DNA, 25 bp, Mus musculus
gaagaagaatttattgaacgctgtt

SEQ ID NO: 631819 - DNA, 25 bp, Mus musculus
gaagaagaattttttgaacgctgtt

SEQ ID NO: 631820 - DNA, 25 bp, Mus musculus
gaagaagacagactcgcagccaaga

SEQ ID NO: 631821 - DNA, 25 bp, Mus musculus
gaagaagacagagtcgcagccaaga

SEQ ID NO: 631822 - DNA, 25 bp, Mus musculus
gaagaagacatacaccccaactcag

SEQ ID NO: 631823 - DNA, 25 bp, Mus musculus
gaagaagacatagaccccaactcag

SEQ ID NO: 631824 - DNA, 25 bp, Mus musculus
gaagaagacatgactggagttgtga

SEQ ID NO: 631825 - DNA, 25 bp, Mus musculus
gaagaagacatgtctggagttgtga

SEQ ID NO: 631826 - DNA, 25 bp, Mus musculus
gaagaagaccgtcgccctgggagct

SEQ ID NO: 631827 - DNA, 25 bp, Mus musculus
gaagaagaccgtggccctgggagct

SEQ ID NO: 631828 - DNA, 25 bp, Mus musculus
gaagaagacctcacatgcccaattt

SEQ ID NO: 631829 - DNA, 25 bp, Mus musculus
gaagaagacctctcatgcccaattt

SEQ ID NO: 631830 - DNA, 25 bp, Mus musculus
gaagaagacgaaaaccatccaacaa

SEQ ID NO: 631831 - DNA, 25 bp, Mus musculus
gaagaagacgaataccatccaacaa

SEQ ID NO: 631832 - DNA, 25 bp, Mus musculus
gaagaagacgctcgtgctcagagac

SEQ ID NO: 631833 - DNA, 25 bp, Mus musculus
gaagaagacgctggtgctcagagac

SEQ ID NO: 631834 - DNA, 25 bp, Mus musculus
gaagaagagacgatggacttccgat

SEQ ID NO: 631835 - DNA, 25 bp, Mus musculus
gaagaagagacgttggacttccgat

SEQ ID NO: 631836 - DNA, 25 bp, Mus musculus
gaagaagagcaaaacatcctccaag

SEQ ID NO: 631837 - DNA, 25 bp, Mus musculus
gaagaagagcaatacatcctccaag

SEQ ID NO: 631838 - DNA, 25 bp, Mus musculus
gaagaagagcctaagtcagtcctct

SEQ ID NO: 631839 - DNA, 25 bp, Mus musculus
gaagaagagccttagtcagtcctct

SEQ ID NO: 631840 - DNA, 25 bp, Mus musculus
gaagaagagggcacacctttcacag

SEQ ID NO: 631841 - DNA, 25 bp, Mus musculus
gaagaagagggctcacctttcacag

SEQ ID NO: 631842 - DNA, 25 bp, Mus musculus
gaagaagagtaccaagacttggcgt

SEQ ID NO: 631843 - DNA, 25 bp, Mus musculus
gaagaagagtacgaagacttggcgt

SEQ ID NO: 631844 - DNA, 25 bp, Mus musculus
gaagaagagtcacagaggaagcttc

SEQ ID NO: 631845 - DNA, 25 bp, Mus musculus
gaagaagagtcagagaggaagcttc

SEQ ID NO: 631846 - DNA, 25 bp, Mus musculus
gaagaagatataacacgtacctccc

SEQ ID NO: 631847 - DNA, 25 bp, Mus musculus
gaagaagatataccaagtcccctga

SEQ ID NO: 631848 - DNA, 25 bp, Mus musculus
gaagaagatatagcaagtcccctga

SEQ ID NO: 631849 - DNA, 25 bp, Mus musculus
gaagaagatatatcacgtacctccc

SEQ ID NO: 631850 - DNA, 25 bp, Mus musculus
gaagaagatccgcagcctcatgaag

SEQ ID NO: 631851 - DNA, 25 bp, Mus musculus
gaagaagatccggagcctcatgaag

SEQ ID NO: 631852 - DNA, 25 bp, Mus musculus
gaagaagatcgcctcggagattgcc

SEQ ID NO: 631853 - DNA, 25 bp, Mus musculus
gaagaagatcgcgtcggagattgcc

SEQ ID NO: 631854 - DNA, 25 bp, Mus musculus
gaagaagatgacagtaatagcaggg

SEQ ID NO: 631855 - DNA, 25 bp, Mus musculus
gaagaagatgactgtaatagcaggg

SEQ ID NO: 631856 - DNA, 25 bp, Mus musculus
gaagaagatgcacgaccaagatgag

SEQ ID NO: 631857 - DNA, 25 bp, Mus musculus
gaagaagatgcaggaccaagatgag

SEQ ID NO: 631858 - DNA, 25 bp, Mus musculus
gaagaagatgccctgcctggtctca

SEQ ID NO: 631859 - DNA, 25 bp, Mus musculus
gaagaagatgccgtgcctggtctca

SEQ ID NO: 631860 - DNA, 25 bp, Mus musculus
gaagaagatggacttagagttcctc

SEQ ID NO: 631861 - DNA, 25 bp, Mus musculus
gaagaagatggagttagagttcctc

SEQ ID NO: 631862 - DNA, 25 bp, Mus musculus
gaagaagatggtcctggaccttcta

SEQ ID NO: 631863 - DNA, 25 bp, Mus musculus
gaagaagatggtgctggaccttcta

SEQ ID NO: 631864 - DNA, 25 bp, Mus musculus
gaagaagattttcgcctctttcagt

SEQ ID NO: 631865 - DNA, 25 bp, Mus musculus
gaagaagattttggcctctttcagt

SEQ ID NO: 631866 - DNA, 25 bp, Mus musculus
gaagaagcaaatcgttgccaatgtg

SEQ ID NO: 631867 - DNA, 25 bp, Mus musculus
gaagaagcaaatggttgccaatgtg

SEQ ID NO: 631868 - DNA, 25 bp, Mus musculus
gaagaagcaatgaggaagctaagga

SEQ ID NO: 631869 - DNA, 25 bp, Mus musculus
gaagaagcaatgtggaagctaagga

SEQ ID NO: 631870 - DNA, 25 bp, Mus musculus
gaagaagcacttccgagacacggtt

SEQ ID NO: 631871 - DNA, 25 bp, Mus musculus
gaagaagcacttgcgagacacggtt

SEQ ID NO: 631872 - DNA, 25 bp, Mus musculus
gaagaagcatttccttcgcagggta

SEQ ID NO: 631873 - DNA, 25 bp, Mus musculus
gaagaagcatttgcttcgcagggta

SEQ ID NO: 631874 - DNA, 25 bp, Mus musculus
gaagaagccaaaccaacatactggg

SEQ ID NO: 631875 - DNA, 25 bp, Mus musculus
gaagaagccaaagcaacatactggg

SEQ ID NO: 631876 - DNA, 25 bp, Mus musculus
gaagaagccaacaggttgacgctgg

SEQ ID NO: 631877 - DNA, 25 bp, Mus musculus
gaagaagccaactggttgacgctgg

SEQ ID NO: 631878 - DNA, 25 bp, Mus musculus
gaagaagccactaaagcagttacag

SEQ ID NO: 631879 - DNA, 25 bp, Mus musculus
gaagaagccacttaagcagttacag

SEQ ID NO: 631880 - DNA, 25 bp, Mus musculus
gaagaagccatacaaaggattcata

SEQ ID NO: 631881 - DNA, 25 bp, Mus musculus
gaagaagccatagaaaggattcata

SEQ ID NO: 631882 - DNA, 25 bp, Mus musculus
gaagaagcccaacatccgtaggaag

SEQ ID NO: 631883 - DNA, 25 bp, Mus musculus
gaagaagcccaagatccgtaggaag

SEQ ID NO: 631884 - DNA, 25 bp, Mus musculus
gaagaagcccaccatgtatcctgag

SEQ ID NO: 631885 - DNA, 25 bp, Mus musculus
gaagaagcccacgatgtatcctgag

SEQ ID NO: 631886 - DNA, 25 bp, Mus musculus
gaagaagcgcttcagggagtcctta

SEQ ID NO: 631887 - DNA, 25 bp, Mus musculus
gaagaagcgcttcgaccacaatgag

SEQ ID NO: 631888 - DNA, 25 bp, Mus musculus
gaagaagcgcttgagggagtcctta

SEQ ID NO: 631889 - DNA, 25 bp, Mus musculus
gaagaagcgcttggaccacaatgag

SEQ ID NO: 631890 - DNA, 25 bp, Mus musculus
gaagaagcgtcactattggtctatg

SEQ ID NO: 631891 - DNA, 25 bp, Mus musculus
gaagaagcgtcagtattggtctatg

SEQ ID NO: 631892 - DNA, 25 bp, Mus musculus
gaagaagctaagaacgcagtggcca

SEQ ID NO: 631893 - DNA, 25 bp, Mus musculus
gaagaagctaagtacgcagtggcca

SEQ ID NO: 631894 - DNA, 25 bp, Mus musculus
gaagaagctattagcactttaaaga

SEQ ID NO: 631895 - DNA, 25 bp, Mus musculus
gaagaagctatttgcactttaaaga

SEQ ID NO: 631896 - DNA, 25 bp, Mus musculus
gaagaagctgaccatgatgatatct

SEQ ID NO: 631897 - DNA, 25 bp, Mus musculus
gaagaagctgacgatgatgatatct

SEQ ID NO: 631898 - DNA, 25 bp, Mus musculus
gaagaagctgatctcactgctctgc

SEQ ID NO: 631899 - DNA, 25 bp, Mus musculus
gaagaagctgatgtcactgctctgc

SEQ ID NO: 631900 - DNA, 25 bp, Mus musculus
gaagaagctgcaaaattgttgaaag

SEQ ID NO: 631901 - DNA, 25 bp, Mus musculus
gaagaagctgcataattgttgaaag

SEQ ID NO: 631902 - DNA, 25 bp, Mus musculus
gaagaagctgcgagatgagatcaac

SEQ ID NO: 631903 - DNA, 25 bp, Mus musculus
gaagaagctgcgtgatgagatcaac

SEQ ID NO: 631904 - DNA, 25 bp, Mus musculus
gaagaagctttaaacagatccaaga

SEQ ID NO: 631905 - DNA, 25 bp, Mus musculus
gaagaagctttatacagatccaaga

SEQ ID NO: 631906 - DNA, 25 bp, Mus musculus
gaagaaggaagacataaagcagaga

SEQ ID NO: 631907 - DNA, 25 bp, Mus musculus
gaagaaggaagagataaagcagaga

SEQ ID NO: 631908 - DNA, 25 bp, Mus musculus
gaagaaggacctccagatgttcctg

SEQ ID NO: 631909 - DNA, 25 bp, Mus musculus
gaagaaggacctgcagatgttcctg

SEQ ID NO: 631910 - DNA, 25 bp, Mus musculus
gaagaaggagaccatggctcgaccc

SEQ ID NO: 631911 - DNA, 25 bp, Mus musculus
gaagaaggagacgatggctcgaccc

SEQ ID NO: 631912 - DNA, 25 bp, Mus musculus
gaagaaggagccatgccacgaggct

SEQ ID NO: 631913 - DNA, 25 bp, Mus musculus
gaagaaggagccttgccacgaggct

SEQ ID NO: 631914 - DNA, 25 bp, Mus musculus
gaagaaggatcaagtcttgctacaa

SEQ ID NO: 631915 - DNA, 25 bp, Mus musculus
gaagaaggatcatgtcttgctacaa

SEQ ID NO: 631916 - DNA, 25 bp, Mus musculus
gaagaaggatcccaacgagtgccct

SEQ ID NO: 631917 - DNA, 25 bp, Mus musculus
gaagaaggatccgaacgagtgccct

SEQ ID NO: 631918 - DNA, 25 bp, Mus musculus
gaagaaggatttccataggatttgc

SEQ ID NO: 631919 - DNA, 25 bp, Mus musculus
gaagaaggatttgcataggatttgc

SEQ ID NO: 631920 - DNA, 25 bp, Mus musculus
gaagaaggcaacatgtggcacagtc

SEQ ID NO: 631921 - DNA, 25 bp, Mus musculus
gaagaaggcaacttgtggcacagtc

SEQ ID NO: 631922 - DNA, 25 bp, Mus musculus
gaagaaggcactcgaaaagcacgca

SEQ ID NO: 631923 - DNA, 25 bp, Mus musculus
gaagaaggcactggaaaagcacgca

SEQ ID NO: 631924 - DNA, 25 bp, Mus musculus
gaagaaggccaaaagacctggtcag

SEQ ID NO: 631925 - DNA, 25 bp, Mus musculus
gaagaaggccaatagacctggtcag

SEQ ID NO: 631926 - DNA, 25 bp, Mus musculus
gaagaaggcgctctttccctgaaga

SEQ ID NO: 631927 - DNA, 25 bp, Mus musculus
gaagaaggcgctgtttccctgaaga

SEQ ID NO: 631928 - DNA, 25 bp, Mus musculus
gaagaaggcgtaagaagttgctgcc

SEQ ID NO: 631929 - DNA, 25 bp, Mus musculus
gaagaaggcgtatgaagttgctgcc

SEQ ID NO: 631930 - DNA, 25 bp, Mus musculus
gaagaaggctctctgtaaccctcat

SEQ ID NO: 631931 - DNA, 25 bp, Mus musculus
gaagaaggctctgtgtaaccctcat

SEQ ID NO: 631932 - DNA, 25 bp, Mus musculus
gaagaagggaaaacaaaatgccttg

SEQ ID NO: 631933 - DNA, 25 bp, Mus musculus
gaagaagggaaatcaaaatgccttg

SEQ ID NO: 631934 - DNA, 25 bp, Mus musculus
gaagaagggacaacatgctgccgag

SEQ ID NO: 631935 - DNA, 25 bp, Mus musculus
gaagaagggacatcatgctgccgag

SEQ ID NO: 631936 - DNA, 25 bp, Mus musculus
gaagaagggaggcaacacatgcctt

SEQ ID NO: 631937 - DNA, 25 bp, Mus musculus
gaagaagggagggaacacatgcctt

SEQ ID NO: 631938 - DNA, 25 bp, Mus musculus
gaagaagggtctccatacagtccgg

SEQ ID NO: 631939 - DNA, 25 bp, Mus musculus
gaagaagggtctgcatacagtccgg

SEQ ID NO: 631940 - DNA, 25 bp, Mus musculus
gaagaaggtagacgcggcccactgt

SEQ ID NO: 631941 - DNA, 25 bp, Mus musculus
gaagaaggtagaggcggcccactgt

SEQ ID NO: 631942 - DNA, 25 bp, Mus musculus
gaagaaggtgatccccagacagaag

SEQ ID NO: 631943 - DNA, 25 bp, Mus musculus
gaagaaggtgatgcccagacagaag

SEQ ID NO: 631944 - DNA, 25 bp, Mus musculus
gaagaaggtgccaccctaggagaag

SEQ ID NO: 631945 - DNA, 25 bp, Mus musculus
gaagaaggtgcctccctaggagaag

SEQ ID NO: 631946 - DNA, 25 bp, Mus musculus
gaagaaggtttacaccctcagatca

SEQ ID NO: 631947 - DNA, 25 bp, Mus musculus
gaagaaggtttagaccctcagatca

SEQ ID NO: 631948 - DNA, 25 bp, Mus musculus
gaagaagtaaaccaatgtggtgaga

SEQ ID NO: 631949 - DNA, 25 bp, Mus musculus
gaagaagtaaacgaatgtggtgaga

SEQ ID NO: 631950 - DNA, 25 bp, Mus musculus
gaagaagtacctcacacaggctcag

SEQ ID NO: 631951 - DNA, 25 bp, Mus musculus
gaagaagtacctgacacaggctcag

SEQ ID NO: 631952 - DNA, 25 bp, Mus musculus
gaagaagtatccacactgcgcaagg

SEQ ID NO: 631953 - DNA, 25 bp, Mus musculus
gaagaagtatcctcactgcgcaagg

SEQ ID NO: 631954 - DNA, 25 bp, Mus musculus
gaagaagtatctacagggcctcgga

SEQ ID NO: 631955 - DNA, 25 bp, Mus musculus
gaagaagtatcttcagggcctcgga

SEQ ID NO: 631956 - DNA, 25 bp, Mus musculus
gaagaagtcaggagatccatccgct

SEQ ID NO: 631957 - DNA, 25 bp, Mus musculus
gaagaagtcaggtgatccatccgct

SEQ ID NO: 631958 - DNA, 25 bp, Mus musculus
gaagaagtgaagagcctgtccttaa

SEQ ID NO: 631959 - DNA, 25 bp, Mus musculus
gaagaagtgaagataggcaacaaga

SEQ ID NO: 631960 - DNA, 25 bp, Mus musculus
gaagaagtgaagtgcctgtccttaa

SEQ ID NO: 631961 - DNA, 25 bp, Mus musculus
gaagaagtgaagttaggcaacaaga

SEQ ID NO: 631962 - DNA, 25 bp, Mus musculus
gaagaagtgacccagaagggacttc

SEQ ID NO: 631963 - DNA, 25 bp, Mus musculus
gaagaagtgaccgagaagggacttc

SEQ ID NO: 631964 - DNA, 25 bp, Mus musculus
gaagaagtgagcctcagcaatgctc

SEQ ID NO: 631965 - DNA, 25 bp, Mus musculus
gaagaagtgagcgtcagcaatgctc

SEQ ID NO: 631966 - DNA, 25 bp, Mus musculus
gaagaagtgtgcagatgggattacc

SEQ ID NO: 631967 - DNA, 25 bp, Mus musculus
gaagaagtgtgctgatgggattacc

SEQ ID NO: 631968 - DNA, 25 bp, Mus musculus
gaagaagttactacgaaagtgtgag

SEQ ID NO: 631969 - DNA, 25 bp, Mus musculus
gaagaagttacttcgaaagtgtgag

SEQ ID NO: 631970 - DNA, 25 bp, Mus musculus
gaagaagttagcattacagggagca

SEQ ID NO: 631971 - DNA, 25 bp, Mus musculus
gaagaagttagctttacagggagca

SEQ ID NO: 631972 - DNA, 25 bp, Mus musculus
gaagaagttatgcagatcacaacag

SEQ ID NO: 631973 - DNA, 25 bp, Mus musculus
gaagaagttatggagatcacaacag

SEQ ID NO: 631974 - DNA, 25 bp, Mus musculus
gaagaagttccgcatttccacagcc

SEQ ID NO: 631975 - DNA, 25 bp, Mus musculus
gaagaagttccggatttccacagcc

SEQ ID NO: 631976 - DNA, 25 bp, Mus musculus
gaagaagttgaaaattctacagtcc

SEQ ID NO: 631977 - DNA, 25 bp, Mus musculus
gaagaagttgaatattctacagtcc

SEQ ID NO: 631978 - DNA, 25 bp, Mus musculus
gaagaagttgagcatctctgccgcc

SEQ ID NO: 631979 - DNA, 25 bp, Mus musculus
gaagaagttgaggatctctgccgcc

SEQ ID NO: 631980 - DNA, 25 bp, Mus musculus
gaagaagttggacgctatcaaagac

SEQ ID NO: 631981 - DNA, 25 bp, Mus musculus
gaagaagttggaggctatcaaagac

SEQ ID NO: 631982 - DNA, 25 bp, Mus musculus
gaagaagttgttctctatgctccag

SEQ ID NO: 631983 - DNA, 25 bp, Mus musculus
gaagaagttgttgtctatgctccag

SEQ ID NO: 631984 - DNA, 25 bp, Mus musculus
gaagaagtttcactggcctgcaagt

SEQ ID NO: 631985 - DNA, 25 bp, Mus musculus
gaagaagtttcagtggcctgcaagt

SEQ ID NO: 631986 - DNA, 25 bp, Mus musculus
gaagaagtttgacacaaaagtccac

SEQ ID NO: 631987 - DNA, 25 bp, Mus musculus
gaagaagtttgagacaaaagtccac

SEQ ID NO: 631988 - DNA, 25 bp, Mus musculus
gaagaataagaactgccgtcgccat

SEQ ID NO: 631989 - DNA, 25 bp, Mus musculus
gaagaataagaagtgccgtcgccat

SEQ ID NO: 631990 - DNA, 25 bp, Mus musculus
gaagaataagacaaaagagtcccct

SEQ ID NO: 631991 - DNA, 25 bp, Mus musculus
gaagaataagactaaagagtcccct

SEQ ID NO: 631992 - DNA, 25 bp, Mus musculus
gaagaataagagacgtcacggcaac

SEQ ID NO: 631993 - DNA, 25 bp, Mus musculus
gaagaataagagtcgtcacggcaac

SEQ ID NO: 631994 - DNA, 25 bp, Mus musculus
gaagaatacaccctttctgtatgac

SEQ ID NO: 631995 - DNA, 25 bp, Mus musculus
gaagaatacaccgtttctgtatgac

SEQ ID NO: 631996 - DNA, 25 bp, Mus musculus
gaagaatacagaaatagaaaatacg

SEQ ID NO: 631997 - DNA, 25 bp, Mus musculus
gaagaatacagatatagaaaatacg

SEQ ID NO: 631998 - DNA, 25 bp, Mus musculus
gaagaatacggtcatggaatgtgat

SEQ ID NO: 631999 - DNA, 25 bp, Mus musculus
gaagaatacggtgatggaatgtgat

SEQ ID NO: 632000 - DNA, 25 bp, Mus musculus
gaagaatagccacgatccagcaaat

SEQ ID NO: 632001 - DNA, 25 bp, Mus musculus
gaagaatagccaggatccagcaaat

SEQ ID NO: 632002 - DNA, 25 bp, Mus musculus
gaagaatagttgaccaagagataag

SEQ ID NO: 632003 - DNA, 25 bp, Mus musculus
gaagaatagttgtccaagagataag

SEQ ID NO: 632004 - DNA, 25 bp, Mus musculus
gaagaatatagacggcaaaccgact

SEQ ID NO: 632005 - DNA, 25 bp, Mus musculus
gaagaatatagagggcaaaccgact

SEQ ID NO: 632006 - DNA, 25 bp, Mus musculus
gaagaatatccacatctgaaaccag

SEQ ID NO: 632007 - DNA, 25 bp, Mus musculus
gaagaatatccagatctgaaaccag

SEQ ID NO: 632008 - DNA, 25 bp, Mus musculus
gaagaatatgtgattgcggccctga

SEQ ID NO: 632009 - DNA, 25 bp, Mus musculus
gaagaatatgtgtttgcggccctga

SEQ ID NO: 632010 - DNA, 25 bp, Mus musculus
gaagaatattcaaggagaggcgagc

SEQ ID NO: 632011 - DNA, 25 bp, Mus musculus
gaagaatattcatggagaggcgagc

SEQ ID NO: 632012 - DNA, 25 bp, Mus musculus
gaagaatatttccaagaagtagggc

SEQ ID NO: 632013 - DNA, 25 bp, Mus musculus
gaagaatatttcgaagaagtagggc

SEQ ID NO: 632014 - DNA, 25 bp, Mus musculus
gaagaatcatttccgcggttgaatc

SEQ ID NO: 632015 - DNA, 25 bp, Mus musculus
gaagaatcatttgcgcggttgaatc

SEQ ID NO: 632016 - DNA, 25 bp, Mus musculus
gaagaatccaaaagcggaccaggag

SEQ ID NO: 632017 - DNA, 25 bp, Mus musculus
gaagaatccaaatgcggaccaggag

SEQ ID NO: 632018 - DNA, 25 bp, Mus musculus
gaagaatccctccaaaatgccagaa

SEQ ID NO: 632019 - DNA, 25 bp, Mus musculus
gaagaatccctcgaaaatgccagaa

SEQ ID NO: 632020 - DNA, 25 bp, Mus musculus
gaagaatcctgacgatttctctagg

SEQ ID NO: 632021 - DNA, 25 bp, Mus musculus
gaagaatcctgaggatttctctagg

SEQ ID NO: 632022 - DNA, 25 bp, Mus musculus
gaagaatccttcaacgctgtacaag

SEQ ID NO: 632023 - DNA, 25 bp, Mus musculus
gaagaatccttctacgctgtacaag

SEQ ID NO: 632024 - DNA, 25 bp, Mus musculus
gaagaatcgaaacgctgtgtaatcc

SEQ ID NO: 632025 - DNA, 25 bp, Mus musculus
gaagaatcgaaaggctgtgtaatcc

SEQ ID NO: 632026 - DNA, 25 bp, Mus musculus
gaagaatcgaccattaaaggacaga

SEQ ID NO: 632027 - DNA, 25 bp, Mus musculus
gaagaatcgacctttaaaggacaga

SEQ ID NO: 632028 - DNA, 25 bp, Mus musculus
gaagaatcgagtacctgcagagcca

SEQ ID NO: 632029 - DNA, 25 bp, Mus musculus
gaagaatcgagttcctgcagagcca

SEQ ID NO: 632030 - DNA, 25 bp, Mus musculus
gaagaatctaaacctttcacctgtt

SEQ ID NO: 632031 - DNA, 25 bp, Mus musculus
gaagaatctaaagctttcacctgtt

SEQ ID NO: 632032 - DNA, 25 bp, Mus musculus
gaagaatctactatggaacagaagc

SEQ ID NO: 632033 - DNA, 25 bp, Mus musculus
gaagaatctactttggaacagaagc

SEQ ID NO: 632034 - DNA, 25 bp, Mus musculus
gaagaatctggaatatgcagccaca

SEQ ID NO: 632035 - DNA, 25 bp, Mus musculus
gaagaatctggattatgcagccaca

SEQ ID NO: 632036 - DNA, 25 bp, Mus musculus
gaagaatcttctagcctcctccagt

SEQ ID NO: 632037 - DNA, 25 bp, Mus musculus
gaagaatcttcttgcctcctccagt

SEQ ID NO: 632038 - DNA, 25 bp, Mus musculus
gaagaatcttgaccctttcatttcc

SEQ ID NO: 632039 - DNA, 25 bp, Mus musculus
gaagaatcttgagcctttcatttcc

SEQ ID NO: 632040 - DNA, 25 bp, Mus musculus
gaagaatgaagtcgctgccctcaca

SEQ ID NO: 632041 - DNA, 25 bp, Mus musculus
gaagaatgaagtggctgccctcaca

SEQ ID NO: 632042 - DNA, 25 bp, Mus musculus
gaagaatgaatccacagaaagtgat

SEQ ID NO: 632043 - DNA, 25 bp, Mus musculus
gaagaatgaatcgacagaaagtgat

SEQ ID NO: 632044 - DNA, 25 bp, Mus musculus
gaagaatgacaccttcctgagagca

SEQ ID NO: 632045 - DNA, 25 bp, Mus musculus
gaagaatgacacgttcctgagagca

SEQ ID NO: 632046 - DNA, 25 bp, Mus musculus
gaagaatgacagagaacgagagcgc

SEQ ID NO: 632047 - DNA, 25 bp, Mus musculus
gaagaatgacagtgaacgagagcgc

SEQ ID NO: 632048 - DNA, 25 bp, Mus musculus
gaagaatgcaagattcccccagtgc

SEQ ID NO: 632049 - DNA, 25 bp, Mus musculus
gaagaatgcaagtttcccccagtgc

SEQ ID NO: 632050 - DNA, 25 bp, Mus musculus
gaagaatgccaacatctgaaaaagc

SEQ ID NO: 632051 - DNA, 25 bp, Mus musculus
gaagaatgccaagatctgaaaaagc

SEQ ID NO: 632052 - DNA, 25 bp, Mus musculus
gaagaatgccataaacatcgaggag

SEQ ID NO: 632053 - DNA, 25 bp, Mus musculus
gaagaatgccattaacatcgaggag

SEQ ID NO: 632054 - DNA, 25 bp, Mus musculus
gaagaatgcgaacccttccgcaagc

SEQ ID NO: 632055 - DNA, 25 bp, Mus musculus
gaagaatgcgaagccttccgcaagc

SEQ ID NO: 632056 - DNA, 25 bp, Mus musculus
gaagaatgctccatgtgtcactctg

SEQ ID NO: 632057 - DNA, 25 bp, Mus musculus
gaagaatgctccttgtgtcactctg

SEQ ID NO: 632058 - DNA, 25 bp, Mus musculus
gaagaatggaacacagcgcccaaga

SEQ ID NO: 632059 - DNA, 25 bp, Mus musculus
gaagaatggaactcagcgcccaaga

SEQ ID NO: 632060 - DNA, 25 bp, Mus musculus
gaagaatggagtaagagctgaatgt

SEQ ID NO: 632061 - DNA, 25 bp, Mus musculus
gaagaatggagttagagctgaatgt

SEQ ID NO: 632062 - DNA, 25 bp, Mus musculus
gaagaatggcataccttctaacagg

SEQ ID NO: 632063 - DNA, 25 bp, Mus musculus
gaagaatggcattccttctaacagg

SEQ ID NO: 632064 - DNA, 25 bp, Mus musculus
gaagaatggccaacatcccgaagaa

SEQ ID NO: 632065 - DNA, 25 bp, Mus musculus
gaagaatggccatcatcccgaagaa

SEQ ID NO: 632066 - DNA, 25 bp, Mus musculus
gaagaatggcctcatgtcaaacccc

SEQ ID NO: 632067 - DNA, 25 bp, Mus musculus
gaagaatggcctgatgtcaaacccc

SEQ ID NO: 632068 - DNA, 25 bp, Mus musculus
gaagaatgggaacgccaatatagcc

SEQ ID NO: 632069 - DNA, 25 bp, Mus musculus
gaagaatgggaaggccaatatagcc

SEQ ID NO: 632070 - DNA, 25 bp, Mus musculus
gaagaatggtggctcaatgttgcct

SEQ ID NO: 632071 - DNA, 25 bp, Mus musculus
gaagaatggtgggtcaatgttgcct

SEQ ID NO: 632072 - DNA, 25 bp, Mus musculus
gaagaatgtgtaaggaaactgacct

SEQ ID NO: 632073 - DNA, 25 bp, Mus musculus
gaagaatgtgtatggaaactgacct

SEQ ID NO: 632074 - DNA, 25 bp, Mus musculus
gaagaatgttttaaatggagatgag

SEQ ID NO: 632075 - DNA, 25 bp, Mus musculus
gaagaatgtttttaatggagatgag

SEQ ID NO: 632076 - DNA, 25 bp, Mus musculus
gaagaattcaaccactatgaggcca

SEQ ID NO: 632077 - DNA, 25 bp, Mus musculus
gaagaattcaacgactatgaggcca

SEQ ID NO: 632078 - DNA, 25 bp, Mus musculus
gaagaattcaggacaaattgctgtg

SEQ ID NO: 632079 - DNA, 25 bp, Mus musculus
gaagaattcaggtcaaattgctgtg

SEQ ID NO: 632080 - DNA, 25 bp, Mus musculus
gaagaattccagaattactttgctg

SEQ ID NO: 632081 - DNA, 25 bp, Mus musculus
gaagaattccagtattactttgctg

SEQ ID NO: 632082 - DNA, 25 bp, Mus musculus
gaagaattcgagagcaactctctga

SEQ ID NO: 632083 - DNA, 25 bp, Mus musculus
gaagaattcgagtgcaactctctga

SEQ ID NO: 632084 - DNA, 25 bp, Mus musculus
gaagaattgaaaacggtgacgaaca

SEQ ID NO: 632085 - DNA, 25 bp, Mus musculus
gaagaattgaaatcggtgacgaaca

SEQ ID NO: 632086 - DNA, 25 bp, Mus musculus
gaagaattgaccagaatgctagcag

SEQ ID NO: 632087 - DNA, 25 bp, Mus musculus
gaagaattgacctgaatgctagcag

SEQ ID NO: 632088 - DNA, 25 bp, Mus musculus
gaagaattgcaacattccagtgtgg

SEQ ID NO: 632089 - DNA, 25 bp, Mus musculus
gaagaattgcaagattccagtgtgg

SEQ ID NO: 632090 - DNA, 25 bp, Mus musculus
gaagaattgcctccagttgctcatg

SEQ ID NO: 632091 - DNA, 25 bp, Mus musculus
gaagaattgcctgcagttgctcatg

SEQ ID NO: 632092 - DNA, 25 bp, Mus musculus
gaagaattgctaaagtgctgtttgc

SEQ ID NO: 632093 - DNA, 25 bp, Mus musculus
gaagaattgctatagtgctgtttgc

SEQ ID NO: 632094 - DNA, 25 bp, Mus musculus
gaagaattggacaccttgaaggagg

SEQ ID NO: 632095 - DNA, 25 bp, Mus musculus
gaagaattggactccttgaaggagg

SEQ ID NO: 632096 - DNA, 25 bp, Mus musculus
gaagaattgtcacctaccctcatgg

SEQ ID NO: 632097 - DNA, 25 bp, Mus musculus
gaagaattgtcagctaccctcatgg

SEQ ID NO: 632098 - DNA, 25 bp, Mus musculus
gaagaatttatcctagctatgcacc

SEQ ID NO: 632099 - DNA, 25 bp, Mus musculus
gaagaatttatcgtagctatgcacc

SEQ ID NO: 632100 - DNA, 25 bp, Mus musculus
gaagaatttccaaccaccagtcagg

SEQ ID NO: 632101 - DNA, 25 bp, Mus musculus
gaagaatttccatccaccagtcagg

SEQ ID NO: 632102 - DNA, 25 bp, Mus musculus
gaagaatttccccttgtgtgtcaca

SEQ ID NO: 632103 - DNA, 25 bp, Mus musculus
gaagaatttcccgttgtgtgtcaca

SEQ ID NO: 632104 - DNA, 25 bp, Mus musculus
gaagaatttcctcatctaactatgt

SEQ ID NO: 632105 - DNA, 25 bp, Mus musculus
gaagaatttcctgatctaactatgt

SEQ ID NO: 632106 - DNA, 25 bp, Mus musculus
gaagaatttgggatttgacacccgg

SEQ ID NO: 632107 - DNA, 25 bp, Mus musculus
gaagaatttgggttttgacacccgg

SEQ ID NO: 632108 - DNA, 25 bp, Mus musculus
gaagacaaaagcaaccttccctgcc

SEQ ID NO: 632109 - DNA, 25 bp, Mus musculus
gaagacaaaagctaccttccctgcc

SEQ ID NO: 632110 - DNA, 25 bp, Mus musculus
gaagacaaatccaaatgccattaaa

SEQ ID NO: 632111 - DNA, 25 bp, Mus musculus
gaagacaaatcctaatgccattaaa

SEQ ID NO: 632112 - DNA, 25 bp, Mus musculus
gaagacaaccacctggttggatcct

SEQ ID NO: 632113 - DNA, 25 bp, Mus musculus
gaagacaaccacgtggttggatcct

SEQ ID NO: 632114 - DNA, 25 bp, Mus musculus
gaagacaaccagcactggacccagt

SEQ ID NO: 632115 - DNA, 25 bp, Mus musculus
gaagacaaccaggactggacccagt

SEQ ID NO: 632116 - DNA, 25 bp, Mus musculus
gaagacaaccgccaagaatggacat

SEQ ID NO: 632117 - DNA, 25 bp, Mus musculus
gaagacaaccgcgaagaatggacat

SEQ ID NO: 632118 - DNA, 25 bp, Mus musculus
gaagacaaccttacatgaaaccagt

SEQ ID NO: 632119 - DNA, 25 bp, Mus musculus
gaagacaacctttcatgaaaccagt

SEQ ID NO: 632120 - DNA, 25 bp, Mus musculus
gaagacaacttccttgtgcccatag

SEQ ID NO: 632121 - DNA, 25 bp, Mus musculus
gaagacaacttcgttgtgcccatag

SEQ ID NO: 632122 - DNA, 25 bp, Mus musculus
gaagacaacttgctgatcgagcgga

SEQ ID NO: 632123 - DNA, 25 bp, Mus musculus
gaagacaacttggtgatcgagcgga

SEQ ID NO: 632124 - DNA, 25 bp, Mus musculus
gaagacaagaatccaatcgatcgtg

SEQ ID NO: 632125 - DNA, 25 bp, Mus musculus
gaagacaagaatgcaatcgatcgtg

SEQ ID NO: 632126 - DNA, 25 bp, Mus musculus
gaagacaagagtcctgccgagtcct

SEQ ID NO: 632127 - DNA, 25 bp, Mus musculus
gaagacaagagtgctgccgagtcct

SEQ ID NO: 632128 - DNA, 25 bp, Mus musculus
gaagacaagatcaagttctggttgg

SEQ ID NO: 632129 - DNA, 25 bp, Mus musculus
gaagacaagatctagttctggttgg

SEQ ID NO: 632130 - DNA, 25 bp, Mus musculus
gaagacaatctaatgggccagtggg

SEQ ID NO: 632131 - DNA, 25 bp, Mus musculus
gaagacaatctattgggccagtggg

SEQ ID NO: 632132 - DNA, 25 bp, Mus musculus
gaagacaattaacctgcagagcctc

SEQ ID NO: 632133 - DNA, 25 bp, Mus musculus
gaagacaattaagctgcagagcctc

SEQ ID NO: 632134 - DNA, 25 bp, Mus musculus
gaagacaattctcctttggatagaa

SEQ ID NO: 632135 - DNA, 25 bp, Mus musculus
gaagacaattctgctttggatagaa

SEQ ID NO: 632136 - DNA, 25 bp, Mus musculus
gaagacacccctagacctagcctgt

SEQ ID NO: 632137 - DNA, 25 bp, Mus musculus
gaagacaccccttgacctagcctgt

SEQ ID NO: 632138 - DNA, 25 bp, Mus musculus
gaagacaccctcactaataacagac

SEQ ID NO: 632139 - DNA, 25 bp, Mus musculus
gaagacaccctctctaataacagac

SEQ ID NO: 632140 - DNA, 25 bp, Mus musculus
gaagacaccgacattcaggagtcag

SEQ ID NO: 632141 - DNA, 25 bp, Mus musculus
gaagacaccgactttcaggagtcag

SEQ ID NO: 632142 - DNA, 25 bp, Mus musculus
gaagacaccggtcgtcatcgattac

SEQ ID NO: 632143 - DNA, 25 bp, Mus musculus
gaagacaccggtggtcatcgattac

SEQ ID NO: 632144 - DNA, 25 bp, Mus musculus
gaagacacgataaaggaagcccggc

SEQ ID NO: 632145 - DNA, 25 bp, Mus musculus
gaagacacgatataggaagcccggc

SEQ ID NO: 632146 - DNA, 25 bp, Mus musculus
gaagacacggtgacactgacatgcg

SEQ ID NO: 632147 - DNA, 25 bp, Mus musculus
gaagacacggtgtcactgacatgcg

SEQ ID NO: 632148 - DNA, 25 bp, Mus musculus
gaagacacgtcaacggccatgttga

SEQ ID NO: 632149 - DNA, 25 bp, Mus musculus
gaagacacgtcatcggccatgttga

SEQ ID NO: 632150 - DNA, 25 bp, Mus musculus
gaagacactgaacccttcgacatag

SEQ ID NO: 632151 - DNA, 25 bp, Mus musculus
gaagacactgaagccttcgacatag

SEQ ID NO: 632152 - DNA, 25 bp, Mus musculus
gaagacactggtacagaagaagccc

SEQ ID NO: 632153 - DNA, 25 bp, Mus musculus
gaagacactggttcagaagaagccc

SEQ ID NO: 632154 - DNA, 25 bp, Mus musculus
gaagacactgtgcaccagctgtgct

SEQ ID NO: 632155 - DNA, 25 bp, Mus musculus
gaagacactgtggaccagctgtgct

SEQ ID NO: 632156 - DNA, 25 bp, Mus musculus
gaagacacttggcttccttacctga

SEQ ID NO: 632157 - DNA, 25 bp, Mus musculus
gaagacacttgggttccttacctga

SEQ ID NO: 632158 - DNA, 25 bp, Mus musculus
gaagacagaagaatgaaatgtggga

SEQ ID NO: 632159 - DNA, 25 bp, Mus musculus
gaagacagaagattgaaatgtggga

SEQ ID NO: 632160 - DNA, 25 bp, Mus musculus
gaagacagaagtacaccggggaaca

SEQ ID NO: 632161 - DNA, 25 bp, Mus musculus
gaagacagaagttcaccggggaaca

SEQ ID NO: 632162 - DNA, 25 bp, Mus musculus
gaagacagacgtaccttcctcacca

SEQ ID NO: 632163 - DNA, 25 bp, Mus musculus
gaagacagacgttccttcctcacca

SEQ ID NO: 632164 - DNA, 25 bp, Mus musculus
gaagacagactgagtttctccggct

SEQ ID NO: 632165 - DNA, 25 bp, Mus musculus
gaagacagactgtgtttctccggct

SEQ ID NO: 632166 - DNA, 25 bp, Mus musculus
gaagacagagatagtacccgacagg

SEQ ID NO: 632167 - DNA, 25 bp, Mus musculus
gaagacagagattgtacccgacagg

SEQ ID NO: 632168 - DNA, 25 bp, Mus musculus
gaagacagcacgctgacctgcatgc

SEQ ID NO: 632169 - DNA, 25 bp, Mus musculus
gaagacagcacggtgacctgcatgc

SEQ ID NO: 632170 - DNA, 25 bp, Mus musculus
gaagacagcattaaggactccctgg

SEQ ID NO: 632171 - DNA, 25 bp, Mus musculus
gaagacagcatttaggactccctgg

SEQ ID NO: 632172 - DNA, 25 bp, Mus musculus
gaagacagccctccagcaaccagaa

SEQ ID NO: 632173 - DNA, 25 bp, Mus musculus
gaagacagccctgcagcaaccagaa

SEQ ID NO: 632174 - DNA, 25 bp, Mus musculus
gaagacagcggaaccttgtctccag

SEQ ID NO: 632175 - DNA, 25 bp, Mus musculus
gaagacagcggatccttgtctccag

SEQ ID NO: 632176 - DNA, 25 bp, Mus musculus
gaagacagcgtccttcagccagtcc

SEQ ID NO: 632177 - DNA, 25 bp, Mus musculus
gaagacagcgtcgttcagccagtcc

SEQ ID NO: 632178 - DNA, 25 bp, Mus musculus
gaagacagcgttaatgtgttcaaag

SEQ ID NO: 632179 - DNA, 25 bp, Mus musculus
gaagacagcgtttatgtgttcaaag

SEQ ID NO: 632180 - DNA, 25 bp, Mus musculus
gaagacagctacatgctcgtgatgc

SEQ ID NO: 632181 - DNA, 25 bp, Mus musculus
gaagacagctacttgctcgtgatgc

SEQ ID NO: 632182 - DNA, 25 bp, Mus musculus
gaagacaggaaaattactcaagaag

SEQ ID NO: 632183 - DNA, 25 bp, Mus musculus
gaagacaggaaacccagtgagctca

SEQ ID NO: 632184 - DNA, 25 bp, Mus musculus
gaagacaggaaagccagtgagctca

SEQ ID NO: 632185 - DNA, 25 bp, Mus musculus
gaagacaggaaatttactcaagaag

SEQ ID NO: 632186 - DNA, 25 bp, Mus musculus
gaagacaggataatctgtgaggccc

SEQ ID NO: 632187 - DNA, 25 bp, Mus musculus
gaagacaggatattctgtgaggccc

SEQ ID NO: 632188 - DNA, 25 bp, Mus musculus
gaagacaggcaaaacgaaggagaaa

SEQ ID NO: 632189 - DNA, 25 bp, Mus musculus
gaagacaggcaatacgaaggagaaa

SEQ ID NO: 632190 - DNA, 25 bp, Mus musculus
gaagacagtcaaccttgcgagcact

SEQ ID NO: 632191 - DNA, 25 bp, Mus musculus
gaagacagtcaagcttgcgagcact

SEQ ID NO: 632192 - DNA, 25 bp, Mus musculus
gaagacagtcacatctctttgcaga

SEQ ID NO: 632193 - DNA, 25 bp, Mus musculus
gaagacagtcacttctctttgcaga

SEQ ID NO: 632194 - DNA, 25 bp, Mus musculus
gaagacatagaccttttttgttcca

SEQ ID NO: 632195 - DNA, 25 bp, Mus musculus
gaagacatagacgttttttgttcca

SEQ ID NO: 632196 - DNA, 25 bp, Mus musculus
gaagacatagctcattcaatgccct

SEQ ID NO: 632197 - DNA, 25 bp, Mus musculus
gaagacatagctgattcaatgccct

SEQ ID NO: 632198 - DNA, 25 bp, Mus musculus
gaagacatatctacctgaagacttt

SEQ ID NO: 632199 - DNA, 25 bp, Mus musculus
gaagacatatcttcctgaagacttt

SEQ ID NO: 632200 - DNA, 25 bp, Mus musculus
gaagacatcaggattacggggccgt

SEQ ID NO: 632201 - DNA, 25 bp, Mus musculus
gaagacatcaggtttacggggccgt

SEQ ID NO: 632202 - DNA, 25 bp, Mus musculus
gaagacatcagtccctttttcttgg

SEQ ID NO: 632203 - DNA, 25 bp, Mus musculus
gaagacatcagtgcctttttcttgg

SEQ ID NO: 632204 - DNA, 25 bp, Mus musculus
gaagacatccaccttccgcatggtg

SEQ ID NO: 632205 - DNA, 25 bp, Mus musculus
gaagacatccacgttccgcatggtg

SEQ ID NO: 632206 - DNA, 25 bp, Mus musculus
gaagacatcgtaccaagtgaacagt

SEQ ID NO: 632207 - DNA, 25 bp, Mus musculus
gaagacatcgtagcaagtgaacagt

SEQ ID NO: 632208 - DNA, 25 bp, Mus musculus
gaagacatctacattgggctctggg

SEQ ID NO: 632209 - DNA, 25 bp, Mus musculus
gaagacatctactttgggctctggg

SEQ ID NO: 632210 - DNA, 25 bp, Mus musculus
gaagacatgacaattgcggagcaat

SEQ ID NO: 632211 - DNA, 25 bp, Mus musculus
gaagacatgacacacatatacaact

SEQ ID NO: 632212 - DNA, 25 bp, Mus musculus
gaagacatgacagacatatacaact

SEQ ID NO: 632213 - DNA, 25 bp, Mus musculus
gaagacatgacatttgcggagcaat

SEQ ID NO: 632214 - DNA, 25 bp, Mus musculus
gaagacatgactcgagttgtgaagt

SEQ ID NO: 632215 - DNA, 25 bp, Mus musculus
gaagacatgactggagttgtgaagt

SEQ ID NO: 632216 - DNA, 25 bp, Mus musculus
gaagacatgagacaaaggtgcaccg

SEQ ID NO: 632217 - DNA, 25 bp, Mus musculus
gaagacatgagagaaaggtgcaccg

SEQ ID NO: 632218 - DNA, 25 bp, Mus musculus
gaagacatgcatcgccagtgggcaa

SEQ ID NO: 632219 - DNA, 25 bp, Mus musculus
gaagacatgcatggccagtgggcaa

SEQ ID NO: 632220 - DNA, 25 bp, Mus musculus
gaagacatgcctcgtactgtttaca

SEQ ID NO: 632221 - DNA, 25 bp, Mus musculus
gaagacatgcctggtactgtttaca

SEQ ID NO: 632222 - DNA, 25 bp, Mus musculus
gaagacatgctcaaccagtgcaccc

SEQ ID NO: 632223 - DNA, 25 bp, Mus musculus
gaagacatgctctaccagtgcaccc

SEQ ID NO: 632224 - DNA, 25 bp, Mus musculus
gaagacatgctgctgcagtgaacat

SEQ ID NO: 632225 - DNA, 25 bp, Mus musculus
gaagacatgctggtgcagtgaacat

SEQ ID NO: 632226 - DNA, 25 bp, Mus musculus
gaagacatgggaactctgttctacc

SEQ ID NO: 632227 - DNA, 25 bp, Mus musculus
gaagacatgggactccctcggtgca

SEQ ID NO: 632228 - DNA, 25 bp, Mus musculus
gaagacatgggagtccctcggtgca

SEQ ID NO: 632229 - DNA, 25 bp, Mus musculus
gaagacatgggatctctgttctacc

SEQ ID NO: 632230 - DNA, 25 bp, Mus musculus
gaagacattaccattatcaaggaac

SEQ ID NO: 632231 - DNA, 25 bp, Mus musculus
gaagacattacctttatcaaggaac

SEQ ID NO: 632232 - DNA, 25 bp, Mus musculus
gaagacattactaacgatgaattag

SEQ ID NO: 632233 - DNA, 25 bp, Mus musculus
gaagacattacttacgatgaattag

SEQ ID NO: 632234 - DNA, 25 bp, Mus musculus
gaagacattcttacaaacagcgact

SEQ ID NO: 632235 - DNA, 25 bp, Mus musculus
gaagacattctttcaaacagcgact

SEQ ID NO: 632236 - DNA, 25 bp, Mus musculus
gaagacattggcatccgctgtcgcc

SEQ ID NO: 632237 - DNA, 25 bp, Mus musculus
gaagacattggcttccgctgtcgcc

SEQ ID NO: 632238 - DNA, 25 bp, Mus musculus
gaagacattgtcacccgaaacccca

SEQ ID NO: 632239 - DNA, 25 bp, Mus musculus
gaagacattgtctcccgaaacccca

SEQ ID NO: 632240 - DNA, 25 bp, Mus musculus
gaagacattttgcaaaagggaatgc

SEQ ID NO: 632241 - DNA, 25 bp, Mus musculus
gaagacattttggaaaagggaatgc

SEQ ID NO: 632242 - DNA, 25 bp, Mus musculus
gaagaccaaattaccatatactgat

SEQ ID NO: 632243 - DNA, 25 bp, Mus musculus
gaagaccaaatttccatatactgat

SEQ ID NO: 632244 - DNA, 25 bp, Mus musculus
gaagaccaacttccgctgtgcactc

SEQ ID NO: 632245 - DNA, 25 bp, Mus musculus
gaagaccaacttgcgctgtgcactc

SEQ ID NO: 632246 - DNA, 25 bp, Mus musculus
gaagaccaagagcaacggtgcagac

SEQ ID NO: 632247 - DNA, 25 bp, Mus musculus
gaagaccaagaggaacggtgcagac

SEQ ID NO: 632248 - DNA, 25 bp, Mus musculus
gaagaccaagatagtaaagaagcca

SEQ ID NO: 632249 - DNA, 25 bp, Mus musculus
gaagaccaagattgtaaagaagcca

SEQ ID NO: 632250 - DNA, 25 bp, Mus musculus
gaagaccacaaccaccgcggtcggg

SEQ ID NO: 632251 - DNA, 25 bp, Mus musculus
gaagaccacaacgaccgcggtcggg

SEQ ID NO: 632252 - DNA, 25 bp, Mus musculus
gaagaccacacacaagctggagtgc

SEQ ID NO: 632253 - DNA, 25 bp, Mus musculus
gaagaccacacagaagctggagtgc

SEQ ID NO: 632254 - DNA, 25 bp, Mus musculus
gaagaccacactcatccctggaggc

SEQ ID NO: 632255 - DNA, 25 bp, Mus musculus
gaagaccacactgatccctggaggc

SEQ ID NO: 632256 - DNA, 25 bp, Mus musculus
gaagaccacatacttgtctgccatg

SEQ ID NO: 632257 - DNA, 25 bp, Mus musculus
gaagaccacatagttgtctgccatg

SEQ ID NO: 632258 - DNA, 25 bp, Mus musculus
gaagaccacgacattccgattggga

SEQ ID NO: 632259 - DNA, 25 bp, Mus musculus
gaagaccacgactttccgattggga

SEQ ID NO: 632260 - DNA, 25 bp, Mus musculus
gaagaccacgtactgcctgggcatg

SEQ ID NO: 632261 - DNA, 25 bp, Mus musculus
gaagaccacgtagtgcctgggcatg

SEQ ID NO: 632262 - DNA, 25 bp, Mus musculus
gaagaccagcaacatctcagacctg

SEQ ID NO: 632263 - DNA, 25 bp, Mus musculus
gaagaccagcaagatctcagacctg

SEQ ID NO: 632264 - DNA, 25 bp, Mus musculus
gaagaccagcccaattatgccatga

SEQ ID NO: 632265 - DNA, 25 bp, Mus musculus
gaagaccagccctattatgccatga

SEQ ID NO: 632266 - DNA, 25 bp, Mus musculus
gaagaccaggacaacagctttccta

SEQ ID NO: 632267 - DNA, 25 bp, Mus musculus
gaagaccaggactacagctttccta

SEQ ID NO: 632268 - DNA, 25 bp, Mus musculus
gaagaccaggatccgccttgaagca

SEQ ID NO: 632269 - DNA, 25 bp, Mus musculus
gaagaccaggatgcgccttgaagca

SEQ ID NO: 632270 - DNA, 25 bp, Mus musculus
gaagaccagggaagctgcatctgcg

SEQ ID NO: 632271 - DNA, 25 bp, Mus musculus
gaagaccagggatgctgcatctgcg

SEQ ID NO: 632272 - DNA, 25 bp, Mus musculus
gaagaccaggtacaaacactgcggg

SEQ ID NO: 632273 - DNA, 25 bp, Mus musculus
gaagaccaggtagaaacactgcggg

SEQ ID NO: 632274 - DNA, 25 bp, Mus musculus
gaagaccagtgtccaaagttcaggc

SEQ ID NO: 632275 - DNA, 25 bp, Mus musculus
gaagaccagtgtgcaaagttcaggc

SEQ ID NO: 632276 - DNA, 25 bp, Mus musculus
gaagaccataatcctaaacgtgtcc

SEQ ID NO: 632277 - DNA, 25 bp, Mus musculus
gaagaccataatgctaaacgtgtcc

SEQ ID NO: 632278 - DNA, 25 bp, Mus musculus
gaagaccatccccatgagtacaaag

SEQ ID NO: 632279 - DNA, 25 bp, Mus musculus
gaagaccatcccgatgagtacaaag

SEQ ID NO: 632280 - DNA, 25 bp, Mus musculus
gaagaccatcgaccgtctgtcgggt

SEQ ID NO: 632281 - DNA, 25 bp, Mus musculus
gaagaccatcgagcgtctgtcgggt

SEQ ID NO: 632282 - DNA, 25 bp, Mus musculus
gaagaccatgagctccatctttgcc

SEQ ID NO: 632283 - DNA, 25 bp, Mus musculus
gaagaccatgaggtccatctttgcc

SEQ ID NO: 632284 - DNA, 25 bp, Mus musculus
gaagaccatgttccgtatcccctgg

SEQ ID NO: 632285 - DNA, 25 bp, Mus musculus
gaagaccatgttgcgtatcccctgg

SEQ ID NO: 632286 - DNA, 25 bp, Mus musculus
gaagacccaaacagcatatcttgct

SEQ ID NO: 632287 - DNA, 25 bp, Mus musculus
gaagacccaaactgcatatcttgct

SEQ ID NO: 632288 - DNA, 25 bp, Mus musculus
gaagacccaactccaggctggaatg

SEQ ID NO: 632289 - DNA, 25 bp, Mus musculus
gaagacccaactctggccaaggctg

SEQ ID NO: 632290 - DNA, 25 bp, Mus musculus
gaagacccaactgcaggctggaatg

SEQ ID NO: 632291 - DNA, 25 bp, Mus musculus
gaagacccaactgtggccaaggctg

SEQ ID NO: 632292 - DNA, 25 bp, Mus musculus
gaagacccaatgcagtgttccctgg

SEQ ID NO: 632293 - DNA, 25 bp, Mus musculus
gaagacccaatggagtgttccctgg

SEQ ID NO: 632294 - DNA, 25 bp, Mus musculus
gaagacccacgtcggacctgaagaa

SEQ ID NO: 632295 - DNA, 25 bp, Mus musculus
gaagacccacgtgggacctgaagaa

SEQ ID NO: 632296 - DNA, 25 bp, Mus musculus
gaagacccactacctattcttattc

SEQ ID NO: 632297 - DNA, 25 bp, Mus musculus
gaagacccactagctattcttattc

SEQ ID NO: 632298 - DNA, 25 bp, Mus musculus
gaagacccagcaacattggacaagc

SEQ ID NO: 632299 - DNA, 25 bp, Mus musculus
gaagacccagcatcattggacaagc

SEQ ID NO: 632300 - DNA, 25 bp, Mus musculus
gaagacccagggaagctccatgtcg

SEQ ID NO: 632301 - DNA, 25 bp, Mus musculus
gaagacccagggtagctccatgtcg

SEQ ID NO: 632302 - DNA, 25 bp, Mus musculus
gaagacccattgagcaacagggcac

SEQ ID NO: 632303 - DNA, 25 bp, Mus musculus
gaagacccattgtgcaacagggcac

SEQ ID NO: 632304 - DNA, 25 bp, Mus musculus
gaagacccgtctccagaaaagcaat

SEQ ID NO: 632305 - DNA, 25 bp, Mus musculus
gaagacccgtctgcagaaaagcaat

SEQ ID NO: 632306 - DNA, 25 bp, Mus musculus
gaagacccgtttctatctaggctct

SEQ ID NO: 632307 - DNA, 25 bp, Mus musculus
gaagacccgtttgtatctaggctct

SEQ ID NO: 632308 - DNA, 25 bp, Mus musculus
gaagaccctattctagagcacccgc

SEQ ID NO: 632309 - DNA, 25 bp, Mus musculus
gaagaccctattgtagagcacccgc

SEQ ID NO: 632310 - DNA, 25 bp, Mus musculus
gaagaccctcgacaaatggtcagat

SEQ ID NO: 632311 - DNA, 25 bp, Mus musculus
gaagaccctcgagaaatggtcagat

SEQ ID NO: 632312 - DNA, 25 bp, Mus musculus
gaagaccctgacaataacttcatgc

SEQ ID NO: 632313 - DNA, 25 bp, Mus musculus
gaagaccctgactataacttcatgc

SEQ ID NO: 632314 - DNA, 25 bp, Mus musculus
gaagaccctgatagctcgagctgtg

SEQ ID NO: 632315 - DNA, 25 bp, Mus musculus
gaagaccctgattgctcgagctgtg

SEQ ID NO: 632316 - DNA, 25 bp, Mus musculus
gaagaccctgtacagttgattgaag

SEQ ID NO: 632317 - DNA, 25 bp, Mus musculus
gaagaccctgtagagttgattgaag

SEQ ID NO: 632318 - DNA, 25 bp, Mus musculus
gaagaccgaaatcacccaatgctgc

SEQ ID NO: 632319 - DNA, 25 bp, Mus musculus
gaagaccgaaatgacccaatgctgc

SEQ ID NO: 632320 - DNA, 25 bp, Mus musculus
gaagaccgagccctttactacctgg

SEQ ID NO: 632321 - DNA, 25 bp, Mus musculus
gaagaccgagccgtttactacctgg

SEQ ID NO: 632322 - DNA, 25 bp, Mus musculus
gaagaccgggacaccgtcatagagg

SEQ ID NO: 632323 - DNA, 25 bp, Mus musculus
gaagaccgggactccgtcatagagg

SEQ ID NO: 632324 - DNA, 25 bp, Mus musculus
gaagaccgtcttattcgaatgaatc

SEQ ID NO: 632325 - DNA, 25 bp, Mus musculus
gaagaccgtctttttcgaatgaatc

SEQ ID NO: 632326 - DNA, 25 bp, Mus musculus
gaagacctacttcagagcatccagg

SEQ ID NO: 632327 - DNA, 25 bp, Mus musculus
gaagacctacttgagagcatccagg

SEQ ID NO: 632328 - DNA, 25 bp, Mus musculus
gaagacctataaaaagaggaggagg

SEQ ID NO: 632329 - DNA, 25 bp, Mus musculus
gaagacctataataagaggaggagg

SEQ ID NO: 632330 - DNA, 25 bp, Mus musculus
gaagacctatgtaacacaaacattg

SEQ ID NO: 632331 - DNA, 25 bp, Mus musculus
gaagacctatgttacacaaacattg

SEQ ID NO: 632332 - DNA, 25 bp, Mus musculus
gaagacctcaatcgctgaaggcgag

SEQ ID NO: 632333 - DNA, 25 bp, Mus musculus
gaagacctcaatggctgaaggcgag

SEQ ID NO: 632334 - DNA, 25 bp, Mus musculus
gaagacctcagtagtgttcaacaag

SEQ ID NO: 632335 - DNA, 25 bp, Mus musculus
gaagacctcagtctgttctaccctg

SEQ ID NO: 632336 - DNA, 25 bp, Mus musculus
gaagacctcagtgtgttctaccctg

SEQ ID NO: 632337 - DNA, 25 bp, Mus musculus
gaagacctcagttgtgttcaacaag

SEQ ID NO: 632338 - DNA, 25 bp, Mus musculus
gaagacctcccactaggaagaaaga

SEQ ID NO: 632339 - DNA, 25 bp, Mus musculus
gaagacctcccagtaggaagaaaga

SEQ ID NO: 632340 - DNA, 25 bp, Mus musculus
gaagacctccttactcactgaactt

SEQ ID NO: 632341 - DNA, 25 bp, Mus musculus
gaagacctcctttctcactgaactt

SEQ ID NO: 632342 - DNA, 25 bp, Mus musculus
gaagacctcttcactcgaatcaacg

SEQ ID NO: 632343 - DNA, 25 bp, Mus musculus
gaagacctcttctctcgaatcaacg

SEQ ID NO: 632344 - DNA, 25 bp, Mus musculus
gaagacctgatgatgttgagagtca

SEQ ID NO: 632345 - DNA, 25 bp, Mus musculus
gaagacctgatgttgttgagagtca

SEQ ID NO: 632346 - DNA, 25 bp, Mus musculus
gaagacctggctactgatgacgtca

SEQ ID NO: 632347 - DNA, 25 bp, Mus musculus
gaagacctggcttctgatgacgtca

SEQ ID NO: 632348 - DNA, 25 bp, Mus musculus
gaagacctggttcaagtgaacccca

SEQ ID NO: 632349 - DNA, 25 bp, Mus musculus
gaagacctggttgaagtgaacccca

SEQ ID NO: 632350 - DNA, 25 bp, Mus musculus
gaagaccttcacagtcattgagaag

SEQ ID NO: 632351 - DNA, 25 bp, Mus musculus
gaagaccttcactgtcattgagaag

SEQ ID NO: 632352 - DNA, 25 bp, Mus musculus
gaagaccttcagaaagggtgagaga

SEQ ID NO: 632353 - DNA, 25 bp, Mus musculus
gaagaccttcagtaagggtgagaga

SEQ ID NO: 632354 - DNA, 25 bp, Mus musculus
gaagaccttctaccgtaagtcaggc

SEQ ID NO: 632355 - DNA, 25 bp, Mus musculus
gaagaccttctagcgtaagtcaggc

SEQ ID NO: 632356 - DNA, 25 bp, Mus musculus
gaagaccttgagaagttgcccagct

SEQ ID NO: 632357 - DNA, 25 bp, Mus musculus
gaagaccttgagtagttgcccagct

SEQ ID NO: 632358 - DNA, 25 bp, Mus musculus
gaagaccttggaagtgaatcaggac

SEQ ID NO: 632359 - DNA, 25 bp, Mus musculus
gaagaccttggatgtgaatcaggac

SEQ ID NO: 632360 - DNA, 25 bp, Mus musculus
gaagaccttggcacctgtatctcaa

SEQ ID NO: 632361 - DNA, 25 bp, Mus musculus
gaagaccttggctcctgtatctcaa

SEQ ID NO: 632362 - DNA, 25 bp, Mus musculus
gaagaccttttaccaccatgggaca

SEQ ID NO: 632363 - DNA, 25 bp, Mus musculus
gaagaccttttagcaccatgggaca

SEQ ID NO: 632364 - DNA, 25 bp, Mus musculus
gaagacgaaaatctgcccattcctc

SEQ ID NO: 632365 - DNA, 25 bp, Mus musculus
gaagacgaaaatgtgcccattcctc

SEQ ID NO: 632366 - DNA, 25 bp, Mus musculus
gaagacgaacggctcgtacctgctg

SEQ ID NO: 632367 - DNA, 25 bp, Mus musculus
gaagacgaacgggtcgtacctgctg

SEQ ID NO: 632368 - DNA, 25 bp, Mus musculus
gaagacgaagagatgaatattctgg

SEQ ID NO: 632369 - DNA, 25 bp, Mus musculus
gaagacgaagagttgaatattctgg

SEQ ID NO: 632370 - DNA, 25 bp, Mus musculus
gaagacgacccgattcgctttggcg

SEQ ID NO: 632371 - DNA, 25 bp, Mus musculus
gaagacgacccgtttcgctttggcg

SEQ ID NO: 632372 - DNA, 25 bp, Mus musculus
gaagacgacgataagacctccagga

SEQ ID NO: 632373 - DNA, 25 bp, Mus musculus
gaagacgacgattagacctccagga

SEQ ID NO: 632374 - DNA, 25 bp, Mus musculus
gaagacgagaaaccgtaacaagcac

SEQ ID NO: 632375 - DNA, 25 bp, Mus musculus
gaagacgagaaagcgtaacaagcac

SEQ ID NO: 632376 - DNA, 25 bp, Mus musculus
gaagacgagtataagaaaactgaag

SEQ ID NO: 632377 - DNA, 25 bp, Mus musculus
gaagacgagtattagaaaactgaag

SEQ ID NO: 632378 - DNA, 25 bp, Mus musculus
gaagacgatattctagaaatgagcg

SEQ ID NO: 632379 - DNA, 25 bp, Mus musculus
gaagacgatattgtagaaatgagcg

SEQ ID NO: 632380 - DNA, 25 bp, Mus musculus
gaagacgcaattcaggtgcctcaac

SEQ ID NO: 632381 - DNA, 25 bp, Mus musculus
gaagacgcaattgaggtgcctcaac

SEQ ID NO: 632382 - DNA, 25 bp, Mus musculus
gaagacgccttactttaccagagca

SEQ ID NO: 632383 - DNA, 25 bp, Mus musculus
gaagacgccttagtttaccagagca

SEQ ID NO: 632384 - DNA, 25 bp, Mus musculus
gaagacgctcatagacgtccttcag

SEQ ID NO: 632385 - DNA, 25 bp, Mus musculus
gaagacgctcattgacgtccttcag

SEQ ID NO: 632386 - DNA, 25 bp, Mus musculus
gaagacgctgcgcatgtacaagacc

SEQ ID NO: 632387 - DNA, 25 bp, Mus musculus
gaagacgctgcggatgtacaagacc

SEQ ID NO: 632388 - DNA, 25 bp, Mus musculus
gaagacggaactacatgtgtccctc

SEQ ID NO: 632389 - DNA, 25 bp, Mus musculus
gaagacggaacttcatgtgtccctc

SEQ ID NO: 632390 - DNA, 25 bp, Mus musculus
gaagacggagataagctaaggatcc

SEQ ID NO: 632391 - DNA, 25 bp, Mus musculus
gaagacggagattagctaaggatcc

SEQ ID NO: 632392 - DNA, 25 bp, Mus musculus
gaagacggaggacctccgaaaaact

SEQ ID NO: 632393 - DNA, 25 bp, Mus musculus
gaagacggaggagctccgaaaaact

SEQ ID NO: 632394 - DNA, 25 bp, Mus musculus
gaagacgggcccactcagatggccc

SEQ ID NO: 632395 - DNA, 25 bp, Mus musculus
gaagacgggccctctcagatggccc

SEQ ID NO: 632396 - DNA, 25 bp, Mus musculus
gaagacgtaaggctacaggcccttc

SEQ ID NO: 632397 - DNA, 25 bp, Mus musculus
gaagacgtaagggtacaggcccttc

SEQ ID NO: 632398 - DNA, 25 bp, Mus musculus
gaagacgtcaatacctctgctcagc

SEQ ID NO: 632399 - DNA, 25 bp, Mus musculus
gaagacgtcaattcctctgctcagc

SEQ ID NO: 632400 - DNA, 25 bp, Mus musculus
gaagacgtcacccactgccatggtt

SEQ ID NO: 632401 - DNA, 25 bp, Mus musculus
gaagacgtcaccgactgccatggtt

SEQ ID NO: 632402 - DNA, 25 bp, Mus musculus
gaagacgtcagcattttggtcaata

SEQ ID NO: 632403 - DNA, 25 bp, Mus musculus
gaagacgtcagctttttggtcaata

SEQ ID NO: 632404 - DNA, 25 bp, Mus musculus
gaagacgtccacctgatcacgggtg

SEQ ID NO: 632405 - DNA, 25 bp, Mus musculus
gaagacgtccacgtgatcacgggtg

SEQ ID NO: 632406 - DNA, 25 bp, Mus musculus
gaagacgtcgcaattacagctgcag

SEQ ID NO: 632407 - DNA, 25 bp, Mus musculus
gaagacgtcgcatttacagctgcag

SEQ ID NO: 632408 - DNA, 25 bp, Mus musculus
gaagacgtgaaacccctggtcaaga

SEQ ID NO: 632409 - DNA, 25 bp, Mus musculus
gaagacgtgaaagccctggtcaaga

SEQ ID NO: 632410 - DNA, 25 bp, Mus musculus
gaagacgtgaagcagtacaagcctg

SEQ ID NO: 632411 - DNA, 25 bp, Mus musculus
gaagacgtgaaggagtacaagcctg

SEQ ID NO: 632412 - DNA, 25 bp, Mus musculus
gaagacgtgagccaaatgaccagcg

SEQ ID NO: 632413 - DNA, 25 bp, Mus musculus
gaagacgtgagcgaaatgaccagcg

SEQ ID NO: 632414 - DNA, 25 bp, Mus musculus
gaagacgtgctcaaccatttcaacc

SEQ ID NO: 632415 - DNA, 25 bp, Mus musculus
gaagacgtgctctaccatttcaacc

SEQ ID NO: 632416 - DNA, 25 bp, Mus musculus
gaagacgtgctgctcatcatggatg

SEQ ID NO: 632417 - DNA, 25 bp, Mus musculus
gaagacgtgctggtcatcatggatg

SEQ ID NO: 632418 - DNA, 25 bp, Mus musculus
gaagactaaaatagggcacagtggc

SEQ ID NO: 632419 - DNA, 25 bp, Mus musculus
gaagactaaaattgggcacagtggc

SEQ ID NO: 632420 - DNA, 25 bp, Mus musculus
gaagactaaagactggaactccacc

SEQ ID NO: 632421 - DNA, 25 bp, Mus musculus
gaagactaaagagtggaactccacc

SEQ ID NO: 632422 - DNA, 25 bp, Mus musculus
gaagactaacttactaaagaagcat

SEQ ID NO: 632423 - DNA, 25 bp, Mus musculus
gaagactaacttcgccatgatgaac

SEQ ID NO: 632424 - DNA, 25 bp, Mus musculus
gaagactaacttggccatgatgaac

SEQ ID NO: 632425 - DNA, 25 bp, Mus musculus
gaagactaactttctaaagaagcat

SEQ ID NO: 632426 - DNA, 25 bp, Mus musculus
gaagactacactcctgagccaactg

SEQ ID NO: 632427 - DNA, 25 bp, Mus musculus
gaagactacactgctgagccaactg

SEQ ID NO: 632428 - DNA, 25 bp, Mus musculus
gaagactacgttaaccattgagatc

SEQ ID NO: 632429 - DNA, 25 bp, Mus musculus
gaagactacgtttaccattgagatc

SEQ ID NO: 632430 - DNA, 25 bp, Mus musculus
gaagactataagcatataactccct

SEQ ID NO: 632431 - DNA, 25 bp, Mus musculus
gaagactataaggatataactccct

SEQ ID NO: 632432 - DNA, 25 bp, Mus musculus
gaagactatacaacattcctgattg

SEQ ID NO: 632433 - DNA, 25 bp, Mus musculus
gaagactatacatcattcctgattg

SEQ ID NO: 632434 - DNA, 25 bp, Mus musculus
gaagactatgaacgcctggccagtg

SEQ ID NO: 632435 - DNA, 25 bp, Mus musculus
gaagactatgaaggcctggccagtg

SEQ ID NO: 632436 - DNA, 25 bp, Mus musculus
gaagactatgagagtttttcctgtg

SEQ ID NO: 632437 - DNA, 25 bp, Mus musculus
gaagactatgagtgtttttcctgtg

SEQ ID NO: 632438 - DNA, 25 bp, Mus musculus
gaagactatgtcagccccttgcaac

SEQ ID NO: 632439 - DNA, 25 bp, Mus musculus
gaagactatgtcctggtccagtgca

SEQ ID NO: 632440 - DNA, 25 bp, Mus musculus
gaagactatgtcgtggtccagtgca

SEQ ID NO: 632441 - DNA, 25 bp, Mus musculus
gaagactatgtctgccccttgcaac

SEQ ID NO: 632442 - DNA, 25 bp, Mus musculus
gaagactcagagaaacaacgcagaa

SEQ ID NO: 632443 - DNA, 25 bp, Mus musculus
gaagactcagagtaacaacgcagaa

SEQ ID NO: 632444 - DNA, 25 bp, Mus musculus
gaagactcagatctcaagcagagga

SEQ ID NO: 632445 - DNA, 25 bp, Mus musculus
gaagactcagatgtcaagcagagga

SEQ ID NO: 632446 - DNA, 25 bp, Mus musculus
gaagactcagctcccaggcagaaca

SEQ ID NO: 632447 - DNA, 25 bp, Mus musculus
gaagactcagctgccaggcagaaca

SEQ ID NO: 632448 - DNA, 25 bp, Mus musculus
gaagactcatatacacacttcaagg

SEQ ID NO: 632449 - DNA, 25 bp, Mus musculus
gaagactcatattcacacttcaagg

SEQ ID NO: 632450 - DNA, 25 bp, Mus musculus
gaagactcatcacctggacaaggtg

SEQ ID NO: 632451 - DNA, 25 bp, Mus musculus
gaagactcatcagctggacaaggtg

SEQ ID NO: 632452 - DNA, 25 bp, Mus musculus
gaagactccaccctatgtgggctag

SEQ ID NO: 632453 - DNA, 25 bp, Mus musculus
gaagactccaccgtatgtgggctag

SEQ ID NO: 632454 - DNA, 25 bp, Mus musculus
gaagactcccatcatgaaactcagg

SEQ ID NO: 632455 - DNA, 25 bp, Mus musculus
gaagactcccatgatgaaactcagg

SEQ ID NO: 632456 - DNA, 25 bp, Mus musculus
gaagactccctcacagttgtttttg

SEQ ID NO: 632457 - DNA, 25 bp, Mus musculus
gaagactccctctcagttgtttttg

SEQ ID NO: 632458 - DNA, 25 bp, Mus musculus
gaagactcctaacaccttcaaaact

SEQ ID NO: 632459 - DNA, 25 bp, Mus musculus
gaagactcctaagaccttcaaaact

SEQ ID NO: 632460 - DNA, 25 bp, Mus musculus
gaagactcggatcaagctcagatgc

SEQ ID NO: 632461 - DNA, 25 bp, Mus musculus
gaagactcggatgaagctcagatgc

SEQ ID NO: 632462 - DNA, 25 bp, Mus musculus
gaagactcgggcctacaatggacag

SEQ ID NO: 632463 - DNA, 25 bp, Mus musculus
gaagactcgggcgtacaatggacag

SEQ ID NO: 632464 - DNA, 25 bp, Mus musculus
gaagactctcagacttatatctgtg

SEQ ID NO: 632465 - DNA, 25 bp, Mus musculus
gaagactctcagtcttatatctgtg

SEQ ID NO: 632466 - DNA, 25 bp, Mus musculus
gaagactctcgcacgggcacaggct

SEQ ID NO: 632467 - DNA, 25 bp, Mus musculus
gaagactctcgctcgggcacaggct

SEQ ID NO: 632468 - DNA, 25 bp, Mus musculus
gaagactctgaacgatgaacgaaat

SEQ ID NO: 632469 - DNA, 25 bp, Mus musculus
gaagactctgaaggatgaacgaaat

SEQ ID NO: 632470 - DNA, 25 bp, Mus musculus
gaagactctgagcagcttcacaaag

SEQ ID NO: 632471 - DNA, 25 bp, Mus musculus
gaagactctgaggagcttcacaaag

SEQ ID NO: 632472 - DNA, 25 bp, Mus musculus
gaagactctgggatttatgcttgtg

SEQ ID NO: 632473 - DNA, 25 bp, Mus musculus
gaagactctgggttttatgcttgtg

SEQ ID NO: 632474 - DNA, 25 bp, Mus musculus
gaagactcttcaatcagctcatcaa

SEQ ID NO: 632475 - DNA, 25 bp, Mus musculus
gaagactcttcattcagctcatcaa

SEQ ID NO: 632476 - DNA, 25 bp, Mus musculus
gaagactgaactatctcctcggccc

SEQ ID NO: 632477 - DNA, 25 bp, Mus musculus
gaagactgaactttctcctcggccc

SEQ ID NO: 632478 - DNA, 25 bp, Mus musculus
gaagactgagagatttggaccatcc

SEQ ID NO: 632479 - DNA, 25 bp, Mus musculus
gaagactgagagttttggaccatcc

SEQ ID NO: 632480 - DNA, 25 bp, Mus musculus
gaagactggaacagtgaaaaaggaa

SEQ ID NO: 632481 - DNA, 25 bp, Mus musculus
gaagactggaactgtgaaaaaggaa

SEQ ID NO: 632482 - DNA, 25 bp, Mus musculus
gaagactggagtcattcaagacacc

SEQ ID NO: 632483 - DNA, 25 bp, Mus musculus
gaagactggagtgattcaagacacc

SEQ ID NO: 632484 - DNA, 25 bp, Mus musculus
gaagactggcgacaccttctacacc

SEQ ID NO: 632485 - DNA, 25 bp, Mus musculus
gaagactggcgagaccttctacacc

SEQ ID NO: 632486 - DNA, 25 bp, Mus musculus
gaagactgggaacactccgtgaata

SEQ ID NO: 632487 - DNA, 25 bp, Mus musculus
gaagactgggaagactccgtgaata

SEQ ID NO: 632488 - DNA, 25 bp, Mus musculus
gaagactgggttagtctttggcacc

SEQ ID NO: 632489 - DNA, 25 bp, Mus musculus
gaagactgggtttgtctttggcacc

SEQ ID NO: 632490 - DNA, 25 bp, Mus musculus
gaagactggtatactcctggcatct

SEQ ID NO: 632491 - DNA, 25 bp, Mus musculus
gaagactggtattctcctggcatct

SEQ ID NO: 632492 - DNA, 25 bp, Mus musculus
gaagactgtaataaaatgtttttgc

SEQ ID NO: 632493 - DNA, 25 bp, Mus musculus
gaagactgtaataatggcgaacccc

SEQ ID NO: 632494 - DNA, 25 bp, Mus musculus
gaagactgtaattaaatgtttttgc

SEQ ID NO: 632495 - DNA, 25 bp, Mus musculus
gaagactgtaattatggcgaacccc

SEQ ID NO: 632496 - DNA, 25 bp, Mus musculus
gaagactgtactatggaagttacac

SEQ ID NO: 632497 - DNA, 25 bp, Mus musculus
gaagactgtactttggaagttacac

SEQ ID NO: 632498 - DNA, 25 bp, Mus musculus
gaagactgtatgcagcttttggcag

SEQ ID NO: 632499 - DNA, 25 bp, Mus musculus
gaagactgtatggagcttttggcag

SEQ ID NO: 632500 - DNA, 25 bp, Mus musculus
gaagactgtccacctagcagcctgg

SEQ ID NO: 632501 - DNA, 25 bp, Mus musculus
gaagactgtccagctagcagcctgg

SEQ ID NO: 632502 - DNA, 25 bp, Mus musculus
gaagactgtgagagtcagttctcac

SEQ ID NO: 632503 - DNA, 25 bp, Mus musculus
gaagactgtgagtgtcagttctcac

SEQ ID NO: 632504 - DNA, 25 bp, Mus musculus
gaagactgtgggactatactcattg

SEQ ID NO: 632505 - DNA, 25 bp, Mus musculus
gaagactgtgggtctatactcattg

SEQ ID NO: 632506 - DNA, 25 bp, Mus musculus
gaagactgtggtcatctccaagaat

SEQ ID NO: 632507 - DNA, 25 bp, Mus musculus
gaagactgtggtgatctccaagaat

SEQ ID NO: 632508 - DNA, 25 bp, Mus musculus
gaagactgttccaagttataaccaa

SEQ ID NO: 632509 - DNA, 25 bp, Mus musculus
gaagactgttcctagttataaccaa

SEQ ID NO: 632510 - DNA, 25 bp, Mus musculus
gaagactgttgccatgcatgaagtc

SEQ ID NO: 632511 - DNA, 25 bp, Mus musculus
gaagactgttgcgatgcatgaagtc

SEQ ID NO: 632512 - DNA, 25 bp, Mus musculus
gaagacttagagattctgcctaatg

SEQ ID NO: 632513 - DNA, 25 bp, Mus musculus
gaagacttagagtttctgcctaatg

SEQ ID NO: 632514 - DNA, 25 bp, Mus musculus
gaagacttagcgactactacgacat

SEQ ID NO: 632515 - DNA, 25 bp, Mus musculus
gaagacttagcgtctactacgacat

SEQ ID NO: 632516 - DNA, 25 bp, Mus musculus
gaagacttagtaagaaagaggctgt

SEQ ID NO: 632517 - DNA, 25 bp, Mus musculus
gaagacttagtatgaaagaggctgt

SEQ ID NO: 632518 - DNA, 25 bp, Mus musculus
gaagacttagttatgatgctgcctc

SEQ ID NO: 632519 - DNA, 25 bp, Mus musculus
gaagacttagttttgatgctgcctc

SEQ ID NO: 632520 - DNA, 25 bp, Mus musculus
gaagacttatctacctttagtagaa

SEQ ID NO: 632521 - DNA, 25 bp, Mus musculus
gaagacttatcttcctttagtagaa

SEQ ID NO: 632522 - DNA, 25 bp, Mus musculus
gaagacttcattctcgacaccctcg

SEQ ID NO: 632523 - DNA, 25 bp, Mus musculus
gaagacttcattgtcgacaccctcg

SEQ ID NO: 632524 - DNA, 25 bp, Mus musculus
gaagacttccctatccacgctatca

SEQ ID NO: 632525 - DNA, 25 bp, Mus musculus
gaagacttccctttccacgctatca

SEQ ID NO: 632526 - DNA, 25 bp, Mus musculus
gaagacttcctacataactctcatc

SEQ ID NO: 632527 - DNA, 25 bp, Mus musculus
gaagacttcctagataactctcatc

SEQ ID NO: 632528 - DNA, 25 bp, Mus musculus
gaagacttcgctcatgaacagagcc

SEQ ID NO: 632529 - DNA, 25 bp, Mus musculus
gaagacttcgctgatgaacagagcc

SEQ ID NO: 632530 - DNA, 25 bp, Mus musculus
gaagacttggccaccaagcttctcc

SEQ ID NO: 632531 - DNA, 25 bp, Mus musculus
gaagacttggccatgtggttaacca

SEQ ID NO: 632532 - DNA, 25 bp, Mus musculus
gaagacttggcctccaagcttctcc

SEQ ID NO: 632533 - DNA, 25 bp, Mus musculus
gaagacttggccttgtggttaacca

SEQ ID NO: 632534 - DNA, 25 bp, Mus musculus
gaagacttggttacccaggatagct

SEQ ID NO: 632535 - DNA, 25 bp, Mus musculus
gaagacttggtttcccaggatagct

SEQ ID NO: 632536 - DNA, 25 bp, Mus musculus
gaagactttagaacaggcgacatgt

SEQ ID NO: 632537 - DNA, 25 bp, Mus musculus
gaagactttagatcaggcgacatgt

SEQ ID NO: 632538 - DNA, 25 bp, Mus musculus
gaagactttcagatacccgctggac

SEQ ID NO: 632539 - DNA, 25 bp, Mus musculus
gaagactttcagttacccgctggac

SEQ ID NO: 632540 - DNA, 25 bp, Mus musculus
gaagactttccgaacagagcgtcct

SEQ ID NO: 632541 - DNA, 25 bp, Mus musculus
gaagactttccgtacagagcgtcct

SEQ ID NO: 632542 - DNA, 25 bp, Mus musculus
gaagagaaaccaattcgagactgtg

SEQ ID NO: 632543 - DNA, 25 bp, Mus musculus
gaagagaaaccatttcgagactgtg

SEQ ID NO: 632544 - DNA, 25 bp, Mus musculus
gaagagaaagagctgtttgcccatg

SEQ ID NO: 632545 - DNA, 25 bp, Mus musculus
gaagagaaagaggtgtttgcccatg

SEQ ID NO: 632546 - DNA, 25 bp, Mus musculus
gaagagaaagcaaccgaacattgca

SEQ ID NO: 632547 - DNA, 25 bp, Mus musculus
gaagagaaagcatccgaacattgca

SEQ ID NO: 632548 - DNA, 25 bp, Mus musculus
gaagagaaagccagaaaatgggttc

SEQ ID NO: 632549 - DNA, 25 bp, Mus musculus
gaagagaaagcctgaaaatgggttc

SEQ ID NO: 632550 - DNA, 25 bp, Mus musculus
gaagagaaagcgctagaagtttatg

SEQ ID NO: 632551 - DNA, 25 bp, Mus musculus
gaagagaaagcggtagaagtttatg

SEQ ID NO: 632552 - DNA, 25 bp, Mus musculus
gaagagaaatggcatatcatctgtc

SEQ ID NO: 632553 - DNA, 25 bp, Mus musculus
gaagagaaatgggatatcatctgtc

SEQ ID NO: 632554 - DNA, 25 bp, Mus musculus
gaagagaacaatcaccaagttacag

SEQ ID NO: 632555 - DNA, 25 bp, Mus musculus
gaagagaacaatgaccaagttacag

SEQ ID NO: 632556 - DNA, 25 bp, Mus musculus
gaagagaacaccattgccttccgac

SEQ ID NO: 632557 - DNA, 25 bp, Mus musculus
gaagagaacacctttgccttccgac

SEQ ID NO: 632558 - DNA, 25 bp, Mus musculus
gaagagaacatcatgctgctgcgaa

SEQ ID NO: 632559 - DNA, 25 bp, Mus musculus
gaagagaacatcttgctgctgcgaa

SEQ ID NO: 632560 - DNA, 25 bp, Mus musculus
gaagagaacttcaggccctggtgaa

SEQ ID NO: 632561 - DNA, 25 bp, Mus musculus
gaagagaacttctggccctggtgaa

SEQ ID NO: 632562 - DNA, 25 bp, Mus musculus
gaagagaagaaacctatgcagtaaa

SEQ ID NO: 632563 - DNA, 25 bp, Mus musculus
gaagagaagaaagctatgcagtaaa

SEQ ID NO: 632564 - DNA, 25 bp, Mus musculus
gaagagaagacgagaccaagtgata

SEQ ID NO: 632565 - DNA, 25 bp, Mus musculus
gaagagaagacgtgaccaagtgata

SEQ ID NO: 632566 - DNA, 25 bp, Mus musculus
gaagagaagatacatgccttacagt

SEQ ID NO: 632567 - DNA, 25 bp, Mus musculus
gaagagaagatagatgccttacagt

SEQ ID NO: 632568 - DNA, 25 bp, Mus musculus
gaagagaagattccaaataatacac

SEQ ID NO: 632569 - DNA, 25 bp, Mus musculus
gaagagaagattgcaaataatacac

SEQ ID NO: 632570 - DNA, 25 bp, Mus musculus
gaagagaagcaaactacaacgatgt

SEQ ID NO: 632571 - DNA, 25 bp, Mus musculus
gaagagaagcaatctacaacgatgt

SEQ ID NO: 632572 - DNA, 25 bp, Mus musculus
gaagagaagcctcccgcttctgact

SEQ ID NO: 632573 - DNA, 25 bp, Mus musculus
gaagagaagcctgccgcttctgact

SEQ ID NO: 632574 - DNA, 25 bp, Mus musculus
gaagagaagcttcagcttcgaaaag

SEQ ID NO: 632575 - DNA, 25 bp, Mus musculus
gaagagaagcttgagcttcgaaaag

SEQ ID NO: 632576 - DNA, 25 bp, Mus musculus
gaagagaaggagaattgtcacctgg

SEQ ID NO: 632577 - DNA, 25 bp, Mus musculus
gaagagaaggagtattgtcacctgg

SEQ ID NO: 632578 - DNA, 25 bp, Mus musculus
gaagagaagtcacagtccatctcca

SEQ ID NO: 632579 - DNA, 25 bp, Mus musculus
gaagagaagtcagagtccatctcca

SEQ ID NO: 632580 - DNA, 25 bp, Mus musculus
gaagagaagttcacgatcctgtttg

SEQ ID NO: 632581 - DNA, 25 bp, Mus musculus
gaagagaagttctcgatcctgtttg

SEQ ID NO: 632582 - DNA, 25 bp, Mus musculus
gaagagaatagcagaactttctgaa

SEQ ID NO: 632583 - DNA, 25 bp, Mus musculus
gaagagaatagctgaactttctgaa

SEQ ID NO: 632584 - DNA, 25 bp, Mus musculus
gaagagaattatctagtctcaacca

SEQ ID NO: 632585 - DNA, 25 bp, Mus musculus
gaagagaattatgtagtctcaacca

SEQ ID NO: 632586 - DNA, 25 bp, Mus musculus
gaagagaattccctgagactcatag

SEQ ID NO: 632587 - DNA, 25 bp, Mus musculus
gaagagaattccgtgagactcatag

SEQ ID NO: 632588 - DNA, 25 bp, Mus musculus
gaagagacattgcaacatccttggt

SEQ ID NO: 632589 - DNA, 25 bp, Mus musculus
gaagagacattggaacatccttggt

SEQ ID NO: 632590 - DNA, 25 bp, Mus musculus
gaagagaccaaaagagcagcaaaag

SEQ ID NO: 632591 - DNA, 25 bp, Mus musculus
gaagagaccaaacaaccgttagtgc

SEQ ID NO: 632592 - DNA, 25 bp, Mus musculus
gaagagaccaaagaaccgttagtgc

SEQ ID NO: 632593 - DNA, 25 bp, Mus musculus
gaagagaccaaatgagcagcaaaag

SEQ ID NO: 632594 - DNA, 25 bp, Mus musculus
gaagagaccctgaaagtaaaggaag

SEQ ID NO: 632595 - DNA, 25 bp, Mus musculus
gaagagaccctgtaagtaaaggaag

SEQ ID NO: 632596 - DNA, 25 bp, Mus musculus
gaagagacctctacctgtggaatcc

SEQ ID NO: 632597 - DNA, 25 bp, Mus musculus
gaagagacctctctggatgccggat

SEQ ID NO: 632598 - DNA, 25 bp, Mus musculus
gaagagacctctgtggatgccggat

SEQ ID NO: 632599 - DNA, 25 bp, Mus musculus
gaagagacctcttcctgtggaatcc

SEQ ID NO: 632600 - DNA, 25 bp, Mus musculus
gaagagacgagaccgccatctgatg

SEQ ID NO: 632601 - DNA, 25 bp, Mus musculus
gaagagacgagagcgccatctgatg

SEQ ID NO: 632602 - DNA, 25 bp, Mus musculus
gaagagacggcacttattgaatcca

SEQ ID NO: 632603 - DNA, 25 bp, Mus musculus
gaagagacggcagttattgaatcca

SEQ ID NO: 632604 - DNA, 25 bp, Mus musculus
gaagagactctgcaaccgggcctcg

SEQ ID NO: 632605 - DNA, 25 bp, Mus musculus
gaagagactctggaaccgggcctcg

SEQ ID NO: 632606 - DNA, 25 bp, Mus musculus
gaagagactgtcagatcaatgctgc

SEQ ID NO: 632607 - DNA, 25 bp, Mus musculus
gaagagactgtctgatcaatgctgc

SEQ ID NO: 632608 - DNA, 25 bp, Mus musculus
gaagagagactgcataggatgctac

SEQ ID NO: 632609 - DNA, 25 bp, Mus musculus
gaagagagactggataggatgctac

SEQ ID NO: 632610 - DNA, 25 bp, Mus musculus
gaagagagaggacttgtgtctatca

SEQ ID NO: 632611 - DNA, 25 bp, Mus musculus
gaagagagaggagttgtgtctatca

SEQ ID NO: 632612 - DNA, 25 bp, Mus musculus
gaagagagagtccagactaaagctc

SEQ ID NO: 632613 - DNA, 25 bp, Mus musculus
gaagagagagtcgagactaaagctc

SEQ ID NO: 632614 - DNA, 25 bp, Mus musculus
gaagagagatctcctcctaagtgga

SEQ ID NO: 632615 - DNA, 25 bp, Mus musculus
gaagagagatctgctcctaagtgga

SEQ ID NO: 632616 - DNA, 25 bp, Mus musculus
gaagagagattcctatagtgcaccg

SEQ ID NO: 632617 - DNA, 25 bp, Mus musculus
gaagagagattcgtatagtgcaccg

SEQ ID NO: 632618 - DNA, 25 bp, Mus musculus
gaagagagccaaagaaagactggag

SEQ ID NO: 632619 - DNA, 25 bp, Mus musculus
gaagagagccaatgaaagactggag

SEQ ID NO: 632620 - DNA, 25 bp, Mus musculus
gaagagagccatctccaggaacaca

SEQ ID NO: 632621 - DNA, 25 bp, Mus musculus
gaagagagccatgtccaggaacaca

SEQ ID NO: 632622 - DNA, 25 bp, Mus musculus
gaagagagccgccaaaagcaactag

SEQ ID NO: 632623 - DNA, 25 bp, Mus musculus
gaagagagccgcgaaaagcaactag

SEQ ID NO: 632624 - DNA, 25 bp, Mus musculus
gaagagagcgcaccgattatgaccg

SEQ ID NO: 632625 - DNA, 25 bp, Mus musculus
gaagagagcgcagcgattatgaccg

SEQ ID NO: 632626 - DNA, 25 bp, Mus musculus
gaagagagctgcatgaggtacctgc

SEQ ID NO: 632627 - DNA, 25 bp, Mus musculus
gaagagagctgcttgaggtacctgc

SEQ ID NO: 632628 - DNA, 25 bp, Mus musculus
gaagagaggctcatctcctgaccat

SEQ ID NO: 632629 - DNA, 25 bp, Mus musculus
gaagagaggctcttctcctgaccat

SEQ ID NO: 632630 - DNA, 25 bp, Mus musculus
gaagagagtgtacatttgcacagca

SEQ ID NO: 632631 - DNA, 25 bp, Mus musculus
gaagagagtgtagatttgcacagca

SEQ ID NO: 632632 - DNA, 25 bp, Mus musculus
gaagagagtgtccaaggccactgtc

SEQ ID NO: 632633 - DNA, 25 bp, Mus musculus
gaagagagtgtcgaaggccactgtc

SEQ ID NO: 632634 - DNA, 25 bp, Mus musculus
gaagagatacagagatgctacagct

SEQ ID NO: 632635 - DNA, 25 bp, Mus musculus
gaagagatacagtgatgctacagct

SEQ ID NO: 632636 - DNA, 25 bp, Mus musculus
gaagagataggccatcccgactctg

SEQ ID NO: 632637 - DNA, 25 bp, Mus musculus
gaagagataggcgatcccgactctg

SEQ ID NO: 632638 - DNA, 25 bp, Mus musculus
gaagagatcagtcgtcccctgacct

SEQ ID NO: 632639 - DNA, 25 bp, Mus musculus
gaagagatcagtggtcccctgacct

SEQ ID NO: 632640 - DNA, 25 bp, Mus musculus
gaagagatcattcacaccaatggag

SEQ ID NO: 632641 - DNA, 25 bp, Mus musculus
gaagagatcattgacaccaatggag

SEQ ID NO: 632642 - DNA, 25 bp, Mus musculus
gaagagatccggctctccatcaatg

SEQ ID NO: 632643 - DNA, 25 bp, Mus musculus
gaagagatccgggtctccatcaatg

SEQ ID NO: 632644 - DNA, 25 bp, Mus musculus
gaagagatcctgatagccaacaaaa

SEQ ID NO: 632645 - DNA, 25 bp, Mus musculus
gaagagatcctgttagccaacaaaa

SEQ ID NO: 632646 - DNA, 25 bp, Mus musculus
gaagagatccttcagctgcactcag

SEQ ID NO: 632647 - DNA, 25 bp, Mus musculus
gaagagatccttgagctgcactcag

SEQ ID NO: 632648 - DNA, 25 bp, Mus musculus
gaagagatcttcaaaattgcctcaa

SEQ ID NO: 632649 - DNA, 25 bp, Mus musculus
gaagagatcttctaaattgcctcaa

SEQ ID NO: 632650 - DNA, 25 bp, Mus musculus
gaagagatgataaagatggcccact

SEQ ID NO: 632651 - DNA, 25 bp, Mus musculus
gaagagatgatatagatggcccact

SEQ ID NO: 632652 - DNA, 25 bp, Mus musculus
gaagagatgattcaaccttatcggc

SEQ ID NO: 632653 - DNA, 25 bp, Mus musculus
gaagagatgattgaaccttatcggc

SEQ ID NO: 632654 - DNA, 25 bp, Mus musculus
gaagagatgcagctacgagcactga

SEQ ID NO: 632655 - DNA, 25 bp, Mus musculus
gaagagatgcaggtacgagcactga

SEQ ID NO: 632656 - DNA, 25 bp, Mus musculus
gaagagatgccgctttgttgaatca

SEQ ID NO: 632657 - DNA, 25 bp, Mus musculus
gaagagatgccggtttgttgaatca

SEQ ID NO: 632658 - DNA, 25 bp, Mus musculus
gaagagatggacagcaaccccatgg

SEQ ID NO: 632659 - DNA, 25 bp, Mus musculus
gaagagatggactgcaaccccatgg

SEQ ID NO: 632660 - DNA, 25 bp, Mus musculus
gaagagattaataagagaggtgtcc

SEQ ID NO: 632661 - DNA, 25 bp, Mus musculus
gaagagattaattagagaggtgtcc

SEQ ID NO: 632662 - DNA, 25 bp, Mus musculus
gaagagattattcctgaagactacg

SEQ ID NO: 632663 - DNA, 25 bp, Mus musculus
gaagagattattgctgaagactacg

SEQ ID NO: 632664 - DNA, 25 bp, Mus musculus
gaagagattgacctggctttccagc

SEQ ID NO: 632665 - DNA, 25 bp, Mus musculus
gaagagattgacgtggctttccagc

SEQ ID NO: 632666 - DNA, 25 bp, Mus musculus
gaagagattgctcatgcccgagagc

SEQ ID NO: 632667 - DNA, 25 bp, Mus musculus
gaagagattgctgatgcccgagagc

SEQ ID NO: 632668 - DNA, 25 bp, Mus musculus
gaagagatttttagaagtccggagg

SEQ ID NO: 632669 - DNA, 25 bp, Mus musculus
gaagagattttttgaagtccggagg

SEQ ID NO: 632670 - DNA, 25 bp, Mus musculus
gaagagcaaatgcaacagcaggcct

SEQ ID NO: 632671 - DNA, 25 bp, Mus musculus
gaagagcaaatggaacagcaggcct

SEQ ID NO: 632672 - DNA, 25 bp, Mus musculus
gaagagcaacaaatgaagttcatga

SEQ ID NO: 632673 - DNA, 25 bp, Mus musculus
gaagagcaacaattgaagttcatga

SEQ ID NO: 632674 - DNA, 25 bp, Mus musculus
gaagagcaagaaccaacaggattct

SEQ ID NO: 632675 - DNA, 25 bp, Mus musculus
gaagagcaagaagcaacaggattct

SEQ ID NO: 632676 - DNA, 25 bp, Mus musculus
gaagagcaagacctaccagagcaac

SEQ ID NO: 632677 - DNA, 25 bp, Mus musculus
gaagagcaagacgtaccagagcaac

SEQ ID NO: 632678 - DNA, 25 bp, Mus musculus
gaagagcacaagctgtctgaaccac

SEQ ID NO: 632679 - DNA, 25 bp, Mus musculus
gaagagcacaaggtgtctgaaccac

SEQ ID NO: 632680 - DNA, 25 bp, Mus musculus
gaagagcacagacctaactgaaggg

SEQ ID NO: 632681 - DNA, 25 bp, Mus musculus
gaagagcacagagctaactgaaggg

SEQ ID NO: 632682 - DNA, 25 bp, Mus musculus
gaagagcaccccagaaagctacatt

SEQ ID NO: 632683 - DNA, 25 bp, Mus musculus
gaagagcacccctgaaagctacatt

SEQ ID NO: 632684 - DNA, 25 bp, Mus musculus
gaagagcaccgtcatcaatgccatg

SEQ ID NO: 632685 - DNA, 25 bp, Mus musculus
gaagagcaccgtgatcaatgccatg

SEQ ID NO: 632686 - DNA, 25 bp, Mus musculus
gaagagcactccatcgggagatcca

SEQ ID NO: 632687 - DNA, 25 bp, Mus musculus
gaagagcactccttcgggagatcca

SEQ ID NO: 632688 - DNA, 25 bp, Mus musculus
gaagagcactctcctcaagaagctg

SEQ ID NO: 632689 - DNA, 25 bp, Mus musculus
gaagagcactctgctcaagaagctg

SEQ ID NO: 632690 - DNA, 25 bp, Mus musculus
gaagagcagtatcatgcctgagccc

SEQ ID NO: 632691 - DNA, 25 bp, Mus musculus
gaagagcagtatgatgcctgagccc

SEQ ID NO: 632692 - DNA, 25 bp, Mus musculus
gaagagcagtgacgctattgctacc

SEQ ID NO: 632693 - DNA, 25 bp, Mus musculus
gaagagcagtgaggctattgctacc

SEQ ID NO: 632694 - DNA, 25 bp, Mus musculus
gaagagcataggcatgcaatgaatg

SEQ ID NO: 632695 - DNA, 25 bp, Mus musculus
gaagagcatagggatgcaatgaatg

SEQ ID NO: 632696 - DNA, 25 bp, Mus musculus
gaagagcatattaaggccattaaga

SEQ ID NO: 632697 - DNA, 25 bp, Mus musculus
gaagagcatatttaggccattaaga

SEQ ID NO: 632698 - DNA, 25 bp, Mus musculus
gaagagcatcgacctcatccagaag

SEQ ID NO: 632699 - DNA, 25 bp, Mus musculus
gaagagcatcgagctcatccagaag

SEQ ID NO: 632700 - DNA, 25 bp, Mus musculus
gaagagcatcttaccaggcaggctg

SEQ ID NO: 632701 - DNA, 25 bp, Mus musculus
gaagagcatctttccaggcaggctg

SEQ ID NO: 632702 - DNA, 25 bp, Mus musculus
gaagagcatgagcaatttttcccag

SEQ ID NO: 632703 - DNA, 25 bp, Mus musculus
gaagagcatgaggaatttttcccag

SEQ ID NO: 632704 - DNA, 25 bp, Mus musculus
gaagagcatgatatttggcgtgaag

SEQ ID NO: 632705 - DNA, 25 bp, Mus musculus
gaagagcatgatttttggcgtgaag

SEQ ID NO: 632706 - DNA, 25 bp, Mus musculus
gaagagcatgttccacaccagggtc

SEQ ID NO: 632707 - DNA, 25 bp, Mus musculus
gaagagcatgttgcacaccagggtc

SEQ ID NO: 632708 - DNA, 25 bp, Mus musculus
gaagagcattgtcctcctcacggcg

SEQ ID NO: 632709 - DNA, 25 bp, Mus musculus
gaagagcattgtgctcctcacggcg

SEQ ID NO: 632710 - DNA, 25 bp, Mus musculus
gaagagcatttacgtgagatccgga

SEQ ID NO: 632711 - DNA, 25 bp, Mus musculus
gaagagcatttaggtgagatccgga

SEQ ID NO: 632712 - DNA, 25 bp, Mus musculus
gaagagccaagacttcagtttccct

SEQ ID NO: 632713 - DNA, 25 bp, Mus musculus
gaagagccaagagttcagtttccct

SEQ ID NO: 632714 - DNA, 25 bp, Mus musculus
gaagagccaagcaggaagatacaca

SEQ ID NO: 632715 - DNA, 25 bp, Mus musculus
gaagagccaagctggaagatacaca

SEQ ID NO: 632716 - DNA, 25 bp, Mus musculus
gaagagccaagtcctgtttgctgtg

SEQ ID NO: 632717 - DNA, 25 bp, Mus musculus
gaagagccaagtgctgtttgctgtg

SEQ ID NO: 632718 - DNA, 25 bp, Mus musculus
gaagagccaccccttggcctggttc

SEQ ID NO: 632719 - DNA, 25 bp, Mus musculus
gaagagccacccgttggcctggttc

SEQ ID NO: 632720 - DNA, 25 bp, Mus musculus
gaagagccaccgaagtgggacttta

SEQ ID NO: 632721 - DNA, 25 bp, Mus musculus
gaagagccaccgtagtgggacttta

SEQ ID NO: 632722 - DNA, 25 bp, Mus musculus
gaagagccatcactttgagatctga

SEQ ID NO: 632723 - DNA, 25 bp, Mus musculus
gaagagccatcagtttgagatctga

SEQ ID NO: 632724 - DNA, 25 bp, Mus musculus
gaagagccatccagacgtctgaaag

SEQ ID NO: 632725 - DNA, 25 bp, Mus musculus
gaagagccatcctgacgtctgaaag

SEQ ID NO: 632726 - DNA, 25 bp, Mus musculus
gaagagccatgaagacgaagctgtg

SEQ ID NO: 632727 - DNA, 25 bp, Mus musculus
gaagagccatgatgacgaagctgtg

SEQ ID NO: 632728 - DNA, 25 bp, Mus musculus
gaagagcccaacatcgacattcaca

SEQ ID NO: 632729 - DNA, 25 bp, Mus musculus
gaagagcccaacttcgacattcaca

SEQ ID NO: 632730 - DNA, 25 bp, Mus musculus
gaagagcccataaccaggaaaggag

SEQ ID NO: 632731 - DNA, 25 bp, Mus musculus
gaagagcccatatccaggaaaggag

SEQ ID NO: 632732 - DNA, 25 bp, Mus musculus
gaagagcccatcaagcaactggtgg

SEQ ID NO: 632733 - DNA, 25 bp, Mus musculus
gaagagcccatctagcaactggtgg

SEQ ID NO: 632734 - DNA, 25 bp, Mus musculus
gaagagccgcttctttgacaccaaa

SEQ ID NO: 632735 - DNA, 25 bp, Mus musculus
gaagagccgcttgtttgacaccaaa

SEQ ID NO: 632736 - DNA, 25 bp, Mus musculus
gaagagcctaaaagtttctgtcagg

SEQ ID NO: 632737 - DNA, 25 bp, Mus musculus
gaagagcctaaatgtttctgtcagg

SEQ ID NO: 632738 - DNA, 25 bp, Mus musculus
gaagagcctcctcaagttctgctct

SEQ ID NO: 632739 - DNA, 25 bp, Mus musculus
gaagagcctcctgaagttctgctct

SEQ ID NO: 632740 - DNA, 25 bp, Mus musculus
gaagagcctcttcgaggcccgagta

SEQ ID NO: 632741 - DNA, 25 bp, Mus musculus
gaagagcctcttggaggcccgagta

SEQ ID NO: 632742 - DNA, 25 bp, Mus musculus
gaagagcctgtgattccgccttgtg

SEQ ID NO: 632743 - DNA, 25 bp, Mus musculus
gaagagcctgtgtttccgccttgtg

SEQ ID NO: 632744 - DNA, 25 bp, Mus musculus
gaagagccttcaagtaagtggaaca

SEQ ID NO: 632745 - DNA, 25 bp, Mus musculus
gaagagccttcatgtaagtggaaca

SEQ ID NO: 632746 - DNA, 25 bp, Mus musculus
gaagagcgacttccatagccagatg

SEQ ID NO: 632747 - DNA, 25 bp, Mus musculus
gaagagcgacttgcatagccagatg

SEQ ID NO: 632748 - DNA, 25 bp, Mus musculus
gaagagcgatacagatacagggagt

SEQ ID NO: 632749 - DNA, 25 bp, Mus musculus
gaagagcgatactgatacagggagt

SEQ ID NO: 632750 - DNA, 25 bp, Mus musculus
gaagagcggaccactgcctagcgcc

SEQ ID NO: 632751 - DNA, 25 bp, Mus musculus
gaagagcggaccatcaggaattgga

SEQ ID NO: 632752 - DNA, 25 bp, Mus musculus
gaagagcggacctctgcctagcgcc

SEQ ID NO: 632753 - DNA, 25 bp, Mus musculus
gaagagcggaccttcaggaattgga

SEQ ID NO: 632754 - DNA, 25 bp, Mus musculus
gaagagcgggacatagagcgtctac

SEQ ID NO: 632755 - DNA, 25 bp, Mus musculus
gaagagcgggacttagagcgtctac

SEQ ID NO: 632756 - DNA, 25 bp, Mus musculus
gaagagcgggatcattgacttaaag

SEQ ID NO: 632757 - DNA, 25 bp, Mus musculus
gaagagcgggatctgtgtgtgtgac

SEQ ID NO: 632758 - DNA, 25 bp, Mus musculus
gaagagcgggatgattgacttaaag

SEQ ID NO: 632759 - DNA, 25 bp, Mus musculus
gaagagcgggatgtgtgtgtgtgac

SEQ ID NO: 632760 - DNA, 25 bp, Mus musculus
gaagagcgtagccacccctgaacag

SEQ ID NO: 632761 - DNA, 25 bp, Mus musculus
gaagagcgtagcgacccctgaacag

SEQ ID NO: 632762 - DNA, 25 bp, Mus musculus
gaagagcgtcaacaactggagaaca

SEQ ID NO: 632763 - DNA, 25 bp, Mus musculus
gaagagcgtcaagaactggagaaca

SEQ ID NO: 632764 - DNA, 25 bp, Mus musculus
gaagagcgtcgacggaagactctcc

SEQ ID NO: 632765 - DNA, 25 bp, Mus musculus
gaagagcgtcgagggaagactctcc

SEQ ID NO: 632766 - DNA, 25 bp, Mus musculus
gaagagctaacccaaatgtcagatg

SEQ ID NO: 632767 - DNA, 25 bp, Mus musculus
gaagagctaaccgaaatgtcagatg

SEQ ID NO: 632768 - DNA, 25 bp, Mus musculus
gaagagctacagaaactgcagcaga

SEQ ID NO: 632769 - DNA, 25 bp, Mus musculus
gaagagctacagtaactgcagcaga

SEQ ID NO: 632770 - DNA, 25 bp, Mus musculus
gaagagctattacactgacctagag

SEQ ID NO: 632771 - DNA, 25 bp, Mus musculus
gaagagctattagactgacctagag

SEQ ID NO: 632772 - DNA, 25 bp, Mus musculus
gaagagctcagcaagactgtggcac

SEQ ID NO: 632773 - DNA, 25 bp, Mus musculus
gaagagctcagctagactgtggcac

SEQ ID NO: 632774 - DNA, 25 bp, Mus musculus
gaagagctcattccagagatcagcc

SEQ ID NO: 632775 - DNA, 25 bp, Mus musculus
gaagagctcattgcagagatcagcc

SEQ ID NO: 632776 - DNA, 25 bp, Mus musculus
gaagagctctgaagttgccaaacct

SEQ ID NO: 632777 - DNA, 25 bp, Mus musculus
gaagagctctgatgttgccaaacct

SEQ ID NO: 632778 - DNA, 25 bp, Mus musculus
gaagagctgaccatctttagcgtcc

SEQ ID NO: 632779 - DNA, 25 bp, Mus musculus
gaagagctgaccttctttagcgtcc

SEQ ID NO: 632780 - DNA, 25 bp, Mus musculus
gaagagctgactattgactatcaaa

SEQ ID NO: 632781 - DNA, 25 bp, Mus musculus
gaagagctgacttttgactatcaaa

SEQ ID NO: 632782 - DNA, 25 bp, Mus musculus
gaagagctgataacgaaggccacct

SEQ ID NO: 632783 - DNA, 25 bp, Mus musculus
gaagagctgatatcgaaggccacct

SEQ ID NO: 632784 - DNA, 25 bp, Mus musculus
gaagagctgcatcagacatacctag

SEQ ID NO: 632785 - DNA, 25 bp, Mus musculus
gaagagctgcatgagacatacctag

SEQ ID NO: 632786 - DNA, 25 bp, Mus musculus
gaagagctgcgtcgctactgcactg

SEQ ID NO: 632787 - DNA, 25 bp, Mus musculus
gaagagctgcgtggctactgcactg

SEQ ID NO: 632788 - DNA, 25 bp, Mus musculus
gaagagctggatccagttgacacag

SEQ ID NO: 632789 - DNA, 25 bp, Mus musculus
gaagagctggatgcagttgacacag

SEQ ID NO: 632790 - DNA, 25 bp, Mus musculus
gaagagctggccaggtacttcccag

SEQ ID NO: 632791 - DNA, 25 bp, Mus musculus
gaagagctggcctggtacttcccag

SEQ ID NO: 632792 - DNA, 25 bp, Mus musculus
gaagagctgtctcgctaaggagaca

SEQ ID NO: 632793 - DNA, 25 bp, Mus musculus
gaagagctgtctggctaaggagaca

SEQ ID NO: 632794 - DNA, 25 bp, Mus musculus
gaagagcttaccaacacaagatcag

SEQ ID NO: 632795 - DNA, 25 bp, Mus musculus
gaagagcttacctacacaagatcag

SEQ ID NO: 632796 - DNA, 25 bp, Mus musculus
gaagagcttcgtaagctactcagct

SEQ ID NO: 632797 - DNA, 25 bp, Mus musculus
gaagagcttcgttagctactcagct

SEQ ID NO: 632798 - DNA, 25 bp, Mus musculus
gaagagcttctacagcgcatggcca

SEQ ID NO: 632799 - DNA, 25 bp, Mus musculus
gaagagcttctagagcgcatggcca

SEQ ID NO: 632800 - DNA, 25 bp, Mus musculus
gaagagcttctccatagcctcggac

SEQ ID NO: 632801 - DNA, 25 bp, Mus musculus
gaagagcttctcgatagcctcggac

SEQ ID NO: 632802 - DNA, 25 bp, Mus musculus
gaagagcttctgacaaaaccagagg

SEQ ID NO: 632803 - DNA, 25 bp, Mus musculus
gaagagcttctgtcaaaaccagagg

SEQ ID NO: 632804 - DNA, 25 bp, Mus musculus
gaagagctttaaacccagacacaag

SEQ ID NO: 632805 - DNA, 25 bp, Mus musculus
gaagagctttaatcccagacacaag

SEQ ID NO: 632806 - DNA, 25 bp, Mus musculus
gaagagctttgcactgtagagcttc

SEQ ID NO: 632807 - DNA, 25 bp, Mus musculus
gaagagctttgctctgtagagcttc

SEQ ID NO: 632808 - DNA, 25 bp, Mus musculus
gaagaggaaaagacggaagccttga

SEQ ID NO: 632809 - DNA, 25 bp, Mus musculus
gaagaggaaaagtcggaagccttga

SEQ ID NO: 632810 - DNA, 25 bp, Mus musculus
gaagaggaaagaacactcttgcatc

SEQ ID NO: 632811 - DNA, 25 bp, Mus musculus
gaagaggaaagatcactcttgcatc

SEQ ID NO: 632812 - DNA, 25 bp, Mus musculus
gaagaggaactgaaaatgacggtgc

SEQ ID NO: 632813 - DNA, 25 bp, Mus musculus
gaagaggaactgtaaatgacggtgc

SEQ ID NO: 632814 - DNA, 25 bp, Mus musculus
gaagaggaagaccaacacttgccag

SEQ ID NO: 632815 - DNA, 25 bp, Mus musculus
gaagaggaagacgaacacttgccag

SEQ ID NO: 632816 - DNA, 25 bp, Mus musculus
gaagaggaatctaggaacgcttacc

SEQ ID NO: 632817 - DNA, 25 bp, Mus musculus
gaagaggaatcttggaacgcttacc

SEQ ID NO: 632818 - DNA, 25 bp, Mus musculus
gaagaggaatggaaaacgattttga

SEQ ID NO: 632819 - DNA, 25 bp, Mus musculus
gaagaggaatggtaaacgattttga

SEQ ID NO: 632820 - DNA, 25 bp, Mus musculus
gaagaggacaacagtactgtcatct

SEQ ID NO: 632821 - DNA, 25 bp, Mus musculus
gaagaggacaactgtactgtcatct

SEQ ID NO: 632822 - DNA, 25 bp, Mus musculus
gaagaggacattctatcagtgacac

SEQ ID NO: 632823 - DNA, 25 bp, Mus musculus
gaagaggacattgtatcagtgacac

SEQ ID NO: 632824 - DNA, 25 bp, Mus musculus
gaagaggaccttccctatgaggaag

SEQ ID NO: 632825 - DNA, 25 bp, Mus musculus
gaagaggaccttgcctatgaggaag

SEQ ID NO: 632826 - DNA, 25 bp, Mus musculus
gaagaggacgttcttgagaccacgc

SEQ ID NO: 632827 - DNA, 25 bp, Mus musculus
gaagaggacgttgttgagaccacgc

SEQ ID NO: 632828 - DNA, 25 bp, Mus musculus
gaagaggactacactcctgtgggct

SEQ ID NO: 632829 - DNA, 25 bp, Mus musculus
gaagaggactactctcctgtgggct

SEQ ID NO: 632830 - DNA, 25 bp, Mus musculus
gaagaggagagcaccgatgaaaatg

SEQ ID NO: 632831 - DNA, 25 bp, Mus musculus
gaagaggagagctccgatgaaaatg

SEQ ID NO: 632832 - DNA, 25 bp, Mus musculus
gaagaggagatgacatccctggaaa

SEQ ID NO: 632833 - DNA, 25 bp, Mus musculus
gaagaggagatgtcatccctggaaa

SEQ ID NO: 632834 - DNA, 25 bp, Mus musculus
gaagaggagcaaactggcactgagc

SEQ ID NO: 632835 - DNA, 25 bp, Mus musculus
gaagaggagcaatctggcactgagc

SEQ ID NO: 632836 - DNA, 25 bp, Mus musculus
gaagaggaggatccaacattacagc

SEQ ID NO: 632837 - DNA, 25 bp, Mus musculus
gaagaggaggatgcaacattacagc

SEQ ID NO: 632838 - DNA, 25 bp, Mus musculus
gaagaggagtccaactctgactggg

SEQ ID NO: 632839 - DNA, 25 bp, Mus musculus
gaagaggagtcctactctgactggg

SEQ ID NO: 632840 - DNA, 25 bp, Mus musculus
gaagaggataccacctgctataaag

SEQ ID NO: 632841 - DNA, 25 bp, Mus musculus
gaagaggatacctcctgctataaag

SEQ ID NO: 632842 - DNA, 25 bp, Mus musculus
gaagaggatccaacactagatcgcc

SEQ ID NO: 632843 - DNA, 25 bp, Mus musculus
gaagaggatccacctgagacctgag

SEQ ID NO: 632844 - DNA, 25 bp, Mus musculus
gaagaggatccagctgagacctgag

SEQ ID NO: 632845 - DNA, 25 bp, Mus musculus
gaagaggatccatcactagatcgcc

SEQ ID NO: 632846 - DNA, 25 bp, Mus musculus
gaagaggatggcactgctagtgcaa

SEQ ID NO: 632847 - DNA, 25 bp, Mus musculus
gaagaggatggctctgctagtgcaa

SEQ ID NO: 632848 - DNA, 25 bp, Mus musculus
gaagaggattctcttttatcacata

SEQ ID NO: 632849 - DNA, 25 bp, Mus musculus
gaagaggattctgttttatcacata

SEQ ID NO: 632850 - DNA, 25 bp, Mus musculus
gaagaggattgcctttcagttcacg

SEQ ID NO: 632851 - DNA, 25 bp, Mus musculus
gaagaggattgcgtttcagttcacg

SEQ ID NO: 632852 - DNA, 25 bp, Mus musculus
gaagaggcaaaacgcctccaccggg

SEQ ID NO: 632853 - DNA, 25 bp, Mus musculus
gaagaggcaaaaggcctccaccggg

SEQ ID NO: 632854 - DNA, 25 bp, Mus musculus
gaagaggcaagaatgacccgcagcc

SEQ ID NO: 632855 - DNA, 25 bp, Mus musculus
gaagaggcaagattgacccgcagcc

SEQ ID NO: 632856 - DNA, 25 bp, Mus musculus
gaagaggcacctcagcttccagtgc

SEQ ID NO: 632857 - DNA, 25 bp, Mus musculus
gaagaggcacctgagcttccagtgc

SEQ ID NO: 632858 - DNA, 25 bp, Mus musculus
gaagaggcagataactgtggattct

SEQ ID NO: 632859 - DNA, 25 bp, Mus musculus
gaagaggcagattactgtggattct

SEQ ID NO: 632860 - DNA, 25 bp, Mus musculus
gaagaggcatctactatcagattga

SEQ ID NO: 632861 - DNA, 25 bp, Mus musculus
gaagaggcatcttctatcagattga

SEQ ID NO: 632862 - DNA, 25 bp, Mus musculus
gaagaggcattacatgccctgaaat

SEQ ID NO: 632863 - DNA, 25 bp, Mus musculus
gaagaggcattagatgccctgaaat

SEQ ID NO: 632864 - DNA, 25 bp, Mus musculus
gaagaggcattcaggattccctcca

SEQ ID NO: 632865 - DNA, 25 bp, Mus musculus
gaagaggcattctggattccctcca

SEQ ID NO: 632866 - DNA, 25 bp, Mus musculus
gaagaggccagaagaggttcctgat

SEQ ID NO: 632867 - DNA, 25 bp, Mus musculus
gaagaggccagactgttcatcgtca

SEQ ID NO: 632868 - DNA, 25 bp, Mus musculus
gaagaggccagagtgttcatcgtca

SEQ ID NO: 632869 - DNA, 25 bp, Mus musculus
gaagaggccagatgaggttcctgat

SEQ ID NO: 632870 - DNA, 25 bp, Mus musculus
gaagaggccagcatctacgacaagc

SEQ ID NO: 632871 - DNA, 25 bp, Mus musculus
gaagaggccagcttctacgacaagc

SEQ ID NO: 632872 - DNA, 25 bp, Mus musculus
gaagaggccttcaggatagacaaga

SEQ ID NO: 632873 - DNA, 25 bp, Mus musculus
gaagaggccttctggatagacaaga

SEQ ID NO: 632874 - DNA, 25 bp, Mus musculus
gaagaggcgcggctttccagacaca

SEQ ID NO: 632875 - DNA, 25 bp, Mus musculus
gaagaggcgcgggtttccagacaca

SEQ ID NO: 632876 - DNA, 25 bp, Mus musculus
gaagaggcggtcaagggaaaaacat

SEQ ID NO: 632877 - DNA, 25 bp, Mus musculus
gaagaggcggtctagggaaaaacat

SEQ ID NO: 632878 - DNA, 25 bp, Mus musculus
gaagaggctaggcagatcaagaact

SEQ ID NO: 632879 - DNA, 25 bp, Mus musculus
gaagaggctagggagatcaagaact

SEQ ID NO: 632880 - DNA, 25 bp, Mus musculus
gaagaggctcctcgaccagttcacg

SEQ ID NO: 632881 - DNA, 25 bp, Mus musculus
gaagaggctcctggaccagttcacg

SEQ ID NO: 632882 - DNA, 25 bp, Mus musculus
gaagaggctgctacagtgacgtcat

SEQ ID NO: 632883 - DNA, 25 bp, Mus musculus
gaagaggctgcttcagtgacgtcat

SEQ ID NO: 632884 - DNA, 25 bp, Mus musculus
gaagaggctttcatgcagtgtgcaa

SEQ ID NO: 632885 - DNA, 25 bp, Mus musculus
gaagaggctttcttgcagtgtgcaa

SEQ ID NO: 632886 - DNA, 25 bp, Mus musculus
gaagagggacgacttctccaccaag

SEQ ID NO: 632887 - DNA, 25 bp, Mus musculus
gaagagggacgagttctccaccaag

SEQ ID NO: 632888 - DNA, 25 bp, Mus musculus
gaagagggatagcttgtgtccccaa

SEQ ID NO: 632889 - DNA, 25 bp, Mus musculus
gaagagggataggttgtgtccccaa

SEQ ID NO: 632890 - DNA, 25 bp, Mus musculus
gaagagggatcgagcatttcctgga

SEQ ID NO: 632891 - DNA, 25 bp, Mus musculus
gaagagggatcgtgcatttcctgga

SEQ ID NO: 632892 - DNA, 25 bp, Mus musculus
gaagagggcacacctttcacagcca

SEQ ID NO: 632893 - DNA, 25 bp, Mus musculus
gaagagggcacagctttcacagcca

SEQ ID NO: 632894 - DNA, 25 bp, Mus musculus
gaagagggccaacgagcaaacaatc

SEQ ID NO: 632895 - DNA, 25 bp, Mus musculus
gaagagggccaaggagcaaacaatc

SEQ ID NO: 632896 - DNA, 25 bp, Mus musculus
gaagagggtaccagccatgatggat

SEQ ID NO: 632897 - DNA, 25 bp, Mus musculus
gaagagggtacctgccatgatggat

SEQ ID NO: 632898 - DNA, 25 bp, Mus musculus
gaagaggtaacaccgggaacccagc

SEQ ID NO: 632899 - DNA, 25 bp, Mus musculus
gaagaggtaacagcgggaacccagc

SEQ ID NO: 632900 - DNA, 25 bp, Mus musculus
gaagaggtccatatctagaagcagg

SEQ ID NO: 632901 - DNA, 25 bp, Mus musculus
gaagaggtccatttctagaagcagg

SEQ ID NO: 632902 - DNA, 25 bp, Mus musculus
gaagaggtcctccttcaggccgaat

SEQ ID NO: 632903 - DNA, 25 bp, Mus musculus
gaagaggtcctcgttcaggccgaat

SEQ ID NO: 632904 - DNA, 25 bp, Mus musculus
gaagaggtgtccatggacagtcccg

SEQ ID NO: 632905 - DNA, 25 bp, Mus musculus
gaagaggtgtccttggacagtcccg

SEQ ID NO: 632906 - DNA, 25 bp, Mus musculus
gaagaggttaacaagtgacctgggc

SEQ ID NO: 632907 - DNA, 25 bp, Mus musculus
gaagaggttaactagtgacctgggc

SEQ ID NO: 632908 - DNA, 25 bp, Mus musculus
gaagaggttcctcgcgagcttatgc

SEQ ID NO: 632909 - DNA, 25 bp, Mus musculus
gaagaggttcctggcgagcttatgc

SEQ ID NO: 632910 - DNA, 25 bp, Mus musculus
gaagaggttctgctgggcacatttt

SEQ ID NO: 632911 - DNA, 25 bp, Mus musculus
gaagaggttctggtgggcacatttt

SEQ ID NO: 632912 - DNA, 25 bp, Mus musculus
gaagaggttgacaatactgaaaagc

SEQ ID NO: 632913 - DNA, 25 bp, Mus musculus
gaagaggttgactatactgaaaagc

SEQ ID NO: 632914 - DNA, 25 bp, Mus musculus
gaagaggttgagataaagaagctga

SEQ ID NO: 632915 - DNA, 25 bp, Mus musculus
gaagaggttgagttaaagaagctga

SEQ ID NO: 632916 - DNA, 25 bp, Mus musculus
gaagaggttggaaccacggatgcca

SEQ ID NO: 632917 - DNA, 25 bp, Mus musculus
gaagaggttggaactagaacgaaag

SEQ ID NO: 632918 - DNA, 25 bp, Mus musculus
gaagaggttggatccacggatgcca

SEQ ID NO: 632919 - DNA, 25 bp, Mus musculus
gaagaggttggatctagaacgaaag

SEQ ID NO: 632920 - DNA, 25 bp, Mus musculus
gaagaggttgttctgactctcttac

SEQ ID NO: 632921 - DNA, 25 bp, Mus musculus
gaagaggttgttgtgactctcttac

SEQ ID NO: 632922 - DNA, 25 bp, Mus musculus
gaagagtaaaatcaatatgaccgag

SEQ ID NO: 632923 - DNA, 25 bp, Mus musculus
gaagagtaaaatgaatatgaccgag

SEQ ID NO: 632924 - DNA, 25 bp, Mus musculus
gaagagtacgataccctgggaacac

SEQ ID NO: 632925 - DNA, 25 bp, Mus musculus
gaagagtacgattccctgggaacac

SEQ ID NO: 632926 - DNA, 25 bp, Mus musculus
gaagagtactgcactcctaccatga

SEQ ID NO: 632927 - DNA, 25 bp, Mus musculus
gaagagtactgctctcctaccatga

SEQ ID NO: 632928 - DNA, 25 bp, Mus musculus
gaagagtactggaaacttactggat

SEQ ID NO: 632929 - DNA, 25 bp, Mus musculus
gaagagtactggaaatgggcctgca

SEQ ID NO: 632930 - DNA, 25 bp, Mus musculus
gaagagtactggtaacttactggat

SEQ ID NO: 632931 - DNA, 25 bp, Mus musculus
gaagagtactggtaatgggcctgca

SEQ ID NO: 632932 - DNA, 25 bp, Mus musculus
gaagagtagaaaatgcgtatcacat

SEQ ID NO: 632933 - DNA, 25 bp, Mus musculus
gaagagtagaaattgcgtatcacat

SEQ ID NO: 632934 - DNA, 25 bp, Mus musculus
gaagagtagcagacctcggctgtgc

SEQ ID NO: 632935 - DNA, 25 bp, Mus musculus
gaagagtagcagtcctcggctgtgc

SEQ ID NO: 632936 - DNA, 25 bp, Mus musculus
gaagagtataccattcagaatcgag

SEQ ID NO: 632937 - DNA, 25 bp, Mus musculus
gaagagtatacctttcagaatcgag

SEQ ID NO: 632938 - DNA, 25 bp, Mus musculus
gaagagtatagtcccatgcgggacc

SEQ ID NO: 632939 - DNA, 25 bp, Mus musculus
gaagagtatagtgccatgcgggacc

SEQ ID NO: 632940 - DNA, 25 bp, Mus musculus
gaagagtatcacatacgaaggaaga

SEQ ID NO: 632941 - DNA, 25 bp, Mus musculus
gaagagtatcacttacgaaggaaga

SEQ ID NO: 632942 - DNA, 25 bp, Mus musculus
gaagagtatccaaccagactacgtg

SEQ ID NO: 632943 - DNA, 25 bp, Mus musculus
gaagagtatccatccagactacgtg

SEQ ID NO: 632944 - DNA, 25 bp, Mus musculus
gaagagtcaacaaccctactcaaca

SEQ ID NO: 632945 - DNA, 25 bp, Mus musculus
gaagagtcaacatccctactcaaca

SEQ ID NO: 632946 - DNA, 25 bp, Mus musculus
gaagagtcagagaggaagcttcttg

SEQ ID NO: 632947 - DNA, 25 bp, Mus musculus
gaagagtcagagtggaagcttcttg

SEQ ID NO: 632948 - DNA, 25 bp, Mus musculus
gaagagtccaacaggtagcccctcc

SEQ ID NO: 632949 - DNA, 25 bp, Mus musculus
gaagagtccaactggtagcccctcc

SEQ ID NO: 632950 - DNA, 25 bp, Mus musculus
gaagagtccagtcctggttacaaaa

SEQ ID NO: 632951 - DNA, 25 bp, Mus musculus
gaagagtccagtgctggttacaaaa

SEQ ID NO: 632952 - DNA, 25 bp, Mus musculus
gaagagtccatcagagaaggcatac

SEQ ID NO: 632953 - DNA, 25 bp, Mus musculus
gaagagtccatctgagaaggcatac

SEQ ID NO: 632954 - DNA, 25 bp, Mus musculus
gaagagtccccaagaaggaaagacc

SEQ ID NO: 632955 - DNA, 25 bp, Mus musculus
gaagagtccccatgaaggaaagacc

SEQ ID NO: 632956 - DNA, 25 bp, Mus musculus
gaagagtccggacgagatgtacatt

SEQ ID NO: 632957 - DNA, 25 bp, Mus musculus
gaagagtccggaggagatgtacatt

SEQ ID NO: 632958 - DNA, 25 bp, Mus musculus
gaagagtccggcagaagccctggct

SEQ ID NO: 632959 - DNA, 25 bp, Mus musculus
gaagagtccggctgaagccctggct

SEQ ID NO: 632960 - DNA, 25 bp, Mus musculus
gaagagtcggatcctctccaggaag

SEQ ID NO: 632961 - DNA, 25 bp, Mus musculus
gaagagtcggatgctctccaggaag

SEQ ID NO: 632962 - DNA, 25 bp, Mus musculus
gaagagtctaccaagaatcccattg

SEQ ID NO: 632963 - DNA, 25 bp, Mus musculus
gaagagtctacctagaatcccattg

SEQ ID NO: 632964 - DNA, 25 bp, Mus musculus
gaagagtctcatctgccagcaactg

SEQ ID NO: 632965 - DNA, 25 bp, Mus musculus
gaagagtctcatgtgccagcaactg

SEQ ID NO: 632966 - DNA, 25 bp, Mus musculus
gaagagtctcctcccctcgatttag

SEQ ID NO: 632967 - DNA, 25 bp, Mus musculus
gaagagtctcctgccctcgatttag

SEQ ID NO: 632968 - DNA, 25 bp, Mus musculus
gaagagtctctcatacattcgcatc

SEQ ID NO: 632969 - DNA, 25 bp, Mus musculus
gaagagtctctcttacattcgcatc

SEQ ID NO: 632970 - DNA, 25 bp, Mus musculus
gaagagtctttacacctctgctggg

SEQ ID NO: 632971 - DNA, 25 bp, Mus musculus
gaagagtctttagacctctgctggg

SEQ ID NO: 632972 - DNA, 25 bp, Mus musculus
gaagagtgaagaatagttgtccaag

SEQ ID NO: 632973 - DNA, 25 bp, Mus musculus
gaagagtgaagattagttgtccaag

SEQ ID NO: 632974 - DNA, 25 bp, Mus musculus
gaagagtgaagtattgcgagtcacc

SEQ ID NO: 632975 - DNA, 25 bp, Mus musculus
gaagagtgaagttttgcgagtcacc

SEQ ID NO: 632976 - DNA, 25 bp, Mus musculus
gaagagtgccaacgagaaagctgac

SEQ ID NO: 632977 - DNA, 25 bp, Mus musculus
gaagagtgccaaggagaaagctgac

SEQ ID NO: 632978 - DNA, 25 bp, Mus musculus
gaagagtgctacaatttttccagtc

SEQ ID NO: 632979 - DNA, 25 bp, Mus musculus
gaagagtgctactatttttccagtc

SEQ ID NO: 632980 - DNA, 25 bp, Mus musculus
gaagagtgctatctggaaatcacca

SEQ ID NO: 632981 - DNA, 25 bp, Mus musculus
gaagagtgctatgtggaaatcacca

SEQ ID NO: 632982 - DNA, 25 bp, Mus musculus
gaagagtggccacatggaaagcccc

SEQ ID NO: 632983 - DNA, 25 bp, Mus musculus
gaagagtggccagatggaaagcccc

SEQ ID NO: 632984 - DNA, 25 bp, Mus musculus
gaagagtgggcccaaggcaccttca

SEQ ID NO: 632985 - DNA, 25 bp, Mus musculus
gaagagtgggccgaaggcaccttca

SEQ ID NO: 632986 - DNA, 25 bp, Mus musculus
gaagagttacaactgaattagcaat

SEQ ID NO: 632987 - DNA, 25 bp, Mus musculus
gaagagttacaagtgaattagcaat

SEQ ID NO: 632988 - DNA, 25 bp, Mus musculus
gaagagttcaggcaaccccaagatc

SEQ ID NO: 632989 - DNA, 25 bp, Mus musculus
gaagagttcagggaaccccaagatc

SEQ ID NO: 632990 - DNA, 25 bp, Mus musculus
gaagagttcatcatcgctcctcgac

SEQ ID NO: 632991 - DNA, 25 bp, Mus musculus
gaagagttcatcttcgctcctcgac

SEQ ID NO: 632992 - DNA, 25 bp, Mus musculus
gaagagttctcaaaggaaaagtttg

SEQ ID NO: 632993 - DNA, 25 bp, Mus musculus
gaagagttctcataggaaaagtttg

SEQ ID NO: 632994 - DNA, 25 bp, Mus musculus
gaagagttctgtcgaagtctatgca

SEQ ID NO: 632995 - DNA, 25 bp, Mus musculus
gaagagttctgtggaagtctatgca

SEQ ID NO: 632996 - DNA, 25 bp, Mus musculus
gaagagttgcatatcatcgcgcagg

SEQ ID NO: 632997 - DNA, 25 bp, Mus musculus
gaagagttgcatttcatcgcgcagg

SEQ ID NO: 632998 - DNA, 25 bp, Mus musculus
gaagagttggtccagctgctcctta

SEQ ID NO: 632999 - DNA, 25 bp, Mus musculus
gaagagttggtcgagctgctcctta

SEQ ID NO: 633000 - DNA, 25 bp, Mus musculus
gaagagttgtgacccttgttgaaga

SEQ ID NO: 633001 - DNA, 25 bp, Mus musculus
gaagagttgtgagccttgttgaaga

SEQ ID NO: 633002 - DNA, 25 bp, Mus musculus
gaagagttgttaataactgcacagc

SEQ ID NO: 633003 - DNA, 25 bp, Mus musculus
gaagagttgttattaactgcacagc

SEQ ID NO: 633004 - DNA, 25 bp, Mus musculus
gaagataaaccaaggcggaaacctg

SEQ ID NO: 633005 - DNA, 25 bp, Mus musculus
gaagataaaccatggcggaaacctg

SEQ ID NO: 633006 - DNA, 25 bp, Mus musculus
gaagataaaccccagcagactttaa

SEQ ID NO: 633007 - DNA, 25 bp, Mus musculus
gaagataaacccgagcagactttaa

SEQ ID NO: 633008 - DNA, 25 bp, Mus musculus
gaagataacagaagagcagagacag

SEQ ID NO: 633009 - DNA, 25 bp, Mus musculus
gaagataacagatgagcagagacag

SEQ ID NO: 633010 - DNA, 25 bp, Mus musculus
gaagataacatcaaaaccttctgct

SEQ ID NO: 633011 - DNA, 25 bp, Mus musculus
gaagataacatctaaaccttctgct

SEQ ID NO: 633012 - DNA, 25 bp, Mus musculus
gaagataacattccacggtgaagga

SEQ ID NO: 633013 - DNA, 25 bp, Mus musculus
gaagataacattgcacggtgaagga

SEQ ID NO: 633014 - DNA, 25 bp, Mus musculus
gaagataacctgagggttaaaatga

SEQ ID NO: 633015 - DNA, 25 bp, Mus musculus
gaagataacctgtgggttaaaatga

SEQ ID NO: 633016 - DNA, 25 bp, Mus musculus
gaagataagattaatgatcgtcagg

SEQ ID NO: 633017 - DNA, 25 bp, Mus musculus
gaagataagatttatgatcgtcagg

SEQ ID NO: 633018 - DNA, 25 bp, Mus musculus
gaagataatggaaggcccctgcgtc

SEQ ID NO: 633019 - DNA, 25 bp, Mus musculus
gaagataatggatggcccctgcgtc

SEQ ID NO: 633020 - DNA, 25 bp, Mus musculus
gaagatacctgtagatacttacaac

SEQ ID NO: 633021 - DNA, 25 bp, Mus musculus
gaagatacctgttgatacttacaac

SEQ ID NO: 633022 - DNA, 25 bp, Mus musculus
gaagatacggttctacatctctgtc

SEQ ID NO: 633023 - DNA, 25 bp, Mus musculus
gaagatacggttgtacatctctgtc

SEQ ID NO: 633024 - DNA, 25 bp, Mus musculus
gaagatacttccaagatgaaccatg

SEQ ID NO: 633025 - DNA, 25 bp, Mus musculus
gaagatacttcctagatgaaccatg

SEQ ID NO: 633026 - DNA, 25 bp, Mus musculus
gaagatagcagtccacatgcaaccc

SEQ ID NO: 633027 - DNA, 25 bp, Mus musculus
gaagatagcagtgcacatgcaaccc

SEQ ID NO: 633028 - DNA, 25 bp, Mus musculus
gaagatagccagctttctagacaag

SEQ ID NO: 633029 - DNA, 25 bp, Mus musculus
gaagatagccaggtttctagacaag

SEQ ID NO: 633030 - DNA, 25 bp, Mus musculus
gaagatagccgaagaccttatgaag

SEQ ID NO: 633031 - DNA, 25 bp, Mus musculus
gaagatagccgatgaccttatgaag

SEQ ID NO: 633032 - DNA, 25 bp, Mus musculus
gaagataggcttagcctgcccagtc

SEQ ID NO: 633033 - DNA, 25 bp, Mus musculus
gaagataggctttgcctgcccagtc

SEQ ID NO: 633034 - DNA, 25 bp, Mus musculus
gaagatagtatcactgcactgggtg

SEQ ID NO: 633035 - DNA, 25 bp, Mus musculus
gaagatagtatctctgcactgggtg

SEQ ID NO: 633036 - DNA, 25 bp, Mus musculus
gaagatagtttaaccaagcagcccg

SEQ ID NO: 633037 - DNA, 25 bp, Mus musculus
gaagatagtttatccaagcagcccg

SEQ ID NO: 633038 - DNA, 25 bp, Mus musculus
gaagatatatttcccaatcagcctg

SEQ ID NO: 633039 - DNA, 25 bp, Mus musculus
gaagatatatttgccaatcagcctg

SEQ ID NO: 633040 - DNA, 25 bp, Mus musculus
gaagatatcaagaacatcttgggcc

SEQ ID NO: 633041 - DNA, 25 bp, Mus musculus
gaagatatcaagtacatcttgggcc

SEQ ID NO: 633042 - DNA, 25 bp, Mus musculus
gaagatatccgacgaattcccattc

SEQ ID NO: 633043 - DNA, 25 bp, Mus musculus
gaagatatccgaggaattcccattc

SEQ ID NO: 633044 - DNA, 25 bp, Mus musculus
gaagatatgccgcacagtcactcag

SEQ ID NO: 633045 - DNA, 25 bp, Mus musculus
gaagatatgccggacagtcactcag

SEQ ID NO: 633046 - DNA, 25 bp, Mus musculus
gaagatattgccagcctctcccaga

SEQ ID NO: 633047 - DNA, 25 bp, Mus musculus
gaagatattgcctgcctctcccaga

SEQ ID NO: 633048 - DNA, 25 bp, Mus musculus
gaagatatttatccagtggagatag

SEQ ID NO: 633049 - DNA, 25 bp, Mus musculus
gaagatatttatgcagtggagatag

SEQ ID NO: 633050 - DNA, 25 bp, Mus musculus
gaagatattttcatttgctcaccag

SEQ ID NO: 633051 - DNA, 25 bp, Mus musculus
gaagatattttccacatgccgagcc

SEQ ID NO: 633052 - DNA, 25 bp, Mus musculus
gaagatattttcgacatgccgagcc

SEQ ID NO: 633053 - DNA, 25 bp, Mus musculus
gaagatattttcttttgctcaccag

SEQ ID NO: 633054 - DNA, 25 bp, Mus musculus
gaagatcaaacgattttgtggacaa

SEQ ID NO: 633055 - DNA, 25 bp, Mus musculus
gaagatcaaacgtttttgtggacaa

SEQ ID NO: 633056 - DNA, 25 bp, Mus musculus
gaagatcaaactcgaaggactgtct

SEQ ID NO: 633057 - DNA, 25 bp, Mus musculus
gaagatcaaactggaaggactgtct

SEQ ID NO: 633058 - DNA, 25 bp, Mus musculus
gaagatcaaagtccctgttgattgg

SEQ ID NO: 633059 - DNA, 25 bp, Mus musculus
gaagatcaaagtgcctgttgattgg

SEQ ID NO: 633060 - DNA, 25 bp, Mus musculus
gaagatcaaccaaagcaagtttatg

SEQ ID NO: 633061 - DNA, 25 bp, Mus musculus
gaagatcaaccatagcaagtttatg

SEQ ID NO: 633062 - DNA, 25 bp, Mus musculus
gaagatcaacgaatggctgggaatc

SEQ ID NO: 633063 - DNA, 25 bp, Mus musculus
gaagatcaacgattggctgggaatc

SEQ ID NO: 633064 - DNA, 25 bp, Mus musculus
gaagatcaagacacgccccacggag

SEQ ID NO: 633065 - DNA, 25 bp, Mus musculus
gaagatcaagactcgccccacggag

SEQ ID NO: 633066 - DNA, 25 bp, Mus musculus
gaagatcaagatactgtgaacctca

SEQ ID NO: 633067 - DNA, 25 bp, Mus musculus
gaagatcaagattctgtgaacctca

SEQ ID NO: 633068 - DNA, 25 bp, Mus musculus
gaagatcaatgactatctggaaaga

SEQ ID NO: 633069 - DNA, 25 bp, Mus musculus
gaagatcaatgagtatctggaaaga

SEQ ID NO: 633070 - DNA, 25 bp, Mus musculus
gaagatcacagtcttcacctggaag

SEQ ID NO: 633071 - DNA, 25 bp, Mus musculus
gaagatcacagtgttcacctggaag

SEQ ID NO: 633072 - DNA, 25 bp, Mus musculus
gaagatcaccatcacgatccgtgac

SEQ ID NO: 633073 - DNA, 25 bp, Mus musculus
gaagatcaccatgacgatccgtgac

SEQ ID NO: 633074 - DNA, 25 bp, Mus musculus
gaagatcaccgacaaaatggctact

SEQ ID NO: 633075 - DNA, 25 bp, Mus musculus
gaagatcaccgagaaaatggctact

SEQ ID NO: 633076 - DNA, 25 bp, Mus musculus
gaagatcacgtcctggtttctctcc

SEQ ID NO: 633077 - DNA, 25 bp, Mus musculus
gaagatcacgtcgtggtttctctcc

SEQ ID NO: 633078 - DNA, 25 bp, Mus musculus
gaagatcagaaactcagatggatat

SEQ ID NO: 633079 - DNA, 25 bp, Mus musculus
gaagatcagaaagtcagatggatat

SEQ ID NO: 633080 - DNA, 25 bp, Mus musculus
gaagatcagaatcagtatgagtccc

SEQ ID NO: 633081 - DNA, 25 bp, Mus musculus
gaagatcagaatgagtatgagtccc

SEQ ID NO: 633082 - DNA, 25 bp, Mus musculus
gaagatcagacacttttcaccatag

SEQ ID NO: 633083 - DNA, 25 bp, Mus musculus
gaagatcagacagttttcaccatag

SEQ ID NO: 633084 - DNA, 25 bp, Mus musculus
gaagatcagagtcctcaggcaacct

SEQ ID NO: 633085 - DNA, 25 bp, Mus musculus
gaagatcagagtgctcaggcaacct

SEQ ID NO: 633086 - DNA, 25 bp, Mus musculus
gaagatcagcacagactccagaatg

SEQ ID NO: 633087 - DNA, 25 bp, Mus musculus
gaagatcagcactgactccagaatg

SEQ ID NO: 633088 - DNA, 25 bp, Mus musculus
gaagatcagcgacctctggaaaaac

SEQ ID NO: 633089 - DNA, 25 bp, Mus musculus
gaagatcagcgagctctggaaaaac

SEQ ID NO: 633090 - DNA, 25 bp, Mus musculus
gaagatcagggtctttactcctgtt

SEQ ID NO: 633091 - DNA, 25 bp, Mus musculus
gaagatcagggtgtttactcctgtt

SEQ ID NO: 633092 - DNA, 25 bp, Mus musculus
gaagatcatcgacttcgggttcgcg

SEQ ID NO: 633093 - DNA, 25 bp, Mus musculus
gaagatcatcgagttcgggttcgcg

SEQ ID NO: 633094 - DNA, 25 bp, Mus musculus
gaagatcatctgcaaaagccaggtg

SEQ ID NO: 633095 - DNA, 25 bp, Mus musculus
gaagatcatctggaaaagccaggtg

SEQ ID NO: 633096 - DNA, 25 bp, Mus musculus
gaagatcatgataatgacagatcag

SEQ ID NO: 633097 - DNA, 25 bp, Mus musculus
gaagatcatgattatgacagatcag

SEQ ID NO: 633098 - DNA, 25 bp, Mus musculus
gaagatcattatcggacagaaatca

SEQ ID NO: 633099 - DNA, 25 bp, Mus musculus
gaagatcattatgggacagaaatca

SEQ ID NO: 633100 - DNA, 25 bp, Mus musculus
gaagatcattgacacactgtcacag

SEQ ID NO: 633101 - DNA, 25 bp, Mus musculus
gaagatcattgagacactgtcacag

SEQ ID NO: 633102 - DNA, 25 bp, Mus musculus
gaagatcattgcagaactcaatgag

SEQ ID NO: 633103 - DNA, 25 bp, Mus musculus
gaagatcattgctgaactcaatgag

SEQ ID NO: 633104 - DNA, 25 bp, Mus musculus
gaagatccacataccggagccggat

SEQ ID NO: 633105 - DNA, 25 bp, Mus musculus
gaagatccacattccggagccggat

SEQ ID NO: 633106 - DNA, 25 bp, Mus musculus
gaagatccagctattgacacacctc

SEQ ID NO: 633107 - DNA, 25 bp, Mus musculus
gaagatccagcttttgacacacctc

SEQ ID NO: 633108 - DNA, 25 bp, Mus musculus
gaagatccagttaacggtcccgctg

SEQ ID NO: 633109 - DNA, 25 bp, Mus musculus
gaagatccagtttacggtcccgctg

SEQ ID NO: 633110 - DNA, 25 bp, Mus musculus
gaagatccatgtcatccgtggaaga

SEQ ID NO: 633111 - DNA, 25 bp, Mus musculus
gaagatccatgtgatccgtggaaga

SEQ ID NO: 633112 - DNA, 25 bp, Mus musculus
gaagatcccaccagacagcatgctt

SEQ ID NO: 633113 - DNA, 25 bp, Mus musculus
gaagatcccacctgacagcatgctt

SEQ ID NO: 633114 - DNA, 25 bp, Mus musculus
gaagatcccagtcttcagacggaga

SEQ ID NO: 633115 - DNA, 25 bp, Mus musculus
gaagatcccagtgttcagacggaga

SEQ ID NO: 633116 - DNA, 25 bp, Mus musculus
gaagatccccataaaatgtttgtga

SEQ ID NO: 633117 - DNA, 25 bp, Mus musculus
gaagatccccattaaatgtttgtga

SEQ ID NO: 633118 - DNA, 25 bp, Mus musculus
gaagatccccgcctgggctggctca

SEQ ID NO: 633119 - DNA, 25 bp, Mus musculus
gaagatccccgcgtgggctggctca

SEQ ID NO: 633120 - DNA, 25 bp, Mus musculus
gaagatccctgtcctggtgcagagc

SEQ ID NO: 633121 - DNA, 25 bp, Mus musculus
gaagatccctgtgctggtgcagagc

SEQ ID NO: 633122 - DNA, 25 bp, Mus musculus
gaagatccgaaaagtcagttccaca

SEQ ID NO: 633123 - DNA, 25 bp, Mus musculus
gaagatccgaaatgtcagttccaca

SEQ ID NO: 633124 - DNA, 25 bp, Mus musculus
gaagatcctatcacgggaaggcaga

SEQ ID NO: 633125 - DNA, 25 bp, Mus musculus
gaagatcctatctcgggaaggcaga

SEQ ID NO: 633126 - DNA, 25 bp, Mus musculus
gaagatcctgctatctgttgtgagc

SEQ ID NO: 633127 - DNA, 25 bp, Mus musculus
gaagatcctgctttctgttgtgagc

SEQ ID NO: 633128 - DNA, 25 bp, Mus musculus
gaagatcctggcaatcaaaggaatc

SEQ ID NO: 633129 - DNA, 25 bp, Mus musculus
gaagatcctggctatcaaaggaatc

SEQ ID NO: 633130 - DNA, 25 bp, Mus musculus
gaagatccttctccagaaaacagga

SEQ ID NO: 633131 - DNA, 25 bp, Mus musculus
gaagatccttctccagacaccgagg

SEQ ID NO: 633132 - DNA, 25 bp, Mus musculus
gaagatccttctgcagaaaacagga

SEQ ID NO: 633133 - DNA, 25 bp, Mus musculus
gaagatccttctgcagacaccgagg

SEQ ID NO: 633134 - DNA, 25 bp, Mus musculus
gaagatccttggaaagctaactaca

SEQ ID NO: 633135 - DNA, 25 bp, Mus musculus
gaagatccttggtaagctaactaca

SEQ ID NO: 633136 - DNA, 25 bp, Mus musculus
gaagatcgacaaatctaacacacca

SEQ ID NO: 633137 - DNA, 25 bp, Mus musculus
gaagatcgacaattctaacacacca

SEQ ID NO: 633138 - DNA, 25 bp, Mus musculus
gaagatcgtgctagcagctcaggca

SEQ ID NO: 633139 - DNA, 25 bp, Mus musculus
gaagatcgtgcttgcagctcaggca

SEQ ID NO: 633140 - DNA, 25 bp, Mus musculus
gaagatcgtggactaattgaagctg

SEQ ID NO: 633141 - DNA, 25 bp, Mus musculus
gaagatcgtggagtaattgaagctg

SEQ ID NO: 633142 - DNA, 25 bp, Mus musculus
gaagatcgtgtccacaaaggcgatt

SEQ ID NO: 633143 - DNA, 25 bp, Mus musculus
gaagatcgtgtcgacaaaggcgatt

SEQ ID NO: 633144 - DNA, 25 bp, Mus musculus
gaagatcgtgttagtgacgggaaac

SEQ ID NO: 633145 - DNA, 25 bp, Mus musculus
gaagatcgtgttcggaagcctctga

SEQ ID NO: 633146 - DNA, 25 bp, Mus musculus
gaagatcgtgttgggaagcctctga

SEQ ID NO: 633147 - DNA, 25 bp, Mus musculus
gaagatcgtgtttgtgacgggaaac

SEQ ID NO: 633148 - DNA, 25 bp, Mus musculus
gaagatctacaacgctgtgcggcga

SEQ ID NO: 633149 - DNA, 25 bp, Mus musculus
gaagatctacaaggctgtgcggcga

SEQ ID NO: 633150 - DNA, 25 bp, Mus musculus
gaagatctatcccttcgtactcgat

SEQ ID NO: 633151 - DNA, 25 bp, Mus musculus
gaagatctatccgttcgtactcgat

SEQ ID NO: 633152 - DNA, 25 bp, Mus musculus
gaagatctcggaagctaatctgcgt

SEQ ID NO: 633153 - DNA, 25 bp, Mus musculus
gaagatctcggatgctaatctgcgt

SEQ ID NO: 633154 - DNA, 25 bp, Mus musculus
gaagatctctgtaagaaatgtatgc

SEQ ID NO: 633155 - DNA, 25 bp, Mus musculus
gaagatctctgttagaaatgtatgc

SEQ ID NO: 633156 - DNA, 25 bp, Mus musculus
gaagatctgaaacacatgggcatcg

SEQ ID NO: 633157 - DNA, 25 bp, Mus musculus
gaagatctgaaagacatgggcatcg

SEQ ID NO: 633158 - DNA, 25 bp, Mus musculus
gaagatctgaataccagatggaggc

SEQ ID NO: 633159 - DNA, 25 bp, Mus musculus
gaagatctgaattccagatggaggc

SEQ ID NO: 633160 - DNA, 25 bp, Mus musculus
gaagatctgagcacagccagctata

SEQ ID NO: 633161 - DNA, 25 bp, Mus musculus
gaagatctgagctcagccagctata

SEQ ID NO: 633162 - DNA, 25 bp, Mus musculus
gaagatctgagtactgaagaaaggg

SEQ ID NO: 633163 - DNA, 25 bp, Mus musculus
gaagatctgagttctgaagaaaggg

SEQ ID NO: 633164 - DNA, 25 bp, Mus musculus
gaagatctgcagcagccagacagct

SEQ ID NO: 633165 - DNA, 25 bp, Mus musculus
gaagatctgcaggagccagacagct

SEQ ID NO: 633166 - DNA, 25 bp, Mus musculus
gaagatctgcatccatttatcgctc

SEQ ID NO: 633167 - DNA, 25 bp, Mus musculus
gaagatctgcatgcatttatcgctc

SEQ ID NO: 633168 - DNA, 25 bp, Mus musculus
gaagatctgcgacttcgaccttggc

SEQ ID NO: 633169 - DNA, 25 bp, Mus musculus
gaagatctgcgagttcgaccttggc

SEQ ID NO: 633170 - DNA, 25 bp, Mus musculus
gaagatctggctctttttattgaag

SEQ ID NO: 633171 - DNA, 25 bp, Mus musculus
gaagatctggctgtttttattgaag

SEQ ID NO: 633172 - DNA, 25 bp, Mus musculus
gaagatctggttagacaagtttaaa

SEQ ID NO: 633173 - DNA, 25 bp, Mus musculus
gaagatctggtttgacaagtttaaa

SEQ ID NO: 633174 - DNA, 25 bp, Mus musculus
gaagatctgtacctgtgcacagtga

SEQ ID NO: 633175 - DNA, 25 bp, Mus musculus
gaagatctgtacgtgtgcacagtga

SEQ ID NO: 633176 - DNA, 25 bp, Mus musculus
gaagatcttagacgatggtttattc

SEQ ID NO: 633177 - DNA, 25 bp, Mus musculus
gaagatcttagaggatggtttattc

SEQ ID NO: 633178 - DNA, 25 bp, Mus musculus
gaagatcttcccatactgaattcat

SEQ ID NO: 633179 - DNA, 25 bp, Mus musculus
gaagatcttcccattaagaaaggag

SEQ ID NO: 633180 - DNA, 25 bp, Mus musculus
gaagatcttcccttactgaattcat

SEQ ID NO: 633181 - DNA, 25 bp, Mus musculus
gaagatcttccctttaagaaaggag

SEQ ID NO: 633182 - DNA, 25 bp, Mus musculus
gaagatcttctgagtcctccccagg

SEQ ID NO: 633183 - DNA, 25 bp, Mus musculus
gaagatcttctgtgtcctccccagg

SEQ ID NO: 633184 - DNA, 25 bp, Mus musculus
gaagatcttgaaccttactgctgat

SEQ ID NO: 633185 - DNA, 25 bp, Mus musculus
gaagatcttgaagcttactgctgat

SEQ ID NO: 633186 - DNA, 25 bp, Mus musculus
gaagatgaacagatgtgggcctcgc

SEQ ID NO: 633187 - DNA, 25 bp, Mus musculus
gaagatgaacagttgtgggcctcgc

SEQ ID NO: 633188 - DNA, 25 bp, Mus musculus
gaagatgaagaacctgaagtgcaag

SEQ ID NO: 633189 - DNA, 25 bp, Mus musculus
gaagatgaagaagctgaagtgcaag

SEQ ID NO: 633190 - DNA, 25 bp, Mus musculus
gaagatgaagtaagatgaaagtgac

SEQ ID NO: 633191 - DNA, 25 bp, Mus musculus
gaagatgaagtatgatgaaagtgac

SEQ ID NO: 633192 - DNA, 25 bp, Mus musculus
gaagatgaatatagagcccatcata

SEQ ID NO: 633193 - DNA, 25 bp, Mus musculus
gaagatgaatattgagcccatcata

SEQ ID NO: 633194 - DNA, 25 bp, Mus musculus
gaagatgaatgtagactcccaggag

SEQ ID NO: 633195 - DNA, 25 bp, Mus musculus
gaagatgaatgttgactcccaggag

SEQ ID NO: 633196 - DNA, 25 bp, Mus musculus
gaagatgacaaacagtgacgatgat

SEQ ID NO: 633197 - DNA, 25 bp, Mus musculus
gaagatgacaaagagtgacgatgat

SEQ ID NO: 633198 - DNA, 25 bp, Mus musculus
gaagatgacactcctggaaccagga

SEQ ID NO: 633199 - DNA, 25 bp, Mus musculus
gaagatgacactgctggaaccagga

SEQ ID NO: 633200 - DNA, 25 bp, Mus musculus
gaagatgacagacttctagcggccc

SEQ ID NO: 633201 - DNA, 25 bp, Mus musculus
gaagatgacagagttctagcggccc

SEQ ID NO: 633202 - DNA, 25 bp, Mus musculus
gaagatgaccgtcttgcaatccatg

SEQ ID NO: 633203 - DNA, 25 bp, Mus musculus
gaagatgaccgtgttgcaatccatg

SEQ ID NO: 633204 - DNA, 25 bp, Mus musculus
gaagatgacctcagtcggcgggcgc

SEQ ID NO: 633205 - DNA, 25 bp, Mus musculus
gaagatgacctctgtcggcgggcgc

SEQ ID NO: 633206 - DNA, 25 bp, Mus musculus
gaagatgaccttctatggccatttt

SEQ ID NO: 633207 - DNA, 25 bp, Mus musculus
gaagatgaccttgtatggccatttt

SEQ ID NO: 633208 - DNA, 25 bp, Mus musculus
gaagatgacgaccacgaacaagagg

SEQ ID NO: 633209 - DNA, 25 bp, Mus musculus
gaagatgacgacgacgaacaagagg

SEQ ID NO: 633210 - DNA, 25 bp, Mus musculus
gaagatgacgccatgctgaccatca

SEQ ID NO: 633211 - DNA, 25 bp, Mus musculus
gaagatgacgccttgctgaccatca

SEQ ID NO: 633212 - DNA, 25 bp, Mus musculus
gaagatgacttgctatcggccttag

SEQ ID NO: 633213 - DNA, 25 bp, Mus musculus
gaagatgacttggtatcggccttag

SEQ ID NO: 633214 - DNA, 25 bp, Mus musculus
gaagatgagacaacaccagagatgg

SEQ ID NO: 633215 - DNA, 25 bp, Mus musculus
gaagatgagacatcaccagagatgg

SEQ ID NO: 633216 - DNA, 25 bp, Mus musculus
gaagatgagaccattgatgctgagg

SEQ ID NO: 633217 - DNA, 25 bp, Mus musculus
gaagatgagacctttgatgctgagg

SEQ ID NO: 633218 - DNA, 25 bp, Mus musculus
gaagatgagatcattaacaagcccg

SEQ ID NO: 633219 - DNA, 25 bp, Mus musculus
gaagatgagatctttaacaagcccg

SEQ ID NO: 633220 - DNA, 25 bp, Mus musculus
gaagatgaggtcatccccgacatcg

SEQ ID NO: 633221 - DNA, 25 bp, Mus musculus
gaagatgaggtcttccccgacatcg

SEQ ID NO: 633222 - DNA, 25 bp, Mus musculus
gaagatgagtttaccccgctcaaga

SEQ ID NO: 633223 - DNA, 25 bp, Mus musculus
gaagatgagttttccccgctcaaga

SEQ ID NO: 633224 - DNA, 25 bp, Mus musculus
gaagatgatagaatgtatccagcag

SEQ ID NO: 633225 - DNA, 25 bp, Mus musculus
gaagatgatagattgtatccagcag

SEQ ID NO: 633226 - DNA, 25 bp, Mus musculus
gaagatgatattctgaccccaggta

SEQ ID NO: 633227 - DNA, 25 bp, Mus musculus
gaagatgatattgtgaccccaggta

SEQ ID NO: 633228 - DNA, 25 bp, Mus musculus
gaagatgatcctcagtacttgcgac

SEQ ID NO: 633229 - DNA, 25 bp, Mus musculus
gaagatgatcctgagtacttgcgac

SEQ ID NO: 633230 - DNA, 25 bp, Mus musculus
gaagatgatctactgctcccactgc

SEQ ID NO: 633231 - DNA, 25 bp, Mus musculus
gaagatgatctagtgctcccactgc

SEQ ID NO: 633232 - DNA, 25 bp, Mus musculus
gaagatgatgaaccacctgtggatt

SEQ ID NO: 633233 - DNA, 25 bp, Mus musculus
gaagatgatgaagcacctgtggatt

SEQ ID NO: 633234 - DNA, 25 bp, Mus musculus
gaagatgatggcattaagaaggccc

SEQ ID NO: 633235 - DNA, 25 bp, Mus musculus
gaagatgatggctttaagaaggccc

SEQ ID NO: 633236 - DNA, 25 bp, Mus musculus
gaagatgatgggaatgacctcacac

SEQ ID NO: 633237 - DNA, 25 bp, Mus musculus
gaagatgatgggtatgacctcacac

SEQ ID NO: 633238 - DNA, 25 bp, Mus musculus
gaagatgatgttcacgtcactatag

SEQ ID NO: 633239 - DNA, 25 bp, Mus musculus
gaagatgatgttgacgtcactatag

SEQ ID NO: 633240 - DNA, 25 bp, Mus musculus
gaagatgattggcaaacataagaac

SEQ ID NO: 633241 - DNA, 25 bp, Mus musculus
gaagatgattgggaaacataagaac

SEQ ID NO: 633242 - DNA, 25 bp, Mus musculus
gaagatgcaatcaataggtcctggg

SEQ ID NO: 633243 - DNA, 25 bp, Mus musculus
gaagatgcaatctataggtcctggg

SEQ ID NO: 633244 - DNA, 25 bp, Mus musculus
gaagatgcaatgaagaacattcaga

SEQ ID NO: 633245 - DNA, 25 bp, Mus musculus
gaagatgcaatgtagaacattcaga

SEQ ID NO: 633246 - DNA, 25 bp, Mus musculus
gaagatgcacctcctgtcatctctg

SEQ ID NO: 633247 - DNA, 25 bp, Mus musculus
gaagatgcacctgctgtcatctctg

SEQ ID NO: 633248 - DNA, 25 bp, Mus musculus
gaagatgcacttcgtatctgtatac

SEQ ID NO: 633249 - DNA, 25 bp, Mus musculus
gaagatgcacttggtatctgtatac

SEQ ID NO: 633250 - DNA, 25 bp, Mus musculus
gaagatgcagaacgttccccagtgg

SEQ ID NO: 633251 - DNA, 25 bp, Mus musculus
gaagatgcagaaggttccccagtgg

SEQ ID NO: 633252 - DNA, 25 bp, Mus musculus
gaagatgcagccaaccgaaggctgg

SEQ ID NO: 633253 - DNA, 25 bp, Mus musculus
gaagatgcagcctaccgaaggctgg

SEQ ID NO: 633254 - DNA, 25 bp, Mus musculus
gaagatgcagtcctacaagatccct

SEQ ID NO: 633255 - DNA, 25 bp, Mus musculus
gaagatgcagtcgtacaagatccct

SEQ ID NO: 633256 - DNA, 25 bp, Mus musculus
gaagatgccaaaacccttacctgtg

SEQ ID NO: 633257 - DNA, 25 bp, Mus musculus
gaagatgccaaatcccttacctgtg

SEQ ID NO: 633258 - DNA, 25 bp, Mus musculus
gaagatgccagaaagtaactccgca

SEQ ID NO: 633259 - DNA, 25 bp, Mus musculus
gaagatgccagatagtaactccgca

SEQ ID NO: 633260 - DNA, 25 bp, Mus musculus
gaagatgccattaattggacgtaag

SEQ ID NO: 633261 - DNA, 25 bp, Mus musculus
gaagatgccatttattggacgtaag

SEQ ID NO: 633262 - DNA, 25 bp, Mus musculus
gaagatgccctaccagatcctgcct

SEQ ID NO: 633263 - DNA, 25 bp, Mus musculus
gaagatgccctagcagatcctgcct

SEQ ID NO: 633264 - DNA, 25 bp, Mus musculus
gaagatgcccttctactacagccac

SEQ ID NO: 633265 - DNA, 25 bp, Mus musculus
gaagatgcccttgtactacagccac

SEQ ID NO: 633266 - DNA, 25 bp, Mus musculus
gaagatgccgctacaacatggagct

SEQ ID NO: 633267 - DNA, 25 bp, Mus musculus
gaagatgccgcttcaacatggagct

SEQ ID NO: 633268 - DNA, 25 bp, Mus musculus
gaagatgccgttcgaactgacccag

SEQ ID NO: 633269 - DNA, 25 bp, Mus musculus
gaagatgccgttggaactgacccag

SEQ ID NO: 633270 - DNA, 25 bp, Mus musculus
gaagatgcctcaagttcttgcagaa

SEQ ID NO: 633271 - DNA, 25 bp, Mus musculus
gaagatgcctcatgttcttgcagaa

SEQ ID NO: 633272 - DNA, 25 bp, Mus musculus
gaagatgcgattattagttgccaag

SEQ ID NO: 633273 - DNA, 25 bp, Mus musculus
gaagatgcgatttttagttgccaag

SEQ ID NO: 633274 - DNA, 25 bp, Mus musculus
gaagatgctcgtattggactcagat

SEQ ID NO: 633275 - DNA, 25 bp, Mus musculus
gaagatgctcgttttggactcagat

SEQ ID NO: 633276 - DNA, 25 bp, Mus musculus
gaagatgctgaaccatgcacccagt

SEQ ID NO: 633277 - DNA, 25 bp, Mus musculus
gaagatgctgaagcatgcacccagt

SEQ ID NO: 633278 - DNA, 25 bp, Mus musculus
gaagatgctgatcaagaagtgtctc

SEQ ID NO: 633279 - DNA, 25 bp, Mus musculus
gaagatgctgatgaagaagtgtctc

SEQ ID NO: 633280 - DNA, 25 bp, Mus musculus
gaagatgctgccctttaccggtacc

SEQ ID NO: 633281 - DNA, 25 bp, Mus musculus
gaagatgctgccgtttaccggtacc

SEQ ID NO: 633282 - DNA, 25 bp, Mus musculus
gaagatgcttgcaaacaccaggagg

SEQ ID NO: 633283 - DNA, 25 bp, Mus musculus
gaagatgcttgctaacaccaggagg

SEQ ID NO: 633284 - DNA, 25 bp, Mus musculus
gaagatggaataattcaggccaaac

SEQ ID NO: 633285 - DNA, 25 bp, Mus musculus
gaagatggaatatttcaggccaaac

SEQ ID NO: 633286 - DNA, 25 bp, Mus musculus
gaagatggagaaccggctccacgct

SEQ ID NO: 633287 - DNA, 25 bp, Mus musculus
gaagatggagaagcggctccacgct

SEQ ID NO: 633288 - DNA, 25 bp, Mus musculus
gaagatggagccacgcttgctgatg

SEQ ID NO: 633289 - DNA, 25 bp, Mus musculus
gaagatggagcctcgcttgctgatg

SEQ ID NO: 633290 - DNA, 25 bp, Mus musculus
gaagatggaggaaatcaaccacctg

SEQ ID NO: 633291 - DNA, 25 bp, Mus musculus
gaagatggaggatatcaaccacctg

SEQ ID NO: 633292 - DNA, 25 bp, Mus musculus
gaagatggaggtcttcaggttccaa

SEQ ID NO: 633293 - DNA, 25 bp, Mus musculus
gaagatggaggtgttcaggttccaa

SEQ ID NO: 633294 - DNA, 25 bp, Mus musculus
gaagatggagttagagttcctctat

SEQ ID NO: 633295 - DNA, 25 bp, Mus musculus
gaagatggagtttgagttcctctat

SEQ ID NO: 633296 - DNA, 25 bp, Mus musculus
gaagatggcacaattccaggactga

SEQ ID NO: 633297 - DNA, 25 bp, Mus musculus
gaagatggcacatttccaggactga

SEQ ID NO: 633298 - DNA, 25 bp, Mus musculus
gaagatggcaccaacacaggtttca

SEQ ID NO: 633299 - DNA, 25 bp, Mus musculus
gaagatggcacctacacaggtttca

SEQ ID NO: 633300 - DNA, 25 bp, Mus musculus
gaagatggcactcgtctctgccatg

SEQ ID NO: 633301 - DNA, 25 bp, Mus musculus
gaagatggcactggtctctgccatg

SEQ ID NO: 633302 - DNA, 25 bp, Mus musculus
gaagatggcattactgctgttaatg

SEQ ID NO: 633303 - DNA, 25 bp, Mus musculus
gaagatggcatttctgctgttaatg

SEQ ID NO: 633304 - DNA, 25 bp, Mus musculus
gaagatggcctcctgttccgtgtcc

SEQ ID NO: 633305 - DNA, 25 bp, Mus musculus
gaagatggcctcgtgttccgtgtcc

SEQ ID NO: 633306 - DNA, 25 bp, Mus musculus
gaagatggcttactatggccagcaa

SEQ ID NO: 633307 - DNA, 25 bp, Mus musculus
gaagatggcttagtatggccagcaa

SEQ ID NO: 633308 - DNA, 25 bp, Mus musculus
gaagatggctttccttatgtgccac

SEQ ID NO: 633309 - DNA, 25 bp, Mus musculus
gaagatggctttgcttatgtgccac

SEQ ID NO: 633310 - DNA, 25 bp, Mus musculus
gaagatggtacgctatccaggccag

SEQ ID NO: 633311 - DNA, 25 bp, Mus musculus
gaagatggtacggtatccaggccag

SEQ ID NO: 633312 - DNA, 25 bp, Mus musculus
gaagatggtcctcctcgaccttccg

SEQ ID NO: 633313 - DNA, 25 bp, Mus musculus
gaagatggtcctgctcgaccttccg

SEQ ID NO: 633314 - DNA, 25 bp, Mus musculus
gaagatggtggtcttatgatcatag

SEQ ID NO: 633315 - DNA, 25 bp, Mus musculus
gaagatggtggtgttatgatcatag

SEQ ID NO: 633316 - DNA, 25 bp, Mus musculus
gaagatggttatataaaccagctgc

SEQ ID NO: 633317 - DNA, 25 bp, Mus musculus
gaagatggttatttaaaccagctgc

SEQ ID NO: 633318 - DNA, 25 bp, Mus musculus
gaagatgtactcattcatatcctga

SEQ ID NO: 633319 - DNA, 25 bp, Mus musculus
gaagatgtactctttcatatcctga

SEQ ID NO: 633320 - DNA, 25 bp, Mus musculus
gaagatgtagaccagtgctgtcaag

SEQ ID NO: 633321 - DNA, 25 bp, Mus musculus
gaagatgtagacgagtgctgtcaag

SEQ ID NO: 633322 - DNA, 25 bp, Mus musculus
gaagatgtagttactgagtccagtc

SEQ ID NO: 633323 - DNA, 25 bp, Mus musculus
gaagatgtagtttctgagtccagtc

SEQ ID NO: 633324 - DNA, 25 bp, Mus musculus
gaagatgtatatctgacatggagtc

SEQ ID NO: 633325 - DNA, 25 bp, Mus musculus
gaagatgtatatgtgacatggagtc

SEQ ID NO: 633326 - DNA, 25 bp, Mus musculus
gaagatgtatcaatgcacggccaag

SEQ ID NO: 633327 - DNA, 25 bp, Mus musculus
gaagatgtatcattgcacggccaag

SEQ ID NO: 633328 - DNA, 25 bp, Mus musculus
gaagatgtcctcacgccccatttca

SEQ ID NO: 633329 - DNA, 25 bp, Mus musculus
gaagatgtcctctcgccccatttca

SEQ ID NO: 633330 - DNA, 25 bp, Mus musculus
gaagatgtcctgaagttggcacaag

SEQ ID NO: 633331 - DNA, 25 bp, Mus musculus
gaagatgtcctgtagttggcacaag

SEQ ID NO: 633332 - DNA, 25 bp, Mus musculus
gaagatgtctatctacaacctgaga

SEQ ID NO: 633333 - DNA, 25 bp, Mus musculus
gaagatgtctatgtacaacctgaga

SEQ ID NO: 633334 - DNA, 25 bp, Mus musculus
gaagatgtctggaacaacacttgag

SEQ ID NO: 633335 - DNA, 25 bp, Mus musculus
gaagatgtctggaacgattgtaaaa

SEQ ID NO: 633336 - DNA, 25 bp, Mus musculus
gaagatgtctggtacaacacttgag

SEQ ID NO: 633337 - DNA, 25 bp, Mus musculus
gaagatgtctggtacgattgtaaaa

SEQ ID NO: 633338 - DNA, 25 bp, Mus musculus
gaagatgtctgtaatcctcggcatc

SEQ ID NO: 633339 - DNA, 25 bp, Mus musculus
gaagatgtctgtcggagtgactcaa

SEQ ID NO: 633340 - DNA, 25 bp, Mus musculus
gaagatgtctgtgggagtgactcaa

SEQ ID NO: 633341 - DNA, 25 bp, Mus musculus
gaagatgtctgttatcctcggcatc

SEQ ID NO: 633342 - DNA, 25 bp, Mus musculus
gaagatgtcttgaaaatattcagca

SEQ ID NO: 633343 - DNA, 25 bp, Mus musculus
gaagatgtcttgtaaatattcagca

SEQ ID NO: 633344 - DNA, 25 bp, Mus musculus
gaagatgtgaagaaatggatcgaaa

SEQ ID NO: 633345 - DNA, 25 bp, Mus musculus
gaagatgtgaagtaatggatcgaaa

SEQ ID NO: 633346 - DNA, 25 bp, Mus musculus
gaagatgtgatgatctctctgaaga

SEQ ID NO: 633347 - DNA, 25 bp, Mus musculus
gaagatgtgatgttctctctgaaga

SEQ ID NO: 633348 - DNA, 25 bp, Mus musculus
gaagatgtgcggatcgaagttgatt

SEQ ID NO: 633349 - DNA, 25 bp, Mus musculus
gaagatgtgcggttcgaagttgatt

SEQ ID NO: 633350 - DNA, 25 bp, Mus musculus
gaagatgttaaacggaaaagatgac

SEQ ID NO: 633351 - DNA, 25 bp, Mus musculus
gaagatgttaaagggaaaagatgac

SEQ ID NO: 633352 - DNA, 25 bp, Mus musculus
gaagatgttcgccacttcgccaagg

SEQ ID NO: 633353 - DNA, 25 bp, Mus musculus
gaagatgttcgcgacttcgccaagg

SEQ ID NO: 633354 - DNA, 25 bp, Mus musculus
gaagatgttcttcaagcaaatatag

SEQ ID NO: 633355 - DNA, 25 bp, Mus musculus
gaagatgttcttgaagcaaatatag

SEQ ID NO: 633356 - DNA, 25 bp, Mus musculus
gaagatgttggcattaactacaggg

SEQ ID NO: 633357 - DNA, 25 bp, Mus musculus
gaagatgttggctttaactacaggg

SEQ ID NO: 633358 - DNA, 25 bp, Mus musculus
gaagatgtttggatccttaccgagg

SEQ ID NO: 633359 - DNA, 25 bp, Mus musculus
gaagatgtttggttccttaccgagg

SEQ ID NO: 633360 - DNA, 25 bp, Mus musculus
gaagattaagaactcacccttgacc

SEQ ID NO: 633361 - DNA, 25 bp, Mus musculus
gaagattaagaagtcacccttgacc

SEQ ID NO: 633362 - DNA, 25 bp, Mus musculus
gaagattatgtcagtcattcgggag

SEQ ID NO: 633363 - DNA, 25 bp, Mus musculus
gaagattatgtctgtcattcgggag

SEQ ID NO: 633364 - DNA, 25 bp, Mus musculus
gaagattcacaaatggctctcacag

SEQ ID NO: 633365 - DNA, 25 bp, Mus musculus
gaagattcacaattggctctcacag

SEQ ID NO: 633366 - DNA, 25 bp, Mus musculus
gaagattcacgtccggaagctgaag

SEQ ID NO: 633367 - DNA, 25 bp, Mus musculus
gaagattcacgtgcggaagctgaag

SEQ ID NO: 633368 - DNA, 25 bp, Mus musculus
gaagattcaggccttatccgtagaa

SEQ ID NO: 633369 - DNA, 25 bp, Mus musculus
gaagattcaggcgttatccgtagaa

SEQ ID NO: 633370 - DNA, 25 bp, Mus musculus
gaagattccaacaactgagttttta

SEQ ID NO: 633371 - DNA, 25 bp, Mus musculus
gaagattccaactactgagttttta

SEQ ID NO: 633372 - DNA, 25 bp, Mus musculus
gaagattccagaaatctcaagtatc

SEQ ID NO: 633373 - DNA, 25 bp, Mus musculus
gaagattccagacctgtggaaacct

SEQ ID NO: 633374 - DNA, 25 bp, Mus musculus
gaagattccagagctgtggaaacct

SEQ ID NO: 633375 - DNA, 25 bp, Mus musculus
gaagattccagatatctcaagtatc

SEQ ID NO: 633376 - DNA, 25 bp, Mus musculus
gaagattccgccactaactgtagat

SEQ ID NO: 633377 - DNA, 25 bp, Mus musculus
gaagattccgcctctaactgtagat

SEQ ID NO: 633378 - DNA, 25 bp, Mus musculus
gaagattccgctcgtactgagccga

SEQ ID NO: 633379 - DNA, 25 bp, Mus musculus
gaagattccgctggtactgagccga

SEQ ID NO: 633380 - DNA, 25 bp, Mus musculus
gaagattccttgcaaagccagtgca

SEQ ID NO: 633381 - DNA, 25 bp, Mus musculus
gaagattccttggaaagccagtgca

SEQ ID NO: 633382 - DNA, 25 bp, Mus musculus
gaagattcgttcagacctgactgct

SEQ ID NO: 633383 - DNA, 25 bp, Mus musculus
gaagattcgttctgacctgactgct

SEQ ID NO: 633384 - DNA, 25 bp, Mus musculus
gaagattctaaacgaggacatcctt

SEQ ID NO: 633385 - DNA, 25 bp, Mus musculus
gaagattctaaaggaggacatcctt

SEQ ID NO: 633386 - DNA, 25 bp, Mus musculus
gaagattctccaactcctgaaggac

SEQ ID NO: 633387 - DNA, 25 bp, Mus musculus
gaagattctccatctcctgaaggac

SEQ ID NO: 633388 - DNA, 25 bp, Mus musculus
gaagattctggtagccgacacagtg

SEQ ID NO: 633389 - DNA, 25 bp, Mus musculus
gaagattctggtcactggatcctct

SEQ ID NO: 633390 - DNA, 25 bp, Mus musculus
gaagattctggtgactggatcctct

SEQ ID NO: 633391 - DNA, 25 bp, Mus musculus
gaagattctggttgccgacacagtg

SEQ ID NO: 633392 - DNA, 25 bp, Mus musculus
gaagattgaaaaagatgttggtggc

SEQ ID NO: 633393 - DNA, 25 bp, Mus musculus
gaagattgaaaatgatgttggtggc

SEQ ID NO: 633394 - DNA, 25 bp, Mus musculus
gaagattgaatcagttctaaagcct

SEQ ID NO: 633395 - DNA, 25 bp, Mus musculus
gaagattgaatctgttctaaagcct

SEQ ID NO: 633396 - DNA, 25 bp, Mus musculus
gaagattgacagctataacagcagg

SEQ ID NO: 633397 - DNA, 25 bp, Mus musculus
gaagattgacaggtataacagcagg

SEQ ID NO: 633398 - DNA, 25 bp, Mus musculus
gaagattgacgccattctcagcagc

SEQ ID NO: 633399 - DNA, 25 bp, Mus musculus
gaagattgacgcgattctcagcagc

SEQ ID NO: 633400 - DNA, 25 bp, Mus musculus
gaagattgcagaaaatcaacgtatc

SEQ ID NO: 633401 - DNA, 25 bp, Mus musculus
gaagattgcagataatcaacgtatc

SEQ ID NO: 633402 - DNA, 25 bp, Mus musculus
gaagattgcattcccgtgttctaaa

SEQ ID NO: 633403 - DNA, 25 bp, Mus musculus
gaagattgcattgccgtgttctaaa

SEQ ID NO: 633404 - DNA, 25 bp, Mus musculus
gaagattgccaacatcacagacgtg

SEQ ID NO: 633405 - DNA, 25 bp, Mus musculus
gaagattgccaagatcacagacgtg

SEQ ID NO: 633406 - DNA, 25 bp, Mus musculus
gaagattgctccagagatgccagcg

SEQ ID NO: 633407 - DNA, 25 bp, Mus musculus
gaagattgctcctgagatgccagcg

SEQ ID NO: 633408 - DNA, 25 bp, Mus musculus
gaagattgctgaatttggacttgca

SEQ ID NO: 633409 - DNA, 25 bp, Mus musculus
gaagattgctgattttggacttgca

SEQ ID NO: 633410 - DNA, 25 bp, Mus musculus
gaagattgctttcgagggagcaaat

SEQ ID NO: 633411 - DNA, 25 bp, Mus musculus
gaagattgctttggagggagcaaat

SEQ ID NO: 633412 - DNA, 25 bp, Mus musculus
gaagattggcagctctaagactcca

SEQ ID NO: 633413 - DNA, 25 bp, Mus musculus
gaagattggcaggtctaagactcca

SEQ ID NO: 633414 - DNA, 25 bp, Mus musculus
gaagattggccgaggacagttcagt

SEQ ID NO: 633415 - DNA, 25 bp, Mus musculus
gaagattggccgtggacagttcagt

SEQ ID NO: 633416 - DNA, 25 bp, Mus musculus
gaagattgggagcaaaatatgtgcc

SEQ ID NO: 633417 - DNA, 25 bp, Mus musculus
gaagattgggaggaaaatatgtgcc

SEQ ID NO: 633418 - DNA, 25 bp, Mus musculus
gaagattgggatctagccattcaga

SEQ ID NO: 633419 - DNA, 25 bp, Mus musculus
gaagattgggatgtagccattcaga

SEQ ID NO: 633420 - DNA, 25 bp, Mus musculus
gaagattgggcactccccagtgaga

SEQ ID NO: 633421 - DNA, 25 bp, Mus musculus
gaagattgggcagtccccagtgaga

SEQ ID NO: 633422 - DNA, 25 bp, Mus musculus
gaagattgtgaaatacctttaggct

SEQ ID NO: 633423 - DNA, 25 bp, Mus musculus
gaagattgtgaattacctttaggct

SEQ ID NO: 633424 - DNA, 25 bp, Mus musculus
gaagattgtggaagagtctaagaac

SEQ ID NO: 633425 - DNA, 25 bp, Mus musculus
gaagattgtggatgagtctaagaac

SEQ ID NO: 633426 - DNA, 25 bp, Mus musculus
gaagattgttggataaaagcaagac

SEQ ID NO: 633427 - DNA, 25 bp, Mus musculus
gaagattgttggttaaaagcaagac

SEQ ID NO: 633428 - DNA, 25 bp, Mus musculus
gaagatttaacaaaaacgaccgcat

SEQ ID NO: 633429 - DNA, 25 bp, Mus musculus
gaagatttaacataaacgaccgcat

SEQ ID NO: 633430 - DNA, 25 bp, Mus musculus
gaagatttagaacgagtagtccaga

SEQ ID NO: 633431 - DNA, 25 bp, Mus musculus
gaagatttagaaggagtagtccaga

SEQ ID NO: 633432 - DNA, 25 bp, Mus musculus
gaagatttcactctctaccttggag

SEQ ID NO: 633433 - DNA, 25 bp, Mus musculus
gaagatttcactgtctaccttggag

SEQ ID NO: 633434 - DNA, 25 bp, Mus musculus
gaagatttccttcaactgaatgcag

SEQ ID NO: 633435 - DNA, 25 bp, Mus musculus
gaagatttccttgaactgaatgcag

SEQ ID NO: 633436 - DNA, 25 bp, Mus musculus
gaagatttctccactccagtgaagc

SEQ ID NO: 633437 - DNA, 25 bp, Mus musculus
gaagatttctcccaacgactcaaga

SEQ ID NO: 633438 - DNA, 25 bp, Mus musculus
gaagatttctccgaacgactcaaga

SEQ ID NO: 633439 - DNA, 25 bp, Mus musculus
gaagatttctcctctccagtgaagc

SEQ ID NO: 633440 - DNA, 25 bp, Mus musculus
gaagatttgagtcagtttttccatc

SEQ ID NO: 633441 - DNA, 25 bp, Mus musculus
gaagatttgagtgagtttttccatc

SEQ ID NO: 633442 - DNA, 25 bp, Mus musculus
gaagatttgcggagttttatcagct

SEQ ID NO: 633443 - DNA, 25 bp, Mus musculus
gaagatttgcggtgttttatcagct

SEQ ID NO: 633444 - DNA, 25 bp, Mus musculus
gaagattttaccctctttacattgg

SEQ ID NO: 633445 - DNA, 25 bp, Mus musculus
gaagattttaccgtctttacattgg

SEQ ID NO: 633446 - DNA, 25 bp, Mus musculus
gaagattttagcagactccattaat

SEQ ID NO: 633447 - DNA, 25 bp, Mus musculus
gaagattttagctgactccattaat

SEQ ID NO: 633448 - DNA, 25 bp, Mus musculus
gaagattttattcaagttcccagga

SEQ ID NO: 633449 - DNA, 25 bp, Mus musculus
gaagattttattgaagttcccagga

SEQ ID NO: 633450 - DNA, 25 bp, Mus musculus
gaagattttgagactttaaaagtca

SEQ ID NO: 633451 - DNA, 25 bp, Mus musculus
gaagattttgagtctttaaaagtca

SEQ ID NO: 633452 - DNA, 25 bp, Mus musculus
gaagattttgcacctccccaggtca

SEQ ID NO: 633453 - DNA, 25 bp, Mus musculus
gaagattttgcagctccccaggtca

SEQ ID NO: 633454 - DNA, 25 bp, Mus musculus
gaagatttttacctttgcagagaag

SEQ ID NO: 633455 - DNA, 25 bp, Mus musculus
gaagatttttacgtttgcagagaag

SEQ ID NO: 633456 - DNA, 25 bp, Mus musculus
gaagcaaaactgcttgcaagcacct

SEQ ID NO: 633457 - DNA, 25 bp, Mus musculus
gaagcaaaactggttgcaagcacct

SEQ ID NO: 633458 - DNA, 25 bp, Mus musculus
gaagcaaaaggccaacctcaaccca

SEQ ID NO: 633459 - DNA, 25 bp, Mus musculus
gaagcaaaaggcgaacctcaaccca

SEQ ID NO: 633460 - DNA, 25 bp, Mus musculus
gaagcaaaagtacaattcccggaag

SEQ ID NO: 633461 - DNA, 25 bp, Mus musculus
gaagcaaaagtagaattcccggaag

SEQ ID NO: 633462 - DNA, 25 bp, Mus musculus
gaagcaaacagaaaattgtggaggt

SEQ ID NO: 633463 - DNA, 25 bp, Mus musculus
gaagcaaacagataattgtggaggt

SEQ ID NO: 633464 - DNA, 25 bp, Mus musculus
gaagcaaagatacaaacagatcccc

SEQ ID NO: 633465 - DNA, 25 bp, Mus musculus
gaagcaaagatagaaacagatcccc

SEQ ID NO: 633466 - DNA, 25 bp, Mus musculus
gaagcaaagtggcttgccagatcct

SEQ ID NO: 633467 - DNA, 25 bp, Mus musculus
gaagcaaagtgggttgccagatcct

SEQ ID NO: 633468 - DNA, 25 bp, Mus musculus
gaagcaaatctcatgcaccttggga

SEQ ID NO: 633469 - DNA, 25 bp, Mus musculus
gaagcaaatctcttgcaccttggga

SEQ ID NO: 633470 - DNA, 25 bp, Mus musculus
gaagcaaatcttatgcctgggctcc

SEQ ID NO: 633471 - DNA, 25 bp, Mus musculus
gaagcaaatcttttgcctgggctcc

SEQ ID NO: 633472 - DNA, 25 bp, Mus musculus
gaagcaaatggccagccacctgtgc

SEQ ID NO: 633473 - DNA, 25 bp, Mus musculus
gaagcaaatggcgagccacctgtgc

SEQ ID NO: 633474 - DNA, 25 bp, Mus musculus
gaagcaaatggtagccaatgtggag

SEQ ID NO: 633475 - DNA, 25 bp, Mus musculus
gaagcaaatggtctccacgtctgaa

SEQ ID NO: 633476 - DNA, 25 bp, Mus musculus
gaagcaaatggtgtccacgtctgaa

SEQ ID NO: 633477 - DNA, 25 bp, Mus musculus
gaagcaaatggttgccaatgtggag

SEQ ID NO: 633478 - DNA, 25 bp, Mus musculus
gaagcaacagctagctgcgtaccag

SEQ ID NO: 633479 - DNA, 25 bp, Mus musculus
gaagcaacagcttgctgcgtaccag

SEQ ID NO: 633480 - DNA, 25 bp, Mus musculus
gaagcaacatcacctctggatacag

SEQ ID NO: 633481 - DNA, 25 bp, Mus musculus
gaagcaacatcagctctggatacag

SEQ ID NO: 633482 - DNA, 25 bp, Mus musculus
gaagcaaccctcaagcacgtgatgg

SEQ ID NO: 633483 - DNA, 25 bp, Mus musculus
gaagcaaccctctagcacgtgatgg

SEQ ID NO: 633484 - DNA, 25 bp, Mus musculus
gaagcaactcacacaaccagaaacc

SEQ ID NO: 633485 - DNA, 25 bp, Mus musculus
gaagcaactcactcaaccagaaacc

SEQ ID NO: 633486 - DNA, 25 bp, Mus musculus
gaagcaactccgaagctcgagccga

SEQ ID NO: 633487 - DNA, 25 bp, Mus musculus
gaagcaactccgtagctcgagccga

SEQ ID NO: 633488 - DNA, 25 bp, Mus musculus
gaagcaacttctccaacagacaaat

SEQ ID NO: 633489 - DNA, 25 bp, Mus musculus
gaagcaacttctgcaacagacaaat

SEQ ID NO: 633490 - DNA, 25 bp, Mus musculus
gaagcaagaaaaccggaatacatat

SEQ ID NO: 633491 - DNA, 25 bp, Mus musculus
gaagcaagaaaagcggaatacatat

SEQ ID NO: 633492 - DNA, 25 bp, Mus musculus
gaagcaagaagtaatcagcaccagc

SEQ ID NO: 633493 - DNA, 25 bp, Mus musculus
gaagcaagaagttatcagcaccagc

SEQ ID NO: 633494 - DNA, 25 bp, Mus musculus
gaagcaagaattcagtgacccgtcg

SEQ ID NO: 633495 - DNA, 25 bp, Mus musculus
gaagcaagaattgagtgacccgtcg

SEQ ID NO: 633496 - DNA, 25 bp, Mus musculus
gaagcaagaccgcaaactcacttgg

SEQ ID NO: 633497 - DNA, 25 bp, Mus musculus
gaagcaagaccggaaactcacttgg

SEQ ID NO: 633498 - DNA, 25 bp, Mus musculus
gaagcaagactgaccagactctcgg

SEQ ID NO: 633499 - DNA, 25 bp, Mus musculus
gaagcaagactgtccagactctcgg

SEQ ID NO: 633500 - DNA, 25 bp, Mus musculus
gaagcaagacttaccccaagagggt

SEQ ID NO: 633501 - DNA, 25 bp, Mus musculus
gaagcaagactttccccaagagggt

SEQ ID NO: 633502 - DNA, 25 bp, Mus musculus
gaagcaagagcaatggctaaagaga

SEQ ID NO: 633503 - DNA, 25 bp, Mus musculus
gaagcaagagcattggctaaagaga

SEQ ID NO: 633504 - DNA, 25 bp, Mus musculus
gaagcaagagtactgtccagccctg

SEQ ID NO: 633505 - DNA, 25 bp, Mus musculus
gaagcaagagtagtgtccagccctg

SEQ ID NO: 633506 - DNA, 25 bp, Mus musculus
gaagcaagatagcatcaccagatat

SEQ ID NO: 633507 - DNA, 25 bp, Mus musculus
gaagcaagataggatcaccagatat

SEQ ID NO: 633508 - DNA, 25 bp, Mus musculus
gaagcaagattcattgtcactggga

SEQ ID NO: 633509 - DNA, 25 bp, Mus musculus
gaagcaagattctttgtcactggga

SEQ ID NO: 633510 - DNA, 25 bp, Mus musculus
gaagcaagcctgatgcgccatttcc

SEQ ID NO: 633511 - DNA, 25 bp, Mus musculus
gaagcaagcctgttgcgccatttcc

SEQ ID NO: 633512 - DNA, 25 bp, Mus musculus
gaagcaagccttaatgtccgagctg

SEQ ID NO: 633513 - DNA, 25 bp, Mus musculus
gaagcaagcctttatgtccgagctg

SEQ ID NO: 633514 - DNA, 25 bp, Mus musculus
gaagcaagctttataaggctattgg

SEQ ID NO: 633515 - DNA, 25 bp, Mus musculus
gaagcaagctttttaaggctattgg

SEQ ID NO: 633516 - DNA, 25 bp, Mus musculus
gaagcaagtcggacagtgacaccct

SEQ ID NO: 633517 - DNA, 25 bp, Mus musculus
gaagcaagtcggtcagtgacaccct

SEQ ID NO: 633518 - DNA, 25 bp, Mus musculus
gaagcaagtgaccatcgacccgaat

SEQ ID NO: 633519 - DNA, 25 bp, Mus musculus
gaagcaagtgacgatcgacccgaat

SEQ ID NO: 633520 - DNA, 25 bp, Mus musculus
gaagcaagtgctaaggatagtttca

SEQ ID NO: 633521 - DNA, 25 bp, Mus musculus
gaagcaagtgcttaggatagtttca

SEQ ID NO: 633522 - DNA, 25 bp, Mus musculus
gaagcaagtgtcatacagaactgac

SEQ ID NO: 633523 - DNA, 25 bp, Mus musculus
gaagcaagtgtcttacagaactgac

SEQ ID NO: 633524 - DNA, 25 bp, Mus musculus
gaagcaagttctcaccagtggaagc

SEQ ID NO: 633525 - DNA, 25 bp, Mus musculus
gaagcaagttctgaccagtggaagc

SEQ ID NO: 633526 - DNA, 25 bp, Mus musculus
gaagcaatccgcagcccttcagtta

SEQ ID NO: 633527 - DNA, 25 bp, Mus musculus
gaagcaatccgctgcccttcagtta

SEQ ID NO: 633528 - DNA, 25 bp, Mus musculus
gaagcaatctgtagctccagctgag

SEQ ID NO: 633529 - DNA, 25 bp, Mus musculus
gaagcaatctgttgctccagctgag

SEQ ID NO: 633530 - DNA, 25 bp, Mus musculus
gaagcaatgccaaggtccttctgaa

SEQ ID NO: 633531 - DNA, 25 bp, Mus musculus
gaagcaatgccatggtccttctgaa

SEQ ID NO: 633532 - DNA, 25 bp, Mus musculus
gaagcaatgctgactatcagtacca

SEQ ID NO: 633533 - DNA, 25 bp, Mus musculus
gaagcaatgctgtctatcagtacca

SEQ ID NO: 633534 - DNA, 25 bp, Mus musculus
gaagcaattgaacaacactccgcat

SEQ ID NO: 633535 - DNA, 25 bp, Mus musculus
gaagcaattgaagaacactccgcat

SEQ ID NO: 633536 - DNA, 25 bp, Mus musculus
gaagcacaaaggcacagagcaaggc

SEQ ID NO: 633537 - DNA, 25 bp, Mus musculus
gaagcacaaagggacagagcaaggc

SEQ ID NO: 633538 - DNA, 25 bp, Mus musculus
gaagcacaaattcatcacacgatac

SEQ ID NO: 633539 - DNA, 25 bp, Mus musculus
gaagcacaaattgatcacacgatac

SEQ ID NO: 633540 - DNA, 25 bp, Mus musculus
gaagcacagaaacttgtaccccagc

SEQ ID NO: 633541 - DNA, 25 bp, Mus musculus
gaagcacagaaagttgtaccccagc

SEQ ID NO: 633542 - DNA, 25 bp, Mus musculus
gaagcacagattcgcgaacgaacct

SEQ ID NO: 633543 - DNA, 25 bp, Mus musculus
gaagcacagattggcgaacgaacct

SEQ ID NO: 633544 - DNA, 25 bp, Mus musculus
gaagcacaggtgcaagagttttctc

SEQ ID NO: 633545 - DNA, 25 bp, Mus musculus
gaagcacaggtggaagagttttctc

SEQ ID NO: 633546 - DNA, 25 bp, Mus musculus
gaagcacatcttagtgttccaagcc

SEQ ID NO: 633547 - DNA, 25 bp, Mus musculus
gaagcacatctttgtgttccaagcc

SEQ ID NO: 633548 - DNA, 25 bp, Mus musculus
gaagcacatgctcgctgcctctaca

SEQ ID NO: 633549 - DNA, 25 bp, Mus musculus
gaagcacatgctggctgcctctaca

SEQ ID NO: 633550 - DNA, 25 bp, Mus musculus
gaagcacatttgatcgagagaaaag

SEQ ID NO: 633551 - DNA, 25 bp, Mus musculus
gaagcacatttgttcgagagaaaag

SEQ ID NO: 633552 - DNA, 25 bp, Mus musculus
gaagcaccaagtaagttaaacacct

SEQ ID NO: 633553 - DNA, 25 bp, Mus musculus
gaagcaccaagttagttaaacacct

SEQ ID NO: 633554 - DNA, 25 bp, Mus musculus
gaagcaccacgcctgagttctgtgc

SEQ ID NO: 633555 - DNA, 25 bp, Mus musculus
gaagcaccacgcgtgagttctgtgc

SEQ ID NO: 633556 - DNA, 25 bp, Mus musculus
gaagcaccaggaacacattttgcgt

SEQ ID NO: 633557 - DNA, 25 bp, Mus musculus
gaagcaccaggatcacattttgcgt

SEQ ID NO: 633558 - DNA, 25 bp, Mus musculus
gaagcacccatgagttcctgcatga

SEQ ID NO: 633559 - DNA, 25 bp, Mus musculus
gaagcacccatgtgttcctgcatga

SEQ ID NO: 633560 - DNA, 25 bp, Mus musculus
gaagcaccccacagttcatgggagg

SEQ ID NO: 633561 - DNA, 25 bp, Mus musculus
gaagcaccccactgttcatgggagg

SEQ ID NO: 633562 - DNA, 25 bp, Mus musculus
gaagcacccccgaaaagcttccatt

SEQ ID NO: 633563 - DNA, 25 bp, Mus musculus
gaagcacccccgtaaagcttccatt

SEQ ID NO: 633564 - DNA, 25 bp, Mus musculus
gaagcaccgcaacgaagaggtgtca

SEQ ID NO: 633565 - DNA, 25 bp, Mus musculus
gaagcaccgcaaggaagaggtgtca

SEQ ID NO: 633566 - DNA, 25 bp, Mus musculus
gaagcacctaatcactgtcaagttg

SEQ ID NO: 633567 - DNA, 25 bp, Mus musculus
gaagcacctaatgactgtcaagttg

SEQ ID NO: 633568 - DNA, 25 bp, Mus musculus
gaagcacctatcctcggaaggcagt

SEQ ID NO: 633569 - DNA, 25 bp, Mus musculus
gaagcacctatcgtcggaaggcagt

SEQ ID NO: 633570 - DNA, 25 bp, Mus musculus
gaagcacctccaagcaagtcaccgt

SEQ ID NO: 633571 - DNA, 25 bp, Mus musculus
gaagcacctccatgcaagtcaccgt

SEQ ID NO: 633572 - DNA, 25 bp, Mus musculus
gaagcacctcccagagtccttaaag

SEQ ID NO: 633573 - DNA, 25 bp, Mus musculus
gaagcacctccctgagtccttaaag

SEQ ID NO: 633574 - DNA, 25 bp, Mus musculus
gaagcacctgcaccaatatcgggtc

SEQ ID NO: 633575 - DNA, 25 bp, Mus musculus
gaagcacctgcagcaatatcgggtc

SEQ ID NO: 633576 - DNA, 25 bp, Mus musculus
gaagcacctgtgcatttaaacaaat

SEQ ID NO: 633577 - DNA, 25 bp, Mus musculus
gaagcacctgtggatttaaacaaat

SEQ ID NO: 633578 - DNA, 25 bp, Mus musculus
gaagcaccttccatgctgggcagct

SEQ ID NO: 633579 - DNA, 25 bp, Mus musculus
gaagcaccttccttgctgggcagct

SEQ ID NO: 633580 - DNA, 25 bp, Mus musculus
gaagcacgaatcctttgtatcagag

SEQ ID NO: 633581 - DNA, 25 bp, Mus musculus
gaagcacgaatcgtttgtatcagag

SEQ ID NO: 633582 - DNA, 25 bp, Mus musculus
gaagcacgacttcaatgccctgaag

SEQ ID NO: 633583 - DNA, 25 bp, Mus musculus
gaagcacgacttgaatgccctgaag

SEQ ID NO: 633584 - DNA, 25 bp, Mus musculus
gaagcacgccaacagaattgtagtg

SEQ ID NO: 633585 - DNA, 25 bp, Mus musculus
gaagcacgccaagagaattgtagtg

SEQ ID NO: 633586 - DNA, 25 bp, Mus musculus
gaagcacgctttaaatgcaaaagac

SEQ ID NO: 633587 - DNA, 25 bp, Mus musculus
gaagcacgcttttaatgcaaaagac

SEQ ID NO: 633588 - DNA, 25 bp, Mus musculus
gaagcacggacgcaagatgacctga

SEQ ID NO: 633589 - DNA, 25 bp, Mus musculus
gaagcacggacggaagatgacctga

SEQ ID NO: 633590 - DNA, 25 bp, Mus musculus
gaagcacgggatacttctccttgaa

SEQ ID NO: 633591 - DNA, 25 bp, Mus musculus
gaagcacgggattcttctccttgaa

SEQ ID NO: 633592 - DNA, 25 bp, Mus musculus
gaagcacgtcctcagtactttcggg

SEQ ID NO: 633593 - DNA, 25 bp, Mus musculus
gaagcacgtcctgagtactttcggg

SEQ ID NO: 633594 - DNA, 25 bp, Mus musculus
gaagcacgtgctaaagcctttttgc

SEQ ID NO: 633595 - DNA, 25 bp, Mus musculus
gaagcacgtgcttaagcctttttgc

SEQ ID NO: 633596 - DNA, 25 bp, Mus musculus
gaagcacgtttgagtcctcagaaaa

SEQ ID NO: 633597 - DNA, 25 bp, Mus musculus
gaagcacgtttgtgtcctcagaaaa

SEQ ID NO: 633598 - DNA, 25 bp, Mus musculus
gaagcactacttagttgcctagaga

SEQ ID NO: 633599 - DNA, 25 bp, Mus musculus
gaagcactactttgttgcctagaga

SEQ ID NO: 633600 - DNA, 25 bp, Mus musculus
gaagcactccatctcaagactctgg

SEQ ID NO: 633601 - DNA, 25 bp, Mus musculus
gaagcactccatgtcaagactctgg

SEQ ID NO: 633602 - DNA, 25 bp, Mus musculus
gaagcactccgacagagagtgagct

SEQ ID NO: 633603 - DNA, 25 bp, Mus musculus
gaagcactccgagagagagtgagct

SEQ ID NO: 633604 - DNA, 25 bp, Mus musculus
gaagcactctaacgtttctggagct

SEQ ID NO: 633605 - DNA, 25 bp, Mus musculus
gaagcactctaaggtttctggagct

SEQ ID NO: 633606 - DNA, 25 bp, Mus musculus
gaagcactctccagatctaatgagt

SEQ ID NO: 633607 - DNA, 25 bp, Mus musculus
gaagcactctcctgatctaatgagt

SEQ ID NO: 633608 - DNA, 25 bp, Mus musculus
gaagcactgccgaagcttcgggaag

SEQ ID NO: 633609 - DNA, 25 bp, Mus musculus
gaagcactgccgtagcttcgggaag

SEQ ID NO: 633610 - DNA, 25 bp, Mus musculus
gaagcactggagactttagccactg

SEQ ID NO: 633611 - DNA, 25 bp, Mus musculus
gaagcactggagtctttagccactg

SEQ ID NO: 633612 - DNA, 25 bp, Mus musculus
gaagcactggcaaccagcaccagct

SEQ ID NO: 633613 - DNA, 25 bp, Mus musculus
gaagcactggcatccagcaccagct

SEQ ID NO: 633614 - DNA, 25 bp, Mus musculus
gaagcactggcccattcagatttac

SEQ ID NO: 633615 - DNA, 25 bp, Mus musculus
gaagcactggccgattcagatttac

SEQ ID NO: 633616 - DNA, 25 bp, Mus musculus
gaagcactgtggcaggtttcgttgg

SEQ ID NO: 633617 - DNA, 25 bp, Mus musculus
gaagcactgtgggaggtttcgttgg

SEQ ID NO: 633618 - DNA, 25 bp, Mus musculus
gaagcacttccacagcgttgaggtg

SEQ ID NO: 633619 - DNA, 25 bp, Mus musculus
gaagcacttccagagcgttgaggtg

SEQ ID NO: 633620 - DNA, 25 bp, Mus musculus
gaagcacttgaaacttgttaatgga

SEQ ID NO: 633621 - DNA, 25 bp, Mus musculus
gaagcacttgaatcttgttaatgga

SEQ ID NO: 633622 - DNA, 25 bp, Mus musculus
gaagcacttttgacccaacgtgccc

SEQ ID NO: 633623 - DNA, 25 bp, Mus musculus
gaagcacttttgtcccaacgtgccc

SEQ ID NO: 633624 - DNA, 25 bp, Mus musculus
gaagcagaaaagaggagagcagcct

SEQ ID NO: 633625 - DNA, 25 bp, Mus musculus
gaagcagaaaagtggagagcagcct

SEQ ID NO: 633626 - DNA, 25 bp, Mus musculus
gaagcagaaacaaaaagacaaatgg

SEQ ID NO: 633627 - DNA, 25 bp, Mus musculus
gaagcagaaacaagtactaccgtgg

SEQ ID NO: 633628 - DNA, 25 bp, Mus musculus
gaagcagaaacataaagacaaatgg

SEQ ID NO: 633629 - DNA, 25 bp, Mus musculus
gaagcagaaacatgtactaccgtgg

SEQ ID NO: 633630 - DNA, 25 bp, Mus musculus
gaagcagaaatgcactgtggatccc

SEQ ID NO: 633631 - DNA, 25 bp, Mus musculus
gaagcagaaatggactgtggatccc

SEQ ID NO: 633632 - DNA, 25 bp, Mus musculus
gaagcagaaattcgtatatatcttg

SEQ ID NO: 633633 - DNA, 25 bp, Mus musculus
gaagcagaaattggtatatatcttg

SEQ ID NO: 633634 - DNA, 25 bp, Mus musculus
gaagcagaagatccagtcctacaag

SEQ ID NO: 633635 - DNA, 25 bp, Mus musculus
gaagcagaagatgcagtcctacaag

SEQ ID NO: 633636 - DNA, 25 bp, Mus musculus
gaagcagaagcactaggaattgata

SEQ ID NO: 633637 - DNA, 25 bp, Mus musculus
gaagcagaagcagtaggaattgata

SEQ ID NO: 633638 - DNA, 25 bp, Mus musculus
gaagcagaagctctttaccgaggtg

SEQ ID NO: 633639 - DNA, 25 bp, Mus musculus
gaagcagaagctgtttaccgaggtg

SEQ ID NO: 633640 - DNA, 25 bp, Mus musculus
gaagcagaagtaaaatgaaagctga

SEQ ID NO: 633641 - DNA, 25 bp, Mus musculus
gaagcagaagtataatgaaagctga

SEQ ID NO: 633642 - DNA, 25 bp, Mus musculus
gaagcagacacgatgctctgtgaga

SEQ ID NO: 633643 - DNA, 25 bp, Mus musculus
gaagcagacacgttgctctgtgaga

SEQ ID NO: 633644 - DNA, 25 bp, Mus musculus
gaagcagacagacgtagaaataacc

SEQ ID NO: 633645 - DNA, 25 bp, Mus musculus
gaagcagacagaggtagaaataacc

SEQ ID NO: 633646 - DNA, 25 bp, Mus musculus
gaagcagacagccatgcgcacagat

SEQ ID NO: 633647 - DNA, 25 bp, Mus musculus
gaagcagacagcgatgcgcacagat

SEQ ID NO: 633648 - DNA, 25 bp, Mus musculus
gaagcagacaggctacctgactatc

SEQ ID NO: 633649 - DNA, 25 bp, Mus musculus
gaagcagacagggtacctgactatc

SEQ ID NO: 633650 - DNA, 25 bp, Mus musculus
gaagcagacatacacgagagccttt

SEQ ID NO: 633651 - DNA, 25 bp, Mus musculus
gaagcagacatagacgagagccttt

SEQ ID NO: 633652 - DNA, 25 bp, Mus musculus
gaagcagacccaccagatgaatcag

SEQ ID NO: 633653 - DNA, 25 bp, Mus musculus
gaagcagacccagcagatgaatcag

SEQ ID NO: 633654 - DNA, 25 bp, Mus musculus
gaagcagactgacttaggattcttg

SEQ ID NO: 633655 - DNA, 25 bp, Mus musculus
gaagcagactgagttaggattcttg

SEQ ID NO: 633656 - DNA, 25 bp, Mus musculus
gaagcagactgtccagatgcgcgcc

SEQ ID NO: 633657 - DNA, 25 bp, Mus musculus
gaagcagactgtgcagatgcgcgcc

SEQ ID NO: 633658 - DNA, 25 bp, Mus musculus
gaagcagagaggaaggcgtcaccca

SEQ ID NO: 633659 - DNA, 25 bp, Mus musculus
gaagcagagaggtaggcgtcaccca

SEQ ID NO: 633660 - DNA, 25 bp, Mus musculus
gaagcagagccacacagggctcgat

SEQ ID NO: 633661 - DNA, 25 bp, Mus musculus
gaagcagagccagacagggctcgat

SEQ ID NO: 633662 - DNA, 25 bp, Mus musculus
gaagcagagccgcaaccccttggtc

SEQ ID NO: 633663 - DNA, 25 bp, Mus musculus
gaagcagagccggaaccccttggtc

SEQ ID NO: 633664 - DNA, 25 bp, Mus musculus
gaagcagatgctcgtctccctcgcg

SEQ ID NO: 633665 - DNA, 25 bp, Mus musculus
gaagcagatgctggtctccctcgcg

SEQ ID NO: 633666 - DNA, 25 bp, Mus musculus
gaagcagattgccaagtgccagcaa

SEQ ID NO: 633667 - DNA, 25 bp, Mus musculus
gaagcagattgcgaagtgccagcaa

SEQ ID NO: 633668 - DNA, 25 bp, Mus musculus
gaagcagcactacctgaggccctct

SEQ ID NO: 633669 - DNA, 25 bp, Mus musculus
gaagcagcactagctgaggccctct

SEQ ID NO: 633670 - DNA, 25 bp, Mus musculus
gaagcagcacttccatctacaaaag

SEQ ID NO: 633671 - DNA, 25 bp, Mus musculus
gaagcagcacttgcatctacaaaag

SEQ ID NO: 633672 - DNA, 25 bp, Mus musculus
gaagcagcagccaatacccagcaga

SEQ ID NO: 633673 - DNA, 25 bp, Mus musculus
gaagcagcagcctatacccagcaga

SEQ ID NO: 633674 - DNA, 25 bp, Mus musculus
gaagcagcagttcccttggtgccac

SEQ ID NO: 633675 - DNA, 25 bp, Mus musculus
gaagcagcagttgccttggtgccac

SEQ ID NO: 633676 - DNA, 25 bp, Mus musculus
gaagcagccagtcgcctctttcaag

SEQ ID NO: 633677 - DNA, 25 bp, Mus musculus
gaagcagccagtggcctctttcaag

SEQ ID NO: 633678 - DNA, 25 bp, Mus musculus
gaagcagcccgactagaaatcaacg

SEQ ID NO: 633679 - DNA, 25 bp, Mus musculus
gaagcagcccgagtagaaatcaacg

SEQ ID NO: 633680 - DNA, 25 bp, Mus musculus
gaagcagccgccatttgagatctac

SEQ ID NO: 633681 - DNA, 25 bp, Mus musculus
gaagcagccgccttttgagatctac

SEQ ID NO: 633682 - DNA, 25 bp, Mus musculus
gaagcagcctcaagactatttctac

SEQ ID NO: 633683 - DNA, 25 bp, Mus musculus
gaagcagcctcacgtctgtgtccgc

SEQ ID NO: 633684 - DNA, 25 bp, Mus musculus
gaagcagcctcaggtctgtgtccgc

SEQ ID NO: 633685 - DNA, 25 bp, Mus musculus
gaagcagcctcatgactatttctac

SEQ ID NO: 633686 - DNA, 25 bp, Mus musculus
gaagcagcctttccagttccacgtg

SEQ ID NO: 633687 - DNA, 25 bp, Mus musculus
gaagcagcctttgcagttccacgtg

SEQ ID NO: 633688 - DNA, 25 bp, Mus musculus
gaagcagcgcagacgccccgtaggt

SEQ ID NO: 633689 - DNA, 25 bp, Mus musculus
gaagcagcgcagtcgccccgtaggt

SEQ ID NO: 633690 - DNA, 25 bp, Mus musculus
gaagcagcggccaactcaacttggc

SEQ ID NO: 633691 - DNA, 25 bp, Mus musculus
gaagcagcggcctactcaacttggc

SEQ ID NO: 633692 - DNA, 25 bp, Mus musculus
gaagcagctacacaatggattggga

SEQ ID NO: 633693 - DNA, 25 bp, Mus musculus
gaagcagctacagaatggattggga

SEQ ID NO: 633694 - DNA, 25 bp, Mus musculus
gaagcagctccgcaccaggatgaaa

SEQ ID NO: 633695 - DNA, 25 bp, Mus musculus
gaagcagctccggaccaggatgaaa

SEQ ID NO: 633696 - DNA, 25 bp, Mus musculus
gaagcagctgccacaaatagcctgt

SEQ ID NO: 633697 - DNA, 25 bp, Mus musculus
gaagcagctgcctcaaatagcctgt

SEQ ID NO: 633698 - DNA, 25 bp, Mus musculus
gaagcagcttctcgaggatatgcag

SEQ ID NO: 633699 - DNA, 25 bp, Mus musculus
gaagcagcttctggaggatatgcag

SEQ ID NO: 633700 - DNA, 25 bp, Mus musculus
gaagcagcttgacgcatcattagat

SEQ ID NO: 633701 - DNA, 25 bp, Mus musculus
gaagcagcttgaggcatcattagat

SEQ ID NO: 633702 - DNA, 25 bp, Mus musculus
gaagcagcttggagccattgccgct

SEQ ID NO: 633703 - DNA, 25 bp, Mus musculus
gaagcagcttggtgccattgccgct

SEQ ID NO: 633704 - DNA, 25 bp, Mus musculus
gaagcagcttgtaggcaccatggcc

SEQ ID NO: 633705 - DNA, 25 bp, Mus musculus
gaagcagcttgttggcaccatggcc

SEQ ID NO: 633706 - DNA, 25 bp, Mus musculus
gaagcaggaacccttcacaagtggg

SEQ ID NO: 633707 - DNA, 25 bp, Mus musculus
gaagcaggaaccgttcacaagtggg

SEQ ID NO: 633708 - DNA, 25 bp, Mus musculus
gaagcaggaactcagcttagactcc

SEQ ID NO: 633709 - DNA, 25 bp, Mus musculus
gaagcaggaactccccacttttgga

SEQ ID NO: 633710 - DNA, 25 bp, Mus musculus
gaagcaggaactgagcttagactcc

SEQ ID NO: 633711 - DNA, 25 bp, Mus musculus
gaagcaggaactgcccacttttgga

SEQ ID NO: 633712 - DNA, 25 bp, Mus musculus
gaagcaggacacacttctaaagctt

SEQ ID NO: 633713 - DNA, 25 bp, Mus musculus
gaagcaggacactcttctaaagctt

SEQ ID NO: 633714 - DNA, 25 bp, Mus musculus
gaagcaggacatcggcgacatcctc

SEQ ID NO: 633715 - DNA, 25 bp, Mus musculus
gaagcaggacatgggcgacatcctc

SEQ ID NO: 633716 - DNA, 25 bp, Mus musculus
gaagcaggagtgaaggttcagatcc

SEQ ID NO: 633717 - DNA, 25 bp, Mus musculus
gaagcaggagtgtaggttcagatcc

SEQ ID NO: 633718 - DNA, 25 bp, Mus musculus
gaagcaggcagaattggtcttttgt

SEQ ID NO: 633719 - DNA, 25 bp, Mus musculus
gaagcaggcagatttggtcttttgt

SEQ ID NO: 633720 - DNA, 25 bp, Mus musculus
gaagcaggcgcgaagccttttggaa

SEQ ID NO: 633721 - DNA, 25 bp, Mus musculus
gaagcaggcgcgtagccttttggaa

SEQ ID NO: 633722 - DNA, 25 bp, Mus musculus
gaagcaggcgctatggaaatggtca

SEQ ID NO: 633723 - DNA, 25 bp, Mus musculus
gaagcaggcgctttggaaatggtca

SEQ ID NO: 633724 - DNA, 25 bp, Mus musculus
gaagcaggctgtcggttcattaacc

SEQ ID NO: 633725 - DNA, 25 bp, Mus musculus
gaagcaggctgtgggttcattaacc

SEQ ID NO: 633726 - DNA, 25 bp, Mus musculus
gaagcagggtcaccgctggaccaac

SEQ ID NO: 633727 - DNA, 25 bp, Mus musculus
gaagcagggtcagcgctggaccaac

SEQ ID NO: 633728 - DNA, 25 bp, Mus musculus
gaagcaggtcctagcagctgtctag

SEQ ID NO: 633729 - DNA, 25 bp, Mus musculus
gaagcaggtccttgcagctgtctag

SEQ ID NO: 633730 - DNA, 25 bp, Mus musculus
gaagcaggtctgattggcaagaatg

SEQ ID NO: 633731 - DNA, 25 bp, Mus musculus
gaagcaggtctgtttggcaagaatg

SEQ ID NO: 633732 - DNA, 25 bp, Mus musculus
gaagcaggtgccctgagtcagccaa

SEQ ID NO: 633733 - DNA, 25 bp, Mus musculus
gaagcaggtgccgtgagtcagccaa

SEQ ID NO: 633734 - DNA, 25 bp, Mus musculus
gaagcaggtggaacaccctttgctg

SEQ ID NO: 633735 - DNA, 25 bp, Mus musculus
gaagcaggtggatcaccctttgctg

SEQ ID NO: 633736 - DNA, 25 bp, Mus musculus
gaagcaggtgttatcaacgtcacag

SEQ ID NO: 633737 - DNA, 25 bp, Mus musculus
gaagcaggtgttttcaacgtcacag

SEQ ID NO: 633738 - DNA, 25 bp, Mus musculus
gaagcagtacaacgaggcagtaaag

SEQ ID NO: 633739 - DNA, 25 bp, Mus musculus
gaagcagtacaaggaggcagtaaag

SEQ ID NO: 633740 - DNA, 25 bp, Mus musculus
gaagcagtacgaccgcagcatcgtg

SEQ ID NO: 633741 - DNA, 25 bp, Mus musculus
gaagcagtacgagcgcagcatcgtg

SEQ ID NO: 633742 - DNA, 25 bp, Mus musculus
gaagcagtatcgaaatgagtaccag

SEQ ID NO: 633743 - DNA, 25 bp, Mus musculus
gaagcagtatcgtaatgagtaccag

SEQ ID NO: 633744 - DNA, 25 bp, Mus musculus
gaagcagtatgaactgacccagtta

SEQ ID NO: 633745 - DNA, 25 bp, Mus musculus
gaagcagtatgatctgacccagtta

SEQ ID NO: 633746 - DNA, 25 bp, Mus musculus
gaagcagtcacaccctagaacaggg

SEQ ID NO: 633747 - DNA, 25 bp, Mus musculus
gaagcagtcacagcctagaacaggg

SEQ ID NO: 633748 - DNA, 25 bp, Mus musculus
gaagcagtcactcaagaatgctgac

SEQ ID NO: 633749 - DNA, 25 bp, Mus musculus
gaagcagtcactgaagaatgctgac

SEQ ID NO: 633750 - DNA, 25 bp, Mus musculus
gaagcagtccaaaaaagtccagaaa

SEQ ID NO: 633751 - DNA, 25 bp, Mus musculus
gaagcagtccaataaagtccagaaa

SEQ ID NO: 633752 - DNA, 25 bp, Mus musculus
gaagcagtcgcacctgttggctttg

SEQ ID NO: 633753 - DNA, 25 bp, Mus musculus
gaagcagtcgcagctgttggctttg

SEQ ID NO: 633754 - DNA, 25 bp, Mus musculus
gaagcagtgcatagtggctcatcct

SEQ ID NO: 633755 - DNA, 25 bp, Mus musculus
gaagcagtgcattgtggctcatcct

SEQ ID NO: 633756 - DNA, 25 bp, Mus musculus
gaagcagtggaaccaacagcttgct

SEQ ID NO: 633757 - DNA, 25 bp, Mus musculus
gaagcagtggaagcaacagcttgct

SEQ ID NO: 633758 - DNA, 25 bp, Mus musculus
gaagcagtggacaatgttatcggtc

SEQ ID NO: 633759 - DNA, 25 bp, Mus musculus
gaagcagtggactatgttatcggtc

SEQ ID NO: 633760 - DNA, 25 bp, Mus musculus
gaagcagtgggaatcgataaagaca

SEQ ID NO: 633761 - DNA, 25 bp, Mus musculus
gaagcagtgggattcgataaagaca

SEQ ID NO: 633762 - DNA, 25 bp, Mus musculus
gaagcagttcaactatgggacccag

SEQ ID NO: 633763 - DNA, 25 bp, Mus musculus
gaagcagttcaagtatgggacccag

SEQ ID NO: 633764 - DNA, 25 bp, Mus musculus
gaagcagttcatatatttcaaacaa

SEQ ID NO: 633765 - DNA, 25 bp, Mus musculus
gaagcagttcatttatttcaaacaa

SEQ ID NO: 633766 - DNA, 25 bp, Mus musculus
gaagcagttcctactcctgcggagg

SEQ ID NO: 633767 - DNA, 25 bp, Mus musculus
gaagcagttccttctcctgcggagg

SEQ ID NO: 633768 - DNA, 25 bp, Mus musculus
gaagcagttcgaagcctaccctaag

SEQ ID NO: 633769 - DNA, 25 bp, Mus musculus
gaagcagttcgatgcctaccctaag

SEQ ID NO: 633770 - DNA, 25 bp, Mus musculus
gaagcagtttccattgtatgaagaa

SEQ ID NO: 633771 - DNA, 25 bp, Mus musculus
gaagcagtttcctttgtatgaagaa

SEQ ID NO: 633772 - DNA, 25 bp, Mus musculus
gaagcagtttgacccgcccacactg

SEQ ID NO: 633773 - DNA, 25 bp, Mus musculus
gaagcagtttgagccgcccacactg

SEQ ID NO: 633774 - DNA, 25 bp, Mus musculus
gaagcataattaactgcctcttcag

SEQ ID NO: 633775 - DNA, 25 bp, Mus musculus
gaagcataattatctgcctcttcag

SEQ ID NO: 633776 - DNA, 25 bp, Mus musculus
gaagcatacagacagtggtctcttg

SEQ ID NO: 633777 - DNA, 25 bp, Mus musculus
gaagcatacagagagtggtctcttg

SEQ ID NO: 633778 - DNA, 25 bp, Mus musculus
gaagcatatggccaaaattagagat

SEQ ID NO: 633779 - DNA, 25 bp, Mus musculus
gaagcatatggcgaaaattagagat

SEQ ID NO: 633780 - DNA, 25 bp, Mus musculus
gaagcatcaaaacctggtctccctg

SEQ ID NO: 633781 - DNA, 25 bp, Mus musculus
gaagcatcaaaagctggtctccctg

SEQ ID NO: 633782 - DNA, 25 bp, Mus musculus
gaagcatcagaaccgctgtaaggag

SEQ ID NO: 633783 - DNA, 25 bp, Mus musculus
gaagcatcagaagcgctgtaaggag

SEQ ID NO: 633784 - DNA, 25 bp, Mus musculus
gaagcatcaggtctcagagcccaaa

SEQ ID NO: 633785 - DNA, 25 bp, Mus musculus
gaagcatcaggtgtcagagcccaaa

SEQ ID NO: 633786 - DNA, 25 bp, Mus musculus
gaagcatccagcaatcatgaatcaa

SEQ ID NO: 633787 - DNA, 25 bp, Mus musculus
gaagcatccagctatcatgaatcaa

SEQ ID NO: 633788 - DNA, 25 bp, Mus musculus
gaagcatccccgaatgggctacctg

SEQ ID NO: 633789 - DNA, 25 bp, Mus musculus
gaagcatccccgtatgggctacctg

SEQ ID NO: 633790 - DNA, 25 bp, Mus musculus
gaagcatcccttcattgtagaactg

SEQ ID NO: 633791 - DNA, 25 bp, Mus musculus
gaagcatcccttgattgtagaactg

SEQ ID NO: 633792 - DNA, 25 bp, Mus musculus
gaagcatcctgcaaaccattcctct

SEQ ID NO: 633793 - DNA, 25 bp, Mus musculus
gaagcatcctgctaaccattcctct

SEQ ID NO: 633794 - DNA, 25 bp, Mus musculus
gaagcatctgctctttcaaaagcta

SEQ ID NO: 633795 - DNA, 25 bp, Mus musculus
gaagcatctgctgtttcaaaagcta

SEQ ID NO: 633796 - DNA, 25 bp, Mus musculus
gaagcatcttaccatcgtgagcttg

SEQ ID NO: 633797 - DNA, 25 bp, Mus musculus
gaagcatcttacgatcgtgagcttg

SEQ ID NO: 633798 - DNA, 25 bp, Mus musculus
gaagcatctttcatgatatggacag

SEQ ID NO: 633799 - DNA, 25 bp, Mus musculus
gaagcatctttcttgatatggacag

SEQ ID NO: 633800 - DNA, 25 bp, Mus musculus
gaagcatgaagccttcctggtggat

SEQ ID NO: 633801 - DNA, 25 bp, Mus musculus
gaagcatgaagcgttcctggtggat

SEQ ID NO: 633802 - DNA, 25 bp, Mus musculus
gaagcatgaaggaatcacgtagaac

SEQ ID NO: 633803 - DNA, 25 bp, Mus musculus
gaagcatgaaggtatcacgtagaac

SEQ ID NO: 633804 - DNA, 25 bp, Mus musculus
gaagcatgacagcagacacgtgccg

SEQ ID NO: 633805 - DNA, 25 bp, Mus musculus
gaagcatgacaggagacacgtgccg

SEQ ID NO: 633806 - DNA, 25 bp, Mus musculus
gaagcatgagctacgggccaaaggt

SEQ ID NO: 633807 - DNA, 25 bp, Mus musculus
gaagcatgagcttcgggccaaaggt

SEQ ID NO: 633808 - DNA, 25 bp, Mus musculus
gaagcatgatgcagtggcacaactt

SEQ ID NO: 633809 - DNA, 25 bp, Mus musculus
gaagcatgatgctgtggcacaactt

SEQ ID NO: 633810 - DNA, 25 bp, Mus musculus
gaagcatgcagaagaaccctgggtc

SEQ ID NO: 633811 - DNA, 25 bp, Mus musculus
gaagcatgcagatgaaccctgggtc

SEQ ID NO: 633812 - DNA, 25 bp, Mus musculus
gaagcatgccataattgtgtccatc

SEQ ID NO: 633813 - DNA, 25 bp, Mus musculus
gaagcatgccattattgtgtccatc

SEQ ID NO: 633814 - DNA, 25 bp, Mus musculus
gaagcatgcctccaatatgcttgga

SEQ ID NO: 633815 - DNA, 25 bp, Mus musculus
gaagcatgcctcgaatatgcttgga

SEQ ID NO: 633816 - DNA, 25 bp, Mus musculus
gaagcatgcgagatctatgccagag

SEQ ID NO: 633817 - DNA, 25 bp, Mus musculus
gaagcatgcgagttctatgccagag

SEQ ID NO: 633818 - DNA, 25 bp, Mus musculus
gaagcatgctccacatacatgtttc

SEQ ID NO: 633819 - DNA, 25 bp, Mus musculus
gaagcatgctcctcatacatgtttc

SEQ ID NO: 633820 - DNA, 25 bp, Mus musculus
gaagcatgggcgactacatggccca

SEQ ID NO: 633821 - DNA, 25 bp, Mus musculus
gaagcatgggcgtctacatggccca

SEQ ID NO: 633822 - DNA, 25 bp, Mus musculus
gaagcatggtgaagctgaacagcaa

SEQ ID NO: 633823 - DNA, 25 bp, Mus musculus
gaagcatggtgatgctgaacagcaa

SEQ ID NO: 633824 - DNA, 25 bp, Mus musculus
gaagcatggttgcaccgtgctcaca

SEQ ID NO: 633825 - DNA, 25 bp, Mus musculus
gaagcatggttggaccgtgctcaca

SEQ ID NO: 633826 - DNA, 25 bp, Mus musculus
gaagcatggtttcaaggcaccttgg

SEQ ID NO: 633827 - DNA, 25 bp, Mus musculus
gaagcatggtttcaccatggaaatg

SEQ ID NO: 633828 - DNA, 25 bp, Mus musculus
gaagcatggtttgaaggcaccttgg

SEQ ID NO: 633829 - DNA, 25 bp, Mus musculus
gaagcatggtttgaccatggaaatg

SEQ ID NO: 633830 - DNA, 25 bp, Mus musculus
gaagcatgtacaagcccctattgca

SEQ ID NO: 633831 - DNA, 25 bp, Mus musculus
gaagcatgtacatgcccctattgca

SEQ ID NO: 633832 - DNA, 25 bp, Mus musculus
gaagcatgtgtaacgtcaacattga

SEQ ID NO: 633833 - DNA, 25 bp, Mus musculus
gaagcatgtgtatcgtcaacattga

SEQ ID NO: 633834 - DNA, 25 bp, Mus musculus
gaagcattaccaagaacgccgtgta

SEQ ID NO: 633835 - DNA, 25 bp, Mus musculus
gaagcattaccatgaacgccgtgta

SEQ ID NO: 633836 - DNA, 25 bp, Mus musculus
gaagcattctgcagaacgcagtgca

SEQ ID NO: 633837 - DNA, 25 bp, Mus musculus
gaagcattctgctgaacgcagtgca

SEQ ID NO: 633838 - DNA, 25 bp, Mus musculus
gaagcattctttcttaaacatattc

SEQ ID NO: 633839 - DNA, 25 bp, Mus musculus
gaagcattctttgttaaacatattc

SEQ ID NO: 633840 - DNA, 25 bp, Mus musculus
gaagcattgcagctggttacctgtc

SEQ ID NO: 633841 - DNA, 25 bp, Mus musculus
gaagcattgcaggtggttacctgtc

SEQ ID NO: 633842 - DNA, 25 bp, Mus musculus
gaagcattggagagtggaagaccat

SEQ ID NO: 633843 - DNA, 25 bp, Mus musculus
gaagcattggagtgtggaagaccat

SEQ ID NO: 633844 - DNA, 25 bp, Mus musculus
gaagcattgtatactcctgtgagtg

SEQ ID NO: 633845 - DNA, 25 bp, Mus musculus
gaagcattgtattctcctgtgagtg

SEQ ID NO: 633846 - DNA, 25 bp, Mus musculus
gaagcattgtctatgttaataccaa

SEQ ID NO: 633847 - DNA, 25 bp, Mus musculus
gaagcattgtctttgttaataccaa

SEQ ID NO: 633848 - DNA, 25 bp, Mus musculus
gaagcatttacacagattgaccggt

SEQ ID NO: 633849 - DNA, 25 bp, Mus musculus
gaagcatttacagagattgaccggt

SEQ ID NO: 633850 - DNA, 25 bp, Mus musculus
gaagcatttcctacgcagggtacca

SEQ ID NO: 633851 - DNA, 25 bp, Mus musculus
gaagcatttccttcgcagggtacca

SEQ ID NO: 633852 - DNA, 25 bp, Mus musculus
gaagcatttcggacgtagggatctg

SEQ ID NO: 633853 - DNA, 25 bp, Mus musculus
gaagcatttcggtcgtagggatctg

SEQ ID NO: 633854 - DNA, 25 bp, Mus musculus
gaagcatttggcaatgcgaagacag

SEQ ID NO: 633855 - DNA, 25 bp, Mus musculus
gaagcatttggctatgcgaagacag

SEQ ID NO: 633856 - DNA, 25 bp, Mus musculus
gaagccaaacacactcgtgattgga

SEQ ID NO: 633857 - DNA, 25 bp, Mus musculus
gaagccaaacactctcgtgattgga

SEQ ID NO: 633858 - DNA, 25 bp, Mus musculus
gaagccaaacagagcaacgtctcag

SEQ ID NO: 633859 - DNA, 25 bp, Mus musculus
gaagccaaacagtgcaacgtctcag

SEQ ID NO: 633860 - DNA, 25 bp, Mus musculus
gaagccaaagacagttgaagccgca

SEQ ID NO: 633861 - DNA, 25 bp, Mus musculus
gaagccaaagactgttgaagccgca

SEQ ID NO: 633862 - DNA, 25 bp, Mus musculus
gaagccaaatggcactgtgtctcca

SEQ ID NO: 633863 - DNA, 25 bp, Mus musculus
gaagccaaatgggactgtgtctcca

SEQ ID NO: 633864 - DNA, 25 bp, Mus musculus
gaagccaacaacactaccttcttct

SEQ ID NO: 633865 - DNA, 25 bp, Mus musculus
gaagccaacaactctaccttcttct

SEQ ID NO: 633866 - DNA, 25 bp, Mus musculus
gaagccaacctacgcaacatgatgg

SEQ ID NO: 633867 - DNA, 25 bp, Mus musculus
gaagccaacctaggcaacatgatgg

SEQ ID NO: 633868 - DNA, 25 bp, Mus musculus
gaagccaacggacaactaaaggtct

SEQ ID NO: 633869 - DNA, 25 bp, Mus musculus
gaagccaacggagaactaaaggtct

SEQ ID NO: 633870 - DNA, 25 bp, Mus musculus
gaagccaacttcagggtccctccgt

SEQ ID NO: 633871 - DNA, 25 bp, Mus musculus
gaagccaacttctgggtccctccgt

SEQ ID NO: 633872 - DNA, 25 bp, Mus musculus
gaagccaacttgcactggaagggaa

SEQ ID NO: 633873 - DNA, 25 bp, Mus musculus
gaagccaacttggactggaagggaa

SEQ ID NO: 633874 - DNA, 25 bp, Mus musculus
gaagccaagaaaagaaccagataag

SEQ ID NO: 633875 - DNA, 25 bp, Mus musculus
gaagccaagaaatgaaccagataag

SEQ ID NO: 633876 - DNA, 25 bp, Mus musculus
gaagccaagaacacactgaccaaga

SEQ ID NO: 633877 - DNA, 25 bp, Mus musculus
gaagccaagaactcactgaccaaga

SEQ ID NO: 633878 - DNA, 25 bp, Mus musculus
gaagccaagagtcaagcccagaaac

SEQ ID NO: 633879 - DNA, 25 bp, Mus musculus
gaagccaagagtgaagcccagaaac

SEQ ID NO: 633880 - DNA, 25 bp, Mus musculus
gaagccaagatactccagcacttcg

SEQ ID NO: 633881 - DNA, 25 bp, Mus musculus
gaagccaagatagtccagcacttcg

SEQ ID NO: 633882 - DNA, 25 bp, Mus musculus
gaagccaagcttcactttaaaagtg

SEQ ID NO: 633883 - DNA, 25 bp, Mus musculus
gaagccaagcttgactttaaaagtg

SEQ ID NO: 633884 - DNA, 25 bp, Mus musculus
gaagccaaggcacccacctttgaga

SEQ ID NO: 633885 - DNA, 25 bp, Mus musculus
gaagccaaggcagccacctttgaga

SEQ ID NO: 633886 - DNA, 25 bp, Mus musculus
gaagccaagggcaatgtgctgaccg

SEQ ID NO: 633887 - DNA, 25 bp, Mus musculus
gaagccaagggctatgtgctgaccg

SEQ ID NO: 633888 - DNA, 25 bp, Mus musculus
gaagccaaggttcaagaattaaagt

SEQ ID NO: 633889 - DNA, 25 bp, Mus musculus
gaagccaaggttgaagaattaaagt

SEQ ID NO: 633890 - DNA, 25 bp, Mus musculus
gaagccaagtgaagacccttgggaa

SEQ ID NO: 633891 - DNA, 25 bp, Mus musculus
gaagccaagtgatgacccttgggaa

SEQ ID NO: 633892 - DNA, 25 bp, Mus musculus
gaagccaatactaccttagatgatg

SEQ ID NO: 633893 - DNA, 25 bp, Mus musculus
gaagccaatacttccttagatgatg

SEQ ID NO: 633894 - DNA, 25 bp, Mus musculus
gaagccaatagtaatgactctgatg

SEQ ID NO: 633895 - DNA, 25 bp, Mus musculus
gaagccaatagttatgactctgatg

SEQ ID NO: 633896 - DNA, 25 bp, Mus musculus
gaagccaatgatcaccgcttgtgcc

SEQ ID NO: 633897 - DNA, 25 bp, Mus musculus
gaagccaatgatgaccgcttgtgcc

SEQ ID NO: 633898 - DNA, 25 bp, Mus musculus
gaagccaatgcccacgagttcatca

SEQ ID NO: 633899 - DNA, 25 bp, Mus musculus
gaagccaatgccgacgagttcatca

SEQ ID NO: 633900 - DNA, 25 bp, Mus musculus
gaagccaatggcaacttccaccact

SEQ ID NO: 633901 - DNA, 25 bp, Mus musculus
gaagccaatggctacttccaccact

SEQ ID NO: 633902 - DNA, 25 bp, Mus musculus
gaagccaatgtgattaccaagcagc

SEQ ID NO: 633903 - DNA, 25 bp, Mus musculus
gaagccaatgtgtttaccaagcagc

SEQ ID NO: 633904 - DNA, 25 bp, Mus musculus
gaagccaatttcctgaacgtccagg

SEQ ID NO: 633905 - DNA, 25 bp, Mus musculus
gaagccaatttcgtgaacgtccagg

SEQ ID NO: 633906 - DNA, 25 bp, Mus musculus
gaagccacaatgatcttggcccatg

SEQ ID NO: 633907 - DNA, 25 bp, Mus musculus
gaagccacaatgttcttggcccatg

SEQ ID NO: 633908 - DNA, 25 bp, Mus musculus
gaagccacacgcagccttgtgtctg

SEQ ID NO: 633909 - DNA, 25 bp, Mus musculus
gaagccacacgctgccttgtgtctg

SEQ ID NO: 633910 - DNA, 25 bp, Mus musculus
gaagccacagagaatagggagccgt

SEQ ID NO: 633911 - DNA, 25 bp, Mus musculus
gaagccacagagtatagggagccgt

SEQ ID NO: 633912 - DNA, 25 bp, Mus musculus
gaagccaccagcaaaactgcagcca

SEQ ID NO: 633913 - DNA, 25 bp, Mus musculus
gaagccaccagctaaactgcagcca

SEQ ID NO: 633914 - DNA, 25 bp, Mus musculus
gaagccaccattcctgtgctcttct

SEQ ID NO: 633915 - DNA, 25 bp, Mus musculus
gaagccaccattgctgtgctcttct

SEQ ID NO: 633916 - DNA, 25 bp, Mus musculus
gaagccaccgagatcattgagggca

SEQ ID NO: 633917 - DNA, 25 bp, Mus musculus
gaagccaccgagttcattgagggca

SEQ ID NO: 633918 - DNA, 25 bp, Mus musculus
gaagccacctagcatcagtgcacag

SEQ ID NO: 633919 - DNA, 25 bp, Mus musculus
gaagccacctaggatcagtgcacag

SEQ ID NO: 633920 - DNA, 25 bp, Mus musculus
gaagccacgaacagtatgacggcag

SEQ ID NO: 633921 - DNA, 25 bp, Mus musculus
gaagccacgaactgtatgacggcag

SEQ ID NO: 633922 - DNA, 25 bp, Mus musculus
gaagccacgattcttgtcatgctcg

SEQ ID NO: 633923 - DNA, 25 bp, Mus musculus
gaagccacgattgttgtcatgctcg

SEQ ID NO: 633924 - DNA, 25 bp, Mus musculus
gaagccactgtcctcactgggatgc

SEQ ID NO: 633925 - DNA, 25 bp, Mus musculus
gaagccactgtcgtcactgggatgc

SEQ ID NO: 633926 - DNA, 25 bp, Mus musculus
gaagccacttgaacatctgaaccat

SEQ ID NO: 633927 - DNA, 25 bp, Mus musculus
gaagccacttgatcatctgaaccat

SEQ ID NO: 633928 - DNA, 25 bp, Mus musculus
gaagccagaaaacattctcttggac

SEQ ID NO: 633929 - DNA, 25 bp, Mus musculus
gaagccagaaaagattctcttggac

SEQ ID NO: 633930 - DNA, 25 bp, Mus musculus
gaagccagaaacattccctcagctg

SEQ ID NO: 633931 - DNA, 25 bp, Mus musculus
gaagccagaaactttccctcagctg

SEQ ID NO: 633932 - DNA, 25 bp, Mus musculus
gaagccagaacaatggaagcaacgt

SEQ ID NO: 633933 - DNA, 25 bp, Mus musculus
gaagccagaacattggaagcaacgt

SEQ ID NO: 633934 - DNA, 25 bp, Mus musculus
gaagccagaatactatcttctcagt

SEQ ID NO: 633935 - DNA, 25 bp, Mus musculus
gaagccagaatagtatcttctcagt

SEQ ID NO: 633936 - DNA, 25 bp, Mus musculus
gaagccagacgtcttttcaacagag

SEQ ID NO: 633937 - DNA, 25 bp, Mus musculus
gaagccagacgtgttttcaacagag

SEQ ID NO: 633938 - DNA, 25 bp, Mus musculus
gaagccagactacaacttcttcgaa

SEQ ID NO: 633939 - DNA, 25 bp, Mus musculus
gaagccagactacgactacctgagg

SEQ ID NO: 633940 - DNA, 25 bp, Mus musculus
gaagccagactagaacttcttcgaa

SEQ ID NO: 633941 - DNA, 25 bp, Mus musculus
gaagccagactaggactacctgagg

SEQ ID NO: 633942 - DNA, 25 bp, Mus musculus
gaagccagacttaaccactgtcaag

SEQ ID NO: 633943 - DNA, 25 bp, Mus musculus
gaagccagactttaccactgtcaag

SEQ ID NO: 633944 - DNA, 25 bp, Mus musculus
gaagccagagaacattctagtgaca

SEQ ID NO: 633945 - DNA, 25 bp, Mus musculus
gaagccagagaagattctagtgaca

SEQ ID NO: 633946 - DNA, 25 bp, Mus musculus
gaagccagagggaacctcaaaccaa

SEQ ID NO: 633947 - DNA, 25 bp, Mus musculus
gaagccagagggtacctcaaaccaa

SEQ ID NO: 633948 - DNA, 25 bp, Mus musculus
gaagccagatccataccacactgaa

SEQ ID NO: 633949 - DNA, 25 bp, Mus musculus
gaagccagatccttaccacactgaa

SEQ ID NO: 633950 - DNA, 25 bp, Mus musculus
gaagccagatgcctatactgagcag

SEQ ID NO: 633951 - DNA, 25 bp, Mus musculus
gaagccagatgcgtatactgagcag

SEQ ID NO: 633952 - DNA, 25 bp, Mus musculus
gaagccagcaaactacctgagtaca

SEQ ID NO: 633953 - DNA, 25 bp, Mus musculus
gaagccagcaaagtacctgagtaca

SEQ ID NO: 633954 - DNA, 25 bp, Mus musculus
gaagccagcatactccaggcaggac

SEQ ID NO: 633955 - DNA, 25 bp, Mus musculus
gaagccagcatagtccaggcaggac

SEQ ID NO: 633956 - DNA, 25 bp, Mus musculus
gaagccagcattattccgccagcag

SEQ ID NO: 633957 - DNA, 25 bp, Mus musculus
gaagccagcatttttccgccagcag

SEQ ID NO: 633958 - DNA, 25 bp, Mus musculus
gaagccagcgaacatcctgctggat

SEQ ID NO: 633959 - DNA, 25 bp, Mus musculus
gaagccagcgaagatcctgctggat

SEQ ID NO: 633960 - DNA, 25 bp, Mus musculus
gaagccagcgttcatcctgagctcc

SEQ ID NO: 633961 - DNA, 25 bp, Mus musculus
gaagccagcgttgatcctgagctcc

SEQ ID NO: 633962 - DNA, 25 bp, Mus musculus
gaagccagcttcagttagagactaa

SEQ ID NO: 633963 - DNA, 25 bp, Mus musculus
gaagccagcttctgttagagactaa

SEQ ID NO: 633964 - DNA, 25 bp, Mus musculus
gaagccaggaaactacattcttcag

SEQ ID NO: 633965 - DNA, 25 bp, Mus musculus
gaagccaggaaagtacattcttcag

SEQ ID NO: 633966 - DNA, 25 bp, Mus musculus
gaagccaggaaccagagttgctttg

SEQ ID NO: 633967 - DNA, 25 bp, Mus musculus
gaagccaggaacgagagttgctttg

SEQ ID NO: 633968 - DNA, 25 bp, Mus musculus
gaagccaggatgcaggcgtctatac

SEQ ID NO: 633969 - DNA, 25 bp, Mus musculus
gaagccaggatggaggcgtctatac

SEQ ID NO: 633970 - DNA, 25 bp, Mus musculus
gaagccaggcaaacttctggccgta

SEQ ID NO: 633971 - DNA, 25 bp, Mus musculus
gaagccaggcaatcttctggccgta

SEQ ID NO: 633972 - DNA, 25 bp, Mus musculus
gaagccaggctactgttgcccagag

SEQ ID NO: 633973 - DNA, 25 bp, Mus musculus
gaagccaggctagtgttgcccagag

SEQ ID NO: 633974 - DNA, 25 bp, Mus musculus
gaagccagggacatgcattctgggc

SEQ ID NO: 633975 - DNA, 25 bp, Mus musculus
gaagccagggacttgcattctgggc

SEQ ID NO: 633976 - DNA, 25 bp, Mus musculus
gaagccagggccatgatgtagacac

SEQ ID NO: 633977 - DNA, 25 bp, Mus musculus
gaagccagggccttgatgtagacac

SEQ ID NO: 633978 - DNA, 25 bp, Mus musculus
gaagccagtccaaagtcaagtacag

SEQ ID NO: 633979 - DNA, 25 bp, Mus musculus
gaagccagtccatagtcaagtacag

SEQ ID NO: 633980 - DNA, 25 bp, Mus musculus
gaagccagtcctaagctgctacttg

SEQ ID NO: 633981 - DNA, 25 bp, Mus musculus
gaagccagtccttagctgctacttg

SEQ ID NO: 633982 - DNA, 25 bp, Mus musculus
gaagccagtcttaaatcattcggac

SEQ ID NO: 633983 - DNA, 25 bp, Mus musculus
gaagccagtctttaatcattcggac

SEQ ID NO: 633984 - DNA, 25 bp, Mus musculus
gaagccagtgcactctatcatctga

SEQ ID NO: 633985 - DNA, 25 bp, Mus musculus
gaagccagtgcagtctatcatctga

SEQ ID NO: 633986 - DNA, 25 bp, Mus musculus
gaagccagttggaacccaagactta

SEQ ID NO: 633987 - DNA, 25 bp, Mus musculus
gaagccagttggtacccaagactta

SEQ ID NO: 633988 - DNA, 25 bp, Mus musculus
gaagccataatgaccgagcggctgg

SEQ ID NO: 633989 - DNA, 25 bp, Mus musculus
gaagccataatgtccgagcggctgg

SEQ ID NO: 633990 - DNA, 25 bp, Mus musculus
gaagccatatatctgacatactggg

SEQ ID NO: 633991 - DNA, 25 bp, Mus musculus
gaagccatatatgtgacatactggg

SEQ ID NO: 633992 - DNA, 25 bp, Mus musculus
gaagccatatttctacaacccagag

SEQ ID NO: 633993 - DNA, 25 bp, Mus musculus
gaagccatatttgtacaacccagag

SEQ ID NO: 633994 - DNA, 25 bp, Mus musculus
gaagccatcaatcaagataacagcg

SEQ ID NO: 633995 - DNA, 25 bp, Mus musculus
gaagccatcaatgaagataacagcg

SEQ ID NO: 633996 - DNA, 25 bp, Mus musculus
gaagccatcatcacccactttaatg

SEQ ID NO: 633997 - DNA, 25 bp, Mus musculus
gaagccatcatctcccactttaatg

SEQ ID NO: 633998 - DNA, 25 bp, Mus musculus
gaagccatcgcacgttatgcacagt

SEQ ID NO: 633999 - DNA, 25 bp, Mus musculus
gaagccatcgcaggttatgcacagt

SEQ ID NO: 634000 - DNA, 25 bp, Mus musculus
gaagccatcgttctgtaaaactgaa

SEQ ID NO: 634001 - DNA, 25 bp, Mus musculus
gaagccatcgttgtgtaaaactgaa

SEQ ID NO: 634002 - DNA, 25 bp, Mus musculus
gaagccatgaatcaaccaggccacc

SEQ ID NO: 634003 - DNA, 25 bp, Mus musculus
gaagccatgaatgaaccaggccacc

SEQ ID NO: 634004 - DNA, 25 bp, Mus musculus
gaagccatgcaaaactcggtcagat

SEQ ID NO: 634005 - DNA, 25 bp, Mus musculus
gaagccatgcaatactcggtcagat

SEQ ID NO: 634006 - DNA, 25 bp, Mus musculus
gaagccatgcacacctgagttttac

SEQ ID NO: 634007 - DNA, 25 bp, Mus musculus
gaagccatgcactcctgagttttac

SEQ ID NO: 634008 - DNA, 25 bp, Mus musculus
gaagccatgcctctatcctgaagtg

SEQ ID NO: 634009 - DNA, 25 bp, Mus musculus
gaagccatgcctgtatcctgaagtg

SEQ ID NO: 634010 - DNA, 25 bp, Mus musculus
gaagccatggctcacggaatgcaca

SEQ ID NO: 634011 - DNA, 25 bp, Mus musculus
gaagccatggctgacggaatgcaca

SEQ ID NO: 634012 - DNA, 25 bp, Mus musculus
gaagccatggttagcatcattgcca

SEQ ID NO: 634013 - DNA, 25 bp, Mus musculus
gaagccatggtttgcatcattgcca

SEQ ID NO: 634014 - DNA, 25 bp, Mus musculus
gaagccatgtataccaaccttcgca

SEQ ID NO: 634015 - DNA, 25 bp, Mus musculus
gaagccatgtattccaaccttcgca

SEQ ID NO: 634016 - DNA, 25 bp, Mus musculus
gaagccatgttgattgcctcaagcc

SEQ ID NO: 634017 - DNA, 25 bp, Mus musculus
gaagccatgttgtttgcctcaagcc

SEQ ID NO: 634018 - DNA, 25 bp, Mus musculus
gaagccatgtttatacagcagcccg

SEQ ID NO: 634019 - DNA, 25 bp, Mus musculus
gaagccatgtttttacagcagcccg

SEQ ID NO: 634020 - DNA, 25 bp, Mus musculus
gaagccattcagacctcaatctcct

SEQ ID NO: 634021 - DNA, 25 bp, Mus musculus
gaagccattcagtcctcaatctcct

SEQ ID NO: 634022 - DNA, 25 bp, Mus musculus
gaagccattcttcactgatgggaca

SEQ ID NO: 634023 - DNA, 25 bp, Mus musculus
gaagccattcttgactgatgggaca

SEQ ID NO: 634024 - DNA, 25 bp, Mus musculus
gaagccattgagctcctggaaagat

SEQ ID NO: 634025 - DNA, 25 bp, Mus musculus
gaagccattgaggtcctggaaagat

SEQ ID NO: 634026 - DNA, 25 bp, Mus musculus
gaagccattgctcaacttgatacat

SEQ ID NO: 634027 - DNA, 25 bp, Mus musculus
gaagccattgctgaacttgatacat

SEQ ID NO: 634028 - DNA, 25 bp, Mus musculus
gaagccattgttcaaaagataaaac

SEQ ID NO: 634029 - DNA, 25 bp, Mus musculus
gaagccattgttgaaaagataaaac

SEQ ID NO: 634030 - DNA, 25 bp, Mus musculus
gaagccattttcagtgccaatcgac

SEQ ID NO: 634031 - DNA, 25 bp, Mus musculus
gaagccattttctgtgccaatcgac

SEQ ID NO: 634032 - DNA, 25 bp, Mus musculus
gaagcccaaactcatgtaccaggag

SEQ ID NO: 634033 - DNA, 25 bp, Mus musculus
gaagcccaaactgatgtaccaggag

SEQ ID NO: 634034 - DNA, 25 bp, Mus musculus
gaagcccaagaacctgaataaatct

SEQ ID NO: 634035 - DNA, 25 bp, Mus musculus
gaagcccaagaagctgaataaatct

SEQ ID NO: 634036 - DNA, 25 bp, Mus musculus
gaagcccaaggcacaagccagcctg

SEQ ID NO: 634037 - DNA, 25 bp, Mus musculus
gaagcccaaggctcaagccagcctg

SEQ ID NO: 634038 - DNA, 25 bp, Mus musculus
gaagcccacaggcactttggtcctg

SEQ ID NO: 634039 - DNA, 25 bp, Mus musculus
gaagcccacagggactttggtcctg

SEQ ID NO: 634040 - DNA, 25 bp, Mus musculus
gaagcccaccgtctgtgagtctgag

SEQ ID NO: 634041 - DNA, 25 bp, Mus musculus
gaagcccaccgtgtgtgagtctgag

SEQ ID NO: 634042 - DNA, 25 bp, Mus musculus
gaagcccacctaccactatttttgt

SEQ ID NO: 634043 - DNA, 25 bp, Mus musculus
gaagcccacctagcactatttttgt

SEQ ID NO: 634044 - DNA, 25 bp, Mus musculus
gaagcccactgaagcagtctacagc

SEQ ID NO: 634045 - DNA, 25 bp, Mus musculus
gaagcccactgaatgcaacactgga

SEQ ID NO: 634046 - DNA, 25 bp, Mus musculus
gaagcccactgatgcagtctacagc

SEQ ID NO: 634047 - DNA, 25 bp, Mus musculus
gaagcccactgattgcaacactgga

SEQ ID NO: 634048 - DNA, 25 bp, Mus musculus
gaagcccagcgtactcaagtctaag

SEQ ID NO: 634049 - DNA, 25 bp, Mus musculus
gaagcccagcgttctcaagtctaag

SEQ ID NO: 634050 - DNA, 25 bp, Mus musculus
gaagcccagggcatttcgcagtggt

SEQ ID NO: 634051 - DNA, 25 bp, Mus musculus
gaagcccagggcttttcgcagtggt

SEQ ID NO: 634052 - DNA, 25 bp, Mus musculus
gaagcccatgagcaacagaatgtgg

SEQ ID NO: 634053 - DNA, 25 bp, Mus musculus
gaagcccatgaggaacagaatgtgg

SEQ ID NO: 634054 - DNA, 25 bp, Mus musculus
gaagcccatgatactgaggagggcc

SEQ ID NO: 634055 - DNA, 25 bp, Mus musculus
gaagcccatgattctgaggagggcc

SEQ ID NO: 634056 - DNA, 25 bp, Mus musculus
gaagcccatgctaaagtaagatttt

SEQ ID NO: 634057 - DNA, 25 bp, Mus musculus
gaagcccatgcttaagtaagatttt

SEQ ID NO: 634058 - DNA, 25 bp, Mus musculus
gaagcccattcaaatgtatatcaac

SEQ ID NO: 634059 - DNA, 25 bp, Mus musculus
gaagcccattcatatgtatatcaac

SEQ ID NO: 634060 - DNA, 25 bp, Mus musculus
gaagcccatttgaggagtcactgaa

SEQ ID NO: 634061 - DNA, 25 bp, Mus musculus
gaagcccatttgtggagtcactgaa

SEQ ID NO: 634062 - DNA, 25 bp, Mus musculus
gaagccccaagtccttcaacaatgg

SEQ ID NO: 634063 - DNA, 25 bp, Mus musculus
gaagccccaagtgcttcaacaatgg

SEQ ID NO: 634064 - DNA, 25 bp, Mus musculus
gaagccccaggaatttgtcaaccgg

SEQ ID NO: 634065 - DNA, 25 bp, Mus musculus
gaagccccaggactgtctgtcatag

SEQ ID NO: 634066 - DNA, 25 bp, Mus musculus
gaagccccaggagtgtctgtcatag

SEQ ID NO: 634067 - DNA, 25 bp, Mus musculus
gaagccccaggattttgtcaaccgg

SEQ ID NO: 634068 - DNA, 25 bp, Mus musculus
gaagccccgcatcgatcatctgaac

SEQ ID NO: 634069 - DNA, 25 bp, Mus musculus
gaagccccgcatggatcatctgaac

SEQ ID NO: 634070 - DNA, 25 bp, Mus musculus
gaagcccctgggagataatttgatg

SEQ ID NO: 634071 - DNA, 25 bp, Mus musculus
gaagcccctgggtgataatttgatg

SEQ ID NO: 634072 - DNA, 25 bp, Mus musculus
gaagcccctgtacatagtgacggag

SEQ ID NO: 634073 - DNA, 25 bp, Mus musculus
gaagcccctgtagatagtgacggag

SEQ ID NO: 634074 - DNA, 25 bp, Mus musculus
gaagccccttctacctgtatctatg

SEQ ID NO: 634075 - DNA, 25 bp, Mus musculus
gaagccccttcttcctgtatctatg

SEQ ID NO: 634076 - DNA, 25 bp, Mus musculus
gaagcccgaatgactggatgcctac

SEQ ID NO: 634077 - DNA, 25 bp, Mus musculus
gaagcccgaatgtctggatgcctac

SEQ ID NO: 634078 - DNA, 25 bp, Mus musculus
gaagcccgacaccatcgaggtgcag

SEQ ID NO: 634079 - DNA, 25 bp, Mus musculus
gaagcccgacacgatcgaggtgcag

SEQ ID NO: 634080 - DNA, 25 bp, Mus musculus
gaagcccgagaaacttctcatcgac

SEQ ID NO: 634081 - DNA, 25 bp, Mus musculus
gaagcccgagaatcttctcatcgac

SEQ ID NO: 634082 - DNA, 25 bp, Mus musculus
gaagcccgagacagcttcgctcgct

SEQ ID NO: 634083 - DNA, 25 bp, Mus musculus
gaagcccgagactgcttcgctcgct

SEQ ID NO: 634084 - DNA, 25 bp, Mus musculus
gaagcccgagatctttgagaaccca

SEQ ID NO: 634085 - DNA, 25 bp, Mus musculus
gaagcccgagatgtttgagaaccca

SEQ ID NO: 634086 - DNA, 25 bp, Mus musculus
gaagcccgccttccgctaactaatg

SEQ ID NO: 634087 - DNA, 25 bp, Mus musculus
gaagcccgccttgcgctaactaatg

SEQ ID NO: 634088 - DNA, 25 bp, Mus musculus
gaagcccgtgccactggtgcttgat

SEQ ID NO: 634089 - DNA, 25 bp, Mus musculus
gaagcccgtgcctctggtgcttgat

SEQ ID NO: 634090 - DNA, 25 bp, Mus musculus
gaagccctaaacatggattacctgg

SEQ ID NO: 634091 - DNA, 25 bp, Mus musculus
gaagccctaaacttggattacctgg

SEQ ID NO: 634092 - DNA, 25 bp, Mus musculus
gaagccctaaatattgagaatgtga

SEQ ID NO: 634093 - DNA, 25 bp, Mus musculus
gaagccctaaattttgagaatgtga

SEQ ID NO: 634094 - DNA, 25 bp, Mus musculus
gaagccctaggcatgagatttcatc

SEQ ID NO: 634095 - DNA, 25 bp, Mus musculus
gaagccctaggcttgagatttcatc

SEQ ID NO: 634096 - DNA, 25 bp, Mus musculus
gaagccctatcaagaaggtccgcaa

SEQ ID NO: 634097 - DNA, 25 bp, Mus musculus
gaagccctatcatgaaggtccgcaa

SEQ ID NO: 634098 - DNA, 25 bp, Mus musculus
gaagccctcagaagctgcgttggag

SEQ ID NO: 634099 - DNA, 25 bp, Mus musculus
gaagccctcagatgctgcgttggag

SEQ ID NO: 634100 - DNA, 25 bp, Mus musculus
gaagccctcagtagtgccctgcaga

SEQ ID NO: 634101 - DNA, 25 bp, Mus musculus
gaagccctcagttgtgccctgcaga

SEQ ID NO: 634102 - DNA, 25 bp, Mus musculus
gaagccctcttcaaacctttgcagc

SEQ ID NO: 634103 - DNA, 25 bp, Mus musculus
gaagccctcttctaacctttgcagc

SEQ ID NO: 634104 - DNA, 25 bp, Mus musculus
gaagccctcttgattgatggccagc

SEQ ID NO: 634105 - DNA, 25 bp, Mus musculus
gaagccctcttgtttgatggccagc

SEQ ID NO: 634106 - DNA, 25 bp, Mus musculus
gaagccctgaagaggtaccggtcag

SEQ ID NO: 634107 - DNA, 25 bp, Mus musculus
gaagccctgaagtggtaccggtcag

SEQ ID NO: 634108 - DNA, 25 bp, Mus musculus
gaagccctgactcattgctccgtag

SEQ ID NO: 634109 - DNA, 25 bp, Mus musculus
gaagccctgactgattgctccgtag

SEQ ID NO: 634110 - DNA, 25 bp, Mus musculus
gaagccctgcatagtggcctgcaga

SEQ ID NO: 634111 - DNA, 25 bp, Mus musculus
gaagccctgcattgtggcctgcaga

SEQ ID NO: 634112 - DNA, 25 bp, Mus musculus
gaagccctgcttctatttccagaag

SEQ ID NO: 634113 - DNA, 25 bp, Mus musculus
gaagccctgcttgtatttccagaag

SEQ ID NO: 634114 - DNA, 25 bp, Mus musculus
gaagccctggagactaagattgttg

SEQ ID NO: 634115 - DNA, 25 bp, Mus musculus
gaagccctggagtctaagattgttg

SEQ ID NO: 634116 - DNA, 25 bp, Mus musculus
gaagccctggcactttatagcagag

SEQ ID NO: 634117 - DNA, 25 bp, Mus musculus
gaagccctggcagtttatagcagag

SEQ ID NO: 634118 - DNA, 25 bp, Mus musculus
gaagcccttcaacgcggtcttcggt

SEQ ID NO: 634119 - DNA, 25 bp, Mus musculus
gaagcccttcaaggcggtcttcggt

SEQ ID NO: 634120 - DNA, 25 bp, Mus musculus
gaagcccttcagaacactccctgtg

SEQ ID NO: 634121 - DNA, 25 bp, Mus musculus
gaagcccttcagtacactccctgtg

SEQ ID NO: 634122 - DNA, 25 bp, Mus musculus
gaagcccttgaacccttctgggagg

SEQ ID NO: 634123 - DNA, 25 bp, Mus musculus
gaagcccttgaagccttctgggagg

SEQ ID NO: 634124 - DNA, 25 bp, Mus musculus
gaagcccttggaaatcgccaggatg

SEQ ID NO: 634125 - DNA, 25 bp, Mus musculus
gaagcccttggatatcgccaggatg

SEQ ID NO: 634126 - DNA, 25 bp, Mus musculus
gaagccctttttcatagagtttaca

SEQ ID NO: 634127 - DNA, 25 bp, Mus musculus
gaagccctttttgatagagtttaca

SEQ ID NO: 634128 - DNA, 25 bp, Mus musculus
gaagccgaaatgatgcgttccatct

SEQ ID NO: 634129 - DNA, 25 bp, Mus musculus
gaagccgaaatgttgcgttccatct

SEQ ID NO: 634130 - DNA, 25 bp, Mus musculus
gaagccgaacagctcataggacagg

SEQ ID NO: 634131 - DNA, 25 bp, Mus musculus
gaagccgaacaggtcataggacagg

SEQ ID NO: 634132 - DNA, 25 bp, Mus musculus
gaagccgaacatacggtggaatgat

SEQ ID NO: 634133 - DNA, 25 bp, Mus musculus
gaagccgaacattcggtggaatgat

SEQ ID NO: 634134 - DNA, 25 bp, Mus musculus
gaagccgaaggccaactgattaaga

SEQ ID NO: 634135 - DNA, 25 bp, Mus musculus
gaagccgaaggcgaactgattaaga

SEQ ID NO: 634136 - DNA, 25 bp, Mus musculus
gaagccgacactaaccggccaggtt

SEQ ID NO: 634137 - DNA, 25 bp, Mus musculus
gaagccgacacttaccggccaggtt

SEQ ID NO: 634138 - DNA, 25 bp, Mus musculus
gaagccgacccgagcaaatttcctg

SEQ ID NO: 634139 - DNA, 25 bp, Mus musculus
gaagccgacccgtgcaaatttcctg

SEQ ID NO: 634140 - DNA, 25 bp, Mus musculus
gaagccgaccggattgacttttcat

SEQ ID NO: 634141 - DNA, 25 bp, Mus musculus
gaagccgaccggtttgacttttcat

SEQ ID NO: 634142 - DNA, 25 bp, Mus musculus
gaagccgagtgacaatccatctggt

SEQ ID NO: 634143 - DNA, 25 bp, Mus musculus
gaagccgagtgagaatccatctggt

SEQ ID NO: 634144 - DNA, 25 bp, Mus musculus
gaagccgcctaaacctatggaaggc

SEQ ID NO: 634145 - DNA, 25 bp, Mus musculus
gaagccgcctaatcctatggaaggc

SEQ ID NO: 634146 - DNA, 25 bp, Mus musculus
gaagccgcggcccacgacaagctga

SEQ ID NO: 634147 - DNA, 25 bp, Mus musculus
gaagccgcggcccatagtgccttgc

SEQ ID NO: 634148 - DNA, 25 bp, Mus musculus
gaagccgcggccgacgacaagctga

SEQ ID NO: 634149 - DNA, 25 bp, Mus musculus
gaagccgcggccgatagtgccttgc

SEQ ID NO: 634150 - DNA, 25 bp, Mus musculus
gaagccgctcgtaggatcaaaacag

SEQ ID NO: 634151 - DNA, 25 bp, Mus musculus
gaagccgctcgttggatcaaaacag

SEQ ID NO: 634152 - DNA, 25 bp, Mus musculus
gaagccgctgccagcaggaatttcc

SEQ ID NO: 634153 - DNA, 25 bp, Mus musculus
gaagccgctgcctgcaggaatttcc

SEQ ID NO: 634154 - DNA, 25 bp, Mus musculus
gaagccgctgttcccaggacaaaca

SEQ ID NO: 634155 - DNA, 25 bp, Mus musculus
gaagccgctgttgccaggacaaaca

SEQ ID NO: 634156 - DNA, 25 bp, Mus musculus
gaagccgcttatctgtatcgctcag

SEQ ID NO: 634157 - DNA, 25 bp, Mus musculus
gaagccgcttatgtgtatcgctcag

SEQ ID NO: 634158 - DNA, 25 bp, Mus musculus
gaagccgctttgacgtcggcggaaa

SEQ ID NO: 634159 - DNA, 25 bp, Mus musculus
gaagccgctttgtcgtcggcggaaa

SEQ ID NO: 634160 - DNA, 25 bp, Mus musculus
gaagccggagcccacctagctcttt

SEQ ID NO: 634161 - DNA, 25 bp, Mus musculus
gaagccggagccgacctagctcttt

SEQ ID NO: 634162 - DNA, 25 bp, Mus musculus
gaagccggccttcatgaagatgcgc

SEQ ID NO: 634163 - DNA, 25 bp, Mus musculus
gaagccggccttgatgaagatgcgc

SEQ ID NO: 634164 - DNA, 25 bp, Mus musculus
gaagccgggcggataactgagctct

SEQ ID NO: 634165 - DNA, 25 bp, Mus musculus
gaagccgggcggttaactgagctct

SEQ ID NO: 634166 - DNA, 25 bp, Mus musculus
gaagccgtaccgatgtcaggaatgc

SEQ ID NO: 634167 - DNA, 25 bp, Mus musculus
gaagccgtaccgttgtcaggaatgc

SEQ ID NO: 634168 - DNA, 25 bp, Mus musculus
gaagccgtgaccaaaggagctgcca

SEQ ID NO: 634169 - DNA, 25 bp, Mus musculus
gaagccgtgacctaaggagctgcca

SEQ ID NO: 634170 - DNA, 25 bp, Mus musculus
gaagccgttgcccaaaactgtatat

SEQ ID NO: 634171 - DNA, 25 bp, Mus musculus
gaagccgttgccgaaaactgtatat

SEQ ID NO: 634172 - DNA, 25 bp, Mus musculus
gaagccgtttcaaggaccagacagg

SEQ ID NO: 634173 - DNA, 25 bp, Mus musculus
gaagccgtttcatggaccagacagg

SEQ ID NO: 634174 - DNA, 25 bp, Mus musculus
gaagccgtttccatgcctgttcccg

SEQ ID NO: 634175 - DNA, 25 bp, Mus musculus
gaagccgtttccttgcctgttcccg

SEQ ID NO: 634176 - DNA, 25 bp, Mus musculus
gaagccgttttcagttcccttcttg

SEQ ID NO: 634177 - DNA, 25 bp, Mus musculus
gaagccgttttctgttcccttcttg

SEQ ID NO: 634178 - DNA, 25 bp, Mus musculus
gaagcctaagctcgaatgagatcca

SEQ ID NO: 634179 - DNA, 25 bp, Mus musculus
gaagcctaagctggaatgagatcca

SEQ ID NO: 634180 - DNA, 25 bp, Mus musculus
gaagcctaagttaggcattgacccc

SEQ ID NO: 634181 - DNA, 25 bp, Mus musculus
gaagcctaagtttggcattgacccc

SEQ ID NO: 634182 - DNA, 25 bp, Mus musculus
gaagcctactgtaatacgaatccca

SEQ ID NO: 634183 - DNA, 25 bp, Mus musculus
gaagcctactgttatacgaatccca

SEQ ID NO: 634184 - DNA, 25 bp, Mus musculus
gaagcctagtagaactcccagccct

SEQ ID NO: 634185 - DNA, 25 bp, Mus musculus
gaagcctagtagtactcccagccct

SEQ ID NO: 634186 - DNA, 25 bp, Mus musculus
gaagcctatcttaaaagcctcaagc

SEQ ID NO: 634187 - DNA, 25 bp, Mus musculus
gaagcctatctttaaagcctcaagc

SEQ ID NO: 634188 - DNA, 25 bp, Mus musculus
gaagcctatgcaccgtgtcacaaga

SEQ ID NO: 634189 - DNA, 25 bp, Mus musculus
gaagcctatgcagcgtgtcacaaga

SEQ ID NO: 634190 - DNA, 25 bp, Mus musculus
gaagcctatggcacctgtcaagtta

SEQ ID NO: 634191 - DNA, 25 bp, Mus musculus
gaagcctatggctcctgtcaagtta

SEQ ID NO: 634192 - DNA, 25 bp, Mus musculus
gaagcctatgtacatctagctggtc

SEQ ID NO: 634193 - DNA, 25 bp, Mus musculus
gaagcctatgtagatctagctggtc

SEQ ID NO: 634194 - DNA, 25 bp, Mus musculus
gaagcctcaaatattcacggaacca

SEQ ID NO: 634195 - DNA, 25 bp, Mus musculus
gaagcctcaaattttcacggaacca

SEQ ID NO: 634196 - DNA, 25 bp, Mus musculus
gaagcctcaatgacaggctgcggct

SEQ ID NO: 634197 - DNA, 25 bp, Mus musculus
gaagcctcaatgtcaggctgcggct

SEQ ID NO: 634198 - DNA, 25 bp, Mus musculus
gaagcctcacttactgggccataga

SEQ ID NO: 634199 - DNA, 25 bp, Mus musculus
gaagcctcactttctgggccataga

SEQ ID NO: 634200 - DNA, 25 bp, Mus musculus
gaagcctcaggacagtcagagaagc

SEQ ID NO: 634201 - DNA, 25 bp, Mus musculus
gaagcctcaggagagtcagagaagc

SEQ ID NO: 634202 - DNA, 25 bp, Mus musculus
gaagcctccctccagaatcaaatcg

SEQ ID NO: 634203 - DNA, 25 bp, Mus musculus
gaagcctccctcgagaatcaaatcg

SEQ ID NO: 634204 - DNA, 25 bp, Mus musculus
gaagcctccctgagcttgatcggga

SEQ ID NO: 634205 - DNA, 25 bp, Mus musculus
gaagcctccctgtgcttgatcggga

SEQ ID NO: 634206 - DNA, 25 bp, Mus musculus
gaagcctccggcaacgaatagagaa

SEQ ID NO: 634207 - DNA, 25 bp, Mus musculus
gaagcctccggctacgaatagagaa

SEQ ID NO: 634208 - DNA, 25 bp, Mus musculus
gaagcctccttactcgatctcaaca

SEQ ID NO: 634209 - DNA, 25 bp, Mus musculus
gaagcctccttagtcgatctcaaca

SEQ ID NO: 634210 - DNA, 25 bp, Mus musculus
gaagcctcgtgcagccttggagaga

SEQ ID NO: 634211 - DNA, 25 bp, Mus musculus
gaagcctcgtgctgccttggagaga

SEQ ID NO: 634212 - DNA, 25 bp, Mus musculus
gaagcctcgtgtacctgcgacaagg

SEQ ID NO: 634213 - DNA, 25 bp, Mus musculus
gaagcctcgtgttcctgcgacaagg

SEQ ID NO: 634214 - DNA, 25 bp, Mus musculus
gaagcctcgttgagatttcctccga

SEQ ID NO: 634215 - DNA, 25 bp, Mus musculus
gaagcctcgttgtgatttcctccga

SEQ ID NO: 634216 - DNA, 25 bp, Mus musculus
gaagcctctactatttcatctgctc

SEQ ID NO: 634217 - DNA, 25 bp, Mus musculus
gaagcctctactttttcatctgctc

SEQ ID NO: 634218 - DNA, 25 bp, Mus musculus
gaagcctctcttcaatgacagccag

SEQ ID NO: 634219 - DNA, 25 bp, Mus musculus
gaagcctctcttgaatgacagccag

SEQ ID NO: 634220 - DNA, 25 bp, Mus musculus
gaagcctcttctccaacgcgctgat

SEQ ID NO: 634221 - DNA, 25 bp, Mus musculus
gaagcctcttctgcaacgcgctgat

SEQ ID NO: 634222 - DNA, 25 bp, Mus musculus
gaagcctcttgaacacaagaacctg

SEQ ID NO: 634223 - DNA, 25 bp, Mus musculus
gaagcctcttgatcacaagaacctg

SEQ ID NO: 634224 - DNA, 25 bp, Mus musculus
gaagcctgaaaaagctcgcctcaga

SEQ ID NO: 634225 - DNA, 25 bp, Mus musculus
gaagcctgaaaatgctcgcctcaga

SEQ ID NO: 634226 - DNA, 25 bp, Mus musculus
gaagcctgaagaccccaaaagctgc

SEQ ID NO: 634227 - DNA, 25 bp, Mus musculus
gaagcctgaagagcccaaaagctgc

SEQ ID NO: 634228 - DNA, 25 bp, Mus musculus
gaagcctgcagaatggacgagagaa

SEQ ID NO: 634229 - DNA, 25 bp, Mus musculus
gaagcctgcagattggacgagagaa

SEQ ID NO: 634230 - DNA, 25 bp, Mus musculus
gaagcctgcccgagtgtatgggaca

SEQ ID NO: 634231 - DNA, 25 bp, Mus musculus
gaagcctgcccgtgtgtatgggaca

SEQ ID NO: 634232 - DNA, 25 bp, Mus musculus
gaagcctgctctcacatggacgtag

SEQ ID NO: 634233 - DNA, 25 bp, Mus musculus
gaagcctgctctgacatggacgtag

SEQ ID NO: 634234 - DNA, 25 bp, Mus musculus
gaagcctggcaacaacgagggcatc

SEQ ID NO: 634235 - DNA, 25 bp, Mus musculus
gaagcctggcaagaacgagggcatc

SEQ ID NO: 634236 - DNA, 25 bp, Mus musculus
gaagcctgggaaccggctcacaagt

SEQ ID NO: 634237 - DNA, 25 bp, Mus musculus
gaagcctgggaagcggctcacaagt

SEQ ID NO: 634238 - DNA, 25 bp, Mus musculus
gaagcctggttcacctgtaaagtcc

SEQ ID NO: 634239 - DNA, 25 bp, Mus musculus
gaagcctggttctcctgtaaagtcc

SEQ ID NO: 634240 - DNA, 25 bp, Mus musculus
gaagcctgtactctgatctagagat

SEQ ID NO: 634241 - DNA, 25 bp, Mus musculus
gaagcctgtactgtgatctagagat

SEQ ID NO: 634242 - DNA, 25 bp, Mus musculus
gaagcctgtagacagtggtgctcct

SEQ ID NO: 634243 - DNA, 25 bp, Mus musculus
gaagcctgtagagagtggtgctcct

SEQ ID NO: 634244 - DNA, 25 bp, Mus musculus
gaagcctgtagtagtcgaatcccag

SEQ ID NO: 634245 - DNA, 25 bp, Mus musculus
gaagcctgtagttgtcgaatcccag

SEQ ID NO: 634246 - DNA, 25 bp, Mus musculus
gaagcctgtcacaaaaacactgtcc

SEQ ID NO: 634247 - DNA, 25 bp, Mus musculus
gaagcctgtcactaaaacactgtcc

SEQ ID NO: 634248 - DNA, 25 bp, Mus musculus
gaagcctgtcttcctcattgggcat

SEQ ID NO: 634249 - DNA, 25 bp, Mus musculus
gaagcctgtcttgctcattgggcat

SEQ ID NO: 634250 - DNA, 25 bp, Mus musculus
gaagcctgtgggaaccttacactgc

SEQ ID NO: 634251 - DNA, 25 bp, Mus musculus
gaagcctgtgggacccagacatcac

SEQ ID NO: 634252 - DNA, 25 bp, Mus musculus
gaagcctgtgggtaccttacactgc

SEQ ID NO: 634253 - DNA, 25 bp, Mus musculus
gaagcctgtgggtcccagacatcac

SEQ ID NO: 634254 - DNA, 25 bp, Mus musculus
gaagcctgttgtacctctggatatc

SEQ ID NO: 634255 - DNA, 25 bp, Mus musculus
gaagcctgttgttcctctggatatc

SEQ ID NO: 634256 - DNA, 25 bp, Mus musculus
gaagccttacacctctttccaggag

SEQ ID NO: 634257 - DNA, 25 bp, Mus musculus
gaagccttacacgtctttccaggag

SEQ ID NO: 634258 - DNA, 25 bp, Mus musculus
gaagccttactactacaacaaccag

SEQ ID NO: 634259 - DNA, 25 bp, Mus musculus
gaagccttactagtacaacaaccag

SEQ ID NO: 634260 - DNA, 25 bp, Mus musculus
gaagccttatctaaatcagtgcctg

SEQ ID NO: 634261 - DNA, 25 bp, Mus musculus
gaagccttatcttaatcagtgcctg

SEQ ID NO: 634262 - DNA, 25 bp, Mus musculus
gaagccttccgacactttgtaatta

SEQ ID NO: 634263 - DNA, 25 bp, Mus musculus
gaagccttccgagactttgtaatta

SEQ ID NO: 634264 - DNA, 25 bp, Mus musculus
gaagccttcctgctggatctgaatg

SEQ ID NO: 634265 - DNA, 25 bp, Mus musculus
gaagccttcctggtggatctgaatg

SEQ ID NO: 634266 - DNA, 25 bp, Mus musculus
gaagccttcggtccctgaataggaa

SEQ ID NO: 634267 - DNA, 25 bp, Mus musculus
gaagccttcggtgcctgaataggaa

SEQ ID NO: 634268 - DNA, 25 bp, Mus musculus
gaagccttctagacccatgtgatct

SEQ ID NO: 634269 - DNA, 25 bp, Mus musculus
gaagccttctagtcccatgtgatct

SEQ ID NO: 634270 - DNA, 25 bp, Mus musculus
gaagccttctccctcttcgacaagg

SEQ ID NO: 634271 - DNA, 25 bp, Mus musculus
gaagccttctccgtcttcgacaagg

SEQ ID NO: 634272 - DNA, 25 bp, Mus musculus
gaagccttcttgattaccatggaaa

SEQ ID NO: 634273 - DNA, 25 bp, Mus musculus
gaagccttcttgtttaccatggaaa

SEQ ID NO: 634274 - DNA, 25 bp, Mus musculus
gaagccttctttccaatgactcgat

SEQ ID NO: 634275 - DNA, 25 bp, Mus musculus
gaagccttctttgcaatgactcgat

SEQ ID NO: 634276 - DNA, 25 bp, Mus musculus
gaagccttgccaagccagaaagggt

SEQ ID NO: 634277 - DNA, 25 bp, Mus musculus
gaagccttgccatgccagaaagggt

SEQ ID NO: 634278 - DNA, 25 bp, Mus musculus
gaagccttgctcattccctgggtag

SEQ ID NO: 634279 - DNA, 25 bp, Mus musculus
gaagccttgctctttccctgggtag

SEQ ID NO: 634280 - DNA, 25 bp, Mus musculus
gaagccttggtcagtcatagaaaag

SEQ ID NO: 634281 - DNA, 25 bp, Mus musculus
gaagccttggtctgtcatagaaaag

SEQ ID NO: 634282 - DNA, 25 bp, Mus musculus
gaagcctttgaccttgagtcgtgaa

SEQ ID NO: 634283 - DNA, 25 bp, Mus musculus
gaagcctttgacgttgagtcgtgaa

SEQ ID NO: 634284 - DNA, 25 bp, Mus musculus
gaagcctttgcacgtatcaaaagtc

SEQ ID NO: 634285 - DNA, 25 bp, Mus musculus
gaagcctttgcaggtatcaaaagtc

SEQ ID NO: 634286 - DNA, 25 bp, Mus musculus
gaagcctttgctactccaccaggga

SEQ ID NO: 634287 - DNA, 25 bp, Mus musculus
gaagcctttgcttctccaccaggga

SEQ ID NO: 634288 - DNA, 25 bp, Mus musculus
gaagcctttggactttacactgctg

SEQ ID NO: 634289 - DNA, 25 bp, Mus musculus
gaagcctttggagtttacactgctg

SEQ ID NO: 634290 - DNA, 25 bp, Mus musculus
gaagcctttgtaattcaaaacatca

SEQ ID NO: 634291 - DNA, 25 bp, Mus musculus
gaagcctttgtatttcaaaacatca

SEQ ID NO: 634292 - DNA, 25 bp, Mus musculus
gaagccttttggagatgtccctcgg

SEQ ID NO: 634293 - DNA, 25 bp, Mus musculus
gaagccttttggtgatgtccctcgg

SEQ ID NO: 634294 - DNA, 25 bp, Mus musculus
gaagcgacacgtacgagtctggaag

SEQ ID NO: 634295 - DNA, 25 bp, Mus musculus
gaagcgacacgttcgagtctggaag

SEQ ID NO: 634296 - DNA, 25 bp, Mus musculus
gaagcgaccaagctgcagatggcct

SEQ ID NO: 634297 - DNA, 25 bp, Mus musculus
gaagcgaccaaggtgcagatggcct

SEQ ID NO: 634298 - DNA, 25 bp, Mus musculus
gaagcgaccattccctctaggagcc

SEQ ID NO: 634299 - DNA, 25 bp, Mus musculus
gaagcgaccattgcctctaggagcc

SEQ ID NO: 634300 - DNA, 25 bp, Mus musculus
gaagcgacttcgctctctgcagcgg

SEQ ID NO: 634301 - DNA, 25 bp, Mus musculus
gaagcgacttcggtctctgcagcgg

SEQ ID NO: 634302 - DNA, 25 bp, Mus musculus
gaagcgagaaaacagccttcaggag

SEQ ID NO: 634303 - DNA, 25 bp, Mus musculus
gaagcgagaaaagagccttcaggag

SEQ ID NO: 634304 - DNA, 25 bp, Mus musculus
gaagcgagaccccttccaggaaagt

SEQ ID NO: 634305 - DNA, 25 bp, Mus musculus
gaagcgagacccgttccaggaaagt

SEQ ID NO: 634306 - DNA, 25 bp, Mus musculus
gaagcgagccatacctgagaactag

SEQ ID NO: 634307 - DNA, 25 bp, Mus musculus
gaagcgagccattcctgagaactag

SEQ ID NO: 634308 - DNA, 25 bp, Mus musculus
gaagcgagtactacacctggttcct

SEQ ID NO: 634309 - DNA, 25 bp, Mus musculus
gaagcgagtacttcacctggttcct

SEQ ID NO: 634310 - DNA, 25 bp, Mus musculus
gaagcgagtcgtcattgacaacacc

SEQ ID NO: 634311 - DNA, 25 bp, Mus musculus
gaagcgagtcgtgattgacaacacc

SEQ ID NO: 634312 - DNA, 25 bp, Mus musculus
gaagcgatactgattaatgcaaagc

SEQ ID NO: 634313 - DNA, 25 bp, Mus musculus
gaagcgatactgtttaatgcaaagc

SEQ ID NO: 634314 - DNA, 25 bp, Mus musculus
gaagcgatcaaacctcgagtcaggg

SEQ ID NO: 634315 - DNA, 25 bp, Mus musculus
gaagcgatcaaagctcgagtcaggg

SEQ ID NO: 634316 - DNA, 25 bp, Mus musculus
gaagcgatttagacaggcctggaac

SEQ ID NO: 634317 - DNA, 25 bp, Mus musculus
gaagcgatttagtcaggcctggaac

SEQ ID NO: 634318 - DNA, 25 bp, Mus musculus
gaagcgcaagcaacatggagacgtg

SEQ ID NO: 634319 - DNA, 25 bp, Mus musculus
gaagcgcaagcatcatggagacgtg

SEQ ID NO: 634320 - DNA, 25 bp, Mus musculus
gaagcgcacaacacaccctcaattt

SEQ ID NO: 634321 - DNA, 25 bp, Mus musculus
gaagcgcacaactcaccctcaattt

SEQ ID NO: 634322 - DNA, 25 bp, Mus musculus
gaagcgcacagccatagaggccttc

SEQ ID NO: 634323 - DNA, 25 bp, Mus musculus
gaagcgcacagcgatagaggccttc

SEQ ID NO: 634324 - DNA, 25 bp, Mus musculus
gaagcgcacgacattcatcctctgg

SEQ ID NO: 634325 - DNA, 25 bp, Mus musculus
gaagcgcacgactttcatcctctgg

SEQ ID NO: 634326 - DNA, 25 bp, Mus musculus
gaagcgcagccaagacctgcagaag

SEQ ID NO: 634327 - DNA, 25 bp, Mus musculus
gaagcgcagccatgacctgcagaag

SEQ ID NO: 634328 - DNA, 25 bp, Mus musculus
gaagcgcatcctctatgccacctgg

SEQ ID NO: 634329 - DNA, 25 bp, Mus musculus
gaagcgcatcctgtatgccacctgg

SEQ ID NO: 634330 - DNA, 25 bp, Mus musculus
gaagcgccagcgactagagatcaat

SEQ ID NO: 634331 - DNA, 25 bp, Mus musculus
gaagcgccagcgtctagagatcaat

SEQ ID NO: 634332 - DNA, 25 bp, Mus musculus
gaagcgccatcgcacacggtccaaa

SEQ ID NO: 634333 - DNA, 25 bp, Mus musculus
gaagcgccatcggacacggtccaaa

SEQ ID NO: 634334 - DNA, 25 bp, Mus musculus
gaagcgccatgaagcagagaccaac

SEQ ID NO: 634335 - DNA, 25 bp, Mus musculus
gaagcgccatgatgcagagaccaac

SEQ ID NO: 634336 - DNA, 25 bp, Mus musculus
gaagcgcccaggactctgcaaaggg

SEQ ID NO: 634337 - DNA, 25 bp, Mus musculus
gaagcgcccaggtctctgcaaaggg

SEQ ID NO: 634338 - DNA, 25 bp, Mus musculus
gaagcgccgcacctctttttacttg

SEQ ID NO: 634339 - DNA, 25 bp, Mus musculus
gaagcgccgcacgtctttttacttg

SEQ ID NO: 634340 - DNA, 25 bp, Mus musculus
gaagcgccgtggcaccggctacaca

SEQ ID NO: 634341 - DNA, 25 bp, Mus musculus
gaagcgccgtgggaccggctacaca

SEQ ID NO: 634342 - DNA, 25 bp, Mus musculus
gaagcgcctcaactctaagacggtt

SEQ ID NO: 634343 - DNA, 25 bp, Mus musculus
gaagcgcctcaagtctaagacggtt

SEQ ID NO: 634344 - DNA, 25 bp, Mus musculus
gaagcgccttgacccactcatggta

SEQ ID NO: 634345 - DNA, 25 bp, Mus musculus
gaagcgccttgagccactcatggta

SEQ ID NO: 634346 - DNA, 25 bp, Mus musculus
gaagcgcgtgatcgtagatgccaat

SEQ ID NO: 634347 - DNA, 25 bp, Mus musculus
gaagcgcgtgatggtagatgccaat

SEQ ID NO: 634348 - DNA, 25 bp, Mus musculus
gaagcgctcaacatgaaattcaagg

SEQ ID NO: 634349 - DNA, 25 bp, Mus musculus
gaagcgctcaacttgaaattcaagg

SEQ ID NO: 634350 - DNA, 25 bp, Mus musculus
gaagcgctcatgaacccgctgtata

SEQ ID NO: 634351 - DNA, 25 bp, Mus musculus
gaagcgctcatgtacccgctgtata

SEQ ID NO: 634352 - DNA, 25 bp, Mus musculus
gaagcgctgcacaggctgttgtaac

SEQ ID NO: 634353 - DNA, 25 bp, Mus musculus
gaagcgctgcactggctgttgtaac

SEQ ID NO: 634354 - DNA, 25 bp, Mus musculus
gaagcgcttcagcttgagcttcaac

SEQ ID NO: 634355 - DNA, 25 bp, Mus musculus
gaagcgcttcaggttgagcttcaac

SEQ ID NO: 634356 - DNA, 25 bp, Mus musculus
gaagcgcttcgtcaaccagattgtg

SEQ ID NO: 634357 - DNA, 25 bp, Mus musculus
gaagcgcttcgtgaaccagattgtg

SEQ ID NO: 634358 - DNA, 25 bp, Mus musculus
gaagcgctttacacgttcggacgag

SEQ ID NO: 634359 - DNA, 25 bp, Mus musculus
gaagcgctttactcgttcggacgag

SEQ ID NO: 634360 - DNA, 25 bp, Mus musculus
gaagcggaaccccactcagcgaatt

SEQ ID NO: 634361 - DNA, 25 bp, Mus musculus
gaagcggaacccgactcagcgaatt

SEQ ID NO: 634362 - DNA, 25 bp, Mus musculus
gaagcggaagaaaaaaggcacttcg

SEQ ID NO: 634363 - DNA, 25 bp, Mus musculus
gaagcggaagaataaaggcacttcg

SEQ ID NO: 634364 - DNA, 25 bp, Mus musculus
gaagcggagatcctacaatgttcac

SEQ ID NO: 634365 - DNA, 25 bp, Mus musculus
gaagcggagatcgtacaatgttcac

SEQ ID NO: 634366 - DNA, 25 bp, Mus musculus
gaagcggaggaaatctatcaccctg

SEQ ID NO: 634367 - DNA, 25 bp, Mus musculus
gaagcggaggaattctatcaccctg

SEQ ID NO: 634368 - DNA, 25 bp, Mus musculus
gaagcggatatgctgggaactcact

SEQ ID NO: 634369 - DNA, 25 bp, Mus musculus
gaagcggatatggtgggaactcact

SEQ ID NO: 634370 - DNA, 25 bp, Mus musculus
gaagcggcataactggtcagtcctg

SEQ ID NO: 634371 - DNA, 25 bp, Mus musculus
gaagcggcataagtggtcagtcctg

SEQ ID NO: 634372 - DNA, 25 bp, Mus musculus
gaagcggcatgtagagactccccag

SEQ ID NO: 634373 - DNA, 25 bp, Mus musculus
gaagcggcatgttgagactccccag

SEQ ID NO: 634374 - DNA, 25 bp, Mus musculus
gaagcgggctacaatactatgcgag

SEQ ID NO: 634375 - DNA, 25 bp, Mus musculus
gaagcgggctactatactatgcgag

SEQ ID NO: 634376 - DNA, 25 bp, Mus musculus
gaagcgggctcaccctttgctgtag

SEQ ID NO: 634377 - DNA, 25 bp, Mus musculus
gaagcgggctcagcctttgctgtag

SEQ ID NO: 634378 - DNA, 25 bp, Mus musculus
gaagcggtaagtctggcagcccatt

SEQ ID NO: 634379 - DNA, 25 bp, Mus musculus
gaagcggtaagtgtggcagcccatt

SEQ ID NO: 634380 - DNA, 25 bp, Mus musculus
gaagcggtcagcaacttcctcactg

SEQ ID NO: 634381 - DNA, 25 bp, Mus musculus
gaagcggtcagctacttcctcactg

SEQ ID NO: 634382 - DNA, 25 bp, Mus musculus
gaagcggtgcgtaatatcaatgaga

SEQ ID NO: 634383 - DNA, 25 bp, Mus musculus
gaagcggtgcgttatatcaatgaga

SEQ ID NO: 634384 - DNA, 25 bp, Mus musculus
gaagcggttcagacaggtctcacac

SEQ ID NO: 634385 - DNA, 25 bp, Mus musculus
gaagcggttcagtcaggtctcacac

SEQ ID NO: 634386 - DNA, 25 bp, Mus musculus
gaagcggttcatcactgactcctat

SEQ ID NO: 634387 - DNA, 25 bp, Mus musculus
gaagcggttcatgactgactcctat

SEQ ID NO: 634388 - DNA, 25 bp, Mus musculus
gaagcggttttgatcctctgggctc

SEQ ID NO: 634389 - DNA, 25 bp, Mus musculus
gaagcggttttgttcctctgggctc

SEQ ID NO: 634390 - DNA, 25 bp, Mus musculus
gaagcgtagcttagggcgagtcact

SEQ ID NO: 634391 - DNA, 25 bp, Mus musculus
gaagcgtagctttgggcgagtcact

SEQ ID NO: 634392 - DNA, 25 bp, Mus musculus
gaagcgtattataggctccgtcaca

SEQ ID NO: 634393 - DNA, 25 bp, Mus musculus
gaagcgtattattggctccgtcaca

SEQ ID NO: 634394 - DNA, 25 bp, Mus musculus
gaagcgtcaaatcagaactgccagc

SEQ ID NO: 634395 - DNA, 25 bp, Mus musculus
gaagcgtcaaatgagaactgccagc

SEQ ID NO: 634396 - DNA, 25 bp, Mus musculus
gaagcgtcatgactaccttctgagt

SEQ ID NO: 634397 - DNA, 25 bp, Mus musculus
gaagcgtcatgagtaccttctgagt

SEQ ID NO: 634398 - DNA, 25 bp, Mus musculus
gaagcgtctcatcatctctgaccgg

SEQ ID NO: 634399 - DNA, 25 bp, Mus musculus
gaagcgtctcatgatctctgaccgg

SEQ ID NO: 634400 - DNA, 25 bp, Mus musculus
gaagcgtctctgaaagcggcagagc

SEQ ID NO: 634401 - DNA, 25 bp, Mus musculus
gaagcgtctctgtaagcggcagagc

SEQ ID NO: 634402 - DNA, 25 bp, Mus musculus
gaagcgtcttgtagctctgatcagt

SEQ ID NO: 634403 - DNA, 25 bp, Mus musculus
gaagcgtcttgttgctctgatcagt

SEQ ID NO: 634404 - DNA, 25 bp, Mus musculus
gaagcgtgacaacaatgtgactcca

SEQ ID NO: 634405 - DNA, 25 bp, Mus musculus
gaagcgtgacaagaatgtgactcca

SEQ ID NO: 634406 - DNA, 25 bp, Mus musculus
gaagcgtgctaacatgcacatcaag

SEQ ID NO: 634407 - DNA, 25 bp, Mus musculus
gaagcgtgctaagatgcacatcaag

SEQ ID NO: 634408 - DNA, 25 bp, Mus musculus
gaagcgtggtagctttcatctgaaa

SEQ ID NO: 634409 - DNA, 25 bp, Mus musculus
gaagcgtggtaggtttcatctgaaa

SEQ ID NO: 634410 - DNA, 25 bp, Mus musculus
gaagcgttagcgaagaggagaggaa

SEQ ID NO: 634411 - DNA, 25 bp, Mus musculus
gaagcgttagcgtagaggagaggaa

SEQ ID NO: 634412 - DNA, 25 bp, Mus musculus
gaagcgtttgaaccgattccacggg

SEQ ID NO: 634413 - DNA, 25 bp, Mus musculus
gaagcgtttgaagcgattccacggg

SEQ ID NO: 634414 - DNA, 25 bp, Mus musculus
gaagcgtttggcagaaaagaatgat

SEQ ID NO: 634415 - DNA, 25 bp, Mus musculus
gaagcgtttggctgaaaagaatgat

SEQ ID NO: 634416 - DNA, 25 bp, Mus musculus
gaagctaaaaatcttggcataaaga

SEQ ID NO: 634417 - DNA, 25 bp, Mus musculus
gaagctaaaaatgttggcataaaga

SEQ ID NO: 634418 - DNA, 25 bp, Mus musculus
gaagctaaaaggagaacttgaaagc

SEQ ID NO: 634419 - DNA, 25 bp, Mus musculus
gaagctaaaaggtgaacttgaaagc

SEQ ID NO: 634420 - DNA, 25 bp, Mus musculus
gaagctaaacaaccatactcgtccc

SEQ ID NO: 634421 - DNA, 25 bp, Mus musculus
gaagctaaacaagcatactcgtccc

SEQ ID NO: 634422 - DNA, 25 bp, Mus musculus
gaagctaaagcacatcgagcacact

SEQ ID NO: 634423 - DNA, 25 bp, Mus musculus
gaagctaaagcagatcgagcacact

SEQ ID NO: 634424 - DNA, 25 bp, Mus musculus
gaagctaaatctcatgctgatcgcc

SEQ ID NO: 634425 - DNA, 25 bp, Mus musculus
gaagctaaatctgatgctgatcgcc

SEQ ID NO: 634426 - DNA, 25 bp, Mus musculus
gaagctaaatttcgtgccagacgtt

SEQ ID NO: 634427 - DNA, 25 bp, Mus musculus
gaagctaaatttggtgccagacgtt

SEQ ID NO: 634428 - DNA, 25 bp, Mus musculus
gaagctaacaagctttagcagtcat

SEQ ID NO: 634429 - DNA, 25 bp, Mus musculus
gaagctaacaaggtttagcagtcat

SEQ ID NO: 634430 - DNA, 25 bp, Mus musculus
gaagctaacagacgcaccaagggct

SEQ ID NO: 634431 - DNA, 25 bp, Mus musculus
gaagctaacagaggcaccaagggct

SEQ ID NO: 634432 - DNA, 25 bp, Mus musculus
gaagctaacaggaatggcattccgg

SEQ ID NO: 634433 - DNA, 25 bp, Mus musculus
gaagctaacaggtatggcattccgg

SEQ ID NO: 634434 - DNA, 25 bp, Mus musculus
gaagctaaccagactgcgtggctca

SEQ ID NO: 634435 - DNA, 25 bp, Mus musculus
gaagctaaccagctgctacagtttg

SEQ ID NO: 634436 - DNA, 25 bp, Mus musculus
gaagctaaccaggtgctacagtttg

SEQ ID NO: 634437 - DNA, 25 bp, Mus musculus
gaagctaaccagtctgcgtggctca

SEQ ID NO: 634438 - DNA, 25 bp, Mus musculus
gaagctaacccacgattatctgaac

SEQ ID NO: 634439 - DNA, 25 bp, Mus musculus
gaagctaacccaggattatctgaac

SEQ ID NO: 634440 - DNA, 25 bp, Mus musculus
gaagctaagccacaaccagagcgat

SEQ ID NO: 634441 - DNA, 25 bp, Mus musculus
gaagctaagccagaaccagagcgat

SEQ ID NO: 634442 - DNA, 25 bp, Mus musculus
gaagctaagcccatttaacatcacc

SEQ ID NO: 634443 - DNA, 25 bp, Mus musculus
gaagctaagcccttttaacatcacc

SEQ ID NO: 634444 - DNA, 25 bp, Mus musculus
gaagctaagctgagacttgaagatc

SEQ ID NO: 634445 - DNA, 25 bp, Mus musculus
gaagctaagctgtgacttgaagatc

SEQ ID NO: 634446 - DNA, 25 bp, Mus musculus
gaagctaaggacctcaaggcacgga

SEQ ID NO: 634447 - DNA, 25 bp, Mus musculus
gaagctaaggacgtcaaggcacgga

SEQ ID NO: 634448 - DNA, 25 bp, Mus musculus
gaagctaatcggaagacacaagaac

SEQ ID NO: 634449 - DNA, 25 bp, Mus musculus
gaagctaatcggtagacacaagaac

SEQ ID NO: 634450 - DNA, 25 bp, Mus musculus
gaagctaatgaaaataaggatgttg

SEQ ID NO: 634451 - DNA, 25 bp, Mus musculus
gaagctaatgaatataaggatgttg

SEQ ID NO: 634452 - DNA, 25 bp, Mus musculus
gaagctaatggaagacccacactag

SEQ ID NO: 634453 - DNA, 25 bp, Mus musculus
gaagctaatggatgacccacactag

SEQ ID NO: 634454 - DNA, 25 bp, Mus musculus
gaagctaatggcaaattcctctaca

SEQ ID NO: 634455 - DNA, 25 bp, Mus musculus
gaagctaatggctaattcctctaca

SEQ ID NO: 634456 - DNA, 25 bp, Mus musculus
gaagctacaagcagaagccaaaatg

SEQ ID NO: 634457 - DNA, 25 bp, Mus musculus
gaagctacaagctgaagccaaaatg

SEQ ID NO: 634458 - DNA, 25 bp, Mus musculus
gaagctacaaggatatcagctcccc

SEQ ID NO: 634459 - DNA, 25 bp, Mus musculus
gaagctacaaggttatcagctcccc

SEQ ID NO: 634460 - DNA, 25 bp, Mus musculus
gaagctaccaataaagaacacacgt

SEQ ID NO: 634461 - DNA, 25 bp, Mus musculus
gaagctaccaattaagaacacacgt

SEQ ID NO: 634462 - DNA, 25 bp, Mus musculus
gaagctacccagctctgtgggtcag

SEQ ID NO: 634463 - DNA, 25 bp, Mus musculus
gaagctacccaggtctgtgggtcag

SEQ ID NO: 634464 - DNA, 25 bp, Mus musculus
gaagctaccgagactgctctcacgt

SEQ ID NO: 634465 - DNA, 25 bp, Mus musculus
gaagctaccgagtctgctctcacgt

SEQ ID NO: 634466 - DNA, 25 bp, Mus musculus
gaagctacgattcgtgtctttgcgg

SEQ ID NO: 634467 - DNA, 25 bp, Mus musculus
gaagctacgattggtgtctttgcgg

SEQ ID NO: 634468 - DNA, 25 bp, Mus musculus
gaagctacgtgaagtctaccgtaaa

SEQ ID NO: 634469 - DNA, 25 bp, Mus musculus
gaagctacgtgatgtctaccgtaaa

SEQ ID NO: 634470 - DNA, 25 bp, Mus musculus
gaagctactaagaggttcttggaac

SEQ ID NO: 634471 - DNA, 25 bp, Mus musculus
gaagctactaagtggttcttggaac

SEQ ID NO: 634472 - DNA, 25 bp, Mus musculus
gaagctactacacaggtgcagctgg

SEQ ID NO: 634473 - DNA, 25 bp, Mus musculus
gaagctactacagaggtgcagctgg

SEQ ID NO: 634474 - DNA, 25 bp, Mus musculus
gaagctactcatcctagatgaccaa

SEQ ID NO: 634475 - DNA, 25 bp, Mus musculus
gaagctactcatgctagatgaccaa

SEQ ID NO: 634476 - DNA, 25 bp, Mus musculus
gaagctacttcacggagacagcagg

SEQ ID NO: 634477 - DNA, 25 bp, Mus musculus
gaagctacttcagggagacagcagg

SEQ ID NO: 634478 - DNA, 25 bp, Mus musculus
gaagctagagcacccacacgtgctg

SEQ ID NO: 634479 - DNA, 25 bp, Mus musculus
gaagctagagcagccacacgtgctg

SEQ ID NO: 634480 - DNA, 25 bp, Mus musculus
gaagctagccggctgaaaacctcac

SEQ ID NO: 634481 - DNA, 25 bp, Mus musculus
gaagctagccgggtgaaaacctcac

SEQ ID NO: 634482 - DNA, 25 bp, Mus musculus
gaagctagcttaagctgttcgaggc

SEQ ID NO: 634483 - DNA, 25 bp, Mus musculus
gaagctagcttaagttgctgctggg

SEQ ID NO: 634484 - DNA, 25 bp, Mus musculus
gaagctagcttatgctgttcgaggc

SEQ ID NO: 634485 - DNA, 25 bp, Mus musculus
gaagctagcttatgttgctgctggg

SEQ ID NO: 634486 - DNA, 25 bp, Mus musculus
gaagctaggagacattgtgacaacc

SEQ ID NO: 634487 - DNA, 25 bp, Mus musculus
gaagctaggagagattgtgacaacc

SEQ ID NO: 634488 - DNA, 25 bp, Mus musculus
gaagctaggcacacggatggctcct

SEQ ID NO: 634489 - DNA, 25 bp, Mus musculus
gaagctaggcactcggatggctcct

SEQ ID NO: 634490 - DNA, 25 bp, Mus musculus
gaagctagggctatcaaccgaatat

SEQ ID NO: 634491 - DNA, 25 bp, Mus musculus
gaagctagggctttcaaccgaatat

SEQ ID NO: 634492 - DNA, 25 bp, Mus musculus
gaagctaggtgacttcggcatccga

SEQ ID NO: 634493 - DNA, 25 bp, Mus musculus
gaagctaggtgagttcggcatccga

SEQ ID NO: 634494 - DNA, 25 bp, Mus musculus
gaagctagtgggacctgaggtgcgc

SEQ ID NO: 634495 - DNA, 25 bp, Mus musculus
gaagctagtgggtcctgaggtgcgc

SEQ ID NO: 634496 - DNA, 25 bp, Mus musculus
gaagctatagctcgattggatcagc

SEQ ID NO: 634497 - DNA, 25 bp, Mus musculus
gaagctatagctggattggatcagc

SEQ ID NO: 634498 - DNA, 25 bp, Mus musculus
gaagctatctaaaaccctgaagaaa

SEQ ID NO: 634499 - DNA, 25 bp, Mus musculus
gaagctatctaataccctgaagaaa

SEQ ID NO: 634500 - DNA, 25 bp, Mus musculus
gaagctatggaactgatagtcaaac

SEQ ID NO: 634501 - DNA, 25 bp, Mus musculus
gaagctatggaagtgatagtcaaac

SEQ ID NO: 634502 - DNA, 25 bp, Mus musculus
gaagctatgggacccttccaggagt

SEQ ID NO: 634503 - DNA, 25 bp, Mus musculus
gaagctatgggagccttccaggagt

SEQ ID NO: 634504 - DNA, 25 bp, Mus musculus
gaagctattagacctgcttggcaaa

SEQ ID NO: 634505 - DNA, 25 bp, Mus musculus
gaagctattagagctgcttggcaaa

SEQ ID NO: 634506 - DNA, 25 bp, Mus musculus
gaagctattcttcttagtagcaagg

SEQ ID NO: 634507 - DNA, 25 bp, Mus musculus
gaagctattcttgttagtagcaagg

SEQ ID NO: 634508 - DNA, 25 bp, Mus musculus
gaagctattgacctctactcggcgc

SEQ ID NO: 634509 - DNA, 25 bp, Mus musculus
gaagctattgacgtctactcggcgc

SEQ ID NO: 634510 - DNA, 25 bp, Mus musculus
gaagctattggcatcgacaaggacc

SEQ ID NO: 634511 - DNA, 25 bp, Mus musculus
gaagctattggcttcgacaaggacc

SEQ ID NO: 634512 - DNA, 25 bp, Mus musculus
gaagctattgttccagttactaaga

SEQ ID NO: 634513 - DNA, 25 bp, Mus musculus
gaagctattgttgcagttactaaga

SEQ ID NO: 634514 - DNA, 25 bp, Mus musculus
gaagctcaacatcgagatttccgat

SEQ ID NO: 634515 - DNA, 25 bp, Mus musculus
gaagctcaacatggagatttccgat

SEQ ID NO: 634516 - DNA, 25 bp, Mus musculus
gaagctcaagaaagacatggcagtg

SEQ ID NO: 634517 - DNA, 25 bp, Mus musculus
gaagctcaagaatgacatggcagtg

SEQ ID NO: 634518 - DNA, 25 bp, Mus musculus
gaagctcaagagaaaacgcattccg

SEQ ID NO: 634519 - DNA, 25 bp, Mus musculus
gaagctcaagagtaaacgcattccg

SEQ ID NO: 634520 - DNA, 25 bp, Mus musculus
gaagctcaaggacagttgcctcaaa

SEQ ID NO: 634521 - DNA, 25 bp, Mus musculus
gaagctcaaggagagttgcctcaaa

SEQ ID NO: 634522 - DNA, 25 bp, Mus musculus
gaagctcaatgaagttatagtcaac

SEQ ID NO: 634523 - DNA, 25 bp, Mus musculus
gaagctcaatgatgttatagtcaac

SEQ ID NO: 634524 - DNA, 25 bp, Mus musculus
gaagctcaatgcagaccgatcacgc

SEQ ID NO: 634525 - DNA, 25 bp, Mus musculus
gaagctcaatgctgaccgatcacgc

SEQ ID NO: 634526 - DNA, 25 bp, Mus musculus
gaagctcaattacctgcgcatctca

SEQ ID NO: 634527 - DNA, 25 bp, Mus musculus
gaagctcaattagctgcgcatctca

SEQ ID NO: 634528 - DNA, 25 bp, Mus musculus
gaagctcacagcagagtttgaggag

SEQ ID NO: 634529 - DNA, 25 bp, Mus musculus
gaagctcacagcctagtacagcact

SEQ ID NO: 634530 - DNA, 25 bp, Mus musculus
gaagctcacagcgtagtacagcact

SEQ ID NO: 634531 - DNA, 25 bp, Mus musculus
gaagctcacagctgagtttgaggag

SEQ ID NO: 634532 - DNA, 25 bp, Mus musculus
gaagctcactaccagtgacattgac

SEQ ID NO: 634533 - DNA, 25 bp, Mus musculus
gaagctcactacgagtgacattgac

SEQ ID NO: 634534 - DNA, 25 bp, Mus musculus
gaagctcactgcattggccccatac

SEQ ID NO: 634535 - DNA, 25 bp, Mus musculus
gaagctcactgctttggccccatac

SEQ ID NO: 634536 - DNA, 25 bp, Mus musculus
gaagctcacttcctaaagctgcagg

SEQ ID NO: 634537 - DNA, 25 bp, Mus musculus
gaagctcacttcgtaaagctgcagg

SEQ ID NO: 634538 - DNA, 25 bp, Mus musculus
gaagctcagattagctcccttggga

SEQ ID NO: 634539 - DNA, 25 bp, Mus musculus
gaagctcagatttgctcccttggga

SEQ ID NO: 634540 - DNA, 25 bp, Mus musculus
gaagctcagccccacttgttgatct

SEQ ID NO: 634541 - DNA, 25 bp, Mus musculus
gaagctcagcccgacttgttgatct

SEQ ID NO: 634542 - DNA, 25 bp, Mus musculus
gaagctcagcgcacagctgctgtga

SEQ ID NO: 634543 - DNA, 25 bp, Mus musculus
gaagctcagcgctcagctgctgtga

SEQ ID NO: 634544 - DNA, 25 bp, Mus musculus
gaagctcaggaaaaaggcgaccact

SEQ ID NO: 634545 - DNA, 25 bp, Mus musculus
gaagctcaggaataaggcgaccact

SEQ ID NO: 634546 - DNA, 25 bp, Mus musculus
gaagctcatcaaagccgtttccaat

SEQ ID NO: 634547 - DNA, 25 bp, Mus musculus
gaagctcatcaatgccgtttccaat

SEQ ID NO: 634548 - DNA, 25 bp, Mus musculus
gaagctcatcggctgctgctggtat

SEQ ID NO: 634549 - DNA, 25 bp, Mus musculus
gaagctcatcgggtgctgctggtat

SEQ ID NO: 634550 - DNA, 25 bp, Mus musculus
gaagctcatgagaggaaccagagaa

SEQ ID NO: 634551 - DNA, 25 bp, Mus musculus
gaagctcatgagtggaaccagagaa

SEQ ID NO: 634552 - DNA, 25 bp, Mus musculus
gaagctcatgcacatggcagatact

SEQ ID NO: 634553 - DNA, 25 bp, Mus musculus
gaagctcatgcagatggcagatact

SEQ ID NO: 634554 - DNA, 25 bp, Mus musculus
gaagctcattttaagactcgttgga

SEQ ID NO: 634555 - DNA, 25 bp, Mus musculus
gaagctcattttctccaacatctcc

SEQ ID NO: 634556 - DNA, 25 bp, Mus musculus
gaagctcattttgtccaacatctcc

SEQ ID NO: 634557 - DNA, 25 bp, Mus musculus
gaagctcatttttagactcgttgga

SEQ ID NO: 634558 - DNA, 25 bp, Mus musculus
gaagctccaggaaacagttgaaccg

SEQ ID NO: 634559 - DNA, 25 bp, Mus musculus
gaagctccaggatacagttgaaccg

SEQ ID NO: 634560 - DNA, 25 bp, Mus musculus
gaagctccaggtaacccgcgcattt

SEQ ID NO: 634561 - DNA, 25 bp, Mus musculus
gaagctccaggtacgcacaagagaa

SEQ ID NO: 634562 - DNA, 25 bp, Mus musculus
gaagctccaggttacccgcgcattt

SEQ ID NO: 634563 - DNA, 25 bp, Mus musculus
gaagctccaggttcgcacaagagaa

SEQ ID NO: 634564 - DNA, 25 bp, Mus musculus
gaagctccatccatgtgcaacacca

SEQ ID NO: 634565 - DNA, 25 bp, Mus musculus
gaagctccatccttgtgcaacacca

SEQ ID NO: 634566 - DNA, 25 bp, Mus musculus
gaagctcccagaattggaccagaca

SEQ ID NO: 634567 - DNA, 25 bp, Mus musculus
gaagctcccagatttggaccagaca

SEQ ID NO: 634568 - DNA, 25 bp, Mus musculus
gaagctccccaaccaaggatatgga

SEQ ID NO: 634569 - DNA, 25 bp, Mus musculus
gaagctccccaagcaaggatatgga

SEQ ID NO: 634570 - DNA, 25 bp, Mus musculus
gaagctccctcaactttggattata

SEQ ID NO: 634571 - DNA, 25 bp, Mus musculus
gaagctccctcatctttggattata

SEQ ID NO: 634572 - DNA, 25 bp, Mus musculus
gaagctccgagaaaaagtggacaaa

SEQ ID NO: 634573 - DNA, 25 bp, Mus musculus
gaagctccgagataaagtggacaaa

SEQ ID NO: 634574 - DNA, 25 bp, Mus musculus
gaagctccgggaacaagtgaattcc

SEQ ID NO: 634575 - DNA, 25 bp, Mus musculus
gaagctccgggatcaagtgaattcc

SEQ ID NO: 634576 - DNA, 25 bp, Mus musculus
gaagctcctgttcacttgagcacag

SEQ ID NO: 634577 - DNA, 25 bp, Mus musculus
gaagctcctgttgacttgagcacag

SEQ ID NO: 634578 - DNA, 25 bp, Mus musculus
gaagctcgaagcaaaactgcttgca

SEQ ID NO: 634579 - DNA, 25 bp, Mus musculus
gaagctcgaagctaaactgcttgca

SEQ ID NO: 634580 - DNA, 25 bp, Mus musculus
gaagctcgacaaagagaacgccttg

SEQ ID NO: 634581 - DNA, 25 bp, Mus musculus
gaagctcgacaatgagaacgccttg

SEQ ID NO: 634582 - DNA, 25 bp, Mus musculus
gaagctcgggtgatgtgtgccccac

SEQ ID NO: 634583 - DNA, 25 bp, Mus musculus
gaagctcgggtgttgtgtgccccac

SEQ ID NO: 634584 - DNA, 25 bp, Mus musculus
gaagctctcagcactccttcctgag

SEQ ID NO: 634585 - DNA, 25 bp, Mus musculus
gaagctctcagcatctcaaaggcag

SEQ ID NO: 634586 - DNA, 25 bp, Mus musculus
gaagctctcagctctccttcctgag

SEQ ID NO: 634587 - DNA, 25 bp, Mus musculus
gaagctctcagcttctcaaaggcag

SEQ ID NO: 634588 - DNA, 25 bp, Mus musculus
gaagctctccatactgaagtaccag

SEQ ID NO: 634589 - DNA, 25 bp, Mus musculus
gaagctctccattctgaagtaccag

SEQ ID NO: 634590 - DNA, 25 bp, Mus musculus
gaagctctcggacacatatacctgc

SEQ ID NO: 634591 - DNA, 25 bp, Mus musculus
gaagctctcggagacatatacctgc

SEQ ID NO: 634592 - DNA, 25 bp, Mus musculus
gaagctctcggtccagctgagcgat

SEQ ID NO: 634593 - DNA, 25 bp, Mus musculus
gaagctctcggtgcagctgagcgat

SEQ ID NO: 634594 - DNA, 25 bp, Mus musculus
gaagctctctgtctggatacggagt

SEQ ID NO: 634595 - DNA, 25 bp, Mus musculus
gaagctctctgtgtggatacggagt

SEQ ID NO: 634596 - DNA, 25 bp, Mus musculus
gaagctctgaagagaaacttcctgg

SEQ ID NO: 634597 - DNA, 25 bp, Mus musculus
gaagctctgaagatgccctaccaga

SEQ ID NO: 634598 - DNA, 25 bp, Mus musculus
gaagctctgaagtgaaacttcctgg

SEQ ID NO: 634599 - DNA, 25 bp, Mus musculus
gaagctctgaagttgccctaccaga

SEQ ID NO: 634600 - DNA, 25 bp, Mus musculus
gaagctctgagtacttggttgcagg

SEQ ID NO: 634601 - DNA, 25 bp, Mus musculus
gaagctctgagttcttggttgcagg

SEQ ID NO: 634602 - DNA, 25 bp, Mus musculus
gaagctctgcagagcattgccacgg

SEQ ID NO: 634603 - DNA, 25 bp, Mus musculus
gaagctctgcagtgcattgccacgg

SEQ ID NO: 634604 - DNA, 25 bp, Mus musculus
gaagctctgcggacgttcaaccggg

SEQ ID NO: 634605 - DNA, 25 bp, Mus musculus
gaagctctgcggtcgttcaaccggg

SEQ ID NO: 634606 - DNA, 25 bp, Mus musculus
gaagctctgggcaaagtttctttaa

SEQ ID NO: 634607 - DNA, 25 bp, Mus musculus
gaagctctgggctaagtttctttaa

SEQ ID NO: 634608 - DNA, 25 bp, Mus musculus
gaagctctgggtatcctgtgtccca

SEQ ID NO: 634609 - DNA, 25 bp, Mus musculus
gaagctctgggtttcctgtgtccca

SEQ ID NO: 634610 - DNA, 25 bp, Mus musculus
gaagctctgtctcctcatccgagta

SEQ ID NO: 634611 - DNA, 25 bp, Mus musculus
gaagctctgtctgctcatccgagta

SEQ ID NO: 634612 - DNA, 25 bp, Mus musculus
gaagctctgttactctgccctcgtc

SEQ ID NO: 634613 - DNA, 25 bp, Mus musculus
gaagctctgttagtctgccctcgtc

SEQ ID NO: 634614 - DNA, 25 bp, Mus musculus
gaagctcttcttcctgcaagtcaag

SEQ ID NO: 634615 - DNA, 25 bp, Mus musculus
gaagctcttcttgctgcaagtcaag

SEQ ID NO: 634616 - DNA, 25 bp, Mus musculus
gaagctcttgatatctgtgcacgga

SEQ ID NO: 634617 - DNA, 25 bp, Mus musculus
gaagctcttgatttctgtgcacgga

SEQ ID NO: 634618 - DNA, 25 bp, Mus musculus
gaagctctttatcaccagcacagca

SEQ ID NO: 634619 - DNA, 25 bp, Mus musculus
gaagctctttatgaccagcacagca

SEQ ID NO: 634620 - DNA, 25 bp, Mus musculus
gaagctctttccaacgaagactgtg

SEQ ID NO: 634621 - DNA, 25 bp, Mus musculus
gaagctctttcctacgaagactgtg

SEQ ID NO: 634622 - DNA, 25 bp, Mus musculus
gaagctctttgcctctcagcaagtc

SEQ ID NO: 634623 - DNA, 25 bp, Mus musculus
gaagctctttgcgtctcagcaagtc

SEQ ID NO: 634624 - DNA, 25 bp, Mus musculus
gaagctgaaaagaatgctcctgcta

SEQ ID NO: 634625 - DNA, 25 bp, Mus musculus
gaagctgaaaagtatgctcctgcta

SEQ ID NO: 634626 - DNA, 25 bp, Mus musculus
gaagctgaaacaaacagtcagatct

SEQ ID NO: 634627 - DNA, 25 bp, Mus musculus
gaagctgaaacatacagtcagatct

SEQ ID NO: 634628 - DNA, 25 bp, Mus musculus
gaagctgaacatccaagccatcctt

SEQ ID NO: 634629 - DNA, 25 bp, Mus musculus
gaagctgaacatcgacatcaagtca

SEQ ID NO: 634630 - DNA, 25 bp, Mus musculus
gaagctgaacatgcaagccatcctt

SEQ ID NO: 634631 - DNA, 25 bp, Mus musculus
gaagctgaacatggacatcaagtca

SEQ ID NO: 634632 - DNA, 25 bp, Mus musculus
gaagctgaagaaacgaatgcagggc

SEQ ID NO: 634633 - DNA, 25 bp, Mus musculus
gaagctgaagaatcgaatgcagggc

SEQ ID NO: 634634 - DNA, 25 bp, Mus musculus
gaagctgaagcactcgcagctgttg

SEQ ID NO: 634635 - DNA, 25 bp, Mus musculus
gaagctgaagcagtcgcagctgttg

SEQ ID NO: 634636 - DNA, 25 bp, Mus musculus
gaagctgaaggaatatttacgaaac

SEQ ID NO: 634637 - DNA, 25 bp, Mus musculus
gaagctgaaggattatttacgaaac

SEQ ID NO: 634638 - DNA, 25 bp, Mus musculus
gaagctgaaggcagataaaagggca

SEQ ID NO: 634639 - DNA, 25 bp, Mus musculus
gaagctgaaggctgataaaagggca

SEQ ID NO: 634640 - DNA, 25 bp, Mus musculus
gaagctgaatctcctgaccgagtac

SEQ ID NO: 634641 - DNA, 25 bp, Mus musculus
gaagctgaatctgctgaccgagtac

SEQ ID NO: 634642 - DNA, 25 bp, Mus musculus
gaagctgaatgacttaggcctggac

SEQ ID NO: 634643 - DNA, 25 bp, Mus musculus
gaagctgaatgagttaggcctggac

SEQ ID NO: 634644 - DNA, 25 bp, Mus musculus
gaagctgaatttcgtaatgacagaa

SEQ ID NO: 634645 - DNA, 25 bp, Mus musculus
gaagctgaatttggtaatgacagaa

SEQ ID NO: 634646 - DNA, 25 bp, Mus musculus
gaagctgacaggcataagtgaccca

SEQ ID NO: 634647 - DNA, 25 bp, Mus musculus
gaagctgacagggataagtgaccca

SEQ ID NO: 634648 - DNA, 25 bp, Mus musculus
gaagctgacattaaggaccagccag

SEQ ID NO: 634649 - DNA, 25 bp, Mus musculus
gaagctgacatttaggaccagccag

SEQ ID NO: 634650 - DNA, 25 bp, Mus musculus
gaagctgaccacaatgagtgcctgt

SEQ ID NO: 634651 - DNA, 25 bp, Mus musculus
gaagctgaccactatgagtgcctgt

SEQ ID NO: 634652 - DNA, 25 bp, Mus musculus
gaagctgaccgaatcaacttgcaga

SEQ ID NO: 634653 - DNA, 25 bp, Mus musculus
gaagctgaccgattcaacttgcaga

SEQ ID NO: 634654 - DNA, 25 bp, Mus musculus
gaagctgaccttaaatcctgaccct

SEQ ID NO: 634655 - DNA, 25 bp, Mus musculus
gaagctgacctttaatcctgaccct

SEQ ID NO: 634656 - DNA, 25 bp, Mus musculus
gaagctgacgatcatgatatctaca

SEQ ID NO: 634657 - DNA, 25 bp, Mus musculus
gaagctgacgatgatgatatctaca

SEQ ID NO: 634658 - DNA, 25 bp, Mus musculus
gaagctgacggaccaatccaacacc

SEQ ID NO: 634659 - DNA, 25 bp, Mus musculus
gaagctgacggagcaatccaacacc

SEQ ID NO: 634660 - DNA, 25 bp, Mus musculus
gaagctgacgtaccttctctgaaca

SEQ ID NO: 634661 - DNA, 25 bp, Mus musculus
gaagctgacgtagcttctctgaaca

SEQ ID NO: 634662 - DNA, 25 bp, Mus musculus
gaagctgactcaaggtgtcctgcac

SEQ ID NO: 634663 - DNA, 25 bp, Mus musculus
gaagctgactcatggtgtcctgcac

SEQ ID NO: 634664 - DNA, 25 bp, Mus musculus
gaagctgagagcactcgcttattga

SEQ ID NO: 634665 - DNA, 25 bp, Mus musculus
gaagctgagagctctcgcttattga

SEQ ID NO: 634666 - DNA, 25 bp, Mus musculus
gaagctgagcagaaacaggcagaag

SEQ ID NO: 634667 - DNA, 25 bp, Mus musculus
gaagctgagcagtaacaggcagaag

SEQ ID NO: 634668 - DNA, 25 bp, Mus musculus
gaagctgagcatctcctggagctgc

SEQ ID NO: 634669 - DNA, 25 bp, Mus musculus
gaagctgagcatgtcctggagctgc

SEQ ID NO: 634670 - DNA, 25 bp, Mus musculus
gaagctgagcctccagaaagatctg

SEQ ID NO: 634671 - DNA, 25 bp, Mus musculus
gaagctgagcctgcagaaagatctg

SEQ ID NO: 634672 - DNA, 25 bp, Mus musculus
gaagctgagctgaattacttgagga

SEQ ID NO: 634673 - DNA, 25 bp, Mus musculus
gaagctgagctgtattacttgagga

SEQ ID NO: 634674 - DNA, 25 bp, Mus musculus
gaagctgaggccattgctataggtg

SEQ ID NO: 634675 - DNA, 25 bp, Mus musculus
gaagctgaggcctttgctataggtg

SEQ ID NO: 634676 - DNA, 25 bp, Mus musculus
gaagctgaggtactgccttcatcag

SEQ ID NO: 634677 - DNA, 25 bp, Mus musculus
gaagctgaggtagtgccttcatcag

SEQ ID NO: 634678 - DNA, 25 bp, Mus musculus
gaagctgagtggaagcattcattta

SEQ ID NO: 634679 - DNA, 25 bp, Mus musculus
gaagctgagtggtagcattcattta

SEQ ID NO: 634680 - DNA, 25 bp, Mus musculus
gaagctgatgcgcatctcatcaatg

SEQ ID NO: 634681 - DNA, 25 bp, Mus musculus
gaagctgatgcggatctcatcaatg

SEQ ID NO: 634682 - DNA, 25 bp, Mus musculus
gaagctgatgctaattgactttgag

SEQ ID NO: 634683 - DNA, 25 bp, Mus musculus
gaagctgatgcttattgactttgag

SEQ ID NO: 634684 - DNA, 25 bp, Mus musculus
gaagctgatgtcactgctctgcaag

SEQ ID NO: 634685 - DNA, 25 bp, Mus musculus
gaagctgatgtctctgctctgcaag

SEQ ID NO: 634686 - DNA, 25 bp, Mus musculus
gaagctgattctctgtatacttgtg

SEQ ID NO: 634687 - DNA, 25 bp, Mus musculus
gaagctgattctgtgtatacttgtg

SEQ ID NO: 634688 - DNA, 25 bp, Mus musculus
gaagctgcaaaacgtggccatacta

SEQ ID NO: 634689 - DNA, 25 bp, Mus musculus
gaagctgcaaaaggtggccatacta

SEQ ID NO: 634690 - DNA, 25 bp, Mus musculus
gaagctgcaaatatttacctccaat

SEQ ID NO: 634691 - DNA, 25 bp, Mus musculus
gaagctgcaaatttttacctccaat

SEQ ID NO: 634692 - DNA, 25 bp, Mus musculus
gaagctgcaagcagatctcaggcca

SEQ ID NO: 634693 - DNA, 25 bp, Mus musculus
gaagctgcaagctgatctcaggcca

SEQ ID NO: 634694 - DNA, 25 bp, Mus musculus
gaagctgcactgcacaaggaactac

SEQ ID NO: 634695 - DNA, 25 bp, Mus musculus
gaagctgcactggacaaggaactac

SEQ ID NO: 634696 - DNA, 25 bp, Mus musculus
gaagctgcatccataatgagaacag

SEQ ID NO: 634697 - DNA, 25 bp, Mus musculus
gaagctgcatccttaatgagaacag

SEQ ID NO: 634698 - DNA, 25 bp, Mus musculus
gaagctgccactattgctagagagc

SEQ ID NO: 634699 - DNA, 25 bp, Mus musculus
gaagctgccacttttgctagagagc

SEQ ID NO: 634700 - DNA, 25 bp, Mus musculus
gaagctgccatcatcctttgcagct

SEQ ID NO: 634701 - DNA, 25 bp, Mus musculus
gaagctgccatcttcctttgcagct

SEQ ID NO: 634702 - DNA, 25 bp, Mus musculus
gaagctgccatgcagcacaaggtga

SEQ ID NO: 634703 - DNA, 25 bp, Mus musculus
gaagctgccatggagcacaaggtga

SEQ ID NO: 634704 - DNA, 25 bp, Mus musculus
gaagctgcccccaatccctgtggtg

SEQ ID NO: 634705 - DNA, 25 bp, Mus musculus
gaagctgccccctatccctgtggtg

SEQ ID NO: 634706 - DNA, 25 bp, Mus musculus
gaagctgccctcatacaggagtccc

SEQ ID NO: 634707 - DNA, 25 bp, Mus musculus
gaagctgccctcttacaggagtccc

SEQ ID NO: 634708 - DNA, 25 bp, Mus musculus
gaagctgccctgaccatatacctgg

SEQ ID NO: 634709 - DNA, 25 bp, Mus musculus
gaagctgccctgtccatatacctgg

SEQ ID NO: 634710 - DNA, 25 bp, Mus musculus
gaagctgccgtaaccaatggtccat

SEQ ID NO: 634711 - DNA, 25 bp, Mus musculus
gaagctgccgtatccaatggtccat

SEQ ID NO: 634712 - DNA, 25 bp, Mus musculus
gaagctgcctacacgaagaggctgg

SEQ ID NO: 634713 - DNA, 25 bp, Mus musculus
gaagctgcctactcgaagaggctgg

SEQ ID NO: 634714 - DNA, 25 bp, Mus musculus
gaagctgcctttcgaagcatgctga

SEQ ID NO: 634715 - DNA, 25 bp, Mus musculus
gaagctgcctttggaagcatgctga

SEQ ID NO: 634716 - DNA, 25 bp, Mus musculus
gaagctgcgctaaaaggtggatcac

SEQ ID NO: 634717 - DNA, 25 bp, Mus musculus
gaagctgcgctataaggtggatcac

SEQ ID NO: 634718 - DNA, 25 bp, Mus musculus
gaagctgcggtcctcaccatgagtc

SEQ ID NO: 634719 - DNA, 25 bp, Mus musculus
gaagctgcggtcgtcaccatgagtc

SEQ ID NO: 634720 - DNA, 25 bp, Mus musculus
gaagctgctactcagatcctacttc

SEQ ID NO: 634721 - DNA, 25 bp, Mus musculus
gaagctgctactgagatcctacttc

SEQ ID NO: 634722 - DNA, 25 bp, Mus musculus
gaagctgctcagctccacgttggtg

SEQ ID NO: 634723 - DNA, 25 bp, Mus musculus
gaagctgctcaggtccacgttggtg

SEQ ID NO: 634724 - DNA, 25 bp, Mus musculus
gaagctgctcttagaatacctgagg

SEQ ID NO: 634725 - DNA, 25 bp, Mus musculus
gaagctgctctttgaatacctgagg

SEQ ID NO: 634726 - DNA, 25 bp, Mus musculus
gaagctgcttaaagccaggcgacga

SEQ ID NO: 634727 - DNA, 25 bp, Mus musculus
gaagctgcttaatgccaggcgacga

SEQ ID NO: 634728 - DNA, 25 bp, Mus musculus
gaagctgcttcaagctgtggcccag

SEQ ID NO: 634729 - DNA, 25 bp, Mus musculus
gaagctgcttcatgctgtggcccag

SEQ ID NO: 634730 - DNA, 25 bp, Mus musculus
gaagctgcttcccatctgatgtcac

SEQ ID NO: 634731 - DNA, 25 bp, Mus musculus
gaagctgcttccgatctgatgtcac

SEQ ID NO: 634732 - DNA, 25 bp, Mus musculus
gaagctgcttctcccattattcatc

SEQ ID NO: 634733 - DNA, 25 bp, Mus musculus
gaagctgcttctgccattattcatc

SEQ ID NO: 634734 - DNA, 25 bp, Mus musculus
gaagctgcttttcagacaattctaa

SEQ ID NO: 634735 - DNA, 25 bp, Mus musculus
gaagctgcttttgagacaattctaa

SEQ ID NO: 634736 - DNA, 25 bp, Mus musculus
gaagctggaaaaaggcagttcaacc

SEQ ID NO: 634737 - DNA, 25 bp, Mus musculus
gaagctggaaaatggcagttcaacc

SEQ ID NO: 634738 - DNA, 25 bp, Mus musculus
gaagctggaacacctcggcagccgg

SEQ ID NO: 634739 - DNA, 25 bp, Mus musculus
gaagctggaacagctcggcagccgg

SEQ ID NO: 634740 - DNA, 25 bp, Mus musculus
gaagctggaatccacagagcctcca

SEQ ID NO: 634741 - DNA, 25 bp, Mus musculus
gaagctggaatcgacagagcctcca

SEQ ID NO: 634742 - DNA, 25 bp, Mus musculus
gaagctggacacaacagagtctgtc

SEQ ID NO: 634743 - DNA, 25 bp, Mus musculus
gaagctggacactacagagtctgtc

SEQ ID NO: 634744 - DNA, 25 bp, Mus musculus
gaagctggacctcccagggtttcgt

SEQ ID NO: 634745 - DNA, 25 bp, Mus musculus
gaagctggacctgccagggtttcgt

SEQ ID NO: 634746 - DNA, 25 bp, Mus musculus
gaagctggacgacaatgccaatgtc

SEQ ID NO: 634747 - DNA, 25 bp, Mus musculus
gaagctggacgagaatgccaatgtc

SEQ ID NO: 634748 - DNA, 25 bp, Mus musculus
gaagctggagatacgttaccgccac

SEQ ID NO: 634749 - DNA, 25 bp, Mus musculus
gaagctggagattcgttaccgccac

SEQ ID NO: 634750 - DNA, 25 bp, Mus musculus
gaagctggagttacaactctcacaa

SEQ ID NO: 634751 - DNA, 25 bp, Mus musculus
gaagctggagttctgttggcttata

SEQ ID NO: 634752 - DNA, 25 bp, Mus musculus
gaagctggagttgtgttggcttata

SEQ ID NO: 634753 - DNA, 25 bp, Mus musculus
gaagctggagtttcaactctcacaa

SEQ ID NO: 634754 - DNA, 25 bp, Mus musculus
gaagctggatctcggaaagagacaa

SEQ ID NO: 634755 - DNA, 25 bp, Mus musculus
gaagctggatctgggaaagagacaa

SEQ ID NO: 634756 - DNA, 25 bp, Mus musculus
gaagctggatgtctatgcttctgcc

SEQ ID NO: 634757 - DNA, 25 bp, Mus musculus
gaagctggatgtgtatgcttctgcc

SEQ ID NO: 634758 - DNA, 25 bp, Mus musculus
gaagctggcaagaccgaattcggag

SEQ ID NO: 634759 - DNA, 25 bp, Mus musculus
gaagctggcaagtccgaattcggag

SEQ ID NO: 634760 - DNA, 25 bp, Mus musculus
gaagctggcgaacgactcgttaccg

SEQ ID NO: 634761 - DNA, 25 bp, Mus musculus
gaagctggcgaaggactcgttaccg

SEQ ID NO: 634762 - DNA, 25 bp, Mus musculus
gaagctggcgagatgcactctgttg

SEQ ID NO: 634763 - DNA, 25 bp, Mus musculus
gaagctggcgagttgcactctgttg

SEQ ID NO: 634764 - DNA, 25 bp, Mus musculus
gaagctggcgcaaagtctggaaatt

SEQ ID NO: 634765 - DNA, 25 bp, Mus musculus
gaagctggcgcatagtctggaaatt

SEQ ID NO: 634766 - DNA, 25 bp, Mus musculus
gaagctggctcacttgcaggcagcc

SEQ ID NO: 634767 - DNA, 25 bp, Mus musculus
gaagctggctcagttgcaggcagcc

SEQ ID NO: 634768 - DNA, 25 bp, Mus musculus
gaagctgggcacattggagtcagtt

SEQ ID NO: 634769 - DNA, 25 bp, Mus musculus
gaagctgggcactttggagtcagtt

SEQ ID NO: 634770 - DNA, 25 bp, Mus musculus
gaagctgggcttcagccactggccc

SEQ ID NO: 634771 - DNA, 25 bp, Mus musculus
gaagctgggcttgagccactggccc

SEQ ID NO: 634772 - DNA, 25 bp, Mus musculus
gaagctgggtgtcgatactatcgcc

SEQ ID NO: 634773 - DNA, 25 bp, Mus musculus
gaagctgggtgtggatactatcgcc

SEQ ID NO: 634774 - DNA, 25 bp, Mus musculus
gaagctgggttcactggaggtacaa

SEQ ID NO: 634775 - DNA, 25 bp, Mus musculus
gaagctgggttctctggaggtacaa

SEQ ID NO: 634776 - DNA, 25 bp, Mus musculus
gaagctggtatcaatgaagttccca

SEQ ID NO: 634777 - DNA, 25 bp, Mus musculus
gaagctggtatctatgaagttccca

SEQ ID NO: 634778 - DNA, 25 bp, Mus musculus
gaagctggtcaccactgagcctgcc

SEQ ID NO: 634779 - DNA, 25 bp, Mus musculus
gaagctggtcacgactgagcctgcc

SEQ ID NO: 634780 - DNA, 25 bp, Mus musculus
gaagctggttgcagaaatatcctcc

SEQ ID NO: 634781 - DNA, 25 bp, Mus musculus
gaagctggttgctgaaatatcctcc

SEQ ID NO: 634782 - DNA, 25 bp, Mus musculus
gaagctggttgtacgatgggcccac

SEQ ID NO: 634783 - DNA, 25 bp, Mus musculus
gaagctggttgttcgatgggcccac

SEQ ID NO: 634784 - DNA, 25 bp, Mus musculus
gaagctggtttccatcaccctgatg

SEQ ID NO: 634785 - DNA, 25 bp, Mus musculus
gaagctggtttcgatcaccctgatg

SEQ ID NO: 634786 - DNA, 25 bp, Mus musculus
gaagctggttttcatctctaaaggg

SEQ ID NO: 634787 - DNA, 25 bp, Mus musculus
gaagctggttttcctggtcgccctg

SEQ ID NO: 634788 - DNA, 25 bp, Mus musculus
gaagctggttttgatctctaaaggg

SEQ ID NO: 634789 - DNA, 25 bp, Mus musculus
gaagctggttttgctggtcgccctg

SEQ ID NO: 634790 - DNA, 25 bp, Mus musculus
gaagctgtacctcattggaattgca

SEQ ID NO: 634791 - DNA, 25 bp, Mus musculus
gaagctgtacctgattggaattgca

SEQ ID NO: 634792 - DNA, 25 bp, Mus musculus
gaagctgtagcgatgtccctgcata

SEQ ID NO: 634793 - DNA, 25 bp, Mus musculus
gaagctgtagcgttgtccctgcata

SEQ ID NO: 634794 - DNA, 25 bp, Mus musculus
gaagctgtccagagcaatgtctgct

SEQ ID NO: 634795 - DNA, 25 bp, Mus musculus
gaagctgtccagtgcaatgtctgct

SEQ ID NO: 634796 - DNA, 25 bp, Mus musculus
gaagctgtccccaggccggactttg

SEQ ID NO: 634797 - DNA, 25 bp, Mus musculus
gaagctgtcccctggccggactttg

SEQ ID NO: 634798 - DNA, 25 bp, Mus musculus
gaagctgtcctgcacatgccaggtg

SEQ ID NO: 634799 - DNA, 25 bp, Mus musculus
gaagctgtcctggacatgccaggtg

SEQ ID NO: 634800 - DNA, 25 bp, Mus musculus
gaagctgtccttaatcaccttccag

SEQ ID NO: 634801 - DNA, 25 bp, Mus musculus
gaagctgtccttcgtgattggttcc

SEQ ID NO: 634802 - DNA, 25 bp, Mus musculus
gaagctgtccttggtgattggttcc

SEQ ID NO: 634803 - DNA, 25 bp, Mus musculus
gaagctgtcctttatcaccttccag

SEQ ID NO: 634804 - DNA, 25 bp, Mus musculus
gaagctgtcgagaccgtttcagtcc

SEQ ID NO: 634805 - DNA, 25 bp, Mus musculus
gaagctgtcgagtccgtttcagtcc

SEQ ID NO: 634806 - DNA, 25 bp, Mus musculus
gaagctgtcggaagacgagcagccc

SEQ ID NO: 634807 - DNA, 25 bp, Mus musculus
gaagctgtcggatgacgagcagccc

SEQ ID NO: 634808 - DNA, 25 bp, Mus musculus
gaagctgtctccatgggttggtcac

SEQ ID NO: 634809 - DNA, 25 bp, Mus musculus
gaagctgtctccttgggttggtcac

SEQ ID NO: 634810 - DNA, 25 bp, Mus musculus
gaagctgtgacaccacactcctttg

SEQ ID NO: 634811 - DNA, 25 bp, Mus musculus
gaagctgtgacagcacactcctttg

SEQ ID NO: 634812 - DNA, 25 bp, Mus musculus
gaagctgtgctaagtggagttactc

SEQ ID NO: 634813 - DNA, 25 bp, Mus musculus
gaagctgtgctatgtggagttactc

SEQ ID NO: 634814 - DNA, 25 bp, Mus musculus
gaagctgtgctcagcgttccaatgc

SEQ ID NO: 634815 - DNA, 25 bp, Mus musculus
gaagctgtgctctgcgttccaatgc

SEQ ID NO: 634816 - DNA, 25 bp, Mus musculus
gaagctgtgcttacaattactctga

SEQ ID NO: 634817 - DNA, 25 bp, Mus musculus
gaagctgtgctttcaattactctga

SEQ ID NO: 634818 - DNA, 25 bp, Mus musculus
gaagctgtgtaccaacgactctgtg

SEQ ID NO: 634819 - DNA, 25 bp, Mus musculus
gaagctgtgtacgaacgactctgtg

SEQ ID NO: 634820 - DNA, 25 bp, Mus musculus
gaagctgtgtctccaagcccggctt

SEQ ID NO: 634821 - DNA, 25 bp, Mus musculus
gaagctgtgtctgcaagcccggctt

SEQ ID NO: 634822 - DNA, 25 bp, Mus musculus
gaagctgtgtgacttcaactgcaac

SEQ ID NO: 634823 - DNA, 25 bp, Mus musculus
gaagctgtgtgagttcaactgcaac

SEQ ID NO: 634824 - DNA, 25 bp, Mus musculus
gaagctgttaatcgcagcggaagca

SEQ ID NO: 634825 - DNA, 25 bp, Mus musculus
gaagctgttaatggcagcggaagca

SEQ ID NO: 634826 - DNA, 25 bp, Mus musculus
gaagctgttcgacctgatcctcatg

SEQ ID NO: 634827 - DNA, 25 bp, Mus musculus
gaagctgttcgagctgatcctcatg

SEQ ID NO: 634828 - DNA, 25 bp, Mus musculus
gaagctgttgagaattcagaactgg

SEQ ID NO: 634829 - DNA, 25 bp, Mus musculus
gaagctgttgagtattcagaactgg

SEQ ID NO: 634830 - DNA, 25 bp, Mus musculus
gaagctgttgatctataaccctgag

SEQ ID NO: 634831 - DNA, 25 bp, Mus musculus
gaagctgttgatgtataaccctgag

SEQ ID NO: 634832 - DNA, 25 bp, Mus musculus
gaagctgttggcagcagctcctatc

SEQ ID NO: 634833 - DNA, 25 bp, Mus musculus
gaagctgttggctgcagctcctatc

SEQ ID NO: 634834 - DNA, 25 bp, Mus musculus
gaagctgttgtccactccagacctg

SEQ ID NO: 634835 - DNA, 25 bp, Mus musculus
gaagctgttgtcgactccagacctg

SEQ ID NO: 634836 - DNA, 25 bp, Mus musculus
gaagctgtttcacttggtctggcac

SEQ ID NO: 634837 - DNA, 25 bp, Mus musculus
gaagctgtttcagttggtctggcac

SEQ ID NO: 634838 - DNA, 25 bp, Mus musculus
gaagctgtttcccactctggcatcg

SEQ ID NO: 634839 - DNA, 25 bp, Mus musculus
gaagctgtttccgactctggcatcg

SEQ ID NO: 634840 - DNA, 25 bp, Mus musculus
gaagcttaaggcagaggcctaccag

SEQ ID NO: 634841 - DNA, 25 bp, Mus musculus
gaagcttaaggctgaggcctaccag

SEQ ID NO: 634842 - DNA, 25 bp, Mus musculus
gaagcttaccttataacagcatgaa

SEQ ID NO: 634843 - DNA, 25 bp, Mus musculus
gaagcttaccttttaacagcatgaa

SEQ ID NO: 634844 - DNA, 25 bp, Mus musculus
gaagcttactgcagatgccaagttt

SEQ ID NO: 634845 - DNA, 25 bp, Mus musculus
gaagcttactgctgatgccaagttt

SEQ ID NO: 634846 - DNA, 25 bp, Mus musculus
gaagcttagcgcagtacagttcatg

SEQ ID NO: 634847 - DNA, 25 bp, Mus musculus
gaagcttagcgctgtacagttcatg

SEQ ID NO: 634848 - DNA, 25 bp, Mus musculus
gaagcttattttctccactatttca

SEQ ID NO: 634849 - DNA, 25 bp, Mus musculus
gaagcttattttgtccactatttca

SEQ ID NO: 634850 - DNA, 25 bp, Mus musculus
gaagcttcaaagacccaatcgccat

SEQ ID NO: 634851 - DNA, 25 bp, Mus musculus
gaagcttcaaagtcccaatcgccat

SEQ ID NO: 634852 - DNA, 25 bp, Mus musculus
gaagcttcactgcaatgggccgcaa

SEQ ID NO: 634853 - DNA, 25 bp, Mus musculus
gaagcttcactggaatgggccgcaa

SEQ ID NO: 634854 - DNA, 25 bp, Mus musculus
gaagcttcagctacgaaaagaaaag

SEQ ID NO: 634855 - DNA, 25 bp, Mus musculus
gaagcttcagcttcgaaaagaaaag

SEQ ID NO: 634856 - DNA, 25 bp, Mus musculus
gaagcttcatctacattgcggttat

SEQ ID NO: 634857 - DNA, 25 bp, Mus musculus
gaagcttcatcttcattgcggttat

SEQ ID NO: 634858 - DNA, 25 bp, Mus musculus
gaagcttcatgacttcttagcacac

SEQ ID NO: 634859 - DNA, 25 bp, Mus musculus
gaagcttcatgagttcttagcacac

SEQ ID NO: 634860 - DNA, 25 bp, Mus musculus
gaagcttccagaatggagcttctgc

SEQ ID NO: 634861 - DNA, 25 bp, Mus musculus
gaagcttccagattggagcttctgc

SEQ ID NO: 634862 - DNA, 25 bp, Mus musculus
gaagcttccatgagcacagatcccg

SEQ ID NO: 634863 - DNA, 25 bp, Mus musculus
gaagcttccatgtgcacagatcccg

SEQ ID NO: 634864 - DNA, 25 bp, Mus musculus
gaagcttcccttagctcgggccaag

SEQ ID NO: 634865 - DNA, 25 bp, Mus musculus
gaagcttccctttgctcgggccaag

SEQ ID NO: 634866 - DNA, 25 bp, Mus musculus
gaagcttcggatccagaaggctctg

SEQ ID NO: 634867 - DNA, 25 bp, Mus musculus
gaagcttcggatgcagaaggctctg

SEQ ID NO: 634868 - DNA, 25 bp, Mus musculus
gaagcttctgaacctgtcaacgtga

SEQ ID NO: 634869 - DNA, 25 bp, Mus musculus
gaagcttctgaagctgtcaacgtga

SEQ ID NO: 634870 - DNA, 25 bp, Mus musculus
gaagcttcttgaagggcatccagca

SEQ ID NO: 634871 - DNA, 25 bp, Mus musculus
gaagcttcttgatgggcatccagca

SEQ ID NO: 634872 - DNA, 25 bp, Mus musculus
gaagcttctttgacgatggcccagg

SEQ ID NO: 634873 - DNA, 25 bp, Mus musculus
gaagcttctttgtcgatggcccagg

SEQ ID NO: 634874 - DNA, 25 bp, Mus musculus
gaagcttgaactaggccatctccgc

SEQ ID NO: 634875 - DNA, 25 bp, Mus musculus
gaagcttgaacttggccatctccgc

SEQ ID NO: 634876 - DNA, 25 bp, Mus musculus
gaagcttgaggacattaggacccgc

SEQ ID NO: 634877 - DNA, 25 bp, Mus musculus
gaagcttgaggagattaggacccgc

SEQ ID NO: 634878 - DNA, 25 bp, Mus musculus
gaagcttgcccacgttggcacgaag

SEQ ID NO: 634879 - DNA, 25 bp, Mus musculus
gaagcttgcccaggttggcacgaag

SEQ ID NO: 634880 - DNA, 25 bp, Mus musculus
gaagcttgccgcaggtggtgccctc

SEQ ID NO: 634881 - DNA, 25 bp, Mus musculus
gaagcttgccgctggtggtgccctc

SEQ ID NO: 634882 - DNA, 25 bp, Mus musculus
gaagcttgcctgcagcctaggttac

SEQ ID NO: 634883 - DNA, 25 bp, Mus musculus
gaagcttgcctggagcctaggttac

SEQ ID NO: 634884 - DNA, 25 bp, Mus musculus
gaagcttggagaattaacagggaca

SEQ ID NO: 634885 - DNA, 25 bp, Mus musculus
gaagcttggagatttaacagggaca

SEQ ID NO: 634886 - DNA, 25 bp, Mus musculus
gaagcttggcttaaggctgcacgcc

SEQ ID NO: 634887 - DNA, 25 bp, Mus musculus
gaagcttggctttaggctgcacgcc

SEQ ID NO: 634888 - DNA, 25 bp, Mus musculus
gaagcttgtagcagttgcccagtct

SEQ ID NO: 634889 - DNA, 25 bp, Mus musculus
gaagcttgtagctgttgcccagtct

SEQ ID NO: 634890 - DNA, 25 bp, Mus musculus
gaagcttgtgaacaactggccattg

SEQ ID NO: 634891 - DNA, 25 bp, Mus musculus
gaagcttgtgaagaactggccattg

SEQ ID NO: 634892 - DNA, 25 bp, Mus musculus
gaagcttgtgcgacctttctgtcca

SEQ ID NO: 634893 - DNA, 25 bp, Mus musculus
gaagcttgtgcgtcctttctgtcca

SEQ ID NO: 634894 - DNA, 25 bp, Mus musculus
gaagcttgtgtcagagatacagact

SEQ ID NO: 634895 - DNA, 25 bp, Mus musculus
gaagcttgtgtctgagatacagact

SEQ ID NO: 634896 - DNA, 25 bp, Mus musculus
gaagctttaaagcatgctcaggaga

SEQ ID NO: 634897 - DNA, 25 bp, Mus musculus
gaagctttaaaggatgctcaggaga

SEQ ID NO: 634898 - DNA, 25 bp, Mus musculus
gaagctttaatcatgagcaggtgta

SEQ ID NO: 634899 - DNA, 25 bp, Mus musculus
gaagctttaatcttgagcaggtgta

SEQ ID NO: 634900 - DNA, 25 bp, Mus musculus
gaagctttagcgcagactgcctgga

SEQ ID NO: 634901 - DNA, 25 bp, Mus musculus
gaagctttagcggagactgcctgga

SEQ ID NO: 634902 - DNA, 25 bp, Mus musculus
gaagctttaggtatctctgtctccc

SEQ ID NO: 634903 - DNA, 25 bp, Mus musculus
gaagctttaggtttctctgtctccc

SEQ ID NO: 634904 - DNA, 25 bp, Mus musculus
gaagctttccaaactgttgtcaata

SEQ ID NO: 634905 - DNA, 25 bp, Mus musculus
gaagctttccaatctgttgtcaata

SEQ ID NO: 634906 - DNA, 25 bp, Mus musculus
gaagctttctacaaggtcttccatc

SEQ ID NO: 634907 - DNA, 25 bp, Mus musculus
gaagctttctactaggtcttccatc

SEQ ID NO: 634908 - DNA, 25 bp, Mus musculus
gaagctttgaatagtgggaccgaat

SEQ ID NO: 634909 - DNA, 25 bp, Mus musculus
gaagctttgaattgtgggaccgaat

SEQ ID NO: 634910 - DNA, 25 bp, Mus musculus
gaagctttgaccatcttgtctccgg

SEQ ID NO: 634911 - DNA, 25 bp, Mus musculus
gaagctttgaccttcttgtctccgg

SEQ ID NO: 634912 - DNA, 25 bp, Mus musculus
gaagctttgagcctttacggacacc

SEQ ID NO: 634913 - DNA, 25 bp, Mus musculus
gaagctttgagcgtttacggacacc

SEQ ID NO: 634914 - DNA, 25 bp, Mus musculus
gaagctttgctgaactgctacacca

SEQ ID NO: 634915 - DNA, 25 bp, Mus musculus
gaagctttgctgtactgctacacca

SEQ ID NO: 634916 - DNA, 25 bp, Mus musculus
gaagctttggagaatgactttgctg

SEQ ID NO: 634917 - DNA, 25 bp, Mus musculus
gaagctttggagtatgactttgctg

SEQ ID NO: 634918 - DNA, 25 bp, Mus musculus
gaagctttgtgtatgaagttataac

SEQ ID NO: 634919 - DNA, 25 bp, Mus musculus
gaagctttgtgtttgaagttataac

SEQ ID NO: 634920 - DNA, 25 bp, Mus musculus
gaagcttttacgagtttatgacctg

SEQ ID NO: 634921 - DNA, 25 bp, Mus musculus
gaagcttttacgtgtttatgacctg

SEQ ID NO: 634922 - DNA, 25 bp, Mus musculus
gaagcttttgccaagcataataaga

SEQ ID NO: 634923 - DNA, 25 bp, Mus musculus
gaagcttttgcctagcataataaga

SEQ ID NO: 634924 - DNA, 25 bp, Mus musculus
gaaggaaaacttcaggatatcaggt

SEQ ID NO: 634925 - DNA, 25 bp, Mus musculus
gaaggaaaacttgaggatatcaggt

SEQ ID NO: 634926 - DNA, 25 bp, Mus musculus
gaaggaaaagccaagcactttgggc

SEQ ID NO: 634927 - DNA, 25 bp, Mus musculus
gaaggaaaagcctagcactttgggc

SEQ ID NO: 634928 - DNA, 25 bp, Mus musculus
gaaggaaaaggactggtattatgct

SEQ ID NO: 634929 - DNA, 25 bp, Mus musculus
gaaggaaaaggagtggtattatgct

SEQ ID NO: 634930 - DNA, 25 bp, Mus musculus
gaaggaaaatcaaatgagcagctaa

SEQ ID NO: 634931 - DNA, 25 bp, Mus musculus
gaaggaaaatcatatgagcagctaa

SEQ ID NO: 634932 - DNA, 25 bp, Mus musculus
gaaggaaaatttcggagatacatgc

SEQ ID NO: 634933 - DNA, 25 bp, Mus musculus
gaaggaaaatttgggagatacatgc

SEQ ID NO: 634934 - DNA, 25 bp, Mus musculus
gaaggaaaccagagagctcaaggag

SEQ ID NO: 634935 - DNA, 25 bp, Mus musculus
gaaggaaaccagtgagctcaaggag

SEQ ID NO: 634936 - DNA, 25 bp, Mus musculus
gaaggaaaccttagatactggctga

SEQ ID NO: 634937 - DNA, 25 bp, Mus musculus
gaaggaaacctttgatactggctga

SEQ ID NO: 634938 - DNA, 25 bp, Mus musculus
gaaggaaactaaagacccgtcagtg

SEQ ID NO: 634939 - DNA, 25 bp, Mus musculus
gaaggaaactaatgacccgtcagtg

SEQ ID NO: 634940 - DNA, 25 bp, Mus musculus
gaaggaaactcacgtcaataatcta

SEQ ID NO: 634941 - DNA, 25 bp, Mus musculus
gaaggaaactcaggtcaataatcta

SEQ ID NO: 634942 - DNA, 25 bp, Mus musculus
gaaggaaagaaacttctacgcaatg

SEQ ID NO: 634943 - DNA, 25 bp, Mus musculus
gaaggaaagaaagttctacgcaatg

SEQ ID NO: 634944 - DNA, 25 bp, Mus musculus
gaaggaaagcaaacaggcctccgct

SEQ ID NO: 634945 - DNA, 25 bp, Mus musculus
gaaggaaagcaatcaggcctccgct

SEQ ID NO: 634946 - DNA, 25 bp, Mus musculus
gaaggaaagcttaggagaagacact

SEQ ID NO: 634947 - DNA, 25 bp, Mus musculus
gaaggaaagctttggagaagacact

SEQ ID NO: 634948 - DNA, 25 bp, Mus musculus
gaaggaaaggaacatatttgaccag

SEQ ID NO: 634949 - DNA, 25 bp, Mus musculus
gaaggaaaggaagatatttgaccag

SEQ ID NO: 634950 - DNA, 25 bp, Mus musculus
gaaggaaagggcaatgtccaccacc

SEQ ID NO: 634951 - DNA, 25 bp, Mus musculus
gaaggaaagggctatgtccaccacc

SEQ ID NO: 634952 - DNA, 25 bp, Mus musculus
gaaggaaatcagacagccagaaaca

SEQ ID NO: 634953 - DNA, 25 bp, Mus musculus
gaaggaaatcagtcagccagaaaca

SEQ ID NO: 634954 - DNA, 25 bp, Mus musculus
gaaggaaatcctattgggccattct

SEQ ID NO: 634955 - DNA, 25 bp, Mus musculus
gaaggaaatccttttgggccattct

SEQ ID NO: 634956 - DNA, 25 bp, Mus musculus
gaaggaaatctacatcatggctgcc

SEQ ID NO: 634957 - DNA, 25 bp, Mus musculus
gaaggaaatctagatcatggctgcc

SEQ ID NO: 634958 - DNA, 25 bp, Mus musculus
gaaggaaatgcgattggctctccag

SEQ ID NO: 634959 - DNA, 25 bp, Mus musculus
gaaggaaatgcgtttggctctccag

SEQ ID NO: 634960 - DNA, 25 bp, Mus musculus
gaaggaaatggtcttggatatcaac

SEQ ID NO: 634961 - DNA, 25 bp, Mus musculus
gaaggaaatggtgttggatatcaac

SEQ ID NO: 634962 - DNA, 25 bp, Mus musculus
gaaggaaattaccttgatgatgctc

SEQ ID NO: 634963 - DNA, 25 bp, Mus musculus
gaaggaaattacgttgatgatgctc

SEQ ID NO: 634964 - DNA, 25 bp, Mus musculus
gaaggaaattccaggctgcctcttt

SEQ ID NO: 634965 - DNA, 25 bp, Mus musculus
gaaggaaattcctggctgcctcttt

SEQ ID NO: 634966 - DNA, 25 bp, Mus musculus
gaaggaaattggaaggccagagccc

SEQ ID NO: 634967 - DNA, 25 bp, Mus musculus
gaaggaaattggtaggccagagccc

SEQ ID NO: 634968 - DNA, 25 bp, Mus musculus
gaaggaacaactcggcttccgacac

SEQ ID NO: 634969 - DNA, 25 bp, Mus musculus
gaaggaacaactgggcttccgacac

SEQ ID NO: 634970 - DNA, 25 bp, Mus musculus
gaaggaacaagaaaccacaatggct

SEQ ID NO: 634971 - DNA, 25 bp, Mus musculus
gaaggaacaagataccacaatggct

SEQ ID NO: 634972 - DNA, 25 bp, Mus musculus
gaaggaacaatcacggtctcgcagg

SEQ ID NO: 634973 - DNA, 25 bp, Mus musculus
gaaggaacaatctcggtctcgcagg

SEQ ID NO: 634974 - DNA, 25 bp, Mus musculus
gaaggaacacacactccgcacttgg

SEQ ID NO: 634975 - DNA, 25 bp, Mus musculus
gaaggaacacactctccgcacttgg

SEQ ID NO: 634976 - DNA, 25 bp, Mus musculus
gaaggaacacgcatcacagagacca

SEQ ID NO: 634977 - DNA, 25 bp, Mus musculus
gaaggaacacgcttcacagagacca

SEQ ID NO: 634978 - DNA, 25 bp, Mus musculus
gaaggaacagcacgaggactttgcc

SEQ ID NO: 634979 - DNA, 25 bp, Mus musculus
gaaggaacagcaggaggactttgcc

SEQ ID NO: 634980 - DNA, 25 bp, Mus musculus
gaaggaacagctagagcggctttac

SEQ ID NO: 634981 - DNA, 25 bp, Mus musculus
gaaggaacagcttgagcggctttac

SEQ ID NO: 634982 - DNA, 25 bp, Mus musculus
gaaggaaccaccaagatcattgcgc

SEQ ID NO: 634983 - DNA, 25 bp, Mus musculus
gaaggaaccacctagatcattgcgc

SEQ ID NO: 634984 - DNA, 25 bp, Mus musculus
gaaggaacccatcgctgtgaacacc

SEQ ID NO: 634985 - DNA, 25 bp, Mus musculus
gaaggaacccatggctgtgaacacc

SEQ ID NO: 634986 - DNA, 25 bp, Mus musculus
gaaggaacccgtatgtccgcatgaa

SEQ ID NO: 634987 - DNA, 25 bp, Mus musculus
gaaggaacccgtttgtccgcatgaa

SEQ ID NO: 634988 - DNA, 25 bp, Mus musculus
gaaggaaccggcattctaagtccaa

SEQ ID NO: 634989 - DNA, 25 bp, Mus musculus
gaaggaaccggctttctaagtccaa

SEQ ID NO: 634990 - DNA, 25 bp, Mus musculus
gaaggaacggaaagacgccaagaat

SEQ ID NO: 634991 - DNA, 25 bp, Mus musculus
gaaggaacggaatgacgccaagaat

SEQ ID NO: 634992 - DNA, 25 bp, Mus musculus
gaaggaactcacacgacagaagaag

SEQ ID NO: 634993 - DNA, 25 bp, Mus musculus
gaaggaactcactcgacagaagaag

SEQ ID NO: 634994 - DNA, 25 bp, Mus musculus
gaaggaactgaactcctcacttgct

SEQ ID NO: 634995 - DNA, 25 bp, Mus musculus
gaaggaactgaagtcctcacttgct

SEQ ID NO: 634996 - DNA, 25 bp, Mus musculus
gaaggaactgcacaacatcagctca

SEQ ID NO: 634997 - DNA, 25 bp, Mus musculus
gaaggaactgcagaacatcagctca

SEQ ID NO: 634998 - DNA, 25 bp, Mus musculus
gaaggaacttcacgccgaagccacc

SEQ ID NO: 634999 - DNA, 25 bp, Mus musculus
gaaggaacttcaggccgaagccacc

SEQ ID NO: 635000 - DNA, 25 bp, Mus musculus
gaaggaacttgaaccccaaattgct

SEQ ID NO: 635001 - DNA, 25 bp, Mus musculus
gaaggaacttgatccccaaattgct

SEQ ID NO: 635002 - DNA, 25 bp, Mus musculus
gaaggaagaaggcaatgaccttgta

SEQ ID NO: 635003 - DNA, 25 bp, Mus musculus
gaaggaagaagggaatgaccttgta

SEQ ID NO: 635004 - DNA, 25 bp, Mus musculus
gaaggaagactgaacccagcctgac

SEQ ID NO: 635005 - DNA, 25 bp, Mus musculus
gaaggaagactgtacccagcctgac

SEQ ID NO: 635006 - DNA, 25 bp, Mus musculus
gaaggaagagccatcaagtaagtgg

SEQ ID NO: 635007 - DNA, 25 bp, Mus musculus
gaaggaagagccttcaagtaagtgg

SEQ ID NO: 635008 - DNA, 25 bp, Mus musculus
gaaggaagagctaaaggcagagtta

SEQ ID NO: 635009 - DNA, 25 bp, Mus musculus
gaaggaagagcttaaggcagagtta

SEQ ID NO: 635010 - DNA, 25 bp, Mus musculus
gaaggaagagtaatcgtgtacatca

SEQ ID NO: 635011 - DNA, 25 bp, Mus musculus
gaaggaagagtattcgtgtacatca

SEQ ID NO: 635012 - DNA, 25 bp, Mus musculus
gaaggaagagtgacacttgcctgta

SEQ ID NO: 635013 - DNA, 25 bp, Mus musculus
gaaggaagagtgtcacttgcctgta

SEQ ID NO: 635014 - DNA, 25 bp, Mus musculus
gaaggaagagttacaacaagacatg

SEQ ID NO: 635015 - DNA, 25 bp, Mus musculus
gaaggaagagtttcaacaagacatg

SEQ ID NO: 635016 - DNA, 25 bp, Mus musculus
gaaggaagatgtaaatgaagccata

SEQ ID NO: 635017 - DNA, 25 bp, Mus musculus
gaaggaagatgttaatgaagccata

SEQ ID NO: 635018 - DNA, 25 bp, Mus musculus
gaaggaagccccagagaactggcag

SEQ ID NO: 635019 - DNA, 25 bp, Mus musculus
gaaggaagcccctgagaactggcag

SEQ ID NO: 635020 - DNA, 25 bp, Mus musculus
gaaggaagccctcggatatctccca

SEQ ID NO: 635021 - DNA, 25 bp, Mus musculus
gaaggaagccctgggatatctccca

SEQ ID NO: 635022 - DNA, 25 bp, Mus musculus
gaaggaagccgacaatacgaagctg

SEQ ID NO: 635023 - DNA, 25 bp, Mus musculus
gaaggaagccgagaatacgaagctg

SEQ ID NO: 635024 - DNA, 25 bp, Mus musculus
gaaggaagcctgaaatgcagaaagc

SEQ ID NO: 635025 - DNA, 25 bp, Mus musculus
gaaggaagcctgtaatgcagaaagc

SEQ ID NO: 635026 - DNA, 25 bp, Mus musculus
gaaggaagctaaacacctcagctat

SEQ ID NO: 635027 - DNA, 25 bp, Mus musculus
gaaggaagctaatcacctcagctat

SEQ ID NO: 635028 - DNA, 25 bp, Mus musculus
gaaggaaggactacccaagtggcct

SEQ ID NO: 635029 - DNA, 25 bp, Mus musculus
gaaggaaggacttcccaagtggcct

SEQ ID NO: 635030 - DNA, 25 bp, Mus musculus
gaaggaagtatacctcttcgaacga

SEQ ID NO: 635031 - DNA, 25 bp, Mus musculus
gaaggaagtatagctcttcgaacga

SEQ ID NO: 635032 - DNA, 25 bp, Mus musculus
gaaggaagtcagacagtttccatct

SEQ ID NO: 635033 - DNA, 25 bp, Mus musculus
gaaggaagtcagtcagtttccatct

SEQ ID NO: 635034 - DNA, 25 bp, Mus musculus
gaaggaagtgaaagtctacatgtat

SEQ ID NO: 635035 - DNA, 25 bp, Mus musculus
gaaggaagtgaatgtctacatgtat

SEQ ID NO: 635036 - DNA, 25 bp, Mus musculus
gaaggaagtgatagatgccctccga

SEQ ID NO: 635037 - DNA, 25 bp, Mus musculus
gaaggaagtgattgatgccctccga

SEQ ID NO: 635038 - DNA, 25 bp, Mus musculus
gaaggaagtggtctaatgaatctca

SEQ ID NO: 635039 - DNA, 25 bp, Mus musculus
gaaggaagtggtgtaatgaatctca

SEQ ID NO: 635040 - DNA, 25 bp, Mus musculus
gaaggaatatcccaacatctgtgca

SEQ ID NO: 635041 - DNA, 25 bp, Mus musculus
gaaggaatatccgaacatctgtgca

SEQ ID NO: 635042 - DNA, 25 bp, Mus musculus
gaaggaatcacgctcccagaaacac

SEQ ID NO: 635043 - DNA, 25 bp, Mus musculus
gaaggaatcacggtcccagaaacac

SEQ ID NO: 635044 - DNA, 25 bp, Mus musculus
gaaggaatcccacttcaatcaggtg

SEQ ID NO: 635045 - DNA, 25 bp, Mus musculus
gaaggaatcccagttcaatcaggtg

SEQ ID NO: 635046 - DNA, 25 bp, Mus musculus
gaaggaatcgatctctcagggccaa

SEQ ID NO: 635047 - DNA, 25 bp, Mus musculus
gaaggaatcgatgtctcagggccaa

SEQ ID NO: 635048 - DNA, 25 bp, Mus musculus
gaaggaatctgcaatgaggcttaac

SEQ ID NO: 635049 - DNA, 25 bp, Mus musculus
gaaggaatctgctatgaggcttaac

SEQ ID NO: 635050 - DNA, 25 bp, Mus musculus
gaaggaatgatcaagcttgctctgt

SEQ ID NO: 635051 - DNA, 25 bp, Mus musculus
gaaggaatgatctagcttgctctgt

SEQ ID NO: 635052 - DNA, 25 bp, Mus musculus
gaaggaatgcaaataggtcgtcacg

SEQ ID NO: 635053 - DNA, 25 bp, Mus musculus
gaaggaatgcaattaggtcgtcacg

SEQ ID NO: 635054 - DNA, 25 bp, Mus musculus
gaaggaatggacagaagacaccatg

SEQ ID NO: 635055 - DNA, 25 bp, Mus musculus
gaaggaatggactgaagacaccatg

SEQ ID NO: 635056 - DNA, 25 bp, Mus musculus
gaaggaattacacactccaggctca

SEQ ID NO: 635057 - DNA, 25 bp, Mus musculus
gaaggaattacagactccaggctca

SEQ ID NO: 635058 - DNA, 25 bp, Mus musculus
gaaggaattcctagctaggtccgga

SEQ ID NO: 635059 - DNA, 25 bp, Mus musculus
gaaggaattccttgctaggtccgga

SEQ ID NO: 635060 - DNA, 25 bp, Mus musculus
gaaggaattctaactcactcccagc

SEQ ID NO: 635061 - DNA, 25 bp, Mus musculus
gaaggaattctatctcactcccagc

SEQ ID NO: 635062 - DNA, 25 bp, Mus musculus
gaaggaattgaacaacctgttgaaa

SEQ ID NO: 635063 - DNA, 25 bp, Mus musculus
gaaggaattgaagaacctgttgaaa

SEQ ID NO: 635064 - DNA, 25 bp, Mus musculus
gaaggaattgtcctacagcagggac

SEQ ID NO: 635065 - DNA, 25 bp, Mus musculus
gaaggaattgtcgtacagcagggac

SEQ ID NO: 635066 - DNA, 25 bp, Mus musculus
gaaggacaaccacctggccattgag

SEQ ID NO: 635067 - DNA, 25 bp, Mus musculus
gaaggacaaccagctggccattgag

SEQ ID NO: 635068 - DNA, 25 bp, Mus musculus
gaaggacaaccccaccacagcaagg

SEQ ID NO: 635069 - DNA, 25 bp, Mus musculus
gaaggacaacccgaccacagcaagg

SEQ ID NO: 635070 - DNA, 25 bp, Mus musculus
gaaggacaagcacactgcaggcctc

SEQ ID NO: 635071 - DNA, 25 bp, Mus musculus
gaaggacaagcagactgcaggcctc

SEQ ID NO: 635072 - DNA, 25 bp, Mus musculus
gaaggacaccatcgtcaagagatac

SEQ ID NO: 635073 - DNA, 25 bp, Mus musculus
gaaggacaccatggtcaagagatac

SEQ ID NO: 635074 - DNA, 25 bp, Mus musculus
gaaggacaccgaatatggattggca

SEQ ID NO: 635075 - DNA, 25 bp, Mus musculus
gaaggacaccgattatggattggca

SEQ ID NO: 635076 - DNA, 25 bp, Mus musculus
gaaggacagaacagggatgaactac

SEQ ID NO: 635077 - DNA, 25 bp, Mus musculus
gaaggacagaactgggatgaactac

SEQ ID NO: 635078 - DNA, 25 bp, Mus musculus
gaaggacagatcacatccttggttg

SEQ ID NO: 635079 - DNA, 25 bp, Mus musculus
gaaggacagatctcatccttggttg

SEQ ID NO: 635080 - DNA, 25 bp, Mus musculus
gaaggacagcctcactgagcaacca

SEQ ID NO: 635081 - DNA, 25 bp, Mus musculus
gaaggacagcctgactgagcaacca

SEQ ID NO: 635082 - DNA, 25 bp, Mus musculus
gaaggacagctcagttgcagccaga

SEQ ID NO: 635083 - DNA, 25 bp, Mus musculus
gaaggacagctctgttgcagccaga

SEQ ID NO: 635084 - DNA, 25 bp, Mus musculus
gaaggacagggactctacacctcag

SEQ ID NO: 635085 - DNA, 25 bp, Mus musculus
gaaggacagggagtctacacctcag

SEQ ID NO: 635086 - DNA, 25 bp, Mus musculus
gaaggacatcacctcagccaaggtc

SEQ ID NO: 635087 - DNA, 25 bp, Mus musculus
gaaggacatcacgtcagccaaggtc

SEQ ID NO: 635088 - DNA, 25 bp, Mus musculus
gaaggacatgcaaggagactcagaa

SEQ ID NO: 635089 - DNA, 25 bp, Mus musculus
gaaggacatgcatggagactcagaa

SEQ ID NO: 635090 - DNA, 25 bp, Mus musculus
gaaggacattgaccctgtggccatc

SEQ ID NO: 635091 - DNA, 25 bp, Mus musculus
gaaggacattgagcctgtggccatc

SEQ ID NO: 635092 - DNA, 25 bp, Mus musculus
gaaggaccagaacaagtgcttcagc

SEQ ID NO: 635093 - DNA, 25 bp, Mus musculus
gaaggaccagaagaagtgcttcagc

SEQ ID NO: 635094 - DNA, 25 bp, Mus musculus
gaaggaccagcaacaaaattactac

SEQ ID NO: 635095 - DNA, 25 bp, Mus musculus
gaaggaccagcatcaaaattactac

SEQ ID NO: 635096 - DNA, 25 bp, Mus musculus
gaaggaccagtgaaccaggaacgat

SEQ ID NO: 635097 - DNA, 25 bp, Mus musculus
gaaggaccagtgtaccaggaacgat

SEQ ID NO: 635098 - DNA, 25 bp, Mus musculus
gaaggaccatgcagctgcctgggat

SEQ ID NO: 635099 - DNA, 25 bp, Mus musculus
gaaggaccatgctgctgcctgggat

SEQ ID NO: 635100 - DNA, 25 bp, Mus musculus
gaaggaccattacgatgctacagca

SEQ ID NO: 635101 - DNA, 25 bp, Mus musculus
gaaggaccattaggatgctacagca

SEQ ID NO: 635102 - DNA, 25 bp, Mus musculus
gaaggacccaaacaggagacattca

SEQ ID NO: 635103 - DNA, 25 bp, Mus musculus
gaaggacccaaagaggagacattca

SEQ ID NO: 635104 - DNA, 25 bp, Mus musculus
gaaggacccacacgatgctttctaa

SEQ ID NO: 635105 - DNA, 25 bp, Mus musculus
gaaggacccacaggatgctttctaa

SEQ ID NO: 635106 - DNA, 25 bp, Mus musculus
gaaggacccagaaatctacacagag

SEQ ID NO: 635107 - DNA, 25 bp, Mus musculus
gaaggacccagatatctacacagag

SEQ ID NO: 635108 - DNA, 25 bp, Mus musculus
gaaggacccatgagaccccaactac

SEQ ID NO: 635109 - DNA, 25 bp, Mus musculus
gaaggacccatgtgaccccaactac

SEQ ID NO: 635110 - DNA, 25 bp, Mus musculus
gaaggaccctgaaccctgggataga

SEQ ID NO: 635111 - DNA, 25 bp, Mus musculus
gaaggaccctgatccctgggataga

SEQ ID NO: 635112 - DNA, 25 bp, Mus musculus
gaaggaccgagaaatgtccacatgg

SEQ ID NO: 635113 - DNA, 25 bp, Mus musculus
gaaggaccgagatatgtccacatgg

SEQ ID NO: 635114 - DNA, 25 bp, Mus musculus
gaaggaccgatgctttgccactcaa

SEQ ID NO: 635115 - DNA, 25 bp, Mus musculus
gaaggaccgatggtttgccactcaa

SEQ ID NO: 635116 - DNA, 25 bp, Mus musculus
gaaggacctgcacatgttcctgtac

SEQ ID NO: 635117 - DNA, 25 bp, Mus musculus
gaaggacctgcagatgttcctgtac

SEQ ID NO: 635118 - DNA, 25 bp, Mus musculus
gaaggacctgctcacttgaaacact

SEQ ID NO: 635119 - DNA, 25 bp, Mus musculus
gaaggacctgctccggaaccttctg

SEQ ID NO: 635120 - DNA, 25 bp, Mus musculus
gaaggacctgctgacttgaaacact

SEQ ID NO: 635121 - DNA, 25 bp, Mus musculus
gaaggacctgctgcggaaccttctg

SEQ ID NO: 635122 - DNA, 25 bp, Mus musculus
gaaggacctggtatctctcttggcc

SEQ ID NO: 635123 - DNA, 25 bp, Mus musculus
gaaggacctggtttctctcttggcc

SEQ ID NO: 635124 - DNA, 25 bp, Mus musculus
gaaggacctgttagaagaaaagatc

SEQ ID NO: 635125 - DNA, 25 bp, Mus musculus
gaaggacctgtttgaagaaaagatc

SEQ ID NO: 635126 - DNA, 25 bp, Mus musculus
gaaggaccttctcagtaccagacta

SEQ ID NO: 635127 - DNA, 25 bp, Mus musculus
gaaggaccttctgagtaccagacta

SEQ ID NO: 635128 - DNA, 25 bp, Mus musculus
gaaggacgcagtaaggaacttgacc

SEQ ID NO: 635129 - DNA, 25 bp, Mus musculus
gaaggacgcagtcgctgccctctga

SEQ ID NO: 635130 - DNA, 25 bp, Mus musculus
gaaggacgcagtggctgccctctga

SEQ ID NO: 635131 - DNA, 25 bp, Mus musculus
gaaggacgcagttaggaacttgacc

SEQ ID NO: 635132 - DNA, 25 bp, Mus musculus
gaaggacgccgtcattattgccctg

SEQ ID NO: 635133 - DNA, 25 bp, Mus musculus
gaaggacgccgtgattattgccctg

SEQ ID NO: 635134 - DNA, 25 bp, Mus musculus
gaaggacgctcccatggagactcca

SEQ ID NO: 635135 - DNA, 25 bp, Mus musculus
gaaggacgctccgatggagactcca

SEQ ID NO: 635136 - DNA, 25 bp, Mus musculus
gaaggacggagacctgcttacatca

SEQ ID NO: 635137 - DNA, 25 bp, Mus musculus
gaaggacggagagctgcttacatca

SEQ ID NO: 635138 - DNA, 25 bp, Mus musculus
gaaggacgggcaagtgaccttcctc

SEQ ID NO: 635139 - DNA, 25 bp, Mus musculus
gaaggacgggcatgtgaccttcctc

SEQ ID NO: 635140 - DNA, 25 bp, Mus musculus
gaaggacgggctcgccttcaatgca

SEQ ID NO: 635141 - DNA, 25 bp, Mus musculus
gaaggacgggctggccttcaatgca

SEQ ID NO: 635142 - DNA, 25 bp, Mus musculus
gaaggactaaaacgcttaatgacag

SEQ ID NO: 635143 - DNA, 25 bp, Mus musculus
gaaggactaaaaggcttaatgacag

SEQ ID NO: 635144 - DNA, 25 bp, Mus musculus
gaaggactaagactcagcacccgtt

SEQ ID NO: 635145 - DNA, 25 bp, Mus musculus
gaaggactaagagtcagcacccgtt

SEQ ID NO: 635146 - DNA, 25 bp, Mus musculus
gaaggactacttcggtctgacctac

SEQ ID NO: 635147 - DNA, 25 bp, Mus musculus
gaaggactacttgggtctgacctac

SEQ ID NO: 635148 - DNA, 25 bp, Mus musculus
gaaggactataaccctggctctatg

SEQ ID NO: 635149 - DNA, 25 bp, Mus musculus
gaaggactataagcctggctctatg

SEQ ID NO: 635150 - DNA, 25 bp, Mus musculus
gaaggactcacaatccatctctact

SEQ ID NO: 635151 - DNA, 25 bp, Mus musculus
gaaggactcacattccatctctact

SEQ ID NO: 635152 - DNA, 25 bp, Mus musculus
gaaggactcccaagactctcaactg

SEQ ID NO: 635153 - DNA, 25 bp, Mus musculus
gaaggactcccatgactctcaactg

SEQ ID NO: 635154 - DNA, 25 bp, Mus musculus
gaaggactccctactaggtgaaaag

SEQ ID NO: 635155 - DNA, 25 bp, Mus musculus
gaaggactcccttctaggtgaaaag

SEQ ID NO: 635156 - DNA, 25 bp, Mus musculus
gaaggactcctcctatgggcctgag

SEQ ID NO: 635157 - DNA, 25 bp, Mus musculus
gaaggactcctcctctggtgccaga

SEQ ID NO: 635158 - DNA, 25 bp, Mus musculus
gaaggactcctcgtatgggcctgag

SEQ ID NO: 635159 - DNA, 25 bp, Mus musculus
gaaggactcctcgtctggtgccaga

SEQ ID NO: 635160 - DNA, 25 bp, Mus musculus
gaaggactcgggaatccaagcttgc

SEQ ID NO: 635161 - DNA, 25 bp, Mus musculus
gaaggactcgggtatccaagcttgc

SEQ ID NO: 635162 - DNA, 25 bp, Mus musculus
gaaggactcgtgcagcactgcaaac

SEQ ID NO: 635163 - DNA, 25 bp, Mus musculus
gaaggactcgtggagcactgcaaac

SEQ ID NO: 635164 - DNA, 25 bp, Mus musculus
gaaggactcgttaccgtcactccca

SEQ ID NO: 635165 - DNA, 25 bp, Mus musculus
gaaggactcgtttccgtcactccca

SEQ ID NO: 635166 - DNA, 25 bp, Mus musculus
gaaggactgatacaggacttccctg

SEQ ID NO: 635167 - DNA, 25 bp, Mus musculus
gaaggactgatagaggacttccctg

SEQ ID NO: 635168 - DNA, 25 bp, Mus musculus
gaaggactgcttcagcatcctgtac

SEQ ID NO: 635169 - DNA, 25 bp, Mus musculus
gaaggactgcttgagcatcctgtac

SEQ ID NO: 635170 - DNA, 25 bp, Mus musculus
gaaggacttagactggtctgcatcc

SEQ ID NO: 635171 - DNA, 25 bp, Mus musculus
gaaggacttagagtggtctgcatcc

SEQ ID NO: 635172 - DNA, 25 bp, Mus musculus
gaaggacttgggacacctcacaaca

SEQ ID NO: 635173 - DNA, 25 bp, Mus musculus
gaaggacttgggagacacatcacaa

SEQ ID NO: 635174 - DNA, 25 bp, Mus musculus
gaaggacttgggtcacctcacaaca

SEQ ID NO: 635175 - DNA, 25 bp, Mus musculus
gaaggacttgggtgacacatcacaa

SEQ ID NO: 635176 - DNA, 25 bp, Mus musculus
gaaggacttggtcacatttcaaaga

SEQ ID NO: 635177 - DNA, 25 bp, Mus musculus
gaaggacttggtgacatttcaaaga

SEQ ID NO: 635178 - DNA, 25 bp, Mus musculus
gaaggagaaacaccagtacttgaag

SEQ ID NO: 635179 - DNA, 25 bp, Mus musculus
gaaggagaaacagcagtacttgaag

SEQ ID NO: 635180 - DNA, 25 bp, Mus musculus
gaaggagaaatgaaggatgaccgcc

SEQ ID NO: 635181 - DNA, 25 bp, Mus musculus
gaaggagaaatgtaggatgaccgcc

SEQ ID NO: 635182 - DNA, 25 bp, Mus musculus
gaaggagaacaaagttgccatcatt

SEQ ID NO: 635183 - DNA, 25 bp, Mus musculus
gaaggagaacaatgttgccatcatt

SEQ ID NO: 635184 - DNA, 25 bp, Mus musculus
gaaggagaacttctgccgcaatcca

SEQ ID NO: 635185 - DNA, 25 bp, Mus musculus
gaaggagaacttgtgccgcaatcca

SEQ ID NO: 635186 - DNA, 25 bp, Mus musculus
gaaggagaagcaaggcgtcatccat

SEQ ID NO: 635187 - DNA, 25 bp, Mus musculus
gaaggagaagcatggcgtcatccat

SEQ ID NO: 635188 - DNA, 25 bp, Mus musculus
gaaggagaaggccacagtgatccta

SEQ ID NO: 635189 - DNA, 25 bp, Mus musculus
gaaggagaaggcgacagtgatccta

SEQ ID NO: 635190 - DNA, 25 bp, Mus musculus
gaaggagaattgacacctggagcag

SEQ ID NO: 635191 - DNA, 25 bp, Mus musculus
gaaggagaattgtcacctggagcag

SEQ ID NO: 635192 - DNA, 25 bp, Mus musculus
gaaggagacactaaccagaagctac

SEQ ID NO: 635193 - DNA, 25 bp, Mus musculus
gaaggagacacttaccagaagctac

SEQ ID NO: 635194 - DNA, 25 bp, Mus musculus
gaaggagacatgcaccatggcttaa

SEQ ID NO: 635195 - DNA, 25 bp, Mus musculus
gaaggagacatggaccatggcttaa

SEQ ID NO: 635196 - DNA, 25 bp, Mus musculus
gaaggagacattcgattccccagtg

SEQ ID NO: 635197 - DNA, 25 bp, Mus musculus
gaaggagacattggattccccagtg

SEQ ID NO: 635198 - DNA, 25 bp, Mus musculus
gaaggagaccataaaaggattccag

SEQ ID NO: 635199 - DNA, 25 bp, Mus musculus
gaaggagaccattaaaggattccag

SEQ ID NO: 635200 - DNA, 25 bp, Mus musculus
gaaggagacctgagcccagaaagac

SEQ ID NO: 635201 - DNA, 25 bp, Mus musculus
gaaggagacctgtgcccagaaagac

SEQ ID NO: 635202 - DNA, 25 bp, Mus musculus
gaaggagaccttccagaacacaaga

SEQ ID NO: 635203 - DNA, 25 bp, Mus musculus
gaaggagaccttgcagaacacaaga

SEQ ID NO: 635204 - DNA, 25 bp, Mus musculus
gaaggagactataaaacgccagcca

SEQ ID NO: 635205 - DNA, 25 bp, Mus musculus
gaaggagactattaaacgccagcca

SEQ ID NO: 635206 - DNA, 25 bp, Mus musculus
gaaggagagatcaccaccattgaga

SEQ ID NO: 635207 - DNA, 25 bp, Mus musculus
gaaggagagatctccaccattgaga

SEQ ID NO: 635208 - DNA, 25 bp, Mus musculus
gaaggagagcgcaaagccaatgata

SEQ ID NO: 635209 - DNA, 25 bp, Mus musculus
gaaggagagcgctaagccaatgata

SEQ ID NO: 635210 - DNA, 25 bp, Mus musculus
gaaggagagtctctggctagcaaac

SEQ ID NO: 635211 - DNA, 25 bp, Mus musculus
gaaggagagtctgtggctagcaaac

SEQ ID NO: 635212 - DNA, 25 bp, Mus musculus
gaaggagatcaaaccctttaagagg

SEQ ID NO: 635213 - DNA, 25 bp, Mus musculus
gaaggagatcaatccctttaagagg

SEQ ID NO: 635214 - DNA, 25 bp, Mus musculus
gaaggagatccacgcaatgaagcgc

SEQ ID NO: 635215 - DNA, 25 bp, Mus musculus
gaaggagatccaggcaatgaagcgc

SEQ ID NO: 635216 - DNA, 25 bp, Mus musculus
gaaggagatcccctacactaaagta

SEQ ID NO: 635217 - DNA, 25 bp, Mus musculus
gaaggagatcccgtacactaaagta

SEQ ID NO: 635218 - DNA, 25 bp, Mus musculus
gaaggagatgaaatccctggagcag

SEQ ID NO: 635219 - DNA, 25 bp, Mus musculus
gaaggagatgaattccctggagcag

SEQ ID NO: 635220 - DNA, 25 bp, Mus musculus
gaaggagatggtagaaaggccatcc

SEQ ID NO: 635221 - DNA, 25 bp, Mus musculus
gaaggagatggttgaaaggccatcc

SEQ ID NO: 635222 - DNA, 25 bp, Mus musculus
gaaggagattcacaattactgagcc

SEQ ID NO: 635223 - DNA, 25 bp, Mus musculus
gaaggagattcagaattactgagcc

SEQ ID NO: 635224 - DNA, 25 bp, Mus musculus
gaaggagattctataaaggcatatg

SEQ ID NO: 635225 - DNA, 25 bp, Mus musculus
gaaggagattctttaaaggcatatg

SEQ ID NO: 635226 - DNA, 25 bp, Mus musculus
gaaggagcagctccacttgtatgac

SEQ ID NO: 635227 - DNA, 25 bp, Mus musculus
gaaggagcagctgcacttgtatgac

SEQ ID NO: 635228 - DNA, 25 bp, Mus musculus
gaaggagcatctactaaagtatgag

SEQ ID NO: 635229 - DNA, 25 bp, Mus musculus
gaaggagcatcttctaaagtatgag

SEQ ID NO: 635230 - DNA, 25 bp, Mus musculus
gaaggagccaacaacggtggagaca

SEQ ID NO: 635231 - DNA, 25 bp, Mus musculus
gaaggagccaactacggtggagaca

SEQ ID NO: 635232 - DNA, 25 bp, Mus musculus
gaaggagcgcatattggctgataaa

SEQ ID NO: 635233 - DNA, 25 bp, Mus musculus
gaaggagcgcattttggctgataaa

SEQ ID NO: 635234 - DNA, 25 bp, Mus musculus
gaaggagctgacaggccgcaccctg

SEQ ID NO: 635235 - DNA, 25 bp, Mus musculus
gaaggagctgacatgctcatggtga

SEQ ID NO: 635236 - DNA, 25 bp, Mus musculus
gaaggagctgactggccgcaccctg

SEQ ID NO: 635237 - DNA, 25 bp, Mus musculus
gaaggagctgacttgctcatggtga

SEQ ID NO: 635238 - DNA, 25 bp, Mus musculus
gaaggagctgcaagcgcacctgctc

SEQ ID NO: 635239 - DNA, 25 bp, Mus musculus
gaaggagctgcatgcgcacctgctc

SEQ ID NO: 635240 - DNA, 25 bp, Mus musculus
gaaggagcttgtcgacccatctgga

SEQ ID NO: 635241 - DNA, 25 bp, Mus musculus
gaaggagcttgtggacccatctgga

SEQ ID NO: 635242 - DNA, 25 bp, Mus musculus
gaaggagctttgcaccgatgcccct

SEQ ID NO: 635243 - DNA, 25 bp, Mus musculus
gaaggagctttggaccgatgcccct

SEQ ID NO: 635244 - DNA, 25 bp, Mus musculus
gaaggaggaacaatgtggctttcac

SEQ ID NO: 635245 - DNA, 25 bp, Mus musculus
gaaggaggaacattgtggctttcac

SEQ ID NO: 635246 - DNA, 25 bp, Mus musculus
gaaggaggacacacagctgtagaac

SEQ ID NO: 635247 - DNA, 25 bp, Mus musculus
gaaggaggacactcagctgtagaac

SEQ ID NO: 635248 - DNA, 25 bp, Mus musculus
gaaggaggatgcagcctatgactgc

SEQ ID NO: 635249 - DNA, 25 bp, Mus musculus
gaaggaggatgctgcctatgactgc

SEQ ID NO: 635250 - DNA, 25 bp, Mus musculus
gaaggaggattgaaaatggagctaa

SEQ ID NO: 635251 - DNA, 25 bp, Mus musculus
gaaggaggattgtaaatggagctaa

SEQ ID NO: 635252 - DNA, 25 bp, Mus musculus
gaaggaggcagaaaatcctttctcc

SEQ ID NO: 635253 - DNA, 25 bp, Mus musculus
gaaggaggcagataatcctttctcc

SEQ ID NO: 635254 - DNA, 25 bp, Mus musculus
gaaggaggcagcactgcttggccca

SEQ ID NO: 635255 - DNA, 25 bp, Mus musculus
gaaggaggcagctctgcttggccca

SEQ ID NO: 635256 - DNA, 25 bp, Mus musculus
gaaggaggccgacaactacttccat

SEQ ID NO: 635257 - DNA, 25 bp, Mus musculus
gaaggaggccgagaactacttccat

SEQ ID NO: 635258 - DNA, 25 bp, Mus musculus
gaaggaggctgcagtcttggattcc

SEQ ID NO: 635259 - DNA, 25 bp, Mus musculus
gaaggaggctgctgtcttggattcc

SEQ ID NO: 635260 - DNA, 25 bp, Mus musculus
gaaggagggactaaccacaaggagc

SEQ ID NO: 635261 - DNA, 25 bp, Mus musculus
gaaggagggacttaccacaaggagc

SEQ ID NO: 635262 - DNA, 25 bp, Mus musculus
gaaggagggcacaaggatgaacacc

SEQ ID NO: 635263 - DNA, 25 bp, Mus musculus
gaaggagggcactaggatgaacacc

SEQ ID NO: 635264 - DNA, 25 bp, Mus musculus
gaaggaggtagacagcctcaagtac

SEQ ID NO: 635265 - DNA, 25 bp, Mus musculus
gaaggaggtagagagcctcaagtac

SEQ ID NO: 635266 - DNA, 25 bp, Mus musculus
gaaggaggtcccctttccagaggct

SEQ ID NO: 635267 - DNA, 25 bp, Mus musculus
gaaggaggtcccgtttccagaggct

SEQ ID NO: 635268 - DNA, 25 bp, Mus musculus
gaaggaggtggccttcttcaataac

SEQ ID NO: 635269 - DNA, 25 bp, Mus musculus
gaaggaggtggcgttcttcaataac

SEQ ID NO: 635270 - DNA, 25 bp, Mus musculus
gaaggaggttacaacttgcagtgtc

SEQ ID NO: 635271 - DNA, 25 bp, Mus musculus
gaaggaggttactacttgcagtgtc

SEQ ID NO: 635272 - DNA, 25 bp, Mus musculus
gaaggagtaacacacctcgtgcgag

SEQ ID NO: 635273 - DNA, 25 bp, Mus musculus
gaaggagtaacagacctcgtgcgag

SEQ ID NO: 635274 - DNA, 25 bp, Mus musculus
gaaggagtagaaatagacgccacac

SEQ ID NO: 635275 - DNA, 25 bp, Mus musculus
gaaggagtagaattagacgccacac

SEQ ID NO: 635276 - DNA, 25 bp, Mus musculus
gaaggagtattcacatataacagaa

SEQ ID NO: 635277 - DNA, 25 bp, Mus musculus
gaaggagtattctcatataacagaa

SEQ ID NO: 635278 - DNA, 25 bp, Mus musculus
gaaggagtcattcaccagatatcca

SEQ ID NO: 635279 - DNA, 25 bp, Mus musculus
gaaggagtcattgaccagatatcca

SEQ ID NO: 635280 - DNA, 25 bp, Mus musculus
gaaggagtctaccataccatttcag

SEQ ID NO: 635281 - DNA, 25 bp, Mus musculus
gaaggagtctacgataccatttcag

SEQ ID NO: 635282 - DNA, 25 bp, Mus musculus
gaaggagtctccaatgaaatgtaca

SEQ ID NO: 635283 - DNA, 25 bp, Mus musculus
gaaggagtctcccttccactgctag

SEQ ID NO: 635284 - DNA, 25 bp, Mus musculus
gaaggagtctccgttccactgctag

SEQ ID NO: 635285 - DNA, 25 bp, Mus musculus
gaaggagtctcctatgaaatgtaca

SEQ ID NO: 635286 - DNA, 25 bp, Mus musculus
gaaggagtctctcgctctggtttcc

SEQ ID NO: 635287 - DNA, 25 bp, Mus musculus
gaaggagtctctggctctggtttcc

SEQ ID NO: 635288 - DNA, 25 bp, Mus musculus
gaaggagtgcacctcatctgctact

SEQ ID NO: 635289 - DNA, 25 bp, Mus musculus
gaaggagtgcacgtcatctgctact

SEQ ID NO: 635290 - DNA, 25 bp, Mus musculus
gaaggagtgcagagacctcaggaca

SEQ ID NO: 635291 - DNA, 25 bp, Mus musculus
gaaggagtgcagtgacctcaggaca

SEQ ID NO: 635292 - DNA, 25 bp, Mus musculus
gaaggagtggaactgtaccaacaca

SEQ ID NO: 635293 - DNA, 25 bp, Mus musculus
gaaggagtggaagtgtaccaacaca

SEQ ID NO: 635294 - DNA, 25 bp, Mus musculus
gaaggagtgtttatggcaaagcatg

SEQ ID NO: 635295 - DNA, 25 bp, Mus musculus
gaaggagtgtttttggcaaagcatg

SEQ ID NO: 635296 - DNA, 25 bp, Mus musculus
gaaggagttcctaatgtgcaaattc

SEQ ID NO: 635297 - DNA, 25 bp, Mus musculus
gaaggagttccttatgtgcaaattc

SEQ ID NO: 635298 - DNA, 25 bp, Mus musculus
gaaggagttcgcactccacatgaga

SEQ ID NO: 635299 - DNA, 25 bp, Mus musculus
gaaggagttcgctctccacatgaga

SEQ ID NO: 635300 - DNA, 25 bp, Mus musculus
gaaggagtttaaccaggagcatcgc

SEQ ID NO: 635301 - DNA, 25 bp, Mus musculus
gaaggagtttaagcaggagcatcgc

SEQ ID NO: 635302 - DNA, 25 bp, Mus musculus
gaaggagtttgaccgcctctcatcc

SEQ ID NO: 635303 - DNA, 25 bp, Mus musculus
gaaggagtttgagcgcctctcatcc

SEQ ID NO: 635304 - DNA, 25 bp, Mus musculus
gaaggagtttgccacaattgttgat

SEQ ID NO: 635305 - DNA, 25 bp, Mus musculus
gaaggagtttgcgacaattgttgat

SEQ ID NO: 635306 - DNA, 25 bp, Mus musculus
gaaggatacaaaatctgcagatcag

SEQ ID NO: 635307 - DNA, 25 bp, Mus musculus
gaaggatacaaattctgcagatcag

SEQ ID NO: 635308 - DNA, 25 bp, Mus musculus
gaaggatacagactatttcaagaac

SEQ ID NO: 635309 - DNA, 25 bp, Mus musculus
gaaggatacagagtatttcaagaac

SEQ ID NO: 635310 - DNA, 25 bp, Mus musculus
gaaggataccgaactgggctatcta

SEQ ID NO: 635311 - DNA, 25 bp, Mus musculus
gaaggataccgatctgggctatcta

SEQ ID NO: 635312 - DNA, 25 bp, Mus musculus
gaaggatagagtaaccccagcataa

SEQ ID NO: 635313 - DNA, 25 bp, Mus musculus
gaaggatagagttaccccagcataa

SEQ ID NO: 635314 - DNA, 25 bp, Mus musculus
gaaggatagctcagtgtccagcctg

SEQ ID NO: 635315 - DNA, 25 bp, Mus musculus
gaaggatagctctgtgtccagcctg

SEQ ID NO: 635316 - DNA, 25 bp, Mus musculus
gaaggatatccgaagtacagaaagc

SEQ ID NO: 635317 - DNA, 25 bp, Mus musculus
gaaggatatccgtagtacagaaagc

SEQ ID NO: 635318 - DNA, 25 bp, Mus musculus
gaaggatatgagaatttcttcggta

SEQ ID NO: 635319 - DNA, 25 bp, Mus musculus
gaaggatatgagtatttcttcggta

SEQ ID NO: 635320 - DNA, 25 bp, Mus musculus
gaaggatcaagtcttgctacaatag

SEQ ID NO: 635321 - DNA, 25 bp, Mus musculus
gaaggatcaagtgttgctacaatag

SEQ ID NO: 635322 - DNA, 25 bp, Mus musculus
gaaggatcactccaacaccggaaat

SEQ ID NO: 635323 - DNA, 25 bp, Mus musculus
gaaggatcactcgaacaccggaaat

SEQ ID NO: 635324 - DNA, 25 bp, Mus musculus
gaaggatcagatctcagcttcatct

SEQ ID NO: 635325 - DNA, 25 bp, Mus musculus
gaaggatcagatgtcagcttcatct

SEQ ID NO: 635326 - DNA, 25 bp, Mus musculus
gaaggatccactcctttcaagtgtc

SEQ ID NO: 635327 - DNA, 25 bp, Mus musculus
gaaggatccactgctttcaagtgtc

SEQ ID NO: 635328 - DNA, 25 bp, Mus musculus
gaaggatccttacgagccccatgaa

SEQ ID NO: 635329 - DNA, 25 bp, Mus musculus
gaaggatccttaggagccccatgaa

SEQ ID NO: 635330 - DNA, 25 bp, Mus musculus
gaaggatccttgagtgcacgatgca

SEQ ID NO: 635331 - DNA, 25 bp, Mus musculus
gaaggatccttgtgtgcacgatgca

SEQ ID NO: 635332 - DNA, 25 bp, Mus musculus
gaaggatcgaagaaccgcagtcgca

SEQ ID NO: 635333 - DNA, 25 bp, Mus musculus
gaaggatcgaagtaccgcagtcgca

SEQ ID NO: 635334 - DNA, 25 bp, Mus musculus
gaaggatcgtcaccagttgcttgca

SEQ ID NO: 635335 - DNA, 25 bp, Mus musculus
gaaggatcgtcagcagttgcttgca

SEQ ID NO: 635336 - DNA, 25 bp, Mus musculus
gaaggatctagaagagatgacacct

SEQ ID NO: 635337 - DNA, 25 bp, Mus musculus
gaaggatctagatgagatgacacct

SEQ ID NO: 635338 - DNA, 25 bp, Mus musculus
gaaggatctccactgcatgcagagc

SEQ ID NO: 635339 - DNA, 25 bp, Mus musculus
gaaggatctccagtgcatgcagagc

SEQ ID NO: 635340 - DNA, 25 bp, Mus musculus
gaaggatctcgaaagctccatgctg

SEQ ID NO: 635341 - DNA, 25 bp, Mus musculus
gaaggatctcgatagctccatgctg

SEQ ID NO: 635342 - DNA, 25 bp, Mus musculus
gaaggatctggccacctttctgtac

SEQ ID NO: 635343 - DNA, 25 bp, Mus musculus
gaaggatctggcgacctttctgtac

SEQ ID NO: 635344 - DNA, 25 bp, Mus musculus
gaaggatctgtcctctcggagtgaa

SEQ ID NO: 635345 - DNA, 25 bp, Mus musculus
gaaggatctgtcgtctcggagtgaa

SEQ ID NO: 635346 - DNA, 25 bp, Mus musculus
gaaggatcttatccaacagtgtaca

SEQ ID NO: 635347 - DNA, 25 bp, Mus musculus
gaaggatcttatgcaacagtgtaca

SEQ ID NO: 635348 - DNA, 25 bp, Mus musculus
gaaggatgaaatcgaatgatccagg

SEQ ID NO: 635349 - DNA, 25 bp, Mus musculus
gaaggatgaaatggaatgatccagg

SEQ ID NO: 635350 - DNA, 25 bp, Mus musculus
gaaggatgaacgaaatggagactgc

SEQ ID NO: 635351 - DNA, 25 bp, Mus musculus
gaaggatgaacgtaatggagactgc

SEQ ID NO: 635352 - DNA, 25 bp, Mus musculus
gaaggatgacagctacgcaccaaag

SEQ ID NO: 635353 - DNA, 25 bp, Mus musculus
gaaggatgacaggtacgcaccaaag

SEQ ID NO: 635354 - DNA, 25 bp, Mus musculus
gaaggatgagttaagtttctcagag

SEQ ID NO: 635355 - DNA, 25 bp, Mus musculus
gaaggatgagtttagtttctcagag

SEQ ID NO: 635356 - DNA, 25 bp, Mus musculus
gaaggatgcccgcactgtgaaactg

SEQ ID NO: 635357 - DNA, 25 bp, Mus musculus
gaaggatgcccggactgtgaaactg

SEQ ID NO: 635358 - DNA, 25 bp, Mus musculus
gaaggatgcgaacgcagcactgctc

SEQ ID NO: 635359 - DNA, 25 bp, Mus musculus
gaaggatgcgaaggcagcactgctc

SEQ ID NO: 635360 - DNA, 25 bp, Mus musculus
gaaggatggaaacaagtattcctcg

SEQ ID NO: 635361 - DNA, 25 bp, Mus musculus
gaaggatggaaagaagtattcctcg

SEQ ID NO: 635362 - DNA, 25 bp, Mus musculus
gaaggatggaacagcagggtcacac

SEQ ID NO: 635363 - DNA, 25 bp, Mus musculus
gaaggatggaactgcagggtcacac

SEQ ID NO: 635364 - DNA, 25 bp, Mus musculus
gaaggatggacaaatgtctccgcac

SEQ ID NO: 635365 - DNA, 25 bp, Mus musculus
gaaggatggacatatgtctccgcac

SEQ ID NO: 635366 - DNA, 25 bp, Mus musculus
gaaggatggagtcaaggtccccaca

SEQ ID NO: 635367 - DNA, 25 bp, Mus musculus
gaaggatggagtgaaggtccccaca

SEQ ID NO: 635368 - DNA, 25 bp, Mus musculus
gaaggatggctccattgtcatacac

SEQ ID NO: 635369 - DNA, 25 bp, Mus musculus
gaaggatggctcgattgtcatacac

SEQ ID NO: 635370 - DNA, 25 bp, Mus musculus
gaaggatggtcacactatcgtggaa

SEQ ID NO: 635371 - DNA, 25 bp, Mus musculus
gaaggatggtcagactatcgtggaa

SEQ ID NO: 635372 - DNA, 25 bp, Mus musculus
gaaggatgtacacatgctgcaagac

SEQ ID NO: 635373 - DNA, 25 bp, Mus musculus
gaaggatgtacagatgctgcaagac

SEQ ID NO: 635374 - DNA, 25 bp, Mus musculus
gaaggatgtcgtctttcacaaaggc

SEQ ID NO: 635375 - DNA, 25 bp, Mus musculus
gaaggatgtcgtgtttcacaaaggc

SEQ ID NO: 635376 - DNA, 25 bp, Mus musculus
gaaggatgtgtgagtcccaaggcca

SEQ ID NO: 635377 - DNA, 25 bp, Mus musculus
gaaggatgtgtgtgtcccaaggcca

SEQ ID NO: 635378 - DNA, 25 bp, Mus musculus
gaaggattacaactagcttggcttg

SEQ ID NO: 635379 - DNA, 25 bp, Mus musculus
gaaggattacaagtagcttggcttg

SEQ ID NO: 635380 - DNA, 25 bp, Mus musculus
gaaggattatttacgaaacaaagag

SEQ ID NO: 635381 - DNA, 25 bp, Mus musculus
gaaggattattttcgaaacaaagag

SEQ ID NO: 635382 - DNA, 25 bp, Mus musculus
gaaggattcatcctgcccatctgtg

SEQ ID NO: 635383 - DNA, 25 bp, Mus musculus
gaaggattcatcgtgcccatctgtg

SEQ ID NO: 635384 - DNA, 25 bp, Mus musculus
gaaggattccctctcatcgagacca

SEQ ID NO: 635385 - DNA, 25 bp, Mus musculus
gaaggattccctgtcatcgagacca

SEQ ID NO: 635386 - DNA, 25 bp, Mus musculus
gaaggattctccatttccgacgcgc

SEQ ID NO: 635387 - DNA, 25 bp, Mus musculus
gaaggattctccttttccgacgcgc

SEQ ID NO: 635388 - DNA, 25 bp, Mus musculus
gaaggattgaccagctaaccaacat

SEQ ID NO: 635389 - DNA, 25 bp, Mus musculus
gaaggattgacctgctaaccaacat

SEQ ID NO: 635390 - DNA, 25 bp, Mus musculus
gaaggattgtggcagatagataaca

SEQ ID NO: 635391 - DNA, 25 bp, Mus musculus
gaaggattgtgggagatagataaca

SEQ ID NO: 635392 - DNA, 25 bp, Mus musculus
gaaggcaaaaccacctaagcttagt

SEQ ID NO: 635393 - DNA, 25 bp, Mus musculus
gaaggcaaaacctcctaagcttagt

SEQ ID NO: 635394 - DNA, 25 bp, Mus musculus
gaaggcaaaactagactgtttcctc

SEQ ID NO: 635395 - DNA, 25 bp, Mus musculus
gaaggcaaaacttgactgtttcctc

SEQ ID NO: 635396 - DNA, 25 bp, Mus musculus
gaaggcaaacttccgttgtgccatg

SEQ ID NO: 635397 - DNA, 25 bp, Mus musculus
gaaggcaaacttgcgttgtgccatg

SEQ ID NO: 635398 - DNA, 25 bp, Mus musculus
gaaggcaaattaacagaggctggga

SEQ ID NO: 635399 - DNA, 25 bp, Mus musculus
gaaggcaaattatcagaggctggga

SEQ ID NO: 635400 - DNA, 25 bp, Mus musculus
gaaggcaacaacaaaggccccaggt

SEQ ID NO: 635401 - DNA, 25 bp, Mus musculus
gaaggcaacaactaaggccccaggt

SEQ ID NO: 635402 - DNA, 25 bp, Mus musculus
gaaggcaacagcaatgacatccgtg

SEQ ID NO: 635403 - DNA, 25 bp, Mus musculus
gaaggcaacagctatgacatccgtg

SEQ ID NO: 635404 - DNA, 25 bp, Mus musculus
gaaggcaacatcacagacttgcaag

SEQ ID NO: 635405 - DNA, 25 bp, Mus musculus
gaaggcaacatctcagacttgcaag

SEQ ID NO: 635406 - DNA, 25 bp, Mus musculus
gaaggcaacttcaactctgaaaatg

SEQ ID NO: 635407 - DNA, 25 bp, Mus musculus
gaaggcaacttctactctgaaaatg

SEQ ID NO: 635408 - DNA, 25 bp, Mus musculus
gaaggcaagaaaccatcgttgagaa

SEQ ID NO: 635409 - DNA, 25 bp, Mus musculus
gaaggcaagaaagcatcgttgagaa

SEQ ID NO: 635410 - DNA, 25 bp, Mus musculus
gaaggcaagcacctctacactttag

SEQ ID NO: 635411 - DNA, 25 bp, Mus musculus
gaaggcaagcacgtctacactttag

SEQ ID NO: 635412 - DNA, 25 bp, Mus musculus
gaaggcaagtccaggtatcaggtcc

SEQ ID NO: 635413 - DNA, 25 bp, Mus musculus
gaaggcaagtcctggtatcaggtcc

SEQ ID NO: 635414 - DNA, 25 bp, Mus musculus
gaaggcaatggaagaaagaagattt

SEQ ID NO: 635415 - DNA, 25 bp, Mus musculus
gaaggcaatggatgaaagaagattt

SEQ ID NO: 635416 - DNA, 25 bp, Mus musculus
gaaggcacaatcattcgatgtcgcc

SEQ ID NO: 635417 - DNA, 25 bp, Mus musculus
gaaggcacaatctttcgatgtcgcc

SEQ ID NO: 635418 - DNA, 25 bp, Mus musculus
gaaggcacatgaaccttaattttgc

SEQ ID NO: 635419 - DNA, 25 bp, Mus musculus
gaaggcacatgatccttaattttgc

SEQ ID NO: 635420 - DNA, 25 bp, Mus musculus
gaaggcaccgatccccagtttctaa

SEQ ID NO: 635421 - DNA, 25 bp, Mus musculus
gaaggcaccgatgcccagtttctaa

SEQ ID NO: 635422 - DNA, 25 bp, Mus musculus
gaaggcaccgccctcttttggaagt

SEQ ID NO: 635423 - DNA, 25 bp, Mus musculus
gaaggcaccgccgtcttttggaagt

SEQ ID NO: 635424 - DNA, 25 bp, Mus musculus
gaaggcaccggcagagtccacccat

SEQ ID NO: 635425 - DNA, 25 bp, Mus musculus
gaaggcaccggctgagtccacccat

SEQ ID NO: 635426 - DNA, 25 bp, Mus musculus
gaaggcacctgacttcccagatgag

SEQ ID NO: 635427 - DNA, 25 bp, Mus musculus
gaaggcacctgagttcccagatgag

SEQ ID NO: 635428 - DNA, 25 bp, Mus musculus
gaaggcacggtaacagttggaacaa

SEQ ID NO: 635429 - DNA, 25 bp, Mus musculus
gaaggcacggtatcagttggaacaa

SEQ ID NO: 635430 - DNA, 25 bp, Mus musculus
gaaggcactaaaaatagcaaatcag

SEQ ID NO: 635431 - DNA, 25 bp, Mus musculus
gaaggcactaaatatagcaaatcag

SEQ ID NO: 635432 - DNA, 25 bp, Mus musculus
gaaggcactacaaagtgttggacag

SEQ ID NO: 635433 - DNA, 25 bp, Mus musculus
gaaggcactacatagtgttggacag

SEQ ID NO: 635434 - DNA, 25 bp, Mus musculus
gaaggcactggaaaagcacgcagac

SEQ ID NO: 635435 - DNA, 25 bp, Mus musculus
gaaggcactggataagcacgcagac

SEQ ID NO: 635436 - DNA, 25 bp, Mus musculus
gaaggcactggtaatgaatagtcag

SEQ ID NO: 635437 - DNA, 25 bp, Mus musculus
gaaggcactggttatgaatagtcag

SEQ ID NO: 635438 - DNA, 25 bp, Mus musculus
gaaggcacttttcggcagttgtgcc

SEQ ID NO: 635439 - DNA, 25 bp, Mus musculus
gaaggcacttttgggcagttgtgcc

SEQ ID NO: 635440 - DNA, 25 bp, Mus musculus
gaaggcagaaggcaaggcttcctct

SEQ ID NO: 635441 - DNA, 25 bp, Mus musculus
gaaggcagaagggaaggcttcctct

SEQ ID NO: 635442 - DNA, 25 bp, Mus musculus
gaaggcagagaaacatcgtggccga

SEQ ID NO: 635443 - DNA, 25 bp, Mus musculus
gaaggcagagaatcatcgtggccga

SEQ ID NO: 635444 - DNA, 25 bp, Mus musculus
gaaggcagagacaggtcccttcctg

SEQ ID NO: 635445 - DNA, 25 bp, Mus musculus
gaaggcagagactggtcccttcctg

SEQ ID NO: 635446 - DNA, 25 bp, Mus musculus
gaaggcagagatcctgatacttggc

SEQ ID NO: 635447 - DNA, 25 bp, Mus musculus
gaaggcagagatgctgatacttggc

SEQ ID NO: 635448 - DNA, 25 bp, Mus musculus
gaaggcagagcgagctggtccctta

SEQ ID NO: 635449 - DNA, 25 bp, Mus musculus
gaaggcagagcgtgctggtccctta

SEQ ID NO: 635450 - DNA, 25 bp, Mus musculus
gaaggcagagtcaccgtcaagattt

SEQ ID NO: 635451 - DNA, 25 bp, Mus musculus
gaaggcagagtctccgtcaagattt

SEQ ID NO: 635452 - DNA, 25 bp, Mus musculus
gaaggcagccgcaaagggagcttct

SEQ ID NO: 635453 - DNA, 25 bp, Mus musculus
gaaggcagccgctaagggagcttct

SEQ ID NO: 635454 - DNA, 25 bp, Mus musculus
gaaggcagccttctcagcctcacag

SEQ ID NO: 635455 - DNA, 25 bp, Mus musculus
gaaggcagccttgtcagcctcacag

SEQ ID NO: 635456 - DNA, 25 bp, Mus musculus
gaaggcagcggtacaaggtcctcga

SEQ ID NO: 635457 - DNA, 25 bp, Mus musculus
gaaggcagcggttcaaggtcctcga

SEQ ID NO: 635458 - DNA, 25 bp, Mus musculus
gaaggcagcttcaacagcttgagaa

SEQ ID NO: 635459 - DNA, 25 bp, Mus musculus
gaaggcagcttctacagcttgagaa

SEQ ID NO: 635460 - DNA, 25 bp, Mus musculus
gaaggcaggcagaacttcgatttcc

SEQ ID NO: 635461 - DNA, 25 bp, Mus musculus
gaaggcaggcagtacttcgatttcc

SEQ ID NO: 635462 - DNA, 25 bp, Mus musculus
gaaggcagggccagtatttaccagt

SEQ ID NO: 635463 - DNA, 25 bp, Mus musculus
gaaggcagggcctgtatttaccagt

SEQ ID NO: 635464 - DNA, 25 bp, Mus musculus
gaaggcaggtgcagcccaaagctct

SEQ ID NO: 635465 - DNA, 25 bp, Mus musculus
gaaggcaggtgctgcccaaagctct

SEQ ID NO: 635466 - DNA, 25 bp, Mus musculus
gaaggcaggttgattgtaccatcgg

SEQ ID NO: 635467 - DNA, 25 bp, Mus musculus
gaaggcaggttgtttgtaccatcgg

SEQ ID NO: 635468 - DNA, 25 bp, Mus musculus
gaaggcagtcgtacagtctcagaat

SEQ ID NO: 635469 - DNA, 25 bp, Mus musculus
gaaggcagtcgttcagtctcagaat

SEQ ID NO: 635470 - DNA, 25 bp, Mus musculus
gaaggcagtggacttagcagccaac

SEQ ID NO: 635471 - DNA, 25 bp, Mus musculus
gaaggcagtggagttagcagccaac

SEQ ID NO: 635472 - DNA, 25 bp, Mus musculus
gaaggcagtgttctcttctaccagc

SEQ ID NO: 635473 - DNA, 25 bp, Mus musculus
gaaggcagtgttgtcttctaccagc

SEQ ID NO: 635474 - DNA, 25 bp, Mus musculus
gaaggcatagttccatgcagtgtgt

SEQ ID NO: 635475 - DNA, 25 bp, Mus musculus
gaaggcatagttgcatgcagtgtgt

SEQ ID NO: 635476 - DNA, 25 bp, Mus musculus
gaaggcatcgatcagccgctggccc

SEQ ID NO: 635477 - DNA, 25 bp, Mus musculus
gaaggcatcgatgagccgctggccc

SEQ ID NO: 635478 - DNA, 25 bp, Mus musculus
gaaggcatctgccacatgtacgtgg

SEQ ID NO: 635479 - DNA, 25 bp, Mus musculus
gaaggcatctgcgacatgtacgtgg

SEQ ID NO: 635480 - DNA, 25 bp, Mus musculus
gaaggcatcttcatgaagcccagtg

SEQ ID NO: 635481 - DNA, 25 bp, Mus musculus
gaaggcatcttcttgaagcccagtg

SEQ ID NO: 635482 - DNA, 25 bp, Mus musculus
gaaggcatgacgctttgagctctcg

SEQ ID NO: 635483 - DNA, 25 bp, Mus musculus
gaaggcatgacggtttgagctctcg

SEQ ID NO: 635484 - DNA, 25 bp, Mus musculus
gaaggcatggccagagtcctgaaca

SEQ ID NO: 635485 - DNA, 25 bp, Mus musculus
gaaggcatggcctgagtcctgaaca

SEQ ID NO: 635486 - DNA, 25 bp, Mus musculus
gaaggcatgggtatcaccgagttct

SEQ ID NO: 635487 - DNA, 25 bp, Mus musculus
gaaggcatgggtttcaccgagttct

SEQ ID NO: 635488 - DNA, 25 bp, Mus musculus
gaaggcatgttcagatccaaagtgt

SEQ ID NO: 635489 - DNA, 25 bp, Mus musculus
gaaggcatgttctgatccaaagtgt

SEQ ID NO: 635490 - DNA, 25 bp, Mus musculus
gaaggcattattcctggagcaaaaa

SEQ ID NO: 635491 - DNA, 25 bp, Mus musculus
gaaggcattattgctggagcaaaaa

SEQ ID NO: 635492 - DNA, 25 bp, Mus musculus
gaaggcattttcacaggcacctcag

SEQ ID NO: 635493 - DNA, 25 bp, Mus musculus
gaaggcattttctcaggcacctcag

SEQ ID NO: 635494 - DNA, 25 bp, Mus musculus
gaaggccaacagctcctctatgtga

SEQ ID NO: 635495 - DNA, 25 bp, Mus musculus
gaaggccaacaggtcctctatgtga

SEQ ID NO: 635496 - DNA, 25 bp, Mus musculus
gaaggccaaggcaatcactccagca

SEQ ID NO: 635497 - DNA, 25 bp, Mus musculus
gaaggccaaggctatcactccagca

SEQ ID NO: 635498 - DNA, 25 bp, Mus musculus
gaaggccaataccatgtccaactac

SEQ ID NO: 635499 - DNA, 25 bp, Mus musculus
gaaggccaatacgatgtccaactac

SEQ ID NO: 635500 - DNA, 25 bp, Mus musculus
gaaggccaatgaagttatctctaaa

SEQ ID NO: 635501 - DNA, 25 bp, Mus musculus
gaaggccaatgatgttatctctaaa

SEQ ID NO: 635502 - DNA, 25 bp, Mus musculus
gaaggccacaatcttgctgattata

SEQ ID NO: 635503 - DNA, 25 bp, Mus musculus
gaaggccacaatgttgctgattata

SEQ ID NO: 635504 - DNA, 25 bp, Mus musculus
gaaggccacaccatttgtgctctgg

SEQ ID NO: 635505 - DNA, 25 bp, Mus musculus
gaaggccacaccttttgtgctctgg

SEQ ID NO: 635506 - DNA, 25 bp, Mus musculus
gaaggccacatacggccccagcagg

SEQ ID NO: 635507 - DNA, 25 bp, Mus musculus
gaaggccacatagggccccagcagg

SEQ ID NO: 635508 - DNA, 25 bp, Mus musculus
gaaggccacgacaccaccactagtg

SEQ ID NO: 635509 - DNA, 25 bp, Mus musculus
gaaggccacgactccaccactagtg

SEQ ID NO: 635510 - DNA, 25 bp, Mus musculus
gaaggccagatcaacatcgccatgg

SEQ ID NO: 635511 - DNA, 25 bp, Mus musculus
gaaggccagatctacatcgccatgg

SEQ ID NO: 635512 - DNA, 25 bp, Mus musculus
gaaggccagcagacttccatgagga

SEQ ID NO: 635513 - DNA, 25 bp, Mus musculus
gaaggccagcagtcttccatgagga

SEQ ID NO: 635514 - DNA, 25 bp, Mus musculus
gaaggccagcctactggtacctctg

SEQ ID NO: 635515 - DNA, 25 bp, Mus musculus
gaaggccagccttctggtacctctg

SEQ ID NO: 635516 - DNA, 25 bp, Mus musculus
gaaggccatcaaaaccgttcagaag

SEQ ID NO: 635517 - DNA, 25 bp, Mus musculus
gaaggccatcaataccgttcagaag

SEQ ID NO: 635518 - DNA, 25 bp, Mus musculus
gaaggccatccccactttaagctgc

SEQ ID NO: 635519 - DNA, 25 bp, Mus musculus
gaaggccatcccgactttaagctgc

SEQ ID NO: 635520 - DNA, 25 bp, Mus musculus
gaaggccattgcaggcactggtgca

SEQ ID NO: 635521 - DNA, 25 bp, Mus musculus
gaaggccattgctggcactggtgca

SEQ ID NO: 635522 - DNA, 25 bp, Mus musculus
gaaggccattgtacaaaagctccgc

SEQ ID NO: 635523 - DNA, 25 bp, Mus musculus
gaaggccattgttcaaaagctccgc

SEQ ID NO: 635524 - DNA, 25 bp, Mus musculus
gaaggcccaagccagtgccatctct

SEQ ID NO: 635525 - DNA, 25 bp, Mus musculus
gaaggcccaagcgagtgccatctct

SEQ ID NO: 635526 - DNA, 25 bp, Mus musculus
gaaggcccacctcgagtagaagagt

SEQ ID NO: 635527 - DNA, 25 bp, Mus musculus
gaaggcccacctggagtagaagagt

SEQ ID NO: 635528 - DNA, 25 bp, Mus musculus
gaaggcccagggacgcatgttctgc

SEQ ID NO: 635529 - DNA, 25 bp, Mus musculus
gaaggcccagggtcgcatgttctgc

SEQ ID NO: 635530 - DNA, 25 bp, Mus musculus
gaaggccccaatctggtccatatct

SEQ ID NO: 635531 - DNA, 25 bp, Mus musculus
gaaggccccaatgtggtccatatct

SEQ ID NO: 635532 - DNA, 25 bp, Mus musculus
gaaggccccgctagcgatacggcaa

SEQ ID NO: 635533 - DNA, 25 bp, Mus musculus
gaaggccccgcttgcgatacggcaa

SEQ ID NO: 635534 - DNA, 25 bp, Mus musculus
gaaggcccctcgacatagagtttag

SEQ ID NO: 635535 - DNA, 25 bp, Mus musculus
gaaggcccctcgtcatagagtttag

SEQ ID NO: 635536 - DNA, 25 bp, Mus musculus
gaaggcccctgccagttacactaag

SEQ ID NO: 635537 - DNA, 25 bp, Mus musculus
gaaggcccctgcgagttacactaag

SEQ ID NO: 635538 - DNA, 25 bp, Mus musculus
gaaggcccgcttcaagatcagagat

SEQ ID NO: 635539 - DNA, 25 bp, Mus musculus
gaaggcccgcttgaagatcagagat

SEQ ID NO: 635540 - DNA, 25 bp, Mus musculus
gaaggccctgacatagaagagtcca

SEQ ID NO: 635541 - DNA, 25 bp, Mus musculus
gaaggccctgacttagaagagtcca

SEQ ID NO: 635542 - DNA, 25 bp, Mus musculus
gaaggccctgtgaagaaactcccag

SEQ ID NO: 635543 - DNA, 25 bp, Mus musculus
gaaggccctgtgtagaaactcccag

SEQ ID NO: 635544 - DNA, 25 bp, Mus musculus
gaaggcccttcaaatagcaccgact

SEQ ID NO: 635545 - DNA, 25 bp, Mus musculus
gaaggcccttcatatagcaccgact

SEQ ID NO: 635546 - DNA, 25 bp, Mus musculus
gaaggccctttaatttgagtacaca

SEQ ID NO: 635547 - DNA, 25 bp, Mus musculus
gaaggccctttattttgagtacaca

SEQ ID NO: 635548 - DNA, 25 bp, Mus musculus
gaaggccgaagaattcatagttgat

SEQ ID NO: 635549 - DNA, 25 bp, Mus musculus
gaaggccgaagatttcatagttgat

SEQ ID NO: 635550 - DNA, 25 bp, Mus musculus
gaaggccgagtacctgggactctta

SEQ ID NO: 635551 - DNA, 25 bp, Mus musculus
gaaggccgagtagctgggactctta

SEQ ID NO: 635552 - DNA, 25 bp, Mus musculus
gaaggccgcaccagcattgtgatcg

SEQ ID NO: 635553 - DNA, 25 bp, Mus musculus
gaaggccgcacctgcattgtgatcg

SEQ ID NO: 635554 - DNA, 25 bp, Mus musculus
gaaggccgcatcaaagatgtcatcc

SEQ ID NO: 635555 - DNA, 25 bp, Mus musculus
gaaggccgcatctaagatgtcatcc

SEQ ID NO: 635556 - DNA, 25 bp, Mus musculus
gaaggccggctcaatcctcctttga

SEQ ID NO: 635557 - DNA, 25 bp, Mus musculus
gaaggccggctctatcctcctttga

SEQ ID NO: 635558 - DNA, 25 bp, Mus musculus
gaaggccggttccaaatgcgatcga

SEQ ID NO: 635559 - DNA, 25 bp, Mus musculus
gaaggccggttcgaaatgcgatcga

SEQ ID NO: 635560 - DNA, 25 bp, Mus musculus
gaaggccgtggaccctcctgaactt

SEQ ID NO: 635561 - DNA, 25 bp, Mus musculus
gaaggccgtggagcctcctgaactt

SEQ ID NO: 635562 - DNA, 25 bp, Mus musculus
gaaggcctcactcacgggatacagg

SEQ ID NO: 635563 - DNA, 25 bp, Mus musculus
gaaggcctcactgacgggatacagg

SEQ ID NO: 635564 - DNA, 25 bp, Mus musculus
gaaggcctcatgcatagcccagaga

SEQ ID NO: 635565 - DNA, 25 bp, Mus musculus
gaaggcctcatggatagcccagaga

SEQ ID NO: 635566 - DNA, 25 bp, Mus musculus
gaaggcctccctcagttagaaaaga

SEQ ID NO: 635567 - DNA, 25 bp, Mus musculus
gaaggcctccctgagttagaaaaga

SEQ ID NO: 635568 - DNA, 25 bp, Mus musculus
gaaggcctccggcataactcagtga

SEQ ID NO: 635569 - DNA, 25 bp, Mus musculus
gaaggcctccgggataactcagtga

SEQ ID NO: 635570 - DNA, 25 bp, Mus musculus
gaaggcctctatatcaacccttact

SEQ ID NO: 635571 - DNA, 25 bp, Mus musculus
gaaggcctctatttcaacccttact

SEQ ID NO: 635572 - DNA, 25 bp, Mus musculus
gaaggcctgcaaagatgccacgctg

SEQ ID NO: 635573 - DNA, 25 bp, Mus musculus
gaaggcctgcaatgatgccacgctg

SEQ ID NO: 635574 - DNA, 25 bp, Mus musculus
gaaggcctgggcctgtcagatacac

SEQ ID NO: 635575 - DNA, 25 bp, Mus musculus
gaaggcctgggcgtgtcagatacac

SEQ ID NO: 635576 - DNA, 25 bp, Mus musculus
gaaggcctgttcagctaccctgtca

SEQ ID NO: 635577 - DNA, 25 bp, Mus musculus
gaaggcctgttctgctaccctgtca

SEQ ID NO: 635578 - DNA, 25 bp, Mus musculus
gaaggccttccaagagagctctcgg

SEQ ID NO: 635579 - DNA, 25 bp, Mus musculus
gaaggccttccatgagagctctcgg

SEQ ID NO: 635580 - DNA, 25 bp, Mus musculus
gaaggccttcgccttacgctatgcc

SEQ ID NO: 635581 - DNA, 25 bp, Mus musculus
gaaggccttcgcgttacgctatgcc

SEQ ID NO: 635582 - DNA, 25 bp, Mus musculus
gaaggccttgaccaaggactcagat

SEQ ID NO: 635583 - DNA, 25 bp, Mus musculus
gaaggccttgacgaaggactcagat

SEQ ID NO: 635584 - DNA, 25 bp, Mus musculus
gaaggccttttcaagcagccagcag

SEQ ID NO: 635585 - DNA, 25 bp, Mus musculus
gaaggccttttctagcagccagcag

SEQ ID NO: 635586 - DNA, 25 bp, Mus musculus
gaaggcgaaaagatgacaaaagtcc

SEQ ID NO: 635587 - DNA, 25 bp, Mus musculus
gaaggcgaaaagttgacaaaagtcc

SEQ ID NO: 635588 - DNA, 25 bp, Mus musculus
gaaggcgaactgaaggatatggaac

SEQ ID NO: 635589 - DNA, 25 bp, Mus musculus
gaaggcgaactgtaggatatggaac

SEQ ID NO: 635590 - DNA, 25 bp, Mus musculus
gaaggcgaagaaacttttgaagtga

SEQ ID NO: 635591 - DNA, 25 bp, Mus musculus
gaaggcgaagaatcttttgaagtga

SEQ ID NO: 635592 - DNA, 25 bp, Mus musculus
gaaggcgaaggtctccttctccagc

SEQ ID NO: 635593 - DNA, 25 bp, Mus musculus
gaaggcgaaggtgtccttctccagc

SEQ ID NO: 635594 - DNA, 25 bp, Mus musculus
gaaggcgaagttactgttgccagac

SEQ ID NO: 635595 - DNA, 25 bp, Mus musculus
gaaggcgaagtttctgttgccagac

SEQ ID NO: 635596 - DNA, 25 bp, Mus musculus
gaaggcgataaactgaagtgctttc

SEQ ID NO: 635597 - DNA, 25 bp, Mus musculus
gaaggcgataaagtgaagtgctttc

SEQ ID NO: 635598 - DNA, 25 bp, Mus musculus
gaaggcgcatttactactttggcta

SEQ ID NO: 635599 - DNA, 25 bp, Mus musculus
gaaggcgcattttctactttggcta

SEQ ID NO: 635600 - DNA, 25 bp, Mus musculus
gaaggcgccactataacgagctgga

SEQ ID NO: 635601 - DNA, 25 bp, Mus musculus
gaaggcgccactttaacgagctgga

SEQ ID NO: 635602 - DNA, 25 bp, Mus musculus
gaaggcgcctatcatttaccccact

SEQ ID NO: 635603 - DNA, 25 bp, Mus musculus
gaaggcgcctatgatttaccccact

SEQ ID NO: 635604 - DNA, 25 bp, Mus musculus
gaaggcgctcttcaagcctagtgcc

SEQ ID NO: 635605 - DNA, 25 bp, Mus musculus
gaaggcgctcttgaagcctagtgcc

SEQ ID NO: 635606 - DNA, 25 bp, Mus musculus
gaaggcggccacataattgacagca

SEQ ID NO: 635607 - DNA, 25 bp, Mus musculus
gaaggcggccacttaattgacagca

SEQ ID NO: 635608 - DNA, 25 bp, Mus musculus
gaaggcggctttagtagcagcatga

SEQ ID NO: 635609 - DNA, 25 bp, Mus musculus
gaaggcggcttttgtagcagcatga

SEQ ID NO: 635610 - DNA, 25 bp, Mus musculus
gaaggcgtacagactgactcctaaa

SEQ ID NO: 635611 - DNA, 25 bp, Mus musculus
gaaggcgtacagtctgactcctaaa

SEQ ID NO: 635612 - DNA, 25 bp, Mus musculus
gaaggcgtggctctctgaaacctta

SEQ ID NO: 635613 - DNA, 25 bp, Mus musculus
gaaggcgtggctgtctgaaacctta

SEQ ID NO: 635614 - DNA, 25 bp, Mus musculus
gaaggctaagctacagcttgatcca

SEQ ID NO: 635615 - DNA, 25 bp, Mus musculus
gaaggctaagcttcagcttgatcca

SEQ ID NO: 635616 - DNA, 25 bp, Mus musculus
gaaggctacgcaactggaaagtggt

SEQ ID NO: 635617 - DNA, 25 bp, Mus musculus
gaaggctacgcatctggaaagtggt

SEQ ID NO: 635618 - DNA, 25 bp, Mus musculus
gaaggctactcacgagcagatatca

SEQ ID NO: 635619 - DNA, 25 bp, Mus musculus
gaaggctactcaggagcagatatca

SEQ ID NO: 635620 - DNA, 25 bp, Mus musculus
gaaggctatgacaaccgtctacggc

SEQ ID NO: 635621 - DNA, 25 bp, Mus musculus
gaaggctatgactaccgtctacggc

SEQ ID NO: 635622 - DNA, 25 bp, Mus musculus
gaaggctcacggctactgtcacgtg

SEQ ID NO: 635623 - DNA, 25 bp, Mus musculus
gaaggctcacgggtactgtcacgtg

SEQ ID NO: 635624 - DNA, 25 bp, Mus musculus
gaaggctcagaaacacttcgtgaca

SEQ ID NO: 635625 - DNA, 25 bp, Mus musculus
gaaggctcagaatcacttcgtgaca

SEQ ID NO: 635626 - DNA, 25 bp, Mus musculus
gaaggctcatggaatttataagcaa

SEQ ID NO: 635627 - DNA, 25 bp, Mus musculus
gaaggctcatggtatttataagcaa

SEQ ID NO: 635628 - DNA, 25 bp, Mus musculus
gaaggctccatcagctggacacagg

SEQ ID NO: 635629 - DNA, 25 bp, Mus musculus
gaaggctccatctgctggacacagg

SEQ ID NO: 635630 - DNA, 25 bp, Mus musculus
gaaggctccattcacagaagcaggc

SEQ ID NO: 635631 - DNA, 25 bp, Mus musculus
gaaggctccattgacagaagcaggc

SEQ ID NO: 635632 - DNA, 25 bp, Mus musculus
gaaggctcctttagatgctcctgtg

SEQ ID NO: 635633 - DNA, 25 bp, Mus musculus
gaaggctccttttgatgctcctgtg

SEQ ID NO: 635634 - DNA, 25 bp, Mus musculus
gaaggctcgattccacgatgagaag

SEQ ID NO: 635635 - DNA, 25 bp, Mus musculus
gaaggctcgattgcacgatgagaag

SEQ ID NO: 635636 - DNA, 25 bp, Mus musculus
gaaggctctacacaaagtgagagca

SEQ ID NO: 635637 - DNA, 25 bp, Mus musculus
gaaggctctacagaaagtgagagca

SEQ ID NO: 635638 - DNA, 25 bp, Mus musculus
gaaggctctagcaaagggagtgcca

SEQ ID NO: 635639 - DNA, 25 bp, Mus musculus
gaaggctctagctaagggagtgcca

SEQ ID NO: 635640 - DNA, 25 bp, Mus musculus
gaaggctctctcagccatagctgag

SEQ ID NO: 635641 - DNA, 25 bp, Mus musculus
gaaggctctctctgccatagctgag

SEQ ID NO: 635642 - DNA, 25 bp, Mus musculus
gaaggctctgcactggcacccagac

SEQ ID NO: 635643 - DNA, 25 bp, Mus musculus
gaaggctctgcagtggcacccagac

SEQ ID NO: 635644 - DNA, 25 bp, Mus musculus
gaaggctctggtctgtcaagacatg

SEQ ID NO: 635645 - DNA, 25 bp, Mus musculus
gaaggctctggtgtgtcaagacatg

SEQ ID NO: 635646 - DNA, 25 bp, Mus musculus
gaaggctctgttcgcagaaggcatc

SEQ ID NO: 635647 - DNA, 25 bp, Mus musculus
gaaggctctgttggcagaaggcatc

SEQ ID NO: 635648 - DNA, 25 bp, Mus musculus
gaaggctctttcatgtggatatatc

SEQ ID NO: 635649 - DNA, 25 bp, Mus musculus
gaaggctctttcttgtggatatatc

SEQ ID NO: 635650 - DNA, 25 bp, Mus musculus
gaaggctgaagcagtaagattgttg

SEQ ID NO: 635651 - DNA, 25 bp, Mus musculus
gaaggctgaagctgtaagattgttg

SEQ ID NO: 635652 - DNA, 25 bp, Mus musculus
gaaggctgagacaacctcagaggcg

SEQ ID NO: 635653 - DNA, 25 bp, Mus musculus
gaaggctgagactacctcagaggcg

SEQ ID NO: 635654 - DNA, 25 bp, Mus musculus
gaaggctgatgtcctcaaggcccta

SEQ ID NO: 635655 - DNA, 25 bp, Mus musculus
gaaggctgatgtgctcaaggcccta

SEQ ID NO: 635656 - DNA, 25 bp, Mus musculus
gaaggctgcacaaaggaattcctca

SEQ ID NO: 635657 - DNA, 25 bp, Mus musculus
gaaggctgcacataggaattcctca

SEQ ID NO: 635658 - DNA, 25 bp, Mus musculus
gaaggctgcagactacacagccctg

SEQ ID NO: 635659 - DNA, 25 bp, Mus musculus
gaaggctgcagagtacacagccctg

SEQ ID NO: 635660 - DNA, 25 bp, Mus musculus
gaaggctgcatcacgaaggactatc

SEQ ID NO: 635661 - DNA, 25 bp, Mus musculus
gaaggctgcatctcgaaggactatc

SEQ ID NO: 635662 - DNA, 25 bp, Mus musculus
gaaggctgccctcaaaacagcctct

SEQ ID NO: 635663 - DNA, 25 bp, Mus musculus
gaaggctgccctgaaaacagcctct

SEQ ID NO: 635664 - DNA, 25 bp, Mus musculus
gaaggctgctgcacatgaagcgtgt

SEQ ID NO: 635665 - DNA, 25 bp, Mus musculus
gaaggctgctgctcatgaagcgtgt

SEQ ID NO: 635666 - DNA, 25 bp, Mus musculus
gaaggctgctgtcactctgttatta

SEQ ID NO: 635667 - DNA, 25 bp, Mus musculus
gaaggctgctgtcatccatgccctg

SEQ ID NO: 635668 - DNA, 25 bp, Mus musculus
gaaggctgctgtgactctgttatta

SEQ ID NO: 635669 - DNA, 25 bp, Mus musculus
gaaggctgctgtgatccatgccctg

SEQ ID NO: 635670 - DNA, 25 bp, Mus musculus
gaaggctggcacacagatcgagaat

SEQ ID NO: 635671 - DNA, 25 bp, Mus musculus
gaaggctggcactcagatcgagaat

SEQ ID NO: 635672 - DNA, 25 bp, Mus musculus
gaaggctggcctactctacgaatgc

SEQ ID NO: 635673 - DNA, 25 bp, Mus musculus
gaaggctggccttctctacgaatgc

SEQ ID NO: 635674 - DNA, 25 bp, Mus musculus
gaaggctggtttcttacacaacaac

SEQ ID NO: 635675 - DNA, 25 bp, Mus musculus
gaaggctggtttgttacacaacaac

SEQ ID NO: 635676 - DNA, 25 bp, Mus musculus
gaaggctgtaaaccagccatcagag

SEQ ID NO: 635677 - DNA, 25 bp, Mus musculus
gaaggctgtaaagcagccatcagag

SEQ ID NO: 635678 - DNA, 25 bp, Mus musculus
gaaggctgtaggagacactcctata

SEQ ID NO: 635679 - DNA, 25 bp, Mus musculus
gaaggctgtaggtgacactcctata

SEQ ID NO: 635680 - DNA, 25 bp, Mus musculus
gaaggctgtcacacacgtgggcatg

SEQ ID NO: 635681 - DNA, 25 bp, Mus musculus
gaaggctgtcactcacgtgggcatg

SEQ ID NO: 635682 - DNA, 25 bp, Mus musculus
gaaggctgtcgaacccttgtataca

SEQ ID NO: 635683 - DNA, 25 bp, Mus musculus
gaaggctgtcgatcccttgtataca

SEQ ID NO: 635684 - DNA, 25 bp, Mus musculus
gaaggctgtggaacacatcaacaag

SEQ ID NO: 635685 - DNA, 25 bp, Mus musculus
gaaggctgtggatcacatcaacaag

SEQ ID NO: 635686 - DNA, 25 bp, Mus musculus
gaaggcttctctcttgttctccgca

SEQ ID NO: 635687 - DNA, 25 bp, Mus musculus
gaaggcttctctgttgttctccgca

SEQ ID NO: 635688 - DNA, 25 bp, Mus musculus
gaaggcttcttcacggtctttgcca

SEQ ID NO: 635689 - DNA, 25 bp, Mus musculus
gaaggcttcttctcggtctttgcca

SEQ ID NO: 635690 - DNA, 25 bp, Mus musculus
gaaggcttgggtcttagctgtccct

SEQ ID NO: 635691 - DNA, 25 bp, Mus musculus
gaaggcttgggtgttagctgtccct

SEQ ID NO: 635692 - DNA, 25 bp, Mus musculus
gaaggcttgtagcattatttgaaga

SEQ ID NO: 635693 - DNA, 25 bp, Mus musculus
gaaggcttgtaggattatttgaaga

SEQ ID NO: 635694 - DNA, 25 bp, Mus musculus
gaaggctttcacactaatgagggaa

SEQ ID NO: 635695 - DNA, 25 bp, Mus musculus
gaaggctttcactctaatgagggaa

SEQ ID NO: 635696 - DNA, 25 bp, Mus musculus
gaaggctttgaaaccatctccaaca

SEQ ID NO: 635697 - DNA, 25 bp, Mus musculus
gaaggctttgaatccatctccaaca

SEQ ID NO: 635698 - DNA, 25 bp, Mus musculus
gaagggaaaactcaccgcacagagc

SEQ ID NO: 635699 - DNA, 25 bp, Mus musculus
gaagggaaaactgaccgcacagagc

SEQ ID NO: 635700 - DNA, 25 bp, Mus musculus
gaagggaaaggacatcatcccatca

SEQ ID NO: 635701 - DNA, 25 bp, Mus musculus
gaagggaaaggagatcatcccatca

SEQ ID NO: 635702 - DNA, 25 bp, Mus musculus
gaagggaacataccctggcctggaa

SEQ ID NO: 635703 - DNA, 25 bp, Mus musculus
gaagggaacatagcctggcctggaa

SEQ ID NO: 635704 - DNA, 25 bp, Mus musculus
gaagggaaccacactgtgtaccgca

SEQ ID NO: 635705 - DNA, 25 bp, Mus musculus
gaagggaaccactctgtgtaccgca

SEQ ID NO: 635706 - DNA, 25 bp, Mus musculus
gaagggaactttcgcttcttcagca

SEQ ID NO: 635707 - DNA, 25 bp, Mus musculus
gaagggaactttggcttcttcagca

SEQ ID NO: 635708 - DNA, 25 bp, Mus musculus
gaagggaagatacccgaagacctta

SEQ ID NO: 635709 - DNA, 25 bp, Mus musculus
gaagggaagatagccgaagacctta

SEQ ID NO: 635710 - DNA, 25 bp, Mus musculus
gaagggaagattacggacctagaga

SEQ ID NO: 635711 - DNA, 25 bp, Mus musculus
gaagggaagatttcggacctagaga

SEQ ID NO: 635712 - DNA, 25 bp, Mus musculus
gaagggaaggctacctctaccactg

SEQ ID NO: 635713 - DNA, 25 bp, Mus musculus
gaagggaaggcttcctctaccactg

SEQ ID NO: 635714 - DNA, 25 bp, Mus musculus
gaagggacaacacaggcactttcca

SEQ ID NO: 635715 - DNA, 25 bp, Mus musculus
gaagggacaacagaggcactttcca

SEQ ID NO: 635716 - DNA, 25 bp, Mus musculus
gaagggacacacagtttcgacggca

SEQ ID NO: 635717 - DNA, 25 bp, Mus musculus
gaagggacacactgtttcgacggca

SEQ ID NO: 635718 - DNA, 25 bp, Mus musculus
gaagggacaccaatcggttctctcg

SEQ ID NO: 635719 - DNA, 25 bp, Mus musculus
gaagggacaccattcggttctctcg

SEQ ID NO: 635720 - DNA, 25 bp, Mus musculus
gaagggacagatcacaggtcaatca

SEQ ID NO: 635721 - DNA, 25 bp, Mus musculus
gaagggacagatgacaggtcaatca

SEQ ID NO: 635722 - DNA, 25 bp, Mus musculus
gaagggaccaagcaagcacatgacc

SEQ ID NO: 635723 - DNA, 25 bp, Mus musculus
gaagggaccaaggaagcacatgacc

SEQ ID NO: 635724 - DNA, 25 bp, Mus musculus
gaagggaccactagataggtcacag

SEQ ID NO: 635725 - DNA, 25 bp, Mus musculus
gaagggaccacttgataggtcacag

SEQ ID NO: 635726 - DNA, 25 bp, Mus musculus
gaagggacccaaatctacctgtttg

SEQ ID NO: 635727 - DNA, 25 bp, Mus musculus
gaagggacccaattctacctgtttg

SEQ ID NO: 635728 - DNA, 25 bp, Mus musculus
gaagggacccagaatcagggcaaaa

SEQ ID NO: 635729 - DNA, 25 bp, Mus musculus
gaagggacccagtatcagggcaaaa

SEQ ID NO: 635730 - DNA, 25 bp, Mus musculus
gaagggaccggactcctacaggcct

SEQ ID NO: 635731 - DNA, 25 bp, Mus musculus
gaagggaccggagtcctacaggcct

SEQ ID NO: 635732 - DNA, 25 bp, Mus musculus
gaagggacctaacccgctcatgaga

SEQ ID NO: 635733 - DNA, 25 bp, Mus musculus
gaagggacctaagccgctcatgaga

SEQ ID NO: 635734 - DNA, 25 bp, Mus musculus
gaagggacctgcagctaacttgaag

SEQ ID NO: 635735 - DNA, 25 bp, Mus musculus
gaagggacctgctgctaacttgaag

SEQ ID NO: 635736 - DNA, 25 bp, Mus musculus
gaagggacggatccattcagacttg

SEQ ID NO: 635737 - DNA, 25 bp, Mus musculus
gaagggacggatgcattcagacttg

SEQ ID NO: 635738 - DNA, 25 bp, Mus musculus
gaagggactacacaaactctctcca

SEQ ID NO: 635739 - DNA, 25 bp, Mus musculus
gaagggactacagaaactctctcca

SEQ ID NO: 635740 - DNA, 25 bp, Mus musculus
gaagggacttctccagaggaattgt

SEQ ID NO: 635741 - DNA, 25 bp, Mus musculus
gaagggacttctgcagaggaattgt

SEQ ID NO: 635742 - DNA, 25 bp, Mus musculus
gaagggagaataagtgtatcctgct

SEQ ID NO: 635743 - DNA, 25 bp, Mus musculus
gaagggagaatatgtgtatcctgct

SEQ ID NO: 635744 - DNA, 25 bp, Mus musculus
gaagggagatatacgtaaatgcccc

SEQ ID NO: 635745 - DNA, 25 bp, Mus musculus
gaagggagatattcgtaaatgcccc

SEQ ID NO: 635746 - DNA, 25 bp, Mus musculus
gaagggagcacacacgttaatgccg

SEQ ID NO: 635747 - DNA, 25 bp, Mus musculus
gaagggagcacagacgttaatgccg

SEQ ID NO: 635748 - DNA, 25 bp, Mus musculus
gaagggaggattctcatggttttcc

SEQ ID NO: 635749 - DNA, 25 bp, Mus musculus
gaagggaggattgtcatggttttcc

SEQ ID NO: 635750 - DNA, 25 bp, Mus musculus
gaagggaggccacatcagtcgtact

SEQ ID NO: 635751 - DNA, 25 bp, Mus musculus
gaagggaggccagatcagtcgtact

SEQ ID NO: 635752 - DNA, 25 bp, Mus musculus
gaagggagtcctcctcacatgcttg

SEQ ID NO: 635753 - DNA, 25 bp, Mus musculus
gaagggagtcctgctcacatgcttg

SEQ ID NO: 635754 - DNA, 25 bp, Mus musculus
gaagggagtttcatattcacaccat

SEQ ID NO: 635755 - DNA, 25 bp, Mus musculus
gaagggagtttcttattcacaccat

SEQ ID NO: 635756 - DNA, 25 bp, Mus musculus
gaagggataaccatctgctttaagg

SEQ ID NO: 635757 - DNA, 25 bp, Mus musculus
gaagggataaccttctgctttaagg

SEQ ID NO: 635758 - DNA, 25 bp, Mus musculus
gaagggatacacagttgggtttcag

SEQ ID NO: 635759 - DNA, 25 bp, Mus musculus
gaagggatacactgttgggtttcag

SEQ ID NO: 635760 - DNA, 25 bp, Mus musculus
gaagggatcaggagcgggagctgag

SEQ ID NO: 635761 - DNA, 25 bp, Mus musculus
gaagggatcaggtgcgggagctgag

SEQ ID NO: 635762 - DNA, 25 bp, Mus musculus
gaagggatgaagcacgtcctcagta

SEQ ID NO: 635763 - DNA, 25 bp, Mus musculus
gaagggatgaaggacgtcctcagta

SEQ ID NO: 635764 - DNA, 25 bp, Mus musculus
gaagggatgctactgagaccacact

SEQ ID NO: 635765 - DNA, 25 bp, Mus musculus
gaagggatgctagtgagaccacact

SEQ ID NO: 635766 - DNA, 25 bp, Mus musculus
gaagggattaatcccagatgggact

SEQ ID NO: 635767 - DNA, 25 bp, Mus musculus
gaagggattaatgccagatgggact

SEQ ID NO: 635768 - DNA, 25 bp, Mus musculus
gaagggattcaacgtgtcctcacct

SEQ ID NO: 635769 - DNA, 25 bp, Mus musculus
gaagggattcaaggtgtcctcacct

SEQ ID NO: 635770 - DNA, 25 bp, Mus musculus
gaagggcaaagacaagtactttgca

SEQ ID NO: 635771 - DNA, 25 bp, Mus musculus
gaagggcaaagagaagtactttgca

SEQ ID NO: 635772 - DNA, 25 bp, Mus musculus
gaagggcaaccaaaagaaagctatt

SEQ ID NO: 635773 - DNA, 25 bp, Mus musculus
gaagggcaaccataagaaagctatt

SEQ ID NO: 635774 - DNA, 25 bp, Mus musculus
gaagggcactgcaactttgtctcag

SEQ ID NO: 635775 - DNA, 25 bp, Mus musculus
gaagggcactgctactttgtctcag

SEQ ID NO: 635776 - DNA, 25 bp, Mus musculus
gaagggcaggcactatttctcatgc

SEQ ID NO: 635777 - DNA, 25 bp, Mus musculus
gaagggcaggcagtatttctcatgc

SEQ ID NO: 635778 - DNA, 25 bp, Mus musculus
gaagggcagggccaacctctcaaat

SEQ ID NO: 635779 - DNA, 25 bp, Mus musculus
gaagggcagggcgaacctctcaaat

SEQ ID NO: 635780 - DNA, 25 bp, Mus musculus
gaagggcatctcctgtagctcctgg

SEQ ID NO: 635781 - DNA, 25 bp, Mus musculus
gaagggcatctcgtgtagctcctgg

SEQ ID NO: 635782 - DNA, 25 bp, Mus musculus
gaagggcatggaaacccaatgtccc

SEQ ID NO: 635783 - DNA, 25 bp, Mus musculus
gaagggcatggatacccaatgtccc

SEQ ID NO: 635784 - DNA, 25 bp, Mus musculus
gaagggcattagagcagaagtgact

SEQ ID NO: 635785 - DNA, 25 bp, Mus musculus
gaagggcattagtgcagaagtgact

SEQ ID NO: 635786 - DNA, 25 bp, Mus musculus
gaagggcattatcccagctacagga

SEQ ID NO: 635787 - DNA, 25 bp, Mus musculus
gaagggcattatgccagctacagga

SEQ ID NO: 635788 - DNA, 25 bp, Mus musculus
gaagggcattgtccaacccacattg

SEQ ID NO: 635789 - DNA, 25 bp, Mus musculus
gaagggcattgtgcaacccacattg

SEQ ID NO: 635790 - DNA, 25 bp, Mus musculus
gaagggccaaacctagtcccaagca

SEQ ID NO: 635791 - DNA, 25 bp, Mus musculus
gaagggccaaacgtagtcccaagca

SEQ ID NO: 635792 - DNA, 25 bp, Mus musculus
gaagggccagacaaataccccacca

SEQ ID NO: 635793 - DNA, 25 bp, Mus musculus
gaagggccagactaataccccacca

SEQ ID NO: 635794 - DNA, 25 bp, Mus musculus
gaagggccatcgcagttagactgcc

SEQ ID NO: 635795 - DNA, 25 bp, Mus musculus
gaagggccatcggagttagactgcc

SEQ ID NO: 635796 - DNA, 25 bp, Mus musculus
gaagggcccatcattttctacacag

SEQ ID NO: 635797 - DNA, 25 bp, Mus musculus
gaagggcccatctttttctacacag

SEQ ID NO: 635798 - DNA, 25 bp, Mus musculus
gaagggccctgcctctatgcagcgt

SEQ ID NO: 635799 - DNA, 25 bp, Mus musculus
gaagggccctgcgtctatgcagcgt

SEQ ID NO: 635800 - DNA, 25 bp, Mus musculus
gaagggccgctgagcaaatggacta

SEQ ID NO: 635801 - DNA, 25 bp, Mus musculus
gaagggccgctgtgcaaatggacta

SEQ ID NO: 635802 - DNA, 25 bp, Mus musculus
gaagggcctagaatttcccatgact

SEQ ID NO: 635803 - DNA, 25 bp, Mus musculus
gaagggcctagattttcccatgact

SEQ ID NO: 635804 - DNA, 25 bp, Mus musculus
gaagggcctccaacctactatgaca

SEQ ID NO: 635805 - DNA, 25 bp, Mus musculus
gaagggcctccatcctactatgaca

SEQ ID NO: 635806 - DNA, 25 bp, Mus musculus
gaagggcgcctgaaagctgcctgta

SEQ ID NO: 635807 - DNA, 25 bp, Mus musculus
gaagggcgcctgtaagctgcctgta

SEQ ID NO: 635808 - DNA, 25 bp, Mus musculus
gaagggcgtgacatcatccaggaat

SEQ ID NO: 635809 - DNA, 25 bp, Mus musculus
gaagggcgtgacttcatccaggaat

SEQ ID NO: 635810 - DNA, 25 bp, Mus musculus
gaagggcgtgctacctgtatttcac

SEQ ID NO: 635811 - DNA, 25 bp, Mus musculus
gaagggcgtgcttcctgtatttcac

SEQ ID NO: 635812 - DNA, 25 bp, Mus musculus
gaagggctacccaggcaaactaagt

SEQ ID NO: 635813 - DNA, 25 bp, Mus musculus
gaagggctaccctggcaaactaagt

SEQ ID NO: 635814 - DNA, 25 bp, Mus musculus
gaagggctagaaatgagcctccaga

SEQ ID NO: 635815 - DNA, 25 bp, Mus musculus
gaagggctagaattgagcctccaga

SEQ ID NO: 635816 - DNA, 25 bp, Mus musculus
gaagggctatgcagacctgtacagc

SEQ ID NO: 635817 - DNA, 25 bp, Mus musculus
gaagggctatgctgacctgtacagc

SEQ ID NO: 635818 - DNA, 25 bp, Mus musculus
gaagggctcaacaatgacttcatct

SEQ ID NO: 635819 - DNA, 25 bp, Mus musculus
gaagggctcaactatgacttcatct

SEQ ID NO: 635820 - DNA, 25 bp, Mus musculus
gaagggctcacgaagctcactctgt

SEQ ID NO: 635821 - DNA, 25 bp, Mus musculus
gaagggctcacgtagctcactctgt

SEQ ID NO: 635822 - DNA, 25 bp, Mus musculus
gaagggctcaggaataacagagtca

SEQ ID NO: 635823 - DNA, 25 bp, Mus musculus
gaagggctcaggtataacagagtca

SEQ ID NO: 635824 - DNA, 25 bp, Mus musculus
gaagggctcccgagtcacagttatg

SEQ ID NO: 635825 - DNA, 25 bp, Mus musculus
gaagggctcccgtgtcacagttatg

SEQ ID NO: 635826 - DNA, 25 bp, Mus musculus
gaagggctctacaccactgcatatg

SEQ ID NO: 635827 - DNA, 25 bp, Mus musculus
gaagggctctactccactgcatatg

SEQ ID NO: 635828 - DNA, 25 bp, Mus musculus
gaagggctgacaccagatgacgtcc

SEQ ID NO: 635829 - DNA, 25 bp, Mus musculus
gaagggctgacagcagatgacgtcc

SEQ ID NO: 635830 - DNA, 25 bp, Mus musculus
gaagggctgagtacccttatttaag

SEQ ID NO: 635831 - DNA, 25 bp, Mus musculus
gaagggctgagttcccttatttaag

SEQ ID NO: 635832 - DNA, 25 bp, Mus musculus
gaagggctggatagatctccacaga

SEQ ID NO: 635833 - DNA, 25 bp, Mus musculus
gaagggctggattgatctccacaga

SEQ ID NO: 635834 - DNA, 25 bp, Mus musculus
gaagggctggtcatgaactcggata

SEQ ID NO: 635835 - DNA, 25 bp, Mus musculus
gaagggctggtcttgaactcggata

SEQ ID NO: 635836 - DNA, 25 bp, Mus musculus
gaagggcttagcatcccgctgctgg

SEQ ID NO: 635837 - DNA, 25 bp, Mus musculus
gaagggcttagcttcccgctgctgg

SEQ ID NO: 635838 - DNA, 25 bp, Mus musculus
gaagggtaatagccctggttatgct

SEQ ID NO: 635839 - DNA, 25 bp, Mus musculus
gaagggtaataggcctggttatgct

SEQ ID NO: 635840 - DNA, 25 bp, Mus musculus
gaagggtaccccacgccatggtcgg

SEQ ID NO: 635841 - DNA, 25 bp, Mus musculus
gaagggtacccctcgccatggtcgg

SEQ ID NO: 635842 - DNA, 25 bp, Mus musculus
gaagggtcaaagcactaacgacact

SEQ ID NO: 635843 - DNA, 25 bp, Mus musculus
gaagggtcaaaggactaacgacact

SEQ ID NO: 635844 - DNA, 25 bp, Mus musculus
gaagggtcaactcttctgttggatt

SEQ ID NO: 635845 - DNA, 25 bp, Mus musculus
gaagggtcaactgttctgttggatt

SEQ ID NO: 635846 - DNA, 25 bp, Mus musculus
gaagggtccaccctcagcgtgccaa

SEQ ID NO: 635847 - DNA, 25 bp, Mus musculus
gaagggtccaccgtcagcgtgccaa

SEQ ID NO: 635848 - DNA, 25 bp, Mus musculus
gaagggtccttccttgagctgccgt

SEQ ID NO: 635849 - DNA, 25 bp, Mus musculus
gaagggtccttcgttgagctgccgt

SEQ ID NO: 635850 - DNA, 25 bp, Mus musculus
gaagggtctccaaacagtccggaat

SEQ ID NO: 635851 - DNA, 25 bp, Mus musculus
gaagggtctccacgcataccaggga

SEQ ID NO: 635852 - DNA, 25 bp, Mus musculus
gaagggtctccaggcataccaggga

SEQ ID NO: 635853 - DNA, 25 bp, Mus musculus
gaagggtctccatacagtccggaat

SEQ ID NO: 635854 - DNA, 25 bp, Mus musculus
gaagggtgcctgctttgactatgac

SEQ ID NO: 635855 - DNA, 25 bp, Mus musculus
gaagggtgcctggtttgactatgac

SEQ ID NO: 635856 - DNA, 25 bp, Mus musculus
gaagggtgcgtgacctgcctgcaca

SEQ ID NO: 635857 - DNA, 25 bp, Mus musculus
gaagggtgcgtgtcctgcctgcaca

SEQ ID NO: 635858 - DNA, 25 bp, Mus musculus
gaagggtgggctccaactcagacat

SEQ ID NO: 635859 - DNA, 25 bp, Mus musculus
gaagggtgggctgcaactcagacat

SEQ ID NO: 635860 - DNA, 25 bp, Mus musculus
gaagggtgtctcacccctaaagcca

SEQ ID NO: 635861 - DNA, 25 bp, Mus musculus
gaagggtgtctctcccctaaagcca

SEQ ID NO: 635862 - DNA, 25 bp, Mus musculus
gaagggtgttcgatccacaggcaag

SEQ ID NO: 635863 - DNA, 25 bp, Mus musculus
gaagggtgttcgttccacaggcaag

SEQ ID NO: 635864 - DNA, 25 bp, Mus musculus
gaagggttagcaaggccagattttc

SEQ ID NO: 635865 - DNA, 25 bp, Mus musculus
gaagggttagcatggccagattttc

SEQ ID NO: 635866 - DNA, 25 bp, Mus musculus
gaagggttatagctacttcactatc

SEQ ID NO: 635867 - DNA, 25 bp, Mus musculus
gaagggttataggtacttcactatc

SEQ ID NO: 635868 - DNA, 25 bp, Mus musculus
gaagggttcagaatgagatgctcac

SEQ ID NO: 635869 - DNA, 25 bp, Mus musculus
gaagggttcagattgagatgctcac

SEQ ID NO: 635870 - DNA, 25 bp, Mus musculus
gaagggttgcaacgttgtcatttgt

SEQ ID NO: 635871 - DNA, 25 bp, Mus musculus
gaagggttgcaaggttgtcatttgt

SEQ ID NO: 635872 - DNA, 25 bp, Mus musculus
gaagggtttgataaagcagacggaa

SEQ ID NO: 635873 - DNA, 25 bp, Mus musculus
gaagggtttgatatcgcgaatggca

SEQ ID NO: 635874 - DNA, 25 bp, Mus musculus
gaagggtttgattaagcagacggaa

SEQ ID NO: 635875 - DNA, 25 bp, Mus musculus
gaagggtttgatttcgcgaatggca

SEQ ID NO: 635876 - DNA, 25 bp, Mus musculus
gaaggtaaggctcgcaatcaaacct

SEQ ID NO: 635877 - DNA, 25 bp, Mus musculus
gaaggtaaggctggcaatcaaacct

SEQ ID NO: 635878 - DNA, 25 bp, Mus musculus
gaaggtacaccgagtaccgctctct

SEQ ID NO: 635879 - DNA, 25 bp, Mus musculus
gaaggtacaccgtgtaccgctctct

SEQ ID NO: 635880 - DNA, 25 bp, Mus musculus
gaaggtaccattcctcagagcgagg

SEQ ID NO: 635881 - DNA, 25 bp, Mus musculus
gaaggtaccattgctcagagcgagg

SEQ ID NO: 635882 - DNA, 25 bp, Mus musculus
gaaggtacgtttctaccgcaatggg

SEQ ID NO: 635883 - DNA, 25 bp, Mus musculus
gaaggtacgtttgtaccgcaatggg

SEQ ID NO: 635884 - DNA, 25 bp, Mus musculus
gaaggtactttacgatttttcatcg

SEQ ID NO: 635885 - DNA, 25 bp, Mus musculus
gaaggtactttaggatttttcatcg

SEQ ID NO: 635886 - DNA, 25 bp, Mus musculus
gaaggtagacacattctgctggaac

SEQ ID NO: 635887 - DNA, 25 bp, Mus musculus
gaaggtagacactttctgctggaac

SEQ ID NO: 635888 - DNA, 25 bp, Mus musculus
gaaggtagatagatgcctgggcact

SEQ ID NO: 635889 - DNA, 25 bp, Mus musculus
gaaggtagatagttgcctgggcact

SEQ ID NO: 635890 - DNA, 25 bp, Mus musculus
gaaggtaggcaacactggttccctc

SEQ ID NO: 635891 - DNA, 25 bp, Mus musculus
gaaggtaggcaagactggttccctc

SEQ ID NO: 635892 - DNA, 25 bp, Mus musculus
gaaggtatgacaagcagatggctct

SEQ ID NO: 635893 - DNA, 25 bp, Mus musculus
gaaggtatgacatgcagatggctct

SEQ ID NO: 635894 - DNA, 25 bp, Mus musculus
gaaggtatgtgaattgccaaaggca

SEQ ID NO: 635895 - DNA, 25 bp, Mus musculus
gaaggtatgtgatttgccaaaggca

SEQ ID NO: 635896 - DNA, 25 bp, Mus musculus
gaaggtattagaaatcttggaactg

SEQ ID NO: 635897 - DNA, 25 bp, Mus musculus
gaaggtattagatatcttggaactg

SEQ ID NO: 635898 - DNA, 25 bp, Mus musculus
gaaggtattgttacatattttgtcc

SEQ ID NO: 635899 - DNA, 25 bp, Mus musculus
gaaggtattgtttcatattttgtcc

SEQ ID NO: 635900 - DNA, 25 bp, Mus musculus
gaaggtatttctctgttgaaatcca

SEQ ID NO: 635901 - DNA, 25 bp, Mus musculus
gaaggtatttctgtgttgaaatcca

SEQ ID NO: 635902 - DNA, 25 bp, Mus musculus
gaaggtcaaacacgaagacagacgt

SEQ ID NO: 635903 - DNA, 25 bp, Mus musculus
gaaggtcaaacaggaagacagacgt

SEQ ID NO: 635904 - DNA, 25 bp, Mus musculus
gaaggtcaagagcaaacaccctcgg

SEQ ID NO: 635905 - DNA, 25 bp, Mus musculus
gaaggtcaagaggaaacaccctcgg

SEQ ID NO: 635906 - DNA, 25 bp, Mus musculus
gaaggtcacatcctccttacagact

SEQ ID NO: 635907 - DNA, 25 bp, Mus musculus
gaaggtcacatcgtccttacagact

SEQ ID NO: 635908 - DNA, 25 bp, Mus musculus
gaaggtcacccacaacaggatggcc

SEQ ID NO: 635909 - DNA, 25 bp, Mus musculus
gaaggtcacccagaacaggatggcc

SEQ ID NO: 635910 - DNA, 25 bp, Mus musculus
gaaggtcaccctacctgtgccggat

SEQ ID NO: 635911 - DNA, 25 bp, Mus musculus
gaaggtcacccttcctgtgccggat

SEQ ID NO: 635912 - DNA, 25 bp, Mus musculus
gaaggtcacctcagcctatctccag

SEQ ID NO: 635913 - DNA, 25 bp, Mus musculus
gaaggtcacctctgcctatctccag

SEQ ID NO: 635914 - DNA, 25 bp, Mus musculus
gaaggtcacggtcaagacgcctaaa

SEQ ID NO: 635915 - DNA, 25 bp, Mus musculus
gaaggtcacggtgaagacgcctaaa

SEQ ID NO: 635916 - DNA, 25 bp, Mus musculus
gaaggtcatcgtcctgcccaaggac

SEQ ID NO: 635917 - DNA, 25 bp, Mus musculus
gaaggtcatcgtgctgcccaaggac

SEQ ID NO: 635918 - DNA, 25 bp, Mus musculus
gaaggtcatcttccggctgcatgac

SEQ ID NO: 635919 - DNA, 25 bp, Mus musculus
gaaggtcatcttgcggctgcatgac

SEQ ID NO: 635920 - DNA, 25 bp, Mus musculus
gaaggtcatgggagttctggacatt

SEQ ID NO: 635921 - DNA, 25 bp, Mus musculus
gaaggtcatgggtgttctggacatt

SEQ ID NO: 635922 - DNA, 25 bp, Mus musculus
gaaggtcatgtgagaggacgccctc

SEQ ID NO: 635923 - DNA, 25 bp, Mus musculus
gaaggtcatgtgtgaggacgccctc

SEQ ID NO: 635924 - DNA, 25 bp, Mus musculus
gaaggtcattccagccgtgagcatc

SEQ ID NO: 635925 - DNA, 25 bp, Mus musculus
gaaggtcattcctgccgtgagcatc

SEQ ID NO: 635926 - DNA, 25 bp, Mus musculus
gaaggtcattctcatcgaactggag

SEQ ID NO: 635927 - DNA, 25 bp, Mus musculus
gaaggtcattctgatcgaactggag

SEQ ID NO: 635928 - DNA, 25 bp, Mus musculus
gaaggtcattggacgctggtcaccc

SEQ ID NO: 635929 - DNA, 25 bp, Mus musculus
gaaggtcattggtcgctggtcaccc

SEQ ID NO: 635930 - DNA, 25 bp, Mus musculus
gaaggtccaggacctagctcacgag

SEQ ID NO: 635931 - DNA, 25 bp, Mus musculus
gaaggtccaggagctagctcacgag

SEQ ID NO: 635932 - DNA, 25 bp, Mus musculus
gaaggtccccaaagcagctgccggg

SEQ ID NO: 635933 - DNA, 25 bp, Mus musculus
gaaggtccccaatgcagctgccggg

SEQ ID NO: 635934 - DNA, 25 bp, Mus musculus
gaaggtccctctcgagaccaatggc

SEQ ID NO: 635935 - DNA, 25 bp, Mus musculus
gaaggtccctctggagaccaatggc

SEQ ID NO: 635936 - DNA, 25 bp, Mus musculus
gaaggtccctgtcgagcaacgactg

SEQ ID NO: 635937 - DNA, 25 bp, Mus musculus
gaaggtccctgtggagcaacgactg

SEQ ID NO: 635938 - DNA, 25 bp, Mus musculus
gaaggtccggagcttacagcttcgc

SEQ ID NO: 635939 - DNA, 25 bp, Mus musculus
gaaggtccggaggttacagcttcgc

SEQ ID NO: 635940 - DNA, 25 bp, Mus musculus
gaaggtcctcacacagtagatgcaa

SEQ ID NO: 635941 - DNA, 25 bp, Mus musculus
gaaggtcctcactcagtagatgcaa

SEQ ID NO: 635942 - DNA, 25 bp, Mus musculus
gaaggtcctgatagataatcctgct

SEQ ID NO: 635943 - DNA, 25 bp, Mus musculus
gaaggtcctgattgataatcctgct

SEQ ID NO: 635944 - DNA, 25 bp, Mus musculus
gaaggtcgatctcacccggttcaag

SEQ ID NO: 635945 - DNA, 25 bp, Mus musculus
gaaggtcgatctgacccggttcaag

SEQ ID NO: 635946 - DNA, 25 bp, Mus musculus
gaaggtcgttcaactgccgcatgag

SEQ ID NO: 635947 - DNA, 25 bp, Mus musculus
gaaggtcgttcatctgccgcatgag

SEQ ID NO: 635948 - DNA, 25 bp, Mus musculus
gaaggtctagttcattgtgatggaa

SEQ ID NO: 635949 - DNA, 25 bp, Mus musculus
gaaggtctagttgattgtgatggaa

SEQ ID NO: 635950 - DNA, 25 bp, Mus musculus
gaaggtctatatcgactataatgcc

SEQ ID NO: 635951 - DNA, 25 bp, Mus musculus
gaaggtctatatggactataatgcc

SEQ ID NO: 635952 - DNA, 25 bp, Mus musculus
gaaggtctccatagaaattgaaggg

SEQ ID NO: 635953 - DNA, 25 bp, Mus musculus
gaaggtctccattgaaattgaaggg

SEQ ID NO: 635954 - DNA, 25 bp, Mus musculus
gaaggtctgcttcacctacgacctg

SEQ ID NO: 635955 - DNA, 25 bp, Mus musculus
gaaggtctgcttgacctacgacctg

SEQ ID NO: 635956 - DNA, 25 bp, Mus musculus
gaaggtctgggtccacttcttcaac

SEQ ID NO: 635957 - DNA, 25 bp, Mus musculus
gaaggtctgggtgcacttcttcaac

SEQ ID NO: 635958 - DNA, 25 bp, Mus musculus
gaaggtctgtgcataagaccgggac

SEQ ID NO: 635959 - DNA, 25 bp, Mus musculus
gaaggtctgtgcttaagaccgggac

SEQ ID NO: 635960 - DNA, 25 bp, Mus musculus
gaaggtctttcgcagcatctgcagc

SEQ ID NO: 635961 - DNA, 25 bp, Mus musculus
gaaggtctttcggagcatctgcagc

SEQ ID NO: 635962 - DNA, 25 bp, Mus musculus
gaaggtgaacctcagcccaagtttg

SEQ ID NO: 635963 - DNA, 25 bp, Mus musculus
gaaggtgaacctgagcccaagtttg

SEQ ID NO: 635964 - DNA, 25 bp, Mus musculus
gaaggtgaagagatcaaacatccag

SEQ ID NO: 635965 - DNA, 25 bp, Mus musculus
gaaggtgaagagttcaaacatccag

SEQ ID NO: 635966 - DNA, 25 bp, Mus musculus
gaaggtgaatgtagccaagcttagg

SEQ ID NO: 635967 - DNA, 25 bp, Mus musculus
gaaggtgaatgttgccaagcttagg

SEQ ID NO: 635968 - DNA, 25 bp, Mus musculus
gaaggtgaccagcaagaatgccttt

SEQ ID NO: 635969 - DNA, 25 bp, Mus musculus
gaaggtgaccaggaagaatgccttt

SEQ ID NO: 635970 - DNA, 25 bp, Mus musculus
gaaggtgactctcattctcatagct

SEQ ID NO: 635971 - DNA, 25 bp, Mus musculus
gaaggtgactctgattctcatagct

SEQ ID NO: 635972 - DNA, 25 bp, Mus musculus
gaaggtgagaacacaagaattgccc

SEQ ID NO: 635973 - DNA, 25 bp, Mus musculus
gaaggtgagaactcaagaattgccc

SEQ ID NO: 635974 - DNA, 25 bp, Mus musculus
gaaggtgagcctacctaagcctcta

SEQ ID NO: 635975 - DNA, 25 bp, Mus musculus
gaaggtgagccttcctaagcctcta

SEQ ID NO: 635976 - DNA, 25 bp, Mus musculus
gaaggtgaggtcctgcacacttgat

SEQ ID NO: 635977 - DNA, 25 bp, Mus musculus
gaaggtgaggtcgtgcacacttgat

SEQ ID NO: 635978 - DNA, 25 bp, Mus musculus
gaaggtgagtatcatctggaactcc

SEQ ID NO: 635979 - DNA, 25 bp, Mus musculus
gaaggtgagtatgatctggaactcc

SEQ ID NO: 635980 - DNA, 25 bp, Mus musculus
gaaggtgatcggaaccatacgcatg

SEQ ID NO: 635981 - DNA, 25 bp, Mus musculus
gaaggtgatcggtaccatacgcatg

SEQ ID NO: 635982 - DNA, 25 bp, Mus musculus
gaaggtgatgtgacatctgtcaaag

SEQ ID NO: 635983 - DNA, 25 bp, Mus musculus
gaaggtgatgtgtcatctgtcaaag

SEQ ID NO: 635984 - DNA, 25 bp, Mus musculus
gaaggtgatgttctaaccctgctca

SEQ ID NO: 635985 - DNA, 25 bp, Mus musculus
gaaggtgatgttgtaaccctgctca

SEQ ID NO: 635986 - DNA, 25 bp, Mus musculus
gaaggtgcaccaccttgccatgacg

SEQ ID NO: 635987 - DNA, 25 bp, Mus musculus
gaaggtgcaccagcttgccatgacg

SEQ ID NO: 635988 - DNA, 25 bp, Mus musculus
gaaggtgcgaccactgagtgccagt

SEQ ID NO: 635989 - DNA, 25 bp, Mus musculus
gaaggtgcgacctctgagtgccagt

SEQ ID NO: 635990 - DNA, 25 bp, Mus musculus
gaaggtgctacgcaaggcggcgttg

SEQ ID NO: 635991 - DNA, 25 bp, Mus musculus
gaaggtgctacggaaggcggcgttg

SEQ ID NO: 635992 - DNA, 25 bp, Mus musculus
gaaggtggacgcacggccctgtatt

SEQ ID NO: 635993 - DNA, 25 bp, Mus musculus
gaaggtggacgctcggccctgtatt

SEQ ID NO: 635994 - DNA, 25 bp, Mus musculus
gaaggtggacggacgcttttctgca

SEQ ID NO: 635995 - DNA, 25 bp, Mus musculus
gaaggtggacggtcgcttttctgca

SEQ ID NO: 635996 - DNA, 25 bp, Mus musculus
gaaggtggcaaacaactcaaggaac

SEQ ID NO: 635997 - DNA, 25 bp, Mus musculus
gaaggtggcaaagaactcaaggaac

SEQ ID NO: 635998 - DNA, 25 bp, Mus musculus
gaaggtggcacacagaacgatctcc

SEQ ID NO: 635999 - DNA, 25 bp, Mus musculus
gaaggtggcacagagaacgatctcc

SEQ ID NO: 636000 - DNA, 25 bp, Mus musculus
gaaggtgggccacttaaatctctct

SEQ ID NO: 636001 - DNA, 25 bp, Mus musculus
gaaggtgggccagttaaatctctct

SEQ ID NO: 636002 - DNA, 25 bp, Mus musculus
gaaggtgggtagcatttcctgtact

SEQ ID NO: 636003 - DNA, 25 bp, Mus musculus
gaaggtgggtaggatttcctgtact

SEQ ID NO: 636004 - DNA, 25 bp, Mus musculus
gaaggtggtaagactcgctgtcttg

SEQ ID NO: 636005 - DNA, 25 bp, Mus musculus
gaaggtggtaagtctcgctgtcttg

SEQ ID NO: 636006 - DNA, 25 bp, Mus musculus
gaaggtgtcaaactcggagatctgt

SEQ ID NO: 636007 - DNA, 25 bp, Mus musculus
gaaggtgtcaaagtcggagatctgt

SEQ ID NO: 636008 - DNA, 25 bp, Mus musculus
gaaggtgtcatccataggtgcaccc

SEQ ID NO: 636009 - DNA, 25 bp, Mus musculus
gaaggtgtcatcgataggtgcaccc

SEQ ID NO: 636010 - DNA, 25 bp, Mus musculus
gaaggtgtccatcaaagagctcaac

SEQ ID NO: 636011 - DNA, 25 bp, Mus musculus
gaaggtgtccatgaaagagctcaac

SEQ ID NO: 636012 - DNA, 25 bp, Mus musculus
gaaggtgtctgacacccggagaccc

SEQ ID NO: 636013 - DNA, 25 bp, Mus musculus
gaaggtgtctgagacccggagaccc

SEQ ID NO: 636014 - DNA, 25 bp, Mus musculus
gaaggtgtgaggacaattctaagcc

SEQ ID NO: 636015 - DNA, 25 bp, Mus musculus
gaaggtgtgaggtcaattctaagcc

SEQ ID NO: 636016 - DNA, 25 bp, Mus musculus
gaaggtgttaaccatgacatccgga

SEQ ID NO: 636017 - DNA, 25 bp, Mus musculus
gaaggtgttaacgatgacatccgga

SEQ ID NO: 636018 - DNA, 25 bp, Mus musculus
gaaggtgttcaaaattcctgccctg

SEQ ID NO: 636019 - DNA, 25 bp, Mus musculus
gaaggtgttcaatattcctgccctg

SEQ ID NO: 636020 - DNA, 25 bp, Mus musculus
gaaggtgttcaccacaggtttcagc

SEQ ID NO: 636021 - DNA, 25 bp, Mus musculus
gaaggtgttcacgacaggtttcagc

SEQ ID NO: 636022 - DNA, 25 bp, Mus musculus
gaaggtgttggcagtcaatcctcag

SEQ ID NO: 636023 - DNA, 25 bp, Mus musculus
gaaggtgttggctgtcaatcctcag

SEQ ID NO: 636024 - DNA, 25 bp, Mus musculus
gaaggtgtttcccattagaaccgct

SEQ ID NO: 636025 - DNA, 25 bp, Mus musculus
gaaggtgtttccgattagaaccgct

SEQ ID NO: 636026 - DNA, 25 bp, Mus musculus
gaaggttaacagaatccgcgtgtgt

SEQ ID NO: 636027 - DNA, 25 bp, Mus musculus
gaaggttaacagtatccgcgtgtgt

SEQ ID NO: 636028 - DNA, 25 bp, Mus musculus
gaaggttaatgaaaagaacccacac

SEQ ID NO: 636029 - DNA, 25 bp, Mus musculus
gaaggttaatgataagaacccacac

SEQ ID NO: 636030 - DNA, 25 bp, Mus musculus
gaaggttcctaccaatgcctctgtc

SEQ ID NO: 636031 - DNA, 25 bp, Mus musculus
gaaggttcctacgaatgcctctgtc

SEQ ID NO: 636032 - DNA, 25 bp, Mus musculus
gaaggttcctggagttactgccatt

SEQ ID NO: 636033 - DNA, 25 bp, Mus musculus
gaaggttcctggtgttactgccatt

SEQ ID NO: 636034 - DNA, 25 bp, Mus musculus
gaaggttcgagaactcaaggagact

SEQ ID NO: 636035 - DNA, 25 bp, Mus musculus
gaaggttcgagatctcaaggagact

SEQ ID NO: 636036 - DNA, 25 bp, Mus musculus
gaaggttcgagccaaggagaccaaa

SEQ ID NO: 636037 - DNA, 25 bp, Mus musculus
gaaggttcgagcgaaggagaccaaa

SEQ ID NO: 636038 - DNA, 25 bp, Mus musculus
gaaggttcgctcagtctttgaaaga

SEQ ID NO: 636039 - DNA, 25 bp, Mus musculus
gaaggttcgctctgtctttgaaaga

SEQ ID NO: 636040 - DNA, 25 bp, Mus musculus
gaaggttcggatcaagcacccctgt

SEQ ID NO: 636041 - DNA, 25 bp, Mus musculus
gaaggttcggatgaagcacccctgt

SEQ ID NO: 636042 - DNA, 25 bp, Mus musculus
gaaggttcgggcaccgctctcacag

SEQ ID NO: 636043 - DNA, 25 bp, Mus musculus
gaaggttcgggctccgctctcacag

SEQ ID NO: 636044 - DNA, 25 bp, Mus musculus
gaaggttctgctaatggtactttta

SEQ ID NO: 636045 - DNA, 25 bp, Mus musculus
gaaggttctgcttatggtactttta

SEQ ID NO: 636046 - DNA, 25 bp, Mus musculus
gaaggttcttctcggactgcttggt

SEQ ID NO: 636047 - DNA, 25 bp, Mus musculus
gaaggttcttctgggactgcttggt

SEQ ID NO: 636048 - DNA, 25 bp, Mus musculus
gaaggttctttccaaacaagagcat

SEQ ID NO: 636049 - DNA, 25 bp, Mus musculus
gaaggttctttcgaaacaagagcat

SEQ ID NO: 636050 - DNA, 25 bp, Mus musculus
gaaggttgacctaatcatctgggag

SEQ ID NO: 636051 - DNA, 25 bp, Mus musculus
gaaggttgaccttatcatctgggag

SEQ ID NO: 636052 - DNA, 25 bp, Mus musculus
gaaggttgacttaccccaagaccag

SEQ ID NO: 636053 - DNA, 25 bp, Mus musculus
gaaggttgactttccccaagaccag

SEQ ID NO: 636054 - DNA, 25 bp, Mus musculus
gaaggttgagttaaccggactgcct

SEQ ID NO: 636055 - DNA, 25 bp, Mus musculus
gaaggttgagtttaccggactgcct

SEQ ID NO: 636056 - DNA, 25 bp, Mus musculus
gaaggttgatcgagtcatgtagtga

SEQ ID NO: 636057 - DNA, 25 bp, Mus musculus
gaaggttgatcgtgtcatgtagtga

SEQ ID NO: 636058 - DNA, 25 bp, Mus musculus
gaaggttgcccacttagctgggtca

SEQ ID NO: 636059 - DNA, 25 bp, Mus musculus
gaaggttgcccagttagctgggtca

SEQ ID NO: 636060 - DNA, 25 bp, Mus musculus
gaaggttgctagagtttaacttggc

SEQ ID NO: 636061 - DNA, 25 bp, Mus musculus
gaaggttgctagtgtttaacttggc

SEQ ID NO: 636062 - DNA, 25 bp, Mus musculus
gaaggttggagccatcgttaatgcc

SEQ ID NO: 636063 - DNA, 25 bp, Mus musculus
gaaggttggagcgatcgttaatgcc

SEQ ID NO: 636064 - DNA, 25 bp, Mus musculus
gaaggttggcccagccatcaaggac

SEQ ID NO: 636065 - DNA, 25 bp, Mus musculus
gaaggttggccctgccatcaaggac

SEQ ID NO: 636066 - DNA, 25 bp, Mus musculus
gaaggttgggttactttgcctgtct

SEQ ID NO: 636067 - DNA, 25 bp, Mus musculus
gaaggttgggtttctttgcctgtct

SEQ ID NO: 636068 - DNA, 25 bp, Mus musculus
gaaggttgtcaaagaaatgtgcccc

SEQ ID NO: 636069 - DNA, 25 bp, Mus musculus
gaaggttgtcaaagcttagggaagg

SEQ ID NO: 636070 - DNA, 25 bp, Mus musculus
gaaggttgtcaatgaaatgtgcccc

SEQ ID NO: 636071 - DNA, 25 bp, Mus musculus
gaaggttgtcaatgcttagggaagg

SEQ ID NO: 636072 - DNA, 25 bp, Mus musculus
gaaggttgtcacaagactcaggtaa

SEQ ID NO: 636073 - DNA, 25 bp, Mus musculus
gaaggttgtcactagactcaggtaa

SEQ ID NO: 636074 - DNA, 25 bp, Mus musculus
gaaggtttaccacaagacccctgct

SEQ ID NO: 636075 - DNA, 25 bp, Mus musculus
gaaggtttaccagaagacccctgct

SEQ ID NO: 636076 - DNA, 25 bp, Mus musculus
gaaggtttcctcaggatgctgccat

SEQ ID NO: 636077 - DNA, 25 bp, Mus musculus
gaaggtttcctctggatgctgccat

SEQ ID NO: 636078 - DNA, 25 bp, Mus musculus
gaaggtttctttctaagtgacaatc

SEQ ID NO: 636079 - DNA, 25 bp, Mus musculus
gaaggtttctttgtaagtgacaatc

SEQ ID NO: 636080 - DNA, 25 bp, Mus musculus
gaaggtttggatctacccgatcaag

SEQ ID NO: 636081 - DNA, 25 bp, Mus musculus
gaaggtttggatgtacccgatcaag

SEQ ID NO: 636082 - DNA, 25 bp, Mus musculus
gaaggtttgtatagtcagtgagatc

SEQ ID NO: 636083 - DNA, 25 bp, Mus musculus
gaaggtttgtattgtcagtgagatc

SEQ ID NO: 636084 - DNA, 25 bp, Mus musculus
gaagtaaaactgcactttgaaaaga

SEQ ID NO: 636085 - DNA, 25 bp, Mus musculus
gaagtaaaactggactttgaaaaga

SEQ ID NO: 636086 - DNA, 25 bp, Mus musculus
gaagtaaaagggaacaaaatccatg

SEQ ID NO: 636087 - DNA, 25 bp, Mus musculus
gaagtaaaagggtacaaaatccatg

SEQ ID NO: 636088 - DNA, 25 bp, Mus musculus
gaagtaaaccggctgctagcagaac

SEQ ID NO: 636089 - DNA, 25 bp, Mus musculus
gaagtaaaccgggtgctagcagaac

SEQ ID NO: 636090 - DNA, 25 bp, Mus musculus
gaagtaaacctccagcctccaggtc

SEQ ID NO: 636091 - DNA, 25 bp, Mus musculus
gaagtaaacctcgagcctccaggtc

SEQ ID NO: 636092 - DNA, 25 bp, Mus musculus
gaagtaaagcttcctgtccagcagg

SEQ ID NO: 636093 - DNA, 25 bp, Mus musculus
gaagtaaagcttgctgtccagcagg

SEQ ID NO: 636094 - DNA, 25 bp, Mus musculus
gaagtaaagtctaggccggactttg

SEQ ID NO: 636095 - DNA, 25 bp, Mus musculus
gaagtaaagtcttggccggactttg

SEQ ID NO: 636096 - DNA, 25 bp, Mus musculus
gaagtaaatggtctcactgcagcac

SEQ ID NO: 636097 - DNA, 25 bp, Mus musculus
gaagtaaatggtgtcactgcagcac

SEQ ID NO: 636098 - DNA, 25 bp, Mus musculus
gaagtaacactgaaggagctccaca

SEQ ID NO: 636099 - DNA, 25 bp, Mus musculus
gaagtaacactgtaggagctccaca

SEQ ID NO: 636100 - DNA, 25 bp, Mus musculus
gaagtaaccacaactgtatgtcaca

SEQ ID NO: 636101 - DNA, 25 bp, Mus musculus
gaagtaaccacatctgtatgtcaca

SEQ ID NO: 636102 - DNA, 25 bp, Mus musculus
gaagtaactgaaccaccatgaaggt

SEQ ID NO: 636103 - DNA, 25 bp, Mus musculus
gaagtaactgaagcaccatgaaggt

SEQ ID NO: 636104 - DNA, 25 bp, Mus musculus
gaagtaactggaacccttggccagc

SEQ ID NO: 636105 - DNA, 25 bp, Mus musculus
gaagtaactggatcccttggccagc

SEQ ID NO: 636106 - DNA, 25 bp, Mus musculus
gaagtaacttgtaaaccagcgcgct

SEQ ID NO: 636107 - DNA, 25 bp, Mus musculus
gaagtaacttgttaaccagcgcgct

SEQ ID NO: 636108 - DNA, 25 bp, Mus musculus
gaagtaagaacacatgagaggagtc

SEQ ID NO: 636109 - DNA, 25 bp, Mus musculus
gaagtaagaacagatgagaggagtc

SEQ ID NO: 636110 - DNA, 25 bp, Mus musculus
gaagtaagattgagaccagcagcga

SEQ ID NO: 636111 - DNA, 25 bp, Mus musculus
gaagtaagattgtgaccagcagcga

SEQ ID NO: 636112 - DNA, 25 bp, Mus musculus
gaagtaagctttcacgagtaagaaa

SEQ ID NO: 636113 - DNA, 25 bp, Mus musculus
gaagtaagctttgacgagtaagaaa

SEQ ID NO: 636114 - DNA, 25 bp, Mus musculus
gaagtaaggtttaggcagacaggac

SEQ ID NO: 636115 - DNA, 25 bp, Mus musculus
gaagtaaggtttcacttggccagtg

SEQ ID NO: 636116 - DNA, 25 bp, Mus musculus
gaagtaaggtttgacttggccagtg

SEQ ID NO: 636117 - DNA, 25 bp, Mus musculus
gaagtaaggttttggcagacaggac

SEQ ID NO: 636118 - DNA, 25 bp, Mus musculus
gaagtaagtcccagtgtcattggga

SEQ ID NO: 636119 - DNA, 25 bp, Mus musculus
gaagtaagtccctgtgtcattggga

SEQ ID NO: 636120 - DNA, 25 bp, Mus musculus
gaagtaatacccagacacacatatg

SEQ ID NO: 636121 - DNA, 25 bp, Mus musculus
gaagtaataccctgacacacatatg

SEQ ID NO: 636122 - DNA, 25 bp, Mus musculus
gaagtaatccggatgcaggatgaca

SEQ ID NO: 636123 - DNA, 25 bp, Mus musculus
gaagtaatccggttgcaggatgaca

SEQ ID NO: 636124 - DNA, 25 bp, Mus musculus
gaagtaatgaatacaagtagcccca

SEQ ID NO: 636125 - DNA, 25 bp, Mus musculus
gaagtaatgaattcaagtagcccca

SEQ ID NO: 636126 - DNA, 25 bp, Mus musculus
gaagtacaagccatacgaggaagcg

SEQ ID NO: 636127 - DNA, 25 bp, Mus musculus
gaagtacaagccttacgaggaagcg

SEQ ID NO: 636128 - DNA, 25 bp, Mus musculus
gaagtacaagcgacggctggattcg

SEQ ID NO: 636129 - DNA, 25 bp, Mus musculus
gaagtacaagcgtcggctggattcg

SEQ ID NO: 636130 - DNA, 25 bp, Mus musculus
gaagtacaagtgaaaaacggaggca

SEQ ID NO: 636131 - DNA, 25 bp, Mus musculus
gaagtacaagtgtaaaacggaggca

SEQ ID NO: 636132 - DNA, 25 bp, Mus musculus
gaagtacacagccttatgggtggca

SEQ ID NO: 636133 - DNA, 25 bp, Mus musculus
gaagtacacagcgttatgggtggca

SEQ ID NO: 636134 - DNA, 25 bp, Mus musculus
gaagtacacatgcatgtcactaata

SEQ ID NO: 636135 - DNA, 25 bp, Mus musculus
gaagtacacatggatgtcactaata

SEQ ID NO: 636136 - DNA, 25 bp, Mus musculus
gaagtacacattagcagcccacatg

SEQ ID NO: 636137 - DNA, 25 bp, Mus musculus
gaagtacacatttgcagcccacatg

SEQ ID NO: 636138 - DNA, 25 bp, Mus musculus
gaagtaccaactactcctgtttgtt

SEQ ID NO: 636139 - DNA, 25 bp, Mus musculus
gaagtaccaacttctcctgtttgtt

SEQ ID NO: 636140 - DNA, 25 bp, Mus musculus
gaagtaccagatccagcccaagtga

SEQ ID NO: 636141 - DNA, 25 bp, Mus musculus
gaagtaccagatgcagcccaagtga

SEQ ID NO: 636142 - DNA, 25 bp, Mus musculus
gaagtacccattcatagtcaccgca

SEQ ID NO: 636143 - DNA, 25 bp, Mus musculus
gaagtacccattgatagtcaccgca

SEQ ID NO: 636144 - DNA, 25 bp, Mus musculus
gaagtaccgggtctatgctttctac

SEQ ID NO: 636145 - DNA, 25 bp, Mus musculus
gaagtaccgggtgtatgctttctac

SEQ ID NO: 636146 - DNA, 25 bp, Mus musculus
gaagtacctccgagaatacgcctgg

SEQ ID NO: 636147 - DNA, 25 bp, Mus musculus
gaagtacctccgtgaatacgcctgg

SEQ ID NO: 636148 - DNA, 25 bp, Mus musculus
gaagtacgaggacgccatccagttc

SEQ ID NO: 636149 - DNA, 25 bp, Mus musculus
gaagtacgaggaggccatccagttc

SEQ ID NO: 636150 - DNA, 25 bp, Mus musculus
gaagtacgatgtcgacacattagac

SEQ ID NO: 636151 - DNA, 25 bp, Mus musculus
gaagtacgatgtggacacattagac

SEQ ID NO: 636152 - DNA, 25 bp, Mus musculus
gaagtacgccctctttatctacgaa

SEQ ID NO: 636153 - DNA, 25 bp, Mus musculus
gaagtacgccctgtttatctacgaa

SEQ ID NO: 636154 - DNA, 25 bp, Mus musculus
gaagtacgccttacatgcagatggt

SEQ ID NO: 636155 - DNA, 25 bp, Mus musculus
gaagtacgcctttcatgcagatggt

SEQ ID NO: 636156 - DNA, 25 bp, Mus musculus
gaagtactatataccccggagttgg

SEQ ID NO: 636157 - DNA, 25 bp, Mus musculus
gaagtactatattccccggagttgg

SEQ ID NO: 636158 - DNA, 25 bp, Mus musculus
gaagtactatgtattacccaagaag

SEQ ID NO: 636159 - DNA, 25 bp, Mus musculus
gaagtactatgttttacccaagaag

SEQ ID NO: 636160 - DNA, 25 bp, Mus musculus
gaagtactccttctcggtggactgg

SEQ ID NO: 636161 - DNA, 25 bp, Mus musculus
gaagtactccttgtcggtggactgg

SEQ ID NO: 636162 - DNA, 25 bp, Mus musculus
gaagtactcgaacaagactgtccac

SEQ ID NO: 636163 - DNA, 25 bp, Mus musculus
gaagtactcgaagaagactgtccac

SEQ ID NO: 636164 - DNA, 25 bp, Mus musculus
gaagtactgggacccatttgccttt

SEQ ID NO: 636165 - DNA, 25 bp, Mus musculus
gaagtactgggagccatttgccttt

SEQ ID NO: 636166 - DNA, 25 bp, Mus musculus
gaagtactgtctacaaccatcagga

SEQ ID NO: 636167 - DNA, 25 bp, Mus musculus
gaagtactgtcttcaaccatcagga

SEQ ID NO: 636168 - DNA, 25 bp, Mus musculus
gaagtacttaagcagctacagggaa

SEQ ID NO: 636169 - DNA, 25 bp, Mus musculus
gaagtacttaaggagctacagggaa

SEQ ID NO: 636170 - DNA, 25 bp, Mus musculus
gaagtacttacaccagcgtccagcg

SEQ ID NO: 636171 - DNA, 25 bp, Mus musculus
gaagtacttacagcagcgtccagcg

SEQ ID NO: 636172 - DNA, 25 bp, Mus musculus
gaagtacttcgacatgacacataat

SEQ ID NO: 636173 - DNA, 25 bp, Mus musculus
gaagtacttcgagatgacacataat

SEQ ID NO: 636174 - DNA, 25 bp, Mus musculus
gaagtactttggaccatggtgatcc

SEQ ID NO: 636175 - DNA, 25 bp, Mus musculus
gaagtactttggtccatggtgatcc

SEQ ID NO: 636176 - DNA, 25 bp, Mus musculus
gaagtagaaaaccaagcccactgct

SEQ ID NO: 636177 - DNA, 25 bp, Mus musculus
gaagtagaaaacgaagcccactgct

SEQ ID NO: 636178 - DNA, 25 bp, Mus musculus
gaagtagaacttctgcagctaagaa

SEQ ID NO: 636179 - DNA, 25 bp, Mus musculus
gaagtagaacttgtgcagctaagaa

SEQ ID NO: 636180 - DNA, 25 bp, Mus musculus
gaagtagacaccaggtagaaaaagt

SEQ ID NO: 636181 - DNA, 25 bp, Mus musculus
gaagtagacacctggtagaaaaagt

SEQ ID NO: 636182 - DNA, 25 bp, Mus musculus
gaagtagacgcaatcatggaggcct

SEQ ID NO: 636183 - DNA, 25 bp, Mus musculus
gaagtagacgcattcatggaggcct

SEQ ID NO: 636184 - DNA, 25 bp, Mus musculus
gaagtagactagaccattgcagaga

SEQ ID NO: 636185 - DNA, 25 bp, Mus musculus
gaagtagactagtccattgcagaga

SEQ ID NO: 636186 - DNA, 25 bp, Mus musculus
gaagtagagaagctccacctggaga

SEQ ID NO: 636187 - DNA, 25 bp, Mus musculus
gaagtagagaaggtccacctggaga

SEQ ID NO: 636188 - DNA, 25 bp, Mus musculus
gaagtagatctgcattcttttgaag

SEQ ID NO: 636189 - DNA, 25 bp, Mus musculus
gaagtagatctggattcttttgaag

SEQ ID NO: 636190 - DNA, 25 bp, Mus musculus
gaagtagattcaattagcaccttac

SEQ ID NO: 636191 - DNA, 25 bp, Mus musculus
gaagtagattcatttagcaccttac

SEQ ID NO: 636192 - DNA, 25 bp, Mus musculus
gaagtagcactacaccctgtgaagg

SEQ ID NO: 636193 - DNA, 25 bp, Mus musculus
gaagtagcactagaccctgtgaagg

SEQ ID NO: 636194 - DNA, 25 bp, Mus musculus
gaagtagcatagaactgccaaaggc

SEQ ID NO: 636195 - DNA, 25 bp, Mus musculus
gaagtagcatagtactgccaaaggc

SEQ ID NO: 636196 - DNA, 25 bp, Mus musculus
gaagtagcatcgatgtcctcgcagc

SEQ ID NO: 636197 - DNA, 25 bp, Mus musculus
gaagtagcatcgttgtcctcgcagc

SEQ ID NO: 636198 - DNA, 25 bp, Mus musculus
gaagtagcatgacatattgaagtaa

SEQ ID NO: 636199 - DNA, 25 bp, Mus musculus
gaagtagcatgagatattgaagtaa

SEQ ID NO: 636200 - DNA, 25 bp, Mus musculus
gaagtagccgagaagtggaaacaga

SEQ ID NO: 636201 - DNA, 25 bp, Mus musculus
gaagtagccgagtagtggaaacaga

SEQ ID NO: 636202 - DNA, 25 bp, Mus musculus
gaagtagcgactatcatgtgtgccg

SEQ ID NO: 636203 - DNA, 25 bp, Mus musculus
gaagtagcgactttcatgtgtgccg

SEQ ID NO: 636204 - DNA, 25 bp, Mus musculus
gaagtagcgtgacaagactgtgcac

SEQ ID NO: 636205 - DNA, 25 bp, Mus musculus
gaagtagcgtgagaagactgtgcac

SEQ ID NO: 636206 - DNA, 25 bp, Mus musculus
gaagtagctattctggattctacaa

SEQ ID NO: 636207 - DNA, 25 bp, Mus musculus
gaagtagctattgtggattctacaa

SEQ ID NO: 636208 - DNA, 25 bp, Mus musculus
gaagtagctgagcacgtgcagtaca

SEQ ID NO: 636209 - DNA, 25 bp, Mus musculus
gaagtagctgaggacgtgcagtaca

SEQ ID NO: 636210 - DNA, 25 bp, Mus musculus
gaagtagctgggatcaccgtctttc

SEQ ID NO: 636211 - DNA, 25 bp, Mus musculus
gaagtagctgggttcaccgtctttc

SEQ ID NO: 636212 - DNA, 25 bp, Mus musculus
gaagtaggactacccatccgaagca

SEQ ID NO: 636213 - DNA, 25 bp, Mus musculus
gaagtaggactagccatccgaagca

SEQ ID NO: 636214 - DNA, 25 bp, Mus musculus
gaagtagggacacgatttgcgctca

SEQ ID NO: 636215 - DNA, 25 bp, Mus musculus
gaagtagggacaggatttgcgctca

SEQ ID NO: 636216 - DNA, 25 bp, Mus musculus
gaagtagggcggcagctactcatcc

SEQ ID NO: 636217 - DNA, 25 bp, Mus musculus
gaagtagggcgggagctactcatcc

SEQ ID NO: 636218 - DNA, 25 bp, Mus musculus
gaagtagggtgaaaagcggctacaa

SEQ ID NO: 636219 - DNA, 25 bp, Mus musculus
gaagtagggtgataagcggctacaa

SEQ ID NO: 636220 - DNA, 25 bp, Mus musculus
gaagtagttggtcacagccctgaaa

SEQ ID NO: 636221 - DNA, 25 bp, Mus musculus
gaagtagttggtgacagccctgaaa

SEQ ID NO: 636222 - DNA, 25 bp, Mus musculus
gaagtataacatccgagtggaagac

SEQ ID NO: 636223 - DNA, 25 bp, Mus musculus
gaagtataacatgcgagtggaagac

SEQ ID NO: 636224 - DNA, 25 bp, Mus musculus
gaagtatacactcttcatagggaga

SEQ ID NO: 636225 - DNA, 25 bp, Mus musculus
gaagtatacactgttcatagggaga

SEQ ID NO: 636226 - DNA, 25 bp, Mus musculus
gaagtatacctcatcgaacgaattg

SEQ ID NO: 636227 - DNA, 25 bp, Mus musculus
gaagtatacctcttcgaacgaattg

SEQ ID NO: 636228 - DNA, 25 bp, Mus musculus
gaagtatagcaaagacctctgggag

SEQ ID NO: 636229 - DNA, 25 bp, Mus musculus
gaagtatagcaatgacctctgggag

SEQ ID NO: 636230 - DNA, 25 bp, Mus musculus
gaagtatagcccacgccagggtgag

SEQ ID NO: 636231 - DNA, 25 bp, Mus musculus
gaagtatagccctcgccagggtgag

SEQ ID NO: 636232 - DNA, 25 bp, Mus musculus
gaagtatccacactgcgcaaggacg

SEQ ID NO: 636233 - DNA, 25 bp, Mus musculus
gaagtatccacagtgcgcaaggacg

SEQ ID NO: 636234 - DNA, 25 bp, Mus musculus
gaagtatcccagcaccctcagggag

SEQ ID NO: 636235 - DNA, 25 bp, Mus musculus
gaagtatcccaggaccctcagggag

SEQ ID NO: 636236 - DNA, 25 bp, Mus musculus
gaagtatccgctatgcagcaggcca

SEQ ID NO: 636237 - DNA, 25 bp, Mus musculus
gaagtatccgctttgcagcaggcca

SEQ ID NO: 636238 - DNA, 25 bp, Mus musculus
gaagtatcctctccagcagggcaag

SEQ ID NO: 636239 - DNA, 25 bp, Mus musculus
gaagtatcctctgcagcagggcaag

SEQ ID NO: 636240 - DNA, 25 bp, Mus musculus
gaagtatctaagcatcccaagggcc

SEQ ID NO: 636241 - DNA, 25 bp, Mus musculus
gaagtatctaaggatcccaagggcc

SEQ ID NO: 636242 - DNA, 25 bp, Mus musculus
gaagtatctcttcggttgggaccga

SEQ ID NO: 636243 - DNA, 25 bp, Mus musculus
gaagtatctcttgggttgggaccga

SEQ ID NO: 636244 - DNA, 25 bp, Mus musculus
gaagtatgaagacaacttcggcctc

SEQ ID NO: 636245 - DNA, 25 bp, Mus musculus
gaagtatgaagagaacttcggcctc

SEQ ID NO: 636246 - DNA, 25 bp, Mus musculus
gaagtatgaggacctcttcccggcc

SEQ ID NO: 636247 - DNA, 25 bp, Mus musculus
gaagtatgaggagctcttcccggcc

SEQ ID NO: 636248 - DNA, 25 bp, Mus musculus
gaagtatggaatatatcgctgtatc

SEQ ID NO: 636249 - DNA, 25 bp, Mus musculus
gaagtatggaatttatcgctgtatc

SEQ ID NO: 636250 - DNA, 25 bp, Mus musculus
gaagtatggagaaacggctaatgag

SEQ ID NO: 636251 - DNA, 25 bp, Mus musculus
gaagtatggagatacggctaatgag

SEQ ID NO: 636252 - DNA, 25 bp, Mus musculus
gaagtatggccgcatgtttcctcgg

SEQ ID NO: 636253 - DNA, 25 bp, Mus musculus
gaagtatggccggatgtttcctcgg

SEQ ID NO: 636254 - DNA, 25 bp, Mus musculus
gaagtatgtgtcctttgtcgacgag

SEQ ID NO: 636255 - DNA, 25 bp, Mus musculus
gaagtatgtgtcgtttgtcgacgag

SEQ ID NO: 636256 - DNA, 25 bp, Mus musculus
gaagtattacatagacccttctaca

SEQ ID NO: 636257 - DNA, 25 bp, Mus musculus
gaagtattacattgacccttctaca

SEQ ID NO: 636258 - DNA, 25 bp, Mus musculus
gaagtattcctacctcaacgtggtg

SEQ ID NO: 636259 - DNA, 25 bp, Mus musculus
gaagtattcctagctcaacgtggtg

SEQ ID NO: 636260 - DNA, 25 bp, Mus musculus
gaagtattcggacgaagttgatgct

SEQ ID NO: 636261 - DNA, 25 bp, Mus musculus
gaagtattcggaggaagttgatgct

SEQ ID NO: 636262 - DNA, 25 bp, Mus musculus
gaagtattgcgactcacccatgaac

SEQ ID NO: 636263 - DNA, 25 bp, Mus musculus
gaagtattgcgagtcacccatgaac

SEQ ID NO: 636264 - DNA, 25 bp, Mus musculus
gaagtatttaaactttgatccacga

SEQ ID NO: 636265 - DNA, 25 bp, Mus musculus
gaagtatttaaagtttgatccacga

SEQ ID NO: 636266 - DNA, 25 bp, Mus musculus
gaagtatttcacctcggatgggtta

SEQ ID NO: 636267 - DNA, 25 bp, Mus musculus
gaagtatttcacgtcggatgggtta

SEQ ID NO: 636268 - DNA, 25 bp, Mus musculus
gaagtatttgacaatttggttgcac

SEQ ID NO: 636269 - DNA, 25 bp, Mus musculus
gaagtatttgactatttggttgcac

SEQ ID NO: 636270 - DNA, 25 bp, Mus musculus
gaagtatttggtcttatccggtcac

SEQ ID NO: 636271 - DNA, 25 bp, Mus musculus
gaagtatttggtgttatccggtcac

SEQ ID NO: 636272 - DNA, 25 bp, Mus musculus
gaagtattttatactccacggtcat

SEQ ID NO: 636273 - DNA, 25 bp, Mus musculus
gaagtattttattctccacggtcat

SEQ ID NO: 636274 - DNA, 25 bp, Mus musculus
gaagtatttttaagtttgccatgca

SEQ ID NO: 636275 - DNA, 25 bp, Mus musculus
gaagtatttttatgtttgccatgca

SEQ ID NO: 636276 - DNA, 25 bp, Mus musculus
gaagtcaaaccacagaatgacagct

SEQ ID NO: 636277 - DNA, 25 bp, Mus musculus
gaagtcaaaccagagaatgacagct

SEQ ID NO: 636278 - DNA, 25 bp, Mus musculus
gaagtcaacaaaaaccagtacctgc

SEQ ID NO: 636279 - DNA, 25 bp, Mus musculus
gaagtcaacaaataccagtacctgc

SEQ ID NO: 636280 - DNA, 25 bp, Mus musculus
gaagtcaaccaacagttcatcaata

SEQ ID NO: 636281 - DNA, 25 bp, Mus musculus
gaagtcaaccaagagttcatcaata

SEQ ID NO: 636282 - DNA, 25 bp, Mus musculus
gaagtcaactggaatgtgatgggaa

SEQ ID NO: 636283 - DNA, 25 bp, Mus musculus
gaagtcaactggtatgtgatgggaa

SEQ ID NO: 636284 - DNA, 25 bp, Mus musculus
gaagtcaactgtactgccatggcca

SEQ ID NO: 636285 - DNA, 25 bp, Mus musculus
gaagtcaactgttctgccatggcca

SEQ ID NO: 636286 - DNA, 25 bp, Mus musculus
gaagtcaagattcccaaaccaagag

SEQ ID NO: 636287 - DNA, 25 bp, Mus musculus
gaagtcaagattgccaaaccaagag

SEQ ID NO: 636288 - DNA, 25 bp, Mus musculus
gaagtcaaggtgattgctaatctaa

SEQ ID NO: 636289 - DNA, 25 bp, Mus musculus
gaagtcaaggtgtttgctaatctaa

SEQ ID NO: 636290 - DNA, 25 bp, Mus musculus
gaagtcaatgctatcttggacaaca

SEQ ID NO: 636291 - DNA, 25 bp, Mus musculus
gaagtcaatgctttcttggacaaca

SEQ ID NO: 636292 - DNA, 25 bp, Mus musculus
gaagtcaatggtcgtgtcacatccc

SEQ ID NO: 636293 - DNA, 25 bp, Mus musculus
gaagtcaatggtggtgtcacatccc

SEQ ID NO: 636294 - DNA, 25 bp, Mus musculus
gaagtcacatggaagagctaccaag

SEQ ID NO: 636295 - DNA, 25 bp, Mus musculus
gaagtcacatggtagagctaccaag

SEQ ID NO: 636296 - DNA, 25 bp, Mus musculus
gaagtcaccaggctgccggaagatc

SEQ ID NO: 636297 - DNA, 25 bp, Mus musculus
gaagtcaccagggtgccggaagatc

SEQ ID NO: 636298 - DNA, 25 bp, Mus musculus
gaagtcacccttcaccatctgcttt

SEQ ID NO: 636299 - DNA, 25 bp, Mus musculus
gaagtcacccttccttggtacctat

SEQ ID NO: 636300 - DNA, 25 bp, Mus musculus
gaagtcacccttgaccatctgcttt

SEQ ID NO: 636301 - DNA, 25 bp, Mus musculus
gaagtcacccttgcttggtacctat

SEQ ID NO: 636302 - DNA, 25 bp, Mus musculus
gaagtcactgttcttctaagtgctc

SEQ ID NO: 636303 - DNA, 25 bp, Mus musculus
gaagtcactgttgttctaagtgctc

SEQ ID NO: 636304 - DNA, 25 bp, Mus musculus
gaagtcacttctagaagctccaggt

SEQ ID NO: 636305 - DNA, 25 bp, Mus musculus
gaagtcacttcttgaagctccaggt

SEQ ID NO: 636306 - DNA, 25 bp, Mus musculus
gaagtcactttgacccacacctaga

SEQ ID NO: 636307 - DNA, 25 bp, Mus musculus
gaagtcactttgtcccacacctaga

SEQ ID NO: 636308 - DNA, 25 bp, Mus musculus
gaagtcagaagaaggacatccattc

SEQ ID NO: 636309 - DNA, 25 bp, Mus musculus
gaagtcagaagatggacatccattc

SEQ ID NO: 636310 - DNA, 25 bp, Mus musculus
gaagtcagaaggactctttgcacag

SEQ ID NO: 636311 - DNA, 25 bp, Mus musculus
gaagtcagaaggtctctttgcacag

SEQ ID NO: 636312 - DNA, 25 bp, Mus musculus
gaagtcagagatccagaggcattac

SEQ ID NO: 636313 - DNA, 25 bp, Mus musculus
gaagtcagagatgcagaggcattac

SEQ ID NO: 636314 - DNA, 25 bp, Mus musculus
gaagtcagagctctcccagctagac

SEQ ID NO: 636315 - DNA, 25 bp, Mus musculus
gaagtcagagctgtcccagctagac

SEQ ID NO: 636316 - DNA, 25 bp, Mus musculus
gaagtcagatccagctctcctggcc

SEQ ID NO: 636317 - DNA, 25 bp, Mus musculus
gaagtcagatcctgctctcctggcc

SEQ ID NO: 636318 - DNA, 25 bp, Mus musculus
gaagtcagccaacagcagccagctt

SEQ ID NO: 636319 - DNA, 25 bp, Mus musculus
gaagtcagccaagagcagccagctt

SEQ ID NO: 636320 - DNA, 25 bp, Mus musculus
gaagtcagctgtcgcggataagcac

SEQ ID NO: 636321 - DNA, 25 bp, Mus musculus
gaagtcagctgtggcggataagcac

SEQ ID NO: 636322 - DNA, 25 bp, Mus musculus
gaagtcagggcaactctatatcatt

SEQ ID NO: 636323 - DNA, 25 bp, Mus musculus
gaagtcagggcatctctatatcatt

SEQ ID NO: 636324 - DNA, 25 bp, Mus musculus
gaagtcagtaagagtgaccttggcc

SEQ ID NO: 636325 - DNA, 25 bp, Mus musculus
gaagtcagtaagtgtgaccttggcc

SEQ ID NO: 636326 - DNA, 25 bp, Mus musculus
gaagtcagtcagattccatctgata

SEQ ID NO: 636327 - DNA, 25 bp, Mus musculus
gaagtcagtcagtttccatctgata

SEQ ID NO: 636328 - DNA, 25 bp, Mus musculus
gaagtcagttctacattgctttgaa

SEQ ID NO: 636329 - DNA, 25 bp, Mus musculus
gaagtcagttcttcattgctttgaa

SEQ ID NO: 636330 - DNA, 25 bp, Mus musculus
gaagtcatccccaacgttgagtggc

SEQ ID NO: 636331 - DNA, 25 bp, Mus musculus
gaagtcatcccctacgttgagtggc

SEQ ID NO: 636332 - DNA, 25 bp, Mus musculus
gaagtcatcctcagtaggccctgta

SEQ ID NO: 636333 - DNA, 25 bp, Mus musculus
gaagtcatcctctgtaggccctgta

SEQ ID NO: 636334 - DNA, 25 bp, Mus musculus
gaagtcatccttccattccttgtgg

SEQ ID NO: 636335 - DNA, 25 bp, Mus musculus
gaagtcatccttgcattccttgtgg

SEQ ID NO: 636336 - DNA, 25 bp, Mus musculus
gaagtcatctgtccctcaattcctg

SEQ ID NO: 636337 - DNA, 25 bp, Mus musculus
gaagtcatctgtgcctcaattcctg

SEQ ID NO: 636338 - DNA, 25 bp, Mus musculus
gaagtcatgaagatcgaaactcctg

SEQ ID NO: 636339 - DNA, 25 bp, Mus musculus
gaagtcatgaagttcgaaactcctg

SEQ ID NO: 636340 - DNA, 25 bp, Mus musculus
gaagtcattagtatcgaagctctga

SEQ ID NO: 636341 - DNA, 25 bp, Mus musculus
gaagtcattagtttcgaagctctga

SEQ ID NO: 636342 - DNA, 25 bp, Mus musculus
gaagtcattattctcacagagtacg

SEQ ID NO: 636343 - DNA, 25 bp, Mus musculus
gaagtcattattgtcacagagtacg

SEQ ID NO: 636344 - DNA, 25 bp, Mus musculus
gaagtcattctgctgagaaaccgta

SEQ ID NO: 636345 - DNA, 25 bp, Mus musculus
gaagtcattctggtgagaaaccgta

SEQ ID NO: 636346 - DNA, 25 bp, Mus musculus
gaagtcattgccacctcgcttccag

SEQ ID NO: 636347 - DNA, 25 bp, Mus musculus
gaagtcattgcctcctcgcttccag

SEQ ID NO: 636348 - DNA, 25 bp, Mus musculus
gaagtcattggtcaaaacagcatgc

SEQ ID NO: 636349 - DNA, 25 bp, Mus musculus
gaagtcattggtgaaaacagcatgc

SEQ ID NO: 636350 - DNA, 25 bp, Mus musculus
gaagtccaaaagagagctacaggca

SEQ ID NO: 636351 - DNA, 25 bp, Mus musculus
gaagtccaaaagtgagctacaggca

SEQ ID NO: 636352 - DNA, 25 bp, Mus musculus
gaagtccaaagaacccctgctctct

SEQ ID NO: 636353 - DNA, 25 bp, Mus musculus
gaagtccaaagatcccctgctctct

SEQ ID NO: 636354 - DNA, 25 bp, Mus musculus
gaagtccacatactaccgaagtcgt

SEQ ID NO: 636355 - DNA, 25 bp, Mus musculus
gaagtccacatagtaccgaagtcgt

SEQ ID NO: 636356 - DNA, 25 bp, Mus musculus
gaagtccacggccttgatgcctatg

SEQ ID NO: 636357 - DNA, 25 bp, Mus musculus
gaagtccacggcgttgatgcctatg

SEQ ID NO: 636358 - DNA, 25 bp, Mus musculus
gaagtccactaacgactaccctgat

SEQ ID NO: 636359 - DNA, 25 bp, Mus musculus
gaagtccactaaggactaccctgat

SEQ ID NO: 636360 - DNA, 25 bp, Mus musculus
gaagtccagaatctgctccgtgact

SEQ ID NO: 636361 - DNA, 25 bp, Mus musculus
gaagtccagaatgtgctccgtgact

SEQ ID NO: 636362 - DNA, 25 bp, Mus musculus
gaagtccagaccacggcttccgatc

SEQ ID NO: 636363 - DNA, 25 bp, Mus musculus
gaagtccagacctcggcttccgatc

SEQ ID NO: 636364 - DNA, 25 bp, Mus musculus
gaagtccaggacatagaaagctctc

SEQ ID NO: 636365 - DNA, 25 bp, Mus musculus
gaagtccaggacttagaaagctctc

SEQ ID NO: 636366 - DNA, 25 bp, Mus musculus
gaagtccaggatacactccggaaga

SEQ ID NO: 636367 - DNA, 25 bp, Mus musculus
gaagtccaggattcactccggaaga

SEQ ID NO: 636368 - DNA, 25 bp, Mus musculus
gaagtccaggcgcttctgtcgttgt

SEQ ID NO: 636369 - DNA, 25 bp, Mus musculus
gaagtccaggcggttctgtcgttgt

SEQ ID NO: 636370 - DNA, 25 bp, Mus musculus
gaagtccagggtctcagcaggatcc

SEQ ID NO: 636371 - DNA, 25 bp, Mus musculus
gaagtccagggtgtcagcaggatcc

SEQ ID NO: 636372 - DNA, 25 bp, Mus musculus
gaagtccaggttcacaccagcaagc

SEQ ID NO: 636373 - DNA, 25 bp, Mus musculus
gaagtccaggttgacaccagcaagc

SEQ ID NO: 636374 - DNA, 25 bp, Mus musculus
gaagtccagtctaggctcacgttcc

SEQ ID NO: 636375 - DNA, 25 bp, Mus musculus
gaagtccagtcttggctcacgttcc

SEQ ID NO: 636376 - DNA, 25 bp, Mus musculus
gaagtccagttcactgcaggtagca

SEQ ID NO: 636377 - DNA, 25 bp, Mus musculus
gaagtccagttctctgcaggtagca

SEQ ID NO: 636378 - DNA, 25 bp, Mus musculus
gaagtccatcatcccagtggttatg

SEQ ID NO: 636379 - DNA, 25 bp, Mus musculus
gaagtccatcatgccagtggttatg

SEQ ID NO: 636380 - DNA, 25 bp, Mus musculus
gaagtccatcttaatgtacatcaca

SEQ ID NO: 636381 - DNA, 25 bp, Mus musculus
gaagtccatctttatgtacatcaca

SEQ ID NO: 636382 - DNA, 25 bp, Mus musculus
gaagtccatgaccaaccaggagaaa

SEQ ID NO: 636383 - DNA, 25 bp, Mus musculus
gaagtccatgacgaaccaggagaaa

SEQ ID NO: 636384 - DNA, 25 bp, Mus musculus
gaagtccattctcatgaagcagcta

SEQ ID NO: 636385 - DNA, 25 bp, Mus musculus
gaagtccattctgatgaagcagcta

SEQ ID NO: 636386 - DNA, 25 bp, Mus musculus
gaagtcccaaagctactgctaggcc

SEQ ID NO: 636387 - DNA, 25 bp, Mus musculus
gaagtcccaaaggtactgctaggcc

SEQ ID NO: 636388 - DNA, 25 bp, Mus musculus
gaagtcccagcaagagaatcagagc

SEQ ID NO: 636389 - DNA, 25 bp, Mus musculus
gaagtcccagcatgagaatcagagc

SEQ ID NO: 636390 - DNA, 25 bp, Mus musculus
gaagtcccaggcactagtaaccatg

SEQ ID NO: 636391 - DNA, 25 bp, Mus musculus
gaagtcccaggctctagtaaccatg

SEQ ID NO: 636392 - DNA, 25 bp, Mus musculus
gaagtccccaggatcaggatgtatt

SEQ ID NO: 636393 - DNA, 25 bp, Mus musculus
gaagtccccaggttcaggatgtatt

SEQ ID NO: 636394 - DNA, 25 bp, Mus musculus
gaagtccccgatctgatccagaagg

SEQ ID NO: 636395 - DNA, 25 bp, Mus musculus
gaagtccccgatgtgatccagaagg

SEQ ID NO: 636396 - DNA, 25 bp, Mus musculus
gaagtccccgtgatcgtcatgtcgg

SEQ ID NO: 636397 - DNA, 25 bp, Mus musculus
gaagtccccgtgttcgtcatgtcgg

SEQ ID NO: 636398 - DNA, 25 bp, Mus musculus
gaagtcccgtgtagccatcctaaaa

SEQ ID NO: 636399 - DNA, 25 bp, Mus musculus
gaagtcccgtgttgccatcctaaaa

SEQ ID NO: 636400 - DNA, 25 bp, Mus musculus
gaagtccctcatccactgacgaaga

SEQ ID NO: 636401 - DNA, 25 bp, Mus musculus
gaagtccctcatgcactgacgaaga

SEQ ID NO: 636402 - DNA, 25 bp, Mus musculus
gaagtccctctcagaagcatcagtg

SEQ ID NO: 636403 - DNA, 25 bp, Mus musculus
gaagtccctctctgaagcatcagtg

SEQ ID NO: 636404 - DNA, 25 bp, Mus musculus
gaagtccctggaccagcttcggtca

SEQ ID NO: 636405 - DNA, 25 bp, Mus musculus
gaagtccctggagcagcttcggtca

SEQ ID NO: 636406 - DNA, 25 bp, Mus musculus
gaagtccctgtcattaacttgtctt

SEQ ID NO: 636407 - DNA, 25 bp, Mus musculus
gaagtccctgtctttaacttgtctt

SEQ ID NO: 636408 - DNA, 25 bp, Mus musculus
gaagtccgcagaaacacagagtact

SEQ ID NO: 636409 - DNA, 25 bp, Mus musculus
gaagtccgcagatacacagagtact

SEQ ID NO: 636410 - DNA, 25 bp, Mus musculus
gaagtccgcgggacccgtgagtcct

SEQ ID NO: 636411 - DNA, 25 bp, Mus musculus
gaagtccgcgggtcccgtgagtcct

SEQ ID NO: 636412 - DNA, 25 bp, Mus musculus
gaagtccgggcaccagctcttgtcc

SEQ ID NO: 636413 - DNA, 25 bp, Mus musculus
gaagtccgggcagcagctcttgtcc

SEQ ID NO: 636414 - DNA, 25 bp, Mus musculus
gaagtccgggtgctactttatgcgc

SEQ ID NO: 636415 - DNA, 25 bp, Mus musculus
gaagtccgggtggtactttatgcgc

SEQ ID NO: 636416 - DNA, 25 bp, Mus musculus
gaagtcctaaagcagttcccagtag

SEQ ID NO: 636417 - DNA, 25 bp, Mus musculus
gaagtcctaaaggagttcccagtag

SEQ ID NO: 636418 - DNA, 25 bp, Mus musculus
gaagtcctcagacacgctgaccttc

SEQ ID NO: 636419 - DNA, 25 bp, Mus musculus
gaagtcctcagagacgctgaccttc

SEQ ID NO: 636420 - DNA, 25 bp, Mus musculus
gaagtcctcagcaaccccgagaggt

SEQ ID NO: 636421 - DNA, 25 bp, Mus musculus
gaagtcctcagctaccccgagaggt

SEQ ID NO: 636422 - DNA, 25 bp, Mus musculus
gaagtcctcgcgatagccgcggcct

SEQ ID NO: 636423 - DNA, 25 bp, Mus musculus
gaagtcctcgcgttagccgcggcct

SEQ ID NO: 636424 - DNA, 25 bp, Mus musculus
gaagtcctcgctaatggtggcccgc

SEQ ID NO: 636425 - DNA, 25 bp, Mus musculus
gaagtcctcgcttatggtggcccgc

SEQ ID NO: 636426 - DNA, 25 bp, Mus musculus
gaagtcctcgttcagatgacagatg

SEQ ID NO: 636427 - DNA, 25 bp, Mus musculus
gaagtcctcgttgagatgacagatg

SEQ ID NO: 636428 - DNA, 25 bp, Mus musculus
gaagtcctgaatcactggctcaagg

SEQ ID NO: 636429 - DNA, 25 bp, Mus musculus
gaagtcctgaatgactggctcaagg

SEQ ID NO: 636430 - DNA, 25 bp, Mus musculus
gaagtcctgcaaaatctctaccgaa

SEQ ID NO: 636431 - DNA, 25 bp, Mus musculus
gaagtcctgcaatatctctaccgaa

SEQ ID NO: 636432 - DNA, 25 bp, Mus musculus
gaagtcctggaaagattctgccact

SEQ ID NO: 636433 - DNA, 25 bp, Mus musculus
gaagtcctggaatgattctgccact

SEQ ID NO: 636434 - DNA, 25 bp, Mus musculus
gaagtcctgggactataaaacgaga

SEQ ID NO: 636435 - DNA, 25 bp, Mus musculus
gaagtcctgggagtataaaacgaga

SEQ ID NO: 636436 - DNA, 25 bp, Mus musculus
gaagtccttctgcacagtgtggttc

SEQ ID NO: 636437 - DNA, 25 bp, Mus musculus
gaagtccttctggacagtgtggttc

SEQ ID NO: 636438 - DNA, 25 bp, Mus musculus
gaagtccttgccaggtggaagtctg

SEQ ID NO: 636439 - DNA, 25 bp, Mus musculus
gaagtccttgcctggtggaagtctg

SEQ ID NO: 636440 - DNA, 25 bp, Mus musculus
gaagtcctttgtccagttccccaat

SEQ ID NO: 636441 - DNA, 25 bp, Mus musculus
gaagtcctttgtgcagttccccaat

SEQ ID NO: 636442 - DNA, 25 bp, Mus musculus
gaagtcgaacggaccttgaaagaga

SEQ ID NO: 636443 - DNA, 25 bp, Mus musculus
gaagtcgaacggtccttgaaagaga

SEQ ID NO: 636444 - DNA, 25 bp, Mus musculus
gaagtcgactgtcaagagatttggt

SEQ ID NO: 636445 - DNA, 25 bp, Mus musculus
gaagtcgactgtgaagagatttggt

SEQ ID NO: 636446 - DNA, 25 bp, Mus musculus
gaagtcgactttccaatgatagtca

SEQ ID NO: 636447 - DNA, 25 bp, Mus musculus
gaagtcgactttgcaatgatagtca

SEQ ID NO: 636448 - DNA, 25 bp, Mus musculus
gaagtcgaggctaacctgtgagacc

SEQ ID NO: 636449 - DNA, 25 bp, Mus musculus
gaagtcgaggcttacctgtgagacc

SEQ ID NO: 636450 - DNA, 25 bp, Mus musculus
gaagtcgatctgaccttcagttttc

SEQ ID NO: 636451 - DNA, 25 bp, Mus musculus
gaagtcgatctgtccttcagttttc

SEQ ID NO: 636452 - DNA, 25 bp, Mus musculus
gaagtcgattctaaagcagctttgt

SEQ ID NO: 636453 - DNA, 25 bp, Mus musculus
gaagtcgattcttaagcagctttgt

SEQ ID NO: 636454 - DNA, 25 bp, Mus musculus
gaagtcgccatgatgtatcctgagc

SEQ ID NO: 636455 - DNA, 25 bp, Mus musculus
gaagtcgccatgttgtatcctgagc

SEQ ID NO: 636456 - DNA, 25 bp, Mus musculus
gaagtcgccctgaacaagttgctgg

SEQ ID NO: 636457 - DNA, 25 bp, Mus musculus
gaagtcgccctgtacaagttgctgg

SEQ ID NO: 636458 - DNA, 25 bp, Mus musculus
gaagtcgcgttcacctgcaagccag

SEQ ID NO: 636459 - DNA, 25 bp, Mus musculus
gaagtcgcgttctcctgcaagccag

SEQ ID NO: 636460 - DNA, 25 bp, Mus musculus
gaagtcgctcctcgtcaagtagcag

SEQ ID NO: 636461 - DNA, 25 bp, Mus musculus
gaagtcgctcctggtcaagtagcag

SEQ ID NO: 636462 - DNA, 25 bp, Mus musculus
gaagtcgctggtagtccttgtcccc

SEQ ID NO: 636463 - DNA, 25 bp, Mus musculus
gaagtcgctggttgtccttgtcccc

SEQ ID NO: 636464 - DNA, 25 bp, Mus musculus
gaagtcggacttcagaaaggacttt

SEQ ID NO: 636465 - DNA, 25 bp, Mus musculus
gaagtcggacttgagaaaggacttt

SEQ ID NO: 636466 - DNA, 25 bp, Mus musculus
gaagtcggcgcacaccttcctgtct

SEQ ID NO: 636467 - DNA, 25 bp, Mus musculus
gaagtcggcgcagaccttcctgtct

SEQ ID NO: 636468 - DNA, 25 bp, Mus musculus
gaagtcgtcgctctgcaccctggtg

SEQ ID NO: 636469 - DNA, 25 bp, Mus musculus
gaagtcgtcgctgtgcaccctggtg

SEQ ID NO: 636470 - DNA, 25 bp, Mus musculus
gaagtcgtgaagcaaaacgaagcct

SEQ ID NO: 636471 - DNA, 25 bp, Mus musculus
gaagtcgtgaaggaaaacgaagcct

SEQ ID NO: 636472 - DNA, 25 bp, Mus musculus
gaagtcgttctcagagcaggctccg

SEQ ID NO: 636473 - DNA, 25 bp, Mus musculus
gaagtcgttctctgagcaggctccg

SEQ ID NO: 636474 - DNA, 25 bp, Mus musculus
gaagtcgttgaaagacacaaccgaa

SEQ ID NO: 636475 - DNA, 25 bp, Mus musculus
gaagtcgttgaatgacacaaccgaa

SEQ ID NO: 636476 - DNA, 25 bp, Mus musculus
gaagtctaaggcatctcaggtcagc

SEQ ID NO: 636477 - DNA, 25 bp, Mus musculus
gaagtctaaggcttctcaggtcagc

SEQ ID NO: 636478 - DNA, 25 bp, Mus musculus
gaagtctacattcatgaagggacct

SEQ ID NO: 636479 - DNA, 25 bp, Mus musculus
gaagtctacattgatgaagggacct

SEQ ID NO: 636480 - DNA, 25 bp, Mus musculus
gaagtctacgaccatggcactaaca

SEQ ID NO: 636481 - DNA, 25 bp, Mus musculus
gaagtctacgacgatggcactaaca

SEQ ID NO: 636482 - DNA, 25 bp, Mus musculus
gaagtctactgtccctacagcgcca

SEQ ID NO: 636483 - DNA, 25 bp, Mus musculus
gaagtctactgtgcctacagcgcca

SEQ ID NO: 636484 - DNA, 25 bp, Mus musculus
gaagtctagcatcctggtccacaag

SEQ ID NO: 636485 - DNA, 25 bp, Mus musculus
gaagtctagcatgctggtccacaag

SEQ ID NO: 636486 - DNA, 25 bp, Mus musculus
gaagtctcagatcttctccacggct

SEQ ID NO: 636487 - DNA, 25 bp, Mus musculus
gaagtctcagatgttctccacggct

SEQ ID NO: 636488 - DNA, 25 bp, Mus musculus
gaagtctccagcaccagcctctaag

SEQ ID NO: 636489 - DNA, 25 bp, Mus musculus
gaagtctccagctccagcctctaag

SEQ ID NO: 636490 - DNA, 25 bp, Mus musculus
gaagtctcctcccaggtgaccagat

SEQ ID NO: 636491 - DNA, 25 bp, Mus musculus
gaagtctcctccgaggtgaccagat

SEQ ID NO: 636492 - DNA, 25 bp, Mus musculus
gaagtctcgtgaccagctggccgct

SEQ ID NO: 636493 - DNA, 25 bp, Mus musculus
gaagtctcgtgagcagctggccgct

SEQ ID NO: 636494 - DNA, 25 bp, Mus musculus
gaagtctctcaacggcctattcttg

SEQ ID NO: 636495 - DNA, 25 bp, Mus musculus
gaagtctctcaagggcctattcttg

SEQ ID NO: 636496 - DNA, 25 bp, Mus musculus
gaagtctctgtgctatcaactccct

SEQ ID NO: 636497 - DNA, 25 bp, Mus musculus
gaagtctctgtggtatcaactccct

SEQ ID NO: 636498 - DNA, 25 bp, Mus musculus
gaagtctcttggactgacaatggga

SEQ ID NO: 636499 - DNA, 25 bp, Mus musculus
gaagtctcttggtctgacaatggga

SEQ ID NO: 636500 - DNA, 25 bp, Mus musculus
gaagtctgaaagaaccctgagggaa

SEQ ID NO: 636501 - DNA, 25 bp, Mus musculus
gaagtctgaaagtaccctgagggaa

SEQ ID NO: 636502 - DNA, 25 bp, Mus musculus
gaagtctgccaactactggtcgcag

SEQ ID NO: 636503 - DNA, 25 bp, Mus musculus
gaagtctgccaagtactggtcgcag

SEQ ID NO: 636504 - DNA, 25 bp, Mus musculus
gaagtctggagaatactacgttaca

SEQ ID NO: 636505 - DNA, 25 bp, Mus musculus
gaagtctggagattactacgttaca

SEQ ID NO: 636506 - DNA, 25 bp, Mus musculus
gaagtctggcccagatcctgagatc

SEQ ID NO: 636507 - DNA, 25 bp, Mus musculus
gaagtctggcccatctcgaggccga

SEQ ID NO: 636508 - DNA, 25 bp, Mus musculus
gaagtctggccctgatcctgagatc

SEQ ID NO: 636509 - DNA, 25 bp, Mus musculus
gaagtctggcccttctcgaggccga

SEQ ID NO: 636510 - DNA, 25 bp, Mus musculus
gaagtctggggtcgttctgctcaac

SEQ ID NO: 636511 - DNA, 25 bp, Mus musculus
gaagtctggggtggttctgctcaac

SEQ ID NO: 636512 - DNA, 25 bp, Mus musculus
gaagtctggtatcacttccctgctt

SEQ ID NO: 636513 - DNA, 25 bp, Mus musculus
gaagtctggtatgacttccctgctt

SEQ ID NO: 636514 - DNA, 25 bp, Mus musculus
gaagtctgttaccaatgaggatgtc

SEQ ID NO: 636515 - DNA, 25 bp, Mus musculus
gaagtctgttacgaatgaggatgtc

SEQ ID NO: 636516 - DNA, 25 bp, Mus musculus
gaagtctgttcaccagcattggcga

SEQ ID NO: 636517 - DNA, 25 bp, Mus musculus
gaagtctgttcagcagcattggcga

SEQ ID NO: 636518 - DNA, 25 bp, Mus musculus
gaagtcttccagaatgagcacatcc

SEQ ID NO: 636519 - DNA, 25 bp, Mus musculus
gaagtcttccagtatgagcacatcc

SEQ ID NO: 636520 - DNA, 25 bp, Mus musculus
gaagtcttccatcatattcggcagc

SEQ ID NO: 636521 - DNA, 25 bp, Mus musculus
gaagtcttccatgatattcggcagc

SEQ ID NO: 636522 - DNA, 25 bp, Mus musculus
gaagtcttccgtagcctgcttctga

SEQ ID NO: 636523 - DNA, 25 bp, Mus musculus
gaagtcttccgttgcctgcttctga

SEQ ID NO: 636524 - DNA, 25 bp, Mus musculus
gaagtcttccttatctaaacccagg

SEQ ID NO: 636525 - DNA, 25 bp, Mus musculus
gaagtcttccttttctaaacccagg

SEQ ID NO: 636526 - DNA, 25 bp, Mus musculus
gaagtcttctacagcgtcaccatgg

SEQ ID NO: 636527 - DNA, 25 bp, Mus musculus
gaagtcttctactgcgtcaccatgg

SEQ ID NO: 636528 - DNA, 25 bp, Mus musculus
gaagtcttctatactgtgtctgcag

SEQ ID NO: 636529 - DNA, 25 bp, Mus musculus
gaagtcttctattctgtgtctgcag

SEQ ID NO: 636530 - DNA, 25 bp, Mus musculus
gaagtcttgctgacgccatgtccca

SEQ ID NO: 636531 - DNA, 25 bp, Mus musculus
gaagtcttgctgtcgccatgtccca

SEQ ID NO: 636532 - DNA, 25 bp, Mus musculus
gaagtcttgtatagtcggaggaaaa

SEQ ID NO: 636533 - DNA, 25 bp, Mus musculus
gaagtcttgtattgtcggaggaaaa

SEQ ID NO: 636534 - DNA, 25 bp, Mus musculus
gaagtcttgtgcacagtgtctgtgg

SEQ ID NO: 636535 - DNA, 25 bp, Mus musculus
gaagtcttgtgctcagtgtctgtgg

SEQ ID NO: 636536 - DNA, 25 bp, Mus musculus
gaagtcttgtttcagagccctgaac

SEQ ID NO: 636537 - DNA, 25 bp, Mus musculus
gaagtcttgtttgagagccctgaac

SEQ ID NO: 636538 - DNA, 25 bp, Mus musculus
gaagtctttcaaagatgatgcaatg

SEQ ID NO: 636539 - DNA, 25 bp, Mus musculus
gaagtctttcaatgatgatgcaatg

SEQ ID NO: 636540 - DNA, 25 bp, Mus musculus
gaagtctttgacctcaacatgaaga

SEQ ID NO: 636541 - DNA, 25 bp, Mus musculus
gaagtctttgacgtcaacatgaaga

SEQ ID NO: 636542 - DNA, 25 bp, Mus musculus
gaagtctttgtactctttcatcaag

SEQ ID NO: 636543 - DNA, 25 bp, Mus musculus
gaagtctttgtagtctttcatcaag

SEQ ID NO: 636544 - DNA, 25 bp, Mus musculus
gaagtctttgtcatctaccttaacc

SEQ ID NO: 636545 - DNA, 25 bp, Mus musculus
gaagtctttgtcttctaccttaacc

SEQ ID NO: 636546 - DNA, 25 bp, Mus musculus
gaagtcttttgtacatcagctggga

SEQ ID NO: 636547 - DNA, 25 bp, Mus musculus
gaagtcttttgttcatcagctggga

SEQ ID NO: 636548 - DNA, 25 bp, Mus musculus
gaagtgaaaagcctgttcgagcaag

SEQ ID NO: 636549 - DNA, 25 bp, Mus musculus
gaagtgaaaagcgtgttcgagcaag

SEQ ID NO: 636550 - DNA, 25 bp, Mus musculus
gaagtgaaaatgaggtgccccgaga

SEQ ID NO: 636551 - DNA, 25 bp, Mus musculus
gaagtgaaaatgtggtgccccgaga

SEQ ID NO: 636552 - DNA, 25 bp, Mus musculus
gaagtgaaagtgaattgggcaacaa

SEQ ID NO: 636553 - DNA, 25 bp, Mus musculus
gaagtgaaagtgtattgggcaacaa

SEQ ID NO: 636554 - DNA, 25 bp, Mus musculus
gaagtgaacgcacccatggtctatg

SEQ ID NO: 636555 - DNA, 25 bp, Mus musculus
gaagtgaacgcagccatggtctatg

SEQ ID NO: 636556 - DNA, 25 bp, Mus musculus
gaagtgaagaatcgcattccttcta

SEQ ID NO: 636557 - DNA, 25 bp, Mus musculus
gaagtgaagaatggcattccttcta

SEQ ID NO: 636558 - DNA, 25 bp, Mus musculus
gaagtgaagatgactggaacgattg

SEQ ID NO: 636559 - DNA, 25 bp, Mus musculus
gaagtgaagatgtctggaacgattg

SEQ ID NO: 636560 - DNA, 25 bp, Mus musculus
gaagtgaagcatactggatcttgca

SEQ ID NO: 636561 - DNA, 25 bp, Mus musculus
gaagtgaagcattctggatcttgca

SEQ ID NO: 636562 - DNA, 25 bp, Mus musculus
gaagtgaagctactccgtaacggag

SEQ ID NO: 636563 - DNA, 25 bp, Mus musculus
gaagtgaagctagtccgtaacggag

SEQ ID NO: 636564 - DNA, 25 bp, Mus musculus
gaagtgaaggttccccagttagctg

SEQ ID NO: 636565 - DNA, 25 bp, Mus musculus
gaagtgaaggttgcccagttagctg

SEQ ID NO: 636566 - DNA, 25 bp, Mus musculus
gaagtgaagttcaagaatgaatcca

SEQ ID NO: 636567 - DNA, 25 bp, Mus musculus
gaagtgaagttctagaatgaatcca

SEQ ID NO: 636568 - DNA, 25 bp, Mus musculus
gaagtgaatcaacatccccggagat

SEQ ID NO: 636569 - DNA, 25 bp, Mus musculus
gaagtgaatcaagatccccggagat

SEQ ID NO: 636570 - DNA, 25 bp, Mus musculus
gaagtgaatgctacccctctcaagc

SEQ ID NO: 636571 - DNA, 25 bp, Mus musculus
gaagtgaatgcttcccctctcaagc

SEQ ID NO: 636572 - DNA, 25 bp, Mus musculus
gaagtgacaaaaatggcatggtgga

SEQ ID NO: 636573 - DNA, 25 bp, Mus musculus
gaagtgacaaaattggcatggtgga

SEQ ID NO: 636574 - DNA, 25 bp, Mus musculus
gaagtgacacaacgaagaactcaac

SEQ ID NO: 636575 - DNA, 25 bp, Mus musculus
gaagtgacacaaggaagaactcaac

SEQ ID NO: 636576 - DNA, 25 bp, Mus musculus
gaagtgacactaaatcagcaaggcc

SEQ ID NO: 636577 - DNA, 25 bp, Mus musculus
gaagtgacactatatcagcaaggcc

SEQ ID NO: 636578 - DNA, 25 bp, Mus musculus
gaagtgacagccagatcctagatca

SEQ ID NO: 636579 - DNA, 25 bp, Mus musculus
gaagtgacagcctgatcctagatca

SEQ ID NO: 636580 - DNA, 25 bp, Mus musculus
gaagtgacattaagttatttaagca

SEQ ID NO: 636581 - DNA, 25 bp, Mus musculus
gaagtgacattatgttatttaagca

SEQ ID NO: 636582 - DNA, 25 bp, Mus musculus
gaagtgaccatgcacaccagtgaaa

SEQ ID NO: 636583 - DNA, 25 bp, Mus musculus
gaagtgaccatggacaccagtgaaa

SEQ ID NO: 636584 - DNA, 25 bp, Mus musculus
gaagtgacccgaaagtggtatgcag

SEQ ID NO: 636585 - DNA, 25 bp, Mus musculus
gaagtgacccgatagtggtatgcag

SEQ ID NO: 636586 - DNA, 25 bp, Mus musculus
gaagtgaccctcagtccattgtgct

SEQ ID NO: 636587 - DNA, 25 bp, Mus musculus
gaagtgaccctctgtccattgtgct

SEQ ID NO: 636588 - DNA, 25 bp, Mus musculus
gaagtgacctccatttagaacaaga

SEQ ID NO: 636589 - DNA, 25 bp, Mus musculus
gaagtgacctccttttagaacaaga

SEQ ID NO: 636590 - DNA, 25 bp, Mus musculus
gaagtgacggcaacagatgtgcgtc

SEQ ID NO: 636591 - DNA, 25 bp, Mus musculus
gaagtgacggcaataagccaagctg

SEQ ID NO: 636592 - DNA, 25 bp, Mus musculus
gaagtgacggcatcagatgtgcgtc

SEQ ID NO: 636593 - DNA, 25 bp, Mus musculus
gaagtgacggcattaagccaagctg

SEQ ID NO: 636594 - DNA, 25 bp, Mus musculus
gaagtgacgggcaacttccccaagg

SEQ ID NO: 636595 - DNA, 25 bp, Mus musculus
gaagtgacgggctacttccccaagg

SEQ ID NO: 636596 - DNA, 25 bp, Mus musculus
gaagtgactctacctatatgcaatc

SEQ ID NO: 636597 - DNA, 25 bp, Mus musculus
gaagtgactctagctatatgcaatc

SEQ ID NO: 636598 - DNA, 25 bp, Mus musculus
gaagtgactgaaccacgtgtcagca

SEQ ID NO: 636599 - DNA, 25 bp, Mus musculus
gaagtgactgaagcacgtgtcagca

SEQ ID NO: 636600 - DNA, 25 bp, Mus musculus
gaagtgactgtcaacgcattcagca

SEQ ID NO: 636601 - DNA, 25 bp, Mus musculus
gaagtgactgtctacgcattcagca

SEQ ID NO: 636602 - DNA, 25 bp, Mus musculus
gaagtgactgttctagacccggcag

SEQ ID NO: 636603 - DNA, 25 bp, Mus musculus
gaagtgactgttgtagacccggcag

SEQ ID NO: 636604 - DNA, 25 bp, Mus musculus
gaagtgactttcacactggtgacag

SEQ ID NO: 636605 - DNA, 25 bp, Mus musculus
gaagtgactttctcactggtgacag

SEQ ID NO: 636606 - DNA, 25 bp, Mus musculus
gaagtgagaaagatgccggcgtccc

SEQ ID NO: 636607 - DNA, 25 bp, Mus musculus
gaagtgagaaagttgccggcgtccc

SEQ ID NO: 636608 - DNA, 25 bp, Mus musculus
gaagtgagaacaatttggagaaggc

SEQ ID NO: 636609 - DNA, 25 bp, Mus musculus
gaagtgagaacattttggagaaggc

SEQ ID NO: 636610 - DNA, 25 bp, Mus musculus
gaagtgagacccatggacggagtcc

SEQ ID NO: 636611 - DNA, 25 bp, Mus musculus
gaagtgagacccttggacggagtcc

SEQ ID NO: 636612 - DNA, 25 bp, Mus musculus
gaagtgagagacacagtggaagaaa

SEQ ID NO: 636613 - DNA, 25 bp, Mus musculus
gaagtgagagactcagtggaagaaa

SEQ ID NO: 636614 - DNA, 25 bp, Mus musculus
gaagtgagatccagaagcttttctg

SEQ ID NO: 636615 - DNA, 25 bp, Mus musculus
gaagtgagatcctgaagcttttctg

SEQ ID NO: 636616 - DNA, 25 bp, Mus musculus
gaagtgagatcgcacagtccagaca

SEQ ID NO: 636617 - DNA, 25 bp, Mus musculus
gaagtgagatcggacagtccagaca

SEQ ID NO: 636618 - DNA, 25 bp, Mus musculus
gaagtgagcccgaagcttgaaggtc

SEQ ID NO: 636619 - DNA, 25 bp, Mus musculus
gaagtgagcccgtagcttgaaggtc

SEQ ID NO: 636620 - DNA, 25 bp, Mus musculus
gaagtgagcctcagcaatgctctgc

SEQ ID NO: 636621 - DNA, 25 bp, Mus musculus
gaagtgagcctctgcaatgctctgc

SEQ ID NO: 636622 - DNA, 25 bp, Mus musculus
gaagtgatactaaggaggcaactct

SEQ ID NO: 636623 - DNA, 25 bp, Mus musculus
gaagtgatactatggaggcaactct

SEQ ID NO: 636624 - DNA, 25 bp, Mus musculus
gaagtgataggccttttgaaaacag

SEQ ID NO: 636625 - DNA, 25 bp, Mus musculus
gaagtgataggcgttttgaaaacag

SEQ ID NO: 636626 - DNA, 25 bp, Mus musculus
gaagtgatattaagtgtctttaggc

SEQ ID NO: 636627 - DNA, 25 bp, Mus musculus
gaagtgatattatgtgtctttaggc

SEQ ID NO: 636628 - DNA, 25 bp, Mus musculus
gaagtgatcaaaaggttatctacat

SEQ ID NO: 636629 - DNA, 25 bp, Mus musculus
gaagtgatcaaatggttatctacat

SEQ ID NO: 636630 - DNA, 25 bp, Mus musculus
gaagtgatcgagactgagaagactc

SEQ ID NO: 636631 - DNA, 25 bp, Mus musculus
gaagtgatcgagtctgagaagactc

SEQ ID NO: 636632 - DNA, 25 bp, Mus musculus
gaagtgatctcaaccgtcgaagtgt

SEQ ID NO: 636633 - DNA, 25 bp, Mus musculus
gaagtgatctcatccgtcgaagtgt

SEQ ID NO: 636634 - DNA, 25 bp, Mus musculus
gaagtgatggagcaactcaacaact

SEQ ID NO: 636635 - DNA, 25 bp, Mus musculus
gaagtgatggaggaactcaacaact

SEQ ID NO: 636636 - DNA, 25 bp, Mus musculus
gaagtgatgttacctgccaagccag

SEQ ID NO: 636637 - DNA, 25 bp, Mus musculus
gaagtgatgttagctgccaagccag

SEQ ID NO: 636638 - DNA, 25 bp, Mus musculus
gaagtgattgacaggtggtctctga

SEQ ID NO: 636639 - DNA, 25 bp, Mus musculus
gaagtgattgactggtggtctctga

SEQ ID NO: 636640 - DNA, 25 bp, Mus musculus
gaagtgattgatcccctccgagtga

SEQ ID NO: 636641 - DNA, 25 bp, Mus musculus
gaagtgattgatgccctccgagtga

SEQ ID NO: 636642 - DNA, 25 bp, Mus musculus
gaagtgcaacgcattgctgacgtca

SEQ ID NO: 636643 - DNA, 25 bp, Mus musculus
gaagtgcaacgctttgctgacgtca

SEQ ID NO: 636644 - DNA, 25 bp, Mus musculus
gaagtgcaagaacaaatgaatctcc

SEQ ID NO: 636645 - DNA, 25 bp, Mus musculus
gaagtgcaagaagaaatgaatctcc

SEQ ID NO: 636646 - DNA, 25 bp, Mus musculus
gaagtgcaagatcgattccgtacac

SEQ ID NO: 636647 - DNA, 25 bp, Mus musculus
gaagtgcaagatggattccgtacac

SEQ ID NO: 636648 - DNA, 25 bp, Mus musculus
gaagtgcaaggcctgcaaagatatg

SEQ ID NO: 636649 - DNA, 25 bp, Mus musculus
gaagtgcaaggcgtgcaaagatatg

SEQ ID NO: 636650 - DNA, 25 bp, Mus musculus
gaagtgcactgtcatgaggccgcca

SEQ ID NO: 636651 - DNA, 25 bp, Mus musculus
gaagtgcactgtgatgaggccgcca

SEQ ID NO: 636652 - DNA, 25 bp, Mus musculus
gaagtgcagaagacagatgtgtcgt

SEQ ID NO: 636653 - DNA, 25 bp, Mus musculus
gaagtgcagaagtcagatgtgtcgt

SEQ ID NO: 636654 - DNA, 25 bp, Mus musculus
gaagtgcagatccaaacaatgaaaa

SEQ ID NO: 636655 - DNA, 25 bp, Mus musculus
gaagtgcagatcgaaacaatgaaaa

SEQ ID NO: 636656 - DNA, 25 bp, Mus musculus
gaagtgcagcccagaacctgtcctg

SEQ ID NO: 636657 - DNA, 25 bp, Mus musculus
gaagtgcagccctgaacctgtcctg

SEQ ID NO: 636658 - DNA, 25 bp, Mus musculus
gaagtgcaggacctcttactaagga

SEQ ID NO: 636659 - DNA, 25 bp, Mus musculus
gaagtgcaggacgtcttactaagga

SEQ ID NO: 636660 - DNA, 25 bp, Mus musculus
gaagtgcatccaattccactacggg

SEQ ID NO: 636661 - DNA, 25 bp, Mus musculus
gaagtgcatccatttccactacggg

SEQ ID NO: 636662 - DNA, 25 bp, Mus musculus
gaagtgcatctacatggcaacaaga

SEQ ID NO: 636663 - DNA, 25 bp, Mus musculus
gaagtgcatctagatggcaacaaga

SEQ ID NO: 636664 - DNA, 25 bp, Mus musculus
gaagtgcatgcgcagtaaaccttca

SEQ ID NO: 636665 - DNA, 25 bp, Mus musculus
gaagtgcatgcggagtaaaccttca

SEQ ID NO: 636666 - DNA, 25 bp, Mus musculus
gaagtgcattgactgtgtacagccc

SEQ ID NO: 636667 - DNA, 25 bp, Mus musculus
gaagtgcattgagtgtgtacagccc

SEQ ID NO: 636668 - DNA, 25 bp, Mus musculus
gaagtgccaaggataaggcctgaca

SEQ ID NO: 636669 - DNA, 25 bp, Mus musculus
gaagtgccaaggttaaggcctgaca

SEQ ID NO: 636670 - DNA, 25 bp, Mus musculus
gaagtgccacacatcctgtaccaac

SEQ ID NO: 636671 - DNA, 25 bp, Mus musculus
gaagtgccacacttcctgtaccaac

SEQ ID NO: 636672 - DNA, 25 bp, Mus musculus
gaagtgcccacgatgtggaaagtcg

SEQ ID NO: 636673 - DNA, 25 bp, Mus musculus
gaagtgcccacgttgtggaaagtcg

SEQ ID NO: 636674 - DNA, 25 bp, Mus musculus
gaagtgcccaggaacttttgtctgt

SEQ ID NO: 636675 - DNA, 25 bp, Mus musculus
gaagtgcccaggtacttttgtctgt

SEQ ID NO: 636676 - DNA, 25 bp, Mus musculus
gaagtgccccatcattcgttatcag

SEQ ID NO: 636677 - DNA, 25 bp, Mus musculus
gaagtgccccatgattcgttatcag

SEQ ID NO: 636678 - DNA, 25 bp, Mus musculus
gaagtgcccctaatgcagtcgctgt

SEQ ID NO: 636679 - DNA, 25 bp, Mus musculus
gaagtgcccctattgcagtcgctgt

SEQ ID NO: 636680 - DNA, 25 bp, Mus musculus
gaagtgcccgccatgctcggcttgg

SEQ ID NO: 636681 - DNA, 25 bp, Mus musculus
gaagtgcccgccttgctcggcttgg

SEQ ID NO: 636682 - DNA, 25 bp, Mus musculus
gaagtgcctggtatctatggagaaa

SEQ ID NO: 636683 - DNA, 25 bp, Mus musculus
gaagtgcctggtttctatggagaaa

SEQ ID NO: 636684 - DNA, 25 bp, Mus musculus
gaagtgccttacatgagggtcacgg

SEQ ID NO: 636685 - DNA, 25 bp, Mus musculus
gaagtgccttacttgagggtcacgg

SEQ ID NO: 636686 - DNA, 25 bp, Mus musculus
gaagtgcgggtcatgctcatctaca

SEQ ID NO: 636687 - DNA, 25 bp, Mus musculus
gaagtgcgggtcttgctcatctaca

SEQ ID NO: 636688 - DNA, 25 bp, Mus musculus
gaagtgcgtcctagtggacaaccag

SEQ ID NO: 636689 - DNA, 25 bp, Mus musculus
gaagtgcgtccttgtggacaaccag

SEQ ID NO: 636690 - DNA, 25 bp, Mus musculus
gaagtgcgtgtacacgtacatccag

SEQ ID NO: 636691 - DNA, 25 bp, Mus musculus
gaagtgcgtgtagacgtacatccag

SEQ ID NO: 636692 - DNA, 25 bp, Mus musculus
gaagtgctaaaacagttaacagaag

SEQ ID NO: 636693 - DNA, 25 bp, Mus musculus
gaagtgctaaaagagttaacagaag

SEQ ID NO: 636694 - DNA, 25 bp, Mus musculus
gaagtgctaagtcatactgtgagca

SEQ ID NO: 636695 - DNA, 25 bp, Mus musculus
gaagtgctaagtgatactgtgagca

SEQ ID NO: 636696 - DNA, 25 bp, Mus musculus
gaagtgctcccaacaacaattctgt

SEQ ID NO: 636697 - DNA, 25 bp, Mus musculus
gaagtgctcccatcaacaattctgt

SEQ ID NO: 636698 - DNA, 25 bp, Mus musculus
gaagtgctcgaacgaacctgttgga

SEQ ID NO: 636699 - DNA, 25 bp, Mus musculus
gaagtgctcgaaggaacctgttgga

SEQ ID NO: 636700 - DNA, 25 bp, Mus musculus
gaagtgctctggctctgtgccaacc

SEQ ID NO: 636701 - DNA, 25 bp, Mus musculus
gaagtgctctgggtctgtgccaacc

SEQ ID NO: 636702 - DNA, 25 bp, Mus musculus
gaagtgcttacccacatacaacgca

SEQ ID NO: 636703 - DNA, 25 bp, Mus musculus
gaagtgcttaccgacatacaacgca

SEQ ID NO: 636704 - DNA, 25 bp, Mus musculus
gaagtgcttaggagtctaccagaca

SEQ ID NO: 636705 - DNA, 25 bp, Mus musculus
gaagtgcttaggtgtctaccagaca

SEQ ID NO: 636706 - DNA, 25 bp, Mus musculus
gaagtgcttcagaaccgtgtcctgg

SEQ ID NO: 636707 - DNA, 25 bp, Mus musculus
gaagtgcttcagtaccgtgtcctgg

SEQ ID NO: 636708 - DNA, 25 bp, Mus musculus
gaagtgcttcgtaaagagccttacg

SEQ ID NO: 636709 - DNA, 25 bp, Mus musculus
gaagtgcttcgttaagagccttacg

SEQ ID NO: 636710 - DNA, 25 bp, Mus musculus
gaagtgcttgctcctgaagcctcag

SEQ ID NO: 636711 - DNA, 25 bp, Mus musculus
gaagtgcttgctgctgaagcctcag

SEQ ID NO: 636712 - DNA, 25 bp, Mus musculus
gaagtgctttatctcctctgcgtgc

SEQ ID NO: 636713 - DNA, 25 bp, Mus musculus
gaagtgctttatgtcctctgcgtgc

SEQ ID NO: 636714 - DNA, 25 bp, Mus musculus
gaagtggaaccacacgctctccatg

SEQ ID NO: 636715 - DNA, 25 bp, Mus musculus
gaagtggaaccagacgctctccatg

SEQ ID NO: 636716 - DNA, 25 bp, Mus musculus
gaagtggaagcgcatgtgaatatca

SEQ ID NO: 636717 - DNA, 25 bp, Mus musculus
gaagtggaagcggatgtgaatatca

SEQ ID NO: 636718 - DNA, 25 bp, Mus musculus
gaagtggacaagcaagattgtcgca

SEQ ID NO: 636719 - DNA, 25 bp, Mus musculus
gaagtggacaaggaagattgtcgca

SEQ ID NO: 636720 - DNA, 25 bp, Mus musculus
gaagtggaccccagaggtgaagcac

SEQ ID NO: 636721 - DNA, 25 bp, Mus musculus
gaagtggaccccagtgacattgttg

SEQ ID NO: 636722 - DNA, 25 bp, Mus musculus
gaagtggacccctgaggtgaagcac

SEQ ID NO: 636723 - DNA, 25 bp, Mus musculus
gaagtggacccctgtgacattgttg

SEQ ID NO: 636724 - DNA, 25 bp, Mus musculus
gaagtggaccttaagagcagagcag

SEQ ID NO: 636725 - DNA, 25 bp, Mus musculus
gaagtggacctttagagcagagcag

SEQ ID NO: 636726 - DNA, 25 bp, Mus musculus
gaagtggacgtaaatcccagttctc

SEQ ID NO: 636727 - DNA, 25 bp, Mus musculus
gaagtggacgtatatcccagttctc

SEQ ID NO: 636728 - DNA, 25 bp, Mus musculus
gaagtggactcccatacttactacg

SEQ ID NO: 636729 - DNA, 25 bp, Mus musculus
gaagtggactccgatacttactacg

SEQ ID NO: 636730 - DNA, 25 bp, Mus musculus
gaagtggactgactgcttgtacagc

SEQ ID NO: 636731 - DNA, 25 bp, Mus musculus
gaagtggactgagtgcttgtacagc

SEQ ID NO: 636732 - DNA, 25 bp, Mus musculus
gaagtggactggagtcagaatacag

SEQ ID NO: 636733 - DNA, 25 bp, Mus musculus
gaagtggactggtgtcagaatacag

SEQ ID NO: 636734 - DNA, 25 bp, Mus musculus
gaagtggagaaaaagttactcaaga

SEQ ID NO: 636735 - DNA, 25 bp, Mus musculus
gaagtggagaaatagttactcaaga

SEQ ID NO: 636736 - DNA, 25 bp, Mus musculus
gaagtggagcggactcctagtaccg

SEQ ID NO: 636737 - DNA, 25 bp, Mus musculus
gaagtggagcggtctcctagtaccg

SEQ ID NO: 636738 - DNA, 25 bp, Mus musculus
gaagtggagcgtccacatcgccatg

SEQ ID NO: 636739 - DNA, 25 bp, Mus musculus
gaagtggagcgtgcacatcgccatg

SEQ ID NO: 636740 - DNA, 25 bp, Mus musculus
gaagtggatccaagccttagaagaa

SEQ ID NO: 636741 - DNA, 25 bp, Mus musculus
gaagtggatccatgccttagaagaa

SEQ ID NO: 636742 - DNA, 25 bp, Mus musculus
gaagtggatgtgatcaactctcccc

SEQ ID NO: 636743 - DNA, 25 bp, Mus musculus
gaagtggatgtgttcaactctcccc

SEQ ID NO: 636744 - DNA, 25 bp, Mus musculus
gaagtggattgaaaagcagaacaga

SEQ ID NO: 636745 - DNA, 25 bp, Mus musculus
gaagtggattgataagcagaacaga

SEQ ID NO: 636746 - DNA, 25 bp, Mus musculus
gaagtggcaacaacactcgctgctg

SEQ ID NO: 636747 - DNA, 25 bp, Mus musculus
gaagtggcaacatcactcgctgctg

SEQ ID NO: 636748 - DNA, 25 bp, Mus musculus
gaagtggcagcgcaaacgcacacag

SEQ ID NO: 636749 - DNA, 25 bp, Mus musculus
gaagtggcagcggaaacgcacacag

SEQ ID NO: 636750 - DNA, 25 bp, Mus musculus
gaagtggccaaaatcctcaagcaag

SEQ ID NO: 636751 - DNA, 25 bp, Mus musculus
gaagtggccaaattcctcaagcaag

SEQ ID NO: 636752 - DNA, 25 bp, Mus musculus
gaagtggccaacaaacagaccatgg

SEQ ID NO: 636753 - DNA, 25 bp, Mus musculus
gaagtggccaactaacagaccatgg

SEQ ID NO: 636754 - DNA, 25 bp, Mus musculus
gaagtggccaagcattctctgtcaa

SEQ ID NO: 636755 - DNA, 25 bp, Mus musculus
gaagtggccaagctaaggaaaccat

SEQ ID NO: 636756 - DNA, 25 bp, Mus musculus
gaagtggccaaggattctctgtcaa

SEQ ID NO: 636757 - DNA, 25 bp, Mus musculus
gaagtggccaaggtaaggaaaccat

SEQ ID NO: 636758 - DNA, 25 bp, Mus musculus
gaagtggccactaagttcagcatct

SEQ ID NO: 636759 - DNA, 25 bp, Mus musculus
gaagtggccacttagttcagcatct

SEQ ID NO: 636760 - DNA, 25 bp, Mus musculus
gaagtggccgagataaatacggtcc

SEQ ID NO: 636761 - DNA, 25 bp, Mus musculus
gaagtggccgagttaaatacggtcc

SEQ ID NO: 636762 - DNA, 25 bp, Mus musculus
gaagtggcgctcaaacagtttcgtt

SEQ ID NO: 636763 - DNA, 25 bp, Mus musculus
gaagtggcgctctaacagtttcgtt

SEQ ID NO: 636764 - DNA, 25 bp, Mus musculus
gaagtggcgctgcttgtacatccgt

SEQ ID NO: 636765 - DNA, 25 bp, Mus musculus
gaagtggcgctggttgtacatccgt

SEQ ID NO: 636766 - DNA, 25 bp, Mus musculus
gaagtggctatcacctacaacggaa

SEQ ID NO: 636767 - DNA, 25 bp, Mus musculus
gaagtggctatctcctacaacggaa

SEQ ID NO: 636768 - DNA, 25 bp, Mus musculus
gaagtggctcttctggctaccgtca

SEQ ID NO: 636769 - DNA, 25 bp, Mus musculus
gaagtggctcttgtggctaccgtca

SEQ ID NO: 636770 - DNA, 25 bp, Mus musculus
gaagtggctgagagcgatggccagg

SEQ ID NO: 636771 - DNA, 25 bp, Mus musculus
gaagtggctgagtgcgatggccagg

SEQ ID NO: 636772 - DNA, 25 bp, Mus musculus
gaagtggctgatacacatctatttt

SEQ ID NO: 636773 - DNA, 25 bp, Mus musculus
gaagtggctgattcacatctatttt

SEQ ID NO: 636774 - DNA, 25 bp, Mus musculus
gaagtggcttcaccgtagagcttgc

SEQ ID NO: 636775 - DNA, 25 bp, Mus musculus
gaagtggcttcagcgtagagcttgc

SEQ ID NO: 636776 - DNA, 25 bp, Mus musculus
gaagtggcttccaaggtgacatgga

SEQ ID NO: 636777 - DNA, 25 bp, Mus musculus
gaagtggcttcctaggtgacatgga

SEQ ID NO: 636778 - DNA, 25 bp, Mus musculus
gaagtgggcacaacaaagaggtcat

SEQ ID NO: 636779 - DNA, 25 bp, Mus musculus
gaagtgggcacatcaaagaggtcat

SEQ ID NO: 636780 - DNA, 25 bp, Mus musculus
gaagtgggcagcacagcccttctca

SEQ ID NO: 636781 - DNA, 25 bp, Mus musculus
gaagtgggcagctcagcccttctca

SEQ ID NO: 636782 - DNA, 25 bp, Mus musculus
gaagtgggcctcatccatcagtact

SEQ ID NO: 636783 - DNA, 25 bp, Mus musculus
gaagtgggcctcttccatcagtact

SEQ ID NO: 636784 - DNA, 25 bp, Mus musculus
gaagtgggtattcacagctgcccac

SEQ ID NO: 636785 - DNA, 25 bp, Mus musculus
gaagtgggtattgacagctgcccac

SEQ ID NO: 636786 - DNA, 25 bp, Mus musculus
gaagtggtacaccaacaggagctca

SEQ ID NO: 636787 - DNA, 25 bp, Mus musculus
gaagtggtacacgaacaggagctca

SEQ ID NO: 636788 - DNA, 25 bp, Mus musculus
gaagtggtattacggaacatcatta

SEQ ID NO: 636789 - DNA, 25 bp, Mus musculus
gaagtggtattagggaacatcatta

SEQ ID NO: 636790 - DNA, 25 bp, Mus musculus
gaagtggtcagaataccctatcctc

SEQ ID NO: 636791 - DNA, 25 bp, Mus musculus
gaagtggtcagattaccctatcctc

SEQ ID NO: 636792 - DNA, 25 bp, Mus musculus
gaagtggtccttctcgatcggaaac

SEQ ID NO: 636793 - DNA, 25 bp, Mus musculus
gaagtggtccttgtcgatcggaaac

SEQ ID NO: 636794 - DNA, 25 bp, Mus musculus
gaagtggtgaccagacattgccgga

SEQ ID NO: 636795 - DNA, 25 bp, Mus musculus
gaagtggtgacctgacattgccgga

SEQ ID NO: 636796 - DNA, 25 bp, Mus musculus
gaagtggtgcaccaacggcccgtcc

SEQ ID NO: 636797 - DNA, 25 bp, Mus musculus
gaagtggtgcacgaacggcccgtcc

SEQ ID NO: 636798 - DNA, 25 bp, Mus musculus
gaagtggtgcgaatatacatttcac

SEQ ID NO: 636799 - DNA, 25 bp, Mus musculus
gaagtggtgcgattatacatttcac

SEQ ID NO: 636800 - DNA, 25 bp, Mus musculus
gaagtggtggcactaccttgtcccg

SEQ ID NO: 636801 - DNA, 25 bp, Mus musculus
gaagtggtggcagtaccttgtcccg

SEQ ID NO: 636802 - DNA, 25 bp, Mus musculus
gaagtggtgtaaagaatctcaaccc

SEQ ID NO: 636803 - DNA, 25 bp, Mus musculus
gaagtggtgtaatgaatctcaaccc

SEQ ID NO: 636804 - DNA, 25 bp, Mus musculus
gaagtggttatgagttatcttcctc

SEQ ID NO: 636805 - DNA, 25 bp, Mus musculus
gaagtggttatgtgttatcttcctc

SEQ ID NO: 636806 - DNA, 25 bp, Mus musculus
gaagtggttcttagcggtgcaagca

SEQ ID NO: 636807 - DNA, 25 bp, Mus musculus
gaagtggttctttgcggtgcaagca

SEQ ID NO: 636808 - DNA, 25 bp, Mus musculus
gaagtggttggaaatggcacctatg

SEQ ID NO: 636809 - DNA, 25 bp, Mus musculus
gaagtggttggatatggcacctatg

SEQ ID NO: 636810 - DNA, 25 bp, Mus musculus
gaagtggttttgactgcctcctcag

SEQ ID NO: 636811 - DNA, 25 bp, Mus musculus
gaagtggttttgtctgcctcctcag

SEQ ID NO: 636812 - DNA, 25 bp, Mus musculus
gaagtgtaaagtaaccagggataag

SEQ ID NO: 636813 - DNA, 25 bp, Mus musculus
gaagtgtaaagttaccagggataag

SEQ ID NO: 636814 - DNA, 25 bp, Mus musculus
gaagtgtacaccaggcttggagaaa

SEQ ID NO: 636815 - DNA, 25 bp, Mus musculus
gaagtgtacacctggcttggagaaa

SEQ ID NO: 636816 - DNA, 25 bp, Mus musculus
gaagtgtaccaacacactggcttgt

SEQ ID NO: 636817 - DNA, 25 bp, Mus musculus
gaagtgtaccaagacactggcttgt

SEQ ID NO: 636818 - DNA, 25 bp, Mus musculus
gaagtgtcaccaatgtgttgagaca

SEQ ID NO: 636819 - DNA, 25 bp, Mus musculus
gaagtgtcaccattgtgttgagaca

SEQ ID NO: 636820 - DNA, 25 bp, Mus musculus
gaagtgtcacgaacactacaccaca

SEQ ID NO: 636821 - DNA, 25 bp, Mus musculus
gaagtgtcacgatcactacaccaca

SEQ ID NO: 636822 - DNA, 25 bp, Mus musculus
gaagtgtcacgtccatcgccatcta

SEQ ID NO: 636823 - DNA, 25 bp, Mus musculus
gaagtgtcacgtgcatcgccatcta

SEQ ID NO: 636824 - DNA, 25 bp, Mus musculus
gaagtgtcatctccgacatattcga

SEQ ID NO: 636825 - DNA, 25 bp, Mus musculus
gaagtgtcatctgcgacatattcga

SEQ ID NO: 636826 - DNA, 25 bp, Mus musculus
gaagtgtccggccagctcattctta

SEQ ID NO: 636827 - DNA, 25 bp, Mus musculus
gaagtgtccggcgagctcattctta

SEQ ID NO: 636828 - DNA, 25 bp, Mus musculus
gaagtgtcgtgtatcccaggactca

SEQ ID NO: 636829 - DNA, 25 bp, Mus musculus
gaagtgtcgtgtttcccaggactca

SEQ ID NO: 636830 - DNA, 25 bp, Mus musculus
gaagtgtctccgcttcgtgcatctg

SEQ ID NO: 636831 - DNA, 25 bp, Mus musculus
gaagtgtctccggttcgtgcatctg

SEQ ID NO: 636832 - DNA, 25 bp, Mus musculus
gaagtgtctgacaccatgatagctg

SEQ ID NO: 636833 - DNA, 25 bp, Mus musculus
gaagtgtctgactccatgatagctg

SEQ ID NO: 636834 - DNA, 25 bp, Mus musculus
gaagtgtcttggagcccacccaagg

SEQ ID NO: 636835 - DNA, 25 bp, Mus musculus
gaagtgtcttggtgcccacccaagg

SEQ ID NO: 636836 - DNA, 25 bp, Mus musculus
gaagtgtgagccactttgatgcagg

SEQ ID NO: 636837 - DNA, 25 bp, Mus musculus
gaagtgtgagcccattgccatgaca

SEQ ID NO: 636838 - DNA, 25 bp, Mus musculus
gaagtgtgagccgattgccatgaca

SEQ ID NO: 636839 - DNA, 25 bp, Mus musculus
gaagtgtgagcctctttgatgcagg

SEQ ID NO: 636840 - DNA, 25 bp, Mus musculus
gaagtgtgcatgaccccatcagcca

SEQ ID NO: 636841 - DNA, 25 bp, Mus musculus
gaagtgtgcatgtccccatcagcca

SEQ ID NO: 636842 - DNA, 25 bp, Mus musculus
gaagtgtgttacacacgcctcacgt

SEQ ID NO: 636843 - DNA, 25 bp, Mus musculus
gaagtgtgttactcacgcctcacgt

SEQ ID NO: 636844 - DNA, 25 bp, Mus musculus
gaagtgttacatctttaactcaggc

SEQ ID NO: 636845 - DNA, 25 bp, Mus musculus
gaagtgttacatgtttaactcaggc

SEQ ID NO: 636846 - DNA, 25 bp, Mus musculus
gaagtgttacttccgcaaggagaat

SEQ ID NO: 636847 - DNA, 25 bp, Mus musculus
gaagtgttacttgcgcaaggagaat

SEQ ID NO: 636848 - DNA, 25 bp, Mus musculus
gaagtgttagaacccttgacttcag

SEQ ID NO: 636849 - DNA, 25 bp, Mus musculus
gaagtgttagaagccttgacttcag

SEQ ID NO: 636850 - DNA, 25 bp, Mus musculus
gaagtgttagcaaccttgaagcgtg

SEQ ID NO: 636851 - DNA, 25 bp, Mus musculus
gaagtgttagcatccttgaagcgtg

SEQ ID NO: 636852 - DNA, 25 bp, Mus musculus
gaagtgttcaaaaccatggccctgc

SEQ ID NO: 636853 - DNA, 25 bp, Mus musculus
gaagtgttcaaatccatggccctgc

SEQ ID NO: 636854 - DNA, 25 bp, Mus musculus
gaagtgttccgtccttgctatcagc

SEQ ID NO: 636855 - DNA, 25 bp, Mus musculus
gaagtgttccgtgcttgctatcagc

SEQ ID NO: 636856 - DNA, 25 bp, Mus musculus
gaagtgttgctcaccatggagagga

SEQ ID NO: 636857 - DNA, 25 bp, Mus musculus
gaagtgttgctctccatggagagga

SEQ ID NO: 636858 - DNA, 25 bp, Mus musculus
gaagtgttggcgctcatcttccgtg

SEQ ID NO: 636859 - DNA, 25 bp, Mus musculus
gaagtgttggcggtcatcttccgtg

SEQ ID NO: 636860 - DNA, 25 bp, Mus musculus
gaagtgtttgaaagctctacaaagc

SEQ ID NO: 636861 - DNA, 25 bp, Mus musculus
gaagtgtttgaatgctctacaaagc

SEQ ID NO: 636862 - DNA, 25 bp, Mus musculus
gaagtgtttgacatgaccaagggca

SEQ ID NO: 636863 - DNA, 25 bp, Mus musculus
gaagtgtttgacttgaccaagggca

SEQ ID NO: 636864 - DNA, 25 bp, Mus musculus
gaagtgttttaaagtcagaagcggc

SEQ ID NO: 636865 - DNA, 25 bp, Mus musculus
gaagtgttttaatgtcagaagcggc

SEQ ID NO: 636866 - DNA, 25 bp, Mus musculus
gaagtgttttgcacagatgacgacc

SEQ ID NO: 636867 - DNA, 25 bp, Mus musculus
gaagtgttttgctcagatgacgacc

SEQ ID NO: 636868 - DNA, 25 bp, Mus musculus
gaagttaaaggcagagggaaaaatg

SEQ ID NO: 636869 - DNA, 25 bp, Mus musculus
gaagttaaaggctgagggaaaaatg

SEQ ID NO: 636870 - DNA, 25 bp, Mus musculus
gaagttaacaacaacacctgttcag

SEQ ID NO: 636871 - DNA, 25 bp, Mus musculus
gaagttaacaactacacctgttcag

SEQ ID NO: 636872 - DNA, 25 bp, Mus musculus
gaagttaacgcccaggatgagaatg

SEQ ID NO: 636873 - DNA, 25 bp, Mus musculus
gaagttaacgccgaggatgagaatg

SEQ ID NO: 636874 - DNA, 25 bp, Mus musculus
gaagttaaggttccggtcagcagca

SEQ ID NO: 636875 - DNA, 25 bp, Mus musculus
gaagttaaggttgcggtcagcagca

SEQ ID NO: 636876 - DNA, 25 bp, Mus musculus
gaagttaagtcacataagctcccag

SEQ ID NO: 636877 - DNA, 25 bp, Mus musculus
gaagttaagtcagataagctcccag

SEQ ID NO: 636878 - DNA, 25 bp, Mus musculus
gaagttaatctgaggtgaagcaaac

SEQ ID NO: 636879 - DNA, 25 bp, Mus musculus
gaagttaatctgtggtgaagcaaac

SEQ ID NO: 636880 - DNA, 25 bp, Mus musculus
gaagttaatcttagatccccaggct

SEQ ID NO: 636881 - DNA, 25 bp, Mus musculus
gaagttaatctttgatccccaggct

SEQ ID NO: 636882 - DNA, 25 bp, Mus musculus
gaagttacttgaaagggctagagga

SEQ ID NO: 636883 - DNA, 25 bp, Mus musculus
gaagttacttgatagggctagagga

SEQ ID NO: 636884 - DNA, 25 bp, Mus musculus
gaagttagaagaactgaggtctgag

SEQ ID NO: 636885 - DNA, 25 bp, Mus musculus
gaagttagaagatctgaggtctgag

SEQ ID NO: 636886 - DNA, 25 bp, Mus musculus
gaagttagacagcaagcattgttgg

SEQ ID NO: 636887 - DNA, 25 bp, Mus musculus
gaagttagacaggaagcattgttgg

SEQ ID NO: 636888 - DNA, 25 bp, Mus musculus
gaagttagacttctcagattggttg

SEQ ID NO: 636889 - DNA, 25 bp, Mus musculus
gaagttagacttgtcagattggttg

SEQ ID NO: 636890 - DNA, 25 bp, Mus musculus
gaagttagataaagaagttctccag

SEQ ID NO: 636891 - DNA, 25 bp, Mus musculus
gaagttagataatgaagttctccag

SEQ ID NO: 636892 - DNA, 25 bp, Mus musculus
gaagttagctggctttccctaaaag

SEQ ID NO: 636893 - DNA, 25 bp, Mus musculus
gaagttagctgggtttccctaaaag

SEQ ID NO: 636894 - DNA, 25 bp, Mus musculus
gaagttagttgcagagacgcctcca

SEQ ID NO: 636895 - DNA, 25 bp, Mus musculus
gaagttagttgctgagacgcctcca

SEQ ID NO: 636896 - DNA, 25 bp, Mus musculus
gaagttatagtcaacaagtctcatg

SEQ ID NO: 636897 - DNA, 25 bp, Mus musculus
gaagttatagtctacaagtctcatg

SEQ ID NO: 636898 - DNA, 25 bp, Mus musculus
gaagttatatgcaacagagatggca

SEQ ID NO: 636899 - DNA, 25 bp, Mus musculus
gaagttatatgctacagagatggca

SEQ ID NO: 636900 - DNA, 25 bp, Mus musculus
gaagttatcagacagaatgaccatc

SEQ ID NO: 636901 - DNA, 25 bp, Mus musculus
gaagttatcagagagaatgaccatc

SEQ ID NO: 636902 - DNA, 25 bp, Mus musculus
gaagttatccagagtctccctgtgt

SEQ ID NO: 636903 - DNA, 25 bp, Mus musculus
gaagttatccagtgtctccctgtgt

SEQ ID NO: 636904 - DNA, 25 bp, Mus musculus
gaagttatggagatcacaacagcca

SEQ ID NO: 636905 - DNA, 25 bp, Mus musculus
gaagttatggagttcacaacagcca

SEQ ID NO: 636906 - DNA, 25 bp, Mus musculus
gaagttatgtgccacgcaagacagg

SEQ ID NO: 636907 - DNA, 25 bp, Mus musculus
gaagttatgtgcgacgcaagacagg

SEQ ID NO: 636908 - DNA, 25 bp, Mus musculus
gaagttcaaaatctccgtgatgtgg

SEQ ID NO: 636909 - DNA, 25 bp, Mus musculus
gaagttcaaaatgtccgtgatgtgg

SEQ ID NO: 636910 - DNA, 25 bp, Mus musculus
gaagttcaacgtcgatgcattcaag

SEQ ID NO: 636911 - DNA, 25 bp, Mus musculus
gaagttcaacgtggatgcattcaag

SEQ ID NO: 636912 - DNA, 25 bp, Mus musculus
gaagttcaacttccagaaggacatc

SEQ ID NO: 636913 - DNA, 25 bp, Mus musculus
gaagttcaacttgcagaaggacatc

SEQ ID NO: 636914 - DNA, 25 bp, Mus musculus
gaagttcaagaacatcattatggga

SEQ ID NO: 636915 - DNA, 25 bp, Mus musculus
gaagttcaagaagatcattatggga

SEQ ID NO: 636916 - DNA, 25 bp, Mus musculus
gaagttcaagagagccatatgccgc

SEQ ID NO: 636917 - DNA, 25 bp, Mus musculus
gaagttcaagagtgccatatgccgc

SEQ ID NO: 636918 - DNA, 25 bp, Mus musculus
gaagttcacaataactgcggcatcg

SEQ ID NO: 636919 - DNA, 25 bp, Mus musculus
gaagttcacaattactgcggcatcg

SEQ ID NO: 636920 - DNA, 25 bp, Mus musculus
gaagttcacacacagccgatgggtg

SEQ ID NO: 636921 - DNA, 25 bp, Mus musculus
gaagttcacacagagccgatgggtg

SEQ ID NO: 636922 - DNA, 25 bp, Mus musculus
gaagttcaccctaaaggctgggcag

SEQ ID NO: 636923 - DNA, 25 bp, Mus musculus
gaagttcacccttaaggctgggcag

SEQ ID NO: 636924 - DNA, 25 bp, Mus musculus
gaagttcacgatcctgtttgactca

SEQ ID NO: 636925 - DNA, 25 bp, Mus musculus
gaagttcacgatgctgtttgactca

SEQ ID NO: 636926 - DNA, 25 bp, Mus musculus
gaagttcagaaaactgcaagatgcc

SEQ ID NO: 636927 - DNA, 25 bp, Mus musculus
gaagttcagaaatctgcaagatgcc

SEQ ID NO: 636928 - DNA, 25 bp, Mus musculus
gaagttcagagaccagatgtcccgc

SEQ ID NO: 636929 - DNA, 25 bp, Mus musculus
gaagttcagagagcagatgtcccgc

SEQ ID NO: 636930 - DNA, 25 bp, Mus musculus
gaagttcagagccattttaaaaata

SEQ ID NO: 636931 - DNA, 25 bp, Mus musculus
gaagttcagagcgattttaaaaata

SEQ ID NO: 636932 - DNA, 25 bp, Mus musculus
gaagttcagtcaccaaaagatgaaa

SEQ ID NO: 636933 - DNA, 25 bp, Mus musculus
gaagttcagtcagcaaaagatgaaa

SEQ ID NO: 636934 - DNA, 25 bp, Mus musculus
gaagttcatcagcaatggacctttc

SEQ ID NO: 636935 - DNA, 25 bp, Mus musculus
gaagttcatcaggaatggacctttc

SEQ ID NO: 636936 - DNA, 25 bp, Mus musculus
gaagttcatccaagtcaactaccta

SEQ ID NO: 636937 - DNA, 25 bp, Mus musculus
gaagttcatccatgtcaactaccta

SEQ ID NO: 636938 - DNA, 25 bp, Mus musculus
gaagttcatctaaggcatatacatg

SEQ ID NO: 636939 - DNA, 25 bp, Mus musculus
gaagttcatctacaccagtcagtac

SEQ ID NO: 636940 - DNA, 25 bp, Mus musculus
gaagttcatctagaccagtcagtac

SEQ ID NO: 636941 - DNA, 25 bp, Mus musculus
gaagttcatctatggcatatacatg

SEQ ID NO: 636942 - DNA, 25 bp, Mus musculus
gaagttcattgtacatagagatcta

SEQ ID NO: 636943 - DNA, 25 bp, Mus musculus
gaagttcattgttcatagagatcta

SEQ ID NO: 636944 - DNA, 25 bp, Mus musculus
gaagttccaattcaaaagatgtttg

SEQ ID NO: 636945 - DNA, 25 bp, Mus musculus
gaagttccaattgaaaagatgtttg

SEQ ID NO: 636946 - DNA, 25 bp, Mus musculus
gaagttccactcagtgcacagtggg

SEQ ID NO: 636947 - DNA, 25 bp, Mus musculus
gaagttccactctgtgcacagtggg

SEQ ID NO: 636948 - DNA, 25 bp, Mus musculus
gaagttccagcaccgttttcagagt

SEQ ID NO: 636949 - DNA, 25 bp, Mus musculus
gaagttccagcagcgttttcagagt

SEQ ID NO: 636950 - DNA, 25 bp, Mus musculus
gaagttccagtaaaaggaggaccac

SEQ ID NO: 636951 - DNA, 25 bp, Mus musculus
gaagttccagtataaggaggaccac

SEQ ID NO: 636952 - DNA, 25 bp, Mus musculus
gaagttcccattcaaggacagaaaa

SEQ ID NO: 636953 - DNA, 25 bp, Mus musculus
gaagttcccattgaaggacagaaaa

SEQ ID NO: 636954 - DNA, 25 bp, Mus musculus
gaagttccccccagtagaaggcagt

SEQ ID NO: 636955 - DNA, 25 bp, Mus musculus
gaagttcccccctgtagaaggcagt

SEQ ID NO: 636956 - DNA, 25 bp, Mus musculus
gaagttcccgaaccgacattaactg

SEQ ID NO: 636957 - DNA, 25 bp, Mus musculus
gaagttcccgaagcgacattaactg

SEQ ID NO: 636958 - DNA, 25 bp, Mus musculus
gaagttccctataaggctggaaggc

SEQ ID NO: 636959 - DNA, 25 bp, Mus musculus
gaagttccctattaggctggaaggc

SEQ ID NO: 636960 - DNA, 25 bp, Mus musculus
gaagttccgggtcccaaagatcgct

SEQ ID NO: 636961 - DNA, 25 bp, Mus musculus
gaagttccgggtgccaaagatcgct

SEQ ID NO: 636962 - DNA, 25 bp, Mus musculus
gaagttccgtgaactgacagtcggc

SEQ ID NO: 636963 - DNA, 25 bp, Mus musculus
gaagttccgtgatctgacagtcggc

SEQ ID NO: 636964 - DNA, 25 bp, Mus musculus
gaagttcctgtcaccgagaaagcca

SEQ ID NO: 636965 - DNA, 25 bp, Mus musculus
gaagttcctgtctccgagaaagcca

SEQ ID NO: 636966 - DNA, 25 bp, Mus musculus
gaagttcctgtgagcactaatcccg

SEQ ID NO: 636967 - DNA, 25 bp, Mus musculus
gaagttcctgtgtgcactaatcccg

SEQ ID NO: 636968 - DNA, 25 bp, Mus musculus
gaagttcctgttagtgaggctccaa

SEQ ID NO: 636969 - DNA, 25 bp, Mus musculus
gaagttcctgtttgtgaggctccaa

SEQ ID NO: 636970 - DNA, 25 bp, Mus musculus
gaagttcgaactaatacatggcaaa

SEQ ID NO: 636971 - DNA, 25 bp, Mus musculus
gaagttcgaacttatacatggcaaa

SEQ ID NO: 636972 - DNA, 25 bp, Mus musculus
gaagttcggaatcccaggaaggtca

SEQ ID NO: 636973 - DNA, 25 bp, Mus musculus
gaagttcggaatgccaggaaggtca

SEQ ID NO: 636974 - DNA, 25 bp, Mus musculus
gaagttcgggaacgagtgggcccat

SEQ ID NO: 636975 - DNA, 25 bp, Mus musculus
gaagttcgggaaggagtgggcccat

SEQ ID NO: 636976 - DNA, 25 bp, Mus musculus
gaagttcgggataggctggcctcca

SEQ ID NO: 636977 - DNA, 25 bp, Mus musculus
gaagttcgggattggctggcctcca

SEQ ID NO: 636978 - DNA, 25 bp, Mus musculus
gaagttcgtgaaccggagtccctct

SEQ ID NO: 636979 - DNA, 25 bp, Mus musculus
gaagttcgtgaagcggagtccctct

SEQ ID NO: 636980 - DNA, 25 bp, Mus musculus
gaagttctaaaaaacctgcgcagca

SEQ ID NO: 636981 - DNA, 25 bp, Mus musculus
gaagttctaaaatacctgcgcagca

SEQ ID NO: 636982 - DNA, 25 bp, Mus musculus
gaagttctacatacaaggcggcgac

SEQ ID NO: 636983 - DNA, 25 bp, Mus musculus
gaagttctacattcaaggcggcgac

SEQ ID NO: 636984 - DNA, 25 bp, Mus musculus
gaagttctacccaggctgggtgcag

SEQ ID NO: 636985 - DNA, 25 bp, Mus musculus
gaagttctaccctggctgggtgcag

SEQ ID NO: 636986 - DNA, 25 bp, Mus musculus
gaagttctacgtcaacctacattaa

SEQ ID NO: 636987 - DNA, 25 bp, Mus musculus
gaagttctacgtgaacctacattaa

SEQ ID NO: 636988 - DNA, 25 bp, Mus musculus
gaagttctcgtcagtggaagccacc

SEQ ID NO: 636989 - DNA, 25 bp, Mus musculus
gaagttctcgtctgtggaagccacc

SEQ ID NO: 636990 - DNA, 25 bp, Mus musculus
gaagttctcttcaacaagaatttga

SEQ ID NO: 636991 - DNA, 25 bp, Mus musculus
gaagttctcttctacaagaatttga

SEQ ID NO: 636992 - DNA, 25 bp, Mus musculus
gaagttctgaccctcctgttaccag

SEQ ID NO: 636993 - DNA, 25 bp, Mus musculus
gaagttctgaccgtcctgttaccag

SEQ ID NO: 636994 - DNA, 25 bp, Mus musculus
gaagttctttgacagcgcctgcacg

SEQ ID NO: 636995 - DNA, 25 bp, Mus musculus
gaagttctttgagagcgcctgcacg

SEQ ID NO: 636996 - DNA, 25 bp, Mus musculus
gaagttgaaagaagatacagggtca

SEQ ID NO: 636997 - DNA, 25 bp, Mus musculus
gaagttgaaagatgatacagggtca

SEQ ID NO: 636998 - DNA, 25 bp, Mus musculus
gaagttgaagaacggccccaatgat

SEQ ID NO: 636999 - DNA, 25 bp, Mus musculus
gaagttgaagaagggccccaatgat

SEQ ID NO: 637000 - DNA, 25 bp, Mus musculus
gaagttgaagaccaagatagtaaag

SEQ ID NO: 637001 - DNA, 25 bp, Mus musculus
gaagttgaagacgaagatagtaaag

SEQ ID NO: 637002 - DNA, 25 bp, Mus musculus
gaagttgacagactttggcttcagc

SEQ ID NO: 637003 - DNA, 25 bp, Mus musculus
gaagttgacagagtttggcttcagc

SEQ ID NO: 637004 - DNA, 25 bp, Mus musculus
gaagttgacagtagacccaggctgg

SEQ ID NO: 637005 - DNA, 25 bp, Mus musculus
gaagttgacagttgacccaggctgg

SEQ ID NO: 637006 - DNA, 25 bp, Mus musculus
gaagttgactacacctgaatgtccc

SEQ ID NO: 637007 - DNA, 25 bp, Mus musculus
gaagttgactactcctgaatgtccc

SEQ ID NO: 637008 - DNA, 25 bp, Mus musculus
gaagttgactttagtaagccctatg

SEQ ID NO: 637009 - DNA, 25 bp, Mus musculus
gaagttgacttttgtaagccctatg

SEQ ID NO: 637010 - DNA, 25 bp, Mus musculus
gaagttgagaaccatgaagtatgga

SEQ ID NO: 637011 - DNA, 25 bp, Mus musculus
gaagttgagaacgatgaagtatgga

SEQ ID NO: 637012 - DNA, 25 bp, Mus musculus
gaagttgagcaaaaggatcctacac

SEQ ID NO: 637013 - DNA, 25 bp, Mus musculus
gaagttgagcaataggatcctacac

SEQ ID NO: 637014 - DNA, 25 bp, Mus musculus
gaagttgaggagaactttgtccgag

SEQ ID NO: 637015 - DNA, 25 bp, Mus musculus
gaagttgaggagtactttgtccgag

SEQ ID NO: 637016 - DNA, 25 bp, Mus musculus
gaagttgaggcgagcaatcaagcag

SEQ ID NO: 637017 - DNA, 25 bp, Mus musculus
gaagttgaggcgtgcaatcaagcag

SEQ ID NO: 637018 - DNA, 25 bp, Mus musculus
gaagttgatcctcttctcaccgtgg

SEQ ID NO: 637019 - DNA, 25 bp, Mus musculus
gaagttgatcctgttctcaccgtgg

SEQ ID NO: 637020 - DNA, 25 bp, Mus musculus
gaagttgattccaagtactcagcta

SEQ ID NO: 637021 - DNA, 25 bp, Mus musculus
gaagttgattcctagtactcagcta

SEQ ID NO: 637022 - DNA, 25 bp, Mus musculus
gaagttgcaatcacgtacataaaag

SEQ ID NO: 637023 - DNA, 25 bp, Mus musculus
gaagttgcaatctcgtacataaaag

SEQ ID NO: 637024 - DNA, 25 bp, Mus musculus
gaagttgcagatcaacctcccacac

SEQ ID NO: 637025 - DNA, 25 bp, Mus musculus
gaagttgcagatgaacctcccacac

SEQ ID NO: 637026 - DNA, 25 bp, Mus musculus
gaagttgcagttaagacacatgttt

SEQ ID NO: 637027 - DNA, 25 bp, Mus musculus
gaagttgcagtttagacacatgttt

SEQ ID NO: 637028 - DNA, 25 bp, Mus musculus
gaagttgccaaaccttgtggacatg

SEQ ID NO: 637029 - DNA, 25 bp, Mus musculus
gaagttgccaaagcttgtggacatg

SEQ ID NO: 637030 - DNA, 25 bp, Mus musculus
gaagttgcccagcaaactgatggat

SEQ ID NO: 637031 - DNA, 25 bp, Mus musculus
gaagttgcccaggaaactgatggat

SEQ ID NO: 637032 - DNA, 25 bp, Mus musculus
gaagttgccgcaaaacttttttcag

SEQ ID NO: 637033 - DNA, 25 bp, Mus musculus
gaagttgccgcataacttttttcag

SEQ ID NO: 637034 - DNA, 25 bp, Mus musculus
gaagttgctaatctccttcagggtg

SEQ ID NO: 637035 - DNA, 25 bp, Mus musculus
gaagttgctaatgtccttcagggtg

SEQ ID NO: 637036 - DNA, 25 bp, Mus musculus
gaagttgctccaccgcctagaagag

SEQ ID NO: 637037 - DNA, 25 bp, Mus musculus
gaagttgctccagcgcctagaagag

SEQ ID NO: 637038 - DNA, 25 bp, Mus musculus
gaagttgctgaacaactggcagaga

SEQ ID NO: 637039 - DNA, 25 bp, Mus musculus
gaagttgctgaactgtaccctaaaa

SEQ ID NO: 637040 - DNA, 25 bp, Mus musculus
gaagttgctgaagaactggcagaga

SEQ ID NO: 637041 - DNA, 25 bp, Mus musculus
gaagttgctgaagtgtaccctaaaa

SEQ ID NO: 637042 - DNA, 25 bp, Mus musculus
gaagttgctgacctactgtcagaag

SEQ ID NO: 637043 - DNA, 25 bp, Mus musculus
gaagttgctgacgtactgtcagaag

SEQ ID NO: 637044 - DNA, 25 bp, Mus musculus
gaagttgctgtacccacgttgttga

SEQ ID NO: 637045 - DNA, 25 bp, Mus musculus
gaagttgctgtagccacgttgttga

SEQ ID NO: 637046 - DNA, 25 bp, Mus musculus
gaagttgctgtgctgtacttccgag

SEQ ID NO: 637047 - DNA, 25 bp, Mus musculus
gaagttgctgtggtgtacttccgag

SEQ ID NO: 637048 - DNA, 25 bp, Mus musculus
gaagttggaagtctgaaagcattga

SEQ ID NO: 637049 - DNA, 25 bp, Mus musculus
gaagttggaagtgtgaaagcattga

SEQ ID NO: 637050 - DNA, 25 bp, Mus musculus
gaagttggacctccgagaatagtgt

SEQ ID NO: 637051 - DNA, 25 bp, Mus musculus
gaagttggacctgcgagaatagtgt

SEQ ID NO: 637052 - DNA, 25 bp, Mus musculus
gaagttggagagagccaacaacctg

SEQ ID NO: 637053 - DNA, 25 bp, Mus musculus
gaagttggagagtgccaacaacctg

SEQ ID NO: 637054 - DNA, 25 bp, Mus musculus
gaagttggagatacacaagtggttg

SEQ ID NO: 637055 - DNA, 25 bp, Mus musculus
gaagttggagatatcttactacaaa

SEQ ID NO: 637056 - DNA, 25 bp, Mus musculus
gaagttggagattcacaagtggttg

SEQ ID NO: 637057 - DNA, 25 bp, Mus musculus
gaagttggagatttcttactacaaa

SEQ ID NO: 637058 - DNA, 25 bp, Mus musculus
gaagttggataaaggtgccttgctc

SEQ ID NO: 637059 - DNA, 25 bp, Mus musculus
gaagttggataatggtgccttgctc

SEQ ID NO: 637060 - DNA, 25 bp, Mus musculus
gaagttggcaatcaagtctggatcc

SEQ ID NO: 637061 - DNA, 25 bp, Mus musculus
gaagttggcaatgaagtctggatcc

SEQ ID NO: 637062 - DNA, 25 bp, Mus musculus
gaagttggctccaccttagtcctca

SEQ ID NO: 637063 - DNA, 25 bp, Mus musculus
gaagttggctccatccaggcaagac

SEQ ID NO: 637064 - DNA, 25 bp, Mus musculus
gaagttggctcctccttagtcctca

SEQ ID NO: 637065 - DNA, 25 bp, Mus musculus
gaagttggctccttccaggcaagac

SEQ ID NO: 637066 - DNA, 25 bp, Mus musculus
gaagttggctctctgagcattggac

SEQ ID NO: 637067 - DNA, 25 bp, Mus musculus
gaagttggctctgtgagcattggac

SEQ ID NO: 637068 - DNA, 25 bp, Mus musculus
gaagttgggaagcagaatctgtttt

SEQ ID NO: 637069 - DNA, 25 bp, Mus musculus
gaagttgggaaggagaatctgtttt

SEQ ID NO: 637070 - DNA, 25 bp, Mus musculus
gaagttgtaagcaaaatagcccagt

SEQ ID NO: 637071 - DNA, 25 bp, Mus musculus
gaagttgtaagctaaatagcccagt

SEQ ID NO: 637072 - DNA, 25 bp, Mus musculus
gaagttgtcccgaaagatgagaaag

SEQ ID NO: 637073 - DNA, 25 bp, Mus musculus
gaagttgtcccgtaagatgagaaag

SEQ ID NO: 637074 - DNA, 25 bp, Mus musculus
gaagttgtcctacacgatgacagag

SEQ ID NO: 637075 - DNA, 25 bp, Mus musculus
gaagttgtcctagacgatgacagag

SEQ ID NO: 637076 - DNA, 25 bp, Mus musculus
gaagttgtgaagactgttaccaatg

SEQ ID NO: 637077 - DNA, 25 bp, Mus musculus
gaagttgtgaagtctgttaccaatg

SEQ ID NO: 637078 - DNA, 25 bp, Mus musculus
gaagttgtgaataatatcagacggc

SEQ ID NO: 637079 - DNA, 25 bp, Mus musculus
gaagttgtgaatcaggcccgtctag

SEQ ID NO: 637080 - DNA, 25 bp, Mus musculus
gaagttgtgaatgaggcccgtctag

SEQ ID NO: 637081 - DNA, 25 bp, Mus musculus
gaagttgtgaattatatcagacggc

SEQ ID NO: 637082 - DNA, 25 bp, Mus musculus
gaagttgtgctcaagtttgaaatgg

SEQ ID NO: 637083 - DNA, 25 bp, Mus musculus
gaagttgtgctctagtttgaaatgg

SEQ ID NO: 637084 - DNA, 25 bp, Mus musculus
gaagttgtgcttcaaagttgtgacc

SEQ ID NO: 637085 - DNA, 25 bp, Mus musculus
gaagttgtgcttgaaagttgtgacc

SEQ ID NO: 637086 - DNA, 25 bp, Mus musculus
gaagttgttacgagtgagctcccag

SEQ ID NO: 637087 - DNA, 25 bp, Mus musculus
gaagttgttacgtgtgagctcccag

SEQ ID NO: 637088 - DNA, 25 bp, Mus musculus
gaagttgttcaaccgccgcagggta

SEQ ID NO: 637089 - DNA, 25 bp, Mus musculus
gaagttgttcaagcgccgcagggta

SEQ ID NO: 637090 - DNA, 25 bp, Mus musculus
gaagttgttgatcccatcatgacca

SEQ ID NO: 637091 - DNA, 25 bp, Mus musculus
gaagttgttgatgccatcatgacca

SEQ ID NO: 637092 - DNA, 25 bp, Mus musculus
gaagttgttgtcaatgctccagaat

SEQ ID NO: 637093 - DNA, 25 bp, Mus musculus
gaagttgttgtctatgctccagaat

SEQ ID NO: 637094 - DNA, 25 bp, Mus musculus
gaagtttaaagacggagacaaagct

SEQ ID NO: 637095 - DNA, 25 bp, Mus musculus
gaagtttaaagagggagacaaagct

SEQ ID NO: 637096 - DNA, 25 bp, Mus musculus
gaagtttaatacaccagccctgaag

SEQ ID NO: 637097 - DNA, 25 bp, Mus musculus
gaagtttaatactccagccctgaag

SEQ ID NO: 637098 - DNA, 25 bp, Mus musculus
gaagtttagcagaactcacccttgg

SEQ ID NO: 637099 - DNA, 25 bp, Mus musculus
gaagtttagcagtactcacccttgg

SEQ ID NO: 637100 - DNA, 25 bp, Mus musculus
gaagtttatgcaaatgaaattgatg

SEQ ID NO: 637101 - DNA, 25 bp, Mus musculus
gaagtttatgcatatgaaattgatg

SEQ ID NO: 637102 - DNA, 25 bp, Mus musculus
gaagtttcaatgagcttatgagtgg

SEQ ID NO: 637103 - DNA, 25 bp, Mus musculus
gaagtttcaatgtgcttatgagtgg

SEQ ID NO: 637104 - DNA, 25 bp, Mus musculus
gaagtttcagagaccactgtacaga

SEQ ID NO: 637105 - DNA, 25 bp, Mus musculus
gaagtttcagagtccactgtacaga

SEQ ID NO: 637106 - DNA, 25 bp, Mus musculus
gaagtttcccctaggagacggctcg

SEQ ID NO: 637107 - DNA, 25 bp, Mus musculus
gaagtttccccttggagacggctcg

SEQ ID NO: 637108 - DNA, 25 bp, Mus musculus
gaagtttcctctcgacggagagaag

SEQ ID NO: 637109 - DNA, 25 bp, Mus musculus
gaagtttcctctggacggagagaag

SEQ ID NO: 637110 - DNA, 25 bp, Mus musculus
gaagtttccttcagttccagtgatg

SEQ ID NO: 637111 - DNA, 25 bp, Mus musculus
gaagtttccttctgttccagtgatg

SEQ ID NO: 637112 - DNA, 25 bp, Mus musculus
gaagtttcggctagttttcttctag

SEQ ID NO: 637113 - DNA, 25 bp, Mus musculus
gaagtttcggcttgttttcttctag

SEQ ID NO: 637114 - DNA, 25 bp, Mus musculus
gaagtttctagaccagtcatttgtg

SEQ ID NO: 637115 - DNA, 25 bp, Mus musculus
gaagtttctagagcagtcatttgtg

SEQ ID NO: 637116 - DNA, 25 bp, Mus musculus
gaagtttctctgaacctcttggaag

SEQ ID NO: 637117 - DNA, 25 bp, Mus musculus
gaagtttctctgtacctcttggaag

SEQ ID NO: 637118 - DNA, 25 bp, Mus musculus
gaagtttcttgaagcactccacaac

SEQ ID NO: 637119 - DNA, 25 bp, Mus musculus
gaagtttcttgatgcactccacaac

SEQ ID NO: 637120 - DNA, 25 bp, Mus musculus
gaagtttgaaaccatgtatgcccag

SEQ ID NO: 637121 - DNA, 25 bp, Mus musculus
gaagtttgaaacgatgtatgcccag

SEQ ID NO: 637122 - DNA, 25 bp, Mus musculus
gaagtttgaggacgtcccaattgca

SEQ ID NO: 637123 - DNA, 25 bp, Mus musculus
gaagtttgaggaggtcccaattgca

SEQ ID NO: 637124 - DNA, 25 bp, Mus musculus
gaagtttgcaatcgtggtccagcac

SEQ ID NO: 637125 - DNA, 25 bp, Mus musculus
gaagtttgcaatggtggtccagcac

SEQ ID NO: 637126 - DNA, 25 bp, Mus musculus
gaagtttgcagaaacgatacaagct

SEQ ID NO: 637127 - DNA, 25 bp, Mus musculus
gaagtttgcagatacgatacaagct

SEQ ID NO: 637128 - DNA, 25 bp, Mus musculus
gaagtttgctatcgctaccaaagaa

SEQ ID NO: 637129 - DNA, 25 bp, Mus musculus
gaagtttgctatggctaccaaagaa

SEQ ID NO: 637130 - DNA, 25 bp, Mus musculus
gaagtttgctggaatgccaatcact

SEQ ID NO: 637131 - DNA, 25 bp, Mus musculus
gaagtttgctggtatgccaatcact

SEQ ID NO: 637132 - DNA, 25 bp, Mus musculus
gaagtttggtgaccggcctccaccc

SEQ ID NO: 637133 - DNA, 25 bp, Mus musculus
gaagtttggtgagcggcctccaccc

SEQ ID NO: 637134 - DNA, 25 bp, Mus musculus
gaagtttgtcataaagcccatcgac

SEQ ID NO: 637135 - DNA, 25 bp, Mus musculus
gaagtttgtcattaagcccatcgac

SEQ ID NO: 637136 - DNA, 25 bp, Mus musculus
gaagtttgtcccaacagactgtccc

SEQ ID NO: 637137 - DNA, 25 bp, Mus musculus
gaagtttgtccctacagactgtccc

SEQ ID NO: 637138 - DNA, 25 bp, Mus musculus
gaagtttgtggacaagtgctctccc

SEQ ID NO: 637139 - DNA, 25 bp, Mus musculus
gaagtttgtggagaagtgctctccc

SEQ ID NO: 637140 - DNA, 25 bp, Mus musculus
gaagtttgttgaaggcctccccatt

SEQ ID NO: 637141 - DNA, 25 bp, Mus musculus
gaagtttgttgatggcctccccatt

SEQ ID NO: 637142 - DNA, 25 bp, Mus musculus
gaagttttagatcggtacttcagcc

SEQ ID NO: 637143 - DNA, 25 bp, Mus musculus
gaagttttagatgggtacttcagcc

SEQ ID NO: 637144 - DNA, 25 bp, Mus musculus
gaagttttatacactacagtcaacg

SEQ ID NO: 637145 - DNA, 25 bp, Mus musculus
gaagttttatactctacagtcaacg

SEQ ID NO: 637146 - DNA, 25 bp, Mus musculus
gaagttttcaggagacttggatgac

SEQ ID NO: 637147 - DNA, 25 bp, Mus musculus
gaagttttcaggtgacttggatgac

SEQ ID NO: 637148 - DNA, 25 bp, Mus musculus
gaagttttcctgatgtactgccatt

SEQ ID NO: 637149 - DNA, 25 bp, Mus musculus
gaagttttcctgttgtactgccatt

SEQ ID NO: 637150 - DNA, 25 bp, Mus musculus
gaagttttcgttcgcaatctccttt

SEQ ID NO: 637151 - DNA, 25 bp, Mus musculus
gaagttttcgttggcaatctccttt

SEQ ID NO: 637152 - DNA, 25 bp, Mus musculus
gaagttttctataatgcccatctgt

SEQ ID NO: 637153 - DNA, 25 bp, Mus musculus
gaagttttctattatgcccatctgt

SEQ ID NO: 637154 - DNA, 25 bp, Mus musculus
gaagttttgtaaaacaatgccatga

SEQ ID NO: 637155 - DNA, 25 bp, Mus musculus
gaagttttgtaatacaatgccatga

SEQ ID NO: 637156 - DNA, 25 bp, Mus musculus
gaataaaaaggacctgaggcaagat

SEQ ID NO: 637157 - DNA, 25 bp, Mus musculus
gaataaaaaggagctgaggcaagat

SEQ ID NO: 637158 - DNA, 25 bp, Mus musculus
gaataaaatcaaaatgttcgcccag

SEQ ID NO: 637159 - DNA, 25 bp, Mus musculus
gaataaaatcaatatgttcgcccag

SEQ ID NO: 637160 - DNA, 25 bp, Mus musculus
gaataaaatggtcatcaatcgcctg

SEQ ID NO: 637161 - DNA, 25 bp, Mus musculus
gaataaaatggtgatcaatcgcctg

SEQ ID NO: 637162 - DNA, 25 bp, Mus musculus
gaataaaatttgcagacatccatat

SEQ ID NO: 637163 - DNA, 25 bp, Mus musculus
gaataaaatttggagacatccatat

SEQ ID NO: 637164 - DNA, 25 bp, Mus musculus
gaataaacacgtatggtgagagcca

SEQ ID NO: 637165 - DNA, 25 bp, Mus musculus
gaataaacacgtttggtgagagcca

SEQ ID NO: 637166 - DNA, 25 bp, Mus musculus
gaataaacagggacccaggatgccc

SEQ ID NO: 637167 - DNA, 25 bp, Mus musculus
gaataaacagggtcccaggatgccc

SEQ ID NO: 637168 - DNA, 25 bp, Mus musculus
gaataaacatttcaaacagcccttc

SEQ ID NO: 637169 - DNA, 25 bp, Mus musculus
gaataaacatttgaaacagcccttc

SEQ ID NO: 637170 - DNA, 25 bp, Mus musculus
gaataaaccccgctgcgtctgtgcc

SEQ ID NO: 637171 - DNA, 25 bp, Mus musculus
gaataaaccccggtgcgtctgtgcc

SEQ ID NO: 637172 - DNA, 25 bp, Mus musculus
gaataaactaccctgtggtataact

SEQ ID NO: 637173 - DNA, 25 bp, Mus musculus
gaataaactaccgtgtggtataact

SEQ ID NO: 637174 - DNA, 25 bp, Mus musculus
gaataaactactagatggttatgag

SEQ ID NO: 637175 - DNA, 25 bp, Mus musculus
gaataaactacttgatggttatgag

SEQ ID NO: 637176 - DNA, 25 bp, Mus musculus
gaataaactccacacatggttcctc

SEQ ID NO: 637177 - DNA, 25 bp, Mus musculus
gaataaactccagacatggttcctc

SEQ ID NO: 637178 - DNA, 25 bp, Mus musculus
gaataaactggaaggcccatgcttc

SEQ ID NO: 637179 - DNA, 25 bp, Mus musculus
gaataaactggaagggcaagtatgg

SEQ ID NO: 637180 - DNA, 25 bp, Mus musculus
gaataaactggatggcccatgcttc

SEQ ID NO: 637181 - DNA, 25 bp, Mus musculus
gaataaactggatgggcaagtatgg

SEQ ID NO: 637182 - DNA, 25 bp, Mus musculus
gaataaagcaccctgtgtacacagc

SEQ ID NO: 637183 - DNA, 25 bp, Mus musculus
gaataaagcaccgtgtgtacacagc

SEQ ID NO: 637184 - DNA, 25 bp, Mus musculus
gaataaagcttccataaacccagac

SEQ ID NO: 637185 - DNA, 25 bp, Mus musculus
gaataaagcttcgataaacccagac

SEQ ID NO: 637186 - DNA, 25 bp, Mus musculus
gaataaaggcagacatgtggaaaca

SEQ ID NO: 637187 - DNA, 25 bp, Mus musculus
gaataaaggcagtcatgtggaaaca

SEQ ID NO: 637188 - DNA, 25 bp, Mus musculus
gaataaattgcgagttctacctgaa

SEQ ID NO: 637189 - DNA, 25 bp, Mus musculus
gaataaattgcgtgttctacctgaa

SEQ ID NO: 637190 - DNA, 25 bp, Mus musculus
gaataacaaacacacactacttggg

SEQ ID NO: 637191 - DNA, 25 bp, Mus musculus
gaataacaaacagacactacttggg

SEQ ID NO: 637192 - DNA, 25 bp, Mus musculus
gaataacaacagcatgtgcaaccac

SEQ ID NO: 637193 - DNA, 25 bp, Mus musculus
gaataacaacaggatgtgcaaccac

SEQ ID NO: 637194 - DNA, 25 bp, Mus musculus
gaataacattcccattattgcatct

SEQ ID NO: 637195 - DNA, 25 bp, Mus musculus
gaataacattccgattattgcatct

SEQ ID NO: 637196 - DNA, 25 bp, Mus musculus
gaataaccacctcctcgttatgagc

SEQ ID NO: 637197 - DNA, 25 bp, Mus musculus
gaataaccacctgctcgttatgagc

SEQ ID NO: 637198 - DNA, 25 bp, Mus musculus
gaataaccctgacatgcgggtacgc

SEQ ID NO: 637199 - DNA, 25 bp, Mus musculus
gaataaccctgagatgcgggtacgc

SEQ ID NO: 637200 - DNA, 25 bp, Mus musculus
gaataaccctgtacagatgtcagaa

SEQ ID NO: 637201 - DNA, 25 bp, Mus musculus
gaataaccctgttcagatgtcagaa

SEQ ID NO: 637202 - DNA, 25 bp, Mus musculus
gaataaccgcctacgcatggagctg

SEQ ID NO: 637203 - DNA, 25 bp, Mus musculus
gaataaccgccttcgcatggagctg

SEQ ID NO: 637204 - DNA, 25 bp, Mus musculus
gaataacctccgagttcgcctagga

SEQ ID NO: 637205 - DNA, 25 bp, Mus musculus
gaataacctccgtgttcgcctagga

SEQ ID NO: 637206 - DNA, 25 bp, Mus musculus
gaataacctggaaatgctctggctg

SEQ ID NO: 637207 - DNA, 25 bp, Mus musculus
gaataacctggatatgctctggctg

SEQ ID NO: 637208 - DNA, 25 bp, Mus musculus
gaataacctggccttgcttatctac

SEQ ID NO: 637209 - DNA, 25 bp, Mus musculus
gaataacctggcgttgcttatctac

SEQ ID NO: 637210 - DNA, 25 bp, Mus musculus
gaataaccttgactccttccaaaga

SEQ ID NO: 637211 - DNA, 25 bp, Mus musculus
gaataaccttgagtccttccaaaga

SEQ ID NO: 637212 - DNA, 25 bp, Mus musculus
gaataacgacatagctctcatgaag

SEQ ID NO: 637213 - DNA, 25 bp, Mus musculus
gaataacgacattgctctcatgaag

SEQ ID NO: 637214 - DNA, 25 bp, Mus musculus
gaataactcctaccagacaagaagg

SEQ ID NO: 637215 - DNA, 25 bp, Mus musculus
gaataactcctagcagacaagaagg

SEQ ID NO: 637216 - DNA, 25 bp, Mus musculus
gaataacttcctctcccggagacct

SEQ ID NO: 637217 - DNA, 25 bp, Mus musculus
gaataacttcctgtcccggagacct

SEQ ID NO: 637218 - DNA, 25 bp, Mus musculus
gaataagaaaatagagaaacggcgt

SEQ ID NO: 637219 - DNA, 25 bp, Mus musculus
gaataagaaaattgagaaacggcgt

SEQ ID NO: 637220 - DNA, 25 bp, Mus musculus
gaataagaatcactgacatcggcct

SEQ ID NO: 637221 - DNA, 25 bp, Mus musculus
gaataagaatcagtgacatcggcct

SEQ ID NO: 637222 - DNA, 25 bp, Mus musculus
gaataagacatgattcaagcacagt

SEQ ID NO: 637223 - DNA, 25 bp, Mus musculus
gaataagacatgtttcaagcacagt

SEQ ID NO: 637224 - DNA, 25 bp, Mus musculus
gaataagactgccagcgaccaagca

SEQ ID NO: 637225 - DNA, 25 bp, Mus musculus
gaataagactgcgagcgaccaagca

SEQ ID NO: 637226 - DNA, 25 bp, Mus musculus
gaataagagatgaactgcccacctg

SEQ ID NO: 637227 - DNA, 25 bp, Mus musculus
gaataagagatgtactgcccacctg

SEQ ID NO: 637228 - DNA, 25 bp, Mus musculus
gaataagattgacgaatttctcgaa

SEQ ID NO: 637229 - DNA, 25 bp, Mus musculus
gaataagattgaggaatttctcgaa

SEQ ID NO: 637230 - DNA, 25 bp, Mus musculus
gaataagcacgtctaccctaggaac

SEQ ID NO: 637231 - DNA, 25 bp, Mus musculus
gaataagcacgtgtaccctaggaac

SEQ ID NO: 637232 - DNA, 25 bp, Mus musculus
gaataagctgtccaataccgaccaa

SEQ ID NO: 637233 - DNA, 25 bp, Mus musculus
gaataagctgtcgaataccgaccaa

SEQ ID NO: 637234 - DNA, 25 bp, Mus musculus
gaataagcttcgacatctgtcagtt

SEQ ID NO: 637235 - DNA, 25 bp, Mus musculus
gaataagcttcgtcatctgtcagtt

SEQ ID NO: 637236 - DNA, 25 bp, Mus musculus
gaataaggaagtattctcaagtcac

SEQ ID NO: 637237 - DNA, 25 bp, Mus musculus
gaataaggaagttttctcaagtcac

SEQ ID NO: 637238 - DNA, 25 bp, Mus musculus
gaataaggatggagaaccagagtac

SEQ ID NO: 637239 - DNA, 25 bp, Mus musculus
gaataaggatggtgaaccagagtac

SEQ ID NO: 637240 - DNA, 25 bp, Mus musculus
gaataaggtccaactcttcccagga

SEQ ID NO: 637241 - DNA, 25 bp, Mus musculus
gaataaggtccatctcttcccagga

SEQ ID NO: 637242 - DNA, 25 bp, Mus musculus
gaataagtagaaatcgtttcccgcg

SEQ ID NO: 637243 - DNA, 25 bp, Mus musculus
gaataagtagaattcgtttcccgcg

SEQ ID NO: 637244 - DNA, 25 bp, Mus musculus
gaataagtatttacgggacacatca

SEQ ID NO: 637245 - DNA, 25 bp, Mus musculus
gaataagtattttcgggacacatca

SEQ ID NO: 637246 - DNA, 25 bp, Mus musculus
gaataagtcaacaacctgatcctgg

SEQ ID NO: 637247 - DNA, 25 bp, Mus musculus
gaataagtcaactacctgatcctgg

SEQ ID NO: 637248 - DNA, 25 bp, Mus musculus
gaataagtccaactccctaaaagtg

SEQ ID NO: 637249 - DNA, 25 bp, Mus musculus
gaataagtccaagtccctaaaagtg

SEQ ID NO: 637250 - DNA, 25 bp, Mus musculus
gaataagttccaccagtatgatagc

SEQ ID NO: 637251 - DNA, 25 bp, Mus musculus
gaataagttccagcagtatgatagc

SEQ ID NO: 637252 - DNA, 25 bp, Mus musculus
gaataagtttgtaccctgaccacac

SEQ ID NO: 637253 - DNA, 25 bp, Mus musculus
gaataagtttgttccctgaccacac

SEQ ID NO: 637254 - DNA, 25 bp, Mus musculus
gaataatagtataacaaaggcccat

SEQ ID NO: 637255 - DNA, 25 bp, Mus musculus
gaataatagtattacaaaggcccat

SEQ ID NO: 637256 - DNA, 25 bp, Mus musculus
gaataatatcccaagagctcggctg

SEQ ID NO: 637257 - DNA, 25 bp, Mus musculus
gaataatatccctagagctcggctg

SEQ ID NO: 637258 - DNA, 25 bp, Mus musculus
gaataatccatcagaaaccaataaa

SEQ ID NO: 637259 - DNA, 25 bp, Mus musculus
gaataatccatctgaaaccaataaa

SEQ ID NO: 637260 - DNA, 25 bp, Mus musculus
gaataatcccctatttgctggaaat

SEQ ID NO: 637261 - DNA, 25 bp, Mus musculus
gaataatcccctttttgctggaaat

SEQ ID NO: 637262 - DNA, 25 bp, Mus musculus
gaataatctcaaagatgcccaagac

SEQ ID NO: 637263 - DNA, 25 bp, Mus musculus
gaataatctcaatgatgcccaagac

SEQ ID NO: 637264 - DNA, 25 bp, Mus musculus
gaataatgagggatcgctgctggcc

SEQ ID NO: 637265 - DNA, 25 bp, Mus musculus
gaataatgagggttcgctgctggcc

SEQ ID NO: 637266 - DNA, 25 bp, Mus musculus
gaataatggatcagaccttgaaagc

SEQ ID NO: 637267 - DNA, 25 bp, Mus musculus
gaataatggatctgaccttgaaagc

SEQ ID NO: 637268 - DNA, 25 bp, Mus musculus
gaataatggcacagatcggtgcttc

SEQ ID NO: 637269 - DNA, 25 bp, Mus musculus
gaataatggcactgatcggtgcttc

SEQ ID NO: 637270 - DNA, 25 bp, Mus musculus
gaataatggccaacacttgttaggg

SEQ ID NO: 637271 - DNA, 25 bp, Mus musculus
gaataatggccatcacttgttaggg

SEQ ID NO: 637272 - DNA, 25 bp, Mus musculus
gaataattctctacaaagaaaaggc

SEQ ID NO: 637273 - DNA, 25 bp, Mus musculus
gaataattctcttcaaagaaaaggc

SEQ ID NO: 637274 - DNA, 25 bp, Mus musculus
gaataatttcgcagagaagggcacc

SEQ ID NO: 637275 - DNA, 25 bp, Mus musculus
gaataatttcgctgagaagggcacc

SEQ ID NO: 637276 - DNA, 25 bp, Mus musculus
gaatacaaagttcggcctccttctt

SEQ ID NO: 637277 - DNA, 25 bp, Mus musculus
gaatacaaagttgggcctccttctt

SEQ ID NO: 637278 - DNA, 25 bp, Mus musculus
gaatacaaggagaccaccgaggagt

SEQ ID NO: 637279 - DNA, 25 bp, Mus musculus
gaatacaaggagtccaccgaggagt

SEQ ID NO: 637280 - DNA, 25 bp, Mus musculus
gaatacacagaaacaggctatgaag

SEQ ID NO: 637281 - DNA, 25 bp, Mus musculus
gaatacacagaatcaggctatgaag

SEQ ID NO: 637282 - DNA, 25 bp, Mus musculus
gaatacacatttaggaacctgtgtg

SEQ ID NO: 637283 - DNA, 25 bp, Mus musculus
gaatacacattttggaacctgtgtg

SEQ ID NO: 637284 - DNA, 25 bp, Mus musculus
gaatacaccattagctttctgccac

SEQ ID NO: 637285 - DNA, 25 bp, Mus musculus
gaatacaccatttgctttctgccac

SEQ ID NO: 637286 - DNA, 25 bp, Mus musculus
gaatacacccacagccacgtctgta

SEQ ID NO: 637287 - DNA, 25 bp, Mus musculus
gaatacacccactgccacgtctgta

SEQ ID NO: 637288 - DNA, 25 bp, Mus musculus
gaatacaccgttactgtatgacctg

SEQ ID NO: 637289 - DNA, 25 bp, Mus musculus
gaatacaccgtttctgtatgacctg

SEQ ID NO: 637290 - DNA, 25 bp, Mus musculus
gaatacacctggatctttcatgtgt

SEQ ID NO: 637291 - DNA, 25 bp, Mus musculus
gaatacacctggttctttcatgtgt

SEQ ID NO: 637292 - DNA, 25 bp, Mus musculus
gaatacagactacttcagccagctg

SEQ ID NO: 637293 - DNA, 25 bp, Mus musculus
gaatacagactagttcagccagctg

SEQ ID NO: 637294 - DNA, 25 bp, Mus musculus
gaatacagctatattttctccagcc

SEQ ID NO: 637295 - DNA, 25 bp, Mus musculus
gaatacagctattttttctccagcc

SEQ ID NO: 637296 - DNA, 25 bp, Mus musculus
gaatacagggtgagctacagaattt

SEQ ID NO: 637297 - DNA, 25 bp, Mus musculus
gaatacagggtgtgctacagaattt

SEQ ID NO: 637298 - DNA, 25 bp, Mus musculus
gaatacagtcccatgttcaacagag

SEQ ID NO: 637299 - DNA, 25 bp, Mus musculus
gaatacagtcccttgttcaacagag

SEQ ID NO: 637300 - DNA, 25 bp, Mus musculus
gaatacatcaccacagctcttcggg

SEQ ID NO: 637301 - DNA, 25 bp, Mus musculus
gaatacatcacctcagctcttcggg

SEQ ID NO: 637302 - DNA, 25 bp, Mus musculus
gaatacatcactcccatcttagaac

SEQ ID NO: 637303 - DNA, 25 bp, Mus musculus
gaatacatcactgccatcttagaac

SEQ ID NO: 637304 - DNA, 25 bp, Mus musculus
gaatacatctgcacccaacagaata

SEQ ID NO: 637305 - DNA, 25 bp, Mus musculus
gaatacatctgctcccaacagaata

SEQ ID NO: 637306 - DNA, 25 bp, Mus musculus
gaatacattgcccaagctcggcgac

SEQ ID NO: 637307 - DNA, 25 bp, Mus musculus
gaatacattgccgaagctcggcgac

SEQ ID NO: 637308 - DNA, 25 bp, Mus musculus
gaatacatttaccagcaaagaaccc

SEQ ID NO: 637309 - DNA, 25 bp, Mus musculus
gaatacatttacgagcaaagaaccc

SEQ ID NO: 637310 - DNA, 25 bp, Mus musculus
gaatacatttgtcccaagtggaaaa

SEQ ID NO: 637311 - DNA, 25 bp, Mus musculus
gaatacatttgtgccaagtggaaaa

SEQ ID NO: 637312 - DNA, 25 bp, Mus musculus
gaatacattttgatggagcccagca

SEQ ID NO: 637313 - DNA, 25 bp, Mus musculus
gaatacattttgttggagcccagca

SEQ ID NO: 637314 - DNA, 25 bp, Mus musculus
gaataccaacatcacaagcctcctt

SEQ ID NO: 637315 - DNA, 25 bp, Mus musculus
gaataccaacatgacaagcctcctt

SEQ ID NO: 637316 - DNA, 25 bp, Mus musculus
gaataccaaccaactgacctcagta

SEQ ID NO: 637317 - DNA, 25 bp, Mus musculus
gaataccaaccatctgacctcagta

SEQ ID NO: 637318 - DNA, 25 bp, Mus musculus
gaataccagacgctgcagaggctca

SEQ ID NO: 637319 - DNA, 25 bp, Mus musculus
gaataccagacggtgcagaggctca

SEQ ID NO: 637320 - DNA, 25 bp, Mus musculus
gaataccagagtccttccgtgggtc

SEQ ID NO: 637321 - DNA, 25 bp, Mus musculus
gaataccagagtgcttccgtgggtc

SEQ ID NO: 637322 - DNA, 25 bp, Mus musculus
gaataccagatgcaggcttctacag

SEQ ID NO: 637323 - DNA, 25 bp, Mus musculus
gaataccagatggaggcttctacag

SEQ ID NO: 637324 - DNA, 25 bp, Mus musculus
gaataccagccaattagccttcagt

SEQ ID NO: 637325 - DNA, 25 bp, Mus musculus
gaataccagccatttagccttcagt

SEQ ID NO: 637326 - DNA, 25 bp, Mus musculus
gaataccagccgcaacagaggaaca

SEQ ID NO: 637327 - DNA, 25 bp, Mus musculus
gaataccagccggaacagaggaaca

SEQ ID NO: 637328 - DNA, 25 bp, Mus musculus
gaataccatgctaggagtgggtcac

SEQ ID NO: 637329 - DNA, 25 bp, Mus musculus
gaataccatgcttggagtgggtcac

SEQ ID NO: 637330 - DNA, 25 bp, Mus musculus
gaatacccaatgcttttcctgagat

SEQ ID NO: 637331 - DNA, 25 bp, Mus musculus
gaatacccaatggttttcctgagat

SEQ ID NO: 637332 - DNA, 25 bp, Mus musculus
gaatacccagatcagctccagtgtg

SEQ ID NO: 637333 - DNA, 25 bp, Mus musculus
gaatacccagatgagctccagtgtg

SEQ ID NO: 637334 - DNA, 25 bp, Mus musculus
gaatacccagctactggagagagtg

SEQ ID NO: 637335 - DNA, 25 bp, Mus musculus
gaatacccagcttctggagagagtg

SEQ ID NO: 637336 - DNA, 25 bp, Mus musculus
gaataccctgagatcctctagcttg

SEQ ID NO: 637337 - DNA, 25 bp, Mus musculus
gaataccctgagttcctctagcttg

SEQ ID NO: 637338 - DNA, 25 bp, Mus musculus
gaataccgggccagtgtgtccaggt

SEQ ID NO: 637339 - DNA, 25 bp, Mus musculus
gaataccgggcctgtgtgtccaggt

SEQ ID NO: 637340 - DNA, 25 bp, Mus musculus
gaataccgtgatccggccttctcga

SEQ ID NO: 637341 - DNA, 25 bp, Mus musculus
gaataccgtgatgcggccttctcga

SEQ ID NO: 637342 - DNA, 25 bp, Mus musculus
gaatacctcatgatgctcatgccgc

SEQ ID NO: 637343 - DNA, 25 bp, Mus musculus
gaatacctcatgttgctcatgccgc

SEQ ID NO: 637344 - DNA, 25 bp, Mus musculus
gaatacctctacaaacaagagaaca

SEQ ID NO: 637345 - DNA, 25 bp, Mus musculus
gaatacctctactaacaagagaaca

SEQ ID NO: 637346 - DNA, 25 bp, Mus musculus
gaatacctctgccttttggatgacc

SEQ ID NO: 637347 - DNA, 25 bp, Mus musculus
gaatacctctgcgttttggatgacc

SEQ ID NO: 637348 - DNA, 25 bp, Mus musculus
gaataccttccccatatacatggtg

SEQ ID NO: 637349 - DNA, 25 bp, Mus musculus
gaataccttcccgatatacatggtg

SEQ ID NO: 637350 - DNA, 25 bp, Mus musculus
gaataccttgaaatagccagaccac

SEQ ID NO: 637351 - DNA, 25 bp, Mus musculus
gaataccttgaattagccagaccac

SEQ ID NO: 637352 - DNA, 25 bp, Mus musculus
gaatacctttcacctagtgttgtgc

SEQ ID NO: 637353 - DNA, 25 bp, Mus musculus
gaatacctttcagctagtgttgtgc

SEQ ID NO: 637354 - DNA, 25 bp, Mus musculus
gaatacgaaatgaagctgacaactg

SEQ ID NO: 637355 - DNA, 25 bp, Mus musculus
gaatacgaaatgtagctgacaactg

SEQ ID NO: 637356 - DNA, 25 bp, Mus musculus
gaatacgaagctcaattggaggctc

SEQ ID NO: 637357 - DNA, 25 bp, Mus musculus
gaatacgaagctgaattggaggctc

SEQ ID NO: 637358 - DNA, 25 bp, Mus musculus
gaatacgacgaacaaggatatccga

SEQ ID NO: 637359 - DNA, 25 bp, Mus musculus
gaatacgacgaagaaggatatccga

SEQ ID NO: 637360 - DNA, 25 bp, Mus musculus
gaatacgattcaatacacagtccgg

SEQ ID NO: 637361 - DNA, 25 bp, Mus musculus
gaatacgattcattacacagtccgg

SEQ ID NO: 637362 - DNA, 25 bp, Mus musculus
gaatacgcaggtcctctaatggaag

SEQ ID NO: 637363 - DNA, 25 bp, Mus musculus
gaatacgcaggtgctctaatggaag

SEQ ID NO: 637364 - DNA, 25 bp, Mus musculus
gaatacgctgacatcttctgccagt

SEQ ID NO: 637365 - DNA, 25 bp, Mus musculus
gaatacgctgacttcttctgccagt

SEQ ID NO: 637366 - DNA, 25 bp, Mus musculus
gaatacgggaccaatgagaatgcca

SEQ ID NO: 637367 - DNA, 25 bp, Mus musculus
gaatacgggacctatgagaatgcca

SEQ ID NO: 637368 - DNA, 25 bp, Mus musculus
gaatacggtgatcgaatgtgatgct

SEQ ID NO: 637369 - DNA, 25 bp, Mus musculus
gaatacggtgatggaatgtgatgct

SEQ ID NO: 637370 - DNA, 25 bp, Mus musculus
gaatactatgagcaagagagctgca

SEQ ID NO: 637371 - DNA, 25 bp, Mus musculus
gaatactatgaggaagagagctgca

SEQ ID NO: 637372 - DNA, 25 bp, Mus musculus
gaatactcacctaccgtgcagaaga

SEQ ID NO: 637373 - DNA, 25 bp, Mus musculus
gaatactcaccttccgtgcagaaga

SEQ ID NO: 637374 - DNA, 25 bp, Mus musculus
gaatactcaggtccgaggccgccct

SEQ ID NO: 637375 - DNA, 25 bp, Mus musculus
gaatactcaggtgcgaggccgccct

SEQ ID NO: 637376 - DNA, 25 bp, Mus musculus
gaatactccagtatctccgaacagt

SEQ ID NO: 637377 - DNA, 25 bp, Mus musculus
gaatactccagtttctccgaacagt

SEQ ID NO: 637378 - DNA, 25 bp, Mus musculus
gaatactcggagctctaggtccaag

SEQ ID NO: 637379 - DNA, 25 bp, Mus musculus
gaatactcggaggtctaggtccaag

SEQ ID NO: 637380 - DNA, 25 bp, Mus musculus
gaatactctaccacacaaagcaagg

SEQ ID NO: 637381 - DNA, 25 bp, Mus musculus
gaatactctacctcacaaagcaagg

SEQ ID NO: 637382 - DNA, 25 bp, Mus musculus
gaatactcttgcactgaggcccttg

SEQ ID NO: 637383 - DNA, 25 bp, Mus musculus
gaatactcttgctctgaggcccttg

SEQ ID NO: 637384 - DNA, 25 bp, Mus musculus
gaatactgcaacctcaactactgcg

SEQ ID NO: 637385 - DNA, 25 bp, Mus musculus
gaatactgcaacgtcaactactgcg

SEQ ID NO: 637386 - DNA, 25 bp, Mus musculus
gaatactgcatcattggcgtcacaa

SEQ ID NO: 637387 - DNA, 25 bp, Mus musculus
gaatactgcatctttggcgtcacaa

SEQ ID NO: 637388 - DNA, 25 bp, Mus musculus
gaatactgccgaaacggtgatctgg

SEQ ID NO: 637389 - DNA, 25 bp, Mus musculus
gaatactgccgatacggtgatctgg

SEQ ID NO: 637390 - DNA, 25 bp, Mus musculus
gaatactgcctcattttggacacca

SEQ ID NO: 637391 - DNA, 25 bp, Mus musculus
gaatactgcctctttttggacacca

SEQ ID NO: 637392 - DNA, 25 bp, Mus musculus
gaatactgtcaaattccgctgtcca

SEQ ID NO: 637393 - DNA, 25 bp, Mus musculus
gaatactgtcaatttccgctgtcca

SEQ ID NO: 637394 - DNA, 25 bp, Mus musculus
gaatacttagatcttccccgtgcaa

SEQ ID NO: 637395 - DNA, 25 bp, Mus musculus
gaatacttagatgttccccgtgcaa

SEQ ID NO: 637396 - DNA, 25 bp, Mus musculus
gaatacttggatctcacccagcctc

SEQ ID NO: 637397 - DNA, 25 bp, Mus musculus
gaatacttggatgtcacccagcctc

SEQ ID NO: 637398 - DNA, 25 bp, Mus musculus
gaatactttattcggtcagttgtcg

SEQ ID NO: 637399 - DNA, 25 bp, Mus musculus
gaatactttattgggtcagttgtcg

SEQ ID NO: 637400 - DNA, 25 bp, Mus musculus
gaatactttcgcacaagtgaccaac

SEQ ID NO: 637401 - DNA, 25 bp, Mus musculus
gaatactttcgctcaagtgaccaac

SEQ ID NO: 637402 - DNA, 25 bp, Mus musculus
gaatactttctgcaaattcccgact

SEQ ID NO: 637403 - DNA, 25 bp, Mus musculus
gaatactttctggaaattcccgact

SEQ ID NO: 637404 - DNA, 25 bp, Mus musculus
gaatagaagcctccagctgctgtct

SEQ ID NO: 637405 - DNA, 25 bp, Mus musculus
gaatagaagcctgcagctgctgtct

SEQ ID NO: 637406 - DNA, 25 bp, Mus musculus
gaatagaatgtgactgcttaggtgg

SEQ ID NO: 637407 - DNA, 25 bp, Mus musculus
gaatagaatgtgtctgcttaggtgg

SEQ ID NO: 637408 - DNA, 25 bp, Mus musculus
gaatagagatgtatcgaaatatgca

SEQ ID NO: 637409 - DNA, 25 bp, Mus musculus
gaatagagatgtttcgaaatatgca

SEQ ID NO: 637410 - DNA, 25 bp, Mus musculus
gaatagagttgtacggaataacctc

SEQ ID NO: 637411 - DNA, 25 bp, Mus musculus
gaatagagttgttcggaataacctc

SEQ ID NO: 637412 - DNA, 25 bp, Mus musculus
gaatagatagccagcctttaactga

SEQ ID NO: 637413 - DNA, 25 bp, Mus musculus
gaatagatagcctgcctttaactga

SEQ ID NO: 637414 - DNA, 25 bp, Mus musculus
gaatagcaacagcaactcgcacaga

SEQ ID NO: 637415 - DNA, 25 bp, Mus musculus
gaatagcaacaggaactcgcacaga

SEQ ID NO: 637416 - DNA, 25 bp, Mus musculus
gaatagcagcaacatgtcgaagcgt

SEQ ID NO: 637417 - DNA, 25 bp, Mus musculus
gaatagcagcaagatgtcgaagcgt

SEQ ID NO: 637418 - DNA, 25 bp, Mus musculus
gaatagccacgtacaggaaactaca

SEQ ID NO: 637419 - DNA, 25 bp, Mus musculus
gaatagccacgttcaggaaactaca

SEQ ID NO: 637420 - DNA, 25 bp, Mus musculus
gaatagccagaacaggatggtgtac

SEQ ID NO: 637421 - DNA, 25 bp, Mus musculus
gaatagccagaagaggatggtgtac

SEQ ID NO: 637422 - DNA, 25 bp, Mus musculus
gaatagccatgtatgacacttggag

SEQ ID NO: 637423 - DNA, 25 bp, Mus musculus
gaatagccatgtttgacacttggag

SEQ ID NO: 637424 - DNA, 25 bp, Mus musculus
gaatagcccatcatggctggcgtaa

SEQ ID NO: 637425 - DNA, 25 bp, Mus musculus
gaatagcccatcttggctggcgtaa

SEQ ID NO: 637426 - DNA, 25 bp, Mus musculus
gaatagcctagtcccaccagctagc

SEQ ID NO: 637427 - DNA, 25 bp, Mus musculus
gaatagcctagtgccaccagctagc

SEQ ID NO: 637428 - DNA, 25 bp, Mus musculus
gaatagccttgaaaagctcaagaag

SEQ ID NO: 637429 - DNA, 25 bp, Mus musculus
gaatagccttgataagctcaagaag

SEQ ID NO: 637430 - DNA, 25 bp, Mus musculus
gaatagcgacaaataggaagcttga

SEQ ID NO: 637431 - DNA, 25 bp, Mus musculus
gaatagcgacaattaggaagcttga

SEQ ID NO: 637432 - DNA, 25 bp, Mus musculus
gaatagctaggcaactgtgagacca

SEQ ID NO: 637433 - DNA, 25 bp, Mus musculus
gaatagctaggctactgtgagacca

SEQ ID NO: 637434 - DNA, 25 bp, Mus musculus
gaatagctcccactagataagcaat

SEQ ID NO: 637435 - DNA, 25 bp, Mus musculus
gaatagctcccagtagataagcaat

SEQ ID NO: 637436 - DNA, 25 bp, Mus musculus
gaatagctgtaaccagttcagggct

SEQ ID NO: 637437 - DNA, 25 bp, Mus musculus
gaatagctgtaagcagttcagggct

SEQ ID NO: 637438 - DNA, 25 bp, Mus musculus
gaatagctttgaccagttttgcatc

SEQ ID NO: 637439 - DNA, 25 bp, Mus musculus
gaatagctttgagcagttttgcatc

SEQ ID NO: 637440 - DNA, 25 bp, Mus musculus
gaataggccttaaacagcatctgcc

SEQ ID NO: 637441 - DNA, 25 bp, Mus musculus
gaataggccttatacagcatctgcc

SEQ ID NO: 637442 - DNA, 25 bp, Mus musculus
gaataggcctttccccacttgcaga

SEQ ID NO: 637443 - DNA, 25 bp, Mus musculus
gaataggcctttgcccacttgcaga

SEQ ID NO: 637444 - DNA, 25 bp, Mus musculus
gaatagtaatcacacaggctacgat

SEQ ID NO: 637445 - DNA, 25 bp, Mus musculus
gaatagtaatcagacaggctacgat

SEQ ID NO: 637446 - DNA, 25 bp, Mus musculus
gaatagtcactgatcgggaaactgg

SEQ ID NO: 637447 - DNA, 25 bp, Mus musculus
gaatagtcactgttcgggaaactgg

SEQ ID NO: 637448 - DNA, 25 bp, Mus musculus
gaatagtcagtaaacattagcagct

SEQ ID NO: 637449 - DNA, 25 bp, Mus musculus
gaatagtcagtatacattagcagct

SEQ ID NO: 637450 - DNA, 25 bp, Mus musculus
gaatagtctgggagtcacaggcact

SEQ ID NO: 637451 - DNA, 25 bp, Mus musculus
gaatagtctgggtgtcacaggcact

SEQ ID NO: 637452 - DNA, 25 bp, Mus musculus
gaatagtgctgcctaaggacctgca

SEQ ID NO: 637453 - DNA, 25 bp, Mus musculus
gaatagtgctgcgtaaggacctgca

SEQ ID NO: 637454 - DNA, 25 bp, Mus musculus
gaatagtggtctaacccctcctgta

SEQ ID NO: 637455 - DNA, 25 bp, Mus musculus
gaatagtggtcttacccctcctgta

SEQ ID NO: 637456 - DNA, 25 bp, Mus musculus
gaatagtgtcttacaaattgacccc

SEQ ID NO: 637457 - DNA, 25 bp, Mus musculus
gaatagtgtctttcaaattgacccc

SEQ ID NO: 637458 - DNA, 25 bp, Mus musculus
gaatagttccaacgaggagagccag

SEQ ID NO: 637459 - DNA, 25 bp, Mus musculus
gaatagttccaaggaggagagccag

SEQ ID NO: 637460 - DNA, 25 bp, Mus musculus
gaatagttcccaagatcttggcatc

SEQ ID NO: 637461 - DNA, 25 bp, Mus musculus
gaatagttcccatgatcttggcatc

SEQ ID NO: 637462 - DNA, 25 bp, Mus musculus
gaatagttgctacctcagcatccca

SEQ ID NO: 637463 - DNA, 25 bp, Mus musculus
gaatagttgctagctcagcatccca

SEQ ID NO: 637464 - DNA, 25 bp, Mus musculus
gaatataaagtaaaaatctcgcctc

SEQ ID NO: 637465 - DNA, 25 bp, Mus musculus
gaatataaagtataaatctcgcctc

SEQ ID NO: 637466 - DNA, 25 bp, Mus musculus
gaatataacatcatccgggtaccca

SEQ ID NO: 637467 - DNA, 25 bp, Mus musculus
gaatataacatcttccgggtaccca

SEQ ID NO: 637468 - DNA, 25 bp, Mus musculus
gaatataagatcaagggacactgtg

SEQ ID NO: 637469 - DNA, 25 bp, Mus musculus
gaatataagatctagggacactgtg

SEQ ID NO: 637470 - DNA, 25 bp, Mus musculus
gaatatacccaaccagaaaaccaga

SEQ ID NO: 637471 - DNA, 25 bp, Mus musculus
gaatatacccaagcagaaaaccaga

SEQ ID NO: 637472 - DNA, 25 bp, Mus musculus
gaatatactttcattaaccctgcac

SEQ ID NO: 637473 - DNA, 25 bp, Mus musculus
gaatatactttctttaaccctgcac

SEQ ID NO: 637474 - DNA, 25 bp, Mus musculus
gaatatagagcccatcatacaatac

SEQ ID NO: 637475 - DNA, 25 bp, Mus musculus
gaatatagagccgatcatacaatac

SEQ ID NO: 637476 - DNA, 25 bp, Mus musculus
gaatataggtacatgggcctggcct

SEQ ID NO: 637477 - DNA, 25 bp, Mus musculus
gaatataggtacttgggcctggcct

SEQ ID NO: 637478 - DNA, 25 bp, Mus musculus
gaatatatttgcacgtacagccctg

SEQ ID NO: 637479 - DNA, 25 bp, Mus musculus
gaatatatttgctcgtacagccctg

SEQ ID NO: 637480 - DNA, 25 bp, Mus musculus
gaatatcaactgaaaatgtgtgccc

SEQ ID NO: 637481 - DNA, 25 bp, Mus musculus
gaatatcaactgtaaatgtgtgccc

SEQ ID NO: 637482 - DNA, 25 bp, Mus musculus
gaatatcacatgatccagagggaga

SEQ ID NO: 637483 - DNA, 25 bp, Mus musculus
gaatatcacatgttccagagggaga

SEQ ID NO: 637484 - DNA, 25 bp, Mus musculus
gaatatcagaaactgtatagtcctc

SEQ ID NO: 637485 - DNA, 25 bp, Mus musculus
gaatatcagaaagtgtatagtcctc

SEQ ID NO: 637486 - DNA, 25 bp, Mus musculus
gaatatcagacaaatccaaatggca

SEQ ID NO: 637487 - DNA, 25 bp, Mus musculus
gaatatcagacatatccaaatggca

SEQ ID NO: 637488 - DNA, 25 bp, Mus musculus
gaatatcataaactttgacaccagt

SEQ ID NO: 637489 - DNA, 25 bp, Mus musculus
gaatatcataaagtttgacaccagt

SEQ ID NO: 637490 - DNA, 25 bp, Mus musculus
gaatatcatagtagtggccaccaag

SEQ ID NO: 637491 - DNA, 25 bp, Mus musculus
gaatatcatagttgtggccaccaag

SEQ ID NO: 637492 - DNA, 25 bp, Mus musculus
gaatatcatcaactatctggactcc

SEQ ID NO: 637493 - DNA, 25 bp, Mus musculus
gaatatcatcaagtatctggactcc

SEQ ID NO: 637494 - DNA, 25 bp, Mus musculus
gaatatcatcagatgccacccattg

SEQ ID NO: 637495 - DNA, 25 bp, Mus musculus
gaatatcatcagttgccacccattg

SEQ ID NO: 637496 - DNA, 25 bp, Mus musculus
gaatatccatggaggtacggagcct

SEQ ID NO: 637497 - DNA, 25 bp, Mus musculus
gaatatccatggtggtacggagcct

SEQ ID NO: 637498 - DNA, 25 bp, Mus musculus
gaatatcccatgagaggttacaggc

SEQ ID NO: 637499 - DNA, 25 bp, Mus musculus
gaatatcccatgtgaggttacaggc

SEQ ID NO: 637500 - DNA, 25 bp, Mus musculus
gaatatccgaaactacaacgtggca

SEQ ID NO: 637501 - DNA, 25 bp, Mus musculus
gaatatccgaaagtacaacgtggca

SEQ ID NO: 637502 - DNA, 25 bp, Mus musculus
gaatatcctcaacaggatccaggag

SEQ ID NO: 637503 - DNA, 25 bp, Mus musculus
gaatatcctcaagaggatccaggag

SEQ ID NO: 637504 - DNA, 25 bp, Mus musculus
gaatatcgagacaacgacaggaacc

SEQ ID NO: 637505 - DNA, 25 bp, Mus musculus
gaatatcgagactacgacaggaacc

SEQ ID NO: 637506 - DNA, 25 bp, Mus musculus
gaatatcgagatcttcctgacagcc

SEQ ID NO: 637507 - DNA, 25 bp, Mus musculus
gaatatcgagatgttcctgacagcc

SEQ ID NO: 637508 - DNA, 25 bp, Mus musculus
gaatatcgatacaagaagtcttaag

SEQ ID NO: 637509 - DNA, 25 bp, Mus musculus
gaatatcgatactagaagtcttaag

SEQ ID NO: 637510 - DNA, 25 bp, Mus musculus
gaatatcgctgcaattcgtgatggg

SEQ ID NO: 637511 - DNA, 25 bp, Mus musculus
gaatatcgctgctattcgtgatggg

SEQ ID NO: 637512 - DNA, 25 bp, Mus musculus
gaatatctctccagtgccttcgtgg

SEQ ID NO: 637513 - DNA, 25 bp, Mus musculus
gaatatctctcctgtgccttcgtgg

SEQ ID NO: 637514 - DNA, 25 bp, Mus musculus
gaatatctcttacaccaggaacatg

SEQ ID NO: 637515 - DNA, 25 bp, Mus musculus
gaatatctcttagaccaggaacatg

SEQ ID NO: 637516 - DNA, 25 bp, Mus musculus
gaatatctgatccaggagctccgaa

SEQ ID NO: 637517 - DNA, 25 bp, Mus musculus
gaatatctgatcgaggagctccgaa

SEQ ID NO: 637518 - DNA, 25 bp, Mus musculus
gaatatctgattagtcttgatccag

SEQ ID NO: 637519 - DNA, 25 bp, Mus musculus
gaatatctgatttgtcttgatccag

SEQ ID NO: 637520 - DNA, 25 bp, Mus musculus
gaatatgaaatgagtattgctgctc

SEQ ID NO: 637521 - DNA, 25 bp, Mus musculus
gaatatgaaatgtgtattgctgctc

SEQ ID NO: 637522 - DNA, 25 bp, Mus musculus
gaatatgaacaaagaagtcctagcc

SEQ ID NO: 637523 - DNA, 25 bp, Mus musculus
gaatatgaacaatgaagtcctagcc

SEQ ID NO: 637524 - DNA, 25 bp, Mus musculus
gaatatgaacctcatcgcaaaaaag

SEQ ID NO: 637525 - DNA, 25 bp, Mus musculus
gaatatgaacctgatcgcaaaaaag

SEQ ID NO: 637526 - DNA, 25 bp, Mus musculus
gaatatgacagaaagtcagaaaggg

SEQ ID NO: 637527 - DNA, 25 bp, Mus musculus
gaatatgacagatagtcagaaaggg

SEQ ID NO: 637528 - DNA, 25 bp, Mus musculus
gaatatgactgtctggccctgaacc

SEQ ID NO: 637529 - DNA, 25 bp, Mus musculus
gaatatgactgtgtggccctgaacc

SEQ ID NO: 637530 - DNA, 25 bp, Mus musculus
gaatatgagaagattgtgagtgaag

SEQ ID NO: 637531 - DNA, 25 bp, Mus musculus
gaatatgagaagtttgtgagtgaag

SEQ ID NO: 637532 - DNA, 25 bp, Mus musculus
gaatatgagtccctgctgtgtgtga

SEQ ID NO: 637533 - DNA, 25 bp, Mus musculus
gaatatgagtccgtgctgtgtgtga

SEQ ID NO: 637534 - DNA, 25 bp, Mus musculus
gaatatgatacacggattgcaccca

SEQ ID NO: 637535 - DNA, 25 bp, Mus musculus
gaatatgatacagggattgcaccca

SEQ ID NO: 637536 - DNA, 25 bp, Mus musculus
gaatatgatcgcctgaagcagcagc

SEQ ID NO: 637537 - DNA, 25 bp, Mus musculus
gaatatgatcgcgtgaagcagcagc

SEQ ID NO: 637538 - DNA, 25 bp, Mus musculus
gaatatgatgagctggcagagcccc

SEQ ID NO: 637539 - DNA, 25 bp, Mus musculus
gaatatgatgaggtggcagagcccc

SEQ ID NO: 637540 - DNA, 25 bp, Mus musculus
gaatatgatgatctccgtcgtgatg

SEQ ID NO: 637541 - DNA, 25 bp, Mus musculus
gaatatgatgatgtccgtcgtgatg

SEQ ID NO: 637542 - DNA, 25 bp, Mus musculus
gaatatgcatatactctacagaatc

SEQ ID NO: 637543 - DNA, 25 bp, Mus musculus
gaatatgcatatcttacacctcgga

SEQ ID NO: 637544 - DNA, 25 bp, Mus musculus
gaatatgcatatgttacacctcgga

SEQ ID NO: 637545 - DNA, 25 bp, Mus musculus
gaatatgcatattctctacagaatc

SEQ ID NO: 637546 - DNA, 25 bp, Mus musculus
gaatatgccattatccttaccaaga

SEQ ID NO: 637547 - DNA, 25 bp, Mus musculus
gaatatgccattttccttaccaaga

SEQ ID NO: 637548 - DNA, 25 bp, Mus musculus
gaatatgcctgcatccagaagcaca

SEQ ID NO: 637549 - DNA, 25 bp, Mus musculus
gaatatgcctgcttccagaagcaca

SEQ ID NO: 637550 - DNA, 25 bp, Mus musculus
gaatatgctgtgcagggtcctgaat

SEQ ID NO: 637551 - DNA, 25 bp, Mus musculus
gaatatgctgtggagggtcctgaat

SEQ ID NO: 637552 - DNA, 25 bp, Mus musculus
gaatatggagagactatgtgcctcc

SEQ ID NO: 637553 - DNA, 25 bp, Mus musculus
gaatatggagagtctatgtgcctcc

SEQ ID NO: 637554 - DNA, 25 bp, Mus musculus
gaatatggcaacagtacaaaatact

SEQ ID NO: 637555 - DNA, 25 bp, Mus musculus
gaatatggcaactgtacaaaatact

SEQ ID NO: 637556 - DNA, 25 bp, Mus musculus
gaatatgggatcagtcgctggagct

SEQ ID NO: 637557 - DNA, 25 bp, Mus musculus
gaatatgggatctgtcgctggagct

SEQ ID NO: 637558 - DNA, 25 bp, Mus musculus
gaatatggtcaacactgttcaaacc

SEQ ID NO: 637559 - DNA, 25 bp, Mus musculus
gaatatggtcaagactgttcaaacc

SEQ ID NO: 637560 - DNA, 25 bp, Mus musculus
gaatatggtggcagactgttctgcc

SEQ ID NO: 637561 - DNA, 25 bp, Mus musculus
gaatatggtggctgactgttctgcc

SEQ ID NO: 637562 - DNA, 25 bp, Mus musculus
gaatatggtgtaacaggatccttta

SEQ ID NO: 637563 - DNA, 25 bp, Mus musculus
gaatatggtgtatcaggatccttta

SEQ ID NO: 637564 - DNA, 25 bp, Mus musculus
gaatatgtacaccatcatgaatccc

SEQ ID NO: 637565 - DNA, 25 bp, Mus musculus
gaatatgtacacgatcatgaatccc

SEQ ID NO: 637566 - DNA, 25 bp, Mus musculus
gaatatgtatacacaagcctaatgg

SEQ ID NO: 637567 - DNA, 25 bp, Mus musculus
gaatatgtatactcaagcctaatgg

SEQ ID NO: 637568 - DNA, 25 bp, Mus musculus
gaatatgtcaatctggtggaagatg

SEQ ID NO: 637569 - DNA, 25 bp, Mus musculus
gaatatgtcaatgtggtggaagatg

SEQ ID NO: 637570 - DNA, 25 bp, Mus musculus
gaatatgtcaccaacaagaccaaga

SEQ ID NO: 637571 - DNA, 25 bp, Mus musculus
gaatatgtcacctacaagaccaaga

SEQ ID NO: 637572 - DNA, 25 bp, Mus musculus
gaatatgtccataccagactacgtc

SEQ ID NO: 637573 - DNA, 25 bp, Mus musculus
gaatatgtccattccagactacgtc

SEQ ID NO: 637574 - DNA, 25 bp, Mus musculus
gaatatgtgcacctctgtctcctga

SEQ ID NO: 637575 - DNA, 25 bp, Mus musculus
gaatatgtgcacgtctgtctcctga

SEQ ID NO: 637576 - DNA, 25 bp, Mus musculus
gaatatgtggaaactggccctatgg

SEQ ID NO: 637577 - DNA, 25 bp, Mus musculus
gaatatgtggaatctggccctatgg

SEQ ID NO: 637578 - DNA, 25 bp, Mus musculus
gaatatgtgtatcctgctaagaagc

SEQ ID NO: 637579 - DNA, 25 bp, Mus musculus
gaatatgtgtatgctgctaagaagc

SEQ ID NO: 637580 - DNA, 25 bp, Mus musculus
gaatattaatgacctcaagtcggaa

SEQ ID NO: 637581 - DNA, 25 bp, Mus musculus
gaatattaatgagctcaagtcggaa

SEQ ID NO: 637582 - DNA, 25 bp, Mus musculus
gaatattactgcagagacccgggag

SEQ ID NO: 637583 - DNA, 25 bp, Mus musculus
gaatattactgctgagacccgggag

SEQ ID NO: 637584 - DNA, 25 bp, Mus musculus
gaatattcactcaagacgaaaggag

SEQ ID NO: 637585 - DNA, 25 bp, Mus musculus
gaatattcactctagacgaaaggag

SEQ ID NO: 637586 - DNA, 25 bp, Mus musculus
gaatattccacacaactgtgactat

SEQ ID NO: 637587 - DNA, 25 bp, Mus musculus
gaatattccacagaactgtgactat

SEQ ID NO: 637588 - DNA, 25 bp, Mus musculus
gaatattccaccagccttgacatgt

SEQ ID NO: 637589 - DNA, 25 bp, Mus musculus
gaatattccacctgccttgacatgt

SEQ ID NO: 637590 - DNA, 25 bp, Mus musculus
gaatattcccatcaccctagaattg

SEQ ID NO: 637591 - DNA, 25 bp, Mus musculus
gaatattcccatgaccctagaattg

SEQ ID NO: 637592 - DNA, 25 bp, Mus musculus
gaatattcctggctgatcaatggcg

SEQ ID NO: 637593 - DNA, 25 bp, Mus musculus
gaatattcctgggtgatcaatggcg

SEQ ID NO: 637594 - DNA, 25 bp, Mus musculus
gaatattcgaggaccgaggccttgg

SEQ ID NO: 637595 - DNA, 25 bp, Mus musculus
gaatattcgaggtccgaggccttgg

SEQ ID NO: 637596 - DNA, 25 bp, Mus musculus
gaatattcggttatcctacaagaaa

SEQ ID NO: 637597 - DNA, 25 bp, Mus musculus
gaatattcggttttcctacaagaaa

SEQ ID NO: 637598 - DNA, 25 bp, Mus musculus
gaatattctattcgagaagtgctta

SEQ ID NO: 637599 - DNA, 25 bp, Mus musculus
gaatattctattggagaagtgctta

SEQ ID NO: 637600 - DNA, 25 bp, Mus musculus
gaatattctggtaaacctctcaaag

SEQ ID NO: 637601 - DNA, 25 bp, Mus musculus
gaatattctggttaacctctcaaag

SEQ ID NO: 637602 - DNA, 25 bp, Mus musculus
gaatattctgtaatgatgactccat

SEQ ID NO: 637603 - DNA, 25 bp, Mus musculus
gaatattctgtattgatgactccat

SEQ ID NO: 637604 - DNA, 25 bp, Mus musculus
gaatattgaccccaaagactcctgt

SEQ ID NO: 637605 - DNA, 25 bp, Mus musculus
gaatattgacccgaaagactcctgt

SEQ ID NO: 637606 - DNA, 25 bp, Mus musculus
gaatattgatgcaggactgtttttc

SEQ ID NO: 637607 - DNA, 25 bp, Mus musculus
gaatattgatgctggactgtttttc

SEQ ID NO: 637608 - DNA, 25 bp, Mus musculus
gaatattgcacgacaacacaaagtg

SEQ ID NO: 637609 - DNA, 25 bp, Mus musculus
gaatattgcacgtcaacacaaagtg

SEQ ID NO: 637610 - DNA, 25 bp, Mus musculus
gaatattgcccaccttctgccacag

SEQ ID NO: 637611 - DNA, 25 bp, Mus musculus
gaatattgcccagcttctgccacag

SEQ ID NO: 637612 - DNA, 25 bp, Mus musculus
gaatattggcagctcctccgagccc

SEQ ID NO: 637613 - DNA, 25 bp, Mus musculus
gaatattggcaggtcctccgagccc

SEQ ID NO: 637614 - DNA, 25 bp, Mus musculus
gaatattggcttcggaacgagttca

SEQ ID NO: 637615 - DNA, 25 bp, Mus musculus
gaatattggcttgggaacgagttca

SEQ ID NO: 637616 - DNA, 25 bp, Mus musculus
gaatattgtttcctcccctgcttaa

SEQ ID NO: 637617 - DNA, 25 bp, Mus musculus
gaatattgtttcgtcccctgcttaa

SEQ ID NO: 637618 - DNA, 25 bp, Mus musculus
gaatatttaccgcaagtcactgaag

SEQ ID NO: 637619 - DNA, 25 bp, Mus musculus
gaatatttaccggaagtcactgaag

SEQ ID NO: 637620 - DNA, 25 bp, Mus musculus
gaatatttgacgaagttcaggcaca

SEQ ID NO: 637621 - DNA, 25 bp, Mus musculus
gaatatttgacgtagttcaggcaca

SEQ ID NO: 637622 - DNA, 25 bp, Mus musculus
gaatatttgagaaaagaggacatgg

SEQ ID NO: 637623 - DNA, 25 bp, Mus musculus
gaatatttgagataagaggacatgg

SEQ ID NO: 637624 - DNA, 25 bp, Mus musculus
gaatatttgagcataacaaacggct

SEQ ID NO: 637625 - DNA, 25 bp, Mus musculus
gaatatttgagcttaacaaacggct

SEQ ID NO: 637626 - DNA, 25 bp, Mus musculus
gaatatttggatcaagccattagac

SEQ ID NO: 637627 - DNA, 25 bp, Mus musculus
gaatatttggatgaagccattagac

SEQ ID NO: 637628 - DNA, 25 bp, Mus musculus
gaatattttaatcaagctccctcaa

SEQ ID NO: 637629 - DNA, 25 bp, Mus musculus
gaatattttaatgaagctccctcaa

SEQ ID NO: 637630 - DNA, 25 bp, Mus musculus
gaatatttttacacacacctcagca

SEQ ID NO: 637631 - DNA, 25 bp, Mus musculus
gaatatttttactcacacctcagca

SEQ ID NO: 637632 - DNA, 25 bp, Mus musculus
gaatcaaaagaactcctgggcatag

SEQ ID NO: 637633 - DNA, 25 bp, Mus musculus
gaatcaaaagaagtcctgggcatag

SEQ ID NO: 637634 - DNA, 25 bp, Mus musculus
gaatcaaaagcacccctgtcttcca

SEQ ID NO: 637635 - DNA, 25 bp, Mus musculus
gaatcaaaagcagccctgtcttcca

SEQ ID NO: 637636 - DNA, 25 bp, Mus musculus
gaatcaaacaagcaatatcagctgg

SEQ ID NO: 637637 - DNA, 25 bp, Mus musculus
gaatcaaacaaggaatatcagctgg

SEQ ID NO: 637638 - DNA, 25 bp, Mus musculus
gaatcaaagagtatctctgctccag

SEQ ID NO: 637639 - DNA, 25 bp, Mus musculus
gaatcaaagagtttctctgctccag

SEQ ID NO: 637640 - DNA, 25 bp, Mus musculus
gaatcaaatcctccgcactatggct

SEQ ID NO: 637641 - DNA, 25 bp, Mus musculus
gaatcaaatcctgcgcactatggct

SEQ ID NO: 637642 - DNA, 25 bp, Mus musculus
gaatcaaattctcgatgcctatgaa

SEQ ID NO: 637643 - DNA, 25 bp, Mus musculus
gaatcaaattctggatgcctatgaa

SEQ ID NO: 637644 - DNA, 25 bp, Mus musculus
gaatcaaatttgaaaacactataaa

SEQ ID NO: 637645 - DNA, 25 bp, Mus musculus
gaatcaaatttgtaaacactataaa

SEQ ID NO: 637646 - DNA, 25 bp, Mus musculus
gaatcaacaccgcagactcgagagt

SEQ ID NO: 637647 - DNA, 25 bp, Mus musculus
gaatcaacaccggagactcgagagt

SEQ ID NO: 637648 - DNA, 25 bp, Mus musculus
gaatcaacaggactgctgacttcct

SEQ ID NO: 637649 - DNA, 25 bp, Mus musculus
gaatcaacaggagtgctgacttcct

SEQ ID NO: 637650 - DNA, 25 bp, Mus musculus
gaatcaacgacaccaccaacgacaa

SEQ ID NO: 637651 - DNA, 25 bp, Mus musculus
gaatcaacgacagcaccaacgacaa

SEQ ID NO: 637652 - DNA, 25 bp, Mus musculus
gaatcaacggaaaaatgcgaagctg

SEQ ID NO: 637653 - DNA, 25 bp, Mus musculus
gaatcaacggaataatgcgaagctg

SEQ ID NO: 637654 - DNA, 25 bp, Mus musculus
gaatcaactctgctctggcactgcc

SEQ ID NO: 637655 - DNA, 25 bp, Mus musculus
gaatcaactctggtctggcactgcc

SEQ ID NO: 637656 - DNA, 25 bp, Mus musculus
gaatcaactgctcagaagcctctga

SEQ ID NO: 637657 - DNA, 25 bp, Mus musculus
gaatcaactgctgagaagcctctga

SEQ ID NO: 637658 - DNA, 25 bp, Mus musculus
gaatcaagcaccatcactctgctgg

SEQ ID NO: 637659 - DNA, 25 bp, Mus musculus
gaatcaagcaccttcactctgctgg

SEQ ID NO: 637660 - DNA, 25 bp, Mus musculus
gaatcaagcatgaacttccatcctt

SEQ ID NO: 637661 - DNA, 25 bp, Mus musculus
gaatcaagcatgcattcaagtggag

SEQ ID NO: 637662 - DNA, 25 bp, Mus musculus
gaatcaagcatggattcaagtggag

SEQ ID NO: 637663 - DNA, 25 bp, Mus musculus
gaatcaagcatgtacttccatcctt

SEQ ID NO: 637664 - DNA, 25 bp, Mus musculus
gaatcaagcattacgcataccggac

SEQ ID NO: 637665 - DNA, 25 bp, Mus musculus
gaatcaagcatttcgcataccggac

SEQ ID NO: 637666 - DNA, 25 bp, Mus musculus
gaatcaagtcaactctgaatccgac

SEQ ID NO: 637667 - DNA, 25 bp, Mus musculus
gaatcaagtcaagtctgaatccgac

SEQ ID NO: 637668 - DNA, 25 bp, Mus musculus
gaatcaagtgctctagactggccaa

SEQ ID NO: 637669 - DNA, 25 bp, Mus musculus
gaatcaagtgctgtagactggccaa

SEQ ID NO: 637670 - DNA, 25 bp, Mus musculus
gaatcaagttagagagtggcaacca

SEQ ID NO: 637671 - DNA, 25 bp, Mus musculus
gaatcaagttagtgagtggcaacca

SEQ ID NO: 637672 - DNA, 25 bp, Mus musculus
gaatcaatctcaacccactgaggac

SEQ ID NO: 637673 - DNA, 25 bp, Mus musculus
gaatcaatctcatcccactgaggac

SEQ ID NO: 637674 - DNA, 25 bp, Mus musculus
gaatcaatgccactctacgagtcag

SEQ ID NO: 637675 - DNA, 25 bp, Mus musculus
gaatcaatgccagtctacgagtcag

SEQ ID NO: 637676 - DNA, 25 bp, Mus musculus
gaatcaattaaacactgcattgtgt

SEQ ID NO: 637677 - DNA, 25 bp, Mus musculus
gaatcaattaaagactgcattgtgt

SEQ ID NO: 637678 - DNA, 25 bp, Mus musculus
gaatcacaaagtcgagagcaatgct

SEQ ID NO: 637679 - DNA, 25 bp, Mus musculus
gaatcacaaagtggagagcaatgct

SEQ ID NO: 637680 - DNA, 25 bp, Mus musculus
gaatcacacactcccgagggaaaag

SEQ ID NO: 637681 - DNA, 25 bp, Mus musculus
gaatcacacactgccgagggaaaag

SEQ ID NO: 637682 - DNA, 25 bp, Mus musculus
gaatcacacccacatgccactgagg

SEQ ID NO: 637683 - DNA, 25 bp, Mus musculus
gaatcacacccagatgccactgagg

SEQ ID NO: 637684 - DNA, 25 bp, Mus musculus
gaatcacagacaaccctcctctagg

SEQ ID NO: 637685 - DNA, 25 bp, Mus musculus
gaatcacagacatccctcctctagg

SEQ ID NO: 637686 - DNA, 25 bp, Mus musculus
gaatcacagagtctggtacgttcat

SEQ ID NO: 637687 - DNA, 25 bp, Mus musculus
gaatcacagagtgtggtacgttcat

SEQ ID NO: 637688 - DNA, 25 bp, Mus musculus
gaatcacaggaaatggataatcgtc

SEQ ID NO: 637689 - DNA, 25 bp, Mus musculus
gaatcacaggaattggataatcgtc

SEQ ID NO: 637690 - DNA, 25 bp, Mus musculus
gaatcacaggcccatgactgcggtg

SEQ ID NO: 637691 - DNA, 25 bp, Mus musculus
gaatcacaggccgatgactgcggtg

SEQ ID NO: 637692 - DNA, 25 bp, Mus musculus
gaatcacagggcagaggtggtctcc

SEQ ID NO: 637693 - DNA, 25 bp, Mus musculus
gaatcacagggctgaggtggtctcc

SEQ ID NO: 637694 - DNA, 25 bp, Mus musculus
gaatcacagtcacaaaaaggcattg

SEQ ID NO: 637695 - DNA, 25 bp, Mus musculus
gaatcacagtcagaaaaaggcattg

SEQ ID NO: 637696 - DNA, 25 bp, Mus musculus
gaatcacagtctcattcggatttgg

SEQ ID NO: 637697 - DNA, 25 bp, Mus musculus
gaatcacagtctgattcggatttgg

SEQ ID NO: 637698 - DNA, 25 bp, Mus musculus
gaatcaccactgatttaaccatgac

SEQ ID NO: 637699 - DNA, 25 bp, Mus musculus
gaatcaccactgttttaaccatgac

SEQ ID NO: 637700 - DNA, 25 bp, Mus musculus
gaatcaccatggctatcgagacagt

SEQ ID NO: 637701 - DNA, 25 bp, Mus musculus
gaatcaccatgggtatcgagacagt

SEQ ID NO: 637702 - DNA, 25 bp, Mus musculus
gaatcacggaatctgactggtatcg

SEQ ID NO: 637703 - DNA, 25 bp, Mus musculus
gaatcacggaatgtgactggtatcg

SEQ ID NO: 637704 - DNA, 25 bp, Mus musculus
gaatcacggtccaacaagacgtcca

SEQ ID NO: 637705 - DNA, 25 bp, Mus musculus
gaatcacggtcctacaagacgtcca

SEQ ID NO: 637706 - DNA, 25 bp, Mus musculus
gaatcacggtgacatggcgagcacc

SEQ ID NO: 637707 - DNA, 25 bp, Mus musculus
gaatcacggtgagatggcgagcacc

SEQ ID NO: 637708 - DNA, 25 bp, Mus musculus
gaatcactcaataagtgccaggtat

SEQ ID NO: 637709 - DNA, 25 bp, Mus musculus
gaatcactcaattagtgccaggtat

SEQ ID NO: 637710 - DNA, 25 bp, Mus musculus
gaatcactccgtattaactttggcc

SEQ ID NO: 637711 - DNA, 25 bp, Mus musculus
gaatcactccgttttaactttggcc

SEQ ID NO: 637712 - DNA, 25 bp, Mus musculus
gaatcactctttaggagtgctcagt

SEQ ID NO: 637713 - DNA, 25 bp, Mus musculus
gaatcactcttttggagtgctcagt

SEQ ID NO: 637714 - DNA, 25 bp, Mus musculus
gaatcactgcagattaactcctccc

SEQ ID NO: 637715 - DNA, 25 bp, Mus musculus
gaatcactgcagtttaactcctccc

SEQ ID NO: 637716 - DNA, 25 bp, Mus musculus
gaatcactgcggcagaatttcttct

SEQ ID NO: 637717 - DNA, 25 bp, Mus musculus
gaatcactgcgggagaatttcttct

SEQ ID NO: 637718 - DNA, 25 bp, Mus musculus
gaatcactggcccagtacaacgcca

SEQ ID NO: 637719 - DNA, 25 bp, Mus musculus
gaatcactggccgagtacaacgcca

SEQ ID NO: 637720 - DNA, 25 bp, Mus musculus
gaatcactggctccaataaacatcg

SEQ ID NO: 637721 - DNA, 25 bp, Mus musculus
gaatcactggctgcaataaacatcg

SEQ ID NO: 637722 - DNA, 25 bp, Mus musculus
gaatcagaaactctgcgtaccagtg

SEQ ID NO: 637723 - DNA, 25 bp, Mus musculus
gaatcagaaactgtgcgtaccagtg

SEQ ID NO: 637724 - DNA, 25 bp, Mus musculus
gaatcagaacgaacatgcacacatg

SEQ ID NO: 637725 - DNA, 25 bp, Mus musculus
gaatcagaacgatcatgcacacatg

SEQ ID NO: 637726 - DNA, 25 bp, Mus musculus
gaatcagacagcactgcacctggct

SEQ ID NO: 637727 - DNA, 25 bp, Mus musculus
gaatcagacagctctgcacctggct

SEQ ID NO: 637728 - DNA, 25 bp, Mus musculus
gaatcagacggcaagacgagaggcc

SEQ ID NO: 637729 - DNA, 25 bp, Mus musculus
gaatcagacggctagacgagaggcc

SEQ ID NO: 637730 - DNA, 25 bp, Mus musculus
gaatcagactacactaacaatgttg

SEQ ID NO: 637731 - DNA, 25 bp, Mus musculus
gaatcagactactctaacaatgttg

SEQ ID NO: 637732 - DNA, 25 bp, Mus musculus
gaatcagagcccactcggctgagct

SEQ ID NO: 637733 - DNA, 25 bp, Mus musculus
gaatcagagccctctcggctgagct

SEQ ID NO: 637734 - DNA, 25 bp, Mus musculus
gaatcagagcttccaagccagccgt

SEQ ID NO: 637735 - DNA, 25 bp, Mus musculus
gaatcagagcttgcaagccagccgt

SEQ ID NO: 637736 - DNA, 25 bp, Mus musculus
gaatcagcaccactgctcatggaga

SEQ ID NO: 637737 - DNA, 25 bp, Mus musculus
gaatcagcaccagtgctcatggaga

SEQ ID NO: 637738 - DNA, 25 bp, Mus musculus
gaatcagcagaaaatttgcatcagt

SEQ ID NO: 637739 - DNA, 25 bp, Mus musculus
gaatcagcagaatatttgcatcagt

SEQ ID NO: 637740 - DNA, 25 bp, Mus musculus
gaatcagcattcatgtcaaaatccc

SEQ ID NO: 637741 - DNA, 25 bp, Mus musculus
gaatcagcattcttgtcaaaatccc

SEQ ID NO: 637742 - DNA, 25 bp, Mus musculus
gaatcagccaagaaggttccaccat

SEQ ID NO: 637743 - DNA, 25 bp, Mus musculus
gaatcagccaagtaggttccaccat

SEQ ID NO: 637744 - DNA, 25 bp, Mus musculus
gaatcagccacacgcctgtgggacg

SEQ ID NO: 637745 - DNA, 25 bp, Mus musculus
gaatcagccacaggcctgtgggacg

SEQ ID NO: 637746 - DNA, 25 bp, Mus musculus
gaatcagccgatcgttacctcaagg

SEQ ID NO: 637747 - DNA, 25 bp, Mus musculus
gaatcagccgatggttacctcaagg

SEQ ID NO: 637748 - DNA, 25 bp, Mus musculus
gaatcagcctccagctcatcttctg

SEQ ID NO: 637749 - DNA, 25 bp, Mus musculus
gaatcagcctcctgctcatcttctg

SEQ ID NO: 637750 - DNA, 25 bp, Mus musculus
gaatcagcctgaagaagttctgccg

SEQ ID NO: 637751 - DNA, 25 bp, Mus musculus
gaatcagcctgatgaagttctgccg

SEQ ID NO: 637752 - DNA, 25 bp, Mus musculus
gaatcagcggatctagtggccttca

SEQ ID NO: 637753 - DNA, 25 bp, Mus musculus
gaatcagcggatgtagtggccttca

SEQ ID NO: 637754 - DNA, 25 bp, Mus musculus
gaatcagctgcccactttagcccat

SEQ ID NO: 637755 - DNA, 25 bp, Mus musculus
gaatcagctgccgactttagcccat

SEQ ID NO: 637756 - DNA, 25 bp, Mus musculus
gaatcagctggcatttgtgacaggc

SEQ ID NO: 637757 - DNA, 25 bp, Mus musculus
gaatcagctggcttttgtgacaggc

SEQ ID NO: 637758 - DNA, 25 bp, Mus musculus
gaatcaggaaaaaacagagtccttg

SEQ ID NO: 637759 - DNA, 25 bp, Mus musculus
gaatcaggaaaatacagagtccttg

SEQ ID NO: 637760 - DNA, 25 bp, Mus musculus
gaatcagggccaatgaaagaaacca

SEQ ID NO: 637761 - DNA, 25 bp, Mus musculus
gaatcagggccattgaaagaaacca

SEQ ID NO: 637762 - DNA, 25 bp, Mus musculus
gaatcagtcaatagagtccaaaggc

SEQ ID NO: 637763 - DNA, 25 bp, Mus musculus
gaatcagtcaattgagtccaaaggc

SEQ ID NO: 637764 - DNA, 25 bp, Mus musculus
gaatcagtcactctaaaaagtccca

SEQ ID NO: 637765 - DNA, 25 bp, Mus musculus
gaatcagtcactgtaaaaagtccca

SEQ ID NO: 637766 - DNA, 25 bp, Mus musculus
gaatcagtctggctgtacggaagac

SEQ ID NO: 637767 - DNA, 25 bp, Mus musculus
gaatcagtctgggtgtacggaagac

SEQ ID NO: 637768 - DNA, 25 bp, Mus musculus
gaatcagtggtcaatgtctcgaccc

SEQ ID NO: 637769 - DNA, 25 bp, Mus musculus
gaatcagtggtctatgtctcgaccc

SEQ ID NO: 637770 - DNA, 25 bp, Mus musculus
gaatcagtggtgcagaccctacagg

SEQ ID NO: 637771 - DNA, 25 bp, Mus musculus
gaatcagtggtggagaccctacagg

SEQ ID NO: 637772 - DNA, 25 bp, Mus musculus
gaatcagttctaaagcctgctctgg

SEQ ID NO: 637773 - DNA, 25 bp, Mus musculus
gaatcagttctatagcctgctctgg

SEQ ID NO: 637774 - DNA, 25 bp, Mus musculus
gaatcagtttgcctcccggagcagc

SEQ ID NO: 637775 - DNA, 25 bp, Mus musculus
gaatcagtttgcgtcccggagcagc

SEQ ID NO: 637776 - DNA, 25 bp, Mus musculus
gaatcatattccacaaaagccaaga

SEQ ID NO: 637777 - DNA, 25 bp, Mus musculus
gaatcatattcctcaaaagccaaga

SEQ ID NO: 637778 - DNA, 25 bp, Mus musculus
gaatcatcaactccagggtccttgt

SEQ ID NO: 637779 - DNA, 25 bp, Mus musculus
gaatcatcaactgcagggtccttgt

SEQ ID NO: 637780 - DNA, 25 bp, Mus musculus
gaatcatcagccctacgcttctggc

SEQ ID NO: 637781 - DNA, 25 bp, Mus musculus
gaatcatcagccgtacgcttctggc

SEQ ID NO: 637782 - DNA, 25 bp, Mus musculus
gaatcatcagctaattccctgaaag

SEQ ID NO: 637783 - DNA, 25 bp, Mus musculus
gaatcatcagcttattccctgaaag

SEQ ID NO: 637784 - DNA, 25 bp, Mus musculus
gaatcatcagtgcagtcaccgtctg

SEQ ID NO: 637785 - DNA, 25 bp, Mus musculus
gaatcatcagtggagtcaccgtctg

SEQ ID NO: 637786 - DNA, 25 bp, Mus musculus
gaatcatctgcaccttgtacacgac

SEQ ID NO: 637787 - DNA, 25 bp, Mus musculus
gaatcatctgcagcttgtacacgac

SEQ ID NO: 637788 - DNA, 25 bp, Mus musculus
gaatcatgacatcccattaagtgca

SEQ ID NO: 637789 - DNA, 25 bp, Mus musculus
gaatcatgacatgccattaagtgca

SEQ ID NO: 637790 - DNA, 25 bp, Mus musculus
gaatcatggactcttattatatgcc

SEQ ID NO: 637791 - DNA, 25 bp, Mus musculus
gaatcatggactgttattatatgcc

SEQ ID NO: 637792 - DNA, 25 bp, Mus musculus
gaatcattaccaagtagcctgtcag

SEQ ID NO: 637793 - DNA, 25 bp, Mus musculus
gaatcattaccatgtagcctgtcag

SEQ ID NO: 637794 - DNA, 25 bp, Mus musculus
gaatcattgattaacccaaggccag

SEQ ID NO: 637795 - DNA, 25 bp, Mus musculus
gaatcattgatttacccaaggccag

SEQ ID NO: 637796 - DNA, 25 bp, Mus musculus
gaatcattggagcttgtcaactcaa

SEQ ID NO: 637797 - DNA, 25 bp, Mus musculus
gaatcattggaggttgtcaactcaa

SEQ ID NO: 637798 - DNA, 25 bp, Mus musculus
gaatcattttcgctggttccctgta

SEQ ID NO: 637799 - DNA, 25 bp, Mus musculus
gaatcattttcggtggttccctgta

SEQ ID NO: 637800 - DNA, 25 bp, Mus musculus
gaatccaaaatgctacaaagaagta

SEQ ID NO: 637801 - DNA, 25 bp, Mus musculus
gaatccaaaatggtacaaagaagta

SEQ ID NO: 637802 - DNA, 25 bp, Mus musculus
gaatccaaacataagtccgattttg

SEQ ID NO: 637803 - DNA, 25 bp, Mus musculus
gaatccaaacattagtccgattttg

SEQ ID NO: 637804 - DNA, 25 bp, Mus musculus
gaatccaaagtgaacgggtgagcaa

SEQ ID NO: 637805 - DNA, 25 bp, Mus musculus
gaatccaaagtgtacgggtgagcaa

SEQ ID NO: 637806 - DNA, 25 bp, Mus musculus
gaatccaaatccaggatcgacgtgc

SEQ ID NO: 637807 - DNA, 25 bp, Mus musculus
gaatccaaatcctggatcgacgtgc

SEQ ID NO: 637808 - DNA, 25 bp, Mus musculus
gaatccaaatgaagaggcaggtcca

SEQ ID NO: 637809 - DNA, 25 bp, Mus musculus
gaatccaaatgatgaggcaggtcca

SEQ ID NO: 637810 - DNA, 25 bp, Mus musculus
gaatccaacgcccacaatgaggtgg

SEQ ID NO: 637811 - DNA, 25 bp, Mus musculus
gaatccaacgccgacaatgaggtgg

SEQ ID NO: 637812 - DNA, 25 bp, Mus musculus
gaatccaactacaccatccatctga

SEQ ID NO: 637813 - DNA, 25 bp, Mus musculus
gaatccaactactccatccatctga

SEQ ID NO: 637814 - DNA, 25 bp, Mus musculus
gaatccaagctgcatagcagcgctg

SEQ ID NO: 637815 - DNA, 25 bp, Mus musculus
gaatccaagctggatagcagcgctg

SEQ ID NO: 637816 - DNA, 25 bp, Mus musculus
gaatccaatttcactccagccacaa

SEQ ID NO: 637817 - DNA, 25 bp, Mus musculus
gaatccaatttctctccagccacaa

SEQ ID NO: 637818 - DNA, 25 bp, Mus musculus
gaatccacactacctctaatgagag

SEQ ID NO: 637819 - DNA, 25 bp, Mus musculus
gaatccacactagctctaatgagag

SEQ ID NO: 637820 - DNA, 25 bp, Mus musculus
gaatccacatctctcgccagtgaag

SEQ ID NO: 637821 - DNA, 25 bp, Mus musculus
gaatccacatctgtcgccagtgaag

SEQ ID NO: 637822 - DNA, 25 bp, Mus musculus
gaatccacattgacgcctttgcaga

SEQ ID NO: 637823 - DNA, 25 bp, Mus musculus
gaatccacattgtcgcctttgcaga

SEQ ID NO: 637824 - DNA, 25 bp, Mus musculus
gaatccaccagccacctgctgttga

SEQ ID NO: 637825 - DNA, 25 bp, Mus musculus
gaatccaccagcgacctgctgttga

SEQ ID NO: 637826 - DNA, 25 bp, Mus musculus
gaatccacccagaccagatgtccaa

SEQ ID NO: 637827 - DNA, 25 bp, Mus musculus
gaatccacccagtccagatgtccaa

SEQ ID NO: 637828 - DNA, 25 bp, Mus musculus
gaatccacgggcacagaaacaaagc

SEQ ID NO: 637829 - DNA, 25 bp, Mus musculus
gaatccacgggctcagaaacaaagc

SEQ ID NO: 637830 - DNA, 25 bp, Mus musculus
gaatccactcaaatctgtgtttgtg

SEQ ID NO: 637831 - DNA, 25 bp, Mus musculus
gaatccactcaattctgtgtttgtg

SEQ ID NO: 637832 - DNA, 25 bp, Mus musculus
gaatccactgttatagagccaaatg

SEQ ID NO: 637833 - DNA, 25 bp, Mus musculus
gaatccactgttttagagccaaatg

SEQ ID NO: 637834 - DNA, 25 bp, Mus musculus
gaatccagaatgagctctccagcgg

SEQ ID NO: 637835 - DNA, 25 bp, Mus musculus
gaatccagaatgtgctctccagcgg

SEQ ID NO: 637836 - DNA, 25 bp, Mus musculus
gaatccagatatcgttgctggagag

SEQ ID NO: 637837 - DNA, 25 bp, Mus musculus
gaatccagatatggttgctggagag

SEQ ID NO: 637838 - DNA, 25 bp, Mus musculus
gaatccagcagaacagcgcggagat

SEQ ID NO: 637839 - DNA, 25 bp, Mus musculus
gaatccagcagatcagcgcggagat

SEQ ID NO: 637840 - DNA, 25 bp, Mus musculus
gaatccagccataccggaaagcact

SEQ ID NO: 637841 - DNA, 25 bp, Mus musculus
gaatccagccattccggaaagcact

SEQ ID NO: 637842 - DNA, 25 bp, Mus musculus
gaatccagcggtcatcatgcaacag

SEQ ID NO: 637843 - DNA, 25 bp, Mus musculus
gaatccagcggtgatcatgcaacag

SEQ ID NO: 637844 - DNA, 25 bp, Mus musculus
gaatccaggaagatcccaacgggaa

SEQ ID NO: 637845 - DNA, 25 bp, Mus musculus
gaatccaggaagttcccaacgggaa

SEQ ID NO: 637846 - DNA, 25 bp, Mus musculus
gaatccaggctaatggcatccagcg

SEQ ID NO: 637847 - DNA, 25 bp, Mus musculus
gaatccaggctattggcatccagcg

SEQ ID NO: 637848 - DNA, 25 bp, Mus musculus
gaatccaggtcaaggctctttatga

SEQ ID NO: 637849 - DNA, 25 bp, Mus musculus
gaatccaggtcatggctctttatga

SEQ ID NO: 637850 - DNA, 25 bp, Mus musculus
gaatccagtactcactttgcaacac

SEQ ID NO: 637851 - DNA, 25 bp, Mus musculus
gaatccagtactgactttgcaacac

SEQ ID NO: 637852 - DNA, 25 bp, Mus musculus
gaatccagtggaatgaaatgcttga

SEQ ID NO: 637853 - DNA, 25 bp, Mus musculus
gaatccagtggaccccaaagtccta

SEQ ID NO: 637854 - DNA, 25 bp, Mus musculus
gaatccagtggagcccaaagtccta

SEQ ID NO: 637855 - DNA, 25 bp, Mus musculus
gaatccagtggattgaaatgcttga

SEQ ID NO: 637856 - DNA, 25 bp, Mus musculus
gaatccagtgtcataccagaaacca

SEQ ID NO: 637857 - DNA, 25 bp, Mus musculus
gaatccagtgtcttaccagaaacca

SEQ ID NO: 637858 - DNA, 25 bp, Mus musculus
gaatccagttcaatcttatgtacct

SEQ ID NO: 637859 - DNA, 25 bp, Mus musculus
gaatccagttcattcttatgtacct

SEQ ID NO: 637860 - DNA, 25 bp, Mus musculus
gaatccagttccactgtcgtatgtg

SEQ ID NO: 637861 - DNA, 25 bp, Mus musculus
gaatccagttcctctgtcgtatgtg

SEQ ID NO: 637862 - DNA, 25 bp, Mus musculus
gaatccagtttcatgtgtatcagat

SEQ ID NO: 637863 - DNA, 25 bp, Mus musculus
gaatccagtttcttgtgtatcagat

SEQ ID NO: 637864 - DNA, 25 bp, Mus musculus
gaatccatactgacaagtggcagca

SEQ ID NO: 637865 - DNA, 25 bp, Mus musculus
gaatccatactgtcaagtggcagca

SEQ ID NO: 637866 - DNA, 25 bp, Mus musculus
gaatccataggtcccatcgtggtgg

SEQ ID NO: 637867 - DNA, 25 bp, Mus musculus
gaatccataggtgccatcgtggtgg

SEQ ID NO: 637868 - DNA, 25 bp, Mus musculus
gaatccatcattccagctgcatgtt

SEQ ID NO: 637869 - DNA, 25 bp, Mus musculus
gaatccatcattgcagctgcatgtt

SEQ ID NO: 637870 - DNA, 25 bp, Mus musculus
gaatccatgacaaccgtatccgcaa

SEQ ID NO: 637871 - DNA, 25 bp, Mus musculus
gaatccatgacatccgtatccgcaa

SEQ ID NO: 637872 - DNA, 25 bp, Mus musculus
gaatccattctactccttggaaatg

SEQ ID NO: 637873 - DNA, 25 bp, Mus musculus
gaatccattctagtccttggaaatg

SEQ ID NO: 637874 - DNA, 25 bp, Mus musculus
gaatccattgaacgcaagcagggaa

SEQ ID NO: 637875 - DNA, 25 bp, Mus musculus
gaatccattgaaggcaagcagggaa

SEQ ID NO: 637876 - DNA, 25 bp, Mus musculus
gaatcccaaagtaggctctgacgcc

SEQ ID NO: 637877 - DNA, 25 bp, Mus musculus
gaatcccaaagttggctctgacgcc

SEQ ID NO: 637878 - DNA, 25 bp, Mus musculus
gaatcccaactactgccgcagcaaa

SEQ ID NO: 637879 - DNA, 25 bp, Mus musculus
gaatcccaactagtgccgcagcaaa

SEQ ID NO: 637880 - DNA, 25 bp, Mus musculus
gaatcccacagaaacccataatcac

SEQ ID NO: 637881 - DNA, 25 bp, Mus musculus
gaatcccacagatacccataatcac

SEQ ID NO: 637882 - DNA, 25 bp, Mus musculus
gaatcccagcctcgagtctggagag

SEQ ID NO: 637883 - DNA, 25 bp, Mus musculus
gaatcccagcctggagtctggagag

SEQ ID NO: 637884 - DNA, 25 bp, Mus musculus
gaatcccagctcatactgtgtgtgg

SEQ ID NO: 637885 - DNA, 25 bp, Mus musculus
gaatcccagctcttactgtgtgtgg

SEQ ID NO: 637886 - DNA, 25 bp, Mus musculus
gaatcccagtggctttgctcatccg

SEQ ID NO: 637887 - DNA, 25 bp, Mus musculus
gaatcccagtgggtttgctcatccg

SEQ ID NO: 637888 - DNA, 25 bp, Mus musculus
gaatcccagttgacttcagaagtac

SEQ ID NO: 637889 - DNA, 25 bp, Mus musculus
gaatcccagttgtcttcagaagtac

SEQ ID NO: 637890 - DNA, 25 bp, Mus musculus
gaatcccatcatcctgccactgtgg

SEQ ID NO: 637891 - DNA, 25 bp, Mus musculus
gaatcccatcatgctgccactgtgg

SEQ ID NO: 637892 - DNA, 25 bp, Mus musculus
gaatccccagaacatcagagttcaa

SEQ ID NO: 637893 - DNA, 25 bp, Mus musculus
gaatccccagaagatcagagttcaa

SEQ ID NO: 637894 - DNA, 25 bp, Mus musculus
gaatccccaggcctcctgggagttt

SEQ ID NO: 637895 - DNA, 25 bp, Mus musculus
gaatccccaggcgtcctgggagttt

SEQ ID NO: 637896 - DNA, 25 bp, Mus musculus
gaatccccatcaacatgaactggca

SEQ ID NO: 637897 - DNA, 25 bp, Mus musculus
gaatccccatcatcatgaactggca

SEQ ID NO: 637898 - DNA, 25 bp, Mus musculus
gaatcccgactgaaacatctgttgc

SEQ ID NO: 637899 - DNA, 25 bp, Mus musculus
gaatcccgactgtaacatctgttgc

SEQ ID NO: 637900 - DNA, 25 bp, Mus musculus
gaatcccgatgacgacttcagctga

SEQ ID NO: 637901 - DNA, 25 bp, Mus musculus
gaatcccgatgaggacttcagctga

SEQ ID NO: 637902 - DNA, 25 bp, Mus musculus
gaatcccgcctaagagtgggacagg

SEQ ID NO: 637903 - DNA, 25 bp, Mus musculus
gaatcccgcctatgagtgggacagg

SEQ ID NO: 637904 - DNA, 25 bp, Mus musculus
gaatcccgctcgctgaagagagtac

SEQ ID NO: 637905 - DNA, 25 bp, Mus musculus
gaatcccgctcggtgaagagagtac

SEQ ID NO: 637906 - DNA, 25 bp, Mus musculus
gaatcccgtcgtcgagtggtcgtcc

SEQ ID NO: 637907 - DNA, 25 bp, Mus musculus
gaatcccgtcgtggagtggtcgtcc

SEQ ID NO: 637908 - DNA, 25 bp, Mus musculus
gaatccctaaacagggtttgccagc

SEQ ID NO: 637909 - DNA, 25 bp, Mus musculus
gaatccctaaactgggtttgccagc

SEQ ID NO: 637910 - DNA, 25 bp, Mus musculus
gaatccctacgtcgtggagtgtaca

SEQ ID NO: 637911 - DNA, 25 bp, Mus musculus
gaatccctacgtggtggagtgtaca

SEQ ID NO: 637912 - DNA, 25 bp, Mus musculus
gaatccctccaacaccgtgtgtata

SEQ ID NO: 637913 - DNA, 25 bp, Mus musculus
gaatccctccaagaccgtgtgtata

SEQ ID NO: 637914 - DNA, 25 bp, Mus musculus
gaatccctgaaccatggaatttccc

SEQ ID NO: 637915 - DNA, 25 bp, Mus musculus
gaatccctgaacgatggaatttccc

SEQ ID NO: 637916 - DNA, 25 bp, Mus musculus
gaatccctgaagctcttcgacagca

SEQ ID NO: 637917 - DNA, 25 bp, Mus musculus
gaatccctgaaggtcttcgacagca

SEQ ID NO: 637918 - DNA, 25 bp, Mus musculus
gaatccctggatacagaggctggca

SEQ ID NO: 637919 - DNA, 25 bp, Mus musculus
gaatccctggatcacatggacttcc

SEQ ID NO: 637920 - DNA, 25 bp, Mus musculus
gaatccctggatgacatggacttcc

SEQ ID NO: 637921 - DNA, 25 bp, Mus musculus
gaatccctggattcagaggctggca

SEQ ID NO: 637922 - DNA, 25 bp, Mus musculus
gaatccctggttaccgaggagacaa

SEQ ID NO: 637923 - DNA, 25 bp, Mus musculus
gaatccctggtttccgaggagacaa

SEQ ID NO: 637924 - DNA, 25 bp, Mus musculus
gaatcccttgctcagtctttacacc

SEQ ID NO: 637925 - DNA, 25 bp, Mus musculus
gaatcccttgctgagtctttacacc

SEQ ID NO: 637926 - DNA, 25 bp, Mus musculus
gaatcccttttgaacccatagtgag

SEQ ID NO: 637927 - DNA, 25 bp, Mus musculus
gaatcccttttgtacccatagtgag

SEQ ID NO: 637928 - DNA, 25 bp, Mus musculus
gaatccgaactaaagttctcgggag

SEQ ID NO: 637929 - DNA, 25 bp, Mus musculus
gaatccgaactatagttctcgggag

SEQ ID NO: 637930 - DNA, 25 bp, Mus musculus
gaatccgagacacctgccagagggc

SEQ ID NO: 637931 - DNA, 25 bp, Mus musculus
gaatccgagacagctgccagagggc

SEQ ID NO: 637932 - DNA, 25 bp, Mus musculus
gaatccgcattgacagcctctcggc

SEQ ID NO: 637933 - DNA, 25 bp, Mus musculus
gaatccgcattgtcagcctctcggc

SEQ ID NO: 637934 - DNA, 25 bp, Mus musculus
gaatccgcctgaaagcaagtcgagg

SEQ ID NO: 637935 - DNA, 25 bp, Mus musculus
gaatccgcctgatagcaagtcgagg

SEQ ID NO: 637936 - DNA, 25 bp, Mus musculus
gaatccgctgagcaaattcaagctg

SEQ ID NO: 637937 - DNA, 25 bp, Mus musculus
gaatccgctgaggaaattcaagctg

SEQ ID NO: 637938 - DNA, 25 bp, Mus musculus
gaatccgcttaacagcacccagtgg

SEQ ID NO: 637939 - DNA, 25 bp, Mus musculus
gaatccgcttaagagcacccagtgg

SEQ ID NO: 637940 - DNA, 25 bp, Mus musculus
gaatccggatctcactggacaagcg

SEQ ID NO: 637941 - DNA, 25 bp, Mus musculus
gaatccggatctgactggacaagcg

SEQ ID NO: 637942 - DNA, 25 bp, Mus musculus
gaatccggcaaaaccaaactaccag

SEQ ID NO: 637943 - DNA, 25 bp, Mus musculus
gaatccggcaaatccaaactaccag

SEQ ID NO: 637944 - DNA, 25 bp, Mus musculus
gaatccggctcaagagagacaacag

SEQ ID NO: 637945 - DNA, 25 bp, Mus musculus
gaatccggctcatgagagacaacag

SEQ ID NO: 637946 - DNA, 25 bp, Mus musculus
gaatccgggaagagcactattgtca

SEQ ID NO: 637947 - DNA, 25 bp, Mus musculus
gaatccgggaagtgcactattgtca

SEQ ID NO: 637948 - DNA, 25 bp, Mus musculus
gaatccgggatactcttcggcgcgt

SEQ ID NO: 637949 - DNA, 25 bp, Mus musculus
gaatccgggatagtcttcggcgcgt

SEQ ID NO: 637950 - DNA, 25 bp, Mus musculus
gaatccgtccaaccttccagacagg

SEQ ID NO: 637951 - DNA, 25 bp, Mus musculus
gaatccgtccaagcttccagacagg

SEQ ID NO: 637952 - DNA, 25 bp, Mus musculus
gaatccgtttggctccctgatgtgg

SEQ ID NO: 637953 - DNA, 25 bp, Mus musculus
gaatccgtttgggtccctgatgtgg

SEQ ID NO: 637954 - DNA, 25 bp, Mus musculus
gaatcctacaagacgcagtacaggg

SEQ ID NO: 637955 - DNA, 25 bp, Mus musculus
gaatcctacaagtcgcagtacaggg

SEQ ID NO: 637956 - DNA, 25 bp, Mus musculus
gaatcctagagccatgcaggcgctg

SEQ ID NO: 637957 - DNA, 25 bp, Mus musculus
gaatcctagagcgatgcaggcgctg

SEQ ID NO: 637958 - DNA, 25 bp, Mus musculus
gaatcctagatgaggacctgtgcgg

SEQ ID NO: 637959 - DNA, 25 bp, Mus musculus
gaatcctagatgtggacctgtgcgg

SEQ ID NO: 637960 - DNA, 25 bp, Mus musculus
gaatcctagcagatcttgaggaaga

SEQ ID NO: 637961 - DNA, 25 bp, Mus musculus
gaatcctagcagttcttgaggaaga

SEQ ID NO: 637962 - DNA, 25 bp, Mus musculus
gaatcctatacccaattcagggtgg

SEQ ID NO: 637963 - DNA, 25 bp, Mus musculus
gaatcctataccgaattcagggtgg

SEQ ID NO: 637964 - DNA, 25 bp, Mus musculus
gaatcctatcacacagtatgttcag

SEQ ID NO: 637965 - DNA, 25 bp, Mus musculus
gaatcctatcactcagtatgttcag

SEQ ID NO: 637966 - DNA, 25 bp, Mus musculus
gaatcctatgataaaagttatccag

SEQ ID NO: 637967 - DNA, 25 bp, Mus musculus
gaatcctatgattaaagttatccag

SEQ ID NO: 637968 - DNA, 25 bp, Mus musculus
gaatcctatgttagcttgtctggaa

SEQ ID NO: 637969 - DNA, 25 bp, Mus musculus
gaatcctatgtttgcttgtctggaa

SEQ ID NO: 637970 - DNA, 25 bp, Mus musculus
gaatcctcaatgaacgagacaactg

SEQ ID NO: 637971 - DNA, 25 bp, Mus musculus
gaatcctcaatgtacgagacaactg

SEQ ID NO: 637972 - DNA, 25 bp, Mus musculus
gaatcctccagaaggaatcgtggca

SEQ ID NO: 637973 - DNA, 25 bp, Mus musculus
gaatcctccagatggaatcgtggca

SEQ ID NO: 637974 - DNA, 25 bp, Mus musculus
gaatcctccgtaccgaaggttgacg

SEQ ID NO: 637975 - DNA, 25 bp, Mus musculus
gaatcctccgtagcgaaggttgacg

SEQ ID NO: 637976 - DNA, 25 bp, Mus musculus
gaatcctcgattaatcagcccaaag

SEQ ID NO: 637977 - DNA, 25 bp, Mus musculus
gaatcctcgatttatcagcccaaag

SEQ ID NO: 637978 - DNA, 25 bp, Mus musculus
gaatcctctagccaagttacatggc

SEQ ID NO: 637979 - DNA, 25 bp, Mus musculus
gaatcctctagcgaagttacatggc

SEQ ID NO: 637980 - DNA, 25 bp, Mus musculus
gaatcctctttcctgccttccagag

SEQ ID NO: 637981 - DNA, 25 bp, Mus musculus
gaatcctctttcgtgccttccagag

SEQ ID NO: 637982 - DNA, 25 bp, Mus musculus
gaatcctgacctctgtgaagagatg

SEQ ID NO: 637983 - DNA, 25 bp, Mus musculus
gaatcctgacctgtgtgaagagatg

SEQ ID NO: 637984 - DNA, 25 bp, Mus musculus
gaatcctgacgaattctctagggct

SEQ ID NO: 637985 - DNA, 25 bp, Mus musculus
gaatcctgacgatttctctagggct

SEQ ID NO: 637986 - DNA, 25 bp, Mus musculus
gaatcctgatctatcaatcctcccg

SEQ ID NO: 637987 - DNA, 25 bp, Mus musculus
gaatcctgatctttcaatcctcccg

SEQ ID NO: 637988 - DNA, 25 bp, Mus musculus
gaatcctgccaccatctaagtgagc

SEQ ID NO: 637989 - DNA, 25 bp, Mus musculus
gaatcctgccacgatctaagtgagc

SEQ ID NO: 637990 - DNA, 25 bp, Mus musculus
gaatcctgccagaatttctacaaag

SEQ ID NO: 637991 - DNA, 25 bp, Mus musculus
gaatcctgccagtatttctacaaag

SEQ ID NO: 637992 - DNA, 25 bp, Mus musculus
gaatcctgctgacttagatgacctc

SEQ ID NO: 637993 - DNA, 25 bp, Mus musculus
gaatcctgctgagttagatgacctc

SEQ ID NO: 637994 - DNA, 25 bp, Mus musculus
gaatcctggaccagcgcatagccac

SEQ ID NO: 637995 - DNA, 25 bp, Mus musculus
gaatcctggacctgcgcatagccac

SEQ ID NO: 637996 - DNA, 25 bp, Mus musculus
gaatcctgggaacaggcaagagccc

SEQ ID NO: 637997 - DNA, 25 bp, Mus musculus
gaatcctgggaagaggcaagagccc

SEQ ID NO: 637998 - DNA, 25 bp, Mus musculus
gaatcctgggatccagggcatgagt

SEQ ID NO: 637999 - DNA, 25 bp, Mus musculus
gaatcctgggatgcagggcatgagt

SEQ ID NO: 638000 - DNA, 25 bp, Mus musculus
gaatcctgtgccataataataaaca

SEQ ID NO: 638001 - DNA, 25 bp, Mus musculus
gaatcctgtgccttaataataaaca

SEQ ID NO: 638002 - DNA, 25 bp, Mus musculus
gaatcctgttatcagactccaagca

SEQ ID NO: 638003 - DNA, 25 bp, Mus musculus
gaatcctgttatgagactccaagca

SEQ ID NO: 638004 - DNA, 25 bp, Mus musculus
gaatccttaccactacagtgcgcag

SEQ ID NO: 638005 - DNA, 25 bp, Mus musculus
gaatccttaccagtacagtgcgcag

SEQ ID NO: 638006 - DNA, 25 bp, Mus musculus
gaatccttagagaaccgggtacctg

SEQ ID NO: 638007 - DNA, 25 bp, Mus musculus
gaatccttagagtaccgggtacctg

SEQ ID NO: 638008 - DNA, 25 bp, Mus musculus
gaatccttccctctatcttataaag

SEQ ID NO: 638009 - DNA, 25 bp, Mus musculus
gaatccttccctgtatcttataaag

SEQ ID NO: 638010 - DNA, 25 bp, Mus musculus
gaatccttcggaagggcagaggtca

SEQ ID NO: 638011 - DNA, 25 bp, Mus musculus
gaatccttcggatgggcagaggtca

SEQ ID NO: 638012 - DNA, 25 bp, Mus musculus
gaatccttctctcggaaatctattc

SEQ ID NO: 638013 - DNA, 25 bp, Mus musculus
gaatccttctctgggaaatctattc

SEQ ID NO: 638014 - DNA, 25 bp, Mus musculus
gaatccttgaatcaagtaggctatg

SEQ ID NO: 638015 - DNA, 25 bp, Mus musculus
gaatccttgaatgaagtaggctatg

SEQ ID NO: 638016 - DNA, 25 bp, Mus musculus
gaatcctttcgacttggccttctcc

SEQ ID NO: 638017 - DNA, 25 bp, Mus musculus
gaatcctttcgagttggccttctcc

SEQ ID NO: 638018 - DNA, 25 bp, Mus musculus
gaatcgacggtcaggcaggaaagct

SEQ ID NO: 638019 - DNA, 25 bp, Mus musculus
gaatcgacggtctggcaggaaagct

SEQ ID NO: 638020 - DNA, 25 bp, Mus musculus
gaatcgagaaagaacaaccctgaaa

SEQ ID NO: 638021 - DNA, 25 bp, Mus musculus
gaatcgagaaagtacaaccctgaaa

SEQ ID NO: 638022 - DNA, 25 bp, Mus musculus
gaatcgaggctaatcctttgaggaa

SEQ ID NO: 638023 - DNA, 25 bp, Mus musculus
gaatcgaggctattcctttgaggaa

SEQ ID NO: 638024 - DNA, 25 bp, Mus musculus
gaatcgagtcctcgctatggagcat

SEQ ID NO: 638025 - DNA, 25 bp, Mus musculus
gaatcgagtcctggctatggagcat

SEQ ID NO: 638026 - DNA, 25 bp, Mus musculus
gaatcgagtgaacgctatgcttaca

SEQ ID NO: 638027 - DNA, 25 bp, Mus musculus
gaatcgagtgaaggctatgcttaca

SEQ ID NO: 638028 - DNA, 25 bp, Mus musculus
gaatcgatctcccatggatactgag

SEQ ID NO: 638029 - DNA, 25 bp, Mus musculus
gaatcgatctccgatggatactgag

SEQ ID NO: 638030 - DNA, 25 bp, Mus musculus
gaatcgcacgtccacaccggtgcgg

SEQ ID NO: 638031 - DNA, 25 bp, Mus musculus
gaatcgcacgtcgacaccggtgcgg

SEQ ID NO: 638032 - DNA, 25 bp, Mus musculus
gaatcgcagcggatatactgggaga

SEQ ID NO: 638033 - DNA, 25 bp, Mus musculus
gaatcgcagcggttatactgggaga

SEQ ID NO: 638034 - DNA, 25 bp, Mus musculus
gaatcgcagtctcagctggatgaag

SEQ ID NO: 638035 - DNA, 25 bp, Mus musculus
gaatcgcagtctgagctggatgaag

SEQ ID NO: 638036 - DNA, 25 bp, Mus musculus
gaatcgcagtgaactgtgtccagaa

SEQ ID NO: 638037 - DNA, 25 bp, Mus musculus
gaatcgcagtgatctgtgtccagaa

SEQ ID NO: 638038 - DNA, 25 bp, Mus musculus
gaatcgccagagctgtaaaacttca

SEQ ID NO: 638039 - DNA, 25 bp, Mus musculus
gaatcgccagaggtgtaaaacttca

SEQ ID NO: 638040 - DNA, 25 bp, Mus musculus
gaatcgccttccacagaaaccagta

SEQ ID NO: 638041 - DNA, 25 bp, Mus musculus
gaatcgccttcctcagaaaccagta

SEQ ID NO: 638042 - DNA, 25 bp, Mus musculus
gaatcgctaggaagcctatcctgga

SEQ ID NO: 638043 - DNA, 25 bp, Mus musculus
gaatcgctaggatgcctatcctgga

SEQ ID NO: 638044 - DNA, 25 bp, Mus musculus
gaatcgctcagaatacatgttccag

SEQ ID NO: 638045 - DNA, 25 bp, Mus musculus
gaatcgctcagattacatgttccag

SEQ ID NO: 638046 - DNA, 25 bp, Mus musculus
gaatcgctgtttcatgtgcaggaag

SEQ ID NO: 638047 - DNA, 25 bp, Mus musculus
gaatcgctgtttgatgtgcaggaag

SEQ ID NO: 638048 - DNA, 25 bp, Mus musculus
gaatcgcttattcgatagcttagaa

SEQ ID NO: 638049 - DNA, 25 bp, Mus musculus
gaatcgcttattggatagcttagaa

SEQ ID NO: 638050 - DNA, 25 bp, Mus musculus
gaatcgctttatcacaccggttaga

SEQ ID NO: 638051 - DNA, 25 bp, Mus musculus
gaatcgctttatgacaccggttaga

SEQ ID NO: 638052 - DNA, 25 bp, Mus musculus
gaatcggaacaacctgactgaccct

SEQ ID NO: 638053 - DNA, 25 bp, Mus musculus
gaatcggaacaagctgactgaccct

SEQ ID NO: 638054 - DNA, 25 bp, Mus musculus
gaatcggaggagacggtgcccaacc

SEQ ID NO: 638055 - DNA, 25 bp, Mus musculus
gaatcggaggagtcggtgcccaacc

SEQ ID NO: 638056 - DNA, 25 bp, Mus musculus
gaatcggatatcaccaaggagagaa

SEQ ID NO: 638057 - DNA, 25 bp, Mus musculus
gaatcggatatctccaaggagagaa

SEQ ID NO: 638058 - DNA, 25 bp, Mus musculus
gaatcggcagtcacattcgcccgaa

SEQ ID NO: 638059 - DNA, 25 bp, Mus musculus
gaatcggcagtctcattcgcccgaa

SEQ ID NO: 638060 - DNA, 25 bp, Mus musculus
gaatcggcctggcaatgccttagag

SEQ ID NO: 638061 - DNA, 25 bp, Mus musculus
gaatcggcctgggaatgccttagag

SEQ ID NO: 638062 - DNA, 25 bp, Mus musculus
gaatcgggcaacagaaagccaagct

SEQ ID NO: 638063 - DNA, 25 bp, Mus musculus
gaatcgggcaactgaaagccaagct

SEQ ID NO: 638064 - DNA, 25 bp, Mus musculus
gaatcggtcaaacagaacatggccc

SEQ ID NO: 638065 - DNA, 25 bp, Mus musculus
gaatcggtcaaagagaacatggccc

SEQ ID NO: 638066 - DNA, 25 bp, Mus musculus
gaatcggtgagcacacaccgggaga

SEQ ID NO: 638067 - DNA, 25 bp, Mus musculus
gaatcggtgagctcacaccgggaga

SEQ ID NO: 638068 - DNA, 25 bp, Mus musculus
gaatcggttaccatctcaagagtgg

SEQ ID NO: 638069 - DNA, 25 bp, Mus musculus
gaatcggttaccttctcaagagtgg

SEQ ID NO: 638070 - DNA, 25 bp, Mus musculus
gaatcgtacaagaacttcccttcct

SEQ ID NO: 638071 - DNA, 25 bp, Mus musculus
gaatcgtacaagtacttcccttcct

SEQ ID NO: 638072 - DNA, 25 bp, Mus musculus
gaatcgtacccacctggtcagcgtg

SEQ ID NO: 638073 - DNA, 25 bp, Mus musculus
gaatcgtacccagctggtcagcgtg

SEQ ID NO: 638074 - DNA, 25 bp, Mus musculus
gaatcgtctataagagggaccggag

SEQ ID NO: 638075 - DNA, 25 bp, Mus musculus
gaatcgtctatatgagggaccggag

SEQ ID NO: 638076 - DNA, 25 bp, Mus musculus
gaatcgtcttcgacgtcatcgtcat

SEQ ID NO: 638077 - DNA, 25 bp, Mus musculus
gaatcgtcttcgtcgtcatcgtcat

SEQ ID NO: 638078 - DNA, 25 bp, Mus musculus
gaatcgtgcagtacttacgcctcct

SEQ ID NO: 638079 - DNA, 25 bp, Mus musculus
gaatcgtgcagttcttacgcctcct

SEQ ID NO: 638080 - DNA, 25 bp, Mus musculus
gaatcgtgtcctcagctggcaaatt

SEQ ID NO: 638081 - DNA, 25 bp, Mus musculus
gaatcgtgtcctgagctggcaaatt

SEQ ID NO: 638082 - DNA, 25 bp, Mus musculus
gaatcgtgtggacacgtcacctacc

SEQ ID NO: 638083 - DNA, 25 bp, Mus musculus
gaatcgtgtggagacgtcacctacc

SEQ ID NO: 638084 - DNA, 25 bp, Mus musculus
gaatcgttagcaacataaaccaggt

SEQ ID NO: 638085 - DNA, 25 bp, Mus musculus
gaatcgttagcatcataaaccaggt

SEQ ID NO: 638086 - DNA, 25 bp, Mus musculus
gaatcgttatgacatggccacatac

SEQ ID NO: 638087 - DNA, 25 bp, Mus musculus
gaatcgttatgagatggccacatac

SEQ ID NO: 638088 - DNA, 25 bp, Mus musculus
gaatcgttcaataggagcagcagct

SEQ ID NO: 638089 - DNA, 25 bp, Mus musculus
gaatcgttcaattggagcagcagct

SEQ ID NO: 638090 - DNA, 25 bp, Mus musculus
gaatcgttccttcatttgtctcttc

SEQ ID NO: 638091 - DNA, 25 bp, Mus musculus
gaatcgttccttgatttgtctcttc

SEQ ID NO: 638092 - DNA, 25 bp, Mus musculus
gaatcgttcgggaggctgagcctcc

SEQ ID NO: 638093 - DNA, 25 bp, Mus musculus
gaatcgttcgggtggctgagcctcc

SEQ ID NO: 638094 - DNA, 25 bp, Mus musculus
gaatctaaaacaatgagccctggtg

SEQ ID NO: 638095 - DNA, 25 bp, Mus musculus
gaatctaaaacattgagccctggtg

SEQ ID NO: 638096 - DNA, 25 bp, Mus musculus
gaatctaaacaaatatgaggtggag

SEQ ID NO: 638097 - DNA, 25 bp, Mus musculus
gaatctaaacaattatgaggtggag

SEQ ID NO: 638098 - DNA, 25 bp, Mus musculus
gaatctaagcagagcggtgaggccc

SEQ ID NO: 638099 - DNA, 25 bp, Mus musculus
gaatctaagcagtgcggtgaggccc

SEQ ID NO: 638100 - DNA, 25 bp, Mus musculus
gaatctaagcctcgaaggcctgcag

SEQ ID NO: 638101 - DNA, 25 bp, Mus musculus
gaatctaagcctggaaggcctgcag

SEQ ID NO: 638102 - DNA, 25 bp, Mus musculus
gaatctacaagaaggaagtccctgg

SEQ ID NO: 638103 - DNA, 25 bp, Mus musculus
gaatctacaagatggaagtccctgg

SEQ ID NO: 638104 - DNA, 25 bp, Mus musculus
gaatctacagctaccagatggccct

SEQ ID NO: 638105 - DNA, 25 bp, Mus musculus
gaatctacagcttccagatggccct

SEQ ID NO: 638106 - DNA, 25 bp, Mus musculus
gaatctaccaacaggcgttccctta

SEQ ID NO: 638107 - DNA, 25 bp, Mus musculus
gaatctaccaactggcgttccctta

SEQ ID NO: 638108 - DNA, 25 bp, Mus musculus
gaatctaccattataaccaagaaag

SEQ ID NO: 638109 - DNA, 25 bp, Mus musculus
gaatctaccattttaaccaagaaag

SEQ ID NO: 638110 - DNA, 25 bp, Mus musculus
gaatctaccctacggtgtgacccca

SEQ ID NO: 638111 - DNA, 25 bp, Mus musculus
gaatctaccctagggtgtgacccca

SEQ ID NO: 638112 - DNA, 25 bp, Mus musculus
gaatctactaagaaaacatggcctt

SEQ ID NO: 638113 - DNA, 25 bp, Mus musculus
gaatctactaagtaaacatggcctt

SEQ ID NO: 638114 - DNA, 25 bp, Mus musculus
gaatctactctcagttgcctacaag

SEQ ID NO: 638115 - DNA, 25 bp, Mus musculus
gaatctactctctgttgcctacaag

SEQ ID NO: 638116 - DNA, 25 bp, Mus musculus
gaatctacttagaaagtgaacacgg

SEQ ID NO: 638117 - DNA, 25 bp, Mus musculus
gaatctacttagtaagtgaacacgg

SEQ ID NO: 638118 - DNA, 25 bp, Mus musculus
gaatctacttcactagggtttggag

SEQ ID NO: 638119 - DNA, 25 bp, Mus musculus
gaatctacttcagtagggtttggag

SEQ ID NO: 638120 - DNA, 25 bp, Mus musculus
gaatctagattcaagaggccagggt

SEQ ID NO: 638121 - DNA, 25 bp, Mus musculus
gaatctagattctagaggccagggt

SEQ ID NO: 638122 - DNA, 25 bp, Mus musculus
gaatctagccaaatttgtgcagacc

SEQ ID NO: 638123 - DNA, 25 bp, Mus musculus
gaatctagccaattttgtgcagacc

SEQ ID NO: 638124 - DNA, 25 bp, Mus musculus
gaatctagtcggaccaaatttcggg

SEQ ID NO: 638125 - DNA, 25 bp, Mus musculus
gaatctagtcggtccaaatttcggg

SEQ ID NO: 638126 - DNA, 25 bp, Mus musculus
gaatctatagataacgtgcccatgt

SEQ ID NO: 638127 - DNA, 25 bp, Mus musculus
gaatctatagattacgtgcccatgt

SEQ ID NO: 638128 - DNA, 25 bp, Mus musculus
gaatctatataaccggctcatccat

SEQ ID NO: 638129 - DNA, 25 bp, Mus musculus
gaatctatataagcggctcatccat

SEQ ID NO: 638130 - DNA, 25 bp, Mus musculus
gaatctatgcaaacgtgaggatggt

SEQ ID NO: 638131 - DNA, 25 bp, Mus musculus
gaatctatgcaatcgtgaggatggt

SEQ ID NO: 638132 - DNA, 25 bp, Mus musculus
gaatctatggatcaactactaagca

SEQ ID NO: 638133 - DNA, 25 bp, Mus musculus
gaatctatggatgaactactaagca

SEQ ID NO: 638134 - DNA, 25 bp, Mus musculus
gaatctattcttaaccagtgggtgg

SEQ ID NO: 638135 - DNA, 25 bp, Mus musculus
gaatctattctttaccagtgggtgg

SEQ ID NO: 638136 - DNA, 25 bp, Mus musculus
gaatctcactatatcctggatccca

SEQ ID NO: 638137 - DNA, 25 bp, Mus musculus
gaatctcactatccttcaggtcttc

SEQ ID NO: 638138 - DNA, 25 bp, Mus musculus
gaatctcactatgcttcaggtcttc

SEQ ID NO: 638139 - DNA, 25 bp, Mus musculus
gaatctcactatttcctggatccca

SEQ ID NO: 638140 - DNA, 25 bp, Mus musculus
gaatctcactgacttgggatatttt

SEQ ID NO: 638141 - DNA, 25 bp, Mus musculus
gaatctcactgagttgggatatttt

SEQ ID NO: 638142 - DNA, 25 bp, Mus musculus
gaatctcagaataggcgctatgcta

SEQ ID NO: 638143 - DNA, 25 bp, Mus musculus
gaatctcagaattggcgctatgcta

SEQ ID NO: 638144 - DNA, 25 bp, Mus musculus
gaatctcagcaaatgcttggaagac

SEQ ID NO: 638145 - DNA, 25 bp, Mus musculus
gaatctcagcaattgcttggaagac

SEQ ID NO: 638146 - DNA, 25 bp, Mus musculus
gaatctcatcctcgctatgctcggg

SEQ ID NO: 638147 - DNA, 25 bp, Mus musculus
gaatctcatcctggctatgctcggg

SEQ ID NO: 638148 - DNA, 25 bp, Mus musculus
gaatctcatgggatcagtacggaaa

SEQ ID NO: 638149 - DNA, 25 bp, Mus musculus
gaatctcatgggttcagtacggaaa

SEQ ID NO: 638150 - DNA, 25 bp, Mus musculus
gaatctccgaaacacaaactccacg

SEQ ID NO: 638151 - DNA, 25 bp, Mus musculus
gaatctccgaaagacaaactccacg

SEQ ID NO: 638152 - DNA, 25 bp, Mus musculus
gaatctccggttccattccaggctt

SEQ ID NO: 638153 - DNA, 25 bp, Mus musculus
gaatctccggttgcattccaggctt

SEQ ID NO: 638154 - DNA, 25 bp, Mus musculus
gaatctcctaaaatcaagatgggaa

SEQ ID NO: 638155 - DNA, 25 bp, Mus musculus
gaatctcctaaattcaagatgggaa

SEQ ID NO: 638156 - DNA, 25 bp, Mus musculus
gaatctcctatacctgtgatcccgg

SEQ ID NO: 638157 - DNA, 25 bp, Mus musculus
gaatctcctatagctgtgatcccgg

SEQ ID NO: 638158 - DNA, 25 bp, Mus musculus
gaatctcgcggtcatggatgacaag

SEQ ID NO: 638159 - DNA, 25 bp, Mus musculus
gaatctcgcggtgatggatgacaag

SEQ ID NO: 638160 - DNA, 25 bp, Mus musculus
gaatctctacataaagaacttggat

SEQ ID NO: 638161 - DNA, 25 bp, Mus musculus
gaatctctacattaagaacttggat

SEQ ID NO: 638162 - DNA, 25 bp, Mus musculus
gaatctctccacagtcttgaaagcc

SEQ ID NO: 638163 - DNA, 25 bp, Mus musculus
gaatctctccactgtcttgaaagcc

SEQ ID NO: 638164 - DNA, 25 bp, Mus musculus
gaatctctccgaaagaactcagcca

SEQ ID NO: 638165 - DNA, 25 bp, Mus musculus
gaatctctccgatagaactcagcca

SEQ ID NO: 638166 - DNA, 25 bp, Mus musculus
gaatctctccggcaactgtctgagg

SEQ ID NO: 638167 - DNA, 25 bp, Mus musculus
gaatctctccgggaactgtctgagg

SEQ ID NO: 638168 - DNA, 25 bp, Mus musculus
gaatctctctgacgcccaagtccaa

SEQ ID NO: 638169 - DNA, 25 bp, Mus musculus
gaatctctctgaggcccaagtccaa

SEQ ID NO: 638170 - DNA, 25 bp, Mus musculus
gaatctctgaagatcctccctgcaa

SEQ ID NO: 638171 - DNA, 25 bp, Mus musculus
gaatctctgaagttcctccctgcaa

SEQ ID NO: 638172 - DNA, 25 bp, Mus musculus
gaatctctgctgaaacccctagtaa

SEQ ID NO: 638173 - DNA, 25 bp, Mus musculus
gaatctctgctgtaacccctagtaa

SEQ ID NO: 638174 - DNA, 25 bp, Mus musculus
gaatctctgggcatcagggtctgga

SEQ ID NO: 638175 - DNA, 25 bp, Mus musculus
gaatctctgggcttcagggtctgga

SEQ ID NO: 638176 - DNA, 25 bp, Mus musculus
gaatctctgtcaacctgtgagctca

SEQ ID NO: 638177 - DNA, 25 bp, Mus musculus
gaatctctgtcacccttctgggact

SEQ ID NO: 638178 - DNA, 25 bp, Mus musculus
gaatctctgtcagccttctgggact

SEQ ID NO: 638179 - DNA, 25 bp, Mus musculus
gaatctctgtcatcctgtgagctca

SEQ ID NO: 638180 - DNA, 25 bp, Mus musculus
gaatctcttcatctgtgtggtggca

SEQ ID NO: 638181 - DNA, 25 bp, Mus musculus
gaatctcttcatgtgtgtggtggca

SEQ ID NO: 638182 - DNA, 25 bp, Mus musculus
gaatctcttccacaaccagatcgag

SEQ ID NO: 638183 - DNA, 25 bp, Mus musculus
gaatctcttccagaaccagatcgag

SEQ ID NO: 638184 - DNA, 25 bp, Mus musculus
gaatctcttgctcatgtctggctat

SEQ ID NO: 638185 - DNA, 25 bp, Mus musculus
gaatctcttgctgatgtctggctat

SEQ ID NO: 638186 - DNA, 25 bp, Mus musculus
gaatctcttggaacatgaagccagg

SEQ ID NO: 638187 - DNA, 25 bp, Mus musculus
gaatctcttggatcatgaagccagg

SEQ ID NO: 638188 - DNA, 25 bp, Mus musculus
gaatctgaaggacaccatggtcaag

SEQ ID NO: 638189 - DNA, 25 bp, Mus musculus
gaatctgaaggagaccatggtcaag

SEQ ID NO: 638190 - DNA, 25 bp, Mus musculus
gaatctgacgaaccttttaggcctg

SEQ ID NO: 638191 - DNA, 25 bp, Mus musculus
gaatctgacgaagcttttaggcctg

SEQ ID NO: 638192 - DNA, 25 bp, Mus musculus
gaatctgacgtcagtgcttaacgaa

SEQ ID NO: 638193 - DNA, 25 bp, Mus musculus
gaatctgacgtctgtgcttaacgaa

SEQ ID NO: 638194 - DNA, 25 bp, Mus musculus
gaatctgacgtgactggctctcaga

SEQ ID NO: 638195 - DNA, 25 bp, Mus musculus
gaatctgacgtgtctggctctcaga

SEQ ID NO: 638196 - DNA, 25 bp, Mus musculus
gaatctgactcacatcaaagctggg

SEQ ID NO: 638197 - DNA, 25 bp, Mus musculus
gaatctgactcagatcaaagctggg

SEQ ID NO: 638198 - DNA, 25 bp, Mus musculus
gaatctgactggaatcggatcaagc

SEQ ID NO: 638199 - DNA, 25 bp, Mus musculus
gaatctgactggtatcggatcaagc

SEQ ID NO: 638200 - DNA, 25 bp, Mus musculus
gaatctgaggaaacgtgttcttctc

SEQ ID NO: 638201 - DNA, 25 bp, Mus musculus
gaatctgaggaacctattcccaata

SEQ ID NO: 638202 - DNA, 25 bp, Mus musculus
gaatctgaggaagctattcccaata

SEQ ID NO: 638203 - DNA, 25 bp, Mus musculus
gaatctgaggaatcgtgttcttctc

SEQ ID NO: 638204 - DNA, 25 bp, Mus musculus
gaatctgatcctcatcgtcttccat

SEQ ID NO: 638205 - DNA, 25 bp, Mus musculus
gaatctgatcctgatcgtcttccat

SEQ ID NO: 638206 - DNA, 25 bp, Mus musculus
gaatctgatgatcaaaaacccacgg

SEQ ID NO: 638207 - DNA, 25 bp, Mus musculus
gaatctgatgatgaaaaacccacgg

SEQ ID NO: 638208 - DNA, 25 bp, Mus musculus
gaatctgattgaaaccatacaaacg

SEQ ID NO: 638209 - DNA, 25 bp, Mus musculus
gaatctgattgataccatacaaacg

SEQ ID NO: 638210 - DNA, 25 bp, Mus musculus
gaatctgcaaatacgaggagtcctg

SEQ ID NO: 638211 - DNA, 25 bp, Mus musculus
gaatctgcaaattcgaggagtcctg

SEQ ID NO: 638212 - DNA, 25 bp, Mus musculus
gaatctgcaggcaaggctcttcagc

SEQ ID NO: 638213 - DNA, 25 bp, Mus musculus
gaatctgcaggctaggctcttcagc

SEQ ID NO: 638214 - DNA, 25 bp, Mus musculus
gaatctgcagtgacaggaatcgttg

SEQ ID NO: 638215 - DNA, 25 bp, Mus musculus
gaatctgcagtgtcaggaatcgttg

SEQ ID NO: 638216 - DNA, 25 bp, Mus musculus
gaatctgcatgacgtgcttcatgac

SEQ ID NO: 638217 - DNA, 25 bp, Mus musculus
gaatctgcatgaggtgcttcatgac

SEQ ID NO: 638218 - DNA, 25 bp, Mus musculus
gaatctgccataaggatttcaggga

SEQ ID NO: 638219 - DNA, 25 bp, Mus musculus
gaatctgccatatggatttcaggga

SEQ ID NO: 638220 - DNA, 25 bp, Mus musculus
gaatctgccgtgctttgatgaggcc

SEQ ID NO: 638221 - DNA, 25 bp, Mus musculus
gaatctgccgtggtttgatgaggcc

SEQ ID NO: 638222 - DNA, 25 bp, Mus musculus
gaatctgcctgtaaaacctgagcca

SEQ ID NO: 638223 - DNA, 25 bp, Mus musculus
gaatctgcctgttaaacctgagcca

SEQ ID NO: 638224 - DNA, 25 bp, Mus musculus
gaatctgcgcaacgagaaggagaca

SEQ ID NO: 638225 - DNA, 25 bp, Mus musculus
gaatctgcgcaaggagaaggagaca

SEQ ID NO: 638226 - DNA, 25 bp, Mus musculus
gaatctgctacaccatctttgacct

SEQ ID NO: 638227 - DNA, 25 bp, Mus musculus
gaatctgctacagcatctttgacct

SEQ ID NO: 638228 - DNA, 25 bp, Mus musculus
gaatctgctatgaggcttaactgct

SEQ ID NO: 638229 - DNA, 25 bp, Mus musculus
gaatctgctatgtggcttaactgct

SEQ ID NO: 638230 - DNA, 25 bp, Mus musculus
gaatctgctccgagacttcaatcca

SEQ ID NO: 638231 - DNA, 25 bp, Mus musculus
gaatctgctccgtgacttcaatcca

SEQ ID NO: 638232 - DNA, 25 bp, Mus musculus
gaatctgctctccatatttatcagc

SEQ ID NO: 638233 - DNA, 25 bp, Mus musculus
gaatctgctctcgatatttatcagc

SEQ ID NO: 638234 - DNA, 25 bp, Mus musculus
gaatctgcttcaagaccactatgga

SEQ ID NO: 638235 - DNA, 25 bp, Mus musculus
gaatctgcttcatgaccactatgga

SEQ ID NO: 638236 - DNA, 25 bp, Mus musculus
gaatctggaactcggctcagaacca

SEQ ID NO: 638237 - DNA, 25 bp, Mus musculus
gaatctggaactgggctcagaacca

SEQ ID NO: 638238 - DNA, 25 bp, Mus musculus
gaatctggctaactgcaagctaaag

SEQ ID NO: 638239 - DNA, 25 bp, Mus musculus
gaatctggctaagtgcaagctaaag

SEQ ID NO: 638240 - DNA, 25 bp, Mus musculus
gaatctggctgcatatttggtcctg

SEQ ID NO: 638241 - DNA, 25 bp, Mus musculus
gaatctggctgcttatttggtcctg

SEQ ID NO: 638242 - DNA, 25 bp, Mus musculus
gaatctggcttcacctccaaggaca

SEQ ID NO: 638243 - DNA, 25 bp, Mus musculus
gaatctggcttctcctccaaggaca

SEQ ID NO: 638244 - DNA, 25 bp, Mus musculus
gaatctgggaatcagacctagggcc

SEQ ID NO: 638245 - DNA, 25 bp, Mus musculus
gaatctgggaatgagacctagggcc

SEQ ID NO: 638246 - DNA, 25 bp, Mus musculus
gaatctgggataattactgtgtgaa

SEQ ID NO: 638247 - DNA, 25 bp, Mus musculus
gaatctgggatatttactgtgtgaa

SEQ ID NO: 638248 - DNA, 25 bp, Mus musculus
gaatctgggccccacgaagaaccta

SEQ ID NO: 638249 - DNA, 25 bp, Mus musculus
gaatctgggcccgacgaagaaccta

SEQ ID NO: 638250 - DNA, 25 bp, Mus musculus
gaatctgggcttactcaggcctata

SEQ ID NO: 638251 - DNA, 25 bp, Mus musculus
gaatctgggctttctcaggcctata

SEQ ID NO: 638252 - DNA, 25 bp, Mus musculus
gaatctggtatcagatgatgacatt

SEQ ID NO: 638253 - DNA, 25 bp, Mus musculus
gaatctggtatctgatgatgacatt

SEQ ID NO: 638254 - DNA, 25 bp, Mus musculus
gaatctggtctaagacgtgactcca

SEQ ID NO: 638255 - DNA, 25 bp, Mus musculus
gaatctggtctatgacgtgactcca

SEQ ID NO: 638256 - DNA, 25 bp, Mus musculus
gaatctggtctgactgtagacccaa

SEQ ID NO: 638257 - DNA, 25 bp, Mus musculus
gaatctggtctgtctgtagacccaa

SEQ ID NO: 638258 - DNA, 25 bp, Mus musculus
gaatctggttgacaacttcttagag

SEQ ID NO: 638259 - DNA, 25 bp, Mus musculus
gaatctggttgagaacttcttagag

SEQ ID NO: 638260 - DNA, 25 bp, Mus musculus
gaatctgtactcatgtttggtgtgt

SEQ ID NO: 638261 - DNA, 25 bp, Mus musculus
gaatctgtactcttgtttggtgtgt

SEQ ID NO: 638262 - DNA, 25 bp, Mus musculus
gaatctgtatacaaatgagtacgtg

SEQ ID NO: 638263 - DNA, 25 bp, Mus musculus
gaatctgtatactaatgagtacgtg

SEQ ID NO: 638264 - DNA, 25 bp, Mus musculus
gaatctgtatgaccggaagctcttg

SEQ ID NO: 638265 - DNA, 25 bp, Mus musculus
gaatctgtatgagcggaagctcttg

SEQ ID NO: 638266 - DNA, 25 bp, Mus musculus
gaatctgtctcactcccgattgtga

SEQ ID NO: 638267 - DNA, 25 bp, Mus musculus
gaatctgtctcagtcccgattgtga

SEQ ID NO: 638268 - DNA, 25 bp, Mus musculus
gaatctgtctccctcatcaagcata

SEQ ID NO: 638269 - DNA, 25 bp, Mus musculus
gaatctgtctccgtcatcaagcata

SEQ ID NO: 638270 - DNA, 25 bp, Mus musculus
gaatctgtgaaaacaatgatcgttc

SEQ ID NO: 638271 - DNA, 25 bp, Mus musculus
gaatctgtgaaatcaatgatcgttc

SEQ ID NO: 638272 - DNA, 25 bp, Mus musculus
gaatctgtgaagcatcccttcattg

SEQ ID NO: 638273 - DNA, 25 bp, Mus musculus
gaatctgtgaaggatcccttcattg

SEQ ID NO: 638274 - DNA, 25 bp, Mus musculus
gaatctgtgactatctggaacagca

SEQ ID NO: 638275 - DNA, 25 bp, Mus musculus
gaatctgtgactttctggaacagca

SEQ ID NO: 638276 - DNA, 25 bp, Mus musculus
gaatctgtgcgcaatctgctgctga

SEQ ID NO: 638277 - DNA, 25 bp, Mus musculus
gaatctgtgcgctatctgctgctga

SEQ ID NO: 638278 - DNA, 25 bp, Mus musculus
gaatctgttggaaaccagatgggtg

SEQ ID NO: 638279 - DNA, 25 bp, Mus musculus
gaatctgttggataccagatgggtg

SEQ ID NO: 638280 - DNA, 25 bp, Mus musculus
gaatcttactcacagagctggtcac

SEQ ID NO: 638281 - DNA, 25 bp, Mus musculus
gaatcttactcagagagctggtcac

SEQ ID NO: 638282 - DNA, 25 bp, Mus musculus
gaatcttagcccctggcatgggtga

SEQ ID NO: 638283 - DNA, 25 bp, Mus musculus
gaatcttagcccgtggcatgggtga

SEQ ID NO: 638284 - DNA, 25 bp, Mus musculus
gaatcttcaaggacgcgggtgtcca

SEQ ID NO: 638285 - DNA, 25 bp, Mus musculus
gaatcttcaaggtcgcgggtgtcca

SEQ ID NO: 638286 - DNA, 25 bp, Mus musculus
gaatcttccagaagtggtaatgaac

SEQ ID NO: 638287 - DNA, 25 bp, Mus musculus
gaatcttccagatgtggtaatgaac

SEQ ID NO: 638288 - DNA, 25 bp, Mus musculus
gaatcttccgtcatcccaacaactg

SEQ ID NO: 638289 - DNA, 25 bp, Mus musculus
gaatcttccgtcttcccaacaactg

SEQ ID NO: 638290 - DNA, 25 bp, Mus musculus
gaatcttcggtgcaaaccctgtgca

SEQ ID NO: 638291 - DNA, 25 bp, Mus musculus
gaatcttcggtggaaaccctgtgca

SEQ ID NO: 638292 - DNA, 25 bp, Mus musculus
gaatcttctagaatctgtgcagagg

SEQ ID NO: 638293 - DNA, 25 bp, Mus musculus
gaatcttctagattctgtgcagagg

SEQ ID NO: 638294 - DNA, 25 bp, Mus musculus
gaatcttctattaggttagtgccac

SEQ ID NO: 638295 - DNA, 25 bp, Mus musculus
gaatcttctatttggttagtgccac

SEQ ID NO: 638296 - DNA, 25 bp, Mus musculus
gaatcttgaccaccaacttcggaaa

SEQ ID NO: 638297 - DNA, 25 bp, Mus musculus
gaatcttgaccagcaacttcggaaa

SEQ ID NO: 638298 - DNA, 25 bp, Mus musculus
gaatcttgacttcctcaagcctttc

SEQ ID NO: 638299 - DNA, 25 bp, Mus musculus
gaatcttgacttgctcaagcctttc

SEQ ID NO: 638300 - DNA, 25 bp, Mus musculus
gaatcttgcacacggacaccatctg

SEQ ID NO: 638301 - DNA, 25 bp, Mus musculus
gaatcttgcacagggacaccatctg

SEQ ID NO: 638302 - DNA, 25 bp, Mus musculus
gaatcttgccatcaagccacagtgg

SEQ ID NO: 638303 - DNA, 25 bp, Mus musculus
gaatcttgccatgaagccacagtgg

SEQ ID NO: 638304 - DNA, 25 bp, Mus musculus
gaatcttggattactctgtggcttc

SEQ ID NO: 638305 - DNA, 25 bp, Mus musculus
gaatcttggattatctattcacacc

SEQ ID NO: 638306 - DNA, 25 bp, Mus musculus
gaatcttggatttctctgtggcttc

SEQ ID NO: 638307 - DNA, 25 bp, Mus musculus
gaatcttggattttctattcacacc

SEQ ID NO: 638308 - DNA, 25 bp, Mus musculus
gaatcttgggagatggacaccaaag

SEQ ID NO: 638309 - DNA, 25 bp, Mus musculus
gaatcttgggagttggacaccaaag

SEQ ID NO: 638310 - DNA, 25 bp, Mus musculus
gaatcttgttgtatgggcctcctgg

SEQ ID NO: 638311 - DNA, 25 bp, Mus musculus
gaatcttgttgtttgggcctcctgg

SEQ ID NO: 638312 - DNA, 25 bp, Mus musculus
gaatctttaatgcacttcatcggct

SEQ ID NO: 638313 - DNA, 25 bp, Mus musculus
gaatctttaatggacttcatcggct

SEQ ID NO: 638314 - DNA, 25 bp, Mus musculus
gaatctttcccacagctttcagcct

SEQ ID NO: 638315 - DNA, 25 bp, Mus musculus
gaatctttcccagagctttcagcct

SEQ ID NO: 638316 - DNA, 25 bp, Mus musculus
gaatctttcgcactgaagggtctgg

SEQ ID NO: 638317 - DNA, 25 bp, Mus musculus
gaatctttcgcagtgaagggtctgg

SEQ ID NO: 638318 - DNA, 25 bp, Mus musculus
gaatctttcggcacaaaaagtggga

SEQ ID NO: 638319 - DNA, 25 bp, Mus musculus
gaatctttcggctcaaaaagtggga

SEQ ID NO: 638320 - DNA, 25 bp, Mus musculus
gaatctttgaggagagcttcttgga

SEQ ID NO: 638321 - DNA, 25 bp, Mus musculus
gaatctttgaggtgagcttcttgga

SEQ ID NO: 638322 - DNA, 25 bp, Mus musculus
gaatctttggaacactctgaacgct

SEQ ID NO: 638323 - DNA, 25 bp, Mus musculus
gaatctttggaagactctgaacgct

SEQ ID NO: 638324 - DNA, 25 bp, Mus musculus
gaatcttttcccaagtcataacgtg

SEQ ID NO: 638325 - DNA, 25 bp, Mus musculus
gaatcttttccctagtcataacgtg

SEQ ID NO: 638326 - DNA, 25 bp, Mus musculus
gaatcttttgcgcacacaaatcaca

SEQ ID NO: 638327 - DNA, 25 bp, Mus musculus
gaatcttttgcggacacaaatcaca

SEQ ID NO: 638328 - DNA, 25 bp, Mus musculus
gaatctttttctacaagttgatgct

SEQ ID NO: 638329 - DNA, 25 bp, Mus musculus
gaatctttttcttcaagttgatgct

SEQ ID NO: 638330 - DNA, 25 bp, Mus musculus
gaatctttttgaagcggaaaggagc

SEQ ID NO: 638331 - DNA, 25 bp, Mus musculus
gaatctttttgatgcggaaaggagc

SEQ ID NO: 638332 - DNA, 25 bp, Mus musculus
gaatgaaaaactccaaagccaggtt

SEQ ID NO: 638333 - DNA, 25 bp, Mus musculus
gaatgaaaaactgcaaagccaggtt

SEQ ID NO: 638334 - DNA, 25 bp, Mus musculus
gaatgaaaacaaacggcggcctttg

SEQ ID NO: 638335 - DNA, 25 bp, Mus musculus
gaatgaaaacaatcggcggcctttg

SEQ ID NO: 638336 - DNA, 25 bp, Mus musculus
gaatgaaaaggtagttctccagctc

SEQ ID NO: 638337 - DNA, 25 bp, Mus musculus
gaatgaaaaggttgttctccagctc

SEQ ID NO: 638338 - DNA, 25 bp, Mus musculus
gaatgaaaatgaccaggcagctatt

SEQ ID NO: 638339 - DNA, 25 bp, Mus musculus
gaatgaaaatgagcaggcagctatt

SEQ ID NO: 638340 - DNA, 25 bp, Mus musculus
gaatgaaaggaccttgaaccccaga

SEQ ID NO: 638341 - DNA, 25 bp, Mus musculus
gaatgaaaggacgttgaaccccaga

SEQ ID NO: 638342 - DNA, 25 bp, Mus musculus
gaatgaaaggccatatgtctgtgag

SEQ ID NO: 638343 - DNA, 25 bp, Mus musculus
gaatgaaaggccttatgtctgtgag

SEQ ID NO: 638344 - DNA, 25 bp, Mus musculus
gaatgaaagtctcacagacaccgct

SEQ ID NO: 638345 - DNA, 25 bp, Mus musculus
gaatgaaagtctgacagacaccgct

SEQ ID NO: 638346 - DNA, 25 bp, Mus musculus
gaatgaaataaccaagataatgagc

SEQ ID NO: 638347 - DNA, 25 bp, Mus musculus
gaatgaaataacgaagataatgagc

SEQ ID NO: 638348 - DNA, 25 bp, Mus musculus
gaatgaaatcgacgcatggaaggca

SEQ ID NO: 638349 - DNA, 25 bp, Mus musculus
gaatgaaatcgaggcatggaaggca

SEQ ID NO: 638350 - DNA, 25 bp, Mus musculus
gaatgaaatcttacaacgtcctccc

SEQ ID NO: 638351 - DNA, 25 bp, Mus musculus
gaatgaaatctttcaacgtcctccc

SEQ ID NO: 638352 - DNA, 25 bp, Mus musculus
gaatgaacaaataactccagcacta

SEQ ID NO: 638353 - DNA, 25 bp, Mus musculus
gaatgaacaaattactccagcacta

SEQ ID NO: 638354 - DNA, 25 bp, Mus musculus
gaatgaacactaccgaacaactggg

SEQ ID NO: 638355 - DNA, 25 bp, Mus musculus
gaatgaacactagcgaacaactggg

SEQ ID NO: 638356 - DNA, 25 bp, Mus musculus
gaatgaacaggaatctcgccttgca

SEQ ID NO: 638357 - DNA, 25 bp, Mus musculus
gaatgaacaggattctcgccttgca

SEQ ID NO: 638358 - DNA, 25 bp, Mus musculus
gaatgaacccgaagtctccactgca

SEQ ID NO: 638359 - DNA, 25 bp, Mus musculus
gaatgaacccgatgtctccactgca

SEQ ID NO: 638360 - DNA, 25 bp, Mus musculus
gaatgaactcaaccgaggagacttt

SEQ ID NO: 638361 - DNA, 25 bp, Mus musculus
gaatgaactcaagcgaggagacttt

SEQ ID NO: 638362 - DNA, 25 bp, Mus musculus
gaatgaacttccagtgcagccggcg

SEQ ID NO: 638363 - DNA, 25 bp, Mus musculus
gaatgaacttcctgtgcagccggcg

SEQ ID NO: 638364 - DNA, 25 bp, Mus musculus
gaatgaagattgacctgatcagcag

SEQ ID NO: 638365 - DNA, 25 bp, Mus musculus
gaatgaagattgtcctgatcagcag

SEQ ID NO: 638366 - DNA, 25 bp, Mus musculus
gaatgaagccatcgaccagcgtaac

SEQ ID NO: 638367 - DNA, 25 bp, Mus musculus
gaatgaagccatggaccagcgtaac

SEQ ID NO: 638368 - DNA, 25 bp, Mus musculus
gaatgaagcccaaaaattcttcctc

SEQ ID NO: 638369 - DNA, 25 bp, Mus musculus
gaatgaagcccataaattcttcctc

SEQ ID NO: 638370 - DNA, 25 bp, Mus musculus
gaatgaagcccgcaaatacgttcgc

SEQ ID NO: 638371 - DNA, 25 bp, Mus musculus
gaatgaagcccggaaatacgttcgc

SEQ ID NO: 638372 - DNA, 25 bp, Mus musculus
gaatgaagctgactggtagcattca

SEQ ID NO: 638373 - DNA, 25 bp, Mus musculus
gaatgaagctgagtggtagcattca

SEQ ID NO: 638374 - DNA, 25 bp, Mus musculus
gaatgaaggatgacagctacgcacc

SEQ ID NO: 638375 - DNA, 25 bp, Mus musculus
gaatgaaggatgtcagctacgcacc

SEQ ID NO: 638376 - DNA, 25 bp, Mus musculus
gaatgaaggcttaatcccaagcaac

SEQ ID NO: 638377 - DNA, 25 bp, Mus musculus
gaatgaaggctttatcccaagcaac

SEQ ID NO: 638378 - DNA, 25 bp, Mus musculus
gaatgaagtctcagattactaatgg

SEQ ID NO: 638379 - DNA, 25 bp, Mus musculus
gaatgaagtctctgattactaatgg

SEQ ID NO: 638380 - DNA, 25 bp, Mus musculus
gaatgaagtggcagccctcacagca

SEQ ID NO: 638381 - DNA, 25 bp, Mus musculus
gaatgaagtggctgccctcacagca

SEQ ID NO: 638382 - DNA, 25 bp, Mus musculus
gaatgaagttctaacctacattaaa

SEQ ID NO: 638383 - DNA, 25 bp, Mus musculus
gaatgaagttcttacctacattaaa

SEQ ID NO: 638384 - DNA, 25 bp, Mus musculus
gaatgaataatccatcagaaaccaa

SEQ ID NO: 638385 - DNA, 25 bp, Mus musculus
gaatgaataatcgatcagaaaccaa

SEQ ID NO: 638386 - DNA, 25 bp, Mus musculus
gaatgaatacggctccatcaaccac

SEQ ID NO: 638387 - DNA, 25 bp, Mus musculus
gaatgaatacgggtccatcaaccac

SEQ ID NO: 638388 - DNA, 25 bp, Mus musculus
gaatgaatatttatactcacacctc

SEQ ID NO: 638389 - DNA, 25 bp, Mus musculus
gaatgaatatttttactcacacctc

SEQ ID NO: 638390 - DNA, 25 bp, Mus musculus
gaatgaatccaactccttgcacacc

SEQ ID NO: 638391 - DNA, 25 bp, Mus musculus
gaatgaatccaagtccttgcacacc

SEQ ID NO: 638392 - DNA, 25 bp, Mus musculus
gaatgaatgatgacctccctaacag

SEQ ID NO: 638393 - DNA, 25 bp, Mus musculus
gaatgaatgatgtcctccctaacag

SEQ ID NO: 638394 - DNA, 25 bp, Mus musculus
gaatgaatgattcaatgagtgcaga

SEQ ID NO: 638395 - DNA, 25 bp, Mus musculus
gaatgaatgattgaatgagtgcaga

SEQ ID NO: 638396 - DNA, 25 bp, Mus musculus
gaatgaatgcatacagccaagttca

SEQ ID NO: 638397 - DNA, 25 bp, Mus musculus
gaatgaatgcattcagccaagttca

SEQ ID NO: 638398 - DNA, 25 bp, Mus musculus
gaatgaatggatatgatagacgtcc

SEQ ID NO: 638399 - DNA, 25 bp, Mus musculus
gaatgaatggatttgatagacgtcc

SEQ ID NO: 638400 - DNA, 25 bp, Mus musculus
gaatgaatggctccgtccatagctg

SEQ ID NO: 638401 - DNA, 25 bp, Mus musculus
gaatgaatggctgcgtccatagctg

SEQ ID NO: 638402 - DNA, 25 bp, Mus musculus
gaatgaatttctcactcgggagctg

SEQ ID NO: 638403 - DNA, 25 bp, Mus musculus
gaatgaatttctgactcgggagctg

SEQ ID NO: 638404 - DNA, 25 bp, Mus musculus
gaatgacaatgaagcctttaccgag

SEQ ID NO: 638405 - DNA, 25 bp, Mus musculus
gaatgacaatgatgcctttaccgag

SEQ ID NO: 638406 - DNA, 25 bp, Mus musculus
gaatgacaatgtagtgatccccgag

SEQ ID NO: 638407 - DNA, 25 bp, Mus musculus
gaatgacaatgttgtgatccccgag

SEQ ID NO: 638408 - DNA, 25 bp, Mus musculus
gaatgacaccaaaagccctcctcat

SEQ ID NO: 638409 - DNA, 25 bp, Mus musculus
gaatgacaccaaccgaggagatgct

SEQ ID NO: 638410 - DNA, 25 bp, Mus musculus
gaatgacaccaagcgaggagatgct

SEQ ID NO: 638411 - DNA, 25 bp, Mus musculus
gaatgacaccaatagccctcctcat

SEQ ID NO: 638412 - DNA, 25 bp, Mus musculus
gaatgacaccttaaaggaactggag

SEQ ID NO: 638413 - DNA, 25 bp, Mus musculus
gaatgacacctttaaggaactggag

SEQ ID NO: 638414 - DNA, 25 bp, Mus musculus
gaatgacacgggatgacctgttcaa

SEQ ID NO: 638415 - DNA, 25 bp, Mus musculus
gaatgacacgggttgacctgttcaa

SEQ ID NO: 638416 - DNA, 25 bp, Mus musculus
gaatgacacgttcctgagagcagcc

SEQ ID NO: 638417 - DNA, 25 bp, Mus musculus
gaatgacacgttgctgagagcagcc

SEQ ID NO: 638418 - DNA, 25 bp, Mus musculus
gaatgacactcacttatgacccgac

SEQ ID NO: 638419 - DNA, 25 bp, Mus musculus
gaatgacactcagttatgacccgac

SEQ ID NO: 638420 - DNA, 25 bp, Mus musculus
gaatgacactccatctaaatgatgg

SEQ ID NO: 638421 - DNA, 25 bp, Mus musculus
gaatgacactccttctaaatgatgg

SEQ ID NO: 638422 - DNA, 25 bp, Mus musculus
gaatgacagaatcctggttttcctc

SEQ ID NO: 638423 - DNA, 25 bp, Mus musculus
gaatgacagaatgctggttttcctc

SEQ ID NO: 638424 - DNA, 25 bp, Mus musculus
gaatgacagctcagtgtctgctgag

SEQ ID NO: 638425 - DNA, 25 bp, Mus musculus
gaatgacagctctgtgtctgctgag

SEQ ID NO: 638426 - DNA, 25 bp, Mus musculus
gaatgacaggacaactgagaaccta

SEQ ID NO: 638427 - DNA, 25 bp, Mus musculus
gaatgacaggactactgagaaccta

SEQ ID NO: 638428 - DNA, 25 bp, Mus musculus
gaatgacaggcaactggaggtacct

SEQ ID NO: 638429 - DNA, 25 bp, Mus musculus
gaatgacaggcatctggaggtacct

SEQ ID NO: 638430 - DNA, 25 bp, Mus musculus
gaatgacagtaccaacgtggccatg

SEQ ID NO: 638431 - DNA, 25 bp, Mus musculus
gaatgacagtacgaacgtggccatg

SEQ ID NO: 638432 - DNA, 25 bp, Mus musculus
gaatgacagttccaacgatgacaaa

SEQ ID NO: 638433 - DNA, 25 bp, Mus musculus
gaatgacagttcgaacgatgacaaa

SEQ ID NO: 638434 - DNA, 25 bp, Mus musculus
gaatgacatagacatctttgagatc

SEQ ID NO: 638435 - DNA, 25 bp, Mus musculus
gaatgacatagagatctttgagatc

SEQ ID NO: 638436 - DNA, 25 bp, Mus musculus
gaatgacattgtcgttcttgggcca

SEQ ID NO: 638437 - DNA, 25 bp, Mus musculus
gaatgacattgtggttcttgggcca

SEQ ID NO: 638438 - DNA, 25 bp, Mus musculus
gaatgaccaatacaccagatttgat

SEQ ID NO: 638439 - DNA, 25 bp, Mus musculus
gaatgaccaatagaccagatttgat

SEQ ID NO: 638440 - DNA, 25 bp, Mus musculus
gaatgaccacaacctcttcagtgga

SEQ ID NO: 638441 - DNA, 25 bp, Mus musculus
gaatgaccacaagctcttcagtgga

SEQ ID NO: 638442 - DNA, 25 bp, Mus musculus
gaatgacccagtcggcacctgctac

SEQ ID NO: 638443 - DNA, 25 bp, Mus musculus
gaatgacccagtgggcacctgctac

SEQ ID NO: 638444 - DNA, 25 bp, Mus musculus
gaatgacccattcattgatccagaa

SEQ ID NO: 638445 - DNA, 25 bp, Mus musculus
gaatgacccattgattgatccagaa

SEQ ID NO: 638446 - DNA, 25 bp, Mus musculus
gaatgacctagacacccaactggag

SEQ ID NO: 638447 - DNA, 25 bp, Mus musculus
gaatgacctagagacccaactggag

SEQ ID NO: 638448 - DNA, 25 bp, Mus musculus
gaatgacctagcaacgtcacagatc

SEQ ID NO: 638449 - DNA, 25 bp, Mus musculus
gaatgacctagctacgtcacagatc

SEQ ID NO: 638450 - DNA, 25 bp, Mus musculus
gaatgaccttcgctcacagaagaca

SEQ ID NO: 638451 - DNA, 25 bp, Mus musculus
gaatgaccttcggtcacagaagaca

SEQ ID NO: 638452 - DNA, 25 bp, Mus musculus
gaatgacgccaacaatgctgtggaa

SEQ ID NO: 638453 - DNA, 25 bp, Mus musculus
gaatgacgccaagaatgctgtggaa

SEQ ID NO: 638454 - DNA, 25 bp, Mus musculus
gaatgacgttcacgaccgtttcgag

SEQ ID NO: 638455 - DNA, 25 bp, Mus musculus
gaatgacgttcaggaccgtttcgag

SEQ ID NO: 638456 - DNA, 25 bp, Mus musculus
gaatgacgttgaagccctgttcacc

SEQ ID NO: 638457 - DNA, 25 bp, Mus musculus
gaatgacgttgatgccctgttcacc

SEQ ID NO: 638458 - DNA, 25 bp, Mus musculus
gaatgactactaaactcctactggg

SEQ ID NO: 638459 - DNA, 25 bp, Mus musculus
gaatgactactatactcctactggg

SEQ ID NO: 638460 - DNA, 25 bp, Mus musculus
gaatgactccgactactaccctaga

SEQ ID NO: 638461 - DNA, 25 bp, Mus musculus
gaatgactccgagtactaccctaga

SEQ ID NO: 638462 - DNA, 25 bp, Mus musculus
gaatgactccggacagtggtacatc

SEQ ID NO: 638463 - DNA, 25 bp, Mus musculus
gaatgactccggtcagtggtacatc

SEQ ID NO: 638464 - DNA, 25 bp, Mus musculus
gaatgactgctaatcagtgcaagct

SEQ ID NO: 638465 - DNA, 25 bp, Mus musculus
gaatgactgctattcagtgcaagct

SEQ ID NO: 638466 - DNA, 25 bp, Mus musculus
gaatgactgtgaacacattttgaca

SEQ ID NO: 638467 - DNA, 25 bp, Mus musculus
gaatgactgtgatcacattttgaca

SEQ ID NO: 638468 - DNA, 25 bp, Mus musculus
gaatgactgtgcctgatactcaccc

SEQ ID NO: 638469 - DNA, 25 bp, Mus musculus
gaatgactgtgcgtgatactcaccc

SEQ ID NO: 638470 - DNA, 25 bp, Mus musculus
gaatgactttgactcggccaagggc

SEQ ID NO: 638471 - DNA, 25 bp, Mus musculus
gaatgactttgagtcggccaagggc

SEQ ID NO: 638472 - DNA, 25 bp, Mus musculus
gaatgactttggacacccagatgtt

SEQ ID NO: 638473 - DNA, 25 bp, Mus musculus
gaatgactttggtcacccagatgtt

SEQ ID NO: 638474 - DNA, 25 bp, Mus musculus
gaatgagaaagtcacgcagtctgac

SEQ ID NO: 638475 - DNA, 25 bp, Mus musculus
gaatgagaaagtgacgcagtctgac

SEQ ID NO: 638476 - DNA, 25 bp, Mus musculus
gaatgagaacgacgtggagtccacc

SEQ ID NO: 638477 - DNA, 25 bp, Mus musculus
gaatgagaacgaggtggagtccacc

SEQ ID NO: 638478 - DNA, 25 bp, Mus musculus
gaatgagaacgcagaatgcaggtca

SEQ ID NO: 638479 - DNA, 25 bp, Mus musculus
gaatgagaacgctgaatgcaggtca

SEQ ID NO: 638480 - DNA, 25 bp, Mus musculus
gaatgagaagcacggcctcgacgcc

SEQ ID NO: 638481 - DNA, 25 bp, Mus musculus
gaatgagaagcagggcctcgacgcc

SEQ ID NO: 638482 - DNA, 25 bp, Mus musculus
gaatgagaatctacagtgggaagtg

SEQ ID NO: 638483 - DNA, 25 bp, Mus musculus
gaatgagaatcttcagtgggaagtg

SEQ ID NO: 638484 - DNA, 25 bp, Mus musculus
gaatgagacatgatcctgggctggc

SEQ ID NO: 638485 - DNA, 25 bp, Mus musculus
gaatgagacatgttcctgggctggc

SEQ ID NO: 638486 - DNA, 25 bp, Mus musculus
gaatgagagactccgggacacacct

SEQ ID NO: 638487 - DNA, 25 bp, Mus musculus
gaatgagagactgcgggacacacct

SEQ ID NO: 638488 - DNA, 25 bp, Mus musculus
gaatgagagagactctatcagacag

SEQ ID NO: 638489 - DNA, 25 bp, Mus musculus
gaatgagagagagtctatcagacag

SEQ ID NO: 638490 - DNA, 25 bp, Mus musculus
gaatgagagaggagaccacaacaga

SEQ ID NO: 638491 - DNA, 25 bp, Mus musculus
gaatgagagaggtgaccacaacaga

SEQ ID NO: 638492 - DNA, 25 bp, Mus musculus
gaatgagagtctcctgtgtcgcaca

SEQ ID NO: 638493 - DNA, 25 bp, Mus musculus
gaatgagagtctgctgtgtcgcaca

SEQ ID NO: 638494 - DNA, 25 bp, Mus musculus
gaatgagatcaccaagctgcggaaa

SEQ ID NO: 638495 - DNA, 25 bp, Mus musculus
gaatgagatcacgaagctgcggaaa

SEQ ID NO: 638496 - DNA, 25 bp, Mus musculus
gaatgagatcgcctccgtcgcttac

SEQ ID NO: 638497 - DNA, 25 bp, Mus musculus
gaatgagatcgcgtccgtcgcttac

SEQ ID NO: 638498 - DNA, 25 bp, Mus musculus
gaatgagatctactttggaaaaaca

SEQ ID NO: 638499 - DNA, 25 bp, Mus musculus
gaatgagatctagtttggaaaaaca

SEQ ID NO: 638500 - DNA, 25 bp, Mus musculus
gaatgagatgggacacacacccctg

SEQ ID NO: 638501 - DNA, 25 bp, Mus musculus
gaatgagatgggtcacacacccctg

SEQ ID NO: 638502 - DNA, 25 bp, Mus musculus
gaatgagcaacaaaaacaactaaca

SEQ ID NO: 638503 - DNA, 25 bp, Mus musculus
gaatgagcaacataaacaactaaca

SEQ ID NO: 638504 - DNA, 25 bp, Mus musculus
gaatgagcagcaatatccacgcgaa

SEQ ID NO: 638505 - DNA, 25 bp, Mus musculus
gaatgagcagcattatccacgcgaa

SEQ ID NO: 638506 - DNA, 25 bp, Mus musculus
gaatgagcctgacacgtggaccttg

SEQ ID NO: 638507 - DNA, 25 bp, Mus musculus
gaatgagcctgagacgtggaccttg

SEQ ID NO: 638508 - DNA, 25 bp, Mus musculus
gaatgagcgctaagacgccgtgcag

SEQ ID NO: 638509 - DNA, 25 bp, Mus musculus
gaatgagcgctatgacgccgtgcag

SEQ ID NO: 638510 - DNA, 25 bp, Mus musculus
gaatgagcgggaaaatgacccaact

SEQ ID NO: 638511 - DNA, 25 bp, Mus musculus
gaatgagcgggataatgacccaact

SEQ ID NO: 638512 - DNA, 25 bp, Mus musculus
gaatgagctcctcaccatgtaccat

SEQ ID NO: 638513 - DNA, 25 bp, Mus musculus
gaatgagctcctgaccatgtaccat

SEQ ID NO: 638514 - DNA, 25 bp, Mus musculus
gaatgagctcggaggtcctgcaccc

SEQ ID NO: 638515 - DNA, 25 bp, Mus musculus
gaatgagctcggtggtcctgcaccc

SEQ ID NO: 638516 - DNA, 25 bp, Mus musculus
gaatgagctcttcaatgtctgccag

SEQ ID NO: 638517 - DNA, 25 bp, Mus musculus
gaatgagctcttgaatgtctgccag

SEQ ID NO: 638518 - DNA, 25 bp, Mus musculus
gaatgaggcaaacccagaagactgt

SEQ ID NO: 638519 - DNA, 25 bp, Mus musculus
gaatgaggcaaagccagaagactgt

SEQ ID NO: 638520 - DNA, 25 bp, Mus musculus
gaatgaggctaccttctgcaacagt

SEQ ID NO: 638521 - DNA, 25 bp, Mus musculus
gaatgaggctacgttctgcaacagt

SEQ ID NO: 638522 - DNA, 25 bp, Mus musculus
gaatgaggctgccagtaccaagaag

SEQ ID NO: 638523 - DNA, 25 bp, Mus musculus
gaatgaggctgcgagtaccaagaag

SEQ ID NO: 638524 - DNA, 25 bp, Mus musculus
gaatgaggtgaacatagacatagct

SEQ ID NO: 638525 - DNA, 25 bp, Mus musculus
gaatgaggtgaagatagacatagct

SEQ ID NO: 638526 - DNA, 25 bp, Mus musculus
gaatgagtacaacttgcagggcaag

SEQ ID NO: 638527 - DNA, 25 bp, Mus musculus
gaatgagtacaagttgcagggcaag

SEQ ID NO: 638528 - DNA, 25 bp, Mus musculus
gaatgagtctgaccagttggtcagc

SEQ ID NO: 638529 - DNA, 25 bp, Mus musculus
gaatgagtctgagcagttggtcagc

SEQ ID NO: 638530 - DNA, 25 bp, Mus musculus
gaatgagtggcgcatgatcacaccg

SEQ ID NO: 638531 - DNA, 25 bp, Mus musculus
gaatgagtggcggatgatcacaccg

SEQ ID NO: 638532 - DNA, 25 bp, Mus musculus
gaatgagttaaaccagaacttcagc

SEQ ID NO: 638533 - DNA, 25 bp, Mus musculus
gaatgagttaaagcagaacttcagc

SEQ ID NO: 638534 - DNA, 25 bp, Mus musculus
gaatgagttaagcacaaagtctcag

SEQ ID NO: 638535 - DNA, 25 bp, Mus musculus
gaatgagttaaggacaaagtctcag

SEQ ID NO: 638536 - DNA, 25 bp, Mus musculus
gaatgagttcgtagccgtgaccagc

SEQ ID NO: 638537 - DNA, 25 bp, Mus musculus
gaatgagttcgttgccgtgaccagc

SEQ ID NO: 638538 - DNA, 25 bp, Mus musculus
gaatgagttgttcaggatgtttaac

SEQ ID NO: 638539 - DNA, 25 bp, Mus musculus
gaatgagttgttgaggatgtttaac

SEQ ID NO: 638540 - DNA, 25 bp, Mus musculus
gaatgataagatccttcccatcagc

SEQ ID NO: 638541 - DNA, 25 bp, Mus musculus
gaatgataagatgcttcccatcagc

SEQ ID NO: 638542 - DNA, 25 bp, Mus musculus
gaatgataccaaagttcagtttttg

SEQ ID NO: 638543 - DNA, 25 bp, Mus musculus
gaatgataccaatgttcagtttttg

SEQ ID NO: 638544 - DNA, 25 bp, Mus musculus
gaatgatactgtaccagaatacaag

SEQ ID NO: 638545 - DNA, 25 bp, Mus musculus
gaatgatactgttccagaatacaag

SEQ ID NO: 638546 - DNA, 25 bp, Mus musculus
gaatgatattgaagtgtccggaact

SEQ ID NO: 638547 - DNA, 25 bp, Mus musculus
gaatgatattgatgtgtccggaact

SEQ ID NO: 638548 - DNA, 25 bp, Mus musculus
gaatgatcactcaaacttctcttac

SEQ ID NO: 638549 - DNA, 25 bp, Mus musculus
gaatgatcactctaacttctcttac

SEQ ID NO: 638550 - DNA, 25 bp, Mus musculus
gaatgatcattactatcggtcagtc

SEQ ID NO: 638551 - DNA, 25 bp, Mus musculus
gaatgatcattagtatcggtcagtc

SEQ ID NO: 638552 - DNA, 25 bp, Mus musculus
gaatgatcgcgacacgttttgaata

SEQ ID NO: 638553 - DNA, 25 bp, Mus musculus
gaatgatcgcgagacgttttgaata

SEQ ID NO: 638554 - DNA, 25 bp, Mus musculus
gaatgatcgtgccttgcagaaaaca

SEQ ID NO: 638555 - DNA, 25 bp, Mus musculus
gaatgatcgtgcgttgcagaaaaca

SEQ ID NO: 638556 - DNA, 25 bp, Mus musculus
gaatgatctcttaggaccccatgac

SEQ ID NO: 638557 - DNA, 25 bp, Mus musculus
gaatgatctctttggaccccatgac

SEQ ID NO: 638558 - DNA, 25 bp, Mus musculus
gaatgatgacagaatactaccacta

SEQ ID NO: 638559 - DNA, 25 bp, Mus musculus
gaatgatgacagtatactaccacta

SEQ ID NO: 638560 - DNA, 25 bp, Mus musculus
gaatgatgaccaaacccatctagaa

SEQ ID NO: 638561 - DNA, 25 bp, Mus musculus
gaatgatgaccatacccatctagaa

SEQ ID NO: 638562 - DNA, 25 bp, Mus musculus
gaatgatgagacaaaagccctcacc

SEQ ID NO: 638563 - DNA, 25 bp, Mus musculus
gaatgatgagactaaagccctcacc

SEQ ID NO: 638564 - DNA, 25 bp, Mus musculus
gaatgatgcccgcacttgtggcagc

SEQ ID NO: 638565 - DNA, 25 bp, Mus musculus
gaatgatgcccggacttgtggcagc

SEQ ID NO: 638566 - DNA, 25 bp, Mus musculus
gaatgatgctgcagtccatttggcc

SEQ ID NO: 638567 - DNA, 25 bp, Mus musculus
gaatgatgctgctgtccatttggcc

SEQ ID NO: 638568 - DNA, 25 bp, Mus musculus
gaatgatggaggacctgccagatcg

SEQ ID NO: 638569 - DNA, 25 bp, Mus musculus
gaatgatggaggtcctgccagatcg

SEQ ID NO: 638570 - DNA, 25 bp, Mus musculus
gaatgatggtccacacagtgcctta

SEQ ID NO: 638571 - DNA, 25 bp, Mus musculus
gaatgatggtcctcacagtgcctta

SEQ ID NO: 638572 - DNA, 25 bp, Mus musculus
gaatgatgtcacagcttttcctgtc

SEQ ID NO: 638573 - DNA, 25 bp, Mus musculus
gaatgatgtcactgcttttcctgtc

SEQ ID NO: 638574 - DNA, 25 bp, Mus musculus
gaatgatgtcctccctaacagccca

SEQ ID NO: 638575 - DNA, 25 bp, Mus musculus
gaatgatgtcctgcctaacagccca

SEQ ID NO: 638576 - DNA, 25 bp, Mus musculus
gaatgatgtcttaactctgctcagt

SEQ ID NO: 638577 - DNA, 25 bp, Mus musculus
gaatgatgtctttactctgctcagt

SEQ ID NO: 638578 - DNA, 25 bp, Mus musculus
gaatgatgtgaaaaactggacccca

SEQ ID NO: 638579 - DNA, 25 bp, Mus musculus
gaatgatgtgaataactggacccca

SEQ ID NO: 638580 - DNA, 25 bp, Mus musculus
gaatgattactgatgcttcgctgca

SEQ ID NO: 638581 - DNA, 25 bp, Mus musculus
gaatgattactgttgcttcgctgca

SEQ ID NO: 638582 - DNA, 25 bp, Mus musculus
gaatgattatttcggccctcgaaga

SEQ ID NO: 638583 - DNA, 25 bp, Mus musculus
gaatgattatttgggccctcgaaga

SEQ ID NO: 638584 - DNA, 25 bp, Mus musculus
gaatgattgatacagaactgaactc
